United States Patent 9,205,144 (IDENTIFICATION OF CONSERVED PEPTIDE BLOCKS IN HOMOLOGOUS POLYPEPTIDES) - sequence listing, part 2

SEQ ID NO: 6781 - protein, 9 aa, Dengue virus
AIGKAWEEG

SEQ ID NO: 6782 - protein, 9 aa, Dengue virus
IGKAWEEGV

SEQ ID NO: 6783 - protein, 9 aa, Dengue virus
GKAWEEGVC

SEQ ID NO: 6784 - protein, 9 aa, Dengue virus
KAWEEGVCG

SEQ ID NO: 6785 - protein, 9 aa, Dengue virus
AWEEGVCGI

SEQ ID NO: 6786 - protein, 9 aa, Dengue virus
WEEGVCGIR

SEQ ID NO: 6787 - protein, 9 aa, Dengue virus
EEGVCGIRS

SEQ ID NO: 6788 - protein, 9 aa, Dengue virus
EGVCGIRSA

SEQ ID NO: 6789 - protein, 9 aa, Dengue virus
GVCGIRSAT

SEQ ID NO: 6790 - protein, 9 aa, Dengue virus
VCGIRSATR

SEQ ID NO: 6791 - protein, 9 aa, Dengue virus
CGIRSATRL

SEQ ID NO: 6792 - protein, 9 aa, Dengue virus
GIRSATRLE

SEQ ID NO: 6793 - protein, 9 aa, Dengue virus
IRSATRLEN

SEQ ID NO: 6794 - protein, 9 aa, Dengue virus
RSATRLENI

SEQ ID NO: 6795 - protein, 9 aa, Dengue virus
SATRLENIM

SEQ ID NO: 6796 - protein, 9 aa, Dengue virus
ATRLENIMW

SEQ ID NO: 6797 - protein, 9 aa, Dengue virus
TRLENIMWK

SEQ ID NO: 6798 - protein, 9 aa, Dengue virus
RLENIMWKQ

SEQ ID NO: 6799 - protein, 9 aa, Dengue virus
LENIMWKQI

SEQ ID NO: 6800 - protein, 9 aa, Dengue virus
ENIMWKQIS

SEQ ID NO: 6801 - protein, 9 aa, Dengue virus
NIMWKQISN

SEQ ID NO: 6802 - protein, 9 aa, Dengue virus
IMWKQISNE

SEQ ID NO: 6803 - protein, 9 aa, Dengue virus
MWKQISNEL

SEQ ID NO: 6804 - protein, 9 aa, Dengue virus
WKQISNELN

SEQ ID NO: 6805 - protein, 9 aa, Dengue virus
KQISNELNH

SEQ ID NO: 6806 - protein, 9 aa, Dengue virus
QISNELNHI

SEQ ID NO: 6807 - protein, 9 aa, Dengue virus
ISNELNHIL

SEQ ID NO: 6808 - protein, 9 aa, Dengue virus
SNELNHILL

SEQ ID NO: 6809 - protein, 9 aa, Dengue virus
NELNHILLE

SEQ ID NO: 6810 - protein, 9 aa, Dengue virus
ELNHILLEN

SEQ ID NO: 6811 - protein, 9 aa, Dengue virus
LNHILLEND

SEQ ID NO: 6812 - protein, 9 aa, Dengue virus
NHILLENDM

SEQ ID NO: 6813 - protein, 9 aa, Dengue virus
HILLENDMK

SEQ ID NO: 6814 - protein, 9 aa, Dengue virus
ILLENDMKF

SEQ ID NO: 6815 - protein, 9 aa, Dengue virus
LLENDMKFT

SEQ ID NO: 6816 - protein, 9 aa, Dengue virus
LENDMKFTV

SEQ ID NO: 6817 - protein, 9 aa, Dengue virus
ENDMKFTVV

SEQ ID NO: 6818 - protein, 9 aa, Dengue virus
NDMKFTVVV

SEQ ID NO: 6819 - protein, 9 aa, Dengue virus
DMKFTVVVG

SEQ ID NO: 6820 - protein, 9 aa, Dengue virus
MKFTVVVGD

SEQ ID NO: 6821 - protein, 9 aa, Dengue virus
KFTVVVGDV

SEQ ID NO: 6822 - protein, 9 aa, Dengue virus
QGKKMIRPQ

SEQ ID NO: 6823 - protein, 9 aa, Dengue virus
GKKMIRPQP

SEQ ID NO: 6824 - protein, 9 aa, Dengue virus
KKMIRPQPM

SEQ ID NO: 6825 - protein, 9 aa, Dengue virus
KMIRPQPME

SEQ ID NO: 6826 - protein, 9 aa, Dengue virus
MIRPQPMEY

SEQ ID NO: 6827 - protein, 9 aa, Dengue virus
IRPQPMEYK

SEQ ID NO: 6828 - protein, 9 aa, Dengue virus
RPQPMEYKY

SEQ ID NO: 6829 - protein, 9 aa, Dengue virus
PQPMEYKYS

SEQ ID NO: 6830 - protein, 9 aa, Dengue virus
QPMEYKYSW

SEQ ID NO: 6831 - protein, 9 aa, Dengue virus
PMEYKYSWK

SEQ ID NO: 6832 - protein, 9 aa, Dengue virus
MEYKYSWKS

SEQ ID NO: 6833 - protein, 9 aa, Dengue virus
EYKYSWKSW

SEQ ID NO: 6834 - protein, 9 aa, Dengue virus
YKYSWKSWG

SEQ ID NO: 6835 - protein, 9 aa, Dengue virus
KYSWKSWGK

SEQ ID NO: 6836 - protein, 9 aa, Dengue virus
YSWKSWGKA

SEQ ID NO: 6837 - protein, 9 aa, Dengue virus
SWKSWGKAK

SEQ ID NO: 6838 - protein, 9 aa, Dengue virus
WKSWGKAKI

SEQ ID NO: 6839 - protein, 9 aa, Dengue virus
KSWGKAKII

SEQ ID NO: 6840 - protein, 9 aa, Dengue virus
SWGKAKIIG

SEQ ID NO: 6841 - protein, 9 aa, Dengue virus
WGKAKIIGA

SEQ ID NO: 6842 - protein, 9 aa, Dengue virus
GKAKIIGAD

SEQ ID NO: 6843 - protein, 9 aa, Dengue virus
KAKIIGADV

SEQ ID NO: 6844 - protein, 9 aa, Dengue virus
AKIIGADVQ

SEQ ID NO: 6845 - protein, 9 aa, Dengue virus
KIIGADVQN

SEQ ID NO: 6846 - protein, 9 aa, Dengue virus
QNTTFIIDG

SEQ ID NO: 6847 - protein, 9 aa, Dengue virus
NTTFIIDGP

SEQ ID NO: 6848 - protein, 9 aa, Dengue virus
TFIIDGPNT

SEQ ID NO: 6849 - protein, 9 aa, Dengue virus
FIIDGPNTP

SEQ ID NO: 6850 - protein, 9 aa, Dengue virus
IIDGPNTPE

SEQ ID NO: 6851 - protein, 9 aa, Dengue virus
IDGPNTPEC

SEQ ID NO: 6852 - protein, 9 aa, Dengue virus
DGPNTPECP

SEQ ID NO: 6853 - protein, 9 aa, Dengue virus
GPNTPECPD

SEQ ID NO: 6854 - protein, 9 aa, Dengue virus
ECPDDQRAW

SEQ ID NO: 6855 - protein, 9 aa, Dengue virus
CPDDQRAWN

SEQ ID NO: 6856 - protein, 9 aa, Dengue virus
PDDQRAWNI

SEQ ID NO: 6857 - protein, 9 aa, Dengue virus
DDQRAWNIW

SEQ ID NO: 6858 - protein, 9 aa, Dengue virus
DQRAWNIWE

SEQ ID NO: 6859 - protein, 9 aa, Dengue virus
QRAWNIWEV

SEQ ID NO: 6860 - protein, 9 aa, Dengue virus
RAWNIWEVE

SEQ ID NO: 6861 - protein, 9 aa, Dengue virus
AWNIWEVED

SEQ ID NO: 6862 - protein, 9 aa, Dengue virus
WNIWEVEDY

SEQ ID NO: 6863 - protein, 9 aa, Dengue virus
NIWEVEDYG

SEQ ID NO: 6864 - protein, 9 aa, Dengue virus
IWEVEDYGF

SEQ ID NO: 6865 - protein, 9 aa, Dengue virus
WEVEDYGFG

SEQ ID NO: 6866 - protein, 9 aa, Dengue virus
EVEDYGFGI

SEQ ID NO: 6867 - protein, 9 aa, Dengue virus
VEDYGFGIF

SEQ ID NO: 6868 - protein, 9 aa, Dengue virus
EDYGFGIFT

SEQ ID NO: 6869 - protein, 9 aa, Dengue virus
DYGFGIFTT

SEQ ID NO: 6870 - protein, 9 aa, Dengue virus
YGFGIFTTN

SEQ ID NO: 6871 - protein, 9 aa, Dengue virus
GFGIFTTNI

SEQ ID NO: 6872 - protein, 9 aa, Dengue virus
FGIFTTNIW

SEQ ID NO: 6873 - protein, 9 aa, Dengue virus
GIFTTNIWL

SEQ ID NO: 6874 - protein, 9 aa, Dengue virus
IFTTNIWLK

SEQ ID NO: 6875 - protein, 9 aa, Dengue virus
FTTNIWLKL

SEQ ID NO: 6876 - protein, 9 aa, Dengue virus
TTNIWLKLR

SEQ ID NO: 6877 - protein, 9 aa, Dengue virus
TNIWLKLRD

SEQ ID NO: 6878 - protein, 9 aa, Dengue virus
NIWLKLRDS

SEQ ID NO: 6879 - protein, 9 aa, Dengue virus
IWLKLRDSY

SEQ ID NO: 6880 - protein, 9 aa, Dengue virus
WLKLRDSYT

SEQ ID NO: 6881 - protein, 9 aa, Dengue virus
LKLRDSYTQ

SEQ ID NO: 6882 - protein, 9 aa, Dengue virus
RDSYTQVCD

SEQ ID NO: 6883 - protein, 9 aa, Dengue virus
DSYTQVCDH

SEQ ID NO: 6884 - protein, 9 aa, Dengue virus
SYTQVCDHR

SEQ ID NO: 6885 - protein, 9 aa, Dengue virus
YTQVCDHRL

SEQ ID NO: 6886 - protein, 9 aa, Dengue virus
TQVCDHRLM

SEQ ID NO: 6887 - protein, 9 aa, Dengue virus
QVCDHRLMS

SEQ ID NO: 6888 - protein, 9 aa, Dengue virus
VCDHRLMSA

SEQ ID NO: 6889 - protein, 9 aa, Dengue virus
CDHRLMSAA

SEQ ID NO: 6890 - protein, 9 aa, Dengue virus
DHRLMSAAI

SEQ ID NO: 6891 - protein, 9 aa, Dengue virus
HRLMSAAIK

SEQ ID NO: 6892 - protein, 9 aa, Dengue virus
RLMSAAIKD

SEQ ID NO: 6893 - protein, 9 aa, Dengue virus
LMSAAIKDS

SEQ ID NO: 6894 - protein, 9 aa, Dengue virus
MSAAIKDSK

SEQ ID NO: 6895 - protein, 9 aa, Dengue virus
SAAIKDSKA

SEQ ID NO: 6896 - protein, 9 aa, Dengue virus
AAIKDSKAV

SEQ ID NO: 6897 - protein, 9 aa, Dengue virus
AIKDSKAVH

SEQ ID NO: 6898 - protein, 9 aa, Dengue virus
IKDSKAVHA

SEQ ID NO: 6899 - protein, 9 aa, Dengue virus
KDSKAVHAD

SEQ ID NO: 6900 - protein, 9 aa, Dengue virus
DSKAVHADM

SEQ ID NO: 6901 - protein, 9 aa, Dengue virus
SKAVHADMG

SEQ ID NO: 6902 - protein, 9 aa, Dengue virus
KAVHADMGY

SEQ ID NO: 6903 - protein, 9 aa, Dengue virus
AVHADMGYW

SEQ ID NO: 6904 - protein, 9 aa, Dengue virus
VHADMGYWI

SEQ ID NO: 6905 - protein, 9 aa, Dengue virus
HADMGYWIE

SEQ ID NO: 6906 - protein, 9 aa, Dengue virus
ADMGYWIES

SEQ ID NO: 6907 - protein, 9 aa, Dengue virus
DMGYWIESE

SEQ ID NO: 6908 - protein, 9 aa, Dengue virus
MGYWIESEK

SEQ ID NO: 6909 - protein, 9 aa, Dengue virus
GYWIESEKN

SEQ ID NO: 6910 - protein, 9 aa, Dengue virus
YWIESEKNE

SEQ ID NO: 6911 - protein, 9 aa, Dengue virus
WIESEKNET

SEQ ID NO: 6912 - protein, 9 aa, Dengue virus
IESEKNETW

SEQ ID NO: 6913 - protein, 9 aa, Dengue virus
ESEKNETWK

SEQ ID NO: 6914 - protein, 9 aa, Dengue virus
SEKNETWKL

SEQ ID NO: 6915 - protein, 9 aa, Dengue virus
EKNETWKLA

SEQ ID NO: 6916 - protein, 9 aa, Dengue virus
NETWKLARA

SEQ ID NO: 6917 - protein, 9 aa, Dengue virus
ETWKLARAS

SEQ ID NO: 6918 - protein, 9 aa, Dengue virus
TWKLARASF

SEQ ID NO: 6919 - protein, 9 aa, Dengue virus
WKLARASFI

SEQ ID NO: 6920 - protein, 9 aa, Dengue virus
KLARASFIE

SEQ ID NO: 6921 - protein, 9 aa, Dengue virus
LARASFIEV

SEQ ID NO: 6922 - protein, 9 aa, Dengue virus
ARASFIEVK

SEQ ID NO: 6923 - protein, 9 aa, Dengue virus
RASFIEVKT

SEQ ID NO: 6924 - protein, 9 aa, Dengue virus
ASFIEVKTC

SEQ ID NO: 6925 - protein, 9 aa, Dengue virus
SFIEVKTCI

SEQ ID NO: 6926 - protein, 9 aa, Dengue virus
FIEVKTCIW

SEQ ID NO: 6927 - protein, 9 aa, Dengue virus
IEVKTCIWP

SEQ ID NO: 6928 - protein, 9 aa, Dengue virus
EVKTCIWPK

SEQ ID NO: 6929 - protein, 9 aa, Dengue virus
VKTCIWPKS

SEQ ID NO: 6930 - protein, 9 aa, Dengue virus
KTCIWPKSH

SEQ ID NO: 6931 - protein, 9 aa, Dengue virus
TCIWPKSHT

SEQ ID NO: 6932 - protein, 9 aa, Dengue virus
CIWPKSHTL

SEQ ID NO: 6933 - protein, 9 aa, Dengue virus
IWPKSHTLW

SEQ ID NO: 6934 - protein, 9 aa, Dengue virus
WPKSHTLWS

SEQ ID NO: 6935 - protein, 9 aa, Dengue virus
PKSHTLWSN

SEQ ID NO: 6936 - protein, 9 aa, Dengue virus
KSHTLWSNG

SEQ ID NO: 6937 - protein, 9 aa, Dengue virus
SHTLWSNGV

SEQ ID NO: 6938 - protein, 9 aa, Dengue virus
HTLWSNGVL

SEQ ID NO: 6939 - protein, 9 aa, Dengue virus
TLWSNGVLE

SEQ ID NO: 6940 - protein, 9 aa, Dengue virus
LWSNGVLES

SEQ ID NO: 6941 - protein, 9 aa, Dengue virus
WSNGVLESE

SEQ ID NO: 6942 - protein, 9 aa, Dengue virus
SNGVLESEM

SEQ ID NO: 6943 - protein, 9 aa, Dengue virus
NGVLESEMI

SEQ ID NO: 6944 - protein, 9 aa, Dengue virus
GVLESEMII

SEQ ID NO: 6945 - protein, 9 aa, Dengue virus
VLESEMIIP

SEQ ID NO: 6946 - protein, 9 aa, Dengue virus
LESEMIIPK

SEQ ID NO: 6947 - protein, 9 aa, Dengue virus
ESEMIIPKI

SEQ ID NO: 6948 - protein, 9 aa, Dengue virus
SEMIIPKIY

SEQ ID NO: 6949 - protein, 9 aa, Dengue virus
EMIIPKIYG

SEQ ID NO: 6950 - protein, 9 aa, Dengue virus
MIIPKIYGG

SEQ ID NO: 6951 - protein, 9 aa, Dengue virus
IIPKIYGGP

SEQ ID NO: 6952 - protein, 9 aa, Dengue virus
PKIYGGPIS

SEQ ID NO: 6953 - protein, 9 aa, Dengue virus
KIYGGPISQ

SEQ ID NO: 6954 - protein, 9 aa, Dengue virus
IYGGPISQH

SEQ ID NO: 6955 - protein, 9 aa, Dengue virus
YGGPISQHN

SEQ ID NO: 6956 - protein, 9 aa, Dengue virus
GGPISQHNY

SEQ ID NO: 6957 - protein, 9 aa, Dengue virus
GPISQHNYR

SEQ ID NO: 6958 - protein, 9 aa, Dengue virus
PISQHNYRP

SEQ ID NO: 6959 - protein, 9 aa, Dengue virus
ISQHNYRPG

SEQ ID NO: 6960 - protein, 9 aa, Dengue virus
SQHNYRPGY

SEQ ID NO: 6961 - protein, 9 aa, Dengue virus
QHNYRPGYF

SEQ ID NO: 6962 - protein, 9 aa, Dengue virus
HNYRPGYFT

SEQ ID NO: 6963 - protein, 9 aa, Dengue virus
NYRPGYFTQ

SEQ ID NO: 6964 - protein, 9 aa, Dengue virus
YRPGYFTQT

SEQ ID NO: 6965 - protein, 9 aa, Dengue virus
RPGYFTQTA

SEQ ID NO: 6966 - protein, 9 aa, Dengue virus
PGYFTQTAG

SEQ ID NO: 6967 - protein, 9 aa, Dengue virus
GYFTQTAGP

SEQ ID NO: 6968 - protein, 9 aa, Dengue virus
YFTQTAGPW

SEQ ID NO: 6969 - protein, 9 aa, Dengue virus
FTQTAGPWH

SEQ ID NO: 6970 - protein, 9 aa, Dengue virus
TQTAGPWHL

SEQ ID NO: 6971 - protein, 9 aa, Dengue virus
QTAGPWHLG

SEQ ID NO: 6972 - protein, 9 aa, Dengue virus
TAGPWHLGK

SEQ ID NO: 6973 - protein, 9 aa, Dengue virus
AGPWHLGKL

SEQ ID NO: 6974 - protein, 9 aa, Dengue virus
GPWHLGKLE

SEQ ID NO: 6975 - protein, 9 aa, Dengue virus
PWHLGKLEL

SEQ ID NO: 6976 - protein, 9 aa, Dengue virus
WHLGKLELD

SEQ ID NO: 6977 - protein, 9 aa, Dengue virus
HLGKLELDF

SEQ ID NO: 6978 - protein, 9 aa, Dengue virus
LGKLELDFD

SEQ ID NO: 6979 - protein, 9 aa, Dengue virus
GKLELDFDL

SEQ ID NO: 6980 - protein, 9 aa, Dengue virus
KLELDFDLC

SEQ ID NO: 6981 - protein, 9 aa, Dengue virus
LELDFDLCE

SEQ ID NO: 6982 - protein, 9 aa, Dengue virus
ELDFDLCEG

SEQ ID NO: 6983 - protein, 9 aa, Dengue virus
LDFDLCEGT

SEQ ID NO: 6984 - protein, 9 aa, Dengue virus
DFDLCEGTT

SEQ ID NO: 6985 - protein, 9 aa, Dengue virus
FDLCEGTTV

SEQ ID NO: 6986 - protein, 9 aa, Dengue virus
DLCEGTTVV

SEQ ID NO: 6987 - protein, 9 aa, Dengue virus
LCEGTTVVV

SEQ ID NO: 6988 - protein, 9 aa, Dengue virus
CEGTTVVVD

SEQ ID NO: 6989 - protein, 9 aa, Dengue virus
EGTTVVVDE

SEQ ID NO: 6990 - protein, 9 aa, Dengue virus
GTTVVVDEH

SEQ ID NO: 6991 - protein, 9 aa, Dengue virus
TTVVVDEHC

SEQ ID NO: 6992 - protein, 9 aa, Dengue virus
TVVVDEHCG

SEQ ID NO: 6993 - protein, 9 aa, Dengue virus
VVVDEHCGN

SEQ ID NO: 6994 - protein, 9 aa, Dengue virus
VVDEHCGNR

SEQ ID NO: 6995 - protein, 9 aa, Dengue virus
VDEHCGNRG

SEQ ID NO: 6996 - protein, 9 aa, Dengue virus
DEHCGNRGP

SEQ ID NO: 6997 - protein, 9 aa, Dengue virus
EHCGNRGPS

SEQ ID NO: 6998 - protein, 9 aa, Dengue virus
HCGNRGPSL

SEQ ID NO: 6999 - protein, 9 aa, Dengue virus
CGNRGPSLR

SEQ ID NO: 7000 - protein, 9 aa, Dengue virus
GNRGPSLRT

SEQ ID NO: 7001 - protein, 9 aa, Dengue virus
NRGPSLRTT

SEQ ID NO: 7002 - protein, 9 aa, Dengue virus
RGPSLRTTT

SEQ ID NO: 7003 - protein, 9 aa, Dengue virus
GPSLRTTTV

SEQ ID NO: 7004 - protein, 9 aa, Dengue virus
PSLRTTTVT

SEQ ID NO: 7005 - protein, 9 aa, Dengue virus
SLRTTTVTG

SEQ ID NO: 7006 - protein, 9 aa, Dengue virus
LRTTTVTGK

SEQ ID NO: 7007 - protein, 9 aa, Dengue virus
RTTTVTGKI

SEQ ID NO: 7008 - protein, 9 aa, Dengue virus
TTTVTGKII

SEQ ID NO: 7009 - protein, 9 aa, Dengue virus
TTVTGKIIH

SEQ ID NO: 7010 - protein, 9 aa, Dengue virus
TVTGKIIHE

SEQ ID NO: 7011 - protein, 9 aa, Dengue virus
VTGKIIHEW

SEQ ID NO: 7012 - protein, 9 aa, Dengue virus
TGKIIHEWC

SEQ ID NO: 7013 - protein, 9 aa, Dengue virus
GKIIHEWCC

SEQ ID NO: 7014 - protein, 9 aa, Dengue virus
KIIHEWCCR

SEQ ID NO: 7015 - protein, 9 aa, Dengue virus
IIHEWCCRS

SEQ ID NO: 7016 - protein, 9 aa, Dengue virus
IHEWCCRSC

SEQ ID NO: 7017 - protein, 9 aa, Dengue virus
HEWCCRSCT

SEQ ID NO: 7018 - protein, 9 aa, Dengue virus
EWCCRSCTL

SEQ ID NO: 7019 - protein, 9 aa, Dengue virus
WCCRSCTLP

SEQ ID NO: 7020 - protein, 9 aa, Dengue virus
CCRSCTLPP

SEQ ID NO: 7021 - protein, 9 aa, Dengue virus
CRSCTLPPL

SEQ ID NO: 7022 - protein, 9 aa, Dengue virus
RSCTLPPLR

SEQ ID NO: 7023 - protein, 9 aa, Dengue virus
SCTLPPLRF

SEQ ID NO: 7024 - protein, 9 aa, Dengue virus
CTLPPLRFR

SEQ ID NO: 7025 - protein, 9 aa, Dengue virus
TLPPLRFRG

SEQ ID NO: 7026 - protein, 9 aa, Dengue virus
LPPLRFRGE

SEQ ID NO: 7027 - protein, 9 aa, Dengue virus
PPLRFRGED

SEQ ID NO: 7028 - protein, 9 aa, Dengue virus
PLRFRGEDG

SEQ ID NO: 7029 - protein, 9 aa, Dengue virus
LRFRGEDGC

SEQ ID NO: 7030 - protein, 9 aa, Dengue virus
RFRGEDGCW

SEQ ID NO: 7031 - protein, 9 aa, Dengue virus
FRGEDGCWY

SEQ ID NO: 7032 - protein, 9 aa, Dengue virus
RGEDGCWYG

SEQ ID NO: 7033 - protein, 9 aa, Dengue virus
GEDGCWYGM

SEQ ID NO: 7034 - protein, 9 aa, Dengue virus
EDGCWYGME

SEQ ID NO: 7035 - protein, 9 aa, Dengue virus
DGCWYGMEI

SEQ ID NO: 7036 - protein, 9 aa, Dengue virus
GCWYGMEIR

SEQ ID NO: 7037 - protein, 9 aa, Dengue virus
CWYGMEIRP

SEQ ID NO: 7038 - protein, 9 aa, Dengue virus
WYGMEIRPV

SEQ ID NO: 7039 - protein, 9 aa, Dengue virus
YGMEIRPVK

SEQ ID NO: 7040 - protein, 9 aa, Dengue virus
GMEIRPVKE

SEQ ID NO: 7041 - protein, 9 aa, Dengue virus
MEIRPVKEK

SEQ ID NO: 7042 - protein, 9 aa, Dengue virus
EIRPVKEKE

SEQ ID NO: 7043 - protein, 9 aa, Dengue virus
IRPVKEKEE

SEQ ID NO: 7044 - protein, 9 aa, Dengue virus
RPVKEKEEN

SEQ ID NO: 7045 - protein, 9 aa, Dengue virus
PVKEKEENL

SEQ ID NO: 7046 - protein, 9 aa, Dengue virus
VKEKEENLV

SEQ ID NO: 7047 - protein, 9 aa, Dengue virus
KEKEENLVK

SEQ ID NO: 7048 - protein, 9 aa, Dengue virus
EKEENLVKS

SEQ ID NO: 7049 - protein, 9 aa, Dengue virus
KEENLVKSM

SEQ ID NO: 7050 - protein, 9 aa, Dengue virus
EENLVKSMV

SEQ ID NO: 7051 - protein, 9 aa, Dengue virus
ENLVKSMVS

SEQ ID NO: 7052 - protein, 9 aa, Dengue virus
NLVKSMVSA

SEQ ID NO: 7053 - protein, 9 aa, Dengue virus
LVKSMVSAG

SEQ ID NO: 7054 - protein, 9 aa, Dengue virus
VKSMVSAGS

SEQ ID NO: 7055 - protein, 9 aa, Dengue virus
KSMVSAGSG

SEQ ID NO: 7056 - protein, 9 aa, Dengue virus
SMVSAGSGE

SEQ ID NO: 7057 - protein, 9 aa, Dengue virus
MVSAGSGEV

SEQ ID NO: 7058 - protein, 9 aa, Dengue virus
VSAGSGEVD

SEQ ID NO: 7059 - protein, 9 aa, Dengue virus
SAGSGEVDS

SEQ ID NO: 7060 - protein, 9 aa, Dengue virus
AGSGEVDSF

SEQ ID NO: 7061 - protein, 9 aa, Dengue virus
GSGEVDSFS

SEQ ID NO: 7062 - protein, 9 aa, Dengue virus
SGEVDSFSL

SEQ ID NO: 7063 - protein, 9 aa, Dengue virus
GEVDSFSLG

SEQ ID NO: 7064 - protein, 9 aa, Dengue virus
EVDSFSLGL

SEQ ID NO: 7065 - protein, 9 aa, Dengue virus
VDSFSLGLL

SEQ ID NO: 7066 - protein, 9 aa, Dengue virus
DSFSLGLLC

SEQ ID NO: 7067 - protein, 9 aa, Dengue virus
FSLGLLCIS

SEQ ID NO: 7068 - protein, 9 aa, Dengue virus
SLGLLCISI

SEQ ID NO: 7069 - protein, 9 aa, Dengue virus
SIMIEEVMR

SEQ ID NO: 7070 - protein, 9 aa, Dengue virus
IMIEEVMRS

SEQ ID NO: 7071 - protein, 9 aa, Dengue virus
MIEEVMRSR

SEQ ID NO: 7072 - protein, 9 aa, Dengue virus
IEEVMRSRW

SEQ ID NO: 7073 - protein, 9 aa, Dengue virus
EEVMRSRWS

SEQ ID NO: 7074 - protein, 9 aa, Dengue virus
EVMRSRWSR

SEQ ID NO: 7075 - protein, 9 aa, Dengue virus
VMRSRWSRK

SEQ ID NO: 7076 - protein, 9 aa, Dengue virus
MRSRWSRKM

SEQ ID NO: 7077 - protein, 9 aa, Dengue virus
RSRWSRKML

SEQ ID NO: 7078 - protein, 9 aa, Dengue virus
SRWSRKMLM

SEQ ID NO: 7079 - protein, 9 aa, Dengue virus
RWSRKMLMT

SEQ ID NO: 7080 - protein, 9 aa, Dengue virus
WSRKMLMTG

SEQ ID NO: 7081 - protein, 9 aa, Dengue virus
SRKMLMTGT

SEQ ID NO: 7082 - protein, 9 aa, Dengue virus
RKMLMTGTL

SEQ ID NO: 7083 - protein, 9 aa, Dengue virus
KMLMTGTLA

SEQ ID NO: 7084 - protein, 9 aa, Dengue virus
MLMTGTLAV

SEQ ID NO: 7085 - protein, 9 aa, Dengue virus
LMTGTLAVF

SEQ ID NO: 7086 - protein, 9 aa, Dengue virus
GTLAVFFLL

SEQ ID NO: 7087 - protein, 9 aa, Dengue virus
GQLTWNDLI

SEQ ID NO: 7088 - protein, 9 aa, Dengue virus
QLTWNDLIR

SEQ ID NO: 7089 - protein, 9 aa, Dengue virus
LTWNDLIRL

SEQ ID NO: 7090 - protein, 9 aa, Dengue virus
TWNDLIRLC

SEQ ID NO: 7091 - protein, 9 aa, Dengue virus
WNDLIRLCI

SEQ ID NO: 7092 - protein, 9 aa, Dengue virus
NDLIRLCIM

SEQ ID NO: 7093 - protein, 9 aa, Dengue virus
DLIRLCIMV

SEQ ID NO: 7094 - protein, 9 aa, Dengue virus
LIRLCIMVG

SEQ ID NO: 7095 - protein, 9 aa, Dengue virus
IRLCIMVGA

SEQ ID NO: 7096 - protein, 9 aa, Dengue virus
RLCIMVGAN

SEQ ID NO: 7097 - protein, 9 aa, Dengue virus
LCIMVGANA

SEQ ID NO: 7098 - protein, 9 aa, Dengue virus
CIMVGANAS

SEQ ID NO: 7099 - protein, 9 aa, Dengue virus
IMVGANASD

SEQ ID NO: 7100 - protein, 9 aa, Dengue virus
MVGANASDR

SEQ ID NO: 7101 - protein, 9 aa, Dengue virus
VGANASDRM

SEQ ID NO: 7102 - protein, 9 aa, Dengue virus
GANASDRMG

SEQ ID NO: 7103 - protein, 9 aa, Dengue virus
ANASDRMGM

SEQ ID NO: 7104 - protein, 9 aa, Dengue virus
NASDRMGMG

SEQ ID NO: 7105 - protein, 9 aa, Dengue virus
SDRMGMGTT

SEQ ID NO: 7106 - protein, 9 aa, Dengue virus
DRMGMGTTY

SEQ ID NO: 7107 - protein, 9 aa, Dengue virus
RMGMGTTYL

SEQ ID NO: 7108 - protein, 9 aa, Dengue virus
MGMGTTYLA

SEQ ID NO: 7109 - protein, 9 aa, Dengue virus
GMGTTYLAL

SEQ ID NO: 7110 - protein, 9 aa, Dengue virus
MGTTYLALM

SEQ ID NO: 7111 - protein, 9 aa, Dengue virus
GTTYLALMA

SEQ ID NO: 7112 - protein, 9 aa, Dengue virus
TTYLALMAT

SEQ ID NO: 7113 - protein, 9 aa, Dengue virus
TYLALMATF

SEQ ID NO: 7114 - protein, 9 aa, Dengue virus
YLALMATFK

SEQ ID NO: 7115 - protein, 9 aa, Dengue virus
LALMATFKM

SEQ ID NO: 7116 - protein, 9 aa, Dengue virus
ALMATFKMR

SEQ ID NO: 7117 - protein, 9 aa, Dengue virus
LMATFKMRP

SEQ ID NO: 7118 - protein, 9 aa, Dengue virus
MATFKMRPM

SEQ ID NO: 7119 - protein, 9 aa, Dengue virus
ATFKMRPMF

SEQ ID NO: 7120 - protein, 9 aa, Dengue virus
TFKMRPMFA

SEQ ID NO: 7121 - protein, 9 aa, Dengue virus
FKMRPMFAV

SEQ ID NO: 7122 - protein, 9 aa, Dengue virus
KMRPMFAVG

SEQ ID NO: 7123 - protein, 9 aa, Dengue virus
MRPMFAVGL

SEQ ID NO: 7124 - protein, 9 aa, Dengue virus
RPMFAVGLL

SEQ ID NO: 7125 - protein, 9 aa, Dengue virus
PMFAVGLLF

SEQ ID NO: 7126 - protein, 9 aa, Dengue virus
MFAVGLLFR

SEQ ID NO: 7127 - protein, 9 aa, Dengue virus
FAVGLLFRR

SEQ ID NO: 7128 - protein, 9 aa, Dengue virus
AVGLLFRRL

SEQ ID NO: 7129 - protein, 9 aa, Dengue virus
VGLLFRRLT

SEQ ID NO: 7130 - protein, 9 aa, Dengue virus
GLLFRRLTS

SEQ ID NO: 7131 - protein, 9 aa, Dengue virus
LLFRRLTSR

SEQ ID NO: 7132 - protein, 9 aa, Dengue virus
LFRRLTSRE

SEQ ID NO: 7133 - protein, 9 aa, Dengue virus
FRRLTSREV

SEQ ID NO: 7134 - protein, 9 aa, Dengue virus
RRLTSREVL

SEQ ID NO: 7135 - protein, 9 aa, Dengue virus
RLTSREVLL

SEQ ID NO: 7136 - protein, 9 aa, Dengue virus
LTSREVLLL

SEQ ID NO: 7137 - protein, 9 aa, Dengue virus
TSREVLLLT

SEQ ID NO: 7138 - protein, 9 aa, Dengue virus
SREVLLLTI

SEQ ID NO: 7139 - protein, 9 aa, Dengue virus
REVLLLTIG

SEQ ID NO: 7140 - protein, 9 aa, Dengue virus
EVLLLTIGL

SEQ ID NO: 7141 - protein, 9 aa, Dengue virus
VLLLTIGLS

SEQ ID NO: 7142 - protein, 9 aa, Dengue virus
LLLTIGLSL

SEQ ID NO: 7143 - protein, 9 aa, Dengue virus
LLTIGLSLV

SEQ ID NO: 7144 - protein, 9 aa, Dengue virus
LTIGLSLVA

SEQ ID NO: 7145 - protein, 9 aa, Dengue virus
TIGLSLVAS

SEQ ID NO: 7146 - protein, 9 aa, Dengue virus
IGLSLVASV

SEQ ID NO: 7147 - protein, 9 aa, Dengue virus
GLSLVASVE

SEQ ID NO: 7148 - protein, 9 aa, Dengue virus
LSLVASVEL

SEQ ID NO: 7149 - protein, 9 aa, Dengue virus
SLVASVELP

SEQ ID NO: 7150 - protein, 9 aa, Dengue virus
ASVELPNSL

SEQ ID NO: 7151 - protein, 9 aa, Dengue virus
SVELPNSLE

SEQ ID NO: 7152 - protein, 9 aa, Dengue virus
VELPNSLEE

SEQ ID NO: 7153 - protein, 9 aa, Dengue virus
ELPNSLEEL

SEQ ID NO: 7154 - protein, 9 aa, Dengue virus
LPNSLEELG

SEQ ID NO: 7155 - protein, 9 aa, Dengue virus
PNSLEELGD

SEQ ID NO: 7156 - protein, 9 aa, Dengue virus
NSLEELGDG

SEQ ID NO: 7157 - protein, 9 aa, Dengue virus
SLEELGDGL

SEQ ID NO: 7158 - protein, 9 aa, Dengue virus
LEELGDGLA

SEQ ID NO: 7159 - protein, 9 aa, Dengue virus
EELGDGLAM

SEQ ID NO: 7160 - protein, 9 aa, Dengue virus
ELGDGLAMG

SEQ ID NO: 7161 - protein, 9 aa, Dengue virus
LGDGLAMGI

SEQ ID NO: 7162 - protein, 9 aa, Dengue virus
GDGLAMGIM

SEQ ID NO: 7163 - protein, 9 aa, Dengue virus
DGLAMGIMI

SEQ ID NO: 7164 - protein, 9 aa, Dengue virus
GLAMGIMIL

SEQ ID NO: 7165 - protein, 9 aa, Dengue virus
LAMGIMILK

SEQ ID NO: 7166 - protein, 9 aa, Dengue virus
AMGIMILKL

SEQ ID NO: 7167 - protein, 9 aa, Dengue virus
MGIMILKLL

SEQ ID NO: 7168 - protein, 9 aa, Dengue virus
GIMILKLLT

SEQ ID NO: 7169 - protein, 9 aa, Dengue virus
IMILKLLTD

SEQ ID NO: 7170 - protein, 9 aa, Dengue virus
MILKLLTDF

SEQ ID NO: 7171 - protein, 9 aa, Dengue virus
ILKLLTDFQ

SEQ ID NO: 7172 - protein, 9 aa, Dengue virus
LKLLTDFQS

SEQ ID NO: 7173 - protein, 9 aa, Dengue virus
KLLTDFQSH

SEQ ID NO: 7174 - protein, 9 aa, Dengue virus
LLTDFQSHQ

SEQ ID NO: 7175 - protein, 9 aa, Dengue virus
LTDFQSHQL

SEQ ID NO: 7176 - protein, 9 aa, Dengue virus
TDFQSHQLW

SEQ ID NO: 7177 - protein, 9 aa, Dengue virus
LLSLTFIKT

SEQ ID NO: 7178 - protein, 9 aa, Dengue virus
HYAWKTMAM

SEQ ID NO: 7179 - protein, 9 aa, Dengue virus
AMVLSIVSL

SEQ ID NO: 7180 - protein, 9 aa, Dengue virus
LSIVSLFPL

SEQ ID NO: 7181 - protein, 9 aa, Dengue virus
SIVSLFPLC

SEQ ID NO: 7182 - protein, 9 aa, Dengue virus
VSLFPLCLS

SEQ ID NO: 7183 - protein, 9 aa, Dengue virus
SLFPLCLST

SEQ ID NO: 7184 - protein, 9 aa, Dengue virus
LFPLCLSTT

SEQ ID NO: 7185 - protein, 9 aa, Dengue virus
FPLCLSTTS

SEQ ID NO: 7186 - protein, 9 aa, Dengue virus
PLCLSTTSQ

SEQ ID NO: 7187 - protein, 9 aa, Dengue virus
LCLSTTSQK

SEQ ID NO: 7188 - protein, 9 aa, Dengue virus
CLSTTSQKT

SEQ ID NO: 7189 - protein, 9 aa, Dengue virus
LSTTSQKTT

SEQ ID NO: 7190 - protein, 9 aa, Dengue virus
STTSQKTTW

SEQ ID NO: 7191 - protein, 9 aa, Dengue virus
TTSQKTTWL

SEQ ID NO: 7192 - protein, 9 aa, Dengue virus
TSQKTTWLP

SEQ ID NO: 7193 - protein, 9 aa, Dengue virus
SQKTTWLPV

SEQ ID NO: 7194 - protein, 9 aa, Dengue virus
QKTTWLPVL

SEQ ID NO: 7195 - protein, 9 aa, Dengue virus
KTTWLPVLL

SEQ ID NO: 7196 - protein, 9 aa, Dengue virus
TTWLPVLLG

SEQ ID NO: 7197 - protein, 9 aa, Dengue virus
TWLPVLLGS

SEQ ID NO: 7198 - protein, 9 aa, Dengue virus
WLPVLLGSL

SEQ ID NO: 7199 - protein, 9 aa, Dengue virus
LPVLLGSLG

SEQ ID NO: 7200 - protein, 9 aa, Dengue virus
PVLLGSLGC

SEQ ID NO: 7201 - protein, 9 aa, Dengue virus
VLLGSLGCK

SEQ ID NO: 7202 - protein, 9 aa, Dengue virus
LLGSLGCKP

SEQ ID NO: 7203 - protein, 9 aa, Dengue virus
LGSLGCKPL

SEQ ID NO: 7204 - protein, 9 aa, Dengue virus
GSLGCKPLT

SEQ ID NO: 7205 - protein, 9 aa, Dengue virus
SLGCKPLTM

SEQ ID NO: 7206 - protein, 9 aa, Dengue virus
LGCKPLTMF

SEQ ID NO: 7207 - protein, 9 aa, Dengue virus
GCKPLTMFL

SEQ ID NO: 7208 - protein, 9 aa, Dengue virus
CKPLTMFLI

SEQ ID NO: 7209 - protein, 9 aa, Dengue virus
KPLTMFLIA

SEQ ID NO: 7210 - protein, 9 aa, Dengue virus
PLTMFLIAE

SEQ ID NO: 7211 - protein, 9 aa, Dengue virus
IAENKIWGR

SEQ ID NO: 7212 - protein, 9 aa, Dengue virus
ENKIWGRKS

SEQ ID NO: 7213 - protein, 9 aa, Dengue virus
NKIWGRKSW

SEQ ID NO: 7214 - protein, 9 aa, Dengue virus
KIWGRKSWP

SEQ ID NO: 7215 - protein, 9 aa, Dengue virus
IWGRKSWPL

SEQ ID NO: 7216 - protein, 9 aa, Dengue virus
WGRKSWPLN

SEQ ID NO: 7217 - protein, 9 aa, Dengue virus
GRKSWPLNE

SEQ ID NO: 7218 - protein, 9 aa, Dengue virus
RKSWPLNEG

SEQ ID NO: 7219 - protein, 9 aa, Dengue virus
KSWPLNEGI

SEQ ID NO: 7220 - protein, 9 aa, Dengue virus
SWPLNEGIM

SEQ ID NO: 7221 - protein, 9 aa, Dengue virus
WPLNEGIMA

SEQ ID NO: 7222 - protein, 9 aa, Dengue virus
PLNEGIMAV

SEQ ID NO: 7223 - protein, 9 aa, Dengue virus
LNEGIMAVG

SEQ ID NO: 7224 - protein, 9 aa, Dengue virus
NEGIMAVGI

SEQ ID NO: 7225 - protein, 9 aa, Dengue virus
EGIMAVGIV

SEQ ID NO: 7226 - protein, 9 aa, Dengue virus
GIMAVGIVS

SEQ ID NO: 7227 - protein, 9 aa, Dengue virus
IMAVGIVSI

SEQ ID NO: 7228 - protein, 9 aa, Dengue virus
MAVGIVSIL

SEQ ID NO: 7229 - protein, 9 aa, Dengue virus
AVGIVSILL

SEQ ID NO: 7230 - protein, 9 aa, Dengue virus
VGIVSILLS

SEQ ID NO: 7231 - protein, 9 aa, Dengue virus
GIVSILLSS

SEQ ID NO: 7232 - protein, 9 aa, Dengue virus
IVSILLSSL

SEQ ID NO: 7233 - protein, 9 aa, Dengue virus
VSILLSSLL

SEQ ID NO: 7234 - protein, 9 aa, Dengue virus
SILLSSLLK

SEQ ID NO: 7235 - protein, 9 aa, Dengue virus
ILLSSLLKN

SEQ ID NO: 7236 - protein, 9 aa, Dengue virus
LLSSLLKND

SEQ ID NO: 7237 - protein, 9 aa, Dengue virus
LSSLLKNDV

SEQ ID NO: 7238 - protein, 9 aa, Dengue virus
SSLLKNDVP

SEQ ID NO: 7239 - protein, 9 aa, Dengue virus
SLLKNDVPL

SEQ ID NO: 7240 - protein, 9 aa, Dengue virus
LLKNDVPLA

SEQ ID NO: 7241 - protein, 9 aa, Dengue virus
LKNDVPLAG

SEQ ID NO: 7242 - protein, 9 aa, Dengue virus
KNDVPLAGP

SEQ ID NO: 7243 - protein, 9 aa, Dengue virus
NDVPLAGPL

SEQ ID NO: 7244 - protein, 9 aa, Dengue virus
DVPLAGPLI

SEQ ID NO: 7245 - protein, 9 aa, Dengue virus
VPLAGPLIA

SEQ ID NO: 7246 - protein, 9 aa, Dengue virus
PLAGPLIAG

SEQ ID NO: 7247 - protein, 9 aa, Dengue virus
LAGPLIAGG

SEQ ID NO: 7248 - protein, 9 aa, Dengue virus
AGPLIAGGM

SEQ ID NO: 7249 - protein, 9 aa, Dengue virus
GPLIAGGML

SEQ ID NO: 7250 - protein, 9 aa, Dengue virus
PLIAGGMLI

SEQ ID NO: 7251 - protein, 9 aa, Dengue virus
LIAGGMLIA

SEQ ID NO: 7252 - protein, 9 aa, Dengue virus
IAGGMLIAC

SEQ ID NO: 7253 - protein, 9 aa, Dengue virus
AGGMLIACY

SEQ ID NO: 7254 - protein, 9 aa, Dengue virus
GGMLIACYV

SEQ ID NO: 7255 - protein, 9 aa, Dengue virus
GMLIACYVI

SEQ ID NO: 7256 - protein, 9 aa, Dengue virus
MLIACYVIS

SEQ ID NO: 7257 - protein, 9 aa, Dengue virus
LIACYVISG

SEQ ID NO: 7258 - protein, 9 aa, Dengue virus
IACYVISGS

SEQ ID NO: 7259 - protein, 9 aa, Dengue virus
ACYVISGSS

SEQ ID NO: 7260 - protein, 9 aa, Dengue virus
CYVISGSSA

SEQ ID NO: 7261 - protein, 9 aa, Dengue virus
YVISGSSAD

SEQ ID NO: 7262 - protein, 9 aa, Dengue virus
VISGSSADL

SEQ ID NO: 7263 - protein, 9 aa, Dengue virus
ISGSSADLS

SEQ ID NO: 7264 - protein, 9 aa, Dengue virus
SGSSADLSL

SEQ ID NO: 7265 - protein, 9 aa, Dengue virus
GSSADLSLE

SEQ ID NO: 7266 - protein, 9 aa, Dengue virus
SSADLSLEK

SEQ ID NO: 7267 - protein, 9 aa, Dengue virus
SADLSLEKA

SEQ ID NO: 7268 - protein, 9 aa, Dengue virus
ADLSLEKAA

SEQ ID NO: 7269 - protein, 9 aa, Dengue virus
DLSLEKAAE

SEQ ID NO: 7270 - protein, 9 aa, Dengue virus
LSLEKAAEV

SEQ ID NO: 7271 - protein, 9 aa, Dengue virus
SLEKAAEVS

SEQ ID NO: 7272 - protein, 9 aa, Dengue virus
LEKAAEVSW

SEQ ID NO: 7273 - protein, 9 aa, Dengue virus
EKAAEVSWE

SEQ ID NO: 7274 - protein, 9 aa, Dengue virus
AAEVSWEEE

SEQ ID NO: 7275 - protein, 9 aa, Dengue virus
AEVSWEEEA

SEQ ID NO: 7276 - protein, 9 aa, Dengue virus
EVSWEEEAE

SEQ ID NO: 7277 - protein, 9 aa, Dengue virus
VSWEEEAEH

SEQ ID NO: 7278 - protein, 9 aa, Dengue virus
SWEEEAEHS

SEQ ID NO: 7279 - protein, 9 aa, Dengue virus
WEEEAEHSG

SEQ ID NO: 7280 - protein, 9 aa, Dengue virus
EEEAEHSGA

SEQ ID NO: 7281 - protein, 9 aa, Dengue virus
EEAEHSGAS

SEQ ID NO: 7282 - protein, 9 aa, Dengue virus
EAEHSGASH

SEQ ID NO: 7283 - protein, 9 aa, Dengue virus
AEHSGASHN

SEQ ID NO: 7284 - protein, 9 aa, Dengue virus
EHSGASHNI

SEQ ID NO: 7285 - protein, 9 aa, Dengue virus
HSGASHNIL

SEQ ID NO: 7286 - protein, 9 aa, Dengue virus
SGASHNILV

SEQ ID NO: 7287 - protein, 9 aa, Dengue virus
GASHNILVE

SEQ ID NO: 7288 - protein, 9 aa, Dengue virus
ASHNILVEV

SEQ ID NO: 7289 - protein, 9 aa, Dengue virus
SHNILVEVQ

SEQ ID NO: 7290 - protein, 9 aa, Dengue virus
HNILVEVQD

SEQ ID NO: 7291 - protein, 9 aa, Dengue virus
NILVEVQDD

SEQ ID NO: 7292 - protein, 9 aa, Dengue virus
ILVEVQDDG

SEQ ID NO: 7293 - protein, 9 aa, Dengue virus
LVEVQDDGT

SEQ ID NO: 7294 - protein, 9 aa, Dengue virus
VEVQDDGTM

SEQ ID NO: 7295 - protein, 9 aa, Dengue virus
EVQDDGTMK

SEQ ID NO: 7296 - protein, 9 aa, Dengue virus
VQDDGTMKI

SEQ ID NO: 7297 - protein, 9 aa, Dengue virus
QDDGTMKIK

SEQ ID NO: 7298 - protein, 9 aa, Dengue virus
DDGTMKIKD

SEQ ID NO: 7299 - protein, 9 aa, Dengue virus
DGTMKIKDE

SEQ ID NO: 7300 - protein, 9 aa, Dengue virus
GTMKIKDEE

SEQ ID NO: 7301 - protein, 9 aa, Dengue virus
TMKIKDEER

SEQ ID NO: 7302 - protein, 9 aa, Dengue virus
MKIKDEERD

SEQ ID NO: 7303 - protein, 9 aa, Dengue virus
KIKDEERDD

SEQ ID NO: 7304 - protein, 9 aa, Dengue virus
IKDEERDDT

SEQ ID NO: 7305 - protein, 9 aa, Dengue virus
KDEERDDTL

SEQ ID NO: 7306 - protein, 9 aa, Dengue virus
DEERDDTLT

SEQ ID NO: 7307 - protein, 9 aa, Dengue virus
EERDDTLTI

SEQ ID NO: 7308 - protein, 9 aa, Dengue virus
ERDDTLTIL

SEQ ID NO: 7309 - protein, 9 aa, Dengue virus
RDDTLTILL

SEQ ID NO: 7310 - protein, 9 aa, Dengue virus
DDTLTILLK

SEQ ID NO: 7311 - protein, 9 aa, Dengue virus
DTLTILLKA

SEQ ID NO: 7312 - protein, 9 aa, Dengue virus
TLTILLKAT

SEQ ID NO: 7313 - protein, 9 aa, Dengue virus
LTILLKATL

SEQ ID NO: 7314 - protein, 9 aa, Dengue virus
TILLKATLL

SEQ ID NO: 7315 - protein, 9 aa, Dengue virus
ILLKATLLA

SEQ ID NO: 7316 - protein, 9 aa, Dengue virus
LLKATLLAV

SEQ ID NO: 7317 - protein, 9 aa, Dengue virus
LKATLLAVS

SEQ ID NO: 7318 - protein, 9 aa, Dengue virus
KATLLAVSG

SEQ ID NO: 7319 - protein, 9 aa, Dengue virus
ATLLAVSGV

SEQ ID NO: 7320 - protein, 9 aa, Dengue virus
TLLAVSGVY

SEQ ID NO: 7321 - protein, 9 aa, Dengue virus
LLAVSGVYP

SEQ ID NO: 7322 - protein, 9 aa, Dengue virus
LAVSGVYPL

SEQ ID NO: 7323 - protein, 9 aa, Dengue virus
AVSGVYPLS

SEQ ID NO: 7324 - protein, 9 aa, Dengue virus
VSGVYPLSI

SEQ ID NO: 7325 - protein, 9 aa, Dengue virus
SGVYPLSIP

SEQ ID NO: 7326 - protein, 9 aa, Dengue virus
GVYPLSIPA

SEQ ID NO: 7327 - protein, 9 aa, Dengue virus
VYPLSIPAT

SEQ ID NO: 7328 - protein, 9 aa, Dengue virus
YPLSIPATL

SEQ ID NO: 7329 - protein, 9 aa, Dengue virus
PLSIPATLF

SEQ ID NO: 7330 - protein, 9 aa, Dengue virus
LSIPATLFV

SEQ ID NO: 7331 - protein, 9 aa, Dengue virus
SIPATLFVW

SEQ ID NO: 7332 - protein, 9 aa, Dengue virus
IPATLFVWY

SEQ ID NO: 7333 - protein, 9 aa, Dengue virus
PATLFVWYF

SEQ ID NO: 7334 - protein, 9 aa, Dengue virus
ATLFVWYFW

SEQ ID NO: 7335 - protein, 9 aa, Dengue virus
TLFVWYFWQ

SEQ ID NO: 7336 - protein, 9 aa, Dengue virus
KKKQRSGVL

SEQ ID NO: 7337 - protein, 9 aa, Dengue virus
KKQRSGVLW

SEQ ID NO: 7338 - protein, 9 aa, Dengue virus
KQRSGVLWD

SEQ ID NO: 7339 - protein, 9 aa, Dengue virus
QRSGVLWDT

SEQ ID NO: 7340 - protein, 9 aa, Dengue virus
RSGVLWDTP

SEQ ID NO: 7341 - protein, 9 aa, Dengue virus
SGVLWDTPS

SEQ ID NO: 7342 - protein, 9 aa, Dengue virus
GVLWDTPSP

SEQ ID NO: 7343 - protein, 9 aa, Dengue virus
VLWDTPSPP

SEQ ID NO: 7344 - protein, 9 aa, Dengue virus
LWDTPSPPE

SEQ ID NO: 7345 - protein, 9 aa, Dengue virus
WDTPSPPEV

SEQ ID NO: 7346 - protein, 9 aa, Dengue virus
DTPSPPEVE

SEQ ID NO: 7347 - protein, 9 aa, Dengue virus
TPSPPEVER

SEQ ID NO: 7348 - protein, 9 aa, Dengue virus
PSPPEVERA

SEQ ID NO: 7349 - protein, 9 aa, Dengue virus
SPPEVERAV

SEQ ID NO: 7350 - protein, 9 aa, Dengue virus
PPEVERAVL

SEQ ID NO: 7351 - protein, 9 aa, Dengue virus
PEVERAVLD

SEQ ID NO: 7352 - protein, 9 aa, Dengue virus
VERAVLDDG

SEQ ID NO: 7353 - protein, 9 aa, Dengue virus
ERAVLDDGI

SEQ ID NO: 7354 - protein, 9 aa, Dengue virus
RAVLDDGIY

SEQ ID NO: 7355 - protein, 9 aa, Dengue virus
AVLDDGIYR

SEQ ID NO: 7356 - protein, 9 aa, Dengue virus
VLDDGIYRI

SEQ ID NO: 7357 - protein, 9 aa, Dengue virus
LDDGIYRIM

SEQ ID NO: 7358 - protein, 9 aa, Dengue virus
DDGIYRIMQ

SEQ ID NO: 7359 - protein, 9 aa, Dengue virus
DGIYRIMQR

SEQ ID NO: 7360 - protein, 9 aa, Dengue virus
GIYRIMQRG

SEQ ID NO: 7361 - protein, 9 aa, Dengue virus
IYRIMQRGL

SEQ ID NO: 7362 - protein, 9 aa, Dengue virus
YRIMQRGLL

SEQ ID NO: 7363 - protein, 9 aa, Dengue virus
RIMQRGLLG

SEQ ID NO: 7364 - protein, 9 aa, Dengue virus
IMQRGLLGR

SEQ ID NO: 7365 - protein, 9 aa, Dengue virus
MQRGLLGRS

SEQ ID NO: 7366 - protein, 9 aa, Dengue virus
QRGLLGRSQ

SEQ ID NO: 7367 - protein, 9 aa, Dengue virus
RGLLGRSQV

SEQ ID NO: 7368 - protein, 9 aa, Dengue virus
GLLGRSQVG

SEQ ID NO: 7369 - protein, 9 aa, Dengue virus
LLGRSQVGV

SEQ ID NO: 7370 - protein, 9 aa, Dengue virus
LGRSQVGVG

SEQ ID NO: 7371 - protein, 9 aa, Dengue virus
GRSQVGVGV

SEQ ID NO: 7372 - protein, 9 aa, Dengue virus
RSQVGVGVF

SEQ ID NO: 7373 - protein, 9 aa, Dengue virus
SQVGVGVFQ

SEQ ID NO: 7374 - protein, 9 aa, Dengue virus
QVGVGVFQE

SEQ ID NO: 7375 - protein, 9 aa, Dengue virus
VGVGVFQEN

SEQ ID NO: 7376 - protein, 9 aa, Dengue virus
GVGVFQENV

SEQ ID NO: 7377 - protein, 9 aa, Dengue virus
VGVFQENVF

SEQ ID NO: 7378 - protein, 9 aa, Dengue virus
GVFQENVFH

SEQ ID NO: 7379 - protein, 9 aa, Dengue virus
VFQENVFHT

SEQ ID NO: 7380 - protein, 9 aa, Dengue virus
FQENVFHTM

SEQ ID NO: 7381 - protein, 9 aa, Dengue virus
QENVFHTMW

SEQ ID NO: 7382 - protein, 9 aa, Dengue virus
ENVFHTMWH

SEQ ID NO: 7383 - protein, 9 aa, Dengue virus
NVFHTMWHV

SEQ ID NO: 7384 - protein, 9 aa, Dengue virus
VFHTMWHVT

SEQ ID NO: 7385 - protein, 9 aa, Dengue virus
FHTMWHVTR

SEQ ID NO: 7386 - protein, 9 aa, Dengue virus
HTMWHVTRG

SEQ ID NO: 7387 - protein, 9 aa, Dengue virus
TMWHVTRGA

SEQ ID NO: 7388 - protein, 9 aa, Dengue virus
MWHVTRGAV

SEQ ID NO: 7389 - protein, 9 aa, Dengue virus
WHVTRGAVL

SEQ ID NO: 7390 - protein, 9 aa, Dengue virus
HVTRGAVLM

SEQ ID NO: 7391 - protein, 9 aa, Dengue virus
VTRGAVLMY

SEQ ID NO: 7392 - protein, 9 aa, Dengue virus
TRGAVLMYQ

SEQ ID NO: 7393 - protein, 9 aa, Dengue virus
RGAVLMYQG

SEQ ID NO: 7394 - protein, 9 aa, Dengue virus
GAVLMYQGK

SEQ ID NO: 7395 - protein, 9 aa, Dengue virus
AVLMYQGKR

SEQ ID NO: 7396 - protein, 9 aa, Dengue virus
VLMYQGKRL

SEQ ID NO: 7397 - protein, 9 aa, Dengue virus
LMYQGKRLE

SEQ ID NO: 7398 - protein, 9 aa, Dengue virus
MYQGKRLEP

SEQ ID NO: 7399 - protein, 9 aa, Dengue virus
YQGKRLEPS

SEQ ID NO: 7400 - protein, 9 aa, Dengue virus
QGKRLEPSW

SEQ ID NO: 7401 - protein, 9 aa, Dengue virus
GKRLEPSWA

SEQ ID NO: 7402 - protein, 9 aa, Dengue virus
KRLEPSWAS

SEQ ID NO: 7403 - protein, 9 aa, Dengue virus
RLEPSWASV

SEQ ID NO: 7404 - protein, 9 aa, Dengue virus
LEPSWASVK

SEQ ID NO: 7405 - protein, 9 aa, Dengue virus
EPSWASVKK

SEQ ID NO: 7406 - protein, 9 aa, Dengue virus
PSWASVKKD

SEQ ID NO: 7407 - protein, 9 aa, Dengue virus
SWASVKKDL

SEQ ID NO: 7408 - protein, 9 aa, Dengue virus
WASVKKDLI

SEQ ID NO: 7409 - protein, 9 aa, Dengue virus
ASVKKDLIS

SEQ ID NO: 7410 - protein, 9 aa, Dengue virus
SVKKDLISY

SEQ ID NO: 7411 - protein, 9 aa, Dengue virus
VKKDLISYG

SEQ ID NO: 7412 - protein, 9 aa, Dengue virus
KKDLISYGG

SEQ ID NO: 7413 - protein, 9 aa, Dengue virus
KDLISYGGG

SEQ ID NO: 7414 - protein, 9 aa, Dengue virus
DLISYGGGW

SEQ ID NO: 7415 - protein, 9 aa, Dengue virus
LISYGGGWR

SEQ ID NO: 7416 - protein, 9 aa, Dengue virus
ISYGGGWRL

SEQ ID NO: 7417 - protein, 9 aa, Dengue virus
SYGGGWRLQ

SEQ ID NO: 7418 - protein, 9 aa, Dengue virus
YGGGWRLQG

SEQ ID NO: 7419 - protein, 9 aa, Dengue virus
GGGWRLQGS

SEQ ID NO: 7420 - protein, 9 aa, Dengue virus
GGWRLQGSW

SEQ ID NO: 7421 - protein, 9 aa, Dengue virus
GWRLQGSWN

SEQ ID NO: 7422 - protein, 9 aa, Dengue virus
QGSWNTGEE

SEQ ID NO: 7423 - protein, 9 aa, Dengue virus
GSWNTGEEV

SEQ ID NO: 7424 - protein, 9 aa, Dengue virus
SWNTGEEVQ

SEQ ID NO: 7425 - protein, 9 aa, Dengue virus
WNTGEEVQV

SEQ ID NO: 7426 - protein, 9 aa, Dengue virus
NTGEEVQVI

SEQ ID NO: 7427 - protein, 9 aa, Dengue virus
TGEEVQVIA

SEQ ID NO: 7428 - protein, 9 aa, Dengue virus
GEEVQVIAV

SEQ ID NO: 7429 - protein, 9 aa, Dengue virus
EEVQVIAVE

SEQ ID NO: 7430 - protein, 9 aa, Dengue virus
EVQVIAVEP

SEQ ID NO: 7431 - protein, 9 aa, Dengue virus
VQVIAVEPG

SEQ ID NO: 7432 - protein, 9 aa, Dengue virus
QVIAVEPGK

SEQ ID NO: 7433 - protein, 9 aa, Dengue virus
VIAVEPGKN

SEQ ID NO: 7434 - protein, 9 aa, Dengue virus
IAVEPGKNP

SEQ ID NO: 7435 - protein, 9 aa, Dengue virus
AVEPGKNPK

SEQ ID NO: 7436 - protein, 9 aa, Dengue virus
VEPGKNPKN

SEQ ID NO: 7437 - protein, 9 aa, Dengue virus
EPGKNPKNV

SEQ ID NO: 7438 - protein, 9 aa, Dengue virus
PGKNPKNVQ

SEQ ID NO: 7439 - protein, 9 aa, Dengue virus
GKNPKNVQT

SEQ ID NO: 7440 - protein, 9 aa, Dengue virus
KNPKNVQTA

SEQ ID NO: 7441 - protein, 9 aa, Dengue virus
NPKNVQTAP

SEQ ID NO: 7442 - protein, 9 aa, Dengue virus
PKNVQTAPG

SEQ ID NO: 7443 - protein, 9 aa, Dengue virus
KNVQTAPGT

SEQ ID NO: 7444 - protein, 9 aa, Dengue virus
NVQTAPGTF

SEQ ID NO: 7445 - protein, 9 aa, Dengue virus
VQTAPGTFK

SEQ ID NO: 7446 - protein, 9 aa, Dengue virus
QTAPGTFKT

SEQ ID NO: 7447 - protein, 9 aa, Dengue virus
TAPGTFKTP

SEQ ID NO: 7448 - protein, 9 aa, Dengue virus
APGTFKTPE

SEQ ID NO: 7449 - protein, 9 aa, Dengue virus
PGTFKTPEG

SEQ ID NO: 7450 - protein, 9 aa, Dengue virus
GTFKTPEGE

SEQ ID NO: 7451 - protein, 9 aa, Dengue virus
TFKTPEGEV

SEQ ID NO: 7452 - protein, 9 aa, Dengue virus
FKTPEGEVG

SEQ ID NO: 7453 - protein, 9 aa, Dengue virus
KTPEGEVGA

SEQ ID NO: 7454 - protein, 9 aa, Dengue virus
TPEGEVGAI

SEQ ID NO: 7455 - protein, 9 aa, Dengue virus
PEGEVGAIA

SEQ ID NO: 7456 - protein, 9 aa, Dengue virus
EGEVGAIAL

SEQ ID NO: 7457 - protein, 9 aa, Dengue virus
GEVGAIALD

SEQ ID NO: 7458 - protein, 9 aa, Dengue virus
EVGAIALDF

SEQ ID NO: 7459 - protein, 9 aa, Dengue virus
VGAIALDFK

SEQ ID NO: 7460 - protein, 9 aa, Dengue virus
GAIALDFKP

SEQ ID NO: 7461 - protein, 9 aa, Dengue virus
AIALDFKPG

SEQ ID NO: 7462 - protein, 9 aa, Dengue virus
IALDFKPGT

SEQ ID NO: 7463 - protein, 9 aa, Dengue virus
ALDFKPGTS

SEQ ID NO: 7464 - protein, 9 aa, Dengue virus
LDFKPGTSG

SEQ ID NO: 7465 - protein, 9 aa, Dengue virus
DFKPGTSGS

SEQ ID NO: 7466 - protein, 9 aa, Dengue virus
FKPGTSGSP

SEQ ID NO: 7467 - protein, 9 aa, Dengue virus
KPGTSGSPI

SEQ ID NO: 7468 - protein, 9 aa, Dengue virus
PGTSGSPIV

SEQ ID NO: 7469 - protein, 9 aa, Dengue virus
GTSGSPIVN

SEQ ID NO: 7470 - protein, 9 aa, Dengue virus
TSGSPIVNR

SEQ ID NO: 7471 - protein, 9 aa, Dengue virus
SGSPIVNRE

SEQ ID NO: 7472 - protein, 9 aa, Dengue virus
GSPIVNREG

SEQ ID NO: 7473 - protein, 9 aa, Dengue virus
SPIVNREGK

SEQ ID NO: 7474 - protein, 9 aa, Dengue virus
PIVNREGKI

SEQ ID NO: 7475 - protein, 9 aa, Dengue virus
IVNREGKIV

SEQ ID NO: 7476 - protein, 9 aa, Dengue virus
VNREGKIVG

SEQ ID NO: 7477 - protein, 9 aa, Dengue virus
NREGKIVGL

SEQ ID NO: 7478 - protein, 9 aa, Dengue virus
REGKIVGLY

SEQ ID NO: 7479 - protein, 9 aa, Dengue virus
EGKIVGLYG

SEQ ID NO: 7480 - protein, 9 aa, Dengue virus
GKIVGLYGN

SEQ ID NO: 7481 - protein, 9 aa, Dengue virus
KIVGLYGNG

SEQ ID NO: 7482 - protein, 9 aa, Dengue virus
IVGLYGNGV

SEQ ID NO: 7483 - protein, 9 aa, Dengue virus
VGLYGNGVV

SEQ ID NO: 7484 - protein, 9 aa, Dengue virus
GLYGNGVVT

SEQ ID NO: 7485 - protein, 9 aa, Dengue virus
LYGNGVVTT

SEQ ID NO: 7486 - protein, 9 aa, Dengue virus
YGNGVVTTS

SEQ ID NO: 7487 - protein, 9 aa, Dengue virus
GNGVVTTSG

SEQ ID NO: 7488 - protein, 9 aa, Dengue virus
NGVVTTSGT

SEQ ID NO: 7489 - protein, 9 aa, Dengue virus
GVVTTSGTY

SEQ ID NO: 7490 - protein, 9 aa, Dengue virus
VVTTSGTYV

SEQ ID NO: 7491 - protein, 9 aa, Dengue virus
VTTSGTYVS

SEQ ID NO: 7492 - protein, 9 aa, Dengue virus
TTSGTYVSA

SEQ ID NO: 7493 - protein, 9 aa, Dengue virus
TSGTYVSAI

SEQ ID NO: 7494 - protein, 9 aa, Dengue virus
SGTYVSAIA

SEQ ID NO: 7495 - protein, 9 aa, Dengue virus
GTYVSAIAQ

SEQ ID NO: 7496 - protein, 9 aa, Dengue virus
TYVSAIAQA

SEQ ID NO: 7497 - protein, 9 aa, Dengue virus
YVSAIAQAK

SEQ ID NO: 7498 - protein, 9 aa, Dengue virus
VSAIAQAKA

SEQ ID NO: 7499 - protein, 9 aa, Dengue virus
SAIAQAKAS

SEQ ID NO: 7500 - protein, 9 aa, Dengue virus
AIAQAKASQ

SEQ ID NO: 7501 - protein, 9 aa, Dengue virus
IAQAKASQE

SEQ ID NO: 7502 - protein, 9 aa, Dengue virus
AQAKASQEG

SEQ ID NO: 7503 - protein, 9 aa, Dengue virus
QAKASQEGP

SEQ ID NO: 7504 - protein, 9 aa, Dengue virus
AKASQEGPL

SEQ ID NO: 7505 - protein, 9 aa, Dengue virus
KASQEGPLP

SEQ ID NO: 7506 - protein, 9 aa, Dengue virus
ASQEGPLPE

SEQ ID NO: 7507 - protein, 9 aa, Dengue virus
SQEGPLPEI

SEQ ID NO: 7508 - protein, 9 aa, Dengue virus
QEGPLPEIE

SEQ ID NO: 7509 - protein, 9 aa, Dengue virus
EGPLPEIED

SEQ ID NO: 7510 - protein, 9 aa, Dengue virus
GPLPEIEDE

SEQ ID NO: 7511 - protein, 9 aa, Dengue virus
PLPEIEDEV

SEQ ID NO: 7512 - protein, 9 aa, Dengue virus
LPEIEDEVF

SEQ ID NO: 7513 - protein, 9 aa, Dengue virus
PEIEDEVFR

SEQ ID NO: 7514 - protein, 9 aa, Dengue virus
EIEDEVFRK

SEQ ID NO: 7515 - protein, 9 aa, Dengue virus
IEDEVFRKR

SEQ ID NO: 7516 - protein, 9 aa, Dengue virus
EDEVFRKRN

SEQ ID NO: 7517 - protein, 9 aa, Dengue virus
DEVFRKRNL

SEQ ID NO: 7518 - protein, 9 aa, Dengue virus
EVFRKRNLT

SEQ ID NO: 7519 - protein, 9 aa, Dengue virus
VFRKRNLTI

SEQ ID NO: 7520 - protein, 9 aa, Dengue virus
FRKRNLTIM

SEQ ID NO: 7521 - protein, 9 aa, Dengue virus
RKRNLTIMD

SEQ ID NO: 7522 - protein, 9 aa, Dengue virus
KRNLTIMDL

SEQ ID NO: 7523 - protein, 9 aa, Dengue virus
RNLTIMDLH

SEQ ID NO: 7524 - protein, 9 aa, Dengue virus
NLTIMDLHP

SEQ ID NO: 7525 - protein, 9 aa, Dengue virus
LTIMDLHPG

SEQ ID NO: 7526 - protein, 9 aa, Dengue virus
TIMDLHPGS

SEQ ID NO: 7527 - protein, 9 aa, Dengue virus
IMDLHPGSG

SEQ ID NO: 7528 - protein, 9 aa, Dengue virus
MDLHPGSGK

SEQ ID NO: 7529 - protein, 9 aa, Dengue virus
DLHPGSGKT

SEQ ID NO: 7530 - protein, 9 aa, Dengue virus
LHPGSGKTR

SEQ ID NO: 7531 - protein, 9 aa, Dengue virus
HPGSGKTRR

SEQ ID NO: 7532 - protein, 9 aa, Dengue virus
PGSGKTRRY

SEQ ID NO: 7533 - protein, 9 aa, Dengue virus
GSGKTRRYL

SEQ ID NO: 7534 - protein, 9 aa, Dengue virus
SGKTRRYLP

SEQ ID NO: 7535 - protein, 9 aa, Dengue virus
GKTRRYLPA

SEQ ID NO: 7536 - protein, 9 aa, Dengue virus
KTRRYLPAI

SEQ ID NO: 7537 - protein, 9 aa, Dengue virus
TRRYLPAIV

SEQ ID NO: 7538 - protein, 9 aa, Dengue virus
RRYLPAIVR

SEQ ID NO: 7539 - protein, 9 aa, Dengue virus
RYLPAIVRE

SEQ ID NO: 7540 - protein, 9 aa, Dengue virus
YLPAIVREA

SEQ ID NO: 7541 - protein, 9 aa, Dengue virus
LPAIVREAI

SEQ ID NO: 7542 - protein, 9 aa, Dengue virus
PAIVREAIK

SEQ ID NO: 7543 - protein, 9 aa, Dengue virus
AIVREAIKR

SEQ ID NO: 7544 - protein, 9 aa, Dengue virus
IVREAIKRK

SEQ ID NO: 7545 - protein, 9 aa, Dengue virus
VREAIKRKL

SEQ ID NO: 7546 - protein, 9 aa, Dengue virus
REAIKRKLR

SEQ ID NO: 7547 - protein, 9 aa, Dengue virus
EAIKRKLRT

SEQ ID NO: 7548 - protein, 9 aa, Dengue virus
AIKRKLRTL

SEQ ID NO: 7549 - protein, 9 aa, Dengue virus
IKRKLRTLI

SEQ ID NO: 7550 - protein, 9 aa, Dengue virus
KRKLRTLIL

SEQ ID NO: 7551 - protein, 9 aa, Dengue virus
RKLRTLILA

SEQ ID NO: 7552 - protein, 9 aa, Dengue virus
KLRTLILAP

SEQ ID NO: 7553 - protein, 9 aa, Dengue virus
LRTLILAPT

SEQ ID NO: 7554 - protein, 9 aa, Dengue virus
RTLILAPTR

SEQ ID NO: 7555 - protein, 9 aa, Dengue virus
TLILAPTRV

SEQ ID NO: 7556 - protein, 9 aa, Dengue virus
LILAPTRVV

SEQ ID NO: 7557 - protein, 9 aa, Dengue virus
ILAPTRVVA

SEQ ID NO: 7558 - protein, 9 aa, Dengue virus
LAPTRVVAS

SEQ ID NO: 7559 - protein, 9 aa, Dengue virus
APTRVVASE

SEQ ID NO: 7560 - protein, 9 aa, Dengue virus
PTRVVASEM

SEQ ID NO: 7561 - protein, 9 aa, Dengue virus
TRVVASEMA

SEQ ID NO: 7562 - protein, 9 aa, Dengue virus
RVVASEMAE

SEQ ID NO: 7563 - protein, 9 aa, Dengue virus
VVASEMAEA

SEQ ID NO: 7564 - protein, 9 aa, Dengue virus
VASEMAEAL

SEQ ID NO: 7565 - protein, 9 aa, Dengue virus
ASEMAEALK

SEQ ID NO: 7566 - protein, 9 aa, Dengue virus
SEMAEALKG

SEQ ID NO: 7567 - protein, 9 aa, Dengue virus
EMAEALKGM

SEQ ID NO: 7568 - protein, 9 aa, Dengue virus
MAEALKGMP

SEQ ID NO: 7569 - protein, 9 aa, Dengue virus
AEALKGMPI

SEQ ID NO: 7570 - protein, 9 aa, Dengue virus
EALKGMPIR

SEQ ID NO: 7571 - protein, 9 aa, Dengue virus
ALKGMPIRY

SEQ ID NO: 7572 - protein, 9 aa, Dengue virus
LKGMPIRYQ

SEQ ID NO: 7573 - protein, 9 aa, Dengue virus
KGMPIRYQT

SEQ ID NO: 7574 - protein, 9 aa, Dengue virus
GMPIRYQTT

SEQ ID NO: 7575 - protein, 9 aa, Dengue virus
MPIRYQTTA

SEQ ID NO: 7576 - protein, 9 aa, Dengue virus
PIRYQTTAV

SEQ ID NO: 7577 - protein, 9 aa, Dengue virus
IRYQTTAVK

SEQ ID NO: 7578 - protein, 9 aa, Dengue virus
RYQTTAVKS

SEQ ID NO: 7579 - protein, 9 aa, Dengue virus
YQTTAVKSE

SEQ ID NO: 7580 - protein, 9 aa, Dengue virus
QTTAVKSEH

SEQ ID NO: 7581 - protein, 9 aa, Dengue virus
TTAVKSEHT

SEQ ID NO: 7582 - protein, 9 aa, Dengue virus
TAVKSEHTG

SEQ ID NO: 7583 - protein, 9 aa, Dengue virus
AVKSEHTGK

SEQ ID NO: 7584 - protein, 9 aa, Dengue virus
VKSEHTGKE

SEQ ID NO: 7585 - protein, 9 aa, Dengue virus
KSEHTGKEI

SEQ ID NO: 7586 - protein, 9 aa, Dengue virus
SEHTGKEIV

SEQ ID NO: 7587 - protein, 9 aa, Dengue virus
EHTGKEIVD

SEQ ID NO: 7588 - protein, 9 aa, Dengue virus
HTGKEIVDL

SEQ ID NO: 7589 - protein, 9 aa, Dengue virus
TGKEIVDLM

SEQ ID NO: 7590 - protein, 9 aa, Dengue virus
GKEIVDLMC

SEQ ID NO: 7591 - protein, 9 aa, Dengue virus
KEIVDLMCH

SEQ ID NO: 7592 - protein, 9 aa, Dengue virus
EIVDLMCHA

SEQ ID NO: 7593 - protein, 9 aa, Dengue virus
IVDLMCHAT

SEQ ID NO: 7594 - protein, 9 aa, Dengue virus
VDLMCHATF

SEQ ID NO: 7595 - protein, 9 aa, Dengue virus
DLMCHATFT

SEQ ID NO: 7596 - protein, 9 aa, Dengue virus
LMCHATFTM

SEQ ID NO: 7597 - protein, 9 aa, Dengue virus
MCHATFTMR

SEQ ID NO: 7598 - protein, 9 aa, Dengue virus
CHATFTMRL

SEQ ID NO: 7599 - protein, 9 aa, Dengue virus
HATFTMRLL

SEQ ID NO: 7600 - protein, 9 aa, Dengue virus
ATFTMRLLS

SEQ ID NO: 7601 - protein, 9 aa, Dengue virus
TFTMRLLSP

SEQ ID NO: 7602 - protein, 9 aa, Dengue virus
FTMRLLSPV

SEQ ID NO: 7603 - protein, 9 aa, Dengue virus
TMRLLSPVR

SEQ ID NO: 7604 - protein, 9 aa, Dengue virus
MRLLSPVRV

SEQ ID NO: 7605 - protein, 9 aa, Dengue virus
RLLSPVRVP

SEQ ID NO: 7606 - protein, 9 aa, Dengue virus
LLSPVRVPN

SEQ ID NO: 7607 - protein, 9 aa, Dengue virus
LSPVRVPNY

SEQ ID NO: 7608 - protein, 9 aa, Dengue virus
SPVRVPNYN

SEQ ID NO: 7609 - protein, 9 aa, Dengue virus
PVRVPNYNM

SEQ ID NO: 7610 - protein, 9 aa, Dengue virus
VRVPNYNMI

SEQ ID NO: 7611 - protein, 9 aa, Dengue virus
RVPNYNMII

SEQ ID NO: 7612 - protein, 9 aa, Dengue virus
VPNYNMIIM

SEQ ID NO: 7613 - protein, 9 aa, Dengue virus
PNYNMIIMD

SEQ ID NO: 7614 - protein, 9 aa, Dengue virus
NYNMIIMDE

SEQ ID NO: 7615 - protein, 9 aa, Dengue virus
YNMIIMDEA

SEQ ID NO: 7616 - protein, 9 aa, Dengue virus
NMIIMDEAH

SEQ ID NO: 7617 - protein, 9 aa, Dengue virus
MIIMDEAHF

SEQ ID NO: 7618 - protein, 9 aa, Dengue virus
IIMDEAHFT

SEQ ID NO: 7619 - protein, 9 aa, Dengue virus
IMDEAHFTD

SEQ ID NO: 7620 - protein, 9 aa, Dengue virus
MDEAHFTDP

SEQ ID NO: 7621 - protein, 9 aa, Dengue virus
DEAHFTDPS

SEQ ID NO: 7622 - protein, 9 aa, Dengue virus
EAHFTDPSS

SEQ ID NO: 7623 - protein, 9 aa, Dengue virus
AHFTDPSSI

SEQ ID NO: 7624 - protein, 9 aa, Dengue virus
HFTDPSSIA

SEQ ID NO: 7625 - protein, 9 aa, Dengue virus
FTDPSSIAA

SEQ ID NO: 7626 - protein, 9 aa, Dengue virus
TDPSSIAAR

SEQ ID NO: 7627 - protein, 9 aa, Dengue virus
DPSSIAARG

SEQ ID NO: 7628 - protein, 9 aa, Dengue virus
PSSIAARGY

SEQ ID NO: 7629 - protein, 9 aa, Dengue virus
SSIAARGYI

SEQ ID NO: 7630 - protein, 9 aa, Dengue virus
SIAARGYIS

SEQ ID NO: 7631 - protein, 9 aa, Dengue virus
IAARGYIST

SEQ ID NO: 7632 - protein, 9 aa, Dengue virus
AARGYISTR

SEQ ID NO: 7633 - protein, 9 aa, Dengue virus
ARGYISTRV

SEQ ID NO: 7634 - protein, 9 aa, Dengue virus
RGYISTRVG

SEQ ID NO: 7635 - protein, 9 aa, Dengue virus
GYISTRVGM

SEQ ID NO: 7636 - protein, 9 aa, Dengue virus
YISTRVGMG

SEQ ID NO: 7637 - protein, 9 aa, Dengue virus
ISTRVGMGE

SEQ ID NO: 7638 - protein, 9 aa, Dengue virus
STRVGMGEA

SEQ ID NO: 7639 - protein, 9 aa, Dengue virus
TRVGMGEAA

SEQ ID NO: 7640 - protein, 9 aa, Dengue virus
RVGMGEAAA

SEQ ID NO: 7641 - protein, 9 aa, Dengue virus
VGMGEAAAI

SEQ ID NO: 7642 - protein, 9 aa, Dengue virus
GMGEAAAIF

SEQ ID NO: 7643 - protein, 9 aa, Dengue virus
MGEAAAIFM

SEQ ID NO: 7644 - protein, 9 aa, Dengue virus
GEAAAIFMT

SEQ ID NO: 7645 - protein, 9 aa, Dengue virus
EAAAIFMTA

SEQ ID NO: 7646 - protein, 9 aa, Dengue virus
AAAIFMTAT

SEQ ID NO: 7647 - protein, 9 aa, Dengue virus
AAIFMTATP

SEQ ID NO: 7648 - protein, 9 aa, Dengue virus
AIFMTATPP

SEQ ID NO: 7649 - protein, 9 aa, Dengue virus
IFMTATPPG

SEQ ID NO: 7650 - protein, 9 aa, Dengue virus
FMTATPPGS

SEQ ID NO: 7651 - protein, 9 aa, Dengue virus
MTATPPGSV

SEQ ID NO: 7652 - protein, 9 aa, Dengue virus
TATPPGSVE

SEQ ID NO: 7653 - protein, 9 aa, Dengue virus
ATPPGSVEA

SEQ ID NO: 7654 - protein, 9 aa, Dengue virus
TPPGSVEAF

SEQ ID NO: 7655 - protein, 9 aa, Dengue virus
PPGSVEAFP

SEQ ID NO: 7656 - protein, 9 aa, Dengue virus
PGSVEAFPQ

SEQ ID NO: 7657 - protein, 9 aa, Dengue virus
GSVEAFPQS

SEQ ID NO: 7658 - protein, 9 aa, Dengue virus
SVEAFPQSN

SEQ ID NO: 7659 - protein, 9 aa, Dengue virus
VEAFPQSNA

SEQ ID NO: 7660 - protein, 9 aa, Dengue virus
EAFPQSNAV

SEQ ID NO: 7661 - protein, 9 aa, Dengue virus
AFPQSNAVI

SEQ ID NO: 7662 - protein, 9 aa, Dengue virus
FPQSNAVIQ

SEQ ID NO: 7663 - protein, 9 aa, Dengue virus
PQSNAVIQD

SEQ ID NO: 7664 - protein, 9 aa, Dengue virus
QSNAVIQDE

SEQ ID NO: 7665 - protein, 9 aa, Dengue virus
SNAVIQDEE

SEQ ID NO: 7666 - protein, 9 aa, Dengue virus
NAVIQDEER

SEQ ID NO: 7667 - protein, 9 aa, Dengue virus
AVIQDEERD

SEQ ID NO: 7668 - protein, 9 aa, Dengue virus
VIQDEERDI

SEQ ID NO: 7669 - protein, 9 aa, Dengue virus
IQDEERDIP

SEQ ID NO: 7670 - protein, 9 aa, Dengue virus
QDEERDIPE

SEQ ID NO: 7671 - protein, 9 aa, Dengue virus
DEERDIPER

SEQ ID NO: 7672 - protein, 9 aa, Dengue virus
EERDIPERS

SEQ ID NO: 7673 - protein, 9 aa, Dengue virus
ERDIPERSW

SEQ ID NO: 7674 - protein, 9 aa, Dengue virus
RDIPERSWN

SEQ ID NO: 7675 - protein, 9 aa, Dengue virus
DIPERSWNS

SEQ ID NO: 7676 - protein, 9 aa, Dengue virus
IPERSWNSG

SEQ ID NO: 7677 - protein, 9 aa, Dengue virus
PERSWNSGY

SEQ ID NO: 7678 - protein, 9 aa, Dengue virus
ERSWNSGYE

SEQ ID NO: 7679 - protein, 9 aa, Dengue virus
RSWNSGYEW

SEQ ID NO: 7680 - protein, 9 aa, Dengue virus
SWNSGYEWI

SEQ ID NO: 7681 - protein, 9 aa, Dengue virus
WNSGYEWIT

SEQ ID NO: 7682 - protein, 9 aa, Dengue virus
NSGYEWITD

SEQ ID NO: 7683 - protein, 9 aa, Dengue virus
SGYEWITDF

SEQ ID NO: 7684 - protein, 9 aa, Dengue virus
GYEWITDFP

SEQ ID NO: 7685 - protein, 9 aa, Dengue virus
YEWITDFPG

SEQ ID NO: 7686 - protein, 9 aa, Dengue virus
EWITDFPGK

SEQ ID NO: 7687 - protein, 9 aa, Dengue virus
WITDFPGKT

SEQ ID NO: 7688 - protein, 9 aa, Dengue virus
ITDFPGKTV

SEQ ID NO: 7689 - protein, 9 aa, Dengue virus
TDFPGKTVW

SEQ ID NO: 7690 - protein, 9 aa, Dengue virus
DFPGKTVWF

SEQ ID NO: 7691 - protein, 9 aa, Dengue virus
FPGKTVWFV

SEQ ID NO: 7692 - protein, 9 aa, Dengue virus
PGKTVWFVP

SEQ ID NO: 7693 - protein, 9 aa, Dengue virus
GKTVWFVPS

SEQ ID NO: 7694 - protein, 9 aa, Dengue virus
KTVWFVPSI

SEQ ID NO: 7695 - protein, 9 aa, Dengue virus
TVWFVPSIK

SEQ ID NO: 7696 - protein, 9 aa, Dengue virus
VWFVPSIKS

SEQ ID NO: 7697 - protein, 9 aa, Dengue virus
WFVPSIKSG

SEQ ID NO: 7698 - protein, 9 aa, Dengue virus
FVPSIKSGN

SEQ ID NO: 7699 - protein, 9 aa, Dengue virus
VPSIKSGND

SEQ ID NO: 7700 - protein, 9 aa, Dengue virus
PSIKSGNDI

SEQ ID NO: 7701 - protein, 9 aa, Dengue virus
SIKSGNDIA

SEQ ID NO: 7702 - protein, 9 aa, Dengue virus
IKSGNDIAN

SEQ ID NO: 7703 - protein, 9 aa, Dengue virus
KSGNDIANC

SEQ ID NO: 7704 - protein, 9 aa, Dengue virus
SGNDIANCL

SEQ ID NO: 7705 - protein, 9 aa, Dengue virus
GNDIANCLR

SEQ ID NO: 7706 - protein, 9 aa, Dengue virus
NDIANCLRK

SEQ ID NO: 7707 - protein, 9 aa, Dengue virus
DIANCLRKN

SEQ ID NO: 7708 - protein, 9 aa, Dengue virus
IANCLRKNG

SEQ ID NO: 7709 - protein, 9 aa, Dengue virus
ANCLRKNGK

SEQ ID NO: 7710 - protein, 9 aa, Dengue virus
NCLRKNGKR

SEQ ID NO: 7711 - protein, 9 aa, Dengue virus
CLRKNGKRV

SEQ ID NO: 7712 - protein, 9 aa, Dengue virus
LRKNGKRVI

SEQ ID NO: 7713 - protein, 9 aa, Dengue virus
RKNGKRVIQ

SEQ ID NO: 7714 - protein, 9 aa, Dengue virus
KNGKRVIQL

SEQ ID NO: 7715 - protein, 9 aa, Dengue virus
NGKRVIQLS

SEQ ID NO: 7716 - protein, 9 aa, Dengue virus
GKRVIQLSR

SEQ ID NO: 7717 - protein, 9 aa, Dengue virus
KRVIQLSRK

SEQ ID NO: 7718 - protein, 9 aa, Dengue virus
RVIQLSRKT

SEQ ID NO: 7719 - protein, 9 aa, Dengue virus
VIQLSRKTF

SEQ ID NO: 7720 - protein, 9 aa, Dengue virus
IQLSRKTFD

SEQ ID NO: 7721 - protein, 9 aa, Dengue virus
QLSRKTFDT

SEQ ID NO: 7722 - protein, 9 aa, Dengue virus
LSRKTFDTE

SEQ ID NO: 7723 - protein, 9 aa, Dengue virus
SRKTFDTEY

SEQ ID NO: 7724 - protein, 9 aa, Dengue virus
RKTFDTEYQ

SEQ ID NO: 7725 - protein, 9 aa, Dengue virus
KTFDTEYQK

SEQ ID NO: 7726 - protein, 9 aa, Dengue virus
TFDTEYQKT

SEQ ID NO: 7727 - protein, 9 aa, Dengue virus
FDTEYQKTK

SEQ ID NO: 7728 - protein, 9 aa, Dengue virus
DTEYQKTKN

SEQ ID NO: 7729 - protein, 9 aa, Dengue virus
TEYQKTKNN

SEQ ID NO: 7730 - protein, 9 aa, Dengue virus
EYQKTKNND

SEQ ID NO: 7731 - protein, 9 aa, Dengue virus
YQKTKNNDW

SEQ ID NO: 7732 - protein, 9 aa, Dengue virus
QKTKNNDWD

SEQ ID NO: 7733 - protein, 9 aa, Dengue virus
KTKNNDWDY

SEQ ID NO: 7734 - protein, 9 aa, Dengue virus
TKNNDWDYV

SEQ ID NO: 7735 - protein, 9 aa, Dengue virus
KNNDWDYVV

SEQ ID NO: 7736 - protein, 9 aa, Dengue virus
NNDWDYVVT

SEQ ID NO: 7737 - protein, 9 aa, Dengue virus
NDWDYVVTT

SEQ ID NO: 7738 - protein, 9 aa, Dengue virus
DWDYVVTTD

SEQ ID NO: 7739 - protein, 9 aa, Dengue virus
WDYVVTTDI

SEQ ID NO: 7740 - protein, 9 aa, Dengue virus
DYVVTTDIS

SEQ ID NO: 7741 - protein, 9 aa, Dengue virus
YVVTTDISE

SEQ ID NO: 7742 - protein, 9 aa, Dengue virus
VVTTDISEM

SEQ ID NO: 7743 - protein, 9 aa, Dengue virus
VTTDISEMG

SEQ ID NO: 7744 - protein, 9 aa, Dengue virus
TTDISEMGA

SEQ ID NO: 7745 - protein, 9 aa, Dengue virus
TDISEMGAN

SEQ ID NO: 7746 - protein, 9 aa, Dengue virus
DISEMGANF

SEQ ID NO: 7747 - protein, 9 aa, Dengue virus
ISEMGANFR

SEQ ID NO: 7748 - protein, 9 aa, Dengue virus
SEMGANFRA

SEQ ID NO: 7749 - protein, 9 aa, Dengue virus
EMGANFRAD

SEQ ID NO: 7750 - protein, 9 aa, Dengue virus
MGANFRADR

SEQ ID NO: 7751 - protein, 9 aa, Dengue virus
GANFRADRV

SEQ ID NO: 7752 - protein, 9 aa, Dengue virus
ANFRADRVI

SEQ ID NO: 7753 - protein, 9 aa, Dengue virus
NFRADRVID

SEQ ID NO: 7754 - protein, 9 aa, Dengue virus
FRADRVIDP

SEQ ID NO: 7755 - protein, 9 aa, Dengue virus
RADRVIDPR

SEQ ID NO: 7756 - protein, 9 aa, Dengue virus
ADRVIDPRR

SEQ ID NO: 7757 - protein, 9 aa, Dengue virus
DRVIDPRRC

SEQ ID NO: 7758 - protein, 9 aa, Dengue virus
RVIDPRRCL

SEQ ID NO: 7759 - protein, 9 aa, Dengue virus
VIDPRRCLK

SEQ ID NO: 7760 - protein, 9 aa, Dengue virus
IDPRRCLKP

SEQ ID NO: 7761 - protein, 9 aa, Dengue virus
DPRRCLKPV

SEQ ID NO: 7762 - protein, 9 aa, Dengue virus
PRRCLKPVI

SEQ ID NO: 7763 - protein, 9 aa, Dengue virus
RRCLKPVIL

SEQ ID NO: 7764 - protein, 9 aa, Dengue virus
RCLKPVILK

SEQ ID NO: 7765 - protein, 9 aa, Dengue virus
CLKPVILKD

SEQ ID NO: 7766 - protein, 9 aa, Dengue virus
LKPVILKDG

SEQ ID NO: 7767 - protein, 9 aa, Dengue virus
KPVILKDGP

SEQ ID NO: 7768 - protein, 9 aa, Dengue virus
PVILKDGPE

SEQ ID NO: 7769 - protein, 9 aa, Dengue virus
VILKDGPER

SEQ ID NO: 7770 - protein, 9 aa, Dengue virus
ILKDGPERV

SEQ ID NO: 7771 - protein, 9 aa, Dengue virus
LKDGPERVI

SEQ ID NO: 7772 - protein, 9 aa, Dengue virus
KDGPERVIL

SEQ ID NO: 7773 - protein, 9 aa, Dengue virus
DGPERVILA

SEQ ID NO: 7774 - protein, 9 aa, Dengue virus
GPERVILAG

SEQ ID NO: 7775 - protein, 9 aa, Dengue virus
PERVILAGP

SEQ ID NO: 7776 - protein, 9 aa, Dengue virus
ERVILAGPM

SEQ ID NO: 7777 - protein, 9 aa, Dengue virus
RVILAGPMP

SEQ ID NO: 7778 - protein, 9 aa, Dengue virus
VILAGPMPV

SEQ ID NO: 7779 - protein, 9 aa, Dengue virus
ILAGPMPVT

SEQ ID NO: 7780 - protein, 9 aa, Dengue virus
LAGPMPVTV

SEQ ID NO: 7781 - protein, 9 aa, Dengue virus
AGPMPVTVA

SEQ ID NO: 7782 - protein, 9 aa, Dengue virus
GPMPVTVAS

SEQ ID NO: 7783 - protein, 9 aa, Dengue virus
PMPVTVASA

SEQ ID NO: 7784 - protein, 9 aa, Dengue virus
MPVTVASAA

SEQ ID NO: 7785 - protein, 9 aa, Dengue virus
PVTVASAAQ

SEQ ID NO: 7786 - protein, 9 aa, Dengue virus
VTVASAAQR

SEQ ID NO: 7787 - protein, 9 aa, Dengue virus
TVASAAQRR

SEQ ID NO: 7788 - protein, 9 aa, Dengue virus
VASAAQRRG

SEQ ID NO: 7789 - protein, 9 aa, Dengue virus
ASAAQRRGR

SEQ ID NO: 7790 - protein, 9 aa, Dengue virus
SAAQRRGRI

SEQ ID NO: 7791 - protein, 9 aa, Dengue virus
AAQRRGRIG

SEQ ID NO: 7792 - protein, 9 aa, Dengue virus
AQRRGRIGR

SEQ ID NO: 7793 - protein, 9 aa, Dengue virus
QRRGRIGRN

SEQ ID NO: 7794 - protein, 9 aa, Dengue virus
RRGRIGRNH

SEQ ID NO: 7795 - protein, 9 aa, Dengue virus
RGRIGRNHN

SEQ ID NO: 7796 - protein, 9 aa, Dengue virus
GRIGRNHNK

SEQ ID NO: 7797 - protein, 9 aa, Dengue virus
RIGRNHNKE

SEQ ID NO: 7798 - protein, 9 aa, Dengue virus
IGRNHNKEG

SEQ ID NO: 7799 - protein, 9 aa, Dengue virus
GRNHNKEGD

SEQ ID NO: 7800 - protein, 9 aa, Dengue virus
RNHNKEGDQ

SEQ ID NO: 7801 - protein, 9 aa, Dengue virus
NHNKEGDQY

SEQ ID NO: 7802 - protein, 9 aa, Dengue virus
HNKEGDQYI

SEQ ID NO: 7803 - protein, 9 aa, Dengue virus
NKEGDQYIY

SEQ ID NO: 7804 - protein, 9 aa, Dengue virus
KEGDQYIYM

SEQ ID NO: 7805 - protein, 9 aa, Dengue virus
EGDQYIYMG

SEQ ID NO: 7806 - protein, 9 aa, Dengue virus
GDQYIYMGQ

SEQ ID NO: 7807 - protein, 9 aa, Dengue virus
DQYIYMGQP

SEQ ID NO: 7808 - protein, 9 aa, Dengue virus
QYIYMGQPL

SEQ ID NO: 7809 - protein, 9 aa, Dengue virus
YIYMGQPLN

SEQ ID NO: 7810 - protein, 9 aa, Dengue virus
IYMGQPLNN

SEQ ID NO: 7811 - protein, 9 aa, Dengue virus
YMGQPLNND

SEQ ID NO: 7812 - protein, 9 aa, Dengue virus
MGQPLNNDE

SEQ ID NO: 7813 - protein, 9 aa, Dengue virus
GQPLNNDED

SEQ ID NO: 7814 - protein, 9 aa, Dengue virus
QPLNNDEDH

SEQ ID NO: 7815 - protein, 9 aa, Dengue virus
PLNNDEDHA

SEQ ID NO: 7816 - protein, 9 aa, Dengue virus
LNNDEDHAH

SEQ ID NO: 7817 - protein, 9 aa, Dengue virus
NNDEDHAHW

SEQ ID NO: 7818 - protein, 9 aa, Dengue virus
NDEDHAHWT

SEQ ID NO: 7819 - protein, 9 aa, Dengue virus
DEDHAHWTE

SEQ ID NO: 7820 - protein, 9 aa, Dengue virus
EDHAHWTEA

SEQ ID NO: 7821 - protein, 9 aa, Dengue virus
DHAHWTEAK

SEQ ID NO: 7822 - protein, 9 aa, Dengue virus
HAHWTEAKM

SEQ ID NO: 7823 - protein, 9 aa, Dengue virus
AHWTEAKML

SEQ ID NO: 7824 - protein, 9 aa, Dengue virus
HWTEAKMLL

SEQ ID NO: 7825 - protein, 9 aa, Dengue virus
WTEAKMLLD

SEQ ID NO: 7826 - protein, 9 aa, Dengue virus
TEAKMLLDN

SEQ ID NO: 7827 - protein, 9 aa, Dengue virus
EAKMLLDNI

SEQ ID NO: 7828 - protein, 9 aa, Dengue virus
AKMLLDNIN

SEQ ID NO: 7829 - protein, 9 aa, Dengue virus
KMLLDNINT

SEQ ID NO: 7830 - protein, 9 aa, Dengue virus
MLLDNINTP

SEQ ID NO: 7831 - protein, 9 aa, Dengue virus
LLDNINTPE

SEQ ID NO: 7832 - protein, 9 aa, Dengue virus
LDNINTPEG

SEQ ID NO: 7833 - protein, 9 aa, Dengue virus
DNINTPEGI

SEQ ID NO: 7834 - protein, 9 aa, Dengue virus
NINTPEGII

SEQ ID NO: 7835 - protein, 9 aa, Dengue virus
INTPEGIIP

SEQ ID NO: 7836 - protein, 9 aa, Dengue virus
NTPEGIIPA

SEQ ID NO: 7837 - protein, 9 aa, Dengue virus
TPEGIIPAL

SEQ ID NO: 7838 - protein, 9 aa, Dengue virus
PEGIIPALF

SEQ ID NO: 7839 - protein, 9 aa, Dengue virus
EGIIPALFE

SEQ ID NO: 7840 - protein, 9 aa, Dengue virus
GIIPALFEP

SEQ ID NO: 7841 - protein, 9 aa, Dengue virus
IIPALFEPE

SEQ ID NO: 7842 - protein, 9 aa, Dengue virus
IPALFEPER

SEQ ID NO: 7843 - protein, 9 aa, Dengue virus
PALFEPERE

SEQ ID NO: 7844 - protein, 9 aa, Dengue virus
ALFEPEREK

SEQ ID NO: 7845 - protein, 9 aa, Dengue virus
LFEPEREKS

SEQ ID NO: 7846 - protein, 9 aa, Dengue virus
FEPEREKSA

SEQ ID NO: 7847 - protein, 9 aa, Dengue virus
EPEREKSAA

SEQ ID NO: 7848 - protein, 9 aa, Dengue virus
PEREKSAAI

SEQ ID NO: 7849 - protein, 9 aa, Dengue virus
EREKSAAID

SEQ ID NO: 7850 - protein, 9 aa, Dengue virus
REKSAAIDG

SEQ ID NO: 7851 - protein, 9 aa, Dengue virus
EKSAAIDGE

SEQ ID NO: 7852 - protein, 9 aa, Dengue virus
KSAAIDGEY

SEQ ID NO: 7853 - protein, 9 aa, Dengue virus
SAAIDGEYR

SEQ ID NO: 7854 - protein, 9 aa, Dengue virus
AAIDGEYRL

SEQ ID NO: 7855 - protein, 9 aa, Dengue virus
AIDGEYRLR

SEQ ID NO: 7856 - protein, 9 aa, Dengue virus
IDGEYRLRG

SEQ ID NO: 7857 - protein, 9 aa, Dengue virus
DGEYRLRGE

SEQ ID NO: 7858 - protein, 9 aa, Dengue virus
GEYRLRGEA

SEQ ID NO: 7859 - protein, 9 aa, Dengue virus
EYRLRGEAR

SEQ ID NO: 7860 - protein, 9 aa, Dengue virus
YRLRGEARK

SEQ ID NO: 7861 - protein, 9 aa, Dengue virus
RLRGEARKT

SEQ ID NO: 7862 - protein, 9 aa, Dengue virus
LRGEARKTF

SEQ ID NO: 7863 - protein, 9 aa, Dengue virus
RGEARKTFV

SEQ ID NO: 7864 - protein, 9 aa, Dengue virus
GEARKTFVE

SEQ ID NO: 7865 - protein, 9 aa, Dengue virus
EARKTFVEL

SEQ ID NO: 7866 - protein, 9 aa, Dengue virus
ARKTFVELM

SEQ ID NO: 7867 - protein, 9 aa, Dengue virus
RKTFVELMR

SEQ ID NO: 7868 - protein, 9 aa, Dengue virus
KTFVELMRR

SEQ ID NO: 7869 - protein, 9 aa, Dengue virus
TFVELMRRG

SEQ ID NO: 7870 - protein, 9 aa, Dengue virus
FVELMRRGD

SEQ ID NO: 7871 - protein, 9 aa, Dengue virus
VELMRRGDL

SEQ ID NO: 7872 - protein, 9 aa, Dengue virus
ELMRRGDLP

SEQ ID NO: 7873 - protein, 9 aa, Dengue virus
LMRRGDLPV

SEQ ID NO: 7874 - protein, 9 aa, Dengue virus
MRRGDLPVW

SEQ ID NO: 7875 - protein, 9 aa, Dengue virus
RRGDLPVWL

SEQ ID NO: 7876 - protein, 9 aa, Dengue virus
RGDLPVWLS

SEQ ID NO: 7877 - protein, 9 aa, Dengue virus
GDLPVWLSY

SEQ ID NO: 7878 - protein, 9 aa, Dengue virus
DLPVWLSYK

SEQ ID NO: 7879 - protein, 9 aa, Dengue virus
LPVWLSYKV

SEQ ID NO: 7880 - protein, 9 aa, Dengue virus
PVWLSYKVA

SEQ ID NO: 7881 - protein, 9 aa, Dengue virus
VWLSYKVAS

SEQ ID NO: 7882 - protein, 9 aa, Dengue virus
WLSYKVASE

SEQ ID NO: 7883 - protein, 9 aa, Dengue virus
LSYKVASEG

SEQ ID NO: 7884 - protein, 9 aa, Dengue virus
SYKVASEGF

SEQ ID NO: 7885 - protein, 9 aa, Dengue virus
YKVASEGFQ

SEQ ID NO: 7886 - protein, 9 aa, Dengue virus
KVASEGFQY

SEQ ID NO: 7887 - protein, 9 aa, Dengue virus
VASEGFQYS

SEQ ID NO: 7888 - protein, 9 aa, Dengue virus
ASEGFQYSD

SEQ ID NO: 7889 - protein, 9 aa, Dengue virus
SEGFQYSDR

SEQ ID NO: 7890 - protein, 9 aa, Dengue virus
EGFQYSDRR

SEQ ID NO: 7891 - protein, 9 aa, Dengue virus
GFQYSDRRW

SEQ ID NO: 7892 - protein, 9 aa, Dengue virus
FQYSDRRWC

SEQ ID NO: 7893 - protein, 9 aa, Dengue virus
QYSDRRWCF

SEQ ID NO: 7894 - protein, 9 aa, Dengue virus
YSDRRWCFD

SEQ ID NO: 7895 - protein, 9 aa, Dengue virus
SDRRWCFDG

SEQ ID NO: 7896 - protein, 9 aa, Dengue virus
DRRWCFDGE

SEQ ID NO: 7897 - protein, 9 aa, Dengue virus
RRWCFDGER

SEQ ID NO: 7898 - protein, 9 aa, Dengue virus
RWCFDGERN

SEQ ID NO: 7899 - protein, 9 aa, Dengue virus
WCFDGERNN

SEQ ID NO: 7900 - protein, 9 aa, Dengue virus
CFDGERNNQ

SEQ ID NO: 7901 - protein, 9 aa, Dengue virus
FDGERNNQV

SEQ ID NO: 7902 - protein, 9 aa, Dengue virus
DGERNNQVL

SEQ ID NO: 7903 - protein, 9 aa, Dengue virus
GERNNQVLE

SEQ ID NO: 7904 - protein, 9 aa, Dengue virus
ERNNQVLEE

SEQ ID NO: 7905 - protein, 9 aa, Dengue virus
RNNQVLEEN

SEQ ID NO: 7906 - protein, 9 aa, Dengue virus
NNQVLEENM

SEQ ID NO: 7907 - protein, 9 aa, Dengue virus
NQVLEENMD

SEQ ID NO: 7908 - protein, 9 aa, Dengue virus
QVLEENMDV

SEQ ID NO: 7909 - protein, 9 aa, Dengue virus
VLEENMDVE

SEQ ID NO: 7910 - protein, 9 aa, Dengue virus
LEENMDVEI

SEQ ID NO: 7911 - protein, 9 aa, Dengue virus
EENMDVEIW

SEQ ID NO: 7912 - protein, 9 aa, Dengue virus
ENMDVEIWT

SEQ ID NO: 7913 - protein, 9 aa, Dengue virus
NMDVEIWTK

SEQ ID NO: 7914 - protein, 9 aa, Dengue virus
MDVEIWTKE

SEQ ID NO: 7915 - protein, 9 aa, Dengue virus
DVEIWTKEG

SEQ ID NO: 7916 - protein, 9 aa, Dengue virus
ERKKLRPRW

SEQ ID NO: 7917 - protein, 9 aa, Dengue virus
RKKLRPRWL

SEQ ID NO: 7918 - protein, 9 aa, Dengue virus
KKLRPRWLD

SEQ ID NO: 7919 - protein, 9 aa, Dengue virus
KLRPRWLDA

SEQ ID NO: 7920 - protein, 9 aa, Dengue virus
LRPRWLDAR

SEQ ID NO: 7921 - protein, 9 aa, Dengue virus
RPRWLDART

SEQ ID NO: 7922 - protein, 9 aa, Dengue virus
PRWLDARTY

SEQ ID NO: 7923 - protein, 9 aa, Dengue virus
RWLDARTYS

SEQ ID NO: 7924 - protein, 9 aa, Dengue virus
WLDARTYSD

SEQ ID NO: 7925 - protein, 9 aa, Dengue virus
LDARTYSDP

SEQ ID NO: 7926 - protein, 9 aa, Dengue virus
DARTYSDPL

SEQ ID NO: 7927 - protein, 9 aa, Dengue virus
ARTYSDPLA

SEQ ID NO: 7928 - protein, 9 aa, Dengue virus
RTYSDPLAL

SEQ ID NO: 7929 - protein, 9 aa, Dengue virus
TYSDPLALR

SEQ ID NO: 7930 - protein, 9 aa, Dengue virus
YSDPLALRE

SEQ ID NO: 7931 - protein, 9 aa, Dengue virus
SDPLALREF

SEQ ID NO: 7932 - protein, 9 aa, Dengue virus
DPLALREFK

SEQ ID NO: 7933 - protein, 9 aa, Dengue virus
PLALREFKE

SEQ ID NO: 7934 - protein, 9 aa, Dengue virus
LALREFKEF

SEQ ID NO: 7935 - protein, 9 aa, Dengue virus
ALREFKEFA

SEQ ID NO: 7936 - protein, 9 aa, Dengue virus
LREFKEFAA

SEQ ID NO: 7937 - protein, 9 aa, Dengue virus
REFKEFAAG

SEQ ID NO: 7938 - protein, 9 aa, Dengue virus
EFKEFAAGR

SEQ ID NO: 7939 - protein, 9 aa, Dengue virus
FKEFAAGRR

SEQ ID NO: 7940 - protein, 9 aa, Dengue virus
KEFAAGRRS

SEQ ID NO: 7941 - protein, 9 aa, Dengue virus
EFAAGRRSV

SEQ ID NO: 7942 - protein, 9 aa, Dengue virus
FAAGRRSVS

SEQ ID NO: 7943 - protein, 9 aa, Dengue virus
AAGRRSVSG

SEQ ID NO: 7944 - protein, 9 aa, Dengue virus
AGRRSVSGD

SEQ ID NO: 7945 - protein, 9 aa, Dengue virus
GRRSVSGDL

SEQ ID NO: 7946 - protein, 9 aa, Dengue virus
RRSVSGDLI

SEQ ID NO: 7947 - protein, 9 aa, Dengue virus
RSVSGDLIL

SEQ ID NO: 7948 - protein, 9 aa, Dengue virus
SVSGDLILE

SEQ ID NO: 7949 - protein, 9 aa, Dengue virus
VSGDLILEI

SEQ ID NO: 7950 - protein, 9 aa, Dengue virus
SGDLILEIG

SEQ ID NO: 7951 - protein, 9 aa, Dengue virus
GDLILEIGK

SEQ ID NO: 7952 - protein, 9 aa, Dengue virus
DLILEIGKL

SEQ ID NO: 7953 - protein, 9 aa, Dengue virus
LILEIGKLP

SEQ ID NO: 7954 - protein, 9 aa, Dengue virus
ILEIGKLPQ

SEQ ID NO: 7955 - protein, 9 aa, Dengue virus
LEIGKLPQH

SEQ ID NO: 7956 - protein, 9 aa, Dengue virus
EIGKLPQHL

SEQ ID NO: 7957 - protein, 9 aa, Dengue virus
IGKLPQHLT

SEQ ID NO: 7958 - protein, 9 aa, Dengue virus
GKLPQHLTQ

SEQ ID NO: 7959 - protein, 9 aa, Dengue virus
KLPQHLTQR

SEQ ID NO: 7960 - protein, 9 aa, Dengue virus
LPQHLTQRA

SEQ ID NO: 7961 - protein, 9 aa, Dengue virus
PQHLTQRAQ

SEQ ID NO: 7962 - protein, 9 aa, Dengue virus
QHLTQRAQN

SEQ ID NO: 7963 - protein, 9 aa, Dengue virus
HLTQRAQNA

SEQ ID NO: 7964 - protein, 9 aa, Dengue virus
LTQRAQNAL

SEQ ID NO: 7965 - protein, 9 aa, Dengue virus
TQRAQNALD

SEQ ID NO: 7966 - protein, 9 aa, Dengue virus
QRAQNALDN

SEQ ID NO: 7967 - protein, 9 aa, Dengue virus
RAQNALDNL

SEQ ID NO: 7968 - protein, 9 aa, Dengue virus
AQNALDNLV

SEQ ID NO: 7969 - protein, 9 aa, Dengue virus
QNALDNLVM

SEQ ID NO: 7970 - protein, 9 aa, Dengue virus
NALDNLVML

SEQ ID NO: 7971 - protein, 9 aa, Dengue virus
ALDNLVMLH

SEQ ID NO: 7972 - protein, 9 aa, Dengue virus
LDNLVMLHN

SEQ ID NO: 7973 - protein, 9 aa, Dengue virus
DNLVMLHNS

SEQ ID NO: 7974 - protein, 9 aa, Dengue virus
NLVMLHNSE

SEQ ID NO: 7975 - protein, 9 aa, Dengue virus
LVMLHNSEQ

SEQ ID NO: 7976 - protein, 9 aa, Dengue virus
VMLHNSEQG

SEQ ID NO: 7977 - protein, 9 aa, Dengue virus
MLHNSEQGG

SEQ ID NO: 7978 - protein, 9 aa, Dengue virus
LHNSEQGGR

SEQ ID NO: 7979 - protein, 9 aa, Dengue virus
HNSEQGGRA

SEQ ID NO: 7980 - protein, 9 aa, Dengue virus
NSEQGGRAY

SEQ ID NO: 7981 - protein, 9 aa, Dengue virus
SEQGGRAYR

SEQ ID NO: 7982 - protein, 9 aa, Dengue virus
EQGGRAYRH

SEQ ID NO: 7983 - protein, 9 aa, Dengue virus
QGGRAYRHA

SEQ ID NO: 7984 - protein, 9 aa, Dengue virus
GGRAYRHAM

SEQ ID NO: 7985 - protein, 9 aa, Dengue virus
GRAYRHAME

SEQ ID NO: 7986 - protein, 9 aa, Dengue virus
RAYRHAMEE

SEQ ID NO: 7987 - protein, 9 aa, Dengue virus
AYRHAMEEL

SEQ ID NO: 7988 - protein, 9 aa, Dengue virus
YRHAMEELP

SEQ ID NO: 7989 - protein, 9 aa, Dengue virus
RHAMEELPD

SEQ ID NO: 7990 - protein, 9 aa, Dengue virus
HAMEELPDT

SEQ ID NO: 7991 - protein, 9 aa, Dengue virus
AMEELPDTI

SEQ ID NO: 7992 - protein, 9 aa, Dengue virus
MEELPDTIE

SEQ ID NO: 7993 - protein, 9 aa, Dengue virus
EELPDTIET

SEQ ID NO: 7994 - protein, 9 aa, Dengue virus
ELPDTIETL

SEQ ID NO: 7995 - protein, 9 aa, Dengue virus
LPDTIETLM

SEQ ID NO: 7996 - protein, 9 aa, Dengue virus
PDTIETLML

SEQ ID NO: 7997 - protein, 9 aa, Dengue virus
DTIETLMLL

SEQ ID NO: 7998 - protein, 9 aa, Dengue virus
TIETLMLLA

SEQ ID NO: 7999 - protein, 9 aa, Dengue virus
IETLMLLAL

SEQ ID NO: 8000 - protein, 9 aa, Dengue virus
ETLMLLALI

SEQ ID NO: 8001 - protein, 9 aa, Dengue virus
TLMLLALIA

SEQ ID NO: 8002 - protein, 9 aa, Dengue virus
LMLLALIAV

SEQ ID NO: 8003 - protein, 9 aa, Dengue virus
MLLALIAVL

SEQ ID NO: 8004 - protein, 9 aa, Dengue virus
LLALIAVLT

SEQ ID NO: 8005 - protein, 9 aa, Dengue virus
LALIAVLTG

SEQ ID NO: 8006 - protein, 9 aa, Dengue virus
ALIAVLTGG

SEQ ID NO: 8007 - protein, 9 aa, Dengue virus
LIAVLTGGV

SEQ ID NO: 8008 - protein, 9 aa, Dengue virus
IAVLTGGVT

SEQ ID NO: 8009 - protein, 9 aa, Dengue virus
AVLTGGVTL

SEQ ID NO: 8010 - protein, 9 aa, Dengue virus
VLTGGVTLF

SEQ ID NO: 8011 - protein, 9 aa, Dengue virus
LTGGVTLFF

SEQ ID NO: 8012 - protein, 9 aa, Dengue virus
TGGVTLFFL

SEQ ID NO: 8013 - protein, 9 aa, Dengue virus
GGVTLFFLS

SEQ ID NO: 8014 - protein, 9 aa, Dengue virus
GVTLFFLSG

SEQ ID NO: 8015 - protein, 9 aa, Dengue virus
VTLFFLSGR

SEQ ID NO: 8016 - protein, 9 aa, Dengue virus
TLFFLSGRG

SEQ ID NO: 8017 - protein, 9 aa, Dengue virus
LFFLSGRGL

SEQ ID NO: 8018 - protein, 9 aa, Dengue virus
FFLSGRGLG

SEQ ID NO: 8019 - protein, 9 aa, Dengue virus
FLSGRGLGK

SEQ ID NO: 8020 - protein, 9 aa, Dengue virus
LSGRGLGKT

SEQ ID NO: 8021 - protein, 9 aa, Dengue virus
SGRGLGKTS

SEQ ID NO: 8022 - protein, 9 aa, Dengue virus
GRGLGKTSI

SEQ ID NO: 8023 - protein, 9 aa, Dengue virus
RGLGKTSIG

SEQ ID NO: 8024 - protein, 9 aa, Dengue virus
GLGKTSIGL

SEQ ID NO: 8025 - protein, 9 aa, Dengue virus
LGKTSIGLL

SEQ ID NO: 8026 - protein, 9 aa, Dengue virus
GKTSIGLLC

SEQ ID NO: 8027 - protein, 9 aa, Dengue virus
KTSIGLLCV

SEQ ID NO: 8028 - protein, 9 aa, Dengue virus
TSIGLLCVM

SEQ ID NO: 8029 - protein, 9 aa, Dengue virus
SIGLLCVMA

SEQ ID NO: 8030 - protein, 9 aa, Dengue virus
IGLLCVMAS

SEQ ID NO: 8031 - protein, 9 aa, Dengue virus
GLLCVMASS

SEQ ID NO: 8032 - protein, 9 aa, Dengue virus
ASSVLLWMA

SEQ ID NO: 8033 - protein, 9 aa, Dengue virus
SSVLLWMAS

SEQ ID NO: 8034 - protein, 9 aa, Dengue virus
SVLLWMASV

SEQ ID NO: 8035 - protein, 9 aa, Dengue virus
VLLWMASVE

SEQ ID NO: 8036 - protein, 9 aa, Dengue virus
LLWMASVEP

SEQ ID NO: 8037 - protein, 9 aa, Dengue virus
LWMASVEPH

SEQ ID NO: 8038 - protein, 9 aa, Dengue virus
WMASVEPHW

SEQ ID NO: 8039 - protein, 9 aa, Dengue virus
MASVEPHWI

SEQ ID NO: 8040 - protein, 9 aa, Dengue virus
ASVEPHWIA

SEQ ID NO: 8041 - protein, 9 aa, Dengue virus
SVEPHWIAA

SEQ ID NO: 8042 - protein, 9 aa, Dengue virus
VEPHWIAAS

SEQ ID NO: 8043 - protein, 9 aa, Dengue virus
EPHWIAASI

SEQ ID NO: 8044 - protein, 9 aa, Dengue virus
PHWIAASII

SEQ ID NO: 8045 - protein, 9 aa, Dengue virus
HWIAASIIL

SEQ ID NO: 8046 - protein, 9 aa, Dengue virus
WIAASIILE

SEQ ID NO: 8047 - protein, 9 aa, Dengue virus
IAASIILEF

SEQ ID NO: 8048 - protein, 9 aa, Dengue virus
AASIILEFF

SEQ ID NO: 8049 - protein, 9 aa, Dengue virus
ASIILEFFL

SEQ ID NO: 8050 - protein, 9 aa, Dengue virus
SIILEFFLM

SEQ ID NO: 8051 - protein, 9 aa, Dengue virus
IILEFFLMV

SEQ ID NO: 8052 - protein, 9 aa, Dengue virus
ILEFFLMVL

SEQ ID NO: 8053 - protein, 9 aa, Dengue virus
LEFFLMVLL

SEQ ID NO: 8054 - protein, 9 aa, Dengue virus
EFFLMVLLI

SEQ ID NO: 8055 - protein, 9 aa, Dengue virus
FFLMVLLIP

SEQ ID NO: 8056 - protein, 9 aa, Dengue virus
FLMVLLIPE

SEQ ID NO: 8057 - protein, 9 aa, Dengue virus
LMVLLIPEP

SEQ ID NO: 8058 - protein, 9 aa, Dengue virus
MVLLIPEPD

SEQ ID NO: 8059 - protein, 9 aa, Dengue virus
VLLIPEPDR

SEQ ID NO: 8060 - protein, 9 aa, Dengue virus
LLIPEPDRQ

SEQ ID NO: 8061 - protein, 9 aa, Dengue virus
LIPEPDRQR

SEQ ID NO: 8062 - protein, 9 aa, Dengue virus
IPEPDRQRT

SEQ ID NO: 8063 - protein, 9 aa, Dengue virus
PEPDRQRTP

SEQ ID NO: 8064 - protein, 9 aa, Dengue virus
EPDRQRTPQ

SEQ ID NO: 8065 - protein, 9 aa, Dengue virus
PDRQRTPQD

SEQ ID NO: 8066 - protein, 9 aa, Dengue virus
DRQRTPQDN

SEQ ID NO: 8067 - protein, 9 aa, Dengue virus
RQRTPQDNQ

SEQ ID NO: 8068 - protein, 9 aa, Dengue virus
QRTPQDNQL

SEQ ID NO: 8069 - protein, 9 aa, Dengue virus
RTPQDNQLA

SEQ ID NO: 8070 - protein, 9 aa, Dengue virus
TPQDNQLAY

SEQ ID NO: 8071 - protein, 9 aa, Dengue virus
PQDNQLAYV

SEQ ID NO: 8072 - protein, 9 aa, Dengue virus
QDNQLAYVV

SEQ ID NO: 8073 - protein, 9 aa, Dengue virus
DNQLAYVVI

SEQ ID NO: 8074 - protein, 9 aa, Dengue virus
NQLAYVVIG

SEQ ID NO: 8075 - protein, 9 aa, Dengue virus
QLAYVVIGL

SEQ ID NO: 8076 - protein, 9 aa, Dengue virus
LAYVVIGLL

SEQ ID NO: 8077 - protein, 9 aa, Dengue virus
AYVVIGLLF

SEQ ID NO: 8078 - protein, 9 aa, Dengue virus
YVVIGLLFM

SEQ ID NO: 8079 - protein, 9 aa, Dengue virus
VVIGLLFMI

SEQ ID NO: 8080 - protein, 9 aa, Dengue virus
VIGLLFMIL

SEQ ID NO: 8081 - protein, 9 aa, Dengue virus
IGLLFMILT

SEQ ID NO: 8082 - protein, 9 aa, Dengue virus
GLLFMILTV

SEQ ID NO: 8083 - protein, 9 aa, Dengue virus
LLFMILTVA

SEQ ID NO: 8084 - protein, 9 aa, Dengue virus
LFMILTVAA

SEQ ID NO: 8085 - protein, 9 aa, Dengue virus
FMILTVAAN

SEQ ID NO: 8086 - protein, 9 aa, Dengue virus
MILTVAANE

SEQ ID NO: 8087 - protein, 9 aa, Dengue virus
ILTVAANEM

SEQ ID NO: 8088 - protein, 9 aa, Dengue virus
LTVAANEMG

SEQ ID NO: 8089 - protein, 9 aa, Dengue virus
TVAANEMGL

SEQ ID NO: 8090 - protein, 9 aa, Dengue virus
VAANEMGLL

SEQ ID NO: 8091 - protein, 9 aa, Dengue virus
AANEMGLLE

SEQ ID NO: 8092 - protein, 9 aa, Dengue virus
ANEMGLLET

SEQ ID NO: 8093 - protein, 9 aa, Dengue virus
NEMGLLETT

SEQ ID NO: 8094 - protein, 9 aa, Dengue virus
EMGLLETTK

SEQ ID NO: 8095 - protein, 9 aa, Dengue virus
MGLLETTKK

SEQ ID NO: 8096 - protein, 9 aa, Dengue virus
GLLETTKKD

SEQ ID NO: 8097 - protein, 9 aa, Dengue virus
LLETTKKDL

SEQ ID NO: 8098 - protein, 9 aa, Dengue virus
LETTKKDLG

SEQ ID NO: 8099 - protein, 9 aa, Dengue virus
ETTKKDLGI

SEQ ID NO: 8100 - protein, 9 aa, Dengue virus
TTKKDLGIG

SEQ ID NO: 8101 - protein, 9 aa, Dengue virus
TKKDLGIGH

SEQ ID NO: 8102 - protein, 9 aa, Dengue virus
KKDLGIGHV

SEQ ID NO: 8103 - protein, 9 aa, Dengue virus
KDLGIGHVA

SEQ ID NO: 8104 - protein, 9 aa, Dengue virus
HAAMLDVDL

SEQ ID NO: 8105 - protein, 9 aa, Dengue virus
AMLDVDLHP

SEQ ID NO: 8106 - protein, 9 aa, Dengue virus
MLDVDLHPA

SEQ ID NO: 8107 - protein, 9 aa, Dengue virus
LDVDLHPAS

SEQ ID NO: 8108 - protein, 9 aa, Dengue virus
DVDLHPASA

SEQ ID NO: 8109 - protein, 9 aa, Dengue virus
VDLHPASAW

SEQ ID NO: 8110 - protein, 9 aa, Dengue virus
DLHPASAWT

SEQ ID NO: 8111 - protein, 9 aa, Dengue virus
LHPASAWTL

SEQ ID NO: 8112 - protein, 9 aa, Dengue virus
HPASAWTLY

SEQ ID NO: 8113 - protein, 9 aa, Dengue virus
PASAWTLYA

SEQ ID NO: 8114 - protein, 9 aa, Dengue virus
ASAWTLYAV

SEQ ID NO: 8115 - protein, 9 aa, Dengue virus
SAWTLYAVA

SEQ ID NO: 8116 - protein, 9 aa, Dengue virus
AWTLYAVAT

SEQ ID NO: 8117 - protein, 9 aa, Dengue virus
WTLYAVATT

SEQ ID NO: 8118 - protein, 9 aa, Dengue virus
TLYAVATTI

SEQ ID NO: 8119 - protein, 9 aa, Dengue virus
LYAVATTII

SEQ ID NO: 8120 - protein, 9 aa, Dengue virus
YAVATTIIT

SEQ ID NO: 8121 - protein, 9 aa, Dengue virus
AVATTIITP

SEQ ID NO: 8122 - protein, 9 aa, Dengue virus
VATTIITPM

SEQ ID NO: 8123 - protein, 9 aa, Dengue virus
ATTIITPMM

SEQ ID NO: 8124 - protein, 9 aa, Dengue virus
TTIITPMMR

SEQ ID NO: 8125 - protein, 9 aa, Dengue virus
TIITPMMRH

SEQ ID NO: 8126 - protein, 9 aa, Dengue virus
IITPMMRHT

SEQ ID NO: 8127 - protein, 9 aa, Dengue virus
ITPMMRHTI

SEQ ID NO: 8128 - protein, 9 aa, Dengue virus
TPMMRHTIE

SEQ ID NO: 8129 - protein, 9 aa, Dengue virus
PMMRHTIEN

SEQ ID NO: 8130 - protein, 9 aa, Dengue virus
MMRHTIENT

SEQ ID NO: 8131 - protein, 9 aa, Dengue virus
MRHTIENTT

SEQ ID NO: 8132 - protein, 9 aa, Dengue virus
RHTIENTTA

SEQ ID NO: 8133 - protein, 9 aa, Dengue virus
HTIENTTAN

SEQ ID NO: 8134 - protein, 9 aa, Dengue virus
TIENTTANI

SEQ ID NO: 8135 - protein, 9 aa, Dengue virus
IENTTANIS

SEQ ID NO: 8136 - protein, 9 aa, Dengue virus
ENTTANISL

SEQ ID NO: 8137 - protein, 9 aa, Dengue virus
NTTANISLT

SEQ ID NO: 8138 - protein, 9 aa, Dengue virus
TTANISLTA

SEQ ID NO: 8139 - protein, 9 aa, Dengue virus
TANISLTAI

SEQ ID NO: 8140 - protein, 9 aa, Dengue virus
ANISLTAIA

SEQ ID NO: 8141 - protein, 9 aa, Dengue virus
NISLTAIAN

SEQ ID NO: 8142 - protein, 9 aa, Dengue virus
ISLTAIANQ

SEQ ID NO: 8143 - protein, 9 aa, Dengue virus
SLTAIANQA

SEQ ID NO: 8144 - protein, 9 aa, Dengue virus
LTAIANQAA

SEQ ID NO: 8145 - protein, 9 aa, Dengue virus
TAIANQAAI

SEQ ID NO: 8146 - protein, 9 aa, Dengue virus
AIANQAAIL

SEQ ID NO: 8147 - protein, 9 aa, Dengue virus
IANQAAILM

SEQ ID NO: 8148 - protein, 9 aa, Dengue virus
ANQAAILMG

SEQ ID NO: 8149 - protein, 9 aa, Dengue virus
NQAAILMGL

SEQ ID NO: 8150 - protein, 9 aa, Dengue virus
QAAILMGLD

SEQ ID NO: 8151 - protein, 9 aa, Dengue virus
AAILMGLDK

SEQ ID NO: 8152 - protein, 9 aa, Dengue virus
AILMGLDKG

SEQ ID NO: 8153 - protein, 9 aa, Dengue virus
ILMGLDKGW

SEQ ID NO: 8154 - protein, 9 aa, Dengue virus
LMGLDKGWP

SEQ ID NO: 8155 - protein, 9 aa, Dengue virus
MGLDKGWPI

SEQ ID NO: 8156 - protein, 9 aa, Dengue virus
GLDKGWPIS

SEQ ID NO: 8157 - protein, 9 aa, Dengue virus
LDKGWPISK

SEQ ID NO: 8158 - protein, 9 aa, Dengue virus
DKGWPISKM

SEQ ID NO: 8159 - protein, 9 aa, Dengue virus
KGWPISKMD

SEQ ID NO: 8160 - protein, 9 aa, Dengue virus
GWPISKMDI

SEQ ID NO: 8161 - protein, 9 aa, Dengue virus
WPISKMDIG

SEQ ID NO: 8162 - protein, 9 aa, Dengue virus
PISKMDIGV

SEQ ID NO: 8163 - protein, 9 aa, Dengue virus
ISKMDIGVP

SEQ ID NO: 8164 - protein, 9 aa, Dengue virus
SKMDIGVPL

SEQ ID NO: 8165 - protein, 9 aa, Dengue virus
KMDIGVPLL

SEQ ID NO: 8166 - protein, 9 aa, Dengue virus
MDIGVPLLA

SEQ ID NO: 8167 - protein, 9 aa, Dengue virus
DIGVPLLAL

SEQ ID NO: 8168 - protein, 9 aa, Dengue virus
IGVPLLALG

SEQ ID NO: 8169 - protein, 9 aa, Dengue virus
GVPLLALGC

SEQ ID NO: 8170 - protein, 9 aa, Dengue virus
VPLLALGCY

SEQ ID NO: 8171 - protein, 9 aa, Dengue virus
PLLALGCYS

SEQ ID NO: 8172 - protein, 9 aa, Dengue virus
LLALGCYSQ

SEQ ID NO: 8173 - protein, 9 aa, Dengue virus
LALGCYSQV

SEQ ID NO: 8174 - protein, 9 aa, Dengue virus
ALGCYSQVN

SEQ ID NO: 8175 - protein, 9 aa, Dengue virus
LGCYSQVNP

SEQ ID NO: 8176 - protein, 9 aa, Dengue virus
GCYSQVNPL

SEQ ID NO: 8177 - protein, 9 aa, Dengue virus
CYSQVNPLT

SEQ ID NO: 8178 - protein, 9 aa, Dengue virus
YSQVNPLTL

SEQ ID NO: 8179 - protein, 9 aa, Dengue virus
SQVNPLTLT

SEQ ID NO: 8180 - protein, 9 aa, Dengue virus
QVNPLTLTA

SEQ ID NO: 8181 - protein, 9 aa, Dengue virus
VNPLTLTAA

SEQ ID NO: 8182 - protein, 9 aa, Dengue virus
NPLTLTAAV

SEQ ID NO: 8183 - protein, 9 aa, Dengue virus
PLTLTAAVL

SEQ ID NO: 8184 - protein, 9 aa, Dengue virus
LTLTAAVLM

SEQ ID NO: 8185 - protein, 9 aa, Dengue virus
TLTAAVLML

SEQ ID NO: 8186 - protein, 9 aa, Dengue virus
LTAAVLMLV

SEQ ID NO: 8187 - protein, 9 aa, Dengue virus
TAAVLMLVA

SEQ ID NO: 8188 - protein, 9 aa, Dengue virus
AAVLMLVAH

SEQ ID NO: 8189 - protein, 9 aa, Dengue virus
AVLMLVAHY

SEQ ID NO: 8190 - protein, 9 aa, Dengue virus
VLMLVAHYA

SEQ ID NO: 8191 - protein, 9 aa, Dengue virus
LMLVAHYAI

SEQ ID NO: 8192 - protein, 9 aa, Dengue virus
MLVAHYAII

SEQ ID NO: 8193 - protein, 9 aa, Dengue virus
LVAHYAIIG

SEQ ID NO: 8194 - protein, 9 aa, Dengue virus
VAHYAIIGP

SEQ ID NO: 8195 - protein, 9 aa, Dengue virus
AHYAIIGPG

SEQ ID NO: 8196 - protein, 9 aa, Dengue virus
HYAIIGPGL

SEQ ID NO: 8197 - protein, 9 aa, Dengue virus
YAIIGPGLQ

SEQ ID NO: 8198 - protein, 9 aa, Dengue virus
AIIGPGLQA

SEQ ID NO: 8199 - protein, 9 aa, Dengue virus
IIGPGLQAK

SEQ ID NO: 8200 - protein, 9 aa, Dengue virus
IGPGLQAKA

SEQ ID NO: 8201 - protein, 9 aa, Dengue virus
GPGLQAKAT

SEQ ID NO: 8202 - protein, 9 aa, Dengue virus
PGLQAKATR

SEQ ID NO: 8203 - protein, 9 aa, Dengue virus
GLQAKATRE

SEQ ID NO: 8204 - protein, 9 aa, Dengue virus
LQAKATREA

SEQ ID NO: 8205 - protein, 9 aa, Dengue virus
QAKATREAQ

SEQ ID NO: 8206 - protein, 9 aa, Dengue virus
AKATREAQK

SEQ ID NO: 8207 - protein, 9 aa, Dengue virus
KATREAQKR

SEQ ID NO: 8208 - protein, 9 aa, Dengue virus
ATREAQKRT

SEQ ID NO: 8209 - protein, 9 aa, Dengue virus
TREAQKRTA

SEQ ID NO: 8210 - protein, 9 aa, Dengue virus
REAQKRTAA

SEQ ID NO: 8211 - protein, 9 aa, Dengue virus
EAQKRTAAG

SEQ ID NO: 8212 - protein, 9 aa, Dengue virus
AQKRTAAGI

SEQ ID NO: 8213 - protein, 9 aa, Dengue virus
QKRTAAGIM

SEQ ID NO: 8214 - protein, 9 aa, Dengue virus
KRTAAGIMK

SEQ ID NO: 8215 - protein, 9 aa, Dengue virus
RTAAGIMKN

SEQ ID NO: 8216 - protein, 9 aa, Dengue virus
TAAGIMKNP

SEQ ID NO: 8217 - protein, 9 aa, Dengue virus
AAGIMKNPT

SEQ ID NO: 8218 - protein, 9 aa, Dengue virus
AGIMKNPTV

SEQ ID NO: 8219 - protein, 9 aa, Dengue virus
GIMKNPTVD

SEQ ID NO: 8220 - protein, 9 aa, Dengue virus
IMKNPTVDG

SEQ ID NO: 8221 - protein, 9 aa, Dengue virus
MKNPTVDGI

SEQ ID NO: 8222 - protein, 9 aa, Dengue virus
KNPTVDGIV

SEQ ID NO: 8223 - protein, 9 aa, Dengue virus
NPTVDGIVA

SEQ ID NO: 8224 - protein, 9 aa, Dengue virus
PTVDGIVAI

SEQ ID NO: 8225 - protein, 9 aa, Dengue virus
TVDGIVAID

SEQ ID NO: 8226 - protein, 9 aa, Dengue virus
VDGIVAIDL

SEQ ID NO: 8227 - protein, 9 aa, Dengue virus
DGIVAIDLD

SEQ ID NO: 8228 - protein, 9 aa, Dengue virus
GIVAIDLDP

SEQ ID NO: 8229 - protein, 9 aa, Dengue virus
IVAIDLDPV

SEQ ID NO: 8230 - protein, 9 aa, Dengue virus
VAIDLDPVV

SEQ ID NO: 8231 - protein, 9 aa, Dengue virus
AIDLDPVVY

SEQ ID NO: 8232 - protein, 9 aa, Dengue virus
IDLDPVVYD

SEQ ID NO: 8233 - protein, 9 aa, Dengue virus
DLDPVVYDA

SEQ ID NO: 8234 - protein, 9 aa, Dengue virus
LDPVVYDAK

SEQ ID NO: 8235 - protein, 9 aa, Dengue virus
DPVVYDAKF

SEQ ID NO: 8236 - protein, 9 aa, Dengue virus
PVVYDAKFE

SEQ ID NO: 8237 - protein, 9 aa, Dengue virus
VVYDAKFEK

SEQ ID NO: 8238 - protein, 9 aa, Dengue virus
VYDAKFEKQ

SEQ ID NO: 8239 - protein, 9 aa, Dengue virus
YDAKFEKQL

SEQ ID NO: 8240 - protein, 9 aa, Dengue virus
DAKFEKQLG

SEQ ID NO: 8241 - protein, 9 aa, Dengue virus
AKFEKQLGQ

SEQ ID NO: 8242 - protein, 9 aa, Dengue virus
KFEKQLGQI

SEQ ID NO: 8243 - protein, 9 aa, Dengue virus
FEKQLGQIM

SEQ ID NO: 8244 - protein, 9 aa, Dengue virus
EKQLGQIML

SEQ ID NO: 8245 - protein, 9 aa, Dengue virus
KQLGQIMLL

SEQ ID NO: 8246 - protein, 9 aa, Dengue virus
QLGQIMLLI

SEQ ID NO: 8247 - protein, 9 aa, Dengue virus
LGQIMLLIL

SEQ ID NO: 8248 - protein, 9 aa, Dengue virus
GQIMLLILC

SEQ ID NO: 8249 - protein, 9 aa, Dengue virus
QIMLLILCT

SEQ ID NO: 8250 - protein, 9 aa, Dengue virus
IMLLILCTS

SEQ ID NO: 8251 - protein, 9 aa, Dengue virus
MLLILCTSQ

SEQ ID NO: 8252 - protein, 9 aa, Dengue virus
LLILCTSQI

SEQ ID NO: 8253 - protein, 9 aa, Dengue virus
LILCTSQIL

SEQ ID NO: 8254 - protein, 9 aa, Dengue virus
ILCTSQILL

SEQ ID NO: 8255 - protein, 9 aa, Dengue virus
LCTSQILLM

SEQ ID NO: 8256 - protein, 9 aa, Dengue virus
CTSQILLMR

SEQ ID NO: 8257 - protein, 9 aa, Dengue virus
TSQILLMRT

SEQ ID NO: 8258 - protein, 9 aa, Dengue virus
SQILLMRTT

SEQ ID NO: 8259 - protein, 9 aa, Dengue virus
QILLMRTTW

SEQ ID NO: 8260 - protein, 9 aa, Dengue virus
ILLMRTTWA

SEQ ID NO: 8261 - protein, 9 aa, Dengue virus
LLMRTTWAL

SEQ ID NO: 8262 - protein, 9 aa, Dengue virus
LMRTTWALC

SEQ ID NO: 8263 - protein, 9 aa, Dengue virus
MRTTWALCE

SEQ ID NO: 8264 - protein, 9 aa, Dengue virus
RTTWALCES

SEQ ID NO: 8265 - protein, 9 aa, Dengue virus
TTWALCESI

SEQ ID NO: 8266 - protein, 9 aa, Dengue virus
TWALCESIT

SEQ ID NO: 8267 - protein, 9 aa, Dengue virus
WALCESITL

SEQ ID NO: 8268 - protein, 9 aa, Dengue virus
ALCESITLA

SEQ ID NO: 8269 - protein, 9 aa, Dengue virus
LCESITLAT

SEQ ID NO: 8270 - protein, 9 aa, Dengue virus
CESITLATG

SEQ ID NO: 8271 - protein, 9 aa, Dengue virus
ESITLATGP

SEQ ID NO: 8272 - protein, 9 aa, Dengue virus
SITLATGPL

SEQ ID NO: 8273 - protein, 9 aa, Dengue virus
ITLATGPLT

SEQ ID NO: 8274 - protein, 9 aa, Dengue virus
TLATGPLTT

SEQ ID NO: 8275 - protein, 9 aa, Dengue virus
LATGPLTTL

SEQ ID NO: 8276 - protein, 9 aa, Dengue virus
ATGPLTTLW

SEQ ID NO: 8277 - protein, 9 aa, Dengue virus
TGPLTTLWE

SEQ ID NO: 8278 - protein, 9 aa, Dengue virus
GPLTTLWEG

SEQ ID NO: 8279 - protein, 9 aa, Dengue virus
PLTTLWEGS

SEQ ID NO: 8280 - protein, 9 aa, Dengue virus
LTTLWEGSP

SEQ ID NO: 8281 - protein, 9 aa, Dengue virus
TTLWEGSPG

SEQ ID NO: 8282 - protein, 9 aa, Dengue virus
TLWEGSPGK

SEQ ID NO: 8283 - protein, 9 aa, Dengue virus
LWEGSPGKF

SEQ ID NO: 8284 - protein, 9 aa, Dengue virus
WEGSPGKFW

SEQ ID NO: 8285 - protein, 9 aa, Dengue virus
EGSPGKFWN

SEQ ID NO: 8286 - protein, 9 aa, Dengue virus
GSPGKFWNT

SEQ ID NO: 8287 - protein, 9 aa, Dengue virus
SPGKFWNTT

SEQ ID NO: 8288 - protein, 9 aa, Dengue virus
PGKFWNTTI

SEQ ID NO: 8289 - protein, 9 aa, Dengue virus
GKFWNTTIA

SEQ ID NO: 8290 - protein, 9 aa, Dengue virus
KFWNTTIAV

SEQ ID NO: 8291 - protein, 9 aa, Dengue virus
FWNTTIAVS

SEQ ID NO: 8292 - protein, 9 aa, Dengue virus
WNTTIAVSM

SEQ ID NO: 8293 - protein, 9 aa, Dengue virus
NTTIAVSMA

SEQ ID NO: 8294 - protein, 9 aa, Dengue virus
TTIAVSMAN

SEQ ID NO: 8295 - protein, 9 aa, Dengue virus
TIAVSMANI

SEQ ID NO: 8296 - protein, 9 aa, Dengue virus
IAVSMANIF

SEQ ID NO: 8297 - protein, 9 aa, Dengue virus
AVSMANIFR

SEQ ID NO: 8298 - protein, 9 aa, Dengue virus
VSMANIFRG

SEQ ID NO: 8299 - protein, 9 aa, Dengue virus
SMANIFRGS

SEQ ID NO: 8300 - protein, 9 aa, Dengue virus
MANIFRGSY

SEQ ID NO: 8301 - protein, 9 aa, Dengue virus
ANIFRGSYL

SEQ ID NO: 8302 - protein, 9 aa, Dengue virus
NIFRGSYLA

SEQ ID NO: 8303 - protein, 9 aa, Dengue virus
IFRGSYLAG

SEQ ID NO: 8304 - protein, 9 aa, Dengue virus
FRGSYLAGA

SEQ ID NO: 8305 - protein, 9 aa, Dengue virus
RGSYLAGAG

SEQ ID NO: 8306 - protein, 9 aa, Dengue virus
GSYLAGAGL

SEQ ID NO: 8307 - protein, 9 aa, Dengue virus
SYLAGAGLA

SEQ ID NO: 8308 - protein, 9 aa, Dengue virus
YLAGAGLAF

SEQ ID NO: 8309 - protein, 9 aa, Dengue virus
LAGAGLAFS

SEQ ID NO: 8310 - protein, 9 aa, Dengue virus
AGAGLAFSL

SEQ ID NO: 8311 - protein, 9 aa, Dengue virus
GAGLAFSLM

SEQ ID NO: 8312 - protein, 9 aa, Dengue virus
AGLAFSLMK

SEQ ID NO: 8313 - protein, 9 aa, Dengue virus
GLAFSLMKS

SEQ ID NO: 8314 - protein, 9 aa, Dengue virus
LAFSLMKSL

SEQ ID NO: 8315 - protein, 9 aa, Dengue virus
AFSLMKSLG

SEQ ID NO: 8316 - protein, 9 aa, Dengue virus
FSLMKSLGG

SEQ ID NO: 8317 - protein, 9 aa, Dengue virus
SLMKSLGGG

SEQ ID NO: 8318 - protein, 9 aa, Dengue virus
LMKSLGGGR

SEQ ID NO: 8319 - protein, 9 aa, Dengue virus
MKSLGGGRR

SEQ ID NO: 8320 - protein, 9 aa, Dengue virus
KSLGGGRRG

SEQ ID NO: 8321 - protein, 9 aa, Dengue virus
SLGGGRRGT

SEQ ID NO: 8322 - protein, 9 aa, Dengue virus
LGGGRRGTG

SEQ ID NO: 8323 - protein, 9 aa, Dengue virus
GGGRRGTGA

SEQ ID NO: 8324 - protein, 9 aa, Dengue virus
GGRRGTGAQ

SEQ ID NO: 8325 - protein, 9 aa, Dengue virus
GRRGTGAQG

SEQ ID NO: 8326 - protein, 9 aa, Dengue virus
RRGTGAQGE

SEQ ID NO: 8327 - protein, 9 aa, Dengue virus
RGTGAQGET

SEQ ID NO: 8328 - protein, 9 aa, Dengue virus
GTGAQGETL

SEQ ID NO: 8329 - protein, 9 aa, Dengue virus
TGAQGETLG

SEQ ID NO: 8330 - protein, 9 aa, Dengue virus
GAQGETLGE

SEQ ID NO: 8331 - protein, 9 aa, Dengue virus
AQGETLGEK

SEQ ID NO: 8332 - protein, 9 aa, Dengue virus
QGETLGEKW

SEQ ID NO: 8333 - protein, 9 aa, Dengue virus
GETLGEKWK

SEQ ID NO: 8334 - protein, 9 aa, Dengue virus
ETLGEKWKR

SEQ ID NO: 8335 - protein, 9 aa, Dengue virus
TLGEKWKRQ

SEQ ID NO: 8336 - protein, 9 aa, Dengue virus
LGEKWKRQL

SEQ ID NO: 8337 - protein, 9 aa, Dengue virus
GEKWKRQLN

SEQ ID NO: 8338 - protein, 9 aa, Dengue virus
EKWKRQLNQ

SEQ ID NO: 8339 - protein, 9 aa, Dengue virus
KWKRQLNQL

SEQ ID NO: 8340 - protein, 9 aa, Dengue virus
WKRQLNQLS

SEQ ID NO: 8341 - protein, 9 aa, Dengue virus
KRQLNQLSK

SEQ ID NO: 8342 - protein, 9 aa, Dengue virus
RQLNQLSKS

SEQ ID NO: 8343 - protein, 9 aa, Dengue virus
QLNQLSKSE

SEQ ID NO: 8344 - protein, 9 aa, Dengue virus
LNQLSKSEF

SEQ ID NO: 8345 - protein, 9 aa, Dengue virus
NQLSKSEFN

SEQ ID NO: 8346 - protein, 9 aa, Dengue virus
QLSKSEFNT

SEQ ID NO: 8347 - protein, 9 aa, Dengue virus
LSKSEFNTY

SEQ ID NO: 8348 - protein, 9 aa, Dengue virus
SKSEFNTYK

SEQ ID NO: 8349 - protein, 9 aa, Dengue virus
KSEFNTYKR

SEQ ID NO: 8350 - protein, 9 aa, Dengue virus
SEFNTYKRS

SEQ ID NO: 8351 - protein, 9 aa, Dengue virus
EFNTYKRSG

SEQ ID NO: 8352 - protein, 9 aa, Dengue virus
FNTYKRSGI

SEQ ID NO: 8353 - protein, 9 aa, Dengue virus
NTYKRSGIM

SEQ ID NO: 8354 - protein, 9 aa, Dengue virus
TYKRSGIME

SEQ ID NO: 8355 - protein, 9 aa, Dengue virus
YKRSGIMEV

SEQ ID NO: 8356 - protein, 9 aa, Dengue virus
KRSGIMEVD

SEQ ID NO: 8357 - protein, 9 aa, Dengue virus
RSGIMEVDR

SEQ ID NO: 8358 - protein, 9 aa, Dengue virus
SGIMEVDRS

SEQ ID NO: 8359 - protein, 9 aa, Dengue virus
GIMEVDRSE

SEQ ID NO: 8360 - protein, 9 aa, Dengue virus
IMEVDRSEA

SEQ ID NO: 8361 - protein, 9 aa, Dengue virus
MEVDRSEAK

SEQ ID NO: 8362 - protein, 9 aa, Dengue virus
EVDRSEAKE

SEQ ID NO: 8363 - protein, 9 aa, Dengue virus
VDRSEAKEG

SEQ ID NO: 8364 - protein, 9 aa, Dengue virus
DRSEAKEGL

SEQ ID NO: 8365 - protein, 9 aa, Dengue virus
RSEAKEGLK

SEQ ID NO: 8366 - protein, 9 aa, Dengue virus
SEAKEGLKR

SEQ ID NO: 8367 - protein, 9 aa, Dengue virus
EAKEGLKRG

SEQ ID NO: 8368 - protein, 9 aa, Dengue virus
AKEGLKRGE

SEQ ID NO: 8369 - protein, 9 aa, Dengue virus
KEGLKRGET

SEQ ID NO: 8370 - protein, 9 aa, Dengue virus
EGLKRGETT

SEQ ID NO: 8371 - protein, 9 aa, Dengue virus
GLKRGETTK

SEQ ID NO: 8372 - protein, 9 aa, Dengue virus
LKRGETTKH

SEQ ID NO: 8373 - protein, 9 aa, Dengue virus
KRGETTKHA

SEQ ID NO: 8374 - protein, 9 aa, Dengue virus
RGETTKHAV

SEQ ID NO: 8375 - protein, 9 aa, Dengue virus
GETTKHAVS

SEQ ID NO: 8376 - protein, 9 aa, Dengue virus
ETTKHAVSR

SEQ ID NO: 8377 - protein, 9 aa, Dengue virus
TTKHAVSRG

SEQ ID NO: 8378 - protein, 9 aa, Dengue virus
TKHAVSRGT

SEQ ID NO: 8379 - protein, 9 aa, Dengue virus
KHAVSRGTA

SEQ ID NO: 8380 - protein, 9 aa, Dengue virus
HAVSRGTAK

SEQ ID NO: 8381 - protein, 9 aa, Dengue virus
AVSRGTAKL

SEQ ID NO: 8382 - protein, 9 aa, Dengue virus
VSRGTAKLR

SEQ ID NO: 8383 - protein, 9 aa, Dengue virus
SRGTAKLRW

SEQ ID NO: 8384 - protein, 9 aa, Dengue virus
RGTAKLRWF

SEQ ID NO: 8385 - protein, 9 aa, Dengue virus
GTAKLRWFV

SEQ ID NO: 8386 - protein, 9 aa, Dengue virus
TAKLRWFVE

SEQ ID NO: 8387 - protein, 9 aa, Dengue virus
AKLRWFVER

SEQ ID NO: 8388 - protein, 9 aa, Dengue virus
KLRWFVERN

SEQ ID NO: 8389 - protein, 9 aa, Dengue virus
LRWFVERNL

SEQ ID NO: 8390 - protein, 9 aa, Dengue virus
RWFVERNLV

SEQ ID NO: 8391 - protein, 9 aa, Dengue virus
WFVERNLVK

SEQ ID NO: 8392 - protein, 9 aa, Dengue virus
FVERNLVKP

SEQ ID NO: 8393 - protein, 9 aa, Dengue virus
VERNLVKPE

SEQ ID NO: 8394 - protein, 9 aa, Dengue virus
ERNLVKPEG

SEQ ID NO: 8395 - protein, 9 aa, Dengue virus
RNLVKPEGK

SEQ ID NO: 8396 - protein, 9 aa, Dengue virus
NLVKPEGKV

SEQ ID NO: 8397 - protein, 9 aa, Dengue virus
LVKPEGKVI

SEQ ID NO: 8398 - protein, 9 aa, Dengue virus
VKPEGKVID

SEQ ID NO: 8399 - protein, 9 aa, Dengue virus
KPEGKVIDL

SEQ ID NO: 8400 - protein, 9 aa, Dengue virus
PEGKVIDLG

SEQ ID NO: 8401 - protein, 9 aa, Dengue virus
EGKVIDLGC

SEQ ID NO: 8402 - protein, 9 aa, Dengue virus
GKVIDLGCG

SEQ ID NO: 8403 - protein, 9 aa, Dengue virus
KVIDLGCGR

SEQ ID NO: 8404 - protein, 9 aa, Dengue virus
VIDLGCGRG

SEQ ID NO: 8405 - protein, 9 aa, Dengue virus
IDLGCGRGG

SEQ ID NO: 8406 - protein, 9 aa, Dengue virus
DLGCGRGGW

SEQ ID NO: 8407 - protein, 9 aa, Dengue virus
LGCGRGGWS

SEQ ID NO: 8408 - protein, 9 aa, Dengue virus
GCGRGGWSY

SEQ ID NO: 8409 - protein, 9 aa, Dengue virus
CGRGGWSYY

SEQ ID NO: 8410 - protein, 9 aa, Dengue virus
GRGGWSYYC

SEQ ID NO: 8411 - protein, 9 aa, Dengue virus
RGGWSYYCA

SEQ ID NO: 8412 - protein, 9 aa, Dengue virus
GGWSYYCAG

SEQ ID NO: 8413 - protein, 9 aa, Dengue virus
GWSYYCAGL

SEQ ID NO: 8414 - protein, 9 aa, Dengue virus
WSYYCAGLK

SEQ ID NO: 8415 - protein, 9 aa, Dengue virus
SYYCAGLKK

SEQ ID NO: 8416 - protein, 9 aa, Dengue virus
YYCAGLKKV

SEQ ID NO: 8417 - protein, 9 aa, Dengue virus
YCAGLKKVT

SEQ ID NO: 8418 - protein, 9 aa, Dengue virus
CAGLKKVTE

SEQ ID NO: 8419 - protein, 9 aa, Dengue virus
AGLKKVTEV

SEQ ID NO: 8420 - protein, 9 aa, Dengue virus
GLKKVTEVK

SEQ ID NO: 8421 - protein, 9 aa, Dengue virus
LKKVTEVKG

SEQ ID NO: 8422 - protein, 9 aa, Dengue virus
KKVTEVKGY

SEQ ID NO: 8423 - protein, 9 aa, Dengue virus
KVTEVKGYT

SEQ ID NO: 8424 - protein, 9 aa, Dengue virus
VTEVKGYTK

SEQ ID NO: 8425 - protein, 9 aa, Dengue virus
TEVKGYTKG

SEQ ID NO: 8426 - protein, 9 aa, Dengue virus
EVKGYTKGG

SEQ ID NO: 8427 - protein, 9 aa, Dengue virus
VKGYTKGGP

SEQ ID NO: 8428 - protein, 9 aa, Dengue virus
KGYTKGGPG

SEQ ID NO: 8429 - protein, 9 aa, Dengue virus
GYTKGGPGH

SEQ ID NO: 8430 - protein, 9 aa, Dengue virus
YTKGGPGHE

SEQ ID NO: 8431 - protein, 9 aa, Dengue virus
TKGGPGHEE

SEQ ID NO: 8432 - protein, 9 aa, Dengue virus
KGGPGHEEP

SEQ ID NO: 8433 - protein, 9 aa, Dengue virus
GGPGHEEPI

SEQ ID NO: 8434 - protein, 9 aa, Dengue virus
GPGHEEPIP

SEQ ID NO: 8435 - protein, 9 aa, Dengue virus
PGHEEPIPM

SEQ ID NO: 8436 - protein, 9 aa, Dengue virus
GHEEPIPMA

SEQ ID NO: 8437 - protein, 9 aa, Dengue virus
HEEPIPMAT

SEQ ID NO: 8438 - protein, 9 aa, Dengue virus
EEPIPMATY

SEQ ID NO: 8439 - protein, 9 aa, Dengue virus
EPIPMATYG

SEQ ID NO: 8440 - protein, 9 aa, Dengue virus
PIPMATYGW

SEQ ID NO: 8441 - protein, 9 aa, Dengue virus
IPMATYGWN

SEQ ID NO: 8442 - protein, 9 aa, Dengue virus
PMATYGWNL

SEQ ID NO: 8443 - protein, 9 aa, Dengue virus
MATYGWNLV

SEQ ID NO: 8444 - protein, 9 aa, Dengue virus
ATYGWNLVK

SEQ ID NO: 8445 - protein, 9 aa, Dengue virus
TYGWNLVKL

SEQ ID NO: 8446 - protein, 9 aa, Dengue virus
YGWNLVKLH

SEQ ID NO: 8447 - protein, 9 aa, Dengue virus
GWNLVKLHS

SEQ ID NO: 8448 - protein, 9 aa, Dengue virus
WNLVKLHSG

SEQ ID NO: 8449 - protein, 9 aa, Dengue virus
NLVKLHSGK

SEQ ID NO: 8450 - protein, 9 aa, Dengue virus
LVKLHSGKD

SEQ ID NO: 8451 - protein, 9 aa, Dengue virus
VKLHSGKDV

SEQ ID NO: 8452 - protein, 9 aa, Dengue virus
KLHSGKDVF

SEQ ID NO: 8453 - protein, 9 aa, Dengue virus
LHSGKDVFF

SEQ ID NO: 8454 - protein, 9 aa, Dengue virus
SGKDVFFIP

SEQ ID NO: 8455 - protein, 9 aa, Dengue virus
GKDVFFIPP

SEQ ID NO: 8456 - protein, 9 aa, Dengue virus
KDVFFIPPE

SEQ ID NO: 8457 - protein, 9 aa, Dengue virus
DVFFIPPEK

SEQ ID NO: 8458 - protein, 9 aa, Dengue virus
VFFIPPEKC

SEQ ID NO: 8459 - protein, 9 aa, Dengue virus
FFIPPEKCD

SEQ ID NO: 8460 - protein, 9 aa, Dengue virus
FIPPEKCDT

SEQ ID NO: 8461 - protein, 9 aa, Dengue virus
IPPEKCDTL

SEQ ID NO: 8462 - protein, 9 aa, Dengue virus
PPEKCDTLL

SEQ ID NO: 8463 - protein, 9 aa, Dengue virus
PEKCDTLLC

SEQ ID NO: 8464 - protein, 9 aa, Dengue virus
EKCDTLLCD

SEQ ID NO: 8465 - protein, 9 aa, Dengue virus
KCDTLLCDI

SEQ ID NO: 8466 - protein, 9 aa, Dengue virus
CDTLLCDIG

SEQ ID NO: 8467 - protein, 9 aa, Dengue virus
DTLLCDIGE

SEQ ID NO: 8468 - protein, 9 aa, Dengue virus
TLLCDIGES

SEQ ID NO: 8469 - protein, 9 aa, Dengue virus
LLCDIGESS

SEQ ID NO: 8470 - protein, 9 aa, Dengue virus
LCDIGESSP

SEQ ID NO: 8471 - protein, 9 aa, Dengue virus
CDIGESSPN

SEQ ID NO: 8472 - protein, 9 aa, Dengue virus
DIGESSPNP

SEQ ID NO: 8473 - protein, 9 aa, Dengue virus
IGESSPNPT

SEQ ID NO: 8474 - protein, 9 aa, Dengue virus
GESSPNPTI

SEQ ID NO: 8475 - protein, 9 aa, Dengue virus
ESSPNPTIE

SEQ ID NO: 8476 - protein, 9 aa, Dengue virus
SSPNPTIEE

SEQ ID NO: 8477 - protein, 9 aa, Dengue virus
SPNPTIEEG

SEQ ID NO: 8478 - protein, 9 aa, Dengue virus
PNPTIEEGR

SEQ ID NO: 8479 - protein, 9 aa, Dengue virus
NPTIEEGRT

SEQ ID NO: 8480 - protein, 9 aa, Dengue virus
PTIEEGRTL

SEQ ID NO: 8481 - protein, 9 aa, Dengue virus
TIEEGRTLR

SEQ ID NO: 8482 - protein, 9 aa, Dengue virus
IEEGRTLRV

SEQ ID NO: 8483 - protein, 9 aa, Dengue virus
EEGRTLRVL

SEQ ID NO: 8484 - protein, 9 aa, Dengue virus
EGRTLRVLK

SEQ ID NO: 8485 - protein, 9 aa, Dengue virus
GRTLRVLKM

SEQ ID NO: 8486 - protein, 9 aa, Dengue virus
RTLRVLKMV

SEQ ID NO: 8487 - protein, 9 aa, Dengue virus
TLRVLKMVE

SEQ ID NO: 8488 - protein, 9 aa, Dengue virus
LRVLKMVEP

SEQ ID NO: 8489 - protein, 9 aa, Dengue virus
RVLKMVEPW

SEQ ID NO: 8490 - protein, 9 aa, Dengue virus
VLKMVEPWL

SEQ ID NO: 8491 - protein, 9 aa, Dengue virus
LKMVEPWLR

SEQ ID NO: 8492 - protein, 9 aa, Dengue virus
KMVEPWLRG

SEQ ID NO: 8493 - protein, 9 aa, Dengue virus
MVEPWLRGN

SEQ ID NO: 8494 - protein, 9 aa, Dengue virus
QFCIKILNP

SEQ ID NO: 8495 - protein, 9 aa, Dengue virus
FCIKILNPY

SEQ ID NO: 8496 - protein, 9 aa, Dengue virus
CIKILNPYM

SEQ ID NO: 8497 - protein, 9 aa, Dengue virus
IKILNPYMP

SEQ ID NO: 8498 - protein, 9 aa, Dengue virus
KILNPYMPS

SEQ ID NO: 8499 - protein, 9 aa, Dengue virus
ILNPYMPSV

SEQ ID NO: 8500 - protein, 9 aa, Dengue virus
LNPYMPSVV

SEQ ID NO: 8501 - protein, 9 aa, Dengue virus
NPYMPSVVE

SEQ ID NO: 8502 - protein, 9 aa, Dengue virus
PYMPSVVET

SEQ ID NO: 8503 - protein, 9 aa, Dengue virus
YMPSVVETL

SEQ ID NO: 8504 - protein, 9 aa, Dengue virus
MPSVVETLE

SEQ ID NO: 8505 - protein, 9 aa, Dengue virus
PSVVETLEQ

SEQ ID NO: 8506 - protein, 9 aa, Dengue virus
SVVETLEQM

SEQ ID NO: 8507 - protein, 9 aa, Dengue virus
VVETLEQMQ

SEQ ID NO: 8508 - protein, 9 aa, Dengue virus
VETLEQMQR

SEQ ID NO: 8509 - protein, 9 aa, Dengue virus
ETLEQMQRK

SEQ ID NO: 8510 - protein, 9 aa, Dengue virus
TLEQMQRKH

SEQ ID NO: 8511 - protein, 9 aa, Dengue virus
LEQMQRKHG

SEQ ID NO: 8512 - protein, 9 aa, Dengue virus
EQMQRKHGG

SEQ ID NO: 8513 - protein, 9 aa, Dengue virus
QMQRKHGGM

SEQ ID NO: 8514 - protein, 9 aa, Dengue virus
MQRKHGGML

SEQ ID NO: 8515 - protein, 9 aa, Dengue virus
QRKHGGMLV

SEQ ID NO: 8516 - protein, 9 aa, Dengue virus
RKHGGMLVR

SEQ ID NO: 8517 - protein, 9 aa, Dengue virus
KHGGMLVRN

SEQ ID NO: 8518 - protein, 9 aa, Dengue virus
HGGMLVRNP

SEQ ID NO: 8519 - protein, 9 aa, Dengue virus
GGMLVRNPL

SEQ ID NO: 8520 - protein, 9 aa, Dengue virus
GMLVRNPLS

SEQ ID NO: 8521 - protein, 9 aa, Dengue virus
MLVRNPLSR

SEQ ID NO: 8522 - protein, 9 aa, Dengue virus
LVRNPLSRN

SEQ ID NO: 8523 - protein, 9 aa, Dengue virus
VRNPLSRNS

SEQ ID NO: 8524 - protein, 9 aa, Dengue virus
RNPLSRNST

SEQ ID NO: 8525 - protein, 9 aa, Dengue virus
NPLSRNSTH

SEQ ID NO: 8526 - protein, 9 aa, Dengue virus
PLSRNSTHE

SEQ ID NO: 8527 - protein, 9 aa, Dengue virus
LSRNSTHEM

SEQ ID NO: 8528 - protein, 9 aa, Dengue virus
SRNSTHEMY

SEQ ID NO: 8529 - protein, 9 aa, Dengue virus
RNSTHEMYW

SEQ ID NO: 8530 - protein, 9 aa, Dengue virus
NSTHEMYWV

SEQ ID NO: 8531 - protein, 9 aa, Dengue virus
STHEMYWVS

SEQ ID NO: 8532 - protein, 9 aa, Dengue virus
THEMYWVSC

SEQ ID NO: 8533 - protein, 9 aa, Dengue virus
HEMYWVSCG

SEQ ID NO: 8534 - protein, 9 aa, Dengue virus
EMYWVSCGT

SEQ ID NO: 8535 - protein, 9 aa, Dengue virus
MYWVSCGTG

SEQ ID NO: 8536 - protein, 9 aa, Dengue virus
YWVSCGTGN

SEQ ID NO: 8537 - protein, 9 aa, Dengue virus
WVSCGTGNI

SEQ ID NO: 8538 - protein, 9 aa, Dengue virus
VSCGTGNIV

SEQ ID NO: 8539 - protein, 9 aa, Dengue virus
SCGTGNIVS

SEQ ID NO: 8540 - protein, 9 aa, Dengue virus
CGTGNIVSA

SEQ ID NO: 8541 - protein, 9 aa, Dengue virus
GTGNIVSAV

SEQ ID NO: 8542 - protein, 9 aa, Dengue virus
TGNIVSAVN

SEQ ID NO: 8543 - protein, 9 aa, Dengue virus
GNIVSAVNM

SEQ ID NO: 8544 - protein, 9 aa, Dengue virus
NIVSAVNMT

SEQ ID NO: 8545 - protein, 9 aa, Dengue virus
IVSAVNMTS

SEQ ID NO: 8546 - protein, 9 aa, Dengue virus
VSAVNMTSR

SEQ ID NO: 8547 - protein, 9 aa, Dengue virus
SAVNMTSRM

SEQ ID NO: 8548 - protein, 9 aa, Dengue virus
AVNMTSRML

SEQ ID NO: 8549 - protein, 9 aa, Dengue virus
VNMTSRMLL

SEQ ID NO: 8550 - protein, 9 aa, Dengue virus
NMTSRMLLN

SEQ ID NO: 8551 - protein, 9 aa, Dengue virus
MTSRMLLNR

SEQ ID NO: 8552 - protein, 9 aa, Dengue virus
TSRMLLNRF

SEQ ID NO: 8553 - protein, 9 aa, Dengue virus
SRMLLNRFT

SEQ ID NO: 8554 - protein, 9 aa, Dengue virus
RMLLNRFTM

SEQ ID NO: 8555 - protein, 9 aa, Dengue virus
MLLNRFTMA

SEQ ID NO: 8556 - protein, 9 aa, Dengue virus
LLNRFTMAH

SEQ ID NO: 8557 - protein, 9 aa, Dengue virus
LNRFTMAHR

SEQ ID NO: 8558 - protein, 9 aa, Dengue virus
NRFTMAHRK

SEQ ID NO: 8559 - protein, 9 aa, Dengue virus
RFTMAHRKP

SEQ ID NO: 8560 - protein, 9 aa, Dengue virus
FTMAHRKPT

SEQ ID NO: 8561 - protein, 9 aa, Dengue virus
TMAHRKPTY

SEQ ID NO: 8562 - protein, 9 aa, Dengue virus
MAHRKPTYE

SEQ ID NO: 8563 - protein, 9 aa, Dengue virus
AHRKPTYER

SEQ ID NO: 8564 - protein, 9 aa, Dengue virus
HRKPTYERD

SEQ ID NO: 8565 - protein, 9 aa, Dengue virus
RKPTYERDV

SEQ ID NO: 8566 - protein, 9 aa, Dengue virus
KPTYERDVD

SEQ ID NO: 8567 - protein, 9 aa, Dengue virus
PTYERDVDL

SEQ ID NO: 8568 - protein, 9 aa, Dengue virus
TYERDVDLG

SEQ ID NO: 8569 - protein, 9 aa, Dengue virus
YERDVDLGA

SEQ ID NO: 8570 - protein, 9 aa, Dengue virus
ERDVDLGAG

SEQ ID NO: 8571 - protein, 9 aa, Dengue virus
RDVDLGAGT

SEQ ID NO: 8572 - protein, 9 aa, Dengue virus
DVDLGAGTR

SEQ ID NO: 8573 - protein, 9 aa, Dengue virus
VDLGAGTRH

SEQ ID NO: 8574 - protein, 9 aa, Dengue virus
DLGAGTRHV

SEQ ID NO: 8575 - protein, 9 aa, Dengue virus
LGAGTRHVA

SEQ ID NO: 8576 - protein, 9 aa, Dengue virus
GAGTRHVAV

SEQ ID NO: 8577 - protein, 9 aa, Dengue virus
AGTRHVAVE

SEQ ID NO: 8578 - protein, 9 aa, Dengue virus
GTRHVAVEP

SEQ ID NO: 8579 - protein, 9 aa, Dengue virus
TRHVAVEPE

SEQ ID NO: 8580 - protein, 9 aa, Dengue virus
RHVAVEPEV

SEQ ID NO: 8581 - protein, 9 aa, Dengue virus
HVAVEPEVA

SEQ ID NO: 8582 - protein, 9 aa, Dengue virus
VAVEPEVAN

SEQ ID NO: 8583 - protein, 9 aa, Dengue virus
VEPEVANLD

SEQ ID NO: 8584 - protein, 9 aa, Dengue virus
EPEVANLDI

SEQ ID NO: 8585 - protein, 9 aa, Dengue virus
PEVANLDII

SEQ ID NO: 8586 - protein, 9 aa, Dengue virus
EVANLDIIG

SEQ ID NO: 8587 - protein, 9 aa, Dengue virus
VANLDIIGQ

SEQ ID NO: 8588 - protein, 9 aa, Dengue virus
ANLDIIGQR

SEQ ID NO: 8589 - protein, 9 aa, Dengue virus
NLDIIGQRI

SEQ ID NO: 8590 - protein, 9 aa, Dengue virus
LDIIGQRIE

SEQ ID NO: 8591 - protein, 9 aa, Dengue virus
DIIGQRIEN

SEQ ID NO: 8592 - protein, 9 aa, Dengue virus
IIGQRIENI

SEQ ID NO: 8593 - protein, 9 aa, Dengue virus
IGQRIENIK

SEQ ID NO: 8594 - protein, 9 aa, Dengue virus
GQRIENIKH

SEQ ID NO: 8595 - protein, 9 aa, Dengue virus
QRIENIKHE

SEQ ID NO: 8596 - protein, 9 aa, Dengue virus
RIENIKHEH

SEQ ID NO: 8597 - protein, 9 aa, Dengue virus
IENIKHEHK

SEQ ID NO: 8598 - protein, 9 aa, Dengue virus
ENIKHEHKS

SEQ ID NO: 8599 - protein, 9 aa, Dengue virus
NIKHEHKST

SEQ ID NO: 8600 - protein, 9 aa, Dengue virus
IKHEHKSTW

SEQ ID NO: 8601 - protein, 9 aa, Dengue virus
KHEHKSTWH

SEQ ID NO: 8602 - protein, 9 aa, Dengue virus
HEHKSTWHY

SEQ ID NO: 8603 - protein, 9 aa, Dengue virus
EHKSTWHYD

SEQ ID NO: 8604 - protein, 9 aa, Dengue virus
HKSTWHYDE

SEQ ID NO: 8605 - protein, 9 aa, Dengue virus
KSTWHYDED

SEQ ID NO: 8606 - protein, 9 aa, Dengue virus
STWHYDEDN

SEQ ID NO: 8607 - protein, 9 aa, Dengue virus
TWHYDEDNP

SEQ ID NO: 8608 - protein, 9 aa, Dengue virus
WHYDEDNPY

SEQ ID NO: 8609 - protein, 9 aa, Dengue virus
HYDEDNPYK

SEQ ID NO: 8610 - protein, 9 aa, Dengue virus
YDEDNPYKT

SEQ ID NO: 8611 - protein, 9 aa, Dengue virus
DEDNPYKTW

SEQ ID NO: 8612 - protein, 9 aa, Dengue virus
EDNPYKTWA

SEQ ID NO: 8613 - protein, 9 aa, Dengue virus
DNPYKTWAY

SEQ ID NO: 8614 - protein, 9 aa, Dengue virus
NPYKTWAYH

SEQ ID NO: 8615 - protein, 9 aa, Dengue virus
PYKTWAYHG

SEQ ID NO: 8616 - protein, 9 aa, Dengue virus
YKTWAYHGS

SEQ ID NO: 8617 - protein, 9 aa, Dengue virus
KTWAYHGSY

SEQ ID NO: 8618 - protein, 9 aa, Dengue virus
TWAYHGSYE

SEQ ID NO: 8619 - protein, 9 aa, Dengue virus
WAYHGSYEV

SEQ ID NO: 8620 - protein, 9 aa, Dengue virus
AYHGSYEVK

SEQ ID NO: 8621 - protein, 9 aa, Dengue virus
YHGSYEVKP

SEQ ID NO: 8622 - protein, 9 aa, Dengue virus
HGSYEVKPS

SEQ ID NO: 8623 - protein, 9 aa, Dengue virus
GSYEVKPSG

SEQ ID NO: 8624 - protein, 9 aa, Dengue virus
SYEVKPSGS

SEQ ID NO: 8625 - protein, 9 aa, Dengue virus
YEVKPSGSA

SEQ ID NO: 8626 - protein, 9 aa, Dengue virus
EVKPSGSAS

SEQ ID NO: 8627 - protein, 9 aa, Dengue virus
VKPSGSASS

SEQ ID NO: 8628 - protein, 9 aa, Dengue virus
KPSGSASSM

SEQ ID NO: 8629 - protein, 9 aa, Dengue virus
PSGSASSMV

SEQ ID NO: 8630 - protein, 9 aa, Dengue virus
SGSASSMVN

SEQ ID NO: 8631 - protein, 9 aa, Dengue virus
GSASSMVNG

SEQ ID NO: 8632 - protein, 9 aa, Dengue virus
SASSMVNGV

SEQ ID NO: 8633 - protein, 9 aa, Dengue virus
ASSMVNGVV

SEQ ID NO: 8634 - protein, 9 aa, Dengue virus
SSMVNGVVK

SEQ ID NO: 8635 - protein, 9 aa, Dengue virus
SMVNGVVKL

SEQ ID NO: 8636 - protein, 9 aa, Dengue virus
MVNGVVKLL

SEQ ID NO: 8637 - protein, 9 aa, Dengue virus
VNGVVKLLT

SEQ ID NO: 8638 - protein, 9 aa, Dengue virus
NGVVKLLTK

SEQ ID NO: 8639 - protein, 9 aa, Dengue virus
GVVKLLTKP

SEQ ID NO: 8640 - protein, 9 aa, Dengue virus
VVKLLTKPW

SEQ ID NO: 8641 - protein, 9 aa, Dengue virus
VKLLTKPWD

SEQ ID NO: 8642 - protein, 9 aa, Dengue virus
KLLTKPWDV

SEQ ID NO: 8643 - protein, 9 aa, Dengue virus
LLTKPWDVI

SEQ ID NO: 8644 - protein, 9 aa, Dengue virus
LTKPWDVIP

SEQ ID NO: 8645 - protein, 9 aa, Dengue virus
TKPWDVIPM

SEQ ID NO: 8646 - protein, 9 aa, Dengue virus
KPWDVIPMV

SEQ ID NO: 8647 - protein, 9 aa, Dengue virus
PWDVIPMVT

SEQ ID NO: 8648 - protein, 9 aa, Dengue virus
WDVIPMVTQ

SEQ ID NO: 8649 - protein, 9 aa, Dengue virus
DVIPMVTQI

SEQ ID NO: 8650 - protein, 9 aa, Dengue virus
VIPMVTQIA

SEQ ID NO: 8651 - protein, 9 aa, Dengue virus
IPMVTQIAM

SEQ ID NO: 8652 - protein, 9 aa, Dengue virus
PMVTQIAMT

SEQ ID NO: 8653 - protein, 9 aa, Dengue virus
MVTQIAMTD

SEQ ID NO: 8654 - protein, 9 aa, Dengue virus
VTQIAMTDT

SEQ ID NO: 8655 - protein, 9 aa, Dengue virus
TQIAMTDTT

SEQ ID NO: 8656 - protein, 9 aa, Dengue virus
QIAMTDTTP

SEQ ID NO: 8657 - protein, 9 aa, Dengue virus
IAMTDTTPF

SEQ ID NO: 8658 - protein, 9 aa, Dengue virus
AMTDTTPFG

SEQ ID NO: 8659 - protein, 9 aa, Dengue virus
MTDTTPFGQ

SEQ ID NO: 8660 - protein, 9 aa, Dengue virus
TDTTPFGQQ

SEQ ID NO: 8661 - protein, 9 aa, Dengue virus
DTTPFGQQR

SEQ ID NO: 8662 - protein, 9 aa, Dengue virus
TTPFGQQRV

SEQ ID NO: 8663 - protein, 9 aa, Dengue virus
TPFGQQRVF

SEQ ID NO: 8664 - protein, 9 aa, Dengue virus
PFGQQRVFK

SEQ ID NO: 8665 - protein, 9 aa, Dengue virus
FGQQRVFKE

SEQ ID NO: 8666 - protein, 9 aa, Dengue virus
GQQRVFKEK

SEQ ID NO: 8667 - protein, 9 aa, Dengue virus
QQRVFKEKV

SEQ ID NO: 8668 - protein, 9 aa, Dengue virus
QRVFKEKVD

SEQ ID NO: 8669 - protein, 9 aa, Dengue virus
RVFKEKVDT

SEQ ID NO: 8670 - protein, 9 aa, Dengue virus
VFKEKVDTR

SEQ ID NO: 8671 - protein, 9 aa, Dengue virus
FKEKVDTRT

SEQ ID NO: 8672 - protein, 9 aa, Dengue virus
KEKVDTRTP

SEQ ID NO: 8673 - protein, 9 aa, Dengue virus
EKVDTRTPK

SEQ ID NO: 8674 - protein, 9 aa, Dengue virus
KVDTRTPKA

SEQ ID NO: 8675 - protein, 9 aa, Dengue virus
VDTRTPKAK

SEQ ID NO: 8676 - protein, 9 aa, Dengue virus
DTRTPKAKR

SEQ ID NO: 8677 - protein, 9 aa, Dengue virus
TRTPKAKRG

SEQ ID NO: 8678 - protein, 9 aa, Dengue virus
RTPKAKRGT

SEQ ID NO: 8679 - protein, 9 aa, Dengue virus
TPKAKRGTA

SEQ ID NO: 8680 - protein, 9 aa, Dengue virus
PKAKRGTAQ

SEQ ID NO: 8681 - protein, 9 aa, Dengue virus
KAKRGTAQI

SEQ ID NO: 8682 - protein, 9 aa, Dengue virus
AKRGTAQIM

SEQ ID NO: 8683 - protein, 9 aa, Dengue virus
KRGTAQIME

SEQ ID NO: 8684 - protein, 9 aa, Dengue virus
RGTAQIMEV

SEQ ID NO: 8685 - protein, 9 aa, Dengue virus
GTAQIMEVT

SEQ ID NO: 8686 - protein, 9 aa, Dengue virus
TAQIMEVTA

SEQ ID NO: 8687 - protein, 9 aa, Dengue virus
QIMEVTAKW

SEQ ID NO: 8688 - protein, 9 aa, Dengue virus
IMEVTAKWL

SEQ ID NO: 8689 - protein, 9 aa, Dengue virus
MEVTAKWLW

SEQ ID NO: 8690 - protein, 9 aa, Dengue virus
EVTAKWLWG

SEQ ID NO: 8691 - protein, 9 aa, Dengue virus
VTAKWLWGF

SEQ ID NO: 8692 - protein, 9 aa, Dengue virus
TAKWLWGFL

SEQ ID NO: 8693 - protein, 9 aa, Dengue virus
AKWLWGFLS

SEQ ID NO: 8694 - protein, 9 aa, Dengue virus
KWLWGFLSR

SEQ ID NO: 8695 - protein, 9 aa, Dengue virus
WLWGFLSRN

SEQ ID NO: 8696 - protein, 9 aa, Dengue virus
LWGFLSRNK

SEQ ID NO: 8697 - protein, 9 aa, Dengue virus
WGFLSRNKK

SEQ ID NO: 8698 - protein, 9 aa, Dengue virus
GFLSRNKKP

SEQ ID NO: 8699 - protein, 9 aa, Dengue virus
FLSRNKKPR

SEQ ID NO: 8700 - protein, 9 aa, Dengue virus
LSRNKKPRI

SEQ ID NO: 8701 - protein, 9 aa, Dengue virus
SRNKKPRIC

SEQ ID NO: 8702 - protein, 9 aa, Dengue virus
RNKKPRICT

SEQ ID NO: 8703 - protein, 9 aa, Dengue virus
NKKPRICTR

SEQ ID NO: 8704 - protein, 9 aa, Dengue virus
KKPRICTRE

SEQ ID NO: 8705 - protein, 9 aa, Dengue virus
KPRICTREE

SEQ ID NO: 8706 - protein, 9 aa, Dengue virus
PRICTREEF

SEQ ID NO: 8707 - protein, 9 aa, Dengue virus
RICTREEFT

SEQ ID NO: 8708 - protein, 9 aa, Dengue virus
ICTREEFTR

SEQ ID NO: 8709 - protein, 9 aa, Dengue virus
CTREEFTRK

SEQ ID NO: 8710 - protein, 9 aa, Dengue virus
TREEFTRKV

SEQ ID NO: 8711 - protein, 9 aa, Dengue virus
REEFTRKVR

SEQ ID NO: 8712 - protein, 9 aa, Dengue virus
EEFTRKVRS

SEQ ID NO: 8713 - protein, 9 aa, Dengue virus
EFTRKVRSN

SEQ ID NO: 8714 - protein, 9 aa, Dengue virus
FTRKVRSNA

SEQ ID NO: 8715 - protein, 9 aa, Dengue virus
TRKVRSNAA

SEQ ID NO: 8716 - protein, 9 aa, Dengue virus
RKVRSNAAI

SEQ ID NO: 8717 - protein, 9 aa, Dengue virus
KVRSNAAIG

SEQ ID NO: 8718 - protein, 9 aa, Dengue virus
VRSNAAIGA

SEQ ID NO: 8719 - protein, 9 aa, Dengue virus
RSNAAIGAV

SEQ ID NO: 8720 - protein, 9 aa, Dengue virus
SNAAIGAVF

SEQ ID NO: 8721 - protein, 9 aa, Dengue virus
NAAIGAVFV

SEQ ID NO: 8722 - protein, 9 aa, Dengue virus
AAIGAVFVD

SEQ ID NO: 8723 - protein, 9 aa, Dengue virus
AIGAVFVDE

SEQ ID NO: 8724 - protein, 9 aa, Dengue virus
IGAVFVDEN

SEQ ID NO: 8725 - protein, 9 aa, Dengue virus
GAVFVDENQ

SEQ ID NO: 8726 - protein, 9 aa, Dengue virus
AVFVDENQW

SEQ ID NO: 8727 - protein, 9 aa, Dengue virus
VFVDENQWN

SEQ ID NO: 8728 - protein, 9 aa, Dengue virus
FVDENQWNS

SEQ ID NO: 8729 - protein, 9 aa, Dengue virus
VDENQWNSA

SEQ ID NO: 8730 - protein, 9 aa, Dengue virus
DENQWNSAK

SEQ ID NO: 8731 - protein, 9 aa, Dengue virus
ENQWNSAKE

SEQ ID NO: 8732 - protein, 9 aa, Dengue virus
NQWNSAKEA

SEQ ID NO: 8733 - protein, 9 aa, Dengue virus
QWNSAKEAV

SEQ ID NO: 8734 - protein, 9 aa, Dengue virus
WNSAKEAVE

SEQ ID NO: 8735 - protein, 9 aa, Dengue virus
NSAKEAVED

SEQ ID NO: 8736 - protein, 9 aa, Dengue virus
SAKEAVEDE

SEQ ID NO: 8737 - protein, 9 aa, Dengue virus
AKEAVEDER

SEQ ID NO: 8738 - protein, 9 aa, Dengue virus
KEAVEDERF

SEQ ID NO: 8739 - protein, 9 aa, Dengue virus
EAVEDERFW

SEQ ID NO: 8740 - protein, 9 aa, Dengue virus
AVEDERFWD

SEQ ID NO: 8741 - protein, 9 aa, Dengue virus
VEDERFWDL

SEQ ID NO: 8742 - protein, 9 aa, Dengue virus
EDERFWDLV

SEQ ID NO: 8743 - protein, 9 aa, Dengue virus
LVHRERELH

SEQ ID NO: 8744 - protein, 9 aa, Dengue virus
VHRERELHK

SEQ ID NO: 8745 - protein, 9 aa, Dengue virus
HRERELHKQ

SEQ ID NO: 8746 - protein, 9 aa, Dengue virus
RERELHKQG

SEQ ID NO: 8747 - protein, 9 aa, Dengue virus
ERELHKQGK

SEQ ID NO: 8748 - protein, 9 aa, Dengue virus
RELHKQGKC

SEQ ID NO: 8749 - protein, 9 aa, Dengue virus
ELHKQGKCA

SEQ ID NO: 8750 - protein, 9 aa, Dengue virus
LHKQGKCAT

SEQ ID NO: 8751 - protein, 9 aa, Dengue virus
HKQGKCATC

SEQ ID NO: 8752 - protein, 9 aa, Dengue virus
KQGKCATCV

SEQ ID NO: 8753 - protein, 9 aa, Dengue virus
QGKCATCVY

SEQ ID NO: 8754 - protein, 9 aa, Dengue virus
GKCATCVYN

SEQ ID NO: 8755 - protein, 9 aa, Dengue virus
KCATCVYNM

SEQ ID NO: 8756 - protein, 9 aa, Dengue virus
CATCVYNMM

SEQ ID NO: 8757 - protein, 9 aa, Dengue virus
ATCVYNMMG

SEQ ID NO: 8758 - protein, 9 aa, Dengue virus
TCVYNMMGK

SEQ ID NO: 8759 - protein, 9 aa, Dengue virus
CVYNMMGKR

SEQ ID NO: 8760 - protein, 9 aa, Dengue virus
VYNMMGKRE

SEQ ID NO: 8761 - protein, 9 aa, Dengue virus
YNMMGKREK

SEQ ID NO: 8762 - protein, 9 aa, Dengue virus
NMMGKREKK

SEQ ID NO: 8763 - protein, 9 aa, Dengue virus
MMGKREKKL

SEQ ID NO: 8764 - protein, 9 aa, Dengue virus
MGKREKKLG

SEQ ID NO: 8765 - protein, 9 aa, Dengue virus
GKREKKLGE

SEQ ID NO: 8766 - protein, 9 aa, Dengue virus
KREKKLGEF

SEQ ID NO: 8767 - protein, 9 aa, Dengue virus
REKKLGEFG

SEQ ID NO: 8768 - protein, 9 aa, Dengue virus
EKKLGEFGK

SEQ ID NO: 8769 - protein, 9 aa, Dengue virus
KKLGEFGKA

SEQ ID NO: 8770 - protein, 9 aa, Dengue virus
KLGEFGKAK

SEQ ID NO: 8771 - protein, 9 aa, Dengue virus
LGEFGKAKG

SEQ ID NO: 8772 - protein, 9 aa, Dengue virus
GEFGKAKGS

SEQ ID NO: 8773 - protein, 9 aa, Dengue virus
EFGKAKGSR

SEQ ID NO: 8774 - protein, 9 aa, Dengue virus
FGKAKGSRA

SEQ ID NO: 8775 - protein, 9 aa, Dengue virus
GKAKGSRAI

SEQ ID NO: 8776 - protein, 9 aa, Dengue virus
KAKGSRAIW

SEQ ID NO: 8777 - protein, 9 aa, Dengue virus
AKGSRAIWY

SEQ ID NO: 8778 - protein, 9 aa, Dengue virus
KGSRAIWYM

SEQ ID NO: 8779 - protein, 9 aa, Dengue virus
GSRAIWYMW

SEQ ID NO: 8780 - protein, 9 aa, Dengue virus
SRAIWYMWL

SEQ ID NO: 8781 - protein, 9 aa, Dengue virus
RAIWYMWLG

SEQ ID NO: 8782 - protein, 9 aa, Dengue virus
AIWYMWLGA

SEQ ID NO: 8783 - protein, 9 aa, Dengue virus
IWYMWLGAR

SEQ ID NO: 8784 - protein, 9 aa, Dengue virus
WYMWLGARF

SEQ ID NO: 8785 - protein, 9 aa, Dengue virus
YMWLGARFL

SEQ ID NO: 8786 - protein, 9 aa, Dengue virus
MWLGARFLE

SEQ ID NO: 8787 - protein, 9 aa, Dengue virus
WLGARFLEF

SEQ ID NO: 8788 - protein, 9 aa, Dengue virus
LGARFLEFE

SEQ ID NO: 8789 - protein, 9 aa, Dengue virus
GARFLEFEA

SEQ ID NO: 8790 - protein, 9 aa, Dengue virus
ARFLEFEAL

SEQ ID NO: 8791 - protein, 9 aa, Dengue virus
RFLEFEALG

SEQ ID NO: 8792 - protein, 9 aa, Dengue virus
FLEFEALGF

SEQ ID NO: 8793 - protein, 9 aa, Dengue virus
LEFEALGFM

SEQ ID NO: 8794 - protein, 9 aa, Dengue virus
EFEALGFMN

SEQ ID NO: 8795 - protein, 9 aa, Dengue virus
FEALGFMNE

SEQ ID NO: 8796 - protein, 9 aa, Dengue virus
EALGFMNED

SEQ ID NO: 8797 - protein, 9 aa, Dengue virus
ALGFMNEDH

SEQ ID NO: 8798 - protein, 9 aa, Dengue virus
LGFMNEDHW

SEQ ID NO: 8799 - protein, 9 aa, Dengue virus
GFMNEDHWF

SEQ ID NO: 8800 - protein, 9 aa, Dengue virus
FMNEDHWFS

SEQ ID NO: 8801 - protein, 9 aa, Dengue virus
MNEDHWFSR

SEQ ID NO: 8802 - protein, 9 aa, Dengue virus
NEDHWFSRE

SEQ ID NO: 8803 - protein, 9 aa, Dengue virus
EDHWFSREN

SEQ ID NO: 8804 - protein, 9 aa, Dengue virus
DHWFSRENS

SEQ ID NO: 8805 - protein, 9 aa, Dengue virus
HWFSRENSL

SEQ ID NO: 8806 - protein, 9 aa, Dengue virus
WFSRENSLS

SEQ ID NO: 8807 - protein, 9 aa, Dengue virus
FSRENSLSG

SEQ ID NO: 8808 - protein, 9 aa, Dengue virus
SRENSLSGV

SEQ ID NO: 8809 - protein, 9 aa, Dengue virus
RENSLSGVE

SEQ ID NO: 8810 - protein, 9 aa, Dengue virus
ENSLSGVEG

SEQ ID NO: 8811 - protein, 9 aa, Dengue virus
NSLSGVEGE

SEQ ID NO: 8812 - protein, 9 aa, Dengue virus
SLSGVEGEG

SEQ ID NO: 8813 - protein, 9 aa, Dengue virus
LSGVEGEGL

SEQ ID NO: 8814 - protein, 9 aa, Dengue virus
SGVEGEGLH

SEQ ID NO: 8815 - protein, 9 aa, Dengue virus
GVEGEGLHK

SEQ ID NO: 8816 - protein, 9 aa, Dengue virus
VEGEGLHKL

SEQ ID NO: 8817 - protein, 9 aa, Dengue virus
EGEGLHKLG

SEQ ID NO: 8818 - protein, 9 aa, Dengue virus
GEGLHKLGY

SEQ ID NO: 8819 - protein, 9 aa, Dengue virus
EGLHKLGYI

SEQ ID NO: 8820 - protein, 9 aa, Dengue virus
GLHKLGYIL

SEQ ID NO: 8821 - protein, 9 aa, Dengue virus
LHKLGYILR

SEQ ID NO: 8822 - protein, 9 aa, Dengue virus
HKLGYILRD

SEQ ID NO: 8823 - protein, 9 aa, Dengue virus
KLGYILRDI

SEQ ID NO: 8824 - protein, 9 aa, Dengue virus
LGYILRDIS

SEQ ID NO: 8825 - protein, 9 aa, Dengue virus
GYILRDISK

SEQ ID NO: 8826 - protein, 9 aa, Dengue virus
YILRDISKI

SEQ ID NO: 8827 - protein, 9 aa, Dengue virus
ILRDISKIP

SEQ ID NO: 8828 - protein, 9 aa, Dengue virus
LRDISKIPG

SEQ ID NO: 8829 - protein, 9 aa, Dengue virus
RDISKIPGG

SEQ ID NO: 8830 - protein, 9 aa, Dengue virus
DISKIPGGN

SEQ ID NO: 8831 - protein, 9 aa, Dengue virus
ISKIPGGNM

SEQ ID NO: 8832 - protein, 9 aa, Dengue virus
SKIPGGNMY

SEQ ID NO: 8833 - protein, 9 aa, Dengue virus
KIPGGNMYA

SEQ ID NO: 8834 - protein, 9 aa, Dengue virus
IPGGNMYAD

SEQ ID NO: 8835 - protein, 9 aa, Dengue virus
PGGNMYADD

SEQ ID NO: 8836 - protein, 9 aa, Dengue virus
GGNMYADDT

SEQ ID NO: 8837 - protein, 9 aa, Dengue virus
GNMYADDTA

SEQ ID NO: 8838 - protein, 9 aa, Dengue virus
NMYADDTAG

SEQ ID NO: 8839 - protein, 9 aa, Dengue virus
MYADDTAGW

SEQ ID NO: 8840 - protein, 9 aa, Dengue virus
YADDTAGWD

SEQ ID NO: 8841 - protein, 9 aa, Dengue virus
ADDTAGWDT

SEQ ID NO: 8842 - protein, 9 aa, Dengue virus
DDTAGWDTR

SEQ ID NO: 8843 - protein, 9 aa, Dengue virus
DTAGWDTRI

SEQ ID NO: 8844 - protein, 9 aa, Dengue virus
TAGWDTRIT

SEQ ID NO: 8845 - protein, 9 aa, Dengue virus
AGWDTRITE

SEQ ID NO: 8846 - protein, 9 aa, Dengue virus
GWDTRITED

SEQ ID NO: 8847 - protein, 9 aa, Dengue virus
WDTRITEDD

SEQ ID NO: 8848 - protein, 9 aa, Dengue virus
DTRITEDDL

SEQ ID NO: 8849 - protein, 9 aa, Dengue virus
TRITEDDLQ

SEQ ID NO: 8850 - protein, 9 aa, Dengue virus
RITEDDLQN

SEQ ID NO: 8851 - protein, 9 aa, Dengue virus
ITEDDLQNE

SEQ ID NO: 8852 - protein, 9 aa, Dengue virus
TEDDLQNEA

SEQ ID NO: 8853 - protein, 9 aa, Dengue virus
EDDLQNEAK

SEQ ID NO: 8854 - protein, 9 aa, Dengue virus
DDLQNEAKI

SEQ ID NO: 8855 - protein, 9 aa, Dengue virus
DLQNEAKIT

SEQ ID NO: 8856 - protein, 9 aa, Dengue virus
LQNEAKITD

SEQ ID NO: 8857 - protein, 9 aa, Dengue virus
QNEAKITDI

SEQ ID NO: 8858 - protein, 9 aa, Dengue virus
NEAKITDIM

SEQ ID NO: 8859 - protein, 9 aa, Dengue virus
EAKITDIME

SEQ ID NO: 8860 - protein, 9 aa, Dengue virus
AKITDIMEP

SEQ ID NO: 8861 - protein, 9 aa, Dengue virus
KITDIMEPE

SEQ ID NO: 8862 - protein, 9 aa, Dengue virus
ITDIMEPEH

SEQ ID NO: 8863 - protein, 9 aa, Dengue virus
TDIMEPEHA

SEQ ID NO: 8864 - protein, 9 aa, Dengue virus
DIMEPEHAL

SEQ ID NO: 8865 - protein, 9 aa, Dengue virus
IMEPEHALL

SEQ ID NO: 8866 - protein, 9 aa, Dengue virus
MEPEHALLA

SEQ ID NO: 8867 - protein, 9 aa, Dengue virus
EPEHALLAK

SEQ ID NO: 8868 - protein, 9 aa, Dengue virus
PEHALLAKS

SEQ ID NO: 8869 - protein, 9 aa, Dengue virus
EHALLAKSI

SEQ ID NO: 8870 - protein, 9 aa, Dengue virus
HALLAKSIF

SEQ ID NO: 8871 - protein, 9 aa, Dengue virus
ALLAKSIFK

SEQ ID NO: 8872 - protein, 9 aa, Dengue virus
LLAKSIFKL

SEQ ID NO: 8873 - protein, 9 aa, Dengue virus
LAKSIFKLT

SEQ ID NO: 8874 - protein, 9 aa, Dengue virus
AKSIFKLTY

SEQ ID NO: 8875 - protein, 9 aa, Dengue virus
KSIFKLTYQ

SEQ ID NO: 8876 - protein, 9 aa, Dengue virus
SIFKLTYQN

SEQ ID NO: 8877 - protein, 9 aa, Dengue virus
IFKLTYQNK

SEQ ID NO: 8878 - protein, 9 aa, Dengue virus
FKLTYQNKV

SEQ ID NO: 8879 - protein, 9 aa, Dengue virus
KLTYQNKVV

SEQ ID NO: 8880 - protein, 9 aa, Dengue virus
LTYQNKVVR

SEQ ID NO: 8881 - protein, 9 aa, Dengue virus
TYQNKVVRV

SEQ ID NO: 8882 - protein, 9 aa, Dengue virus
YQNKVVRVQ

SEQ ID NO: 8883 - protein, 9 aa, Dengue virus
QNKVVRVQR

SEQ ID NO: 8884 - protein, 9 aa, Dengue virus
NKVVRVQRP

SEQ ID NO: 8885 - protein, 9 aa, Dengue virus
KVVRVQRPA

SEQ ID NO: 8886 - protein, 9 aa, Dengue virus
VVRVQRPAK

SEQ ID NO: 8887 - protein, 9 aa, Dengue virus
VRVQRPAKN

SEQ ID NO: 8888 - protein, 9 aa, Dengue virus
RVQRPAKNG

SEQ ID NO: 8889 - protein, 9 aa, Dengue virus
VQRPAKNGT

SEQ ID NO: 8890 - protein, 9 aa, Dengue virus
QRPAKNGTV

SEQ ID NO: 8891 - protein, 9 aa, Dengue virus
RPAKNGTVM

SEQ ID NO: 8892 - protein, 9 aa, Dengue virus
PAKNGTVMD

SEQ ID NO: 8893 - protein, 9 aa, Dengue virus
AKNGTVMDV

SEQ ID NO: 8894 - protein, 9 aa, Dengue virus
KNGTVMDVI

SEQ ID NO: 8895 - protein, 9 aa, Dengue virus
NGTVMDVIS

SEQ ID NO: 8896 - protein, 9 aa, Dengue virus
GTVMDVISR

SEQ ID NO: 8897 - protein, 9 aa, Dengue virus
TVMDVISRR

SEQ ID NO: 8898 - protein, 9 aa, Dengue virus
VMDVISRRD

SEQ ID NO: 8899 - protein, 9 aa, Dengue virus
MDVISRRDQ

SEQ ID NO: 8900 - protein, 9 aa, Dengue virus
DVISRRDQR

SEQ ID NO: 8901 - protein, 9 aa, Dengue virus
VISRRDQRG

SEQ ID NO: 8902 - protein, 9 aa, Dengue virus
ISRRDQRGS

SEQ ID NO: 8903 - protein, 9 aa, Dengue virus
SRRDQRGSG

SEQ ID NO: 8904 - protein, 9 aa, Dengue virus
RRDQRGSGQ

SEQ ID NO: 8905 - protein, 9 aa, Dengue virus
RDQRGSGQV

SEQ ID NO: 8906 - protein, 9 aa, Dengue virus
DQRGSGQVG

SEQ ID NO: 8907 - protein, 9 aa, Dengue virus
QRGSGQVGT

SEQ ID NO: 8908 - protein, 9 aa, Dengue virus
RGSGQVGTY

SEQ ID NO: 8909 - protein, 9 aa, Dengue virus
GSGQVGTYG

SEQ ID NO: 8910 - protein, 9 aa, Dengue virus
SGQVGTYGL

SEQ ID NO: 8911 - protein, 9 aa, Dengue virus
GQVGTYGLN

SEQ ID NO: 8912 - protein, 9 aa, Dengue virus
QVGTYGLNT

SEQ ID NO: 8913 - protein, 9 aa, Dengue virus
VGTYGLNTF

SEQ ID NO: 8914 - protein, 9 aa, Dengue virus
GTYGLNTFT

SEQ ID NO: 8915 - protein, 9 aa, Dengue virus
TYGLNTFTN

SEQ ID NO: 8916 - protein, 9 aa, Dengue virus
YGLNTFTNM

SEQ ID NO: 8917 - protein, 9 aa, Dengue virus
GLNTFTNME

SEQ ID NO: 8918 - protein, 9 aa, Dengue virus
LNTFTNMEA

SEQ ID NO: 8919 - protein, 9 aa, Dengue virus
NTFTNMEAQ

SEQ ID NO: 8920 - protein, 9 aa, Dengue virus
TFTNMEAQL

SEQ ID NO: 8921 - protein, 9 aa, Dengue virus
FTNMEAQLI

SEQ ID NO: 8922 - protein, 9 aa, Dengue virus
TNMEAQLIR

SEQ ID NO: 8923 - protein, 9 aa, Dengue virus
NMEAQLIRQ

SEQ ID NO: 8924 - protein, 9 aa, Dengue virus
MEAQLIRQM

SEQ ID NO: 8925 - protein, 9 aa, Dengue virus
EAQLIRQME

SEQ ID NO: 8926 - protein, 9 aa, Dengue virus
AQLIRQMES

SEQ ID NO: 8927 - protein, 9 aa, Dengue virus
QLIRQMESE

SEQ ID NO: 8928 - protein, 9 aa, Dengue virus
LIRQMESEG

SEQ ID NO: 8929 - protein, 9 aa, Dengue virus
IRQMESEGI

SEQ ID NO: 8930 - protein, 9 aa, Dengue virus
RQMESEGIF

SEQ ID NO: 8931 - protein, 9 aa, Dengue virus
QMESEGIFS

SEQ ID NO: 8932 - protein, 9 aa, Dengue virus
MESEGIFSP

SEQ ID NO: 8933 - protein, 9 aa, Dengue virus
ERLKRMAIS

SEQ ID NO: 8934 - protein, 9 aa, Dengue virus
RLKRMAISG

SEQ ID NO: 8935 - protein, 9 aa, Dengue virus
LKRMAISGD

SEQ ID NO: 8936 - protein, 9 aa, Dengue virus
KRMAISGDD

SEQ ID NO: 8937 - protein, 9 aa, Dengue virus
RMAISGDDC

SEQ ID NO: 8938 - protein, 9 aa, Dengue virus
MAISGDDCV

SEQ ID NO: 8939 - protein, 9 aa, Dengue virus
AISGDDCVV

SEQ ID NO: 8940 - protein, 9 aa, Dengue virus
ISGDDCVVK

SEQ ID NO: 8941 - protein, 9 aa, Dengue virus
SGDDCVVKP

SEQ ID NO: 8942 - protein, 9 aa, Dengue virus
GDDCVVKPI

SEQ ID NO: 8943 - protein, 9 aa, Dengue virus
DDCVVKPID

SEQ ID NO: 8944 - protein, 9 aa, Dengue virus
DCVVKPIDD

SEQ ID NO: 8945 - protein, 9 aa, Dengue virus
CVVKPIDDR

SEQ ID NO: 8946 - protein, 9 aa, Dengue virus
VVKPIDDRF

SEQ ID NO: 8947 - protein, 9 aa, Dengue virus
VKPIDDRFA

SEQ ID NO: 8948 - protein, 9 aa, Dengue virus
KPIDDRFAT

SEQ ID NO: 8949 - protein, 9 aa, Dengue virus
PIDDRFATA

SEQ ID NO: 8950 - protein, 9 aa, Dengue virus
IDDRFATAL

SEQ ID NO: 8951 - protein, 9 aa, Dengue virus
DDRFATALT

SEQ ID NO: 8952 - protein, 9 aa, Dengue virus
DRFATALTA

SEQ ID NO: 8953 - protein, 9 aa, Dengue virus
RFATALTAL

SEQ ID NO: 8954 - protein, 9 aa, Dengue virus
FATALTALN

SEQ ID NO: 8955 - protein, 9 aa, Dengue virus
ATALTALND

SEQ ID NO: 8956 - protein, 9 aa, Dengue virus
TALTALNDM

SEQ ID NO: 8957 - protein, 9 aa, Dengue virus
ALTALNDMG

SEQ ID NO: 8958 - protein, 9 aa, Dengue virus
LTALNDMGK

SEQ ID NO: 8959 - protein, 9 aa, Dengue virus
TALNDMGKV

SEQ ID NO: 8960 - protein, 9 aa, Dengue virus
ALNDMGKVR

SEQ ID NO: 8961 - protein, 9 aa, Dengue virus
LNDMGKVRK

SEQ ID NO: 8962 - protein, 9 aa, Dengue virus
NDMGKVRKD

SEQ ID NO: 8963 - protein, 9 aa, Dengue virus
DMGKVRKDI

SEQ ID NO: 8964 - protein, 9 aa, Dengue virus
MGKVRKDIP

SEQ ID NO: 8965 - protein, 9 aa, Dengue virus
GKVRKDIPQ

SEQ ID NO: 8966 - protein, 9 aa, Dengue virus
KVRKDIPQW

SEQ ID NO: 8967 - protein, 9 aa, Dengue virus
VRKDIPQWE

SEQ ID NO: 8968 - protein, 9 aa, Dengue virus
RKDIPQWEP

SEQ ID NO: 8969 - protein, 9 aa, Dengue virus
KDIPQWEPS

SEQ ID NO: 8970 - protein, 9 aa, Dengue virus
DIPQWEPSK

SEQ ID NO: 8971 - protein, 9 aa, Dengue virus
IPQWEPSKG

SEQ ID NO: 8972 - protein, 9 aa, Dengue virus
PQWEPSKGW

SEQ ID NO: 8973 - protein, 9 aa, Dengue virus
QWEPSKGWN

SEQ ID NO: 8974 - protein, 9 aa, Dengue virus
WEPSKGWND

SEQ ID NO: 8975 - protein, 9 aa, Dengue virus
EPSKGWNDW

SEQ ID NO: 8976 - protein, 9 aa, Dengue virus
PSKGWNDWQ

SEQ ID NO: 8977 - protein, 9 aa, Dengue virus
SKGWNDWQQ

SEQ ID NO: 8978 - protein, 9 aa, Dengue virus
KGWNDWQQV

SEQ ID NO: 8979 - protein, 9 aa, Dengue virus
GWNDWQQVP

SEQ ID NO: 8980 - protein, 9 aa, Dengue virus
WNDWQQVPF

SEQ ID NO: 8981 - protein, 9 aa, Dengue virus
NDWQQVPFC

SEQ ID NO: 8982 - protein, 9 aa, Dengue virus
DWQQVPFCS

SEQ ID NO: 8983 - protein, 9 aa, Dengue virus
WQQVPFCSH

SEQ ID NO: 8984 - protein, 9 aa, Dengue virus
QQVPFCSHH

SEQ ID NO: 8985 - protein, 9 aa, Dengue virus
QVPFCSHHF

SEQ ID NO: 8986 - protein, 9 aa, Dengue virus
VPFCSHHFH

SEQ ID NO: 8987 - protein, 9 aa, Dengue virus
PFCSHHFHQ

SEQ ID NO: 8988 - protein, 9 aa, Dengue virus
FCSHHFHQL

SEQ ID NO: 8989 - protein, 9 aa, Dengue virus
CSHHFHQLI

SEQ ID NO: 8990 - protein, 9 aa, Dengue virus
SHHFHQLIM

SEQ ID NO: 8991 - protein, 9 aa, Dengue virus
HHFHQLIMK

SEQ ID NO: 8992 - protein, 9 aa, Dengue virus
HFHQLIMKD

SEQ ID NO: 8993 - protein, 9 aa, Dengue virus
FHQLIMKDG

SEQ ID NO: 8994 - protein, 9 aa, Dengue virus
HQLIMKDGR

SEQ ID NO: 8995 - protein, 9 aa, Dengue virus
QLIMKDGRE

SEQ ID NO: 8996 - protein, 9 aa, Dengue virus
LIMKDGREI

SEQ ID NO: 8997 - protein, 9 aa, Dengue virus
IMKDGREIV

SEQ ID NO: 8998 - protein, 9 aa, Dengue virus
MKDGREIVV

SEQ ID NO: 8999 - protein, 9 aa, Dengue virus
KDGREIVVP

SEQ ID NO: 9000 - protein, 9 aa, Dengue virus
DGREIVVPC

SEQ ID NO: 9001 - protein, 9 aa, Dengue virus
GREIVVPCR

SEQ ID NO: 9002 - protein, 9 aa, Dengue virus
REIVVPCRN

SEQ ID NO: 9003 - protein, 9 aa, Dengue virus
EIVVPCRNQ

SEQ ID NO: 9004 - protein, 9 aa, Dengue virus
IVVPCRNQD

SEQ ID NO: 9005 - protein, 9 aa, Dengue virus
VVPCRNQDE

SEQ ID NO: 9006 - protein, 9 aa, Dengue virus
VPCRNQDEL

SEQ ID NO: 9007 - protein, 9 aa, Dengue virus
PCRNQDELV

SEQ ID NO: 9008 - protein, 9 aa, Dengue virus
CRNQDELVG

SEQ ID NO: 9009 - protein, 9 aa, Dengue virus
RNQDELVGR

SEQ ID NO: 9010 - protein, 9 aa, Dengue virus
NQDELVGRA

SEQ ID NO: 9011 - protein, 9 aa, Dengue virus
QDELVGRAR

SEQ ID NO: 9012 - protein, 9 aa, Dengue virus
DELVGRARV

SEQ ID NO: 9013 - protein, 9 aa, Dengue virus
ELVGRARVS

SEQ ID NO: 9014 - protein, 9 aa, Dengue virus
LVGRARVSQ

SEQ ID NO: 9015 - protein, 9 aa, Dengue virus
VGRARVSQG

SEQ ID NO: 9016 - protein, 9 aa, Dengue virus
GRARVSQGA

SEQ ID NO: 9017 - protein, 9 aa, Dengue virus
RARVSQGAG

SEQ ID NO: 9018 - protein, 9 aa, Dengue virus
ARVSQGAGW

SEQ ID NO: 9019 - protein, 9 aa, Dengue virus
RVSQGAGWS

SEQ ID NO: 9020 - protein, 9 aa, Dengue virus
VSQGAGWSL

SEQ ID NO: 9021 - protein, 9 aa, Dengue virus
SQGAGWSLR

SEQ ID NO: 9022 - protein, 9 aa, Dengue virus
QGAGWSLRE

SEQ ID NO: 9023 - protein, 9 aa, Dengue virus
GAGWSLRET

SEQ ID NO: 9024 - protein, 9 aa, Dengue virus
AGWSLRETA

SEQ ID NO: 9025 - protein, 9 aa, Dengue virus
GWSLRETAC

SEQ ID NO: 9026 - protein, 9 aa, Dengue virus
WSLRETACL

SEQ ID NO: 9027 - protein, 9 aa, Dengue virus
SLRETACLG

SEQ ID NO: 9028 - protein, 9 aa, Dengue virus
LRETACLGK

SEQ ID NO: 9029 - protein, 9 aa, Dengue virus
RETACLGKS

SEQ ID NO: 9030 - protein, 9 aa, Dengue virus
ETACLGKSY

SEQ ID NO: 9031 - protein, 9 aa, Dengue virus
TACLGKSYA

SEQ ID NO: 9032 - protein, 9 aa, Dengue virus
ACLGKSYAQ

SEQ ID NO: 9033 - protein, 9 aa, Dengue virus
CLGKSYAQM

SEQ ID NO: 9034 - protein, 9 aa, Dengue virus
LGKSYAQMW

SEQ ID NO: 9035 - protein, 9 aa, Dengue virus
GKSYAQMWQ

SEQ ID NO: 9036 - protein, 9 aa, Dengue virus
KSYAQMWQL

SEQ ID NO: 9037 - protein, 9 aa, Dengue virus
SYAQMWQLM

SEQ ID NO: 9038 - protein, 9 aa, Dengue virus
YAQMWQLMY

SEQ ID NO: 9039 - protein, 9 aa, Dengue virus
AQMWQLMYF

SEQ ID NO: 9040 - protein, 9 aa, Dengue virus
QMWQLMYFH

SEQ ID NO: 9041 - protein, 9 aa, Dengue virus
MWQLMYFHR

SEQ ID NO: 9042 - protein, 9 aa, Dengue virus
WQLMYFHRR

SEQ ID NO: 9043 - protein, 9 aa, Dengue virus
QLMYFHRRD

SEQ ID NO: 9044 - protein, 9 aa, Dengue virus
LMYFHRRDL

SEQ ID NO: 9045 - protein, 9 aa, Dengue virus
MYFHRRDLR

SEQ ID NO: 9046 - protein, 9 aa, Dengue virus
YFHRRDLRL

SEQ ID NO: 9047 - protein, 9 aa, Dengue virus
FHRRDLRLA

SEQ ID NO: 9048 - protein, 9 aa, Dengue virus
HRRDLRLAA

SEQ ID NO: 9049 - protein, 9 aa, Dengue virus
RRDLRLAAN

SEQ ID NO: 9050 - protein, 9 aa, Dengue virus
RDLRLAANA

SEQ ID NO: 9051 - protein, 9 aa, Dengue virus
DLRLAANAI

SEQ ID NO: 9052 - protein, 9 aa, Dengue virus
LRLAANAIC

SEQ ID NO: 9053 - protein, 9 aa, Dengue virus
RLAANAICS

SEQ ID NO: 9054 - protein, 9 aa, Dengue virus
LAANAICSA

SEQ ID NO: 9055 - protein, 9 aa, Dengue virus
AANAICSAV

SEQ ID NO: 9056 - protein, 9 aa, Dengue virus
ANAICSAVP

SEQ ID NO: 9057 - protein, 9 aa, Dengue virus
NAICSAVPV

SEQ ID NO: 9058 - protein, 9 aa, Dengue virus
PVDWVPTSR

SEQ ID NO: 9059 - protein, 9 aa, Dengue virus
VDWVPTSRT

SEQ ID NO: 9060 - protein, 9 aa, Dengue virus
DWVPTSRTT

SEQ ID NO: 9061 - protein, 9 aa, Dengue virus
WVPTSRTTW

SEQ ID NO: 9062 - protein, 9 aa, Dengue virus
VPTSRTTWS

SEQ ID NO: 9063 - protein, 9 aa, Dengue virus
PTSRTTWSI

SEQ ID NO: 9064 - protein, 9 aa, Dengue virus
TSRTTWSIH

SEQ ID NO: 9065 - protein, 9 aa, Dengue virus
SRTTWSIHA

SEQ ID NO: 9066 - protein, 9 aa, Dengue virus
RTTWSIHAH

SEQ ID NO: 9067 - protein, 9 aa, Dengue virus
TTWSIHAHH

SEQ ID NO: 9068 - protein, 9 aa, Dengue virus
TWSIHAHHQ

SEQ ID NO: 9069 - protein, 9 aa, Dengue virus
WSIHAHHQW

SEQ ID NO: 9070 - protein, 9 aa, Dengue virus
SIHAHHQWM

SEQ ID NO: 9071 - protein, 9 aa, Dengue virus
IHAHHQWMT

SEQ ID NO: 9072 - protein, 9 aa, Dengue virus
HAHHQWMTT

SEQ ID NO: 9073 - protein, 9 aa, Dengue virus
AHHQWMTTE

SEQ ID NO: 9074 - protein, 9 aa, Dengue virus
HHQWMTTED

SEQ ID NO: 9075 - protein, 9 aa, Dengue virus
HQWMTTEDM

SEQ ID NO: 9076 - protein, 9 aa, Dengue virus
QWMTTEDML

SEQ ID NO: 9077 - protein, 9 aa, Dengue virus
WMTTEDMLS

SEQ ID NO: 9078 - protein, 9 aa, Dengue virus
MTTEDMLSV

SEQ ID NO: 9079 - protein, 9 aa, Dengue virus
TTEDMLSVW

SEQ ID NO: 9080 - protein, 9 aa, Dengue virus
TEDMLSVWN

SEQ ID NO: 9081 - protein, 9 aa, Dengue virus
EDMLSVWNR

SEQ ID NO: 9082 - protein, 9 aa, Dengue virus
DMLSVWNRV

SEQ ID NO: 9083 - protein, 9 aa, Dengue virus
MLSVWNRVW

SEQ ID NO: 9084 - protein, 9 aa, Dengue virus
LSVWNRVWI

SEQ ID NO: 9085 - protein, 9 aa, Dengue virus
SVWNRVWIE

SEQ ID NO: 9086 - protein, 9 aa, Dengue virus
VWNRVWIEE

SEQ ID NO: 9087 - protein, 9 aa, Dengue virus
WNRVWIEEN

SEQ ID NO: 9088 - protein, 9 aa, Dengue virus
NRVWIEENP

SEQ ID NO: 9089 - protein, 9 aa, Dengue virus
RVWIEENPW

SEQ ID NO: 9090 - protein, 9 aa, Dengue virus
VWIEENPWM

SEQ ID NO: 9091 - protein, 9 aa, Dengue virus
WIEENPWME

SEQ ID NO: 9092 - protein, 9 aa, Dengue virus
IEENPWMED

SEQ ID NO: 9093 - protein, 9 aa, Dengue virus
EENPWMEDK

SEQ ID NO: 9094 - protein, 9 aa, Dengue virus
ENPWMEDKT

SEQ ID NO: 9095 - protein, 9 aa, Dengue virus
NPWMEDKTH

SEQ ID NO: 9096 - protein, 9 aa, Dengue virus
PWMEDKTHI

SEQ ID NO: 9097 - protein, 9 aa, Dengue virus
WMEDKTHIS

SEQ ID NO: 9098 - protein, 9 aa, Dengue virus
MEDKTHISS

SEQ ID NO: 9099 - protein, 9 aa, Dengue virus
EDKTHISSW

SEQ ID NO: 9100 - protein, 9 aa, Dengue virus
DKTHISSWG

SEQ ID NO: 9101 - protein, 9 aa, Dengue virus
ISSWGDVPY

SEQ ID NO: 9102 - protein, 9 aa, Dengue virus
SSWGDVPYL

SEQ ID NO: 9103 - protein, 9 aa, Dengue virus
SWGDVPYLG

SEQ ID NO: 9104 - protein, 9 aa, Dengue virus
WGDVPYLGK

SEQ ID NO: 9105 - protein, 9 aa, Dengue virus
GDVPYLGKR

SEQ ID NO: 9106 - protein, 9 aa, Dengue virus
DVPYLGKRE

SEQ ID NO: 9107 - protein, 9 aa, Dengue virus
VPYLGKRED

SEQ ID NO: 9108 - protein, 9 aa, Dengue virus
PYLGKREDQ

SEQ ID NO: 9109 - protein, 9 aa, Dengue virus
YLGKREDQW

SEQ ID NO: 9110 - protein, 9 aa, Dengue virus
LGKREDQWC

SEQ ID NO: 9111 - protein, 9 aa, Dengue virus
GKREDQWCG

SEQ ID NO: 9112 - protein, 9 aa, Dengue virus
KREDQWCGS

SEQ ID NO: 9113 - protein, 9 aa, Dengue virus
REDQWCGSL

SEQ ID NO: 9114 - protein, 9 aa, Dengue virus
EDQWCGSLI

SEQ ID NO: 9115 - protein, 9 aa, Dengue virus
DQWCGSLIG

SEQ ID NO: 9116 - protein, 9 aa, Dengue virus
QWCGSLIGL

SEQ ID NO: 9117 - protein, 9 aa, Dengue virus
WCGSLIGLT

SEQ ID NO: 9118 - protein, 9 aa, Dengue virus
CGSLIGLTA

SEQ ID NO: 9119 - protein, 9 aa, Dengue virus
GSLIGLTAR

SEQ ID NO: 9120 - protein, 9 aa, Dengue virus
SLIGLTARA

SEQ ID NO: 9121 - protein, 9 aa, Dengue virus
LIGLTARAT

SEQ ID NO: 9122 - protein, 9 aa, Dengue virus
IGLTARATW

SEQ ID NO: 9123 - protein, 9 aa, Dengue virus
GLTARATWA

SEQ ID NO: 9124 - protein, 9 aa, Dengue virus
LTARATWAT

SEQ ID NO: 9125 - protein, 9 aa, Dengue virus
TARATWATN

SEQ ID NO: 9126 - protein, 9 aa, Dengue virus
ARATWATNI

SEQ ID NO: 9127 - protein, 9 aa, Dengue virus
RATWATNIQ

SEQ ID NO: 9128 - protein, 9 aa, Dengue virus
ATWATNIQV

SEQ ID NO: 9129 - protein, 9 aa, Dengue virus
TWATNIQVA

SEQ ID NO: 9130 - protein, 9 aa, Dengue virus
WATNIQVAI

SEQ ID NO: 9131 - protein, 9 aa, Dengue virus
ATNIQVAIN

SEQ ID NO: 9132 - protein, 9 aa, Dengue virus
TNIQVAINQ

SEQ ID NO: 9133 - protein, 9 aa, Dengue virus
NIQVAINQV

SEQ ID NO: 9134 - protein, 9 aa, Dengue virus
IQVAINQVR

SEQ ID NO: 9135 - protein, 9 aa, Dengue virus
QVAINQVRR

SEQ ID NO: 9136 - protein, 9 aa, Dengue virus
VAINQVRRL

SEQ ID NO: 9137 - protein, 9 aa, Dengue virus
AINQVRRLI

SEQ ID NO: 9138 - protein, 9 aa, Dengue virus
INQVRRLIG

SEQ ID NO: 9139 - protein, 9 aa, Dengue virus
NQVRRLIGN

SEQ ID NO: 9140 - protein, 9 aa, Dengue virus
QVRRLIGNE

SEQ ID NO: 9141 - protein, 9 aa, Dengue virus
VRRLIGNEN

SEQ ID NO: 9142 - protein, 9 aa, Dengue virus
RRLIGNENY

SEQ ID NO: 9143 - protein, 9 aa, Dengue virus
RLIGNENYL

SEQ ID NO: 9144 - protein, 9 aa, Dengue virus
LIGNENYLD

SEQ ID NO: 9145 - protein, 9 aa, Dengue virus
IGNENYLDY

SEQ ID NO: 9146 - protein, 9 aa, Dengue virus
GNENYLDYM

SEQ ID NO: 9147 - protein, 9 aa, Dengue virus
NENYLDYMT

SEQ ID NO: 9148 - protein, 9 aa, Dengue virus
ENYLDYMTS

SEQ ID NO: 9149 - protein, 9 aa, Dengue virus
NYLDYMTSM

SEQ ID NO: 9150 - protein, 9 aa, Dengue virus
YLDYMTSMK

SEQ ID NO: 9151 - protein, 9 aa, Dengue virus
LDYMTSMKR

SEQ ID NO: 9152 - protein, 9 aa, Dengue virus
DYMTSMKRF

SEQ ID NO: 9153 - protein, 9 aa, Dengue virus
YMTSMKRFK

SEQ ID NO: 9154 - protein, 9 aa, Dengue virus
MTSMKRFKN

SEQ ID NO: 9155 - protein, 9 aa, Dengue virus
TSMKRFKNE

SEQ ID NO: 9156 - protein, 9 aa, Dengue virus
SMKRFKNES

SEQ ID NO: 9157 - protein, 9 aa, Dengue virus
MNNQRKKTG

SEQ ID NO: 9158 - protein, 9 aa, Dengue virus
NNQRKKTGR

SEQ ID NO: 9159 - protein, 9 aa, Dengue virus
NQRKKTGRP

SEQ ID NO: 9160 - protein, 9 aa, Dengue virus
QRKKTGRPS

SEQ ID NO: 9161 - protein, 9 aa, Dengue virus
RKKTGRPSF

SEQ ID NO: 9162 - protein, 9 aa, Dengue virus
KKTGRPSFN

SEQ ID NO: 9163 - protein, 9 aa, Dengue virus
KTGRPSFNM

SEQ ID NO: 9164 - protein, 9 aa, Dengue virus
TGRPSFNML

SEQ ID NO: 9165 - protein, 9 aa, Dengue virus
GRPSFNMLK

SEQ ID NO: 9166 - protein, 9 aa, Dengue virus
QPSFNMLKR

SEQ ID NO: 9167 - protein, 9 aa, Dengue virus
RARNRVSTG

SEQ ID NO: 9168 - protein, 9 aa, Dengue virus
ARNRVSTGS

SEQ ID NO: 9169 - protein, 9 aa, Dengue virus
RNRVSTGSQ

SEQ ID NO: 9170 - protein, 9 aa, Dengue virus
NRVSTGSQL

SEQ ID NO: 9171 - protein, 9 aa, Dengue virus
RVSTGSQLA

SEQ ID NO: 9172 - protein, 9 aa, Dengue virus
VSTGSQLAK

SEQ ID NO: 9173 - protein, 9 aa, Dengue virus
STGSQLAKR

SEQ ID NO: 9174 - protein, 9 aa, Dengue virus
TGSQLAKRF

SEQ ID NO: 9175 - protein, 9 aa, Dengue virus
GSQLAKRFS

SEQ ID NO: 9176 - protein, 9 aa, Dengue virus
LSGQGPMKM

SEQ ID NO: 9177 - protein, 9 aa, Dengue virus
SGQGPMKMV

SEQ ID NO: 9178 - protein, 9 aa, Dengue virus
GQGPMKMVM

SEQ ID NO: 9179 - protein, 9 aa, Dengue virus
QGPMKMVMA

SEQ ID NO: 9180 - protein, 9 aa, Dengue virus
GPMKMVMAF

SEQ ID NO: 9181 - protein, 9 aa, Dengue virus
PMKMVMAFI

SEQ ID NO: 9182 - protein, 9 aa, Dengue virus
MKMVMAFIA

SEQ ID NO: 9183 - protein, 9 aa, Dengue virus
KMVMAFIAF

SEQ ID NO: 9184 - protein, 9 aa, Dengue virus
MVMAFIAFL

SEQ ID NO: 9185 - protein, 9 aa, Dengue virus
TAGILARWS

SEQ ID NO: 9186 - protein, 9 aa, Dengue virus
AGILARWSS

SEQ ID NO: 9187 - protein, 9 aa, Dengue virus
GILARWSSF

SEQ ID NO: 9188 - protein, 9 aa, Dengue virus
ILARWSSFK

SEQ ID NO: 9189 - protein, 9 aa, Dengue virus
LARWSSFKK

SEQ ID NO: 9190 - protein, 9 aa, Dengue virus
ARWGSFKKS

SEQ ID NO: 9191 - protein, 9 aa, Dengue virus
RWGSFKKSG

SEQ ID NO: 9192 - protein, 9 aa, Dengue virus
WGSFKKSGA

SEQ ID NO: 9193 - protein, 9 aa, Dengue virus
GSFKKSGAI

SEQ ID NO: 9194 - protein, 9 aa, Dengue virus
SFKKSGAIK

SEQ ID NO: 9195 - protein, 9 aa, Dengue virus
FKKSGAIKV

SEQ ID NO: 9196 - protein, 9 aa, Dengue virus
KKSGAIKVL

SEQ ID NO: 9197 - protein, 9 aa, Dengue virus
KSGAIKVLR

SEQ ID NO: 9198 - protein, 9 aa, Dengue virus
SGAIKVLRG

SEQ ID NO: 9199 - protein, 9 aa, Dengue virus
GAIRVLRGF

SEQ ID NO: 9200 - protein, 9 aa, Dengue virus
IKVLRGFKR

SEQ ID NO: 9201 - protein, 9 aa, Dengue virus
KVLRGFKRE

SEQ ID NO: 9202 - protein, 9 aa, Dengue virus
VLRGFKKEV

SEQ ID NO: 9203 - protein, 9 aa, Dengue virus
LRGFKKEVS

SEQ ID NO: 9204 - protein, 9 aa, Dengue virus
RGFKKEISS

SEQ ID NO: 9205 - protein, 9 aa, Dengue virus
GFKKEISSM

SEQ ID NO: 9206 - protein, 9 aa, Dengue virus
FKKEISSML

SEQ ID NO: 9207 - protein, 9 aa, Dengue virus
KKEISSMLN

SEQ ID NO: 9208 - protein, 9 aa, Dengue virus
MLNTMNRRK

SEQ ID NO: 9209 - protein, 9 aa, Dengue virus
MNRRKKSVT

SEQ ID NO: 9210 - protein, 9 aa, Dengue virus
NRRKKSVTM

SEQ ID NO: 9211 - protein, 9 aa, Dengue virus
RRKKSVTML

SEQ ID NO: 9212 - protein, 9 aa, Dengue virus
RKKSVTMLL

SEQ ID NO: 9213 - protein, 9 aa, Dengue virus
KSVTMLLML

SEQ ID NO: 9214 - protein, 9 aa, Dengue virus
PTVLTFHLT

SEQ ID NO: 9215 - protein, 9 aa, Dengue virus
TVLTFHLTT

SEQ ID NO: 9216 - protein, 9 aa, Dengue virus
VLTFHLTTR

SEQ ID NO: 9217 - protein, 9 aa, Dengue virus
LTFHLTTRG

SEQ ID NO: 9218 - protein, 9 aa, Dengue virus
TFHLTTRGG

SEQ ID NO: 9219 - protein, 9 aa, Dengue virus
TRGGEPHMV

SEQ ID NO: 9220 - protein, 9 aa, Dengue virus
RGGEPHMVV

SEQ ID NO: 9221 - protein, 9 aa, Dengue virus
GGEPHMIVT

SEQ ID NO: 9222 - protein, 9 aa, Dengue virus
GEPHMIVTK

SEQ ID NO: 9223 - protein, 9 aa, Dengue virus
EPHMIVTKQ

SEQ ID NO: 9224 - protein, 9 aa, Dengue virus
PHMIVTKQE

SEQ ID NO: 9225 - protein, 9 aa, Dengue virus
HMIVTKQER

SEQ ID NO: 9226 - protein, 9 aa, Dengue virus
MIVTKQERG

SEQ ID NO: 9227 - protein, 9 aa, Dengue virus
IVTKQERGK

SEQ ID NO: 9228 - protein, 9 aa, Dengue virus
VTKQERGKS

SEQ ID NO: 9229 - protein, 9 aa, Dengue virus
TKQERGKSL

SEQ ID NO: 9230 - protein, 9 aa, Dengue virus
KSLLFKTSV

SEQ ID NO: 9231 - protein, 9 aa, Dengue virus
SLLFKTSVG

SEQ ID NO: 9232 - protein, 9 aa, Dengue virus
LLFKTSVGV

SEQ ID NO: 9233 - protein, 9 aa, Dengue virus
LFKTSVGVN

SEQ ID NO: 9234 - protein, 9 aa, Dengue virus
FKTSVGVNM

SEQ ID NO: 9235 - protein, 9 aa, Dengue virus
KTSVGVNMC

SEQ ID NO: 9236 - protein, 9 aa, Dengue virus
TSVGVNMCT

SEQ ID NO: 9237 - protein, 9 aa, Dengue virus
SVGVNMCTL

SEQ ID NO: 9238 - protein, 9 aa, Dengue virus
VGVNMCTLI

SEQ ID NO: 9239 - protein, 9 aa, Dengue virus
GINMCTLIA

SEQ ID NO: 9240 - protein, 9 aa, Dengue virus
INMCTLIAM

SEQ ID NO: 9241 - protein, 9 aa, Dengue virus
LIAMDLGEF

SEQ ID NO: 9242 - protein, 9 aa, Dengue virus
IAMDLGEFC

SEQ ID NO: 9243 - protein, 9 aa, Dengue virus
AMDLGEFCE

SEQ ID NO: 9244 - protein, 9 aa, Dengue virus
MDLGEFCED

SEQ ID NO: 9245 - protein, 9 aa, Dengue virus
DLGEFCEDT

SEQ ID NO: 9246 - protein, 9 aa, Dengue virus
LGEFCEDTM

SEQ ID NO: 9247 - protein, 9 aa, Dengue virus
GEFCEDTMT

SEQ ID NO: 9248 - protein, 9 aa, Dengue virus
EFCEDTMTY

SEQ ID NO: 9249 - protein, 9 aa, Dengue virus
FCEDTMTYK

SEQ ID NO: 9250 - protein, 9 aa, Dengue virus
CDDTMTYKC

SEQ ID NO: 9251 - protein, 9 aa, Dengue virus
DDTMTYKCP

SEQ ID NO: 9252 - protein, 9 aa, Dengue virus
DTMTYKCPQ

SEQ ID NO: 9253 - protein, 9 aa, Dengue virus
TMTYKCPQI

SEQ ID NO: 9254 - protein, 9 aa, Dengue virus
MTYKCPQIT

SEQ ID NO: 9255 - protein, 9 aa, Dengue virus
TYKCPQITE

SEQ ID NO: 9256 - protein, 9 aa, Dengue virus
YKCPRITET

SEQ ID NO: 9257 - protein, 9 aa, Dengue virus
KCPRITETE

SEQ ID NO: 9258 - protein, 9 aa, Dengue virus
CPRITETEP

SEQ ID NO: 9259 - protein, 9 aa, Dengue virus
PRITETEPD

SEQ ID NO: 9260 - protein, 9 aa, Dengue virus
RITETEPDD

SEQ ID NO: 9261 - protein, 9 aa, Dengue virus
ITETEPDDV

SEQ ID NO: 9262 - protein, 9 aa, Dengue virus
TETEPDDVD

SEQ ID NO: 9263 - protein, 9 aa, Dengue virus
ETEPDDVDC

SEQ ID NO: 9264 - protein, 9 aa, Dengue virus
TEPDDVDCW

SEQ ID NO: 9265 - protein, 9 aa, Dengue virus
DDVDCWCNT

SEQ ID NO: 9266 - protein, 9 aa, Dengue virus
DVDCWCNTT

SEQ ID NO: 9267 - protein, 9 aa, Dengue virus
VDCWCNATE

SEQ ID NO: 9268 - protein, 9 aa, Dengue virus
DCWCNATET

SEQ ID NO: 9269 - protein, 9 aa, Dengue virus
CWCNATETW

SEQ ID NO: 9270 - protein, 9 aa, Dengue virus
WCNATETWV

SEQ ID NO: 9271 - protein, 9 aa, Dengue virus
CNATETWVT

SEQ ID NO: 9272 - protein, 9 aa, Dengue virus
NATETWVTY

SEQ ID NO: 9273 - protein, 9 aa, Dengue virus
ATETWVTYG

SEQ ID NO: 9274 - protein, 9 aa, Dengue virus
TETWVTYGT

SEQ ID NO: 9275 - protein, 9 aa, Dengue virus
ETWVTYGTC

SEQ ID NO: 9276 - protein, 9 aa, Dengue virus
YGTCSQTGG

SEQ ID NO: 9277 - protein, 9 aa, Dengue virus
GTCSQTGGH

SEQ ID NO: 9278 - protein, 9 aa, Dengue virus
TCTQIGEHR

SEQ ID NO: 9279 - protein, 9 aa, Dengue virus
CSQTGGHRR

SEQ ID NO: 9280 - protein, 9 aa, Dengue virus
SQTGEHRRE

SEQ ID NO: 9281 - protein, 9 aa, Dengue virus
QTGEHRREK

SEQ ID NO: 9282 - protein, 9 aa, Dengue virus
TGEHRREKR

SEQ ID NO: 9283 - protein, 9 aa, Dengue virus
GEHRREKRS

SEQ ID NO: 9284 - protein, 9 aa, Dengue virus
EHRREKRSV

SEQ ID NO: 9285 - protein, 9 aa, Dengue virus
HRREKRSVA

SEQ ID NO: 9286 - protein, 9 aa, Dengue virus
RREKRSVAL

SEQ ID NO: 9287 - protein, 9 aa, Dengue virus
REKRSVALA

SEQ ID NO: 9288 - protein, 9 aa, Dengue virus
EKRSVALAP

SEQ ID NO: 9289 - protein, 9 aa, Dengue virus
VGLGLETRA

SEQ ID NO: 9290 - protein, 9 aa, Dengue virus
GLGLETRAE

SEQ ID NO: 9291 - protein, 9 aa, Dengue virus
LGLETRAET

SEQ ID NO: 9292 - protein, 9 aa, Dengue virus
GLETRAETW

SEQ ID NO: 9293 - protein, 9 aa, Dengue virus
LETRAETWM

SEQ ID NO: 9294 - protein, 9 aa, Dengue virus
ETRAETWMS

SEQ ID NO: 9295 - protein, 9 aa, Dengue virus
TRAETWMSS

SEQ ID NO: 9296 - protein, 9 aa, Dengue virus
RAETWMSSE

SEQ ID NO: 9297 - protein, 9 aa, Dengue virus
AETWMSSEG

SEQ ID NO: 9298 - protein, 9 aa, Dengue virus
WMSSEGAWR

SEQ ID NO: 9299 - protein, 9 aa, Dengue virus
MSSEGAWRQ

SEQ ID NO: 9300 - protein, 9 aa, Dengue virus
SSEGAWRQI

SEQ ID NO: 9301 - protein, 9 aa, Dengue virus
SEGAWRQIQ

SEQ ID NO: 9302 - protein, 9 aa, Dengue virus
EGAWKQIQK

SEQ ID NO: 9303 - protein, 9 aa, Dengue virus
GAWKQIQKV

SEQ ID NO: 9304 - protein, 9 aa, Dengue virus
AWKQIQKVE

SEQ ID NO: 9305 - protein, 9 aa, Dengue virus
WKQIQKVET

SEQ ID NO: 9306 - protein, 9 aa, Dengue virus
KQIQKVETW

SEQ ID NO: 9307 - protein, 9 aa, Dengue virus
QIQKVETWA

SEQ ID NO: 9308 - protein, 9 aa, Dengue virus
IQKVETWAL

SEQ ID NO: 9309 - protein, 9 aa, Dengue virus
QKVETWALR

SEQ ID NO: 9310 - protein, 9 aa, Dengue virus
KVETWALRH

SEQ ID NO: 9311 - protein, 9 aa, Dengue virus
VLRHPGFTV

SEQ ID NO: 9312 - protein, 9 aa, Dengue virus
LRHPGFTVT

SEQ ID NO: 9313 - protein, 9 aa, Dengue virus
RHPGFTVTA

SEQ ID NO: 9314 - protein, 9 aa, Dengue virus
HPGFTVIAF

SEQ ID NO: 9315 - protein, 9 aa, Dengue virus
PGFTVIAFF

SEQ ID NO: 9316 - protein, 9 aa, Dengue virus
GFTVIAFFL

SEQ ID NO: 9317 - protein, 9 aa, Dengue virus
FTVIAFFLA

SEQ ID NO: 9318 - protein, 9 aa, Dengue virus
AFFLAHAIG

SEQ ID NO: 9319 - protein, 9 aa, Dengue virus
FFLAHAIGT

SEQ ID NO: 9320 - protein, 9 aa, Dengue virus
FLAHVIGTS

SEQ ID NO: 9321 - protein, 9 aa, Dengue virus
LAHVIGTSI

SEQ ID NO: 9322 - protein, 9 aa, Dengue virus
AHVIGTSIT

SEQ ID NO: 9323 - protein, 9 aa, Dengue virus
HVIGTSITQ

SEQ ID NO: 9324 - protein, 9 aa, Dengue virus
VIGTSITQK

SEQ ID NO: 9325 - protein, 9 aa, Dengue virus
IIFILLMLA

SEQ ID NO: 9326 - protein, 9 aa, Dengue virus
IFILLMLAT

SEQ ID NO: 9327 - protein, 9 aa, Dengue virus
FILLMLATP

SEQ ID NO: 9328 - protein, 9 aa, Dengue virus
ILLMLATPS

SEQ ID NO: 9329 - protein, 9 aa, Dengue virus
LLMLATPSM

SEQ ID NO: 9330 - protein, 9 aa, Dengue virus
LMLATPSMA

SEQ ID NO: 9331 - protein, 9 aa, Dengue virus
MLATPSMAM

SEQ ID NO: 9332 - protein, 9 aa, Dengue virus
AMRCVGIGN

SEQ ID NO: 9333 - protein, 9 aa, Dengue virus
MRCVGIGNR

SEQ ID NO: 9334 - protein, 9 aa, Dengue virus
RCVGIGNRD

SEQ ID NO: 9335 - protein, 9 aa, Dengue virus
CVGIGNRDF

SEQ ID NO: 9336 - protein, 9 aa, Dengue virus
VGIGNRDFV

SEQ ID NO: 9337 - protein, 9 aa, Dengue virus
GIGNRDFVE

SEQ ID NO: 9338 - protein, 9 aa, Dengue virus
IGNRDFVEG

SEQ ID NO: 9339 - protein, 9 aa, Dengue virus
GNRDFVEGL

SEQ ID NO: 9340 - protein, 9 aa, Dengue virus
NRDFVEGLS

SEQ ID NO: 9341 - protein, 9 aa, Dengue virus
SCVTTMAKN

SEQ ID NO: 9342 - protein, 9 aa, Dengue virus
CVTTMAKNK

SEQ ID NO: 9343 - protein, 9 aa, Dengue virus
VTTMAKNKP

SEQ ID NO: 9344 - protein, 9 aa, Dengue virus
TTMAKNKPT

SEQ ID NO: 9345 - protein, 9 aa, Dengue virus
TMAKNKPTL

SEQ ID NO: 9346 - protein, 9 aa, Dengue virus
MAKNKPTLD

SEQ ID NO: 9347 - protein, 9 aa, Dengue virus
AKNKPTLDI

SEQ ID NO: 9348 - protein, 9 aa, Dengue virus
KNKPTLDIE

SEQ ID NO: 9349 - protein, 9 aa, Dengue virus
NKPTLDIEL

SEQ ID NO: 9350 - protein, 9 aa, Dengue virus
ELLKTEVTD

SEQ ID NO: 9351 - protein, 9 aa, Dengue virus
LLKTEVTDP

SEQ ID NO: 9352 - protein, 9 aa, Dengue virus
LKTEVTDPA

SEQ ID NO: 9353 - protein, 9 aa, Dengue virus
KTEVTNPAI

SEQ ID NO: 9354 - protein, 9 aa, Dengue virus
TEVTNPAIL

SEQ ID NO: 9355 - protein, 9 aa, Dengue virus
EVTNPAILR

SEQ ID NO: 9356 - protein, 9 aa, Dengue virus
VTNPAILRK

SEQ ID NO: 9357 - protein, 9 aa, Dengue virus
TNPAILRKL

SEQ ID NO: 9358 - protein, 9 aa, Dengue virus
NPAILRKLC

SEQ ID NO: 9359 - protein, 9 aa, Dengue virus
PAILRKLCI

SEQ ID NO: 9360 - protein, 9 aa, Dengue virus
AILRKLCIE

SEQ ID NO: 9361 - protein, 9 aa, Dengue virus
ILRKLCIEA

SEQ ID NO: 9362 - protein, 9 aa, Dengue virus
PTQGEATLM

SEQ ID NO: 9363 - protein, 9 aa, Dengue virus
TQGEATLME

SEQ ID NO: 9364 - protein, 9 aa, Dengue virus
QGEATLMEE

SEQ ID NO: 9365 - protein, 9 aa, Dengue virus
GEATLMEEQ

SEQ ID NO: 9366 - protein, 9 aa, Dengue virus
EATLMEEQD

SEQ ID NO: 9367 - protein, 9 aa, Dengue virus
ATLMEEQDA

SEQ ID NO: 9368 - protein, 9 aa, Dengue virus
TLMEEQDAN

SEQ ID NO: 9369 - protein, 9 aa, Dengue virus
LMEEQDANF

SEQ ID NO: 9370 - protein, 9 aa, Dengue virus
MEEQDANFV

SEQ ID NO: 9371 - protein, 9 aa, Dengue virus
EEQDTNFVC

SEQ ID NO: 9372 - protein, 9 aa, Dengue virus
EQDTNFVCR

SEQ ID NO: 9373 - protein, 9 aa, Dengue virus
QDTNFVCRR

SEQ ID NO: 9374 - protein, 9 aa, Dengue virus
DTNFVCRRT

SEQ ID NO: 9375 - protein, 9 aa, Dengue virus
TNFVCRRTF

SEQ ID NO: 9376 - protein, 9 aa, Dengue virus
NFVCRRTLV

SEQ ID NO: 9377 - protein, 9 aa, Dengue virus
FVCRRTLVD

SEQ ID NO: 9378 - protein, 9 aa, Dengue virus
VCRRTLVDR

SEQ ID NO: 9379 - protein, 9 aa, Dengue virus
CRRTLVDRG

SEQ ID NO: 9380 - protein, 9 aa, Dengue virus
RRTLVDRGW

SEQ ID NO: 9381 - protein, 9 aa, Dengue virus
RTLVDRGWG

SEQ ID NO: 9382 - protein, 9 aa, Dengue virus
TLVDRGWGN

SEQ ID NO: 9383 - protein, 9 aa, Dengue virus
LVDRGWGNG

SEQ ID NO: 9384 - protein, 9 aa, Dengue virus
GLFGKGSLL

SEQ ID NO: 9385 - protein, 9 aa, Dengue virus
LFGKGSLLT

SEQ ID NO: 9386 - protein, 9 aa, Dengue virus
FGKGSLLTC

SEQ ID NO: 9387 - protein, 9 aa, Dengue virus
GKGSLLTCA

SEQ ID NO: 9388 - protein, 9 aa, Dengue virus
KGSLLTCAK

SEQ ID NO: 9389 - protein, 9 aa, Dengue virus
GSLLTCAKF

SEQ ID NO: 9390 - protein, 9 aa, Dengue virus
SLLTCAKFK

SEQ ID NO: 9391 - protein, 9 aa, Dengue virus
LLTCAKFKC

SEQ ID NO: 9392 - protein, 9 aa, Dengue virus
LTCAKFKCV

SEQ ID NO: 9393 - protein, 9 aa, Dengue virus
CVTKLEGKT

SEQ ID NO: 9394 - protein, 9 aa, Dengue virus
VTKLEGKTV

SEQ ID NO: 9395 - protein, 9 aa, Dengue virus
TKLEGKTVQ

SEQ ID NO: 9396 - protein, 9 aa, Dengue virus
KLEGKTVQY

SEQ ID NO: 9397 - protein, 9 aa, Dengue virus
LEGKTVQYE

SEQ ID NO: 9398 - protein, 9 aa, Dengue virus
EGKTVQYEN

SEQ ID NO: 9399 - protein, 9 aa, Dengue virus
GKTVQYENL

SEQ ID NO: 9400 - protein, 9 aa, Dengue virus
KTVQYENLK

SEQ ID NO: 9401 - protein, 9 aa, Dengue virus
TVQYENLKY

SEQ ID NO: 9402 - protein, 9 aa, Dengue virus
VQHENLKYS

SEQ ID NO: 9403 - protein, 9 aa, Dengue virus
QHENLKYSV

SEQ ID NO: 9404 - protein, 9 aa, Dengue virus
HENLKYSVI

SEQ ID NO: 9405 - protein, 9 aa, Dengue virus
DQHQVGNET

SEQ ID NO: 9406 - protein, 9 aa, Dengue virus
QHQVGNETT

SEQ ID NO: 9407 - protein, 9 aa, Dengue virus
HQVGNETTE

SEQ ID NO: 9408 - protein, 9 aa, Dengue virus
QVGNETTEH

SEQ ID NO: 9409 - protein, 9 aa, Dengue virus
VGNETTEHG

SEQ ID NO: 9410 - protein, 9 aa, Dengue virus
GNETTEHGT

SEQ ID NO: 9411 - protein, 9 aa, Dengue virus
NETTEHGTI

SEQ ID NO: 9412 - protein, 9 aa, Dengue virus
ETTEHGTIA

SEQ ID NO: 9413 - protein, 9 aa, Dengue virus
TTEHGTIAT

SEQ ID NO: 9414 - protein, 9 aa, Dengue virus
TEHGTIATI

SEQ ID NO: 9415 - protein, 9 aa, Dengue virus
EHGTIATIT

SEQ ID NO: 9416 - protein, 9 aa, Dengue virus
HGTIATITP

SEQ ID NO: 9417 - protein, 9 aa, Dengue virus
GTIATITPQ

SEQ ID NO: 9418 - protein, 9 aa, Dengue virus
TIATITPQA

SEQ ID NO: 9419 - protein, 9 aa, Dengue virus
IATITPQAP

SEQ ID NO: 9420 - protein, 9 aa, Dengue virus
ATITPQAPS

SEQ ID NO: 9421 - protein, 9 aa, Dengue virus
TITPQAPTS

SEQ ID NO: 9422 - protein, 9 aa, Dengue virus
ITPQAPTSE

SEQ ID NO: 9423 - protein, 9 aa, Dengue virus
TPQAPTSEI

SEQ ID NO: 9424 - protein, 9 aa, Dengue virus
PQAPTSEIQ

SEQ ID NO: 9425 - protein, 9 aa, Dengue virus
QAPTSEIQL

SEQ ID NO: 9426 - protein, 9 aa, Dengue virus
APTSEIQLT

SEQ ID NO: 9427 - protein, 9 aa, Dengue virus
PTSEIQLTD

SEQ ID NO: 9428 - protein, 9 aa, Dengue virus
TSEIQLTDY

SEQ ID NO: 9429 - protein, 9 aa, Dengue virus
SEIQLTDYG

SEQ ID NO: 9430 - protein, 9 aa, Dengue virus
EIQLTDYGT

SEQ ID NO: 9431 - protein, 9 aa, Dengue virus
IQLTDYGTL

SEQ ID NO: 9432 - protein, 9 aa, Dengue virus
QLTDYGTLT

SEQ ID NO: 9433 - protein, 9 aa, Dengue virus
LTDYGTLTL

SEQ ID NO: 9434 - protein, 9 aa, Dengue virus
TDYGTLTLD

SEQ ID NO: 9435 - protein, 9 aa, Dengue virus
DYGTLTLDC

SEQ ID NO: 9436 - protein, 9 aa, Dengue virus
YGTLTLDCS

SEQ ID NO: 9437 - protein, 9 aa, Dengue virus
GTLTLDCSP

SEQ ID NO: 9438 - protein, 9 aa, Dengue virus
TLTLDCSPR

SEQ ID NO: 9439 - protein, 9 aa, Dengue virus
NEMVLLTME

SEQ ID NO: 9440 - protein, 9 aa, Dengue virus
EMVLLTMKK

SEQ ID NO: 9441 - protein, 9 aa, Dengue virus
MVLLTMKKK

SEQ ID NO: 9442 - protein, 9 aa, Dengue virus
VLLTMKKKS

SEQ ID NO: 9443 - protein, 9 aa, Dengue virus
LLTMKKKSW

SEQ ID NO: 9444 - protein, 9 aa, Dengue virus
LTMKKKSWL

SEQ ID NO: 9445 - protein, 9 aa, Dengue virus
TMKKKSWLV

SEQ ID NO: 9446 - protein, 9 aa, Dengue virus
MKKKSWLVH

SEQ ID NO: 9447 - protein, 9 aa, Dengue virus
KKKSWLVHK

SEQ ID NO: 9448 - protein, 9 aa, Dengue virus
KKSWLVHKQ

SEQ ID NO: 9449 - protein, 9 aa, Dengue virus
KAWLVHKQW

SEQ ID NO: 9450 - protein, 9 aa, Dengue virus
PLPWTSGAT

SEQ ID NO: 9451 - protein, 9 aa, Dengue virus
LPWTSGATT

SEQ ID NO: 9452 - protein, 9 aa, Dengue virus
TSQETWNRK

SEQ ID NO: 9453 - protein, 9 aa, Dengue virus
SQETWNRKD

SEQ ID NO: 9454 - protein, 9 aa, Dengue virus
QETWNRKDL

SEQ ID NO: 9455 - protein, 9 aa, Dengue virus
ETWNRKDLL

SEQ ID NO: 9456 - protein, 9 aa, Dengue virus
TWNRKDLLV

SEQ ID NO: 9457 - protein, 9 aa, Dengue virus
WNRKDLLVT

SEQ ID NO: 9458 - protein, 9 aa, Dengue virus
NRKDLLVTF

SEQ ID NO: 9459 - protein, 9 aa, Dengue virus
RKDLLVTFK

SEQ ID NO: 9460 - protein, 9 aa, Dengue virus
KDLLVTFKT

SEQ ID NO: 9461 - protein, 9 aa, Dengue virus
ATEIQTTGT

SEQ ID NO: 9462 - protein, 9 aa, Dengue virus
TEIQTTGTT

SEQ ID NO: 9463 - protein, 9 aa, Dengue virus
EIQTTGTTT

SEQ ID NO: 9464 - protein, 9 aa, Dengue virus
IQTTGTTTI

SEQ ID NO: 9465 - protein, 9 aa, Dengue virus
QTTGTTTIF

SEQ ID NO: 9466 - protein, 9 aa, Dengue virus
TTGTTTIFA

SEQ ID NO: 9467 - protein, 9 aa, Dengue virus
TGTTTIFAG

SEQ ID NO: 9468 - protein, 9 aa, Dengue virus
LKMDKLTLR

SEQ ID NO: 9469 - protein, 9 aa, Dengue virus
KMDKLTLRG

SEQ ID NO: 9470 - protein, 9 aa, Dengue virus
MDKLTLKGT

SEQ ID NO: 9471 - protein, 9 aa, Dengue virus
DKLTLKGTS

SEQ ID NO: 9472 - protein, 9 aa, Dengue virus
KLTLKGTSY

SEQ ID NO: 9473 - protein, 9 aa, Dengue virus
LTLKGTSYV

SEQ ID NO: 9474 - protein, 9 aa, Dengue virus
TLKGTSYVM

SEQ ID NO: 9475 - protein, 9 aa, Dengue virus
LKGTSYVMC

SEQ ID NO: 9476 - protein, 9 aa, Dengue virus
KGTSYVMCT

SEQ ID NO: 9477 - protein, 9 aa, Dengue virus
GTSYVMCTG

SEQ ID NO: 9478 - protein, 9 aa, Dengue virus
SYVMCTGLF

SEQ ID NO: 9479 - protein, 9 aa, Dengue virus
YVMCTGPFK

SEQ ID NO: 9480 - protein, 9 aa, Dengue virus
VMCTGLFKL

SEQ ID NO: 9481 - protein, 9 aa, Dengue virus
MCTGLFKLE

SEQ ID NO: 9482 - protein, 9 aa, Dengue virus
CTGLFKLEK

SEQ ID NO: 9483 - protein, 9 aa, Dengue virus
TGLFKLEKE

SEQ ID NO: 9484 - protein, 9 aa, Dengue virus
GSFKLEKEL

SEQ ID NO: 9485 - protein, 9 aa, Dengue virus
SFKLEKELA

SEQ ID NO: 9486 - protein, 9 aa, Dengue virus
FKLEKELAE

SEQ ID NO: 9487 - protein, 9 aa, Dengue virus
KLEKELAET

SEQ ID NO: 9488 - protein, 9 aa, Dengue virus
LEKELAETQ

SEQ ID NO: 9489 - protein, 9 aa, Dengue virus
EKELAETQH

SEQ ID NO: 9490 - protein, 9 aa, Dengue virus
KELAETQHG

SEQ ID NO: 9491 - protein, 9 aa, Dengue virus
ELAETQHGT

SEQ ID NO: 9492 - protein, 9 aa, Dengue virus
LAETQHGTV

SEQ ID NO: 9493 - protein, 9 aa, Dengue virus
QHGTVLVQV

SEQ ID NO: 9494 - protein, 9 aa, Dengue virus
HGTVLVQVK

SEQ ID NO: 9495 - protein, 9 aa, Dengue virus
GTVLVQVKY

SEQ ID NO: 9496 - protein, 9 aa, Dengue virus
TVLVQVKYE

SEQ ID NO: 9497 - protein, 9 aa, Dengue virus
VLVQVKYEG

SEQ ID NO: 9498 - protein, 9 aa, Dengue virus
LVQVKYEGT

SEQ ID NO: 9499 - protein, 9 aa, Dengue virus
VQVKYEGTD

SEQ ID NO: 9500 - protein, 9 aa, Dengue virus
QVKYEGTDA

SEQ ID NO: 9501 - protein, 9 aa, Dengue virus
VKYEGTDAP

SEQ ID NO: 9502 - protein, 9 aa, Dengue virus
RYEGTDAPC

SEQ ID NO: 9503 - protein, 9 aa, Dengue virus
DAPCKIPFL

SEQ ID NO: 9504 - protein, 9 aa, Dengue virus
APCKIPFLT

SEQ ID NO: 9505 - protein, 9 aa, Dengue virus
PCKIPFLTQ

SEQ ID NO: 9506 - protein, 9 aa, Dengue virus
CKIPFLTQD

SEQ ID NO: 9507 - protein, 9 aa, Dengue virus
KIPFLTQDE

SEQ ID NO: 9508 - protein, 9 aa, Dengue virus
QDEKGVIQN

SEQ ID NO: 9509 - protein, 9 aa, Dengue virus
DEKGVIQNG

SEQ ID NO: 9510 - protein, 9 aa, Dengue virus
EKGVIQNGR

SEQ ID NO: 9511 - protein, 9 aa, Dengue virus
KGVIQNGRL

SEQ ID NO: 9512 - protein, 9 aa, Dengue virus
GVIQNGRLI

SEQ ID NO: 9513 - protein, 9 aa, Dengue virus
VIQNGRLIT

SEQ ID NO: 9514 - protein, 9 aa, Dengue virus
IQNGRLITA

SEQ ID NO: 9515 - protein, 9 aa, Dengue virus
QNGRLVTAN

SEQ ID NO: 9516 - protein, 9 aa, Dengue virus
NGRLVTANP

SEQ ID NO: 9517 - protein, 9 aa, Dengue virus
GRLVTANPI

SEQ ID NO: 9518 - protein, 9 aa, Dengue virus
RLVTANPIV

SEQ ID NO: 9519 - protein, 9 aa, Dengue virus
LVTANPIVT

SEQ ID NO: 9520 - protein, 9 aa, Dengue virus
VTANPIVTD

SEQ ID NO: 9521 - protein, 9 aa, Dengue virus
TANPIVTDR

SEQ ID NO: 9522 - protein, 9 aa, Dengue virus
ANPIVTDKD

SEQ ID NO: 9523 - protein, 9 aa, Dengue virus
NPIVTDKDK

SEQ ID NO: 9524 - protein, 9 aa, Dengue virus
PIVTDKDKP

SEQ ID NO: 9525 - protein, 9 aa, Dengue virus
IVTDKDKPV

SEQ ID NO: 9526 - protein, 9 aa, Dengue virus
VTDKDKPVN

SEQ ID NO: 9527 - protein, 9 aa, Dengue virus
TDKDKPVNI

SEQ ID NO: 9528 - protein, 9 aa, Dengue virus
DKDKPVNIE

SEQ ID NO: 9529 - protein, 9 aa, Dengue virus
KEKPVNIET

SEQ ID NO: 9530 - protein, 9 aa, Dengue virus
EKPVNIETE

SEQ ID NO: 9531 - protein, 9 aa, Dengue virus
KPVNIETEP

SEQ ID NO: 9532 - protein, 9 aa, Dengue virus
PVNIETEPP

SEQ ID NO: 9533 - protein, 9 aa, Dengue virus
VNIETEPPF

SEQ ID NO: 9534 - protein, 9 aa, Dengue virus
NIETEPPFG

SEQ ID NO: 9535 - protein, 9 aa, Dengue virus
IETEPPFGE

SEQ ID NO: 9536 - protein, 9 aa, Dengue virus
ETEPPFGES

SEQ ID NO: 9537 - protein, 9 aa, Dengue virus
TEPPFGESY

SEQ ID NO: 9538 - protein, 9 aa, Dengue virus
PPFGESYII

SEQ ID NO: 9539 - protein, 9 aa, Dengue virus
PFGESYIVV

SEQ ID NO: 9540 - protein, 9 aa, Dengue virus
FGESYIVVG

SEQ ID NO: 9541 - protein, 9 aa, Dengue virus
VGAGEKALK

SEQ ID NO: 9542 - protein, 9 aa, Dengue virus
GVGEKALKL

SEQ ID NO: 9543 - protein, 9 aa, Dengue virus
VGEKALKLS

SEQ ID NO: 9544 - protein, 9 aa, Dengue virus
GEKTLKLSW

SEQ ID NO: 9545 - protein, 9 aa, Dengue virus
EKTLKLSWF

SEQ ID NO: 9546 - protein, 9 aa, Dengue virus
KTLKLSWFK

SEQ ID NO: 9547 - protein, 9 aa, Dengue virus
ALKLSWFKR

SEQ ID NO: 9548 - protein, 9 aa, Dengue virus
LKLSWFKRG

SEQ ID NO: 9549 - protein, 9 aa, Dengue virus
KLSWFKRGS

SEQ ID NO: 9550 - protein, 9 aa, Dengue virus
LSWFKRGSS

SEQ ID NO: 9551 - protein, 9 aa, Dengue virus
SWFKRGSSI

SEQ ID NO: 9552 - protein, 9 aa, Dengue virus
WFKRGSSIG

SEQ ID NO: 9553 - protein, 9 aa, Dengue virus
FKRGSSIGK

SEQ ID NO: 9554 - protein, 9 aa, Dengue virus
KRGSSIGKM

SEQ ID NO: 9555 - protein, 9 aa, Dengue virus
RGSSIGKMF

SEQ ID NO: 9556 - protein, 9 aa, Dengue virus
GSTIGKMFE

SEQ ID NO: 9557 - protein, 9 aa, Dengue virus
STIGKMFEA

SEQ ID NO: 9558 - protein, 9 aa, Dengue virus
TIGKMFEAT

SEQ ID NO: 9559 - protein, 9 aa, Dengue virus
IGKMFVATA

SEQ ID NO: 9560 - protein, 9 aa, Dengue virus
GKMFVATAR

SEQ ID NO: 9561 - protein, 9 aa, Dengue virus
KMFVATARG

SEQ ID NO: 9562 - protein, 9 aa, Dengue virus
DTAWDFGSV

SEQ ID NO: 9563 - protein, 9 aa, Dengue virus
TAWDFGSVG

SEQ ID NO: 9564 - protein, 9 aa, Dengue virus
AWDFGSVGG

SEQ ID NO: 9565 - protein, 9 aa, Dengue virus
WDFGSVGGV

SEQ ID NO: 9566 - protein, 9 aa, Dengue virus
DFGSVGGVF

SEQ ID NO: 9567 - protein, 9 aa, Dengue virus
FGSVGGVFT

SEQ ID NO: 9568 - protein, 9 aa, Dengue virus
GSVGGVFTS

SEQ ID NO: 9569 - protein, 9 aa, Dengue virus
GGVFTSIGK

SEQ ID NO: 9570 - protein, 9 aa, Dengue virus
GVFTSIGKL

SEQ ID NO: 9571 - protein, 9 aa, Dengue virus
FTSVGKLIH

SEQ ID NO: 9572 - protein, 9 aa, Dengue virus
TSVGKLIHQ

SEQ ID NO: 9573 - protein, 9 aa, Dengue virus
GKLVHQVFG

SEQ ID NO: 9574 - protein, 9 aa, Dengue virus
KLVHQVFGT

SEQ ID NO: 9575 - protein, 9 aa, Dengue virus
LVHQVFGTA

SEQ ID NO: 9576 - protein, 9 aa, Dengue virus
VHQVFGTAY

SEQ ID NO: 9577 - protein, 9 aa, Dengue virus
HQVFGTAYG

SEQ ID NO: 9578 - protein, 9 aa, Dengue virus
QVFGTAYGV

SEQ ID NO: 9579 - protein, 9 aa, Dengue virus
VFGTAYGVL

SEQ ID NO: 9580 - protein, 9 aa, Dengue virus
FGAAYGVLF

SEQ ID NO: 9581 - protein, 9 aa, Dengue virus
GAAYGVLFS

SEQ ID NO: 9582 - protein, 9 aa, Dengue virus
AAYGVLFSG

SEQ ID NO: 9583 - protein, 9 aa, Dengue virus
VSWTMKIGL

SEQ ID NO: 9584 - protein, 9 aa, Dengue virus
SWTMKIGLG

SEQ ID NO: 9585 - protein, 9 aa, Dengue virus
WTMKIGIGI

SEQ ID NO: 9586 - protein, 9 aa, Dengue virus
TMKIGIGIL

SEQ ID NO: 9587 - protein, 9 aa, Dengue virus
MKIGIGILL

SEQ ID NO: 9588 - protein, 9 aa, Dengue virus
KIGIGILLT

SEQ ID NO: 9589 - protein, 9 aa, Dengue virus
IGIGILLTW

SEQ ID NO: 9590 - protein, 9 aa, Dengue virus
GIGILLTWL

SEQ ID NO: 9591 - protein, 9 aa, Dengue virus
IGILLTWLG

SEQ ID NO: 9592 - protein, 9 aa, Dengue virus
GILLTWLGL

SEQ ID NO: 9593 - protein, 9 aa, Dengue virus
ILLTWLGLN

SEQ ID NO: 9594 - protein, 9 aa, Dengue virus
TWLGLNSRN

SEQ ID NO: 9595 - protein, 9 aa, Dengue virus
WLGLNSRSA

SEQ ID NO: 9596 - protein, 9 aa, Dengue virus
LGLNSRSAS

SEQ ID NO: 9597 - protein, 9 aa, Dengue virus
GLNSRSTSF

SEQ ID NO: 9598 - protein, 9 aa, Dengue virus
LNSRSTSFS

SEQ ID NO: 9599 - protein, 9 aa, Dengue virus
NSRSTSFSM

SEQ ID NO: 9600 - protein, 9 aa, Dengue virus
SRSTSFSMT

SEQ ID NO: 9601 - protein, 9 aa, Dengue virus
RSTSFSMTC

SEQ ID NO: 9602 - protein, 9 aa, Dengue virus
STSFSMTCI

SEQ ID NO: 9603 - protein, 9 aa, Dengue virus
TSFSMTCIA

SEQ ID NO: 9604 - protein, 9 aa, Dengue virus
SFSMTCIAV

SEQ ID NO: 9605 - protein, 9 aa, Dengue virus
FSMTCIAVG

SEQ ID NO: 9606 - protein, 9 aa, Dengue virus
SMTCIAVGM

SEQ ID NO: 9607 - protein, 9 aa, Dengue virus
MTCIAVGMV

SEQ ID NO: 9608 - protein, 9 aa, Dengue virus
TCIAVGMVT

SEQ ID NO: 9609 - protein, 9 aa, Dengue virus
CIAVGMVTL

SEQ ID NO: 9610 - protein, 9 aa, Dengue virus
IAVGMVTLY

SEQ ID NO: 9611 - protein, 9 aa, Dengue virus
AVGMVTLYL

SEQ ID NO: 9612 - protein, 9 aa, Dengue virus
VGMVTLYLG

SEQ ID NO: 9613 - protein, 9 aa, Dengue virus
GMVTLYLGV

SEQ ID NO: 9614 - protein, 9 aa, Dengue virus
MVTLYLGVM

SEQ ID NO: 9615 - protein, 9 aa, Dengue virus
ITLYLGVMV

SEQ ID NO: 9616 - protein, 9 aa, Dengue virus
TLYLGAMVQ

SEQ ID NO: 9617 - protein, 9 aa, Dengue virus
LYLGAMVQA

SEQ ID NO: 9618 - protein, 9 aa, Dengue virus
YLGAMVQAD

SEQ ID NO: 9619 - protein, 9 aa, Dengue virus
LGAMVQADS

SEQ ID NO: 9620 - protein, 9 aa, Dengue virus
GAMVQADSG

SEQ ID NO: 9621 - protein, 9 aa, Dengue virus
AMVQADSGC

SEQ ID NO: 9622 - protein, 9 aa, Dengue virus
VQADSGCVV

SEQ ID NO: 9623 - protein, 9 aa, Dengue virus
QADSGCVVN

SEQ ID NO: 9624 - protein, 9 aa, Dengue virus
ADSGCVVNW

SEQ ID NO: 9625 - protein, 9 aa, Dengue virus
DSGCVVNWK

SEQ ID NO: 9626 - protein, 9 aa, Dengue virus
SGCVVNWKG

SEQ ID NO: 9627 - protein, 9 aa, Dengue virus
GCVVNWKGR

SEQ ID NO: 9628 - protein, 9 aa, Dengue virus
CVVNWKGRE

SEQ ID NO: 9629 - protein, 9 aa, Dengue virus
VVNWKGREL

SEQ ID NO: 9630 - protein, 9 aa, Dengue virus
KRLSAAIGR

SEQ ID NO: 9631 - protein, 9 aa, Dengue virus
RLSAAIGRA

SEQ ID NO: 9632 - protein, 9 aa, Dengue virus
LSAAIGRAW

SEQ ID NO: 9633 - protein, 9 aa, Dengue virus
SAAIGRAWE

SEQ ID NO: 9634 - protein, 9 aa, Dengue virus
AAIGRAWEE

SEQ ID NO: 9635 - protein, 9 aa, Dengue virus
AIGRAWEEG

SEQ ID NO: 9636 - protein, 9 aa, Dengue virus
IGRAWEEGV

SEQ ID NO: 9637 - protein, 9 aa, Dengue virus
GRAWEEGVC

SEQ ID NO: 9638 - protein, 9 aa, Dengue virus
RAWEEGVCG

SEQ ID NO: 9639 - protein, 9 aa, Dengue virus
EGVCGIRST

SEQ ID NO: 9640 - protein, 9 aa, Dengue virus
GVCGIRSTT

SEQ ID NO: 9641 - protein, 9 aa, Dengue virus
VCGIRSTTR

SEQ ID NO: 9642 - protein, 9 aa, Dengue virus
CGIRSTTRL

SEQ ID NO: 9643 - protein, 9 aa, Dengue virus
GIRSTTRLE

SEQ ID NO: 9644 - protein, 9 aa, Dengue virus
IRSTTRLEN

SEQ ID NO: 9645 - protein, 9 aa, Dengue virus
RSTTRLENI

SEQ ID NO: 9646 - protein, 9 aa, Dengue virus
STTRLENIM

SEQ ID NO: 9647 - protein, 9 aa, Dengue virus
TTRLENIMW

SEQ ID NO: 9648 - protein, 9 aa, Dengue virus
TRLENIMWR

SEQ ID NO: 9649 - protein, 9 aa, Dengue virus
RLENIMWRQ

SEQ ID NO: 9650 - protein, 9 aa, Dengue virus
LENIMWRQI

SEQ ID NO: 9651 - protein, 9 aa, Dengue virus
ENIMWRQIS

SEQ ID NO: 9652 - protein, 9 aa, Dengue virus
NIMWRQISN

SEQ ID NO: 9653 - protein, 9 aa, Dengue virus
IMWRQISNE

SEQ ID NO: 9654 - protein, 9 aa, Dengue virus
MWRQISNEL

SEQ ID NO: 9655 - protein, 9 aa, Dengue virus
WRQISNELN

SEQ ID NO: 9656 - protein, 9 aa, Dengue virus
RQISNELNH

SEQ ID NO: 9657 - protein, 9 aa, Dengue virus
QISNELNYI

SEQ ID NO: 9658 - protein, 9 aa, Dengue virus
ISNELNYIL

SEQ ID NO: 9659 - protein, 9 aa, Dengue virus
SNELNYILL

SEQ ID NO: 9660 - protein, 9 aa, Dengue virus
NELNYILLE

SEQ ID NO: 9661 - protein, 9 aa, Dengue virus
ELNYILLEN

SEQ ID NO: 9662 - protein, 9 aa, Dengue virus
LNHILLENG

SEQ ID NO: 9663 - protein, 9 aa, Dengue virus
NHILLENGM

SEQ ID NO: 9664 - protein, 9 aa, Dengue virus
HILLENGMK

SEQ ID NO: 9665 - protein, 9 aa, Dengue virus
ILLENDMKL

SEQ ID NO: 9666 - protein, 9 aa, Dengue virus
LLENDMKLT

SEQ ID NO: 9667 - protein, 9 aa, Dengue virus
LENDMKLTV

SEQ ID NO: 9668 - protein, 9 aa, Dengue virus
ENDMKLTVV

SEQ ID NO: 9669 - protein, 9 aa, Dengue virus
NDMKLTVVV

SEQ ID NO: 9670 - protein, 9 aa, Dengue virus
DMKLTVVVG

SEQ ID NO: 9671 - protein, 9 aa, Dengue virus
MKLTVVVGD

SEQ ID NO: 9672 - protein, 9 aa, Dengue virus
KFTVVVGDA

SEQ ID NO: 9673 - protein, 9 aa, Dengue virus
QGKKTIRPQ

SEQ ID NO: 9674 - protein, 9 aa, Dengue virus
GKKTIRPQP

SEQ ID NO: 9675 - protein, 9 aa, Dengue virus
KKTIRPQPM

SEQ ID NO: 9676 - protein, 9 aa, Dengue virus
KTIRPQPME

SEQ ID NO: 9677 - protein, 9 aa, Dengue virus
MIRPQPMEH

SEQ ID NO: 9678 - protein, 9 aa, Dengue virus
IRPQPMEHK

SEQ ID NO: 9679 - protein, 9 aa, Dengue virus
RPQPMEHKY

SEQ ID NO: 9680 - protein, 9 aa, Dengue virus
PQPMEHKYS

SEQ ID NO: 9681 - protein, 9 aa, Dengue virus
QPMEHKYSW

SEQ ID NO: 9682 - protein, 9 aa, Dengue virus
PMEHKYSWK

SEQ ID NO: 9683 - protein, 9 aa, Dengue virus
MEHKYSWKS

SEQ ID NO: 9684 - protein, 9 aa, Dengue virus
EHKYSWKSW

SEQ ID NO: 9685 - protein, 9 aa, Dengue virus
HKYSWKSWG

SEQ ID NO: 9686 - protein, 9 aa, Dengue virus
RYSWKSWGK

SEQ ID NO: 9687 - protein, 9 aa, Dengue virus
YSWRSWGKA

SEQ ID NO: 9688 - protein, 9 aa, Dengue virus
SWKIWGKAK

SEQ ID NO: 9689 - protein, 9 aa, Dengue virus
WKIWGKAKI

SEQ ID NO: 9690 - protein, 9 aa, Dengue virus
RSWGKAKII

SEQ ID NO: 9691 - protein, 9 aa, Dengue virus
IWGKAKIIG

SEQ ID NO: 9692 - protein, 9 aa, Dengue virus
KAKIIGADI

SEQ ID NO: 9693 - protein, 9 aa, Dengue virus
AKIIGADIQ

SEQ ID NO: 9694 - protein, 9 aa, Dengue virus
KIIGADIQN

SEQ ID NO: 9695 - protein, 9 aa, Dengue virus
QNSTFIIDG

SEQ ID NO: 9696 - protein, 9 aa, Dengue virus
NSTFIIDGP

SEQ ID NO: 9697 - protein, 9 aa, Dengue virus
TFIIDGPDT

SEQ ID NO: 9698 - protein, 9 aa, Dengue virus
FIIDGPDTP

SEQ ID NO: 9699 - protein, 9 aa, Dengue virus
IIDGPDTPE

SEQ ID NO: 9700 - protein, 9 aa, Dengue virus
IDGPDTPEC

SEQ ID NO: 9701 - protein, 9 aa, Dengue virus
DGPDTPECP

SEQ ID NO: 9702 - protein, 9 aa, Dengue virus
GPDTPECPD

SEQ ID NO: 9703 - protein, 9 aa, Dengue virus
ECPDNQRAW

SEQ ID NO: 9704 - protein, 9 aa, Dengue virus
CPDNQRAWN

SEQ ID NO: 9705 - protein, 9 aa, Dengue virus
PDNQRAWNI

SEQ ID NO: 9706 - protein, 9 aa, Dengue virus
DNQRAWNIW

SEQ ID NO: 9707 - protein, 9 aa, Dengue virus
NQRAWNIWE

SEQ ID NO: 9708 - protein, 9 aa, Dengue virus
EVEDYGFGV

SEQ ID NO: 9709 - protein, 9 aa, Dengue virus
VEDYGFGVF

SEQ ID NO: 9710 - protein, 9 aa, Dengue virus
EDYGFGVFT

SEQ ID NO: 9711 - protein, 9 aa, Dengue virus
DYGFGVFTT

SEQ ID NO: 9712 - protein, 9 aa, Dengue virus
YGFGVFTTN

SEQ ID NO: 9713 - protein, 9 aa, Dengue virus
GFGVFTTNI

SEQ ID NO: 9714 - protein, 9 aa, Dengue virus
FGVFTTNIW

SEQ ID NO: 9715 - protein, 9 aa, Dengue virus
GVFTTNIWL

SEQ ID NO: 9716 - protein, 9 aa, Dengue virus
VFTTNIWLK

SEQ ID NO: 9717 - protein, 9 aa, Dengue virus
FTTNIWLKM

SEQ ID NO: 9718 - protein, 9 aa, Dengue virus
TTNIWLKMR

SEQ ID NO: 9719 - protein, 9 aa, Dengue virus
TNIWLKMRD

SEQ ID NO: 9720 - protein, 9 aa, Dengue virus
NIWLKMRDS

SEQ ID NO: 9721 - protein, 9 aa, Dengue virus
IWLKLRDSH

SEQ ID NO: 9722 - protein, 9 aa, Dengue virus
WLKLRDSHT

SEQ ID NO: 9723 - protein, 9 aa, Dengue virus
LKLRDSHTQ

SEQ ID NO: 9724 - protein, 9 aa, Dengue virus
RDSYTQMCD

SEQ ID NO: 9725 - protein, 9 aa, Dengue virus
DSYTQMCDH

SEQ ID NO: 9726 - protein, 9 aa, Dengue virus
SYTQMCDHR

SEQ ID NO: 9727 - protein, 9 aa, Dengue virus
YTQMCDHRL

SEQ ID NO: 9728 - protein, 9 aa, Dengue virus
TQMCDHRLM

SEQ ID NO: 9729 - protein, 9 aa, Dengue virus
QMCDHRLMS

SEQ ID NO: 9730 - protein, 9 aa, Dengue virus
MCDHRLMSA

SEQ ID NO: 9731 - protein, 9 aa, Dengue virus
MGYWIESER

SEQ ID NO: 9732 - protein, 9 aa, Dengue virus
GYWIESERN

SEQ ID NO: 9733 - protein, 9 aa, Dengue virus
YWIESERNE

SEQ ID NO: 9734 - protein, 9 aa, Dengue virus
WIESERNET

SEQ ID NO: 9735 - protein, 9 aa, Dengue virus
IESERNETW

SEQ ID NO: 9736 - protein, 9 aa, Dengue virus
ESERNETWK

SEQ ID NO: 9737 - protein, 9 aa, Dengue virus
SERNETWKL

SEQ ID NO: 9738 - protein, 9 aa, Dengue virus
ERNETWKLA

SEQ ID NO: 9739 - protein, 9 aa, Dengue virus
NETWKLAKA

SEQ ID NO: 9740 - protein, 9 aa, Dengue virus
ETWKLAKAS

SEQ ID NO: 9741 - protein, 9 aa, Dengue virus
TWKLAKASF

SEQ ID NO: 9742 - protein, 9 aa, Dengue virus
WKLAKASFI

SEQ ID NO: 9743 - protein, 9 aa, Dengue virus
KLAKASFIE

SEQ ID NO: 9744 - protein, 9 aa, Dengue virus
LAKASFIEV

SEQ ID NO: 9745 - protein, 9 aa, Dengue virus
AKASFIEVK

SEQ ID NO: 9746 - protein, 9 aa, Dengue virus
KASFIEVKT

SEQ ID NO: 9747 - protein, 9 aa, Dengue virus
SFIEVKTCT

SEQ ID NO: 9748 - protein, 9 aa, Dengue virus
FIEVKTCTW

SEQ ID NO: 9749 - protein, 9 aa, Dengue virus
IEVKTCTWP

SEQ ID NO: 9750 - protein, 9 aa, Dengue virus
EVKTCTWPK

SEQ ID NO: 9751 - protein, 9 aa, Dengue virus
VKTCTWPKS

SEQ ID NO: 9752 - protein, 9 aa, Dengue virus
KTCTWPKSH

SEQ ID NO: 9753 - protein, 9 aa, Dengue virus
TCTWPKSHT

SEQ ID NO: 9754 - protein, 9 aa, Dengue virus
CTWPKSHTL

SEQ ID NO: 9755 - protein, 9 aa, Dengue virus
TWPKSHTLW

SEQ ID NO: 9756 - protein, 9 aa, Dengue virus
NGVLESEMV

SEQ ID NO: 9757 - protein, 9 aa, Dengue virus
GVLESEMVI

SEQ ID NO: 9758 - protein, 9 aa, Dengue virus
VLESEMVIP

SEQ ID NO: 9759 - protein, 9 aa, Dengue virus
LESEMVIPK

SEQ ID NO: 9760 - protein, 9 aa, Dengue virus
ESEMVIPKI

SEQ ID NO: 9761 - protein, 9 aa, Dengue virus
SEMIIPKIH

SEQ ID NO: 9762 - protein, 9 aa, Dengue virus
EMIIPKIHG

SEQ ID NO: 9763 - protein, 9 aa, Dengue virus
MIIPKIHGG

SEQ ID NO: 9764 - protein, 9 aa, Dengue virus
IIPKIHGGP

SEQ ID NO: 9765 - protein, 9 aa, Dengue virus
PKIHGGPIS

SEQ ID NO: 9766 - protein, 9 aa, Dengue virus
KIHGGPISQ

SEQ ID NO: 9767 - protein, 9 aa, Dengue virus
IHGGPISQH

SEQ ID NO: 9768 - protein, 9 aa, Dengue virus
HGGPISQHN

SEQ ID NO: 9769 - protein, 9 aa, Dengue virus
GGPTSQHNY

SEQ ID NO: 9770 - protein, 9 aa, Dengue virus
GPTSQHNYR

SEQ ID NO: 9771 - protein, 9 aa, Dengue virus
PTSQHNYRP

SEQ ID NO: 9772 - protein, 9 aa, Dengue virus
TSQHNYRPG

SEQ ID NO: 9773 - protein, 9 aa, Dengue virus
QHNHRPGYF

SEQ ID NO: 9774 - protein, 9 aa, Dengue virus
HNHRPGYFT

SEQ ID NO: 9775 - protein, 9 aa, Dengue virus
NHRPGYFTQ

SEQ ID NO: 9776 - protein, 9 aa, Dengue virus
YRPGYFTQA

SEQ ID NO: 9777 - protein, 9 aa, Dengue virus
RPGYFTQAA

SEQ ID NO: 9778 - protein, 9 aa, Dengue virus
PGYFTQAAG

SEQ ID NO: 9779 - protein, 9 aa, Dengue virus
GYFTQAAGP

SEQ ID NO: 9780 - protein, 9 aa, Dengue virus
YFTQAAGPW

SEQ ID NO: 9781 - protein, 9 aa, Dengue virus
FTQAAGPWH

SEQ ID NO: 9782 - protein, 9 aa, Dengue virus
TQAAGPWHL

SEQ ID NO: 9783 - protein, 9 aa, Dengue virus
QAAGPWHLG

SEQ ID NO: 9784 - protein, 9 aa, Dengue virus
AAGPWHLGK

SEQ ID NO: 9785 - protein, 9 aa, Dengue virus
LGKLELDFN

SEQ ID NO: 9786 - protein, 9 aa, Dengue virus
GKLELDFNL

SEQ ID NO: 9787 - protein, 9 aa, Dengue virus
KLELDFNLC

SEQ ID NO: 9788 - protein, 9 aa, Dengue virus
LELDFNLCE

SEQ ID NO: 9789 - protein, 9 aa, Dengue virus
ELDFNLCEG

SEQ ID NO: 9790 - protein, 9 aa, Dengue virus
LDFNLCEGT

SEQ ID NO: 9791 - protein, 9 aa, Dengue virus
DFNLCEGTT

SEQ ID NO: 9792 - protein, 9 aa, Dengue virus
FNLCEGTTV

SEQ ID NO: 9793 - protein, 9 aa, Dengue virus
NLCEGTTVV

SEQ ID NO: 9794 - protein, 9 aa, Dengue virus
FCEGTTVVV

SEQ ID NO: 9795 - protein, 9 aa, Dengue virus
VVVDEHCGS

SEQ ID NO: 9796 - protein, 9 aa, Dengue virus
VVDEHCGSR

SEQ ID NO: 9797 - protein, 9 aa, Dengue virus
VDEHCGSRG

SEQ ID NO: 9798 - protein, 9 aa, Dengue virus
DEHCGSRGP

SEQ ID NO: 9799 - protein, 9 aa, Dengue virus
EHCGYRGPS

SEQ ID NO: 9800 - protein, 9 aa, Dengue virus
HCGSRGPSL

SEQ ID NO: 9801 - protein, 9 aa, Dengue virus
CGYRGPSLR

SEQ ID NO: 9802 - protein, 9 aa, Dengue virus
GYRGPSLRT

SEQ ID NO: 9803 - protein, 9 aa, Dengue virus
SRGPSLRTT

SEQ ID NO: 9804 - protein, 9 aa, Dengue virus
RTTTVTGKT

SEQ ID NO: 9805 - protein, 9 aa, Dengue virus
TTTVTGKTI

SEQ ID NO: 9806 - protein, 9 aa, Dengue virus
TTVTGKTIH

SEQ ID NO: 9807 - protein, 9 aa, Dengue virus
TVTGKTIHE

SEQ ID NO: 9808 - protein, 9 aa, Dengue virus
VTGKTIHEW

SEQ ID NO: 9809 - protein, 9 aa, Dengue virus
TGKTIHEWC

SEQ ID NO: 9810 - protein, 9 aa, Dengue virus
GKTIHEWCC

SEQ ID NO: 9811 - protein, 9 aa, Dengue virus
KTIHEWCCR

SEQ ID NO: 9812 - protein, 9 aa, Dengue virus
TIHEWCCRS

SEQ ID NO: 9813 - protein, 9 aa, Dengue virus
CTLPPLRFK

SEQ ID NO: 9814 - protein, 9 aa, Dengue virus
TLPPLRFKG

SEQ ID NO: 9815 - protein, 9 aa, Dengue virus
LPPLRFKGE

SEQ ID NO: 9816 - protein, 9 aa, Dengue virus
PPLRFKGED

SEQ ID NO: 9817 - protein, 9 aa, Dengue virus
PLRFKGEDG

SEQ ID NO: 9818 - protein, 9 aa, Dengue virus
LRFKGEDGC

SEQ ID NO: 9819 - protein, 9 aa, Dengue virus
RFKGEDGCW

SEQ ID NO: 9820 - protein, 9 aa, Dengue virus
FKGEDGCWY

SEQ ID NO: 9821 - protein, 9 aa, Dengue virus
KGEDGCWYG

SEQ ID NO: 9822 - protein, 9 aa, Dengue virus
GMEIRPVKD

SEQ ID NO: 9823 - protein, 9 aa, Dengue virus
MEIRPVKDK

SEQ ID NO: 9824 - protein, 9 aa, Dengue virus
EIRPVKDKE

SEQ ID NO: 9825 - protein, 9 aa, Dengue virus
IRPVKDKEE

SEQ ID NO: 9826 - protein, 9 aa, Dengue virus
RPVKDKEEN

SEQ ID NO: 9827 - protein, 9 aa, Dengue virus
PVKDKEENL

SEQ ID NO: 9828 - protein, 9 aa, Dengue virus
VKDKEENLV

SEQ ID NO: 9829 - protein, 9 aa, Dengue virus
KEKEENLVR

SEQ ID NO: 9830 - protein, 9 aa, Dengue virus
EKEENLVRS

SEQ ID NO: 9831 - protein, 9 aa, Dengue virus
KEENLVRSM

SEQ ID NO: 9832 - protein, 9 aa, Dengue virus
EENLVRSMV

SEQ ID NO: 9833 - protein, 9 aa, Dengue virus
ENLVRSMVS

SEQ ID NO: 9834 - protein, 9 aa, Dengue virus
NLVRSMVSA

SEQ ID NO: 9835 - protein, 9 aa, Dengue virus
LVRSMVSAG

SEQ ID NO: 9836 - protein, 9 aa, Dengue virus
VRSMVSAGS

SEQ ID NO: 9837 - protein, 9 aa, Dengue virus
RSMVSAGSG

SEQ ID NO: 9838 - protein, 9 aa, Dengue virus
SMVSAGLGE

SEQ ID NO: 9839 - protein, 9 aa, Dengue virus
MVSAGLGEV

SEQ ID NO: 9840 - protein, 9 aa, Dengue virus
VSAGLGEVD

SEQ ID NO: 9841 - protein, 9 aa, Dengue virus
SAGLGEVDS

SEQ ID NO: 9842 - protein, 9 aa, Dengue virus
AGLGEVDSF

SEQ ID NO: 9843 - protein, 9 aa, Dengue virus
GLGEVDSFS

SEQ ID NO: 9844 - protein, 9 aa, Dengue virus
LGEVDSFSL

SEQ ID NO: 9845 - protein, 9 aa, Dengue virus
EVDSFSLGI

SEQ ID NO: 9846 - protein, 9 aa, Dengue virus
VDSFSLGIL

SEQ ID NO: 9847 - protein, 9 aa, Dengue virus
DSFSLGILC

SEQ ID NO: 9848 - protein, 9 aa, Dengue virus
FSLGILCVS

SEQ ID NO: 9849 - protein, 9 aa, Dengue virus
SLGILCVSI

SEQ ID NO: 9850 - protein, 9 aa, Dengue virus
SILIEEVMR

SEQ ID NO: 9851 - protein, 9 aa, Dengue virus
ILIEEVMRS

SEQ ID NO: 9852 - protein, 9 aa, Dengue virus
LIEEVMRSR

SEQ ID NO: 9853 - protein, 9 aa, Dengue virus
TEEVMRSRW

SEQ ID NO: 9854 - protein, 9 aa, Dengue virus
EVMRSRWSK

SEQ ID NO: 9855 - protein, 9 aa, Dengue virus
VMRSRWSRR

SEQ ID NO: 9856 - protein, 9 aa, Dengue virus
MRSRWSRRM

SEQ ID NO: 9857 - protein, 9 aa, Dengue virus
RSRWSRRML

SEQ ID NO: 9858 - protein, 9 aa, Dengue virus
SRWSRRMLM

SEQ ID NO: 9859 - protein, 9 aa, Dengue virus
RWSRRMLMT

SEQ ID NO: 9860 - protein, 9 aa, Dengue virus
WSRRMLMTG

SEQ ID NO: 9861 - protein, 9 aa, Dengue virus
SRRMLMTGT

SEQ ID NO: 9862 - protein, 9 aa, Dengue virus
RRMLMTGTL

SEQ ID NO: 9863 - protein, 9 aa, Dengue virus
RMLMTGTLA

SEQ ID NO: 9864 - protein, 9 aa, Dengue virus
MLMTGTLVV

SEQ ID NO: 9865 - protein, 9 aa, Dengue virus
LMTGTLVVF

SEQ ID NO: 9866 - protein, 9 aa, Dengue virus
GTLAVFLLL

SEQ ID NO: 9867 - protein, 9 aa, Dengue virus
GQLTWSDLI

SEQ ID NO: 9868 - protein, 9 aa, Dengue virus
QLTWSDLIR

SEQ ID NO: 9869 - protein, 9 aa, Dengue virus
LTWNDLIRS

SEQ ID NO: 9870 - protein, 9 aa, Dengue virus
TWNDLIRSC

SEQ ID NO: 9871 - protein, 9 aa, Dengue virus
WNDLIRSCI

SEQ ID NO: 9872 - protein, 9 aa, Dengue virus
NDLIRSCIM

SEQ ID NO: 9873 - protein, 9 aa, Dengue virus
DLIRSCIMV

SEQ ID NO: 9874 - protein, 9 aa, Dengue virus
LIRSCIMVG

SEQ ID NO: 9875 - protein, 9 aa, Dengue virus
IRSCIMVGA

SEQ ID NO: 9876 - protein, 9 aa, Dengue virus
RSCIMVGAN

SEQ ID NO: 9877 - protein, 9 aa, Dengue virus
SCIMVGANA

SEQ ID NO: 9878 - protein, 9 aa, Dengue virus
CIMVGANAF

SEQ ID NO: 9879 - protein, 9 aa, Dengue virus
IMVGANAFD

SEQ ID NO: 9880 - protein, 9 aa, Dengue virus
MVGANASDK

SEQ ID NO: 9881 - protein, 9 aa, Dengue virus
VGANASDKM

SEQ ID NO: 9882 - protein, 9 aa, Dengue virus
GANASDKMG

SEQ ID NO: 9883 - protein, 9 aa, Dengue virus
ANASDKMGM

SEQ ID NO: 9884 - protein, 9 aa, Dengue virus
NASDKMGMG

SEQ ID NO: 9885 - protein, 9 aa, Dengue virus
SDKMGMGTT

SEQ ID NO: 9886 - protein, 9 aa, Dengue virus
DKMGMGTTY

SEQ ID NO: 9887 - protein, 9 aa, Dengue virus
KMGMGTTYL

SEQ ID NO: 9888 - protein, 9 aa, Dengue virus
MGMGMTYLA

SEQ ID NO: 9889 - protein, 9 aa, Dengue virus
GMGMTYLAL

SEQ ID NO: 9890 - protein, 9 aa, Dengue virus
MGMTYLALM

SEQ ID NO: 9891 - protein, 9 aa, Dengue virus
GMTYLALMA

SEQ ID NO: 9892 - protein, 9 aa, Dengue virus
MTYLALMAT

SEQ ID NO: 9893 - protein, 9 aa, Dengue virus
YLALMATFR

SEQ ID NO: 9894 - protein, 9 aa, Dengue virus
LALMATFRM

SEQ ID NO: 9895 - protein, 9 aa, Dengue virus
ALMATFRMR

SEQ ID NO: 9896 - protein, 9 aa, Dengue virus
LMATFRMRP

SEQ ID NO: 9897 - protein, 9 aa, Dengue virus
MATFRMRPM

SEQ ID NO: 9898 - protein, 9 aa, Dengue virus
ATFRMRPMF

SEQ ID NO: 9899 - protein, 9 aa, Dengue virus
TFRMRPMFA

SEQ ID NO: 9900 - protein, 9 aa, Dengue virus
FRMRPMFAV

SEQ ID NO: 9901 - protein, 9 aa, Dengue virus
RMRPMFAVG

SEQ ID NO: 9902 - protein, 9 aa, Dengue virus
MRPMLAVGL

SEQ ID NO: 9903 - protein, 9 aa, Dengue virus
RPMLAVGLL

SEQ ID NO: 9904 - protein, 9 aa, Dengue virus
PMLAVGLLF

SEQ ID NO: 9905 - protein, 9 aa, Dengue virus
MLAVGLLFR

SEQ ID NO: 9906 - protein, 9 aa, Dengue virus
LAVGLLFRR

SEQ ID NO: 9907 - protein, 9 aa, Dengue virus
AVGLLIRRL

SEQ ID NO: 9908 - protein, 9 aa, Dengue virus
VGLLIRRLT

SEQ ID NO: 9909 - protein, 9 aa, Dengue virus
GLLIRRLTS

SEQ ID NO: 9910 - protein, 9 aa, Dengue virus
LLIRRLTSR

SEQ ID NO: 9911 - protein, 9 aa, Dengue virus
LIRRLTSRE

SEQ ID NO: 9912 - protein, 9 aa, Dengue virus
IRRLTSREV

SEQ ID NO: 9913 - protein, 9 aa, Dengue virus
SREVLLLTV

SEQ ID NO: 9914 - protein, 9 aa, Dengue virus
REVLLLTVG

SEQ ID NO: 9915 - protein, 9 aa, Dengue virus
EVLLLTVGL

SEQ ID NO: 9916 - protein, 9 aa, Dengue virus
VLLLTVGLS

SEQ ID NO: 9917 - protein, 9 aa, Dengue virus
LLLTVGLSL

SEQ ID NO: 9918 - protein, 9 aa, Dengue virus
LLTVGLSLV

SEQ ID NO: 9919 - protein, 9 aa, Dengue virus
LTVGLSLVA

SEQ ID NO: 9920 - protein, 9 aa, Dengue virus
TVGLSLVAS

SEQ ID NO: 9921 - protein, 9 aa, Dengue virus
VGLSLVASV

SEQ ID NO: 9922 - protein, 9 aa, Dengue virus
GLSLVAFVE

SEQ ID NO: 9923 - protein, 9 aa, Dengue virus
LSLVAFVEL

SEQ ID NO: 9924 - protein, 9 aa, Dengue virus
SLVAFVELP

SEQ ID NO: 9925 - protein, 9 aa, Dengue virus
ASVELPSSL

SEQ ID NO: 9926 - protein, 9 aa, Dengue virus
SVELPSSLE

SEQ ID NO: 9927 - protein, 9 aa, Dengue virus
VELPSSLEE

SEQ ID NO: 9928 - protein, 9 aa, Dengue virus
ELPSSLEEL

SEQ ID NO: 9929 - protein, 9 aa, Dengue virus
LPSSLEELG

SEQ ID NO: 9930 - protein, 9 aa, Dengue virus
PSSLEELGD

SEQ ID NO: 9931 - protein, 9 aa, Dengue virus
SSLEELGDG

SEQ ID NO: 9932 - protein, 9 aa, Dengue virus
SLDELGDGL

SEQ ID NO: 9933 - protein, 9 aa, Dengue virus
EELGDGLAI

SEQ ID NO: 9934 - protein, 9 aa, Dengue virus
ELGDGLAIG

SEQ ID NO: 9935 - protein, 9 aa, Dengue virus
LGDGLAIGI

SEQ ID NO: 9936 - protein, 9 aa, Dengue virus
GDGLAIGIM

SEQ ID NO: 9937 - protein, 9 aa, Dengue virus
DGLAMGIMM

SEQ ID NO: 9938 - protein, 9 aa, Dengue virus
GLAMGIMML

SEQ ID NO: 9939 - protein, 9 aa, Dengue virus
LAMGIMMLK

SEQ ID NO: 9940 - protein, 9 aa, Dengue virus
AMGIMMLKL

SEQ ID NO: 9941 - protein, 9 aa, Dengue virus
MGIMMLKLL

SEQ ID NO: 9942 - protein, 9 aa, Dengue virus
GIMMLKLLT

SEQ ID NO: 9943 - protein, 9 aa, Dengue virus
IMMLKLLTE

SEQ ID NO: 9944 - protein, 9 aa, Dengue virus
MMLKLLTEF

SEQ ID NO: 9945 - protein, 9 aa, Dengue virus
MLKLLTEFQ

SEQ ID NO: 9946 - protein, 9 aa, Dengue virus
LKLLTEFQP

SEQ ID NO: 9947 - protein, 9 aa, Dengue virus
KLLTEFQPH

SEQ ID NO: 9948 - protein, 9 aa, Dengue virus
LLTEFQPHQ

SEQ ID NO: 9949 - protein, 9 aa, Dengue virus
LTEFQPHQL

SEQ ID NO: 9950 - protein, 9 aa, Dengue virus
TEFQPHQLW

SEQ ID NO: 9951 - protein, 9 aa, Dengue virus
LLSLTFVKT

SEQ ID NO: 9952 - protein, 9 aa, Dengue virus
DYAWKTTAM

SEQ ID NO: 9953 - protein, 9 aa, Dengue virus
AMALSIVSL

SEQ ID NO: 9954 - protein, 9 aa, Dengue virus
LSIVSLLPL

SEQ ID NO: 9955 - protein, 9 aa, Dengue virus
SIVSLLPLC

SEQ ID NO: 9956 - protein, 9 aa, Dengue virus
VSLLPLCLS

SEQ ID NO: 9957 - protein, 9 aa, Dengue virus
SLLPLCLST

SEQ ID NO: 9958 - protein, 9 aa, Dengue virus
LLPLCLSTT

SEQ ID NO: 9959 - protein, 9 aa, Dengue virus
LPLCLSTTS

SEQ ID NO: 9960 - protein, 9 aa, Dengue virus
PLCMSTTSQ

SEQ ID NO: 9961 - protein, 9 aa, Dengue virus
LCMSTTSQK

SEQ ID NO: 9962 - protein, 9 aa, Dengue virus
WLPVLLGSF

SEQ ID NO: 9963 - protein, 9 aa, Dengue virus
LPVLLGSFG

SEQ ID NO: 9964 - protein, 9 aa, Dengue virus
PVLLGSFGC

SEQ ID NO: 9965 - protein, 9 aa, Dengue virus
VLLGSFGCK

SEQ ID NO: 9966 - protein, 9 aa, Dengue virus
LLGSFGCKP

SEQ ID NO: 9967 - protein, 9 aa, Dengue virus
LGSFGCKPL

SEQ ID NO: 9968 - protein, 9 aa, Dengue virus
GSFGCKPLT

SEQ ID NO: 9969 - protein, 9 aa, Dengue virus
SFGCKPLTM

SEQ ID NO: 9970 - protein, 9 aa, Dengue virus
FGCKPLTMF

SEQ ID NO: 9971 - protein, 9 aa, Dengue virus
GCKPLPMFL

SEQ ID NO: 9972 - protein, 9 aa, Dengue virus
CKPLPMFLI

SEQ ID NO: 9973 - protein, 9 aa, Dengue virus
KPLTMFLIT

SEQ ID NO: 9974 - protein, 9 aa, Dengue virus
PLTMFLITE

SEQ ID NO: 9975 - protein, 9 aa, Dengue virus
ITENKIWGR

SEQ ID NO: 9976 - protein, 9 aa, Dengue virus
ENKIWGRRS

SEQ ID NO: 9977 - protein, 9 aa, Dengue virus
NKIWGRRSW

SEQ ID NO: 9978 - protein, 9 aa, Dengue virus
KIWGRRSWP

SEQ ID NO: 9979 - protein, 9 aa, Dengue virus
IWGRRSWPL

SEQ ID NO: 9980 - protein, 9 aa, Dengue virus
WGRRSWPLN

SEQ ID NO: 9981 - protein, 9 aa, Dengue virus
GRRSWPLNE

SEQ ID NO: 9982 - protein, 9 aa, Dengue virus
RRSWPLNEG

SEQ ID NO: 9983 - protein, 9 aa, Dengue virus
RSWPLNEGI

SEQ ID NO: 9984 - protein, 9 aa, Dengue virus
SWPINEGIM

SEQ ID NO: 9985 - protein, 9 aa, Dengue virus
WPINEGIMA

SEQ ID NO: 9986 - protein, 9 aa, Dengue virus
PLNEGIMAI

SEQ ID NO: 9987 - protein, 9 aa, Dengue virus
LNEGIMAIG

SEQ ID NO: 9988 - protein, 9 aa, Dengue virus
NEGIMAIGI

SEQ ID NO: 9989 - protein, 9 aa, Dengue virus
EGIMAIGIV

SEQ ID NO: 9990 - protein, 9 aa, Dengue virus
GIMAIGIVS

SEQ ID NO: 9991 - protein, 9 aa, Dengue virus
IMAIGIVSI

SEQ ID NO: 9992 - protein, 9 aa, Dengue virus
MAIGIVSIL

SEQ ID NO: 9993 - protein, 9 aa, Dengue virus
AIGIVSILL

SEQ ID NO: 9994 - protein, 9 aa, Dengue virus
IGIVSILLS

SEQ ID NO: 9995 - protein, 9 aa, Dengue virus
GVVSILLSS

SEQ ID NO: 9996 - protein, 9 aa, Dengue virus
VVSILLSSL

SEQ ID NO: 9997 - protein, 9 aa, Dengue virus
VSILLSALL

SEQ ID NO: 9998 - protein, 9 aa, Dengue virus
SILLSALLK

SEQ ID NO: 9999 - protein, 9 aa, Dengue virus
ILLSALLKN

SEQ ID NO: 10000 - protein, 9 aa, Dengue virus
LLSALLKND

SEQ ID NO: 10001 - protein, 9 aa, Dengue virus
LSALLKNDV

SEQ ID NO: 10002 - protein, 9 aa, Dengue virus
SALLKNDVP

SEQ ID NO: 10003 - protein, 9 aa, Dengue virus
ALLKNDVPL

SEQ ID NO: 10004 - protein, 9 aa, Dengue virus
SSADLLLEK

SEQ ID NO: 10005 - protein, 9 aa, Dengue virus
SADLLLEKA

SEQ ID NO: 10006 - protein, 9 aa, Dengue virus
ADLLLEKAA

SEQ ID NO: 10007 - protein, 9 aa, Dengue virus
DLSLEKAAV

SEQ ID NO: 10008 - protein, 9 aa, Dengue virus
LSLEKAAVV

SEQ ID NO: 10009 - protein, 9 aa, Dengue virus
SLEKAAVVS

SEQ ID NO: 10010 - protein, 9 aa, Dengue virus
LEKAAVVSW

SEQ ID NO: 10011 - protein, 9 aa, Dengue virus
EKAAVVSWE

SEQ ID NO: 10012 - protein, 9 aa, Dengue virus
AAEVSWEQE

SEQ ID NO: 10013 - protein, 9 aa, Dengue virus
AEVSWEQEA

SEQ ID NO: 10014 - protein, 9 aa, Dengue virus
EVSWEQEAE

SEQ ID NO: 10015 - protein, 9 aa, Dengue virus
VSWEQEAEH

SEQ ID NO: 10016 - protein, 9 aa, Dengue virus
SWEQEAEHS

SEQ ID NO: 10017 - protein, 9 aa, Dengue virus
WEQEAEHSG

SEQ ID NO: 10018 - protein, 9 aa, Dengue virus
EQEAEHSGT

SEQ ID NO: 10019 - protein, 9 aa, Dengue virus
QEAEHSGTS

SEQ ID NO: 10020 - protein, 9 aa, Dengue virus
EAEHSGTSH

SEQ ID NO: 10021 - protein, 9 aa, Dengue virus
AEHSGTSHN

SEQ ID NO: 10022 - protein, 9 aa, Dengue virus
EHSGTSHNI

SEQ ID NO: 10023 - protein, 9 aa, Dengue virus
HSGTSHNIL

SEQ ID NO: 10024 - protein, 9 aa, Dengue virus
SGTSHNILV

SEQ ID NO: 10025 - protein, 9 aa, Dengue virus
GTSHNILVE

SEQ ID NO: 10026 - protein, 9 aa, Dengue virus
TSHNILVEV

SEQ ID NO: 10027 - protein, 9 aa, Dengue virus
SHNILVEIQ

SEQ ID NO: 10028 - protein, 9 aa, Dengue virus
HNILVEIQD

SEQ ID NO: 10029 - protein, 9 aa, Dengue virus
NILVEIQDD

SEQ ID NO: 10030 - protein, 9 aa, Dengue virus
ILVEIQDDG

SEQ ID NO: 10031 - protein, 9 aa, Dengue virus
LVEIQDDGT

SEQ ID NO: 10032 - protein, 9 aa, Dengue virus
VEIQDDGTM

SEQ ID NO: 10033 - protein, 9 aa, Dengue virus
EIQDDGTMK

SEQ ID NO: 10034 - protein, 9 aa, Dengue virus
IQDDGTMKI

SEQ ID NO: 10035 - protein, 9 aa, Dengue virus
TMKIKDEEK

SEQ ID NO: 10036 - protein, 9 aa, Dengue virus
KIKDEEKDD

SEQ ID NO: 10037 - protein, 9 aa, Dengue virus
IKDEEKDDT

SEQ ID NO: 10038 - protein, 9 aa, Dengue virus
KDEERDDTI

SEQ ID NO: 10039 - protein, 9 aa, Dengue virus
DEERDDTIT

SEQ ID NO: 10040 - protein, 9 aa, Dengue virus
EERDDTITI

SEQ ID NO: 10041 - protein, 9 aa, Dengue virus
ERDDTITIL

SEQ ID NO: 10042 - protein, 9 aa, Dengue virus
RDDTITILL

SEQ ID NO: 10043 - protein, 9 aa, Dengue virus
DDTITILLK

SEQ ID NO: 10044 - protein, 9 aa, Dengue virus
DTITILLKA

SEQ ID NO: 10045 - protein, 9 aa, Dengue virus
TITILLKAT

SEQ ID NO: 10046 - protein, 9 aa, Dengue virus
ITILLKATL

SEQ ID NO: 10047 - protein, 9 aa, Dengue virus
LLKATLLAI

SEQ ID NO: 10048 - protein, 9 aa, Dengue virus
LKATLLAIS

SEQ ID NO: 10049 - protein, 9 aa, Dengue virus
KATLLAISG

SEQ ID NO: 10050 - protein, 9 aa, Dengue virus
ATLLAISGV

SEQ ID NO: 10051 - protein, 9 aa, Dengue virus
TLLAISGVY

SEQ ID NO: 10052 - protein, 9 aa, Dengue virus
LLAISGVYP

SEQ ID NO: 10053 - protein, 9 aa, Dengue virus
LAVSGVYPM

SEQ ID NO: 10054 - protein, 9 aa, Dengue virus
AVSGVYPMS

SEQ ID NO: 10055 - protein, 9 aa, Dengue virus
VSGVYPMSI

SEQ ID NO: 10056 - protein, 9 aa, Dengue virus
SGVYPMSIP

SEQ ID NO: 10057 - protein, 9 aa, Dengue virus
GVYPMSIPA

SEQ ID NO: 10058 - protein, 9 aa, Dengue virus
VYPMSIPAT

SEQ ID NO: 10059 - protein, 9 aa, Dengue virus
YPMSIPATL

SEQ ID NO: 10060 - protein, 9 aa, Dengue virus
PMSIPATLF

SEQ ID NO: 10061 - protein, 9 aa, Dengue virus
MSIPATLFV

SEQ ID NO: 10062 - protein, 9 aa, Dengue virus
SIPATLFLW

SEQ ID NO: 10063 - protein, 9 aa, Dengue virus
IPATLFVWH

SEQ ID NO: 10064 - protein, 9 aa, Dengue virus
PATLFVWHF

SEQ ID NO: 10065 - protein, 9 aa, Dengue virus
ATLFVWHFW

SEQ ID NO: 10066 - protein, 9 aa, Dengue virus
TLFVWHFWQ

SEQ ID NO: 10067 - protein, 9 aa, Dengue virus
LWDTPSPPK

SEQ ID NO: 10068 - protein, 9 aa, Dengue virus
WDTPSPPKV

SEQ ID NO: 10069 - protein, 9 aa, Dengue virus
DTPSPPEVG

SEQ ID NO: 10070 - protein, 9 aa, Dengue virus
TPSPPEVGR

SEQ ID NO: 10071 - protein, 9 aa, Dengue virus
PSPPEVGRA

SEQ ID NO: 10072 - protein, 9 aa, Dengue virus
SPPEVGRAV

SEQ ID NO: 10073 - protein, 9 aa, Dengue virus
PPEVGRAVL

SEQ ID NO: 10074 - protein, 9 aa, Dengue virus
PEVGRAVLD

SEQ ID NO: 10075 - protein, 9 aa, Dengue virus
VGRAVLDDG

SEQ ID NO: 10076 - protein, 9 aa, Dengue virus
GRAVLDDGI

SEQ ID NO: 10077 - protein, 9 aa, Dengue virus
KAVLDDGIY

SEQ ID NO: 10078 - protein, 9 aa, Dengue virus
LDDGIYRIL

SEQ ID NO: 10079 - protein, 9 aa, Dengue virus
DDGIYRILQ

SEQ ID NO: 10080 - protein, 9 aa, Dengue virus
DGIYRILQR

SEQ ID NO: 10081 - protein, 9 aa, Dengue virus
GIYRILQRG

SEQ ID NO: 10082 - protein, 9 aa, Dengue virus
IYRILQRGL

SEQ ID NO: 10083 - protein, 9 aa, Dengue virus
YRILQRGLL

SEQ ID NO: 10084 - protein, 9 aa, Dengue virus
RILQRGLLG

SEQ ID NO: 10085 - protein, 9 aa, Dengue virus
ILQRGLLGR

SEQ ID NO: 10086 - protein, 9 aa, Dengue virus
LQRGLLGRS

SEQ ID NO: 10087 - protein, 9 aa, Dengue virus
QVGVGVFQD

SEQ ID NO: 10088 - protein, 9 aa, Dengue virus
VGVGVFQDG

SEQ ID NO: 10089 - protein, 9 aa, Dengue virus
GVGVFQDGV

SEQ ID NO: 10090 - protein, 9 aa, Dengue virus
VGVFQDGVF

SEQ ID NO: 10091 - protein, 9 aa, Dengue virus
GVFQDGVFH

SEQ ID NO: 10092 - protein, 9 aa, Dengue virus
VFQDGVFHT

SEQ ID NO: 10093 - protein, 9 aa, Dengue virus
FQDGVFHTM

SEQ ID NO: 10094 - protein, 9 aa, Dengue virus
QDGVFHTMW

SEQ ID NO: 10095 - protein, 9 aa, Dengue virus
DGVFHTMWH

SEQ ID NO: 10096 - protein, 9 aa, Dengue virus
GVFHTMWHV

SEQ ID NO: 10097 - protein, 9 aa, Dengue virus
ISYGGGWRF

SEQ ID NO: 10098 - protein, 9 aa, Dengue virus
SYGGGWRFQ

SEQ ID NO: 10099 - protein, 9 aa, Dengue virus
YGGGWRFQG

SEQ ID NO: 10100 - protein, 9 aa, Dengue virus
GGGWRFQGS

SEQ ID NO: 10101 - protein, 9 aa, Dengue virus
GGWRFQGSW

SEQ ID NO: 10102 - protein, 9 aa, Dengue virus
GWRFQGSWN

SEQ ID NO: 10103 - protein, 9 aa, Dengue virus
RGSWNTGEE

SEQ ID NO: 10104 - protein, 9 aa, Dengue virus
GSWNAGEEV

SEQ ID NO: 10105 - protein, 9 aa, Dengue virus
SWNAGEEVQ

SEQ ID NO: 10106 - protein, 9 aa, Dengue virus
WNAGEEVQV

SEQ ID NO: 10107 - protein, 9 aa, Dengue virus
NAGEEVQVI

SEQ ID NO: 10108 - protein, 9 aa, Dengue virus
AGEEVQVIA

SEQ ID NO: 10109 - protein, 9 aa, Dengue virus
KNPKNVQTT

SEQ ID NO: 10110 - protein, 9 aa, Dengue virus
NPKNVQTTP

SEQ ID NO: 10111 - protein, 9 aa, Dengue virus
PKNVQTTPG

SEQ ID NO: 10112 - protein, 9 aa, Dengue virus
KNVQTTPGT

SEQ ID NO: 10113 - protein, 9 aa, Dengue virus
NVQTTPGTF

SEQ ID NO: 10114 - protein, 9 aa, Dengue virus
VQTTPGTFK

SEQ ID NO: 10115 - protein, 9 aa, Dengue virus
QTTPGTFKT

SEQ ID NO: 10116 - protein, 9 aa, Dengue virus
TTPGTFKTP

SEQ ID NO: 10117 - protein, 9 aa, Dengue virus
TPGTFKTPE

SEQ ID NO: 10118 - protein, 9 aa, Dengue virus
PGTFKTSEG

SEQ ID NO: 10119 - protein, 9 aa, Dengue virus
GTFKTSEGE

SEQ ID NO: 10120 - protein, 9 aa, Dengue virus
TFKTSEGEV

SEQ ID NO: 10121 - protein, 9 aa, Dengue virus
FKTSEGEVG

SEQ ID NO: 10122 - protein, 9 aa, Dengue virus
KTSEGEVGA

SEQ ID NO: 10123 - protein, 9 aa, Dengue virus
TSEGEVGAI

SEQ ID NO: 10124 - protein, 9 aa, Dengue virus
SEGEVGAIA

SEQ ID NO: 10125 - protein, 9 aa, Dengue virus
IVNRERKIV

SEQ ID NO: 10126 - protein, 9 aa, Dengue virus
VNRERKIVG

SEQ ID NO: 10127 - protein, 9 aa, Dengue virus
NRERKIVGL

SEQ ID NO: 10128 - protein, 9 aa, Dengue virus
YVSAIAQAR

SEQ ID NO: 10129 - protein, 9 aa, Dengue virus
VSAIAQAKT

SEQ ID NO: 10130 - protein, 9 aa, Dengue virus
SAIAQAKTS

SEQ ID NO: 10131 - protein, 9 aa, Dengue virus
AIAQAKTSQ

SEQ ID NO: 10132 - protein, 9 aa, Dengue virus
IAQAKTSQE

SEQ ID NO: 10133 - protein, 9 aa, Dengue virus
AQAKTSQEG

SEQ ID NO: 10134 - protein, 9 aa, Dengue virus
QAKTSQEGP

SEQ ID NO: 10135 - protein, 9 aa, Dengue virus
AKTSQEGPL

SEQ ID NO: 10136 - protein, 9 aa, Dengue virus
KTSQEGPLP

SEQ ID NO: 10137 - protein, 9 aa, Dengue virus
TSQEGPLPE

SEQ ID NO: 10138 - protein, 9 aa, Dengue virus
EGPLPEIEE

SEQ ID NO: 10139 - protein, 9 aa, Dengue virus
GPLPEIEEE

SEQ ID NO: 10140 - protein, 9 aa, Dengue virus
PLPEIEEEV

SEQ ID NO: 10141 - protein, 9 aa, Dengue virus
LPEIEEEVF

SEQ ID NO: 10142 - protein, 9 aa, Dengue virus
PEIEDEVFK

SEQ ID NO: 10143 - protein, 9 aa, Dengue virus
EIEDEVFKK

SEQ ID NO: 10144 - protein, 9 aa, Dengue virus
IEDEVFKKR

SEQ ID NO: 10145 - protein, 9 aa, Dengue virus
EDEVFKKRN

SEQ ID NO: 10146 - protein, 9 aa, Dengue virus
DEVFKKRNL

SEQ ID NO: 10147 - protein, 9 aa, Dengue virus
EVFKKRNLT

SEQ ID NO: 10148 - protein, 9 aa, Dengue virus
VFKKRNLTI

SEQ ID NO: 10149 - protein, 9 aa, Dengue virus
FKKRNLTIM

SEQ ID NO: 10150 - protein, 9 aa, Dengue virus
KKRNLTIMD

SEQ ID NO: 10151 - protein, 9 aa, Dengue virus
KTRRYLPAM

SEQ ID NO: 10152 - protein, 9 aa, Dengue virus
TRRYLPAMV

SEQ ID NO: 10153 - protein, 9 aa, Dengue virus
RRYLPAMVR

SEQ ID NO: 10154 - protein, 9 aa, Dengue virus
RYLPAMVRE

SEQ ID NO: 10155 - protein, 9 aa, Dengue virus
YLPAMVREA

SEQ ID NO: 10156 - protein, 9 aa, Dengue virus
LPAMVREAI

SEQ ID NO: 10157 - protein, 9 aa, Dengue virus
PAMVREAIK

SEQ ID NO: 10158 - protein, 9 aa, Dengue virus
AMVREAIKR

SEQ ID NO: 10159 - protein, 9 aa, Dengue virus
IVREAIKRR

SEQ ID NO: 10160 - protein, 9 aa, Dengue virus
VREAIKRRL

SEQ ID NO: 10161 - protein, 9 aa, Dengue virus
REAIKRRLR

SEQ ID NO: 10162 - protein, 9 aa, Dengue virus
EAIKRRLRT

SEQ ID NO: 10163 - protein, 9 aa, Dengue virus
AIKRRLRTL

SEQ ID NO: 10164 - protein, 9 aa, Dengue virus
IKRKLRTLV

SEQ ID NO: 10165 - protein, 9 aa, Dengue virus
KRRLRTLIL

SEQ ID NO: 10166 - protein, 9 aa, Dengue virus
RRLRTLILA

SEQ ID NO: 10167 - protein, 9 aa, Dengue virus
RLRTLILAP

SEQ ID NO: 10168 - protein, 9 aa, Dengue virus
LRTLVLAPT

SEQ ID NO: 10169 - protein, 9 aa, Dengue virus
RTLVLAPTR

SEQ ID NO: 10170 - protein, 9 aa, Dengue virus
TLVLAPTRV

SEQ ID NO: 10171 - protein, 9 aa, Dengue virus
LVLAPTRVV

SEQ ID NO: 10172 - protein, 9 aa, Dengue virus
VLAPTRVVA

SEQ ID NO: 10173 - protein, 9 aa, Dengue virus
EMAEALKGV

SEQ ID NO: 10174 - protein, 9 aa, Dengue virus
MAEALKGVP

SEQ ID NO: 10175 - protein, 9 aa, Dengue virus
AEALKGVPI

SEQ ID NO: 10176 - protein, 9 aa, Dengue virus
EALKGVPIR

SEQ ID NO: 10177 - protein, 9 aa, Dengue virus
ALKGVPIRY

SEQ ID NO: 10178 - protein, 9 aa, Dengue virus
LKGVPIRYQ

SEQ ID NO: 10179 - protein, 9 aa, Dengue virus
KGVPIRYQT

SEQ ID NO: 10180 - protein, 9 aa, Dengue virus
GVPIRYQTT

SEQ ID NO: 10181 - protein, 9 aa, Dengue virus
VPIRYQTTA

SEQ ID NO: 10182 - protein, 9 aa, Dengue virus
AVKSEHTGR

SEQ ID NO: 10183 - protein, 9 aa, Dengue virus
VKSEHTGRE

SEQ ID NO: 10184 - protein, 9 aa, Dengue virus
KSEHTGREI

SEQ ID NO: 10185 - protein, 9 aa, Dengue virus
SEHTGREIV

SEQ ID NO: 10186 - protein, 9 aa, Dengue virus
EHTGREIVD

SEQ ID NO: 10187 - protein, 9 aa, Dengue virus
HTGREIVDL

SEQ ID NO: 10188 - protein, 9 aa, Dengue virus
TGREIVDLM

SEQ ID NO: 10189 - protein, 9 aa, Dengue virus
GREIVDLMC

SEQ ID NO: 10190 - protein, 9 aa, Dengue virus
REIVDLMCH

SEQ ID NO: 10191 - protein, 9 aa, Dengue virus
DEAHFTDPA

SEQ ID NO: 10192 - protein, 9 aa, Dengue virus
EAHFTDPAS

SEQ ID NO: 10193 - protein, 9 aa, Dengue virus
AHFTDPASI

SEQ ID NO: 10194 - protein, 9 aa, Dengue virus
HFTDPASIA

SEQ ID NO: 10195 - protein, 9 aa, Dengue virus
FTDPASIAA

SEQ ID NO: 10196 - protein, 9 aa, Dengue virus
TDPASIAAR

SEQ ID NO: 10197 - protein, 9 aa, Dengue virus
DPASIAARG

SEQ ID NO: 10198 - protein, 9 aa, Dengue virus
PASIAARGY

SEQ ID NO: 10199 - protein, 9 aa, Dengue virus
ASIAARGYI

SEQ ID NO: 10200 - protein, 9 aa, Dengue virus
MTATPPGSM

SEQ ID NO: 10201 - protein, 9 aa, Dengue virus
TATPPGSME

SEQ ID NO: 10202 - protein, 9 aa, Dengue virus
ATPPGSMEA

SEQ ID NO: 10203 - protein, 9 aa, Dengue virus
TPPGSMEAF

SEQ ID NO: 10204 - protein, 9 aa, Dengue virus
PPGSMEAFP

SEQ ID NO: 10205 - protein, 9 aa, Dengue virus
PGSMEAFPQ

SEQ ID NO: 10206 - protein, 9 aa, Dengue virus
GSMEAFPQS

SEQ ID NO: 10207 - protein, 9 aa, Dengue virus
SMEAFPQSN

SEQ ID NO: 10208 - protein, 9 aa, Dengue virus
MEAFPQSNA

SEQ ID NO: 10209 - protein, 9 aa, Dengue virus
EAFPQSNAI

SEQ ID NO: 10210 - protein, 9 aa, Dengue virus
AFPQSNAII

SEQ ID NO: 10211 - protein, 9 aa, Dengue virus
FPQSNAIIQ

SEQ ID NO: 10212 - protein, 9 aa, Dengue virus
PQSNAIIQD

SEQ ID NO: 10213 - protein, 9 aa, Dengue virus
QSNAIIQDE

SEQ ID NO: 10214 - protein, 9 aa, Dengue virus
SNAIIQDEE

SEQ ID NO: 10215 - protein, 9 aa, Dengue virus
NAVIQDEEK

SEQ ID NO: 10216 - protein, 9 aa, Dengue virus
AVIQDEEKD

SEQ ID NO: 10217 - protein, 9 aa, Dengue virus
VIQDEEKDI

SEQ ID NO: 10218 - protein, 9 aa, Dengue virus
IQDEEKDIP

SEQ ID NO: 10219 - protein, 9 aa, Dengue virus
QDEEKDIPE

SEQ ID NO: 10220 - protein, 9 aa, Dengue virus
DEEKDIPER

SEQ ID NO: 10221 - protein, 9 aa, Dengue virus
EEKDIPERS

SEQ ID NO: 10222 - protein, 9 aa, Dengue virus
EKDIPERSW

SEQ ID NO: 10223 - protein, 9 aa, Dengue virus
KDIPERSWN

SEQ ID NO: 10224 - protein, 9 aa, Dengue virus
PERSWNSGH

SEQ ID NO: 10225 - protein, 9 aa, Dengue virus
ERSWNSGYD

SEQ ID NO: 10226 - protein, 9 aa, Dengue virus
RSWNSGYDW

SEQ ID NO: 10227 - protein, 9 aa, Dengue virus
SWNSGYDWI

SEQ ID NO: 10228 - protein, 9 aa, Dengue virus
WNSGYDWIT

SEQ ID NO: 10229 - protein, 9 aa, Dengue virus
NSGYDWITD

SEQ ID NO: 10230 - protein, 9 aa, Dengue virus
SGYDWITDF

SEQ ID NO: 10231 - protein, 9 aa, Dengue virus
GYDWITDFP

SEQ ID NO: 10232 - protein, 9 aa, Dengue virus
YDWITDFPG

SEQ ID NO: 10233 - protein, 9 aa, Dengue virus
DWITDFPGK

SEQ ID NO: 10234 - protein, 9 aa, Dengue virus
VWFVPSIKA

SEQ ID NO: 10235 - protein, 9 aa, Dengue virus
WFVPSIKAG

SEQ ID NO: 10236 - protein, 9 aa, Dengue virus
FVPSIKAGN

SEQ ID NO: 10237 - protein, 9 aa, Dengue virus
VPSIKAGND

SEQ ID NO: 10238 - protein, 9 aa, Dengue virus
PSIKAGNDI

SEQ ID NO: 10239 - protein, 9 aa, Dengue virus
SIKAGNDIA

SEQ ID NO: 10240 - protein, 9 aa, Dengue virus
IKAGNDIAN

SEQ ID NO: 10241 - protein, 9 aa, Dengue virus
KAGNDIANC

SEQ ID NO: 10242 - protein, 9 aa, Dengue virus
AGNDIANCL

SEQ ID NO: 10243 - protein, 9 aa, Dengue virus
LRKNGKRVV

SEQ ID NO: 10244 - protein, 9 aa, Dengue virus
RKNGKRVVQ

SEQ ID NO: 10245 - protein, 9 aa, Dengue virus
KNGKRVVQL

SEQ ID NO: 10246 - protein, 9 aa, Dengue virus
NGKRVVQLS

SEQ ID NO: 10247 - protein, 9 aa, Dengue virus
GKRVVQLSR

SEQ ID NO: 10248 - protein, 9 aa, Dengue virus
KRVVQLSRK

SEQ ID NO: 10249 - protein, 9 aa, Dengue virus
RVVQLSRKT

SEQ ID NO: 10250 - protein, 9 aa, Dengue virus
VVQLSRKTF

SEQ ID NO: 10251 - protein, 9 aa, Dengue virus
VQLSRKTFD

SEQ ID NO: 10252 - protein, 9 aa, Dengue virus
FDTEYQKTR

SEQ ID NO: 10253 - protein, 9 aa, Dengue virus
DTEYQKTRN

SEQ ID NO: 10254 - protein, 9 aa, Dengue virus
TEYQKTRNN

SEQ ID NO: 10255 - protein, 9 aa, Dengue virus
EYQKTRNND

SEQ ID NO: 10256 - protein, 9 aa, Dengue virus
YQKTRNNDW

SEQ ID NO: 10257 - protein, 9 aa, Dengue virus
QKTRNNDWD

SEQ ID NO: 10258 - protein, 9 aa, Dengue virus
KTRNNDWDY

SEQ ID NO: 10259 - protein, 9 aa, Dengue virus
TRNNDWDYV

SEQ ID NO: 10260 - protein, 9 aa, Dengue virus
RNNDWDYVV

SEQ ID NO: 10261 - protein, 9 aa, Dengue virus
RRGRIGRNQ

SEQ ID NO: 10262 - protein, 9 aa, Dengue virus
RGRIGRNQN

SEQ ID NO: 10263 - protein, 9 aa, Dengue virus
GRIGRNQNK

SEQ ID NO: 10264 - protein, 9 aa, Dengue virus
RIGRNQNKE

SEQ ID NO: 10265 - protein, 9 aa, Dengue virus
IGRNQNKEG

SEQ ID NO: 10266 - protein, 9 aa, Dengue virus
GRNQNKEGD

SEQ ID NO: 10267 - protein, 9 aa, Dengue virus
RNQNKEGDQ

SEQ ID NO: 10268 - protein, 9 aa, Dengue virus
NQNKEGDQY

SEQ ID NO: 10269 - protein, 9 aa, Dengue virus
QNKEGDQYV

SEQ ID NO: 10270 - protein, 9 aa, Dengue virus
NKEGDQYVY

SEQ ID NO: 10271 - protein, 9 aa, Dengue virus
KEGDQYVYM

SEQ ID NO: 10272 - protein, 9 aa, Dengue virus
EGDQYVYMG

SEQ ID NO: 10273 - protein, 9 aa, Dengue virus
GDQYVYMGQ

SEQ ID NO: 10274 - protein, 9 aa, Dengue virus
DQYVYMGQP

SEQ ID NO: 10275 - protein, 9 aa, Dengue virus
QYVYMGQPL

SEQ ID NO: 10276 - protein, 9 aa, Dengue virus
YVYMGQPLN

SEQ ID NO: 10277 - protein, 9 aa, Dengue virus
VYMGQPLNN

SEQ ID NO: 10278 - protein, 9 aa, Dengue virus
YMGQPLKND

SEQ ID NO: 10279 - protein, 9 aa, Dengue virus
MGQPLKNDE

SEQ ID NO: 10280 - protein, 9 aa, Dengue virus
GQPLKNDED

SEQ ID NO: 10281 - protein, 9 aa, Dengue virus
QPLKNDEDH

SEQ ID NO: 10282 - protein, 9 aa, Dengue virus
PLKNDEDHA

SEQ ID NO: 10283 - protein, 9 aa, Dengue virus
LKNDEDHAH

SEQ ID NO: 10284 - protein, 9 aa, Dengue virus
PEREKSAAV

SEQ ID NO: 10285 - protein, 9 aa, Dengue virus
EREKSAAVD

SEQ ID NO: 10286 - protein, 9 aa, Dengue virus
REKSAAVDG

SEQ ID NO: 10287 - protein, 9 aa, Dengue virus
EKSAAVDGE

SEQ ID NO: 10288 - protein, 9 aa, Dengue virus
KSAAVDGEY

SEQ ID NO: 10289 - protein, 9 aa, Dengue virus
SAAVDGEYR

SEQ ID NO: 10290 - protein, 9 aa, Dengue virus
AAVDGEYRL

SEQ ID NO: 10291 - protein, 9 aa, Dengue virus
AVDGEYRLR

SEQ ID NO: 10292 - protein, 9 aa, Dengue virus
VDGEYRLRG

SEQ ID NO: 10293 - protein, 9 aa, Dengue virus
GDLPVWLSH

SEQ ID NO: 10294 - protein, 9 aa, Dengue virus
DLPVWLSHK

SEQ ID NO: 10295 - protein, 9 aa, Dengue virus
LPVWLSHKV

SEQ ID NO: 10296 - protein, 9 aa, Dengue virus
PVWLSHKVA

SEQ ID NO: 10297 - protein, 9 aa, Dengue virus
VWLSHKVAS

SEQ ID NO: 10298 - protein, 9 aa, Dengue virus
WLSHKVASE

SEQ ID NO: 10299 - protein, 9 aa, Dengue virus
LSHKVASEG

SEQ ID NO: 10300 - protein, 9 aa, Dengue virus
SHKVASEGF

SEQ ID NO: 10301 - protein, 9 aa, Dengue virus
HKVASEGFQ

SEQ ID NO: 10302 - protein, 9 aa, Dengue virus
FAAGRRSIS

SEQ ID NO: 10303 - protein, 9 aa, Dengue virus
AAGRRSISG

SEQ ID NO: 10304 - protein, 9 aa, Dengue virus
AGRRSISGD

SEQ ID NO: 10305 - protein, 9 aa, Dengue virus
GRRSISGDL

SEQ ID NO: 10306 - protein, 9 aa, Dengue virus
RRSISGDLI

SEQ ID NO: 10307 - protein, 9 aa, Dengue virus
RSVSGDLIS

SEQ ID NO: 10308 - protein, 9 aa, Dengue virus
SVSGDLISE

SEQ ID NO: 10309 - protein, 9 aa, Dengue virus
VSGDLISEI

SEQ ID NO: 10310 - protein, 9 aa, Dengue virus
SGDLISEIG

SEQ ID NO: 10311 - protein, 9 aa, Dengue virus
GDLISEIGK

SEQ ID NO: 10312 - protein, 9 aa, Dengue virus
GKLPQHLTL

SEQ ID NO: 10313 - protein, 9 aa, Dengue virus
KLPQHLTLR

SEQ ID NO: 10314 - protein, 9 aa, Dengue virus
LPQHLTLRA

SEQ ID NO: 10315 - protein, 9 aa, Dengue virus
PQHLTLRAQ

SEQ ID NO: 10316 - protein, 9 aa, Dengue virus
QHLTLRAQN

SEQ ID NO: 10317 - protein, 9 aa, Dengue virus
HLTLRAQNA

SEQ ID NO: 10318 - protein, 9 aa, Dengue virus
LTLRAQNAL

SEQ ID NO: 10319 - protein, 9 aa, Dengue virus
TLRAQNALD

SEQ ID NO: 10320 - protein, 9 aa, Dengue virus
LRAQNALDN

SEQ ID NO: 10321 - protein, 9 aa, Dengue virus
KAQNALDNL

SEQ ID NO: 10322 - protein, 9 aa, Dengue virus
LHNSEQGGK

SEQ ID NO: 10323 - protein, 9 aa, Dengue virus
HNSEQGGKA

SEQ ID NO: 10324 - protein, 9 aa, Dengue virus
NSEQGGKAY

SEQ ID NO: 10325 - protein, 9 aa, Dengue virus
SEQGGKAYR

SEQ ID NO: 10326 - protein, 9 aa, Dengue virus
EQGGKAYRH

SEQ ID NO: 10327 - protein, 9 aa, Dengue virus
QGGKAYRHA

SEQ ID NO: 10328 - protein, 9 aa, Dengue virus
GGKAYRHAM

SEQ ID NO: 10329 - protein, 9 aa, Dengue virus
GKAYRHAME

SEQ ID NO: 10330 - protein, 9 aa, Dengue virus
KAYRHAMEE

SEQ ID NO: 10331 - protein, 9 aa, Dengue virus
AYRHALEEL

SEQ ID NO: 10332 - protein, 9 aa, Dengue virus
YRHALEELP

SEQ ID NO: 10333 - protein, 9 aa, Dengue virus
RHALEELPD

SEQ ID NO: 10334 - protein, 9 aa, Dengue virus
HALEELPDT

SEQ ID NO: 10335 - protein, 9 aa, Dengue virus
ALEELPDTI

SEQ ID NO: 10336 - protein, 9 aa, Dengue virus
LEELPDTIE

SEQ ID NO: 10337 - protein, 9 aa, Dengue virus
ELPDTIETI

SEQ ID NO: 10338 - protein, 9 aa, Dengue virus
LPDTIETIM

SEQ ID NO: 10339 - protein, 9 aa, Dengue virus
PDTIETIML

SEQ ID NO: 10340 - protein, 9 aa, Dengue virus
DTIETIMLL

SEQ ID NO: 10341 - protein, 9 aa, Dengue virus
TIETIMLLA

SEQ ID NO: 10342 - protein, 9 aa, Dengue virus
IETIMLLAL

SEQ ID NO: 10343 - protein, 9 aa, Dengue virus
ETIMLLALI

SEQ ID NO: 10344 - protein, 9 aa, Dengue virus
TIMLLALIA

SEQ ID NO: 10345 - protein, 9 aa, Dengue virus
IMLLALIAV

SEQ ID NO: 10346 - protein, 9 aa, Dengue virus
IAVLTGGVM

SEQ ID NO: 10347 - protein, 9 aa, Dengue virus
AVLTGGVML

SEQ ID NO: 10348 - protein, 9 aa, Dengue virus
VLTGGVMLF

SEQ ID NO: 10349 - protein, 9 aa, Dengue virus
LTGGVMLFF

SEQ ID NO: 10350 - protein, 9 aa, Dengue virus
TGGVMLFFL

SEQ ID NO: 10351 - protein, 9 aa, Dengue virus
GGVMLFFLS

SEQ ID NO: 10352 - protein, 9 aa, Dengue virus
GVMLFFLSG

SEQ ID NO: 10353 - protein, 9 aa, Dengue virus
VTLFFLSGK

SEQ ID NO: 10354 - protein, 9 aa, Dengue virus
TLFFLSGKG

SEQ ID NO: 10355 - protein, 9 aa, Dengue virus
LFFLSGKGL

SEQ ID NO: 10356 - protein, 9 aa, Dengue virus
FFLSGKGLG

SEQ ID NO: 10357 - protein, 9 aa, Dengue virus
FLSGKGLGK

SEQ ID NO: 10358 - protein, 9 aa, Dengue virus
LSGKGLGKT

SEQ ID NO: 10359 - protein, 9 aa, Dengue virus
SGKGLGKTS

SEQ ID NO: 10360 - protein, 9 aa, Dengue virus
GKGLGKTSI

SEQ ID NO: 10361 - protein, 9 aa, Dengue virus
KGLGKTSIG

SEQ ID NO: 10362 - protein, 9 aa, Dengue virus
TSIGLLCVT

SEQ ID NO: 10363 - protein, 9 aa, Dengue virus
SIGLLCVTA

SEQ ID NO: 10364 - protein, 9 aa, Dengue virus
IGLLCVTAS

SEQ ID NO: 10365 - protein, 9 aa, Dengue virus
GLLCVTASS

SEQ ID NO: 10366 - protein, 9 aa, Dengue virus
ASSALLWMA

SEQ ID NO: 10367 - protein, 9 aa, Dengue virus
SSALLWMAS

SEQ ID NO: 10368 - protein, 9 aa, Dengue virus
SALLWMASV

SEQ ID NO: 10369 - protein, 9 aa, Dengue virus
ALLWMASVE

SEQ ID NO: 10370 - protein, 9 aa, Dengue virus
LLWMANVEP

SEQ ID NO: 10371 - protein, 9 aa, Dengue virus
LWMANVEPH

SEQ ID NO: 10372 - protein, 9 aa, Dengue virus
WMANVEPHW

SEQ ID NO: 10373 - protein, 9 aa, Dengue virus
MANVEPHWI

SEQ ID NO: 10374 - protein, 9 aa, Dengue virus
ANVEPHWIA

SEQ ID NO: 10375 - protein, 9 aa, Dengue virus
NVEPHWIAA

SEQ ID NO: 10376 - protein, 9 aa, Dengue virus
YVVIGLLFV

SEQ ID NO: 10377 - protein, 9 aa, Dengue virus
VVIGLLFII

SEQ ID NO: 10378 - protein, 9 aa, Dengue virus
VIGLLFVIL

SEQ ID NO: 10379 - protein, 9 aa, Dengue virus
IGLLFIILT

SEQ ID NO: 10380 - protein, 9 aa, Dengue virus
GLLFIILTV

SEQ ID NO: 10381 - protein, 9 aa, Dengue virus
LLFIILTVA

SEQ ID NO: 10382 - protein, 9 aa, Dengue virus
LFIILTVAA

SEQ ID NO: 10383 - protein, 9 aa, Dengue virus
FIILTVAAN

SEQ ID NO: 10384 - protein, 9 aa, Dengue virus
IILTVAANE

SEQ ID NO: 10385 - protein, 9 aa, Dengue virus
TKKDLGIGY

SEQ ID NO: 10386 - protein, 9 aa, Dengue virus
KKDLGIGYV

SEQ ID NO: 10387 - protein, 9 aa, Dengue virus
KDLGIGYVA

SEQ ID NO: 10388 - protein, 9 aa, Dengue virus
HATMLDVDL

SEQ ID NO: 10389 - protein, 9 aa, Dengue virus
TMLDVDLHP

SEQ ID NO: 10390 - protein, 9 aa, Dengue virus
MLDVDLRPA

SEQ ID NO: 10391 - protein, 9 aa, Dengue virus
LDVDLRPAS

SEQ ID NO: 10392 - protein, 9 aa, Dengue virus
DVDLRPASA

SEQ ID NO: 10393 - protein, 9 aa, Dengue virus
VDLRPASAW

SEQ ID NO: 10394 - protein, 9 aa, Dengue virus
DLRPASAWT

SEQ ID NO: 10395 - protein, 9 aa, Dengue virus
LRPASAWTL

SEQ ID NO: 10396 - protein, 9 aa, Dengue virus
RPASAWTLY

SEQ ID NO: 10397 - protein, 9 aa, Dengue virus
TLYAVATTV

SEQ ID NO: 10398 - protein, 9 aa, Dengue virus
LYAVATTVI

SEQ ID NO: 10399 - protein, 9 aa, Dengue virus
YAVATTVIT

SEQ ID NO: 10400 - protein, 9 aa, Dengue virus
AVATTVITP

SEQ ID NO: 10401 - protein, 9 aa, Dengue virus
VATTVITPM

SEQ ID NO: 10402 - protein, 9 aa, Dengue virus
ATTVITPMM

SEQ ID NO: 10403 - protein, 9 aa, Dengue virus
TTVITPMMR

SEQ ID NO: 10404 - protein, 9 aa, Dengue virus
TVITPMMRH

SEQ ID NO: 10405 - protein, 9 aa, Dengue virus
VITPMMRHT

SEQ ID NO: 10406 - protein, 9 aa, Dengue virus
GWPISKMDL

SEQ ID NO: 10407 - protein, 9 aa, Dengue virus
WPISKMDLG

SEQ ID NO: 10408 - protein, 9 aa, Dengue virus
PISKMDLGV

SEQ ID NO: 10409 - protein, 9 aa, Dengue virus
ISKMDLGVP

SEQ ID NO: 10410 - protein, 9 aa, Dengue virus
SQVNPLTLI

SEQ ID NO: 10411 - protein, 9 aa, Dengue virus
QVNPLTLIA

SEQ ID NO: 10412 - protein, 9 aa, Dengue virus
VNPLTLIAA

SEQ ID NO: 10413 - protein, 9 aa, Dengue virus
NPLTLIAAV

SEQ ID NO: 10414 - protein, 9 aa, Dengue virus
PLTLIAAVL

SEQ ID NO: 10415 - protein, 9 aa, Dengue virus
LTLIAAVLM

SEQ ID NO: 10416 - protein, 9 aa, Dengue virus
TLIAAVLML

SEQ ID NO: 10417 - protein, 9 aa, Dengue virus
LIAAVLMLV

SEQ ID NO: 10418 - protein, 9 aa, Dengue virus
IAAVLMLVA

SEQ ID NO: 10419 - protein, 9 aa, Dengue virus
AAVLMLLAH

SEQ ID NO: 10420 - protein, 9 aa, Dengue virus
AVLMLLAHY

SEQ ID NO: 10421 - protein, 9 aa, Dengue virus
VLMLLAHYA

SEQ ID NO: 10422 - protein, 9 aa, Dengue virus
LMLLAHYAI

SEQ ID NO: 10423 - protein, 9 aa, Dengue virus
AGIMKNPTI

SEQ ID NO: 10424 - protein, 9 aa, Dengue virus
GIMKNPTID

SEQ ID NO: 10425 - protein, 9 aa, Dengue virus
IMKNPTIDG

SEQ ID NO: 10426 - protein, 9 aa, Dengue virus
MKNPTIDGI

SEQ ID NO: 10427 - protein, 9 aa, Dengue virus
KNPTIDGIV

SEQ ID NO: 10428 - protein, 9 aa, Dengue virus
NPTIDGIVA

SEQ ID NO: 10429 - protein, 9 aa, Dengue virus
PTIDGIVAI

SEQ ID NO: 10430 - protein, 9 aa, Dengue virus
TIDGIVAID

SEQ ID NO: 10431 - protein, 9 aa, Dengue virus
IDGIVAIDL

SEQ ID NO: 10432 - protein, 9 aa, Dengue virus
DGIVTIDLD

SEQ ID NO: 10433 - protein, 9 aa, Dengue virus
GIVTIDLDP

SEQ ID NO: 10434 - protein, 9 aa, Dengue virus
IVTIDLDPV

SEQ ID NO: 10435 - protein, 9 aa, Dengue virus
VTIDLDPVV

SEQ ID NO: 10436 - protein, 9 aa, Dengue virus
TIDLDPVVY

SEQ ID NO: 10437 - protein, 9 aa, Dengue virus
DLDPVVYDT

SEQ ID NO: 10438 - protein, 9 aa, Dengue virus
LDPVVYDTK

SEQ ID NO: 10439 - protein, 9 aa, Dengue virus
DPVVYDTKF

SEQ ID NO: 10440 - protein, 9 aa, Dengue virus
PVVYDTKFE

SEQ ID NO: 10441 - protein, 9 aa, Dengue virus
VVYDTKFEK

SEQ ID NO: 10442 - protein, 9 aa, Dengue virus
VYDTKFEKQ

SEQ ID NO: 10443 - protein, 9 aa, Dengue virus
YDTKFEKQL

SEQ ID NO: 10444 - protein, 9 aa, Dengue virus
DTKFEKQLG

SEQ ID NO: 10445 - protein, 9 aa, Dengue virus
TKFEKQLGQ

SEQ ID NO: 10446 - protein, 9 aa, Dengue virus
QLGQVMLLI

SEQ ID NO: 10447 - protein, 9 aa, Dengue virus
LGQVMLLIL

SEQ ID NO: 10448 - protein, 9 aa, Dengue virus
GQVMLLILC

SEQ ID NO: 10449 - protein, 9 aa, Dengue virus
QVMLLILCT

SEQ ID NO: 10450 - protein, 9 aa, Dengue virus
VMLLILCTS

SEQ ID NO: 10451 - protein, 9 aa, Dengue virus
QLSKSEFNI

SEQ ID NO: 10452 - protein, 9 aa, Dengue virus
LSKSEFNIY

SEQ ID NO: 10453 - protein, 9 aa, Dengue virus
SKSEFNIYK

SEQ ID NO: 10454 - protein, 9 aa, Dengue virus
KSEFNIYKR

SEQ ID NO: 10455 - protein, 9 aa, Dengue virus
SEFNIYKRS

SEQ ID NO: 10456 - protein, 9 aa, Dengue virus
EFNIYKRSG

SEQ ID NO: 10457 - protein, 9 aa, Dengue virus
FNIYKRSGI

SEQ ID NO: 10458 - protein, 9 aa, Dengue virus
NIYKRSGIM

SEQ ID NO: 10459 - protein, 9 aa, Dengue virus
IYKRSGIME

SEQ ID NO: 10460 - protein, 9 aa, Dengue virus
YKRSGIIEV

SEQ ID NO: 10461 - protein, 9 aa, Dengue virus
KRSGIIEVD

SEQ ID NO: 10462 - protein, 9 aa, Dengue virus
RSGIIEVDR

SEQ ID NO: 10463 - protein, 9 aa, Dengue virus
SGIIEVDRS

SEQ ID NO: 10464 - protein, 9 aa, Dengue virus
GIIEVDRSE

SEQ ID NO: 10465 - protein, 9 aa, Dengue virus
IIEVDRSEA

SEQ ID NO: 10466 - protein, 9 aa, Dengue virus
IEVDRSEAK

SEQ ID NO: 10467 - protein, 9 aa, Dengue virus
RSEAKEGLR

SEQ ID NO: 10468 - protein, 9 aa, Dengue virus
SEAKEGLRR

SEQ ID NO: 10469 - protein, 9 aa, Dengue virus
EAKEGLRRG

SEQ ID NO: 10470 - protein, 9 aa, Dengue virus
AKEGLRRGE

SEQ ID NO: 10471 - protein, 9 aa, Dengue virus
KEGLRRGET

SEQ ID NO: 10472 - protein, 9 aa, Dengue virus
EGLRRGETT

SEQ ID NO: 10473 - protein, 9 aa, Dengue virus
GLKRGETTR

SEQ ID NO: 10474 - protein, 9 aa, Dengue virus
LKRGETTRH

SEQ ID NO: 10475 - protein, 9 aa, Dengue virus
KRGETTRHA

SEQ ID NO: 10476 - protein, 9 aa, Dengue virus
RGETTRHAV

SEQ ID NO: 10477 - protein, 9 aa, Dengue virus
GETTRHAVS

SEQ ID NO: 10478 - protein, 9 aa, Dengue virus
ETTRHAVSR

SEQ ID NO: 10479 - protein, 9 aa, Dengue virus
TTRHAVSRG

SEQ ID NO: 10480 - protein, 9 aa, Dengue virus
TRHAVSRGT

SEQ ID NO: 10481 - protein, 9 aa, Dengue virus
RHAVSRGTA

SEQ ID NO: 10482 - protein, 9 aa, Dengue virus
VKGYTKGGL

SEQ ID NO: 10483 - protein, 9 aa, Dengue virus
KGYTKGGLG

SEQ ID NO: 10484 - protein, 9 aa, Dengue virus
GYTKGGLGH

SEQ ID NO: 10485 - protein, 9 aa, Dengue virus
YTKGGLGHE

SEQ ID NO: 10486 - protein, 9 aa, Dengue virus
TKGGAGHEE

SEQ ID NO: 10487 - protein, 9 aa, Dengue virus
KGGAGHEEP

SEQ ID NO: 10488 - protein, 9 aa, Dengue virus
GGPGHEEPV

SEQ ID NO: 10489 - protein, 9 aa, Dengue virus
GPGHEEPVP

SEQ ID NO: 10490 - protein, 9 aa, Dengue virus
PGHEEPVPM

SEQ ID NO: 10491 - protein, 9 aa, Dengue virus
GHEEPVPMA

SEQ ID NO: 10492 - protein, 9 aa, Dengue virus
HEEPVPMAT

SEQ ID NO: 10493 - protein, 9 aa, Dengue virus
EEPVPMATY

SEQ ID NO: 10494 - protein, 9 aa, Dengue virus
EPVPMATYG

SEQ ID NO: 10495 - protein, 9 aa, Dengue virus
PVPMATYGW

SEQ ID NO: 10496 - protein, 9 aa, Dengue virus
VPMATYGWN

SEQ ID NO: 10497 - protein, 9 aa, Dengue virus
ATYGWNLVR

SEQ ID NO: 10498 - protein, 9 aa, Dengue virus
TYGWNLVRL

SEQ ID NO: 10499 - protein, 9 aa, Dengue virus
YGWNLVKLY

SEQ ID NO: 10500 - protein, 9 aa, Dengue virus
GWNLVKLYS

SEQ ID NO: 10501 - protein, 9 aa, Dengue virus
WNLVKLYSG

SEQ ID NO: 10502 - protein, 9 aa, Dengue virus
NLVKLYSGK

SEQ ID NO: 10503 - protein, 9 aa, Dengue virus
LVKLYSGKD

SEQ ID NO: 10504 - protein, 9 aa, Dengue virus
VKLYSGKDV

SEQ ID NO: 10505 - protein, 9 aa, Dengue virus
KLYSGKDVF

SEQ ID NO: 10506 - protein, 9 aa, Dengue virus
LYSGKDVFF

SEQ ID NO: 10507 - protein, 9 aa, Dengue virus
SGKDVFFTP

SEQ ID NO: 10508 - protein, 9 aa, Dengue virus
GKDVFFTPP

SEQ ID NO: 10509 - protein, 9 aa, Dengue virus
KDVFFTPPE

SEQ ID NO: 10510 - protein, 9 aa, Dengue virus
DVFFTPPEK

SEQ ID NO: 10511 - protein, 9 aa, Dengue virus
VFFTPPEKC

SEQ ID NO: 10512 - protein, 9 aa, Dengue virus
FFTPPEKCD

SEQ ID NO: 10513 - protein, 9 aa, Dengue virus
FTPPEKCDT

SEQ ID NO: 10514 - protein, 9 aa, Dengue virus
TPPEKCDTL

SEQ ID NO: 10515 - protein, 9 aa, Dengue virus
LKMVEPWLK

SEQ ID NO: 10516 - protein, 9 aa, Dengue virus
KMVEPWLKG

SEQ ID NO: 10517 - protein, 9 aa, Dengue virus
MVEPWLKGN

SEQ ID NO: 10518 - protein, 9 aa, Dengue virus
PYMPSVVEA

SEQ ID NO: 10519 - protein, 9 aa, Dengue virus
YMPSVVEAL

SEQ ID NO: 10520 - protein, 9 aa, Dengue virus
MPSVVEALE

SEQ ID NO: 10521 - protein, 9 aa, Dengue virus
PSVVEALEQ

SEQ ID NO: 10522 - protein, 9 aa, Dengue virus
SVVEALEQM

SEQ ID NO: 10523 - protein, 9 aa, Dengue virus
VVEALEQMQ

SEQ ID NO: 10524 - protein, 9 aa, Dengue virus
VEALEQMQR

SEQ ID NO: 10525 - protein, 9 aa, Dengue virus
EALEQMQRK

SEQ ID NO: 10526 - protein, 9 aa, Dengue virus
ALEQMQRKH

SEQ ID NO: 10527 - protein, 9 aa, Dengue virus
LEQMQRKYG

SEQ ID NO: 10528 - protein, 9 aa, Dengue virus
EQMQRKYGG

SEQ ID NO: 10529 - protein, 9 aa, Dengue virus
QMQRKYGGM

SEQ ID NO: 10530 - protein, 9 aa, Dengue virus
MQRKYGGML

SEQ ID NO: 10531 - protein, 9 aa, Dengue virus
QRKYGGMLV

SEQ ID NO: 10532 - protein, 9 aa, Dengue virus
RKYGGMLVR

SEQ ID NO: 10533 - protein, 9 aa, Dengue virus
KYGGMLVRN

SEQ ID NO: 10534 - protein, 9 aa, Dengue virus
MLLNRFTMT

SEQ ID NO: 10535 - protein, 9 aa, Dengue virus
LLNRFTMTH

SEQ ID NO: 10536 - protein, 9 aa, Dengue virus
LNRFTMTHR

SEQ ID NO: 10537 - protein, 9 aa, Dengue virus
NRFTMTHRK

SEQ ID NO: 10538 - protein, 9 aa, Dengue virus
RFTMTHRKP

SEQ ID NO: 10539 - protein, 9 aa, Dengue virus
FTMTHRKPT

SEQ ID NO: 10540 - protein, 9 aa, Dengue virus
TMTHRKPTY

SEQ ID NO: 10541 - protein, 9 aa, Dengue virus
MTHRKPTYE

SEQ ID NO: 10542 - protein, 9 aa, Dengue virus
AHRKPTYEK

SEQ ID NO: 10543 - protein, 9 aa, Dengue virus
HRKPTYEKD

SEQ ID NO: 10544 - protein, 9 aa, Dengue virus
RKPTYEKDV

SEQ ID NO: 10545 - protein, 9 aa, Dengue virus
KPTYEKDVD

SEQ ID NO: 10546 - protein, 9 aa, Dengue virus
PTYEKDVDL

SEQ ID NO: 10547 - protein, 9 aa, Dengue virus
TYEKDVDLG

SEQ ID NO: 10548 - protein, 9 aa, Dengue virus
YERDVDLGT

SEQ ID NO: 10549 - protein, 9 aa, Dengue virus
ERDVDLGTG

SEQ ID NO: 10550 - protein, 9 aa, Dengue virus
RDVDLGTGT

SEQ ID NO: 10551 - protein, 9 aa, Dengue virus
DVDLGTGTR

SEQ ID NO: 10552 - protein, 9 aa, Dengue virus
VDLGTGTRH

SEQ ID NO: 10553 - protein, 9 aa, Dengue virus
DLGTGTRHV

SEQ ID NO: 10554 - protein, 9 aa, Dengue virus
LGTGTRHVA

SEQ ID NO: 10555 - protein, 9 aa, Dengue virus
GTGTRHVAV

SEQ ID NO: 10556 - protein, 9 aa, Dengue virus
TGTRHVAVE

SEQ ID NO: 10557 - protein, 9 aa, Dengue virus
GTRHVTVEP

SEQ ID NO: 10558 - protein, 9 aa, Dengue virus
TRHVTVEPE

SEQ ID NO: 10559 - protein, 9 aa, Dengue virus
RHVAVEPEI

SEQ ID NO: 10560 - protein, 9 aa, Dengue virus
HVAVEPEIA

SEQ ID NO: 10561 - protein, 9 aa, Dengue virus
VAVEPEIAN

SEQ ID NO: 10562 - protein, 9 aa, Dengue virus
VEPEIANLD

SEQ ID NO: 10563 - protein, 9 aa, Dengue virus
EPEIANLDI

SEQ ID NO: 10564 - protein, 9 aa, Dengue virus
PEIANLDII

SEQ ID NO: 10565 - protein, 9 aa, Dengue virus
EIANLDIIG

SEQ ID NO: 10566 - protein, 9 aa, Dengue virus
IANLDIIGQ

SEQ ID NO: 10567 - protein, 9 aa, Dengue virus
ANIDIIGQR

SEQ ID NO: 10568 - protein, 9 aa, Dengue virus
GQRIENIKN

SEQ ID NO: 10569 - protein, 9 aa, Dengue virus
QRIENIKNE

SEQ ID NO: 10570 - protein, 9 aa, Dengue virus
RIENIKNEH

SEQ ID NO: 10571 - protein, 9 aa, Dengue virus
IENIKNEHK

SEQ ID NO: 10572 - protein, 9 aa, Dengue virus
ENIKNEHKS

SEQ ID NO: 10573 - protein, 9 aa, Dengue virus
NIKNEHKST

SEQ ID NO: 10574 - protein, 9 aa, Dengue virus
IKNEHKSTW

SEQ ID NO: 10575 - protein, 9 aa, Dengue virus
KNEHKSTWH

SEQ ID NO: 10576 - protein, 9 aa, Dengue virus
NEHKSTWHY

SEQ ID NO: 10577 - protein, 9 aa, Dengue virus
SSMVNGVVR

SEQ ID NO: 10578 - protein, 9 aa, Dengue virus
SMVNGVVRL

SEQ ID NO: 10579 - protein, 9 aa, Dengue virus
MVNGVVRLL

SEQ ID NO: 10580 - protein, 9 aa, Dengue virus
VNGVVRLLT

SEQ ID NO: 10581 - protein, 9 aa, Dengue virus
NGVVRLLTK

SEQ ID NO: 10582 - protein, 9 aa, Dengue virus
GVVRLLTKP

SEQ ID NO: 10583 - protein, 9 aa, Dengue virus
VVRLLTKPW

SEQ ID NO: 10584 - protein, 9 aa, Dengue virus
VRLLTKPWD

SEQ ID NO: 10585 - protein, 9 aa, Dengue virus
RLLTKPWDV

SEQ ID NO: 10586 - protein, 9 aa, Dengue virus
EKVDTRTPR

SEQ ID NO: 10587 - protein, 9 aa, Dengue virus
KVDTRTPRA

SEQ ID NO: 10588 - protein, 9 aa, Dengue virus
VDTRTPRAK

SEQ ID NO: 10589 - protein, 9 aa, Dengue virus
DTRTPRAKR

SEQ ID NO: 10590 - protein, 9 aa, Dengue virus
TRTPRAKRG

SEQ ID NO: 10591 - protein, 9 aa, Dengue virus
RTPRAKRGT

SEQ ID NO: 10592 - protein, 9 aa, Dengue virus
TPRAKRGTT

SEQ ID NO: 10593 - protein, 9 aa, Dengue virus
PRAKRGTTQ

SEQ ID NO: 10594 - protein, 9 aa, Dengue virus
RAKRGTTQI

SEQ ID NO: 10595 - protein, 9 aa, Dengue virus
AKRGTTQIM

SEQ ID NO: 10596 - protein, 9 aa, Dengue virus
KRGTTQIME

SEQ ID NO: 10597 - protein, 9 aa, Dengue virus
RGTTQIMEV

SEQ ID NO: 10598 - protein, 9 aa, Dengue virus
GTTQIMEVT

SEQ ID NO: 10599 - protein, 9 aa, Dengue virus
TTQIMEVTA

SEQ ID NO: 10600 - protein, 9 aa, Dengue virus
QIMEVTARW

SEQ ID NO: 10601 - protein, 9 aa, Dengue virus
IMEVTARWL

SEQ ID NO: 10602 - protein, 9 aa, Dengue virus
MEVTARWLW

SEQ ID NO: 10603 - protein, 9 aa, Dengue virus
EVTARWLWG

SEQ ID NO: 10604 - protein, 9 aa, Dengue virus
VTARWLWGF

SEQ ID NO: 10605 - protein, 9 aa, Dengue virus
TARWLWGFL

SEQ ID NO: 10606 - protein, 9 aa, Dengue virus
ARWLWGFLS

SEQ ID NO: 10607 - protein, 9 aa, Dengue virus
RWLWGFLSR

SEQ ID NO: 10608 - protein, 9 aa, Dengue virus
WLWSFLSRN

SEQ ID NO: 10609 - protein, 9 aa, Dengue virus
LWSFLSRNK

SEQ ID NO: 10610 - protein, 9 aa, Dengue virus
WSFLSRNKK

SEQ ID NO: 10611 - protein, 9 aa, Dengue virus
SFLSRNKKP

SEQ ID NO: 10612 - protein, 9 aa, Dengue virus
NAAIGAVFI

SEQ ID NO: 10613 - protein, 9 aa, Dengue virus
AAIGAVFID

SEQ ID NO: 10614 - protein, 9 aa, Dengue virus
AIGAVFIDE

SEQ ID NO: 10615 - protein, 9 aa, Dengue virus
IGAVFIDEN

SEQ ID NO: 10616 - protein, 9 aa, Dengue virus
GAVFIDENQ

SEQ ID NO: 10617 - protein, 9 aa, Dengue virus
AVFIDENQW

SEQ ID NO: 10618 - protein, 9 aa, Dengue virus
VFIDENQWN

SEQ ID NO: 10619 - protein, 9 aa, Dengue virus
FIDENQWNS

SEQ ID NO: 10620 - protein, 9 aa, Dengue virus
IDENQWNSA

SEQ ID NO: 10621 - protein, 9 aa, Dengue virus
SAKEAVEDD

SEQ ID NO: 10622 - protein, 9 aa, Dengue virus
AKEAVEDDR

SEQ ID NO: 10623 - protein, 9 aa, Dengue virus
KEAVEDDRF

SEQ ID NO: 10624 - protein, 9 aa, Dengue virus
EAVEDDRFW

SEQ ID NO: 10625 - protein, 9 aa, Dengue virus
AVEDDRFWD

SEQ ID NO: 10626 - protein, 9 aa, Dengue virus
VEDDRFWDL

SEQ ID NO: 10627 - protein, 9 aa, Dengue virus
EDDRFWDLV

SEQ ID NO: 10628 - protein, 9 aa, Dengue virus
LVQKERELH

SEQ ID NO: 10629 - protein, 9 aa, Dengue virus
VQKERELHK

SEQ ID NO: 10630 - protein, 9 aa, Dengue virus
QKERELHKQ

SEQ ID NO: 10631 - protein, 9 aa, Dengue virus
KERELHKQG

SEQ ID NO: 10632 - protein, 9 aa, Dengue virus
HWFSRENSF

SEQ ID NO: 10633 - protein, 9 aa, Dengue virus
WFSRENSFS

SEQ ID NO: 10634 - protein, 9 aa, Dengue virus
FSRENSFSG

SEQ ID NO: 10635 - protein, 9 aa, Dengue virus
SRENSFSGV

SEQ ID NO: 10636 - protein, 9 aa, Dengue virus
RENSFSGVE

SEQ ID NO: 10637 - protein, 9 aa, Dengue virus
ENSFSGVEG

SEQ ID NO: 10638 - protein, 9 aa, Dengue virus
NSFSGVEGE

SEQ ID NO: 10639 - protein, 9 aa, Dengue virus
SFSGVEGEG

SEQ ID NO: 10640 - protein, 9 aa, Dengue virus
FSGVEGEGL

SEQ ID NO: 10641 - protein, 9 aa, Dengue virus
GVEGEGLHR

SEQ ID NO: 10642 - protein, 9 aa, Dengue virus
VEGEGLHRL

SEQ ID NO: 10643 - protein, 9 aa, Dengue virus
EGEGLHRLG

SEQ ID NO: 10644 - protein, 9 aa, Dengue virus
GEGLHRLGY

SEQ ID NO: 10645 - protein, 9 aa, Dengue virus
EGLHRLGYI

SEQ ID NO: 10646 - protein, 9 aa, Dengue virus
RLGYILRDI

SEQ ID NO: 10647 - protein, 9 aa, Dengue virus
GYILRDISN

SEQ ID NO: 10648 - protein, 9 aa, Dengue virus
YILRDISNI

SEQ ID NO: 10649 - protein, 9 aa, Dengue virus
ILRDISNIP

SEQ ID NO: 10650 - protein, 9 aa, Dengue virus
LRDISNIPG

SEQ ID NO: 10651 - protein, 9 aa, Dengue virus
RDISNIPGG

SEQ ID NO: 10652 - protein, 9 aa, Dengue virus
DISNIPGGN

SEQ ID NO: 10653 - protein, 9 aa, Dengue virus
ISNIPGGNM

SEQ ID NO: 10654 - protein, 9 aa, Dengue virus
SNIPGGNMY

SEQ ID NO: 10655 - protein, 9 aa, Dengue virus
NIPGGNMYA

SEQ ID NO: 10656 - protein, 9 aa, Dengue virus
IPGGSMYAD

SEQ ID NO: 10657 - protein, 9 aa, Dengue virus
SGGNMYADD

SEQ ID NO: 10658 - protein, 9 aa, Dengue virus
GGSMYADDT

SEQ ID NO: 10659 - protein, 9 aa, Dengue virus
GSMYADDTA

SEQ ID NO: 10660 - protein, 9 aa, Dengue virus
SMYADDTAG

SEQ ID NO: 10661 - protein, 9 aa, Dengue virus
TRVTEDDLQ

SEQ ID NO: 10662 - protein, 9 aa, Dengue virus
RVTEDDLQN

SEQ ID NO: 10663 - protein, 9 aa, Dengue virus
VTEDDLQNE

SEQ ID NO: 10664 - protein, 9 aa, Dengue virus
EDDLQNEAR

SEQ ID NO: 10665 - protein, 9 aa, Dengue virus
DDLQNEARI

SEQ ID NO: 10666 - protein, 9 aa, Dengue virus
DLQNEARIT

SEQ ID NO: 10667 - protein, 9 aa, Dengue virus
LQNEARITD

SEQ ID NO: 10668 - protein, 9 aa, Dengue virus
QNEARITDI

SEQ ID NO: 10669 - protein, 9 aa, Dengue virus
NEARITDIM

SEQ ID NO: 10670 - protein, 9 aa, Dengue virus
EARITDIME

SEQ ID NO: 10671 - protein, 9 aa, Dengue virus
ARITDIMEP

SEQ ID NO: 10672 - protein, 9 aa, Dengue virus
RITDIMEPE

SEQ ID NO: 10673 - protein, 9 aa, Dengue virus
ITEIMEPEH

SEQ ID NO: 10674 - protein, 9 aa, Dengue virus
TEIMEPEHA

SEQ ID NO: 10675 - protein, 9 aa, Dengue virus
EIMEPEHAL

SEQ ID NO: 10676 - protein, 9 aa, Dengue virus
EPEHALLAT

SEQ ID NO: 10677 - protein, 9 aa, Dengue virus
PEHALLATS

SEQ ID NO: 10678 - protein, 9 aa, Dengue virus
EHALLATSI

SEQ ID NO: 10679 - protein, 9 aa, Dengue virus
HALLATSIF

SEQ ID NO: 10680 - protein, 9 aa, Dengue virus
ALLATSIFK

SEQ ID NO: 10681 - protein, 9 aa, Dengue virus
LLATSIFKL

SEQ ID NO: 10682 - protein, 9 aa, Dengue virus
LATSIFKLT

SEQ ID NO: 10683 - protein, 9 aa, Dengue virus
ATSIFKLTY

SEQ ID NO: 10684 - protein, 9 aa, Dengue virus
TSIFKLTYQ

SEQ ID NO: 10685 - protein, 9 aa, Dengue virus
AIFKLTYQN

SEQ ID NO: 10686 - protein, 9 aa, Dengue virus
KVVRVQRPT

SEQ ID NO: 10687 - protein, 9 aa, Dengue virus
VVRVQRPAR

SEQ ID NO: 10688 - protein, 9 aa, Dengue virus
VRVQRPAKS

SEQ ID NO: 10689 - protein, 9 aa, Dengue virus
RVQRPAKSG

SEQ ID NO: 10690 - protein, 9 aa, Dengue virus
VQRPAKSGT

SEQ ID NO: 10691 - protein, 9 aa, Dengue virus
QRPAKSGTV

SEQ ID NO: 10692 - protein, 9 aa, Dengue virus
RPAKSGTVM

SEQ ID NO: 10693 - protein, 9 aa, Dengue virus
PAKSGTVMD

SEQ ID NO: 10694 - protein, 9 aa, Dengue virus
AKSGTVMDV

SEQ ID NO: 10695 - protein, 9 aa, Dengue virus
KSGTVMDVI

SEQ ID NO: 10696 - protein, 9 aa, Dengue virus
SGTVMDVIS

SEQ ID NO: 10697 - protein, 9 aa, Dengue virus
GLNTFTNMG

SEQ ID NO: 10698 - protein, 9 aa, Dengue virus
LNTFTNMEV

SEQ ID NO: 10699 - protein, 9 aa, Dengue virus
NTFTNMEVQ

SEQ ID NO: 10700 - protein, 9 aa, Dengue virus
TFTNMEVQL

SEQ ID NO: 10701 - protein, 9 aa, Dengue virus
FTNMEVQLI

SEQ ID NO: 10702 - protein, 9 aa, Dengue virus
TNMEVQLIR

SEQ ID NO: 10703 - protein, 9 aa, Dengue virus
NMEVQLIRQ

SEQ ID NO: 10704 - protein, 9 aa, Dengue virus
MEVQLIRQM

SEQ ID NO: 10705 - protein, 9 aa, Dengue virus
EVQLIRQME

SEQ ID NO: 10706 - protein, 9 aa, Dengue virus
VQLIRQMES

SEQ ID NO: 10707 - protein, 9 aa, Dengue virus
LIRQMESEE

SEQ ID NO: 10708 - protein, 9 aa, Dengue virus
IRQMESEEI

SEQ ID NO: 10709 - protein, 9 aa, Dengue virus
RQMESEEIF

SEQ ID NO: 10710 - protein, 9 aa, Dengue virus
QMESEGIFL

SEQ ID NO: 10711 - protein, 9 aa, Dengue virus
MESEGIFLP

SEQ ID NO: 10712 - protein, 9 aa, Dengue virus
ERLRRMAIS

SEQ ID NO: 10713 - protein, 9 aa, Dengue virus
RLRRMAISG

SEQ ID NO: 10714 - protein, 9 aa, Dengue virus
LRRMAISGD

SEQ ID NO: 10715 - protein, 9 aa, Dengue virus
RRMAISGDD

SEQ ID NO: 10716 - protein, 9 aa, Dengue virus
GDDCVVKPT

SEQ ID NO: 10717 - protein, 9 aa, Dengue virus
DDCVVKPTD

SEQ ID NO: 10718 - protein, 9 aa, Dengue virus
DCVVKPTDD

SEQ ID NO: 10719 - protein, 9 aa, Dengue virus
CVVKPTDDR

SEQ ID NO: 10720 - protein, 9 aa, Dengue virus
VVKPTDDRF

SEQ ID NO: 10721 - protein, 9 aa, Dengue virus
VKPTDDRFA

SEQ ID NO: 10722 - protein, 9 aa, Dengue virus
KPTDDRFAT

SEQ ID NO: 10723 - protein, 9 aa, Dengue virus
PTDDRFATA

SEQ ID NO: 10724 - protein, 9 aa, Dengue virus
TDDRFATAL

SEQ ID NO: 10725 - protein, 9 aa, Dengue virus
DDRFATALI

SEQ ID NO: 10726 - protein, 9 aa, Dengue virus
DRFATALIA

SEQ ID NO: 10727 - protein, 9 aa, Dengue virus
RFATALIAL

SEQ ID NO: 10728 - protein, 9 aa, Dengue virus
FATALIALN

SEQ ID NO: 10729 - protein, 9 aa, Dengue virus
ATALIALND

SEQ ID NO: 10730 - protein, 9 aa, Dengue virus
TALIALNDM

SEQ ID NO: 10731 - protein, 9 aa, Dengue virus
ALIALNDMG

SEQ ID NO: 10732 - protein, 9 aa, Dengue virus
LIALNDMGK

SEQ ID NO: 10733 - protein, 9 aa, Dengue virus
IALNDMGKV

SEQ ID NO: 10734 - protein, 9 aa, Dengue virus
DMGKVRKDV

SEQ ID NO: 10735 - protein, 9 aa, Dengue virus
MGKVRKDVP

SEQ ID NO: 10736 - protein, 9 aa, Dengue virus
GKVRKDVPQ

SEQ ID NO: 10737 - protein, 9 aa, Dengue virus
KVRKDVPQW

SEQ ID NO: 10738 - protein, 9 aa, Dengue virus
VRKDVPQWE

SEQ ID NO: 10739 - protein, 9 aa, Dengue virus
RKDVPQWEP

SEQ ID NO: 10740 - protein, 9 aa, Dengue virus
KDVPQWEPS

SEQ ID NO: 10741 - protein, 9 aa, Dengue virus
DVPQWEPSK

SEQ ID NO: 10742 - protein, 9 aa, Dengue virus
VPQWEPSKG

SEQ ID NO: 10743 - protein, 9 aa, Dengue virus
GWSLKETAC

SEQ ID NO: 10744 - protein, 9 aa, Dengue virus
SLKETACLG

SEQ ID NO: 10745 - protein, 9 aa, Dengue virus
AANAICSAD

SEQ ID NO: 10746 - protein, 9 aa, Dengue virus
ANAICSADP

SEQ ID NO: 10747 - protein, 9 aa, Dengue virus
NAICSAVPI

SEQ ID NO: 10748 - protein, 9 aa, Dengue virus
PVDWIPTSR

SEQ ID NO: 10749 - protein, 9 aa, Dengue virus
VDWIPTSRT

SEQ ID NO: 10750 - protein, 9 aa, Dengue virus
DWIPTSRTT

SEQ ID NO: 10751 - protein, 9 aa, Dengue virus
WIPTSRTTW

SEQ ID NO: 10752 - protein, 9 aa, Dengue virus
IPTSRTTWS

SEQ ID NO: 10753 - protein, 9 aa, Dengue virus
NPWMEDKTR

SEQ ID NO: 10754 - protein, 9 aa, Dengue virus
PWMEDKTHV

SEQ ID NO: 10755 - protein, 9 aa, Dengue virus
WMEDKTHVS

SEQ ID NO: 10756 - protein, 9 aa, Dengue virus
MEDKTHVSS

SEQ ID NO: 10757 - protein, 9 aa, Dengue virus
EDKTHVSSW

SEQ ID NO: 10758 - protein, 9 aa, Dengue virus
DKTHVSSWE

SEQ ID NO: 10759 - protein, 9 aa, Dengue virus
VSSWEEVPY

SEQ ID NO: 10760 - protein, 9 aa, Dengue virus
SSWEDVPYL

SEQ ID NO: 10761 - protein, 9 aa, Dengue virus
SWEDVPYLG

SEQ ID NO: 10762 - protein, 9 aa, Dengue virus
WEDVPYLGK

SEQ ID NO: 10763 - protein, 9 aa, Dengue virus
EDVPYLGKR

SEQ ID NO: 10764 - protein, 9 aa, Dengue virus
EVPYLGKRE

SEQ ID NO: 10765 - protein, 9 aa, Dengue virus
LTARATWAS

SEQ ID NO: 10766 - protein, 9 aa, Dengue virus
TARATWASN

SEQ ID NO: 10767 - protein, 9 aa, Dengue virus
ARATWASNI

SEQ ID NO: 10768 - protein, 9 aa, Dengue virus
RATWASNIQ

SEQ ID NO: 10769 - protein, 9 aa, Dengue virus
ATWASNIQV

SEQ ID NO: 10770 - protein, 9 aa, Dengue virus
TWASNIQVA

SEQ ID NO: 10771 - protein, 9 aa, Dengue virus
WASNIQVAI

SEQ ID NO: 10772 - protein, 9 aa, Dengue virus
ASNIQVAIN

SEQ ID NO: 10773 - protein, 9 aa, Dengue virus
SNIQVAINQ

SEQ ID NO: 10774 - protein, 9 aa, Dengue virus
AINQVRRLL

SEQ ID NO: 10775 - protein, 9 aa, Dengue virus
INQVRRLLG

SEQ ID NO: 10776 - protein, 9 aa, Dengue virus
NQVRRLLGN

SEQ ID NO: 10777 - protein, 9 aa, Dengue virus
QVRRLLGNE

SEQ ID NO: 10778 - protein, 9 aa, Dengue virus
VRRLLGNEN

SEQ ID NO: 10779 - protein, 9 aa, Dengue virus
RRLLGNENY

SEQ ID NO: 10780 - protein, 9 aa, Dengue virus
RLLGNENYL

SEQ ID NO: 10781 - protein, 9 aa, Dengue virus
LLGNENYLD

SEQ ID NO: 10782 - protein, 9 aa, Dengue virus
LGNENYLDY

SEQ ID NO: 10783 - protein, 9 aa, Dengue virus
GNENYSDYM

SEQ ID NO: 10784 - protein, 9 aa, Dengue virus
NENYSDYMT

SEQ ID NO: 10785 - protein, 9 aa, Dengue virus
ENYSDYMTS

SEQ ID NO: 10786 - protein, 9 aa, Dengue virus
NYSDYMTSM

SEQ ID NO: 10787 - protein, 9 aa, Dengue virus
YSDYMTSMK

SEQ ID NO: 10788 - protein, 9 aa, Dengue virus
SDYMTSMKR

SEQ ID NO: 10789 - protein, 9 aa, Dengue virus
DYMISMKRF

SEQ ID NO: 10790 - protein, 9 aa, Dengue virus
YMISMKRFK

SEQ ID NO: 10791 - protein, 9 aa, Dengue virus
MISMKRFKN

SEQ ID NO: 10792 - protein, 9 aa, Dengue virus
ISMKRFKNE

SEQ ID NO: 10793 - protein, 9 aa, Dengue virus
SMKRFKNEG

SEQ ID NO: 10794 - protein, 9 aa, Dengue virus
MINQRKKTG

SEQ ID NO: 10795 - protein, 9 aa, Dengue virus
NNQRKKTGQ

SEQ ID NO: 10796 - protein, 9 aa, Dengue virus
NQRKKTGQP

SEQ ID NO: 10797 - protein, 9 aa, Dengue virus
QRKKTGQPS

SEQ ID NO: 10798 - protein, 9 aa, Dengue virus
RKKTGQPSF

SEQ ID NO: 10799 - protein, 9 aa, Dengue virus
KKTGQPSFN

SEQ ID NO: 10800 - protein, 9 aa, Dengue virus
KTGQPSFNM

SEQ ID NO: 10801 - protein, 9 aa, Dengue virus
TGQPSFNML

SEQ ID NO: 10802 - protein, 9 aa, Dengue virus
GQPSFNMLK

SEQ ID NO: 10803 - protein, 9 aa, Dengue virus
LSGQGPMKF

SEQ ID NO: 10804 - protein, 9 aa, Dengue virus
SGQGPMKFV

SEQ ID NO: 10805 - protein, 9 aa, Dengue virus
GQGPMKFVM

SEQ ID NO: 10806 - protein, 9 aa, Dengue virus
QGPMKFVMA

SEQ ID NO: 10807 - protein, 9 aa, Dengue virus
GPMKFVMAF

SEQ ID NO: 10808 - protein, 9 aa, Dengue virus
PMKFVMAFI

SEQ ID NO: 10809 - protein, 9 aa, Dengue virus
MKFVMAFIA

SEQ ID NO: 10810 - protein, 9 aa, Dengue virus
KFVMAFIAF

SEQ ID NO: 10811 - protein, 9 aa, Dengue virus
FVMAFIAFL

SEQ ID NO: 10812 - protein, 9 aa, Dengue virus
ARWSSFKKN

SEQ ID NO: 10813 - protein, 9 aa, Dengue virus
RWSSFKKNG

SEQ ID NO: 10814 - protein, 9 aa, Dengue virus
WSSFKKNGA

SEQ ID NO: 10815 - protein, 9 aa, Dengue virus
SSFKKNGAI

SEQ ID NO: 10816 - protein, 9 aa, Dengue virus
NGAIRVLRG

SEQ ID NO: 10817 - protein, 9 aa, Dengue virus
VLRGFKREI

SEQ ID NO: 10818 - protein, 9 aa, Dengue virus
LRGFKREIS

SEQ ID NO: 10819 - protein, 9 aa, Dengue virus
RGFKKEVSN

SEQ ID NO: 10820 - protein, 9 aa, Dengue virus
GFKKEVSNM

SEQ ID NO: 10821 - protein, 9 aa, Dengue virus
FKKEVSNML

SEQ ID NO: 10822 - protein, 9 aa, Dengue virus
KKEVSNMLN

SEQ ID NO: 10823 - protein, 9 aa, Dengue virus
MLNIINRRK

SEQ ID NO: 10824 - protein, 9 aa, Dengue virus
INRRKRSVT

SEQ ID NO: 10825 - protein, 9 aa, Dengue virus
NRRRKSVTM

SEQ ID NO: 10826 - protein, 9 aa, Dengue virus
RRKRSVTMF

SEQ ID NO: 10827 - protein, 9 aa, Dengue virus
RKRSVTMFL

SEQ ID NO: 10828 - protein, 9 aa, Dengue virus
RSVTMFLML

SEQ ID NO: 10829 - protein, 9 aa, Dengue virus
PTVLAFHLT

SEQ ID NO: 10830 - protein, 9 aa, Dengue virus
TVLAFHLTT

SEQ ID NO: 10831 - protein, 9 aa, Dengue virus
VLAFHLTTR

SEQ ID NO: 10832 - protein, 9 aa, Dengue virus
GGEPHMVVS

SEQ ID NO: 10833 - protein, 9 aa, Dengue virus
GEPHMVVSK

SEQ ID NO: 10834 - protein, 9 aa, Dengue virus
EPHMVVSKQ

SEQ ID NO: 10835 - protein, 9 aa, Dengue virus
PHMVVSKQE

SEQ ID NO: 10836 - protein, 9 aa, Dengue virus
HMVVSKQER

SEQ ID NO: 10837 - protein, 9 aa, Dengue virus
MVVSKQERG

SEQ ID NO: 10838 - protein, 9 aa, Dengue virus
VVSKQERGK

SEQ ID NO: 10839 - protein, 9 aa, Dengue virus
VGKQERGKS

SEQ ID NO: 10840 - protein, 9 aa, Dengue virus
GKQERGKSL

SEQ ID NO: 10841 - protein, 9 aa, Dengue virus
KSLLFKTST

SEQ ID NO: 10842 - protein, 9 aa, Dengue virus
SLLFKTSTG

SEQ ID NO: 10843 - protein, 9 aa, Dengue virus
LLFKTSAGI

SEQ ID NO: 10844 - protein, 9 aa, Dengue virus
LFKTSAGIN

SEQ ID NO: 10845 - protein, 9 aa, Dengue virus
FKTSAGINM

SEQ ID NO: 10846 - protein, 9 aa, Dengue virus
KTSAGINMC

SEQ ID NO: 10847 - protein, 9 aa, Dengue virus
TSAGINMCT

SEQ ID NO: 10848 - protein, 9 aa, Dengue virus
SAGINMCTL

SEQ ID NO: 10849 - protein, 9 aa, Dengue virus
AGINMCTLI

SEQ ID NO: 10850 - protein, 9 aa, Dengue virus
AMDLGELCD

SEQ ID NO: 10851 - protein, 9 aa, Dengue virus
MDLGELCDD

SEQ ID NO: 10852 - protein, 9 aa, Dengue virus
DLGELCDDT

SEQ ID NO: 10853 - protein, 9 aa, Dengue virus
LGELCDDTM

SEQ ID NO: 10854 - protein, 9 aa, Dengue virus
GELCDDTMT

SEQ ID NO: 10855 - protein, 9 aa, Dengue virus
ELCDDTMTY

SEQ ID NO: 10856 - protein, 9 aa, Dengue virus
LCDDTMTYK

SEQ ID NO: 10857 - protein, 9 aa, Dengue virus
CEDTITYKC

SEQ ID NO: 10858 - protein, 9 aa, Dengue virus
EDTITYKCP

SEQ ID NO: 10859 - protein, 9 aa, Dengue virus
DTITYKCPR

SEQ ID NO: 10860 - protein, 9 aa, Dengue virus
TITYKCPRI

SEQ ID NO: 10861 - protein, 9 aa, Dengue virus
MTYKCPRIS

SEQ ID NO: 10862 - protein, 9 aa, Dengue virus
TYKCPRISE

SEQ ID NO: 10863 - protein, 9 aa, Dengue virus
YKCPQITEA

SEQ ID NO: 10864 - protein, 9 aa, Dengue virus
KCPQITEAE

SEQ ID NO: 10865 - protein, 9 aa, Dengue virus
CPQITEAEP

SEQ ID NO: 10866 - protein, 9 aa, Dengue virus
PQITEAEPD

SEQ ID NO: 10867 - protein, 9 aa, Dengue virus
QITEAEPDD

SEQ ID NO: 10868 - protein, 9 aa, Dengue virus
ITEVEPDDV

SEQ ID NO: 10869 - protein, 9 aa, Dengue virus
TEVEPDDVD

SEQ ID NO: 10870 - protein, 9 aa, Dengue virus
EVEPDDVDC

SEQ ID NO: 10871 - protein, 9 aa, Dengue virus
VEPDDVDCW

SEQ ID NO: 10872 - protein, 9 aa, Dengue virus
VDCWCNTTD

SEQ ID NO: 10873 - protein, 9 aa, Dengue virus
DCWCNTTDT

SEQ ID NO: 10874 - protein, 9 aa, Dengue virus
CWCNTTDTW

SEQ ID NO: 10875 - protein, 9 aa, Dengue virus
WCNTTDTWV

SEQ ID NO: 10876 - protein, 9 aa, Dengue virus
CNTTDTWVT

SEQ ID NO: 10877 - protein, 9 aa, Dengue virus
NTTDTWVTY

SEQ ID NO: 10878 - protein, 9 aa, Dengue virus
TTDTWVTYG

SEQ ID NO: 10879 - protein, 9 aa, Dengue virus
GTCTQIGEH

SEQ ID NO: 10880 - protein, 9 aa, Dengue virus
TCSQTGGHR

SEQ ID NO: 10881 - protein, 9 aa, Dengue virus
CTQIGEHRR

SEQ ID NO: 10882 - protein, 9 aa, Dengue virus
TQIGEHRRD

SEQ ID NO: 10883 - protein, 9 aa, Dengue virus
QIGEHRRDK

SEQ ID NO: 10884 - protein, 9 aa, Dengue virus
IGEHRRDKR

SEQ ID NO: 10885 - protein, 9 aa, Dengue virus
EGAWRQIQK

SEQ ID NO: 10886 - protein, 9 aa, Dengue virus
GAWRQIQKV

SEQ ID NO: 10887 - protein, 9 aa, Dengue virus
AWRQIQKVE

SEQ ID NO: 10888 - protein, 9 aa, Dengue virus
WRQIQKVET

SEQ ID NO: 10889 - protein, 9 aa, Dengue virus
RQIQKVETW

SEQ ID NO: 10890 - protein, 9 aa, Dengue virus
QIQRVETWV

SEQ ID NO: 10891 - protein, 9 aa, Dengue virus
IQRVETWVL

SEQ ID NO: 10892 - protein, 9 aa, Dengue virus
LRHPGFTVM

SEQ ID NO: 10893 - protein, 9 aa, Dengue virus
RHPGFTVMA

SEQ ID NO: 10894 - protein, 9 aa, Dengue virus
HPGFTVTAL

SEQ ID NO: 10895 - protein, 9 aa, Dengue virus
PGFTVTALF

SEQ ID NO: 10896 - protein, 9 aa, Dengue virus
GFTVTALFL

SEQ ID NO: 10897 - protein, 9 aa, Dengue virus
FTVTALFLA

SEQ ID NO: 10898 - protein, 9 aa, Dengue virus
ALFLAHVIG

SEQ ID NO: 10899 - protein, 9 aa, Dengue virus
LFLAHVIGT

SEQ ID NO: 10900 - protein, 9 aa, Dengue virus
ELLKTEVAN

SEQ ID NO: 10901 - protein, 9 aa, Dengue virus
KTEVTDPAV

SEQ ID NO: 10902 - protein, 9 aa, Dengue virus
TEVTDPAVL

SEQ ID NO: 10903 - protein, 9 aa, Dengue virus
EVTDPAVLR

SEQ ID NO: 10904 - protein, 9 aa, Dengue virus
VTDPAVLRK

SEQ ID NO: 10905 - protein, 9 aa, Dengue virus
TDPAVLRKL

SEQ ID NO: 10906 - protein, 9 aa, Dengue virus
DPAVLRKLC

SEQ ID NO: 10907 - protein, 9 aa, Dengue virus
ATLVEEQDT

SEQ ID NO: 10908 - protein, 9 aa, Dengue virus
TLVEEQDTN

SEQ ID NO: 10909 - protein, 9 aa, Dengue virus
LVEEQDTNF

SEQ ID NO: 10910 - protein, 9 aa, Dengue virus
VEEQDTNFV

SEQ ID NO: 10911 - protein, 9 aa, Dengue virus
EEQDSNFVC

SEQ ID NO: 10912 - protein, 9 aa, Dengue virus
EQDSNFVCR

SEQ ID NO: 10913 - protein, 9 aa, Dengue virus
QDSNFVCRR

SEQ ID NO: 10914 - protein, 9 aa, Dengue virus
DSNFVCRRT

SEQ ID NO: 10915 - protein, 9 aa, Dengue virus
SNFVCRRTF

SEQ ID NO: 10916 - protein, 9 aa, Dengue virus
GKGSLMTCA

SEQ ID NO: 10917 - protein, 9 aa, Dengue virus
KGSLMTCAK

SEQ ID NO: 10918 - protein, 9 aa, Dengue virus
GSLMTCAKF

SEQ ID NO: 10919 - protein, 9 aa, Dengue virus
SLMTCAKFK

SEQ ID NO: 10920 - protein, 9 aa, Dengue virus
LMTCAKFKC

SEQ ID NO: 10921 - protein, 9 aa, Dengue virus
MTCAKFKCV

SEQ ID NO: 10922 - protein, 9 aa, Dengue virus
VTKLEGKIA

SEQ ID NO: 10923 - protein, 9 aa, Dengue virus
TKLEGKIAQ

SEQ ID NO: 10924 - protein, 9 aa, Dengue virus
KLEGKIAQY

SEQ ID NO: 10925 - protein, 9 aa, Dengue virus
LEGKIAQYE

SEQ ID NO: 10926 - protein, 9 aa, Dengue virus
EGKIAQYEN

SEQ ID NO: 10927 - protein, 9 aa, Dengue virus
GKIAQYENL

SEQ ID NO: 10928 - protein, 9 aa, Dengue virus
KIAQYENLK

SEQ ID NO: 10929 - protein, 9 aa, Dengue virus
IAQYENLKY

SEQ ID NO: 10930 - protein, 9 aa, Dengue virus
AQYENLKYS

SEQ ID NO: 10931 - protein, 9 aa, Dengue virus
HQVGNETTD

SEQ ID NO: 10932 - protein, 9 aa, Dengue virus
QVGNETTDH

SEQ ID NO: 10933 - protein, 9 aa, Dengue virus
VGNETTDHG

SEQ ID NO: 10934 - protein, 9 aa, Dengue virus
GNETTDHGT

SEQ ID NO: 10935 - protein, 9 aa, Dengue virus
NETTEHGTT

SEQ ID NO: 10936 - protein, 9 aa, Dengue virus
ETTEHGTTA

SEQ ID NO: 10937 - protein, 9 aa, Dengue virus
TTEHGTTAT

SEQ ID NO: 10938 - protein, 9 aa, Dengue virus
TDHGTTATI

SEQ ID NO: 10939 - protein, 9 aa, Dengue virus
DHGTTATIT

SEQ ID NO: 10940 - protein, 9 aa, Dengue virus
TITPQAPST

SEQ ID NO: 10941 - protein, 9 aa, Dengue virus
ITPQAPSTE

SEQ ID NO: 10942 - protein, 9 aa, Dengue virus
TPQAPSTEI

SEQ ID NO: 10943 - protein, 9 aa, Dengue virus
PQAPSTEIQ

SEQ ID NO: 10944 - protein, 9 aa, Dengue virus
QAPSTEIQL

SEQ ID NO: 10945 - protein, 9 aa, Dengue virus
APSTEIQLT

SEQ ID NO: 10946 - protein, 9 aa, Dengue virus
PSTEIQLTD

SEQ ID NO: 10947 - protein, 9 aa, Dengue virus
STEIQLTDY

SEQ ID NO: 10948 - protein, 9 aa, Dengue virus
EIQLTDYGV

SEQ ID NO: 10949 - protein, 9 aa, Dengue virus
IQLTDYGVL

SEQ ID NO: 10950 - protein, 9 aa, Dengue virus
QLTDYGVLT

SEQ ID NO: 10951 - protein, 9 aa, Dengue virus
LTDYGVLTL

SEQ ID NO: 10952 - protein, 9 aa, Dengue virus
TDYGVLTLD

SEQ ID NO: 10953 - protein, 9 aa, Dengue virus
EMVLLTMEK

SEQ ID NO: 10954 - protein, 9 aa, Dengue virus
MVLLTMKGK

SEQ ID NO: 10955 - protein, 9 aa, Dengue virus
VLLTMKEKA

SEQ ID NO: 10956 - protein, 9 aa, Dengue virus
LLTMKEKAW

SEQ ID NO: 10957 - protein, 9 aa, Dengue virus
LTMKEKAWL

SEQ ID NO: 10958 - protein, 9 aa, Dengue virus
TMKEKAWLV

SEQ ID NO: 10959 - protein, 9 aa, Dengue virus
MKEKAWLVH

SEQ ID NO: 10960 - protein, 9 aa, Dengue virus
KEKAWLVHK

SEQ ID NO: 10961 - protein, 9 aa, Dengue virus
EKAWLVHKQ

SEQ ID NO: 10962 - protein, 9 aa, Dengue virus
PLPWTSGAL

SEQ ID NO: 10963 - protein, 9 aa, Dengue virus
LPWTSGALT

SEQ ID NO: 10964 - protein, 9 aa, Dengue virus
TLQETWNRQ

SEQ ID NO: 10965 - protein, 9 aa, Dengue virus
LQETWNRQD

SEQ ID NO: 10966 - protein, 9 aa, Dengue virus
MSGTTTIFA

SEQ ID NO: 10967 - protein, 9 aa, Dengue virus
MDKLTLRGM

SEQ ID NO: 10968 - protein, 9 aa, Dengue virus
DKLTLRGMS

SEQ ID NO: 10969 - protein, 9 aa, Dengue virus
KLTLRGMSY

SEQ ID NO: 10970 - protein, 9 aa, Dengue virus
LTLRGMSYV

SEQ ID NO: 10971 - protein, 9 aa, Dengue virus
TLRGMSYVM

SEQ ID NO: 10972 - protein, 9 aa, Dengue virus
LRGMSYVMC

SEQ ID NO: 10973 - protein, 9 aa, Dengue virus
RGMSYVMCT

SEQ ID NO: 10974 - protein, 9 aa, Dengue virus
GISYVMCTG

SEQ ID NO: 10975 - protein, 9 aa, Dengue virus
SYVMCTGPF

SEQ ID NO: 10976 - protein, 9 aa, Dengue virus
YVMCTGLFK

SEQ ID NO: 10977 - protein, 9 aa, Dengue virus
VMCTGPFKL

SEQ ID NO: 10978 - protein, 9 aa, Dengue virus
MCTGPFKLE

SEQ ID NO: 10979 - protein, 9 aa, Dengue virus
CTGPFKLEK

SEQ ID NO: 10980 - protein, 9 aa, Dengue virus
TGPFKLEKE

SEQ ID NO: 10981 - protein, 9 aa, Dengue virus
GLFKLEKEV

SEQ ID NO: 10982 - protein, 9 aa, Dengue virus
LFKLEKEVA

SEQ ID NO: 10983 - protein, 9 aa, Dengue virus
HGTVLVQIR

SEQ ID NO: 10984 - protein, 9 aa, Dengue virus
GTVLVQIRY

SEQ ID NO: 10985 - protein, 9 aa, Dengue virus
TVLVQIRYE

SEQ ID NO: 10986 - protein, 9 aa, Dengue virus
VLVQIRYEG

SEQ ID NO: 10987 - protein, 9 aa, Dengue virus
LVQIRYEGT

SEQ ID NO: 10988 - protein, 9 aa, Dengue virus
VQIRYEGTD

SEQ ID NO: 10989 - protein, 9 aa, Dengue virus
QIRYEGTDA

SEQ ID NO: 10990 - protein, 9 aa, Dengue virus
IRYEGTDAP

SEQ ID NO: 10991 - protein, 9 aa, Dengue virus
APCKIPFSS

SEQ ID NO: 10992 - protein, 9 aa, Dengue virus
PCKIPFSSQ

SEQ ID NO: 10993 - protein, 9 aa, Dengue virus
CKIPFSSQD

SEQ ID NO: 10994 - protein, 9 aa, Dengue virus
KIPFSSQDE

SEQ ID NO: 10995 - protein, 9 aa, Dengue virus
QDEKGATQN

SEQ ID NO: 10996 - protein, 9 aa, Dengue virus
DEKGATQNG

SEQ ID NO: 10997 - protein, 9 aa, Dengue virus
EKGATQNGR

SEQ ID NO: 10998 - protein, 9 aa, Dengue virus
KGATQNGRL

SEQ ID NO: 10999 - protein, 9 aa, Dengue virus
GATQNGRLI

SEQ ID NO: 11000 - protein, 9 aa, Dengue virus
ATQNGRLIT

SEQ ID NO: 11001 - protein, 9 aa, Dengue virus
TQNGRLVTA

SEQ ID NO: 11002 - protein, 9 aa, Dengue virus
QNGRVITAN

SEQ ID NO: 11003 - protein, 9 aa, Dengue virus
NGRVITANP

SEQ ID NO: 11004 - protein, 9 aa, Dengue virus
GRVITANPI

SEQ ID NO: 11005 - protein, 9 aa, Dengue virus
RVITANPIV

SEQ ID NO: 11006 - protein, 9 aa, Dengue virus
VITANPIVT

SEQ ID NO: 11007 - protein, 9 aa, Dengue virus
ANPIVTDRE

SEQ ID NO: 11008 - protein, 9 aa, Dengue virus
NPIVTDREK

SEQ ID NO: 11009 - protein, 9 aa, Dengue virus
PIVTDREKP

SEQ ID NO: 11010 - protein, 9 aa, Dengue virus
IVTDREKPV

SEQ ID NO: 11011 - protein, 9 aa, Dengue virus
VTDREKPVN

SEQ ID NO: 11012 - protein, 9 aa, Dengue virus
TDREKPVNI

SEQ ID NO: 11013 - protein, 9 aa, Dengue virus
DREKPVNIE

SEQ ID NO: 11014 - protein, 9 aa, Dengue virus
KDKPVNIEA

SEQ ID NO: 11015 - protein, 9 aa, Dengue virus
DKPVNIEAE

SEQ ID NO: 11016 - protein, 9 aa, Dengue virus
PPFGESYIT

SEQ ID NO: 11017 - protein, 9 aa, Dengue virus
PFGESYIII

SEQ ID NO: 11018 - protein, 9 aa, Dengue virus
FGESYIIIG

SEQ ID NO: 11019 - protein, 9 aa, Dengue virus
IGVGEKALK

SEQ ID NO: 11020 - protein, 9 aa, Dengue virus
GAGEKTLKL

SEQ ID NO: 11021 - protein, 9 aa, Dengue virus
AGEKTLKLS

SEQ ID NO: 11022 - protein, 9 aa, Dengue virus
EEALKLSWF

SEQ ID NO: 11023 - protein, 9 aa, Dengue virus
KALKLSWFR

SEQ ID NO: 11024 - protein, 9 aa, Dengue virus
TLKLSWFKK

SEQ ID NO: 11025 - protein, 9 aa, Dengue virus
LSWFKKGST

SEQ ID NO: 11026 - protein, 9 aa, Dengue virus
SWFKKGSTI

SEQ ID NO: 11027 - protein, 9 aa, Dengue virus
WFKKGSTIG

SEQ ID NO: 11028 - protein, 9 aa, Dengue virus
FKKGSTIGK

SEQ ID NO: 11029 - protein, 9 aa, Dengue virus
KKGSTIGKM

SEQ ID NO: 11030 - protein, 9 aa, Dengue virus
KGSTIGKMF

SEQ ID NO: 11031 - protein, 9 aa, Dengue virus
GSNIGKMFE

SEQ ID NO: 11032 - protein, 9 aa, Dengue virus
SNIGKMFEA

SEQ ID NO: 11033 - protein, 9 aa, Dengue virus
SIGKMFVAT

SEQ ID NO: 11034 - protein, 9 aa, Dengue virus
WDFGSIGGL

SEQ ID NO: 11035 - protein, 9 aa, Dengue virus
DFGSIGGLF

SEQ ID NO: 11036 - protein, 9 aa, Dengue virus
FGSIGGLFT

SEQ ID NO: 11037 - protein, 9 aa, Dengue virus
GSIGGLFTS

SEQ ID NO: 11038 - protein, 9 aa, Dengue virus
GGLFTSVGK

SEQ ID NO: 11039 - protein, 9 aa, Dengue virus
GLFTSVGKL

SEQ ID NO: 11040 - protein, 9 aa, Dengue virus
FTSIGKLVH

SEQ ID NO: 11041 - protein, 9 aa, Dengue virus
TSIGKLVHQ

SEQ ID NO: 11042 - protein, 9 aa, Dengue virus
GKLIHQIFG

SEQ ID NO: 11043 - protein, 9 aa, Dengue virus
KLIHQIFGT

SEQ ID NO: 11044 - protein, 9 aa, Dengue virus
LIHQIFGTA

SEQ ID NO: 11045 - protein, 9 aa, Dengue virus
IHQIFGTAY

SEQ ID NO: 11046 - protein, 9 aa, Dengue virus
HQVFGAAYG

SEQ ID NO: 11047 - protein, 9 aa, Dengue virus
QVFGAAYGV

SEQ ID NO: 11048 - protein, 9 aa, Dengue virus
VFGAAYGVL

SEQ ID NO: 11049 - protein, 9 aa, Dengue virus
WTMKIGLGV

SEQ ID NO: 11050 - protein, 9 aa, Dengue virus
TMKIGLGVL

SEQ ID NO: 11051 - protein, 9 aa, Dengue virus
MKIGLGVLL

SEQ ID NO: 11052 - protein, 9 aa, Dengue virus
KIGLGVLLT

SEQ ID NO: 11053 - protein, 9 aa, Dengue virus
IGLGVLLTW

SEQ ID NO: 11054 - protein, 9 aa, Dengue virus
GLGVLLTWL

SEQ ID NO: 11055 - protein, 9 aa, Dengue virus
LGVLLTWLG

SEQ ID NO: 11056 - protein, 9 aa, Dengue virus
WLGLNSRNT

SEQ ID NO: 11057 - protein, 9 aa, Dengue virus
LGLNSRNTS

SEQ ID NO: 11058 - protein, 9 aa, Dengue virus
GLNSRNTSL

SEQ ID NO: 11059 - protein, 9 aa, Dengue virus
LNSRSASLS

SEQ ID NO: 11060 - protein, 9 aa, Dengue virus
NSRSASLSM

SEQ ID NO: 11061 - protein, 9 aa, Dengue virus
SRSASLSMT

SEQ ID NO: 11062 - protein, 9 aa, Dengue virus
RSASLSMTC

SEQ ID NO: 11063 - protein, 9 aa, Dengue virus
SASLSMTCI

SEQ ID NO: 11064 - protein, 9 aa, Dengue virus
ASLSMTCIA

SEQ ID NO: 11065 - protein, 9 aa, Dengue virus
SLSVMCIAV

SEQ ID NO: 11066 - protein, 9 aa, Dengue virus
LSVMCIAVG

SEQ ID NO: 11067 - protein, 9 aa, Dengue virus
SVMCIAVGM

SEQ ID NO: 11068 - protein, 9 aa, Dengue virus
MTCIAVGLI

SEQ ID NO: 11069 - protein, 9 aa, Dengue virus
TCIAVGLIT

SEQ ID NO: 11070 - protein, 9 aa, Dengue virus
CIAVGLITL

SEQ ID NO: 11071 - protein, 9 aa, Dengue virus
IAVGLITLY

SEQ ID NO: 11072 - protein, 9 aa, Dengue virus
AVGLITLYL

SEQ ID NO: 11073 - protein, 9 aa, Dengue virus
VGLITLYLG

SEQ ID NO: 11074 - protein, 9 aa, Dengue virus
GLITLYLGV

SEQ ID NO: 11075 - protein, 9 aa, Dengue virus
LITLYLGVM

SEQ ID NO: 11076 - protein, 9 aa, Dengue virus
EGVCGIRSV

SEQ ID NO: 11077 - protein, 9 aa, Dengue virus
GVCGIRSVT

SEQ ID NO: 11078 - protein, 9 aa, Dengue virus
VCGIRSVTR

SEQ ID NO: 11079 - protein, 9 aa, Dengue virus
CGIRSVTRL

SEQ ID NO: 11080 - protein, 9 aa, Dengue virus
GIRSVTRLE

SEQ ID NO: 11081 - protein, 9 aa, Dengue virus
IRSVTRLEN

SEQ ID NO: 11082 - protein, 9 aa, Dengue virus
RSVTRLENI

SEQ ID NO: 11083 - protein, 9 aa, Dengue virus
SVTRLENIM

SEQ ID NO: 11084 - protein, 9 aa, Dengue virus
VTRLENIMW

SEQ ID NO: 11085 - protein, 9 aa, Dengue virus
KQISNELNY

SEQ ID NO: 11086 - protein, 9 aa, Dengue virus
LNYILLEND

SEQ ID NO: 11087 - protein, 9 aa, Dengue virus
NYILLENDM

SEQ ID NO: 11088 - protein, 9 aa, Dengue virus
YILLENDMK

SEQ ID NO: 11089 - protein, 9 aa, Dengue virus
ILLENGMKF

SEQ ID NO: 11090 - protein, 9 aa, Dengue virus
LLENGMKFT

SEQ ID NO: 11091 - protein, 9 aa, Dengue virus
LENGMKFTV

SEQ ID NO: 11092 - protein, 9 aa, Dengue virus
ENGMKFTVV

SEQ ID NO: 11093 - protein, 9 aa, Dengue virus
NGMKFTVVV

SEQ ID NO: 11094 - protein, 9 aa, Dengue virus
GMKFTVVVG

SEQ ID NO: 11095 - protein, 9 aa, Dengue virus
IKFTVVVGN

SEQ ID NO: 11096 - protein, 9 aa, Dengue virus
KLTVVVGDV

SEQ ID NO: 11097 - protein, 9 aa, Dengue virus
QGRKMIRPQ

SEQ ID NO: 11098 - protein, 9 aa, Dengue virus
GRKMIRPQP

SEQ ID NO: 11099 - protein, 9 aa, Dengue virus
KKMVRPQPM

SEQ ID NO: 11100 - protein, 9 aa, Dengue virus
KMVRPQPME

SEQ ID NO: 11101 - protein, 9 aa, Dengue virus
TIRPQPMEH

SEQ ID NO: 11102 - protein, 9 aa, Dengue virus
IRPQPMEHR

SEQ ID NO: 11103 - protein, 9 aa, Dengue virus
RPQPMEHRY

SEQ ID NO: 11104 - protein, 9 aa, Dengue virus
PQPMEHRYS

SEQ ID NO: 11105 - protein, 9 aa, Dengue virus
QPMEHRYSW

SEQ ID NO: 11106 - protein, 9 aa, Dengue virus
PMEHRYSWK

SEQ ID NO: 11107 - protein, 9 aa, Dengue virus
MEHRYSWKS

SEQ ID NO: 11108 - protein, 9 aa, Dengue virus
EHRYSWKSW

SEQ ID NO: 11109 - protein, 9 aa, Dengue virus
HRYSWKSWG

SEQ ID NO: 11110 - protein, 9 aa, Dengue virus
KYSWRSWGK

SEQ ID NO: 11111 - protein, 9 aa, Dengue virus
YSWKIWGKA

SEQ ID NO: 11112 - protein, 9 aa, Dengue virus
SWRSWGKAK

SEQ ID NO: 11113 - protein, 9 aa, Dengue virus
WRSWGKAKI

SEQ ID NO: 11114 - protein, 9 aa, Dengue virus
KIWGKAKII

SEQ ID NO: 11115 - protein, 9 aa, Dengue virus
SWGKAKVIG

SEQ ID NO: 11116 - protein, 9 aa, Dengue virus
KAKIIGADA

SEQ ID NO: 11117 - protein, 9 aa, Dengue virus
AKIIGADAQ

SEQ ID NO: 11118 - protein, 9 aa, Dengue virus
KIIGADAQN

SEQ ID NO: 11119 - protein, 9 aa, Dengue virus
QNATFIIDG

SEQ ID NO: 11120 - protein, 9 aa, Dengue virus
NATFIIDGP

SEQ ID NO: 11121 - protein, 9 aa, Dengue virus
DGPNTPECS

SEQ ID NO: 11122 - protein, 9 aa, Dengue virus
GPNTPECSD

SEQ ID NO: 11123 - protein, 9 aa, Dengue virus
ECPDGQRAW

SEQ ID NO: 11124 - protein, 9 aa, Dengue virus
CPDGQRAWN

SEQ ID NO: 11125 - protein, 9 aa, Dengue virus
PDGQRAWNI

SEQ ID NO: 11126 - protein, 9 aa, Dengue virus
DGQRAWNIW

SEQ ID NO: 11127 - protein, 9 aa, Dengue virus
GQRAWNIWE

SEQ ID NO: 11128 - protein, 9 aa, Dengue virus
IFTTNIWLR

SEQ ID NO: 11129 - protein, 9 aa, Dengue virus
IWLKMRDSY

SEQ ID NO: 11130 - protein, 9 aa, Dengue virus
WLKMRDSYT

SEQ ID NO: 11131 - protein, 9 aa, Dengue virus
LKMRDSYTQ

SEQ ID NO: 11132 - protein, 9 aa, Dengue virus
RDSHTQVCD

SEQ ID NO: 11133 - protein, 9 aa, Dengue virus
DSHTQVCDH

SEQ ID NO: 11134 - protein, 9 aa, Dengue virus
SHTQVCDHR

SEQ ID NO: 11135 - protein, 9 aa, Dengue virus
HTQVCDHRL

SEQ ID NO: 11136 - protein, 9 aa, Dengue virus
TQACDHRLM

SEQ ID NO: 11137 - protein, 9 aa, Dengue virus
QACDHRLMS

SEQ ID NO: 11138 - protein, 9 aa, Dengue virus
ACDHRLMSA

SEQ ID NO: 11139 - protein, 9 aa, Dengue virus
EKNDTWKLA

SEQ ID NO: 11140 - protein, 9 aa, Dengue virus
NETWKLAGA

SEQ ID NO: 11141 - protein, 9 aa, Dengue virus
ETWKLAGAS

SEQ ID NO: 11142 - protein, 9 aa, Dengue virus
TWKLAGASF

SEQ ID NO: 11143 - protein, 9 aa, Dengue virus
WKLAGASFI

SEQ ID NO: 11144 - protein, 9 aa, Dengue virus
KLAGASFIE

SEQ ID NO: 11145 - protein, 9 aa, Dengue virus
LAGASFIEV

SEQ ID NO: 11146 - protein, 9 aa, Dengue virus
AGASFIEVK

SEQ ID NO: 11147 - protein, 9 aa, Dengue virus
SFIEVKTCV

SEQ ID NO: 11148 - protein, 9 aa, Dengue virus
FIEVKTCVW

SEQ ID NO: 11149 - protein, 9 aa, Dengue virus
IEVKTCVWP

SEQ ID NO: 11150 - protein, 9 aa, Dengue virus
EVKTCVWPK

SEQ ID NO: 11151 - protein, 9 aa, Dengue virus
VKTCVWPKS

SEQ ID NO: 11152 - protein, 9 aa, Dengue virus
KTCVWPKSH

SEQ ID NO: 11153 - protein, 9 aa, Dengue virus
TCVWPKSHT

SEQ ID NO: 11154 - protein, 9 aa, Dengue virus
CVWPKSHTL

SEQ ID NO: 11155 - protein, 9 aa, Dengue virus
VWPKSHTLW

SEQ ID NO: 11156 - protein, 9 aa, Dengue virus
ESEMIIPKM

SEQ ID NO: 11157 - protein, 9 aa, Dengue virus
SEMVIPKIY

SEQ ID NO: 11158 - protein, 9 aa, Dengue virus
EMVIPKIYG

SEQ ID NO: 11159 - protein, 9 aa, Dengue virus
MVIPKIYGG

SEQ ID NO: 11160 - protein, 9 aa, Dengue virus
VIPKIYGGP

SEQ ID NO: 11161 - protein, 9 aa, Dengue virus
PKIYGGPTS

SEQ ID NO: 11162 - protein, 9 aa, Dengue virus
KIYGGPTSQ

SEQ ID NO: 11163 - protein, 9 aa, Dengue virus
IYGGPTSQH

SEQ ID NO: 11164 - protein, 9 aa, Dengue virus
YGGPTSQHN

SEQ ID NO: 11165 - protein, 9 aa, Dengue virus
GGPISQHNH

SEQ ID NO: 11166 - protein, 9 aa, Dengue virus
GPISQHNHR

SEQ ID NO: 11167 - protein, 9 aa, Dengue virus
PISQHNHRP

SEQ ID NO: 11168 - protein, 9 aa, Dengue virus
ISQHNHRPG

SEQ ID NO: 11169 - protein, 9 aa, Dengue virus
HRPGYFTQT

SEQ ID NO: 11170 - protein, 9 aa, Dengue virus
GKLELDFDF

SEQ ID NO: 11171 - protein, 9 aa, Dengue virus
KLELDFDFC

SEQ ID NO: 11172 - protein, 9 aa, Dengue virus
LELDFDFCE

SEQ ID NO: 11173 - protein, 9 aa, Dengue virus
ELDFDFCEG

SEQ ID NO: 11174 - protein, 9 aa, Dengue virus
LDFDFCEGT

SEQ ID NO: 11175 - protein, 9 aa, Dengue virus
DFDFCEGTT

SEQ ID NO: 11176 - protein, 9 aa, Dengue virus
FDFCEGTTV

SEQ ID NO: 11177 - protein, 9 aa, Dengue virus
DFCEGTTVV

SEQ ID NO: 11178 - protein, 9 aa, Dengue virus
VVVDEHCGY

SEQ ID NO: 11179 - protein, 9 aa, Dengue virus
VVDEHCGYR

SEQ ID NO: 11180 - protein, 9 aa, Dengue virus
VDEHCGYRG

SEQ ID NO: 11181 - protein, 9 aa, Dengue virus
DEHCGYRGP

SEQ ID NO: 11182 - protein, 9 aa, Dengue virus
EHCGSRGPS

SEQ ID NO: 11183 - protein, 9 aa, Dengue virus
HCGYRGPSL

SEQ ID NO: 11184 - protein, 9 aa, Dengue virus
CGSRGPSLR

SEQ ID NO: 11185 - protein, 9 aa, Dengue virus
GSRGPSLRT

SEQ ID NO: 11186 - protein, 9 aa, Dengue virus
YRGPSLRTT

SEQ ID NO: 11187 - protein, 9 aa, Dengue virus
KDKEENLVK

SEQ ID NO: 11188 - protein, 9 aa, Dengue virus
DKEENLVKS

SEQ ID NO: 11189 - protein, 9 aa, Dengue virus
VKSMVSAGL

SEQ ID NO: 11190 - protein, 9 aa, Dengue virus
KSMVSAGLG

SEQ ID NO: 11191 - protein, 9 aa, Dengue virus
GSGEVDNFS

SEQ ID NO: 11192 - protein, 9 aa, Dengue virus
SGEVDNFSL

SEQ ID NO: 11193 - protein, 9 aa, Dengue virus
FSLGILCAS

SEQ ID NO: 11194 - protein, 9 aa, Dengue virus
SLGILCASI

SEQ ID NO: 11195 - protein, 9 aa, Dengue virus
SIIIEEVMR

SEQ ID NO: 11196 - protein, 9 aa, Dengue virus
IIIEEVMRS

SEQ ID NO: 11197 - protein, 9 aa, Dengue virus
IIEEVMRSR

SEQ ID NO: 11198 - protein, 9 aa, Dengue virus
VMRSRWSKK

SEQ ID NO: 11199 - protein, 9 aa, Dengue virus
MRSRWSKKM

SEQ ID NO: 11200 - protein, 9 aa, Dengue virus
RSRWSKKML

SEQ ID NO: 11201 - protein, 9 aa, Dengue virus
SRWSKKMLM

SEQ ID NO: 11202 - protein, 9 aa, Dengue virus
RWSKKMLMT

SEQ ID NO: 11203 - protein, 9 aa, Dengue virus
WSKKMLMTG

SEQ ID NO: 11204 - protein, 9 aa, Dengue virus
SKKMLMTGT

SEQ ID NO: 11205 - protein, 9 aa, Dengue virus
KKMLMTGTL

SEQ ID NO: 11206 - protein, 9 aa, Dengue virus
KMLMTGTLV

SEQ ID NO: 11207 - protein, 9 aa, Dengue virus
MLMTGILAV

SEQ ID NO: 11208 - protein, 9 aa, Dengue virus
LMTGILAVF

SEQ ID NO: 11209 - protein, 9 aa, Dengue virus
GTLVVFLLL

SEQ ID NO: 11210 - protein, 9 aa, Dengue virus
GQLTWNDLT

SEQ ID NO: 11211 - protein, 9 aa, Dengue virus
QLTWNDLTR

SEQ ID NO: 11212 - protein, 9 aa, Dengue virus
LTWSDLIRL

SEQ ID NO: 11213 - protein, 9 aa, Dengue virus
TWSDLIRLC

SEQ ID NO: 11214 - protein, 9 aa, Dengue virus
WSDLIRLCI

SEQ ID NO: 11215 - protein, 9 aa, Dengue virus
SDLIRLCIM

SEQ ID NO: 11216 - protein, 9 aa, Dengue virus
DLTRLCIMV

SEQ ID NO: 11217 - protein, 9 aa, Dengue virus
LTRLCIMVG

SEQ ID NO: 11218 - protein, 9 aa, Dengue virus
TRLCIMVGA

SEQ ID NO: 11219 - protein, 9 aa, Dengue virus
LCIMVGANV

SEQ ID NO: 11220 - protein, 9 aa, Dengue virus
CIMVGANVS

SEQ ID NO: 11221 - protein, 9 aa, Dengue virus
IMVGANVSD

SEQ ID NO: 11222 - protein, 9 aa, Dengue virus
MVGANAFDR

SEQ ID NO: 11223 - protein, 9 aa, Dengue virus
VGANAFDRM

SEQ ID NO: 11224 - protein, 9 aa, Dengue virus
GANAFDRMG

SEQ ID NO: 11225 - protein, 9 aa, Dengue virus
ANAFDRMGM

SEQ ID NO: 11226 - protein, 9 aa, Dengue virus
NAFDRMGMG

SEQ ID NO: 11227 - protein, 9 aa, Dengue virus
FDRMGMGTT

SEQ ID NO: 11228 - protein, 9 aa, Dengue virus
DNMGMGTTY

SEQ ID NO: 11229 - protein, 9 aa, Dengue virus
NMGMGTTYL

SEQ ID NO: 11230 - protein, 9 aa, Dengue virus
MGTTHLALM

SEQ ID NO: 11231 - protein, 9 aa, Dengue virus
GTTHLALMA

SEQ ID NO: 11232 - protein, 9 aa, Dengue virus
TTHLALMAT

SEQ ID NO: 11233 - protein, 9 aa, Dengue virus
LALMATFKI

SEQ ID NO: 11234 - protein, 9 aa, Dengue virus
ALMATFKIR

SEQ ID NO: 11235 - protein, 9 aa, Dengue virus
LMATFKIRP

SEQ ID NO: 11236 - protein, 9 aa, Dengue virus
MATFKIRPM

SEQ ID NO: 11237 - protein, 9 aa, Dengue virus
ATFKMRPML

SEQ ID NO: 11238 - protein, 9 aa, Dengue virus
TFKMRPMLA

SEQ ID NO: 11239 - protein, 9 aa, Dengue virus
FKMRPMLAV

SEQ ID NO: 11240 - protein, 9 aa, Dengue virus
KMRPMLAVG

SEQ ID NO: 11241 - protein, 9 aa, Dengue virus
IRPMFAVGL

SEQ ID NO: 11242 - protein, 9 aa, Dengue virus
PMFAVGLLI

SEQ ID NO: 11243 - protein, 9 aa, Dengue virus
MFAVGLLIR

SEQ ID NO: 11244 - protein, 9 aa, Dengue virus
FAVGLLIRR

SEQ ID NO: 11245 - protein, 9 aa, Dengue virus
AVGLLFRKL

SEQ ID NO: 11246 - protein, 9 aa, Dengue virus
VGLLFRKLT

SEQ ID NO: 11247 - protein, 9 aa, Dengue virus
GLLFRKLTS

SEQ ID NO: 11248 - protein, 9 aa, Dengue virus
LLFRKLTSR

SEQ ID NO: 11249 - protein, 9 aa, Dengue virus
LFRKLTSRE

SEQ ID NO: 11250 - protein, 9 aa, Dengue virus
FRKLTSREV

SEQ ID NO: 11251 - protein, 9 aa, Dengue virus
TIGLSLVAF

SEQ ID NO: 11252 - protein, 9 aa, Dengue virus
IGLSLVAFV

SEQ ID NO: 11253 - protein, 9 aa, Dengue virus
GLSLVACVE

SEQ ID NO: 11254 - protein, 9 aa, Dengue virus
LSLMASMEL

SEQ ID NO: 11255 - protein, 9 aa, Dengue virus
SLVASAELP

SEQ ID NO: 11256 - protein, 9 aa, Dengue virus
AFVELPNSL

SEQ ID NO: 11257 - protein, 9 aa, Dengue virus
SVELPNSLD

SEQ ID NO: 11258 - protein, 9 aa, Dengue virus
VELPNSLDE

SEQ ID NO: 11259 - protein, 9 aa, Dengue virus
ELPNSLDEL

SEQ ID NO: 11260 - protein, 9 aa, Dengue virus
LPNSLDELG

SEQ ID NO: 11261 - protein, 9 aa, Dengue virus
PNSLDELGD

SEQ ID NO: 11262 - protein, 9 aa, Dengue virus
NSLDELGDG

SEQ ID NO: 11263 - protein, 9 aa, Dengue virus
DGLAIGIMM

SEQ ID NO: 11264 - protein, 9 aa, Dengue virus
GLAIGIMML

SEQ ID NO: 11265 - protein, 9 aa, Dengue virus
LAIGIMMLK

SEQ ID NO: 11266 - protein, 9 aa, Dengue virus
IMMLKLLTD

SEQ ID NO: 11267 - protein, 9 aa, Dengue virus
MMLKLLTDF

SEQ ID NO: 11268 - protein, 9 aa, Dengue virus
MLKLLTDFQ

SEQ ID NO: 11269 - protein, 9 aa, Dengue virus
LKLLTDFQP

SEQ ID NO: 11270 - protein, 9 aa, Dengue virus
KLLTDFQSY

SEQ ID NO: 11271 - protein, 9 aa, Dengue virus
LLTDFQSYQ

SEQ ID NO: 11272 - protein, 9 aa, Dengue virus
LTDFQSYQL

SEQ ID NO: 11273 - protein, 9 aa, Dengue virus
TDFQSYQLW

SEQ ID NO: 11274 - protein, 9 aa, Dengue virus
LLSLTFIRT

SEQ ID NO: 11275 - protein, 9 aa, Dengue virus
DYAWKTMAM

SEQ ID NO: 11276 - protein, 9 aa, Dengue virus
AMILSIVSL

SEQ ID NO: 11277 - protein, 9 aa, Dengue virus
LSIASLFPL

SEQ ID NO: 11278 - protein, 9 aa, Dengue virus
SIASLFPLC

SEQ ID NO: 11279 - protein, 9 aa, Dengue virus
ASLFPLCLS

SEQ ID NO: 11280 - protein, 9 aa, Dengue virus
SLIPLCLST

SEQ ID NO: 11281 - protein, 9 aa, Dengue virus
LIPLCLSTT

SEQ ID NO: 11282 - protein, 9 aa, Dengue virus
IPLCLSTTS

SEQ ID NO: 11283 - protein, 9 aa, Dengue virus
GSLGCKPLP

SEQ ID NO: 11284 - protein, 9 aa, Dengue virus
SLGCKPLPM

SEQ ID NO: 11285 - protein, 9 aa, Dengue virus
LGCKPLPMF

SEQ ID NO: 11286 - protein, 9 aa, Dengue virus
GCKPLAMFL

SEQ ID NO: 11287 - protein, 9 aa, Dengue virus
CKPLAMFLI

SEQ ID NO: 11288 - protein, 9 aa, Dengue virus
KPLPMFLIT

SEQ ID NO: 11289 - protein, 9 aa, Dengue virus
PLPMFLITE

SEQ ID NO: 11290 - protein, 9 aa, Dengue virus
ITETKIWGR

SEQ ID NO: 11291 - protein, 9 aa, Dengue virus
ETKIWGRKS

SEQ ID NO: 11292 - protein, 9 aa, Dengue virus
TKIWGRKSW

SEQ ID NO: 11293 - protein, 9 aa, Dengue virus
EIWGRKSWP

SEQ ID NO: 11294 - protein, 9 aa, Dengue virus
IWGRKSWPI

SEQ ID NO: 11295 - protein, 9 aa, Dengue virus
WGRKSWPIN

SEQ ID NO: 11296 - protein, 9 aa, Dengue virus
GRKSWPINE

SEQ ID NO: 11297 - protein, 9 aa, Dengue virus
RKSWPINEG

SEQ ID NO: 11298 - protein, 9 aa, Dengue virus
KSWPINEGI

SEQ ID NO: 11299 - protein, 9 aa, Dengue virus
PINEGIMAV

SEQ ID NO: 11300 - protein, 9 aa, Dengue virus
INEGIMAVG

SEQ ID NO: 11301 - protein, 9 aa, Dengue virus
NEGIMAVGV

SEQ ID NO: 11302 - protein, 9 aa, Dengue virus
EGIMAVGVV

SEQ ID NO: 11303 - protein, 9 aa, Dengue virus
GIMAVGVVS

SEQ ID NO: 11304 - protein, 9 aa, Dengue virus
IMAVGVVSI

SEQ ID NO: 11305 - protein, 9 aa, Dengue virus
MAVGVVSIL

SEQ ID NO: 11306 - protein, 9 aa, Dengue virus
AVGVVSILL

SEQ ID NO: 11307 - protein, 9 aa, Dengue virus
VGVVSILLS

SEQ ID NO: 11308 - protein, 9 aa, Dengue virus
GIVSILLSA

SEQ ID NO: 11309 - protein, 9 aa, Dengue virus
IVSILLSAL

SEQ ID NO: 11310 - protein, 9 aa, Dengue virus
SADLSLDKA

SEQ ID NO: 11311 - protein, 9 aa, Dengue virus
ADLSLDKAA

SEQ ID NO: 11312 - protein, 9 aa, Dengue virus
DLSLEKAAK

SEQ ID NO: 11313 - protein, 9 aa, Dengue virus
LSLEKAAKV

SEQ ID NO: 11314 - protein, 9 aa, Dengue virus
SLEKAAKVS

SEQ ID NO: 11315 - protein, 9 aa, Dengue virus
LEKAAKVSW

SEQ ID NO: 11316 - protein, 9 aa, Dengue virus
EKAAKVSWE

SEQ ID NO: 11317 - protein, 9 aa, Dengue virus
AAVVSWEEE

SEQ ID NO: 11318 - protein, 9 aa, Dengue virus
AVVSWEEEA

SEQ ID NO: 11319 - protein, 9 aa, Dengue virus
VVSWEEEAE

SEQ ID NO: 11320 - protein, 9 aa, Dengue virus
VSWEKEAEH

SEQ ID NO: 11321 - protein, 9 aa, Dengue virus
EEEAEHSGT

SEQ ID NO: 11322 - protein, 9 aa, Dengue virus
EEAEHSGTS

SEQ ID NO: 11323 - protein, 9 aa, Dengue virus
HSGASHNIF

SEQ ID NO: 11324 - protein, 9 aa, Dengue virus
SGASHNISV

SEQ ID NO: 11325 - protein, 9 aa, Dengue virus
GASHNILVV

SEQ ID NO: 11326 - protein, 9 aa, Dengue virus
ASHNILVEI

SEQ ID NO: 11327 - protein, 9 aa, Dengue virus
SHNILVVVQ

SEQ ID NO: 11328 - protein, 9 aa, Dengue virus
HNILVVVQD

SEQ ID NO: 11329 - protein, 9 aa, Dengue virus
NILVVVQDD

SEQ ID NO: 11330 - protein, 9 aa, Dengue virus
ILVVVQDDG

SEQ ID NO: 11331 - protein, 9 aa, Dengue virus
LVVVQDDGT

SEQ ID NO: 11332 - protein, 9 aa, Dengue virus
VVVQDDGTM

SEQ ID NO: 11333 - protein, 9 aa, Dengue virus
VVQDDGTMK

SEQ ID NO: 11334 - protein, 9 aa, Dengue virus
KDEEKDDTL

SEQ ID NO: 11335 - protein, 9 aa, Dengue virus
DEEKDDTLT

SEQ ID NO: 11336 - protein, 9 aa, Dengue virus
EEKDDTLTI

SEQ ID NO: 11337 - protein, 9 aa, Dengue virus
EKDDTLTIL

SEQ ID NO: 11338 - protein, 9 aa, Dengue virus
KDDTLTILL

SEQ ID NO: 11339 - protein, 9 aa, Dengue virus
ATLLAVSGM

SEQ ID NO: 11340 - protein, 9 aa, Dengue virus
TLLAVSGMY

SEQ ID NO: 11341 - protein, 9 aa, Dengue virus
LLAVSGMYP

SEQ ID NO: 11342 - protein, 9 aa, Dengue virus
LAISGVYPM

SEQ ID NO: 11343 - protein, 9 aa, Dengue virus
AISGVYPMS

SEQ ID NO: 11344 - protein, 9 aa, Dengue virus
ISGVYPMSI

SEQ ID NO: 11345 - protein, 9 aa, Dengue virus
LSIPATLFL

SEQ ID NO: 11346 - protein, 9 aa, Dengue virus
IPATLFLWY

SEQ ID NO: 11347 - protein, 9 aa, Dengue virus
PATLFLWYF

SEQ ID NO: 11348 - protein, 9 aa, Dengue virus
ATLFLWYFW

SEQ ID NO: 11349 - protein, 9 aa, Dengue virus
TLFLWYFWQ

SEQ ID NO: 11350 - protein, 9 aa, Dengue virus
DTPSPPKVE

SEQ ID NO: 11351 - protein, 9 aa, Dengue virus
TPSPPEVEK

SEQ ID NO: 11352 - protein, 9 aa, Dengue virus
PSPPEVEKA

SEQ ID NO: 11353 - protein, 9 aa, Dengue virus
SPPEVEKAV

SEQ ID NO: 11354 - protein, 9 aa, Dengue virus
PPEVEKAVL

SEQ ID NO: 11355 - protein, 9 aa, Dengue virus
PEVEKAVLD

SEQ ID NO: 11356 - protein, 9 aa, Dengue virus
VEKAVLDDG

SEQ ID NO: 11357 - protein, 9 aa, Dengue virus
EKAVLDDGI

SEQ ID NO: 11358 - protein, 9 aa, Dengue virus
VGVGVFQEG

SEQ ID NO: 11359 - protein, 9 aa, Dengue virus
GVGVFQEGV

SEQ ID NO: 11360 - protein, 9 aa, Dengue virus
VGVFQEGVF

SEQ ID NO: 11361 - protein, 9 aa, Dengue virus
GVFQEGVFH

SEQ ID NO: 11362 - protein, 9 aa, Dengue virus
VFQEGVFHT

SEQ ID NO: 11363 - protein, 9 aa, Dengue virus
FQEGVFHTM

SEQ ID NO: 11364 - protein, 9 aa, Dengue virus
QEGVFHTMW

SEQ ID NO: 11365 - protein, 9 aa, Dengue virus
EGVFHTMWH

SEQ ID NO: 11366 - protein, 9 aa, Dengue virus
SYGGGWRLR

SEQ ID NO: 11367 - protein, 9 aa, Dengue virus
YGGGWRLRG

SEQ ID NO: 11368 - protein, 9 aa, Dengue virus
GGGWRLRGS

SEQ ID NO: 11369 - protein, 9 aa, Dengue virus
GGWRLRGSW

SEQ ID NO: 11370 - protein, 9 aa, Dengue virus
GWRLRGSWN

SEQ ID NO: 11371 - protein, 9 aa, Dengue virus
QGSWNAGEE

SEQ ID NO: 11372 - protein, 9 aa, Dengue virus
GLWNTGEEV

SEQ ID NO: 11373 - protein, 9 aa, Dengue virus
LWNTGEEVQ

SEQ ID NO: 11374 - protein, 9 aa, Dengue virus
KNPKNVQTM

SEQ ID NO: 11375 - protein, 9 aa, Dengue virus
NPKNVQTMP

SEQ ID NO: 11376 - protein, 9 aa, Dengue virus
PKNVQTMPG

SEQ ID NO: 11377 - protein, 9 aa, Dengue virus
KNVQTMPGT

SEQ ID NO: 11378 - protein, 9 aa, Dengue virus
NVQTMPGTF

SEQ ID NO: 11379 - protein, 9 aa, Dengue virus
VQTMPGTFK

SEQ ID NO: 11380 - protein, 9 aa, Dengue virus
QTMPGTFKT

SEQ ID NO: 11381 - protein, 9 aa, Dengue virus
TAPGTFKTS

SEQ ID NO: 11382 - protein, 9 aa, Dengue virus
APGTFKTSE

SEQ ID NO: 11383 - protein, 9 aa, Dengue virus
VSAIAQARA

SEQ ID NO: 11384 - protein, 9 aa, Dengue virus
SAIAQARAS

SEQ ID NO: 11385 - protein, 9 aa, Dengue virus
AIAQARASQ

SEQ ID NO: 11386 - protein, 9 aa, Dengue virus
IAQARASQE

SEQ ID NO: 11387 - protein, 9 aa, Dengue virus
AQARASQEG

SEQ ID NO: 11388 - protein, 9 aa, Dengue virus
QARASQEGP

SEQ ID NO: 11389 - protein, 9 aa, Dengue virus
ARASQEGPL

SEQ ID NO: 11390 - protein, 9 aa, Dengue virus
RASQEGPLP

SEQ ID NO: 11391 - protein, 9 aa, Dengue virus
EGPLPEIEN

SEQ ID NO: 11392 - protein, 9 aa, Dengue virus
GPLPEIENE

SEQ ID NO: 11393 - protein, 9 aa, Dengue virus
PLPEIENEV

SEQ ID NO: 11394 - protein, 9 aa, Dengue virus
LPEIENEVF

SEQ ID NO: 11395 - protein, 9 aa, Dengue virus
PEIEEEVFK

SEQ ID NO: 11396 - protein, 9 aa, Dengue virus
EIEEEVFKK

SEQ ID NO: 11397 - protein, 9 aa, Dengue virus
IEEEVFKKR

SEQ ID NO: 11398 - protein, 9 aa, Dengue virus
EEEVFKKRN

SEQ ID NO: 11399 - protein, 9 aa, Dengue virus
EEVFKKRNL

SEQ ID NO: 11400 - protein, 9 aa, Dengue virus
PAIVREAIR

SEQ ID NO: 11401 - protein, 9 aa, Dengue virus
AIVREAIRR

SEQ ID NO: 11402 - protein, 9 aa, Dengue virus
MVREAIKRK

SEQ ID NO: 11403 - protein, 9 aa, Dengue virus
VREAIKRKM

SEQ ID NO: 11404 - protein, 9 aa, Dengue virus
REAIKRKMR

SEQ ID NO: 11405 - protein, 9 aa, Dengue virus
EAIRRNVRT

SEQ ID NO: 11406 - protein, 9 aa, Dengue virus
AIRRNVRTL

SEQ ID NO: 11407 - protein, 9 aa, Dengue virus
IKRRLRTLI

SEQ ID NO: 11408 - protein, 9 aa, Dengue virus
KRKLRTLVL

SEQ ID NO: 11409 - protein, 9 aa, Dengue virus
RKLRTLVLA

SEQ ID NO: 11410 - protein, 9 aa, Dengue virus
KLRTLVLAP

SEQ ID NO: 11411 - protein, 9 aa, Dengue virus
NAIIQDEER

SEQ ID NO: 11412 - protein, 9 aa, Dengue virus
AIIQDEERD

SEQ ID NO: 11413 - protein, 9 aa, Dengue virus
IIQDEERDI

SEQ ID NO: 11414 - protein, 9 aa, Dengue virus
ERSWNSGHE

SEQ ID NO: 11415 - protein, 9 aa, Dengue virus
RSWNSGHEW

SEQ ID NO: 11416 - protein, 9 aa, Dengue virus
SWNSGHEWI

SEQ ID NO: 11417 - protein, 9 aa, Dengue virus
WNSGHEWIT

SEQ ID NO: 11418 - protein, 9 aa, Dengue virus
NSGHEWITD

SEQ ID NO: 11419 - protein, 9 aa, Dengue virus
SGHEWITDF

SEQ ID NO: 11420 - protein, 9 aa, Dengue virus
GHEWITDFP

SEQ ID NO: 11421 - protein, 9 aa, Dengue virus
HEWITDFPG

SEQ ID NO: 11422 - protein, 9 aa, Dengue virus
RRGRIGRNP

SEQ ID NO: 11423 - protein, 9 aa, Dengue virus
RGRIGRNYN

SEQ ID NO: 11424 - protein, 9 aa, Dengue virus
GRIGRNPNK

SEQ ID NO: 11425 - protein, 9 aa, Dengue virus
RIGRNPNKE

SEQ ID NO: 11426 - protein, 9 aa, Dengue virus
IGRNPNKEG

SEQ ID NO: 11427 - protein, 9 aa, Dengue virus
GRNPNKEGD

SEQ ID NO: 11428 - protein, 9 aa, Dengue virus
RNPNKEGDQ

SEQ ID NO: 11429 - protein, 9 aa, Dengue virus
NPNKEGDQY

SEQ ID NO: 11430 - protein, 9 aa, Dengue virus
QNKEGDQYI

SEQ ID NO: 11431 - protein, 9 aa, Dengue virus
YIYMGQPLK

SEQ ID NO: 11432 - protein, 9 aa, Dengue virus
IYMGQPLKN

SEQ ID NO: 11433 - protein, 9 aa, Dengue virus
RSISGDLIL

SEQ ID NO: 11434 - protein, 9 aa, Dengue virus
SISGDLILE

SEQ ID NO: 11435 - protein, 9 aa, Dengue virus
ISGDLILEI

SEQ ID NO: 11436 - protein, 9 aa, Dengue virus
KLPQHLTQK

SEQ ID NO: 11437 - protein, 9 aa, Dengue virus
LPQHLTQKA

SEQ ID NO: 11438 - protein, 9 aa, Dengue virus
PQHLTQKAQ

SEQ ID NO: 11439 - protein, 9 aa, Dengue virus
QHLTQKAQN

SEQ ID NO: 11440 - protein, 9 aa, Dengue virus
HLTQKAQNA

SEQ ID NO: 11441 - protein, 9 aa, Dengue virus
LTQKAQNAL

SEQ ID NO: 11442 - protein, 9 aa, Dengue virus
TQKAQNALD

SEQ ID NO: 11443 - protein, 9 aa, Dengue virus
QKAQNALDN

SEQ ID NO: 11444 - protein, 9 aa, Dengue virus
GGRAYRHAL

SEQ ID NO: 11445 - protein, 9 aa, Dengue virus
GRAYRHALE

SEQ ID NO: 11446 - protein, 9 aa, Dengue virus
RAYRHALEE

SEQ ID NO: 11447 - protein, 9 aa, Dengue virus
VMLFFLSGK

SEQ ID NO: 11448 - protein, 9 aa, Dengue virus
MLFFLSGKG

SEQ ID NO: 11449 - protein, 9 aa, Dengue virus
TSIGLLCVI

SEQ ID NO: 11450 - protein, 9 aa, Dengue virus
SIGLLCVTS

SEQ ID NO: 11451 - protein, 9 aa, Dengue virus
IGLLCVTSS

SEQ ID NO: 11452 - protein, 9 aa, Dengue virus
GLLCVTSSS

SEQ ID NO: 11453 - protein, 9 aa, Dengue virus
SSSALLWMA

SEQ ID NO: 11454 - protein, 9 aa, Dengue virus
SSALLWMAN

SEQ ID NO: 11455 - protein, 9 aa, Dengue virus
SALLWMANV

SEQ ID NO: 11456 - protein, 9 aa, Dengue virus
ALLWMANVE

SEQ ID NO: 11457 - protein, 9 aa, Dengue virus
YVVIGLLFI

SEQ ID NO: 11458 - protein, 9 aa, Dengue virus
VVIGLLFVI

SEQ ID NO: 11459 - protein, 9 aa, Dengue virus
VIGLLFIIL

SEQ ID NO: 11460 - protein, 9 aa, Dengue virus
IGLLFVILT

SEQ ID NO: 11461 - protein, 9 aa, Dengue virus
GLLFVILTV

SEQ ID NO: 11462 - protein, 9 aa, Dengue virus
LLFVILTVA

SEQ ID NO: 11463 - protein, 9 aa, Dengue virus
LFVILTVAA

SEQ ID NO: 11464 - protein, 9 aa, Dengue virus
FVILTVAAN

SEQ ID NO: 11465 - protein, 9 aa, Dengue virus
VILTVAANE

SEQ ID NO: 11466 - protein, 9 aa, Dengue virus
KKDLGIGHA

SEQ ID NO: 11467 - protein, 9 aa, Dengue virus
KDLGIGHAA

SEQ ID NO: 11468 - protein, 9 aa, Dengue virus
HVTMLDVDL

SEQ ID NO: 11469 - protein, 9 aa, Dengue virus
TMLDVDLRP

SEQ ID NO: 11470 - protein, 9 aa, Dengue virus
PLTLTATVL

SEQ ID NO: 11471 - protein, 9 aa, Dengue virus
LTLTATVLM

SEQ ID NO: 11472 - protein, 9 aa, Dengue virus
TLTATVLML

SEQ ID NO: 11473 - protein, 9 aa, Dengue virus
LTAAVLMLL

SEQ ID NO: 11474 - protein, 9 aa, Dengue virus
TAAVLMLLA

SEQ ID NO: 11475 - protein, 9 aa, Dengue virus
ATVLMLVAH

SEQ ID NO: 11476 - protein, 9 aa, Dengue virus
TVLMLVAHY

SEQ ID NO: 11477 - protein, 9 aa, Dengue virus
NPTVDGIVT

SEQ ID NO: 11478 - protein, 9 aa, Dengue virus
PTVDGIVTI

SEQ ID NO: 11479 - protein, 9 aa, Dengue virus
TVDGIVTID

SEQ ID NO: 11480 - protein, 9 aa, Dengue virus
VDGIVTIDL

SEQ ID NO: 11481 - protein, 9 aa, Dengue virus
SKPEFNTYK

SEQ ID NO: 11482 - protein, 9 aa, Dengue virus
KSEFNTYKK

SEQ ID NO: 11483 - protein, 9 aa, Dengue virus
SEFNTYKKS

SEQ ID NO: 11484 - protein, 9 aa, Dengue virus
EFNTYKKSG

SEQ ID NO: 11485 - protein, 9 aa, Dengue virus
FNTYKKSGI

SEQ ID NO: 11486 - protein, 9 aa, Dengue virus
NTYKRSGII

SEQ ID NO: 11487 - protein, 9 aa, Dengue virus
TYKRSGIIE

SEQ ID NO: 11488 - protein, 9 aa, Dengue virus
YKKSGIMEV

SEQ ID NO: 11489 - protein, 9 aa, Dengue virus
KKSGIMEVD

SEQ ID NO: 11490 - protein, 9 aa, Dengue virus
KSGIMEVDR

SEQ ID NO: 11491 - protein, 9 aa, Dengue virus
SGIVEVDRS

SEQ ID NO: 11492 - protein, 9 aa, Dengue virus
GIVEVDRSE

SEQ ID NO: 11493 - protein, 9 aa, Dengue virus
IVEVDRSEA

SEQ ID NO: 11494 - protein, 9 aa, Dengue virus
VEVDRSEAK

SEQ ID NO: 11495 - protein, 9 aa, Dengue virus
KEGLKRGEI

SEQ ID NO: 11496 - protein, 9 aa, Dengue virus
EGLKRGEIT

SEQ ID NO: 11497 - protein, 9 aa, Dengue virus
GLRRGETTK

SEQ ID NO: 11498 - protein, 9 aa, Dengue virus
LRRGETTKH

SEQ ID NO: 11499 - protein, 9 aa, Dengue virus
RRGETTKHA

SEQ ID NO: 11500 - protein, 9 aa, Dengue virus
RGEITKHAV

SEQ ID NO: 11501 - protein, 9 aa, Dengue virus
GEITKHAVS

SEQ ID NO: 11502 - protein, 9 aa, Dengue virus
EITKHAVSR

SEQ ID NO: 11503 - protein, 9 aa, Dengue virus
ITKHAVSRG

SEQ ID NO: 11504 - protein, 9 aa, Dengue virus
IKHAVSRGT

SEQ ID NO: 11505 - protein, 9 aa, Dengue virus
KGGLGHEEP

SEQ ID NO: 11506 - protein, 9 aa, Dengue virus
GGAGHEEPI

SEQ ID NO: 11507 - protein, 9 aa, Dengue virus
GAGHEEPIP

SEQ ID NO: 11508 - protein, 9 aa, Dengue virus
AGHEEPIPM

SEQ ID NO: 11509 - protein, 9 aa, Dengue virus
YGWNLVRLH

SEQ ID NO: 11510 - protein, 9 aa, Dengue virus
GWNLVRLHS

SEQ ID NO: 11511 - protein, 9 aa, Dengue virus
WNLVRLHSG

SEQ ID NO: 11512 - protein, 9 aa, Dengue virus
NLVRLHSGK

SEQ ID NO: 11513 - protein, 9 aa, Dengue virus
LVRLHSGKD

SEQ ID NO: 11514 - protein, 9 aa, Dengue virus
VRLHSGKDV

SEQ ID NO: 11515 - protein, 9 aa, Dengue virus
RLHSGKDVF

SEQ ID NO: 11516 - protein, 9 aa, Dengue virus
SGKDVFFMP

SEQ ID NO: 11517 - protein, 9 aa, Dengue virus
GKDVFFMPP

SEQ ID NO: 11518 - protein, 9 aa, Dengue virus
KDVFFMPPE

SEQ ID NO: 11519 - protein, 9 aa, Dengue virus
DVFFMPPEK

SEQ ID NO: 11520 - protein, 9 aa, Dengue virus
VFFMPPEKC

SEQ ID NO: 11521 - protein, 9 aa, Dengue virus
FFMPPEKCD

SEQ ID NO: 11522 - protein, 9 aa, Dengue virus
FMPPEKCDT

SEQ ID NO: 11523 - protein, 9 aa, Dengue virus
MPPEKCDTL

SEQ ID NO: 11524 - protein, 9 aa, Dengue virus
PSVVETLEH

SEQ ID NO: 11525 - protein, 9 aa, Dengue virus
SVVETLERM

SEQ ID NO: 11526 - protein, 9 aa, Dengue virus
VVETLERMQ

SEQ ID NO: 11527 - protein, 9 aa, Dengue virus
VETLERMQR

SEQ ID NO: 11528 - protein, 9 aa, Dengue virus
ETLEQMQRR

SEQ ID NO: 11529 - protein, 9 aa, Dengue virus
TLEQMQRKY

SEQ ID NO: 11530 - protein, 9 aa, Dengue virus
LEQMQRRHG

SEQ ID NO: 11531 - protein, 9 aa, Dengue virus
EQMQRRHGG

SEQ ID NO: 11532 - protein, 9 aa, Dengue virus
QMQRRHGGM

SEQ ID NO: 11533 - protein, 9 aa, Dengue virus
TMAHRKPTF

SEQ ID NO: 11534 - protein, 9 aa, Dengue virus
MAHRKPTFE

SEQ ID NO: 11535 - protein, 9 aa, Dengue virus
THRKPTYER

SEQ ID NO: 11536 - protein, 9 aa, Dengue virus
HRKPTFERD

SEQ ID NO: 11537 - protein, 9 aa, Dengue virus
RKPTFERDV

SEQ ID NO: 11538 - protein, 9 aa, Dengue virus
KPTFERDVD

SEQ ID NO: 11539 - protein, 9 aa, Dengue virus
PTFERDVDL

SEQ ID NO: 11540 - protein, 9 aa, Dengue virus
TFERDVDLG

SEQ ID NO: 11541 - protein, 9 aa, Dengue virus
YEKDVDLGA

SEQ ID NO: 11542 - protein, 9 aa, Dengue virus
EKDVDLGAG

SEQ ID NO: 11543 - protein, 9 aa, Dengue virus
KDVDLGAGT

SEQ ID NO: 11544 - protein, 9 aa, Dengue virus
LGAGTRHVT

SEQ ID NO: 11545 - protein, 9 aa, Dengue virus
GAGTRHVTV

SEQ ID NO: 11546 - protein, 9 aa, Dengue virus
AGTRHVTVE

SEQ ID NO: 11547 - protein, 9 aa, Dengue virus
RHVAVEPEE

SEQ ID NO: 11548 - protein, 9 aa, Dengue virus
HVAVEPEEA

SEQ ID NO: 11549 - protein, 9 aa, Dengue virus
VAVEPEEAN

SEQ ID NO: 11550 - protein, 9 aa, Dengue virus
VEPEEANLD

SEQ ID NO: 11551 - protein, 9 aa, Dengue virus
EPEEANLDI

SEQ ID NO: 11552 - protein, 9 aa, Dengue virus
PEEANLDII

SEQ ID NO: 11553 - protein, 9 aa, Dengue virus
EEANLDIIG

SEQ ID NO: 11554 - protein, 9 aa, Dengue virus
EANLDIIGQ

SEQ ID NO: 11555 - protein, 9 aa, Dengue virus
DTRTPKAKQ

SEQ ID NO: 11556 - protein, 9 aa, Dengue virus
TRTPKAKQG

SEQ ID NO: 11557 - protein, 9 aa, Dengue virus
RTPKAKQGT

SEQ ID NO: 11558 - protein, 9 aa, Dengue virus
TPRAKRGTA

SEQ ID NO: 11559 - protein, 9 aa, Dengue virus
PRAKRGTAQ

SEQ ID NO: 11560 - protein, 9 aa, Dengue virus
RAKRGTAQI

SEQ ID NO: 11561 - protein, 9 aa, Dengue virus
AKRGTVQIM

SEQ ID NO: 11562 - protein, 9 aa, Dengue virus
KRGTVQIME

SEQ ID NO: 11563 - protein, 9 aa, Dengue virus
RGTVQIMEV

SEQ ID NO: 11564 - protein, 9 aa, Dengue virus
GTVQIMEVT

SEQ ID NO: 11565 - protein, 9 aa, Dengue virus
TVQIMEVTA

SEQ ID NO: 11566 - protein, 9 aa, Dengue virus
QIMEMTAKW

SEQ ID NO: 11567 - protein, 9 aa, Dengue virus
IMEMTAKWL

SEQ ID NO: 11568 - protein, 9 aa, Dengue virus
EMTAKWLWG

SEQ ID NO: 11569 - protein, 9 aa, Dengue virus
MTAKWLWGF

SEQ ID NO: 11570 - protein, 9 aa, Dengue virus
TARWLWSFL

SEQ ID NO: 11571 - protein, 9 aa, Dengue virus
ARWLWSFLS

SEQ ID NO: 11572 - protein, 9 aa, Dengue virus
RWLWSFLSR

SEQ ID NO: 11573 - protein, 9 aa, Dengue virus
AVEDERFWE

SEQ ID NO: 11574 - protein, 9 aa, Dengue virus
VEDERFWEL

SEQ ID NO: 11575 - protein, 9 aa, Dengue virus
EDERFWELV

SEQ ID NO: 11576 - protein, 9 aa, Dengue virus
LVRRERELH

SEQ ID NO: 11577 - protein, 9 aa, Dengue virus
VRRERELHK

SEQ ID NO: 11578 - protein, 9 aa, Dengue virus
RRERELHKQ

SEQ ID NO: 11579 - protein, 9 aa, Dengue virus
GYILRDISR

SEQ ID NO: 11580 - protein, 9 aa, Dengue virus
YILRDISRI

SEQ ID NO: 11581 - protein, 9 aa, Dengue virus
ILRDISRIP

SEQ ID NO: 11582 - protein, 9 aa, Dengue virus
LRDISRIPG

SEQ ID NO: 11583 - protein, 9 aa, Dengue virus
RDISRIPGG

SEQ ID NO: 11584 - protein, 9 aa, Dengue virus
DISRIPGGN

SEQ ID NO: 11585 - protein, 9 aa, Dengue virus
ISRIPGGNM

SEQ ID NO: 11586 - protein, 9 aa, Dengue virus
SRIPGGNMY

SEQ ID NO: 11587 - protein, 9 aa, Dengue virus
RIPGGNMYA

SEQ ID NO: 11588 - protein, 9 aa, Dengue virus
ISGGNMYAD

SEQ ID NO: 11589 - protein, 9 aa, Dengue virus
PGGSMYADD

SEQ ID NO: 11590 - protein, 9 aa, Dengue virus
LQNEAKITE

SEQ ID NO: 11591 - protein, 9 aa, Dengue virus
QNEAKITEI

SEQ ID NO: 11592 - protein, 9 aa, Dengue virus
NEAKITEIM

SEQ ID NO: 11593 - protein, 9 aa, Dengue virus
EAKITEIME

SEQ ID NO: 11594 - protein, 9 aa, Dengue virus
AKITEIMEP

SEQ ID NO: 11595 - protein, 9 aa, Dengue virus
KITEIMEPE

SEQ ID NO: 11596 - protein, 9 aa, Dengue virus
ITDIMEAEH

SEQ ID NO: 11597 - protein, 9 aa, Dengue virus
EPEHALLAR

SEQ ID NO: 11598 - protein, 9 aa, Dengue virus
PEHALLAKA

SEQ ID NO: 11599 - protein, 9 aa, Dengue virus
EHALLAKAI

SEQ ID NO: 11600 - protein, 9 aa, Dengue virus
HALLAKAIF

SEQ ID NO: 11601 - protein, 9 aa, Dengue virus
ALLAKAIFK

SEQ ID NO: 11602 - protein, 9 aa, Dengue virus
LLAKAIFKL

SEQ ID NO: 11603 - protein, 9 aa, Dengue virus
LAKAIFKLT

SEQ ID NO: 11604 - protein, 9 aa, Dengue virus
AKAIFKLTY

SEQ ID NO: 11605 - protein, 9 aa, Dengue virus
KAIFKLTYQ

SEQ ID NO: 11606 - protein, 9 aa, Dengue virus
VVRVQRPTK

SEQ ID NO: 11607 - protein, 9 aa, Dengue virus
VRVQRPARN

SEQ ID NO: 11608 - protein, 9 aa, Dengue virus
RVQRPARNG

SEQ ID NO: 11609 - protein, 9 aa, Dengue virus
VQRPARNGT

SEQ ID NO: 11610 - protein, 9 aa, Dengue virus
QRPARNGTV

SEQ ID NO: 11611 - protein, 9 aa, Dengue virus
RPARNGTVM

SEQ ID NO: 11612 - protein, 9 aa, Dengue virus
PARNGTVMD

SEQ ID NO: 11613 - protein, 9 aa, Dengue virus
ARNGTVMDV

SEQ ID NO: 11614 - protein, 9 aa, Dengue virus
RNGTVMDVI

SEQ ID NO: 11615 - protein, 9 aa, Dengue virus
LNTFTNMGA

SEQ ID NO: 11616 - protein, 9 aa, Dengue virus
NTFTNMGAQ

SEQ ID NO: 11617 - protein, 9 aa, Dengue virus
TFTNMGAQL

SEQ ID NO: 11618 - protein, 9 aa, Dengue virus
FTNMGAQLI

SEQ ID NO: 11619 - protein, 9 aa, Dengue virus
TNMGAQLIR

SEQ ID NO: 11620 - protein, 9 aa, Dengue virus
NMGAQLIRQ

SEQ ID NO: 11621 - protein, 9 aa, Dengue virus
MGAQLIRQM

SEQ ID NO: 11622 - protein, 9 aa, Dengue virus
GAQLIRQME

SEQ ID NO: 11623 - protein, 9 aa, Dengue virus
QMESEGIFF

SEQ ID NO: 11624 - protein, 9 aa, Dengue virus
MESEGIFFP

SEQ ID NO: 11625 - protein, 9 aa, Dengue virus
GDDCVVKPV

SEQ ID NO: 11626 - protein, 9 aa, Dengue virus
DDCVVKPVD

SEQ ID NO: 11627 - protein, 9 aa, Dengue virus
DCVVKPVDD

SEQ ID NO: 11628 - protein, 9 aa, Dengue virus
CVVKPVDDR

SEQ ID NO: 11629 - protein, 9 aa, Dengue virus
VVKPVDDRF

SEQ ID NO: 11630 - protein, 9 aa, Dengue virus
VKPVDDRFA

SEQ ID NO: 11631 - protein, 9 aa, Dengue virus
KPVDDRFAT

SEQ ID NO: 11632 - protein, 9 aa, Dengue virus
PVDDRFATA

SEQ ID NO: 11633 - protein, 9 aa, Dengue virus
VDDRFATAL

SEQ ID NO: 11634 - protein, 9 aa, Dengue virus
DDRFATALS

SEQ ID NO: 11635 - protein, 9 aa, Dengue virus
DRFATALSA

SEQ ID NO: 11636 - protein, 9 aa, Dengue virus
RFATALSAL

SEQ ID NO: 11637 - protein, 9 aa, Dengue virus
FATALSALN

SEQ ID NO: 11638 - protein, 9 aa, Dengue virus
ATALSALND

SEQ ID NO: 11639 - protein, 9 aa, Dengue virus
TALSALNDM

SEQ ID NO: 11640 - protein, 9 aa, Dengue virus
ALSALNDMG

SEQ ID NO: 11641 - protein, 9 aa, Dengue virus
LSALNDMGK

SEQ ID NO: 11642 - protein, 9 aa, Dengue virus
SALNDMGKV

SEQ ID NO: 11643 - protein, 9 aa, Dengue virus
NAICSADPV

SEQ ID NO: 11644 - protein, 9 aa, Dengue virus
PVEWVPTSR

SEQ ID NO: 11645 - protein, 9 aa, Dengue virus
VEWVPTSRT

SEQ ID NO: 11646 - protein, 9 aa, Dengue virus
EWVPTSRTT

SEQ ID NO: 11647 - protein, 9 aa, Dengue virus
PWMEDKTRI

SEQ ID NO: 11648 - protein, 9 aa, Dengue virus
WMEDKTRIS

SEQ ID NO: 11649 - protein, 9 aa, Dengue virus
MEDKTRISS

SEQ ID NO: 11650 - protein, 9 aa, Dengue virus
EDKTRISSW

SEQ ID NO: 11651 - protein, 9 aa, Dengue virus
DKTHVSSWG

SEQ ID NO: 11652 - protein, 9 aa, Dengue virus
ISSWEDVPY

SEQ ID NO: 11653 - protein, 9 aa, Dengue virus
SSWEEVPYL

SEQ ID NO: 11654 - protein, 9 aa, Dengue virus
SWEEVPYLG

SEQ ID NO: 11655 - protein, 9 aa, Dengue virus
WEEVPYLGK

SEQ ID NO: 11656 - protein, 9 aa, Dengue virus
EEVPYLGKR

SEQ ID NO: 11657 - protein, 9 aa, Dengue virus
ATNVQVAIN

SEQ ID NO: 11658 - protein, 9 aa, Dengue virus
RLIGNENYS

SEQ ID NO: 11659 - protein, 9 aa, Dengue virus
LIGNENYSD

SEQ ID NO: 11660 - protein, 9 aa, Dengue virus
IGNENYSDY

SEQ ID NO: 11661 - protein, 9 aa, Dengue virus
GNENYLDFM

SEQ ID NO: 11662 - protein, 9 aa, Dengue virus
NENYLDFMT

SEQ ID NO: 11663 - protein, 9 aa, Dengue virus
ENYLDFMTS

SEQ ID NO: 11664 - protein, 9 aa, Dengue virus
NYLDFMTSM

SEQ ID NO: 11665 - protein, 9 aa, Dengue virus
YLDFMTSMK

SEQ ID NO: 11666 - protein, 9 aa, Dengue virus
LDFMTSMKR

SEQ ID NO: 11667 - protein, 9 aa, Dengue virus
DFMTSMKRF

SEQ ID NO: 11668 - protein, 9 aa, Dengue virus
FMTSMKRFK

SEQ ID NO: 11669 - protein, 9 aa, Dengue virus
TSMKRFKND

SEQ ID NO: 11670 - protein, 9 aa, Dengue virus
SMKRFKNEI

SEQ ID NO: 11671 - protein, 9 aa, Dengue virus
INQRKKTGR

SEQ ID NO: 11672 - protein, 9 aa, Dengue virus
RGFKREISN

SEQ ID NO: 11673 - protein, 9 aa, Dengue virus
GFKREISNM

SEQ ID NO: 11674 - protein, 9 aa, Dengue virus
FKREISNML

SEQ ID NO: 11675 - protein, 9 aa, Dengue virus
KREISNMLN

SEQ ID NO: 11676 - protein, 9 aa, Dengue virus
MLSIMNRRK

SEQ ID NO: 11677 - protein, 9 aa, Dengue virus
MNRRRKSVT

SEQ ID NO: 11678 - protein, 9 aa, Dengue virus
RRKRSVTMI

SEQ ID NO: 11679 - protein, 9 aa, Dengue virus
RKRSVTMIL

SEQ ID NO: 11680 - protein, 9 aa, Dengue virus
RSVTMILML

SEQ ID NO: 11681 - protein, 9 aa, Dengue virus
PTALTFHLT

SEQ ID NO: 11682 - protein, 9 aa, Dengue virus
TALTFHLTT

SEQ ID NO: 11683 - protein, 9 aa, Dengue virus
ALTFHLTTR

SEQ ID NO: 11684 - protein, 9 aa, Dengue virus
GGEPHMIVG

SEQ ID NO: 11685 - protein, 9 aa, Dengue virus
GEPHMIVGK

SEQ ID NO: 11686 - protein, 9 aa, Dengue virus
EPHMIVGKQ

SEQ ID NO: 11687 - protein, 9 aa, Dengue virus
PHMIVGKQE

SEQ ID NO: 11688 - protein, 9 aa, Dengue virus
HMIVGKQER

SEQ ID NO: 11689 - protein, 9 aa, Dengue virus
MIVGKQERG

SEQ ID NO: 11690 - protein, 9 aa, Dengue virus
IVGKQERGK

SEQ ID NO: 11691 - protein, 9 aa, Dengue virus
LLFKTSTGV

SEQ ID NO: 11692 - protein, 9 aa, Dengue virus
LFKTSTGVN

SEQ ID NO: 11693 - protein, 9 aa, Dengue virus
FKTSTGVNM

SEQ ID NO: 11694 - protein, 9 aa, Dengue virus
KTSTGVNMC

SEQ ID NO: 11695 - protein, 9 aa, Dengue virus
TSTGVNMCT

SEQ ID NO: 11696 - protein, 9 aa, Dengue virus
STGVNMCTL

SEQ ID NO: 11697 - protein, 9 aa, Dengue virus
TGVNMCTLI

SEQ ID NO: 11698 - protein, 9 aa, Dengue virus
LGELCEDTI

SEQ ID NO: 11699 - protein, 9 aa, Dengue virus
GELCEDTIT

SEQ ID NO: 11700 - protein, 9 aa, Dengue virus
ELCEDTITY

SEQ ID NO: 11701 - protein, 9 aa, Dengue virus
LCEDTITYK

SEQ ID NO: 11702 - protein, 9 aa, Dengue virus
ITYKCPRIT

SEQ ID NO: 11703 - protein, 9 aa, Dengue virus
YKCPRITEV

SEQ ID NO: 11704 - protein, 9 aa, Dengue virus
KCPRITEVE

SEQ ID NO: 11705 - protein, 9 aa, Dengue virus
CPRITEVEP

SEQ ID NO: 11706 - protein, 9 aa, Dengue virus
PRITEVEPD

SEQ ID NO: 11707 - protein, 9 aa, Dengue virus
RITEVEPDD

SEQ ID NO: 11708 - protein, 9 aa, Dengue virus
ISEAEPDDV

SEQ ID NO: 11709 - protein, 9 aa, Dengue virus
SEAEPDDVD

SEQ ID NO: 11710 - protein, 9 aa, Dengue virus
SRTGEHRRD

SEQ ID NO: 11711 - protein, 9 aa, Dengue virus
RTGEHRRDK

SEQ ID NO: 11712 - protein, 9 aa, Dengue virus
HPGFTVMAL

SEQ ID NO: 11713 - protein, 9 aa, Dengue virus
PGFTVMALF

SEQ ID NO: 11714 - protein, 9 aa, Dengue virus
GFTVMALFL

SEQ ID NO: 11715 - protein, 9 aa, Dengue virus
FTVMALFLA

SEQ ID NO: 11716 - protein, 9 aa, Dengue virus
VANPAVLRK

SEQ ID NO: 11717 - protein, 9 aa, Dengue virus
TSPAILRKL

SEQ ID NO: 11718 - protein, 9 aa, Dengue virus
ATLVEEQDS

SEQ ID NO: 11719 - protein, 9 aa, Dengue virus
TLVEEQDSN

SEQ ID NO: 11720 - protein, 9 aa, Dengue virus
LVEEQDSNF

SEQ ID NO: 11721 - protein, 9 aa, Dengue virus
VEEQDSNFV

SEQ ID NO: 11722 - protein, 9 aa, Dengue virus
ANFVCRRTL

SEQ ID NO: 11723 - protein, 9 aa, Dengue virus
VTKLEGKVV

SEQ ID NO: 11724 - protein, 9 aa, Dengue virus
KLEGKTVQH

SEQ ID NO: 11725 - protein, 9 aa, Dengue virus
LEGKIVQHE

SEQ ID NO: 11726 - protein, 9 aa, Dengue virus
EGKIVQHEN

SEQ ID NO: 11727 - protein, 9 aa, Dengue virus
GKTVQHENL

SEQ ID NO: 11728 - protein, 9 aa, Dengue virus
KTVQHENLK

SEQ ID NO: 11729 - protein, 9 aa, Dengue virus
IVQHENLKY

SEQ ID NO: 11730 - protein, 9 aa, Dengue virus
NESTEHGTI

SEQ ID NO: 11731 - protein, 9 aa, Dengue virus
ESTEHGTIA

SEQ ID NO: 11732 - protein, 9 aa, Dengue virus
STEHGTIAT

SEQ ID NO: 11733 - protein, 9 aa, Dengue virus
MVLLTMEKK

SEQ ID NO: 11734 - protein, 9 aa, Dengue virus
VLLTMEKKS

SEQ ID NO: 11735 - protein, 9 aa, Dengue virus
LLTMEKKSW

SEQ ID NO: 11736 - protein, 9 aa, Dengue virus
LTMEKKSWL

SEQ ID NO: 11737 - protein, 9 aa, Dengue virus
TMEKKSWLV

SEQ ID NO: 11738 - protein, 9 aa, Dengue virus
MEKKSWLVH

SEQ ID NO: 11739 - protein, 9 aa, Dengue virus
EKKSWLVHK

SEQ ID NO: 11740 - protein, 9 aa, Dengue virus
TTQETWNRQ

SEQ ID NO: 11741 - protein, 9 aa, Dengue virus
MDKLTLKGI

SEQ ID NO: 11742 - protein, 9 aa, Dengue virus
DKLTLKGIS

SEQ ID NO: 11743 - protein, 9 aa, Dengue virus
KLTLKGISY

SEQ ID NO: 11744 - protein, 9 aa, Dengue virus
LTLKGISYV

SEQ ID NO: 11745 - protein, 9 aa, Dengue virus
TLKGISYVM

SEQ ID NO: 11746 - protein, 9 aa, Dengue virus
LKGISYVMC

SEQ ID NO: 11747 - protein, 9 aa, Dengue virus
KGISYVMCT

SEQ ID NO: 11748 - protein, 9 aa, Dengue virus
GVSYVMCTG

SEQ ID NO: 11749 - protein, 9 aa, Dengue virus
GPFKLEKEV

SEQ ID NO: 11750 - protein, 9 aa, Dengue virus
APCKIPFSA

SEQ ID NO: 11751 - protein, 9 aa, Dengue virus
PCKIPFSAQ

SEQ ID NO: 11752 - protein, 9 aa, Dengue virus
CKIPFSAQD

SEQ ID NO: 11753 - protein, 9 aa, Dengue virus
KIPFSAQDE

SEQ ID NO: 11754 - protein, 9 aa, Dengue virus
QDGKGVTQN

SEQ ID NO: 11755 - protein, 9 aa, Dengue virus
DGKGVTQNG

SEQ ID NO: 11756 - protein, 9 aa, Dengue virus
GKGVTQNGR

SEQ ID NO: 11757 - protein, 9 aa, Dengue virus
KGVTQNGRV

SEQ ID NO: 11758 - protein, 9 aa, Dengue virus
GVTQNGRLV

SEQ ID NO: 11759 - protein, 9 aa, Dengue virus
VTQNGRLVT

SEQ ID NO: 11760 - protein, 9 aa, Dengue virus
TQNGRVITA

SEQ ID NO: 11761 - protein, 9 aa, Dengue virus
IVTDKEKPI

SEQ ID NO: 11762 - protein, 9 aa, Dengue virus
VTDKEKPIN

SEQ ID NO: 11763 - protein, 9 aa, Dengue virus
TDKEKPINI

SEQ ID NO: 11764 - protein, 9 aa, Dengue virus
REKPVNIEA

SEQ ID NO: 11765 - protein, 9 aa, Dengue virus
PFGESYIIV

SEQ ID NO: 11766 - protein, 9 aa, Dengue virus
FGESYIIVG

SEQ ID NO: 11767 - protein, 9 aa, Dengue virus
IGAGEKTLK

SEQ ID NO: 11768 - protein, 9 aa, Dengue virus
LSWFKKGSN

SEQ ID NO: 11769 - protein, 9 aa, Dengue virus
SWFKKGSNI

SEQ ID NO: 11770 - protein, 9 aa, Dengue virus
NIGKMFEAT

SEQ ID NO: 11771 - protein, 9 aa, Dengue virus
GGVFTSMGK

SEQ ID NO: 11772 - protein, 9 aa, Dengue virus
GVFTSAGKL

SEQ ID NO: 11773 - protein, 9 aa, Dengue virus
FTSMGKLVH

SEQ ID NO: 11774 - protein, 9 aa, Dengue virus
TSAGKLVHQ

SEQ ID NO: 11775 - protein, 9 aa, Dengue virus
GKLIHQVFG

SEQ ID NO: 11776 - protein, 9 aa, Dengue virus
KLVHQVFGA

SEQ ID NO: 11777 - protein, 9 aa, Dengue virus
LVHQVFGAA

SEQ ID NO: 11778 - protein, 9 aa, Dengue virus
VHQVFGAAY

SEQ ID NO: 11779 - protein, 9 aa, Dengue virus
GLNSRSASL

SEQ ID NO: 11780 - protein, 9 aa, Dengue virus
LNSRNTSLS

SEQ ID NO: 11781 - protein, 9 aa, Dengue virus
NSRNTSLSV

SEQ ID NO: 11782 - protein, 9 aa, Dengue virus
SRNTSLSVM

SEQ ID NO: 11783 - protein, 9 aa, Dengue virus
RNTSLSVMC

SEQ ID NO: 11784 - protein, 9 aa, Dengue virus
NTSLSVMCI

SEQ ID NO: 11785 - protein, 9 aa, Dengue virus
TSLSMTCIV

SEQ ID NO: 11786 - protein, 9 aa, Dengue virus
SLSMTCIVV

SEQ ID NO: 11787 - protein, 9 aa, Dengue virus
LSMTCIVVG

SEQ ID NO: 11788 - protein, 9 aa, Dengue virus
SMTCIVVGM

SEQ ID NO: 11789 - protein, 9 aa, Dengue virus
VMCIAVGMV

SEQ ID NO: 11790 - protein, 9 aa, Dengue virus
MCIAVGMVT

SEQ ID NO: 11791 - protein, 9 aa, Dengue virus
CIVVGMVTL

SEQ ID NO: 11792 - protein, 9 aa, Dengue virus
IVVGMVTLY

SEQ ID NO: 11793 - protein, 9 aa, Dengue virus
LVTLYLGAM

SEQ ID NO: 11794 - protein, 9 aa, Dengue virus
NHILLENDI

SEQ ID NO: 11795 - protein, 9 aa, Dengue virus
HILLENDIK

SEQ ID NO: 11796 - protein, 9 aa, Dengue virus
ILLENDIKF

SEQ ID NO: 11797 - protein, 9 aa, Dengue virus
LLENDIKFT

SEQ ID NO: 11798 - protein, 9 aa, Dengue virus
LENDIKFTV

SEQ ID NO: 11799 - protein, 9 aa, Dengue virus
ENDIKFTVV

SEQ ID NO: 11800 - protein, 9 aa, Dengue virus
NDIKFTVVV

SEQ ID NO: 11801 - protein, 9 aa, Dengue virus
DIKFTVVVG

SEQ ID NO: 11802 - protein, 9 aa, Dengue virus
KFTVVVGNA

SEQ ID NO: 11803 - protein, 9 aa, Dengue virus
QGKKMVRPQ

SEQ ID NO: 11804 - protein, 9 aa, Dengue virus
GKKMVRPQP

SEQ ID NO: 11805 - protein, 9 aa, Dengue virus
RKMIRPQPM

SEQ ID NO: 11806 - protein, 9 aa, Dengue virus
MVRPQPMEH

SEQ ID NO: 11807 - protein, 9 aa, Dengue virus
MEYKYSWRS

SEQ ID NO: 11808 - protein, 9 aa, Dengue virus
EYKYSWKIW

SEQ ID NO: 11809 - protein, 9 aa, Dengue virus
YKYSWRSWG

SEQ ID NO: 11810 - protein, 9 aa, Dengue virus
KYSWKIWGK

SEQ ID NO: 11811 - protein, 9 aa, Dengue virus
KAKIIGADT

SEQ ID NO: 11812 - protein, 9 aa, Dengue virus
AKIIGADTQ

SEQ ID NO: 11813 - protein, 9 aa, Dengue virus
KIIGADTQN

SEQ ID NO: 11814 - protein, 9 aa, Dengue virus
GPDTPECPN

SEQ ID NO: 11815 - protein, 9 aa, Dengue virus
ECPDEQRAW

SEQ ID NO: 11816 - protein, 9 aa, Dengue virus
CPDEQRAWN

SEQ ID NO: 11817 - protein, 9 aa, Dengue virus
PDEQRAWNI

SEQ ID NO: 11818 - protein, 9 aa, Dengue virus
DEQRAWNIW

SEQ ID NO: 11819 - protein, 9 aa, Dengue virus
EQRAWNIWE

SEQ ID NO: 11820 - protein, 9 aa, Dengue virus
RDSYTQACD

SEQ ID NO: 11821 - protein, 9 aa, Dengue virus
DSYTQACDH

SEQ ID NO: 11822 - protein, 9 aa, Dengue virus
SYTQACDHR

SEQ ID NO: 11823 - protein, 9 aa, Dengue virus
YTQACDHRL

SEQ ID NO: 11824 - protein, 9 aa, Dengue virus
ETWKLTRAS

SEQ ID NO: 11825 - protein, 9 aa, Dengue virus
SEMIIPKMY

SEQ ID NO: 11826 - protein, 9 aa, Dengue virus
EMIIPKMYG

SEQ ID NO: 11827 - protein, 9 aa, Dengue virus
MIIPKMYGG

SEQ ID NO: 11828 - protein, 9 aa, Dengue virus
IIPKMYGGP

SEQ ID NO: 11829 - protein, 9 aa, Dengue virus
PKMYGGPIS

SEQ ID NO: 11830 - protein, 9 aa, Dengue virus
KMYGGPISQ

SEQ ID NO: 11831 - protein, 9 aa, Dengue virus
MYGGPISQH

SEQ ID NO: 11832 - protein, 9 aa, Dengue virus
FSLGLLCTS

SEQ ID NO: 11833 - protein, 9 aa, Dengue virus
SLGLLCTSI

SEQ ID NO: 11834 - protein, 9 aa, Dengue virus
SIMTEEVMR

SEQ ID NO: 11835 - protein, 9 aa, Dengue virus
IMTEEVMRS

SEQ ID NO: 11836 - protein, 9 aa, Dengue virus
MTEEVMRSR

SEQ ID NO: 11837 - protein, 9 aa, Dengue virus
RWSRKMLMA

SEQ ID NO: 11838 - protein, 9 aa, Dengue virus
SRKMLMTGI

SEQ ID NO: 11839 - protein, 9 aa, Dengue virus
RKMLMTGIL

SEQ ID NO: 11840 - protein, 9 aa, Dengue virus
KMLMTGILA

SEQ ID NO: 11841 - protein, 9 aa, Dengue virus
MLMAGTLAV

SEQ ID NO: 11842 - protein, 9 aa, Dengue virus
LMTGTLAVL

SEQ ID NO: 11843 - protein, 9 aa, Dengue virus
GILAVFFLL

SEQ ID NO: 11844 - protein, 9 aa, Dengue virus
LTWNDLTRL

SEQ ID NO: 11845 - protein, 9 aa, Dengue virus
TWNDLTRLC

SEQ ID NO: 11846 - protein, 9 aa, Dengue virus
WNDLTRLCI

SEQ ID NO: 11847 - protein, 9 aa, Dengue virus
NDLTRLCIM

SEQ ID NO: 11848 - protein, 9 aa, Dengue virus
MVGANASDN

SEQ ID NO: 11849 - protein, 9 aa, Dengue virus
VGANASDNM

SEQ ID NO: 11850 - protein, 9 aa, Dengue virus
GANASDNMG

SEQ ID NO: 11851 - protein, 9 aa, Dengue virus
ANASDNMGM

SEQ ID NO: 11852 - protein, 9 aa, Dengue virus
NASDNMGMG

SEQ ID NO: 11853 - protein, 9 aa, Dengue virus
SDNMGMGTT

SEQ ID NO: 11854 - protein, 9 aa, Dengue virus
DRMGMGMTY

SEQ ID NO: 11855 - protein, 9 aa, Dengue virus
RMGMGMTYL

SEQ ID NO: 11856 - protein, 9 aa, Dengue virus
ATFKIRPMF

SEQ ID NO: 11857 - protein, 9 aa, Dengue virus
TFKIRPMFA

SEQ ID NO: 11858 - protein, 9 aa, Dengue virus
FKIRPMFAV

SEQ ID NO: 11859 - protein, 9 aa, Dengue virus
KIRPMFAVG

SEQ ID NO: 11860 - protein, 9 aa, Dengue virus
PMFAVGLLL

SEQ ID NO: 11861 - protein, 9 aa, Dengue virus
MFAVGLLLR

SEQ ID NO: 11862 - protein, 9 aa, Dengue virus
FAVGLLFRK

SEQ ID NO: 11863 - protein, 9 aa, Dengue virus
VGLLLRRLT

SEQ ID NO: 11864 - protein, 9 aa, Dengue virus
IGLSLVASA

SEQ ID NO: 11865 - protein, 9 aa, Dengue virus
LSLVASVEI

SEQ ID NO: 11866 - protein, 9 aa, Dengue virus
SLVACVELP

SEQ ID NO: 11867 - protein, 9 aa, Dengue virus
ASVEIPNSL

SEQ ID NO: 11868 - protein, 9 aa, Dengue virus
FVELPNSLE

SEQ ID NO: 11869 - protein, 9 aa, Dengue virus
KLLTDFQPH

SEQ ID NO: 11870 - protein, 9 aa, Dengue virus
LLTDFQPHQ

SEQ ID NO: 11871 - protein, 9 aa, Dengue virus
LTDFQPHQL

SEQ ID NO: 11872 - protein, 9 aa, Dengue virus
TDFQPHQLW

SEQ ID NO: 11873 - protein, 9 aa, Dengue virus
LLSLTFVRT

SEQ ID NO: 11874 - protein, 9 aa, Dengue virus
DYAWRTMAM

SEQ ID NO: 11875 - protein, 9 aa, Dengue virus
AMVLSVVSL

SEQ ID NO: 11876 - protein, 9 aa, Dengue virus
LSVVSLFPL

SEQ ID NO: 11877 - protein, 9 aa, Dengue virus
SVVSLFPLC

SEQ ID NO: 11878 - protein, 9 aa, Dengue virus
VSLIPLCLS

SEQ ID NO: 11879 - protein, 9 aa, Dengue virus
SLFPLCMST

SEQ ID NO: 11880 - protein, 9 aa, Dengue virus
LFPLCMSTT

SEQ ID NO: 11881 - protein, 9 aa, Dengue virus
FPLCMSTTS

SEQ ID NO: 11882 - protein, 9 aa, Dengue virus
LGCKPLAMF

SEQ ID NO: 11883 - protein, 9 aa, Dengue virus
KPLTMFLIV

SEQ ID NO: 11884 - protein, 9 aa, Dengue virus
PLTMFLIVE

SEQ ID NO: 11885 - protein, 9 aa, Dengue virus
ITENEIWGR

SEQ ID NO: 11886 - protein, 9 aa, Dengue virus
ENEIWGRKS

SEQ ID NO: 11887 - protein, 9 aa, Dengue virus
NEIWGRKSW

SEQ ID NO: 11888 - protein, 9 aa, Dengue virus
DLLLEKAAE

SEQ ID NO: 11889 - protein, 9 aa, Dengue virus
LLLEKAAEV

SEQ ID NO: 11890 - protein, 9 aa, Dengue virus
LLEKAAEVS

SEQ ID NO: 11891 - protein, 9 aa, Dengue virus
LDKAAEVSW

SEQ ID NO: 11892 - protein, 9 aa, Dengue virus
AAKVSWEEE

SEQ ID NO: 11893 - protein, 9 aa, Dengue virus
AKVSWEEEA

SEQ ID NO: 11894 - protein, 9 aa, Dengue virus
KVSWEEEAE

SEQ ID NO: 11895 - protein, 9 aa, Dengue virus
EQEAEHSGA

SEQ ID NO: 11896 - protein, 9 aa, Dengue virus
QEAEHSGAS

SEQ ID NO: 11897 - protein, 9 aa, Dengue virus
GASHNISVE

SEQ ID NO: 11898 - protein, 9 aa, Dengue virus
ASHNILVVV

SEQ ID NO: 11899 - protein, 9 aa, Dengue virus
LVEVQDDGP

SEQ ID NO: 11900 - protein, 9 aa, Dengue virus
LAISGVYPL

SEQ ID NO: 11901 - protein, 9 aa, Dengue virus
AVSGMYPLS

SEQ ID NO: 11902 - protein, 9 aa, Dengue virus
ISGVYPLSI

SEQ ID NO: 11903 - protein, 9 aa, Dengue virus
TPSPPKVER

SEQ ID NO: 11904 - protein, 9 aa, Dengue virus
PSPPKVERA

SEQ ID NO: 11905 - protein, 9 aa, Dengue virus
SPPKVERAV

SEQ ID NO: 11906 - protein, 9 aa, Dengue virus
PPKVERAVL

SEQ ID NO: 11907 - protein, 9 aa, Dengue virus
PKVERAVLD

SEQ ID NO: 11908 - protein, 9 aa, Dengue virus
VERAVLDNG

SEQ ID NO: 11909 - protein, 9 aa, Dengue virus
ERAVLDNGI

SEQ ID NO: 11910 - protein, 9 aa, Dengue virus
QGLWNTGEE

SEQ ID NO: 11911 - protein, 9 aa, Dengue virus
TMPGTFKTP

SEQ ID NO: 11912 - protein, 9 aa, Dengue virus
MPGTFKTPE

SEQ ID NO: 11913 - protein, 9 aa, Dengue virus
SAIAQTKAS

SEQ ID NO: 11914 - protein, 9 aa, Dengue virus
AIAQTKASQ

SEQ ID NO: 11915 - protein, 9 aa, Dengue virus
IAQTKASQE

SEQ ID NO: 11916 - protein, 9 aa, Dengue virus
AQTKASQEG

SEQ ID NO: 11917 - protein, 9 aa, Dengue virus
QTKASQEGP

SEQ ID NO: 11918 - protein, 9 aa, Dengue virus
TKASQEGPL

SEQ ID NO: 11919 - protein, 9 aa, Dengue virus
GPLPEIEDK

SEQ ID NO: 11920 - protein, 9 aa, Dengue virus
PEIENEVFR

SEQ ID NO: 11921 - protein, 9 aa, Dengue virus
EIENEVFRK

SEQ ID NO: 11922 - protein, 9 aa, Dengue virus
IENEVFRKR

SEQ ID NO: 11923 - protein, 9 aa, Dengue virus
ENEVFRKRN

SEQ ID NO: 11924 - protein, 9 aa, Dengue virus
NEVFRKRNL

SEQ ID NO: 11925 - protein, 9 aa, Dengue virus
IVREAIRRN

SEQ ID NO: 11926 - protein, 9 aa, Dengue virus
VREAIRRNV

SEQ ID NO: 11927 - protein, 9 aa, Dengue virus
REAIRRNVR

SEQ ID NO: 11928 - protein, 9 aa, Dengue virus
EAIKRKMRT

SEQ ID NO: 11929 - protein, 9 aa, Dengue virus
AIKRKMRTL

SEQ ID NO: 11930 - protein, 9 aa, Dengue virus
IKRRLRTLV

SEQ ID NO: 11931 - protein, 9 aa, Dengue virus
KRRLRTLVL

SEQ ID NO: 11932 - protein, 9 aa, Dengue virus
RRLRTLVLA

SEQ ID NO: 11933 - protein, 9 aa, Dengue virus
RLRTLVLAP

SEQ ID NO: 11934 - protein, 9 aa, Dengue virus
HNKEGDQYV

SEQ ID NO: 11935 - protein, 9 aa, Dengue virus
KSVSGDLIL

SEQ ID NO: 11936 - protein, 9 aa, Dengue virus
KLPQHLTLK

SEQ ID NO: 11937 - protein, 9 aa, Dengue virus
LPQHLTLKA

SEQ ID NO: 11938 - protein, 9 aa, Dengue virus
PQHLTLKAQ

SEQ ID NO: 11939 - protein, 9 aa, Dengue virus
QHLTLKAQN

SEQ ID NO: 11940 - protein, 9 aa, Dengue virus
HLTLKAQNA

SEQ ID NO: 11941 - protein, 9 aa, Dengue virus
LTLKAQNAL

SEQ ID NO: 11942 - protein, 9 aa, Dengue virus
TLKAQNALD

SEQ ID NO: 11943 - protein, 9 aa, Dengue virus
LKAQNALDN

SEQ ID NO: 11944 - protein, 9 aa, Dengue virus
SIGLLCVIA

SEQ ID NO: 11945 - protein, 9 aa, Dengue virus
IGLLCVIAS

SEQ ID NO: 11946 - protein, 9 aa, Dengue virus
GLLCVIASS

SEQ ID NO: 11947 - protein, 9 aa, Dengue virus
TSSVLLWMA

SEQ ID NO: 11948 - protein, 9 aa, Dengue virus
SALLWIASV

SEQ ID NO: 11949 - protein, 9 aa, Dengue virus
ALLWIASVE

SEQ ID NO: 11950 - protein, 9 aa, Dengue virus
KDLGIGHAV

SEQ ID NO: 11951 - protein, 9 aa, Dengue virus
HATMLDIDL

SEQ ID NO: 11952 - protein, 9 aa, Dengue virus
TMLDIDLHP

SEQ ID NO: 11953 - protein, 9 aa, Dengue virus
LTATVLMLV

SEQ ID NO: 11954 - protein, 9 aa, Dengue virus
TATVLMLVA

SEQ ID NO: 11955 - protein, 9 aa, Dengue virus
NTYKKSGIM

SEQ ID NO: 11956 - protein, 9 aa, Dengue virus
TYKKSGIME

SEQ ID NO: 11957 - protein, 9 aa, Dengue virus
GLKRGEITK

SEQ ID NO: 11958 - protein, 9 aa, Dengue virus
LKRGEITKH

SEQ ID NO: 11959 - protein, 9 aa, Dengue virus
KRGEITKHA

SEQ ID NO: 11960 - protein, 9 aa, Dengue virus
GGLGHEEPI

SEQ ID NO: 11961 - protein, 9 aa, Dengue virus
GLGHEEPIP

SEQ ID NO: 11962 - protein, 9 aa, Dengue virus
LGHEEPIPM

SEQ ID NO: 11963 - protein, 9 aa, Dengue virus
VKLHSGKDA

SEQ ID NO: 11964 - protein, 9 aa, Dengue virus
KLHSGKDAF

SEQ ID NO: 11965 - protein, 9 aa, Dengue virus
SGKDVFFVP

SEQ ID NO: 11966 - protein, 9 aa, Dengue virus
GKDVFFVPP

SEQ ID NO: 11967 - protein, 9 aa, Dengue virus
KDVFFVPPE

SEQ ID NO: 11968 - protein, 9 aa, Dengue virus
DVFFVPPEK

SEQ ID NO: 11969 - protein, 9 aa, Dengue virus
VFFVPPEKC

SEQ ID NO: 11970 - protein, 9 aa, Dengue virus
FFVPPEKCD

SEQ ID NO: 11971 - protein, 9 aa, Dengue virus
FVPPEKCDT

SEQ ID NO: 11972 - protein, 9 aa, Dengue virus
VPPEKCDTL

SEQ ID NO: 11973 - protein, 9 aa, Dengue virus
ETLERMQRK

SEQ ID NO: 11974 - protein, 9 aa, Dengue virus
TLEQMQRRH

SEQ ID NO: 11975 - protein, 9 aa, Dengue virus
AHRKPTFER

SEQ ID NO: 11976 - protein, 9 aa, Dengue virus
FERDVDLGA

SEQ ID NO: 11977 - protein, 9 aa, Dengue virus
RHVTVEPEV

SEQ ID NO: 11978 - protein, 9 aa, Dengue virus
HVTVEPEVA

SEQ ID NO: 11979 - protein, 9 aa, Dengue virus
VTVEPEVAN

SEQ ID NO: 11980 - protein, 9 aa, Dengue virus
VEPEVPNLD

SEQ ID NO: 11981 - protein, 9 aa, Dengue virus
EPEVANIDI

SEQ ID NO: 11982 - protein, 9 aa, Dengue virus
PEVANIDII

SEQ ID NO: 11983 - protein, 9 aa, Dengue virus
EVPNLDIIG

SEQ ID NO: 11984 - protein, 9 aa, Dengue virus
VPNLDIIGQ

SEQ ID NO: 11985 - protein, 9 aa, Dengue virus
TPKAKRGTV

SEQ ID NO: 11986 - protein, 9 aa, Dengue virus
PKAKRGTVQ

SEQ ID NO: 11987 - protein, 9 aa, Dengue virus
KAKRGTVQI

SEQ ID NO: 11988 - protein, 9 aa, Dengue virus
AKQGTAQIM

SEQ ID NO: 11989 - protein, 9 aa, Dengue virus
KQGTAQIME

SEQ ID NO: 11990 - protein, 9 aa, Dengue virus
QGTAQIMEV

SEQ ID NO: 11991 - protein, 9 aa, Dengue virus
GTAQIMEMT

SEQ ID NO: 11992 - protein, 9 aa, Dengue virus
TAQIMEMTA

SEQ ID NO: 11993 - protein, 9 aa, Dengue virus
VTARWLWSF

SEQ ID NO: 11994 - protein, 9 aa, Dengue virus
AVEDERFWN

SEQ ID NO: 11995 - protein, 9 aa, Dengue virus
VEDERFWNL

SEQ ID NO: 11996 - protein, 9 aa, Dengue virus
EDERFWNLV

SEQ ID NO: 11997 - protein, 9 aa, Dengue virus
LVKKERELH

SEQ ID NO: 11998 - protein, 9 aa, Dengue virus
VKKERELHK

SEQ ID NO: 11999 - protein, 9 aa, Dengue virus
KKERELHKQ

SEQ ID NO: 12000 - protein, 9 aa, Dengue virus
DISKIPGGS

SEQ ID NO: 12001 - protein, 9 aa, Dengue virus
ISKISGGNM

SEQ ID NO: 12002 - protein, 9 aa, Dengue virus
SKISGGNMY

SEQ ID NO: 12003 - protein, 9 aa, Dengue virus
KIPGGSMYA

SEQ ID NO: 12004 - protein, 9 aa, Dengue virus
RNEAKITDI

SEQ ID NO: 12005 - protein, 9 aa, Dengue virus
AKITDIMKP

SEQ ID NO: 12006 - protein, 9 aa, Dengue virus
RITDIMEAE

SEQ ID NO: 12007 - protein, 9 aa, Dengue virus
PEHALLARS

SEQ ID NO: 12008 - protein, 9 aa, Dengue virus
EHALLARSI

SEQ ID NO: 12009 - protein, 9 aa, Dengue virus
HALLARSIF

SEQ ID NO: 12010 - protein, 9 aa, Dengue virus
ALLARSIFK

SEQ ID NO: 12011 - protein, 9 aa, Dengue virus
LLARSIFKL

SEQ ID NO: 12012 - protein, 9 aa, Dengue virus
LARSIFKLT

SEQ ID NO: 12013 - protein, 9 aa, Dengue virus
ARSIFKLTY

SEQ ID NO: 12014 - protein, 9 aa, Dengue virus
RSIFKLTYQ

SEQ ID NO: 12015 - protein, 9 aa, Dengue virus
VRVQRPTKN

SEQ ID NO: 12016 - protein, 9 aa, Dengue virus
RVQRPTKNG

SEQ ID NO: 12017 - protein, 9 aa, Dengue virus
VQRPTKNGT

SEQ ID NO: 12018 - protein, 9 aa, Dengue virus
QRPTKNGTV

SEQ ID NO: 12019 - protein, 9 aa, Dengue virus
RPTKNGTVM

SEQ ID NO: 12020 - protein, 9 aa, Dengue virus
PTKNGTVMD

SEQ ID NO: 12021 - protein, 9 aa, Dengue virus
TKNGTVMDV

SEQ ID NO: 12022 - protein, 9 aa, Dengue virus
QMESEEIFS

SEQ ID NO: 12023 - protein, 9 aa, Dengue virus
MESEEIFSP

SEQ ID NO: 12024 - protein, 9 aa, Dengue virus
KPIDDRFAA

SEQ ID NO: 12025 - protein, 9 aa, Dengue virus
PIDDRFAAA

SEQ ID NO: 12026 - protein, 9 aa, Dengue virus
IDDRFAAAL

SEQ ID NO: 12027 - protein, 9 aa, Dengue virus
DDRFAAALT

SEQ ID NO: 12028 - protein, 9 aa, Dengue virus
DRFAAALTA

SEQ ID NO: 12029 - protein, 9 aa, Dengue virus
RFAAALTAL

SEQ ID NO: 12030 - protein, 9 aa, Dengue virus
FAAALTALN

SEQ ID NO: 12031 - protein, 9 aa, Dengue virus
AAALTALND

SEQ ID NO: 12032 - protein, 9 aa, Dengue virus
AALTALNDM

SEQ ID NO: 12033 - protein, 9 aa, Dengue virus
NANCSAVPV

SEQ ID NO: 12034 - protein, 9 aa, Dengue virus
PVNWVPTSR

SEQ ID NO: 12035 - protein, 9 aa, Dengue virus
IDWVPTSRT

SEQ ID NO: 12036 - protein, 9 aa, Dengue virus
DKTHISSWE

SEQ ID NO: 12037 - protein, 9 aa, Dengue virus
VSSWGDVPY

SEQ ID NO: 12038 - protein, 9 aa, Dengue virus
IGNENYLDF

SEQ ID NO: 12039 - protein, 9 aa, Dengue virus
NENYLDYMI

SEQ ID NO: 12040 - protein, 9 aa, Dengue virus
ENYLDYMIS

SEQ ID NO: 12041 - protein, 9 aa, Dengue virus
NYLDYMISM

SEQ ID NO: 12042 - protein, 9 aa, Dengue virus
YLDYMISMK

SEQ ID NO: 12043 - protein, 9 aa, Dengue virus
LDYMISMKR

SEQ ID NO: 12044 - protein, 9 aa, Dengue virus
SMKRFKNDS

SEQ ID NO: 12045 - protein, 9 aa, Dengue virus
MLNVMNRRK

SEQ ID NO: 12046 - protein, 9 aa, Dengue virus
RRKRSATML

SEQ ID NO: 12047 - protein, 9 aa, Dengue virus
RKRSVTMLF

SEQ ID NO: 12048 - protein, 9 aa, Dengue virus
RSATMLLML

SEQ ID NO: 12049 - protein, 9 aa, Dengue virus
TTLAFHLTT

SEQ ID NO: 12050 - protein, 9 aa, Dengue virus
YKCPRISEA

SEQ ID NO: 12051 - protein, 9 aa, Dengue virus
KCPRISEAE

SEQ ID NO: 12052 - protein, 9 aa, Dengue virus
CPRISEAEP

SEQ ID NO: 12053 - protein, 9 aa, Dengue virus
PRISEAEPD

SEQ ID NO: 12054 - protein, 9 aa, Dengue virus
RISEAEPDD

SEQ ID NO: 12055 - protein, 9 aa, Dengue virus
HPGFTMIAL

SEQ ID NO: 12056 - protein, 9 aa, Dengue virus
PGFTMIALF

SEQ ID NO: 12057 - protein, 9 aa, Dengue virus
GFTMIALFL

SEQ ID NO: 12058 - protein, 9 aa, Dengue virus
FTMIALFLA

SEQ ID NO: 12059 - protein, 9 aa, Dengue virus
KLEGKIVQH

SEQ ID NO: 12060 - protein, 9 aa, Dengue virus
LEGKTVQHE

SEQ ID NO: 12061 - protein, 9 aa, Dengue virus
NETTDHGTT

SEQ ID NO: 12062 - protein, 9 aa, Dengue virus
ETTDHGTTA

SEQ ID NO: 12063 - protein, 9 aa, Dengue virus
TTDHGTTAT

SEQ ID NO: 12064 - protein, 9 aa, Dengue virus
ASQETWNRK

SEQ ID NO: 12065 - protein, 9 aa, Dengue virus
MDKLTLKGV

SEQ ID NO: 12066 - protein, 9 aa, Dengue virus
DKLTLKGVS

SEQ ID NO: 12067 - protein, 9 aa, Dengue virus
KLTLKGVSY

SEQ ID NO: 12068 - protein, 9 aa, Dengue virus
LTLKGVSYV

SEQ ID NO: 12069 - protein, 9 aa, Dengue virus
TLKGVSYVM

SEQ ID NO: 12070 - protein, 9 aa, Dengue virus
KIPFSTQDG

SEQ ID NO: 12071 - protein, 9 aa, Dengue virus
QDERGVTQN

SEQ ID NO: 12072 - protein, 9 aa, Dengue virus
DERGVTQNG

SEQ ID NO: 12073 - protein, 9 aa, Dengue virus
ERGVTQNGR

SEQ ID NO: 12074 - protein, 9 aa, Dengue virus
RGVTQNGRL

SEQ ID NO: 12075 - protein, 9 aa, Dengue virus
GVTQNGRVI

SEQ ID NO: 12076 - protein, 9 aa, Dengue virus
VTQNGRVIT

SEQ ID NO: 12077 - protein, 9 aa, Dengue virus
PFGESYITI

SEQ ID NO: 12078 - protein, 9 aa, Dengue virus
FGESYITIG

SEQ ID NO: 12079 - protein, 9 aa, Dengue virus
GGVFTSAGK

SEQ ID NO: 12080 - protein, 9 aa, Dengue virus
GVFTSMGKL

SEQ ID NO: 12081 - protein, 9 aa, Dengue virus
FTSAGKLVH

SEQ ID NO: 12082 - protein, 9 aa, Dengue virus
TSMGKLVHQ

SEQ ID NO: 12083 - protein, 9 aa, Dengue virus
KLIHQVFGT

SEQ ID NO: 12084 - protein, 9 aa, Dengue virus
LIHQVFGTA

SEQ ID NO: 12085 - protein, 9 aa, Dengue virus
IHQVFGTAY

SEQ ID NO: 12086 - protein, 9 aa, Dengue virus
TSLSVMCIA

SEQ ID NO: 12087 - protein, 9 aa, Dengue virus
MTCIVVGMV

SEQ ID NO: 12088 - protein, 9 aa, Dengue virus
TCIVVGMVT

SEQ ID NO: 12089 - protein, 9 aa, Dengue virus
MEYKYSWKI

SEQ ID NO: 12090 - protein, 9 aa, Dengue virus
EYKYSWRSW

SEQ ID NO: 12091 - protein, 9 aa, Dengue virus
YKYSWKIWG

SEQ ID NO: 12092 - protein, 9 aa, Dengue virus
GPNTPECPN

SEQ ID NO: 12093 - protein, 9 aa, Dengue virus
ECSDDQRAW

SEQ ID NO: 12094 - protein, 9 aa, Dengue virus
CSDDQRAWN

SEQ ID NO: 12095 - protein, 9 aa, Dengue virus
SDDQRAWNI

SEQ ID NO: 12096 - protein, 9 aa, Dengue virus
RDSHTQMCD

SEQ ID NO: 12097 - protein, 9 aa, Dengue virus
DSHTQMCDH

SEQ ID NO: 12098 - protein, 9 aa, Dengue virus
SHTQMCDHR

SEQ ID NO: 12099 - protein, 9 aa, Dengue virus
HTQMCDHRL

SEQ ID NO: 12100 - protein, 9 aa, Dengue virus
PKIYGGPMS

SEQ ID NO: 12101 - protein, 9 aa, Dengue virus
KIYGGPMSQ

SEQ ID NO: 12102 - protein, 9 aa, Dengue virus
IYGGPMSQH

SEQ ID NO: 12103 - protein, 9 aa, Dengue virus
FSLGLLCVS

SEQ ID NO: 12104 - protein, 9 aa, Dengue virus
SLGLLCVSI

SEQ ID NO: 12105 - protein, 9 aa, Dengue virus
SRKMLMAGT

SEQ ID NO: 12106 - protein, 9 aa, Dengue virus
RKMLMAGTL

SEQ ID NO: 12107 - protein, 9 aa, Dengue virus
LMAGTLAVF

SEQ ID NO: 12108 - protein, 9 aa, Dengue virus
GTLAVLFLL

SEQ ID NO: 12109 - protein, 9 aa, Dengue virus
LTWKDLIRL

SEQ ID NO: 12110 - protein, 9 aa, Dengue virus
MVGANVSDR

SEQ ID NO: 12111 - protein, 9 aa, Dengue virus
VGANVSDRM

SEQ ID NO: 12112 - protein, 9 aa, Dengue virus
GANVSDRMG

SEQ ID NO: 12113 - protein, 9 aa, Dengue virus
ANVSDRMGM

SEQ ID NO: 12114 - protein, 9 aa, Dengue virus
NVSDRMGMG

SEQ ID NO: 12115 - protein, 9 aa, Dengue virus
SDRMGMGMT

SEQ ID NO: 12116 - protein, 9 aa, Dengue virus
DRMGMGTTH

SEQ ID NO: 12117 - protein, 9 aa, Dengue virus
RMGMGTTHL

SEQ ID NO: 12118 - protein, 9 aa, Dengue virus
FAVGLLLRR

SEQ ID NO: 12119 - protein, 9 aa, Dengue virus
ASMELPNSL

SEQ ID NO: 12120 - protein, 9 aa, Dengue virus
SAELPNSLE

SEQ ID NO: 12121 - protein, 9 aa, Dengue virus
LLSFTFIKT

SEQ ID NO: 12122 - protein, 9 aa, Dengue virus
HCAWKTMAM

SEQ ID NO: 12123 - protein, 9 aa, Dengue virus
AMVLSIASL

SEQ ID NO: 12124 - protein, 9 aa, Dengue virus
LSIVSLIPL

SEQ ID NO: 12125 - protein, 9 aa, Dengue virus
SIVSLIPLC

SEQ ID NO: 12126 - protein, 9 aa, Dengue virus
VSLFPLCMS

SEQ ID NO: 12127 - protein, 9 aa, Dengue virus
KPLAMFLIA

SEQ ID NO: 12128 - protein, 9 aa, Dengue virus
PLAMFLIAE

SEQ ID NO: 12129 - protein, 9 aa, Dengue virus
IVENKIWGR

SEQ ID NO: 12130 - protein, 9 aa, Dengue virus
LSLEKTAEV

SEQ ID NO: 12131 - protein, 9 aa, Dengue virus
SLDKAAEVS

SEQ ID NO: 12132 - protein, 9 aa, Dengue virus
AAEVSWEKE

SEQ ID NO: 12133 - protein, 9 aa, Dengue virus
AEVSWEKEA

SEQ ID NO: 12134 - protein, 9 aa, Dengue virus
EVSWEKEAE

SEQ ID NO: 12135 - protein, 9 aa, Dengue virus
EKEAEHSGA

SEQ ID NO: 12136 - protein, 9 aa, Dengue virus
KEAEHSGAS

SEQ ID NO: 12137 - protein, 9 aa, Dengue virus
ASHNIFVEV

SEQ ID NO: 12138 - protein, 9 aa, Dengue virus
LAVSGMYPL

SEQ ID NO: 12139 - protein, 9 aa, Dengue virus
AISGVYPLS

SEQ ID NO: 12140 - protein, 9 aa, Dengue virus
TPSPPVVER

SEQ ID NO: 12141 - protein, 9 aa, Dengue virus
SPPVVERAV

SEQ ID NO: 12142 - protein, 9 aa, Dengue virus
PPVVERAVL

SEQ ID NO: 12143 - protein, 9 aa, Dengue virus
PVVERAVLD

SEQ ID NO: 12144 - protein, 9 aa, Dengue virus
IIREAIKRK

SEQ ID NO: 12145 - protein, 9 aa, Dengue virus
VREAMKRKL

SEQ ID NO: 12146 - protein, 9 aa, Dengue virus
IKRKMRTLI

SEQ ID NO: 12147 - protein, 9 aa, Dengue virus
SIGLLCVMS

SEQ ID NO: 12148 - protein, 9 aa, Dengue virus
IGLLCVMSS

SEQ ID NO: 12149 - protein, 9 aa, Dengue virus
GLLCVMSSS

SEQ ID NO: 12150 - protein, 9 aa, Dengue virus
ASSALLWIA

SEQ ID NO: 12151 - protein, 9 aa, Dengue virus
KDLGIGHVV

SEQ ID NO: 12152 - protein, 9 aa, Dengue virus
NIYKRSGIV

SEQ ID NO: 12153 - protein, 9 aa, Dengue virus
IYKRSGIVE

SEQ ID NO: 12154 - protein, 9 aa, Dengue virus
VFFTPPERC

SEQ ID NO: 12155 - protein, 9 aa, Dengue virus
TLERMQRKH

SEQ ID NO: 12156 - protein, 9 aa, Dengue virus
HVAVEPEVP

SEQ ID NO: 12157 - protein, 9 aa, Dengue virus
VAVEPEVPN

SEQ ID NO: 12158 - protein, 9 aa, Dengue virus
TPKAKQGTA

SEQ ID NO: 12159 - protein, 9 aa, Dengue virus
PKAKQGTAQ

SEQ ID NO: 12160 - protein, 9 aa, Dengue virus
KAKQGTAQI

SEQ ID NO: 12161 - protein, 9 aa, Dengue virus
RGTAQIMEM

SEQ ID NO: 12162 - protein, 9 aa, Dengue virus
LVHKERELH

SEQ ID NO: 12163 - protein, 9 aa, Dengue virus
VHKERELHK

SEQ ID NO: 12164 - protein, 9 aa, Dengue virus
ISKIPGGSM

SEQ ID NO: 12165 - protein, 9 aa, Dengue virus
SKIPGGSMY

SEQ ID NO: 12166 - protein, 9 aa, Dengue virus
KISGGNMYA

SEQ ID NO: 12167 - protein, 9 aa, Dengue virus
PIDWVPTSR

SEQ ID NO: 12168 - protein, 9 aa, Dengue virus
VNWVPTSRT

SEQ ID NO: 12169 - protein, 9 aa, Dengue virus
DKTRISSWE

SEQ ID NO: 12170 - protein, 9 aa, Dengue virus
VSSWEDVPY

SEQ ID NO: 12171 - protein, 10 aa, Dengue virus
MNNQRKKTAR

SEQ ID NO: 12172 - protein, 10 aa, Dengue virus
NNQRKKTARP

SEQ ID NO: 12173 - protein, 10 aa, Dengue virus
NQRKKTARPS

SEQ ID NO: 12174 - protein, 10 aa, Dengue virus
QRKKTARPSF

SEQ ID NO: 12175 - protein, 10 aa, Dengue virus
RKKTARPSFN

SEQ ID NO: 12176 - protein, 10 aa, Dengue virus
KKTARPSFNM

SEQ ID NO: 12177 - protein, 10 aa, Dengue virus
KTARPSFNML

SEQ ID NO: 12178 - protein, 10 aa, Dengue virus
TARPSFNMLK

SEQ ID NO: 12179 - protein, 10 aa, Dengue virus
ARPSFNMLKR

SEQ ID NO: 12180 - protein, 10 aa, Dengue virus
RPSFNMLKRA

SEQ ID NO: 12181 - protein, 10 aa, Dengue virus
PSFNMLKRAR

SEQ ID NO: 12182 - protein, 10 aa, Dengue virus
SFNMLKRARN

SEQ ID NO: 12183 - protein, 10 aa, Dengue virus
FNMLKRARNR

SEQ ID NO: 12184 - protein, 10 aa, Dengue virus
NMLKRARNRV

SEQ ID NO: 12185 - protein, 10 aa, Dengue virus
MLKRARNRVS

SEQ ID NO: 12186 - protein, 10 aa, Dengue virus
LKRARNRVST

SEQ ID NO: 12187 - protein, 10 aa, Dengue virus
KRARNRVSTV

SEQ ID NO: 12188 - protein, 10 aa, Dengue virus
RARNRVSTVS

SEQ ID NO: 12189 - protein, 10 aa, Dengue virus
ARNRVSTVSQ

SEQ ID NO: 12190 - protein, 10 aa, Dengue virus
RNRVSTVSQL

SEQ ID NO: 12191 - protein, 10 aa, Dengue virus
NRVSTVSQLA

SEQ ID NO: 12192 - protein, 10 aa, Dengue virus
RVSTVSQLAK

SEQ ID NO: 12193 - protein, 10 aa, Dengue virus
VSTVSQLAKR

SEQ ID NO: 12194 - protein, 10 aa, Dengue virus
STVSQLAKRF

SEQ ID NO: 12195 - protein, 10 aa, Dengue virus
TVSQLAKRFS

SEQ ID NO: 12196 - protein, 10 aa, Dengue virus
VSQLAKRFSK

SEQ ID NO: 12197 - protein, 10 aa, Dengue virus
SQLAKRFSKG

SEQ ID NO: 12198 - protein, 10 aa, Dengue virus
QLAKRFSKGL

SEQ ID NO: 12199 - protein, 10 aa, Dengue virus
LAKRFSKGLL

SEQ ID NO: 12200 - protein, 10 aa, Dengue virus
AKRFSKGLLS

SEQ ID NO: 12201 - protein, 10 aa, Dengue virus
KRFSKGLLSG

SEQ ID NO: 12202 - protein, 10 aa, Dengue virus
RFSKGLLSGQ

SEQ ID NO: 12203 - protein, 10 aa, Dengue virus
FSKGLLSGQG

SEQ ID NO: 12204 - protein, 10 aa, Dengue virus
SKGLLSGQGP

SEQ ID NO: 12205 - protein, 10 aa, Dengue virus
KGLLSGQGPM

SEQ ID NO: 12206 - protein, 10 aa, Dengue virus
GLLSGQGPMK

SEQ ID NO: 12207 - protein, 10 aa, Dengue virus
LLSGQGPMKL

SEQ ID NO: 12208 - protein, 10 aa, Dengue virus
LSGQGPMKLV

SEQ ID NO: 12209 - protein, 10 aa, Dengue virus
SGQGPMKLVM

SEQ ID NO: 12210 - protein, 10 aa, Dengue virus
GQGPMKLVMA

SEQ ID NO: 12211 - protein, 10 aa, Dengue virus
QGPMKLVMAF

SEQ ID NO: 12212 - protein, 10 aa, Dengue virus
GPMKLVMAFI

SEQ ID NO: 12213 - protein, 10 aa, Dengue virus
PMKLVMAFIA

SEQ ID NO: 12214 - protein, 10 aa, Dengue virus
MKLVMAFIAF

SEQ ID NO: 12215 - protein, 10 aa, Dengue virus
KLVMAFIAFL

SEQ ID NO: 12216 - protein, 10 aa, Dengue virus
LVMAFIAFLR

SEQ ID NO: 12217 - protein, 10 aa, Dengue virus
VMAFIAFLRF

SEQ ID NO: 12218 - protein, 10 aa, Dengue virus
MAFIAFLRFL

SEQ ID NO: 12219 - protein, 10 aa, Dengue virus
AFIAFLRFLA

SEQ ID NO: 12220 - protein, 10 aa, Dengue virus
FIAFLRFLAI

SEQ ID NO: 12221 - protein, 10 aa, Dengue virus
IAFLRFLAIP

SEQ ID NO: 12222 - protein, 10 aa, Dengue virus
AFLRFLAIPP

SEQ ID NO: 12223 - protein, 10 aa, Dengue virus
FLRFLAIPPT

SEQ ID NO: 12224 - protein, 10 aa, Dengue virus
LRFLAIPPTA

SEQ ID NO: 12225 - protein, 10 aa, Dengue virus
RFLAIPPTAG

SEQ ID NO: 12226 - protein, 10 aa, Dengue virus
FLAIPPTAGI

SEQ ID NO: 12227 - protein, 10 aa, Dengue virus
LAIPPTAGIL

SEQ ID NO: 12228 - protein, 10 aa, Dengue virus
AIPPTAGILA

SEQ ID NO: 12229 - protein, 10 aa, Dengue virus
IPPTAGILAR

SEQ ID NO: 12230 - protein, 10 aa, Dengue virus
PPTAGILARW

SEQ ID NO: 12231 - protein, 10 aa, Dengue virus
PTAGILARWG

SEQ ID NO: 12232 - protein, 10 aa, Dengue virus
TAGILARWGS

SEQ ID NO: 12233 - protein, 10 aa, Dengue virus
AGILARWGSF

SEQ ID NO: 12234 - protein, 10 aa, Dengue virus
GILARWGSFK

SEQ ID NO: 12235 - protein, 10 aa, Dengue virus
ILARWGSFKK

SEQ ID NO: 12236 - protein, 10 aa, Dengue virus
LARWGSFKKN

SEQ ID NO: 12237 - protein, 10 aa, Dengue virus
ARWGSFKKNG

SEQ ID NO: 12238 - protein, 10 aa, Dengue virus
RWGSFKKNGA

SEQ ID NO: 12239 - protein, 10 aa, Dengue virus
WGSFKKNGAI

SEQ ID NO: 12240 - protein, 10 aa, Dengue virus
GSFKKNGAIK

SEQ ID NO: 12241 - protein, 10 aa, Dengue virus
SFKKNGAIKV

SEQ ID NO: 12242 - protein, 10 aa, Dengue virus
FKKNGAIKVL

SEQ ID NO: 12243 - protein, 10 aa, Dengue virus
KKNGAIKVLR

SEQ ID NO: 12244 - protein, 10 aa, Dengue virus
KNGAIKVLRG

SEQ ID NO: 12245 - protein, 10 aa, Dengue virus
NGAIKVLRGF

SEQ ID NO: 12246 - protein, 10 aa, Dengue virus
GAIKVLRGFK

SEQ ID NO: 12247 - protein, 10 aa, Dengue virus
AIKVLRGFKK

SEQ ID NO: 12248 - protein, 10 aa, Dengue virus
IKVLRGFKKE

SEQ ID NO: 12249 - protein, 10 aa, Dengue virus
KVLRGFKKEI

SEQ ID NO: 12250 - protein, 10 aa, Dengue virus
VLRGFKKEIS

SEQ ID NO: 12251 - protein, 10 aa, Dengue virus
LRGFKKEISN

SEQ ID NO: 12252 - protein, 10 aa, Dengue virus
RGFKKEISNM

SEQ ID NO: 12253 - protein, 10 aa, Dengue virus
GFKKEISNML

SEQ ID NO: 12254 - protein, 10 aa, Dengue virus
FKKEISNMLN

SEQ ID NO: 12255 - protein, 10 aa, Dengue virus
MNRRKRSVTM

SEQ ID NO: 12256 - protein, 10 aa, Dengue virus
NRRKRSVTML

SEQ ID NO: 12257 - protein, 10 aa, Dengue virus
PTALAFHLTT

SEQ ID NO: 12258 - protein, 10 aa, Dengue virus
TALAFHLTTR

SEQ ID NO: 12259 - protein, 10 aa, Dengue virus
ALAFHLTTRG

SEQ ID NO: 12260 - protein, 10 aa, Dengue virus
LAFHLTTRGG

SEQ ID NO: 12261 - protein, 10 aa, Dengue virus
AFHLTTRGGE

SEQ ID NO: 12262 - protein, 10 aa, Dengue virus
FHLTTRGGEP

SEQ ID NO: 12263 - protein, 10 aa, Dengue virus
HLTTRGGEPH

SEQ ID NO: 12264 - protein, 10 aa, Dengue virus
LTTRGGEPHM

SEQ ID NO: 12265 - protein, 10 aa, Dengue virus
TTRGGEPHMI

SEQ ID NO: 12266 - protein, 10 aa, Dengue virus
TRGGEPHMIV

SEQ ID NO: 12267 - protein, 10 aa, Dengue virus
RGGEPHMIVS

SEQ ID NO: 12268 - protein, 10 aa, Dengue virus
GGEPHMIVSK

SEQ ID NO: 12269 - protein, 10 aa, Dengue virus
GEPHMIVSKQ

SEQ ID NO: 12270 - protein, 10 aa, Dengue virus
EPHMIVSKQE

SEQ ID NO: 12271 - protein, 10 aa, Dengue virus
PHMIVSKQER

SEQ ID NO: 12272 - protein, 10 aa, Dengue virus
HMIVSKQERG

SEQ ID NO: 12273 - protein, 10 aa, Dengue virus
MIVSKQERGK

SEQ ID NO: 12274 - protein, 10 aa, Dengue virus
IVSKQERGKS

SEQ ID NO: 12275 - protein, 10 aa, Dengue virus
VSKQERGKSL

SEQ ID NO: 12276 - protein, 10 aa, Dengue virus
SKQERGKSLL

SEQ ID NO: 12277 - protein, 10 aa, Dengue virus
KQERGKSLLF

SEQ ID NO: 12278 - protein, 10 aa, Dengue virus
QERGKSLLFK

SEQ ID NO: 12279 - protein, 10 aa, Dengue virus
ERGKSLLFKT

SEQ ID NO: 12280 - protein, 10 aa, Dengue virus
RGKSLLFKTS

SEQ ID NO: 12281 - protein, 10 aa, Dengue virus
GKSLLFKTSA

SEQ ID NO: 12282 - protein, 10 aa, Dengue virus
KSLLFKTSAG

SEQ ID NO: 12283 - protein, 10 aa, Dengue virus
SLLFKTSAGV

SEQ ID NO: 12284 - protein, 10 aa, Dengue virus
LLFKTSAGVN

SEQ ID NO: 12285 - protein, 10 aa, Dengue virus
LFKTSAGVNM

SEQ ID NO: 12286 - protein, 10 aa, Dengue virus
FKTSAGVNMC

SEQ ID NO: 12287 - protein, 10 aa, Dengue virus
KTSAGVNMCT

SEQ ID NO: 12288 - protein, 10 aa, Dengue virus
TSAGVNMCTL

SEQ ID NO: 12289 - protein, 10 aa, Dengue virus
SAGVNMCTLI

SEQ ID NO: 12290 - protein, 10 aa, Dengue virus
AGVNMCTLIA

SEQ ID NO: 12291 - protein, 10 aa, Dengue virus
GVNMCTLIAM

SEQ ID NO: 12292 - protein, 10 aa, Dengue virus
VNMCTLIAMD

SEQ ID NO: 12293 - protein, 10 aa, Dengue virus
NMCTLIAMDL

SEQ ID NO: 12294 - protein, 10 aa, Dengue virus
MCTLIAMDLG

SEQ ID NO: 12295 - protein, 10 aa, Dengue virus
CTLIAMDLGE

SEQ ID NO: 12296 - protein, 10 aa, Dengue virus
TLIAMDLGEL

SEQ ID NO: 12297 - protein, 10 aa, Dengue virus
LIAMDLGELC

SEQ ID NO: 12298 - protein, 10 aa, Dengue virus
IAMDLGELCE

SEQ ID NO: 12299 - protein, 10 aa, Dengue virus
AMDLGELCED

SEQ ID NO: 12300 - protein, 10 aa, Dengue virus
MDLGELCEDT

SEQ ID NO: 12301 - protein, 10 aa, Dengue virus
DLGELCEDTM

SEQ ID NO: 12302 - protein, 10 aa, Dengue virus
LGELCEDTMT

SEQ ID NO: 12303 - protein, 10 aa, Dengue virus
GELCEDTMTY

SEQ ID NO: 12304 - protein, 10 aa, Dengue virus
ELCEDTMTYK

SEQ ID NO: 12305 - protein, 10 aa, Dengue virus
LCEDTMTYKC

SEQ ID NO: 12306 - protein, 10 aa, Dengue virus
CEDTMTYKCP

SEQ ID NO: 12307 - protein, 10 aa, Dengue virus
EDTMTYKCPR

SEQ ID NO: 12308 - protein, 10 aa, Dengue virus
DTMTYKCPRI

SEQ ID NO: 12309 - protein, 10 aa, Dengue virus
TMTYKCPRIT

SEQ ID NO: 12310 - protein, 10 aa, Dengue virus
MTYKCPRITE

SEQ ID NO: 12311 - protein, 10 aa, Dengue virus
TYKCPRITEA

SEQ ID NO: 12312 - protein, 10 aa, Dengue virus
YKCPRITEAE

SEQ ID NO: 12313 - protein, 10 aa, Dengue virus
KCPRITEAEP

SEQ ID NO: 12314 - protein, 10 aa, Dengue virus
CPRITEAEPD

SEQ ID NO: 12315 - protein, 10 aa, Dengue virus
PRITEAEPDD

SEQ ID NO: 12316 - protein, 10 aa, Dengue virus
RITEAEPDDV

SEQ ID NO: 12317 - protein, 10 aa, Dengue virus
ITEAEPDDVD

SEQ ID NO: 12318 - protein, 10 aa, Dengue virus
TEAEPDDVDC

SEQ ID NO: 12319 - protein, 10 aa, Dengue virus
EAEPDDVDCW

SEQ ID NO: 12320 - protein, 10 aa, Dengue virus
AEPDDVDCWC

SEQ ID NO: 12321 - protein, 10 aa, Dengue virus
EPDDVDCWCN

SEQ ID NO: 12322 - protein, 10 aa, Dengue virus
PDDVDCWCNA

SEQ ID NO: 12323 - protein, 10 aa, Dengue virus
DDVDCWCNAT

SEQ ID NO: 12324 - protein, 10 aa, Dengue virus
DVDCWCNATD

SEQ ID NO: 12325 - protein, 10 aa, Dengue virus
VDCWCNATDT

SEQ ID NO: 12326 - protein, 10 aa, Dengue virus
DCWCNATDTW

SEQ ID NO: 12327 - protein, 10 aa, Dengue virus
CWCNATDTWV

SEQ ID NO: 12328 - protein, 10 aa, Dengue virus
WCNATDTWVT

SEQ ID NO: 12329 - protein, 10 aa, Dengue virus
CNATDTWVTY

SEQ ID NO: 12330 - protein, 10 aa, Dengue virus
NATDTWVTYG

SEQ ID NO: 12331 - protein, 10 aa, Dengue virus
ATDTWVTYGT

SEQ ID NO: 12332 - protein, 10 aa, Dengue virus
TDTWVTYGTC

SEQ ID NO: 12333 - protein, 10 aa, Dengue virus
DTWVTYGTCS

SEQ ID NO: 12334 - protein, 10 aa, Dengue virus
TWVTYGTCSQ

SEQ ID NO: 12335 - protein, 10 aa, Dengue virus
WVTYGTCSQT

SEQ ID NO: 12336 - protein, 10 aa, Dengue virus
VTYGTCSQTG

SEQ ID NO: 12337 - protein, 10 aa, Dengue virus
TYGTCSQTGE

SEQ ID NO: 12338 - protein, 10 aa, Dengue virus
YGTCSQTGEH

SEQ ID NO: 12339 - protein, 10 aa, Dengue virus
GTCSQTGEHR

SEQ ID NO: 12340 - protein, 10 aa, Dengue virus
TCSQTGEHRR

SEQ ID NO: 12341 - protein, 10 aa, Dengue virus
CSQTGEHRRD

SEQ ID NO: 12342 - protein, 10 aa, Dengue virus
SQTGEHRRDK

SEQ ID NO: 12343 - protein, 10 aa, Dengue virus
QTGEHRRDKR

SEQ ID NO: 12344 - protein, 10 aa, Dengue virus
TGEHRRDKRS

SEQ ID NO: 12345 - protein, 10 aa, Dengue virus
GEHRRDKRSV

SEQ ID NO: 12346 - protein, 10 aa, Dengue virus
EHRRDKRSVA

SEQ ID NO: 12347 - protein, 10 aa, Dengue virus
HRRDKRSVAL

SEQ ID NO: 12348 - protein, 10 aa, Dengue virus
RRDKRSVALA

SEQ ID NO: 12349 - protein, 10 aa, Dengue virus
RDKRSVALAP

SEQ ID NO: 12350 - protein, 10 aa, Dengue virus
DKRSVALAPH

SEQ ID NO: 12351 - protein, 10 aa, Dengue virus
KRSVALAPHV

SEQ ID NO: 12352 - protein, 10 aa, Dengue virus
RSVALAPHVG

SEQ ID NO: 12353 - protein, 10 aa, Dengue virus
SVALAPHVGL

SEQ ID NO: 12354 - protein, 10 aa, Dengue virus
VALAPHVGLG

SEQ ID NO: 12355 - protein, 10 aa, Dengue virus
ALAPHVGLGL

SEQ ID NO: 12356 - protein, 10 aa, Dengue virus
LAPHVGLGLE

SEQ ID NO: 12357 - protein, 10 aa, Dengue virus
APHVGLGLET

SEQ ID NO: 12358 - protein, 10 aa, Dengue virus
PHVGLGLETR

SEQ ID NO: 12359 - protein, 10 aa, Dengue virus
HVGLGLETRT

SEQ ID NO: 12360 - protein, 10 aa, Dengue virus
VGLGLETRTE

SEQ ID NO: 12361 - protein, 10 aa, Dengue virus
GLGLETRTET

SEQ ID NO: 12362 - protein, 10 aa, Dengue virus
LGLETRTETW

SEQ ID NO: 12363 - protein, 10 aa, Dengue virus
GLETRTETWM

SEQ ID NO: 12364 - protein, 10 aa, Dengue virus
LETRTETWMS

SEQ ID NO: 12365 - protein, 10 aa, Dengue virus
ETRTETWMSS

SEQ ID NO: 12366 - protein, 10 aa, Dengue virus
TRTETWMSSE

SEQ ID NO: 12367 - protein, 10 aa, Dengue virus
RTETWMSSEG

SEQ ID NO: 12368 - protein, 10 aa, Dengue virus
TETWMSSEGA

SEQ ID NO: 12369 - protein, 10 aa, Dengue virus
ETWMSSEGAW

SEQ ID NO: 12370 - protein, 10 aa, Dengue virus
TWMSSEGAWK

SEQ ID NO: 12371 - protein, 10 aa, Dengue virus
WMSSEGAWKQ

SEQ ID NO: 12372 - protein, 10 aa, Dengue virus
MSSEGAWKQI

SEQ ID NO: 12373 - protein, 10 aa, Dengue virus
SSEGAWKQIQ

SEQ ID NO: 12374 - protein, 10 aa, Dengue virus
SEGAWKQIQR

SEQ ID NO: 12375 - protein, 10 aa, Dengue virus
EGAWKQIQRV

SEQ ID NO: 12376 - protein, 10 aa, Dengue virus
GAWKQIQRVE

SEQ ID NO: 12377 - protein, 10 aa, Dengue virus
AWKQIQRVET

SEQ ID NO: 12378 - protein, 10 aa, Dengue virus
WKQIQRVETW

SEQ ID NO: 12379 - protein, 10 aa, Dengue virus
KQIQRVETWA

SEQ ID NO: 12380 - protein, 10 aa, Dengue virus
QIQRVETWAL

SEQ ID NO: 12381 - protein, 10 aa, Dengue virus
IQRVETWALR

SEQ ID NO: 12382 - protein, 10 aa, Dengue virus
QRVETWALRH

SEQ ID NO: 12383 - protein, 10 aa, Dengue virus
RVETWALRHP

SEQ ID NO: 12384 - protein, 10 aa, Dengue virus
VETWALRHPG

SEQ ID NO: 12385 - protein, 10 aa, Dengue virus
ETWALRHPGF

SEQ ID NO: 12386 - protein, 10 aa, Dengue virus
TWALRHPGFT

SEQ ID NO: 12387 - protein, 10 aa, Dengue virus
WALRHPGFTV

SEQ ID NO: 12388 - protein, 10 aa, Dengue virus
ALRHPGFTVI

SEQ ID NO: 12389 - protein, 10 aa, Dengue virus
LRHPGFTVIA

SEQ ID NO: 12390 - protein, 10 aa, Dengue virus
RHPGFTVIAL

SEQ ID NO: 12391 - protein, 10 aa, Dengue virus
HPGFTVIALF

SEQ ID NO: 12392 - protein, 10 aa, Dengue virus
PGFTVIALFL

SEQ ID NO: 12393 - protein, 10 aa, Dengue virus
GFTVIALFLA

SEQ ID NO: 12394 - protein, 10 aa, Dengue virus
ALFLAHAIGT

SEQ ID NO: 12395 - protein, 10 aa, Dengue virus
LFLAHAIGTS

SEQ ID NO: 12396 - protein, 10 aa, Dengue virus
FLAHAIGTSI

SEQ ID NO: 12397 - protein, 10 aa, Dengue virus
LAHAIGTSIT

SEQ ID NO: 12398 - protein, 10 aa, Dengue virus
AHAIGTSITQ

SEQ ID NO: 12399 - protein, 10 aa, Dengue virus
HAIGTSITQK

SEQ ID NO: 12400 - protein, 10 aa, Dengue virus
AIGTSITQKG

SEQ ID NO: 12401 - protein, 10 aa, Dengue virus
IGTSITQKGI

SEQ ID NO: 12402 - protein, 10 aa, Dengue virus
GTSITQKGII

SEQ ID NO: 12403 - protein, 10 aa, Dengue virus
TSITQKGIIF

SEQ ID NO: 12404 - protein, 10 aa, Dengue virus
SITQKGIIFI

SEQ ID NO: 12405 - protein, 10 aa, Dengue virus
ITQKGIIFIL

SEQ ID NO: 12406 - protein, 10 aa, Dengue virus
TQKGIIFILL

SEQ ID NO: 12407 - protein, 10 aa, Dengue virus
QKGIIFILLM

SEQ ID NO: 12408 - protein, 10 aa, Dengue virus
KGIIFILLML

SEQ ID NO: 12409 - protein, 10 aa, Dengue virus
GIIFILLMLV

SEQ ID NO: 12410 - protein, 10 aa, Dengue virus
IIFILLMLVT

SEQ ID NO: 12411 - protein, 10 aa, Dengue virus
IFILLMLVTP

SEQ ID NO: 12412 - protein, 10 aa, Dengue virus
FILLMLVTPS

SEQ ID NO: 12413 - protein, 10 aa, Dengue virus
ILLMLVTPSM

SEQ ID NO: 12414 - protein, 10 aa, Dengue virus
LLMLVTPSMA

SEQ ID NO: 12415 - protein, 10 aa, Dengue virus
LMLVTPSMAM

SEQ ID NO: 12416 - protein, 10 aa, Dengue virus
MLVTPSMAMR

SEQ ID NO: 12417 - protein, 10 aa, Dengue virus
LVTPSMAMRC

SEQ ID NO: 12418 - protein, 10 aa, Dengue virus
VTPSMAMRCV

SEQ ID NO: 12419 - protein, 10 aa, Dengue virus
TPSMAMRCVG

SEQ ID NO: 12420 - protein, 10 aa, Dengue virus
PSMAMRCVGI

SEQ ID NO: 12421 - protein, 10 aa, Dengue virus
SMAMRCVGIG

SEQ ID NO: 12422 - protein, 10 aa, Dengue virus
MAMRCVGIGS

SEQ ID NO: 12423 - protein, 10 aa, Dengue virus
AMRCVGIGSR

SEQ ID NO: 12424 - protein, 10 aa, Dengue virus
MRCVGIGSRD

SEQ ID NO: 12425 - protein, 10 aa, Dengue virus
RCVGIGSRDF

SEQ ID NO: 12426 - protein, 10 aa, Dengue virus
CVGIGSRDFV

SEQ ID NO: 12427 - protein, 10 aa, Dengue virus
VGIGSRDFVE

SEQ ID NO: 12428 - protein, 10 aa, Dengue virus
GIGSRDFVEG

SEQ ID NO: 12429 - protein, 10 aa, Dengue virus
IGSRDFVEGL

SEQ ID NO: 12430 - protein, 10 aa, Dengue virus
GSRDFVEGLS

SEQ ID NO: 12431 - protein, 10 aa, Dengue virus
SRDFVEGLSG

SEQ ID NO: 12432 - protein, 10 aa, Dengue virus
RDFVEGLSGA

SEQ ID NO: 12433 - protein, 10 aa, Dengue virus
DFVEGLSGAT

SEQ ID NO: 12434 - protein, 10 aa, Dengue virus
FVEGLSGATW

SEQ ID NO: 12435 - protein, 10 aa, Dengue virus
VEGLSGATWV

SEQ ID NO: 12436 - protein, 10 aa, Dengue virus
EGLSGATWVD

SEQ ID NO: 12437 - protein, 10 aa, Dengue virus
GLSGATWVDV

SEQ ID NO: 12438 - protein, 10 aa, Dengue virus
LSGATWVDVV

SEQ ID NO: 12439 - protein, 10 aa, Dengue virus
SGATWVDVVL

SEQ ID NO: 12440 - protein, 10 aa, Dengue virus
GATWVDVVLE

SEQ ID NO: 12441 - protein, 10 aa, Dengue virus
ATWVDVVLEH

SEQ ID NO: 12442 - protein, 10 aa, Dengue virus
TWVDVVLEHG

SEQ ID NO: 12443 - protein, 10 aa, Dengue virus
WVDVVLEHGS

SEQ ID NO: 12444 - protein, 10 aa, Dengue virus
VDVVLEHGSC

SEQ ID NO: 12445 - protein, 10 aa, Dengue virus
DVVLEHGSCV

SEQ ID NO: 12446 - protein, 10 aa, Dengue virus
VVLEHGSCVT

SEQ ID NO: 12447 - protein, 10 aa, Dengue virus
VLEHGSCVTT

SEQ ID NO: 12448 - protein, 10 aa, Dengue virus
LEHGSCVTTM

SEQ ID NO: 12449 - protein, 10 aa, Dengue virus
EHGSCVTTMA

SEQ ID NO: 12450 - protein, 10 aa, Dengue virus
HGSCVTTMAK

SEQ ID NO: 12451 - protein, 10 aa, Dengue virus
GSCVTTMAKD

SEQ ID NO: 12452 - protein, 10 aa, Dengue virus
SCVTTMAKDK

SEQ ID NO: 12453 - protein, 10 aa, Dengue virus
CVTTMAKDKP

SEQ ID NO: 12454 - protein, 10 aa, Dengue virus
VTTMAKDKPT

SEQ ID NO: 12455 - protein, 10 aa, Dengue virus
TTMAKDKPTL

SEQ ID NO: 12456 - protein, 10 aa, Dengue virus
TMAKDKPTLD

SEQ ID NO: 12457 - protein, 10 aa, Dengue virus
MAKDKPTLDI

SEQ ID NO: 12458 - protein, 10 aa, Dengue virus
AKDKPTLDIE

SEQ ID NO: 12459 - protein, 10 aa, Dengue virus
KDKPTLDIEL

SEQ ID NO: 12460 - protein, 10 aa, Dengue virus
DKPTLDIELL

SEQ ID NO: 12461 - protein, 10 aa, Dengue virus
KPTLDIELLK

SEQ ID NO: 12462 - protein, 10 aa, Dengue virus
PTLDIELLKT

SEQ ID NO: 12463 - protein, 10 aa, Dengue virus
TLDIELLKTE

SEQ ID NO: 12464 - protein, 10 aa, Dengue virus
LDIELLKTEV

SEQ ID NO: 12465 - protein, 10 aa, Dengue virus
DIELLKTEVT

SEQ ID NO: 12466 - protein, 10 aa, Dengue virus
IELLKTEVTN

SEQ ID NO: 12467 - protein, 10 aa, Dengue virus
ELLKTEVTNP

SEQ ID NO: 12468 - protein, 10 aa, Dengue virus
LLKTEVTNPA

SEQ ID NO: 12469 - protein, 10 aa, Dengue virus
LKTEVTNPAV

SEQ ID NO: 12470 - protein, 10 aa, Dengue virus
KTEVTNPAVL

SEQ ID NO: 12471 - protein, 10 aa, Dengue virus
TEVTNPAVLR

SEQ ID NO: 12472 - protein, 10 aa, Dengue virus
EVTNPAVLRK

SEQ ID NO: 12473 - protein, 10 aa, Dengue virus
VTNPAVLRKL

SEQ ID NO: 12474 - protein, 10 aa, Dengue virus
TNPAVLRKLC

SEQ ID NO: 12475 - protein, 10 aa, Dengue virus
NPAVLRKLCI

SEQ ID NO: 12476 - protein, 10 aa, Dengue virus
PAVLRKLCIE

SEQ ID NO: 12477 - protein, 10 aa, Dengue virus
AVLRKLCIEA

SEQ ID NO: 12478 - protein, 10 aa, Dengue virus
VLRKLCIEAK

SEQ ID NO: 12479 - protein, 10 aa, Dengue virus
LRKLCIEAKI

SEQ ID NO: 12480 - protein, 10 aa, Dengue virus
RKLCIEAKIS

SEQ ID NO: 12481 - protein, 10 aa, Dengue virus
KLCIEAKISN

SEQ ID NO: 12482 - protein, 10 aa, Dengue virus
LCIEAKISNT

SEQ ID NO: 12483 - protein, 10 aa, Dengue virus
CIEAKISNTT

SEQ ID NO: 12484 - protein, 10 aa, Dengue virus
IEAKISNTTT

SEQ ID NO: 12485 - protein, 10 aa, Dengue virus
EAKISNTTTD

SEQ ID NO: 12486 - protein, 10 aa, Dengue virus
AKISNTTTDS

SEQ ID NO: 12487 - protein, 10 aa, Dengue virus
KISNTTTDSR

SEQ ID NO: 12488 - protein, 10 aa, Dengue virus
ISNTTTDSRC

SEQ ID NO: 12489 - protein, 10 aa, Dengue virus
SNTTTDSRCP

SEQ ID NO: 12490 - protein, 10 aa, Dengue virus
NTTTDSRCPT

SEQ ID NO: 12491 - protein, 10 aa, Dengue virus
TTTDSRCPTQ

SEQ ID NO: 12492 - protein, 10 aa, Dengue virus
TTDSRCPTQG

SEQ ID NO: 12493 - protein, 10 aa, Dengue virus
TDSRCPTQGE

SEQ ID NO: 12494 - protein, 10 aa, Dengue virus
DSRCPTQGEA

SEQ ID NO: 12495 - protein, 10 aa, Dengue virus
SRCPTQGEAT

SEQ ID NO: 12496 - protein, 10 aa, Dengue virus
RCPTQGEATL

SEQ ID NO: 12497 - protein, 10 aa, Dengue virus
CPTQGEATLV

SEQ ID NO: 12498 - protein, 10 aa, Dengue virus
PTQGEATLVE

SEQ ID NO: 12499 - protein, 10 aa, Dengue virus
TQGEATLVEE

SEQ ID NO: 12500 - protein, 10 aa, Dengue virus
QGEATLVEEQ

SEQ ID NO: 12501 - protein, 10 aa, Dengue virus
GEATLVEEQD

SEQ ID NO: 12502 - protein, 10 aa, Dengue virus
EATLVEEQDA

SEQ ID NO: 12503 - protein, 10 aa, Dengue virus
ATLVEEQDAN

SEQ ID NO: 12504 - protein, 10 aa, Dengue virus
TLVEEQDANF

SEQ ID NO: 12505 - protein, 10 aa, Dengue virus
LVEEQDANFV

SEQ ID NO: 12506 - protein, 10 aa, Dengue virus
VEEQDANFVC

SEQ ID NO: 12507 - protein, 10 aa, Dengue virus
EEQDANFVCR

SEQ ID NO: 12508 - protein, 10 aa, Dengue virus
EQDANFVCRR

SEQ ID NO: 12509 - protein, 10 aa, Dengue virus
QDANFVCRRT

SEQ ID NO: 12510 - protein, 10 aa, Dengue virus
DANFVCRRTF

SEQ ID NO: 12511 - protein, 10 aa, Dengue virus
ANFVCRRTFV

SEQ ID NO: 12512 - protein, 10 aa, Dengue virus
NFVCRRTFVD

SEQ ID NO: 12513 - protein, 10 aa, Dengue virus
FVCRRTFVDR

SEQ ID NO: 12514 - protein, 10 aa, Dengue virus
VCRRTFVDRG

SEQ ID NO: 12515 - protein, 10 aa, Dengue virus
CRRTFVDRGW

SEQ ID NO: 12516 - protein, 10 aa, Dengue virus
RRTFVDRGWG

SEQ ID NO: 12517 - protein, 10 aa, Dengue virus
RTFVDRGWGN

SEQ ID NO: 12518 - protein, 10 aa, Dengue virus
TFVDRGWGNG

SEQ ID NO: 12519 - protein, 10 aa, Dengue virus
FVDRGWGNGC

SEQ ID NO: 12520 - protein, 10 aa, Dengue virus
VDRGWGNGCG

SEQ ID NO: 12521 - protein, 10 aa, Dengue virus
DRGWGNGCGL

SEQ ID NO: 12522 - protein, 10 aa, Dengue virus
RGWGNGCGLF

SEQ ID NO: 12523 - protein, 10 aa, Dengue virus
GWGNGCGLFG

SEQ ID NO: 12524 - protein, 10 aa, Dengue virus
WGNGCGLFGK

SEQ ID NO: 12525 - protein, 10 aa, Dengue virus
GNGCGLFGKG

SEQ ID NO: 12526 - protein, 10 aa, Dengue virus
NGCGLFGKGS

SEQ ID NO: 12527 - protein, 10 aa, Dengue virus
GCGLFGKGSL

SEQ ID NO: 12528 - protein, 10 aa, Dengue virus
CGLFGKGSLI

SEQ ID NO: 12529 - protein, 10 aa, Dengue virus
GLFGKGSLIT

SEQ ID NO: 12530 - protein, 10 aa, Dengue virus
LFGKGSLITC

SEQ ID NO: 12531 - protein, 10 aa, Dengue virus
FGKGSLITCA

SEQ ID NO: 12532 - protein, 10 aa, Dengue virus
GKGSLITCAK

SEQ ID NO: 12533 - protein, 10 aa, Dengue virus
KGSLITCAKF

SEQ ID NO: 12534 - protein, 10 aa, Dengue virus
GSLITCAKFK

SEQ ID NO: 12535 - protein, 10 aa, Dengue virus
SLITCAKFKC

SEQ ID NO: 12536 - protein, 10 aa, Dengue virus
LITCAKFKCV

SEQ ID NO: 12537 - protein, 10 aa, Dengue virus
ITCAKFKCVT

SEQ ID NO: 12538 - protein, 10 aa, Dengue virus
TCAKFKCVTK

SEQ ID NO: 12539 - protein, 10 aa, Dengue virus
CAKFKCVTKL

SEQ ID NO: 12540 - protein, 10 aa, Dengue virus
AKFKCVTKLE

SEQ ID NO: 12541 - protein, 10 aa, Dengue virus
KFKCVTKLEG

SEQ ID NO: 12542 - protein, 10 aa, Dengue virus
FKCVTKLEGK

SEQ ID NO: 12543 - protein, 10 aa, Dengue virus
KCVTKLEGKI

SEQ ID NO: 12544 - protein, 10 aa, Dengue virus
CVTKLEGKIV

SEQ ID NO: 12545 - protein, 10 aa, Dengue virus
VTKLEGKIVQ

SEQ ID NO: 12546 - protein, 10 aa, Dengue virus
TKLEGKIVQY

SEQ ID NO: 12547 - protein, 10 aa, Dengue virus
KLEGKIVQYE

SEQ ID NO: 12548 - protein, 10 aa, Dengue virus
LEGKIVQYEN

SEQ ID NO: 12549 - protein, 10 aa, Dengue virus
EGKIVQYENL

SEQ ID NO: 12550 - protein, 10 aa, Dengue virus
GKIVQYENLK

SEQ ID NO: 12551 - protein, 10 aa, Dengue virus
KIVQYENLKY

SEQ ID NO: 12552 - protein, 10 aa, Dengue virus
IVQYENLKYS

SEQ ID NO: 12553 - protein, 10 aa, Dengue virus
VQYENLKYSV

SEQ ID NO: 12554 - protein, 10 aa, Dengue virus
QYENLKYSVI

SEQ ID NO: 12555 - protein, 10 aa, Dengue virus
YENLKYSVIV

SEQ ID NO: 12556 - protein, 10 aa, Dengue virus
ENLKYSVIVT

SEQ ID NO: 12557 - protein, 10 aa, Dengue virus
NLKYSVIVTV

SEQ ID NO: 12558 - protein, 10 aa, Dengue virus
LKYSVIVTVH

SEQ ID NO: 12559 - protein, 10 aa, Dengue virus
KYSVIVTVHT

SEQ ID NO: 12560 - protein, 10 aa, Dengue virus
YSVIVTVHTG

SEQ ID NO: 12561 - protein, 10 aa, Dengue virus
SVIVTVHTGD

SEQ ID NO: 12562 - protein, 10 aa, Dengue virus
VIVTVHTGDQ

SEQ ID NO: 12563 - protein, 10 aa, Dengue virus
IVTVHTGDQH

SEQ ID NO: 12564 - protein, 10 aa, Dengue virus
VTVHTGDQHQ

SEQ ID NO: 12565 - protein, 10 aa, Dengue virus
TVHTGDQHQV

SEQ ID NO: 12566 - protein, 10 aa, Dengue virus
VHTGDQHQVG

SEQ ID NO: 12567 - protein, 10 aa, Dengue virus
HTGDQHQVGN

SEQ ID NO: 12568 - protein, 10 aa, Dengue virus
TGDQHQVGNE

SEQ ID NO: 12569 - protein, 10 aa, Dengue virus
GDQHQVGNES

SEQ ID NO: 12570 - protein, 10 aa, Dengue virus
DQHQVGNEST

SEQ ID NO: 12571 - protein, 10 aa, Dengue virus
QHQVGNESTE

SEQ ID NO: 12572 - protein, 10 aa, Dengue virus
HQVGNESTEH

SEQ ID NO: 12573 - protein, 10 aa, Dengue virus
QVGNESTEHG

SEQ ID NO: 12574 - protein, 10 aa, Dengue virus
VGNESTEHGT

SEQ ID NO: 12575 - protein, 10 aa, Dengue virus
GNESTEHGTT

SEQ ID NO: 12576 - protein, 10 aa, Dengue virus
NESTEHGTTA

SEQ ID NO: 12577 - protein, 10 aa, Dengue virus
ESTEHGTTAT

SEQ ID NO: 12578 - protein, 10 aa, Dengue virus
STEHGTTATI

SEQ ID NO: 12579 - protein, 10 aa, Dengue virus
TEHGTTATIT

SEQ ID NO: 12580 - protein, 10 aa, Dengue virus
EHGTTATITP

SEQ ID NO: 12581 - protein, 10 aa, Dengue virus
HGTTATITPQ

SEQ ID NO: 12582 - protein, 10 aa, Dengue virus
GTTATITPQA

SEQ ID NO: 12583 - protein, 10 aa, Dengue virus
TTATITPQAP

SEQ ID NO: 12584 - protein, 10 aa, Dengue virus
TATITPQAPT

SEQ ID NO: 12585 - protein, 10 aa, Dengue virus
ATITPQAPTT

SEQ ID NO: 12586 - protein, 10 aa, Dengue virus
TITPQAPTTE

SEQ ID NO: 12587 - protein, 10 aa, Dengue virus
ITPQAPTTEI

SEQ ID NO: 12588 - protein, 10 aa, Dengue virus
TPQAPTTEIQ

SEQ ID NO: 12589 - protein, 10 aa, Dengue virus
PQAPTTEIQL

SEQ ID NO: 12590 - protein, 10 aa, Dengue virus
QAPTTEIQLT

SEQ ID NO: 12591 - protein, 10 aa, Dengue virus
APTTEIQLTD

SEQ ID NO: 12592 - protein, 10 aa, Dengue virus
PTTEIQLTDY

SEQ ID NO: 12593 - protein, 10 aa, Dengue virus
TTEIQLTDYG

SEQ ID NO: 12594 - protein, 10 aa, Dengue virus
TEIQLTDYGA

SEQ ID NO: 12595 - protein, 10 aa, Dengue virus
EIQLTDYGAL

SEQ ID NO: 12596 - protein, 10 aa, Dengue virus
IQLTDYGALT

SEQ ID NO: 12597 - protein, 10 aa, Dengue virus
QLTDYGALTL

SEQ ID NO: 12598 - protein, 10 aa, Dengue virus
LTDYGALTLD

SEQ ID NO: 12599 - protein, 10 aa, Dengue virus
TDYGALTLDC

SEQ ID NO: 12600 - protein, 10 aa, Dengue virus
DYGALTLDCS

SEQ ID NO: 12601 - protein, 10 aa, Dengue virus
YGALTLDCSP

SEQ ID NO: 12602 - protein, 10 aa, Dengue virus
GALTLDCSPR

SEQ ID NO: 12603 - protein, 10 aa, Dengue virus
ALTLDCSPRT

SEQ ID NO: 12604 - protein, 10 aa, Dengue virus
LTLDCSPRTG

SEQ ID NO: 12605 - protein, 10 aa, Dengue virus
TLDCSPRTGL

SEQ ID NO: 12606 - protein, 10 aa, Dengue virus
LDCSPRTGLD

SEQ ID NO: 12607 - protein, 10 aa, Dengue virus
DCSPRTGLDF

SEQ ID NO: 12608 - protein, 10 aa, Dengue virus
CSPRTGLDFN

SEQ ID NO: 12609 - protein, 10 aa, Dengue virus
SPRTGLDFNE

SEQ ID NO: 12610 - protein, 10 aa, Dengue virus
PRTGLDFNEM

SEQ ID NO: 12611 - protein, 10 aa, Dengue virus
RTGLDFNEMV

SEQ ID NO: 12612 - protein, 10 aa, Dengue virus
TGLDFNEMVL

SEQ ID NO: 12613 - protein, 10 aa, Dengue virus
GLDFNEMVLL

SEQ ID NO: 12614 - protein, 10 aa, Dengue virus
LDFNEMVLLT

SEQ ID NO: 12615 - protein, 10 aa, Dengue virus
DFNEMVLLTM

SEQ ID NO: 12616 - protein, 10 aa, Dengue virus
FNEMVLLTMK

SEQ ID NO: 12617 - protein, 10 aa, Dengue virus
NEMVLLTMKE

SEQ ID NO: 12618 - protein, 10 aa, Dengue virus
EMVLLTMKEK

SEQ ID NO: 12619 - protein, 10 aa, Dengue virus
MVLLTMKEKS

SEQ ID NO: 12620 - protein, 10 aa, Dengue virus
VLLTMKEKSW

SEQ ID NO: 12621 - protein, 10 aa, Dengue virus
LLTMKEKSWL

SEQ ID NO: 12622 - protein, 10 aa, Dengue virus
LTMKEKSWLV

SEQ ID NO: 12623 - protein, 10 aa, Dengue virus
TMKEKSWLVH

SEQ ID NO: 12624 - protein, 10 aa, Dengue virus
MKEKSWLVHK

SEQ ID NO: 12625 - protein, 10 aa, Dengue virus
KEKSWLVHKQ

SEQ ID NO: 12626 - protein, 10 aa, Dengue virus
EKSWLVHKQW

SEQ ID NO: 12627 - protein, 10 aa, Dengue virus
KSWLVHKQWF

SEQ ID NO: 12628 - protein, 10 aa, Dengue virus
SWLVHKQWFL

SEQ ID NO: 12629 - protein, 10 aa, Dengue virus
WLVHKQWFLD

SEQ ID NO: 12630 - protein, 10 aa, Dengue virus
LVHKQWFLDL

SEQ ID NO: 12631 - protein, 10 aa, Dengue virus
VHKQWFLDLP

SEQ ID NO: 12632 - protein, 10 aa, Dengue virus
HKQWFLDLPL

SEQ ID NO: 12633 - protein, 10 aa, Dengue virus
KQWFLDLPLP

SEQ ID NO: 12634 - protein, 10 aa, Dengue virus
QWFLDLPLPW

SEQ ID NO: 12635 - protein, 10 aa, Dengue virus
WFLDLPLPWT

SEQ ID NO: 12636 - protein, 10 aa, Dengue virus
FLDLPLPWTS

SEQ ID NO: 12637 - protein, 10 aa, Dengue virus
LDLPLPWTSG

SEQ ID NO: 12638 - protein, 10 aa, Dengue virus
DLPLPWTSGA

SEQ ID NO: 12639 - protein, 10 aa, Dengue virus
LPLPWTSGAS

SEQ ID NO: 12640 - protein, 10 aa, Dengue virus
PLPWTSGAST

SEQ ID NO: 12641 - protein, 10 aa, Dengue virus
TSQETWNRQD

SEQ ID NO: 12642 - protein, 10 aa, Dengue virus
SQETWNRQDL

SEQ ID NO: 12643 - protein, 10 aa, Dengue virus
QETWNRQDLL

SEQ ID NO: 12644 - protein, 10 aa, Dengue virus
ETWNRQDLLV

SEQ ID NO: 12645 - protein, 10 aa, Dengue virus
TWNRQDLLVT

SEQ ID NO: 12646 - protein, 10 aa, Dengue virus
WNRQDLLVTF

SEQ ID NO: 12647 - protein, 10 aa, Dengue virus
NRQDLLVTFK

SEQ ID NO: 12648 - protein, 10 aa, Dengue virus
RQDLLVTFKT

SEQ ID NO: 12649 - protein, 10 aa, Dengue virus
QDLLVTFKTA

SEQ ID NO: 12650 - protein, 10 aa, Dengue virus
DLLVTFKTAH

SEQ ID NO: 12651 - protein, 10 aa, Dengue virus
LLVTFKTAHA

SEQ ID NO: 12652 - protein, 10 aa, Dengue virus
LVTFKTAHAK

SEQ ID NO: 12653 - protein, 10 aa, Dengue virus
VTFKTAHAKK

SEQ ID NO: 12654 - protein, 10 aa, Dengue virus
TFKTAHAKKQ

SEQ ID NO: 12655 - protein, 10 aa, Dengue virus
FKTAHAKKQE

SEQ ID NO: 12656 - protein, 10 aa, Dengue virus
KTAHAKKQEV

SEQ ID NO: 12657 - protein, 10 aa, Dengue virus
TAHAKKQEVV

SEQ ID NO: 12658 - protein, 10 aa, Dengue virus
AHAKKQEVVV

SEQ ID NO: 12659 - protein, 10 aa, Dengue virus
HAKKQEVVVL

SEQ ID NO: 12660 - protein, 10 aa, Dengue virus
AKKQEVVVLG

SEQ ID NO: 12661 - protein, 10 aa, Dengue virus
KKQEVVVLGS

SEQ ID NO: 12662 - protein, 10 aa, Dengue virus
KQEVVVLGSQ

SEQ ID NO: 12663 - protein, 10 aa, Dengue virus
QEVVVLGSQE

SEQ ID NO: 12664 - protein, 10 aa, Dengue virus
EVVVLGSQEG

SEQ ID NO: 12665 - protein, 10 aa, Dengue virus
VVVLGSQEGA

SEQ ID NO: 12666 - protein, 10 aa, Dengue virus
VVLGSQEGAM

SEQ ID NO: 12667 - protein, 10 aa, Dengue virus
VLGSQEGAMH

SEQ ID NO: 12668 - protein, 10 aa, Dengue virus
LGSQEGAMHT

SEQ ID NO: 12669 - protein, 10 aa, Dengue virus
GSQEGAMHTA

SEQ ID NO: 12670 - protein, 10 aa, Dengue virus
SQEGAMHTAL

SEQ ID NO: 12671 - protein, 10 aa, Dengue virus
QEGAMHTALT

SEQ ID NO: 12672 - protein, 10 aa, Dengue virus
EGAMHTALTG

SEQ ID NO: 12673 - protein, 10 aa, Dengue virus
GAMHTALTGA

SEQ ID NO: 12674 - protein, 10 aa, Dengue virus
AMHTALTGAT

SEQ ID NO: 12675 - protein, 10 aa, Dengue virus
MHTALTGATE

SEQ ID NO: 12676 - protein, 10 aa, Dengue virus
HTALTGATEI

SEQ ID NO: 12677 - protein, 10 aa, Dengue virus
TALTGATEIQ

SEQ ID NO: 12678 - protein, 10 aa, Dengue virus
ALTGATEIQT

SEQ ID NO: 12679 - protein, 10 aa, Dengue virus
LTGATEIQTS

SEQ ID NO: 12680 - protein, 10 aa, Dengue virus
TGATEIQTSG

SEQ ID NO: 12681 - protein, 10 aa, Dengue virus
GATEIQTSGT

SEQ ID NO: 12682 - protein, 10 aa, Dengue virus
ATEIQTSGTT

SEQ ID NO: 12683 - protein, 10 aa, Dengue virus
TEIQTSGTTT

SEQ ID NO: 12684 - protein, 10 aa, Dengue virus
EIQTSGTTTI

SEQ ID NO: 12685 - protein, 10 aa, Dengue virus
IQTSGTTTIF

SEQ ID NO: 12686 - protein, 10 aa, Dengue virus
QTSGTTTIFA

SEQ ID NO: 12687 - protein, 10 aa, Dengue virus
TSGTTTIFAG

SEQ ID NO: 12688 - protein, 10 aa, Dengue virus
SGTTTIFAGH

SEQ ID NO: 12689 - protein, 10 aa, Dengue virus
GTTTIFAGHL

SEQ ID NO: 12690 - protein, 10 aa, Dengue virus
TTTIFAGHLK

SEQ ID NO: 12691 - protein, 10 aa, Dengue virus
TTIFAGHLKC

SEQ ID NO: 12692 - protein, 10 aa, Dengue virus
TIFAGHLKCR

SEQ ID NO: 12693 - protein, 10 aa, Dengue virus
IFAGHLKCRL

SEQ ID NO: 12694 - protein, 10 aa, Dengue virus
FAGHLKCRLK

SEQ ID NO: 12695 - protein, 10 aa, Dengue virus
AGHLKCRLKM

SEQ ID NO: 12696 - protein, 10 aa, Dengue virus
GHLKCRLKMD

SEQ ID NO: 12697 - protein, 10 aa, Dengue virus
HLKCRLKMDK

SEQ ID NO: 12698 - protein, 10 aa, Dengue virus
LKCRLKMDKL

SEQ ID NO: 12699 - protein, 10 aa, Dengue virus
KCRLKMDKLT

SEQ ID NO: 12700 - protein, 10 aa, Dengue virus
CRLKMDKLTL

SEQ ID NO: 12701 - protein, 10 aa, Dengue virus
RLKMDKLTLK

SEQ ID NO: 12702 - protein, 10 aa, Dengue virus
LKMDKLTLKG

SEQ ID NO: 12703 - protein, 10 aa, Dengue virus
KMDKLTLKGM

SEQ ID NO: 12704 - protein, 10 aa, Dengue virus
MDKLTLKGMS

SEQ ID NO: 12705 - protein, 10 aa, Dengue virus
DKLTLKGMSY

SEQ ID NO: 12706 - protein, 10 aa, Dengue virus
KLTLKGMSYV

SEQ ID NO: 12707 - protein, 10 aa, Dengue virus
LTLKGMSYVM

SEQ ID NO: 12708 - protein, 10 aa, Dengue virus
TLKGMSYVMC

SEQ ID NO: 12709 - protein, 10 aa, Dengue virus
LKGMSYVMCT

SEQ ID NO: 12710 - protein, 10 aa, Dengue virus
KGMSYVMCTG

SEQ ID NO: 12711 - protein, 10 aa, Dengue virus
SYVMCTGSFK

SEQ ID NO: 12712 - protein, 10 aa, Dengue virus
YVMCTGSFKL

SEQ ID NO: 12713 - protein, 10 aa, Dengue virus
VMCTGSFKLE

SEQ ID NO: 12714 - protein, 10 aa, Dengue virus
MCTGSFKLEK

SEQ ID NO: 12715 - protein, 10 aa, Dengue virus
CTGSFKLEKE

SEQ ID NO: 12716 - protein, 10 aa, Dengue virus
TGSFKLEKEV

SEQ ID NO: 12717 - protein, 10 aa, Dengue virus
GSFKLEKEVA

SEQ ID NO: 12718 - protein, 10 aa, Dengue virus
SFKLEKEVAE

SEQ ID NO: 12719 - protein, 10 aa, Dengue virus
FKLEKEVAET

SEQ ID NO: 12720 - protein, 10 aa, Dengue virus
KLEKEVAETQ

SEQ ID NO: 12721 - protein, 10 aa, Dengue virus
LEKEVAETQH

SEQ ID NO: 12722 - protein, 10 aa, Dengue virus
EKEVAETQHG

SEQ ID NO: 12723 - protein, 10 aa, Dengue virus
KEVAETQHGT

SEQ ID NO: 12724 - protein, 10 aa, Dengue virus
EVAETQHGTV

SEQ ID NO: 12725 - protein, 10 aa, Dengue virus
VAETQHGTVL

SEQ ID NO: 12726 - protein, 10 aa, Dengue virus
AETQHGTVLV

SEQ ID NO: 12727 - protein, 10 aa, Dengue virus
ETQHGTVLVQ

SEQ ID NO: 12728 - protein, 10 aa, Dengue virus
TQHGTVLVQI

SEQ ID NO: 12729 - protein, 10 aa, Dengue virus
QHGTVLVQIK

SEQ ID NO: 12730 - protein, 10 aa, Dengue virus
HGTVLVQIKY

SEQ ID NO: 12731 - protein, 10 aa, Dengue virus
GTVLVQIKYE

SEQ ID NO: 12732 - protein, 10 aa, Dengue virus
TVLVQIKYEG

SEQ ID NO: 12733 - protein, 10 aa, Dengue virus
VLVQIKYEGT

SEQ ID NO: 12734 - protein, 10 aa, Dengue virus
LVQIKYEGTD

SEQ ID NO: 12735 - protein, 10 aa, Dengue virus
VQIKYEGTDA

SEQ ID NO: 12736 - protein, 10 aa, Dengue virus
QIKYEGTDAP

SEQ ID NO: 12737 - protein, 10 aa, Dengue virus
IKYEGTDAPC

SEQ ID NO: 12738 - protein, 10 aa, Dengue virus
KYEGTDAPCK

SEQ ID NO: 12739 - protein, 10 aa, Dengue virus
YEGTDAPCKI

SEQ ID NO: 12740 - protein, 10 aa, Dengue virus
EGTDAPCKIP

SEQ ID NO: 12741 - protein, 10 aa, Dengue virus
GTDAPCKIPF

SEQ ID NO: 12742 - protein, 10 aa, Dengue virus
TDAPCKIPFS

SEQ ID NO: 12743 - protein, 10 aa, Dengue virus
DAPCKIPFST

SEQ ID NO: 12744 - protein, 10 aa, Dengue virus
APCKIPFSTQ

SEQ ID NO: 12745 - protein, 10 aa, Dengue virus
PCKIPFSTQD

SEQ ID NO: 12746 - protein, 10 aa, Dengue virus
CKIPFSTQDE

SEQ ID NO: 12747 - protein, 10 aa, Dengue virus
QDEKGVTQNG

SEQ ID NO: 12748 - protein, 10 aa, Dengue virus
DEKGVTQNGR

SEQ ID NO: 12749 - protein, 10 aa, Dengue virus
GVTQNGRLIT

SEQ ID NO: 12750 - protein, 10 aa, Dengue virus
VTQNGRLITA

SEQ ID NO: 12751 - protein, 10 aa, Dengue virus
TQNGRLITAN

SEQ ID NO: 12752 - protein, 10 aa, Dengue virus
QNGRLITANP

SEQ ID NO: 12753 - protein, 10 aa, Dengue virus
NGRLITANPI

SEQ ID NO: 12754 - protein, 10 aa, Dengue virus
GRLITANPIV

SEQ ID NO: 12755 - protein, 10 aa, Dengue virus
RLITANPIVT

SEQ ID NO: 12756 - protein, 10 aa, Dengue virus
LITANPIVTD

SEQ ID NO: 12757 - protein, 10 aa, Dengue virus
ITANPIVTDK

SEQ ID NO: 12758 - protein, 10 aa, Dengue virus
TANPIVTDKE

SEQ ID NO: 12759 - protein, 10 aa, Dengue virus
ANPIVTDKEK

SEQ ID NO: 12760 - protein, 10 aa, Dengue virus
NPIVTDKEKP

SEQ ID NO: 12761 - protein, 10 aa, Dengue virus
PIVTDKEKPV

SEQ ID NO: 12762 - protein, 10 aa, Dengue virus
IVTDKEKPVN

SEQ ID NO: 12763 - protein, 10 aa, Dengue virus
VTDKEKPVNI

SEQ ID NO: 12764 - protein, 10 aa, Dengue virus
TDKEKPVNIE

SEQ ID NO: 12765 - protein, 10 aa, Dengue virus
DKEKPVNIEA

SEQ ID NO: 12766 - protein, 10 aa, Dengue virus
KEKPVNIEAE

SEQ ID NO: 12767 - protein, 10 aa, Dengue virus
EKPVNIEAEP

SEQ ID NO: 12768 - protein, 10 aa, Dengue virus
KPVNIEAEPP

SEQ ID NO: 12769 - protein, 10 aa, Dengue virus
PVNIEAEPPF

SEQ ID NO: 12770 - protein, 10 aa, Dengue virus
VNIEAEPPFG

SEQ ID NO: 12771 - protein, 10 aa, Dengue virus
NIEAEPPFGE

SEQ ID NO: 12772 - protein, 10 aa, Dengue virus
IEAEPPFGES

SEQ ID NO: 12773 - protein, 10 aa, Dengue virus
EAEPPFGESY

SEQ ID NO: 12774 - protein, 10 aa, Dengue virus
AEPPFGESYI

SEQ ID NO: 12775 - protein, 10 aa, Dengue virus
EPPFGESYIV

SEQ ID NO: 12776 - protein, 10 aa, Dengue virus
PPFGESYIVI

SEQ ID NO: 12777 - protein, 10 aa, Dengue virus
PFGESYIVIG

SEQ ID NO: 12778 - protein, 10 aa, Dengue virus
IGAGEKALKL

SEQ ID NO: 12779 - protein, 10 aa, Dengue virus
GAGEKALKLS

SEQ ID NO: 12780 - protein, 10 aa, Dengue virus
AGEKALKLSW

SEQ ID NO: 12781 - protein, 10 aa, Dengue virus
GEKALKLSWF

SEQ ID NO: 12782 - protein, 10 aa, Dengue virus
EKALKLSWFK

SEQ ID NO: 12783 - protein, 10 aa, Dengue virus
KALKLSWFKK

SEQ ID NO: 12784 - protein, 10 aa, Dengue virus
ALKLSWFKKG

SEQ ID NO: 12785 - protein, 10 aa, Dengue virus
LKLSWFKKGS

SEQ ID NO: 12786 - protein, 10 aa, Dengue virus
KLSWFKKGSS

SEQ ID NO: 12787 - protein, 10 aa, Dengue virus
LSWFKKGSSI

SEQ ID NO: 12788 - protein, 10 aa, Dengue virus
SWFKKGSSIG

SEQ ID NO: 12789 - protein, 10 aa, Dengue virus
WFKKGSSIGK

SEQ ID NO: 12790 - protein, 10 aa, Dengue virus
FKKGSSIGKM

SEQ ID NO: 12791 - protein, 10 aa, Dengue virus
KKGSSIGKMF

SEQ ID NO: 12792 - protein, 10 aa, Dengue virus
KGSSIGKMFE

SEQ ID NO: 12793 - protein, 10 aa, Dengue virus
GSSIGKMFEA

SEQ ID NO: 12794 - protein, 10 aa, Dengue virus
SSIGKMFEAT

SEQ ID NO: 12795 - protein, 10 aa, Dengue virus
SIGKMFEATA

SEQ ID NO: 12796 - protein, 10 aa, Dengue virus
IGKMFEATAR

SEQ ID NO: 12797 - protein, 10 aa, Dengue virus
GKMFEATARG

SEQ ID NO: 12798 - protein, 10 aa, Dengue virus
KMFEATARGA

SEQ ID NO: 12799 - protein, 10 aa, Dengue virus
MFEATARGAR

SEQ ID NO: 12800 - protein, 10 aa, Dengue virus
FEATARGARR

SEQ ID NO: 12801 - protein, 10 aa, Dengue virus
EATARGARRM

SEQ ID NO: 12802 - protein, 10 aa, Dengue virus
ATARGARRMA

SEQ ID NO: 12803 - protein, 10 aa, Dengue virus
TARGARRMAI

SEQ ID NO: 12804 - protein, 10 aa, Dengue virus
ARGARRMAIL

SEQ ID NO: 12805 - protein, 10 aa, Dengue virus
RGARRMAILG

SEQ ID NO: 12806 - protein, 10 aa, Dengue virus
GARRMAILGD

SEQ ID NO: 12807 - protein, 10 aa, Dengue virus
ARRMAILGDT

SEQ ID NO: 12808 - protein, 10 aa, Dengue virus
RRMAILGDTA

SEQ ID NO: 12809 - protein, 10 aa, Dengue virus
RMAILGDTAW

SEQ ID NO: 12810 - protein, 10 aa, Dengue virus
MAILGDTAWD

SEQ ID NO: 12811 - protein, 10 aa, Dengue virus
AILGDTAWDF

SEQ ID NO: 12812 - protein, 10 aa, Dengue virus
ILGDTAWDFG

SEQ ID NO: 12813 - protein, 10 aa, Dengue virus
LGDTAWDFGS

SEQ ID NO: 12814 - protein, 10 aa, Dengue virus
GDTAWDFGSI

SEQ ID NO: 12815 - protein, 10 aa, Dengue virus
DTAWDFGSIG

SEQ ID NO: 12816 - protein, 10 aa, Dengue virus
TAWDFGSIGG

SEQ ID NO: 12817 - protein, 10 aa, Dengue virus
AWDFGSIGGV

SEQ ID NO: 12818 - protein, 10 aa, Dengue virus
WDFGSIGGVF

SEQ ID NO: 12819 - protein, 10 aa, Dengue virus
DFGSIGGVFT

SEQ ID NO: 12820 - protein, 10 aa, Dengue virus
FGSIGGVFTS

SEQ ID NO: 12821 - protein, 10 aa, Dengue virus
GGVFTSVGKL

SEQ ID NO: 12822 - protein, 10 aa, Dengue virus
FTSVGKLVHQ

SEQ ID NO: 12823 - protein, 10 aa, Dengue virus
GKLVHQIFGT

SEQ ID NO: 12824 - protein, 10 aa, Dengue virus
KLVHQIFGTA

SEQ ID NO: 12825 - protein, 10 aa, Dengue virus
LVHQIFGTAY

SEQ ID NO: 12826 - protein, 10 aa, Dengue virus
VHQIFGTAYG

SEQ ID NO: 12827 - protein, 10 aa, Dengue virus
HQIFGTAYGV

SEQ ID NO: 12828 - protein, 10 aa, Dengue virus
QIFGTAYGVL

SEQ ID NO: 12829 - protein, 10 aa, Dengue virus
IFGTAYGVLF

SEQ ID NO: 12830 - protein, 10 aa, Dengue virus
FGTAYGVLFS

SEQ ID NO: 12831 - protein, 10 aa, Dengue virus
GTAYGVLFSG

SEQ ID NO: 12832 - protein, 10 aa, Dengue virus
TAYGVLFSGV

SEQ ID NO: 12833 - protein, 10 aa, Dengue virus
AYGVLFSGVS

SEQ ID NO: 12834 - protein, 10 aa, Dengue virus
YGVLFSGVSW

SEQ ID NO: 12835 - protein, 10 aa, Dengue virus
GVLFSGVSWT

SEQ ID NO: 12836 - protein, 10 aa, Dengue virus
VLFSGVSWTM

SEQ ID NO: 12837 - protein, 10 aa, Dengue virus
LFSGVSWTMK

SEQ ID NO: 12838 - protein, 10 aa, Dengue virus
FSGVSWTMKI

SEQ ID NO: 12839 - protein, 10 aa, Dengue virus
SGVSWTMKIG

SEQ ID NO: 12840 - protein, 10 aa, Dengue virus
GVSWTMKIGI

SEQ ID NO: 12841 - protein, 10 aa, Dengue virus
VSWTMKIGIG

SEQ ID NO: 12842 - protein, 10 aa, Dengue virus
SWTMKIGIGV

SEQ ID NO: 12843 - protein, 10 aa, Dengue virus
WTMKIGIGVL

SEQ ID NO: 12844 - protein, 10 aa, Dengue virus
TMKIGIGVLL

SEQ ID NO: 12845 - protein, 10 aa, Dengue virus
MKIGIGVLLT

SEQ ID NO: 12846 - protein, 10 aa, Dengue virus
KIGIGVLLTW

SEQ ID NO: 12847 - protein, 10 aa, Dengue virus
IGIGVLLTWL

SEQ ID NO: 12848 - protein, 10 aa, Dengue virus
GIGVLLTWLG

SEQ ID NO: 12849 - protein, 10 aa, Dengue virus
IGVLLTWLGL

SEQ ID NO: 12850 - protein, 10 aa, Dengue virus
GVLLTWLGLN

SEQ ID NO: 12851 - protein, 10 aa, Dengue virus
VLLTWLGLNS

SEQ ID NO: 12852 - protein, 10 aa, Dengue virus
LLTWLGLNSR

SEQ ID NO: 12853 - protein, 10 aa, Dengue virus
LTWLGLNSRS

SEQ ID NO: 12854 - protein, 10 aa, Dengue virus
TWLGLNSRST

SEQ ID NO: 12855 - protein, 10 aa, Dengue virus
WLGLNSRSTS

SEQ ID NO: 12856 - protein, 10 aa, Dengue virus
LGLNSRSTSL

SEQ ID NO: 12857 - protein, 10 aa, Dengue virus
GLNSRSTSLS

SEQ ID NO: 12858 - protein, 10 aa, Dengue virus
LNSRSTSLSM

SEQ ID NO: 12859 - protein, 10 aa, Dengue virus
NSRSTSLSMT

SEQ ID NO: 12860 - protein, 10 aa, Dengue virus
SRSTSLSMTC

SEQ ID NO: 12861 - protein, 10 aa, Dengue virus
RSTSLSMTCI

SEQ ID NO: 12862 - protein, 10 aa, Dengue virus
STSLSMTCIA

SEQ ID NO: 12863 - protein, 10 aa, Dengue virus
TSLSMTCIAV

SEQ ID NO: 12864 - protein, 10 aa, Dengue virus
SLSMTCIAVG

SEQ ID NO: 12865 - protein, 10 aa, Dengue virus
LSMTCIAVGL

SEQ ID NO: 12866 - protein, 10 aa, Dengue virus
SMTCIAVGLV

SEQ ID NO: 12867 - protein, 10 aa, Dengue virus
MTCIAVGLVT

SEQ ID NO: 12868 - protein, 10 aa, Dengue virus
TCIAVGLVTL

SEQ ID NO: 12869 - protein, 10 aa, Dengue virus
CIAVGLVTLY

SEQ ID NO: 12870 - protein, 10 aa, Dengue virus
IAVGLVTLYL

SEQ ID NO: 12871 - protein, 10 aa, Dengue virus
AVGLVTLYLG

SEQ ID NO: 12872 - protein, 10 aa, Dengue virus
VGLVTLYLGV

SEQ ID NO: 12873 - protein, 10 aa, Dengue virus
GLVTLYLGVM

SEQ ID NO: 12874 - protein, 10 aa, Dengue virus
LVTLYLGVMV

SEQ ID NO: 12875 - protein, 10 aa, Dengue virus
VTLYLGVMVQ

SEQ ID NO: 12876 - protein, 10 aa, Dengue virus
TLYLGVMVQA

SEQ ID NO: 12877 - protein, 10 aa, Dengue virus
LYLGVMVQAD

SEQ ID NO: 12878 - protein, 10 aa, Dengue virus
YLGVMVQADS

SEQ ID NO: 12879 - protein, 10 aa, Dengue virus
LGVMVQADSG

SEQ ID NO: 12880 - protein, 10 aa, Dengue virus
GVMVQADSGC

SEQ ID NO: 12881 - protein, 10 aa, Dengue virus
VMVQADSGCV

SEQ ID NO: 12882 - protein, 10 aa, Dengue virus
MVQADSGCVI

SEQ ID NO: 12883 - protein, 10 aa, Dengue virus
VQADSGCVIN

SEQ ID NO: 12884 - protein, 10 aa, Dengue virus
QADSGCVINW

SEQ ID NO: 12885 - protein, 10 aa, Dengue virus
ADSGCVINWK

SEQ ID NO: 12886 - protein, 10 aa, Dengue virus
DSGCVINWKG

SEQ ID NO: 12887 - protein, 10 aa, Dengue virus
SGCVINWKGR

SEQ ID NO: 12888 - protein, 10 aa, Dengue virus
GCVINWKGRE

SEQ ID NO: 12889 - protein, 10 aa, Dengue virus
CVINWKGREL

SEQ ID NO: 12890 - protein, 10 aa, Dengue virus
VINWKGRELK

SEQ ID NO: 12891 - protein, 10 aa, Dengue virus
INWKGRELKC

SEQ ID NO: 12892 - protein, 10 aa, Dengue virus
NWKGRELKCG

SEQ ID NO: 12893 - protein, 10 aa, Dengue virus
WKGRELKCGS

SEQ ID NO: 12894 - protein, 10 aa, Dengue virus
KGRELKCGSG

SEQ ID NO: 12895 - protein, 10 aa, Dengue virus
GRELKCGSGI

SEQ ID NO: 12896 - protein, 10 aa, Dengue virus
RELKCGSGIF

SEQ ID NO: 12897 - protein, 10 aa, Dengue virus
ELKCGSGIFV

SEQ ID NO: 12898 - protein, 10 aa, Dengue virus
LKCGSGIFVT

SEQ ID NO: 12899 - protein, 10 aa, Dengue virus
KCGSGIFVTN

SEQ ID NO: 12900 - protein, 10 aa, Dengue virus
CGSGIFVTNE

SEQ ID NO: 12901 - protein, 10 aa, Dengue virus
GSGIFVTNEV

SEQ ID NO: 12902 - protein, 10 aa, Dengue virus
SGIFVTNEVH

SEQ ID NO: 12903 - protein, 10 aa, Dengue virus
GIFVTNEVHT

SEQ ID NO: 12904 - protein, 10 aa, Dengue virus
IFVTNEVHTW

SEQ ID NO: 12905 - protein, 10 aa, Dengue virus
FVTNEVHTWT

SEQ ID NO: 12906 - protein, 10 aa, Dengue virus
VTNEVHTWTE

SEQ ID NO: 12907 - protein, 10 aa, Dengue virus
TNEVHTWTEQ

SEQ ID NO: 12908 - protein, 10 aa, Dengue virus
NEVHTWTEQY

SEQ ID NO: 12909 - protein, 10 aa, Dengue virus
EVHTWTEQYK

SEQ ID NO: 12910 - protein, 10 aa, Dengue virus
VHTWTEQYKF

SEQ ID NO: 12911 - protein, 10 aa, Dengue virus
HTWTEQYKFQ

SEQ ID NO: 12912 - protein, 10 aa, Dengue virus
TWTEQYKFQA

SEQ ID NO: 12913 - protein, 10 aa, Dengue virus
WTEQYKFQAD

SEQ ID NO: 12914 - protein, 10 aa, Dengue virus
TEQYKFQADS

SEQ ID NO: 12915 - protein, 10 aa, Dengue virus
EQYKFQADSP

SEQ ID NO: 12916 - protein, 10 aa, Dengue virus
QYKFQADSPK

SEQ ID NO: 12917 - protein, 10 aa, Dengue virus
YKFQADSPKR

SEQ ID NO: 12918 - protein, 10 aa, Dengue virus
KFQADSPKRL

SEQ ID NO: 12919 - protein, 10 aa, Dengue virus
FQADSPKRLS

SEQ ID NO: 12920 - protein, 10 aa, Dengue virus
QADSPKRLSA

SEQ ID NO: 12921 - protein, 10 aa, Dengue virus
ADSPKRLSAA

SEQ ID NO: 12922 - protein, 10 aa, Dengue virus
DSPKRLSAAI

SEQ ID NO: 12923 - protein, 10 aa, Dengue virus
SPKRLSAAIG

SEQ ID NO: 12924 - protein, 10 aa, Dengue virus
PKRLSAAIGK

SEQ ID NO: 12925 - protein, 10 aa, Dengue virus
KRLSAAIGKA

SEQ ID NO: 12926 - protein, 10 aa, Dengue virus
RLSAAIGKAW

SEQ ID NO: 12927 - protein, 10 aa, Dengue virus
LSAAIGKAWE

SEQ ID NO: 12928 - protein, 10 aa, Dengue virus
SAAIGKAWEE

SEQ ID NO: 12929 - protein, 10 aa, Dengue virus
AAIGKAWEEG

SEQ ID NO: 12930 - protein, 10 aa, Dengue virus
AIGKAWEEGV

SEQ ID NO: 12931 - protein, 10 aa, Dengue virus
IGKAWEEGVC

SEQ ID NO: 12932 - protein, 10 aa, Dengue virus
GKAWEEGVCG

SEQ ID NO: 12933 - protein, 10 aa, Dengue virus
KAWEEGVCGI

SEQ ID NO: 12934 - protein, 10 aa, Dengue virus
AWEEGVCGIR

SEQ ID NO: 12935 - protein, 10 aa, Dengue virus
WEEGVCGIRS

SEQ ID NO: 12936 - protein, 10 aa, Dengue virus
EEGVCGIRSA

SEQ ID NO: 12937 - protein, 10 aa, Dengue virus
EGVCGIRSAT

SEQ ID NO: 12938 - protein, 10 aa, Dengue virus
GVCGIRSATR

SEQ ID NO: 12939 - protein, 10 aa, Dengue virus
VCGIRSATRL

SEQ ID NO: 12940 - protein, 10 aa, Dengue virus
CGIRSATRLE

SEQ ID NO: 12941 - protein, 10 aa, Dengue virus
GIRSATRLEN

SEQ ID NO: 12942 - protein, 10 aa, Dengue virus
IRSATRLENI

SEQ ID NO: 12943 - protein, 10 aa, Dengue virus
RSATRLENIM

SEQ ID NO: 12944 - protein, 10 aa, Dengue virus
SATRLENIMW

SEQ ID NO: 12945 - protein, 10 aa, Dengue virus
ATRLENIMWK

SEQ ID NO: 12946 - protein, 10 aa, Dengue virus
TRLENIMWKQ

SEQ ID NO: 12947 - protein, 10 aa, Dengue virus
RLENIMWKQI

SEQ ID NO: 12948 - protein, 10 aa, Dengue virus
LENIMWKQIS

SEQ ID NO: 12949 - protein, 10 aa, Dengue virus
ENIMWKQISN

SEQ ID NO: 12950 - protein, 10 aa, Dengue virus
NIMWKQISNE

SEQ ID NO: 12951 - protein, 10 aa, Dengue virus
IMWKQISNEL

SEQ ID NO: 12952 - protein, 10 aa, Dengue virus
MWKQISNELN

SEQ ID NO: 12953 - protein, 10 aa, Dengue virus
WKQISNELNH

SEQ ID NO: 12954 - protein, 10 aa, Dengue virus
KQISNELNHI

SEQ ID NO: 12955 - protein, 10 aa, Dengue virus
QISNELNHIL

SEQ ID NO: 12956 - protein, 10 aa, Dengue virus
ISNELNHILL

SEQ ID NO: 12957 - protein, 10 aa, Dengue virus
SNELNHILLE

SEQ ID NO: 12958 - protein, 10 aa, Dengue virus
NELNHILLEN

SEQ ID NO: 12959 - protein, 10 aa, Dengue virus
ELNHILLEND

SEQ ID NO: 12960 - protein, 10 aa, Dengue virus
LNHILLENDM

SEQ ID NO: 12961 - protein, 10 aa, Dengue virus
NHILLENDMK

SEQ ID NO: 12962 - protein, 10 aa, Dengue virus
HILLENDMKF

SEQ ID NO: 12963 - protein, 10 aa, Dengue virus
ILLENDMKFT

SEQ ID NO: 12964 - protein, 10 aa, Dengue virus
LLENDMKFTV

SEQ ID NO: 12965 - protein, 10 aa, Dengue virus
LENDMKFTVV

SEQ ID NO: 12966 - protein, 10 aa, Dengue virus
ENDMKFTVVV

SEQ ID NO: 12967 - protein, 10 aa, Dengue virus
NDMKFTVVVG

SEQ ID NO: 12968 - protein, 10 aa, Dengue virus
DMKFTVVVGD

SEQ ID NO: 12969 - protein, 10 aa, Dengue virus
MKFTVVVGDV

SEQ ID NO: 12970 - protein, 10 aa, Dengue virus
QGKKMIRPQP

SEQ ID NO: 12971 - protein, 10 aa, Dengue virus
GKKMIRPQPM

SEQ ID NO: 12972 - protein, 10 aa, Dengue virus
KKMIRPQPME

SEQ ID NO: 12973 - protein, 10 aa, Dengue virus
KMIRPQPMEY

SEQ ID NO: 12974 - protein, 10 aa, Dengue virus
MIRPQPMEYK

SEQ ID NO: 12975 - protein, 10 aa, Dengue virus
IRPQPMEYKY

SEQ ID NO: 12976 - protein, 10 aa, Dengue virus
RPQPMEYKYS

SEQ ID NO: 12977 - protein, 10 aa, Dengue virus
PQPMEYKYSW

SEQ ID NO: 12978 - protein, 10 aa, Dengue virus
QPMEYKYSWK

SEQ ID NO: 12979 - protein, 10 aa, Dengue virus
PMEYKYSWKS

SEQ ID NO: 12980 - protein, 10 aa, Dengue virus
MEYKYSWKSW

SEQ ID NO: 12981 - protein, 10 aa, Dengue virus
EYKYSWKSWG

SEQ ID NO: 12982 - protein, 10 aa, Dengue virus
YKYSWKSWGK

SEQ ID NO: 12983 - protein, 10 aa, Dengue virus
KYSWKSWGKA

SEQ ID NO: 12984 - protein, 10 aa, Dengue virus
YSWKSWGKAK

SEQ ID NO: 12985 - protein, 10 aa, Dengue virus
SWKSWGKAKI

SEQ ID NO: 12986 - protein, 10 aa, Dengue virus
WKSWGKAKII

SEQ ID NO: 12987 - protein, 10 aa, Dengue virus
KSWGKAKIIG

SEQ ID NO: 12988 - protein, 10 aa, Dengue virus
SWGKAKIIGA

SEQ ID NO: 12989 - protein, 10 aa, Dengue virus
WGKAKIIGAD

SEQ ID NO: 12990 - protein, 10 aa, Dengue virus
GKAKIIGADV

SEQ ID NO: 12991 - protein, 10 aa, Dengue virus
KAKIIGADVQ

SEQ ID NO: 12992 - protein, 10 aa, Dengue virus
AKIIGADVQN

SEQ ID NO: 12993 - protein, 10 aa, Dengue virus
QNTTFIIDGP

SEQ ID NO: 12994 - protein, 10 aa, Dengue virus
TFIIDGPNTP

SEQ ID NO: 12995 - protein, 10 aa, Dengue virus
FIIDGPNTPE

SEQ ID NO: 12996 - protein, 10 aa, Dengue virus
IIDGPNTPEC

SEQ ID NO: 12997 - protein, 10 aa, Dengue virus
IDGPNTPECP

SEQ ID NO: 12998 - protein, 10 aa, Dengue virus
DGPNTPECPD

SEQ ID NO: 12999 - protein, 10 aa, Dengue virus
ECPDDQRAWN

SEQ ID NO: 13000 - protein, 10 aa, Dengue virus
CPDDQRAWNI

SEQ ID NO: 13001 - protein, 10 aa, Dengue virus
PDDQRAWNIW

SEQ ID NO: 13002 - protein, 10 aa, Dengue virus
DDQRAWNIWE

SEQ ID NO: 13003 - protein, 10 aa, Dengue virus
DQRAWNIWEV

SEQ ID NO: 13004 - protein, 10 aa, Dengue virus
QRAWNIWEVE

SEQ ID NO: 13005 - protein, 10 aa, Dengue virus
RAWNIWEVED

SEQ ID NO: 13006 - protein, 10 aa, Dengue virus
AWNIWEVEDY

SEQ ID NO: 13007 - protein, 10 aa, Dengue virus
WNIWEVEDYG

SEQ ID NO: 13008 - protein, 10 aa, Dengue virus
NIWEVEDYGF

SEQ ID NO: 13009 - protein, 10 aa, Dengue virus
IWEVEDYGFG

SEQ ID NO: 13010 - protein, 10 aa, Dengue virus
WEVEDYGFGI

SEQ ID NO: 13011 - protein, 10 aa, Dengue virus
EVEDYGFGIF

SEQ ID NO: 13012 - protein, 10 aa, Dengue virus
VEDYGFGIFT

SEQ ID NO: 13013 - protein, 10 aa, Dengue virus
EDYGFGIFTT

SEQ ID NO: 13014 - protein, 10 aa, Dengue virus
DYGFGIFTTN

SEQ ID NO: 13015 - protein, 10 aa, Dengue virus
YGFGIFTTNI

SEQ ID NO: 13016 - protein, 10 aa, Dengue virus
GFGIFTTNIW

SEQ ID NO: 13017 - protein, 10 aa, Dengue virus
FGIFTTNIWL

SEQ ID NO: 13018 - protein, 10 aa, Dengue virus
GIFTTNIWLK

SEQ ID NO: 13019 - protein, 10 aa, Dengue virus
IFTTNIWLKL

SEQ ID NO: 13020 - protein, 10 aa, Dengue virus
FTTNIWLKLR

SEQ ID NO: 13021 - protein, 10 aa, Dengue virus
TTNIWLKLRD

SEQ ID NO: 13022 - protein, 10 aa, Dengue virus
TNIWLKLRDS

SEQ ID NO: 13023 - protein, 10 aa, Dengue virus
NIWLKLRDSY

SEQ ID NO: 13024 - protein, 10 aa, Dengue virus
IWLKLRDSYT

SEQ ID NO: 13025 - protein, 10 aa, Dengue virus
WLKLRDSYTQ

SEQ ID NO: 13026 - protein, 10 aa, Dengue virus
RDSYTQVCDH

SEQ ID NO: 13027 - protein, 10 aa, Dengue virus
DSYTQVCDHR

SEQ ID NO: 13028 - protein, 10 aa, Dengue virus
SYTQVCDHRL

SEQ ID NO: 13029 - protein, 10 aa, Dengue virus
YTQVCDHRLM

SEQ ID NO: 13030 - protein, 10 aa, Dengue virus
TQVCDHRLMS

SEQ ID NO: 13031 - protein, 10 aa, Dengue virus
QVCDHRLMSA

SEQ ID NO: 13032 - protein, 10 aa, Dengue virus
VCDHRLMSAA

SEQ ID NO: 13033 - protein, 10 aa, Dengue virus
CDHRLMSAAI

SEQ ID NO: 13034 - protein, 10 aa, Dengue virus
DHRLMSAAIK

SEQ ID NO: 13035 - protein, 10 aa, Dengue virus
HRLMSAAIKD

SEQ ID NO: 13036 - protein, 10 aa, Dengue virus
RLMSAAIKDS

SEQ ID NO: 13037 - protein, 10 aa, Dengue virus
LMSAAIKDSK

SEQ ID NO: 13038 - protein, 10 aa, Dengue virus
MSAAIKDSKA

SEQ ID NO: 13039 - protein, 10 aa, Dengue virus
SAAIKDSKAV

SEQ ID NO: 13040 - protein, 10 aa, Dengue virus
AAIKDSKAVH

SEQ ID NO: 13041 - protein, 10 aa, Dengue virus
AIKDSKAVHA

SEQ ID NO: 13042 - protein, 10 aa, Dengue virus
IKDSKAVHAD

SEQ ID NO: 13043 - protein, 10 aa, Dengue virus
KDSKAVHADM

SEQ ID NO: 13044 - protein, 10 aa, Dengue virus
DSKAVHADMG

SEQ ID NO: 13045 - protein, 10 aa, Dengue virus
SKAVHADMGY

SEQ ID NO: 13046 - protein, 10 aa, Dengue virus
KAVHADMGYW

SEQ ID NO: 13047 - protein, 10 aa, Dengue virus
AVHADMGYWI

SEQ ID NO: 13048 - protein, 10 aa, Dengue virus
VHADMGYWIE

SEQ ID NO: 13049 - protein, 10 aa, Dengue virus
HADMGYWIES

SEQ ID NO: 13050 - protein, 10 aa, Dengue virus
ADMGYWIESE

SEQ ID NO: 13051 - protein, 10 aa, Dengue virus
DMGYWIESEK

SEQ ID NO: 13052 - protein, 10 aa, Dengue virus
MGYWIESEKN

SEQ ID NO: 13053 - protein, 10 aa, Dengue virus
GYWIESEKNE

SEQ ID NO: 13054 - protein, 10 aa, Dengue virus
YWIESEKNET

SEQ ID NO: 13055 - protein, 10 aa, Dengue virus
WIESEKNETW

SEQ ID NO: 13056 - protein, 10 aa, Dengue virus
IESEKNETWK

SEQ ID NO: 13057 - protein, 10 aa, Dengue virus
ESEKNETWKL

SEQ ID NO: 13058 - protein, 10 aa, Dengue virus
SEKNETWKLA

SEQ ID NO: 13059 - protein, 10 aa, Dengue virus
NETWKLARAS

SEQ ID NO: 13060 - protein, 10 aa, Dengue virus
ETWKLARASF

SEQ ID NO: 13061 - protein, 10 aa, Dengue virus
TWKLARASFI

SEQ ID NO: 13062 - protein, 10 aa, Dengue virus
WKLARASFIE

SEQ ID NO: 13063 - protein, 10 aa, Dengue virus
KLARASFIEV

SEQ ID NO: 13064 - protein, 10 aa, Dengue virus
LARASFIEVK

SEQ ID NO: 13065 - protein, 10 aa, Dengue virus
ARASFIEVKT

SEQ ID NO: 13066 - protein, 10 aa, Dengue virus
RASFIEVKTC

SEQ ID NO: 13067 - protein, 10 aa, Dengue virus
ASFIEVKTCI

SEQ ID NO: 13068 - protein, 10 aa, Dengue virus
SFIEVKTCIW

SEQ ID NO: 13069 - protein, 10 aa, Dengue virus
FIEVKTCIWP

SEQ ID NO: 13070 - protein, 10 aa, Dengue virus
IEVKTCIWPK

SEQ ID NO: 13071 - protein, 10 aa, Dengue virus
EVKTCIWPKS

SEQ ID NO: 13072 - protein, 10 aa, Dengue virus
VKTCIWPKSH

SEQ ID NO: 13073 - protein, 10 aa, Dengue virus
KTCIWPKSHT

SEQ ID NO: 13074 - protein, 10 aa, Dengue virus
TCIWPKSHTL

SEQ ID NO: 13075 - protein, 10 aa, Dengue virus
CIWPKSHTLW

SEQ ID NO: 13076 - protein, 10 aa, Dengue virus
IWPKSHTLWS

SEQ ID NO: 13077 - protein, 10 aa, Dengue virus
WPKSHTLWSN

SEQ ID NO: 13078 - protein, 10 aa, Dengue virus
PKSHTLWSNG

SEQ ID NO: 13079 - protein, 10 aa, Dengue virus
KSHTLWSNGV

SEQ ID NO: 13080 - protein, 10 aa, Dengue virus
SHTLWSNGVL

SEQ ID NO: 13081 - protein, 10 aa, Dengue virus
HTLWSNGVLE

SEQ ID NO: 13082 - protein, 10 aa, Dengue virus
TLWSNGVLES

SEQ ID NO: 13083 - protein, 10 aa, Dengue virus
LWSNGVLESE

SEQ ID NO: 13084 - protein, 10 aa, Dengue virus
WSNGVLESEM

SEQ ID NO: 13085 - protein, 10 aa, Dengue virus
SNGVLESEMI

SEQ ID NO: 13086 - protein, 10 aa, Dengue virus
NGVLESEMII

SEQ ID NO: 13087 - protein, 10 aa, Dengue virus
GVLESEMIIP

SEQ ID NO: 13088 - protein, 10 aa, Dengue virus
VLESEMIIPK

SEQ ID NO: 13089 - protein, 10 aa, Dengue virus
LESEMIIPKI

SEQ ID NO: 13090 - protein, 10 aa, Dengue virus
ESEMIIPKIY

SEQ ID NO: 13091 - protein, 10 aa, Dengue virus
SEMIIPKIYG

SEQ ID NO: 13092 - protein, 10 aa, Dengue virus
EMIIPKIYGG

SEQ ID NO: 13093 - protein, 10 aa, Dengue virus
MIIPKIYGGP

SEQ ID NO: 13094 - protein, 10 aa, Dengue virus
PKIYGGPISQ

SEQ ID NO: 13095 - protein, 10 aa, Dengue virus
KIYGGPISQH

SEQ ID NO: 13096 - protein, 10 aa, Dengue virus
IYGGPISQHN

SEQ ID NO: 13097 - protein, 10 aa, Dengue virus
YGGPISQHNY

SEQ ID NO: 13098 - protein, 10 aa, Dengue virus
GGPISQHNYR

SEQ ID NO: 13099 - protein, 10 aa, Dengue virus
GPISQHNYRP

SEQ ID NO: 13100 - protein, 10 aa, Dengue virus
PISQHNYRPG

SEQ ID NO: 13101 - protein, 10 aa, Dengue virus
ISQHNYRPGY

SEQ ID NO: 13102 - protein, 10 aa, Dengue virus
SQHNYRPGYF

SEQ ID NO: 13103 - protein, 10 aa, Dengue virus
QHNYRPGYFT

SEQ ID NO: 13104 - protein, 10 aa, Dengue virus
HNYRPGYFTQ

SEQ ID NO: 13105 - protein, 10 aa, Dengue virus
NYRPGYFTQT

SEQ ID NO: 13106 - protein, 10 aa, Dengue virus
YRPGYFTQTA

SEQ ID NO: 13107 - protein, 10 aa, Dengue virus
RPGYFTQTAG

SEQ ID NO: 13108 - protein, 10 aa, Dengue virus
PGYFTQTAGP

SEQ ID NO: 13109 - protein, 10 aa, Dengue virus
GYFTQTAGPW

SEQ ID NO: 13110 - protein, 10 aa, Dengue virus
YFTQTAGPWH

SEQ ID NO: 13111 - protein, 10 aa, Dengue virus
FTQTAGPWHL

SEQ ID NO: 13112 - protein, 10 aa, Dengue virus
TQTAGPWHLG

SEQ ID NO: 13113 - protein, 10 aa, Dengue virus
QTAGPWHLGK

SEQ ID NO: 13114 - protein, 10 aa, Dengue virus
TAGPWHLGKL

SEQ ID NO: 13115 - protein, 10 aa, Dengue virus
AGPWHLGKLE

SEQ ID NO: 13116 - protein, 10 aa, Dengue virus
GPWHLGKLEL

SEQ ID NO: 13117 - protein, 10 aa, Dengue virus
PWHLGKLELD

SEQ ID NO: 13118 - protein, 10 aa, Dengue virus
WHLGKLELDF

SEQ ID NO: 13119 - protein, 10 aa, Dengue virus
HLGKLELDFD

SEQ ID NO: 13120 - protein, 10 aa, Dengue virus
LGKLELDFDL

SEQ ID NO: 13121 - protein, 10 aa, Dengue virus
GKLELDFDLC

SEQ ID NO: 13122 - protein, 10 aa, Dengue virus
KLELDFDLCE

SEQ ID NO: 13123 - protein, 10 aa, Dengue virus
LELDFDLCEG

SEQ ID NO: 13124 - protein, 10 aa, Dengue virus
ELDFDLCEGT

SEQ ID NO: 13125 - protein, 10 aa, Dengue virus
LDFDLCEGTT

SEQ ID NO: 13126 - protein, 10 aa, Dengue virus
DFDLCEGTTV

SEQ ID NO: 13127 - protein, 10 aa, Dengue virus
FDLCEGTTVV

SEQ ID NO: 13128 - protein, 10 aa, Dengue virus
DLCEGTTVVV

SEQ ID NO: 13129 - protein, 10 aa, Dengue virus
LCEGTTVVVD

SEQ ID NO: 13130 - protein, 10 aa, Dengue virus
CEGTTVVVDE

SEQ ID NO: 13131 - protein, 10 aa, Dengue virus
EGTTVVVDEH

SEQ ID NO: 13132 - protein, 10 aa, Dengue virus
GTTVVVDEHC

SEQ ID NO: 13133 - protein, 10 aa, Dengue virus
TTVVVDEHCG

SEQ ID NO: 13134 - protein, 10 aa, Dengue virus
TVVVDEHCGN

SEQ ID NO: 13135 - protein, 10 aa, Dengue virus
VVVDEHCGNR

SEQ ID NO: 13136 - protein, 10 aa, Dengue virus
VVDEHCGNRG

SEQ ID NO: 13137 - protein, 10 aa, Dengue virus
VDEHCGNRGP

SEQ ID NO: 13138 - protein, 10 aa, Dengue virus
DEHCGNRGPS

SEQ ID NO: 13139 - protein, 10 aa, Dengue virus
EHCGNRGPSL

SEQ ID NO: 13140 - protein, 10 aa, Dengue virus
HCGNRGPSLR

SEQ ID NO: 13141 - protein, 10 aa, Dengue virus
CGNRGPSLRT

SEQ ID NO: 13142 - protein, 10 aa, Dengue virus
GNRGPSLRTT

SEQ ID NO: 13143 - protein, 10 aa, Dengue virus
NRGPSLRTTT

SEQ ID NO: 13144 - protein, 10 aa, Dengue virus
RGPSLRTTTV

SEQ ID NO: 13145 - protein, 10 aa, Dengue virus
GPSLRTTTVT

SEQ ID NO: 13146 - protein, 10 aa, Dengue virus
PSLRTTTVTG

SEQ ID NO: 13147 - protein, 10 aa, Dengue virus
SLRTTTVTGK

SEQ ID NO: 13148 - protein, 10 aa, Dengue virus
LRTTTVTGKI

SEQ ID NO: 13149 - protein, 10 aa, Dengue virus
RTTTVTGKII

SEQ ID NO: 13150 - protein, 10 aa, Dengue virus
TTTVTGKIIH

SEQ ID NO: 13151 - protein, 10 aa, Dengue virus
TTVTGKIIHE

SEQ ID NO: 13152 - protein, 10 aa, Dengue virus
TVTGKIIHEW

SEQ ID NO: 13153 - protein, 10 aa, Dengue virus
VTGKIIHEWC

SEQ ID NO: 13154 - protein, 10 aa, Dengue virus
TGKIIHEWCC

SEQ ID NO: 13155 - protein, 10 aa, Dengue virus
GKIIHEWCCR

SEQ ID NO: 13156 - protein, 10 aa, Dengue virus
KIIHEWCCRS

SEQ ID NO: 13157 - protein, 10 aa, Dengue virus
IIHEWCCRSC

SEQ ID NO: 13158 - protein, 10 aa, Dengue virus
IHEWCCRSCT

SEQ ID NO: 13159 - protein, 10 aa, Dengue virus
HEWCCRSCTL

SEQ ID NO: 13160 - protein, 10 aa, Dengue virus
EWCCRSCTLP

SEQ ID NO: 13161 - protein, 10 aa, Dengue virus
WCCRSCTLPP

SEQ ID NO: 13162 - protein, 10 aa, Dengue virus
CCRSCTLPPL

SEQ ID NO: 13163 - protein, 10 aa, Dengue virus
CRSCTLPPLR

SEQ ID NO: 13164 - protein, 10 aa, Dengue virus
RSCTLPPLRF

SEQ ID NO: 13165 - protein, 10 aa, Dengue virus
SCTLPPLRFR

SEQ ID NO: 13166 - protein, 10 aa, Dengue virus
CTLPPLRFRG

SEQ ID NO: 13167 - protein, 10 aa, Dengue virus
TLPPLRFRGE

SEQ ID NO: 13168 - protein, 10 aa, Dengue virus
LPPLRFRGED

SEQ ID NO: 13169 - protein, 10 aa, Dengue virus
PPLRFRGEDG

SEQ ID NO: 13170 - protein, 10 aa, Dengue virus
PLRFRGEDGC

SEQ ID NO: 13171 - protein, 10 aa, Dengue virus
LRFRGEDGCW

SEQ ID NO: 13172 - protein, 10 aa, Dengue virus
RFRGEDGCWY

SEQ ID NO: 13173 - protein, 10 aa, Dengue virus
FRGEDGCWYG

SEQ ID NO: 13174 - protein, 10 aa, Dengue virus
RGEDGCWYGM

SEQ ID NO: 13175 - protein, 10 aa, Dengue virus
GEDGCWYGME

SEQ ID NO: 13176 - protein, 10 aa, Dengue virus
EDGCWYGMEI

SEQ ID NO: 13177 - protein, 10 aa, Dengue virus
DGCWYGMEIR

SEQ ID NO: 13178 - protein, 10 aa, Dengue virus
GCWYGMEIRP

SEQ ID NO: 13179 - protein, 10 aa, Dengue virus
CWYGMEIRPV

SEQ ID NO: 13180 - protein, 10 aa, Dengue virus
WYGMEIRPVK

SEQ ID NO: 13181 - protein, 10 aa, Dengue virus
YGMEIRPVKE

SEQ ID NO: 13182 - protein, 10 aa, Dengue virus
GMEIRPVKEK

SEQ ID NO: 13183 - protein, 10 aa, Dengue virus
MEIRPVKEKE

SEQ ID NO: 13184 - protein, 10 aa, Dengue virus
EIRPVKEKEE

SEQ ID NO: 13185 - protein, 10 aa, Dengue virus
IRPVKEKEEN

SEQ ID NO: 13186 - protein, 10 aa, Dengue virus
RPVKEKEENL

SEQ ID NO: 13187 - protein, 10 aa, Dengue virus
PVKEKEENLV

SEQ ID NO: 13188 - protein, 10 aa, Dengue virus
VKEKEENLVK

SEQ ID NO: 13189 - protein, 10 aa, Dengue virus
KEKEENLVKS

SEQ ID NO: 13190 - protein, 10 aa, Dengue virus
EKEENLVKSM

SEQ ID NO: 13191 - protein, 10 aa, Dengue virus
KEENLVKSMV

SEQ ID NO: 13192 - protein, 10 aa, Dengue virus
EENLVKSMVS

SEQ ID NO: 13193 - protein, 10 aa, Dengue virus
ENLVKSMVSA

SEQ ID NO: 13194 - protein, 10 aa, Dengue virus
NLVKSMVSAG

SEQ ID NO: 13195 - protein, 10 aa, Dengue virus
LVKSMVSAGS

SEQ ID NO: 13196 - protein, 10 aa, Dengue virus
VKSMVSAGSG

SEQ ID NO: 13197 - protein, 10 aa, Dengue virus
KSMVSAGSGE

SEQ ID NO: 13198 - protein, 10 aa, Dengue virus
SMVSAGSGEV

SEQ ID NO: 13199 - protein, 10 aa, Dengue virus
MVSAGSGEVD

SEQ ID NO: 13200 - protein, 10 aa, Dengue virus
VSAGSGEVDS

SEQ ID NO: 13201 - protein, 10 aa, Dengue virus
SAGSGEVDSF

SEQ ID NO: 13202 - protein, 10 aa, Dengue virus
AGSGEVDSFS

SEQ ID NO: 13203 - protein, 10 aa, Dengue virus
GSGEVDSFSL

SEQ ID NO: 13204 - protein, 10 aa, Dengue virus
SGEVDSFSLG

SEQ ID NO: 13205 - protein, 10 aa, Dengue virus
GEVDSFSLGL

SEQ ID NO: 13206 - protein, 10 aa, Dengue virus
EVDSFSLGLL

SEQ ID NO: 13207 - protein, 10 aa, Dengue virus
VDSFSLGLLC

SEQ ID NO: 13208 - protein, 10 aa, Dengue virus
FSLGLLCISI

SEQ ID NO: 13209 - protein, 10 aa, Dengue virus
SIMIEEVMRS

SEQ ID NO: 13210 - protein, 10 aa, Dengue virus
IMIEEVMRSR

SEQ ID NO: 13211 - protein, 10 aa, Dengue virus
MIEEVMRSRW

SEQ ID NO: 13212 - protein, 10 aa, Dengue virus
IEEVMRSRWS

SEQ ID NO: 13213 - protein, 10 aa, Dengue virus
EEVMRSRWSR

SEQ ID NO: 13214 - protein, 10 aa, Dengue virus
EVMRSRWSRK

SEQ ID NO: 13215 - protein, 10 aa, Dengue virus
VMRSRWSRKM

SEQ ID NO: 13216 - protein, 10 aa, Dengue virus
MRSRWSRKML

SEQ ID NO: 13217 - protein, 10 aa, Dengue virus
RSRWSRKMLM

SEQ ID NO: 13218 - protein, 10 aa, Dengue virus
SRWSRKMLMT

SEQ ID NO: 13219 - protein, 10 aa, Dengue virus
RWSRKMLMTG

SEQ ID NO: 13220 - protein, 10 aa, Dengue virus
WSRKMLMTGT

SEQ ID NO: 13221 - protein, 10 aa, Dengue virus
SRKMLMTGTL

SEQ ID NO: 13222 - protein, 10 aa, Dengue virus
KMLMTGTLAV

SEQ ID NO: 13223 - protein, 10 aa, Dengue virus
MLMTGTLAVF

SEQ ID NO: 13224 - protein, 10 aa, Dengue virus
GQLTWNDLIR

SEQ ID NO: 13225 - protein, 10 aa, Dengue virus
QLTWNDLIRL

SEQ ID NO: 13226 - protein, 10 aa, Dengue virus
LTWNDLIRLC

SEQ ID NO: 13227 - protein, 10 aa, Dengue virus
TWNDLIRLCI

SEQ ID NO: 13228 - protein, 10 aa, Dengue virus
WNDLIRLCIM

SEQ ID NO: 13229 - protein, 10 aa, Dengue virus
NDLIRLCIMV

SEQ ID NO: 13230 - protein, 10 aa, Dengue virus
DLIRLCIMVG

SEQ ID NO: 13231 - protein, 10 aa, Dengue virus
LIRLCIMVGA

SEQ ID NO: 13232 - protein, 10 aa, Dengue virus
IRLCIMVGAN

SEQ ID NO: 13233 - protein, 10 aa, Dengue virus
RLCIMVGANA

SEQ ID NO: 13234 - protein, 10 aa, Dengue virus
LCIMVGANAS

SEQ ID NO: 13235 - protein, 10 aa, Dengue virus
CIMVGANASD

SEQ ID NO: 13236 - protein, 10 aa, Dengue virus
IMVGANASDR

SEQ ID NO: 13237 - protein, 10 aa, Dengue virus
MVGANASDRM

SEQ ID NO: 13238 - protein, 10 aa, Dengue virus
VGANASDRMG

SEQ ID NO: 13239 - protein, 10 aa, Dengue virus
GANASDRMGM

SEQ ID NO: 13240 - protein, 10 aa, Dengue virus
ANASDRMGMG

SEQ ID NO: 13241 - protein, 10 aa, Dengue virus
DRMGMGTTYL

SEQ ID NO: 13242 - protein, 10 aa, Dengue virus
RMGMGTTYLA

SEQ ID NO: 13243 - protein, 10 aa, Dengue virus
MGMGTTYLAL

SEQ ID NO: 13244 - protein, 10 aa, Dengue virus
GMGTTYLALM

SEQ ID NO: 13245 - protein, 10 aa, Dengue virus
MGTTYLALMA

SEQ ID NO: 13246 - protein, 10 aa, Dengue virus
GTTYLALMAT

SEQ ID NO: 13247 - protein, 10 aa, Dengue virus
TTYLALMATF

SEQ ID NO: 13248 - protein, 10 aa, Dengue virus
TYLALMATFK

SEQ ID NO: 13249 - protein, 10 aa, Dengue virus
YLALMATFKM

SEQ ID NO: 13250 - protein, 10 aa, Dengue virus
LALMATFKMR

SEQ ID NO: 13251 - protein, 10 aa, Dengue virus
ALMATFKMRP

SEQ ID NO: 13252 - protein, 10 aa, Dengue virus
LMATFKMRPM

SEQ ID NO: 13253 - protein, 10 aa, Dengue virus
MATFKMRPMF

SEQ ID NO: 13254 - protein, 10 aa, Dengue virus
ATFKMRPMFA

SEQ ID NO: 13255 - protein, 10 aa, Dengue virus
TFKMRPMFAV

SEQ ID NO: 13256 - protein, 10 aa, Dengue virus
FKMRPMFAVG

SEQ ID NO: 13257 - protein, 10 aa, Dengue virus
KMRPMFAVGL

SEQ ID NO: 13258 - protein, 10 aa, Dengue virus
MRPMFAVGLL

SEQ ID NO: 13259 - protein, 10 aa, Dengue virus
RPMFAVGLLF

SEQ ID NO: 13260 - protein, 10 aa, Dengue virus
PMFAVGLLFR

SEQ ID NO: 13261 - protein, 10 aa, Dengue virus
MFAVGLLFRR

SEQ ID NO: 13262 - protein, 10 aa, Dengue virus
FAVGLLFRRL

SEQ ID NO: 13263 - protein, 10 aa, Dengue virus
AVGLLFRRLT

SEQ ID NO: 13264 - protein, 10 aa, Dengue virus
VGLLFRRLTS

SEQ ID NO: 13265 - protein, 10 aa, Dengue virus
GLLFRRLTSR

SEQ ID NO: 13266 - protein, 10 aa, Dengue virus
LLFRRLTSRE

SEQ ID NO: 13267 - protein, 10 aa, Dengue virus
LFRRLTSREV

SEQ ID NO: 13268 - protein, 10 aa, Dengue virus
FRRLTSREVL

SEQ ID NO: 13269 - protein, 10 aa, Dengue virus
RRLTSREVLL

SEQ ID NO: 13270 - protein, 10 aa, Dengue virus
RLTSREVLLL

SEQ ID NO: 13271 - protein, 10 aa, Dengue virus
LTSREVLLLT

SEQ ID NO: 13272 - protein, 10 aa, Dengue virus
TSREVLLLTI

SEQ ID NO: 13273 - protein, 10 aa, Dengue virus
SREVLLLTIG

SEQ ID NO: 13274 - protein, 10 aa, Dengue virus
REVLLLTIGL

SEQ ID NO: 13275 - protein, 10 aa, Dengue virus
EVLLLTIGLS

SEQ ID NO: 13276 - protein, 10 aa, Dengue virus
VLLLTIGLSL

SEQ ID NO: 13277 - protein, 10 aa, Dengue virus
LLLTIGLSLV

SEQ ID NO: 13278 - protein, 10 aa, Dengue virus
LLTIGLSLVA

SEQ ID NO: 13279 - protein, 10 aa, Dengue virus
LTIGLSLVAS

SEQ ID NO: 13280 - protein, 10 aa, Dengue virus
TIGLSLVASV

SEQ ID NO: 13281 - protein, 10 aa, Dengue virus
IGLSLVASVE

SEQ ID NO: 13282 - protein, 10 aa, Dengue virus
GLSLVASVEL

SEQ ID NO: 13283 - protein, 10 aa, Dengue virus
LSLVASVELP

SEQ ID NO: 13284 - protein, 10 aa, Dengue virus
SVELPNSLEE

SEQ ID NO: 13285 - protein, 10 aa, Dengue virus
VELPNSLEEL

SEQ ID NO: 13286 - protein, 10 aa, Dengue virus
ELPNSLEELG

SEQ ID NO: 13287 - protein, 10 aa, Dengue virus
LPNSLEELGD

SEQ ID NO: 13288 - protein, 10 aa, Dengue virus
PNSLEELGDG

SEQ ID NO: 13289 - protein, 10 aa, Dengue virus
NSLEELGDGL

SEQ ID NO: 13290 - protein, 10 aa, Dengue virus
SLEELGDGLA

SEQ ID NO: 13291 - protein, 10 aa, Dengue virus
LEELGDGLAM

SEQ ID NO: 13292 - protein, 10 aa, Dengue virus
EELGDGLAMG

SEQ ID NO: 13293 - protein, 10 aa, Dengue virus
ELGDGLAMGI

SEQ ID NO: 13294 - protein, 10 aa, Dengue virus
LGDGLAMGIM

SEQ ID NO: 13295 - protein, 10 aa, Dengue virus
GDGLAMGIMI

SEQ ID NO: 13296 - protein, 10 aa, Dengue virus
DGLAMGIMIL

SEQ ID NO: 13297 - protein, 10 aa, Dengue virus
GLAMGIMILK

SEQ ID NO: 13298 - protein, 10 aa, Dengue virus
LAMGIMILKL

SEQ ID NO: 13299 - protein, 10 aa, Dengue virus
AMGIMILKLL

SEQ ID NO: 13300 - protein, 10 aa, Dengue virus
MGIMILKLLT

SEQ ID NO: 13301 - protein, 10 aa, Dengue virus
GIMILKLLTD

SEQ ID NO: 13302 - protein, 10 aa, Dengue virus
IMILKLLTDF

SEQ ID NO: 13303 - protein, 10 aa, Dengue virus
MILKLLTDFQ

SEQ ID NO: 13304 - protein, 10 aa, Dengue virus
ILKLLTDFQS

SEQ ID NO: 13305 - protein, 10 aa, Dengue virus
LKLLTDFQSH

SEQ ID NO: 13306 - protein, 10 aa, Dengue virus
KLLTDFQSHQ

SEQ ID NO: 13307 - protein, 10 aa, Dengue virus
LLTDFQSHQL

SEQ ID NO: 13308 - protein, 10 aa, Dengue virus
LTDFQSHQLW

SEQ ID NO: 13309 - protein, 10 aa, Dengue virus
LSIVSLFPLC

SEQ ID NO: 13310 - protein, 10 aa, Dengue virus
VSLFPLCLST

SEQ ID NO: 13311 - protein, 10 aa, Dengue virus
SLFPLCLSTT

SEQ ID NO: 13312 - protein, 10 aa, Dengue virus
LFPLCLSTTS

SEQ ID NO: 13313 - protein, 10 aa, Dengue virus
FPLCLSTTSQ

SEQ ID NO: 13314 - protein, 10 aa, Dengue virus
PLCLSTTSQK

SEQ ID NO: 13315 - protein, 10 aa, Dengue virus
LCLSTTSQKT

SEQ ID NO: 13316 - protein, 10 aa, Dengue virus
CLSTTSQKTT

SEQ ID NO: 13317 - protein, 10 aa, Dengue virus
LSTTSQKTTW

SEQ ID NO: 13318 - protein, 10 aa, Dengue virus
STTSQKTTWL

SEQ ID NO: 13319 - protein, 10 aa, Dengue virus
TTSQKTTWLP

SEQ ID NO: 13320 - protein, 10 aa, Dengue virus
TSQKTTWLPV

SEQ ID NO: 13321 - protein, 10 aa, Dengue virus
SQKTTWLPVL

SEQ ID NO: 13322 - protein, 10 aa, Dengue virus
QKTTWLPVLL

SEQ ID NO: 13323 - protein, 10 aa, Dengue virus
KTTWLPVLLG

SEQ ID NO: 13324 - protein, 10 aa, Dengue virus
TTWLPVLLGS

SEQ ID NO: 13325 - protein, 10 aa, Dengue virus
TWLPVLLGSL

SEQ ID NO: 13326 - protein, 10 aa, Dengue virus
WLPVLLGSLG

SEQ ID NO: 13327 - protein, 10 aa, Dengue virus
LPVLLGSLGC

SEQ ID NO: 13328 - protein, 10 aa, Dengue virus
PVLLGSLGCK

SEQ ID NO: 13329 - protein, 10 aa, Dengue virus
VLLGSLGCKP

SEQ ID NO: 13330 - protein, 10 aa, Dengue virus
LLGSLGCKPL

SEQ ID NO: 13331 - protein, 10 aa, Dengue virus
LGSLGCKPLT

SEQ ID NO: 13332 - protein, 10 aa, Dengue virus
GSLGCKPLTM

SEQ ID NO: 13333 - protein, 10 aa, Dengue virus
SLGCKPLTMF

SEQ ID NO: 13334 - protein, 10 aa, Dengue virus
LGCKPLTMFL

SEQ ID NO: 13335 - protein, 10 aa, Dengue virus
GCKPLTMFLI

SEQ ID NO: 13336 - protein, 10 aa, Dengue virus
CKPLTMFLIA

SEQ ID NO: 13337 - protein, 10 aa, Dengue virus
KPLTMFLIAE

SEQ ID NO: 13338 - protein, 10 aa, Dengue virus
ENKIWGRKSW

SEQ ID NO: 13339 - protein, 10 aa, Dengue virus
NKIWGRKSWP

SEQ ID NO: 13340 - protein, 10 aa, Dengue virus
KIWGRKSWPL

SEQ ID NO: 13341 - protein, 10 aa, Dengue virus
IWGRKSWPLN

SEQ ID NO: 13342 - protein, 10 aa, Dengue virus
WGRKSWPLNE

SEQ ID NO: 13343 - protein, 10 aa, Dengue virus
GRKSWPLNEG

SEQ ID NO: 13344 - protein, 10 aa, Dengue virus
RKSWPLNEGI

SEQ ID NO: 13345 - protein, 10 aa, Dengue virus
KSWPLNEGIM

SEQ ID NO: 13346 - protein, 10 aa, Dengue virus
SWPLNEGIMA

SEQ ID NO: 13347 - protein, 10 aa, Dengue virus
WPLNEGIMAV

SEQ ID NO: 13348 - protein, 10 aa, Dengue virus
PLNEGIMAVG

SEQ ID NO: 13349 - protein, 10 aa, Dengue virus
LNEGIMAVGI

SEQ ID NO: 13350 - protein, 10 aa, Dengue virus
NEGIMAVGIV

SEQ ID NO: 13351 - protein, 10 aa, Dengue virus
EGIMAVGIVS

SEQ ID NO: 13352 - protein, 10 aa, Dengue virus
GIMAVGIVSI

SEQ ID NO: 13353 - protein, 10 aa, Dengue virus
IMAVGIVSIL

SEQ ID NO: 13354 - protein, 10 aa, Dengue virus
MAVGIVSILL

SEQ ID NO: 13355 - protein, 10 aa, Dengue virus
AVGIVSILLS

SEQ ID NO: 13356 - protein, 10 aa, Dengue virus
VGIVSILLSS

SEQ ID NO: 13357 - protein, 10 aa, Dengue virus
GIVSILLSSL

SEQ ID NO: 13358 - protein, 10 aa, Dengue virus
IVSILLSSLL

SEQ ID NO: 13359 - protein, 10 aa, Dengue virus
VSILLSSLLK

SEQ ID NO: 13360 - protein, 10 aa, Dengue virus
SILLSSLLKN

SEQ ID NO: 13361 - protein, 10 aa, Dengue virus
ILLSSLLKND

SEQ ID NO: 13362 - protein, 10 aa, Dengue virus
LLSSLLKNDV

SEQ ID NO: 13363 - protein, 10 aa, Dengue virus
LSSLLKNDVP

SEQ ID NO: 13364 - protein, 10 aa, Dengue virus
SSLLKNDVPL

SEQ ID NO: 13365 - protein, 10 aa, Dengue virus
SLLKNDVPLA

SEQ ID NO: 13366 - protein, 10 aa, Dengue virus
LLKNDVPLAG

SEQ ID NO: 13367 - protein, 10 aa, Dengue virus
LKNDVPLAGP

SEQ ID NO: 13368 - protein, 10 aa, Dengue virus
KNDVPLAGPL

SEQ ID NO: 13369 - protein, 10 aa, Dengue virus
NDVPLAGPLI

SEQ ID NO: 13370 - protein, 10 aa, Dengue virus
DVPLAGPLIA

SEQ ID NO: 13371 - protein, 10 aa, Dengue virus
VPLAGPLIAG

SEQ ID NO: 13372 - protein, 10 aa, Dengue virus
PLAGPLIAGG

SEQ ID NO: 13373 - protein, 10 aa, Dengue virus
LAGPLIAGGM

SEQ ID NO: 13374 - protein, 10 aa, Dengue virus
AGPLIAGGML

SEQ ID NO: 13375 - protein, 10 aa, Dengue virus
GPLIAGGMLI

SEQ ID NO: 13376 - protein, 10 aa, Dengue virus
PLIAGGMLIA

SEQ ID NO: 13377 - protein, 10 aa, Dengue virus
LIAGGMLIAC

SEQ ID NO: 13378 - protein, 10 aa, Dengue virus
IAGGMLIACY

SEQ ID NO: 13379 - protein, 10 aa, Dengue virus
AGGMLIACYV

SEQ ID NO: 13380 - protein, 10 aa, Dengue virus
GGMLIACYVI

SEQ ID NO: 13381 - protein, 10 aa, Dengue virus
GMLIACYVIS

SEQ ID NO: 13382 - protein, 10 aa, Dengue virus
MLIACYVISG

SEQ ID NO: 13383 - protein, 10 aa, Dengue virus
LIACYVISGS

SEQ ID NO: 13384 - protein, 10 aa, Dengue virus
IACYVISGSS

SEQ ID NO: 13385 - protein, 10 aa, Dengue virus
ACYVISGSSA

SEQ ID NO: 13386 - protein, 10 aa, Dengue virus
CYVISGSSAD

SEQ ID NO: 13387 - protein, 10 aa, Dengue virus
YVISGSSADL

SEQ ID NO: 13388 - protein, 10 aa, Dengue virus
VISGSSADLS

SEQ ID NO: 13389 - protein, 10 aa, Dengue virus
ISGSSADLSL

SEQ ID NO: 13390 - protein, 10 aa, Dengue virus
SGSSADLSLE

SEQ ID NO: 13391 - protein, 10 aa, Dengue virus
GSSADLSLEK

SEQ ID NO: 13392 - protein, 10 aa, Dengue virus
SSADLSLEKA

SEQ ID NO: 13393 - protein, 10 aa, Dengue virus
SADLSLEKAA

SEQ ID NO: 13394 - protein, 10 aa, Dengue virus
ADLSLEKAAE

SEQ ID NO: 13395 - protein, 10 aa, Dengue virus
DLSLEKAAEV

SEQ ID NO: 13396 - protein, 10 aa, Dengue virus
LSLEKAAEVS

SEQ ID NO: 13397 - protein, 10 aa, Dengue virus
SLEKAAEVSW

SEQ ID NO: 13398 - protein, 10 aa, Dengue virus
LEKAAEVSWE

SEQ ID NO: 13399 - protein, 10 aa, Dengue virus
AEVSWEEEAE

SEQ ID NO: 13400 - protein, 10 aa, Dengue virus
EVSWEEEAEH

SEQ ID NO: 13401 - protein, 10 aa, Dengue virus
VSWEEEAEHS

SEQ ID NO: 13402 - protein, 10 aa, Dengue virus
SWEEEAEHSG

SEQ ID NO: 13403 - protein, 10 aa, Dengue virus
WEEEAEHSGA

SEQ ID NO: 13404 - protein, 10 aa, Dengue virus
EEEAEHSGAS

SEQ ID NO: 13405 - protein, 10 aa, Dengue virus
EEAEHSGASH

SEQ ID NO: 13406 - protein, 10 aa, Dengue virus
EAEHSGASHN

SEQ ID NO: 13407 - protein, 10 aa, Dengue virus
AEHSGASHNI

SEQ ID NO: 13408 - protein, 10 aa, Dengue virus
EHSGASHNIL

SEQ ID NO: 13409 - protein, 10 aa, Dengue virus
HSGASHNILV

SEQ ID NO: 13410 - protein, 10 aa, Dengue virus
SGASHNILVE

SEQ ID NO: 13411 - protein, 10 aa, Dengue virus
GASHNILVEV

SEQ ID NO: 13412 - protein, 10 aa, Dengue virus
ASHNILVEVQ

SEQ ID NO: 13413 - protein, 10 aa, Dengue virus
SHNILVEVQD

SEQ ID NO: 13414 - protein, 10 aa, Dengue virus
HNILVEVQDD

SEQ ID NO: 13415 - protein, 10 aa, Dengue virus
NILVEVQDDG

SEQ ID NO: 13416 - protein, 10 aa, Dengue virus
ILVEVQDDGT

SEQ ID NO: 13417 - protein, 10 aa, Dengue virus
LVEVQDDGTM

SEQ ID NO: 13418 - protein, 10 aa, Dengue virus
VEVQDDGTMK

SEQ ID NO: 13419 - protein, 10 aa, Dengue virus
EVQDDGTMKI

SEQ ID NO: 13420 - protein, 10 aa, Dengue virus
VQDDGTMKIK

SEQ ID NO: 13421 - protein, 10 aa, Dengue virus
QDDGTMKIKD

SEQ ID NO: 13422 - protein, 10 aa, Dengue virus
DDGTMKIKDE

SEQ ID NO: 13423 - protein, 10 aa, Dengue virus
DGTMKIKDEE

SEQ ID NO: 13424 - protein, 10 aa, Dengue virus
GTMKIKDEER

SEQ ID NO: 13425 - protein, 10 aa, Dengue virus
TMKIKDEERD

SEQ ID NO: 13426 - protein, 10 aa, Dengue virus
MKIKDEERDD

SEQ ID NO: 13427 - protein, 10 aa, Dengue virus
KIKDEERDDT

SEQ ID NO: 13428 - protein, 10 aa, Dengue virus
IKDEERDDTL

SEQ ID NO: 13429 - protein, 10 aa, Dengue virus
KDEERDDTLT

SEQ ID NO: 13430 - protein, 10 aa, Dengue virus
DEERDDTLTI

SEQ ID NO: 13431 - protein, 10 aa, Dengue virus
EERDDTLTIL

SEQ ID NO: 13432 - protein, 10 aa, Dengue virus
ERDDTLTILL

SEQ ID NO: 13433 - protein, 10 aa, Dengue virus
RDDTLTILLK

SEQ ID NO: 13434 - protein, 10 aa, Dengue virus
DDTLTILLKA

SEQ ID NO: 13435 - protein, 10 aa, Dengue virus
DTLTILLKAT

SEQ ID NO: 13436 - protein, 10 aa, Dengue virus
TLTILLKATL

SEQ ID NO: 13437 - protein, 10 aa, Dengue virus
LTILLKATLL

SEQ ID NO: 13438 - protein, 10 aa, Dengue virus
TILLKATLLA

SEQ ID NO: 13439 - protein, 10 aa, Dengue virus
ILLKATLLAV

SEQ ID NO: 13440 - protein, 10 aa, Dengue virus
LLKATLLAVS

SEQ ID NO: 13441 - protein, 10 aa, Dengue virus
LKATLLAVSG

SEQ ID NO: 13442 - protein, 10 aa, Dengue virus
KATLLAVSGV

SEQ ID NO: 13443 - protein, 10 aa, Dengue virus
ATLLAVSGVY

SEQ ID NO: 13444 - protein, 10 aa, Dengue virus
TLLAVSGVYP

SEQ ID NO: 13445 - protein, 10 aa, Dengue virus
LLAVSGVYPL

SEQ ID NO: 13446 - protein, 10 aa, Dengue virus
LAVSGVYPLS

SEQ ID NO: 13447 - protein, 10 aa, Dengue virus
AVSGVYPLSI

SEQ ID NO: 13448 - protein, 10 aa, Dengue virus
VSGVYPLSIP

SEQ ID NO: 13449 - protein, 10 aa, Dengue virus
SGVYPLSIPA

SEQ ID NO: 13450 - protein, 10 aa, Dengue virus
GVYPLSIPAT

SEQ ID NO: 13451 - protein, 10 aa, Dengue virus
VYPLSIPATL

SEQ ID NO: 13452 - protein, 10 aa, Dengue virus
YPLSIPATLF

SEQ ID NO: 13453 - protein, 10 aa, Dengue virus
PLSIPATLFV

SEQ ID NO: 13454 - protein, 10 aa, Dengue virus
LSIPATLFVW

SEQ ID NO: 13455 - protein, 10 aa, Dengue virus
SIPATLFVWY

SEQ ID NO: 13456 - protein, 10 aa, Dengue virus
IPATLFVWYF

SEQ ID NO: 13457 - protein, 10 aa, Dengue virus
PATLFVWYFW

SEQ ID NO: 13458 - protein, 10 aa, Dengue virus
ATLFVWYFWQ

SEQ ID NO: 13459 - protein, 10 aa, Dengue virus
KKKQRSGVLW

SEQ ID NO: 13460 - protein, 10 aa, Dengue virus
KKQRSGVLWD

SEQ ID NO: 13461 - protein, 10 aa, Dengue virus
KQRSGVLWDT

SEQ ID NO: 13462 - protein, 10 aa, Dengue virus
QRSGVLWDTP

SEQ ID NO: 13463 - protein, 10 aa, Dengue virus
RSGVLWDTPS

SEQ ID NO: 13464 - protein, 10 aa, Dengue virus
SGVLWDTPSP

SEQ ID NO: 13465 - protein, 10 aa, Dengue virus
GVLWDTPSPP

SEQ ID NO: 13466 - protein, 10 aa, Dengue virus
VLWDTPSPPE

SEQ ID NO: 13467 - protein, 10 aa, Dengue virus
LWDTPSPPEV

SEQ ID NO: 13468 - protein, 10 aa, Dengue virus
WDTPSPPEVE

SEQ ID NO: 13469 - protein, 10 aa, Dengue virus
DTPSPPEVER

SEQ ID NO: 13470 - protein, 10 aa, Dengue virus
TPSPPEVERA

SEQ ID NO: 13471 - protein, 10 aa, Dengue virus
PSPPEVERAV

SEQ ID NO: 13472 - protein, 10 aa, Dengue virus
SPPEVERAVL

SEQ ID NO: 13473 - protein, 10 aa, Dengue virus
PPEVERAVLD

SEQ ID NO: 13474 - protein, 10 aa, Dengue virus
VERAVLDDGI

SEQ ID NO: 13475 - protein, 10 aa, Dengue virus
ERAVLDDGIY

SEQ ID NO: 13476 - protein, 10 aa, Dengue virus
RAVLDDGIYR

SEQ ID NO: 13477 - protein, 10 aa, Dengue virus
AVLDDGIYRI

SEQ ID NO: 13478 - protein, 10 aa, Dengue virus
VLDDGIYRIM

SEQ ID NO: 13479 - protein, 10 aa, Dengue virus
LDDGIYRIMQ

SEQ ID NO: 13480 - protein, 10 aa, Dengue virus
DDGIYRIMQR

SEQ ID NO: 13481 - protein, 10 aa, Dengue virus
DGIYRIMQRG

SEQ ID NO: 13482 - protein, 10 aa, Dengue virus
GIYRIMQRGL

SEQ ID NO: 13483 - protein, 10 aa, Dengue virus
IYRIMQRGLL

SEQ ID NO: 13484 - protein, 10 aa, Dengue virus
YRIMQRGLLG

SEQ ID NO: 13485 - protein, 10 aa, Dengue virus
RIMQRGLLGR

SEQ ID NO: 13486 - protein, 10 aa, Dengue virus
IMQRGLLGRS

SEQ ID NO: 13487 - protein, 10 aa, Dengue virus
MQRGLLGRSQ

SEQ ID NO: 13488 - protein, 10 aa, Dengue virus
QRGLLGRSQV

SEQ ID NO: 13489 - protein, 10 aa, Dengue virus
RGLLGRSQVG

SEQ ID NO: 13490 - protein, 10 aa, Dengue virus
GLLGRSQVGV

SEQ ID NO: 13491 - protein, 10 aa, Dengue virus
LLGRSQVGVG

SEQ ID NO: 13492 - protein, 10 aa, Dengue virus
LGRSQVGVGV

SEQ ID NO: 13493 - protein, 10 aa, Dengue virus
GRSQVGVGVF

SEQ ID NO: 13494 - protein, 10 aa, Dengue virus
RSQVGVGVFQ

SEQ ID NO: 13495 - protein, 10 aa, Dengue virus
SQVGVGVFQE

SEQ ID NO: 13496 - protein, 10 aa, Dengue virus
QVGVGVFQEN

SEQ ID NO: 13497 - protein, 10 aa, Dengue virus
VGVGVFQENV

SEQ ID NO: 13498 - protein, 10 aa, Dengue virus
GVGVFQENVF

SEQ ID NO: 13499 - protein, 10 aa, Dengue virus
VGVFQENVFH

SEQ ID NO: 13500 - protein, 10 aa, Dengue virus
GVFQENVFHT

SEQ ID NO: 13501 - protein, 10 aa, Dengue virus
VFQENVFHTM

SEQ ID NO: 13502 - protein, 10 aa, Dengue virus
FQENVFHTMW

SEQ ID NO: 13503 - protein, 10 aa, Dengue virus
QENVFHTMWH

SEQ ID NO: 13504 - protein, 10 aa, Dengue virus
ENVFHTMWHV

SEQ ID NO: 13505 - protein, 10 aa, Dengue virus
NVFHTMWHVT

SEQ ID NO: 13506 - protein, 10 aa, Dengue virus
VFHTMWHVTR

SEQ ID NO: 13507 - protein, 10 aa, Dengue virus
FHTMWHVTRG

SEQ ID NO: 13508 - protein, 10 aa, Dengue virus
HTMWHVTRGA

SEQ ID NO: 13509 - protein, 10 aa, Dengue virus
TMWHVTRGAV

SEQ ID NO: 13510 - protein, 10 aa, Dengue virus
MWHVTRGAVL

SEQ ID NO: 13511 - protein, 10 aa, Dengue virus
WHVTRGAVLM

SEQ ID NO: 13512 - protein, 10 aa, Dengue virus
HVTRGAVLMY

SEQ ID NO: 13513 - protein, 10 aa, Dengue virus
VTRGAVLMYQ

SEQ ID NO: 13514 - protein, 10 aa, Dengue virus
TRGAVLMYQG

SEQ ID NO: 13515 - protein, 10 aa, Dengue virus
RGAVLMYQGK

SEQ ID NO: 13516 - protein, 10 aa, Dengue virus
GAVLMYQGKR

SEQ ID NO: 13517 - protein, 10 aa, Dengue virus
AVLMYQGKRL

SEQ ID NO: 13518 - protein, 10 aa, Dengue virus
VLMYQGKRLE

SEQ ID NO: 13519 - protein, 10 aa, Dengue virus
LMYQGKRLEP

SEQ ID NO: 13520 - protein, 10 aa, Dengue virus
MYQGKRLEPS

SEQ ID NO: 13521 - protein, 10 aa, Dengue virus
YQGKRLEPSW

SEQ ID NO: 13522 - protein, 10 aa, Dengue virus
QGKRLEPSWA

SEQ ID NO: 13523 - protein, 10 aa, Dengue virus
GKRLEPSWAS

SEQ ID NO: 13524 - protein, 10 aa, Dengue virus
KRLEPSWASV

SEQ ID NO: 13525 - protein, 10 aa, Dengue virus
RLEPSWASVK

SEQ ID NO: 13526 - protein, 10 aa, Dengue virus
LEPSWASVKK

SEQ ID NO: 13527 - protein, 10 aa, Dengue virus
EPSWASVKKD

SEQ ID NO: 13528 - protein, 10 aa, Dengue virus
PSWASVKKDL

SEQ ID NO: 13529 - protein, 10 aa, Dengue virus
SWASVKKDLI

SEQ ID NO: 13530 - protein, 10 aa, Dengue virus
WASVKKDLIS

SEQ ID NO: 13531 - protein, 10 aa, Dengue virus
ASVKKDLISY

SEQ ID NO: 13532 - protein, 10 aa, Dengue virus
SVKKDLISYG

SEQ ID NO: 13533 - protein, 10 aa, Dengue virus
VKKDLISYGG

SEQ ID NO: 13534 - protein, 10 aa, Dengue virus
KKDLISYGGG

SEQ ID NO: 13535 - protein, 10 aa, Dengue virus
KDLISYGGGW

SEQ ID NO: 13536 - protein, 10 aa, Dengue virus
DLISYGGGWR

SEQ ID NO: 13537 - protein, 10 aa, Dengue virus
LISYGGGWRL

SEQ ID NO: 13538 - protein, 10 aa, Dengue virus
ISYGGGWRLQ

SEQ ID NO: 13539 - protein, 10 aa, Dengue virus
SYGGGWRLQG

SEQ ID NO: 13540 - protein, 10 aa, Dengue virus
YGGGWRLQGS

SEQ ID NO: 13541 - protein, 10 aa, Dengue virus
GGGWRLQGSW

SEQ ID NO: 13542 - protein, 10 aa, Dengue virus
GGWRLQGSWN

SEQ ID NO: 13543 - protein, 10 aa, Dengue virus
QGSWNTGEEV

SEQ ID NO: 13544 - protein, 10 aa, Dengue virus
GSWNTGEEVQ

SEQ ID NO: 13545 - protein, 10 aa, Dengue virus
SWNTGEEVQV

SEQ ID NO: 13546 - protein, 10 aa, Dengue virus
WNTGEEVQVI

SEQ ID NO: 13547 - protein, 10 aa, Dengue virus
NTGEEVQVIA

SEQ ID NO: 13548 - protein, 10 aa, Dengue virus
TGEEVQVIAV

SEQ ID NO: 13549 - protein, 10 aa, Dengue virus
GEEVQVIAVE

SEQ ID NO: 13550 - protein, 10 aa, Dengue virus
EEVQVIAVEP

SEQ ID NO: 13551 - protein, 10 aa, Dengue virus
EVQVIAVEPG

SEQ ID NO: 13552 - protein, 10 aa, Dengue virus
VQVIAVEPGK

SEQ ID NO: 13553 - protein, 10 aa, Dengue virus
QVIAVEPGKN

SEQ ID NO: 13554 - protein, 10 aa, Dengue virus
VIAVEPGKNP

SEQ ID NO: 13555 - protein, 10 aa, Dengue virus
IAVEPGKNPK

SEQ ID NO: 13556 - protein, 10 aa, Dengue virus
AVEPGKNPKN

SEQ ID NO: 13557 - protein, 10 aa, Dengue virus
VEPGKNPKNV

SEQ ID NO: 13558 - protein, 10 aa, Dengue virus
EPGKNPKNVQ

SEQ ID NO: 13559 - protein, 10 aa, Dengue virus
PGKNPKNVQT

SEQ ID NO: 13560 - protein, 10 aa, Dengue virus
GKNPKNVQTA

SEQ ID NO: 13561 - protein, 10 aa, Dengue virus
KNPKNVQTAP

SEQ ID NO: 13562 - protein, 10 aa, Dengue virus
NPKNVQTAPG

SEQ ID NO: 13563 - protein, 10 aa, Dengue virus
PKNVQTAPGT

SEQ ID NO: 13564 - protein, 10 aa, Dengue virus
KNVQTAPGTF

SEQ ID NO: 13565 - protein, 10 aa, Dengue virus
NVQTAPGTFK

SEQ ID NO: 13566 - protein, 10 aa, Dengue virus
VQTAPGTFKT

SEQ ID NO: 13567 - protein, 10 aa, Dengue virus
QTAPGTFKTP

SEQ ID NO: 13568 - protein, 10 aa, Dengue virus
TAPGTFKTPE

SEQ ID NO: 13569 - protein, 10 aa, Dengue virus
APGTFKTPEG

SEQ ID NO: 13570 - protein, 10 aa, Dengue virus
PGTFKTPEGE

SEQ ID NO: 13571 - protein, 10 aa, Dengue virus
GTFKTPEGEV

SEQ ID NO: 13572 - protein, 10 aa, Dengue virus
TFKTPEGEVG

SEQ ID NO: 13573 - protein, 10 aa, Dengue virus
FKTPEGEVGA

SEQ ID NO: 13574 - protein, 10 aa, Dengue virus
KTPEGEVGAI

SEQ ID NO: 13575 - protein, 10 aa, Dengue virus
TPEGEVGAIA

SEQ ID NO: 13576 - protein, 10 aa, Dengue virus
PEGEVGAIAL

SEQ ID NO: 13577 - protein, 10 aa, Dengue virus
EGEVGAIALD

SEQ ID NO: 13578 - protein, 10 aa, Dengue virus
GEVGAIALDF

SEQ ID NO: 13579 - protein, 10 aa, Dengue virus
EVGAIALDFK

SEQ ID NO: 13580 - protein, 10 aa, Dengue virus
VGAIALDFKP

SEQ ID NO: 13581 - protein, 10 aa, Dengue virus
GAIALDFKPG

SEQ ID NO: 13582 - protein, 10 aa, Dengue virus
AIALDFKPGT

SEQ ID NO: 13583 - protein, 10 aa, Dengue virus
IALDFKPGTS

SEQ ID NO: 13584 - protein, 10 aa, Dengue virus
ALDFKPGTSG

SEQ ID NO: 13585 - protein, 10 aa, Dengue virus
LDFKPGTSGS

SEQ ID NO: 13586 - protein, 10 aa, Dengue virus
DFKPGTSGSP

SEQ ID NO: 13587 - protein, 10 aa, Dengue virus
FKPGTSGSPI

SEQ ID NO: 13588 - protein, 10 aa, Dengue virus
KPGTSGSPIV

SEQ ID NO: 13589 - protein, 10 aa, Dengue virus
PGTSGSPIVN

SEQ ID NO: 13590 - protein, 10 aa, Dengue virus
GTSGSPIVNR

SEQ ID NO: 13591 - protein, 10 aa, Dengue virus
TSGSPIVNRE

SEQ ID NO: 13592 - protein, 10 aa, Dengue virus
SGSPIVNREG

SEQ ID NO: 13593 - protein, 10 aa, Dengue virus
GSPIVNREGK

SEQ ID NO: 13594 - protein, 10 aa, Dengue virus
SPIVNREGKI

SEQ ID NO: 13595 - protein, 10 aa, Dengue virus
PIVNREGKIV

SEQ ID NO: 13596 - protein, 10 aa, Dengue virus
IVNREGKIVG

SEQ ID NO: 13597 - protein, 10 aa, Dengue virus
VNREGKIVGL

SEQ ID NO: 13598 - protein, 10 aa, Dengue virus
NREGKIVGLY

SEQ ID NO: 13599 - protein, 10 aa, Dengue virus
REGKIVGLYG

SEQ ID NO: 13600 - protein, 10 aa, Dengue virus
EGKIVGLYGN

SEQ ID NO: 13601 - protein, 10 aa, Dengue virus
GKIVGLYGNG

SEQ ID NO: 13602 - protein, 10 aa, Dengue virus
KIVGLYGNGV

SEQ ID NO: 13603 - protein, 10 aa, Dengue virus
IVGLYGNGVV

SEQ ID NO: 13604 - protein, 10 aa, Dengue virus
VGLYGNGVVT

SEQ ID NO: 13605 - protein, 10 aa, Dengue virus
GLYGNGVVTT

SEQ ID NO: 13606 - protein, 10 aa, Dengue virus
LYGNGVVTTS

SEQ ID NO: 13607 - protein, 10 aa, Dengue virus
YGNGVVTTSG

SEQ ID NO: 13608 - protein, 10 aa, Dengue virus
GNGVVTTSGT

SEQ ID NO: 13609 - protein, 10 aa, Dengue virus
NGVVTTSGTY

SEQ ID NO: 13610 - protein, 10 aa, Dengue virus
GVVTTSGTYV

SEQ ID NO: 13611 - protein, 10 aa, Dengue virus
VVTTSGTYVS

SEQ ID NO: 13612 - protein, 10 aa, Dengue virus
VTTSGTYVSA

SEQ ID NO: 13613 - protein, 10 aa, Dengue virus
TTSGTYVSAI

SEQ ID NO: 13614 - protein, 10 aa, Dengue virus
TSGTYVSAIA

SEQ ID NO: 13615 - protein, 10 aa, Dengue virus
SGTYVSAIAQ

SEQ ID NO: 13616 - protein, 10 aa, Dengue virus
GTYVSAIAQA

SEQ ID NO: 13617 - protein, 10 aa, Dengue virus
TYVSAIAQAK

SEQ ID NO: 13618 - protein, 10 aa, Dengue virus
YVSAIAQAKA

SEQ ID NO: 13619 - protein, 10 aa, Dengue virus
VSAIAQAKAS

SEQ ID NO: 13620 - protein, 10 aa, Dengue virus
SAIAQAKASQ

SEQ ID NO: 13621 - protein, 10 aa, Dengue virus
AIAQAKASQE

SEQ ID NO: 13622 - protein, 10 aa, Dengue virus
IAQAKASQEG

SEQ ID NO: 13623 - protein, 10 aa, Dengue virus
AQAKASQEGP

SEQ ID NO: 13624 - protein, 10 aa, Dengue virus
QAKASQEGPL

SEQ ID NO: 13625 - protein, 10 aa, Dengue virus
AKASQEGPLP

SEQ ID NO: 13626 - protein, 10 aa, Dengue virus
KASQEGPLPE

SEQ ID NO: 13627 - protein, 10 aa, Dengue virus
ASQEGPLPEI

SEQ ID NO: 13628 - protein, 10 aa, Dengue virus
SQEGPLPEIE

SEQ ID NO: 13629 - protein, 10 aa, Dengue virus
QEGPLPEIED

SEQ ID NO: 13630 - protein, 10 aa, Dengue virus
EGPLPEIEDE

SEQ ID NO: 13631 - protein, 10 aa, Dengue virus
GPLPEIEDEV

SEQ ID NO: 13632 - protein, 10 aa, Dengue virus
PLPEIEDEVF

SEQ ID NO: 13633 - protein, 10 aa, Dengue virus
LPEIEDEVFR

SEQ ID NO: 13634 - protein, 10 aa, Dengue virus
PEIEDEVFRK

SEQ ID NO: 13635 - protein, 10 aa, Dengue virus
EIEDEVFRKR

SEQ ID NO: 13636 - protein, 10 aa, Dengue virus
IEDEVFRKRN

SEQ ID NO: 13637 - protein, 10 aa, Dengue virus
EDEVFRKRNL

SEQ ID NO: 13638 - protein, 10 aa, Dengue virus
DEVFRKRNLT

SEQ ID NO: 13639 - protein, 10 aa, Dengue virus
EVFRKRNLTI

SEQ ID NO: 13640 - protein, 10 aa, Dengue virus
VFRKRNLTIM

SEQ ID NO: 13641 - protein, 10 aa, Dengue virus
FRKRNLTIMD

SEQ ID NO: 13642 - protein, 10 aa, Dengue virus
RKRNLTIMDL

SEQ ID NO: 13643 - protein, 10 aa, Dengue virus
KRNLTIMDLH

SEQ ID NO: 13644 - protein, 10 aa, Dengue virus
RNLTIMDLHP

SEQ ID NO: 13645 - protein, 10 aa, Dengue virus
NLTIMDLHPG

SEQ ID NO: 13646 - protein, 10 aa, Dengue virus
LTIMDLHPGS

SEQ ID NO: 13647 - protein, 10 aa, Dengue virus
TIMDLHPGSG

SEQ ID NO: 13648 - protein, 10 aa, Dengue virus
IMDLHPGSGK

SEQ ID NO: 13649 - protein, 10 aa, Dengue virus
MDLHPGSGKT

SEQ ID NO: 13650 - protein, 10 aa, Dengue virus
DLHPGSGKTR

SEQ ID NO: 13651 - protein, 10 aa, Dengue virus
LHPGSGKTRR

SEQ ID NO: 13652 - protein, 10 aa, Dengue virus
HPGSGKTRRY

SEQ ID NO: 13653 - protein, 10 aa, Dengue virus
PGSGKTRRYL

SEQ ID NO: 13654 - protein, 10 aa, Dengue virus
GSGKTRRYLP

SEQ ID NO: 13655 - protein, 10 aa, Dengue virus
SGKTRRYLPA

SEQ ID NO: 13656 - protein, 10 aa, Dengue virus
GKTRRYLPAI

SEQ ID NO: 13657 - protein, 10 aa, Dengue virus
KTRRYLPAIV

SEQ ID NO: 13658 - protein, 10 aa, Dengue virus
TRRYLPAIVR

SEQ ID NO: 13659 - protein, 10 aa, Dengue virus
RRYLPAIVRE

SEQ ID NO: 13660 - protein, 10 aa, Dengue virus
RYLPAIVREA

SEQ ID NO: 13661 - protein, 10 aa, Dengue virus
YLPAIVREAI

SEQ ID NO: 13662 - protein, 10 aa, Dengue virus
LPAIVREAIK

SEQ ID NO: 13663 - protein, 10 aa, Dengue virus
PAIVREAIKR

SEQ ID NO: 13664 - protein, 10 aa, Dengue virus
AIVREAIKRK

SEQ ID NO: 13665 - protein, 10 aa, Dengue virus
VREAIKRKLR

SEQ ID NO: 13666 - protein, 10 aa, Dengue virus
REAIKRKLRT

SEQ ID NO: 13667 - protein, 10 aa, Dengue virus
EAIKRKLRTL

SEQ ID NO: 13668 - protein, 10 aa, Dengue virus
IKRKLRTLIL

SEQ ID NO: 13669 - protein, 10 aa, Dengue virus
KRKLRTLILA

SEQ ID NO: 13670 - protein, 10 aa, Dengue virus
RKLRTLILAP

SEQ ID NO: 13671 - protein, 10 aa, Dengue virus
KLRTLILAPT

SEQ ID NO: 13672 - protein, 10 aa, Dengue virus
LRTLILAPTR

SEQ ID NO: 13673 - protein, 10 aa, Dengue virus
RTLILAPTRV

SEQ ID NO: 13674 - protein, 10 aa, Dengue virus
TLILAPTRVV

SEQ ID NO: 13675 - protein, 10 aa, Dengue virus
LILAPTRVVA

SEQ ID NO: 13676 - protein, 10 aa, Dengue virus
ILAPTRVVAS

SEQ ID NO: 13677 - protein, 10 aa, Dengue virus
LAPTRVVASE

SEQ ID NO: 13678 - protein, 10 aa, Dengue virus
APTRVVASEM

SEQ ID NO: 13679 - protein, 10 aa, Dengue virus
PTRVVASEMA

SEQ ID NO: 13680 - protein, 10 aa, Dengue virus
TRVVASEMAE

SEQ ID NO: 13681 - protein, 10 aa, Dengue virus
RVVASEMAEA

SEQ ID NO: 13682 - protein, 10 aa, Dengue virus
VVASEMAEAL

SEQ ID NO: 13683 - protein, 10 aa, Dengue virus
VASEMAEALK

SEQ ID NO: 13684 - protein, 10 aa, Dengue virus
ASEMAEALKG

SEQ ID NO: 13685 - protein, 10 aa, Dengue virus
SEMAEALKGM

SEQ ID NO: 13686 - protein, 10 aa, Dengue virus
EMAEALKGMP

SEQ ID NO: 13687 - protein, 10 aa, Dengue virus
MAEALKGMPI

SEQ ID NO: 13688 - protein, 10 aa, Dengue virus
AEALKGMPIR

SEQ ID NO: 13689 - protein, 10 aa, Dengue virus
EALKGMPIRY

SEQ ID NO: 13690 - protein, 10 aa, Dengue virus
ALKGMPIRYQ

SEQ ID NO: 13691 - protein, 10 aa, Dengue virus
LKGMPIRYQT

SEQ ID NO: 13692 - protein, 10 aa, Dengue virus
KGMPIRYQTT

SEQ ID NO: 13693 - protein, 10 aa, Dengue virus
GMPIRYQTTA

SEQ ID NO: 13694 - protein, 10 aa, Dengue virus
MPIRYQTTAV

SEQ ID NO: 13695 - protein, 10 aa, Dengue virus
PIRYQTTAVK

SEQ ID NO: 13696 - protein, 10 aa, Dengue virus
IRYQTTAVKS

SEQ ID NO: 13697 - protein, 10 aa, Dengue virus
RYQTTAVKSE

SEQ ID NO: 13698 - protein, 10 aa, Dengue virus
YQTTAVKSEH

SEQ ID NO: 13699 - protein, 10 aa, Dengue virus
QTTAVKSEHT

SEQ ID NO: 13700 - protein, 10 aa, Dengue virus
TTAVKSEHTG

SEQ ID NO: 13701 - protein, 10 aa, Dengue virus
TAVKSEHTGK

SEQ ID NO: 13702 - protein, 10 aa, Dengue virus
AVKSEHTGKE

SEQ ID NO: 13703 - protein, 10 aa, Dengue virus
VKSEHTGKEI

SEQ ID NO: 13704 - protein, 10 aa, Dengue virus
KSEHTGKEIV

SEQ ID NO: 13705 - protein, 10 aa, Dengue virus
SEHTGKEIVD

SEQ ID NO: 13706 - protein, 10 aa, Dengue virus
EHTGKEIVDL

SEQ ID NO: 13707 - protein, 10 aa, Dengue virus
HTGKEIVDLM

SEQ ID NO: 13708 - protein, 10 aa, Dengue virus
TGKEIVDLMC

SEQ ID NO: 13709 - protein, 10 aa, Dengue virus
GKEIVDLMCH

SEQ ID NO: 13710 - protein, 10 aa, Dengue virus
KEIVDLMCHA

SEQ ID NO: 13711 - protein, 10 aa, Dengue virus
EIVDLMCHAT

SEQ ID NO: 13712 - protein, 10 aa, Dengue virus
IVDLMCHATF

SEQ ID NO: 13713 - protein, 10 aa, Dengue virus
VDLMCHATFT

SEQ ID NO: 13714 - protein, 10 aa, Dengue virus
DLMCHATFTM

SEQ ID NO: 13715 - protein, 10 aa, Dengue virus
LMCHATFTMR

SEQ ID NO: 13716 - protein, 10 aa, Dengue virus
MCHATFTMRL

SEQ ID NO: 13717 - protein, 10 aa, Dengue virus
CHATFTMRLL

SEQ ID NO: 13718 - protein, 10 aa, Dengue virus
HATFTMRLLS

SEQ ID NO: 13719 - protein, 10 aa, Dengue virus
ATFTMRLLSP

SEQ ID NO: 13720 - protein, 10 aa, Dengue virus
TFTMRLLSPV

SEQ ID NO: 13721 - protein, 10 aa, Dengue virus
FTMRLLSPVR

SEQ ID NO: 13722 - protein, 10 aa, Dengue virus
TMRLLSPVRV

SEQ ID NO: 13723 - protein, 10 aa, Dengue virus
MRLLSPVRVP

SEQ ID NO: 13724 - protein, 10 aa, Dengue virus
RLLSPVRVPN

SEQ ID NO: 13725 - protein, 10 aa, Dengue virus
LLSPVRVPNY

SEQ ID NO: 13726 - protein, 10 aa, Dengue virus
LSPVRVPNYN

SEQ ID NO: 13727 - protein, 10 aa, Dengue virus
SPVRVPNYNM

SEQ ID NO: 13728 - protein, 10 aa, Dengue virus
PVRVPNYNMI

SEQ ID NO: 13729 - protein, 10 aa, Dengue virus
VRVPNYNMII

SEQ ID NO: 13730 - protein, 10 aa, Dengue virus
RVPNYNMIIM

SEQ ID NO: 13731 - protein, 10 aa, Dengue virus
VPNYNMIIMD

SEQ ID NO: 13732 - protein, 10 aa, Dengue virus
PNYNMIIMDE

SEQ ID NO: 13733 - protein, 10 aa, Dengue virus
NYNMIIMDEA

SEQ ID NO: 13734 - protein, 10 aa, Dengue virus
YNMIIMDEAH

SEQ ID NO: 13735 - protein, 10 aa, Dengue virus
NMIIMDEAHF

SEQ ID NO: 13736 - protein, 10 aa, Dengue virus
MIIMDEAHFT

SEQ ID NO: 13737 - protein, 10 aa, Dengue virus
IIMDEAHFTD

SEQ ID NO: 13738 - protein, 10 aa, Dengue virus
IMDEAHFTDP

SEQ ID NO: 13739 - protein, 10 aa, Dengue virus
MDEAHFTDPS

SEQ ID NO: 13740 - protein, 10 aa, Dengue virus
DEAHFTDPSS

SEQ ID NO: 13741 - protein, 10 aa, Dengue virus
EAHFTDPSSI

SEQ ID NO: 13742 - protein, 10 aa, Dengue virus
AHFTDPSSIA

SEQ ID NO: 13743 - protein, 10 aa, Dengue virus
HFTDPSSIAA

SEQ ID NO: 13744 - protein, 10 aa, Dengue virus
FTDPSSIAAR

SEQ ID NO: 13745 - protein, 10 aa, Dengue virus
TDPSSIAARG

SEQ ID NO: 13746 - protein, 10 aa, Dengue virus
DPSSIAARGY

SEQ ID NO: 13747 - protein, 10 aa, Dengue virus
PSSIAARGYI

SEQ ID NO: 13748 - protein, 10 aa, Dengue virus
SSIAARGYIS

SEQ ID NO: 13749 - protein, 10 aa, Dengue virus
SIAARGYIST

SEQ ID NO: 13750 - protein, 10 aa, Dengue virus
IAARGYISTR

SEQ ID NO: 13751 - protein, 10 aa, Dengue virus
AARGYISTRV

SEQ ID NO: 13752 - protein, 10 aa, Dengue virus
ARGYISTRVG

SEQ ID NO: 13753 - protein, 10 aa, Dengue virus
RGYISTRVGM

SEQ ID NO: 13754 - protein, 10 aa, Dengue virus
GYISTRVGMG

SEQ ID NO: 13755 - protein, 10 aa, Dengue virus
YISTRVGMGE

SEQ ID NO: 13756 - protein, 10 aa, Dengue virus
ISTRVGMGEA

SEQ ID NO: 13757 - protein, 10 aa, Dengue virus
STRVGMGEAA

SEQ ID NO: 13758 - protein, 10 aa, Dengue virus
TRVGMGEAAA

SEQ ID NO: 13759 - protein, 10 aa, Dengue virus
RVGMGEAAAI

SEQ ID NO: 13760 - protein, 10 aa, Dengue virus
VGMGEAAAIF

SEQ ID NO: 13761 - protein, 10 aa, Dengue virus
GMGEAAAIFM

SEQ ID NO: 13762 - protein, 10 aa, Dengue virus
MGEAAAIFMT

SEQ ID NO: 13763 - protein, 10 aa, Dengue virus
GEAAAIFMTA

SEQ ID NO: 13764 - protein, 10 aa, Dengue virus
EAAAIFMTAT

SEQ ID NO: 13765 - protein, 10 aa, Dengue virus
AAAIFMTATP

SEQ ID NO: 13766 - protein, 10 aa, Dengue virus
AAIFMTATPP

SEQ ID NO: 13767 - protein, 10 aa, Dengue virus
AIFMTATPPG

SEQ ID NO: 13768 - protein, 10 aa, Dengue virus
IFMTATPPGS

SEQ ID NO: 13769 - protein, 10 aa, Dengue virus
FMTATPPGSV

SEQ ID NO: 13770 - protein, 10 aa, Dengue virus
MTATPPGSVE

SEQ ID NO: 13771 - protein, 10 aa, Dengue virus
TATPPGSVEA

SEQ ID NO: 13772 - protein, 10 aa, Dengue virus
ATPPGSVEAF

SEQ ID NO: 13773 - protein, 10 aa, Dengue virus
TPPGSVEAFP

SEQ ID NO: 13774 - protein, 10 aa, Dengue virus
PPGSVEAFPQ

SEQ ID NO: 13775 - protein, 10 aa, Dengue virus
PGSVEAFPQS

SEQ ID NO: 13776 - protein, 10 aa, Dengue virus
GSVEAFPQSN

SEQ ID NO: 13777 - protein, 10 aa, Dengue virus
SVEAFPQSNA

SEQ ID NO: 13778 - protein, 10 aa, Dengue virus
VEAFPQSNAV

SEQ ID NO: 13779 - protein, 10 aa, Dengue virus
EAFPQSNAVI

SEQ ID NO: 13780 - protein, 10 aa, Dengue virus
AFPQSNAVIQ

SEQ ID NO: 13781 - protein, 10 aa, Dengue virus
FPQSNAVIQD

SEQ ID NO: 13782 - protein, 10 aa, Dengue virus
PQSNAVIQDE

SEQ ID NO: 13783 - protein, 10 aa, Dengue virus
QSNAVIQDEE

SEQ ID NO: 13784 - protein, 10 aa, Dengue virus
SNAVIQDEER

SEQ ID NO: 13785 - protein, 10 aa, Dengue virus
NAVIQDEERD

SEQ ID NO: 13786 - protein, 10 aa, Dengue virus
AVIQDEERDI

SEQ ID NO: 13787 - protein, 10 aa, Dengue virus
VIQDEERDIP

SEQ ID NO: 13788 - protein, 10 aa, Dengue virus
IQDEERDIPE

SEQ ID NO: 13789 - protein, 10 aa, Dengue virus
QDEERDIPER

SEQ ID NO: 13790 - protein, 10 aa, Dengue virus
DEERDIPERS

SEQ ID NO: 13791 - protein, 10 aa, Dengue virus
EERDIPERSW

SEQ ID NO: 13792 - protein, 10 aa, Dengue virus
ERDIPERSWN

SEQ ID NO: 13793 - protein, 10 aa, Dengue virus
RDIPERSWNS

SEQ ID NO: 13794 - protein, 10 aa, Dengue virus
DIPERSWNSG

SEQ ID NO: 13795 - protein, 10 aa, Dengue virus
IPERSWNSGY

SEQ ID NO: 13796 - protein, 10 aa, Dengue virus
PERSWNSGYE

SEQ ID NO: 13797 - protein, 10 aa, Dengue virus
ERSWNSGYEW

SEQ ID NO: 13798 - protein, 10 aa, Dengue virus
RSWNSGYEWI

SEQ ID NO: 13799 - protein, 10 aa, Dengue virus
SWNSGYEWIT

SEQ ID NO: 13800 - protein, 10 aa, Dengue virus
WNSGYEWITD

SEQ ID NO: 13801 - protein, 10 aa, Dengue virus
NSGYEWITDF

SEQ ID NO: 13802 - protein, 10 aa, Dengue virus
SGYEWITDFP

SEQ ID NO: 13803 - protein, 10 aa, Dengue virus
GYEWITDFPG

SEQ ID NO: 13804 - protein, 10 aa, Dengue virus
YEWITDFPGK

SEQ ID NO: 13805 - protein, 10 aa, Dengue virus
EWITDFPGKT

SEQ ID NO: 13806 - protein, 10 aa, Dengue virus
WITDFPGKTV

SEQ ID NO: 13807 - protein, 10 aa, Dengue virus
ITDFPGKTVW

SEQ ID NO: 13808 - protein, 10 aa, Dengue virus
TDFPGKTVWF

SEQ ID NO: 13809 - protein, 10 aa, Dengue virus
DFPGKTVWFV

SEQ ID NO: 13810 - protein, 10 aa, Dengue virus
FPGKTVWFVP

SEQ ID NO: 13811 - protein, 10 aa, Dengue virus
PGKTVWFVPS

SEQ ID NO: 13812 - protein, 10 aa, Dengue virus
GKTVWFVPSI

SEQ ID NO: 13813 - protein, 10 aa, Dengue virus
KTVWFVPSIK

SEQ ID NO: 13814 - protein, 10 aa, Dengue virus
TVWFVPSIKS

SEQ ID NO: 13815 - protein, 10 aa, Dengue virus
VWFVPSIKSG

SEQ ID NO: 13816 - protein, 10 aa, Dengue virus
WFVPSIKSGN

SEQ ID NO: 13817 - protein, 10 aa, Dengue virus
FVPSIKSGND

SEQ ID NO: 13818 - protein, 10 aa, Dengue virus
VPSIKSGNDI

SEQ ID NO: 13819 - protein, 10 aa, Dengue virus
PSIKSGNDIA

SEQ ID NO: 13820 - protein, 10 aa, Dengue virus
SIKSGNDIAN

SEQ ID NO: 13821 - protein, 10 aa, Dengue virus
IKSGNDIANC

SEQ ID NO: 13822 - protein, 10 aa, Dengue virus
KSGNDIANCL

SEQ ID NO: 13823 - protein, 10 aa, Dengue virus
SGNDIANCLR

SEQ ID NO: 13824 - protein, 10 aa, Dengue virus
GNDIANCLRK

SEQ ID NO: 13825 - protein, 10 aa, Dengue virus
NDIANCLRKN

SEQ ID NO: 13826 - protein, 10 aa, Dengue virus
DIANCLRKNG

SEQ ID NO: 13827 - protein, 10 aa, Dengue virus
IANCLRKNGK

SEQ ID NO: 13828 - protein, 10 aa, Dengue virus
ANCLRKNGKR

SEQ ID NO: 13829 - protein, 10 aa, Dengue virus
NCLRKNGKRV

SEQ ID NO: 13830 - protein, 10 aa, Dengue virus
CLRKNGKRVI

SEQ ID NO: 13831 - protein, 10 aa, Dengue virus
LRKNGKRVIQ

SEQ ID NO: 13832 - protein, 10 aa, Dengue virus
RKNGKRVIQL

SEQ ID NO: 13833 - protein, 10 aa, Dengue virus
KNGKRVIQLS

SEQ ID NO: 13834 - protein, 10 aa, Dengue virus
NGKRVIQLSR

SEQ ID NO: 13835 - protein, 10 aa, Dengue virus
GKRVIQLSRK

SEQ ID NO: 13836 - protein, 10 aa, Dengue virus
KRVIQLSRKT

SEQ ID NO: 13837 - protein, 10 aa, Dengue virus
RVIQLSRKTF

SEQ ID NO: 13838 - protein, 10 aa, Dengue virus
VIQLSRKTFD

SEQ ID NO: 13839 - protein, 10 aa, Dengue virus
IQLSRKTFDT

SEQ ID NO: 13840 - protein, 10 aa, Dengue virus
QLSRKTFDTE

SEQ ID NO: 13841 - protein, 10 aa, Dengue virus
LSRKTFDTEY

SEQ ID NO: 13842 - protein, 10 aa, Dengue virus
SRKTFDTEYQ

SEQ ID NO: 13843 - protein, 10 aa, Dengue virus
RKTFDTEYQK

SEQ ID NO: 13844 - protein, 10 aa, Dengue virus
KTFDTEYQKT

SEQ ID NO: 13845 - protein, 10 aa, Dengue virus
TFDTEYQKTK

SEQ ID NO: 13846 - protein, 10 aa, Dengue virus
FDTEYQKTKN

SEQ ID NO: 13847 - protein, 10 aa, Dengue virus
DTEYQKTKNN

SEQ ID NO: 13848 - protein, 10 aa, Dengue virus
TEYQKTKNND

SEQ ID NO: 13849 - protein, 10 aa, Dengue virus
EYQKTKNNDW

SEQ ID NO: 13850 - protein, 10 aa, Dengue virus
YQKTKNNDWD

SEQ ID NO: 13851 - protein, 10 aa, Dengue virus
QKTKNNDWDY

SEQ ID NO: 13852 - protein, 10 aa, Dengue virus
KTKNNDWDYV

SEQ ID NO: 13853 - protein, 10 aa, Dengue virus
TKNNDWDYVV

SEQ ID NO: 13854 - protein, 10 aa, Dengue virus
KNNDWDYVVT

SEQ ID NO: 13855 - protein, 10 aa, Dengue virus
NNDWDYVVTT

SEQ ID NO: 13856 - protein, 10 aa, Dengue virus
NDWDYVVTTD

SEQ ID NO: 13857 - protein, 10 aa, Dengue virus
DWDYVVTTDI

SEQ ID NO: 13858 - protein, 10 aa, Dengue virus
WDYVVTTDIS

SEQ ID NO: 13859 - protein, 10 aa, Dengue virus
DYVVTTDISE

SEQ ID NO: 13860 - protein, 10 aa, Dengue virus
YVVTTDISEM

SEQ ID NO: 13861 - protein, 10 aa, Dengue virus
VVTTDISEMG

SEQ ID NO: 13862 - protein, 10 aa, Dengue virus
VTTDISEMGA

SEQ ID NO: 13863 - protein, 10 aa, Dengue virus
TTDISEMGAN

SEQ ID NO: 13864 - protein, 10 aa, Dengue virus
TDISEMGANF

SEQ ID NO: 13865 - protein, 10 aa, Dengue virus
DISEMGANFR

SEQ ID NO: 13866 - protein, 10 aa, Dengue virus
ISEMGANFRA

SEQ ID NO: 13867 - protein, 10 aa, Dengue virus
SEMGANFRAD

SEQ ID NO: 13868 - protein, 10 aa, Dengue virus
EMGANFRADR

SEQ ID NO: 13869 - protein, 10 aa, Dengue virus
MGANFRADRV

SEQ ID NO: 13870 - protein, 10 aa, Dengue virus
GANFRADRVI

SEQ ID NO: 13871 - protein, 10 aa, Dengue virus
ANFRADRVID

SEQ ID NO: 13872 - protein, 10 aa, Dengue virus
NFRADRVIDP

SEQ ID NO: 13873 - protein, 10 aa, Dengue virus
FRADRVIDPR

SEQ ID NO: 13874 - protein, 10 aa, Dengue virus
RADRVIDPRR

SEQ ID NO: 13875 - protein, 10 aa, Dengue virus
ADRVIDPRRC

SEQ ID NO: 13876 - protein, 10 aa, Dengue virus
DRVIDPRRCL

SEQ ID NO: 13877 - protein, 10 aa, Dengue virus
RVIDPRRCLK

SEQ ID NO: 13878 - protein, 10 aa, Dengue virus
VIDPRRCLKP

SEQ ID NO: 13879 - protein, 10 aa, Dengue virus
IDPRRCLKPV

SEQ ID NO: 13880 - protein, 10 aa, Dengue virus
DPRRCLKPVI

SEQ ID NO: 13881 - protein, 10 aa, Dengue virus
PRRCLKPVIL

SEQ ID NO: 13882 - protein, 10 aa, Dengue virus
RRCLKPVILK

SEQ ID NO: 13883 - protein, 10 aa, Dengue virus
RCLKPVILKD

SEQ ID NO: 13884 - protein, 10 aa, Dengue virus
CLKPVILKDG

SEQ ID NO: 13885 - protein, 10 aa, Dengue virus
LKPVILKDGP

SEQ ID NO: 13886 - protein, 10 aa, Dengue virus
KPVILKDGPE

SEQ ID NO: 13887 - protein, 10 aa, Dengue virus
PVILKDGPER

SEQ ID NO: 13888 - protein, 10 aa, Dengue virus
VILKDGPERV

SEQ ID NO: 13889 - protein, 10 aa, Dengue virus
ILKDGPERVI

SEQ ID NO: 13890 - protein, 10 aa, Dengue virus
LKDGPERVIL

SEQ ID NO: 13891 - protein, 10 aa, Dengue virus
KDGPERVILA

SEQ ID NO: 13892 - protein, 10 aa, Dengue virus
DGPERVILAG

SEQ ID NO: 13893 - protein, 10 aa, Dengue virus
GPERVILAGP

SEQ ID NO: 13894 - protein, 10 aa, Dengue virus
PERVILAGPM

SEQ ID NO: 13895 - protein, 10 aa, Dengue virus
ERVILAGPMP

SEQ ID NO: 13896 - protein, 10 aa, Dengue virus
RVILAGPMPV

SEQ ID NO: 13897 - protein, 10 aa, Dengue virus
VILAGPMPVT

SEQ ID NO: 13898 - protein, 10 aa, Dengue virus
ILAGPMPVTV

SEQ ID NO: 13899 - protein, 10 aa, Dengue virus
LAGPMPVTVA

SEQ ID NO: 13900 - protein, 10 aa, Dengue virus
AGPMPVTVAS

SEQ ID NO: 13901 - protein, 10 aa, Dengue virus
GPMPVTVASA

SEQ ID NO: 13902 - protein, 10 aa, Dengue virus
PMPVTVASAA

SEQ ID NO: 13903 - protein, 10 aa, Dengue virus
MPVTVASAAQ

SEQ ID NO: 13904 - protein, 10 aa, Dengue virus
PVTVASAAQR

SEQ ID NO: 13905 - protein, 10 aa, Dengue virus
VTVASAAQRR

SEQ ID NO: 13906 - protein, 10 aa, Dengue virus
TVASAAQRRG

SEQ ID NO: 13907 - protein, 10 aa, Dengue virus
VASAAQRRGR

SEQ ID NO: 13908 - protein, 10 aa, Dengue virus
ASAAQRRGRI

SEQ ID NO: 13909 - protein, 10 aa, Dengue virus
SAAQRRGRIG

SEQ ID NO: 13910 - protein, 10 aa, Dengue virus
AAQRRGRIGR

SEQ ID NO: 13911 - protein, 10 aa, Dengue virus
AQRRGRIGRN

SEQ ID NO: 13912 - protein, 10 aa, Dengue virus
QRRGRIGRNH

SEQ ID NO: 13913 - protein, 10 aa, Dengue virus
RRGRIGRNHN

SEQ ID NO: 13914 - protein, 10 aa, Dengue virus
RGRIGRNHNK

SEQ ID NO: 13915 - protein, 10 aa, Dengue virus
GRIGRNHNKE

SEQ ID NO: 13916 - protein, 10 aa, Dengue virus
RIGRNHNKEG

SEQ ID NO: 13917 - protein, 10 aa, Dengue virus
IGRNHNKEGD

SEQ ID NO: 13918 - protein, 10 aa, Dengue virus
GRNHNKEGDQ

SEQ ID NO: 13919 - protein, 10 aa, Dengue virus
RNHNKEGDQY

SEQ ID NO: 13920 - protein, 10 aa, Dengue virus
NHNKEGDQYI

SEQ ID NO: 13921 - protein, 10 aa, Dengue virus
HNKEGDQYIY

SEQ ID NO: 13922 - protein, 10 aa, Dengue virus
NKEGDQYIYM

SEQ ID NO: 13923 - protein, 10 aa, Dengue virus
KEGDQYIYMG

SEQ ID NO: 13924 - protein, 10 aa, Dengue virus
EGDQYIYMGQ

SEQ ID NO: 13925 - protein, 10 aa, Dengue virus
GDQYIYMGQP

SEQ ID NO: 13926 - protein, 10 aa, Dengue virus
DQYIYMGQPL

SEQ ID NO: 13927 - protein, 10 aa, Dengue virus
QYIYMGQPLN

SEQ ID NO: 13928 - protein, 10 aa, Dengue virus
YIYMGQPLNN

SEQ ID NO: 13929 - protein, 10 aa, Dengue virus
IYMGQPLNND

SEQ ID NO: 13930 - protein, 10 aa, Dengue virus
YMGQPLNNDE

SEQ ID NO: 13931 - protein, 10 aa, Dengue virus
MGQPLNNDED

SEQ ID NO: 13932 - protein, 10 aa, Dengue virus
GQPLNNDEDH

SEQ ID NO: 13933 - protein, 10 aa, Dengue virus
QPLNNDEDHA

SEQ ID NO: 13934 - protein, 10 aa, Dengue virus
PLNNDEDHAH

SEQ ID NO: 13935 - protein, 10 aa, Dengue virus
LNNDEDHAHW

SEQ ID NO: 13936 - protein, 10 aa, Dengue virus
NNDEDHAHWT

SEQ ID NO: 13937 - protein, 10 aa, Dengue virus
NDEDHAHWTE

SEQ ID NO: 13938 - protein, 10 aa, Dengue virus
DEDHAHWTEA

SEQ ID NO: 13939 - protein, 10 aa, Dengue virus
EDHAHWTEAK

SEQ ID NO: 13940 - protein, 10 aa, Dengue virus
DHAHWTEAKM

SEQ ID NO: 13941 - protein, 10 aa, Dengue virus
HAHWTEAKML

SEQ ID NO: 13942 - protein, 10 aa, Dengue virus
AHWTEAKMLL

SEQ ID NO: 13943 - protein, 10 aa, Dengue virus
HWTEAKMLLD

SEQ ID NO: 13944 - protein, 10 aa, Dengue virus
WTEAKMLLDN

SEQ ID NO: 13945 - protein, 10 aa, Dengue virus
TEAKMLLDNI

SEQ ID NO: 13946 - protein, 10 aa, Dengue virus
EAKMLLDNIN

SEQ ID NO: 13947 - protein, 10 aa, Dengue virus
AKMLLDNINT

SEQ ID NO: 13948 - protein, 10 aa, Dengue virus
KMLLDNINTP

SEQ ID NO: 13949 - protein, 10 aa, Dengue virus
MLLDNINTPE

SEQ ID NO: 13950 - protein, 10 aa, Dengue virus
LLDNINTPEG

SEQ ID NO: 13951 - protein, 10 aa, Dengue virus
LDNINTPEGI

SEQ ID NO: 13952 - protein, 10 aa, Dengue virus
DNINTPEGII

SEQ ID NO: 13953 - protein, 10 aa, Dengue virus
NINTPEGIIP

SEQ ID NO: 13954 - protein, 10 aa, Dengue virus
INTPEGIIPA

SEQ ID NO: 13955 - protein, 10 aa, Dengue virus
NTPEGIIPAL

SEQ ID NO: 13956 - protein, 10 aa, Dengue virus
TPEGIIPALF

SEQ ID NO: 13957 - protein, 10 aa, Dengue virus
PEGIIPALFE

SEQ ID NO: 13958 - protein, 10 aa, Dengue virus
EGIIPALFEP

SEQ ID NO: 13959 - protein, 10 aa, Dengue virus
GIIPALFEPE

SEQ ID NO: 13960 - protein, 10 aa, Dengue virus
IIPALFEPER

SEQ ID NO: 13961 - protein, 10 aa, Dengue virus
IPALFEPERE

SEQ ID NO: 13962 - protein, 10 aa, Dengue virus
PALFEPEREK

SEQ ID NO: 13963 - protein, 10 aa, Dengue virus
ALFEPEREKS

SEQ ID NO: 13964 - protein, 10 aa, Dengue virus
LFEPEREKSA

SEQ ID NO: 13965 - protein, 10 aa, Dengue virus
FEPEREKSAA

SEQ ID NO: 13966 - protein, 10 aa, Dengue virus
EPEREKSAAI

SEQ ID NO: 13967 - protein, 10 aa, Dengue virus
PEREKSAAID

SEQ ID NO: 13968 - protein, 10 aa, Dengue virus
EREKSAAIDG

SEQ ID NO: 13969 - protein, 10 aa, Dengue virus
REKSAAIDGE

SEQ ID NO: 13970 - protein, 10 aa, Dengue virus
EKSAAIDGEY

SEQ ID NO: 13971 - protein, 10 aa, Dengue virus
KSAAIDGEYR

SEQ ID NO: 13972 - protein, 10 aa, Dengue virus
SAAIDGEYRL

SEQ ID NO: 13973 - protein, 10 aa, Dengue virus
AAIDGEYRLR

SEQ ID NO: 13974 - protein, 10 aa, Dengue virus
AIDGEYRLRG

SEQ ID NO: 13975 - protein, 10 aa, Dengue virus
IDGEYRLRGE

SEQ ID NO: 13976 - protein, 10 aa, Dengue virus
DGEYRLRGEA

SEQ ID NO: 13977 - protein, 10 aa, Dengue virus
GEYRLRGEAR

SEQ ID NO: 13978 - protein, 10 aa, Dengue virus
EYRLRGEARK

SEQ ID NO: 13979 - protein, 10 aa, Dengue virus
YRLRGEARKT

SEQ ID NO: 13980 - protein, 10 aa, Dengue virus
RLRGEARKTF

SEQ ID NO: 13981 - protein, 10 aa, Dengue virus
LRGEARKTFV

SEQ ID NO: 13982 - protein, 10 aa, Dengue virus
RGEARKTFVE

SEQ ID NO: 13983 - protein, 10 aa, Dengue virus
GEARKTFVEL

SEQ ID NO: 13984 - protein, 10 aa, Dengue virus
EARKTFVELM

SEQ ID NO: 13985 - protein, 10 aa, Dengue virus
ARKTFVELMR

SEQ ID NO: 13986 - protein, 10 aa, Dengue virus
RKTFVELMRR

SEQ ID NO: 13987 - protein, 10 aa, Dengue virus
KTFVELMRRG

SEQ ID NO: 13988 - protein, 10 aa, Dengue virus
TFVELMRRGD

SEQ ID NO: 13989 - protein, 10 aa, Dengue virus
FVELMRRGDL

SEQ ID NO: 13990 - protein, 10 aa, Dengue virus
VELMRRGDLP

SEQ ID NO: 13991 - protein, 10 aa, Dengue virus
ELMRRGDLPV

SEQ ID NO: 13992 - protein, 10 aa, Dengue virus
LMRRGDLPVW

SEQ ID NO: 13993 - protein, 10 aa, Dengue virus
MRRGDLPVWL

SEQ ID NO: 13994 - protein, 10 aa, Dengue virus
RRGDLPVWLS

SEQ ID NO: 13995 - protein, 10 aa, Dengue virus
RGDLPVWLSY

SEQ ID NO: 13996 - protein, 10 aa, Dengue virus
GDLPVWLSYK

SEQ ID NO: 13997 - protein, 10 aa, Dengue virus
DLPVWLSYKV

SEQ ID NO: 13998 - protein, 10 aa, Dengue virus
LPVWLSYKVA

SEQ ID NO: 13999 - protein, 10 aa, Dengue virus
PVWLSYKVAS

SEQ ID NO: 14000 - protein, 10 aa, Dengue virus
VWLSYKVASE

SEQ ID NO: 14001 - protein, 10 aa, Dengue virus
WLSYKVASEG

SEQ ID NO: 14002 - protein, 10 aa, Dengue virus
LSYKVASEGF

SEQ ID NO: 14003 - protein, 10 aa, Dengue virus
SYKVASEGFQ

SEQ ID NO: 14004 - protein, 10 aa, Dengue virus
YKVASEGFQY

SEQ ID NO: 14005 - protein, 10 aa, Dengue virus
KVASEGFQYS

SEQ ID NO: 14006 - protein, 10 aa, Dengue virus
VASEGFQYSD

SEQ ID NO: 14007 - protein, 10 aa, Dengue virus
ASEGFQYSDR

SEQ ID NO: 14008 - protein, 10 aa, Dengue virus
SEGFQYSDRR

SEQ ID NO: 14009 - protein, 10 aa, Dengue virus
EGFQYSDRRW

SEQ ID NO: 14010 - protein, 10 aa, Dengue virus
GFQYSDRRWC

SEQ ID NO: 14011 - protein, 10 aa, Dengue virus
FQYSDRRWCF

SEQ ID NO: 14012 - protein, 10 aa, Dengue virus
QYSDRRWCFD

SEQ ID NO: 14013 - protein, 10 aa, Dengue virus
YSDRRWCFDG

SEQ ID NO: 14014 - protein, 10 aa, Dengue virus
SDRRWCFDGE

SEQ ID NO: 14015 - protein, 10 aa, Dengue virus
DRRWCFDGER

SEQ ID NO: 14016 - protein, 10 aa, Dengue virus
RRWCFDGERN

SEQ ID NO: 14017 - protein, 10 aa, Dengue virus
RWCFDGERNN

SEQ ID NO: 14018 - protein, 10 aa, Dengue virus
WCFDGERNNQ

SEQ ID NO: 14019 - protein, 10 aa, Dengue virus
CFDGERNNQV

SEQ ID NO: 14020 - protein, 10 aa, Dengue virus
FDGERNNQVL

SEQ ID NO: 14021 - protein, 10 aa, Dengue virus
DGERNNQVLE

SEQ ID NO: 14022 - protein, 10 aa, Dengue virus
GERNNQVLEE

SEQ ID NO: 14023 - protein, 10 aa, Dengue virus
ERNNQVLEEN

SEQ ID NO: 14024 - protein, 10 aa, Dengue virus
RNNQVLEENM

SEQ ID NO: 14025 - protein, 10 aa, Dengue virus
NNQVLEENMD

SEQ ID NO: 14026 - protein, 10 aa, Dengue virus
NQVLEENMDV

SEQ ID NO: 14027 - protein, 10 aa, Dengue virus
QVLEENMDVE

SEQ ID NO: 14028 - protein, 10 aa, Dengue virus
VLEENMDVEI

SEQ ID NO: 14029 - protein, 10 aa, Dengue virus
LEENMDVEIW

SEQ ID NO: 14030 - protein, 10 aa, Dengue virus
EENMDVEIWT

SEQ ID NO: 14031 - protein, 10 aa, Dengue virus
ENMDVEIWTK

SEQ ID NO: 14032 - protein, 10 aa, Dengue virus
NMDVEIWTKE

SEQ ID NO: 14033 - protein, 10 aa, Dengue virus
MDVEIWTKEG

SEQ ID NO: 14034 - protein, 10 aa, Dengue virus
ERKKLRPRWL

SEQ ID NO: 14035 - protein, 10 aa, Dengue virus
RKKLRPRWLD

SEQ ID NO: 14036 - protein, 10 aa, Dengue virus
KKLRPRWLDA

SEQ ID NO: 14037 - protein, 10 aa, Dengue virus
KLRPRWLDAR

SEQ ID NO: 14038 - protein, 10 aa, Dengue virus
LRPRWLDART

SEQ ID NO: 14039 - protein, 10 aa, Dengue virus
RPRWLDARTY

SEQ ID NO: 14040 - protein, 10 aa, Dengue virus
PRWLDARTYS

SEQ ID NO: 14041 - protein, 10 aa, Dengue virus
RWLDARTYSD

SEQ ID NO: 14042 - protein, 10 aa, Dengue virus
WLDARTYSDP

SEQ ID NO: 14043 - protein, 10 aa, Dengue virus
LDARTYSDPL

SEQ ID NO: 14044 - protein, 10 aa, Dengue virus
DARTYSDPLA

SEQ ID NO: 14045 - protein, 10 aa, Dengue virus
ARTYSDPLAL

SEQ ID NO: 14046 - protein, 10 aa, Dengue virus
RTYSDPLALR

SEQ ID NO: 14047 - protein, 10 aa, Dengue virus
TYSDPLALRE

SEQ ID NO: 14048 - protein, 10 aa, Dengue virus
YSDPLALREF

SEQ ID NO: 14049 - protein, 10 aa, Dengue virus
SDPLALREFK

SEQ ID NO: 14050 - protein, 10 aa, Dengue virus
DPLALREFKE

SEQ ID NO: 14051 - protein, 10 aa, Dengue virus
PLALREFKEF

SEQ ID NO: 14052 - protein, 10 aa, Dengue virus
LALREFKEFA

SEQ ID NO: 14053 - protein, 10 aa, Dengue virus
ALREFKEFAA

SEQ ID NO: 14054 - protein, 10 aa, Dengue virus
LREFKEFAAG

SEQ ID NO: 14055 - protein, 10 aa, Dengue virus
REFKEFAAGR

SEQ ID NO: 14056 - protein, 10 aa, Dengue virus
EFKEFAAGRR

SEQ ID NO: 14057 - protein, 10 aa, Dengue virus
FKEFAAGRRS

SEQ ID NO: 14058 - protein, 10 aa, Dengue virus
KEFAAGRRSV

SEQ ID NO: 14059 - protein, 10 aa, Dengue virus
EFAAGRRSVS

SEQ ID NO: 14060 - protein, 10 aa, Dengue virus
FAAGRRSVSG

SEQ ID NO: 14061 - protein, 10 aa, Dengue virus
AAGRRSVSGD

SEQ ID NO: 14062 - protein, 10 aa, Dengue virus
AGRRSVSGDL

SEQ ID NO: 14063 - protein, 10 aa, Dengue virus
GRRSVSGDLI

SEQ ID NO: 14064 - protein, 10 aa, Dengue virus
RRSVSGDLIL

SEQ ID NO: 14065 - protein, 10 aa, Dengue virus
RSVSGDLILE

SEQ ID NO: 14066 - protein, 10 aa, Dengue virus
SVSGDLILEI

SEQ ID NO: 14067 - protein, 10 aa, Dengue virus
VSGDLILEIG

SEQ ID NO: 14068 - protein, 10 aa, Dengue virus
SGDLILEIGK

SEQ ID NO: 14069 - protein, 10 aa, Dengue virus
GDLILEIGKL

SEQ ID NO: 14070 - protein, 10 aa, Dengue virus
DLILEIGKLP

SEQ ID NO: 14071 - protein, 10 aa, Dengue virus
LILEIGKLPQ

SEQ ID NO: 14072 - protein, 10 aa, Dengue virus
ILEIGKLPQH

SEQ ID NO: 14073 - protein, 10 aa, Dengue virus
LEIGKLPQHL

SEQ ID NO: 14074 - protein, 10 aa, Dengue virus
EIGKLPQHLT

SEQ ID NO: 14075 - protein, 10 aa, Dengue virus
IGKLPQHLTQ

SEQ ID NO: 14076 - protein, 10 aa, Dengue virus
GKLPQHLTQR

SEQ ID NO: 14077 - protein, 10 aa, Dengue virus
KLPQHLTQRA

SEQ ID NO: 14078 - protein, 10 aa, Dengue virus
LPQHLTQRAQ

SEQ ID NO: 14079 - protein, 10 aa, Dengue virus
PQHLTQRAQN

SEQ ID NO: 14080 - protein, 10 aa, Dengue virus
QHLTQRAQNA

SEQ ID NO: 14081 - protein, 10 aa, Dengue virus
HLTQRAQNAL

SEQ ID NO: 14082 - protein, 10 aa, Dengue virus
LTQRAQNALD

SEQ ID NO: 14083 - protein, 10 aa, Dengue virus
TQRAQNALDN

SEQ ID NO: 14084 - protein, 10 aa, Dengue virus
QRAQNALDNL

SEQ ID NO: 14085 - protein, 10 aa, Dengue virus
RAQNALDNLV

SEQ ID NO: 14086 - protein, 10 aa, Dengue virus
AQNALDNLVM

SEQ ID NO: 14087 - protein, 10 aa, Dengue virus
QNALDNLVML

SEQ ID NO: 14088 - protein, 10 aa, Dengue virus
NALDNLVMLH

SEQ ID NO: 14089 - protein, 10 aa, Dengue virus
ALDNLVMLHN

SEQ ID NO: 14090 - protein, 10 aa, Dengue virus
LDNLVMLHNS

SEQ ID NO: 14091 - protein, 10 aa, Dengue virus
DNLVMLHNSE

SEQ ID NO: 14092 - protein, 10 aa, Dengue virus
NLVMLHNSEQ

SEQ ID NO: 14093 - protein, 10 aa, Dengue virus
LVMLHNSEQG

SEQ ID NO: 14094 - protein, 10 aa, Dengue virus
VMLHNSEQGG

SEQ ID NO: 14095 - protein, 10 aa, Dengue virus
MLHNSEQGGR

SEQ ID NO: 14096 - protein, 10 aa, Dengue virus
LHNSEQGGRA

SEQ ID NO: 14097 - protein, 10 aa, Dengue virus
HNSEQGGRAY

SEQ ID NO: 14098 - protein, 10 aa, Dengue virus
NSEQGGRAYR

SEQ ID NO: 14099 - protein, 10 aa, Dengue virus
SEQGGRAYRH

SEQ ID NO: 14100 - protein, 10 aa, Dengue virus
EQGGRAYRHA

SEQ ID NO: 14101 - protein, 10 aa, Dengue virus
QGGRAYRHAM

SEQ ID NO: 14102 - protein, 10 aa, Dengue virus
GGRAYRHAME

SEQ ID NO: 14103 - protein, 10 aa, Dengue virus
GRAYRHAMEE

SEQ ID NO: 14104 - protein, 10 aa, Dengue virus
RAYRHAMEEL

SEQ ID NO: 14105 - protein, 10 aa, Dengue virus
AYRHAMEELP

SEQ ID NO: 14106 - protein, 10 aa, Dengue virus
YRHAMEELPD

SEQ ID NO: 14107 - protein, 10 aa, Dengue virus
RHAMEELPDT

SEQ ID NO: 14108 - protein, 10 aa, Dengue virus
HAMEELPDTI

SEQ ID NO: 14109 - protein, 10 aa, Dengue virus
AMEELPDTIE

SEQ ID NO: 14110 - protein, 10 aa, Dengue virus
MEELPDTIET

SEQ ID NO: 14111 - protein, 10 aa, Dengue virus
EELPDTIETL

SEQ ID NO: 14112 - protein, 10 aa, Dengue virus
ELPDTIETLM

SEQ ID NO: 14113 - protein, 10 aa, Dengue virus
LPDTIETLML

SEQ ID NO: 14114 - protein, 10 aa, Dengue virus
PDTIETLMLL

SEQ ID NO: 14115 - protein, 10 aa, Dengue virus
DTIETLMLLA

SEQ ID NO: 14116 - protein, 10 aa, Dengue virus
TIETLMLLAL

SEQ ID NO: 14117 - protein, 10 aa, Dengue virus
IETLMLLALI

SEQ ID NO: 14118 - protein, 10 aa, Dengue virus
ETLMLLALIA

SEQ ID NO: 14119 - protein, 10 aa, Dengue virus
TLMLLALIAV

SEQ ID NO: 14120 - protein, 10 aa, Dengue virus
LMLLALIAVL

SEQ ID NO: 14121 - protein, 10 aa, Dengue virus
MLLALIAVLT

SEQ ID NO: 14122 - protein, 10 aa, Dengue virus
LLALIAVLTG

SEQ ID NO: 14123 - protein, 10 aa, Dengue virus
LALIAVLTGG

SEQ ID NO: 14124 - protein, 10 aa, Dengue virus
ALIAVLTGGV

SEQ ID NO: 14125 - protein, 10 aa, Dengue virus
LIAVLTGGVT

SEQ ID NO: 14126 - protein, 10 aa, Dengue virus
IAVLTGGVTL

SEQ ID NO: 14127 - protein, 10 aa, Dengue virus
AVLTGGVTLF

SEQ ID NO: 14128 - protein, 10 aa, Dengue virus
VLTGGVTLFF

SEQ ID NO: 14129 - protein, 10 aa, Dengue virus
LTGGVTLFFL

SEQ ID NO: 14130 - protein, 10 aa, Dengue virus
TGGVTLFFLS

SEQ ID NO: 14131 - protein, 10 aa, Dengue virus
GGVTLFFLSG

SEQ ID NO: 14132 - protein, 10 aa, Dengue virus
GVTLFFLSGR

SEQ ID NO: 14133 - protein, 10 aa, Dengue virus
VTLFFLSGRG

SEQ ID NO: 14134 - protein, 10 aa, Dengue virus
TLFFLSGRGL

SEQ ID NO: 14135 - protein, 10 aa, Dengue virus
LFFLSGRGLG

SEQ ID NO: 14136 - protein, 10 aa, Dengue virus
FFLSGRGLGK

SEQ ID NO: 14137 - protein, 10 aa, Dengue virus
FLSGRGLGKT

SEQ ID NO: 14138 - protein, 10 aa, Dengue virus
LSGRGLGKTS

SEQ ID NO: 14139 - protein, 10 aa, Dengue virus
SGRGLGKTSI

SEQ ID NO: 14140 - protein, 10 aa, Dengue virus
GRGLGKTSIG

SEQ ID NO: 14141 - protein, 10 aa, Dengue virus
RGLGKTSIGL

SEQ ID NO: 14142 - protein, 10 aa, Dengue virus
GLGKTSIGLL

SEQ ID NO: 14143 - protein, 10 aa, Dengue virus
LGKTSIGLLC

SEQ ID NO: 14144 - protein, 10 aa, Dengue virus
GKTSIGLLCV

SEQ ID NO: 14145 - protein, 10 aa, Dengue virus
KTSIGLLCVM

SEQ ID NO: 14146 - protein, 10 aa, Dengue virus
TSIGLLCVMA

SEQ ID NO: 14147 - protein, 10 aa, Dengue virus
SIGLLCVMAS

SEQ ID NO: 14148 - protein, 10 aa, Dengue virus
IGLLCVMASS

SEQ ID NO: 14149 - protein, 10 aa, Dengue virus
SSVLLWMASV

SEQ ID NO: 14150 - protein, 10 aa, Dengue virus
SVLLWMASVE

SEQ ID NO: 14151 - protein, 10 aa, Dengue virus
VLLWMASVEP

SEQ ID NO: 14152 - protein, 10 aa, Dengue virus
LLWMASVEPH

SEQ ID NO: 14153 - protein, 10 aa, Dengue virus
LWMASVEPHW

SEQ ID NO: 14154 - protein, 10 aa, Dengue virus
WMASVEPHWI

SEQ ID NO: 14155 - protein, 10 aa, Dengue virus
MASVEPHWIA

SEQ ID NO: 14156 - protein, 10 aa, Dengue virus
ASVEPHWIAA

SEQ ID NO: 14157 - protein, 10 aa, Dengue virus
SVEPHWIAAS

SEQ ID NO: 14158 - protein, 10 aa, Dengue virus
VEPHWIAASI

SEQ ID NO: 14159 - protein, 10 aa, Dengue virus
EPHWIAASII

SEQ ID NO: 14160 - protein, 10 aa, Dengue virus
PHWIAASIIL

SEQ ID NO: 14161 - protein, 10 aa, Dengue virus
HWIAASIILE

SEQ ID NO: 14162 - protein, 10 aa, Dengue virus
WIAASIILEF

SEQ ID NO: 14163 - protein, 10 aa, Dengue virus
IAASIILEFF

SEQ ID NO: 14164 - protein, 10 aa, Dengue virus
AASIILEFFL

SEQ ID NO: 14165 - protein, 10 aa, Dengue virus
ASIILEFFLM

SEQ ID NO: 14166 - protein, 10 aa, Dengue virus
SIILEFFLMV

SEQ ID NO: 14167 - protein, 10 aa, Dengue virus
IILEFFLMVL

SEQ ID NO: 14168 - protein, 10 aa, Dengue virus
ILEFFLMVLL

SEQ ID NO: 14169 - protein, 10 aa, Dengue virus
LEFFLMVLLI

SEQ ID NO: 14170 - protein, 10 aa, Dengue virus
EFFLMVLLIP

SEQ ID NO: 14171 - protein, 10 aa, Dengue virus
FFLMVLLIPE

SEQ ID NO: 14172 - protein, 10 aa, Dengue virus
FLMVLLIPEP

SEQ ID NO: 14173 - protein, 10 aa, Dengue virus
LMVLLIPEPD

SEQ ID NO: 14174 - protein, 10 aa, Dengue virus
MVLLIPEPDR

SEQ ID NO: 14175 - protein, 10 aa, Dengue virus
VLLIPEPDRQ

SEQ ID NO: 14176 - protein, 10 aa, Dengue virus
LLIPEPDRQR

SEQ ID NO: 14177 - protein, 10 aa, Dengue virus
LIPEPDRQRT

SEQ ID NO: 14178 - protein, 10 aa, Dengue virus
IPEPDRQRTP

SEQ ID NO: 14179 - protein, 10 aa, Dengue virus
PEPDRQRTPQ

SEQ ID NO: 14180 - protein, 10 aa, Dengue virus
EPDRQRTPQD

SEQ ID NO: 14181 - protein, 10 aa, Dengue virus
PDRQRTPQDN

SEQ ID NO: 14182 - protein, 10 aa, Dengue virus
DRQRTPQDNQ

SEQ ID NO: 14183 - protein, 10 aa, Dengue virus
RQRTPQDNQL

SEQ ID NO: 14184 - protein, 10 aa, Dengue virus
QRTPQDNQLA

SEQ ID NO: 14185 - protein, 10 aa, Dengue virus
RTPQDNQLAY

SEQ ID NO: 14186 - protein, 10 aa, Dengue virus
TPQDNQLAYV

SEQ ID NO: 14187 - protein, 10 aa, Dengue virus
PQDNQLAYVV

SEQ ID NO: 14188 - protein, 10 aa, Dengue virus
QDNQLAYVVI

SEQ ID NO: 14189 - protein, 10 aa, Dengue virus
DNQLAYVVIG

SEQ ID NO: 14190 - protein, 10 aa, Dengue virus
NQLAYVVIGL

SEQ ID NO: 14191 - protein, 10 aa, Dengue virus
QLAYVVIGLL

SEQ ID NO: 14192 - protein, 10 aa, Dengue virus
LAYVVIGLLF

SEQ ID NO: 14193 - protein, 10 aa, Dengue virus
AYVVIGLLFM

SEQ ID NO: 14194 - protein, 10 aa, Dengue virus
YVVIGLLFMI

SEQ ID NO: 14195 - protein, 10 aa, Dengue virus
VVIGLLFMIL

SEQ ID NO: 14196 - protein, 10 aa, Dengue virus
VIGLLFMILT

SEQ ID NO: 14197 - protein, 10 aa, Dengue virus
IGLLFMILTV

SEQ ID NO: 14198 - protein, 10 aa, Dengue virus
GLLFMILTVA

SEQ ID NO: 14199 - protein, 10 aa, Dengue virus
LLFMILTVAA

SEQ ID NO: 14200 - protein, 10 aa, Dengue virus
LFMILTVAAN

SEQ ID NO: 14201 - protein, 10 aa, Dengue virus
FMILTVAANE

SEQ ID NO: 14202 - protein, 10 aa, Dengue virus
MILTVAANEM

SEQ ID NO: 14203 - protein, 10 aa, Dengue virus
ILTVAANEMG

SEQ ID NO: 14204 - protein, 10 aa, Dengue virus
LTVAANEMGL

SEQ ID NO: 14205 - protein, 10 aa, Dengue virus
TVAANEMGLL

SEQ ID NO: 14206 - protein, 10 aa, Dengue virus
VAANEMGLLE

SEQ ID NO: 14207 - protein, 10 aa, Dengue virus
AANEMGLLET

SEQ ID NO: 14208 - protein, 10 aa, Dengue virus
ANEMGLLETT

SEQ ID NO: 14209 - protein, 10 aa, Dengue virus
NEMGLLETTK

SEQ ID NO: 14210 - protein, 10 aa, Dengue virus
EMGLLETTKK

SEQ ID NO: 14211 - protein, 10 aa, Dengue virus
MGLLETTKKD

SEQ ID NO: 14212 - protein, 10 aa, Dengue virus
GLLETTKKDL

SEQ ID NO: 14213 - protein, 10 aa, Dengue virus
LLETTKKDLG

SEQ ID NO: 14214 - protein, 10 aa, Dengue virus
LETTKKDLGI

SEQ ID NO: 14215 - protein, 10 aa, Dengue virus
ETTKKDLGIG

SEQ ID NO: 14216 - protein, 10 aa, Dengue virus
TTKKDLGIGH

SEQ ID NO: 14217 - protein, 10 aa, Dengue virus
TKKDLGIGHV

SEQ ID NO: 14218 - protein, 10 aa, Dengue virus
KKDLGIGHVA

SEQ ID NO: 14219 - protein, 10 aa, Dengue virus
AMLDVDLHPA

SEQ ID NO: 14220 - protein, 10 aa, Dengue virus
MLDVDLHPAS

SEQ ID NO: 14221 - protein, 10 aa, Dengue virus
LDVDLHPASA

SEQ ID NO: 14222 - protein, 10 aa, Dengue virus
DVDLHPASAW

SEQ ID NO: 14223 - protein, 10 aa, Dengue virus
VDLHPASAWT

SEQ ID NO: 14224 - protein, 10 aa, Dengue virus
DLHPASAWTL

SEQ ID NO: 14225 - protein, 10 aa, Dengue virus
LHPASAWTLY

SEQ ID NO: 14226 - protein, 10 aa, Dengue virus
HPASAWTLYA

SEQ ID NO: 14227 - protein, 10 aa, Dengue virus
PASAWTLYAV

SEQ ID NO: 14228 - protein, 10 aa, Dengue virus
ASAWTLYAVA

SEQ ID NO: 14229 - protein, 10 aa, Dengue virus
SAWTLYAVAT

SEQ ID NO: 14230 - protein, 10 aa, Dengue virus
AWTLYAVATT

SEQ ID NO: 14231 - protein, 10 aa, Dengue virus
WTLYAVATTI

SEQ ID NO: 14232 - protein, 10 aa, Dengue virus
TLYAVATTII

SEQ ID NO: 14233 - protein, 10 aa, Dengue virus
LYAVATTIIT

SEQ ID NO: 14234 - protein, 10 aa, Dengue virus
YAVATTIITP

SEQ ID NO: 14235 - protein, 10 aa, Dengue virus
AVATTIITPM

SEQ ID NO: 14236 - protein, 10 aa, Dengue virus
VATTIITPMM

SEQ ID NO: 14237 - protein, 10 aa, Dengue virus
ATTIITPMMR

SEQ ID NO: 14238 - protein, 10 aa, Dengue virus
TTIITPMMRH

SEQ ID NO: 14239 - protein, 10 aa, Dengue virus
TIITPMMRHT

SEQ ID NO: 14240 - protein, 10 aa, Dengue virus
IITPMMRHTI

SEQ ID NO: 14241 - protein, 10 aa, Dengue virus
ITPMMRHTIE

SEQ ID NO: 14242 - protein, 10 aa, Dengue virus
TPMMRHTIEN

SEQ ID NO: 14243 - protein, 10 aa, Dengue virus
PMMRHTIENT

SEQ ID NO: 14244 - protein, 10 aa, Dengue virus
MMRHTIENTT

SEQ ID NO: 14245 - protein, 10 aa, Dengue virus
MRHTIENTTA

SEQ ID NO: 14246 - protein, 10 aa, Dengue virus
RHTIENTTAN

SEQ ID NO: 14247 - protein, 10 aa, Dengue virus
HTIENTTANI

SEQ ID NO: 14248 - protein, 10 aa, Dengue virus
TIENTTANIS

SEQ ID NO: 14249 - protein, 10 aa, Dengue virus
IENTTANISL

SEQ ID NO: 14250 - protein, 10 aa, Dengue virus
ENTTANISLT

SEQ ID NO: 14251 - protein, 10 aa, Dengue virus
NTTANISLTA

SEQ ID NO: 14252 - protein, 10 aa, Dengue virus
TTANISLTAI

SEQ ID NO: 14253 - protein, 10 aa, Dengue virus
TANISLTAIA

SEQ ID NO: 14254 - protein, 10 aa, Dengue virus
ANISLTAIAN

SEQ ID NO: 14255 - protein, 10 aa, Dengue virus
NISLTAIANQ

SEQ ID NO: 14256 - protein, 10 aa, Dengue virus
ISLTAIANQA

SEQ ID NO: 14257 - protein, 10 aa, Dengue virus
SLTAIANQAA

SEQ ID NO: 14258 - protein, 10 aa, Dengue virus
LTAIANQAAI

SEQ ID NO: 14259 - protein, 10 aa, Dengue virus
TAIANQAAIL

SEQ ID NO: 14260 - protein, 10 aa, Dengue virus
AIANQAAILM

SEQ ID NO: 14261 - protein, 10 aa, Dengue virus
IANQAAILMG

SEQ ID NO: 14262 - protein, 10 aa, Dengue virus
ANQAAILMGL

SEQ ID NO: 14263 - protein, 10 aa, Dengue virus
NQAAILMGLD

SEQ ID NO: 14264 - protein, 10 aa, Dengue virus
QAAILMGLDK

SEQ ID NO: 14265 - protein, 10 aa, Dengue virus
AAILMGLDKG

SEQ ID NO: 14266 - protein, 10 aa, Dengue virus
AILMGLDKGW

SEQ ID NO: 14267 - protein, 10 aa, Dengue virus
ILMGLDKGWP

SEQ ID NO: 14268 - protein, 10 aa, Dengue virus
LMGLDKGWPI

SEQ ID NO: 14269 - protein, 10 aa, Dengue virus
MGLDKGWPIS

SEQ ID NO: 14270 - protein, 10 aa, Dengue virus
GLDKGWPISK

SEQ ID NO: 14271 - protein, 10 aa, Dengue virus
LDKGWPISKM

SEQ ID NO: 14272 - protein, 10 aa, Dengue virus
DKGWPISKMD

SEQ ID NO: 14273 - protein, 10 aa, Dengue virus
KGWPISKMDI

SEQ ID NO: 14274 - protein, 10 aa, Dengue virus
GWPISKMDIG

SEQ ID NO: 14275 - protein, 10 aa, Dengue virus
WPISKMDIGV

SEQ ID NO: 14276 - protein, 10 aa, Dengue virus
PISKMDIGVP

SEQ ID NO: 14277 - protein, 10 aa, Dengue virus
ISKMDIGVPL

SEQ ID NO: 14278 - protein, 10 aa, Dengue virus
SKMDIGVPLL

SEQ ID NO: 14279 - protein, 10 aa, Dengue virus
KMDIGVPLLA

SEQ ID NO: 14280 - protein, 10 aa, Dengue virus
MDIGVPLLAL

SEQ ID NO: 14281 - protein, 10 aa, Dengue virus
DIGVPLLALG

SEQ ID NO: 14282 - protein, 10 aa, Dengue virus
IGVPLLALGC

SEQ ID NO: 14283 - protein, 10 aa, Dengue virus
GVPLLALGCY

SEQ ID NO: 14284 - protein, 10 aa, Dengue virus
VPLLALGCYS

SEQ ID NO: 14285 - protein, 10 aa, Dengue virus
PLLALGCYSQ

SEQ ID NO: 14286 - protein, 10 aa, Dengue virus
LLALGCYSQV

SEQ ID NO: 14287 - protein, 10 aa, Dengue virus
LALGCYSQVN

SEQ ID NO: 14288 - protein, 10 aa, Dengue virus
ALGCYSQVNP

SEQ ID NO: 14289 - protein, 10 aa, Dengue virus
LGCYSQVNPL

SEQ ID NO: 14290 - protein, 10 aa, Dengue virus
GCYSQVNPLT

SEQ ID NO: 14291 - protein, 10 aa, Dengue virus
CYSQVNPLTL

SEQ ID NO: 14292 - protein, 10 aa, Dengue virus
YSQVNPLTLT

SEQ ID NO: 14293 - protein, 10 aa, Dengue virus
SQVNPLTLTA

SEQ ID NO: 14294 - protein, 10 aa, Dengue virus
QVNPLTLTAA

SEQ ID NO: 14295 - protein, 10 aa, Dengue virus
VNPLTLTAAV

SEQ ID NO: 14296 - protein, 10 aa, Dengue virus
NPLTLTAAVL

SEQ ID NO: 14297 - protein, 10 aa, Dengue virus
PLTLTAAVLM

SEQ ID NO: 14298 - protein, 10 aa, Dengue virus
LTLTAAVLML

SEQ ID NO: 14299 - protein, 10 aa, Dengue virus
TLTAAVLMLV

SEQ ID NO: 14300 - protein, 10 aa, Dengue virus
LTAAVLMLVA

SEQ ID NO: 14301 - protein, 10 aa, Dengue virus
TAAVLMLVAH

SEQ ID NO: 14302 - protein, 10 aa, Dengue virus
AAVLMLVAHY

SEQ ID NO: 14303 - protein, 10 aa, Dengue virus
AVLMLVAHYA

SEQ ID NO: 14304 - protein, 10 aa, Dengue virus
VLMLVAHYAI

SEQ ID NO: 14305 - protein, 10 aa, Dengue virus
LMLVAHYAII

SEQ ID NO: 14306 - protein, 10 aa, Dengue virus
MLVAHYAIIG

SEQ ID NO: 14307 - protein, 10 aa, Dengue virus
LVAHYAIIGP

SEQ ID NO: 14308 - protein, 10 aa, Dengue virus
VAHYAIIGPG

SEQ ID NO: 14309 - protein, 10 aa, Dengue virus
AHYAIIGPGL

SEQ ID NO: 14310 - protein, 10 aa, Dengue virus
HYAIIGPGLQ

SEQ ID NO: 14311 - protein, 10 aa, Dengue virus
YAIIGPGLQA

SEQ ID NO: 14312 - protein, 10 aa, Dengue virus
AIIGPGLQAK

SEQ ID NO: 14313 - protein, 10 aa, Dengue virus
IIGPGLQAKA

SEQ ID NO: 14314 - protein, 10 aa, Dengue virus
IGPGLQAKAT

SEQ ID NO: 14315 - protein, 10 aa, Dengue virus
GPGLQAKATR

SEQ ID NO: 14316 - protein, 10 aa, Dengue virus
PGLQAKATRE

SEQ ID NO: 14317 - protein, 10 aa, Dengue virus
GLQAKATREA

SEQ ID NO: 14318 - protein, 10 aa, Dengue virus
LQAKATREAQ

SEQ ID NO: 14319 - protein, 10 aa, Dengue virus
QAKATREAQK

SEQ ID NO: 14320 - protein, 10 aa, Dengue virus
AKATREAQKR

SEQ ID NO: 14321 - protein, 10 aa, Dengue virus
KATREAQKRT

SEQ ID NO: 14322 - protein, 10 aa, Dengue virus
ATREAQKRTA

SEQ ID NO: 14323 - protein, 10 aa, Dengue virus
TREAQKRTAA

SEQ ID NO: 14324 - protein, 10 aa, Dengue virus
REAQKRTAAG

SEQ ID NO: 14325 - protein, 10 aa, Dengue virus
EAQKRTAAGI

SEQ ID NO: 14326 - protein, 10 aa, Dengue virus
AQKRTAAGIM

SEQ ID NO: 14327 - protein, 10 aa, Dengue virus
QKRTAAGIMK

SEQ ID NO: 14328 - protein, 10 aa, Dengue virus
KRTAAGIMKN

SEQ ID NO: 14329 - protein, 10 aa, Dengue virus
RTAAGIMKNP

SEQ ID NO: 14330 - protein, 10 aa, Dengue virus
TAAGIMKNPT

SEQ ID NO: 14331 - protein, 10 aa, Dengue virus
AAGIMKNPTV

SEQ ID NO: 14332 - protein, 10 aa, Dengue virus
AGIMKNPTVD

SEQ ID NO: 14333 - protein, 10 aa, Dengue virus
GIMKNPTVDG

SEQ ID NO: 14334 - protein, 10 aa, Dengue virus
IMKNPTVDGI

SEQ ID NO: 14335 - protein, 10 aa, Dengue virus
MKNPTVDGIV

SEQ ID NO: 14336 - protein, 10 aa, Dengue virus
KNPTVDGIVA

SEQ ID NO: 14337 - protein, 10 aa, Dengue virus
NPTVDGIVAI

SEQ ID NO: 14338 - protein, 10 aa, Dengue virus
PTVDGIVAID

SEQ ID NO: 14339 - protein, 10 aa, Dengue virus
TVDGIVAIDL

SEQ ID NO: 14340 - protein, 10 aa, Dengue virus
VDGIVAIDLD

SEQ ID NO: 14341 - protein, 10 aa, Dengue virus
DGIVAIDLDP

SEQ ID NO: 14342 - protein, 10 aa, Dengue virus
GIVAIDLDPV

SEQ ID NO: 14343 - protein, 10 aa, Dengue virus
IVAIDLDPVV

SEQ ID NO: 14344 - protein, 10 aa, Dengue virus
VAIDLDPVVY

SEQ ID NO: 14345 - protein, 10 aa, Dengue virus
AIDLDPVVYD

SEQ ID NO: 14346 - protein, 10 aa, Dengue virus
IDLDPVVYDA

SEQ ID NO: 14347 - protein, 10 aa, Dengue virus
DLDPVVYDAK

SEQ ID NO: 14348 - protein, 10 aa, Dengue virus
LDPVVYDAKF

SEQ ID NO: 14349 - protein, 10 aa, Dengue virus
DPVVYDAKFE

SEQ ID NO: 14350 - protein, 10 aa, Dengue virus
PVVYDAKFEK

SEQ ID NO: 14351 - protein, 10 aa, Dengue virus
VVYDAKFEKQ

SEQ ID NO: 14352 - protein, 10 aa, Dengue virus
VYDAKFEKQL

SEQ ID NO: 14353 - protein, 10 aa, Dengue virus
YDAKFEKQLG

SEQ ID NO: 14354 - protein, 10 aa, Dengue virus
DAKFEKQLGQ

SEQ ID NO: 14355 - protein, 10 aa, Dengue virus
AKFEKQLGQI

SEQ ID NO: 14356 - protein, 10 aa, Dengue virus
KFEKQLGQIM

SEQ ID NO: 14357 - protein, 10 aa, Dengue virus
FEKQLGQIML

SEQ ID NO: 14358 - protein, 10 aa, Dengue virus
EKQLGQIMLL

SEQ ID NO: 14359 - protein, 10 aa, Dengue virus
KQLGQIMLLI

SEQ ID NO: 14360 - protein, 10 aa, Dengue virus
QLGQIMLLIL

SEQ ID NO: 14361 - protein, 10 aa, Dengue virus
LGQIMLLILC

SEQ ID NO: 14362 - protein, 10 aa, Dengue virus
GQIMLLILCT

SEQ ID NO: 14363 - protein, 10 aa, Dengue virus
QIMLLILCTS

SEQ ID NO: 14364 - protein, 10 aa, Dengue virus
IMLLILCTSQ

SEQ ID NO: 14365 - protein, 10 aa, Dengue virus
MLLILCTSQI

SEQ ID NO: 14366 - protein, 10 aa, Dengue virus
LLILCTSQIL

SEQ ID NO: 14367 - protein, 10 aa, Dengue virus
LILCTSQILL

SEQ ID NO: 14368 - protein, 10 aa, Dengue virus
ILCTSQILLM

SEQ ID NO: 14369 - protein, 10 aa, Dengue virus
LCTSQILLMR

SEQ ID NO: 14370 - protein, 10 aa, Dengue virus
CTSQILLMRT

SEQ ID NO: 14371 - protein, 10 aa, Dengue virus
TSQILLMRTT

SEQ ID NO: 14372 - protein, 10 aa, Dengue virus
SQILLMRTTW

SEQ ID NO: 14373 - protein, 10 aa, Dengue virus
QILLMRTTWA

SEQ ID NO: 14374 - protein, 10 aa, Dengue virus
ILLMRTTWAL

SEQ ID NO: 14375 - protein, 10 aa, Dengue virus
LLMRTTWALC

SEQ ID NO: 14376 - protein, 10 aa, Dengue virus
LMRTTWALCE

SEQ ID NO: 14377 - protein, 10 aa, Dengue virus
MRTTWALCES

SEQ ID NO: 14378 - protein, 10 aa, Dengue virus
RTTWALCESI

SEQ ID NO: 14379 - protein, 10 aa, Dengue virus
TTWALCESIT

SEQ ID NO: 14380 - protein, 10 aa, Dengue virus
TWALCESITL

SEQ ID NO: 14381 - protein, 10 aa, Dengue virus
WALCESITLA

SEQ ID NO: 14382 - protein, 10 aa, Dengue virus
ALCESITLAT

SEQ ID NO: 14383 - protein, 10 aa, Dengue virus
LCESITLATG

SEQ ID NO: 14384 - protein, 10 aa, Dengue virus
CESITLATGP

SEQ ID NO: 14385 - protein, 10 aa, Dengue virus
ESITLATGPL

SEQ ID NO: 14386 - protein, 10 aa, Dengue virus
SITLATGPLT

SEQ ID NO: 14387 - protein, 10 aa, Dengue virus
ITLATGPLTT

SEQ ID NO: 14388 - protein, 10 aa, Dengue virus
TLATGPLTTL

SEQ ID NO: 14389 - protein, 10 aa, Dengue virus
LATGPLTTLW

SEQ ID NO: 14390 - protein, 10 aa, Dengue virus
ATGPLTTLWE

SEQ ID NO: 14391 - protein, 10 aa, Dengue virus
TGPLTTLWEG

SEQ ID NO: 14392 - protein, 10 aa, Dengue virus
GPLTTLWEGS

SEQ ID NO: 14393 - protein, 10 aa, Dengue virus
PLTTLWEGSP

SEQ ID NO: 14394 - protein, 10 aa, Dengue virus
LTTLWEGSPG

SEQ ID NO: 14395 - protein, 10 aa, Dengue virus
TTLWEGSPGK

SEQ ID NO: 14396 - protein, 10 aa, Dengue virus
TLWEGSPGKF

SEQ ID NO: 14397 - protein, 10 aa, Dengue virus
LWEGSPGKFW

SEQ ID NO: 14398 - protein, 10 aa, Dengue virus
WEGSPGKFWN

SEQ ID NO: 14399 - protein, 10 aa, Dengue virus
EGSPGKFWNT

SEQ ID NO: 14400 - protein, 10 aa, Dengue virus
GSPGKFWNTT

SEQ ID NO: 14401 - protein, 10 aa, Dengue virus
SPGKFWNTTI

SEQ ID NO: 14402 - protein, 10 aa, Dengue virus
PGKFWNTTIA

SEQ ID NO: 14403 - protein, 10 aa, Dengue virus
GKFWNTTIAV

SEQ ID NO: 14404 - protein, 10 aa, Dengue virus
KFWNTTIAVS

SEQ ID NO: 14405 - protein, 10 aa, Dengue virus
FWNTTIAVSM

SEQ ID NO: 14406 - protein, 10 aa, Dengue virus
WNTTIAVSMA

SEQ ID NO: 14407 - protein, 10 aa, Dengue virus
NTTIAVSMAN

SEQ ID NO: 14408 - protein, 10 aa, Dengue virus
TTIAVSMANI

SEQ ID NO: 14409 - protein, 10 aa, Dengue virus
TIAVSMANIF

SEQ ID NO: 14410 - protein, 10 aa, Dengue virus
IAVSMANIFR

SEQ ID NO: 14411 - protein, 10 aa, Dengue virus
AVSMANIFRG

SEQ ID NO: 14412 - protein, 10 aa, Dengue virus
VSMANIFRGS

SEQ ID NO: 14413 - protein, 10 aa, Dengue virus
SMANIFRGSY

SEQ ID NO: 14414 - protein, 10 aa, Dengue virus
MANIFRGSYL

SEQ ID NO: 14415 - protein, 10 aa, Dengue virus
ANIFRGSYLA

SEQ ID NO: 14416 - protein, 10 aa, Dengue virus
NIFRGSYLAG

SEQ ID NO: 14417 - protein, 10 aa, Dengue virus
IFRGSYLAGA

SEQ ID NO: 14418 - protein, 10 aa, Dengue virus
FRGSYLAGAG

SEQ ID NO: 14419 - protein, 10 aa, Dengue virus
RGSYLAGAGL

SEQ ID NO: 14420 - protein, 10 aa, Dengue virus
GSYLAGAGLA

SEQ ID NO: 14421 - protein, 10 aa, Dengue virus
SYLAGAGLAF

SEQ ID NO: 14422 - protein, 10 aa, Dengue virus
YLAGAGLAFS

SEQ ID NO: 14423 - protein, 10 aa, Dengue virus
LAGAGLAFSL

SEQ ID NO: 14424 - protein, 10 aa, Dengue virus
AGAGLAFSLM

SEQ ID NO: 14425 - protein, 10 aa, Dengue virus
GAGLAFSLMK

SEQ ID NO: 14426 - protein, 10 aa, Dengue virus
AGLAFSLMKS

SEQ ID NO: 14427 - protein, 10 aa, Dengue virus
GLAFSLMKSL

SEQ ID NO: 14428 - protein, 10 aa, Dengue virus
LAFSLMKSLG

SEQ ID NO: 14429 - protein, 10 aa, Dengue virus
AFSLMKSLGG

SEQ ID NO: 14430 - protein, 10 aa, Dengue virus
FSLMKSLGGG

SEQ ID NO: 14431 - protein, 10 aa, Dengue virus
SLMKSLGGGR

SEQ ID NO: 14432 - protein, 10 aa, Dengue virus
LMKSLGGGRR

SEQ ID NO: 14433 - protein, 10 aa, Dengue virus
MKSLGGGRRG

SEQ ID NO: 14434 - protein, 10 aa, Dengue virus
KSLGGGRRGT

SEQ ID NO: 14435 - protein, 10 aa, Dengue virus
SLGGGRRGTG

SEQ ID NO: 14436 - protein, 10 aa, Dengue virus
LGGGRRGTGA

SEQ ID NO: 14437 - protein, 10 aa, Dengue virus
GGGRRGTGAQ

SEQ ID NO: 14438 - protein, 10 aa, Dengue virus
GGRRGTGAQG

SEQ ID NO: 14439 - protein, 10 aa, Dengue virus
GRRGTGAQGE

SEQ ID NO: 14440 - protein, 10 aa, Dengue virus
RRGTGAQGET

SEQ ID NO: 14441 - protein, 10 aa, Dengue virus
RGTGAQGETL

SEQ ID NO: 14442 - protein, 10 aa, Dengue virus
GTGAQGETLG

SEQ ID NO: 14443 - protein, 10 aa, Dengue virus
TGAQGETLGE

SEQ ID NO: 14444 - protein, 10 aa, Dengue virus
GAQGETLGEK

SEQ ID NO: 14445 - protein, 10 aa, Dengue virus
AQGETLGEKW

SEQ ID NO: 14446 - protein, 10 aa, Dengue virus
QGETLGEKWK

SEQ ID NO: 14447 - protein, 10 aa, Dengue virus
GETLGEKWKR

SEQ ID NO: 14448 - protein, 10 aa, Dengue virus
ETLGEKWKRQ

SEQ ID NO: 14449 - protein, 10 aa, Dengue virus
TLGEKWKRQL

SEQ ID NO: 14450 - protein, 10 aa, Dengue virus
LGEKWKRQLN

SEQ ID NO: 14451 - protein, 10 aa, Dengue virus
GEKWKRQLNQ

SEQ ID NO: 14452 - protein, 10 aa, Dengue virus
EKWKRQLNQL

SEQ ID NO: 14453 - protein, 10 aa, Dengue virus
KWKRQLNQLS

SEQ ID NO: 14454 - protein, 10 aa, Dengue virus
WKRQLNQLSK

SEQ ID NO: 14455 - protein, 10 aa, Dengue virus
KRQLNQLSKS

SEQ ID NO: 14456 - protein, 10 aa, Dengue virus
RQLNQLSKSE

SEQ ID NO: 14457 - protein, 10 aa, Dengue virus
QLNQLSKSEF

SEQ ID NO: 14458 - protein, 10 aa, Dengue virus
LNQLSKSEFN

SEQ ID NO: 14459 - protein, 10 aa, Dengue virus
NQLSKSEFNT

SEQ ID NO: 14460 - protein, 10 aa, Dengue virus
QLSKSEFNTY

SEQ ID NO: 14461 - protein, 10 aa, Dengue virus
LSKSEFNTYK

SEQ ID NO: 14462 - protein, 10 aa, Dengue virus
SKSEFNTYKR

SEQ ID NO: 14463 - protein, 10 aa, Dengue virus
KSEFNTYKRS

SEQ ID NO: 14464 - protein, 10 aa, Dengue virus
SEFNTYKRSG

SEQ ID NO: 14465 - protein, 10 aa, Dengue virus
EFNTYKRSGI

SEQ ID NO: 14466 - protein, 10 aa, Dengue virus
FNTYKRSGIM

SEQ ID NO: 14467 - protein, 10 aa, Dengue virus
NTYKRSGIME

SEQ ID NO: 14468 - protein, 10 aa, Dengue virus
TYKRSGIMEV

SEQ ID NO: 14469 - protein, 10 aa, Dengue virus
YKRSGIMEVD

SEQ ID NO: 14470 - protein, 10 aa, Dengue virus
KRSGIMEVDR

SEQ ID NO: 14471 - protein, 10 aa, Dengue virus
RSGIMEVDRS

SEQ ID NO: 14472 - protein, 10 aa, Dengue virus
SGIMEVDRSE

SEQ ID NO: 14473 - protein, 10 aa, Dengue virus
GIMEVDRSEA

SEQ ID NO: 14474 - protein, 10 aa, Dengue virus
IMEVDRSEAK

SEQ ID NO: 14475 - protein, 10 aa, Dengue virus
MEVDRSEAKE

SEQ ID NO: 14476 - protein, 10 aa, Dengue virus
EVDRSEAKEG

SEQ ID NO: 14477 - protein, 10 aa, Dengue virus
VDRSEAKEGL

SEQ ID NO: 14478 - protein, 10 aa, Dengue virus
DRSEAKEGLK

SEQ ID NO: 14479 - protein, 10 aa, Dengue virus
RSEAKEGLKR

SEQ ID NO: 14480 - protein, 10 aa, Dengue virus
SEAKEGLKRG

SEQ ID NO: 14481 - protein, 10 aa, Dengue virus
EAKEGLKRGE

SEQ ID NO: 14482 - protein, 10 aa, Dengue virus
AKEGLKRGET

SEQ ID NO: 14483 - protein, 10 aa, Dengue virus
KEGLKRGETT

SEQ ID NO: 14484 - protein, 10 aa, Dengue virus
EGLKRGETTK

SEQ ID NO: 14485 - protein, 10 aa, Dengue virus
GLKRGETTKH

SEQ ID NO: 14486 - protein, 10 aa, Dengue virus
LKRGETTKHA

SEQ ID NO: 14487 - protein, 10 aa, Dengue virus
KRGETTKHAV

SEQ ID NO: 14488 - protein, 10 aa, Dengue virus
RGETTKHAVS

SEQ ID NO: 14489 - protein, 10 aa, Dengue virus
GETTKHAVSR

SEQ ID NO: 14490 - protein, 10 aa, Dengue virus
ETTKHAVSRG

SEQ ID NO: 14491 - protein, 10 aa, Dengue virus
TTKHAVSRGT

SEQ ID NO: 14492 - protein, 10 aa, Dengue virus
TKHAVSRGTA

SEQ ID NO: 14493 - protein, 10 aa, Dengue virus
KHAVSRGTAK

SEQ ID NO: 14494 - protein, 10 aa, Dengue virus
HAVSRGTAKL

SEQ ID NO: 14495 - protein, 10 aa, Dengue virus
AVSRGTAKLR

SEQ ID NO: 14496 - protein, 10 aa, Dengue virus
VSRGTAKLRW

SEQ ID NO: 14497 - protein, 10 aa, Dengue virus
SRGTAKLRWF

SEQ ID NO: 14498 - protein, 10 aa, Dengue virus
RGTAKLRWFV

SEQ ID NO: 14499 - protein, 10 aa, Dengue virus
GTAKLRWFVE

SEQ ID NO: 14500 - protein, 10 aa, Dengue virus
TAKLRWFVER

SEQ ID NO: 14501 - protein, 10 aa, Dengue virus
AKLRWFVERN

SEQ ID NO: 14502 - protein, 10 aa, Dengue virus
KLRWFVERNL

SEQ ID NO: 14503 - protein, 10 aa, Dengue virus
LRWFVERNLV

SEQ ID NO: 14504 - protein, 10 aa, Dengue virus
RWFVERNLVK

SEQ ID NO: 14505 - protein, 10 aa, Dengue virus
WFVERNLVKP

SEQ ID NO: 14506 - protein, 10 aa, Dengue virus
FVERNLVKPE

SEQ ID NO: 14507 - protein, 10 aa, Dengue virus
VERNLVKPEG

SEQ ID NO: 14508 - protein, 10 aa, Dengue virus
ERNLVKPEGK

SEQ ID NO: 14509 - protein, 10 aa, Dengue virus
RNLVKPEGKV

SEQ ID NO: 14510 - protein, 10 aa, Dengue virus
NLVKPEGKVI

SEQ ID NO: 14511 - protein, 10 aa, Dengue virus
LVKPEGKVID

SEQ ID NO: 14512 - protein, 10 aa, Dengue virus
VKPEGKVIDL

SEQ ID NO: 14513 - protein, 10 aa, Dengue virus
KPEGKVIDLG

SEQ ID NO: 14514 - protein, 10 aa, Dengue virus
PEGKVIDLGC

SEQ ID NO: 14515 - protein, 10 aa, Dengue virus
EGKVIDLGCG

SEQ ID NO: 14516 - protein, 10 aa, Dengue virus
GKVIDLGCGR

SEQ ID NO: 14517 - protein, 10 aa, Dengue virus
KVIDLGCGRG

SEQ ID NO: 14518 - protein, 10 aa, Dengue virus
VIDLGCGRGG

SEQ ID NO: 14519 - protein, 10 aa, Dengue virus
IDLGCGRGGW

SEQ ID NO: 14520 - protein, 10 aa, Dengue virus
DLGCGRGGWS

SEQ ID NO: 14521 - protein, 10 aa, Dengue virus
LGCGRGGWSY

SEQ ID NO: 14522 - protein, 10 aa, Dengue virus
GCGRGGWSYY

SEQ ID NO: 14523 - protein, 10 aa, Dengue virus
CGRGGWSYYC

SEQ ID NO: 14524 - protein, 10 aa, Dengue virus
GRGGWSYYCA

SEQ ID NO: 14525 - protein, 10 aa, Dengue virus
RGGWSYYCAG

SEQ ID NO: 14526 - protein, 10 aa, Dengue virus
GGWSYYCAGL

SEQ ID NO: 14527 - protein, 10 aa, Dengue virus
GWSYYCAGLK

SEQ ID NO: 14528 - protein, 10 aa, Dengue virus
WSYYCAGLKK

SEQ ID NO: 14529 - protein, 10 aa, Dengue virus
SYYCAGLKKV

SEQ ID NO: 14530 - protein, 10 aa, Dengue virus
YYCAGLKKVT

SEQ ID NO: 14531 - protein, 10 aa, Dengue virus
YCAGLKKVTE

SEQ ID NO: 14532 - protein, 10 aa, Dengue virus
CAGLKKVTEV

SEQ ID NO: 14533 - protein, 10 aa, Dengue virus
AGLKKVTEVK

SEQ ID NO: 14534 - protein, 10 aa, Dengue virus
GLKKVTEVKG

SEQ ID NO: 14535 - protein, 10 aa, Dengue virus
LKKVTEVKGY

SEQ ID NO: 14536 - protein, 10 aa, Dengue virus
KKVTEVKGYT

SEQ ID NO: 14537 - protein, 10 aa, Dengue virus
KVTEVKGYTK

SEQ ID NO: 14538 - protein, 10 aa, Dengue virus
VTEVKGYTKG

SEQ ID NO: 14539 - protein, 10 aa, Dengue virus
TEVKGYTKGG

SEQ ID NO: 14540 - protein, 10 aa, Dengue virus
EVKGYTKGGP

SEQ ID NO: 14541 - protein, 10 aa, Dengue virus
VKGYTKGGPG

SEQ ID NO: 14542 - protein, 10 aa, Dengue virus
KGYTKGGPGH

SEQ ID NO: 14543 - protein, 10 aa, Dengue virus
GYTKGGPGHE

SEQ ID NO: 14544 - protein, 10 aa, Dengue virus
YTKGGPGHEE

SEQ ID NO: 14545 - protein, 10 aa, Dengue virus
TKGGPGHEEP

SEQ ID NO: 14546 - protein, 10 aa, Dengue virus
KGGPGHEEPI

SEQ ID NO: 14547 - protein, 10 aa, Dengue virus
GGPGHEEPIP

SEQ ID NO: 14548 - protein, 10 aa, Dengue virus
GPGHEEPIPM

SEQ ID NO: 14549 - protein, 10 aa, Dengue virus
PGHEEPIPMA

SEQ ID NO: 14550 - protein, 10 aa, Dengue virus
GHEEPIPMAT

SEQ ID NO: 14551 - protein, 10 aa, Dengue virus
HEEPIPMATY

SEQ ID NO: 14552 - protein, 10 aa, Dengue virus
EEPIPMATYG

SEQ ID NO: 14553 - protein, 10 aa, Dengue virus
EPIPMATYGW

SEQ ID NO: 14554 - protein, 10 aa, Dengue virus
PIPMATYGWN

SEQ ID NO: 14555 - protein, 10 aa, Dengue virus
IPMATYGWNL

SEQ ID NO: 14556 - protein, 10 aa, Dengue virus
PMATYGWNLV

SEQ ID NO: 14557 - protein, 10 aa, Dengue virus
MATYGWNLVK

SEQ ID NO: 14558 - protein, 10 aa, Dengue virus
ATYGWNLVKL

SEQ ID NO: 14559 - protein, 10 aa, Dengue virus
TYGWNLVKLH

SEQ ID NO: 14560 - protein, 10 aa, Dengue virus
YGWNLVKLHS

SEQ ID NO: 14561 - protein, 10 aa, Dengue virus
GWNLVKLHSG

SEQ ID NO: 14562 - protein, 10 aa, Dengue virus
WNLVKLHSGK

SEQ ID NO: 14563 - protein, 10 aa, Dengue virus
NLVKLHSGKD

SEQ ID NO: 14564 - protein, 10 aa, Dengue virus
LVKLHSGKDV

SEQ ID NO: 14565 - protein, 10 aa, Dengue virus
VKLHSGKDVF

SEQ ID NO: 14566 - protein, 10 aa, Dengue virus
KLHSGKDVFF

SEQ ID NO: 14567 - protein, 10 aa, Dengue virus
SGKDVFFIPP

SEQ ID NO: 14568 - protein, 10 aa, Dengue virus
GKDVFFIPPE

SEQ ID NO: 14569 - protein, 10 aa, Dengue virus
KDVFFIPPEK

SEQ ID NO: 14570 - protein, 10 aa, Dengue virus
DVFFIPPEKC

SEQ ID NO: 14571 - protein, 10 aa, Dengue virus
VFFIPPEKCD

SEQ ID NO: 14572 - protein, 10 aa, Dengue virus
FFIPPEKCDT

SEQ ID NO: 14573 - protein, 10 aa, Dengue virus
FIPPEKCDTL

SEQ ID NO: 14574 - protein, 10 aa, Dengue virus
IPPEKCDTLL

SEQ ID NO: 14575 - protein, 10 aa, Dengue virus
PPEKCDTLLC

SEQ ID NO: 14576 - protein, 10 aa, Dengue virus
PEKCDTLLCD

SEQ ID NO: 14577 - protein, 10 aa, Dengue virus
EKCDTLLCDI

SEQ ID NO: 14578 - protein, 10 aa, Dengue virus
KCDTLLCDIG

SEQ ID NO: 14579 - protein, 10 aa, Dengue virus
CDTLLCDIGE

SEQ ID NO: 14580 - protein, 10 aa, Dengue virus
DTLLCDIGES

SEQ ID NO: 14581 - protein, 10 aa, Dengue virus
TLLCDIGESS

SEQ ID NO: 14582 - protein, 10 aa, Dengue virus
LLCDIGESSP

SEQ ID NO: 14583 - protein, 10 aa, Dengue virus
LCDIGESSPN

SEQ ID NO: 14584 - protein, 10 aa, Dengue virus
CDIGESSPNP

SEQ ID NO: 14585 - protein, 10 aa, Dengue virus
DIGESSPNPT

SEQ ID NO: 14586 - protein, 10 aa, Dengue virus
IGESSPNPTI

SEQ ID NO: 14587 - protein, 10 aa, Dengue virus
GESSPNPTIE

SEQ ID NO: 14588 - protein, 10 aa, Dengue virus
ESSPNPTIEE

SEQ ID NO: 14589 - protein, 10 aa, Dengue virus
SSPNPTIEEG

SEQ ID NO: 14590 - protein, 10 aa, Dengue virus
SPNPTIEEGR

SEQ ID NO: 14591 - protein, 10 aa, Dengue virus
PNPTIEEGRT

SEQ ID NO: 14592 - protein, 10 aa, Dengue virus
NPTIEEGRTL

SEQ ID NO: 14593 - protein, 10 aa, Dengue virus
PTIEEGRTLR

SEQ ID NO: 14594 - protein, 10 aa, Dengue virus
TIEEGRTLRV

SEQ ID NO: 14595 - protein, 10 aa, Dengue virus
IEEGRTLRVL

SEQ ID NO: 14596 - protein, 10 aa, Dengue virus
EEGRTLRVLK

SEQ ID NO: 14597 - protein, 10 aa, Dengue virus
EGRTLRVLKM

SEQ ID NO: 14598 - protein, 10 aa, Dengue virus
GRTLRVLKMV

SEQ ID NO: 14599 - protein, 10 aa, Dengue virus
RTLRVLKMVE

SEQ ID NO: 14600 - protein, 10 aa, Dengue virus
TLRVLKMVEP

SEQ ID NO: 14601 - protein, 10 aa, Dengue virus
LRVLKMVEPW

SEQ ID NO: 14602 - protein, 10 aa, Dengue virus
RVLKMVEPWL

SEQ ID NO: 14603 - protein, 10 aa, Dengue virus
VLKMVEPWLR

SEQ ID NO: 14604 - protein, 10 aa, Dengue virus
LKMVEPWLRG

SEQ ID NO: 14605 - protein, 10 aa, Dengue virus
KMVEPWLRGN

SEQ ID NO: 14606 - protein, 10 aa, Dengue virus
QFCIKILNPY

SEQ ID NO: 14607 - protein, 10 aa, Dengue virus
FCIKILNPYM

SEQ ID NO: 14608 - protein, 10 aa, Dengue virus
CIKILNPYMP

SEQ ID NO: 14609 - protein, 10 aa, Dengue virus
IKILNPYMPS

SEQ ID NO: 14610 - protein, 10 aa, Dengue virus
KILNPYMPSV

SEQ ID NO: 14611 - protein, 10 aa, Dengue virus
ILNPYMPSVV

SEQ ID NO: 14612 - protein, 10 aa, Dengue virus
LNPYMPSVVE

SEQ ID NO: 14613 - protein, 10 aa, Dengue virus
NPYMPSVVET

SEQ ID NO: 14614 - protein, 10 aa, Dengue virus
PYMPSVVETL

SEQ ID NO: 14615 - protein, 10 aa, Dengue virus
YMPSVVETLE

SEQ ID NO: 14616 - protein, 10 aa, Dengue virus
MPSVVETLEQ

SEQ ID NO: 14617 - protein, 10 aa, Dengue virus
PSVVETLEQM

SEQ ID NO: 14618 - protein, 10 aa, Dengue virus
SVVETLEQMQ

SEQ ID NO: 14619 - protein, 10 aa, Dengue virus
VVETLEQMQR

SEQ ID NO: 14620 - protein, 10 aa, Dengue virus
VETLEQMQRK

SEQ ID NO: 14621 - protein, 10 aa, Dengue virus
ETLEQMQRKH

SEQ ID NO: 14622 - protein, 10 aa, Dengue virus
TLEQMQRKHG

SEQ ID NO: 14623 - protein, 10 aa, Dengue virus
LEQMQRKHGG

SEQ ID NO: 14624 - protein, 10 aa, Dengue virus
EQMQRKHGGM

SEQ ID NO: 14625 - protein, 10 aa, Dengue virus
QMQRKHGGML

SEQ ID NO: 14626 - protein, 10 aa, Dengue virus
MQRKHGGMLV

SEQ ID NO: 14627 - protein, 10 aa, Dengue virus
QRKHGGMLVR

SEQ ID NO: 14628 - protein, 10 aa, Dengue virus
RKHGGMLVRN

SEQ ID NO: 14629 - protein, 10 aa, Dengue virus
KHGGMLVRNP

SEQ ID NO: 14630 - protein, 10 aa, Dengue virus
HGGMLVRNPL

SEQ ID NO: 14631 - protein, 10 aa, Dengue virus
GGMLVRNPLS

SEQ ID NO: 14632 - protein, 10 aa, Dengue virus
GMLVRNPLSR

SEQ ID NO: 14633 - protein, 10 aa, Dengue virus
MLVRNPLSRN

SEQ ID NO: 14634 - protein, 10 aa, Dengue virus
LVRNPLSRNS

SEQ ID NO: 14635 - protein, 10 aa, Dengue virus
VRNPLSRNST

SEQ ID NO: 14636 - protein, 10 aa, Dengue virus
RNPLSRNSTH

SEQ ID NO: 14637 - protein, 10 aa, Dengue virus
NPLSRNSTHE

SEQ ID NO: 14638 - protein, 10 aa, Dengue virus
PLSRNSTHEM

SEQ ID NO: 14639 - protein, 10 aa, Dengue virus
LSRNSTHEMY

SEQ ID NO: 14640 - protein, 10 aa, Dengue virus
SRNSTHEMYW

SEQ ID NO: 14641 - protein, 10 aa, Dengue virus
RNSTHEMYWV

SEQ ID NO: 14642 - protein, 10 aa, Dengue virus
NSTHEMYWVS

SEQ ID NO: 14643 - protein, 10 aa, Dengue virus
STHEMYWVSC

SEQ ID NO: 14644 - protein, 10 aa, Dengue virus
THEMYWVSCG

SEQ ID NO: 14645 - protein, 10 aa, Dengue virus
HEMYWVSCGT

SEQ ID NO: 14646 - protein, 10 aa, Dengue virus
EMYWVSCGTG

SEQ ID NO: 14647 - protein, 10 aa, Dengue virus
MYWVSCGTGN

SEQ ID NO: 14648 - protein, 10 aa, Dengue virus
YWVSCGTGNI

SEQ ID NO: 14649 - protein, 10 aa, Dengue virus
WVSCGTGNIV

SEQ ID NO: 14650 - protein, 10 aa, Dengue virus
VSCGTGNIVS

SEQ ID NO: 14651 - protein, 10 aa, Dengue virus
SCGTGNIVSA

SEQ ID NO: 14652 - protein, 10 aa, Dengue virus
CGTGNIVSAV

SEQ ID NO: 14653 - protein, 10 aa, Dengue virus
GTGNIVSAVN

SEQ ID NO: 14654 - protein, 10 aa, Dengue virus
TGNIVSAVNM

SEQ ID NO: 14655 - protein, 10 aa, Dengue virus
GNIVSAVNMT

SEQ ID NO: 14656 - protein, 10 aa, Dengue virus
NIVSAVNMTS

SEQ ID NO: 14657 - protein, 10 aa, Dengue virus
IVSAVNMTSR

SEQ ID NO: 14658 - protein, 10 aa, Dengue virus
VSAVNMTSRM

SEQ ID NO: 14659 - protein, 10 aa, Dengue virus
SAVNMTSRML

SEQ ID NO: 14660 - protein, 10 aa, Dengue virus
AVNMTSRMLL

SEQ ID NO: 14661 - protein, 10 aa, Dengue virus
VNMTSRMLLN

SEQ ID NO: 14662 - protein, 10 aa, Dengue virus
NMTSRMLLNR

SEQ ID NO: 14663 - protein, 10 aa, Dengue virus
MTSRMLLNRF

SEQ ID NO: 14664 - protein, 10 aa, Dengue virus
TSRMLLNRFT

SEQ ID NO: 14665 - protein, 10 aa, Dengue virus
SRMLLNRFTM

SEQ ID NO: 14666 - protein, 10 aa, Dengue virus
RMLLNRFTMA

SEQ ID NO: 14667 - protein, 10 aa, Dengue virus
MLLNRFTMAH

SEQ ID NO: 14668 - protein, 10 aa, Dengue virus
LLNRFTMAHR

SEQ ID NO: 14669 - protein, 10 aa, Dengue virus
LNRFTMAHRK

SEQ ID NO: 14670 - protein, 10 aa, Dengue virus
NRFTMAHRKP

SEQ ID NO: 14671 - protein, 10 aa, Dengue virus
RFTMAHRKPT

SEQ ID NO: 14672 - protein, 10 aa, Dengue virus
FTMAHRKPTY

SEQ ID NO: 14673 - protein, 10 aa, Dengue virus
TMAHRKPTYE

SEQ ID NO: 14674 - protein, 10 aa, Dengue virus
MAHRKPTYER

SEQ ID NO: 14675 - protein, 10 aa, Dengue virus
AHRKPTYERD

SEQ ID NO: 14676 - protein, 10 aa, Dengue virus
HRKPTYERDV

SEQ ID NO: 14677 - protein, 10 aa, Dengue virus
RKPTYERDVD

SEQ ID NO: 14678 - protein, 10 aa, Dengue virus
KPTYERDVDL

SEQ ID NO: 14679 - protein, 10 aa, Dengue virus
PTYERDVDLG

SEQ ID NO: 14680 - protein, 10 aa, Dengue virus
TYERDVDLGA

SEQ ID NO: 14681 - protein, 10 aa, Dengue virus
YERDVDLGAG

SEQ ID NO: 14682 - protein, 10 aa, Dengue virus
ERDVDLGAGT

SEQ ID NO: 14683 - protein, 10 aa, Dengue virus
RDVDLGAGTR

SEQ ID NO: 14684 - protein, 10 aa, Dengue virus
DVDLGAGTRH

SEQ ID NO: 14685 - protein, 10 aa, Dengue virus
VDLGAGTRHV

SEQ ID NO: 14686 - protein, 10 aa, Dengue virus
DLGAGTRHVA

SEQ ID NO: 14687 - protein, 10 aa, Dengue virus
LGAGTRHVAV

SEQ ID NO: 14688 - protein, 10 aa, Dengue virus
GAGTRHVAVE

SEQ ID NO: 14689 - protein, 10 aa, Dengue virus
AGTRHVAVEP

SEQ ID NO: 14690 - protein, 10 aa, Dengue virus
GTRHVAVEPE

SEQ ID NO: 14691 - protein, 10 aa, Dengue virus
TRHVAVEPEV

SEQ ID NO: 14692 - protein, 10 aa, Dengue virus
RHVAVEPEVA

SEQ ID NO: 14693 - protein, 10 aa, Dengue virus
HVAVEPEVAN

SEQ ID NO: 14694 - protein, 10 aa, Dengue virus
VEPEVANLDI

SEQ ID NO: 14695 - protein, 10 aa, Dengue virus
EPEVANLDII

SEQ ID NO: 14696 - protein, 10 aa, Dengue virus
PEVANLDIIG

SEQ ID NO: 14697 - protein, 10 aa, Dengue virus
EVANLDIIGQ

SEQ ID NO: 14698 - protein, 10 aa, Dengue virus
VANLDIIGQR

SEQ ID NO: 14699 - protein, 10 aa, Dengue virus
ANLDIIGQRI

SEQ ID NO: 14700 - protein, 10 aa, Dengue virus
NLDIIGQRIE

SEQ ID NO: 14701 - protein, 10 aa, Dengue virus
LDIIGQRIEN

SEQ ID NO: 14702 - protein, 10 aa, Dengue virus
DIIGQRIENI

SEQ ID NO: 14703 - protein, 10 aa, Dengue virus
IIGQRIENIK

SEQ ID NO: 14704 - protein, 10 aa, Dengue virus
IGQRIENIKH

SEQ ID NO: 14705 - protein, 10 aa, Dengue virus
GQRIENIKHE

SEQ ID NO: 14706 - protein, 10 aa, Dengue virus
QRIENIKHEH

SEQ ID NO: 14707 - protein, 10 aa, Dengue virus
RIENIKHEHK

SEQ ID NO: 14708 - protein, 10 aa, Dengue virus
IENIKHEHKS

SEQ ID NO: 14709 - protein, 10 aa, Dengue virus
ENIKHEHKST

SEQ ID NO: 14710 - protein, 10 aa, Dengue virus
NIKHEHKSTW

SEQ ID NO: 14711 - protein, 10 aa, Dengue virus
IKHEHKSTWH

SEQ ID NO: 14712 - protein, 10 aa, Dengue virus
KHEHKSTWHY

SEQ ID NO: 14713 - protein, 10 aa, Dengue virus
HEHKSTWHYD

SEQ ID NO: 14714 - protein, 10 aa, Dengue virus
EHKSTWHYDE

SEQ ID NO: 14715 - protein, 10 aa, Dengue virus
HKSTWHYDED

SEQ ID NO: 14716 - protein, 10 aa, Dengue virus
KSTWHYDEDN

SEQ ID NO: 14717 - protein, 10 aa, Dengue virus
STWHYDEDNP

SEQ ID NO: 14718 - protein, 10 aa, Dengue virus
TWHYDEDNPY

SEQ ID NO: 14719 - protein, 10 aa, Dengue virus
WHYDEDNPYK

SEQ ID NO: 14720 - protein, 10 aa, Dengue virus
HYDEDNPYKT

SEQ ID NO: 14721 - protein, 10 aa, Dengue virus
YDEDNPYKTW

SEQ ID NO: 14722 - protein, 10 aa, Dengue virus
DEDNPYKTWA

SEQ ID NO: 14723 - protein, 10 aa, Dengue virus
EDNPYKTWAY

SEQ ID NO: 14724 - protein, 10 aa, Dengue virus
DNPYKTWAYH

SEQ ID NO: 14725 - protein, 10 aa, Dengue virus
NPYKTWAYHG

SEQ ID NO: 14726 - protein, 10 aa, Dengue virus
PYKTWAYHGS

SEQ ID NO: 14727 - protein, 10 aa, Dengue virus
YKTWAYHGSY

SEQ ID NO: 14728 - protein, 10 aa, Dengue virus
KTWAYHGSYE

SEQ ID NO: 14729 - protein, 10 aa, Dengue virus
TWAYHGSYEV

SEQ ID NO: 14730 - protein, 10 aa, Dengue virus
WAYHGSYEVK

SEQ ID NO: 14731 - protein, 10 aa, Dengue virus
AYHGSYEVKP

SEQ ID NO: 14732 - protein, 10 aa, Dengue virus
YHGSYEVKPS

SEQ ID NO: 14733 - protein, 10 aa, Dengue virus
HGSYEVKPSG

SEQ ID NO: 14734 - protein, 10 aa, Dengue virus
GSYEVKPSGS

SEQ ID NO: 14735 - protein, 10 aa, Dengue virus
SYEVKPSGSA

SEQ ID NO: 14736 - protein, 10 aa, Dengue virus
YEVKPSGSAS

SEQ ID NO: 14737 - protein, 10 aa, Dengue virus
EVKPSGSASS

SEQ ID NO: 14738 - protein, 10 aa, Dengue virus
VKPSGSASSM

SEQ ID NO: 14739 - protein, 10 aa, Dengue virus
KPSGSASSMV

SEQ ID NO: 14740 - protein, 10 aa, Dengue virus
PSGSASSMVN

SEQ ID NO: 14741 - protein, 10 aa, Dengue virus
SGSASSMVNG

SEQ ID NO: 14742 - protein, 10 aa, Dengue virus
GSASSMVNGV

SEQ ID NO: 14743 - protein, 10 aa, Dengue virus
SASSMVNGVV

SEQ ID NO: 14744 - protein, 10 aa, Dengue virus
ASSMVNGVVK

SEQ ID NO: 14745 - protein, 10 aa, Dengue virus
SSMVNGVVKL

SEQ ID NO: 14746 - protein, 10 aa, Dengue virus
SMVNGVVKLL

SEQ ID NO: 14747 - protein, 10 aa, Dengue virus
MVNGVVKLLT

SEQ ID NO: 14748 - protein, 10 aa, Dengue virus
VNGVVKLLTK

SEQ ID NO: 14749 - protein, 10 aa, Dengue virus
NGVVKLLTKP

SEQ ID NO: 14750 - protein, 10 aa, Dengue virus
GVVKLLTKPW

SEQ ID NO: 14751 - protein, 10 aa, Dengue virus
VVKLLTKPWD

SEQ ID NO: 14752 - protein, 10 aa, Dengue virus
VKLLTKPWDV

SEQ ID NO: 14753 - protein, 10 aa, Dengue virus
KLLTKPWDVI

SEQ ID NO: 14754 - protein, 10 aa, Dengue virus
LLTKPWDVIP

SEQ ID NO: 14755 - protein, 10 aa, Dengue virus
LTKPWDVIPM

SEQ ID NO: 14756 - protein, 10 aa, Dengue virus
TKPWDVIPMV

SEQ ID NO: 14757 - protein, 10 aa, Dengue virus
KPWDVIPMVT

SEQ ID NO: 14758 - protein, 10 aa, Dengue virus
PWDVIPMVTQ

SEQ ID NO: 14759 - protein, 10 aa, Dengue virus
WDVIPMVTQI

SEQ ID NO: 14760 - protein, 10 aa, Dengue virus
DVIPMVTQIA

SEQ ID NO: 14761 - protein, 10 aa, Dengue virus
VIPMVTQIAM

SEQ ID NO: 14762 - protein, 10 aa, Dengue virus
IPMVTQIAMT

SEQ ID NO: 14763 - protein, 10 aa, Dengue virus
PMVTQIAMTD

SEQ ID NO: 14764 - protein, 10 aa, Dengue virus
MVTQIAMTDT

SEQ ID NO: 14765 - protein, 10 aa, Dengue virus
VTQIAMTDTT

SEQ ID NO: 14766 - protein, 10 aa, Dengue virus
TQIAMTDTTP

SEQ ID NO: 14767 - protein, 10 aa, Dengue virus
QIAMTDTTPF

SEQ ID NO: 14768 - protein, 10 aa, Dengue virus
IAMTDTTPFG

SEQ ID NO: 14769 - protein, 10 aa, Dengue virus
AMTDTTPFGQ

SEQ ID NO: 14770 - protein, 10 aa, Dengue virus
MTDTTPFGQQ

SEQ ID NO: 14771 - protein, 10 aa, Dengue virus
TDTTPFGQQR

SEQ ID NO: 14772 - protein, 10 aa, Dengue virus
DTTPFGQQRV

SEQ ID NO: 14773 - protein, 10 aa, Dengue virus
TTPFGQQRVF

SEQ ID NO: 14774 - protein, 10 aa, Dengue virus
TPFGQQRVFK

SEQ ID NO: 14775 - protein, 10 aa, Dengue virus
PFGQQRVFKE

SEQ ID NO: 14776 - protein, 10 aa, Dengue virus
FGQQRVFKEK

SEQ ID NO: 14777 - protein, 10 aa, Dengue virus
GQQRVFKEKV

SEQ ID NO: 14778 - protein, 10 aa, Dengue virus
QQRVFKEKVD

SEQ ID NO: 14779 - protein, 10 aa, Dengue virus
QRVFKEKVDT

SEQ ID NO: 14780 - protein, 10 aa, Dengue virus
RVFKEKVDTR

SEQ ID NO: 14781 - protein, 10 aa, Dengue virus
VFKEKVDTRT

SEQ ID NO: 14782 - protein, 10 aa, Dengue virus
FKEKVDTRTP

SEQ ID NO: 14783 - protein, 10 aa, Dengue virus
KEKVDTRTPK

SEQ ID NO: 14784 - protein, 10 aa, Dengue virus
EKVDTRTPKA

SEQ ID NO: 14785 - protein, 10 aa, Dengue virus
KVDTRTPKAK

SEQ ID NO: 14786 - protein, 10 aa, Dengue virus
VDTRTPKAKR

SEQ ID NO: 14787 - protein, 10 aa, Dengue virus
DTRTPKAKRG

SEQ ID NO: 14788 - protein, 10 aa, Dengue virus
TRTPKAKRGT

SEQ ID NO: 14789 - protein, 10 aa, Dengue virus
RTPKAKRGTA

SEQ ID NO: 14790 - protein, 10 aa, Dengue virus
TPKAKRGTAQ

SEQ ID NO: 14791 - protein, 10 aa, Dengue virus
PKAKRGTAQI

SEQ ID NO: 14792 - protein, 10 aa, Dengue virus
KAKRGTAQIM

SEQ ID NO: 14793 - protein, 10 aa, Dengue virus
AKRGTAQIME

SEQ ID NO: 14794 - protein, 10 aa, Dengue virus
KRGTAQIMEV

SEQ ID NO: 14795 - protein, 10 aa, Dengue virus
RGTAQIMEVT

SEQ ID NO: 14796 - protein, 10 aa, Dengue virus
GTAQIMEVTA

SEQ ID NO: 14797 - protein, 10 aa, Dengue virus
QIMEVTAKWL

SEQ ID NO: 14798 - protein, 10 aa, Dengue virus
IMEVTAKWLW

SEQ ID NO: 14799 - protein, 10 aa, Dengue virus
MEVTAKWLWG

SEQ ID NO: 14800 - protein, 10 aa, Dengue virus
EVTAKWLWGF

SEQ ID NO: 14801 - protein, 10 aa, Dengue virus
VTAKWLWGFL

SEQ ID NO: 14802 - protein, 10 aa, Dengue virus
TAKWLWGFLS

SEQ ID NO: 14803 - protein, 10 aa, Dengue virus
AKWLWGFLSR

SEQ ID NO: 14804 - protein, 10 aa, Dengue virus
KWLWGFLSRN

SEQ ID NO: 14805 - protein, 10 aa, Dengue virus
WLWGFLSRNK

SEQ ID NO: 14806 - protein, 10 aa, Dengue virus
LWGFLSRNKK

SEQ ID NO: 14807 - protein, 10 aa, Dengue virus
WGFLSRNKKP

SEQ ID NO: 14808 - protein, 10 aa, Dengue virus
GFLSRNKKPR

SEQ ID NO: 14809 - protein, 10 aa, Dengue virus
FLSRNKKPRI

SEQ ID NO: 14810 - protein, 10 aa, Dengue virus
LSRNKKPRIC

SEQ ID NO: 14811 - protein, 10 aa, Dengue virus
SRNKKPRICT

SEQ ID NO: 14812 - protein, 10 aa, Dengue virus
RNKKPRICTR

SEQ ID NO: 14813 - protein, 10 aa, Dengue virus
NKKPRICTRE

SEQ ID NO: 14814 - protein, 10 aa, Dengue virus
KKPRICTREE

SEQ ID NO: 14815 - protein, 10 aa, Dengue virus
KPRICTREEF

SEQ ID NO: 14816 - protein, 10 aa, Dengue virus
PRICTREEFT

SEQ ID NO: 14817 - protein, 10 aa, Dengue virus
RICTREEFTR

SEQ ID NO: 14818 - protein, 10 aa, Dengue virus
ICTREEFTRK

SEQ ID NO: 14819 - protein, 10 aa, Dengue virus
CTREEFTRKV

SEQ ID NO: 14820 - protein, 10 aa, Dengue virus
TREEFTRKVR

SEQ ID NO: 14821 - protein, 10 aa, Dengue virus
REEFTRKVRS

SEQ ID NO: 14822 - protein, 10 aa, Dengue virus
EEFTRKVRSN

SEQ ID NO: 14823 - protein, 10 aa, Dengue virus
EFTRKVRSNA

SEQ ID NO: 14824 - protein, 10 aa, Dengue virus
FTRKVRSNAA

SEQ ID NO: 14825 - protein, 10 aa, Dengue virus
TRKVRSNAAI

SEQ ID NO: 14826 - protein, 10 aa, Dengue virus
RKVRSNAAIG

SEQ ID NO: 14827 - protein, 10 aa, Dengue virus
KVRSNAAIGA

SEQ ID NO: 14828 - protein, 10 aa, Dengue virus
VRSNAAIGAV

SEQ ID NO: 14829 - protein, 10 aa, Dengue virus
RSNAAIGAVF

SEQ ID NO: 14830 - protein, 10 aa, Dengue virus
SNAAIGAVFV

SEQ ID NO: 14831 - protein, 10 aa, Dengue virus
NAAIGAVFVD

SEQ ID NO: 14832 - protein, 10 aa, Dengue virus
AAIGAVFVDE

SEQ ID NO: 14833 - protein, 10 aa, Dengue virus
AIGAVFVDEN

SEQ ID NO: 14834 - protein, 10 aa, Dengue virus
IGAVFVDENQ

SEQ ID NO: 14835 - protein, 10 aa, Dengue virus
GAVFVDENQW

SEQ ID NO: 14836 - protein, 10 aa, Dengue virus
AVFVDENQWN

SEQ ID NO: 14837 - protein, 10 aa, Dengue virus
VFVDENQWNS

SEQ ID NO: 14838 - protein, 10 aa, Dengue virus
FVDENQWNSA

SEQ ID NO: 14839 - protein, 10 aa, Dengue virus
VDENQWNSAK

SEQ ID NO: 14840 - protein, 10 aa, Dengue virus
DENQWNSAKE

SEQ ID NO: 14841 - protein, 10 aa, Dengue virus
ENQWNSAKEA

SEQ ID NO: 14842 - protein, 10 aa, Dengue virus
NQWNSAKEAV

SEQ ID NO: 14843 - protein, 10 aa, Dengue virus
QWNSAKEAVE

SEQ ID NO: 14844 - protein, 10 aa, Dengue virus
WNSAKEAVED

SEQ ID NO: 14845 - protein, 10 aa, Dengue virus
NSAKEAVEDE

SEQ ID NO: 14846 - protein, 10 aa, Dengue virus
SAKEAVEDER

SEQ ID NO: 14847 - protein, 10 aa, Dengue virus
AKEAVEDERF

SEQ ID NO: 14848 - protein, 10 aa, Dengue virus
KEAVEDERFW

SEQ ID NO: 14849 - protein, 10 aa, Dengue virus
EAVEDERFWD

SEQ ID NO: 14850 - protein, 10 aa, Dengue virus
AVEDERFWDL

SEQ ID NO: 14851 - protein, 10 aa, Dengue virus
VEDERFWDLV

SEQ ID NO: 14852 - protein, 10 aa, Dengue virus
LVHRERELHK

SEQ ID NO: 14853 - protein, 10 aa, Dengue virus
VHRERELHKQ

SEQ ID NO: 14854 - protein, 10 aa, Dengue virus
HRERELHKQG

SEQ ID NO: 14855 - protein, 10 aa, Dengue virus
RERELHKQGK

SEQ ID NO: 14856 - protein, 10 aa, Dengue virus
ERELHKQGKC

SEQ ID NO: 14857 - protein, 10 aa, Dengue virus
RELHKQGKCA

SEQ ID NO: 14858 - protein, 10 aa, Dengue virus
ELHKQGKCAT

SEQ ID NO: 14859 - protein, 10 aa, Dengue virus
LHKQGKCATC

SEQ ID NO: 14860 - protein, 10 aa, Dengue virus
HKQGKCATCV

SEQ ID NO: 14861 - protein, 10 aa, Dengue virus
KQGKCATCVY

SEQ ID NO: 14862 - protein, 10 aa, Dengue virus
QGKCATCVYN

SEQ ID NO: 14863 - protein, 10 aa, Dengue virus
GKCATCVYNM

SEQ ID NO: 14864 - protein, 10 aa, Dengue virus
KCATCVYNMM

SEQ ID NO: 14865 - protein, 10 aa, Dengue virus
CATCVYNMMG

SEQ ID NO: 14866 - protein, 10 aa, Dengue virus
ATCVYNMMGK

SEQ ID NO: 14867 - protein, 10 aa, Dengue virus
TCVYNMMGKR

SEQ ID NO: 14868 - protein, 10 aa, Dengue virus
CVYNMMGKRE

SEQ ID NO: 14869 - protein, 10 aa, Dengue virus
VYNMMGKREK

SEQ ID NO: 14870 - protein, 10 aa, Dengue virus
YNMMGKREKK

SEQ ID NO: 14871 - protein, 10 aa, Dengue virus
NMMGKREKKL

SEQ ID NO: 14872 - protein, 10 aa, Dengue virus
MMGKREKKLG

SEQ ID NO: 14873 - protein, 10 aa, Dengue virus
MGKREKKLGE

SEQ ID NO: 14874 - protein, 10 aa, Dengue virus
GKREKKLGEF

SEQ ID NO: 14875 - protein, 10 aa, Dengue virus
KREKKLGEFG

SEQ ID NO: 14876 - protein, 10 aa, Dengue virus
REKKLGEFGK

SEQ ID NO: 14877 - protein, 10 aa, Dengue virus
EKKLGEFGKA

SEQ ID NO: 14878 - protein, 10 aa, Dengue virus
KKLGEFGKAK

SEQ ID NO: 14879 - protein, 10 aa, Dengue virus
KLGEFGKAKG

SEQ ID NO: 14880 - protein, 10 aa, Dengue virus
LGEFGKAKGS

SEQ ID NO: 14881 - protein, 10 aa, Dengue virus
GEFGKAKGSR

SEQ ID NO: 14882 - protein, 10 aa, Dengue virus
EFGKAKGSRA

SEQ ID NO: 14883 - protein, 10 aa, Dengue virus
FGKAKGSRAI

SEQ ID NO: 14884 - protein, 10 aa, Dengue virus
GKAKGSRAIW

SEQ ID NO: 14885 - protein, 10 aa, Dengue virus
KAKGSRAIWY

SEQ ID NO: 14886 - protein, 10 aa, Dengue virus
AKGSRAIWYM

SEQ ID NO: 14887 - protein, 10 aa, Dengue virus
KGSRAIWYMW

SEQ ID NO: 14888 - protein, 10 aa, Dengue virus
GSRAIWYMWL

SEQ ID NO: 14889 - protein, 10 aa, Dengue virus
SRAIWYMWLG

SEQ ID NO: 14890 - protein, 10 aa, Dengue virus
RAIWYMWLGA

SEQ ID NO: 14891 - protein, 10 aa, Dengue virus
AIWYMWLGAR

SEQ ID NO: 14892 - protein, 10 aa, Dengue virus
IWYMWLGARF

SEQ ID NO: 14893 - protein, 10 aa, Dengue virus
WYMWLGARFL

SEQ ID NO: 14894 - protein, 10 aa, Dengue virus
YMWLGARFLE

SEQ ID NO: 14895 - protein, 10 aa, Dengue virus
MWLGARFLEF

SEQ ID NO: 14896 - protein, 10 aa, Dengue virus
WLGARFLEFE

SEQ ID NO: 14897 - protein, 10 aa, Dengue virus
LGARFLEFEA

SEQ ID NO: 14898 - protein, 10 aa, Dengue virus
GARFLEFEAL

SEQ ID NO: 14899 - protein, 10 aa, Dengue virus
ARFLEFEALG

SEQ ID NO: 14900 - protein, 10 aa, Dengue virus
RFLEFEALGF

SEQ ID NO: 14901 - protein, 10 aa, Dengue virus
FLEFEALGFM

SEQ ID NO: 14902 - protein, 10 aa, Dengue virus
LEFEALGFMN

SEQ ID NO: 14903 - protein, 10 aa, Dengue virus
EFEALGFMNE

SEQ ID NO: 14904 - protein, 10 aa, Dengue virus
FEALGFMNED

SEQ ID NO: 14905 - protein, 10 aa, Dengue virus
EALGFMNEDH

SEQ ID NO: 14906 - protein, 10 aa, Dengue virus
ALGFMNEDHW

SEQ ID NO: 14907 - protein, 10 aa, Dengue virus
LGFMNEDHWF

SEQ ID NO: 14908 - protein, 10 aa, Dengue virus
GFMNEDHWFS

SEQ ID NO: 14909 - protein, 10 aa, Dengue virus
FMNEDHWFSR

SEQ ID NO: 14910 - protein, 10 aa, Dengue virus
MNEDHWFSRE

SEQ ID NO: 14911 - protein, 10 aa, Dengue virus
NEDHWFSREN

SEQ ID NO: 14912 - protein, 10 aa, Dengue virus
EDHWFSRENS

SEQ ID NO: 14913 - protein, 10 aa, Dengue virus
DHWFSRENSL

SEQ ID NO: 14914 - protein, 10 aa, Dengue virus
HWFSRENSLS

SEQ ID NO: 14915 - protein, 10 aa, Dengue virus
WFSRENSLSG

SEQ ID NO: 14916 - protein, 10 aa, Dengue virus
FSRENSLSGV

SEQ ID NO: 14917 - protein, 10 aa, Dengue virus
SRENSLSGVE

SEQ ID NO: 14918 - protein, 10 aa, Dengue virus
RENSLSGVEG

SEQ ID NO: 14919 - protein, 10 aa, Dengue virus
ENSLSGVEGE

SEQ ID NO: 14920 - protein, 10 aa, Dengue virus
NSLSGVEGEG

SEQ ID NO: 14921 - protein, 10 aa, Dengue virus
SLSGVEGEGL

SEQ ID NO: 14922 - protein, 10 aa, Dengue virus
LSGVEGEGLH

SEQ ID NO: 14923 - protein, 10 aa, Dengue virus
SGVEGEGLHK

SEQ ID NO: 14924 - protein, 10 aa, Dengue virus
GVEGEGLHKL

SEQ ID NO: 14925 - protein, 10 aa, Dengue virus
VEGEGLHKLG

SEQ ID NO: 14926 - protein, 10 aa, Dengue virus
EGEGLHKLGY

SEQ ID NO: 14927 - protein, 10 aa, Dengue virus
GEGLHKLGYI

SEQ ID NO: 14928 - protein, 10 aa, Dengue virus
EGLHKLGYIL

SEQ ID NO: 14929 - protein, 10 aa, Dengue virus
GLHKLGYILR

SEQ ID NO: 14930 - protein, 10 aa, Dengue virus
LHKLGYILRD

SEQ ID NO: 14931 - protein, 10 aa, Dengue virus
HKLGYILRDI

SEQ ID NO: 14932 - protein, 10 aa, Dengue virus
KLGYILRDIS

SEQ ID NO: 14933 - protein, 10 aa, Dengue virus
LGYILRDISK

SEQ ID NO: 14934 - protein, 10 aa, Dengue virus
GYILRDISKI

SEQ ID NO: 14935 - protein, 10 aa, Dengue virus
YILRDISKIP

SEQ ID NO: 14936 - protein, 10 aa, Dengue virus
ILRDISKIPG

SEQ ID NO: 14937 - protein, 10 aa, Dengue virus
LRDISKIPGG

SEQ ID NO: 14938 - protein, 10 aa, Dengue virus
RDISKIPGGN

SEQ ID NO: 14939 - protein, 10 aa, Dengue virus
DISKIPGGNM

SEQ ID NO: 14940 - protein, 10 aa, Dengue virus
ISKIPGGNMY

SEQ ID NO: 14941 - protein, 10 aa, Dengue virus
SKIPGGNMYA

SEQ ID NO: 14942 - protein, 10 aa, Dengue virus
KIPGGNMYAD

SEQ ID NO: 14943 - protein, 10 aa, Dengue virus
IPGGNMYADD

SEQ ID NO: 14944 - protein, 10 aa, Dengue virus
PGGNMYADDT

SEQ ID NO: 14945 - protein, 10 aa, Dengue virus
GGNMYADDTA

SEQ ID NO: 14946 - protein, 10 aa, Dengue virus
GNMYADDTAG

SEQ ID NO: 14947 - protein, 10 aa, Dengue virus
NMYADDTAGW

SEQ ID NO: 14948 - protein, 10 aa, Dengue virus
MYADDTAGWD

SEQ ID NO: 14949 - protein, 10 aa, Dengue virus
YADDTAGWDT

SEQ ID NO: 14950 - protein, 10 aa, Dengue virus
ADDTAGWDTR

SEQ ID NO: 14951 - protein, 10 aa, Dengue virus
DDTAGWDTRI

SEQ ID NO: 14952 - protein, 10 aa, Dengue virus
DTAGWDTRIT

SEQ ID NO: 14953 - protein, 10 aa, Dengue virus
TAGWDTRITE

SEQ ID NO: 14954 - protein, 10 aa, Dengue virus
AGWDTRITED

SEQ ID NO: 14955 - protein, 10 aa, Dengue virus
GWDTRITEDD

SEQ ID NO: 14956 - protein, 10 aa, Dengue virus
WDTRITEDDL

SEQ ID NO: 14957 - protein, 10 aa, Dengue virus
DTRITEDDLQ

SEQ ID NO: 14958 - protein, 10 aa, Dengue virus
TRITEDDLQN

SEQ ID NO: 14959 - protein, 10 aa, Dengue virus
RITEDDLQNE

SEQ ID NO: 14960 - protein, 10 aa, Dengue virus
ITEDDLQNEA

SEQ ID NO: 14961 - protein, 10 aa, Dengue virus
TEDDLQNEAK

SEQ ID NO: 14962 - protein, 10 aa, Dengue virus
EDDLQNEAKI

SEQ ID NO: 14963 - protein, 10 aa, Dengue virus
DDLQNEAKIT

SEQ ID NO: 14964 - protein, 10 aa, Dengue virus
DLQNEAKITD

SEQ ID NO: 14965 - protein, 10 aa, Dengue virus
LQNEAKITDI

SEQ ID NO: 14966 - protein, 10 aa, Dengue virus
QNEAKITDIM

SEQ ID NO: 14967 - protein, 10 aa, Dengue virus
NEAKITDIME

SEQ ID NO: 14968 - protein, 10 aa, Dengue virus
EAKITDIMEP

SEQ ID NO: 14969 - protein, 10 aa, Dengue virus
AKITDIMEPE

SEQ ID NO: 14970 - protein, 10 aa, Dengue virus
KITDIMEPEH

SEQ ID NO: 14971 - protein, 10 aa, Dengue virus
ITDIMEPEHA

SEQ ID NO: 14972 - protein, 10 aa, Dengue virus
TDIMEPEHAL

SEQ ID NO: 14973 - protein, 10 aa, Dengue virus
DIMEPEHALL

SEQ ID NO: 14974 - protein, 10 aa, Dengue virus
IMEPEHALLA

SEQ ID NO: 14975 - protein, 10 aa, Dengue virus
MEPEHALLAK

SEQ ID NO: 14976 - protein, 10 aa, Dengue virus
EPEHALLAKS

SEQ ID NO: 14977 - protein, 10 aa, Dengue virus
PEHALLAKSI

SEQ ID NO: 14978 - protein, 10 aa, Dengue virus
EHALLAKSIF

SEQ ID NO: 14979 - protein, 10 aa, Dengue virus
HALLAKSIFK

SEQ ID NO: 14980 - protein, 10 aa, Dengue virus
ALLAKSIFKL

SEQ ID NO: 14981 - protein, 10 aa, Dengue virus
LLAKSIFKLT

SEQ ID NO: 14982 - protein, 10 aa, Dengue virus
LAKSIFKLTY

SEQ ID NO: 14983 - protein, 10 aa, Dengue virus
AKSIFKLTYQ

SEQ ID NO: 14984 - protein, 10 aa, Dengue virus
KSIFKLTYQN

SEQ ID NO: 14985 - protein, 10 aa, Dengue virus
SIFKLTYQNK

SEQ ID NO: 14986 - protein, 10 aa, Dengue virus
IFKLTYQNKV

SEQ ID NO: 14987 - protein, 10 aa, Dengue virus
FKLTYQNKVV

SEQ ID NO: 14988 - protein, 10 aa, Dengue virus
KLTYQNKVVR

SEQ ID NO: 14989 - protein, 10 aa, Dengue virus
LTYQNKVVRV

SEQ ID NO: 14990 - protein, 10 aa, Dengue virus
TYQNKVVRVQ

SEQ ID NO: 14991 - protein, 10 aa, Dengue virus
YQNKVVRVQR

SEQ ID NO: 14992 - protein, 10 aa, Dengue virus
QNKVVRVQRP

SEQ ID NO: 14993 - protein, 10 aa, Dengue virus
NKVVRVQRPA

SEQ ID NO: 14994 - protein, 10 aa, Dengue virus
KVVRVQRPAK

SEQ ID NO: 14995 - protein, 10 aa, Dengue virus
VVRVQRPAKN

SEQ ID NO: 14996 - protein, 10 aa, Dengue virus
VRVQRPAKNG

SEQ ID NO: 14997 - protein, 10 aa, Dengue virus
RVQRPAKNGT

SEQ ID NO: 14998 - protein, 10 aa, Dengue virus
VQRPAKNGTV

SEQ ID NO: 14999 - protein, 10 aa, Dengue virus
QRPAKNGTVM

SEQ ID NO: 15000 - protein, 10 aa, Dengue virus
RPAKNGTVMD

SEQ ID NO: 15001 - protein, 10 aa, Dengue virus
PAKNGTVMDV

SEQ ID NO: 15002 - protein, 10 aa, Dengue virus
AKNGTVMDVI

SEQ ID NO: 15003 - protein, 10 aa, Dengue virus
KNGTVMDVIS

SEQ ID NO: 15004 - protein, 10 aa, Dengue virus
NGTVMDVISR

SEQ ID NO: 15005 - protein, 10 aa, Dengue virus
GTVMDVISRR

SEQ ID NO: 15006 - protein, 10 aa, Dengue virus
TVMDVISRRD

SEQ ID NO: 15007 - protein, 10 aa, Dengue virus
VMDVISRRDQ

SEQ ID NO: 15008 - protein, 10 aa, Dengue virus
MDVISRRDQR

SEQ ID NO: 15009 - protein, 10 aa, Dengue virus
DVISRRDQRG

SEQ ID NO: 15010 - protein, 10 aa, Dengue virus
VISRRDQRGS

SEQ ID NO: 15011 - protein, 10 aa, Dengue virus
ISRRDQRGSG

SEQ ID NO: 15012 - protein, 10 aa, Dengue virus
SRRDQRGSGQ

SEQ ID NO: 15013 - protein, 10 aa, Dengue virus
RRDQRGSGQV

SEQ ID NO: 15014 - protein, 10 aa, Dengue virus
RDQRGSGQVG

SEQ ID NO: 15015 - protein, 10 aa, Dengue virus
DQRGSGQVGT

SEQ ID NO: 15016 - protein, 10 aa, Dengue virus
QRGSGQVGTY

SEQ ID NO: 15017 - protein, 10 aa, Dengue virus
RGSGQVGTYG

SEQ ID NO: 15018 - protein, 10 aa, Dengue virus
GSGQVGTYGL

SEQ ID NO: 15019 - protein, 10 aa, Dengue virus
SGQVGTYGLN

SEQ ID NO: 15020 - protein, 10 aa, Dengue virus
GQVGTYGLNT

SEQ ID NO: 15021 - protein, 10 aa, Dengue virus
QVGTYGLNTF

SEQ ID NO: 15022 - protein, 10 aa, Dengue virus
VGTYGLNTFT

SEQ ID NO: 15023 - protein, 10 aa, Dengue virus
GTYGLNTFTN

SEQ ID NO: 15024 - protein, 10 aa, Dengue virus
TYGLNTFTNM

SEQ ID NO: 15025 - protein, 10 aa, Dengue virus
YGLNTFTNME

SEQ ID NO: 15026 - protein, 10 aa, Dengue virus
GLNTFTNMEA

SEQ ID NO: 15027 - protein, 10 aa, Dengue virus
LNTFTNMEAQ

SEQ ID NO: 15028 - protein, 10 aa, Dengue virus
NTFTNMEAQL

SEQ ID NO: 15029 - protein, 10 aa, Dengue virus
TFTNMEAQLI

SEQ ID NO: 15030 - protein, 10 aa, Dengue virus
FTNMEAQLIR

SEQ ID NO: 15031 - protein, 10 aa, Dengue virus
TNMEAQLIRQ

SEQ ID NO: 15032 - protein, 10 aa, Dengue virus
NMEAQLIRQM

SEQ ID NO: 15033 - protein, 10 aa, Dengue virus
MEAQLIRQME

SEQ ID NO: 15034 - protein, 10 aa, Dengue virus
EAQLIRQMES

SEQ ID NO: 15035 - protein, 10 aa, Dengue virus
AQLIRQMESE

SEQ ID NO: 15036 - protein, 10 aa, Dengue virus
QLIRQMESEG

SEQ ID NO: 15037 - protein, 10 aa, Dengue virus
LIRQMESEGI

SEQ ID NO: 15038 - protein, 10 aa, Dengue virus
IRQMESEGIF

SEQ ID NO: 15039 - protein, 10 aa, Dengue virus
RQMESEGIFS

SEQ ID NO: 15040 - protein, 10 aa, Dengue virus
QMESEGIFSP

SEQ ID NO: 15041 - protein, 10 aa, Dengue virus
ERLKRMAISG

SEQ ID NO: 15042 - protein, 10 aa, Dengue virus
RLKRMAISGD

SEQ ID NO: 15043 - protein, 10 aa, Dengue virus
LKRMAISGDD

SEQ ID NO: 15044 - protein, 10 aa, Dengue virus
KRMAISGDDC

SEQ ID NO: 15045 - protein, 10 aa, Dengue virus
RMAISGDDCV

SEQ ID NO: 15046 - protein, 10 aa, Dengue virus
MAISGDDCVV

SEQ ID NO: 15047 - protein, 10 aa, Dengue virus
AISGDDCVVK

SEQ ID NO: 15048 - protein, 10 aa, Dengue virus
ISGDDCVVKP

SEQ ID NO: 15049 - protein, 10 aa, Dengue virus
SGDDCVVKPI

SEQ ID NO: 15050 - protein, 10 aa, Dengue virus
GDDCVVKPID

SEQ ID NO: 15051 - protein, 10 aa, Dengue virus
DDCVVKPIDD

SEQ ID NO: 15052 - protein, 10 aa, Dengue virus
DCVVKPIDDR

SEQ ID NO: 15053 - protein, 10 aa, Dengue virus
CVVKPIDDRF

SEQ ID NO: 15054 - protein, 10 aa, Dengue virus
VVKPIDDRFA

SEQ ID NO: 15055 - protein, 10 aa, Dengue virus
VKPIDDRFAT

SEQ ID NO: 15056 - protein, 10 aa, Dengue virus
KPIDDRFATA

SEQ ID NO: 15057 - protein, 10 aa, Dengue virus
PIDDRFATAL

SEQ ID NO: 15058 - protein, 10 aa, Dengue virus
DDRFATALTA

SEQ ID NO: 15059 - protein, 10 aa, Dengue virus
DRFATALTAL

SEQ ID NO: 15060 - protein, 10 aa, Dengue virus
RFATALTALN

SEQ ID NO: 15061 - protein, 10 aa, Dengue virus
FATALTALND

SEQ ID NO: 15062 - protein, 10 aa, Dengue virus
ATALTALNDM

SEQ ID NO: 15063 - protein, 10 aa, Dengue virus
TALTALNDMG

SEQ ID NO: 15064 - protein, 10 aa, Dengue virus
ALTALNDMGK

SEQ ID NO: 15065 - protein, 10 aa, Dengue virus
LTALNDMGKV

SEQ ID NO: 15066 - protein, 10 aa, Dengue virus
TALNDMGKVR

SEQ ID NO: 15067 - protein, 10 aa, Dengue virus
ALNDMGKVRK

SEQ ID NO: 15068 - protein, 10 aa, Dengue virus
LNDMGKVRKD

SEQ ID NO: 15069 - protein, 10 aa, Dengue virus
NDMGKVRKDI

SEQ ID NO: 15070 - protein, 10 aa, Dengue virus
DMGKVRKDIP

SEQ ID NO: 15071 - protein, 10 aa, Dengue virus
MGKVRKDIPQ

SEQ ID NO: 15072 - protein, 10 aa, Dengue virus
GKVRKDIPQW

SEQ ID NO: 15073 - protein, 10 aa, Dengue virus
KVRKDIPQWE

SEQ ID NO: 15074 - protein, 10 aa, Dengue virus
VRKDIPQWEP

SEQ ID NO: 15075 - protein, 10 aa, Dengue virus
RKDIPQWEPS

SEQ ID NO: 15076 - protein, 10 aa, Dengue virus
KDIPQWEPSK

SEQ ID NO: 15077 - protein, 10 aa, Dengue virus
DIPQWEPSKG

SEQ ID NO: 15078 - protein, 10 aa, Dengue virus
IPQWEPSKGW

SEQ ID NO: 15079 - protein, 10 aa, Dengue virus
PQWEPSKGWN

SEQ ID NO: 15080 - protein, 10 aa, Dengue virus
QWEPSKGWND

SEQ ID NO: 15081 - protein, 10 aa, Dengue virus
WEPSKGWNDW

SEQ ID NO: 15082 - protein, 10 aa, Dengue virus
EPSKGWNDWQ

SEQ ID NO: 15083 - protein, 10 aa, Dengue virus
PSKGWNDWQQ

SEQ ID NO: 15084 - protein, 10 aa, Dengue virus
SKGWNDWQQV

SEQ ID NO: 15085 - protein, 10 aa, Dengue virus
KGWNDWQQVP

SEQ ID NO: 15086 - protein, 10 aa, Dengue virus
GWNDWQQVPF

SEQ ID NO: 15087 - protein, 10 aa, Dengue virus
WNDWQQVPFC

SEQ ID NO: 15088 - protein, 10 aa, Dengue virus
NDWQQVPFCS

SEQ ID NO: 15089 - protein, 10 aa, Dengue virus
DWQQVPFCSH

SEQ ID NO: 15090 - protein, 10 aa, Dengue virus
WQQVPFCSHH

SEQ ID NO: 15091 - protein, 10 aa, Dengue virus
QQVPFCSHHF

SEQ ID NO: 15092 - protein, 10 aa, Dengue virus
QVPFCSHHFH

SEQ ID NO: 15093 - protein, 10 aa, Dengue virus
VPFCSHHFHQ

SEQ ID NO: 15094 - protein, 10 aa, Dengue virus
PFCSHHFHQL

SEQ ID NO: 15095 - protein, 10 aa, Dengue virus
FCSHHFHQLI

SEQ ID NO: 15096 - protein, 10 aa, Dengue virus
CSHHFHQLIM

SEQ ID NO: 15097 - protein, 10 aa, Dengue virus
SHHFHQLIMK

SEQ ID NO: 15098 - protein, 10 aa, Dengue virus
HHFHQLIMKD

SEQ ID NO: 15099 - protein, 10 aa, Dengue virus
HFHQLIMKDG

SEQ ID NO: 15100 - protein, 10 aa, Dengue virus
FHQLIMKDGR

SEQ ID NO: 15101 - protein, 10 aa, Dengue virus
HQLIMKDGRE

SEQ ID NO: 15102 - protein, 10 aa, Dengue virus
QLIMKDGREI

SEQ ID NO: 15103 - protein, 10 aa, Dengue virus
LIMKDGREIV

SEQ ID NO: 15104 - protein, 10 aa, Dengue virus
IMKDGREIVV

SEQ ID NO: 15105 - protein, 10 aa, Dengue virus
MKDGREIVVP

SEQ ID NO: 15106 - protein, 10 aa, Dengue virus
KDGREIVVPC

SEQ ID NO: 15107 - protein, 10 aa, Dengue virus
DGREIVVPCR

SEQ ID NO: 15108 - protein, 10 aa, Dengue virus
GREIVVPCRN

SEQ ID NO: 15109 - protein, 10 aa, Dengue virus
REIVVPCRNQ

SEQ ID NO: 15110 - protein, 10 aa, Dengue virus
EIVVPCRNQD

SEQ ID NO: 15111 - protein, 10 aa, Dengue virus
IVVPCRNQDE

SEQ ID NO: 15112 - protein, 10 aa, Dengue virus
VVPCRNQDEL

SEQ ID NO: 15113 - protein, 10 aa, Dengue virus
VPCRNQDELV

SEQ ID NO: 15114 - protein, 10 aa, Dengue virus
PCRNQDELVG

SEQ ID NO: 15115 - protein, 10 aa, Dengue virus
CRNQDELVGR

SEQ ID NO: 15116 - protein, 10 aa, Dengue virus
RNQDELVGRA

SEQ ID NO: 15117 - protein, 10 aa, Dengue virus
NQDELVGRAR

SEQ ID NO: 15118 - protein, 10 aa, Dengue virus
QDELVGRARV

SEQ ID NO: 15119 - protein, 10 aa, Dengue virus
DELVGRARVS

SEQ ID NO: 15120 - protein, 10 aa, Dengue virus
ELVGRARVSQ

SEQ ID NO: 15121 - protein, 10 aa, Dengue virus
LVGRARVSQG

SEQ ID NO: 15122 - protein, 10 aa, Dengue virus
VGRARVSQGA

SEQ ID NO: 15123 - protein, 10 aa, Dengue virus
GRARVSQGAG

SEQ ID NO: 15124 - protein, 10 aa, Dengue virus
RARVSQGAGW

SEQ ID NO: 15125 - protein, 10 aa, Dengue virus
ARVSQGAGWS

SEQ ID NO: 15126 - protein, 10 aa, Dengue virus
RVSQGAGWSL

SEQ ID NO: 15127 - protein, 10 aa, Dengue virus
VSQGAGWSLR

SEQ ID NO: 15128 - protein, 10 aa, Dengue virus
SQGAGWSLRE

SEQ ID NO: 15129 - protein, 10 aa, Dengue virus
QGAGWSLRET

SEQ ID NO: 15130 - protein, 10 aa, Dengue virus
GAGWSLRETA

SEQ ID NO: 15131 - protein, 10 aa, Dengue virus
AGWSLRETAC

SEQ ID NO: 15132 - protein, 10 aa, Dengue virus
GWSLRETACL

SEQ ID NO: 15133 - protein, 10 aa, Dengue virus
WSLRETACLG

SEQ ID NO: 15134 - protein, 10 aa, Dengue virus
SLRETACLGK

SEQ ID NO: 15135 - protein, 10 aa, Dengue virus
LRETACLGKS

SEQ ID NO: 15136 - protein, 10 aa, Dengue virus
RETACLGKSY

SEQ ID NO: 15137 - protein, 10 aa, Dengue virus
ETACLGKSYA

SEQ ID NO: 15138 - protein, 10 aa, Dengue virus
TACLGKSYAQ

SEQ ID NO: 15139 - protein, 10 aa, Dengue virus
ACLGKSYAQM

SEQ ID NO: 15140 - protein, 10 aa, Dengue virus
CLGKSYAQMW

SEQ ID NO: 15141 - protein, 10 aa, Dengue virus
LGKSYAQMWQ

SEQ ID NO: 15142 - protein, 10 aa, Dengue virus
GKSYAQMWQL

SEQ ID NO: 15143 - protein, 10 aa, Dengue virus
KSYAQMWQLM

SEQ ID NO: 15144 - protein, 10 aa, Dengue virus
SYAQMWQLMY

SEQ ID NO: 15145 - protein, 10 aa, Dengue virus
YAQMWQLMYF

SEQ ID NO: 15146 - protein, 10 aa, Dengue virus
AQMWQLMYFH

SEQ ID NO: 15147 - protein, 10 aa, Dengue virus
QMWQLMYFHR

SEQ ID NO: 15148 - protein, 10 aa, Dengue virus
MWQLMYFHRR

SEQ ID NO: 15149 - protein, 10 aa, Dengue virus
WQLMYFHRRD

SEQ ID NO: 15150 - protein, 10 aa, Dengue virus
QLMYFHRRDL

SEQ ID NO: 15151 - protein, 10 aa, Dengue virus
LMYFHRRDLR

SEQ ID NO: 15152 - protein, 10 aa, Dengue virus
MYFHRRDLRL

SEQ ID NO: 15153 - protein, 10 aa, Dengue virus
YFHRRDLRLA

SEQ ID NO: 15154 - protein, 10 aa, Dengue virus
FHRRDLRLAA

SEQ ID NO: 15155 - protein, 10 aa, Dengue virus
HRRDLRLAAN

SEQ ID NO: 15156 - protein, 10 aa, Dengue virus
RRDLRLAANA

SEQ ID NO: 15157 - protein, 10 aa, Dengue virus
RDLRLAANAI

SEQ ID NO: 15158 - protein, 10 aa, Dengue virus
DLRLAANAIC

SEQ ID NO: 15159 - protein, 10 aa, Dengue virus
LRLAANAICS

SEQ ID NO: 15160 - protein, 10 aa, Dengue virus
RLAANAICSA

SEQ ID NO: 15161 - protein, 10 aa, Dengue virus
LAANAICSAV

SEQ ID NO: 15162 - protein, 10 aa, Dengue virus
AANAICSAVP

SEQ ID NO: 15163 - protein, 10 aa, Dengue virus
ANAICSAVPV

SEQ ID NO: 15164 - protein, 10 aa, Dengue virus
PVDWVPTSRT

SEQ ID NO: 15165 - protein, 10 aa, Dengue virus
VDWVPTSRTT

SEQ ID NO: 15166 - protein, 10 aa, Dengue virus
DWVPTSRTTW

SEQ ID NO: 15167 - protein, 10 aa, Dengue virus
WVPTSRTTWS

SEQ ID NO: 15168 - protein, 10 aa, Dengue virus
VPTSRTTWSI

SEQ ID NO: 15169 - protein, 10 aa, Dengue virus
PTSRTTWSIH

SEQ ID NO: 15170 - protein, 10 aa, Dengue virus
TSRTTWSIHA

SEQ ID NO: 15171 - protein, 10 aa, Dengue virus
SRTTWSIHAH

SEQ ID NO: 15172 - protein, 10 aa, Dengue virus
RTTWSIHAHH

SEQ ID NO: 15173 - protein, 10 aa, Dengue virus
TTWSIHAHHQ

SEQ ID NO: 15174 - protein, 10 aa, Dengue virus
TWSIHAHHQW

SEQ ID NO: 15175 - protein, 10 aa, Dengue virus
WSIHAHHQWM

SEQ ID NO: 15176 - protein, 10 aa, Dengue virus
SIHAHHQWMT

SEQ ID NO: 15177 - protein, 10 aa, Dengue virus
IHAHHQWMTT

SEQ ID NO: 15178 - protein, 10 aa, Dengue virus
HAHHQWMTTE

SEQ ID NO: 15179 - protein, 10 aa, Dengue virus
AHHQWMTTED

SEQ ID NO: 15180 - protein, 10 aa, Dengue virus
HHQWMTTEDM

SEQ ID NO: 15181 - protein, 10 aa, Dengue virus
HQWMTTEDML

SEQ ID NO: 15182 - protein, 10 aa, Dengue virus
QWMTTEDMLS

SEQ ID NO: 15183 - protein, 10 aa, Dengue virus
WMTTEDMLSV

SEQ ID NO: 15184 - protein, 10 aa, Dengue virus
MTTEDMLSVW

SEQ ID NO: 15185 - protein, 10 aa, Dengue virus
TTEDMLSVWN

SEQ ID NO: 15186 - protein, 10 aa, Dengue virus
TEDMLSVWNR

SEQ ID NO: 15187 - protein, 10 aa, Dengue virus
EDMLSVWNRV

SEQ ID NO: 15188 - protein, 10 aa, Dengue virus
DMLSVWNRVW

SEQ ID NO: 15189 - protein, 10 aa, Dengue virus
MLSVWNRVWI

SEQ ID NO: 15190 - protein, 10 aa, Dengue virus
LSVWNRVWIE

SEQ ID NO: 15191 - protein, 10 aa, Dengue virus
SVWNRVWIEE

SEQ ID NO: 15192 - protein, 10 aa, Dengue virus
VWNRVWIEEN

SEQ ID NO: 15193 - protein, 10 aa, Dengue virus
WNRVWIEENP

SEQ ID NO: 15194 - protein, 10 aa, Dengue virus
NRVWIEENPW

SEQ ID NO: 15195 - protein, 10 aa, Dengue virus
RVWIEENPWM

SEQ ID NO: 15196 - protein, 10 aa, Dengue virus
VWIEENPWME

SEQ ID NO: 15197 - protein, 10 aa, Dengue virus
WIEENPWMED

SEQ ID NO: 15198 - protein, 10 aa, Dengue virus
IEENPWMEDK

SEQ ID NO: 15199 - protein, 10 aa, Dengue virus
EENPWMEDKT

SEQ ID NO: 15200 - protein, 10 aa, Dengue virus
ENPWMEDKTH

SEQ ID NO: 15201 - protein, 10 aa, Dengue virus
NPWMEDKTHI

SEQ ID NO: 15202 - protein, 10 aa, Dengue virus
PWMEDKTHIS

SEQ ID NO: 15203 - protein, 10 aa, Dengue virus
WMEDKTHISS

SEQ ID NO: 15204 - protein, 10 aa, Dengue virus
MEDKTHISSW

SEQ ID NO: 15205 - protein, 10 aa, Dengue virus
EDKTHISSWG

SEQ ID NO: 15206 - protein, 10 aa, Dengue virus
ISSWGDVPYL

SEQ ID NO: 15207 - protein, 10 aa, Dengue virus
SSWGDVPYLG

SEQ ID NO: 15208 - protein, 10 aa, Dengue virus
SWGDVPYLGK

SEQ ID NO: 15209 - protein, 10 aa, Dengue virus
WGDVPYLGKR

SEQ ID NO: 15210 - protein, 10 aa, Dengue virus
GDVPYLGKRE

SEQ ID NO: 15211 - protein, 10 aa, Dengue virus
DVPYLGKRED

SEQ ID NO: 15212 - protein, 10 aa, Dengue virus
VPYLGKREDQ

SEQ ID NO: 15213 - protein, 10 aa, Dengue virus
PYLGKREDQW

SEQ ID NO: 15214 - protein, 10 aa, Dengue virus
YLGKREDQWC

SEQ ID NO: 15215 - protein, 10 aa, Dengue virus
LGKREDQWCG

SEQ ID NO: 15216 - protein, 10 aa, Dengue virus
GKREDQWCGS

SEQ ID NO: 15217 - protein, 10 aa, Dengue virus
KREDQWCGSL

SEQ ID NO: 15218 - protein, 10 aa, Dengue virus
REDQWCGSLI

SEQ ID NO: 15219 - protein, 10 aa, Dengue virus
EDQWCGSLIG

SEQ ID NO: 15220 - protein, 10 aa, Dengue virus
DQWCGSLIGL

SEQ ID NO: 15221 - protein, 10 aa, Dengue virus
QWCGSLIGLT

SEQ ID NO: 15222 - protein, 10 aa, Dengue virus
WCGSLIGLTA

SEQ ID NO: 15223 - protein, 10 aa, Dengue virus
CGSLIGLTAR

SEQ ID NO: 15224 - protein, 10 aa, Dengue virus
GSLIGLTARA

SEQ ID NO: 15225 - protein, 10 aa, Dengue virus
SLIGLTARAT

SEQ ID NO: 15226 - protein, 10 aa, Dengue virus
LIGLTARATW

SEQ ID NO: 15227 - protein, 10 aa, Dengue virus
IGLTARATWA

SEQ ID NO: 15228 - protein, 10 aa, Dengue virus
GLTARATWAT

SEQ ID NO: 15229 - protein, 10 aa, Dengue virus
LTARATWATN

SEQ ID NO: 15230 - protein, 10 aa, Dengue virus
TARATWATNI

SEQ ID NO: 15231 - protein, 10 aa, Dengue virus
ARATWATNIQ

SEQ ID NO: 15232 - protein, 10 aa, Dengue virus
RATWATNIQV

SEQ ID NO: 15233 - protein, 10 aa, Dengue virus
ATWATNIQVA

SEQ ID NO: 15234 - protein, 10 aa, Dengue virus
TWATNIQVAI

SEQ ID NO: 15235 - protein, 10 aa, Dengue virus
WATNIQVAIN

SEQ ID NO: 15236 - protein, 10 aa, Dengue virus
ATNIQVAINQ

SEQ ID NO: 15237 - protein, 10 aa, Dengue virus
TNIQVAINQV

SEQ ID NO: 15238 - protein, 10 aa, Dengue virus
NIQVAINQVR

SEQ ID NO: 15239 - protein, 10 aa, Dengue virus
IQVAINQVRR

SEQ ID NO: 15240 - protein, 10 aa, Dengue virus
QVAINQVRRL

SEQ ID NO: 15241 - protein, 10 aa, Dengue virus
VAINQVRRLI

SEQ ID NO: 15242 - protein, 10 aa, Dengue virus
AINQVRRLIG

SEQ ID NO: 15243 - protein, 10 aa, Dengue virus
INQVRRLIGN

SEQ ID NO: 15244 - protein, 10 aa, Dengue virus
NQVRRLIGNE

SEQ ID NO: 15245 - protein, 10 aa, Dengue virus
QVRRLIGNEN

SEQ ID NO: 15246 - protein, 10 aa, Dengue virus
VRRLIGNENY

SEQ ID NO: 15247 - protein, 10 aa, Dengue virus
RRLIGNENYL

SEQ ID NO: 15248 - protein, 10 aa, Dengue virus
RLIGNENYLD

SEQ ID NO: 15249 - protein, 10 aa, Dengue virus
LIGNENYLDY

SEQ ID NO: 15250 - protein, 10 aa, Dengue virus
IGNENYLDYM

SEQ ID NO: 15251 - protein, 10 aa, Dengue virus
GNENYLDYMT

SEQ ID NO: 15252 - protein, 10 aa, Dengue virus
NENYLDYMTS

SEQ ID NO: 15253 - protein, 10 aa, Dengue virus
ENYLDYMTSM

SEQ ID NO: 15254 - protein, 10 aa, Dengue virus
NYLDYMTSMK

SEQ ID NO: 15255 - protein, 10 aa, Dengue virus
YLDYMTSMKR

SEQ ID NO: 15256 - protein, 10 aa, Dengue virus
LDYMTSMKRF

SEQ ID NO: 15257 - protein, 10 aa, Dengue virus
DYMTSMKRFK

SEQ ID NO: 15258 - protein, 10 aa, Dengue virus
YMTSMKRFKN

SEQ ID NO: 15259 - protein, 10 aa, Dengue virus
MTSMKRFKNE

SEQ ID NO: 15260 - protein, 10 aa, Dengue virus
MNNQRKKTGR

SEQ ID NO: 15261 - protein, 10 aa, Dengue virus
NNQRKKTGRP

SEQ ID NO: 15262 - protein, 10 aa, Dengue virus
NQRKKTGRPS

SEQ ID NO: 15263 - protein, 10 aa, Dengue virus
QRKKTGRPSF

SEQ ID NO: 15264 - protein, 10 aa, Dengue virus
RKKTGRPSFN

SEQ ID NO: 15265 - protein, 10 aa, Dengue virus
KKTGRPSFNM

SEQ ID NO: 15266 - protein, 10 aa, Dengue virus
KTGRPSFNML

SEQ ID NO: 15267 - protein, 10 aa, Dengue virus
TGRPSFNMLK

SEQ ID NO: 15268 - protein, 10 aa, Dengue virus
GRPSFNMLKR

SEQ ID NO: 15269 - protein, 10 aa, Dengue virus
QPSFNMLKRA

SEQ ID NO: 15270 - protein, 10 aa, Dengue virus
KRARNRVSTG

SEQ ID NO: 15271 - protein, 10 aa, Dengue virus
RARNRVSTGS

SEQ ID NO: 15272 - protein, 10 aa, Dengue virus
ARNRVSTGSQ

SEQ ID NO: 15273 - protein, 10 aa, Dengue virus
RNRVSTGSQL

SEQ ID NO: 15274 - protein, 10 aa, Dengue virus
NRVSTGSQLA

SEQ ID NO: 15275 - protein, 10 aa, Dengue virus
RVSTGSQLAK

SEQ ID NO: 15276 - protein, 10 aa, Dengue virus
VSTGSQLAKR

SEQ ID NO: 15277 - protein, 10 aa, Dengue virus
STGSQLAKRF

SEQ ID NO: 15278 - protein, 10 aa, Dengue virus
TGSQLAKRFS

SEQ ID NO: 15279 - protein, 10 aa, Dengue virus
GSQLAKRFSK

SEQ ID NO: 15280 - protein, 10 aa, Dengue virus
LLSGQGPMKM

SEQ ID NO: 15281 - protein, 10 aa, Dengue virus
LSGQGPMKMV

SEQ ID NO: 15282 - protein, 10 aa, Dengue virus
SGQGPMKMVM

SEQ ID NO: 15283 - protein, 10 aa, Dengue virus
GQGPMKMVMA

SEQ ID NO: 15284 - protein, 10 aa, Dengue virus
QGPMKMVMAF

SEQ ID NO: 15285 - protein, 10 aa, Dengue virus
GPMKMVMAFI

SEQ ID NO: 15286 - protein, 10 aa, Dengue virus
PMKMVMAFIA

SEQ ID NO: 15287 - protein, 10 aa, Dengue virus
MKMVMAFIAF

SEQ ID NO: 15288 - protein, 10 aa, Dengue virus
KMVMAFIAFL

SEQ ID NO: 15289 - protein, 10 aa, Dengue virus
MVMAFIAFLR

SEQ ID NO: 15290 - protein, 10 aa, Dengue virus
PTAGILARWS

SEQ ID NO: 15291 - protein, 10 aa, Dengue virus
TAGILARWSS

SEQ ID NO: 15292 - protein, 10 aa, Dengue virus
AGILARWSSF

SEQ ID NO: 15293 - protein, 10 aa, Dengue virus
GILARWSSFK

SEQ ID NO: 15294 - protein, 10 aa, Dengue virus
ILARWSSFKK

SEQ ID NO: 15295 - protein, 10 aa, Dengue virus
LARWGSFKKS

SEQ ID NO: 15296 - protein, 10 aa, Dengue virus
ARWGSFKKSG

SEQ ID NO: 15297 - protein, 10 aa, Dengue virus
RWGSFKKSGA

SEQ ID NO: 15298 - protein, 10 aa, Dengue virus
WGSFKKSGAI

SEQ ID NO: 15299 - protein, 10 aa, Dengue virus
GSFKKSGAIK

SEQ ID NO: 15300 - protein, 10 aa, Dengue virus
SFKKSGAIKV

SEQ ID NO: 15301 - protein, 10 aa, Dengue virus
FKKSGAIKVL

SEQ ID NO: 15302 - protein, 10 aa, Dengue virus
KKSGAIKVLR

SEQ ID NO: 15303 - protein, 10 aa, Dengue virus
KSGAIKVLRG

SEQ ID NO: 15304 - protein, 10 aa, Dengue virus
SGAIKVLRGF

SEQ ID NO: 15305 - protein, 10 aa, Dengue virus
GAIRVLRGFK

SEQ ID NO: 15306 - protein, 10 aa, Dengue virus
AIKVLRGFKR

SEQ ID NO: 15307 - protein, 10 aa, Dengue virus
IKVLRGFKRE

SEQ ID NO: 15308 - protein, 10 aa, Dengue virus
KVLRGFKKEV

SEQ ID NO: 15309 - protein, 10 aa, Dengue virus
VLRGFKKEVS

SEQ ID NO: 15310 - protein, 10 aa, Dengue virus
LRGFKKEISS

SEQ ID NO: 15311 - protein, 10 aa, Dengue virus
RGFKKEISSM

SEQ ID NO: 15312 - protein, 10 aa, Dengue virus
GFKKEISSML

SEQ ID NO: 15313 - protein, 10 aa, Dengue virus
FKKEISSMLN

SEQ ID NO: 15314 - protein, 10 aa, Dengue virus
MNRRKKSVTM

SEQ ID NO: 15315 - protein, 10 aa, Dengue virus
NRRKKSVTML

SEQ ID NO: 15316 - protein, 10 aa, Dengue virus
PTVLTFHLTT

SEQ ID NO: 15317 - protein, 10 aa, Dengue virus
TVLTFHLTTR

SEQ ID NO: 15318 - protein, 10 aa, Dengue virus
VLTFHLTTRG

SEQ ID NO: 15319 - protein, 10 aa, Dengue virus
LTFHLTTRGG

SEQ ID NO: 15320 - protein, 10 aa, Dengue virus
TFHLTTRGGE

SEQ ID NO: 15321 - protein, 10 aa, Dengue virus
TTRGGEPHMV

SEQ ID NO: 15322 - protein, 10 aa, Dengue virus
TRGGEPHMVV

SEQ ID NO: 15323 - protein, 10 aa, Dengue virus
RGGEPHMIVT

SEQ ID NO: 15324 - protein, 10 aa, Dengue virus
GGEPHMIVTK

SEQ ID NO: 15325 - protein, 10 aa, Dengue virus
GEPHMIVTKQ

SEQ ID NO: 15326 - protein, 10 aa, Dengue virus
EPHMIVTKQE

SEQ ID NO: 15327 - protein, 10 aa, Dengue virus
PHMIVTKQER

SEQ ID NO: 15328 - protein, 10 aa, Dengue virus
HMIVTKQERG

SEQ ID NO: 15329 - protein, 10 aa, Dengue virus
MIVTKQERGK

SEQ ID NO: 15330 - protein, 10 aa, Dengue virus
IVTKQERGKS

SEQ ID NO: 15331 - protein, 10 aa, Dengue virus
VTKQERGKSL

SEQ ID NO: 15332 - protein, 10 aa, Dengue virus
TKQERGKSLL

SEQ ID NO: 15333 - protein, 10 aa, Dengue virus
GKSLLFKTSV

SEQ ID NO: 15334 - protein, 10 aa, Dengue virus
KSLLFKTSVG

SEQ ID NO: 15335 - protein, 10 aa, Dengue virus
SLLFKTSVGV

SEQ ID NO: 15336 - protein, 10 aa, Dengue virus
LLFKTSVGVN

SEQ ID NO: 15337 - protein, 10 aa, Dengue virus
LFKTSVGVNM

SEQ ID NO: 15338 - protein, 10 aa, Dengue virus
FKTSVGVNMC

SEQ ID NO: 15339 - protein, 10 aa, Dengue virus
KTSVGVNMCT

SEQ ID NO: 15340 - protein, 10 aa, Dengue virus
TSVGVNMCTL

SEQ ID NO: 15341 - protein, 10 aa, Dengue virus
SVGVNMCTLI

SEQ ID NO: 15342 - protein, 10 aa, Dengue virus
VGVNMCTLIA

SEQ ID NO: 15343 - protein, 10 aa, Dengue virus
GINMCTLIAM

SEQ ID NO: 15344 - protein, 10 aa, Dengue virus
INMCTLIAMD

SEQ ID NO: 15345 - protein, 10 aa, Dengue virus
TLIAMDLGEF

SEQ ID NO: 15346 - protein, 10 aa, Dengue virus
LIAMDLGEFC

SEQ ID NO: 15347 - protein, 10 aa, Dengue virus
IAMDLGEFCE

SEQ ID NO: 15348 - protein, 10 aa, Dengue virus
AMDLGEFCED

SEQ ID NO: 15349 - protein, 10 aa, Dengue virus
MDLGEFCEDT

SEQ ID NO: 15350 - protein, 10 aa, Dengue virus
DLGEFCEDTM

SEQ ID NO: 15351 - protein, 10 aa, Dengue virus
LGEFCEDTMT

SEQ ID NO: 15352 - protein, 10 aa, Dengue virus
GEFCEDTMTY

SEQ ID NO: 15353 - protein, 10 aa, Dengue virus
EFCEDTMTYK

SEQ ID NO: 15354 - protein, 10 aa, Dengue virus
FCEDTMTYKC

SEQ ID NO: 15355 - protein, 10 aa, Dengue virus
CDDTMTYKCP

SEQ ID NO: 15356 - protein, 10 aa, Dengue virus
EDTMTYKCPQ

SEQ ID NO: 15357 - protein, 10 aa, Dengue virus
DTMTYKCPQI

SEQ ID NO: 15358 - protein, 10 aa, Dengue virus
TMTYKCPQIT

SEQ ID NO: 15359 - protein, 10 aa, Dengue virus
MTYKCPQITE

SEQ ID NO: 15360 - protein, 10 aa, Dengue virus
TYKCPRITET

SEQ ID NO: 15361 - protein, 10 aa, Dengue virus
YKCPRITETE

SEQ ID NO: 15362 - protein, 10 aa, Dengue virus
KCPRITETEP

SEQ ID NO: 15363 - protein, 10 aa, Dengue virus
CPRITETEPD

SEQ ID NO: 15364 - protein, 10 aa, Dengue virus
PRITETEPDD

SEQ ID NO: 15365 - protein, 10 aa, Dengue virus
RITETEPDDV

SEQ ID NO: 15366 - protein, 10 aa, Dengue virus
ITETEPDDVD

SEQ ID NO: 15367 - protein, 10 aa, Dengue virus
TETEPDDVDC

SEQ ID NO: 15368 - protein, 10 aa, Dengue virus
ETEPDDVDCW

SEQ ID NO: 15369 - protein, 10 aa, Dengue virus
TEPDDVDCWC

SEQ ID NO: 15370 - protein, 10 aa, Dengue virus
PDDVDCWCNT

SEQ ID NO: 15371 - protein, 10 aa, Dengue virus
DDVDCWCNTT

SEQ ID NO: 15372 - protein, 10 aa, Dengue virus
DVDCWCNATE

SEQ ID NO: 15373 - protein, 10 aa, Dengue virus
VDCWCNATET

SEQ ID NO: 15374 - protein, 10 aa, Dengue virus
DCWCNATETW

SEQ ID NO: 15375 - protein, 10 aa, Dengue virus
CWCNATETWV

SEQ ID NO: 15376 - protein, 10 aa, Dengue virus
WCNATETWVT

SEQ ID NO: 15377 - protein, 10 aa, Dengue virus
CNATETWVTY

SEQ ID NO: 15378 - protein, 10 aa, Dengue virus
NATETWVTYG

SEQ ID NO: 15379 - protein, 10 aa, Dengue virus
ATETWVTYGT

SEQ ID NO: 15380 - protein, 10 aa, Dengue virus
TETWVTYGTC

SEQ ID NO: 15381 - protein, 10 aa, Dengue virus
ETWVTYGTCS

SEQ ID NO: 15382 - protein, 10 aa, Dengue virus
TWVTYGTCTQ

SEQ ID NO: 15383 - protein, 10 aa, Dengue virus
TYGTCSQTGG

SEQ ID NO: 15384 - protein, 10 aa, Dengue virus
YGTCSQTGGH

SEQ ID NO: 15385 - protein, 10 aa, Dengue virus
GTCSQTGGHR

SEQ ID NO: 15386 - protein, 10 aa, Dengue virus
TCTQIGEHRR

SEQ ID NO: 15387 - protein, 10 aa, Dengue virus
CSQTGEHRRE

SEQ ID NO: 15388 - protein, 10 aa, Dengue virus
SQTGEHRREK

SEQ ID NO: 15389 - protein, 10 aa, Dengue virus
QTGEHRREKR

SEQ ID NO: 15390 - protein, 10 aa, Dengue virus
TGEHRREKRS

SEQ ID NO: 15391 - protein, 10 aa, Dengue virus
GEHRREKRSV

SEQ ID NO: 15392 - protein, 10 aa, Dengue virus
EHRREKRSVA

SEQ ID NO: 15393 - protein, 10 aa, Dengue virus
HRREKRSVAL

SEQ ID NO: 15394 - protein, 10 aa, Dengue virus
RREKRSVALA

SEQ ID NO: 15395 - protein, 10 aa, Dengue virus
REKRSVALAP

SEQ ID NO: 15396 - protein, 10 aa, Dengue virus
EKRSVALAPH

SEQ ID NO: 15397 - protein, 10 aa, Dengue virus
HVGLGLETRA

SEQ ID NO: 15398 - protein, 10 aa, Dengue virus
VGLGLETRAE

SEQ ID NO: 15399 - protein, 10 aa, Dengue virus
GLGLETRAET

SEQ ID NO: 15400 - protein, 10 aa, Dengue virus
LGLETRAETW

SEQ ID NO: 15401 - protein, 10 aa, Dengue virus
GLETRAETWM

SEQ ID NO: 15402 - protein, 10 aa, Dengue virus
LETRAETWMS

SEQ ID NO: 15403 - protein, 10 aa, Dengue virus
ETRAETWMSS

SEQ ID NO: 15404 - protein, 10 aa, Dengue virus
TRAETWMSSE

SEQ ID NO: 15405 - protein, 10 aa, Dengue virus
RAETWMSSEG

SEQ ID NO: 15406 - protein, 10 aa, Dengue virus
AETWMSSEGA

SEQ ID NO: 15407 - protein, 10 aa, Dengue virus
TWMSSEGAWR

SEQ ID NO: 15408 - protein, 10 aa, Dengue virus
WMSSEGAWRQ

SEQ ID NO: 15409 - protein, 10 aa, Dengue virus
MSSEGAWRQI

SEQ ID NO: 15410 - protein, 10 aa, Dengue virus
SSEGAWRQIQ

SEQ ID NO: 15411 - protein, 10 aa, Dengue virus
SEGAWKQIQK

SEQ ID NO: 15412 - protein, 10 aa, Dengue virus
EGAWKQIQKV

SEQ ID NO: 15413 - protein, 10 aa, Dengue virus
GAWKQIQKVE

SEQ ID NO: 15414 - protein, 10 aa, Dengue virus
AWKQIQKVET

SEQ ID NO: 15415 - protein, 10 aa, Dengue virus
WKQIQKVETW

SEQ ID NO: 15416 - protein, 10 aa, Dengue virus
KQIQKVETWA

SEQ ID NO: 15417 - protein, 10 aa, Dengue virus
QIQKVETWAL

SEQ ID NO: 15418 - protein, 10 aa, Dengue virus
IQKVETWALR

SEQ ID NO: 15419 - protein, 10 aa, Dengue virus
QKVETWALRH

SEQ ID NO: 15420 - protein, 10 aa, Dengue virus
KVETWALRHP

SEQ ID NO: 15421 - protein, 10 aa, Dengue virus
TWVLRHPGFT

SEQ ID NO: 15422 - protein, 10 aa, Dengue virus
WVLRHPGFTV

SEQ ID NO: 15423 - protein, 10 aa, Dengue virus
ALRHPGFTVT

SEQ ID NO: 15424 - protein, 10 aa, Dengue virus
LRHPGFTVTA

SEQ ID NO: 15425 - protein, 10 aa, Dengue virus
RHPGFTVIAF

SEQ ID NO: 15426 - protein, 10 aa, Dengue virus
HPGFTVIAFF

SEQ ID NO: 15427 - protein, 10 aa, Dengue virus
PGFTVIAFFL

SEQ ID NO: 15428 - protein, 10 aa, Dengue virus
GFTVIAFFLA

SEQ ID NO: 15429 - protein, 10 aa, Dengue virus
AFFLAHAIGT

SEQ ID NO: 15430 - protein, 10 aa, Dengue virus
FFLAHAIGTS

SEQ ID NO: 15431 - protein, 10 aa, Dengue virus
FLAHVIGTSI

SEQ ID NO: 15432 - protein, 10 aa, Dengue virus
LAHVIGTSIT

SEQ ID NO: 15433 - protein, 10 aa, Dengue virus
AHVIGTSITQ

SEQ ID NO: 15434 - protein, 10 aa, Dengue virus
HVIGTSITQK

SEQ ID NO: 15435 - protein, 10 aa, Dengue virus
VIGTSITQKG

SEQ ID NO: 15436 - protein, 10 aa, Dengue virus
GIIFILLMLA

SEQ ID NO: 15437 - protein, 10 aa, Dengue virus
IIFILLMLAT

SEQ ID NO: 15438 - protein, 10 aa, Dengue virus
IFILLMLATP

SEQ ID NO: 15439 - protein, 10 aa, Dengue virus
FILLMLATPS

SEQ ID NO: 15440 - protein, 10 aa, Dengue virus
ILLMLATPSM

SEQ ID NO: 15441 - protein, 10 aa, Dengue virus
LLMLATPSMA

SEQ ID NO: 15442 - protein, 10 aa, Dengue virus
LMLATPSMAM

SEQ ID NO: 15443 - protein, 10 aa, Dengue virus
MLATPSMAMR

SEQ ID NO: 15444 - protein, 10 aa, Dengue virus
MAMRCVGIGN

SEQ ID NO: 15445 - protein, 10 aa, Dengue virus
AMRCVGIGNR

SEQ ID NO: 15446 - protein, 10 aa, Dengue virus
MRCVGIGNRD

SEQ ID NO: 15447 - protein, 10 aa, Dengue virus
RCVGIGNRDF

SEQ ID NO: 15448 - protein, 10 aa, Dengue virus
CVGIGNRDFV

SEQ ID NO: 15449 - protein, 10 aa, Dengue virus
VGIGNRDFVE

SEQ ID NO: 15450 - protein, 10 aa, Dengue virus
GIGNRDFVEG

SEQ ID NO: 15451 - protein, 10 aa, Dengue virus
IGNRDFVEGL

SEQ ID NO: 15452 - protein, 10 aa, Dengue virus
GNRDFVEGLS

SEQ ID NO: 15453 - protein, 10 aa, Dengue virus
NRDFVEGLSG

SEQ ID NO: 15454 - protein, 10 aa, Dengue virus
GSCVTTMAKN

SEQ ID NO: 15455 - protein, 10 aa, Dengue virus
SCVTTMAKNK

SEQ ID NO: 15456 - protein, 10 aa, Dengue virus
CVTTMAKNKP

SEQ ID NO: 15457 - protein, 10 aa, Dengue virus
VTTMAKNKPT

SEQ ID NO: 15458 - protein, 10 aa, Dengue virus
TTMAKNKPTL

SEQ ID NO: 15459 - protein, 10 aa, Dengue virus
TMAKNKPTLD

SEQ ID NO: 15460 - protein, 10 aa, Dengue virus
MAKNKPTLDI

SEQ ID NO: 15461 - protein, 10 aa, Dengue virus
AKNKPTLDIE

SEQ ID NO: 15462 - protein, 10 aa, Dengue virus
KNKPTLDIEL

SEQ ID NO: 15463 - protein, 10 aa, Dengue virus
NKPTLDIELL

SEQ ID NO: 15464 - protein, 10 aa, Dengue virus
IELLKTEVTD

SEQ ID NO: 15465 - protein, 10 aa, Dengue virus
ELLKTEVTDP

SEQ ID NO: 15466 - protein, 10 aa, Dengue virus
LLKTEVTDPA

SEQ ID NO: 15467 - protein, 10 aa, Dengue virus
LKTEVTNPAI

SEQ ID NO: 15468 - protein, 10 aa, Dengue virus
KTEVTNPAIL

SEQ ID NO: 15469 - protein, 10 aa, Dengue virus
TEVTNPAILR

SEQ ID NO: 15470 - protein, 10 aa, Dengue virus
EVTNPAILRK

SEQ ID NO: 15471 - protein, 10 aa, Dengue virus
VTNPAILRKL

SEQ ID NO: 15472 - protein, 10 aa, Dengue virus
TNPAILRKLC

SEQ ID NO: 15473 - protein, 10 aa, Dengue virus
NPAILRKLCI

SEQ ID NO: 15474 - protein, 10 aa, Dengue virus
PAILRKLCIE

SEQ ID NO: 15475 - protein, 10 aa, Dengue virus
AILRKLCIEA

SEQ ID NO: 15476 - protein, 10 aa, Dengue virus
ILRKLCIEAK

SEQ ID NO: 15477 - protein, 10 aa, Dengue virus
CPTQGEATLM

SEQ ID NO: 15478 - protein, 10 aa, Dengue virus
PTQGEATLME

SEQ ID NO: 15479 - protein, 10 aa, Dengue virus
TQGEATLMEE

SEQ ID NO: 15480 - protein, 10 aa, Dengue virus
QGEATLMEEQ

SEQ ID NO: 15481 - protein, 10 aa, Dengue virus
GEATLMEEQD

SEQ ID NO: 15482 - protein, 10 aa, Dengue virus
EATLMEEQDA

SEQ ID NO: 15483 - protein, 10 aa, Dengue virus
ATLMEEQDAN

SEQ ID NO: 15484 - protein, 10 aa, Dengue virus
TLMEEQDANF

SEQ ID NO: 15485 - protein, 10 aa, Dengue virus
LMEEQDANFV

SEQ ID NO: 15486 - protein, 10 aa, Dengue virus
MEEQDANFVC

SEQ ID NO: 15487 - protein, 10 aa, Dengue virus
EEQDTNFVCR

SEQ ID NO: 15488 - protein, 10 aa, Dengue virus
EQDTNFVCRR

SEQ ID NO: 15489 - protein, 10 aa, Dengue virus
QDTNFVCRRT

SEQ ID NO: 15490 - protein, 10 aa, Dengue virus
DTNFVCRRTF

SEQ ID NO: 15491 - protein, 10 aa, Dengue virus
TNFVCRRTFV

SEQ ID NO: 15492 - protein, 10 aa, Dengue virus
NFVCRRTLVD

SEQ ID NO: 15493 - protein, 10 aa, Dengue virus
FVCRRTLVDR

SEQ ID NO: 15494 - protein, 10 aa, Dengue virus
VCRRTLVDRG

SEQ ID NO: 15495 - protein, 10 aa, Dengue virus
CRRTLVDRGW

SEQ ID NO: 15496 - protein, 10 aa, Dengue virus
RRTLVDRGWG

SEQ ID NO: 15497 - protein, 10 aa, Dengue virus
RTLVDRGWGN

SEQ ID NO: 15498 - protein, 10 aa, Dengue virus
TLVDRGWGNG

SEQ ID NO: 15499 - protein, 10 aa, Dengue virus
LVDRGWGNGC

SEQ ID NO: 15500 - protein, 10 aa, Dengue virus
CGLFGKGSLL

SEQ ID NO: 15501 - protein, 10 aa, Dengue virus
GLFGKGSLLT

SEQ ID NO: 15502 - protein, 10 aa, Dengue virus
LFGKGSLLTC

SEQ ID NO: 15503 - protein, 10 aa, Dengue virus
FGKGSLLTCA

SEQ ID NO: 15504 - protein, 10 aa, Dengue virus
GKGSLLTCAK

SEQ ID NO: 15505 - protein, 10 aa, Dengue virus
KGSLLTCAKF

SEQ ID NO: 15506 - protein, 10 aa, Dengue virus
GSLLTCAKFK

SEQ ID NO: 15507 - protein, 10 aa, Dengue virus
SLLTCAKFKC

SEQ ID NO: 15508 - protein, 10 aa, Dengue virus
LLTCAKFKCV

SEQ ID NO: 15509 - protein, 10 aa, Dengue virus
LTCAKFKCVT

SEQ ID NO: 15510 - protein, 10 aa, Dengue virus
KCVTKLEGKT

SEQ ID NO: 15511 - protein, 10 aa, Dengue virus
CVTKLEGKTV

SEQ ID NO: 15512 - protein, 10 aa, Dengue virus
VTKLEGKTVQ

SEQ ID NO: 15513 - protein, 10 aa, Dengue virus
TKLEGKTVQY

SEQ ID NO: 15514 - protein, 10 aa, Dengue virus
KLEGKTVQYE

SEQ ID NO: 15515 - protein, 10 aa, Dengue virus
LEGKTVQYEN

SEQ ID NO: 15516 - protein, 10 aa, Dengue virus
EGKTVQYENL

SEQ ID NO: 15517 - protein, 10 aa, Dengue virus
GKTVQYENLK

SEQ ID NO: 15518 - protein, 10 aa, Dengue virus
KTVQYENLKY

SEQ ID NO: 15519 - protein, 10 aa, Dengue virus
TVQYENLKYS

SEQ ID NO: 15520 - protein, 10 aa, Dengue virus
VQHENLKYSV

SEQ ID NO: 15521 - protein, 10 aa, Dengue virus
QHENLKYSVI

SEQ ID NO: 15522 - protein, 10 aa, Dengue virus
HENLKYSVIV

SEQ ID NO: 15523 - protein, 10 aa, Dengue virus
GDQHQVGNET

SEQ ID NO: 15524 - protein, 10 aa, Dengue virus
DQHQVGNETT

SEQ ID NO: 15525 - protein, 10 aa, Dengue virus
QHQVGNETTE

SEQ ID NO: 15526 - protein, 10 aa, Dengue virus
HQVGNETTEH

SEQ ID NO: 15527 - protein, 10 aa, Dengue virus
QVGNETTEHG

SEQ ID NO: 15528 - protein, 10 aa, Dengue virus
VGNETTEHGT

SEQ ID NO: 15529 - protein, 10 aa, Dengue virus
GNETTEHGTI

SEQ ID NO: 15530 - protein, 10 aa, Dengue virus
NETTEHGTIA

SEQ ID NO: 15531 - protein, 10 aa, Dengue virus
ETTEHGTIAT

SEQ ID NO: 15532 - protein, 10 aa, Dengue virus
TTEHGTIATI

SEQ ID NO: 15533 - protein, 10 aa, Dengue virus
TEHGTIATIT

SEQ ID NO: 15534 - protein, 10 aa, Dengue virus
EHGTIATITP

SEQ ID NO: 15535 - protein, 10 aa, Dengue virus
HGTIATITPQ

SEQ ID NO: 15536 - protein, 10 aa, Dengue virus
GTIATITPQA

SEQ ID NO: 15537 - protein, 10 aa, Dengue virus
TIATITPQAP

SEQ ID NO: 15538 - protein, 10 aa, Dengue virus
IATITPQAPT

SEQ ID NO: 15539 - protein, 10 aa, Dengue virus
ATITPQAPTS

SEQ ID NO: 15540 - protein, 10 aa, Dengue virus
TITPQAPTSE

SEQ ID NO: 15541 - protein, 10 aa, Dengue virus
ITPQAPTSEI

SEQ ID NO: 15542 - protein, 10 aa, Dengue virus
TPQAPTSEIQ

SEQ ID NO: 15543 - protein, 10 aa, Dengue virus
PQAPTSEIQL

SEQ ID NO: 15544 - protein, 10 aa, Dengue virus
QAPTSEIQLT

SEQ ID NO: 15545 - protein, 10 aa, Dengue virus
APTSEIQLTD

SEQ ID NO: 15546 - protein, 10 aa, Dengue virus
PTSEIQLTDY

SEQ ID NO: 15547 - protein, 10 aa, Dengue virus
TSEIQLTDYG

SEQ ID NO: 15548 - protein, 10 aa, Dengue virus
SEIQLTDYGA

SEQ ID NO: 15549 - protein, 10 aa, Dengue virus
EIQLTDYGTL

SEQ ID NO: 15550 - protein, 10 aa, Dengue virus
IQLTDYGTLT

SEQ ID NO: 15551 - protein, 10 aa, Dengue virus
QLTDYGTLTL

SEQ ID NO: 15552 - protein, 10 aa, Dengue virus
LTDYGTLTLD

SEQ ID NO: 15553 - protein, 10 aa, Dengue virus
TDYGTLTLDC

SEQ ID NO: 15554 - protein, 10 aa, Dengue virus
DYGTLTLDCS

SEQ ID NO: 15555 - protein, 10 aa, Dengue virus
YGTLTLDCSP

SEQ ID NO: 15556 - protein, 10 aa, Dengue virus
GTLTLDCSPR

SEQ ID NO: 15557 - protein, 10 aa, Dengue virus
TLTLDCSPRT

SEQ ID NO: 15558 - protein, 10 aa, Dengue virus
FNEMVLLTME

SEQ ID NO: 15559 - protein, 10 aa, Dengue virus
NEMVLLTMKK

SEQ ID NO: 15560 - protein, 10 aa, Dengue virus
EMVLLTMKKK

SEQ ID NO: 15561 - protein, 10 aa, Dengue virus
MVLLTMKKKS

SEQ ID NO: 15562 - protein, 10 aa, Dengue virus
VLLTMKKKSW

SEQ ID NO: 15563 - protein, 10 aa, Dengue virus
LLTMKKKSWL

SEQ ID NO: 15564 - protein, 10 aa, Dengue virus
LTMKKKSWLV

SEQ ID NO: 15565 - protein, 10 aa, Dengue virus
TMKKKSWLVH

SEQ ID NO: 15566 - protein, 10 aa, Dengue virus
MKKKSWLVHK

SEQ ID NO: 15567 - protein, 10 aa, Dengue virus
KKKSWLVHKQ

SEQ ID NO: 15568 - protein, 10 aa, Dengue virus
KKSWLVHKQW

SEQ ID NO: 15569 - protein, 10 aa, Dengue virus
KAWLVHKQWF

SEQ ID NO: 15570 - protein, 10 aa, Dengue virus
LPLPWTSGAT

SEQ ID NO: 15571 - protein, 10 aa, Dengue virus
PLPWTSGATT

SEQ ID NO: 15572 - protein, 10 aa, Dengue virus
TSQETWNRKD

SEQ ID NO: 15573 - protein, 10 aa, Dengue virus
SQETWNRKDL

SEQ ID NO: 15574 - protein, 10 aa, Dengue virus
QETWNRKDLL

SEQ ID NO: 15575 - protein, 10 aa, Dengue virus
ETWNRKDLLV

SEQ ID NO: 15576 - protein, 10 aa, Dengue virus
TWNRKDLLVT

SEQ ID NO: 15577 - protein, 10 aa, Dengue virus
WNRKDLLVTF

SEQ ID NO: 15578 - protein, 10 aa, Dengue virus
NRKDLLVTFK

SEQ ID NO: 15579 - protein, 10 aa, Dengue virus
RKDLLVTFKT

SEQ ID NO: 15580 - protein, 10 aa, Dengue virus
KDLLVTFKTA

SEQ ID NO: 15581 - protein, 10 aa, Dengue virus
LTGATEIQMS

SEQ ID NO: 15582 - protein, 10 aa, Dengue virus
GATEIQTTGT

SEQ ID NO: 15583 - protein, 10 aa, Dengue virus
ATEIQTTGTT

SEQ ID NO: 15584 - protein, 10 aa, Dengue virus
TEIQTTGTTT

SEQ ID NO: 15585 - protein, 10 aa, Dengue virus
EIQTTGTTTI

SEQ ID NO: 15586 - protein, 10 aa, Dengue virus
IQTTGTTTIF

SEQ ID NO: 15587 - protein, 10 aa, Dengue virus
QTTGTTTIFA

SEQ ID NO: 15588 - protein, 10 aa, Dengue virus
TTGTTTIFAG

SEQ ID NO: 15589 - protein, 10 aa, Dengue virus
TGTTTIFAGH

SEQ ID NO: 15590 - protein, 10 aa, Dengue virus
RLKMDKLTLR

SEQ ID NO: 15591 - protein, 10 aa, Dengue virus
LKMDKLTLRG

SEQ ID NO: 15592 - protein, 10 aa, Dengue virus
KMDKLTLKGT

SEQ ID NO: 15593 - protein, 10 aa, Dengue virus
MDKLTLKGTS

SEQ ID NO: 15594 - protein, 10 aa, Dengue virus
DKLTLKGTSY

SEQ ID NO: 15595 - protein, 10 aa, Dengue virus
KLTLKGTSYV

SEQ ID NO: 15596 - protein, 10 aa, Dengue virus
LTLKGTSYVM

SEQ ID NO: 15597 - protein, 10 aa, Dengue virus
TLKGTSYVMC

SEQ ID NO: 15598 - protein, 10 aa, Dengue virus
LKGTSYVMCT

SEQ ID NO: 15599 - protein, 10 aa, Dengue virus
KGTSYVMCTG

SEQ ID NO: 15600 - protein, 10 aa, Dengue virus
SYVMCTGLFK

SEQ ID NO: 15601 - protein, 10 aa, Dengue virus
YVMCTGPFKL

SEQ ID NO: 15602 - protein, 10 aa, Dengue virus
VMCTGLFKLE

SEQ ID NO: 15603 - protein, 10 aa, Dengue virus
MCTGPFKLEK

SEQ ID NO: 15604 - protein, 10 aa, Dengue virus
CTGLFKLEKE

SEQ ID NO: 15605 - protein, 10 aa, Dengue virus
TGSFKLEKEL

SEQ ID NO: 15606 - protein, 10 aa, Dengue virus
GSFKLEKELA

SEQ ID NO: 15607 - protein, 10 aa, Dengue virus
SFKLEKELAE

SEQ ID NO: 15608 - protein, 10 aa, Dengue virus
FKLEKELAET

SEQ ID NO: 15609 - protein, 10 aa, Dengue virus
KLEKELAETQ

SEQ ID NO: 15610 - protein, 10 aa, Dengue virus
LEKELAETQH

SEQ ID NO: 15611 - protein, 10 aa, Dengue virus
EKELAETQHG

SEQ ID NO: 15612 - protein, 10 aa, Dengue virus
KELAETQHGT

SEQ ID NO: 15613 - protein, 10 aa, Dengue virus
ELAETQHGTV

SEQ ID NO: 15614 - protein, 10 aa, Dengue virus
LAETQHGTVL

SEQ ID NO: 15615 - protein, 10 aa, Dengue virus
TQHGTVLVQV

SEQ ID NO: 15616 - protein, 10 aa, Dengue virus
QHGTVLVQVK

SEQ ID NO: 15617 - protein, 10 aa, Dengue virus
HGTVLVQVKY

SEQ ID NO: 15618 - protein, 10 aa, Dengue virus
GTVLVQVKYE

SEQ ID NO: 15619 - protein, 10 aa, Dengue virus
TVLVQVKYEG

SEQ ID NO: 15620 - protein, 10 aa, Dengue virus
VLVQVKYEGT

SEQ ID NO: 15621 - protein, 10 aa, Dengue virus
LVQVKYEGTD

SEQ ID NO: 15622 - protein, 10 aa, Dengue virus
VQVKYEGTDA

SEQ ID NO: 15623 - protein, 10 aa, Dengue virus
QVKYEGTDAP

SEQ ID NO: 15624 - protein, 10 aa, Dengue virus
VKYEGTDAPC

SEQ ID NO: 15625 - protein, 10 aa, Dengue virus
RYEGTDAPCK

SEQ ID NO: 15626 - protein, 10 aa, Dengue virus
TDAPCKIPFL

SEQ ID NO: 15627 - protein, 10 aa, Dengue virus
DAPCKIPFLT

SEQ ID NO: 15628 - protein, 10 aa, Dengue virus
APCKIPFLTQ

SEQ ID NO: 15629 - protein, 10 aa, Dengue virus
PCKIPFLTQD

SEQ ID NO: 15630 - protein, 10 aa, Dengue virus
CKIPFLTQDE

SEQ ID NO: 15631 - protein, 10 aa, Dengue virus
QDEKGVIQNG

SEQ ID NO: 15632 - protein, 10 aa, Dengue virus
DEKGVIQNGR

SEQ ID NO: 15633 - protein, 10 aa, Dengue virus
GVIQNGRLIT

SEQ ID NO: 15634 - protein, 10 aa, Dengue virus
VIQNGRLITA

SEQ ID NO: 15635 - protein, 10 aa, Dengue virus
IQNGRLITAN

SEQ ID NO: 15636 - protein, 10 aa, Dengue virus
QNGRLVTANP

SEQ ID NO: 15637 - protein, 10 aa, Dengue virus
NGRLVTANPI

SEQ ID NO: 15638 - protein, 10 aa, Dengue virus
GRLVTANPIV

SEQ ID NO: 15639 - protein, 10 aa, Dengue virus
RLVTANPIVT

SEQ ID NO: 15640 - protein, 10 aa, Dengue virus
LVTANPIVTD

SEQ ID NO: 15641 - protein, 10 aa, Dengue virus
VTANPIVTDK

SEQ ID NO: 15642 - protein, 10 aa, Dengue virus
TANPIVTDKD

SEQ ID NO: 15643 - protein, 10 aa, Dengue virus
ANPIVTDKDK

SEQ ID NO: 15644 - protein, 10 aa, Dengue virus
NPIVTDKDKP

SEQ ID NO: 15645 - protein, 10 aa, Dengue virus
PIVTDKDKPV

SEQ ID NO: 15646 - protein, 10 aa, Dengue virus
IVTDKDKPVN

SEQ ID NO: 15647 - protein, 10 aa, Dengue virus
VTDKDKPVNI

SEQ ID NO: 15648 - protein, 10 aa, Dengue virus
TDKDKPVNIE

SEQ ID NO: 15649 - protein, 10 aa, Dengue virus
DKEKPVNIET

SEQ ID NO: 15650 - protein, 10 aa, Dengue virus
KEKPVNIETE

SEQ ID NO: 15651 - protein, 10 aa, Dengue virus
EKPVNIETEP

SEQ ID NO: 15652 - protein, 10 aa, Dengue virus
KPVNIETEPP

SEQ ID NO: 15653 - protein, 10 aa, Dengue virus
PVNIETEPPF

SEQ ID NO: 15654 - protein, 10 aa, Dengue virus
VNIETEPPFG

SEQ ID NO: 15655 - protein, 10 aa, Dengue virus
NIETEPPFGE

SEQ ID NO: 15656 - protein, 10 aa, Dengue virus
IETEPPFGES

SEQ ID NO: 15657 - protein, 10 aa, Dengue virus
ETEPPFGESY

SEQ ID NO: 15658 - protein, 10 aa, Dengue virus
TEPPFGESYI

SEQ ID NO: 15659 - protein, 10 aa, Dengue virus
EPPFGESYII

SEQ ID NO: 15660 - protein, 10 aa, Dengue virus
PPFGESYIVV

SEQ ID NO: 15661 - protein, 10 aa, Dengue virus
PFGESYIVVG

SEQ ID NO: 15662 - protein, 10 aa, Dengue virus
VGAGEKALKL

SEQ ID NO: 15663 - protein, 10 aa, Dengue virus
GVGEKALKLS

SEQ ID NO: 15664 - protein, 10 aa, Dengue virus
VGEKALKLSW

SEQ ID NO: 15665 - protein, 10 aa, Dengue virus
GEKTLKLSWF

SEQ ID NO: 15666 - protein, 10 aa, Dengue virus
EKTLKLSWFK

SEQ ID NO: 15667 - protein, 10 aa, Dengue virus
KALKLSWFKR

SEQ ID NO: 15668 - protein, 10 aa, Dengue virus
ALKLSWFKRG

SEQ ID NO: 15669 - protein, 10 aa, Dengue virus
LKLSWFKRGS

SEQ ID NO: 15670 - protein, 10 aa, Dengue virus
KLSWFKRGSS

SEQ ID NO: 15671 - protein, 10 aa, Dengue virus
LSWFKRGSSI

SEQ ID NO: 15672 - protein, 10 aa, Dengue virus
SWFKRGSSIG

SEQ ID NO: 15673 - protein, 10 aa, Dengue virus
WFKRGSSIGK

SEQ ID NO: 15674 - protein, 10 aa, Dengue virus
FKRGSSIGKM

SEQ ID NO: 15675 - protein, 10 aa, Dengue virus
KRGSSIGKMF

SEQ ID NO: 15676 - protein, 10 aa, Dengue virus
RGSSIGKMFE

SEQ ID NO: 15677 - protein, 10 aa, Dengue virus
GSTIGKMFEA

SEQ ID NO: 15678 - protein, 10 aa, Dengue virus
STIGKMFEAT

SEQ ID NO: 15679 - protein, 10 aa, Dengue virus
TIGKMFEATA

SEQ ID NO: 15680 - protein, 10 aa, Dengue virus
IGKMFVATAR

SEQ ID NO: 15681 - protein, 10 aa, Dengue virus
GKMFVATARG

SEQ ID NO: 15682 - protein, 10 aa, Dengue virus
KMFVATARGA

SEQ ID NO: 15683 - protein, 10 aa, Dengue virus
GDTAWDFGSV

SEQ ID NO: 15684 - protein, 10 aa, Dengue virus
DTAWDFGSVG

SEQ ID NO: 15685 - protein, 10 aa, Dengue virus
TAWDFGSVGG

SEQ ID NO: 15686 - protein, 10 aa, Dengue virus
AWDFGSVGGV

SEQ ID NO: 15687 - protein, 10 aa, Dengue virus
WDFGSVGGVF

SEQ ID NO: 15688 - protein, 10 aa, Dengue virus
DFGSVGGVFT

SEQ ID NO: 15689 - protein, 10 aa, Dengue virus
FGSVGGVFTS

SEQ ID NO: 15690 - protein, 10 aa, Dengue virus
GGVFTSIGKL

SEQ ID NO: 15691 - protein, 10 aa, Dengue virus
FTSVGKLIHQ

SEQ ID NO: 15692 - protein, 10 aa, Dengue virus
GKLVHQVFGT

SEQ ID NO: 15693 - protein, 10 aa, Dengue virus
KLVHQVFGTA

SEQ ID NO: 15694 - protein, 10 aa, Dengue virus
LVHQVFGTAY

SEQ ID NO: 15695 - protein, 10 aa, Dengue virus
VHQVFGTAYG

SEQ ID NO: 15696 - protein, 10 aa, Dengue virus
HQVFGTAYGV

SEQ ID NO: 15697 - protein, 10 aa, Dengue virus
QVFGTAYGVL

SEQ ID NO: 15698 - protein, 10 aa, Dengue virus
VFGTAYGVLF

SEQ ID NO: 15699 - protein, 10 aa, Dengue virus
FGAAYGVLFS

SEQ ID NO: 15700 - protein, 10 aa, Dengue virus
GAAYGVLFSG

SEQ ID NO: 15701 - protein, 10 aa, Dengue virus
AAYGVLFSGV

SEQ ID NO: 15702 - protein, 10 aa, Dengue virus
GVSWTMKIGL

SEQ ID NO: 15703 - protein, 10 aa, Dengue virus
VSWTMKIGLG

SEQ ID NO: 15704 - protein, 10 aa, Dengue virus
SWTMKIGIGI

SEQ ID NO: 15705 - protein, 10 aa, Dengue virus
WTMKIGIGIL

SEQ ID NO: 15706 - protein, 10 aa, Dengue virus
TMKIGIGILL

SEQ ID NO: 15707 - protein, 10 aa, Dengue virus
MKIGIGILLT

SEQ ID NO: 15708 - protein, 10 aa, Dengue virus
KIGIGILLTW

SEQ ID NO: 15709 - protein, 10 aa, Dengue virus
IGIGILLTWL

SEQ ID NO: 15710 - protein, 10 aa, Dengue virus
GIGILLTWLG

SEQ ID NO: 15711 - protein, 10 aa, Dengue virus
IGILLTWLGL

SEQ ID NO: 15712 - protein, 10 aa, Dengue virus
GILLTWLGLN

SEQ ID NO: 15713 - protein, 10 aa, Dengue virus
ILLTWLGLNS

SEQ ID NO: 15714 - protein, 10 aa, Dengue virus
LTWLGLNSRN

SEQ ID NO: 15715 - protein, 10 aa, Dengue virus
TWLGLNSRSA

SEQ ID NO: 15716 - protein, 10 aa, Dengue virus
WLGLNSRSAS

SEQ ID NO: 15717 - protein, 10 aa, Dengue virus
LGLNSRSTSF

SEQ ID NO: 15718 - protein, 10 aa, Dengue virus
GLNSRSTSFS

SEQ ID NO: 15719 - protein, 10 aa, Dengue virus
LNSRSTSFSM

SEQ ID NO: 15720 - protein, 10 aa, Dengue virus
NSRSTSFSMT

SEQ ID NO: 15721 - protein, 10 aa, Dengue virus
SRSTSFSMTC

SEQ ID NO: 15722 - protein, 10 aa, Dengue virus
RSTSFSMTCI

SEQ ID NO: 15723 - protein, 10 aa, Dengue virus
STSFSMTCIA

SEQ ID NO: 15724 - protein, 10 aa, Dengue virus
TSFSMTCIAV

SEQ ID NO: 15725 - protein, 10 aa, Dengue virus
SFSMTCIAVG

SEQ ID NO: 15726 - protein, 10 aa, Dengue virus
LSMTCIAVGM

SEQ ID NO: 15727 - protein, 10 aa, Dengue virus
SMTCIAVGMV

SEQ ID NO: 15728 - protein, 10 aa, Dengue virus
MTCIAVGMVT

SEQ ID NO: 15729 - protein, 10 aa, Dengue virus
TCIAVGMVTL

SEQ ID NO: 15730 - protein, 10 aa, Dengue virus
CIAVGMVTLY

SEQ ID NO: 15731 - protein, 10 aa, Dengue virus
IAVGMVTLYL

SEQ ID NO: 15732 - protein, 10 aa, Dengue virus
AVGMVTLYLG

SEQ ID NO: 15733 - protein, 10 aa, Dengue virus
VGMVTLYLGV

SEQ ID NO: 15734 - protein, 10 aa, Dengue virus
GMVTLYLGVM

SEQ ID NO: 15735 - protein, 10 aa, Dengue virus
MVTLYLGVMV

SEQ ID NO: 15736 - protein, 10 aa, Dengue virus
ITLYLGVMVQ

SEQ ID NO: 15737 - protein, 10 aa, Dengue virus
TLYLGAMVQA

SEQ ID NO: 15738 - protein, 10 aa, Dengue virus
LYLGAMVQAD

SEQ ID NO: 15739 - protein, 10 aa, Dengue virus
YLGAMVQADS

SEQ ID NO: 15740 - protein, 10 aa, Dengue virus
LGAMVQADSG

SEQ ID NO: 15741 - protein, 10 aa, Dengue virus
GAMVQADSGC

SEQ ID NO: 15742 - protein, 10 aa, Dengue virus
AMVQADSGCV

SEQ ID NO: 15743 - protein, 10 aa, Dengue virus
MVQADSGCVV

SEQ ID NO: 15744 - protein, 10 aa, Dengue virus
VQADSGCVVN

SEQ ID NO: 15745 - protein, 10 aa, Dengue virus
QADSGCVVNW

SEQ ID NO: 15746 - protein, 10 aa, Dengue virus
ADSGCVVNWK

SEQ ID NO: 15747 - protein, 10 aa, Dengue virus
DSGCVVNWKG

SEQ ID NO: 15748 - protein, 10 aa, Dengue virus
SGCVVNWKGR

SEQ ID NO: 15749 - protein, 10 aa, Dengue virus
GCVVNWKGRE

SEQ ID NO: 15750 - protein, 10 aa, Dengue virus
CVVNWKGREL

SEQ ID NO: 15751 - protein, 10 aa, Dengue virus
VVNWKGRELK

SEQ ID NO: 15752 - protein, 10 aa, Dengue virus
PKRLSAAIGR

SEQ ID NO: 15753 - protein, 10 aa, Dengue virus
KRLSAAIGRA

SEQ ID NO: 15754 - protein, 10 aa, Dengue virus
RLSAAIGRAW

SEQ ID NO: 15755 - protein, 10 aa, Dengue virus
LSAAIGRAWE

SEQ ID NO: 15756 - protein, 10 aa, Dengue virus
SAAIGRAWEE

SEQ ID NO: 15757 - protein, 10 aa, Dengue virus
AAIGRAWEEG

SEQ ID NO: 15758 - protein, 10 aa, Dengue virus
AIGRAWEEGV

SEQ ID NO: 15759 - protein, 10 aa, Dengue virus
IGRAWEEGVC

SEQ ID NO: 15760 - protein, 10 aa, Dengue virus
GRAWEEGVCG

SEQ ID NO: 15761 - protein, 10 aa, Dengue virus
RAWEEGVCGI

SEQ ID NO: 15762 - protein, 10 aa, Dengue virus
EEGVCGIRST

SEQ ID NO: 15763 - protein, 10 aa, Dengue virus
EGVCGIRSTT

SEQ ID NO: 15764 - protein, 10 aa, Dengue virus
GVCGIRSTTR

SEQ ID NO: 15765 - protein, 10 aa, Dengue virus
VCGIRSTTRL

SEQ ID NO: 15766 - protein, 10 aa, Dengue virus
CGIRSTTRLE

SEQ ID NO: 15767 - protein, 10 aa, Dengue virus
GIRSTTRLEN

SEQ ID NO: 15768 - protein, 10 aa, Dengue virus
IRSTTRLENI

SEQ ID NO: 15769 - protein, 10 aa, Dengue virus
RSTTRLENIM

SEQ ID NO: 15770 - protein, 10 aa, Dengue virus
STTRLENIMW

SEQ ID NO: 15771 - protein, 10 aa, Dengue virus
ATRLENIMWR

SEQ ID NO: 15772 - protein, 10 aa, Dengue virus
TRLENIMWRQ

SEQ ID NO: 15773 - protein, 10 aa, Dengue virus
RLENIMWRQI

SEQ ID NO: 15774 - protein, 10 aa, Dengue virus
LENIMWRQIS

SEQ ID NO: 15775 - protein, 10 aa, Dengue virus
ENIMWRQISN

SEQ ID NO: 15776 - protein, 10 aa, Dengue virus
NIMWRQISNE

SEQ ID NO: 15777 - protein, 10 aa, Dengue virus
IMWRQISNEL

SEQ ID NO: 15778 - protein, 10 aa, Dengue virus
MWRQISNELN

SEQ ID NO: 15779 - protein, 10 aa, Dengue virus
WRQISNELNH

SEQ ID NO: 15780 - protein, 10 aa, Dengue virus
RQISNELNHI

SEQ ID NO: 15781 - protein, 10 aa, Dengue virus
QISNELNYIL

SEQ ID NO: 15782 - protein, 10 aa, Dengue virus
ISNELNYILL

SEQ ID NO: 15783 - protein, 10 aa, Dengue virus
SNELNYILLE

SEQ ID NO: 15784 - protein, 10 aa, Dengue virus
NELNYILLEN

SEQ ID NO: 15785 - protein, 10 aa, Dengue virus
ELNHILLENG

SEQ ID NO: 15786 - protein, 10 aa, Dengue virus
LNHILLENGM

SEQ ID NO: 15787 - protein, 10 aa, Dengue virus
NHILLENGMK

SEQ ID NO: 15788 - protein, 10 aa, Dengue virus
HILLENDMKL

SEQ ID NO: 15789 - protein, 10 aa, Dengue virus
ILLENDMKLT

SEQ ID NO: 15790 - protein, 10 aa, Dengue virus
LLENDMKLTV

SEQ ID NO: 15791 - protein, 10 aa, Dengue virus
LENDMKLTVV

SEQ ID NO: 15792 - protein, 10 aa, Dengue virus
ENDMKLTVVV

SEQ ID NO: 15793 - protein, 10 aa, Dengue virus
NDMKLTVVVG

SEQ ID NO: 15794 - protein, 10 aa, Dengue virus
DMKLTVVVGD

SEQ ID NO: 15795 - protein, 10 aa, Dengue virus
MKFTVVVGDA

SEQ ID NO: 15796 - protein, 10 aa, Dengue virus
QGKKTIRPQP

SEQ ID NO: 15797 - protein, 10 aa, Dengue virus
GKKTIRPQPM

SEQ ID NO: 15798 - protein, 10 aa, Dengue virus
KKTIRPQPME

SEQ ID NO: 15799 - protein, 10 aa, Dengue virus
KMIRPQPMEH

SEQ ID NO: 15800 - protein, 10 aa, Dengue virus
MIRPQPMEHK

SEQ ID NO: 15801 - protein, 10 aa, Dengue virus
IRPQPMEHKY

SEQ ID NO: 15802 - protein, 10 aa, Dengue virus
RPQPMEHKYS

SEQ ID NO: 15803 - protein, 10 aa, Dengue virus
PQPMEHKYSW

SEQ ID NO: 15804 - protein, 10 aa, Dengue virus
QPMEHKYSWK

SEQ ID NO: 15805 - protein, 10 aa, Dengue virus
PMEHKYSWKS

SEQ ID NO: 15806 - protein, 10 aa, Dengue virus
MEHKYSWKSW

SEQ ID NO: 15807 - protein, 10 aa, Dengue virus
EHKYSWKSWG

SEQ ID NO: 15808 - protein, 10 aa, Dengue virus
HKYSWKSWGK

SEQ ID NO: 15809 - protein, 10 aa, Dengue virus
RYSWKSWGKA

SEQ ID NO: 15810 - protein, 10 aa, Dengue virus
YSWRSWGKAK

SEQ ID NO: 15811 - protein, 10 aa, Dengue virus
SWKIWGKAKI

SEQ ID NO: 15812 - protein, 10 aa, Dengue virus
WRSWGKAKII

SEQ ID NO: 15813 - protein, 10 aa, Dengue virus
KIWGKAKIIG

SEQ ID NO: 15814 - protein, 10 aa, Dengue virus
IWGKAKIIGA

SEQ ID NO: 15815 - protein, 10 aa, Dengue virus
GKAKIIGADI

SEQ ID NO: 15816 - protein, 10 aa, Dengue virus
KAKIIGADIQ

SEQ ID NO: 15817 - protein, 10 aa, Dengue virus
AKIIGADIQN

SEQ ID NO: 15818 - protein, 10 aa, Dengue virus
QNSTFIIDGP

SEQ ID NO: 15819 - protein, 10 aa, Dengue virus
TFIIDGPDTP

SEQ ID NO: 15820 - protein, 10 aa, Dengue virus
FIIDGPDTPE

SEQ ID NO: 15821 - protein, 10 aa, Dengue virus
IIDGPDTPEC

SEQ ID NO: 15822 - protein, 10 aa, Dengue virus
IDGPDTPECP

SEQ ID NO: 15823 - protein, 10 aa, Dengue virus
DGPDTPECPD

SEQ ID NO: 15824 - protein, 10 aa, Dengue virus
ECPDNQRAWN

SEQ ID NO: 15825 - protein, 10 aa, Dengue virus
CPDNQRAWNI

SEQ ID NO: 15826 - protein, 10 aa, Dengue virus
PDNQRAWNIW

SEQ ID NO: 15827 - protein, 10 aa, Dengue virus
DNQRAWNIWE

SEQ ID NO: 15828 - protein, 10 aa, Dengue virus
NQRAWNIWEV

SEQ ID NO: 15829 - protein, 10 aa, Dengue virus
WEVEDYGFGV

SEQ ID NO: 15830 - protein, 10 aa, Dengue virus
EVEDYGFGVF

SEQ ID NO: 15831 - protein, 10 aa, Dengue virus
VEDYGFGVFT

SEQ ID NO: 15832 - protein, 10 aa, Dengue virus
EDYGFGVFTT

SEQ ID NO: 15833 - protein, 10 aa, Dengue virus
DYGFGVFTTN

SEQ ID NO: 15834 - protein, 10 aa, Dengue virus
YGFGVFTTNI

SEQ ID NO: 15835 - protein, 10 aa, Dengue virus
GFGVFTTNIW

SEQ ID NO: 15836 - protein, 10 aa, Dengue virus
FGVFTTNIWL

SEQ ID NO: 15837 - protein, 10 aa, Dengue virus
GVFTTNIWLK

SEQ ID NO: 15838 - protein, 10 aa, Dengue virus
VFTTNIWLKL

SEQ ID NO: 15839 - protein, 10 aa, Dengue virus
FTTNIWLKMR

SEQ ID NO: 15840 - protein, 10 aa, Dengue virus
TTNIWLKMRD

SEQ ID NO: 15841 - protein, 10 aa, Dengue virus
TNIWLKMRDS

SEQ ID NO: 15842 - protein, 10 aa, Dengue virus
NIWLKLRDSH

SEQ ID NO: 15843 - protein, 10 aa, Dengue virus
IWLKLRDSHT

SEQ ID NO: 15844 - protein, 10 aa, Dengue virus
WLKLRDSHTQ

SEQ ID NO: 15845 - protein, 10 aa, Dengue virus
RDSYTQMCDH

SEQ ID NO: 15846 - protein, 10 aa, Dengue virus
DSYTQMCDHR

SEQ ID NO: 15847 - protein, 10 aa, Dengue virus
SYTQMCDHRL

SEQ ID NO: 15848 - protein, 10 aa, Dengue virus
YTQMCDHRLM

SEQ ID NO: 15849 - protein, 10 aa, Dengue virus
TQMCDHRLMS

SEQ ID NO: 15850 - protein, 10 aa, Dengue virus
QMCDHRLMSA

SEQ ID NO: 15851 - protein, 10 aa, Dengue virus
MCDHRLMSAA

SEQ ID NO: 15852 - protein, 10 aa, Dengue virus
DMGYWIESER

SEQ ID NO: 15853 - protein, 10 aa, Dengue virus
MGYWIESERN

SEQ ID NO: 15854 - protein, 10 aa, Dengue virus
GYWIESERNE

SEQ ID NO: 15855 - protein, 10 aa, Dengue virus
YWIESERNET

SEQ ID NO: 15856 - protein, 10 aa, Dengue virus
WIESERNETW

SEQ ID NO: 15857 - protein, 10 aa, Dengue virus
IESERNETWK

SEQ ID NO: 15858 - protein, 10 aa, Dengue virus
ESERNETWKL

SEQ ID NO: 15859 - protein, 10 aa, Dengue virus
SERNETWKLA

SEQ ID NO: 15860 - protein, 10 aa, Dengue virus
NETWKLAKAS

SEQ ID NO: 15861 - protein, 10 aa, Dengue virus
ETWKLAKASF

SEQ ID NO: 15862 - protein, 10 aa, Dengue virus
TWKLAKASFI

SEQ ID NO: 15863 - protein, 10 aa, Dengue virus
WKLAKASFIE

SEQ ID NO: 15864 - protein, 10 aa, Dengue virus
KLAKASFIEV

SEQ ID NO: 15865 - protein, 10 aa, Dengue virus
LAKASFIEVK

SEQ ID NO: 15866 - protein, 10 aa, Dengue virus
AKASFIEVKT

SEQ ID NO: 15867 - protein, 10 aa, Dengue virus
KASFIEVKTC

SEQ ID NO: 15868 - protein, 10 aa, Dengue virus
ASFIEVKTCT

SEQ ID NO: 15869 - protein, 10 aa, Dengue virus
SFIEVKTCTW

SEQ ID NO: 15870 - protein, 10 aa, Dengue virus
FIEVKTCTWP

SEQ ID NO: 15871 - protein, 10 aa, Dengue virus
IEVKTCTWPK

SEQ ID NO: 15872 - protein, 10 aa, Dengue virus
EVKTCTWPKS

SEQ ID NO: 15873 - protein, 10 aa, Dengue virus
VKTCTWPKSH

SEQ ID NO: 15874 - protein, 10 aa, Dengue virus
KTCTWPKSHT

SEQ ID NO: 15875 - protein, 10 aa, Dengue virus
TCTWPKSHTL

SEQ ID NO: 15876 - protein, 10 aa, Dengue virus
CTWPKSHTLW

SEQ ID NO: 15877 - protein, 10 aa, Dengue virus
TWPKSHTLWS

SEQ ID NO: 15878 - protein, 10 aa, Dengue virus
SNGVLESEMV

SEQ ID NO: 15879 - protein, 10 aa, Dengue virus
NGVLESEMVI

SEQ ID NO: 15880 - protein, 10 aa, Dengue virus
GVLESEMVIP

SEQ ID NO: 15881 - protein, 10 aa, Dengue virus
VLESEMVIPK

SEQ ID NO: 15882 - protein, 10 aa, Dengue virus
LESEMVIPKI

SEQ ID NO: 15883 - protein, 10 aa, Dengue virus
ESEMIIPKIH

SEQ ID NO: 15884 - protein, 10 aa, Dengue virus
SEMIIPKIHG

SEQ ID NO: 15885 - protein, 10 aa, Dengue virus
EMIIPKIHGG

SEQ ID NO: 15886 - protein, 10 aa, Dengue virus
MIIPKIHGGP

SEQ ID NO: 15887 - protein, 10 aa, Dengue virus
PKIHGGPISQ

SEQ ID NO: 15888 - protein, 10 aa, Dengue virus
KIHGGPISQH

SEQ ID NO: 15889 - protein, 10 aa, Dengue virus
IHGGPISQHN

SEQ ID NO: 15890 - protein, 10 aa, Dengue virus
HGGPISQHNY

SEQ ID NO: 15891 - protein, 10 aa, Dengue virus
GGPTSQHNYR

SEQ ID NO: 15892 - protein, 10 aa, Dengue virus
GPTSQHNYRP

SEQ ID NO: 15893 - protein, 10 aa, Dengue virus
PTSQHNYRPG

SEQ ID NO: 15894 - protein, 10 aa, Dengue virus
TSQHNYRPGY

SEQ ID NO: 15895 - protein, 10 aa, Dengue virus
SQHNHRPGYF

SEQ ID NO: 15896 - protein, 10 aa, Dengue virus
QHNHRPGYFT

SEQ ID NO: 15897 - protein, 10 aa, Dengue virus
HNHRPGYFTQ

SEQ ID NO: 15898 - protein, 10 aa, Dengue virus
NYRPGYFTQA

SEQ ID NO: 15899 - protein, 10 aa, Dengue virus
YRPGYFTQAA

SEQ ID NO: 15900 - protein, 10 aa, Dengue virus
RPGYFTQAAG

SEQ ID NO: 15901 - protein, 10 aa, Dengue virus
PGYFTQAAGP

SEQ ID NO: 15902 - protein, 10 aa, Dengue virus
GYFTQAAGPW

SEQ ID NO: 15903 - protein, 10 aa, Dengue virus
YFTQAAGPWH

SEQ ID NO: 15904 - protein, 10 aa, Dengue virus
FTQAAGPWHL

SEQ ID NO: 15905 - protein, 10 aa, Dengue virus
TQAAGPWHLG

SEQ ID NO: 15906 - protein, 10 aa, Dengue virus
QAAGPWHLGK

SEQ ID NO: 15907 - protein, 10 aa, Dengue virus
AAGPWHLGKL

SEQ ID NO: 15908 - protein, 10 aa, Dengue virus
HLGKLELDFN

SEQ ID NO: 15909 - protein, 10 aa, Dengue virus
LGKLELDFNL

SEQ ID NO: 15910 - protein, 10 aa, Dengue virus
GKLELDFNLC

SEQ ID NO: 15911 - protein, 10 aa, Dengue virus
KLELDFNLCE

SEQ ID NO: 15912 - protein, 10 aa, Dengue virus
LELDFNLCEG

SEQ ID NO: 15913 - protein, 10 aa, Dengue virus
ELDFNLCEGT

SEQ ID NO: 15914 - protein, 10 aa, Dengue virus
LDFNLCEGTT

SEQ ID NO: 15915 - protein, 10 aa, Dengue virus
DFNLCEGTTV

SEQ ID NO: 15916 - protein, 10 aa, Dengue virus
FNLCEGTTVV

SEQ ID NO: 15917 - protein, 10 aa, Dengue virus
NLCEGTTVVV

SEQ ID NO: 15918 - protein, 10 aa, Dengue virus
FCEGTTVVVD

SEQ ID NO: 15919 - protein, 10 aa, Dengue virus
TVVVDEHCGS

SEQ ID NO: 15920 - protein, 10 aa, Dengue virus
VVVDEHCGYR

SEQ ID NO: 15921 - protein, 10 aa, Dengue virus
VVDEHCGSRG

SEQ ID NO: 15922 - protein, 10 aa, Dengue virus
VDEHCGSRGP

SEQ ID NO: 15923 - protein, 10 aa, Dengue virus
DEHCGYRGPS

SEQ ID NO: 15924 - protein, 10 aa, Dengue virus
EHCGYRGPSL

SEQ ID NO: 15925 - protein, 10 aa, Dengue virus
HCGYRGPSLR

SEQ ID NO: 15926 - protein, 10 aa, Dengue virus
CGYRGPSLRT

SEQ ID NO: 15927 - protein, 10 aa, Dengue virus
GSRGPSLRTT

SEQ ID NO: 15928 - protein, 10 aa, Dengue virus
YRGPSLRTTT

SEQ ID NO: 15929 - protein, 10 aa, Dengue virus
LRTTTVTGKT

SEQ ID NO: 15930 - protein, 10 aa, Dengue virus
RTTTVTGKTI

SEQ ID NO: 15931 - protein, 10 aa, Dengue virus
TTTVTGKTIH

SEQ ID NO: 15932 - protein, 10 aa, Dengue virus
TTVTGKTIHE

SEQ ID NO: 15933 - protein, 10 aa, Dengue virus
TVTGKTIHEW

SEQ ID NO: 15934 - protein, 10 aa, Dengue virus
VTGKTIHEWC

SEQ ID NO: 15935 - protein, 10 aa, Dengue virus
TGKTIHEWCC

SEQ ID NO: 15936 - protein, 10 aa, Dengue virus
GKTIHEWCCR

SEQ ID NO: 15937 - protein, 10 aa, Dengue virus
KTIHEWCCRS

SEQ ID NO: 15938 - protein, 10 aa, Dengue virus
TIHEWCCRSC

SEQ ID NO: 15939 - protein, 10 aa, Dengue virus
SCTLPPLRFK

SEQ ID NO: 15940 - protein, 10 aa, Dengue virus
CTLPPLRFKG

SEQ ID NO: 15941 - protein, 10 aa, Dengue virus
TLPPLRFKGE

SEQ ID NO: 15942 - protein, 10 aa, Dengue virus
LPPLRFKGED

SEQ ID NO: 15943 - protein, 10 aa, Dengue virus
PPLRFKGEDG

SEQ ID NO: 15944 - protein, 10 aa, Dengue virus
PLRFKGEDGC

SEQ ID NO: 15945 - protein, 10 aa, Dengue virus
LRFKGEDGCW

SEQ ID NO: 15946 - protein, 10 aa, Dengue virus
RFKGEDGCWY

SEQ ID NO: 15947 - protein, 10 aa, Dengue virus
FKGEDGCWYG

SEQ ID NO: 15948 - protein, 10 aa, Dengue virus
KGEDGCWYGM

SEQ ID NO: 15949 - protein, 10 aa, Dengue virus
YGMEIRPVKD

SEQ ID NO: 15950 - protein, 10 aa, Dengue virus
GMEIRPVKDK

SEQ ID NO: 15951 - protein, 10 aa, Dengue virus
MEIRPVKDKE

SEQ ID NO: 15952 - protein, 10 aa, Dengue virus
EIRPVKDKEE

SEQ ID NO: 15953 - protein, 10 aa, Dengue virus
IRPVKDKEEN

SEQ ID NO: 15954 - protein, 10 aa, Dengue virus
RPVKDKEENL

SEQ ID NO: 15955 - protein, 10 aa, Dengue virus
PVKDKEENLV

SEQ ID NO: 15956 - protein, 10 aa, Dengue virus
VKEKEENLVR

SEQ ID NO: 15957 - protein, 10 aa, Dengue virus
KEKEENLVRS

SEQ ID NO: 15958 - protein, 10 aa, Dengue virus
EKEENLVRSM

SEQ ID NO: 15959 - protein, 10 aa, Dengue virus
KEENLVRSMV

SEQ ID NO: 15960 - protein, 10 aa, Dengue virus
EENLVRSMVS

SEQ ID NO: 15961 - protein, 10 aa, Dengue virus
ENLVRSMVSA

SEQ ID NO: 15962 - protein, 10 aa, Dengue virus
NLVRSMVSAG

SEQ ID NO: 15963 - protein, 10 aa, Dengue virus
LVRSMVSAGS

SEQ ID NO: 15964 - protein, 10 aa, Dengue virus
VRSMVSAGSG

SEQ ID NO: 15965 - protein, 10 aa, Dengue virus
RSMVSAGSGE

SEQ ID NO: 15966 - protein, 10 aa, Dengue virus
SMVSAGLGEV

SEQ ID NO: 15967 - protein, 10 aa, Dengue virus
MVSAGLGEVD

SEQ ID NO: 15968 - protein, 10 aa, Dengue virus
VSAGLGEVDS

SEQ ID NO: 15969 - protein, 10 aa, Dengue virus
SAGLGEVDSF

SEQ ID NO: 15970 - protein, 10 aa, Dengue virus
AGLGEVDSFS

SEQ ID NO: 15971 - protein, 10 aa, Dengue virus
GLGEVDSFSL

SEQ ID NO: 15972 - protein, 10 aa, Dengue virus
LGEVDSFSLG

SEQ ID NO: 15973 - protein, 10 aa, Dengue virus
GEVDSFSLGI

SEQ ID NO: 15974 - protein, 10 aa, Dengue virus
EVDSFSLGIL

SEQ ID NO: 15975 - protein, 10 aa, Dengue virus
VDSFSLGILC

SEQ ID NO: 15976 - protein, 10 aa, Dengue virus
FSLGILCVSI

SEQ ID NO: 15977 - protein, 10 aa, Dengue virus
SILIEEVMRS

SEQ ID NO: 15978 - protein, 10 aa, Dengue virus
ILIEEVMRSR

SEQ ID NO: 15979 - protein, 10 aa, Dengue virus
LIEEVMRSRW

SEQ ID NO: 15980 - protein, 10 aa, Dengue virus
TEEVMRSRWS

SEQ ID NO: 15981 - protein, 10 aa, Dengue virus
EEVMRSRWSK

SEQ ID NO: 15982 - protein, 10 aa, Dengue virus
EVMRSRWSRR

SEQ ID NO: 15983 - protein, 10 aa, Dengue virus
VMRSRWSRRM

SEQ ID NO: 15984 - protein, 10 aa, Dengue virus
MRSRWSRRML

SEQ ID NO: 15985 - protein, 10 aa, Dengue virus
RSRWSRRMLM

SEQ ID NO: 15986 - protein, 10 aa, Dengue virus
SRWSRRMLMT

SEQ ID NO: 15987 - protein, 10 aa, Dengue virus
RWSRRMLMTG

SEQ ID NO: 15988 - protein, 10 aa, Dengue virus
WSRRMLMTGT

SEQ ID NO: 15989 - protein, 10 aa, Dengue virus
SRRMLMTGTL

SEQ ID NO: 15990 - protein, 10 aa, Dengue virus
RMLMTGTLAV

SEQ ID NO: 15991 - protein, 10 aa, Dengue virus
MLMTGTLVVF

SEQ ID NO: 15992 - protein, 10 aa, Dengue virus
GQLTWSDLIR

SEQ ID NO: 15993 - protein, 10 aa, Dengue virus
QLTWNDLIRS

SEQ ID NO: 15994 - protein, 10 aa, Dengue virus
LTWNDLIRSC

SEQ ID NO: 15995 - protein, 10 aa, Dengue virus
TWNDLIRSCI

SEQ ID NO: 15996 - protein, 10 aa, Dengue virus
WNDLIRSCIM

SEQ ID NO: 15997 - protein, 10 aa, Dengue virus
NDLIRSCIMV

SEQ ID NO: 15998 - protein, 10 aa, Dengue virus
DLIRSCIMVG

SEQ ID NO: 15999 - protein, 10 aa, Dengue virus
LIRSCIMVGA

SEQ ID NO: 16000 - protein, 10 aa, Dengue virus
IRSCIMVGAN

SEQ ID NO: 16001 - protein, 10 aa, Dengue virus
RSCIMVGANA

SEQ ID NO: 16002 - protein, 10 aa, Dengue virus
SCIMVGANAS

SEQ ID NO: 16003 - protein, 10 aa, Dengue virus
CIMVGANAFD

SEQ ID NO: 16004 - protein, 10 aa, Dengue virus
IMVGANASDK

SEQ ID NO: 16005 - protein, 10 aa, Dengue virus
MVGANASDKM

SEQ ID NO: 16006 - protein, 10 aa, Dengue virus
VGANASDKMG

SEQ ID NO: 16007 - protein, 10 aa, Dengue virus
GANASDKMGM

SEQ ID NO: 16008 - protein, 10 aa, Dengue virus
ANASDKMGMG

SEQ ID NO: 16009 - protein, 10 aa, Dengue virus
DKMGMGTTYL

SEQ ID NO: 16010 - protein, 10 aa, Dengue virus
KMGMGTTYLA

SEQ ID NO: 16011 - protein, 10 aa, Dengue virus
MGMGMTYLAL

SEQ ID NO: 16012 - protein, 10 aa, Dengue virus
GMGMTYLALM

SEQ ID NO: 16013 - protein, 10 aa, Dengue virus
MGMTYLALMA

SEQ ID NO: 16014 - protein, 10 aa, Dengue virus
GMTYLALMAT

SEQ ID NO: 16015 - protein, 10 aa, Dengue virus
MTYLALMATF

SEQ ID NO: 16016 - protein, 10 aa, Dengue virus
TYLALMATFR

SEQ ID NO: 16017 - protein, 10 aa, Dengue virus
YLALMATFRM

SEQ ID NO: 16018 - protein, 10 aa, Dengue virus
LALMATFRMR

SEQ ID NO: 16019 - protein, 10 aa, Dengue virus
ALMATFRMRP

SEQ ID NO: 16020 - protein, 10 aa, Dengue virus
LMATFRMRPM

SEQ ID NO: 16021 - protein, 10 aa, Dengue virus
MATFRMRPMF

SEQ ID NO: 16022 - protein, 10 aa, Dengue virus
ATFRMRPMFA

SEQ ID NO: 16023 - protein, 10 aa, Dengue virus
TFRMRPMFAV

SEQ ID NO: 16024 - protein, 10 aa, Dengue virus
FRMRPMFAVG

SEQ ID NO: 16025 - protein, 10 aa, Dengue virus
RMRPMFAVGL

SEQ ID NO: 16026 - protein, 10 aa, Dengue virus
MRPMLAVGLL

SEQ ID NO: 16027 - protein, 10 aa, Dengue virus
RPMLAVGLLF

SEQ ID NO: 16028 - protein, 10 aa, Dengue virus
PMLAVGLLFR

SEQ ID NO: 16029 - protein, 10 aa, Dengue virus
MLAVGLLFRR

SEQ ID NO: 16030 - protein, 10 aa, Dengue virus
LAVGLLFRRL

SEQ ID NO: 16031 - protein, 10 aa, Dengue virus
AVGLLIRRLT

SEQ ID NO: 16032 - protein, 10 aa, Dengue virus
VGLLIRRLTS

SEQ ID NO: 16033 - protein, 10 aa, Dengue virus
GLLIRRLTSR

SEQ ID NO: 16034 - protein, 10 aa, Dengue virus
LLIRRLTSRE

SEQ ID NO: 16035 - protein, 10 aa, Dengue virus
LIRRLTSREV

SEQ ID NO: 16036 - protein, 10 aa, Dengue virus
IRRLTSREVL

SEQ ID NO: 16037 - protein, 10 aa, Dengue virus
TSREVLLLTV

SEQ ID NO: 16038 - protein, 10 aa, Dengue virus
SREVLLLTVG

SEQ ID NO: 16039 - protein, 10 aa, Dengue virus
REVLLLTVGL

SEQ ID NO: 16040 - protein, 10 aa, Dengue virus
EVLLLTVGLS

SEQ ID NO: 16041 - protein, 10 aa, Dengue virus
VLLLTVGLSL

SEQ ID NO: 16042 - protein, 10 aa, Dengue virus
LLLTVGLSLV

SEQ ID NO: 16043 - protein, 10 aa, Dengue virus
LLTVGLSLVA

SEQ ID NO: 16044 - protein, 10 aa, Dengue virus
LTVGLSLVAS

SEQ ID NO: 16045 - protein, 10 aa, Dengue virus
TVGLSLVASV

SEQ ID NO: 16046 - protein, 10 aa, Dengue virus
VGLSLVASVE

SEQ ID NO: 16047 - protein, 10 aa, Dengue virus
GLSLVAFVEL

SEQ ID NO: 16048 - protein, 10 aa, Dengue virus
LSLVAFVELP

SEQ ID NO: 16049 - protein, 10 aa, Dengue virus
SVELPSSLEE

SEQ ID NO: 16050 - protein, 10 aa, Dengue virus
VELPSSLEEL

SEQ ID NO: 16051 - protein, 10 aa, Dengue virus
ELPSSLEELG

SEQ ID NO: 16052 - protein, 10 aa, Dengue virus
LPSSLEELGD

SEQ ID NO: 16053 - protein, 10 aa, Dengue virus
PSSLEELGDG

SEQ ID NO: 16054 - protein, 10 aa, Dengue virus
SSLEELGDGL

SEQ ID NO: 16055 - protein, 10 aa, Dengue virus
SLDELGDGLA

SEQ ID NO: 16056 - protein, 10 aa, Dengue virus
LEELGDGLAI

SEQ ID NO: 16057 - protein, 10 aa, Dengue virus
EELGDGLAIG

SEQ ID NO: 16058 - protein, 10 aa, Dengue virus
ELGDGLAIGI

SEQ ID NO: 16059 - protein, 10 aa, Dengue virus
LGDGLAIGIM

SEQ ID NO: 16060 - protein, 10 aa, Dengue virus
GDGLAMGIMM

SEQ ID NO: 16061 - protein, 10 aa, Dengue virus
DGLAMGIMML

SEQ ID NO: 16062 - protein, 10 aa, Dengue virus
GLAMGIMMLK

SEQ ID NO: 16063 - protein, 10 aa, Dengue virus
LAMGIMMLKL

SEQ ID NO: 16064 - protein, 10 aa, Dengue virus
AMGIMMLKLL

SEQ ID NO: 16065 - protein, 10 aa, Dengue virus
MGIMMLKLLT

SEQ ID NO: 16066 - protein, 10 aa, Dengue virus
GIMMLKLLTE

SEQ ID NO: 16067 - protein, 10 aa, Dengue virus
IMMLKLLTEF

SEQ ID NO: 16068 - protein, 10 aa, Dengue virus
MMLKLLTEFQ

SEQ ID NO: 16069 - protein, 10 aa, Dengue virus
MLKLLTEFQP

SEQ ID NO: 16070 - protein, 10 aa, Dengue virus
LKLLTEFQPH

SEQ ID NO: 16071 - protein, 10 aa, Dengue virus
KLLTEFQPHQ

SEQ ID NO: 16072 - protein, 10 aa, Dengue virus
LLTEFQPHQL

SEQ ID NO: 16073 - protein, 10 aa, Dengue virus
LTEFQPHQLW

SEQ ID NO: 16074 - protein, 10 aa, Dengue virus
LSIVSLLPLC

SEQ ID NO: 16075 - protein, 10 aa, Dengue virus
VSLLPLCLST

SEQ ID NO: 16076 - protein, 10 aa, Dengue virus
SLLPLCLSTT

SEQ ID NO: 16077 - protein, 10 aa, Dengue virus
LLPLCLSTTS

SEQ ID NO: 16078 - protein, 10 aa, Dengue virus
LPLCLSTTSQ

SEQ ID NO: 16079 - protein, 10 aa, Dengue virus
PLCMSTTSQK

SEQ ID NO: 16080 - protein, 10 aa, Dengue virus
LCMSTTSQKT

SEQ ID NO: 16081 - protein, 10 aa, Dengue virus
TWLPVLLGSF

SEQ ID NO: 16082 - protein, 10 aa, Dengue virus
WLPVLLGSFG

SEQ ID NO: 16083 - protein, 10 aa, Dengue virus
LPVLLGSFGC

SEQ ID NO: 16084 - protein, 10 aa, Dengue virus
PVLLGSFGCK

SEQ ID NO: 16085 - protein, 10 aa, Dengue virus
VLLGSFGCKP

SEQ ID NO: 16086 - protein, 10 aa, Dengue virus
LLGSFGCKPL

SEQ ID NO: 16087 - protein, 10 aa, Dengue virus
LGSFGCKPLT

SEQ ID NO: 16088 - protein, 10 aa, Dengue virus
GSFGCKPLTM

SEQ ID NO: 16089 - protein, 10 aa, Dengue virus
SFGCKPLTMF

SEQ ID NO: 16090 - protein, 10 aa, Dengue virus
FGCKPLTMFL

SEQ ID NO: 16091 - protein, 10 aa, Dengue virus
GCKPLPMFLI

SEQ ID NO: 16092 - protein, 10 aa, Dengue virus
CKPLTMFLIT

SEQ ID NO: 16093 - protein, 10 aa, Dengue virus
KPLTMFLITE

SEQ ID NO: 16094 - protein, 10 aa, Dengue virus
ENKIWGRRSW

SEQ ID NO: 16095 - protein, 10 aa, Dengue virus
NKIWGRRSWP

SEQ ID NO: 16096 - protein, 10 aa, Dengue virus
KIWGRRSWPL

SEQ ID NO: 16097 - protein, 10 aa, Dengue virus
IWGRRSWPLN

SEQ ID NO: 16098 - protein, 10 aa, Dengue virus
WGRRSWPLNE

SEQ ID NO: 16099 - protein, 10 aa, Dengue virus
GRRSWPLNEG

SEQ ID NO: 16100 - protein, 10 aa, Dengue virus
RRSWPLNEGI

SEQ ID NO: 16101 - protein, 10 aa, Dengue virus
RSWPLNEGIM

SEQ ID NO: 16102 - protein, 10 aa, Dengue virus
SWPINEGIMA

SEQ ID NO: 16103 - protein, 10 aa, Dengue virus
WPLNEGIMAI

SEQ ID NO: 16104 - protein, 10 aa, Dengue virus
PLNEGIMAIG

SEQ ID NO: 16105 - protein, 10 aa, Dengue virus
LNEGIMAIGI

SEQ ID NO: 16106 - protein, 10 aa, Dengue virus
NEGIMAIGIV

SEQ ID NO: 16107 - protein, 10 aa, Dengue virus
EGIMAIGIVS

SEQ ID NO: 16108 - protein, 10 aa, Dengue virus
GIMAIGIVSI

SEQ ID NO: 16109 - protein, 10 aa, Dengue virus
IMAIGIVSIL

SEQ ID NO: 16110 - protein, 10 aa, Dengue virus
MAIGIVSILL

SEQ ID NO: 16111 - protein, 10 aa, Dengue virus
AIGIVSILLS

SEQ ID NO: 16112 - protein, 10 aa, Dengue virus
IGIVSILLSS

SEQ ID NO: 16113 - protein, 10 aa, Dengue virus
GVVSILLSSL

SEQ ID NO: 16114 - protein, 10 aa, Dengue virus
VVSILLSSLL

SEQ ID NO: 16115 - protein, 10 aa, Dengue virus
VSILLSALLK

SEQ ID NO: 16116 - protein, 10 aa, Dengue virus
SILLSALLKN

SEQ ID NO: 16117 - protein, 10 aa, Dengue virus
ILLSALLKND

SEQ ID NO: 16118 - protein, 10 aa, Dengue virus
LLSALLKNDV

SEQ ID NO: 16119 - protein, 10 aa, Dengue virus
LSALLKNDVP

SEQ ID NO: 16120 - protein, 10 aa, Dengue virus
SALLKNDVPL

SEQ ID NO: 16121 - protein, 10 aa, Dengue virus
ALLKNDVPLA

SEQ ID NO: 16122 - protein, 10 aa, Dengue virus
GSSADLLLEK

SEQ ID NO: 16123 - protein, 10 aa, Dengue virus
SSADLLLEKA

SEQ ID NO: 16124 - protein, 10 aa, Dengue virus
SADLLLEKAA

SEQ ID NO: 16125 - protein, 10 aa, Dengue virus
ADLSLEKAAV

SEQ ID NO: 16126 - protein, 10 aa, Dengue virus
DLSLEKAAVV

SEQ ID NO: 16127 - protein, 10 aa, Dengue virus
LSLEKAAVVS

SEQ ID NO: 16128 - protein, 10 aa, Dengue virus
SLEKAAVVSW

SEQ ID NO: 16129 - protein, 10 aa, Dengue virus
LEKAAVVSWE

SEQ ID NO: 16130 - protein, 10 aa, Dengue virus
AEVSWEQEAE

SEQ ID NO: 16131 - protein, 10 aa, Dengue virus
EVSWEQEAEH

SEQ ID NO: 16132 - protein, 10 aa, Dengue virus
VSWEQEAEHS

SEQ ID NO: 16133 - protein, 10 aa, Dengue virus
SWEQEAEHSG

SEQ ID NO: 16134 - protein, 10 aa, Dengue virus
WEQEAEHSGT

SEQ ID NO: 16135 - protein, 10 aa, Dengue virus
EQEAEHSGTS

SEQ ID NO: 16136 - protein, 10 aa, Dengue virus
QEAEHSGTSH

SEQ ID NO: 16137 - protein, 10 aa, Dengue virus
EAEHSGTSHN

SEQ ID NO: 16138 - protein, 10 aa, Dengue virus
AEHSGTSHNI

SEQ ID NO: 16139 - protein, 10 aa, Dengue virus
EHSGTSHNIL

SEQ ID NO: 16140 - protein, 10 aa, Dengue virus
HSGTSHNILV

SEQ ID NO: 16141 - protein, 10 aa, Dengue virus
SGTSHNILVE

SEQ ID NO: 16142 - protein, 10 aa, Dengue virus
GTSHNILVEV

SEQ ID NO: 16143 - protein, 10 aa, Dengue virus
TSHNILVEVQ

SEQ ID NO: 16144 - protein, 10 aa, Dengue virus
SHNILVEIQD

SEQ ID NO: 16145 - protein, 10 aa, Dengue virus
HNILVEIQDD

SEQ ID NO: 16146 - protein, 10 aa, Dengue virus
NILVEIQDDG

SEQ ID NO: 16147 - protein, 10 aa, Dengue virus
ILVEIQDDGT

SEQ ID NO: 16148 - protein, 10 aa, Dengue virus
LVEIQDDGTM

SEQ ID NO: 16149 - protein, 10 aa, Dengue virus
VEIQDDGTMK

SEQ ID NO: 16150 - protein, 10 aa, Dengue virus
EIQDDGTMKI

SEQ ID NO: 16151 - protein, 10 aa, Dengue virus
IQDDGTMKIK

SEQ ID NO: 16152 - protein, 10 aa, Dengue virus
GTMKIKDEEK

SEQ ID NO: 16153 - protein, 10 aa, Dengue virus
TMKIKDEEKD

SEQ ID NO: 16154 - protein, 10 aa, Dengue virus
MKIKDEEKDD

SEQ ID NO: 16155 - protein, 10 aa, Dengue virus
KIKDEEKDDT

SEQ ID NO: 16156 - protein, 10 aa, Dengue virus
IKDEERDDTI

SEQ ID NO: 16157 - protein, 10 aa, Dengue virus
KDEERDDTIT

SEQ ID NO: 16158 - protein, 10 aa, Dengue virus
DEERDDTITI

SEQ ID NO: 16159 - protein, 10 aa, Dengue virus
EERDDTITIL

SEQ ID NO: 16160 - protein, 10 aa, Dengue virus
ERDDTITILL

SEQ ID NO: 16161 - protein, 10 aa, Dengue virus
RDDTITILLK

SEQ ID NO: 16162 - protein, 10 aa, Dengue virus
DDTITILLKA

SEQ ID NO: 16163 - protein, 10 aa, Dengue virus
DTITILLKAT

SEQ ID NO: 16164 - protein, 10 aa, Dengue virus
TITILLKATL

SEQ ID NO: 16165 - protein, 10 aa, Dengue virus
ITILLKATLL

SEQ ID NO: 16166 - protein, 10 aa, Dengue virus
ILLKATLLAI

SEQ ID NO: 16167 - protein, 10 aa, Dengue virus
LLKATLLAIS

SEQ ID NO: 16168 - protein, 10 aa, Dengue virus
LKATLLAISG

SEQ ID NO: 16169 - protein, 10 aa, Dengue virus
KATLLAISGV

SEQ ID NO: 16170 - protein, 10 aa, Dengue virus
ATLLAISGVY

SEQ ID NO: 16171 - protein, 10 aa, Dengue virus
TLLAISGVYP

SEQ ID NO: 16172 - protein, 10 aa, Dengue virus
LLAVSGVYPM

SEQ ID NO: 16173 - protein, 10 aa, Dengue virus
LAVSGVYPMS

SEQ ID NO: 16174 - protein, 10 aa, Dengue virus
AVSGVYPMSI

SEQ ID NO: 16175 - protein, 10 aa, Dengue virus
VSGVYPMSIP

SEQ ID NO: 16176 - protein, 10 aa, Dengue virus
SGVYPMSIPA

SEQ ID NO: 16177 - protein, 10 aa, Dengue virus
GVYPMSIPAT

SEQ ID NO: 16178 - protein, 10 aa, Dengue virus
VYPMSIPATL

SEQ ID NO: 16179 - protein, 10 aa, Dengue virus
YPMSIPATLF

SEQ ID NO: 16180 - protein, 10 aa, Dengue virus
PMSIPATLFV

SEQ ID NO: 16181 - protein, 10 aa, Dengue virus
MSIPATLFVW

SEQ ID NO: 16182 - protein, 10 aa, Dengue virus
SIPATLFVWH

SEQ ID NO: 16183 - protein, 10 aa, Dengue virus
IPATLFVWHF

SEQ ID NO: 16184 - protein, 10 aa, Dengue virus
PATLFVWHFW

SEQ ID NO: 16185 - protein, 10 aa, Dengue virus
ATLFVWHFWQ

SEQ ID NO: 16186 - protein, 10 aa, Dengue virus
VLWDTPSPPK

SEQ ID NO: 16187 - protein, 10 aa, Dengue virus
LWDTPSPPKV

SEQ ID NO: 16188 - protein, 10 aa, Dengue virus
WDTPSPPEVG

SEQ ID NO: 16189 - protein, 10 aa, Dengue virus
DTPSPPEVGR

SEQ ID NO: 16190 - protein, 10 aa, Dengue virus
TPSPPEVGRA

SEQ ID NO: 16191 - protein, 10 aa, Dengue virus
PSPPEVGRAV

SEQ ID NO: 16192 - protein, 10 aa, Dengue virus
SPPEVGRAVL

SEQ ID NO: 16193 - protein, 10 aa, Dengue virus
PPEVGRAVLD

SEQ ID NO: 16194 - protein, 10 aa, Dengue virus
VGRAVLDDGI

SEQ ID NO: 16195 - protein, 10 aa, Dengue virus
GRAVLDDGIY

SEQ ID NO: 16196 - protein, 10 aa, Dengue virus
KAVLDDGIYR

SEQ ID NO: 16197 - protein, 10 aa, Dengue virus
VLDDGIYRIL

SEQ ID NO: 16198 - protein, 10 aa, Dengue virus
LDDGIYRILQ

SEQ ID NO: 16199 - protein, 10 aa, Dengue virus
DDGIYRILQR

SEQ ID NO: 16200 - protein, 10 aa, Dengue virus
DGIYRILQRG

SEQ ID NO: 16201 - protein, 10 aa, Dengue virus
GIYRILQRGL

SEQ ID NO: 16202 - protein, 10 aa, Dengue virus
IYRILQRGLL

SEQ ID NO: 16203 - protein, 10 aa, Dengue virus
YRILQRGLLG

SEQ ID NO: 16204 - protein, 10 aa, Dengue virus
RILQRGLLGR

SEQ ID NO: 16205 - protein, 10 aa, Dengue virus
ILQRGLLGRS

SEQ ID NO: 16206 - protein, 10 aa, Dengue virus
LQRGLLGRSQ

SEQ ID NO: 16207 - protein, 10 aa, Dengue virus
SQVGVGVFQD

SEQ ID NO: 16208 - protein, 10 aa, Dengue virus
QVGVGVFQDG

SEQ ID NO: 16209 - protein, 10 aa, Dengue virus
VGVGVFQDGV

SEQ ID NO: 16210 - protein, 10 aa, Dengue virus
GVGVFQDGVF

SEQ ID NO: 16211 - protein, 10 aa, Dengue virus
VGVFQDGVFH

SEQ ID NO: 16212 - protein, 10 aa, Dengue virus
GVFQDGVFHT

SEQ ID NO: 16213 - protein, 10 aa, Dengue virus
VFQDGVFHTM

SEQ ID NO: 16214 - protein, 10 aa, Dengue virus
FQDGVFHTMW

SEQ ID NO: 16215 - protein, 10 aa, Dengue virus
QDGVFHTMWH

SEQ ID NO: 16216 - protein, 10 aa, Dengue virus
DGVFHTMWHV

SEQ ID NO: 16217 - protein, 10 aa, Dengue virus
GVFHTMWHVT

SEQ ID NO: 16218 - protein, 10 aa, Dengue virus
LISYGGGWRF

SEQ ID NO: 16219 - protein, 10 aa, Dengue virus
ISYGGGWRFQ

SEQ ID NO: 16220 - protein, 10 aa, Dengue virus
SYGGGWRFQG

SEQ ID NO: 16221 - protein, 10 aa, Dengue virus
YGGGWRFQGS

SEQ ID NO: 16222 - protein, 10 aa, Dengue virus
GGGWRFQGSW

SEQ ID NO: 16223 - protein, 10 aa, Dengue virus
GGWRFQGSWN

SEQ ID NO: 16224 - protein, 10 aa, Dengue virus
RGSWNTGEEV

SEQ ID NO: 16225 - protein, 10 aa, Dengue virus
GSWNAGEEVQ

SEQ ID NO: 16226 - protein, 10 aa, Dengue virus
SWNAGEEVQV

SEQ ID NO: 16227 - protein, 10 aa, Dengue virus
WNAGEEVQVI

SEQ ID NO: 16228 - protein, 10 aa, Dengue virus
NAGEEVQVIA

SEQ ID NO: 16229 - protein, 10 aa, Dengue virus
AGEEVQVIAV

SEQ ID NO: 16230 - protein, 10 aa, Dengue virus
GKNPKNVQTT

SEQ ID NO: 16231 - protein, 10 aa, Dengue virus
KNPKNVQTTP

SEQ ID NO: 16232 - protein, 10 aa, Dengue virus
NPKNVQTTPG

SEQ ID NO: 16233 - protein, 10 aa, Dengue virus
PKNVQTTPGT

SEQ ID NO: 16234 - protein, 10 aa, Dengue virus
KNVQTTPGTF

SEQ ID NO: 16235 - protein, 10 aa, Dengue virus
NVQTTPGTFK

SEQ ID NO: 16236 - protein, 10 aa, Dengue virus
VQTTPGTFKT

SEQ ID NO: 16237 - protein, 10 aa, Dengue virus
QTTPGTFKTP

SEQ ID NO: 16238 - protein, 10 aa, Dengue virus
TTPGTFKTPE

SEQ ID NO: 16239 - protein, 10 aa, Dengue virus
TPGTFKTPEG

SEQ ID NO: 16240 - protein, 10 aa, Dengue virus
PGTFKTSEGE

SEQ ID NO: 16241 - protein, 10 aa, Dengue virus
GTFKTSEGEV

SEQ ID NO: 16242 - protein, 10 aa, Dengue virus
TFKTSEGEVG

SEQ ID NO: 16243 - protein, 10 aa, Dengue virus
FKTSEGEVGA

SEQ ID NO: 16244 - protein, 10 aa, Dengue virus
KTSEGEVGAI

SEQ ID NO: 16245 - protein, 10 aa, Dengue virus
TSEGEVGAIA

SEQ ID NO: 16246 - protein, 10 aa, Dengue virus
SEGEVGAIAL

SEQ ID NO: 16247 - protein, 10 aa, Dengue virus
PIVNREGKVV

SEQ ID NO: 16248 - protein, 10 aa, Dengue virus
IVNRERKIVG

SEQ ID NO: 16249 - protein, 10 aa, Dengue virus
VNRERKIVGL

SEQ ID NO: 16250 - protein, 10 aa, Dengue virus
NREGKVVGLY

SEQ ID NO: 16251 - protein, 10 aa, Dengue virus
TYVSAIAQAR

SEQ ID NO: 16252 - protein, 10 aa, Dengue virus
YVSAIAQAKT

SEQ ID NO: 16253 - protein, 10 aa, Dengue virus
VSAIAQAKTS

SEQ ID NO: 16254 - protein, 10 aa, Dengue virus
SAIAQAKTSQ

SEQ ID NO: 16255 - protein, 10 aa, Dengue virus
AIAQAKTSQE

SEQ ID NO: 16256 - protein, 10 aa, Dengue virus
IAQAKTSQEG

SEQ ID NO: 16257 - protein, 10 aa, Dengue virus
AQAKTSQEGP

SEQ ID NO: 16258 - protein, 10 aa, Dengue virus
QAKTSQEGPL

SEQ ID NO: 16259 - protein, 10 aa, Dengue virus
AKTSQEGPLP

SEQ ID NO: 16260 - protein, 10 aa, Dengue virus
KTSQEGPLPE

SEQ ID NO: 16261 - protein, 10 aa, Dengue virus
TSQEGPLPEI

SEQ ID NO: 16262 - protein, 10 aa, Dengue virus
QEGPLPEIEE

SEQ ID NO: 16263 - protein, 10 aa, Dengue virus
EGPLPEIEEE

SEQ ID NO: 16264 - protein, 10 aa, Dengue virus
GPLPEIEEEV

SEQ ID NO: 16265 - protein, 10 aa, Dengue virus
PLPEIEEEVF

SEQ ID NO: 16266 - protein, 10 aa, Dengue virus
LPEIEDEVFK

SEQ ID NO: 16267 - protein, 10 aa, Dengue virus
PEIEDEVFKK

SEQ ID NO: 16268 - protein, 10 aa, Dengue virus
EIEDEVFKKR

SEQ ID NO: 16269 - protein, 10 aa, Dengue virus
IEDEVFKKRN

SEQ ID NO: 16270 - protein, 10 aa, Dengue virus
EDEVFKKRNL

SEQ ID NO: 16271 - protein, 10 aa, Dengue virus
DEVFKKRNLT

SEQ ID NO: 16272 - protein, 10 aa, Dengue virus
EVFKKRNLTI

SEQ ID NO: 16273 - protein, 10 aa, Dengue virus
VFKKRNLTIM

SEQ ID NO: 16274 - protein, 10 aa, Dengue virus
FKKRNLTIMD

SEQ ID NO: 16275 - protein, 10 aa, Dengue virus
KKRNLTIMDL

SEQ ID NO: 16276 - protein, 10 aa, Dengue virus
GKTRRYLPAM

SEQ ID NO: 16277 - protein, 10 aa, Dengue virus
KTRRYLPAMV

SEQ ID NO: 16278 - protein, 10 aa, Dengue virus
TRRYLPAMVR

SEQ ID NO: 16279 - protein, 10 aa, Dengue virus
RRYLPAMVRE

SEQ ID NO: 16280 - protein, 10 aa, Dengue virus
RYLPAMVREA

SEQ ID NO: 16281 - protein, 10 aa, Dengue virus
YLPAMVREAI

SEQ ID NO: 16282 - protein, 10 aa, Dengue virus
LPAMVREAIK

SEQ ID NO: 16283 - protein, 10 aa, Dengue virus
PAMVREAIKR

SEQ ID NO: 16284 - protein, 10 aa, Dengue virus
AIVREAIKRR

SEQ ID NO: 16285 - protein, 10 aa, Dengue virus
VREAIKRRLR

SEQ ID NO: 16286 - protein, 10 aa, Dengue virus
REAIKRRLRT

SEQ ID NO: 16287 - protein, 10 aa, Dengue virus
EAIKRRLRTL

SEQ ID NO: 16288 - protein, 10 aa, Dengue virus
IKRKLRTLVL

SEQ ID NO: 16289 - protein, 10 aa, Dengue virus
KRRLRTLILA

SEQ ID NO: 16290 - protein, 10 aa, Dengue virus
RRLRTLILAP

SEQ ID NO: 16291 - protein, 10 aa, Dengue virus
RLRTLILAPT

SEQ ID NO: 16292 - protein, 10 aa, Dengue virus
LRTLVLAPTR

SEQ ID NO: 16293 - protein, 10 aa, Dengue virus
RTLVLAPTRV

SEQ ID NO: 16294 - protein, 10 aa, Dengue virus
TLVLAPTRVV

SEQ ID NO: 16295 - protein, 10 aa, Dengue virus
LVLAPTRVVA

SEQ ID NO: 16296 - protein, 10 aa, Dengue virus
VLAPTRVVAS

SEQ ID NO: 16297 - protein, 10 aa, Dengue virus
SEMAEALKGV

SEQ ID NO: 16298 - protein, 10 aa, Dengue virus
EMAEALKGVP

SEQ ID NO: 16299 - protein, 10 aa, Dengue virus
MAEALKGVPI

SEQ ID NO: 16300 - protein, 10 aa, Dengue virus
AEALKGVPIR

SEQ ID NO: 16301 - protein, 10 aa, Dengue virus
EALKGVPIRY

SEQ ID NO: 16302 - protein, 10 aa, Dengue virus
ALKGVPIRYQ

SEQ ID NO: 16303 - protein, 10 aa, Dengue virus
LKGVPIRYQT

SEQ ID NO: 16304 - protein, 10 aa, Dengue virus
KGVPIRYQTT

SEQ ID NO: 16305 - protein, 10 aa, Dengue virus
GVPIRYQTTA

SEQ ID NO: 16306 - protein, 10 aa, Dengue virus
VPIRYQTTAV

SEQ ID NO: 16307 - protein, 10 aa, Dengue virus
TAVKSEHTGR

SEQ ID NO: 16308 - protein, 10 aa, Dengue virus
AVKSEHTGRE

SEQ ID NO: 16309 - protein, 10 aa, Dengue virus
VKSEHTGREI

SEQ ID NO: 16310 - protein, 10 aa, Dengue virus
KSEHTGREIV

SEQ ID NO: 16311 - protein, 10 aa, Dengue virus
SEHTGREIVD

SEQ ID NO: 16312 - protein, 10 aa, Dengue virus
EHTGREIVDL

SEQ ID NO: 16313 - protein, 10 aa, Dengue virus
HTGREIVDLM

SEQ ID NO: 16314 - protein, 10 aa, Dengue virus
TGREIVDLMC

SEQ ID NO: 16315 - protein, 10 aa, Dengue virus
GREIVDLMCH

SEQ ID NO: 16316 - protein, 10 aa, Dengue virus
REIVDLMCHA

SEQ ID NO: 16317 - protein, 10 aa, Dengue virus
MDEAHFTDPA

SEQ ID NO: 16318 - protein, 10 aa, Dengue virus
DEAHFTDPAS

SEQ ID NO: 16319 - protein, 10 aa, Dengue virus
EAHFTDPASI

SEQ ID NO: 16320 - protein, 10 aa, Dengue virus
AHFTDPASIA

SEQ ID NO: 16321 - protein, 10 aa, Dengue virus
HFTDPASIAA

SEQ ID NO: 16322 - protein, 10 aa, Dengue virus
FTDPASIAAR

SEQ ID NO: 16323 - protein, 10 aa, Dengue virus
TDPASIAARG

SEQ ID NO: 16324 - protein, 10 aa, Dengue virus
DPASIAARGY

SEQ ID NO: 16325 - protein, 10 aa, Dengue virus
PASIAARGYI

SEQ ID NO: 16326 - protein, 10 aa, Dengue virus
ASIAARGYIS

SEQ ID NO: 16327 - protein, 10 aa, Dengue virus
FMTATPPGSM

SEQ ID NO: 16328 - protein, 10 aa, Dengue virus
MTATPPGSME

SEQ ID NO: 16329 - protein, 10 aa, Dengue virus
TATPPGSMEA

SEQ ID NO: 16330 - protein, 10 aa, Dengue virus
ATPPGSMEAF

SEQ ID NO: 16331 - protein, 10 aa, Dengue virus
TPPGSMEAFP

SEQ ID NO: 16332 - protein, 10 aa, Dengue virus
PPGSMEAFPQ

SEQ ID NO: 16333 - protein, 10 aa, Dengue virus
PGSMEAFPQS

SEQ ID NO: 16334 - protein, 10 aa, Dengue virus
GSMEAFPQSN

SEQ ID NO: 16335 - protein, 10 aa, Dengue virus
SMEAFPQSNA

SEQ ID NO: 16336 - protein, 10 aa, Dengue virus
MEAFPQSNAV

SEQ ID NO: 16337 - protein, 10 aa, Dengue virus
EAFPQSNAII

SEQ ID NO: 16338 - protein, 10 aa, Dengue virus
AFPQSNAIIQ

SEQ ID NO: 16339 - protein, 10 aa, Dengue virus
FPQSNAIIQD

SEQ ID NO: 16340 - protein, 10 aa, Dengue virus
PQSNAIIQDE

SEQ ID NO: 16341 - protein, 10 aa, Dengue virus
QSNAIIQDEE

SEQ ID NO: 16342 - protein, 10 aa, Dengue virus
SNAVIQDEEK

SEQ ID NO: 16343 - protein, 10 aa, Dengue virus
NAVIQDEEKD

SEQ ID NO: 16344 - protein, 10 aa, Dengue virus
AVIQDEEKDI

SEQ ID NO: 16345 - protein, 10 aa, Dengue virus
VIQDEEKDIP

SEQ ID NO: 16346 - protein, 10 aa, Dengue virus
IQDEEKDIPE

SEQ ID NO: 16347 - protein, 10 aa, Dengue virus
QDEEKDIPER

SEQ ID NO: 16348 - protein, 10 aa, Dengue virus
DEEKDIPERS

SEQ ID NO: 16349 - protein, 10 aa, Dengue virus
EEKDIPERSW

SEQ ID NO: 16350 - protein, 10 aa, Dengue virus
EKDIPERSWN

SEQ ID NO: 16351 - protein, 10 aa, Dengue virus
KDIPERSWNS

SEQ ID NO: 16352 - protein, 10 aa, Dengue virus
IPERSWNSGH

SEQ ID NO: 16353 - protein, 10 aa, Dengue virus
PERSWNSGYD

SEQ ID NO: 16354 - protein, 10 aa, Dengue virus
ERSWNSGYDW

SEQ ID NO: 16355 - protein, 10 aa, Dengue virus
RSWNSGYDWI

SEQ ID NO: 16356 - protein, 10 aa, Dengue virus
SWNSGYDWIT

SEQ ID NO: 16357 - protein, 10 aa, Dengue virus
WNSGYDWITD

SEQ ID NO: 16358 - protein, 10 aa, Dengue virus
NSGYDWITDF

SEQ ID NO: 16359 - protein, 10 aa, Dengue virus
SGYDWITDFP

SEQ ID NO: 16360 - protein, 10 aa, Dengue virus
GYDWITDFPG

SEQ ID NO: 16361 - protein, 10 aa, Dengue virus
YDWITDFPGK

SEQ ID NO: 16362 - protein, 10 aa, Dengue virus
DWITDFPGKT

SEQ ID NO: 16363 - protein, 10 aa, Dengue virus
TVWFVPSIKA

SEQ ID NO: 16364 - protein, 10 aa, Dengue virus
VWFVPSIKAG

SEQ ID NO: 16365 - protein, 10 aa, Dengue virus
WFVPSIKAGN

SEQ ID NO: 16366 - protein, 10 aa, Dengue virus
FVPSIKAGND

SEQ ID NO: 16367 - protein, 10 aa, Dengue virus
VPSIKAGNDI

SEQ ID NO: 16368 - protein, 10 aa, Dengue virus
PSIKAGNDIA

SEQ ID NO: 16369 - protein, 10 aa, Dengue virus
SIKAGNDIAN

SEQ ID NO: 16370 - protein, 10 aa, Dengue virus
IKAGNDIANC

SEQ ID NO: 16371 - protein, 10 aa, Dengue virus
KAGNDIANCL

SEQ ID NO: 16372 - protein, 10 aa, Dengue virus
AGNDIANCLR

SEQ ID NO: 16373 - protein, 10 aa, Dengue virus
CLRKNGKRVV

SEQ ID NO: 16374 - protein, 10 aa, Dengue virus
LRKNGKRVVQ

SEQ ID NO: 16375 - protein, 10 aa, Dengue virus
RKNGKRVVQL

SEQ ID NO: 16376 - protein, 10 aa, Dengue virus
KNGKRVVQLS

SEQ ID NO: 16377 - protein, 10 aa, Dengue virus
NGKRVVQLSR

SEQ ID NO: 16378 - protein, 10 aa, Dengue virus
GKRVVQLSRK

SEQ ID NO: 16379 - protein, 10 aa, Dengue virus
KRVVQLSRKT

SEQ ID NO: 16380 - protein, 10 aa, Dengue virus
RVVQLSRKTF

SEQ ID NO: 16381 - protein, 10 aa, Dengue virus
VVQLSRKTFD

SEQ ID NO: 16382 - protein, 10 aa, Dengue virus
VQLSRKTFDT

SEQ ID NO: 16383 - protein, 10 aa, Dengue virus
TFDTEYQKTR

SEQ ID NO: 16384 - protein, 10 aa, Dengue virus
FDTEYQKTRN

SEQ ID NO: 16385 - protein, 10 aa, Dengue virus
DTEYQKTRNN

SEQ ID NO: 16386 - protein, 10 aa, Dengue virus
TEYQKTRNND

SEQ ID NO: 16387 - protein, 10 aa, Dengue virus
EYQKTRNNDW

SEQ ID NO: 16388 - protein, 10 aa, Dengue virus
YQKTRNNDWD

SEQ ID NO: 16389 - protein, 10 aa, Dengue virus
QKTRNNDWDY

SEQ ID NO: 16390 - protein, 10 aa, Dengue virus
KTRNNDWDYV

SEQ ID NO: 16391 - protein, 10 aa, Dengue virus
TRNNDWDYVV

SEQ ID NO: 16392 - protein, 10 aa, Dengue virus
RNNDWDYVVT

SEQ ID NO: 16393 - protein, 10 aa, Dengue virus
QRRGRIGRNQ

SEQ ID NO: 16394 - protein, 10 aa, Dengue virus
RRGRIGRNQN

SEQ ID NO: 16395 - protein, 10 aa, Dengue virus
RGRIGRNQNK

SEQ ID NO: 16396 - protein, 10 aa, Dengue virus
GRIGRNQNKE

SEQ ID NO: 16397 - protein, 10 aa, Dengue virus
RIGRNQNKEG

SEQ ID NO: 16398 - protein, 10 aa, Dengue virus
IGRNQNKEGD

SEQ ID NO: 16399 - protein, 10 aa, Dengue virus
GRNQNKEGDQ

SEQ ID NO: 16400 - protein, 10 aa, Dengue virus
RNQNKEGDQY

SEQ ID NO: 16401 - protein, 10 aa, Dengue virus
NQNKEGDQYV

SEQ ID NO: 16402 - protein, 10 aa, Dengue virus
QNKEGDQYVY

SEQ ID NO: 16403 - protein, 10 aa, Dengue virus
NKEGDQYVYM

SEQ ID NO: 16404 - protein, 10 aa, Dengue virus
KEGDQYVYMG

SEQ ID NO: 16405 - protein, 10 aa, Dengue virus
EGDQYVYMGQ

SEQ ID NO: 16406 - protein, 10 aa, Dengue virus
GDQYVYMGQP

SEQ ID NO: 16407 - protein, 10 aa, Dengue virus
DQYVYMGQPL

SEQ ID NO: 16408 - protein, 10 aa, Dengue virus
QYVYMGQPLN

SEQ ID NO: 16409 - protein, 10 aa, Dengue virus
YVYMGQPLNN

SEQ ID NO: 16410 - protein, 10 aa, Dengue virus
VYMGQPLNND

SEQ ID NO: 16411 - protein, 10 aa, Dengue virus
YMGQPLKNDE

SEQ ID NO: 16412 - protein, 10 aa, Dengue virus
MGQPLKNDED

SEQ ID NO: 16413 - protein, 10 aa, Dengue virus
GQPLKNDEDH

SEQ ID NO: 16414 - protein, 10 aa, Dengue virus
QPLKNDEDHA

SEQ ID NO: 16415 - protein, 10 aa, Dengue virus
PLKNDEDHAH

SEQ ID NO: 16416 - protein, 10 aa, Dengue virus
LKNDEDHAHW

SEQ ID NO: 16417 - protein, 10 aa, Dengue virus
EPEREKSAAV

SEQ ID NO: 16418 - protein, 10 aa, Dengue virus
PEREKSAAVD

SEQ ID NO: 16419 - protein, 10 aa, Dengue virus
EREKSAAVDG

SEQ ID NO: 16420 - protein, 10 aa, Dengue virus
REKSAAVDGE

SEQ ID NO: 16421 - protein, 10 aa, Dengue virus
EKSAAVDGEY

SEQ ID NO: 16422 - protein, 10 aa, Dengue virus
KSAAVDGEYR

SEQ ID NO: 16423 - protein, 10 aa, Dengue virus
SAAVDGEYRL

SEQ ID NO: 16424 - protein, 10 aa, Dengue virus
AAVDGEYRLR

SEQ ID NO: 16425 - protein, 10 aa, Dengue virus
AVDGEYRLRG

SEQ ID NO: 16426 - protein, 10 aa, Dengue virus
VDGEYRLRGE

SEQ ID NO: 16427 - protein, 10 aa, Dengue virus
RGDLPVWLSH

SEQ ID NO: 16428 - protein, 10 aa, Dengue virus
GDLPVWLSHK

SEQ ID NO: 16429 - protein, 10 aa, Dengue virus
DLPVWLSHKV

SEQ ID NO: 16430 - protein, 10 aa, Dengue virus
LPVWLSHKVA

SEQ ID NO: 16431 - protein, 10 aa, Dengue virus
PVWLSHKVAS

SEQ ID NO: 16432 - protein, 10 aa, Dengue virus
VWLSHKVASE

SEQ ID NO: 16433 - protein, 10 aa, Dengue virus
WLSHKVASEG

SEQ ID NO: 16434 - protein, 10 aa, Dengue virus
LSHKVASEGF

SEQ ID NO: 16435 - protein, 10 aa, Dengue virus
SHKVASEGFQ

SEQ ID NO: 16436 - protein, 10 aa, Dengue virus
HKVASEGFQY

SEQ ID NO: 16437 - protein, 10 aa, Dengue virus
EFAAGRRSIS

SEQ ID NO: 16438 - protein, 10 aa, Dengue virus
FAAGRRSISG

SEQ ID NO: 16439 - protein, 10 aa, Dengue virus
AAGRRSISGD

SEQ ID NO: 16440 - protein, 10 aa, Dengue virus
AGRRSISGDL

SEQ ID NO: 16441 - protein, 10 aa, Dengue virus
GRRSISGDLI

SEQ ID NO: 16442 - protein, 10 aa, Dengue virus
RRSVSGDLIS

SEQ ID NO: 16443 - protein, 10 aa, Dengue virus
RSVSGDLISE

SEQ ID NO: 16444 - protein, 10 aa, Dengue virus
SVSGDLISEI

SEQ ID NO: 16445 - protein, 10 aa, Dengue virus
VSGDLISEIG

SEQ ID NO: 16446 - protein, 10 aa, Dengue virus
SGDLISEIGK

SEQ ID NO: 16447 - protein, 10 aa, Dengue virus
GDLISEIGKL

SEQ ID NO: 16448 - protein, 10 aa, Dengue virus
IGKLPQHLTL

SEQ ID NO: 16449 - protein, 10 aa, Dengue virus
GKLPQHLTLR

SEQ ID NO: 16450 - protein, 10 aa, Dengue virus
KLPQHLTLRA

SEQ ID NO: 16451 - protein, 10 aa, Dengue virus
LPQHLTLRAQ

SEQ ID NO: 16452 - protein, 10 aa, Dengue virus
PQHLTLRAQN

SEQ ID NO: 16453 - protein, 10 aa, Dengue virus
QHLTLRAQNA

SEQ ID NO: 16454 - protein, 10 aa, Dengue virus
HLTLRAQNAL

SEQ ID NO: 16455 - protein, 10 aa, Dengue virus
LTLRAQNALD

SEQ ID NO: 16456 - protein, 10 aa, Dengue virus
TLRAQNALDN

SEQ ID NO: 16457 - protein, 10 aa, Dengue virus
LRAQNALDNL

SEQ ID NO: 16458 - protein, 10 aa, Dengue virus
KAQNALDNLV

SEQ ID NO: 16459 - protein, 10 aa, Dengue virus
MLHNSEQGGK

SEQ ID NO: 16460 - protein, 10 aa, Dengue virus
LHNSEQGGKA

SEQ ID NO: 16461 - protein, 10 aa, Dengue virus
HNSEQGGKAY

SEQ ID NO: 16462 - protein, 10 aa, Dengue virus
NSEQGGKAYR

SEQ ID NO: 16463 - protein, 10 aa, Dengue virus
SEQGGKAYRH

SEQ ID NO: 16464 - protein, 10 aa, Dengue virus
EQGGKAYRHA

SEQ ID NO: 16465 - protein, 10 aa, Dengue virus
QGGKAYRHAM

SEQ ID NO: 16466 - protein, 10 aa, Dengue virus
GGKAYRHAME

SEQ ID NO: 16467 - protein, 10 aa, Dengue virus
GKAYRHAMEE

SEQ ID NO: 16468 - protein, 10 aa, Dengue virus
KAYRHAMEEL

SEQ ID NO: 16469 - protein, 10 aa, Dengue virus
AYRHALEELP

SEQ ID NO: 16470 - protein, 10 aa, Dengue virus
YRHALEELPD

SEQ ID NO: 16471 - protein, 10 aa, Dengue virus
RHALEELPDT

SEQ ID NO: 16472 - protein, 10 aa, Dengue virus
HALEELPDTI

SEQ ID NO: 16473 - protein, 10 aa, Dengue virus
ALEELPDTIE

SEQ ID NO: 16474 - protein, 10 aa, Dengue virus
LEELPDTIET

SEQ ID NO: 16475 - protein, 10 aa, Dengue virus
EELPDTIETI

SEQ ID NO: 16476 - protein, 10 aa, Dengue virus
ELPDTIETIM

SEQ ID NO: 16477 - protein, 10 aa, Dengue virus
LPDTIETIML

SEQ ID NO: 16478 - protein, 10 aa, Dengue virus
PDTIETIMLL

SEQ ID NO: 16479 - protein, 10 aa, Dengue virus
DTIETIMLLA

SEQ ID NO: 16480 - protein, 10 aa, Dengue virus
TIETIMLLAL

SEQ ID NO: 16481 - protein, 10 aa, Dengue virus
IETIMLLALI

SEQ ID NO: 16482 - protein, 10 aa, Dengue virus
ETIMLLALIA

SEQ ID NO: 16483 - protein, 10 aa, Dengue virus
TIMLLALIAV

SEQ ID NO: 16484 - protein, 10 aa, Dengue virus
IMLLALIAVL

SEQ ID NO: 16485 - protein, 10 aa, Dengue virus
LIAVLTGGVM

SEQ ID NO: 16486 - protein, 10 aa, Dengue virus
IAVLTGGVML

SEQ ID NO: 16487 - protein, 10 aa, Dengue virus
AVLTGGVMLF

SEQ ID NO: 16488 - protein, 10 aa, Dengue virus
VLTGGVMLFF

SEQ ID NO: 16489 - protein, 10 aa, Dengue virus
LTGGVMLFFL

SEQ ID NO: 16490 - protein, 10 aa, Dengue virus
TGGVMLFFLS

SEQ ID NO: 16491 - protein, 10 aa, Dengue virus
GGVMLFFLSG

SEQ ID NO: 16492 - protein, 10 aa, Dengue virus
GVTLFFLSGK

SEQ ID NO: 16493 - protein, 10 aa, Dengue virus
VTLFFLSGKG

SEQ ID NO: 16494 - protein, 10 aa, Dengue virus
TLFFLSGKGL

SEQ ID NO: 16495 - protein, 10 aa, Dengue virus
LFFLSGKGLG

SEQ ID NO: 16496 - protein, 10 aa, Dengue virus
FFLSGKGLGK

SEQ ID NO: 16497 - protein, 10 aa, Dengue virus
FLSGKGLGKT

SEQ ID NO: 16498 - protein, 10 aa, Dengue virus
LSGKGLGKTS

SEQ ID NO: 16499 - protein, 10 aa, Dengue virus
SGKGLGKTSI

SEQ ID NO: 16500 - protein, 10 aa, Dengue virus
GKGLGKTSIG

SEQ ID NO: 16501 - protein, 10 aa, Dengue virus
KGLGKTSIGL

SEQ ID NO: 16502 - protein, 10 aa, Dengue virus
KTSIGLLCVT

SEQ ID NO: 16503 - protein, 10 aa, Dengue virus
TSIGLLCVTA

SEQ ID NO: 16504 - protein, 10 aa, Dengue virus
SIGLLCVTAS

SEQ ID NO: 16505 - protein, 10 aa, Dengue virus
IGLLCVTASS

SEQ ID NO: 16506 - protein, 10 aa, Dengue virus
SSALLWMASV

SEQ ID NO: 16507 - protein, 10 aa, Dengue virus
SALLWMASVE

SEQ ID NO: 16508 - protein, 10 aa, Dengue virus
ALLWMASVEP

SEQ ID NO: 16509 - protein, 10 aa, Dengue virus
LLWMANVEPH

SEQ ID NO: 16510 - protein, 10 aa, Dengue virus
LWMANVEPHW

SEQ ID NO: 16511 - protein, 10 aa, Dengue virus
WMANVEPHWI

SEQ ID NO: 16512 - protein, 10 aa, Dengue virus
MANVEPHWIA

SEQ ID NO: 16513 - protein, 10 aa, Dengue virus
ANVEPHWIAA

SEQ ID NO: 16514 - protein, 10 aa, Dengue virus
NVEPHWIAAS

SEQ ID NO: 16515 - protein, 10 aa, Dengue virus
AYVVIGLLFV

SEQ ID NO: 16516 - protein, 10 aa, Dengue virus
YVVIGLLFII

SEQ ID NO: 16517 - protein, 10 aa, Dengue virus
VVIGLLFVIL

SEQ ID NO: 16518 - protein, 10 aa, Dengue virus
VIGLLFVILT

SEQ ID NO: 16519 - protein, 10 aa, Dengue virus
IGLLFIILTV

SEQ ID NO: 16520 - protein, 10 aa, Dengue virus
GLLFIILTVA

SEQ ID NO: 16521 - protein, 10 aa, Dengue virus
LLFIILTVAA

SEQ ID NO: 16522 - protein, 10 aa, Dengue virus
LFIILTVAAN

SEQ ID NO: 16523 - protein, 10 aa, Dengue virus
FIILTVAANE

SEQ ID NO: 16524 - protein, 10 aa, Dengue virus
IILTVAANEM

SEQ ID NO: 16525 - protein, 10 aa, Dengue virus
TTKKDLGIGY

SEQ ID NO: 16526 - protein, 10 aa, Dengue virus
TKKDLGIGYV

SEQ ID NO: 16527 - protein, 10 aa, Dengue virus
KKDLGIGYVA

SEQ ID NO: 16528 - protein, 10 aa, Dengue virus
TMLDVDLHPA

SEQ ID NO: 16529 - protein, 10 aa, Dengue virus
MLDVDLRPAS

SEQ ID NO: 16530 - protein, 10 aa, Dengue virus
LDVDLRPASA

SEQ ID NO: 16531 - protein, 10 aa, Dengue virus
DVDLRPASAW

SEQ ID NO: 16532 - protein, 10 aa, Dengue virus
VDLRPASAWT

SEQ ID NO: 16533 - protein, 10 aa, Dengue virus
DLRPASAWTL

SEQ ID NO: 16534 - protein, 10 aa, Dengue virus
LRPASAWTLY

SEQ ID NO: 16535 - protein, 10 aa, Dengue virus
RPASAWTLYA

SEQ ID NO: 16536 - protein, 10 aa, Dengue virus
WTLYAVATTV

SEQ ID NO: 16537 - protein, 10 aa, Dengue virus
TLYAVATTVI

SEQ ID NO: 16538 - protein, 10 aa, Dengue virus
LYAVATTVIT

SEQ ID NO: 16539 - protein, 10 aa, Dengue virus
YAVATTVITP

SEQ ID NO: 16540 - protein, 10 aa, Dengue virus
AVATTVITPM

SEQ ID NO: 16541 - protein, 10 aa, Dengue virus
VATTVITPMM

SEQ ID NO: 16542 - protein, 10 aa, Dengue virus
ATTVITPMMR

SEQ ID NO: 16543 - protein, 10 aa, Dengue virus
TTVITPMMRH

SEQ ID NO: 16544 - protein, 10 aa, Dengue virus
TVITPMMRHT

SEQ ID NO: 16545 - protein, 10 aa, Dengue virus
VITPMMRHTI

SEQ ID NO: 16546 - protein, 10 aa, Dengue virus
KGWPISKMDL

SEQ ID NO: 16547 - protein, 10 aa, Dengue virus
GWPISKMDLG

SEQ ID NO: 16548 - protein, 10 aa, Dengue virus
WPISKMDLGV

SEQ ID NO: 16549 - protein, 10 aa, Dengue virus
PISKMDLGVP

SEQ ID NO: 16550 - protein, 10 aa, Dengue virus
ISKMDLGVPL

SEQ ID NO: 16551 - protein, 10 aa, Dengue virus
YSQVNPLTLI

SEQ ID NO: 16552 - protein, 10 aa, Dengue virus
SQVNPLTLIA

SEQ ID NO: 16553 - protein, 10 aa, Dengue virus
QVNPLTLIAA

SEQ ID NO: 16554 - protein, 10 aa, Dengue virus
VNPLTLIAAV

SEQ ID NO: 16555 - protein, 10 aa, Dengue virus
NPLTLIAAVL

SEQ ID NO: 16556 - protein, 10 aa, Dengue virus
PLTLIAAVLM

SEQ ID NO: 16557 - protein, 10 aa, Dengue virus
LTLIAAVLML

SEQ ID NO: 16558 - protein, 10 aa, Dengue virus
TLIAAVLMLV

SEQ ID NO: 16559 - protein, 10 aa, Dengue virus
LIAAVLMLVA

SEQ ID NO: 16560 - protein, 10 aa, Dengue virus
IAAVLMLVAH

SEQ ID NO: 16561 - protein, 10 aa, Dengue virus
AAVLMLLAHY

SEQ ID NO: 16562 - protein, 10 aa, Dengue virus
AVLMLLAHYA

SEQ ID NO: 16563 - protein, 10 aa, Dengue virus
VLMLLAHYAI

SEQ ID NO: 16564 - protein, 10 aa, Dengue virus
LMLLAHYAII

SEQ ID NO: 16565 - protein, 10 aa, Dengue virus
AAGIMKNPTI

SEQ ID NO: 16566 - protein, 10 aa, Dengue virus
AGIMKNPTID

SEQ ID NO: 16567 - protein, 10 aa, Dengue virus
GIMKNPTIDG

SEQ ID NO: 16568 - protein, 10 aa, Dengue virus
IMKNPTIDGI

SEQ ID NO: 16569 - protein, 10 aa, Dengue virus
MKNPTIDGIV

SEQ ID NO: 16570 - protein, 10 aa, Dengue virus
KNPTIDGIVA

SEQ ID NO: 16571 - protein, 10 aa, Dengue virus
NPTIDGIVAI

SEQ ID NO: 16572 - protein, 10 aa, Dengue virus
PTIDGIVAID

SEQ ID NO: 16573 - protein, 10 aa, Dengue virus
TIDGIVAIDL

SEQ ID NO: 16574 - protein, 10 aa, Dengue virus
IDGIVAIDLD

SEQ ID NO: 16575 - protein, 10 aa, Dengue virus
DGIVTIDLDP

SEQ ID NO: 16576 - protein, 10 aa, Dengue virus
GIVTIDLDPV

SEQ ID NO: 16577 - protein, 10 aa, Dengue virus
IVTIDLDPVV

SEQ ID NO: 16578 - protein, 10 aa, Dengue virus
VTIDLDPVVY

SEQ ID NO: 16579 - protein, 10 aa, Dengue virus
TIDLDPVVYD

SEQ ID NO: 16580 - protein, 10 aa, Dengue virus
IDLDPVVYDT

SEQ ID NO: 16581 - protein, 10 aa, Dengue virus
DLDPVVYDTK

SEQ ID NO: 16582 - protein, 10 aa, Dengue virus
LDPVVYDTKF

SEQ ID NO: 16583 - protein, 10 aa, Dengue virus
DPVVYDTKFE

SEQ ID NO: 16584 - protein, 10 aa, Dengue virus
PVVYDTKFEK

SEQ ID NO: 16585 - protein, 10 aa, Dengue virus
VVYDTKFEKQ

SEQ ID NO: 16586 - protein, 10 aa, Dengue virus
VYDTKFEKQL

SEQ ID NO: 16587 - protein, 10 aa, Dengue virus
YDTKFEKQLG

SEQ ID NO: 16588 - protein, 10 aa, Dengue virus
DTKFEKQLGQ

SEQ ID NO: 16589 - protein, 10 aa, Dengue virus
TKFEKQLGQI

SEQ ID NO: 16590 - protein, 10 aa, Dengue virus
KQLGQVMLLI

SEQ ID NO: 16591 - protein, 10 aa, Dengue virus
QLGQVMLLIL

SEQ ID NO: 16592 - protein, 10 aa, Dengue virus
LGQVMLLILC

SEQ ID NO: 16593 - protein, 10 aa, Dengue virus
GQVMLLILCT

SEQ ID NO: 16594 - protein, 10 aa, Dengue virus
QVMLLILCTS

SEQ ID NO: 16595 - protein, 10 aa, Dengue virus
VMLLILCTSQ

SEQ ID NO: 16596 - protein, 10 aa, Dengue virus
NQLSKSEFNI

SEQ ID NO: 16597 - protein, 10 aa, Dengue virus
QLSKSEFNIY

SEQ ID NO: 16598 - protein, 10 aa, Dengue virus
LSKSEFNIYK

SEQ ID NO: 16599 - protein, 10 aa, Dengue virus
SKSEFNIYKR

SEQ ID NO: 16600 - protein, 10 aa, Dengue virus
KSEFNIYKRS

SEQ ID NO: 16601 - protein, 10 aa, Dengue virus
SEFNIYKRSG

SEQ ID NO: 16602 - protein, 10 aa, Dengue virus
EFNIYKRSGI

SEQ ID NO: 16603 - protein, 10 aa, Dengue virus
FNIYKRSGIM

SEQ ID NO: 16604 - protein, 10 aa, Dengue virus
NIYKRSGIME

SEQ ID NO: 16605 - protein, 10 aa, Dengue virus
IYKRSGIMEV

SEQ ID NO: 16606 - protein, 10 aa, Dengue virus
YKRSGIIEVD

SEQ ID NO: 16607 - protein, 10 aa, Dengue virus
KRSGIIEVDR

SEQ ID NO: 16608 - protein, 10 aa, Dengue virus
RSGIIEVDRS

SEQ ID NO: 16609 - protein, 10 aa, Dengue virus
SGIIEVDRSE

SEQ ID NO: 16610 - protein, 10 aa, Dengue virus
GIIEVDRSEA

SEQ ID NO: 16611 - protein, 10 aa, Dengue virus
IIEVDRSEAK

SEQ ID NO: 16612 - protein, 10 aa, Dengue virus
IEVDRSEAKE

SEQ ID NO: 16613 - protein, 10 aa, Dengue virus
DRSEAKEGLR

SEQ ID NO: 16614 - protein, 10 aa, Dengue virus
RSEAKEGLRR

SEQ ID NO: 16615 - protein, 10 aa, Dengue virus
SEAKEGLRRG

SEQ ID NO: 16616 - protein, 10 aa, Dengue virus
EAKEGLRRGE

SEQ ID NO: 16617 - protein, 10 aa, Dengue virus
AKEGLRRGET

SEQ ID NO: 16618 - protein, 10 aa, Dengue virus
KEGLRRGETT

SEQ ID NO: 16619 - protein, 10 aa, Dengue virus
EGLKRGETTR

SEQ ID NO: 16620 - protein, 10 aa, Dengue virus
GLKRGETTRH

SEQ ID NO: 16621 - protein, 10 aa, Dengue virus
LKRGETTRHA

SEQ ID NO: 16622 - protein, 10 aa, Dengue virus
KRGETTRHAV

SEQ ID NO: 16623 - protein, 10 aa, Dengue virus
RGETTRHAVS

SEQ ID NO: 16624 - protein, 10 aa, Dengue virus
GETTRHAVSR

SEQ ID NO: 16625 - protein, 10 aa, Dengue virus
ETTRHAVSRG

SEQ ID NO: 16626 - protein, 10 aa, Dengue virus
TTRHAVSRGT

SEQ ID NO: 16627 - protein, 10 aa, Dengue virus
TRHAVSRGTA

SEQ ID NO: 16628 - protein, 10 aa, Dengue virus
RHAVSRGTAK

SEQ ID NO: 16629 - protein, 10 aa, Dengue virus
EVKGYTKGGA

SEQ ID NO: 16630 - protein, 10 aa, Dengue virus
VKGYTKGGAG

SEQ ID NO: 16631 - protein, 10 aa, Dengue virus
KGYTKGGAGH

SEQ ID NO: 16632 - protein, 10 aa, Dengue virus
GYTKGGLGHE

SEQ ID NO: 16633 - protein, 10 aa, Dengue virus
YTKGGAGHEE

SEQ ID NO: 16634 - protein, 10 aa, Dengue virus
TKGGAGHEEP

SEQ ID NO: 16635 - protein, 10 aa, Dengue virus
KGGPGHEEPV

SEQ ID NO: 16636 - protein, 10 aa, Dengue virus
GGPGHEEPVP

SEQ ID NO: 16637 - protein, 10 aa, Dengue virus
GPGHEEPVPM

SEQ ID NO: 16638 - protein, 10 aa, Dengue virus
PGHEEPVPMA

SEQ ID NO: 16639 - protein, 10 aa, Dengue virus
GHEEPVPMAT

SEQ ID NO: 16640 - protein, 10 aa, Dengue virus
HEEPVPMATY

SEQ ID NO: 16641 - protein, 10 aa, Dengue virus
EEPVPMATYG

SEQ ID NO: 16642 - protein, 10 aa, Dengue virus
EPVPMATYGW

SEQ ID NO: 16643 - protein, 10 aa, Dengue virus
PVPMATYGWN

SEQ ID NO: 16644 - protein, 10 aa, Dengue virus
VPMATYGWNL

SEQ ID NO: 16645 - protein, 10 aa, Dengue virus
MATYGWNLVR

SEQ ID NO: 16646 - protein, 10 aa, Dengue virus
ATYGWNLVRL

SEQ ID NO: 16647 - protein, 10 aa, Dengue virus
TYGWNLVKLY

SEQ ID NO: 16648 - protein, 10 aa, Dengue virus
YGWNLVKLYS

SEQ ID NO: 16649 - protein, 10 aa, Dengue virus
GWNLVKLYSG

SEQ ID NO: 16650 - protein, 10 aa, Dengue virus
WNLVKLYSGK

SEQ ID NO: 16651 - protein, 10 aa, Dengue virus
NLVKLYSGKD

SEQ ID NO: 16652 - protein, 10 aa, Dengue virus
LVKLYSGKDV

SEQ ID NO: 16653 - protein, 10 aa, Dengue virus
VKLYSGKDVF

SEQ ID NO: 16654 - protein, 10 aa, Dengue virus
KLYSGKDVFF

SEQ ID NO: 16655 - protein, 10 aa, Dengue virus
SGKDVFFTPP

SEQ ID NO: 16656 - protein, 10 aa, Dengue virus
GKDVFFTPPE

SEQ ID NO: 16657 - protein, 10 aa, Dengue virus
KDVFFTPPEK

SEQ ID NO: 16658 - protein, 10 aa, Dengue virus
DVFFTPPEKC

SEQ ID NO: 16659 - protein, 10 aa, Dengue virus
VFFTPPEKCD

SEQ ID NO: 16660 - protein, 10 aa, Dengue virus
FFTPPEKCDT

SEQ ID NO: 16661 - protein, 10 aa, Dengue virus
FTPPEKCDTL

SEQ ID NO: 16662 - protein, 10 aa, Dengue virus
TPPEKCDTLL

SEQ ID NO: 16663 - protein, 10 aa, Dengue virus
VLKMVEPWLK

SEQ ID NO: 16664 - protein, 10 aa, Dengue virus
LKMVEPWLKG

SEQ ID NO: 16665 - protein, 10 aa, Dengue virus
KMVEPWLKGN

SEQ ID NO: 16666 - protein, 10 aa, Dengue virus
NPYMPSVVEA

SEQ ID NO: 16667 - protein, 10 aa, Dengue virus
PYMPSVVEAL

SEQ ID NO: 16668 - protein, 10 aa, Dengue virus
YMPSVVEALE

SEQ ID NO: 16669 - protein, 10 aa, Dengue virus
MPSVVEALEQ

SEQ ID NO: 16670 - protein, 10 aa, Dengue virus
PSVVEALEQM

SEQ ID NO: 16671 - protein, 10 aa, Dengue virus
SVVEALEQMQ

SEQ ID NO: 16672 - protein, 10 aa, Dengue virus
VVEALEQMQR

SEQ ID NO: 16673 - protein, 10 aa, Dengue virus
VEALEQMQRK

SEQ ID NO: 16674 - protein, 10 aa, Dengue virus
EALEQMQRKH

SEQ ID NO: 16675 - protein, 10 aa, Dengue virus
ALEQMQRKHG

SEQ ID NO: 16676 - protein, 10 aa, Dengue virus
LEQMQRKYGG

SEQ ID NO: 16677 - protein, 10 aa, Dengue virus
EQMQRKYGGM

SEQ ID NO: 16678 - protein, 10 aa, Dengue virus
QMQRKYGGML

SEQ ID NO: 16679 - protein, 10 aa, Dengue virus
MQRKYGGMLV

SEQ ID NO: 16680 - protein, 10 aa, Dengue virus
QRKYGGMLVR

SEQ ID NO: 16681 - protein, 10 aa, Dengue virus
RKYGGMLVRN

SEQ ID NO: 16682 - protein, 10 aa, Dengue virus
KYGGMLVRNP

SEQ ID NO: 16683 - protein, 10 aa, Dengue virus
RMLLNRFTMT

SEQ ID NO: 16684 - protein, 10 aa, Dengue virus
MLLNRFTMTH

SEQ ID NO: 16685 - protein, 10 aa, Dengue virus
LLNRFTMTHR

SEQ ID NO: 16686 - protein, 10 aa, Dengue virus
LNRFTMTHRK

SEQ ID NO: 16687 - protein, 10 aa, Dengue virus
NRFTMTHRKP

SEQ ID NO: 16688 - protein, 10 aa, Dengue virus
RFTMTHRKPT

SEQ ID NO: 16689 - protein, 10 aa, Dengue virus
FTMTHRKPTY

SEQ ID NO: 16690 - protein, 10 aa, Dengue virus
TMTHRKPTYE

SEQ ID NO: 16691 - protein, 10 aa, Dengue virus
MTHRKPTYER

SEQ ID NO: 16692 - protein, 10 aa, Dengue virus
THRKPTYERD

SEQ ID NO: 16693 - protein, 10 aa, Dengue virus
HRKPTYEKDV

SEQ ID NO: 16694 - protein, 10 aa, Dengue virus
RKPTYEKDVD

SEQ ID NO: 16695 - protein, 10 aa, Dengue virus
KPTYEKDVDL

SEQ ID NO: 16696 - protein, 10 aa, Dengue virus
PTYEKDVDLG

SEQ ID NO: 16697 - protein, 10 aa, Dengue virus
TYERDVDLGT

SEQ ID NO: 16698 - protein, 10 aa, Dengue virus
YERDVDLGTG

SEQ ID NO: 16699 - protein, 10 aa, Dengue virus
ERDVDLGTGT

SEQ ID NO: 16700 - protein, 10 aa, Dengue virus
RDVDLGTGTR

SEQ ID NO: 16701 - protein, 10 aa, Dengue virus
DVDLGTGTRH

SEQ ID NO: 16702 - protein, 10 aa, Dengue virus
VDLGTGTRHV

SEQ ID NO: 16703 - protein, 10 aa, Dengue virus
DLGTGTRHVA

SEQ ID NO: 16704 - protein, 10 aa, Dengue virus
LGTGTRHVAV

SEQ ID NO: 16705 - protein, 10 aa, Dengue virus
GTGTRHVAVE

SEQ ID NO: 16706 - protein, 10 aa, Dengue virus
TGTRHVAVEP

SEQ ID NO: 16707 - protein, 10 aa, Dengue virus
GTRHVTVEPE

SEQ ID NO: 16708 - protein, 10 aa, Dengue virus
TRHVAVEPEI

SEQ ID NO: 16709 - protein, 10 aa, Dengue virus
RHVAVEPEIA

SEQ ID NO: 16710 - protein, 10 aa, Dengue virus
HVAVEPEIAN

SEQ ID NO: 16711 - protein, 10 aa, Dengue virus
VEPEIANLDI

SEQ ID NO: 16712 - protein, 10 aa, Dengue virus
EPEIANLDII

SEQ ID NO: 16713 - protein, 10 aa, Dengue virus
PEIANLDIIG

SEQ ID NO: 16714 - protein, 10 aa, Dengue virus
EIANLDIIGQ

SEQ ID NO: 16715 - protein, 10 aa, Dengue virus
IANLDIIGQR

SEQ ID NO: 16716 - protein, 10 aa, Dengue virus
PNLDIIGQRI

SEQ ID NO: 16717 - protein, 10 aa, Dengue virus
IGQRIENIKN

SEQ ID NO: 16718 - protein, 10 aa, Dengue virus
GQRIENIKNE

SEQ ID NO: 16719 - protein, 10 aa, Dengue virus
QRIENIKNEH

SEQ ID NO: 16720 - protein, 10 aa, Dengue virus
RIENIKNEHK

SEQ ID NO: 16721 - protein, 10 aa, Dengue virus
IENIKNEHKS

SEQ ID NO: 16722 - protein, 10 aa, Dengue virus
ENIKNEHKST

SEQ ID NO: 16723 - protein, 10 aa, Dengue virus
NIKNEHKSTW

SEQ ID NO: 16724 - protein, 10 aa, Dengue virus
IKNEHKSTWH

SEQ ID NO: 16725 - protein, 10 aa, Dengue virus
KNEHKSTWHY

SEQ ID NO: 16726 - protein, 10 aa, Dengue virus
NEHKSTWHYD

SEQ ID NO: 16727 - protein, 10 aa, Dengue virus
ASSMVNGVVR

SEQ ID NO: 16728 - protein, 10 aa, Dengue virus
SSMVNGVVRL

SEQ ID NO: 16729 - protein, 10 aa, Dengue virus
SMVNGVVRLL

SEQ ID NO: 16730 - protein, 10 aa, Dengue virus
MVNGVVRLLT

SEQ ID NO: 16731 - protein, 10 aa, Dengue virus
VNGVVRLLTK

SEQ ID NO: 16732 - protein, 10 aa, Dengue virus
NGVVRLLTKP

SEQ ID NO: 16733 - protein, 10 aa, Dengue virus
GVVRLLTKPW

SEQ ID NO: 16734 - protein, 10 aa, Dengue virus
VVRLLTKPWD

SEQ ID NO: 16735 - protein, 10 aa, Dengue virus
VRLLTKPWDV

SEQ ID NO: 16736 - protein, 10 aa, Dengue virus
RLLTKPWDVI

SEQ ID NO: 16737 - protein, 10 aa, Dengue virus
KEKVDTRTPR

SEQ ID NO: 16738 - protein, 10 aa, Dengue virus
EKVDTRTPRA

SEQ ID NO: 16739 - protein, 10 aa, Dengue virus
KVDTRTPRAK

SEQ ID NO: 16740 - protein, 10 aa, Dengue virus
VDTRTPRAKR

SEQ ID NO: 16741 - protein, 10 aa, Dengue virus
DTRTPRAKRG

SEQ ID NO: 16742 - protein, 10 aa, Dengue virus
TRTPRAKRGT

SEQ ID NO: 16743 - protein, 10 aa, Dengue virus
RTPRAKRGTT

SEQ ID NO: 16744 - protein, 10 aa, Dengue virus
TPRAKRGTTQ

SEQ ID NO: 16745 - protein, 10 aa, Dengue virus
PRAKRGTTQI

SEQ ID NO: 16746 - protein, 10 aa, Dengue virus
RAKRGTTQIM

SEQ ID NO: 16747 - protein, 10 aa, Dengue virus
AKRGTTQIME

SEQ ID NO: 16748 - protein, 10 aa, Dengue virus
KRGTTQIMEV

SEQ ID NO: 16749 - protein, 10 aa, Dengue virus
RGTTQIMEVT

SEQ ID NO: 16750 - protein, 10 aa, Dengue virus
GTTQIMEVTA

SEQ ID NO: 16751 - protein, 10 aa, Dengue virus
QIMEVTARWL

SEQ ID NO: 16752 - protein, 10 aa, Dengue virus
IMEVTARWLW

SEQ ID NO: 16753 - protein, 10 aa, Dengue virus
MEVTARWLWG

SEQ ID NO: 16754 - protein, 10 aa, Dengue virus
EVTARWLWGF

SEQ ID NO: 16755 - protein, 10 aa, Dengue virus
VTARWLWGFL

SEQ ID NO: 16756 - protein, 10 aa, Dengue virus
TARWLWGFLS

SEQ ID NO: 16757 - protein, 10 aa, Dengue virus
ARWLWGFLSR

SEQ ID NO: 16758 - protein, 10 aa, Dengue virus
RWLWGFLSRN

SEQ ID NO: 16759 - protein, 10 aa, Dengue virus
WLWSFLSRNK

SEQ ID NO: 16760 - protein, 10 aa, Dengue virus
LWSFLSRNKK

SEQ ID NO: 16761 - protein, 10 aa, Dengue virus
WSFLSRNKKP

SEQ ID NO: 16762 - protein, 10 aa, Dengue virus
SFLSRNKKPR

SEQ ID NO: 16763 - protein, 10 aa, Dengue virus
SNAAIGAVFI

SEQ ID NO: 16764 - protein, 10 aa, Dengue virus
NAAIGAVFID

SEQ ID NO: 16765 - protein, 10 aa, Dengue virus
AAIGAVFIDE

SEQ ID NO: 16766 - protein, 10 aa, Dengue virus
AIGAVFIDEN

SEQ ID NO: 16767 - protein, 10 aa, Dengue virus
IGAVFIDENQ

SEQ ID NO: 16768 - protein, 10 aa, Dengue virus
GAVFIDENQW

SEQ ID NO: 16769 - protein, 10 aa, Dengue virus
AVFIDENQWN

SEQ ID NO: 16770 - protein, 10 aa, Dengue virus
VFIDENQWNS

SEQ ID NO: 16771 - protein, 10 aa, Dengue virus
FIDENQWNSA

SEQ ID NO: 16772 - protein, 10 aa, Dengue virus
IDENQWNSAK

SEQ ID NO: 16773 - protein, 10 aa, Dengue virus
NSAKEAVEDD

SEQ ID NO: 16774 - protein, 10 aa, Dengue virus
SAKEAVEDDR

SEQ ID NO: 16775 - protein, 10 aa, Dengue virus
AKEAVEDDRF

SEQ ID NO: 16776 - protein, 10 aa, Dengue virus
KEAVEDDRFW

SEQ ID NO: 16777 - protein, 10 aa, Dengue virus
EAVEDDRFWD

SEQ ID NO: 16778 - protein, 10 aa, Dengue virus
AVEDDRFWDL

SEQ ID NO: 16779 - protein, 10 aa, Dengue virus
VEDDRFWDLV

SEQ ID NO: 16780 - protein, 10 aa, Dengue virus
LVQKERELHK

SEQ ID NO: 16781 - protein, 10 aa, Dengue virus
VQKERELHKQ

SEQ ID NO: 16782 - protein, 10 aa, Dengue virus
QKERELHKQG

SEQ ID NO: 16783 - protein, 10 aa, Dengue virus
KERELHKQGK

SEQ ID NO: 16784 - protein, 10 aa, Dengue virus
DHWFSRENSF

SEQ ID NO: 16785 - protein, 10 aa, Dengue virus
HWFSRENSFS

SEQ ID NO: 16786 - protein, 10 aa, Dengue virus
WFSRENSFSG

SEQ ID NO: 16787 - protein, 10 aa, Dengue virus
FSRENSFSGV

SEQ ID NO: 16788 - protein, 10 aa, Dengue virus
SRENSFSGVE

SEQ ID NO: 16789 - protein, 10 aa, Dengue virus
RENSFSGVEG

SEQ ID NO: 16790 - protein, 10 aa, Dengue virus
ENSFSGVEGE

SEQ ID NO: 16791 - protein, 10 aa, Dengue virus
NSFSGVEGEG

SEQ ID NO: 16792 - protein, 10 aa, Dengue virus
SFSGVEGEGL

SEQ ID NO: 16793 - protein, 10 aa, Dengue virus
FSGVEGEGLH

SEQ ID NO: 16794 - protein, 10 aa, Dengue virus
SGVEGEGLHR

SEQ ID NO: 16795 - protein, 10 aa, Dengue virus
GVEGEGLHRL

SEQ ID NO: 16796 - protein, 10 aa, Dengue virus
VEGEGLHRLG

SEQ ID NO: 16797 - protein, 10 aa, Dengue virus
EGEGLHRLGY

SEQ ID NO: 16798 - protein, 10 aa, Dengue virus
GEGLHRLGYI

SEQ ID NO: 16799 - protein, 10 aa, Dengue virus
EGLHRLGYIL

SEQ ID NO: 16800 - protein, 10 aa, Dengue virus
HRLGYILRDI

SEQ ID NO: 16801 - protein, 10 aa, Dengue virus
RLGYILRDIS

SEQ ID NO: 16802 - protein, 10 aa, Dengue virus
LGYILRDISN

SEQ ID NO: 16803 - protein, 10 aa, Dengue virus
GYILRDISNI

SEQ ID NO: 16804 - protein, 10 aa, Dengue virus
YILRDISNIP

SEQ ID NO: 16805 - protein, 10 aa, Dengue virus
ILRDISNIPG

SEQ ID NO: 16806 - protein, 10 aa, Dengue virus
LRDISNIPGG

SEQ ID NO: 16807 - protein, 10 aa, Dengue virus
RDISNIPGGN

SEQ ID NO: 16808 - protein, 10 aa, Dengue virus
DISNIPGGNM

SEQ ID NO: 16809 - protein, 10 aa, Dengue virus
ISNIPGGNMY

SEQ ID NO: 16810 - protein, 10 aa, Dengue virus
SNIPGGNMYA

SEQ ID NO: 16811 - protein, 10 aa, Dengue virus
NIPGGNMYAD

SEQ ID NO: 16812 - protein, 10 aa, Dengue virus
IPGGSMYADD

SEQ ID NO: 16813 - protein, 10 aa, Dengue virus
PGGSMYADDT

SEQ ID NO: 16814 - protein, 10 aa, Dengue virus
GGSMYADDTA

SEQ ID NO: 16815 - protein, 10 aa, Dengue virus
GSMYADDTAG

SEQ ID NO: 16816 - protein, 10 aa, Dengue virus
SMYADDTAGW

SEQ ID NO: 16817 - protein, 10 aa, Dengue virus
DTRVTEDDLQ

SEQ ID NO: 16818 - protein, 10 aa, Dengue virus
TRVTEDDLQN

SEQ ID NO: 16819 - protein, 10 aa, Dengue virus
RVTEDDLQNE

SEQ ID NO: 16820 - protein, 10 aa, Dengue virus
VTEDDLQNEA

SEQ ID NO: 16821 - protein, 10 aa, Dengue virus
TEDDLQNEAR

SEQ ID NO: 16822 - protein, 10 aa, Dengue virus
EDDLQNEARI

SEQ ID NO: 16823 - protein, 10 aa, Dengue virus
DDLQNEARIT

SEQ ID NO: 16824 - protein, 10 aa, Dengue virus
DLQNEARITD

SEQ ID NO: 16825 - protein, 10 aa, Dengue virus
LQNEARITDI

SEQ ID NO: 16826 - protein, 10 aa, Dengue virus
QNEARITDIM

SEQ ID NO: 16827 - protein, 10 aa, Dengue virus
NEARITDIME

SEQ ID NO: 16828 - protein, 10 aa, Dengue virus
EARITDIMEP

SEQ ID NO: 16829 - protein, 10 aa, Dengue virus
ARITDIMEPE

SEQ ID NO: 16830 - protein, 10 aa, Dengue virus
RITDIMEPEH

SEQ ID NO: 16831 - protein, 10 aa, Dengue virus
ITEIMEPEHA

SEQ ID NO: 16832 - protein, 10 aa, Dengue virus
TEIMEPEHAL

SEQ ID NO: 16833 - protein, 10 aa, Dengue virus
EIMEPEHALL

SEQ ID NO: 16834 - protein, 10 aa, Dengue virus
MEPEHALLAT

SEQ ID NO: 16835 - protein, 10 aa, Dengue virus
EPEHALLATS

SEQ ID NO: 16836 - protein, 10 aa, Dengue virus
PEHALLATSI

SEQ ID NO: 16837 - protein, 10 aa, Dengue virus
EHALLATSIF

SEQ ID NO: 16838 - protein, 10 aa, Dengue virus
HALLATSIFK

SEQ ID NO: 16839 - protein, 10 aa, Dengue virus
ALLATSIFKL

SEQ ID NO: 16840 - protein, 10 aa, Dengue virus
LLATSIFKLT

SEQ ID NO: 16841 - protein, 10 aa, Dengue virus
LATSIFKLTY

SEQ ID NO: 16842 - protein, 10 aa, Dengue virus
ATSIFKLTYQ

SEQ ID NO: 16843 - protein, 10 aa, Dengue virus
TSIFKLTYQN

SEQ ID NO: 16844 - protein, 10 aa, Dengue virus
AIFKLTYQNK

SEQ ID NO: 16845 - protein, 10 aa, Dengue virus
NKVVRVQRPT

SEQ ID NO: 16846 - protein, 10 aa, Dengue virus
KVVRVQRPAR

SEQ ID NO: 16847 - protein, 10 aa, Dengue virus
VVRVQRPAKS

SEQ ID NO: 16848 - protein, 10 aa, Dengue virus
VRVQRPAKSG

SEQ ID NO: 16849 - protein, 10 aa, Dengue virus
RVQRPAKSGT

SEQ ID NO: 16850 - protein, 10 aa, Dengue virus
VQRPAKSGTV

SEQ ID NO: 16851 - protein, 10 aa, Dengue virus
QRPAKSGTVM

SEQ ID NO: 16852 - protein, 10 aa, Dengue virus
RPAKSGTVMD

SEQ ID NO: 16853 - protein, 10 aa, Dengue virus
PAKSGTVMDV

SEQ ID NO: 16854 - protein, 10 aa, Dengue virus
AKSGTVMDVI

SEQ ID NO: 16855 - protein, 10 aa, Dengue virus
KSGTVMDVIS

SEQ ID NO: 16856 - protein, 10 aa, Dengue virus
SGTVMDVISR

SEQ ID NO: 16857 - protein, 10 aa, Dengue virus
YGLNTFTNMG

SEQ ID NO: 16858 - protein, 10 aa, Dengue virus
GLNTFTNMEV

SEQ ID NO: 16859 - protein, 10 aa, Dengue virus
LNTFTNMEVQ

SEQ ID NO: 16860 - protein, 10 aa, Dengue virus
NTFTNMEVQL

SEQ ID NO: 16861 - protein, 10 aa, Dengue virus
TFTNMEVQLI

SEQ ID NO: 16862 - protein, 10 aa, Dengue virus
FTNMEVQLIR

SEQ ID NO: 16863 - protein, 10 aa, Dengue virus
TNMEVQLIRQ

SEQ ID NO: 16864 - protein, 10 aa, Dengue virus
NMEVQLIRQM

SEQ ID NO: 16865 - protein, 10 aa, Dengue virus
MEVQLIRQME

SEQ ID NO: 16866 - protein, 10 aa, Dengue virus
EVQLIRQMES

SEQ ID NO: 16867 - protein, 10 aa, Dengue virus
VQLIRQMESE

SEQ ID NO: 16868 - protein, 10 aa, Dengue virus
QLIRQMESEE

SEQ ID NO: 16869 - protein, 10 aa, Dengue virus
LIRQMESEEI

SEQ ID NO: 16870 - protein, 10 aa, Dengue virus
IRQMESEEIF

SEQ ID NO: 16871 - protein, 10 aa, Dengue virus
RQMESEGIFL

SEQ ID NO: 16872 - protein, 10 aa, Dengue virus
QMESEGIFLP

SEQ ID NO: 16873 - protein, 10 aa, Dengue virus
ERLRRMAISG

SEQ ID NO: 16874 - protein, 10 aa, Dengue virus
RLRRMAISGD

SEQ ID NO: 16875 - protein, 10 aa, Dengue virus
LRRMAISGDD

SEQ ID NO: 16876 - protein, 10 aa, Dengue virus
RRMAISGDDC

SEQ ID NO: 16877 - protein, 10 aa, Dengue virus
SGDDCVVKPT

SEQ ID NO: 16878 - protein, 10 aa, Dengue virus
GDDCVVKPTD

SEQ ID NO: 16879 - protein, 10 aa, Dengue virus
DDCVVKPTDD

SEQ ID NO: 16880 - protein, 10 aa, Dengue virus
DCVVKPTDDR

SEQ ID NO: 16881 - protein, 10 aa, Dengue virus
CVVKPTDDRF

SEQ ID NO: 16882 - protein, 10 aa, Dengue virus
VVKPTDDRFA

SEQ ID NO: 16883 - protein, 10 aa, Dengue virus
VKPTDDRFAT

SEQ ID NO: 16884 - protein, 10 aa, Dengue virus
KPTDDRFATA

SEQ ID NO: 16885 - protein, 10 aa, Dengue virus
PTDDRFATAL

SEQ ID NO: 16886 - protein, 10 aa, Dengue virus
DDRFATALIA

SEQ ID NO: 16887 - protein, 10 aa, Dengue virus
DRFATALIAL

SEQ ID NO: 16888 - protein, 10 aa, Dengue virus
RFATALIALN

SEQ ID NO: 16889 - protein, 10 aa, Dengue virus
FATALIALND

SEQ ID NO: 16890 - protein, 10 aa, Dengue virus
ATALIALNDM

SEQ ID NO: 16891 - protein, 10 aa, Dengue virus
TALIALNDMG

SEQ ID NO: 16892 - protein, 10 aa, Dengue virus
ALIALNDMGK

SEQ ID NO: 16893 - protein, 10 aa, Dengue virus
LIALNDMGKV

SEQ ID NO: 16894 - protein, 10 aa, Dengue virus
IALNDMGKVR

SEQ ID NO: 16895 - protein, 10 aa, Dengue virus
NDMGKVRKDV

SEQ ID NO: 16896 - protein, 10 aa, Dengue virus
DMGKVRKDVP

SEQ ID NO: 16897 - protein, 10 aa, Dengue virus
MGKVRKDVPQ

SEQ ID NO: 16898 - protein, 10 aa, Dengue virus
GKVRKDVPQW

SEQ ID NO: 16899 - protein, 10 aa, Dengue virus
KVRKDVPQWE

SEQ ID NO: 16900 - protein, 10 aa, Dengue virus
VRKDVPQWEP

SEQ ID NO: 16901 - protein, 10 aa, Dengue virus
RKDVPQWEPS

SEQ ID NO: 16902 - protein, 10 aa, Dengue virus
KDVPQWEPSK

SEQ ID NO: 16903 - protein, 10 aa, Dengue virus
DVPQWEPSKG

SEQ ID NO: 16904 - protein, 10 aa, Dengue virus
VPQWEPSKGW

SEQ ID NO: 16905 - protein, 10 aa, Dengue virus
AGWSLKETAC

SEQ ID NO: 16906 - protein, 10 aa, Dengue virus
GWSLKETACL

SEQ ID NO: 16907 - protein, 10 aa, Dengue virus
WSLKETACLG

SEQ ID NO: 16908 - protein, 10 aa, Dengue virus
SLKETACLGK

SEQ ID NO: 16909 - protein, 10 aa, Dengue virus
LAANAICSAD

SEQ ID NO: 16910 - protein, 10 aa, Dengue virus
AANAICSADP

SEQ ID NO: 16911 - protein, 10 aa, Dengue virus
ANAICSAVPI

SEQ ID NO: 16912 - protein, 10 aa, Dengue virus
PVDWIPTSRT

SEQ ID NO: 16913 - protein, 10 aa, Dengue virus
VDWIPTSRTT

SEQ ID NO: 16914 - protein, 10 aa, Dengue virus
DWIPTSRTTW

SEQ ID NO: 16915 - protein, 10 aa, Dengue virus
WIPTSRTTWS

SEQ ID NO: 16916 - protein, 10 aa, Dengue virus
IPTSRTTWSI

SEQ ID NO: 16917 - protein, 10 aa, Dengue virus
ENPWMEDKTR

SEQ ID NO: 16918 - protein, 10 aa, Dengue virus
NPWMEDKTHV

SEQ ID NO: 16919 - protein, 10 aa, Dengue virus
PWMEDKTHVS

SEQ ID NO: 16920 - protein, 10 aa, Dengue virus
WMEDKTHVSS

SEQ ID NO: 16921 - protein, 10 aa, Dengue virus
MEDKTHVSSW

SEQ ID NO: 16922 - protein, 10 aa, Dengue virus
EDKTHVSSWE

SEQ ID NO: 16923 - protein, 10 aa, Dengue virus
VSSWEEVPYL

SEQ ID NO: 16924 - protein, 10 aa, Dengue virus
SSWEDVPYLG

SEQ ID NO: 16925 - protein, 10 aa, Dengue virus
SWEDVPYLGK

SEQ ID NO: 16926 - protein, 10 aa, Dengue virus
WEDVPYLGKR

SEQ ID NO: 16927 - protein, 10 aa, Dengue virus
EDVPYLGKRE

SEQ ID NO: 16928 - protein, 10 aa, Dengue virus
EVPYLGKRED

SEQ ID NO: 16929 - protein, 10 aa, Dengue virus
GLTARATWAS

SEQ ID NO: 16930 - protein, 10 aa, Dengue virus
LTARATWASN

SEQ ID NO: 16931 - protein, 10 aa, Dengue virus
TARATWASNI

SEQ ID NO: 16932 - protein, 10 aa, Dengue virus
ARATWASNIQ

SEQ ID NO: 16933 - protein, 10 aa, Dengue virus
RATWASNIQV

SEQ ID NO: 16934 - protein, 10 aa, Dengue virus
ATWASNIQVA

SEQ ID NO: 16935 - protein, 10 aa, Dengue virus
TWASNIQVAI

SEQ ID NO: 16936 - protein, 10 aa, Dengue virus
WASNIQVAIN

SEQ ID NO: 16937 - protein, 10 aa, Dengue virus
ASNIQVAINQ

SEQ ID NO: 16938 - protein, 10 aa, Dengue virus
SNIQVAINQV

SEQ ID NO: 16939 - protein, 10 aa, Dengue virus
VAINQVRRLL

SEQ ID NO: 16940 - protein, 10 aa, Dengue virus
AINQVRRLLG

SEQ ID NO: 16941 - protein, 10 aa, Dengue virus
INQVRRLLGN

SEQ ID NO: 16942 - protein, 10 aa, Dengue virus
NQVRRLLGNE

SEQ ID NO: 16943 - protein, 10 aa, Dengue virus
QVRRLLGNEN

SEQ ID NO: 16944 - protein, 10 aa, Dengue virus
VRRLLGNENY

SEQ ID NO: 16945 - protein, 10 aa, Dengue virus
RRLLGNENYL

SEQ ID NO: 16946 - protein, 10 aa, Dengue virus
RLLGNENYLD

SEQ ID NO: 16947 - protein, 10 aa, Dengue virus
LLGNENYLDY

SEQ ID NO: 16948 - protein, 10 aa, Dengue virus
LGNENYLDYM

SEQ ID NO: 16949 - protein, 10 aa, Dengue virus
GNENYSDYMT

SEQ ID NO: 16950 - protein, 10 aa, Dengue virus
NENYSDYMTS

SEQ ID NO: 16951 - protein, 10 aa, Dengue virus
ENYSDYMTSM

SEQ ID NO: 16952 - protein, 10 aa, Dengue virus
NYSDYMTSMK

SEQ ID NO: 16953 - protein, 10 aa, Dengue virus
YSDYMTSMKR

SEQ ID NO: 16954 - protein, 10 aa, Dengue virus
SDYMTSMKRF

SEQ ID NO: 16955 - protein, 10 aa, Dengue virus
DYMISMKRFK

SEQ ID NO: 16956 - protein, 10 aa, Dengue virus
YMISMKRFKN

SEQ ID NO: 16957 - protein, 10 aa, Dengue virus
MISMKRFKNE

SEQ ID NO: 16958 - protein, 10 aa, Dengue virus
MNNQRKKTGQ

SEQ ID NO: 16959 - protein, 10 aa, Dengue virus
NNQRKKTGQP

SEQ ID NO: 16960 - protein, 10 aa, Dengue virus
NQRKKTGQPS

SEQ ID NO: 16961 - protein, 10 aa, Dengue virus
QRKKTGQPSF

SEQ ID NO: 16962 - protein, 10 aa, Dengue virus
RKKTGQPSFN

SEQ ID NO: 16963 - protein, 10 aa, Dengue virus
KKTGQPSFNM

SEQ ID NO: 16964 - protein, 10 aa, Dengue virus
KTGQPSFNML

SEQ ID NO: 16965 - protein, 10 aa, Dengue virus
TGQPSFNMLK

SEQ ID NO: 16966 - protein, 10 aa, Dengue virus
GQPSFNMLKR

SEQ ID NO: 16967 - protein, 10 aa, Dengue virus
LLSGQGPMKF

SEQ ID NO: 16968 - protein, 10 aa, Dengue virus
LSGQGPMKFV

SEQ ID NO: 16969 - protein, 10 aa, Dengue virus
SGQGPMKFVM

SEQ ID NO: 16970 - protein, 10 aa, Dengue virus
GQGPMKFVMA

SEQ ID NO: 16971 - protein, 10 aa, Dengue virus
QGPMKFVMAF

SEQ ID NO: 16972 - protein, 10 aa, Dengue virus
GPMKFVMAFI

SEQ ID NO: 16973 - protein, 10 aa, Dengue virus
PMKFVMAFIA

SEQ ID NO: 16974 - protein, 10 aa, Dengue virus
MKFVMAFIAF

SEQ ID NO: 16975 - protein, 10 aa, Dengue virus
KFVMAFIAFL

SEQ ID NO: 16976 - protein, 10 aa, Dengue virus
FVMAFIAFLR

SEQ ID NO: 16977 - protein, 10 aa, Dengue virus
LARWSSFKKN

SEQ ID NO: 16978 - protein, 10 aa, Dengue virus
ARWSSFKKNG

SEQ ID NO: 16979 - protein, 10 aa, Dengue virus
RWSSFKKNGA

SEQ ID NO: 16980 - protein, 10 aa, Dengue virus
WSSFKKNGAI

SEQ ID NO: 16981 - protein, 10 aa, Dengue virus
SSFKKNGAIK

SEQ ID NO: 16982 - protein, 10 aa, Dengue virus
KNGAIRVLRG

SEQ ID NO: 16983 - protein, 10 aa, Dengue virus
NGAIRVLRGF

SEQ ID NO: 16984 - protein, 10 aa, Dengue virus
KVLRGFKREI

SEQ ID NO: 16985 - protein, 10 aa, Dengue virus
VLRGFKREIS

SEQ ID NO: 16986 - protein, 10 aa, Dengue virus
LRGFKKEVSN

SEQ ID NO: 16987 - protein, 10 aa, Dengue virus
RGFKKEVSNM

SEQ ID NO: 16988 - protein, 10 aa, Dengue virus
GFKKEVSNML

SEQ ID NO: 16989 - protein, 10 aa, Dengue virus
FKKEVSNMLN

SEQ ID NO: 16990 - protein, 10 aa, Dengue virus
INRRKRSVTM

SEQ ID NO: 16991 - protein, 10 aa, Dengue virus
NRRKRSVTMF

SEQ ID NO: 16992 - protein, 10 aa, Dengue virus
PTVLAFHLTT

SEQ ID NO: 16993 - protein, 10 aa, Dengue virus
TVLAFHLTTR

SEQ ID NO: 16994 - protein, 10 aa, Dengue virus
VLAFHLTTRG

SEQ ID NO: 16995 - protein, 10 aa, Dengue virus
RGGEPHMVVS

SEQ ID NO: 16996 - protein, 10 aa, Dengue virus
GGEPHMVVSK

SEQ ID NO: 16997 - protein, 10 aa, Dengue virus
GEPHMVVSKQ

SEQ ID NO: 16998 - protein, 10 aa, Dengue virus
EPHMVVSKQE

SEQ ID NO: 16999 - protein, 10 aa, Dengue virus
PHMVVSKQER

SEQ ID NO: 17000 - protein, 10 aa, Dengue virus
HMVVSKQERG

SEQ ID NO: 17001 - protein, 10 aa, Dengue virus
MVVSKQERGK

SEQ ID NO: 17002 - protein, 10 aa, Dengue virus
VVSKQERGKS

SEQ ID NO: 17003 - protein, 10 aa, Dengue virus
VGKQERGKSL

SEQ ID NO: 17004 - protein, 10 aa, Dengue virus
GKQERGKSLL

SEQ ID NO: 17005 - protein, 10 aa, Dengue virus
GKSLLFKTST

SEQ ID NO: 17006 - protein, 10 aa, Dengue virus
KSLLFKTSTG

SEQ ID NO: 17007 - protein, 10 aa, Dengue virus
SLLFKTSAGI

SEQ ID NO: 17008 - protein, 10 aa, Dengue virus
LLFKTSAGIN

SEQ ID NO: 17009 - protein, 10 aa, Dengue virus
LFKTSAGINM

SEQ ID NO: 17010 - protein, 10 aa, Dengue virus
FKTSAGINMC

SEQ ID NO: 17011 - protein, 10 aa, Dengue virus
KTSAGINMCT

SEQ ID NO: 17012 - protein, 10 aa, Dengue virus
TSAGINMCTL

SEQ ID NO: 17013 - protein, 10 aa, Dengue virus
SAGINMCTLI

SEQ ID NO: 17014 - protein, 10 aa, Dengue virus
AGINMCTLIA

SEQ ID NO: 17015 - protein, 10 aa, Dengue virus
IAMDLGELCD

SEQ ID NO: 17016 - protein, 10 aa, Dengue virus
AMDLGELCDD

SEQ ID NO: 17017 - protein, 10 aa, Dengue virus
MDLGELCDDT

SEQ ID NO: 17018 - protein, 10 aa, Dengue virus
DLGELCDDTM

SEQ ID NO: 17019 - protein, 10 aa, Dengue virus
LGELCDDTMT

SEQ ID NO: 17020 - protein, 10 aa, Dengue virus
GELCDDTMTY

SEQ ID NO: 17021 - protein, 10 aa, Dengue virus
ELCDDTMTYK

SEQ ID NO: 17022 - protein, 10 aa, Dengue virus
LCDDTMTYKC

SEQ ID NO: 17023 - protein, 10 aa, Dengue virus
CEDTITYKCP

SEQ ID NO: 17024 - protein, 10 aa, Dengue virus
DDTMTYKCPR

SEQ ID NO: 17025 - protein, 10 aa, Dengue virus
DTITYKCPRI

SEQ ID NO: 17026 - protein, 10 aa, Dengue virus
TMTYKCPRIS

SEQ ID NO: 17027 - protein, 10 aa, Dengue virus
MTYKCPRISE

SEQ ID NO: 17028 - protein, 10 aa, Dengue virus
TYKCPQITEA

SEQ ID NO: 17029 - protein, 10 aa, Dengue virus
YKCPQITEAE

SEQ ID NO: 17030 - protein, 10 aa, Dengue virus
KCPQITEAEP

SEQ ID NO: 17031 - protein, 10 aa, Dengue virus
CPQITEAEPD

SEQ ID NO: 17032 - protein, 10 aa, Dengue virus
PQITEAEPDD

SEQ ID NO: 17033 - protein, 10 aa, Dengue virus
QITEAEPDDV

SEQ ID NO: 17034 - protein, 10 aa, Dengue virus
ITEVEPDDVD

SEQ ID NO: 17035 - protein, 10 aa, Dengue virus
TEVEPDDVDC

SEQ ID NO: 17036 - protein, 10 aa, Dengue virus
EVEPDDVDCW

SEQ ID NO: 17037 - protein, 10 aa, Dengue virus
VEPDDVDCWC

SEQ ID NO: 17038 - protein, 10 aa, Dengue virus
DVDCWCNTTD

SEQ ID NO: 17039 - protein, 10 aa, Dengue virus
VDCWCNTTDT

SEQ ID NO: 17040 - protein, 10 aa, Dengue virus
DCWCNTTDTW

SEQ ID NO: 17041 - protein, 10 aa, Dengue virus
CWCNTTDTWV

SEQ ID NO: 17042 - protein, 10 aa, Dengue virus
WCNTTDTWVT

SEQ ID NO: 17043 - protein, 10 aa, Dengue virus
CNTTDTWVTY

SEQ ID NO: 17044 - protein, 10 aa, Dengue virus
NTTDTWVTYG

SEQ ID NO: 17045 - protein, 10 aa, Dengue virus
TTDTWVTYGT

SEQ ID NO: 17046 - protein, 10 aa, Dengue virus
YGTCTQIGEH

SEQ ID NO: 17047 - protein, 10 aa, Dengue virus
GTCTQIGEHR

SEQ ID NO: 17048 - protein, 10 aa, Dengue virus
TCSQTGGHRR

SEQ ID NO: 17049 - protein, 10 aa, Dengue virus
CTQIGEHRRD

SEQ ID NO: 17050 - protein, 10 aa, Dengue virus
TQIGEHRRDK

SEQ ID NO: 17051 - protein, 10 aa, Dengue virus
QIGEHRRDKR

SEQ ID NO: 17052 - protein, 10 aa, Dengue virus
IGEHRRDKRS

SEQ ID NO: 17053 - protein, 10 aa, Dengue virus
SEGAWRQIQK

SEQ ID NO: 17054 - protein, 10 aa, Dengue virus
EGAWRQIQKV

SEQ ID NO: 17055 - protein, 10 aa, Dengue virus
GAWRQIQKVE

SEQ ID NO: 17056 - protein, 10 aa, Dengue virus
AWRQIQKVET

SEQ ID NO: 17057 - protein, 10 aa, Dengue virus
WRQIQKVETW

SEQ ID NO: 17058 - protein, 10 aa, Dengue virus
RQIQKVETWA

SEQ ID NO: 17059 - protein, 10 aa, Dengue virus
QIQRVETWVL

SEQ ID NO: 17060 - protein, 10 aa, Dengue virus
IQRVETWVLR

SEQ ID NO: 17061 - protein, 10 aa, Dengue virus
VLRHPGFTVI

SEQ ID NO: 17062 - protein, 10 aa, Dengue virus
LRHPGFTVMA

SEQ ID NO: 17063 - protein, 10 aa, Dengue virus
RHPGFTVTAL

SEQ ID NO: 17064 - protein, 10 aa, Dengue virus
HPGFTVTALF

SEQ ID NO: 17065 - protein, 10 aa, Dengue virus
PGFTVTALFL

SEQ ID NO: 17066 - protein, 10 aa, Dengue virus
GFTVTALFLA

SEQ ID NO: 17067 - protein, 10 aa, Dengue virus
ALFLAHVIGT

SEQ ID NO: 17068 - protein, 10 aa, Dengue virus
LFLAHVIGTS

SEQ ID NO: 17069 - protein, 10 aa, Dengue virus
IELLKTEVAN

SEQ ID NO: 17070 - protein, 10 aa, Dengue virus
ELLKTEVANP

SEQ ID NO: 17071 - protein, 10 aa, Dengue virus
LKTEVTDPAV

SEQ ID NO: 17072 - protein, 10 aa, Dengue virus
KTEVTDPAVL

SEQ ID NO: 17073 - protein, 10 aa, Dengue virus
TEVTDPAVLR

SEQ ID NO: 17074 - protein, 10 aa, Dengue virus
EVTDPAVLRK

SEQ ID NO: 17075 - protein, 10 aa, Dengue virus
VTDPAVLRKL

SEQ ID NO: 17076 - protein, 10 aa, Dengue virus
TDPAVLRKLC

SEQ ID NO: 17077 - protein, 10 aa, Dengue virus
DPAVLRKLCI

SEQ ID NO: 17078 - protein, 10 aa, Dengue virus
EATLVEEQDT

SEQ ID NO: 17079 - protein, 10 aa, Dengue virus
ATLVEEQDTN

SEQ ID NO: 17080 - protein, 10 aa, Dengue virus
TLVEEQDTNF

SEQ ID NO: 17081 - protein, 10 aa, Dengue virus
LVEEQDTNFV

SEQ ID NO: 17082 - protein, 10 aa, Dengue virus
VEEQDTNFVC

SEQ ID NO: 17083 - protein, 10 aa, Dengue virus
EEQDSNFVCR

SEQ ID NO: 17084 - protein, 10 aa, Dengue virus
EQDSNFVCRR

SEQ ID NO: 17085 - protein, 10 aa, Dengue virus
QDSNFVCRRT

SEQ ID NO: 17086 - protein, 10 aa, Dengue virus
DSNFVCRRTF

SEQ ID NO: 17087 - protein, 10 aa, Dengue virus
SNFVCRRTFV

SEQ ID NO: 17088 - protein, 10 aa, Dengue virus
FGKGSLMTCA

SEQ ID NO: 17089 - protein, 10 aa, Dengue virus
GKGSLMTCAK

SEQ ID NO: 17090 - protein, 10 aa, Dengue virus
KGSLMTCAKF

SEQ ID NO: 17091 - protein, 10 aa, Dengue virus
GSLMTCAKFK

SEQ ID NO: 17092 - protein, 10 aa, Dengue virus
SLMTCAKFKC

SEQ ID NO: 17093 - protein, 10 aa, Dengue virus
LMTCAKFKCV

SEQ ID NO: 17094 - protein, 10 aa, Dengue virus
MTCAKFKCVT

SEQ ID NO: 17095 - protein, 10 aa, Dengue virus
CVTKLEGKIA

SEQ ID NO: 17096 - protein, 10 aa, Dengue virus
VTKLEGKIAQ

SEQ ID NO: 17097 - protein, 10 aa, Dengue virus
TKLEGKIAQY

SEQ ID NO: 17098 - protein, 10 aa, Dengue virus
KLEGKIAQYE

SEQ ID NO: 17099 - protein, 10 aa, Dengue virus
LEGKIAQYEN

SEQ ID NO: 17100 - protein, 10 aa, Dengue virus
EGKIAQYENL

SEQ ID NO: 17101 - protein, 10 aa, Dengue virus
GKIAQYENLK

SEQ ID NO: 17102 - protein, 10 aa, Dengue virus
KIAQYENLKY

SEQ ID NO: 17103 - protein, 10 aa, Dengue virus
IAQYENLKYS

SEQ ID NO: 17104 - protein, 10 aa, Dengue virus
AQYENLKYSV

SEQ ID NO: 17105 - protein, 10 aa, Dengue virus
QHQVGNETTD

SEQ ID NO: 17106 - protein, 10 aa, Dengue virus
HQVGNETTDH

SEQ ID NO: 17107 - protein, 10 aa, Dengue virus
QVGNETTDHG

SEQ ID NO: 17108 - protein, 10 aa, Dengue virus
VGNETTDHGT

SEQ ID NO: 17109 - protein, 10 aa, Dengue virus
GNETTEHGTT

SEQ ID NO: 17110 - protein, 10 aa, Dengue virus
NETTEHGTTA

SEQ ID NO: 17111 - protein, 10 aa, Dengue virus
ETTEHGTTAT

SEQ ID NO: 17112 - protein, 10 aa, Dengue virus
TTEHGTTATI

SEQ ID NO: 17113 - protein, 10 aa, Dengue virus
TDHGTTATIT

SEQ ID NO: 17114 - protein, 10 aa, Dengue virus
DHGTTATITP

SEQ ID NO: 17115 - protein, 10 aa, Dengue virus
TATITPQAPS

SEQ ID NO: 17116 - protein, 10 aa, Dengue virus
ATITPQAPST

SEQ ID NO: 17117 - protein, 10 aa, Dengue virus
TITPQAPSTE

SEQ ID NO: 17118 - protein, 10 aa, Dengue virus
ITPQAPSTEI

SEQ ID NO: 17119 - protein, 10 aa, Dengue virus
TPQAPSTEIQ

SEQ ID NO: 17120 - protein, 10 aa, Dengue virus
PQAPSTEIQL

SEQ ID NO: 17121 - protein, 10 aa, Dengue virus
QAPSTEIQLT

SEQ ID NO: 17122 - protein, 10 aa, Dengue virus
APSTEIQLTD

SEQ ID NO: 17123 - protein, 10 aa, Dengue virus
PSTEIQLTDY

SEQ ID NO: 17124 - protein, 10 aa, Dengue virus
STEIQLTDYG

SEQ ID NO: 17125 - protein, 10 aa, Dengue virus
SEIQLTDYGT

SEQ ID NO: 17126 - protein, 10 aa, Dengue virus
EIQLTDYGVL

SEQ ID NO: 17127 - protein, 10 aa, Dengue virus
IQLTDYGVLT

SEQ ID NO: 17128 - protein, 10 aa, Dengue virus
QLTDYGVLTL

SEQ ID NO: 17129 - protein, 10 aa, Dengue virus
LTDYGVLTLD

SEQ ID NO: 17130 - protein, 10 aa, Dengue virus
TDYGVLTLDC

SEQ ID NO: 17131 - protein, 10 aa, Dengue virus
NEMVLLTMKG

SEQ ID NO: 17132 - protein, 10 aa, Dengue virus
EMVLLTMEKK

SEQ ID NO: 17133 - protein, 10 aa, Dengue virus
MVLLTMKEKA

SEQ ID NO: 17134 - protein, 10 aa, Dengue virus
VLLTMKEKAW

SEQ ID NO: 17135 - protein, 10 aa, Dengue virus
LLTMKEKAWL

SEQ ID NO: 17136 - protein, 10 aa, Dengue virus
LTMKEKAWLV

SEQ ID NO: 17137 - protein, 10 aa, Dengue virus
TMKEKAWLVH

SEQ ID NO: 17138 - protein, 10 aa, Dengue virus
MKEKAWLVHK

SEQ ID NO: 17139 - protein, 10 aa, Dengue virus
KEKAWLVHKQ

SEQ ID NO: 17140 - protein, 10 aa, Dengue virus
EKAWLVHKQW

SEQ ID NO: 17141 - protein, 10 aa, Dengue virus
LPLPWTSGAL

SEQ ID NO: 17142 - protein, 10 aa, Dengue virus
PLPWTSGALT

SEQ ID NO: 17143 - protein, 10 aa, Dengue virus
TLQETWNRQD

SEQ ID NO: 17144 - protein, 10 aa, Dengue virus
LQETWNRQDL

SEQ ID NO: 17145 - protein, 10 aa, Dengue virus
QMSGTTTIFA

SEQ ID NO: 17146 - protein, 10 aa, Dengue virus
MSGTTTIFAG

SEQ ID NO: 17147 - protein, 10 aa, Dengue virus
KMDKLTLRGM

SEQ ID NO: 17148 - protein, 10 aa, Dengue virus
MDKLTLRGMS

SEQ ID NO: 17149 - protein, 10 aa, Dengue virus
DKLTLRGMSY

SEQ ID NO: 17150 - protein, 10 aa, Dengue virus
KLTLRGMSYV

SEQ ID NO: 17151 - protein, 10 aa, Dengue virus
LTLRGMSYVM

SEQ ID NO: 17152 - protein, 10 aa, Dengue virus
TLRGMSYVMC

SEQ ID NO: 17153 - protein, 10 aa, Dengue virus
LRGMSYVMCT

SEQ ID NO: 17154 - protein, 10 aa, Dengue virus
RGMSYVMCTG

SEQ ID NO: 17155 - protein, 10 aa, Dengue virus
SYVMCTGPFK

SEQ ID NO: 17156 - protein, 10 aa, Dengue virus
YVMCTGLFKL

SEQ ID NO: 17157 - protein, 10 aa, Dengue virus
VMCTGPFKLE

SEQ ID NO: 17158 - protein, 10 aa, Dengue virus
MCTGLFKLEK

SEQ ID NO: 17159 - protein, 10 aa, Dengue virus
CTGPFKLEKE

SEQ ID NO: 17160 - protein, 10 aa, Dengue virus
TGLFKLEKEV

SEQ ID NO: 17161 - protein, 10 aa, Dengue virus
GPFKLEKEVA

SEQ ID NO: 17162 - protein, 10 aa, Dengue virus
LFKLEKEVAE

SEQ ID NO: 17163 - protein, 10 aa, Dengue virus
QHGTVLVQIR

SEQ ID NO: 17164 - protein, 10 aa, Dengue virus
HGTVLVQIRY

SEQ ID NO: 17165 - protein, 10 aa, Dengue virus
GTVLVQIRYE

SEQ ID NO: 17166 - protein, 10 aa, Dengue virus
TVLVQIRYEG

SEQ ID NO: 17167 - protein, 10 aa, Dengue virus
VLVQIRYEGT

SEQ ID NO: 17168 - protein, 10 aa, Dengue virus
LVQIRYEGTD

SEQ ID NO: 17169 - protein, 10 aa, Dengue virus
VQIRYEGTDA

SEQ ID NO: 17170 - protein, 10 aa, Dengue virus
QIRYEGTDAP

SEQ ID NO: 17171 - protein, 10 aa, Dengue virus
IRYEGTDAPC

SEQ ID NO: 17172 - protein, 10 aa, Dengue virus
TDVPCKIPFS

SEQ ID NO: 17173 - protein, 10 aa, Dengue virus
DAPCKIPFSS

SEQ ID NO: 17174 - protein, 10 aa, Dengue virus
APCKIPFSSQ

SEQ ID NO: 17175 - protein, 10 aa, Dengue virus
PCKIPFSSQD

SEQ ID NO: 17176 - protein, 10 aa, Dengue virus
CKIPFSSQDE

SEQ ID NO: 17177 - protein, 10 aa, Dengue virus
QDEKGATQNG

SEQ ID NO: 17178 - protein, 10 aa, Dengue virus
DEKGATQNGR

SEQ ID NO: 17179 - protein, 10 aa, Dengue virus
GATQNGRLIT

SEQ ID NO: 17180 - protein, 10 aa, Dengue virus
ATQNGRLITA

SEQ ID NO: 17181 - protein, 10 aa, Dengue virus
TQNGRLVTAN

SEQ ID NO: 17182 - protein, 10 aa, Dengue virus
QNGRVITANP

SEQ ID NO: 17183 - protein, 10 aa, Dengue virus
NGRVITANPI

SEQ ID NO: 17184 - protein, 10 aa, Dengue virus
GRVITANPIV

SEQ ID NO: 17185 - protein, 10 aa, Dengue virus
RVITANPIVT

SEQ ID NO: 17186 - protein, 10 aa, Dengue virus
VITANPIVTD

SEQ ID NO: 17187 - protein, 10 aa, Dengue virus
ITANPIVTDR

SEQ ID NO: 17188 - protein, 10 aa, Dengue virus
TANPIVTDRE

SEQ ID NO: 17189 - protein, 10 aa, Dengue virus
ANPIVTDREK

SEQ ID NO: 17190 - protein, 10 aa, Dengue virus
NPIVTDREKP

SEQ ID NO: 17191 - protein, 10 aa, Dengue virus
PIVTDREKPV

SEQ ID NO: 17192 - protein, 10 aa, Dengue virus
IVTDREKPVN

SEQ ID NO: 17193 - protein, 10 aa, Dengue virus
VTDREKPVNI

SEQ ID NO: 17194 - protein, 10 aa, Dengue virus
TDREKPVNIE

SEQ ID NO: 17195 - protein, 10 aa, Dengue virus
DKDKPVNIEA

SEQ ID NO: 17196 - protein, 10 aa, Dengue virus
KDKPVNIEAE

SEQ ID NO: 17197 - protein, 10 aa, Dengue virus
DKPVNIEAEP

SEQ ID NO: 17198 - protein, 10 aa, Dengue virus
EPPFGESYIT

SEQ ID NO: 17199 - protein, 10 aa, Dengue virus
PPFGESYIII

SEQ ID NO: 17200 - protein, 10 aa, Dengue virus
PFGESYIIIG

SEQ ID NO: 17201 - protein, 10 aa, Dengue virus
IGVGEKALKL

SEQ ID NO: 17202 - protein, 10 aa, Dengue virus
GAGEKTLKLS

SEQ ID NO: 17203 - protein, 10 aa, Dengue virus
AGEKTLKLSW

SEQ ID NO: 17204 - protein, 10 aa, Dengue virus
GGKALKLSWF

SEQ ID NO: 17205 - protein, 10 aa, Dengue virus
EKALKLSWFR

SEQ ID NO: 17206 - protein, 10 aa, Dengue virus
KTLKLSWFKK

SEQ ID NO: 17207 - protein, 10 aa, Dengue virus
TLKLSWFKKG

SEQ ID NO: 17208 - protein, 10 aa, Dengue virus
KLSWFKKGST

SEQ ID NO: 17209 - protein, 10 aa, Dengue virus
LSWFKKGSTI

SEQ ID NO: 17210 - protein, 10 aa, Dengue virus
SWFKKGSTIG

SEQ ID NO: 17211 - protein, 10 aa, Dengue virus
WFKKGSTIGK

SEQ ID NO: 17212 - protein, 10 aa, Dengue virus
FKKGSTIGKM

SEQ ID NO: 17213 - protein, 10 aa, Dengue virus
KKGSTIGKMF

SEQ ID NO: 17214 - protein, 10 aa, Dengue virus
KGSTIGKMFE

SEQ ID NO: 17215 - protein, 10 aa, Dengue virus
GSSIGKMFVA

SEQ ID NO: 17216 - protein, 10 aa, Dengue virus
SSIGKMFVAT

SEQ ID NO: 17217 - protein, 10 aa, Dengue virus
SIGKMFVATA

SEQ ID NO: 17218 - protein, 10 aa, Dengue virus
AWDFGSIGGL

SEQ ID NO: 17219 - protein, 10 aa, Dengue virus
WDFGSIGGLF

SEQ ID NO: 17220 - protein, 10 aa, Dengue virus
DFGSIGGLFT

SEQ ID NO: 17221 - protein, 10 aa, Dengue virus
FGSIGGLFTS

SEQ ID NO: 17222 - protein, 10 aa, Dengue virus
GGLFTSVGKL

SEQ ID NO: 17223 - protein, 10 aa, Dengue virus
FTSIGKLVHQ

SEQ ID NO: 17224 - protein, 10 aa, Dengue virus
GKLIHQIFGT

SEQ ID NO: 17225 - protein, 10 aa, Dengue virus
KLIHQIFGTA

SEQ ID NO: 17226 - protein, 10 aa, Dengue virus
LIHQIFGTAY

SEQ ID NO: 17227 - protein, 10 aa, Dengue virus
IHQIFGTAYG

SEQ ID NO: 17228 - protein, 10 aa, Dengue virus
HQVFGAAYGV

SEQ ID NO: 17229 - protein, 10 aa, Dengue virus
QVFGAAYGVL

SEQ ID NO: 17230 - protein, 10 aa, Dengue virus
VFGAAYGVLF

SEQ ID NO: 17231 - protein, 10 aa, Dengue virus
SWTMKIGLGV

SEQ ID NO: 17232 - protein, 10 aa, Dengue virus
WTMKIGLGVL

SEQ ID NO: 17233 - protein, 10 aa, Dengue virus
TMKIGLGVLL

SEQ ID NO: 17234 - protein, 10 aa, Dengue virus
MKIGLGVLLT

SEQ ID NO: 17235 - protein, 10 aa, Dengue virus
KIGLGVLLTW

SEQ ID NO: 17236 - protein, 10 aa, Dengue virus
IGLGVLLTWL

SEQ ID NO: 17237 - protein, 10 aa, Dengue virus
GLGVLLTWLG

SEQ ID NO: 17238 - protein, 10 aa, Dengue virus
LGVLLTWLGL

SEQ ID NO: 17239 - protein, 10 aa, Dengue virus
TWLGLNSRNT

SEQ ID NO: 17240 - protein, 10 aa, Dengue virus
WLGLNSRNTS

SEQ ID NO: 17241 - protein, 10 aa, Dengue virus
LGLNSRSASL

SEQ ID NO: 17242 - protein, 10 aa, Dengue virus
GLNSRNTSLS

SEQ ID NO: 17243 - protein, 10 aa, Dengue virus
LNSRSASLSM

SEQ ID NO: 17244 - protein, 10 aa, Dengue virus
NSRSASLSMT

SEQ ID NO: 17245 - protein, 10 aa, Dengue virus
SRSASLSMTC

SEQ ID NO: 17246 - protein, 10 aa, Dengue virus
RSASLSMTCI

SEQ ID NO: 17247 - protein, 10 aa, Dengue virus
SASLSMTCIA

SEQ ID NO: 17248 - protein, 10 aa, Dengue virus
ASLSMTCIAV

SEQ ID NO: 17249 - protein, 10 aa, Dengue virus
SLSVMCIAVG

SEQ ID NO: 17250 - protein, 10 aa, Dengue virus
FSMTCIAVGL

SEQ ID NO: 17251 - protein, 10 aa, Dengue virus
SMTCIAVGLI

SEQ ID NO: 17252 - protein, 10 aa, Dengue virus
MTCIAVGLIT

SEQ ID NO: 17253 - protein, 10 aa, Dengue virus
TCIAVGLITL

SEQ ID NO: 17254 - protein, 10 aa, Dengue virus
CIAVGLITLY

SEQ ID NO: 17255 - protein, 10 aa, Dengue virus
IAVGLITLYL

SEQ ID NO: 17256 - protein, 10 aa, Dengue virus
AVGLITLYLG

SEQ ID NO: 17257 - protein, 10 aa, Dengue virus
VGLITLYLGV

SEQ ID NO: 17258 - protein, 10 aa, Dengue virus
GLITLYLGVM

SEQ ID NO: 17259 - protein, 10 aa, Dengue virus
LITLYLGVMV

SEQ ID NO: 17260 - protein, 10 aa, Dengue virus
VTLYLGAMVQ

SEQ ID NO: 17261 - protein, 10 aa, Dengue virus
EEGVCGIRSV

SEQ ID NO: 17262 - protein, 10 aa, Dengue virus
EGVCGIRSVT

SEQ ID NO: 17263 - protein, 10 aa, Dengue virus
GVCGIRSVTR

SEQ ID NO: 17264 - protein, 10 aa, Dengue virus
VCGIRSVTRL

SEQ ID NO: 17265 - protein, 10 aa, Dengue virus
CGIRSVTRLE

SEQ ID NO: 17266 - protein, 10 aa, Dengue virus
GIRSVTRLEN

SEQ ID NO: 17267 - protein, 10 aa, Dengue virus
IRSVTRLENI

SEQ ID NO: 17268 - protein, 10 aa, Dengue virus
RSVTRLENIM

SEQ ID NO: 17269 - protein, 10 aa, Dengue virus
SVTRLENIMW

SEQ ID NO: 17270 - protein, 10 aa, Dengue virus
TTRLENIMWK

SEQ ID NO: 17271 - protein, 10 aa, Dengue virus
WKQISNELNY

SEQ ID NO: 17272 - protein, 10 aa, Dengue virus
KQISNELNYI

SEQ ID NO: 17273 - protein, 10 aa, Dengue virus
ELNYILLEND

SEQ ID NO: 17274 - protein, 10 aa, Dengue virus
LNYILLENDM

SEQ ID NO: 17275 - protein, 10 aa, Dengue virus
NYILLENDMK

SEQ ID NO: 17276 - protein, 10 aa, Dengue virus
HILLENGMKF

SEQ ID NO: 17277 - protein, 10 aa, Dengue virus
ILLENGMKFT

SEQ ID NO: 17278 - protein, 10 aa, Dengue virus
LLENGMKFTV

SEQ ID NO: 17279 - protein, 10 aa, Dengue virus
LENGMKFTVV

SEQ ID NO: 17280 - protein, 10 aa, Dengue virus
ENGMKFTVVV

SEQ ID NO: 17281 - protein, 10 aa, Dengue virus
NGMKFTVVVG

SEQ ID NO: 17282 - protein, 10 aa, Dengue virus
GMKFTVVVGD

SEQ ID NO: 17283 - protein, 10 aa, Dengue virus
MKLTVVVGDV

SEQ ID NO: 17284 - protein, 10 aa, Dengue virus
QGRKMIRPQP

SEQ ID NO: 17285 - protein, 10 aa, Dengue virus
GKKMVRPQPM

SEQ ID NO: 17286 - protein, 10 aa, Dengue virus
RKMIRPQPME

SEQ ID NO: 17287 - protein, 10 aa, Dengue virus
KTIRPQPMEH

SEQ ID NO: 17288 - protein, 10 aa, Dengue virus
MIRPQPMEHR

SEQ ID NO: 17289 - protein, 10 aa, Dengue virus
IRPQPMEHRY

SEQ ID NO: 17290 - protein, 10 aa, Dengue virus
RPQPMEHRYS

SEQ ID NO: 17291 - protein, 10 aa, Dengue virus
PQPMEHRYSW

SEQ ID NO: 17292 - protein, 10 aa, Dengue virus
QPMEHRYSWK

SEQ ID NO: 17293 - protein, 10 aa, Dengue virus
PMEHRYSWKS

SEQ ID NO: 17294 - protein, 10 aa, Dengue virus
MEHRYSWKSW

SEQ ID NO: 17295 - protein, 10 aa, Dengue virus
EHRYSWKSWG

SEQ ID NO: 17296 - protein, 10 aa, Dengue virus
HRYSWKSWGK

SEQ ID NO: 17297 - protein, 10 aa, Dengue virus
KYSWKIWGKA

SEQ ID NO: 17298 - protein, 10 aa, Dengue virus
YSWKIWGKAK

SEQ ID NO: 17299 - protein, 10 aa, Dengue virus
SWRSWGKAKI

SEQ ID NO: 17300 - protein, 10 aa, Dengue virus
WKIWGKAKII

SEQ ID NO: 17301 - protein, 10 aa, Dengue virus
RSWGKAKIIG

SEQ ID NO: 17302 - protein, 10 aa, Dengue virus
SWGKAKVIGA

SEQ ID NO: 17303 - protein, 10 aa, Dengue virus
GKAKIIGADA

SEQ ID NO: 17304 - protein, 10 aa, Dengue virus
KAKIIGADAQ

SEQ ID NO: 17305 - protein, 10 aa, Dengue virus
AKIIGADAQN

SEQ ID NO: 17306 - protein, 10 aa, Dengue virus
QNATFIIDGP

SEQ ID NO: 17307 - protein, 10 aa, Dengue virus
IDGPNTPECS

SEQ ID NO: 17308 - protein, 10 aa, Dengue virus
DGPNTPECSD

SEQ ID NO: 17309 - protein, 10 aa, Dengue virus
ECPDGQRAWN

SEQ ID NO: 17310 - protein, 10 aa, Dengue virus
CPDGQRAWNI

SEQ ID NO: 17311 - protein, 10 aa, Dengue virus
PDGQRAWNIW

SEQ ID NO: 17312 - protein, 10 aa, Dengue virus
DGQRAWNIWE

SEQ ID NO: 17313 - protein, 10 aa, Dengue virus
GQRAWNIWEV

SEQ ID NO: 17314 - protein, 10 aa, Dengue virus
GIFTTNIWLR

SEQ ID NO: 17315 - protein, 10 aa, Dengue virus
IFTTNIWLKM

SEQ ID NO: 17316 - protein, 10 aa, Dengue virus
TTNIWLRLRD

SEQ ID NO: 17317 - protein, 10 aa, Dengue virus
NIWLKMRDSY

SEQ ID NO: 17318 - protein, 10 aa, Dengue virus
IWLKMRDSYT

SEQ ID NO: 17319 - protein, 10 aa, Dengue virus
WLKMRDSYTQ

SEQ ID NO: 17320 - protein, 10 aa, Dengue virus
RDSHTQVCDH

SEQ ID NO: 17321 - protein, 10 aa, Dengue virus
DSHTQVCDHR

SEQ ID NO: 17322 - protein, 10 aa, Dengue virus
SHTQVCDHRL

SEQ ID NO: 17323 - protein, 10 aa, Dengue virus
HTQVCDHRLM

SEQ ID NO: 17324 - protein, 10 aa, Dengue virus
TQACDHRLMS

SEQ ID NO: 17325 - protein, 10 aa, Dengue virus
QACDHRLMSA

SEQ ID NO: 17326 - protein, 10 aa, Dengue virus
ACDHRLMSAA

SEQ ID NO: 17327 - protein, 10 aa, Dengue virus
SEKNEPWKLA

SEQ ID NO: 17328 - protein, 10 aa, Dengue virus
NETWKLAGAS

SEQ ID NO: 17329 - protein, 10 aa, Dengue virus
ETWKLAGASF

SEQ ID NO: 17330 - protein, 10 aa, Dengue virus
TWKLAGASFI

SEQ ID NO: 17331 - protein, 10 aa, Dengue virus
WKLAGASFIE

SEQ ID NO: 17332 - protein, 10 aa, Dengue virus
KLAGASFIEV

SEQ ID NO: 17333 - protein, 10 aa, Dengue virus
LAGASFIEVK

SEQ ID NO: 17334 - protein, 10 aa, Dengue virus
AGASFIEVKT

SEQ ID NO: 17335 - protein, 10 aa, Dengue virus
ASFIEVKTCV

SEQ ID NO: 17336 - protein, 10 aa, Dengue virus
SFIEVKTCVW

SEQ ID NO: 17337 - protein, 10 aa, Dengue virus
FIEVKTCVWP

SEQ ID NO: 17338 - protein, 10 aa, Dengue virus
IEVKTCVWPK

SEQ ID NO: 17339 - protein, 10 aa, Dengue virus
EVKTCVWPKS

SEQ ID NO: 17340 - protein, 10 aa, Dengue virus
VKTCVWPKSH

SEQ ID NO: 17341 - protein, 10 aa, Dengue virus
KTCVWPKSHT

SEQ ID NO: 17342 - protein, 10 aa, Dengue virus
TCVWPKSHTL

SEQ ID NO: 17343 - protein, 10 aa, Dengue virus
CVWPKSHTLW

SEQ ID NO: 17344 - protein, 10 aa, Dengue virus
VWPKSHTLWS

SEQ ID NO: 17345 - protein, 10 aa, Dengue virus
LESEMIIPKM

SEQ ID NO: 17346 - protein, 10 aa, Dengue virus
ESEMVIPKIY

SEQ ID NO: 17347 - protein, 10 aa, Dengue virus
SEMVIPKIYG

SEQ ID NO: 17348 - protein, 10 aa, Dengue virus
EMVIPKIYGG

SEQ ID NO: 17349 - protein, 10 aa, Dengue virus
MVIPKIYGGP

SEQ ID NO: 17350 - protein, 10 aa, Dengue virus
PKIYGGPTSQ

SEQ ID NO: 17351 - protein, 10 aa, Dengue virus
KIYGGPTSQH

SEQ ID NO: 17352 - protein, 10 aa, Dengue virus
IYGGPTSQHN

SEQ ID NO: 17353 - protein, 10 aa, Dengue virus
YGGPTSQHNY

SEQ ID NO: 17354 - protein, 10 aa, Dengue virus
GGPISQHNHR

SEQ ID NO: 17355 - protein, 10 aa, Dengue virus
GPISQHNHRP

SEQ ID NO: 17356 - protein, 10 aa, Dengue virus
PISQHNHRPG

SEQ ID NO: 17357 - protein, 10 aa, Dengue virus
ISQHNHRPGY

SEQ ID NO: 17358 - protein, 10 aa, Dengue virus
NHRPGYFTQT

SEQ ID NO: 17359 - protein, 10 aa, Dengue virus
HRPGYFTQTA

SEQ ID NO: 17360 - protein, 10 aa, Dengue virus
LGKLELDFDF

SEQ ID NO: 17361 - protein, 10 aa, Dengue virus
GKLELDFDFC

SEQ ID NO: 17362 - protein, 10 aa, Dengue virus
KLELDFDFCE

SEQ ID NO: 17363 - protein, 10 aa, Dengue virus
LELDFDFCEG

SEQ ID NO: 17364 - protein, 10 aa, Dengue virus
ELDFDFCEGT

SEQ ID NO: 17365 - protein, 10 aa, Dengue virus
LDFDFCEGTT

SEQ ID NO: 17366 - protein, 10 aa, Dengue virus
DFDFCEGTTV

SEQ ID NO: 17367 - protein, 10 aa, Dengue virus
FDFCEGTTVV

SEQ ID NO: 17368 - protein, 10 aa, Dengue virus
DFCEGTTVVV

SEQ ID NO: 17369 - protein, 10 aa, Dengue virus
TVVVDEHCGY

SEQ ID NO: 17370 - protein, 10 aa, Dengue virus
VVVDEHCGSR

SEQ ID NO: 17371 - protein, 10 aa, Dengue virus
VVDEHCGYRG

SEQ ID NO: 17372 - protein, 10 aa, Dengue virus
VDEHCGYRGP

SEQ ID NO: 17373 - protein, 10 aa, Dengue virus
DEHCGSRGPS

SEQ ID NO: 17374 - protein, 10 aa, Dengue virus
EHCGSRGPSL

SEQ ID NO: 17375 - protein, 10 aa, Dengue virus
HCGSRGPSLR

SEQ ID NO: 17376 - protein, 10 aa, Dengue virus
CGSRGPSLRT

SEQ ID NO: 17377 - protein, 10 aa, Dengue virus
GYRGPSLRTT

SEQ ID NO: 17378 - protein, 10 aa, Dengue virus
SRGPSLRTTT

SEQ ID NO: 17379 - protein, 10 aa, Dengue virus
VKDKEENLVK

SEQ ID NO: 17380 - protein, 10 aa, Dengue virus
KDKEENLVKS

SEQ ID NO: 17381 - protein, 10 aa, Dengue virus
DKEENLVKSM

SEQ ID NO: 17382 - protein, 10 aa, Dengue virus
LVKSMVSAGL

SEQ ID NO: 17383 - protein, 10 aa, Dengue virus
VKSMVSAGLG

SEQ ID NO: 17384 - protein, 10 aa, Dengue virus
KSMVSAGLGE

SEQ ID NO: 17385 - protein, 10 aa, Dengue virus
AGSGEVDNFS

SEQ ID NO: 17386 - protein, 10 aa, Dengue virus
GSGEVDNFSL

SEQ ID NO: 17387 - protein, 10 aa, Dengue virus
SGEVDNFSLG

SEQ ID NO: 17388 - protein, 10 aa, Dengue virus
GEVDNFSLGI

SEQ ID NO: 17389 - protein, 10 aa, Dengue virus
VDNFSLGILC

SEQ ID NO: 17390 - protein, 10 aa, Dengue virus
FSLGILCASI

SEQ ID NO: 17391 - protein, 10 aa, Dengue virus
SIIIEEVMRS

SEQ ID NO: 17392 - protein, 10 aa, Dengue virus
IIIEEVMRSR

SEQ ID NO: 17393 - protein, 10 aa, Dengue virus
IIEEVMRSRW

SEQ ID NO: 17394 - protein, 10 aa, Dengue virus
EVMRSRWSKK

SEQ ID NO: 17395 - protein, 10 aa, Dengue virus
VMRSRWSKKM

SEQ ID NO: 17396 - protein, 10 aa, Dengue virus
MRSRWSKKML

SEQ ID NO: 17397 - protein, 10 aa, Dengue virus
RSRWSKKMLM

SEQ ID NO: 17398 - protein, 10 aa, Dengue virus
SRWSKKMLMT

SEQ ID NO: 17399 - protein, 10 aa, Dengue virus
RWSKKMLMTG

SEQ ID NO: 17400 - protein, 10 aa, Dengue virus
WSKKMLMTGT

SEQ ID NO: 17401 - protein, 10 aa, Dengue virus
SKKMLMTGTL

SEQ ID NO: 17402 - protein, 10 aa, Dengue virus
KMLMTGTLVV

SEQ ID NO: 17403 - protein, 10 aa, Dengue virus
MLMTGILAVF

SEQ ID NO: 17404 - protein, 10 aa, Dengue virus
GQLTWNDLTR

SEQ ID NO: 17405 - protein, 10 aa, Dengue virus
QLTWSDLIRL

SEQ ID NO: 17406 - protein, 10 aa, Dengue virus
LTWSDLIRLC

SEQ ID NO: 17407 - protein, 10 aa, Dengue virus
TWSDLIRLCI

SEQ ID NO: 17408 - protein, 10 aa, Dengue virus
WSDLIRLCIM

SEQ ID NO: 17409 - protein, 10 aa, Dengue virus
SDLIRLCIMV

SEQ ID NO: 17410 - protein, 10 aa, Dengue virus
DLTRLCIMVG

SEQ ID NO: 17411 - protein, 10 aa, Dengue virus
LTRLCIMVGA

SEQ ID NO: 17412 - protein, 10 aa, Dengue virus
TRLCIMVGAN

SEQ ID NO: 17413 - protein, 10 aa, Dengue virus
RLCIMVGANV

SEQ ID NO: 17414 - protein, 10 aa, Dengue virus
LCIMVGANAF

SEQ ID NO: 17415 - protein, 10 aa, Dengue virus
CIMVGANVSD

SEQ ID NO: 17416 - protein, 10 aa, Dengue virus
IMVGANAFDR

SEQ ID NO: 17417 - protein, 10 aa, Dengue virus
MVGANAFDRM

SEQ ID NO: 17418 - protein, 10 aa, Dengue virus
VGANAFDRMG

SEQ ID NO: 17419 - protein, 10 aa, Dengue virus
GANAFDRMGM

SEQ ID NO: 17420 - protein, 10 aa, Dengue virus
ANAFDRMGMG

SEQ ID NO: 17421 - protein, 10 aa, Dengue virus
DNMGMGTTYL

SEQ ID NO: 17422 - protein, 10 aa, Dengue virus
NMGMGTTYLA

SEQ ID NO: 17423 - protein, 10 aa, Dengue virus
GMGTTHLALM

SEQ ID NO: 17424 - protein, 10 aa, Dengue virus
MGTTHLALMA

SEQ ID NO: 17425 - protein, 10 aa, Dengue virus
GTTHLALMAT

SEQ ID NO: 17426 - protein, 10 aa, Dengue virus
TTHLALMATF

SEQ ID NO: 17427 - protein, 10 aa, Dengue virus
YLALMATFKI

SEQ ID NO: 17428 - protein, 10 aa, Dengue virus
LALMATFKIR

SEQ ID NO: 17429 - protein, 10 aa, Dengue virus
ALMATFKIRP

SEQ ID NO: 17430 - protein, 10 aa, Dengue virus
LMATFKIRPM

SEQ ID NO: 17431 - protein, 10 aa, Dengue virus
MATFKMRPML

SEQ ID NO: 17432 - protein, 10 aa, Dengue virus
ATFKMRPMLA

SEQ ID NO: 17433 - protein, 10 aa, Dengue virus
TFKMRPMLAV

SEQ ID NO: 17434 - protein, 10 aa, Dengue virus
FKMRPMLAVG

SEQ ID NO: 17435 - protein, 10 aa, Dengue virus
KMRPMLAVGL

SEQ ID NO: 17436 - protein, 10 aa, Dengue virus
IRPMFAVGLL

SEQ ID NO: 17437 - protein, 10 aa, Dengue virus
RPMFAVGLLI

SEQ ID NO: 17438 - protein, 10 aa, Dengue virus
PMFAVGLLIR

SEQ ID NO: 17439 - protein, 10 aa, Dengue virus
MFAVGLLIRR

SEQ ID NO: 17440 - protein, 10 aa, Dengue virus
FAVGLLIRRL

SEQ ID NO: 17441 - protein, 10 aa, Dengue virus
AVGLLFRKLT

SEQ ID NO: 17442 - protein, 10 aa, Dengue virus
VGLLFRKLTS

SEQ ID NO: 17443 - protein, 10 aa, Dengue virus
GLLFRKLTSR

SEQ ID NO: 17444 - protein, 10 aa, Dengue virus
LLFRKLTSRE

SEQ ID NO: 17445 - protein, 10 aa, Dengue virus
LFRKLTSREV

SEQ ID NO: 17446 - protein, 10 aa, Dengue virus
FRKLTSREVL

SEQ ID NO: 17447 - protein, 10 aa, Dengue virus
LTIGLSLVAF

SEQ ID NO: 17448 - protein, 10 aa, Dengue virus
TIGLSLVAFV

SEQ ID NO: 17449 - protein, 10 aa, Dengue virus
IGLSLVAFVE

SEQ ID NO: 17450 - protein, 10 aa, Dengue virus
GLSLVASAEL

SEQ ID NO: 17451 - protein, 10 aa, Dengue virus
LSLVASVEIP

SEQ ID NO: 17452 - protein, 10 aa, Dengue virus
SVELPNSLDE

SEQ ID NO: 17453 - protein, 10 aa, Dengue virus
VELPNSLDEL

SEQ ID NO: 17454 - protein, 10 aa, Dengue virus
ELPNSLDELG

SEQ ID NO: 17455 - protein, 10 aa, Dengue virus
LPNSLDELGD

SEQ ID NO: 17456 - protein, 10 aa, Dengue virus
PNSLDELGDG

SEQ ID NO: 17457 - protein, 10 aa, Dengue virus
NSLDELGDGL

SEQ ID NO: 17458 - protein, 10 aa, Dengue virus
GDGLAIGIMM

SEQ ID NO: 17459 - protein, 10 aa, Dengue virus
DGLAIGIMML

SEQ ID NO: 17460 - protein, 10 aa, Dengue virus
GLAIGIMMLK

SEQ ID NO: 17461 - protein, 10 aa, Dengue virus
LAIGIMMLKL

SEQ ID NO: 17462 - protein, 10 aa, Dengue virus
IGIMMLKLLT

SEQ ID NO: 17463 - protein, 10 aa, Dengue virus
GIMMLKLLTD

SEQ ID NO: 17464 - protein, 10 aa, Dengue virus
IMMLKLLTDF

SEQ ID NO: 17465 - protein, 10 aa, Dengue virus
MMLKLLTDFQ

SEQ ID NO: 17466 - protein, 10 aa, Dengue virus
MLKLLTDFQS

SEQ ID NO: 17467 - protein, 10 aa, Dengue virus
LKLLTDFQSY

SEQ ID NO: 17468 - protein, 10 aa, Dengue virus
KLLTDFQSYQ

SEQ ID NO: 17469 - protein, 10 aa, Dengue virus
LLTDFQSYQL

SEQ ID NO: 17470 - protein, 10 aa, Dengue virus
LTDFQSYQLW

SEQ ID NO: 17471 - protein, 10 aa, Dengue virus
LSIASLFPLC

SEQ ID NO: 17472 - protein, 10 aa, Dengue virus
ASLFPLCLST

SEQ ID NO: 17473 - protein, 10 aa, Dengue virus
SLIPLCLSTT

SEQ ID NO: 17474 - protein, 10 aa, Dengue virus
LIPLCLSTTS

SEQ ID NO: 17475 - protein, 10 aa, Dengue virus
IPLCLSTTSQ

SEQ ID NO: 17476 - protein, 10 aa, Dengue virus
LGSLGCKPLP

SEQ ID NO: 17477 - protein, 10 aa, Dengue virus
GSLGCKPLPM

SEQ ID NO: 17478 - protein, 10 aa, Dengue virus
SLGCKPLPMF

SEQ ID NO: 17479 - protein, 10 aa, Dengue virus
LGCKPLPMFL

SEQ ID NO: 17480 - protein, 10 aa, Dengue virus
GCKPLAMFLI

SEQ ID NO: 17481 - protein, 10 aa, Dengue virus
CKPLPMFLIT

SEQ ID NO: 17482 - protein, 10 aa, Dengue virus
KPLPMFLITE

SEQ ID NO: 17483 - protein, 10 aa, Dengue virus
ETKIWGRKSW

SEQ ID NO: 17484 - protein, 10 aa, Dengue virus
TKIWGRKSWP

SEQ ID NO: 17485 - protein, 10 aa, Dengue virus
KIWGRKSWPI

SEQ ID NO: 17486 - protein, 10 aa, Dengue virus
IWGRKSWPIN

SEQ ID NO: 17487 - protein, 10 aa, Dengue virus
WGRKSWPINE

SEQ ID NO: 17488 - protein, 10 aa, Dengue virus
GRKSWPINEG

SEQ ID NO: 17489 - protein, 10 aa, Dengue virus
RKSWPINEGI

SEQ ID NO: 17490 - protein, 10 aa, Dengue virus
KSWPINEGIM

SEQ ID NO: 17491 - protein, 10 aa, Dengue virus
WPINEGIMAV

SEQ ID NO: 17492 - protein, 10 aa, Dengue virus
PINEGIMAVG

SEQ ID NO: 17493 - protein, 10 aa, Dengue virus
LNEGIMAVGV

SEQ ID NO: 17494 - protein, 10 aa, Dengue virus
NEGIMAVGVV

SEQ ID NO: 17495 - protein, 10 aa, Dengue virus
EGIMAVGVVS

SEQ ID NO: 17496 - protein, 10 aa, Dengue virus
GIMAVGVVSI

SEQ ID NO: 17497 - protein, 10 aa, Dengue virus
IMAVGVVSIL

SEQ ID NO: 17498 - protein, 10 aa, Dengue virus
MAVGVVSILL

SEQ ID NO: 17499 - protein, 10 aa, Dengue virus
AVGVVSILLS

SEQ ID NO: 17500 - protein, 10 aa, Dengue virus
VGVVSILLSS

SEQ ID NO: 17501 - protein, 10 aa, Dengue virus
GIVSILLSAL

SEQ ID NO: 17502 - protein, 10 aa, Dengue virus
IVSILLSALL

SEQ ID NO: 17503 - protein, 10 aa, Dengue virus
SSADLSLDKA

SEQ ID NO: 17504 - protein, 10 aa, Dengue virus
SADLSLDKAA

SEQ ID NO: 17505 - protein, 10 aa, Dengue virus
ADLSLEKAAK

SEQ ID NO: 17506 - protein, 10 aa, Dengue virus
DLSLEKAAKV

SEQ ID NO: 17507 - protein, 10 aa, Dengue virus
LSLEKAAKVS

SEQ ID NO: 17508 - protein, 10 aa, Dengue virus
SLEKAAKVSW

SEQ ID NO: 17509 - protein, 10 aa, Dengue virus
LEKAAKVSWE

SEQ ID NO: 17510 - protein, 10 aa, Dengue virus
AVVSWEEEAE

SEQ ID NO: 17511 - protein, 10 aa, Dengue virus
VVSWEEEAEH

SEQ ID NO: 17512 - protein, 10 aa, Dengue virus
VSWEKEAEHS

SEQ ID NO: 17513 - protein, 10 aa, Dengue virus
WEEEAEHSGT

SEQ ID NO: 17514 - protein, 10 aa, Dengue virus
EEEAEHSGTS

SEQ ID NO: 17515 - protein, 10 aa, Dengue virus
EEAEHSGTSH

SEQ ID NO: 17516 - protein, 10 aa, Dengue virus
EHSGASHNIF

SEQ ID NO: 17517 - protein, 10 aa, Dengue virus
HSGASHNISV

SEQ ID NO: 17518 - protein, 10 aa, Dengue virus
SGASHNILVV

SEQ ID NO: 17519 - protein, 10 aa, Dengue virus
GASHNILVEI

SEQ ID NO: 17520 - protein, 10 aa, Dengue virus
ASHNILVEIQ

SEQ ID NO: 17521 - protein, 10 aa, Dengue virus
SHNILVVVQD

SEQ ID NO: 17522 - protein, 10 aa, Dengue virus
HNILVVVQDD

SEQ ID NO: 17523 - protein, 10 aa, Dengue virus
NILVVVQDDG

SEQ ID NO: 17524 - protein, 10 aa, Dengue virus
ILVVVQDDGT

SEQ ID NO: 17525 - protein, 10 aa, Dengue virus
LVVVQDDGTM

SEQ ID NO: 17526 - protein, 10 aa, Dengue virus
VVVQDDGTMK

SEQ ID NO: 17527 - protein, 10 aa, Dengue virus
VVQDDGTMKI

SEQ ID NO: 17528 - protein, 10 aa, Dengue virus
IKDEEKDDTL

SEQ ID NO: 17529 - protein, 10 aa, Dengue virus
KDEEKDDTLT

SEQ ID NO: 17530 - protein, 10 aa, Dengue virus
DEEKDDTLTI

SEQ ID NO: 17531 - protein, 10 aa, Dengue virus
EEKDDTLTIL

SEQ ID NO: 17532 - protein, 10 aa, Dengue virus
EKDDTLTILL

SEQ ID NO: 17533 - protein, 10 aa, Dengue virus
KDDTLTILLK

SEQ ID NO: 17534 - protein, 10 aa, Dengue virus
KATLLAVSGM

SEQ ID NO: 17535 - protein, 10 aa, Dengue virus
ATLLAVSGMY

SEQ ID NO: 17536 - protein, 10 aa, Dengue virus
TLLAVSGMYP

SEQ ID NO: 17537 - protein, 10 aa, Dengue virus
LLAISGVYPM

SEQ ID NO: 17538 - protein, 10 aa, Dengue virus
LAISGVYPMS

SEQ ID NO: 17539 - protein, 10 aa, Dengue virus
AISGVYPMSI

SEQ ID NO: 17540 - protein, 10 aa, Dengue virus
ISGVYPMSIP

SEQ ID NO: 17541 - protein, 10 aa, Dengue virus
PLSIPATLFL

SEQ ID NO: 17542 - protein, 10 aa, Dengue virus
LSIPATLFLW

SEQ ID NO: 17543 - protein, 10 aa, Dengue virus
SIPATLFLWY

SEQ ID NO: 17544 - protein, 10 aa, Dengue virus
IPATLFLWYF

SEQ ID NO: 17545 - protein, 10 aa, Dengue virus
PATLFLWYFW

SEQ ID NO: 17546 - protein, 10 aa, Dengue virus
ATLFLWYFWQ

SEQ ID NO: 17547 - protein, 10 aa, Dengue virus
WDTPSPPKVE

SEQ ID NO: 17548 - protein, 10 aa, Dengue virus
DTPSPPEVEK

SEQ ID NO: 17549 - protein, 10 aa, Dengue virus
TPSPPEVEKA

SEQ ID NO: 17550 - protein, 10 aa, Dengue virus
PSPPEVEKAV

SEQ ID NO: 17551 - protein, 10 aa, Dengue virus
SPPEVEKAVL

SEQ ID NO: 17552 - protein, 10 aa, Dengue virus
PPEVEKAVLD

SEQ ID NO: 17553 - protein, 10 aa, Dengue virus
VEKAVLDDGI

SEQ ID NO: 17554 - protein, 10 aa, Dengue virus
EKAVLDDGIY

SEQ ID NO: 17555 - protein, 10 aa, Dengue virus
QVGVGVFQEG

SEQ ID NO: 17556 - protein, 10 aa, Dengue virus
VGVGVFQEGV

SEQ ID NO: 17557 - protein, 10 aa, Dengue virus
GVGVFQEGVF

SEQ ID NO: 17558 - protein, 10 aa, Dengue virus
VGVFQEGVFH

SEQ ID NO: 17559 - protein, 10 aa, Dengue virus
GVFQEGVFHT

SEQ ID NO: 17560 - protein, 10 aa, Dengue virus
VFQEGVFHTM

SEQ ID NO: 17561 - protein, 10 aa, Dengue virus
FQEGVFHTMW

SEQ ID NO: 17562 - protein, 10 aa, Dengue virus
QEGVFHTMWH

SEQ ID NO: 17563 - protein, 10 aa, Dengue virus
EGVFHTMWHV

SEQ ID NO: 17564 - protein, 10 aa, Dengue virus
ISYGGGWRLR

SEQ ID NO: 17565 - protein, 10 aa, Dengue virus
SYGGGWRLRG

SEQ ID NO: 17566 - protein, 10 aa, Dengue virus
YGGGWRLRGS

SEQ ID NO: 17567 - protein, 10 aa, Dengue virus
GGGWRLRGSW

SEQ ID NO: 17568 - protein, 10 aa, Dengue virus
GGWRLRGSWN

SEQ ID NO: 17569 - protein, 10 aa, Dengue virus
QGSWNAGEEV

SEQ ID NO: 17570 - protein, 10 aa, Dengue virus
GLWNTGEEVQ

SEQ ID NO: 17571 - protein, 10 aa, Dengue virus
LWNTGEEVQV

SEQ ID NO: 17572 - protein, 10 aa, Dengue virus
GKNPKNVQTM

SEQ ID NO: 17573 - protein, 10 aa, Dengue virus
KNPKNVQTMP

SEQ ID NO: 17574 - protein, 10 aa, Dengue virus
NPKNVQTMPG

SEQ ID NO: 17575 - protein, 10 aa, Dengue virus
PKNVQTMPGT

SEQ ID NO: 17576 - protein, 10 aa, Dengue virus
KNVQTMPGTF

SEQ ID NO: 17577 - protein, 10 aa, Dengue virus
NVQTMPGTFK

SEQ ID NO: 17578 - protein, 10 aa, Dengue virus
VQTMPGTFKT

SEQ ID NO: 17579 - protein, 10 aa, Dengue virus
QTAPGTFKTS

SEQ ID NO: 17580 - protein, 10 aa, Dengue virus
TAPGTFKTSE

SEQ ID NO: 17581 - protein, 10 aa, Dengue virus
APGTFKTSEG

SEQ ID NO: 17582 - protein, 10 aa, Dengue virus
YVSAIAQARA

SEQ ID NO: 17583 - protein, 10 aa, Dengue virus
VSAIAQARAS

SEQ ID NO: 17584 - protein, 10 aa, Dengue virus
SAIAQARASQ

SEQ ID NO: 17585 - protein, 10 aa, Dengue virus
AIAQARASQE

SEQ ID NO: 17586 - protein, 10 aa, Dengue virus
IAQARASQEG

SEQ ID NO: 17587 - protein, 10 aa, Dengue virus
AQARASQEGP

SEQ ID NO: 17588 - protein, 10 aa, Dengue virus
QARASQEGPL

SEQ ID NO: 17589 - protein, 10 aa, Dengue virus
ARASQEGPLP

SEQ ID NO: 17590 - protein, 10 aa, Dengue virus
RASQEGPLPE

SEQ ID NO: 17591 - protein, 10 aa, Dengue virus
QEGPLPEIEN

SEQ ID NO: 17592 - protein, 10 aa, Dengue virus
EGPLPEIENE

SEQ ID NO: 17593 - protein, 10 aa, Dengue virus
GPLPEIENEV

SEQ ID NO: 17594 - protein, 10 aa, Dengue virus
PLPEIENEVF

SEQ ID NO: 17595 - protein, 10 aa, Dengue virus
LPEIEEEVFK

SEQ ID NO: 17596 - protein, 10 aa, Dengue virus
PEIEEEVFKK

SEQ ID NO: 17597 - protein, 10 aa, Dengue virus
EIEEEVFKKR

SEQ ID NO: 17598 - protein, 10 aa, Dengue virus
IEEEVFKKRN

SEQ ID NO: 17599 - protein, 10 aa, Dengue virus
EEEVFKKRNL

SEQ ID NO: 17600 - protein, 10 aa, Dengue virus
EEVFKKRNLT

SEQ ID NO: 17601 - protein, 10 aa, Dengue virus
KVFRKRNLTI

SEQ ID NO: 17602 - protein, 10 aa, Dengue virus
LPAIVREAIR

SEQ ID NO: 17603 - protein, 10 aa, Dengue virus
PAIVREAIRR

SEQ ID NO: 17604 - protein, 10 aa, Dengue virus
AMVREAIKRK

SEQ ID NO: 17605 - protein, 10 aa, Dengue virus
VREAIRRNVR

SEQ ID NO: 17606 - protein, 10 aa, Dengue virus
REAIKRKMRT

SEQ ID NO: 17607 - protein, 10 aa, Dengue virus
EAIKRKMRTL

SEQ ID NO: 17608 - protein, 10 aa, Dengue virus
IKRRLRTLIL

SEQ ID NO: 17609 - protein, 10 aa, Dengue virus
KRKLRTLVLA

SEQ ID NO: 17610 - protein, 10 aa, Dengue virus
RKLRTLVLAP

SEQ ID NO: 17611 - protein, 10 aa, Dengue virus
KLRTLVLAPT

SEQ ID NO: 17612 - protein, 10 aa, Dengue virus
VEAFPQSNAI

SEQ ID NO: 17613 - protein, 10 aa, Dengue virus
SNAIIQDEER

SEQ ID NO: 17614 - protein, 10 aa, Dengue virus
NAIIQDEERD

SEQ ID NO: 17615 - protein, 10 aa, Dengue virus
AIIQDEERDI

SEQ ID NO: 17616 - protein, 10 aa, Dengue virus
IIQDEERDIP

SEQ ID NO: 17617 - protein, 10 aa, Dengue virus
PERSWNSGHE

SEQ ID NO: 17618 - protein, 10 aa, Dengue virus
ERSWNSGHEW

SEQ ID NO: 17619 - protein, 10 aa, Dengue virus
RSWNSGHEWI

SEQ ID NO: 17620 - protein, 10 aa, Dengue virus
SWNSGHEWIT

SEQ ID NO: 17621 - protein, 10 aa, Dengue virus
WNSGHEWITD

SEQ ID NO: 17622 - protein, 10 aa, Dengue virus
NSGHEWITDF

SEQ ID NO: 17623 - protein, 10 aa, Dengue virus
SGHEWITDFP

SEQ ID NO: 17624 - protein, 10 aa, Dengue virus
GHEWITDFPG

SEQ ID NO: 17625 - protein, 10 aa, Dengue virus
HEWITDFPGK

SEQ ID NO: 17626 - protein, 10 aa, Dengue virus
QRRGRIGRNP

SEQ ID NO: 17627 - protein, 10 aa, Dengue virus
RRGRIGRNPN

SEQ ID NO: 17628 - protein, 10 aa, Dengue virus
RGRIGRNYNK

SEQ ID NO: 17629 - protein, 10 aa, Dengue virus
GRIGRNPNKE

SEQ ID NO: 17630 - protein, 10 aa, Dengue virus
RIGRNYNKEG

SEQ ID NO: 17631 - protein, 10 aa, Dengue virus
IGRNPNKEGD

SEQ ID NO: 17632 - protein, 10 aa, Dengue virus
GRNPNKEGDQ

SEQ ID NO: 17633 - protein, 10 aa, Dengue virus
RNYNKEGDQY

SEQ ID NO: 17634 - protein, 10 aa, Dengue virus
NQNKEGDQYI

SEQ ID NO: 17635 - protein, 10 aa, Dengue virus
QNKEGDQYIY

SEQ ID NO: 17636 - protein, 10 aa, Dengue virus
QYIYMGQPLK

SEQ ID NO: 17637 - protein, 10 aa, Dengue virus
YIYMGQPLKN

SEQ ID NO: 17638 - protein, 10 aa, Dengue virus
IYMGQPLKND

SEQ ID NO: 17639 - protein, 10 aa, Dengue virus
RRSISGDLIL

SEQ ID NO: 17640 - protein, 10 aa, Dengue virus
RSISGDLILE

SEQ ID NO: 17641 - protein, 10 aa, Dengue virus
SISGDLILEI

SEQ ID NO: 17642 - protein, 10 aa, Dengue virus
ISGDLILEIG

SEQ ID NO: 17643 - protein, 10 aa, Dengue virus
GKLPQHLTQK

SEQ ID NO: 17644 - protein, 10 aa, Dengue virus
KLPQHLTQKA

SEQ ID NO: 17645 - protein, 10 aa, Dengue virus
LPQHLTQKAQ

SEQ ID NO: 17646 - protein, 10 aa, Dengue virus
PQHLTQKAQN

SEQ ID NO: 17647 - protein, 10 aa, Dengue virus
QHLTQKAQNA

SEQ ID NO: 17648 - protein, 10 aa, Dengue virus
HLTQKAQNAL

SEQ ID NO: 17649 - protein, 10 aa, Dengue virus
LTQKAQNALD

SEQ ID NO: 17650 - protein, 10 aa, Dengue virus
TQKAQNALDN

SEQ ID NO: 17651 - protein, 10 aa, Dengue virus
QKAQNALDNL

SEQ ID NO: 17652 - protein, 10 aa, Dengue virus
QGGRAYRHAL

SEQ ID NO: 17653 - protein, 10 aa, Dengue virus
GGRAYRHALE

SEQ ID NO: 17654 - protein, 10 aa, Dengue virus
GRAYRHALEE

SEQ ID NO: 17655 - protein, 10 aa, Dengue virus
RAYRHALEEL

SEQ ID NO: 17656 - protein, 10 aa, Dengue virus
GVMLFFLSGK

SEQ ID NO: 17657 - protein, 10 aa, Dengue virus
VMLFFLSGKG

SEQ ID NO: 17658 - protein, 10 aa, Dengue virus
MLFFLSGKGL

SEQ ID NO: 17659 - protein, 10 aa, Dengue virus
KTSIGLLCVI

SEQ ID NO: 17660 - protein, 10 aa, Dengue virus
TSIGLLCVTS

SEQ ID NO: 17661 - protein, 10 aa, Dengue virus
SIGLLCVTSS

SEQ ID NO: 17662 - protein, 10 aa, Dengue virus
IGLLCVTSSS

SEQ ID NO: 17663 - protein, 10 aa, Dengue virus
SSALLWMANV

SEQ ID NO: 17664 - protein, 10 aa, Dengue virus
SALLWMANVE

SEQ ID NO: 17665 - protein, 10 aa, Dengue virus
ALLWMANVEP

SEQ ID NO: 17666 - protein, 10 aa, Dengue virus
AYVVIGLLFI

SEQ ID NO: 17667 - protein, 10 aa, Dengue virus
YVVIGLLFVI

SEQ ID NO: 17668 - protein, 10 aa, Dengue virus
VVIGLLFIIL

SEQ ID NO: 17669 - protein, 10 aa, Dengue virus
VIGLLFIILT

SEQ ID NO: 17670 - protein, 10 aa, Dengue virus
IGLLFVILTV

SEQ ID NO: 17671 - protein, 10 aa, Dengue virus
GLLFVILTVA

SEQ ID NO: 17672 - protein, 10 aa, Dengue virus
LLFVILTVAA

SEQ ID NO: 17673 - protein, 10 aa, Dengue virus
LFVILTVAAN

SEQ ID NO: 17674 - protein, 10 aa, Dengue virus
FVILTVAANE

SEQ ID NO: 17675 - protein, 10 aa, Dengue virus
VILTVAANEM

SEQ ID NO: 17676 - protein, 10 aa, Dengue virus
TKKDLGIGHA

SEQ ID NO: 17677 - protein, 10 aa, Dengue virus
KKDLGIGHAA

SEQ ID NO: 17678 - protein, 10 aa, Dengue virus
TMLDVDLRPA

SEQ ID NO: 17679 - protein, 10 aa, Dengue virus
NPLTLTATVL

SEQ ID NO: 17680 - protein, 10 aa, Dengue virus
PLTLTATVLM

SEQ ID NO: 17681 - protein, 10 aa, Dengue virus
LTLTATVLML

SEQ ID NO: 17682 - protein, 10 aa, Dengue virus
TLTAAVLMLL

SEQ ID NO: 17683 - protein, 10 aa, Dengue virus
LTAAVLMLLA

SEQ ID NO: 17684 - protein, 10 aa, Dengue virus
TAAVLMLLAH

SEQ ID NO: 17685 - protein, 10 aa, Dengue virus
ATVLMLVAHY

SEQ ID NO: 17686 - protein, 10 aa, Dengue virus
TVLMLVAHYA

SEQ ID NO: 17687 - protein, 10 aa, Dengue virus
KNPTVDGIVT

SEQ ID NO: 17688 - protein, 10 aa, Dengue virus
NPTVDGIVTI

SEQ ID NO: 17689 - protein, 10 aa, Dengue virus
PTVDGIVTID

SEQ ID NO: 17690 - protein, 10 aa, Dengue virus
TVDGIVTIDL

SEQ ID NO: 17691 - protein, 10 aa, Dengue virus
VDGIVTIDLD

SEQ ID NO: 17692 - protein, 10 aa, Dengue virus
AKFEKQLGQV

SEQ ID NO: 17693 - protein, 10 aa, Dengue virus
LSKPEFNTYK

SEQ ID NO: 17694 - protein, 10 aa, Dengue virus
SKSEFNTYKK

SEQ ID NO: 17695 - protein, 10 aa, Dengue virus
KSEFNTYKKS

SEQ ID NO: 17696 - protein, 10 aa, Dengue virus
SEFNTYKKSG

SEQ ID NO: 17697 - protein, 10 aa, Dengue virus
EFNTYKKSGI

SEQ ID NO: 17698 - protein, 10 aa, Dengue virus
FNTYKRSGII

SEQ ID NO: 17699 - protein, 10 aa, Dengue virus
NTYKRSGIIE

SEQ ID NO: 17700 - protein, 10 aa, Dengue virus
TYKRSGIIEV

SEQ ID NO: 17701 - protein, 10 aa, Dengue virus
YKKSGIMEVD

SEQ ID NO: 17702 - protein, 10 aa, Dengue virus
KKSGIMEVDR

SEQ ID NO: 17703 - protein, 10 aa, Dengue virus
KSGIMEVDRS

SEQ ID NO: 17704 - protein, 10 aa, Dengue virus
SGIVEVDRSE

SEQ ID NO: 17705 - protein, 10 aa, Dengue virus
GIVEVDRSEA

SEQ ID NO: 17706 - protein, 10 aa, Dengue virus
IVEVDRSEAK

SEQ ID NO: 17707 - protein, 10 aa, Dengue virus
VEVDRSEAKE

SEQ ID NO: 17708 - protein, 10 aa, Dengue virus
AKEGLKRGEI

SEQ ID NO: 17709 - protein, 10 aa, Dengue virus
KEGLKRGEIT

SEQ ID NO: 17710 - protein, 10 aa, Dengue virus
EGLRRGETTK

SEQ ID NO: 17711 - protein, 10 aa, Dengue virus
GLRRGETTKH

SEQ ID NO: 17712 - protein, 10 aa, Dengue virus
LRRGETTKHA

SEQ ID NO: 17713 - protein, 10 aa, Dengue virus
RRGETTKHAV

SEQ ID NO: 17714 - protein, 10 aa, Dengue virus
RGEITKHAVS

SEQ ID NO: 17715 - protein, 10 aa, Dengue virus
GEITKHAVSR

SEQ ID NO: 17716 - protein, 10 aa, Dengue virus
EITKHAVSRG

SEQ ID NO: 17717 - protein, 10 aa, Dengue virus
ITKHAVSRGT

SEQ ID NO: 17718 - protein, 10 aa, Dengue virus
IKHAVSRGTA

SEQ ID NO: 17719 - protein, 10 aa, Dengue virus
YTKGGLGHEE

SEQ ID NO: 17720 - protein, 10 aa, Dengue virus
TKGGLGHEEP

SEQ ID NO: 17721 - protein, 10 aa, Dengue virus
KGGAGHEEPI

SEQ ID NO: 17722 - protein, 10 aa, Dengue virus
GGAGHEEPIP

SEQ ID NO: 17723 - protein, 10 aa, Dengue virus
GAGHEEPIPM

SEQ ID NO: 17724 - protein, 10 aa, Dengue virus
AGHEEPIPMA

SEQ ID NO: 17725 - protein, 10 aa, Dengue virus
TYGWNLVRLH

SEQ ID NO: 17726 - protein, 10 aa, Dengue virus
YGWNLVRLHS

SEQ ID NO: 17727 - protein, 10 aa, Dengue virus
GWNLVRLHSG

SEQ ID NO: 17728 - protein, 10 aa, Dengue virus
WNLVRLHSGK

SEQ ID NO: 17729 - protein, 10 aa, Dengue virus
NLVRLHSGKD

SEQ ID NO: 17730 - protein, 10 aa, Dengue virus
LVRLHSGKDV

SEQ ID NO: 17731 - protein, 10 aa, Dengue virus
VRLHSGKDVF

SEQ ID NO: 17732 - protein, 10 aa, Dengue virus
RLHSGKDVFF

SEQ ID NO: 17733 - protein, 10 aa, Dengue virus
SGKDVFFMPP

SEQ ID NO: 17734 - protein, 10 aa, Dengue virus
GKDVFFMPPE

SEQ ID NO: 17735 - protein, 10 aa, Dengue virus
KDVFFMPPEK

SEQ ID NO: 17736 - protein, 10 aa, Dengue virus
DVFFMPPEKC

SEQ ID NO: 17737 - protein, 10 aa, Dengue virus
VFFMPPEKCD

SEQ ID NO: 17738 - protein, 10 aa, Dengue virus
FFMPPEKCDT

SEQ ID NO: 17739 - protein, 10 aa, Dengue virus
FMPPEKCDTL

SEQ ID NO: 17740 - protein, 10 aa, Dengue virus
MPPEKCDTLL

SEQ ID NO: 17741 - protein, 10 aa, Dengue virus
MPSVVETLEH

SEQ ID NO: 17742 - protein, 10 aa, Dengue virus
PSVVETLEHM

SEQ ID NO: 17743 - protein, 10 aa, Dengue virus
SVVETLEHMQ

SEQ ID NO: 17744 - protein, 10 aa, Dengue virus
VVETLERMQR

SEQ ID NO: 17745 - protein, 10 aa, Dengue virus
VETLEQMQRR

SEQ ID NO: 17746 - protein, 10 aa, Dengue virus
ETLEQMQRKY

SEQ ID NO: 17747 - protein, 10 aa, Dengue virus
TLEQMQRKYG

SEQ ID NO: 17748 - protein, 10 aa, Dengue virus
LEQMQRRHGG

SEQ ID NO: 17749 - protein, 10 aa, Dengue virus
EQMQRRHGGM

SEQ ID NO: 17750 - protein, 10 aa, Dengue virus
QMQRRHGGML

SEQ ID NO: 17751 - protein, 10 aa, Dengue virus
FTMAHRKPTF

SEQ ID NO: 17752 - protein, 10 aa, Dengue virus
TMAHRKPTFE

SEQ ID NO: 17753 - protein, 10 aa, Dengue virus
MAHRKPTYEK

SEQ ID NO: 17754 - protein, 10 aa, Dengue virus
AHRKPTYEKD

SEQ ID NO: 17755 - protein, 10 aa, Dengue virus
HRKPTFERDV

SEQ ID NO: 17756 - protein, 10 aa, Dengue virus
RKPTFERDVD

SEQ ID NO: 17757 - protein, 10 aa, Dengue virus
KPTFERDVDL

SEQ ID NO: 17758 - protein, 10 aa, Dengue virus
PTFERDVDLG

SEQ ID NO: 17759 - protein, 10 aa, Dengue virus
TYEKDVDLGA

SEQ ID NO: 17760 - protein, 10 aa, Dengue virus
YEKDVDLGAG

SEQ ID NO: 17761 - protein, 10 aa, Dengue virus
EKDVDLGAGT

SEQ ID NO: 17762 - protein, 10 aa, Dengue virus
KDVDLGAGTR

SEQ ID NO: 17763 - protein, 10 aa, Dengue virus
DLGAGTRHVT

SEQ ID NO: 17764 - protein, 10 aa, Dengue virus
LGAGTRHVTV

SEQ ID NO: 17765 - protein, 10 aa, Dengue virus
GAGTRHVTVE

SEQ ID NO: 17766 - protein, 10 aa, Dengue virus
AGTRHVTVEP

SEQ ID NO: 17767 - protein, 10 aa, Dengue virus
TRHVAVEPEE

SEQ ID NO: 17768 - protein, 10 aa, Dengue virus
RHVAVEPEEA

SEQ ID NO: 17769 - protein, 10 aa, Dengue virus
HVAVEPEEAN

SEQ ID NO: 17770 - protein, 10 aa, Dengue virus
VEPEEANLDI

SEQ ID NO: 17771 - protein, 10 aa, Dengue virus
EPEEANLDII

SEQ ID NO: 17772 - protein, 10 aa, Dengue virus
PEEANLDIIG

SEQ ID NO: 17773 - protein, 10 aa, Dengue virus
EEANLDIIGQ

SEQ ID NO: 17774 - protein, 10 aa, Dengue virus
EANLDIIGQR

SEQ ID NO: 17775 - protein, 10 aa, Dengue virus
VDTRTPKAKQ

SEQ ID NO: 17776 - protein, 10 aa, Dengue virus
DTRTPKAKQG

SEQ ID NO: 17777 - protein, 10 aa, Dengue virus
TRTPKAKQGT

SEQ ID NO: 17778 - protein, 10 aa, Dengue virus
RTPRAKRGTA

SEQ ID NO: 17779 - protein, 10 aa, Dengue virus
TPRAKRGTAQ

SEQ ID NO: 17780 - protein, 10 aa, Dengue virus
PRAKRGTAQI

SEQ ID NO: 17781 - protein, 10 aa, Dengue virus
RAKRGTAQIM

SEQ ID NO: 17782 - protein, 10 aa, Dengue virus
AKRGTVQIME

SEQ ID NO: 17783 - protein, 10 aa, Dengue virus
KRGTVQIMEV

SEQ ID NO: 17784 - protein, 10 aa, Dengue virus
RGTVQIMEVT

SEQ ID NO: 17785 - protein, 10 aa, Dengue virus
GTVQIMEVTA

SEQ ID NO: 17786 - protein, 10 aa, Dengue virus
QIMEMTAKWL

SEQ ID NO: 17787 - protein, 10 aa, Dengue virus
IMEMTAKWLW

SEQ ID NO: 17788 - protein, 10 aa, Dengue virus
MEMTAKWLWG

SEQ ID NO: 17789 - protein, 10 aa, Dengue virus
EMTAKWLWGF

SEQ ID NO: 17790 - protein, 10 aa, Dengue virus
MTAKWLWGFL

SEQ ID NO: 17791 - protein, 10 aa, Dengue virus
TARWLWSFLS

SEQ ID NO: 17792 - protein, 10 aa, Dengue virus
ARWLWSFLSR

SEQ ID NO: 17793 - protein, 10 aa, Dengue virus
RWLWSFLSRN

SEQ ID NO: 17794 - protein, 10 aa, Dengue virus
EAVEDERFWE

SEQ ID NO: 17795 - protein, 10 aa, Dengue virus
AVEDERFWEL

SEQ ID NO: 17796 - protein, 10 aa, Dengue virus
VEDERFWELV

SEQ ID NO: 17797 - protein, 10 aa, Dengue virus
LVRRERELHK

SEQ ID NO: 17798 - protein, 10 aa, Dengue virus
VRRERELHKQ

SEQ ID NO: 17799 - protein, 10 aa, Dengue virus
RRERELHKQG

SEQ ID NO: 17800 - protein, 10 aa, Dengue virus
LGYILRDISR

SEQ ID NO: 17801 - protein, 10 aa, Dengue virus
GYILRDISRI

SEQ ID NO: 17802 - protein, 10 aa, Dengue virus
YILRDISRIP

SEQ ID NO: 17803 - protein, 10 aa, Dengue virus
ILRDISRIPG

SEQ ID NO: 17804 - protein, 10 aa, Dengue virus
LRDISRIPGG

SEQ ID NO: 17805 - protein, 10 aa, Dengue virus
RDISRIPGGN

SEQ ID NO: 17806 - protein, 10 aa, Dengue virus
DISRIPGGNM

SEQ ID NO: 17807 - protein, 10 aa, Dengue virus
ISRIPGGNMY

SEQ ID NO: 17808 - protein, 10 aa, Dengue virus
SRIPGGNMYA

SEQ ID NO: 17809 - protein, 10 aa, Dengue virus
RIPGGNMYAD

SEQ ID NO: 17810 - protein, 10 aa, Dengue virus
ISGGNMYADD

SEQ ID NO: 17811 - protein, 10 aa, Dengue virus
SGGNMYADDT

SEQ ID NO: 17812 - protein, 10 aa, Dengue virus
EDDLRNEAKI

SEQ ID NO: 17813 - protein, 10 aa, Dengue virus
DLQNEAKITE

SEQ ID NO: 17814 - protein, 10 aa, Dengue virus
LQNEAKITEI

SEQ ID NO: 17815 - protein, 10 aa, Dengue virus
QNEAKITEIM

SEQ ID NO: 17816 - protein, 10 aa, Dengue virus
NEAKITEIME

SEQ ID NO: 17817 - protein, 10 aa, Dengue virus
EAKITEIMEP

SEQ ID NO: 17818 - protein, 10 aa, Dengue virus
AKITEIMEPE

SEQ ID NO: 17819 - protein, 10 aa, Dengue virus
KITEIMEPEH

SEQ ID NO: 17820 - protein, 10 aa, Dengue virus
ITDIMEAEHA

SEQ ID NO: 17821 - protein, 10 aa, Dengue virus
MEPEHALLAR

SEQ ID NO: 17822 - protein, 10 aa, Dengue virus
EPEHALLAKA

SEQ ID NO: 17823 - protein, 10 aa, Dengue virus
PEHALLAKAI

SEQ ID NO: 17824 - protein, 10 aa, Dengue virus
EHALLAKAIF

SEQ ID NO: 17825 - protein, 10 aa, Dengue virus
HALLAKAIFK

SEQ ID NO: 17826 - protein, 10 aa, Dengue virus
ALLAKAIFKL

SEQ ID NO: 17827 - protein, 10 aa, Dengue virus
LLAKAIFKLT

SEQ ID NO: 17828 - protein, 10 aa, Dengue virus
LAKAIFKLTY

SEQ ID NO: 17829 - protein, 10 aa, Dengue virus
AKAIFKLTYQ

SEQ ID NO: 17830 - protein, 10 aa, Dengue virus
KAIFKLTYQN

SEQ ID NO: 17831 - protein, 10 aa, Dengue virus
KVVRVQRPTK

SEQ ID NO: 17832 - protein, 10 aa, Dengue virus
VVRVQRPARN

SEQ ID NO: 17833 - protein, 10 aa, Dengue virus
VRVQRPARNG

SEQ ID NO: 17834 - protein, 10 aa, Dengue virus
RVQRPARNGT

SEQ ID NO: 17835 - protein, 10 aa, Dengue virus
VQRPARNGTV

SEQ ID NO: 17836 - protein, 10 aa, Dengue virus
QRPARNGTVM

SEQ ID NO: 17837 - protein, 10 aa, Dengue virus
RPARNGTVMD

SEQ ID NO: 17838 - protein, 10 aa, Dengue virus
PARNGTVMDV

SEQ ID NO: 17839 - protein, 10 aa, Dengue virus
ARNGTVMDVI

SEQ ID NO: 17840 - protein, 10 aa, Dengue virus
RNGTVMDVIS

SEQ ID NO: 17841 - protein, 10 aa, Dengue virus
GLNTFTNMGA

SEQ ID NO: 17842 - protein, 10 aa, Dengue virus
LNTFTNMGAQ

SEQ ID NO: 17843 - protein, 10 aa, Dengue virus
NTFTNMGAQL

SEQ ID NO: 17844 - protein, 10 aa, Dengue virus
TFTNMGAQLI

SEQ ID NO: 17845 - protein, 10 aa, Dengue virus
FTNMGAQLIR

SEQ ID NO: 17846 - protein, 10 aa, Dengue virus
TNMGAQLIRQ

SEQ ID NO: 17847 - protein, 10 aa, Dengue virus
NMGAQLIRQM

SEQ ID NO: 17848 - protein, 10 aa, Dengue virus
MGAQLIRQME

SEQ ID NO: 17849 - protein, 10 aa, Dengue virus
GAQLIRQMES

SEQ ID NO: 17850 - protein, 10 aa, Dengue virus
RQMESEGIFF

SEQ ID NO: 17851 - protein, 10 aa, Dengue virus
QMESEGIFFP

SEQ ID NO: 17852 - protein, 10 aa, Dengue virus
SGDDCVVKPV

SEQ ID NO: 17853 - protein, 10 aa, Dengue virus
GDDCVVKPVD

SEQ ID NO: 17854 - protein, 10 aa, Dengue virus
DDCVVKPVDD

SEQ ID NO: 17855 - protein, 10 aa, Dengue virus
DCVVKPVDDR

SEQ ID NO: 17856 - protein, 10 aa, Dengue virus
CVVKPVDDRF

SEQ ID NO: 17857 - protein, 10 aa, Dengue virus
VVKPVDDRFA

SEQ ID NO: 17858 - protein, 10 aa, Dengue virus
VKPVDDRFAT

SEQ ID NO: 17859 - protein, 10 aa, Dengue virus
KPVDDRFATA

SEQ ID NO: 17860 - protein, 10 aa, Dengue virus
PVDDRFATAL

SEQ ID NO: 17861 - protein, 10 aa, Dengue virus
DDRFATALSA

SEQ ID NO: 17862 - protein, 10 aa, Dengue virus
DRFATALSAL

SEQ ID NO: 17863 - protein, 10 aa, Dengue virus
RFATALSALN

SEQ ID NO: 17864 - protein, 10 aa, Dengue virus
FATALSALND

SEQ ID NO: 17865 - protein, 10 aa, Dengue virus
ATALSALNDM

SEQ ID NO: 17866 - protein, 10 aa, Dengue virus
TALSALNDMG

SEQ ID NO: 17867 - protein, 10 aa, Dengue virus
ALSALNDMGK

SEQ ID NO: 17868 - protein, 10 aa, Dengue virus
LSALNDMGKV

SEQ ID NO: 17869 - protein, 10 aa, Dengue virus
SALNDMGKVR

SEQ ID NO: 17870 - protein, 10 aa, Dengue virus
ANAICSADPV

SEQ ID NO: 17871 - protein, 10 aa, Dengue virus
PVEWVPTSRT

SEQ ID NO: 17872 - protein, 10 aa, Dengue virus
VEWVPTSRTT

SEQ ID NO: 17873 - protein, 10 aa, Dengue virus
EWVPTSRTTW

SEQ ID NO: 17874 - protein, 10 aa, Dengue virus
NPWMEDKTRI

SEQ ID NO: 17875 - protein, 10 aa, Dengue virus
PWMEDKTRIS

SEQ ID NO: 17876 - protein, 10 aa, Dengue virus
WMEDKTRISS

SEQ ID NO: 17877 - protein, 10 aa, Dengue virus
MEDKTRISSW

SEQ ID NO: 17878 - protein, 10 aa, Dengue virus
EDKTHVSSWG

SEQ ID NO: 17879 - protein, 10 aa, Dengue virus
ISSWEDVPYL

SEQ ID NO: 17880 - protein, 10 aa, Dengue virus
SSWEEVPYLG

SEQ ID NO: 17881 - protein, 10 aa, Dengue virus
SWEEVPYLGK

SEQ ID NO: 17882 - protein, 10 aa, Dengue virus
WEEVPYLGKR

SEQ ID NO: 17883 - protein, 10 aa, Dengue virus
EEVPYLGKRE

SEQ ID NO: 17884 - protein, 10 aa, Dengue virus
WATNVQVAIN

SEQ ID NO: 17885 - protein, 10 aa, Dengue virus
ATNVQVAINQ

SEQ ID NO: 17886 - protein, 10 aa, Dengue virus
RRLIGNENYS

SEQ ID NO: 17887 - protein, 10 aa, Dengue virus
RLIGNENYSD

SEQ ID NO: 17888 - protein, 10 aa, Dengue virus
LIGNENYSDY

SEQ ID NO: 17889 - protein, 10 aa, Dengue virus
IGNENYSDYM

SEQ ID NO: 17890 - protein, 10 aa, Dengue virus
GNENYLDFMT

SEQ ID NO: 17891 - protein, 10 aa, Dengue virus
NENYLDFMTS

SEQ ID NO: 17892 - protein, 10 aa, Dengue virus
ENYLDFMTSM

SEQ ID NO: 17893 - protein, 10 aa, Dengue virus
NYLDFMTSMK

SEQ ID NO: 17894 - protein, 10 aa, Dengue virus
YLDFMTSMKR

SEQ ID NO: 17895 - protein, 10 aa, Dengue virus
LDFMTSMKRF

SEQ ID NO: 17896 - protein, 10 aa, Dengue virus
DFMTSMKRFK

SEQ ID NO: 17897 - protein, 10 aa, Dengue virus
FMTSMKRFKN

SEQ ID NO: 17898 - protein, 10 aa, Dengue virus
MTSMKRFKND

SEQ ID NO: 17899 - protein, 10 aa, Dengue virus
MINQRKKTGR

SEQ ID NO: 17900 - protein, 10 aa, Dengue virus
INQRKKTGRP

SEQ ID NO: 17901 - protein, 10 aa, Dengue virus
LRGFKREISN

SEQ ID NO: 17902 - protein, 10 aa, Dengue virus
RGFKREISNM

SEQ ID NO: 17903 - protein, 10 aa, Dengue virus
GFKREISNML

SEQ ID NO: 17904 - protein, 10 aa, Dengue virus
FKREISNMLN

SEQ ID NO: 17905 - protein, 10 aa, Dengue virus
MNRRRKSVTM

SEQ ID NO: 17906 - protein, 10 aa, Dengue virus
NRRKRSVTMI

SEQ ID NO: 17907 - protein, 10 aa, Dengue virus
PTALTFHLTT

SEQ ID NO: 17908 - protein, 10 aa, Dengue virus
TALTFHLTTR

SEQ ID NO: 17909 - protein, 10 aa, Dengue virus
ALTFHLTTRG

SEQ ID NO: 17910 - protein, 10 aa, Dengue virus
RGGEPHMIVG

SEQ ID NO: 17911 - protein, 10 aa, Dengue virus
GGEPHMIVGK

SEQ ID NO: 17912 - protein, 10 aa, Dengue virus
GEPHMIVGKQ

SEQ ID NO: 17913 - protein, 10 aa, Dengue virus
EPHMIVGKQE

SEQ ID NO: 17914 - protein, 10 aa, Dengue virus
PHMIVGKQER

SEQ ID NO: 17915 - protein, 10 aa, Dengue virus
HMIVGKQERG

SEQ ID NO: 17916 - protein, 10 aa, Dengue virus
MIVGKQERGK

SEQ ID NO: 17917 - protein, 10 aa, Dengue virus
IVGKQERGKS

SEQ ID NO: 17918 - protein, 10 aa, Dengue virus
SLLFKTSTGV

SEQ ID NO: 17919 - protein, 10 aa, Dengue virus
LLFKTSTGVN

SEQ ID NO: 17920 - protein, 10 aa, Dengue virus
LFKTSTGVNM

SEQ ID NO: 17921 - protein, 10 aa, Dengue virus
FKTSTGVNMC

SEQ ID NO: 17922 - protein, 10 aa, Dengue virus
KTSTGVNMCT

SEQ ID NO: 17923 - protein, 10 aa, Dengue virus
TSTGVNMCTL

SEQ ID NO: 17924 - protein, 10 aa, Dengue virus
STGVNMCTLI

SEQ ID NO: 17925 - protein, 10 aa, Dengue virus
TGVNMCTLIA

SEQ ID NO: 17926 - protein, 10 aa, Dengue virus
DLGELCEDTI

SEQ ID NO: 17927 - protein, 10 aa, Dengue virus
LGELCEDTIT

SEQ ID NO: 17928 - protein, 10 aa, Dengue virus
GELCEDTITY

SEQ ID NO: 17929 - protein, 10 aa, Dengue virus
ELCEDTITYK

SEQ ID NO: 17930 - protein, 10 aa, Dengue virus
LCEDTITYKC

SEQ ID NO: 17931 - protein, 10 aa, Dengue virus
EDTITYKCPR

SEQ ID NO: 17932 - protein, 10 aa, Dengue virus
TITYKCPRIT

SEQ ID NO: 17933 - protein, 10 aa, Dengue virus
ITYKCPRITE

SEQ ID NO: 17934 - protein, 10 aa, Dengue virus
TYKCPRITEV

SEQ ID NO: 17935 - protein, 10 aa, Dengue virus
YKCPRITEVE

SEQ ID NO: 17936 - protein, 10 aa, Dengue virus
KCPRITEVEP

SEQ ID NO: 17937 - protein, 10 aa, Dengue virus
CPRITEVEPD

SEQ ID NO: 17938 - protein, 10 aa, Dengue virus
PRITEVEPDD

SEQ ID NO: 17939 - protein, 10 aa, Dengue virus
RITEVEPDDV

SEQ ID NO: 17940 - protein, 10 aa, Dengue virus
ISEAEPDDVD

SEQ ID NO: 17941 - protein, 10 aa, Dengue virus
SEAEPDDVDC

SEQ ID NO: 17942 - protein, 10 aa, Dengue virus
CSRTGEHRRD

SEQ ID NO: 17943 - protein, 10 aa, Dengue virus
SRTGEHRRDK

SEQ ID NO: 17944 - protein, 10 aa, Dengue virus
RTGEHRRDKR

SEQ ID NO: 17945 - protein, 10 aa, Dengue virus
KQIQRVETWV

SEQ ID NO: 17946 - protein, 10 aa, Dengue virus
ALRHPGFTVM

SEQ ID NO: 17947 - protein, 10 aa, Dengue virus
RHPGFTVMAL

SEQ ID NO: 17948 - protein, 10 aa, Dengue virus
HPGFTVMALF

SEQ ID NO: 17949 - protein, 10 aa, Dengue virus
PGFTVMALFL

SEQ ID NO: 17950 - protein, 10 aa, Dengue virus
GFTVMALFLA

SEQ ID NO: 17951 - protein, 10 aa, Dengue virus
TEVANPAVLR

SEQ ID NO: 17952 - protein, 10 aa, Dengue virus
EVTSPAILRK

SEQ ID NO: 17953 - protein, 10 aa, Dengue virus
VANPAVLRKL

SEQ ID NO: 17954 - protein, 10 aa, Dengue virus
ANPAVLRKLC

SEQ ID NO: 17955 - protein, 10 aa, Dengue virus
EATLVEEQDS

SEQ ID NO: 17956 - protein, 10 aa, Dengue virus
ATLVEEQDSN

SEQ ID NO: 17957 - protein, 10 aa, Dengue virus
TLVEEQDSNF

SEQ ID NO: 17958 - protein, 10 aa, Dengue virus
LVEEQDSNFV

SEQ ID NO: 17959 - protein, 10 aa, Dengue virus
VEEQDSNFVC

SEQ ID NO: 17960 - protein, 10 aa, Dengue virus
DANFVCRRTL

SEQ ID NO: 17961 - protein, 10 aa, Dengue virus
ANFVCRRTLV

SEQ ID NO: 17962 - protein, 10 aa, Dengue virus
CVTKLEGKVV

SEQ ID NO: 17963 - protein, 10 aa, Dengue virus
VTRLEGKIVQ

SEQ ID NO: 17964 - protein, 10 aa, Dengue virus
TKLEGKTVQH

SEQ ID NO: 17965 - protein, 10 aa, Dengue virus
KLEGKIVQHE

SEQ ID NO: 17966 - protein, 10 aa, Dengue virus
LEGKIVQHEN

SEQ ID NO: 17967 - protein, 10 aa, Dengue virus
EGKTVQHENL

SEQ ID NO: 17968 - protein, 10 aa, Dengue virus
GKTVQHENLK

SEQ ID NO: 17969 - protein, 10 aa, Dengue virus
KIVQHENLKY

SEQ ID NO: 17970 - protein, 10 aa, Dengue virus
TVQHENLKYS

SEQ ID NO: 17971 - protein, 10 aa, Dengue virus
GNESTEHGTI

SEQ ID NO: 17972 - protein, 10 aa, Dengue virus
NESTEHGTIA

SEQ ID NO: 17973 - protein, 10 aa, Dengue virus
ESTEHGTIAT

SEQ ID NO: 17974 - protein, 10 aa, Dengue virus
STEHGTIATI

SEQ ID NO: 17975 - protein, 10 aa, Dengue virus
IATITPQAPS

SEQ ID NO: 17976 - protein, 10 aa, Dengue virus
TEIQLTDYGV

SEQ ID NO: 17977 - protein, 10 aa, Dengue virus
NEMVLLTMEK

SEQ ID NO: 17978 - protein, 10 aa, Dengue virus
EMVLLTMKGK

SEQ ID NO: 17979 - protein, 10 aa, Dengue virus
MVLLTMEKKS

SEQ ID NO: 17980 - protein, 10 aa, Dengue virus
VLLTMKGKSW

SEQ ID NO: 17981 - protein, 10 aa, Dengue virus
LLTMEKKSWL

SEQ ID NO: 17982 - protein, 10 aa, Dengue virus
LTMEKKSWLV

SEQ ID NO: 17983 - protein, 10 aa, Dengue virus
TMEKKSWLVH

SEQ ID NO: 17984 - protein, 10 aa, Dengue virus
MEKKSWLVHK

SEQ ID NO: 17985 - protein, 10 aa, Dengue virus
EKKSWLVHKQ

SEQ ID NO: 17986 - protein, 10 aa, Dengue virus
TTQETWNRQD

SEQ ID NO: 17987 - protein, 10 aa, Dengue virus
KMDKLTLKGI

SEQ ID NO: 17988 - protein, 10 aa, Dengue virus
MDKLTLKGIS

SEQ ID NO: 17989 - protein, 10 aa, Dengue virus
DKLTLKGISY

SEQ ID NO: 17990 - protein, 10 aa, Dengue virus
KLTLKGISYV

SEQ ID NO: 17991 - protein, 10 aa, Dengue virus
LTLKGISYVM

SEQ ID NO: 17992 - protein, 10 aa, Dengue virus
TLKGISYVMC

SEQ ID NO: 17993 - protein, 10 aa, Dengue virus
LKGISYVMCT

SEQ ID NO: 17994 - protein, 10 aa, Dengue virus
KGISYVMCTG

SEQ ID NO: 17995 - protein, 10 aa, Dengue virus
TGPFKLEKEV

SEQ ID NO: 17996 - protein, 10 aa, Dengue virus
GLFKLEKEVA

SEQ ID NO: 17997 - protein, 10 aa, Dengue virus
VLVQVRYEGT

SEQ ID NO: 17998 - protein, 10 aa, Dengue virus
VQVRYEGTDA

SEQ ID NO: 17999 - protein, 10 aa, Dengue virus
DAPCKIPFSA

SEQ ID NO: 18000 - protein, 10 aa, Dengue virus
APCKIPFSAQ

SEQ ID NO: 18001 - protein, 10 aa, Dengue virus
PCKIPFSAQD

SEQ ID NO: 18002 - protein, 10 aa, Dengue virus
CKIPFSAQDE

SEQ ID NO: 18003 - protein, 10 aa, Dengue virus
QDGKGVTQNG

SEQ ID NO: 18004 - protein, 10 aa, Dengue virus
DGKGVTQNGR

SEQ ID NO: 18005 - protein, 10 aa, Dengue virus
GVTQNGRLVT

SEQ ID NO: 18006 - protein, 10 aa, Dengue virus
VTQNGRLVTA

SEQ ID NO: 18007 - protein, 10 aa, Dengue virus
TQNGRVITAN

SEQ ID NO: 18008 - protein, 10 aa, Dengue virus
PIVTDKEKPI

SEQ ID NO: 18009 - protein, 10 aa, Dengue virus
IVTDKEKPIN

SEQ ID NO: 18010 - protein, 10 aa, Dengue virus
VTDKEKPINI

SEQ ID NO: 18011 - protein, 10 aa, Dengue virus
TDKEKPINIE

SEQ ID NO: 18012 - protein, 10 aa, Dengue virus
DREKPVNIEA

SEQ ID NO: 18013 - protein, 10 aa, Dengue virus
REKPVNIEAE

SEQ ID NO: 18014 - protein, 10 aa, Dengue virus
PPFGESYIIV

SEQ ID NO: 18015 - protein, 10 aa, Dengue virus
PFGESYIIVG

SEQ ID NO: 18016 - protein, 10 aa, Dengue virus
IGAGEKTLKL

SEQ ID NO: 18017 - protein, 10 aa, Dengue virus
EKALKQCWFK

SEQ ID NO: 18018 - protein, 10 aa, Dengue virus
KALKLSWFRK

SEQ ID NO: 18019 - protein, 10 aa, Dengue virus
KLSWFKKGSN

SEQ ID NO: 18020 - protein, 10 aa, Dengue virus
LSWFRKGSSI

SEQ ID NO: 18021 - protein, 10 aa, Dengue virus
SWFKKGSNIG

SEQ ID NO: 18022 - protein, 10 aa, Dengue virus
RKGSSIGKMF

SEQ ID NO: 18023 - protein, 10 aa, Dengue virus
KGSNIGKMFE

SEQ ID NO: 18024 - protein, 10 aa, Dengue virus
SNIGKMFEAT

SEQ ID NO: 18025 - protein, 10 aa, Dengue virus
NIGKMFEATA

SEQ ID NO: 18026 - protein, 10 aa, Dengue virus
GGVFTSAGKL

SEQ ID NO: 18027 - protein, 10 aa, Dengue virus
FTSAGKLVHQ

SEQ ID NO: 18028 - protein, 10 aa, Dengue virus
GKLVHQVFGA

SEQ ID NO: 18029 - protein, 10 aa, Dengue virus
KLVHQVFGAA

SEQ ID NO: 18030 - protein, 10 aa, Dengue virus
LVHQVFGAAY

SEQ ID NO: 18031 - protein, 10 aa, Dengue virus
VHQVFGAAYG

SEQ ID NO: 18032 - protein, 10 aa, Dengue virus
LGLNSRNTSL

SEQ ID NO: 18033 - protein, 10 aa, Dengue virus
GLNSRSASLS

SEQ ID NO: 18034 - protein, 10 aa, Dengue virus
LNSRNTSLSV

SEQ ID NO: 18035 - protein, 10 aa, Dengue virus
NSRNTSLSVM

SEQ ID NO: 18036 - protein, 10 aa, Dengue virus
SRNTSLSVMC

SEQ ID NO: 18037 - protein, 10 aa, Dengue virus
RNTSLSVMCI

SEQ ID NO: 18038 - protein, 10 aa, Dengue virus
NTSLSVMCIA

SEQ ID NO: 18039 - protein, 10 aa, Dengue virus
TSLSMTCIVV

SEQ ID NO: 18040 - protein, 10 aa, Dengue virus
SLSMTCIVVG

SEQ ID NO: 18041 - protein, 10 aa, Dengue virus
LSVMCIAVGM

SEQ ID NO: 18042 - protein, 10 aa, Dengue virus
SVMCIAVGMV

SEQ ID NO: 18043 - protein, 10 aa, Dengue virus
VMCIAVGMVT

SEQ ID NO: 18044 - protein, 10 aa, Dengue virus
MCIAVGMVTL

SEQ ID NO: 18045 - protein, 10 aa, Dengue virus
CIVVGMVTLY

SEQ ID NO: 18046 - protein, 10 aa, Dengue virus
IVVGMVTLYL

SEQ ID NO: 18047 - protein, 10 aa, Dengue virus
GLVTLYLGAM

SEQ ID NO: 18048 - protein, 10 aa, Dengue virus
LVTLYLGAMV

SEQ ID NO: 18049 - protein, 10 aa, Dengue virus
IRSATRLENV

SEQ ID NO: 18050 - protein, 10 aa, Dengue virus
VTRLENIMWK

SEQ ID NO: 18051 - protein, 10 aa, Dengue virus
LNHILLENDI

SEQ ID NO: 18052 - protein, 10 aa, Dengue virus
NHILLENDIK

SEQ ID NO: 18053 - protein, 10 aa, Dengue virus
YILLENDMKF

SEQ ID NO: 18054 - protein, 10 aa, Dengue virus
ILLENDIKFT

SEQ ID NO: 18055 - protein, 10 aa, Dengue virus
LLENDIKFTV

SEQ ID NO: 18056 - protein, 10 aa, Dengue virus
LENDIKFTVV

SEQ ID NO: 18057 - protein, 10 aa, Dengue virus
ENDIKFTVVV

SEQ ID NO: 18058 - protein, 10 aa, Dengue virus
NDIKFTVVVG

SEQ ID NO: 18059 - protein, 10 aa, Dengue virus
DIKFTVVVGN

SEQ ID NO: 18060 - protein, 10 aa, Dengue virus
IKFTVVVGNA

SEQ ID NO: 18061 - protein, 10 aa, Dengue virus
QGKKMVRPQP

SEQ ID NO: 18062 - protein, 10 aa, Dengue virus
GRKMIRPQPM

SEQ ID NO: 18063 - protein, 10 aa, Dengue virus
KKMVRPQPME

SEQ ID NO: 18064 - protein, 10 aa, Dengue virus
KMVRPQPMEH

SEQ ID NO: 18065 - protein, 10 aa, Dengue virus
TIRPQPMEHK

SEQ ID NO: 18066 - protein, 10 aa, Dengue virus
PMEYKYSWKI

SEQ ID NO: 18067 - protein, 10 aa, Dengue virus
MEYKYSWKIW

SEQ ID NO: 18068 - protein, 10 aa, Dengue virus
EYKYSWRSWG

SEQ ID NO: 18069 - protein, 10 aa, Dengue virus
YKYSWRSWGK

SEQ ID NO: 18070 - protein, 10 aa, Dengue virus
KYSWRSWGKA

SEQ ID NO: 18071 - protein, 10 aa, Dengue virus
KSWGKAKVIG

SEQ ID NO: 18072 - protein, 10 aa, Dengue virus
GKAKIIGADT

SEQ ID NO: 18073 - protein, 10 aa, Dengue virus
KAKIIGADTQ

SEQ ID NO: 18074 - protein, 10 aa, Dengue virus
AKIIGADTQN

SEQ ID NO: 18075 - protein, 10 aa, Dengue virus
DGPDTPECPN

SEQ ID NO: 18076 - protein, 10 aa, Dengue virus
ECPDEQRAWN

SEQ ID NO: 18077 - protein, 10 aa, Dengue virus
CPDEQRAWNI

SEQ ID NO: 18078 - protein, 10 aa, Dengue virus
PDEQRAWNIW

SEQ ID NO: 18079 - protein, 10 aa, Dengue virus
DEQRAWNIWE

SEQ ID NO: 18080 - protein, 10 aa, Dengue virus
EQRAWNIWEV

SEQ ID NO: 18081 - protein, 10 aa, Dengue virus
IFTTNIWLRL

SEQ ID NO: 18082 - protein, 10 aa, Dengue virus
RDSYTQACDH

SEQ ID NO: 18083 - protein, 10 aa, Dengue virus
DSYTQACDHR

SEQ ID NO: 18084 - protein, 10 aa, Dengue virus
SYTQACDHRL

SEQ ID NO: 18085 - protein, 10 aa, Dengue virus
YTQACDHRLM

SEQ ID NO: 18086 - protein, 10 aa, Dengue virus
NEPWKLARAS

SEQ ID NO: 18087 - protein, 10 aa, Dengue virus
EPWKLARASF

SEQ ID NO: 18088 - protein, 10 aa, Dengue virus
ESEMIIPKMY

SEQ ID NO: 18089 - protein, 10 aa, Dengue virus
SEMIIPKMYG

SEQ ID NO: 18090 - protein, 10 aa, Dengue virus
EMIIPKMYGG

SEQ ID NO: 18091 - protein, 10 aa, Dengue virus
MIIPKMYGGP

SEQ ID NO: 18092 - protein, 10 aa, Dengue virus
PKMYGGPISQ

SEQ ID NO: 18093 - protein, 10 aa, Dengue virus
KMYGGPISQH

SEQ ID NO: 18094 - protein, 10 aa, Dengue virus
MYGGPISQHN

SEQ ID NO: 18095 - protein, 10 aa, Dengue virus
YGGPISQHNH

SEQ ID NO: 18096 - protein, 10 aa, Dengue virus
FSLGLLCTSI

SEQ ID NO: 18097 - protein, 10 aa, Dengue virus
SIMTEEVMRS

SEQ ID NO: 18098 - protein, 10 aa, Dengue virus
IMTEEVMRSR

SEQ ID NO: 18099 - protein, 10 aa, Dengue virus
MTEEVMRSRW

SEQ ID NO: 18100 - protein, 10 aa, Dengue virus
SRWSRKMLMA

SEQ ID NO: 18101 - protein, 10 aa, Dengue virus
RWSRKMLMAG

SEQ ID NO: 18102 - protein, 10 aa, Dengue virus
WSRKMLMTGI

SEQ ID NO: 18103 - protein, 10 aa, Dengue virus
SRKMLMTGIL

SEQ ID NO: 18104 - protein, 10 aa, Dengue virus
KMLMTGILAV

SEQ ID NO: 18105 - protein, 10 aa, Dengue virus
MLMTGTLAVL

SEQ ID NO: 18106 - protein, 10 aa, Dengue virus
QLTWNDLTRL

SEQ ID NO: 18107 - protein, 10 aa, Dengue virus
LTWNDLTRLC

SEQ ID NO: 18108 - protein, 10 aa, Dengue virus
TWNDLTRLCI

SEQ ID NO: 18109 - protein, 10 aa, Dengue virus
WNDLTRLCIM

SEQ ID NO: 18110 - protein, 10 aa, Dengue virus
NDLTRLCIMV

SEQ ID NO: 18111 - protein, 10 aa, Dengue virus
LCIMVGANVS

SEQ ID NO: 18112 - protein, 10 aa, Dengue virus
IMVGANASDN

SEQ ID NO: 18113 - protein, 10 aa, Dengue virus
MVGANASDNM

SEQ ID NO: 18114 - protein, 10 aa, Dengue virus
VGANASDNMG

SEQ ID NO: 18115 - protein, 10 aa, Dengue virus
GANASDNMGM

SEQ ID NO: 18116 - protein, 10 aa, Dengue virus
ANASDNMGMG

SEQ ID NO: 18117 - protein, 10 aa, Dengue virus
DRMGMGMTYL

SEQ ID NO: 18118 - protein, 10 aa, Dengue virus
RMGMGMTYLA

SEQ ID NO: 18119 - protein, 10 aa, Dengue virus
MATFKIRPMF

SEQ ID NO: 18120 - protein, 10 aa, Dengue virus
ATFKIRPMFA

SEQ ID NO: 18121 - protein, 10 aa, Dengue virus
TFKIRPMFAV

SEQ ID NO: 18122 - protein, 10 aa, Dengue virus
FKIRPMFAVG

SEQ ID NO: 18123 - protein, 10 aa, Dengue virus
KIRPMFAVGL

SEQ ID NO: 18124 - protein, 10 aa, Dengue virus
RPMFAVGLLL

SEQ ID NO: 18125 - protein, 10 aa, Dengue virus
PMFAVGLLLR

SEQ ID NO: 18126 - protein, 10 aa, Dengue virus
MFAVGLLFRK

SEQ ID NO: 18127 - protein, 10 aa, Dengue virus
FAVGLLFRKL

SEQ ID NO: 18128 - protein, 10 aa, Dengue virus
AVGLLLRRLT

SEQ ID NO: 18129 - protein, 10 aa, Dengue virus
VGLLLRRLTS

SEQ ID NO: 18130 - protein, 10 aa, Dengue virus
TIGLSLMASM

SEQ ID NO: 18131 - protein, 10 aa, Dengue virus
IGLSLVASAE

SEQ ID NO: 18132 - protein, 10 aa, Dengue virus
GLSLVASVEI

SEQ ID NO: 18133 - protein, 10 aa, Dengue virus
LSLMASMELP

SEQ ID NO: 18134 - protein, 10 aa, Dengue virus
FVELPNSLEE

SEQ ID NO: 18135 - protein, 10 aa, Dengue virus
MLKLLTDFQP

SEQ ID NO: 18136 - protein, 10 aa, Dengue virus
LKLLTDFQPH

SEQ ID NO: 18137 - protein, 10 aa, Dengue virus
KLLTDFQPHQ

SEQ ID NO: 18138 - protein, 10 aa, Dengue virus
LLTDFQPHQL

SEQ ID NO: 18139 - protein, 10 aa, Dengue virus
LTDFQPHQLW

SEQ ID NO: 18140 - protein, 10 aa, Dengue virus
LSVVSLFPLC

SEQ ID NO: 18141 - protein, 10 aa, Dengue virus
VSLIPLCLST

SEQ ID NO: 18142 - protein, 10 aa, Dengue virus
SLFPLCMSTT

SEQ ID NO: 18143 - protein, 10 aa, Dengue virus
LFPLCMSTTS

SEQ ID NO: 18144 - protein, 10 aa, Dengue virus
FPLCMSTTSQ

SEQ ID NO: 18145 - protein, 10 aa, Dengue virus
SLGCKPLAMF

SEQ ID NO: 18146 - protein, 10 aa, Dengue virus
LGCKPLAMFL

SEQ ID NO: 18147 - protein, 10 aa, Dengue virus
CKPLAMFLIA

SEQ ID NO: 18148 - protein, 10 aa, Dengue virus
KPLAMFLIAE

SEQ ID NO: 18149 - protein, 10 aa, Dengue virus
ENEIWGRKSW

SEQ ID NO: 18150 - protein, 10 aa, Dengue virus
NEIWGRKSWP

SEQ ID NO: 18151 - protein, 10 aa, Dengue virus
EIWGRKSWPL

SEQ ID NO: 18152 - protein, 10 aa, Dengue virus
INEGIMAVGI

SEQ ID NO: 18153 - protein, 10 aa, Dengue virus
VGIVSILLSA

SEQ ID NO: 18154 - protein, 10 aa, Dengue virus
ADLLLEKAAE

SEQ ID NO: 18155 - protein, 10 aa, Dengue virus
DLLLEKAAEV

SEQ ID NO: 18156 - protein, 10 aa, Dengue virus
LLLEKAAEVS

SEQ ID NO: 18157 - protein, 10 aa, Dengue virus
LLEKAAEVSW

SEQ ID NO: 18158 - protein, 10 aa, Dengue virus
LDKAAEVSWE

SEQ ID NO: 18159 - protein, 10 aa, Dengue virus
AKVSWEEEAE

SEQ ID NO: 18160 - protein, 10 aa, Dengue virus
KVSWEEEAEH

SEQ ID NO: 18161 - protein, 10 aa, Dengue virus
WEQEAEHSGA

SEQ ID NO: 18162 - protein, 10 aa, Dengue virus
EQEAEHSGAS

SEQ ID NO: 18163 - protein, 10 aa, Dengue virus
QEAEHSGASH

SEQ ID NO: 18164 - protein, 10 aa, Dengue virus
SGASHNISVE

SEQ ID NO: 18165 - protein, 10 aa, Dengue virus
GASHNILVVV

SEQ ID NO: 18166 - protein, 10 aa, Dengue virus
ASHNILVVVQ

SEQ ID NO: 18167 - protein, 10 aa, Dengue virus
ILVEVQDDGP

SEQ ID NO: 18168 - protein, 10 aa, Dengue virus
LVEVQDDGPM

SEQ ID NO: 18169 - protein, 10 aa, Dengue virus
LLAVSGMYPL

SEQ ID NO: 18170 - protein, 10 aa, Dengue virus
LAVSGMYPLS

SEQ ID NO: 18171 - protein, 10 aa, Dengue virus
AVSGMYPLSI

SEQ ID NO: 18172 - protein, 10 aa, Dengue virus
VSGMYPLSIP

SEQ ID NO: 18173 - protein, 10 aa, Dengue virus
DTPSPPKVER

SEQ ID NO: 18174 - protein, 10 aa, Dengue virus
TPSPPKVERA

SEQ ID NO: 18175 - protein, 10 aa, Dengue virus
PSPPKVERAV

SEQ ID NO: 18176 - protein, 10 aa, Dengue virus
SPPKVERAVL

SEQ ID NO: 18177 - protein, 10 aa, Dengue virus
PPKVERAVLD

SEQ ID NO: 18178 - protein, 10 aa, Dengue virus
VERAVLDNGI

SEQ ID NO: 18179 - protein, 10 aa, Dengue virus
ERAVLDNGIY

SEQ ID NO: 18180 - protein, 10 aa, Dengue virus
QGLWNTGEEV

SEQ ID NO: 18181 - protein, 10 aa, Dengue virus
QTMPGTFKTP

SEQ ID NO: 18182 - protein, 10 aa, Dengue virus
TMPGTFKTPE

SEQ ID NO: 18183 - protein, 10 aa, Dengue virus
MPGTFKTPEG

SEQ ID NO: 18184 - protein, 10 aa, Dengue virus
VSAIAQTKAS

SEQ ID NO: 18185 - protein, 10 aa, Dengue virus
SAIAQTKASQ

SEQ ID NO: 18186 - protein, 10 aa, Dengue virus
AIAQTKASQE

SEQ ID NO: 18187 - protein, 10 aa, Dengue virus
IAQTKASQEG

SEQ ID NO: 18188 - protein, 10 aa, Dengue virus
AQTKASQEGP

SEQ ID NO: 18189 - protein, 10 aa, Dengue virus
QTKASQEGPL

SEQ ID NO: 18190 - protein, 10 aa, Dengue virus
TKASQEGPLP

SEQ ID NO: 18191 - protein, 10 aa, Dengue virus
EGPLPEIEDK

SEQ ID NO: 18192 - protein, 10 aa, Dengue virus
GPLPEIEDKV

SEQ ID NO: 18193 - protein, 10 aa, Dengue virus
LPEIENEVFR

SEQ ID NO: 18194 - protein, 10 aa, Dengue virus
PEIENEVFRK

SEQ ID NO: 18195 - protein, 10 aa, Dengue virus
EIENEVFRKR

SEQ ID NO: 18196 - protein, 10 aa, Dengue virus
IENEVFRKRN

SEQ ID NO: 18197 - protein, 10 aa, Dengue virus
ENEVFRKRNL

SEQ ID NO: 18198 - protein, 10 aa, Dengue virus
NEVFRKRNLT

SEQ ID NO: 18199 - protein, 10 aa, Dengue virus
AIVREAIRRN

SEQ ID NO: 18200 - protein, 10 aa, Dengue virus
VREAIKRKMR

SEQ ID NO: 18201 - protein, 10 aa, Dengue virus
REAIRRNVRT

SEQ ID NO: 18202 - protein, 10 aa, Dengue virus
EAIRRNVRTL

SEQ ID NO: 18203 - protein, 10 aa, Dengue virus
IKRRLRTLVL

SEQ ID NO: 18204 - protein, 10 aa, Dengue virus
KRRLRTLVLA

SEQ ID NO: 18205 - protein, 10 aa, Dengue virus
RRLRTLVLAP

SEQ ID NO: 18206 - protein, 10 aa, Dengue virus
RLRTLVLAPT

SEQ ID NO: 18207 - protein, 10 aa, Dengue virus
AEAFPQSNAV

SEQ ID NO: 18208 - protein, 10 aa, Dengue virus
NHNKEGDQYV

SEQ ID NO: 18209 - protein, 10 aa, Dengue virus
HNKEGDQYVY

SEQ ID NO: 18210 - protein, 10 aa, Dengue virus
RKSVSGDLIL

SEQ ID NO: 18211 - protein, 10 aa, Dengue virus
RSVSSDLILE

SEQ ID NO: 18212 - protein, 10 aa, Dengue virus
GKLPQHLTLK

SEQ ID NO: 18213 - protein, 10 aa, Dengue virus
KLPQHLTLKA

SEQ ID NO: 18214 - protein, 10 aa, Dengue virus
LPQHLTLKAQ

SEQ ID NO: 18215 - protein, 10 aa, Dengue virus
PQHLTLKAQN

SEQ ID NO: 18216 - protein, 10 aa, Dengue virus
QHLTLKAQNA

SEQ ID NO: 18217 - protein, 10 aa, Dengue virus
HLTLKAQNAL

SEQ ID NO: 18218 - protein, 10 aa, Dengue virus
LTLKAQNALD

SEQ ID NO: 18219 - protein, 10 aa, Dengue virus
TLKAQNALDN

SEQ ID NO: 18220 - protein, 10 aa, Dengue virus
LKAQNALDNL

SEQ ID NO: 18221 - protein, 10 aa, Dengue virus
TSIGLLCVMS

SEQ ID NO: 18222 - protein, 10 aa, Dengue virus
SIGLLCVIAS

SEQ ID NO: 18223 - protein, 10 aa, Dengue virus
IGLLCVIASS

SEQ ID NO: 18224 - protein, 10 aa, Dengue virus
SSVLLWIASV

SEQ ID NO: 18225 - protein, 10 aa, Dengue virus
SALLWIASVE

SEQ ID NO: 18226 - protein, 10 aa, Dengue virus
VLLWIASVEP

SEQ ID NO: 18227 - protein, 10 aa, Dengue virus
KKDLGIGHAV

SEQ ID NO: 18228 - protein, 10 aa, Dengue virus
TMLDIDLHPA

SEQ ID NO: 18229 - protein, 10 aa, Dengue virus
TLTATVLMLV

SEQ ID NO: 18230 - protein, 10 aa, Dengue virus
LTATVLMLVA

SEQ ID NO: 18231 - protein, 10 aa, Dengue virus
TATVLMLVAH

SEQ ID NO: 18232 - protein, 10 aa, Dengue virus
SKPEFNTYKR

SEQ ID NO: 18233 - protein, 10 aa, Dengue virus
FNTYKKSGIM

SEQ ID NO: 18234 - protein, 10 aa, Dengue virus
NTYKKSGIME

SEQ ID NO: 18235 - protein, 10 aa, Dengue virus
TYKKSGIMEV

SEQ ID NO: 18236 - protein, 10 aa, Dengue virus
RSGIVEVDRS

SEQ ID NO: 18237 - protein, 10 aa, Dengue virus
EGLKRGEITK

SEQ ID NO: 18238 - protein, 10 aa, Dengue virus
GLKRGEITKH

SEQ ID NO: 18239 - protein, 10 aa, Dengue virus
LKRGEITKHA

SEQ ID NO: 18240 - protein, 10 aa, Dengue virus
KRGEITKHAV

SEQ ID NO: 18241 - protein, 10 aa, Dengue virus
TIKHAVSRGT

SEQ ID NO: 18242 - protein, 10 aa, Dengue virus
KGGLGHEEPI

SEQ ID NO: 18243 - protein, 10 aa, Dengue virus
GGLGHEEPIP

SEQ ID NO: 18244 - protein, 10 aa, Dengue virus
GLGHEEPIPM

SEQ ID NO: 18245 - protein, 10 aa, Dengue virus
LGHEEPIPMA

SEQ ID NO: 18246 - protein, 10 aa, Dengue virus
LVKLHSGKDA

SEQ ID NO: 18247 - protein, 10 aa, Dengue virus
VKLHSGKDAF

SEQ ID NO: 18248 - protein, 10 aa, Dengue virus
KLHSGKDAFF

SEQ ID NO: 18249 - protein, 10 aa, Dengue virus
SGKDVFFVPP

SEQ ID NO: 18250 - protein, 10 aa, Dengue virus
GKDVFFVPPE

SEQ ID NO: 18251 - protein, 10 aa, Dengue virus
KDVFFVPPEK

SEQ ID NO: 18252 - protein, 10 aa, Dengue virus
DVFFVPPEKC

SEQ ID NO: 18253 - protein, 10 aa, Dengue virus
VFFVPPEKCD

SEQ ID NO: 18254 - protein, 10 aa, Dengue virus
FFVPPEKCDT

SEQ ID NO: 18255 - protein, 10 aa, Dengue virus
FVPPEKCDTL

SEQ ID NO: 18256 - protein, 10 aa, Dengue virus
VPPEKCDTLL

SEQ ID NO: 18257 - protein, 10 aa, Dengue virus
VETLEHMQRK

SEQ ID NO: 18258 - protein, 10 aa, Dengue virus
ETLEQMQRRH

SEQ ID NO: 18259 - protein, 10 aa, Dengue virus
TLEQMQRRHG

SEQ ID NO: 18260 - protein, 10 aa, Dengue virus
HMQRKHGGML

SEQ ID NO: 18261 - protein, 10 aa, Dengue virus
MAHRKPTFER

SEQ ID NO: 18262 - protein, 10 aa, Dengue virus
AHRKPTFERD

SEQ ID NO: 18263 - protein, 10 aa, Dengue virus
TFERDVDLGA

SEQ ID NO: 18264 - protein, 10 aa, Dengue virus
FERDVDLGAG

SEQ ID NO: 18265 - protein, 10 aa, Dengue virus
TRHVTVEPEV

SEQ ID NO: 18266 - protein, 10 aa, Dengue virus
RHVTVEPEVA

SEQ ID NO: 18267 - protein, 10 aa, Dengue virus
HVTVEPEVAN

SEQ ID NO: 18268 - protein, 10 aa, Dengue virus
VEPEVANIDI

SEQ ID NO: 18269 - protein, 10 aa, Dengue virus
EPEVANIDII

SEQ ID NO: 18270 - protein, 10 aa, Dengue virus
PEVANIDIIG

SEQ ID NO: 18271 - protein, 10 aa, Dengue virus
EVANIDIIGQ

SEQ ID NO: 18272 - protein, 10 aa, Dengue virus
VANIDIIGQR

SEQ ID NO: 18273 - protein, 10 aa, Dengue virus
RTPKAKRGTV

SEQ ID NO: 18274 - protein, 10 aa, Dengue virus
TPKAKRGTVQ

SEQ ID NO: 18275 - protein, 10 aa, Dengue virus
PKAKRGTVQI

SEQ ID NO: 18276 - protein, 10 aa, Dengue virus
KAKRGTVQIM

SEQ ID NO: 18277 - protein, 10 aa, Dengue virus
AKQGTAQIME

SEQ ID NO: 18278 - protein, 10 aa, Dengue virus
KQGTAQIMEV

SEQ ID NO: 18279 - protein, 10 aa, Dengue virus
QGTAQIMEVT

SEQ ID NO: 18280 - protein, 10 aa, Dengue virus
GTAQIMEMTA

SEQ ID NO: 18281 - protein, 10 aa, Dengue virus
EVTARWLWSF

SEQ ID NO: 18282 - protein, 10 aa, Dengue virus
VTARWLWSFL

SEQ ID NO: 18283 - protein, 10 aa, Dengue virus
EAVEDERFWN

SEQ ID NO: 18284 - protein, 10 aa, Dengue virus
AVEDERFWNL

SEQ ID NO: 18285 - protein, 10 aa, Dengue virus
VEDERFWNLV

SEQ ID NO: 18286 - protein, 10 aa, Dengue virus
LVKKERELHK

SEQ ID NO: 18287 - protein, 10 aa, Dengue virus
VKKERELHKQ

SEQ ID NO: 18288 - protein, 10 aa, Dengue virus
KKERELHKQG

SEQ ID NO: 18289 - protein, 10 aa, Dengue virus
RDISKISGGN

SEQ ID NO: 18290 - protein, 10 aa, Dengue virus
DISKIPGGSM

SEQ ID NO: 18291 - protein, 10 aa, Dengue virus
ISKIPGGSMY

SEQ ID NO: 18292 - protein, 10 aa, Dengue virus
SKIPGGSMYA

SEQ ID NO: 18293 - protein, 10 aa, Dengue virus
KISGGNMYAD

SEQ ID NO: 18294 - protein, 10 aa, Dengue virus
LRNEAKITDI

SEQ ID NO: 18295 - protein, 10 aa, Dengue virus
RNEAKITDIM

SEQ ID NO: 18296 - protein, 10 aa, Dengue virus
EAKVTDIMEP

SEQ ID NO: 18297 - protein, 10 aa, Dengue virus
ARITDIMEAE

SEQ ID NO: 18298 - protein, 10 aa, Dengue virus
RITDTMEPEH

SEQ ID NO: 18299 - protein, 10 aa, Dengue virus
EPEHALLARS

SEQ ID NO: 18300 - protein, 10 aa, Dengue virus
PEHALLARSI

SEQ ID NO: 18301 - protein, 10 aa, Dengue virus
EHALLARSIF

SEQ ID NO: 18302 - protein, 10 aa, Dengue virus
HALLARSIFK

SEQ ID NO: 18303 - protein, 10 aa, Dengue virus
ALLARSIFKL

SEQ ID NO: 18304 - protein, 10 aa, Dengue virus
LLARSIFKLT

SEQ ID NO: 18305 - protein, 10 aa, Dengue virus
LARSIFKLTY

SEQ ID NO: 18306 - protein, 10 aa, Dengue virus
ARSIFKLTYQ

SEQ ID NO: 18307 - protein, 10 aa, Dengue virus
RSIFKLTYQN

SEQ ID NO: 18308 - protein, 10 aa, Dengue virus
VVRVQRPTKN

SEQ ID NO: 18309 - protein, 10 aa, Dengue virus
VRVQRPTKNG

SEQ ID NO: 18310 - protein, 10 aa, Dengue virus
RVQRPTKNGT

SEQ ID NO: 18311 - protein, 10 aa, Dengue virus
VQRPTKNGTV

SEQ ID NO: 18312 - protein, 10 aa, Dengue virus
QRPTKNGTVM

SEQ ID NO: 18313 - protein, 10 aa, Dengue virus
RPTKNGTVMD

SEQ ID NO: 18314 - protein, 10 aa, Dengue virus
PTKNGTVMDV

SEQ ID NO: 18315 - protein, 10 aa, Dengue virus
TKNGTVMDVI

SEQ ID NO: 18316 - protein, 10 aa, Dengue virus
RQMESEEIFS

SEQ ID NO: 18317 - protein, 10 aa, Dengue virus
QMESEEIFSP

SEQ ID NO: 18318 - protein, 10 aa, Dengue virus
VKPIDDRFAA

SEQ ID NO: 18319 - protein, 10 aa, Dengue virus
KPIDDRFAAA

SEQ ID NO: 18320 - protein, 10 aa, Dengue virus
PIDDRFAAAL

SEQ ID NO: 18321 - protein, 10 aa, Dengue virus
DDRFAAALTA

SEQ ID NO: 18322 - protein, 10 aa, Dengue virus
DRFAAALTAL

SEQ ID NO: 18323 - protein, 10 aa, Dengue virus
RFAAALTALN

SEQ ID NO: 18324 - protein, 10 aa, Dengue virus
FAAALTALND

SEQ ID NO: 18325 - protein, 10 aa, Dengue virus
AAALTALNDM

SEQ ID NO: 18326 - protein, 10 aa, Dengue virus
AALTALNDMG

SEQ ID NO: 18327 - protein, 10 aa, Dengue virus
ANANCSAVPV

SEQ ID NO: 18328 - protein, 10 aa, Dengue virus
PVNWVPTSRT

SEQ ID NO: 18329 - protein, 10 aa, Dengue virus
VNWVPTSRTT

SEQ ID NO: 18330 - protein, 10 aa, Dengue virus
EDKTHISSWE

SEQ ID NO: 18331 - protein, 10 aa, Dengue virus
VSSWGDVPYL

SEQ ID NO: 18332 - protein, 10 aa, Dengue virus
LIGNENYLDF

SEQ ID NO: 18333 - protein, 10 aa, Dengue virus
IGNENYLDFM

SEQ ID NO: 18334 - protein, 10 aa, Dengue virus
GNENYLDYMI

SEQ ID NO: 18335 - protein, 10 aa, Dengue virus
NENYLDYMIS

SEQ ID NO: 18336 - protein, 10 aa, Dengue virus
ENYLDYMISM

SEQ ID NO: 18337 - protein, 10 aa, Dengue virus
NYLDYMISMK

SEQ ID NO: 18338 - protein, 10 aa, Dengue virus
YLDYMISMKR

SEQ ID NO: 18339 - protein, 10 aa, Dengue virus
LDYMISMKRF

SEQ ID NO: 18340 - protein, 10 aa, Dengue virus
MNRRKRSATM

SEQ ID NO: 18341 - protein, 10 aa, Dengue virus
NRRKRSVTTL

SEQ ID NO: 18342 - protein, 10 aa, Dengue virus
PTTLAFHLTT

SEQ ID NO: 18343 - protein, 10 aa, Dengue virus
TTLAFHLTTR

SEQ ID NO: 18344 - protein, 10 aa, Dengue virus
SAGVNMCTLV

SEQ ID NO: 18345 - protein, 10 aa, Dengue virus
TYKCPRISEA

SEQ ID NO: 18346 - protein, 10 aa, Dengue virus
YKCPRISEAE

SEQ ID NO: 18347 - protein, 10 aa, Dengue virus
KCPRISEAEP

SEQ ID NO: 18348 - protein, 10 aa, Dengue virus
CPRISEAEPD

SEQ ID NO: 18349 - protein, 10 aa, Dengue virus
PRISEAEPDD

SEQ ID NO: 18350 - protein, 10 aa, Dengue virus
RISEAEPDDV

SEQ ID NO: 18351 - protein, 10 aa, Dengue virus
SQTGGHRREK

SEQ ID NO: 18352 - protein, 10 aa, Dengue virus
RHPGFTMIAL

SEQ ID NO: 18353 - protein, 10 aa, Dengue virus
HPGFTMIALF

SEQ ID NO: 18354 - protein, 10 aa, Dengue virus
PGFTMIALFL

SEQ ID NO: 18355 - protein, 10 aa, Dengue virus
GFTMIALFLA

SEQ ID NO: 18356 - protein, 10 aa, Dengue virus
TKLEGKIVQH

SEQ ID NO: 18357 - protein, 10 aa, Dengue virus
KLEGKTVQHE

SEQ ID NO: 18358 - protein, 10 aa, Dengue virus
LEGKTVQHEN

SEQ ID NO: 18359 - protein, 10 aa, Dengue virus
IVQHENLKYS

SEQ ID NO: 18360 - protein, 10 aa, Dengue virus
GNETTDHGTT

SEQ ID NO: 18361 - protein, 10 aa, Dengue virus
NETTDHGTTA

SEQ ID NO: 18362 - protein, 10 aa, Dengue virus
ETTDHGTTAT

SEQ ID NO: 18363 - protein, 10 aa, Dengue virus
TTDHGTTATI

SEQ ID NO: 18364 - protein, 10 aa, Dengue virus
MVLLTMKGKS

SEQ ID NO: 18365 - protein, 10 aa, Dengue virus
ASQETWNRKD

SEQ ID NO: 18366 - protein, 10 aa, Dengue virus
KMDKLTLKGV

SEQ ID NO: 18367 - protein, 10 aa, Dengue virus
MDKLTLKGVS

SEQ ID NO: 18368 - protein, 10 aa, Dengue virus
DKLTLKGVSY

SEQ ID NO: 18369 - protein, 10 aa, Dengue virus
KLTLKGVSYV

SEQ ID NO: 18370 - protein, 10 aa, Dengue virus
LTLKGVSYVM

SEQ ID NO: 18371 - protein, 10 aa, Dengue virus
TLKGVSYVMC

SEQ ID NO: 18372 - protein, 10 aa, Dengue virus
KGVSYVMCTG

SEQ ID NO: 18373 - protein, 10 aa, Dengue virus
CKIPFSTQDG

SEQ ID NO: 18374 - protein, 10 aa, Dengue virus
QDERGVTQNG

SEQ ID NO: 18375 - protein, 10 aa, Dengue virus
DERGVTQNGR

SEQ ID NO: 18376 - protein, 10 aa, Dengue virus
GVTQNGRVIT

SEQ ID NO: 18377 - protein, 10 aa, Dengue virus
VTQNGRVITA

SEQ ID NO: 18378 - protein, 10 aa, Dengue virus
TVTDKEKPVN

SEQ ID NO: 18379 - protein, 10 aa, Dengue virus
PPFGESYITI

SEQ ID NO: 18380 - protein, 10 aa, Dengue virus
PFGESYITIG

SEQ ID NO: 18381 - protein, 10 aa, Dengue virus
IGAGEEALKL

SEQ ID NO: 18382 - protein, 10 aa, Dengue virus
GGVFTSMGKL

SEQ ID NO: 18383 - protein, 10 aa, Dengue virus
FTSMGKLVHQ

SEQ ID NO: 18384 - protein, 10 aa, Dengue virus
GKLIHQVFGT

SEQ ID NO: 18385 - protein, 10 aa, Dengue virus
KLIHQVFGTA

SEQ ID NO: 18386 - protein, 10 aa, Dengue virus
LIHQVFGTAY

SEQ ID NO: 18387 - protein, 10 aa, Dengue virus
IHQVFGTAYG

SEQ ID NO: 18388 - protein, 10 aa, Dengue virus
STSLSMTCIV

SEQ ID NO: 18389 - protein, 10 aa, Dengue virus
TSLSVMCIAV

SEQ ID NO: 18390 - protein, 10 aa, Dengue virus
LSMTCIVVGM

SEQ ID NO: 18391 - protein, 10 aa, Dengue virus
SMTCIVVGMV

SEQ ID NO: 18392 - protein, 10 aa, Dengue virus
MTCIVVGMVT

SEQ ID NO: 18393 - protein, 10 aa, Dengue virus
TCIVVGMVTL

SEQ ID NO: 18394 - protein, 10 aa, Dengue virus
HILLENDIKF

SEQ ID NO: 18395 - protein, 10 aa, Dengue virus
MKLTVVVGDA

SEQ ID NO: 18396 - protein, 10 aa, Dengue virus
MVRPQPMEHK

SEQ ID NO: 18397 - protein, 10 aa, Dengue virus
PMEYKYSWRS

SEQ ID NO: 18398 - protein, 10 aa, Dengue virus
MEYKYSWRSW

SEQ ID NO: 18399 - protein, 10 aa, Dengue virus
EYKYSWKIWG

SEQ ID NO: 18400 - protein, 10 aa, Dengue virus
YKYSWKIWGK

SEQ ID NO: 18401 - protein, 10 aa, Dengue virus
DGPNTSECPD

SEQ ID NO: 18402 - protein, 10 aa, Dengue virus
ECSDDQRAWN

SEQ ID NO: 18403 - protein, 10 aa, Dengue virus
CSDDQRAWNI

SEQ ID NO: 18404 - protein, 10 aa, Dengue virus
SDDQRAWNIW

SEQ ID NO: 18405 - protein, 10 aa, Dengue virus
RDSHTQMCDH

SEQ ID NO: 18406 - protein, 10 aa, Dengue virus
DSHTQMCDHR

SEQ ID NO: 18407 - protein, 10 aa, Dengue virus
SHTQMCDHRL

SEQ ID NO: 18408 - protein, 10 aa, Dengue virus
HTQMCDHRLM

SEQ ID NO: 18409 - protein, 10 aa, Dengue virus
PKIYGGPMSQ

SEQ ID NO: 18410 - protein, 10 aa, Dengue virus
KIYGGPMSQH

SEQ ID NO: 18411 - protein, 10 aa, Dengue virus
IYGGPMSQHN

SEQ ID NO: 18412 - protein, 10 aa, Dengue virus
FSLGLLCVSI

SEQ ID NO: 18413 - protein, 10 aa, Dengue virus
WSRKMLMAGT

SEQ ID NO: 18414 - protein, 10 aa, Dengue virus
SRKMLMAGTL

SEQ ID NO: 18415 - protein, 10 aa, Dengue virus
KMLMAGTLAV

SEQ ID NO: 18416 - protein, 10 aa, Dengue virus
MLMAGTLAVF

SEQ ID NO: 18417 - protein, 10 aa, Dengue virus
QLTWKDLIRL

SEQ ID NO: 18418 - protein, 10 aa, Dengue virus
LTWKDLIRLC

SEQ ID NO: 18419 - protein, 10 aa, Dengue virus
IMVGANVSDR

SEQ ID NO: 18420 - protein, 10 aa, Dengue virus
MVGANVSDRM

SEQ ID NO: 18421 - protein, 10 aa, Dengue virus
VGANVSDRMG

SEQ ID NO: 18422 - protein, 10 aa, Dengue virus
GANVSDRMGM

SEQ ID NO: 18423 - protein, 10 aa, Dengue virus
ANVSDRMGMG

SEQ ID NO: 18424 - protein, 10 aa, Dengue virus
DRMGMGTTHL

SEQ ID NO: 18425 - protein, 10 aa, Dengue virus
RMGMGTTHLA

SEQ ID NO: 18426 - protein, 10 aa, Dengue virus
MFAVGLLLRR

SEQ ID NO: 18427 - protein, 10 aa, Dengue virus
FAVGLLLRRL

SEQ ID NO: 18428 - protein, 10 aa, Dengue virus
SAELPNSLEE

SEQ ID NO: 18429 - protein, 10 aa, Dengue virus
ILKLLTDFQP

SEQ ID NO: 18430 - protein, 10 aa, Dengue virus
LSIVSLIPLC

SEQ ID NO: 18431 - protein, 10 aa, Dengue virus
VSLFPLCMST

SEQ ID NO: 18432 - protein, 10 aa, Dengue virus
LGCKPLTMFF

SEQ ID NO: 18433 - protein, 10 aa, Dengue virus
CKPLTMFLIV

SEQ ID NO: 18434 - protein, 10 aa, Dengue virus
KPLTMFLIVE

SEQ ID NO: 18435 - protein, 10 aa, Dengue virus
ADLSLEKTAE

SEQ ID NO: 18436 - protein, 10 aa, Dengue virus
DLSLEKTAEV

SEQ ID NO: 18437 - protein, 10 aa, Dengue virus
LSLDKAAEVS

SEQ ID NO: 18438 - protein, 10 aa, Dengue virus
SLEKTAEVSW

SEQ ID NO: 18439 - protein, 10 aa, Dengue virus
AEVSWEKEAE

SEQ ID NO: 18440 - protein, 10 aa, Dengue virus
EVSWEKEAEH

SEQ ID NO: 18441 - protein, 10 aa, Dengue virus
WEKEAEHSGA

SEQ ID NO: 18442 - protein, 10 aa, Dengue virus
EKEAEHSGAS

SEQ ID NO: 18443 - protein, 10 aa, Dengue virus
KEAEHSGASH

SEQ ID NO: 18444 - protein, 10 aa, Dengue virus
GASHNIFVEV

SEQ ID NO: 18445 - protein, 10 aa, Dengue virus
ASHNIFVEVQ

SEQ ID NO: 18446 - protein, 10 aa, Dengue virus
LLAISGVYPL

SEQ ID NO: 18447 - protein, 10 aa, Dengue virus
LAISGVYPLS

SEQ ID NO: 18448 - protein, 10 aa, Dengue virus
AISGVYPLSI

SEQ ID NO: 18449 - protein, 10 aa, Dengue virus
DTPSPPVVER

SEQ ID NO: 18450 - protein, 10 aa, Dengue virus
TPSPPVVERA

SEQ ID NO: 18451 - protein, 10 aa, Dengue virus
PSPPVVERAV

SEQ ID NO: 18452 - protein, 10 aa, Dengue virus
SPPVVERAVL

SEQ ID NO: 18453 - protein, 10 aa, Dengue virus
PPVVERAVLD

SEQ ID NO: 18454 - protein, 10 aa, Dengue virus
AIVREAMKRK

SEQ ID NO: 18455 - protein, 10 aa, Dengue virus
IREAIKRKLR

SEQ ID NO: 18456 - protein, 10 aa, Dengue virus
IKRKMRTLIL

SEQ ID NO: 18457 - protein, 10 aa, Dengue virus
NYNKEGDQYI

SEQ ID NO: 18458 - protein, 10 aa, Dengue virus
TSIGLLCVIA

SEQ ID NO: 18459 - protein, 10 aa, Dengue virus
SIGLLCVMSS

SEQ ID NO: 18460 - protein, 10 aa, Dengue virus
IGLLCVMSSS

SEQ ID NO: 18461 - protein, 10 aa, Dengue virus
KKDLGIGHVV

SEQ ID NO: 18462 - protein, 10 aa, Dengue virus
FNIYKRSGIV

SEQ ID NO: 18463 - protein, 10 aa, Dengue virus
NIYKRSGIVE

SEQ ID NO: 18464 - protein, 10 aa, Dengue virus
IYKRSGIVEV

SEQ ID NO: 18465 - protein, 10 aa, Dengue virus
DVFFTPPERC

SEQ ID NO: 18466 - protein, 10 aa, Dengue virus
VFFTPPERCD

SEQ ID NO: 18467 - protein, 10 aa, Dengue virus
ETLERMQRKH

SEQ ID NO: 18468 - protein, 10 aa, Dengue virus
TLEHMQRKHG

SEQ ID NO: 18469 - protein, 10 aa, Dengue virus
RHVAVEPEVP

SEQ ID NO: 18470 - protein, 10 aa, Dengue virus
HVAVEPEVPN

SEQ ID NO: 18471 - protein, 10 aa, Dengue virus
VEPEVPNLDI

SEQ ID NO: 18472 - protein, 10 aa, Dengue virus
RTPKAKQGTA

SEQ ID NO: 18473 - protein, 10 aa, Dengue virus
TPKAKQGTAQ

SEQ ID NO: 18474 - protein, 10 aa, Dengue virus
PKAKQGTAQI

SEQ ID NO: 18475 - protein, 10 aa, Dengue virus
KAKQGTAQIM

SEQ ID NO: 18476 - protein, 10 aa, Dengue virus
PKRGTAQIME

SEQ ID NO: 18477 - protein, 10 aa, Dengue virus
KRGTAQIMEM

SEQ ID NO: 18478 - protein, 10 aa, Dengue virus
RGTAQIMEMT

SEQ ID NO: 18479 - protein, 10 aa, Dengue virus
LVHKERELHK

SEQ ID NO: 18480 - protein, 10 aa, Dengue virus
VHKERELHKQ

SEQ ID NO: 18481 - protein, 10 aa, Dengue virus
DISKISGGNM

SEQ ID NO: 18482 - protein, 10 aa, Dengue virus
ISKISGGNMY

SEQ ID NO: 18483 - protein, 10 aa, Dengue virus
SKISGGNMYA

SEQ ID NO: 18484 - protein, 10 aa, Dengue virus
KIPGGSMYAD

SEQ ID NO: 18485 - protein, 10 aa, Dengue virus
AKITDIMKPE

SEQ ID NO: 18486 - protein, 10 aa, Dengue virus
PIDWVPTSRT

SEQ ID NO: 18487 - protein, 10 aa, Dengue virus
IDWVPTSRTT

SEQ ID NO: 18488 - protein, 10 aa, Dengue virus
EDKTRISSWE

SEQ ID NO: 18489 - protein, 10 aa, Dengue virus
VSSWEDVPYL

SEQ ID NO: 18490 - protein, 11 aa, Dengue virus
MNNQRKKTARP

SEQ ID NO: 18491 - protein, 11 aa, Dengue virus
NNQRKKTARPS

SEQ ID NO: 18492 - protein, 11 aa, Dengue virus
NQRKKTARPSF

SEQ ID NO: 18493 - protein, 11 aa, Dengue virus
QRKKTARPSFN

SEQ ID NO: 18494 - protein, 11 aa, Dengue virus
RKKTARPSFNM

SEQ ID NO: 18495 - protein, 11 aa, Dengue virus
KKTARPSFNML

SEQ ID NO: 18496 - protein, 11 aa, Dengue virus
KTARPSFNMLK

SEQ ID NO: 18497 - protein, 11 aa, Dengue virus
TARPSFNMLKR

SEQ ID NO: 18498 - protein, 11 aa, Dengue virus
ARPSFNMLKRA

SEQ ID NO: 18499 - protein, 11 aa, Dengue virus
RPSFNMLKRAR

SEQ ID NO: 18500 - protein, 11 aa, Dengue virus
PSFNMLKRARN

SEQ ID NO: 18501 - protein, 11 aa, Dengue virus
SFNMLKRARNR

SEQ ID NO: 18502 - protein, 11 aa, Dengue virus
FNMLKRARNRV

SEQ ID NO: 18503 - protein, 11 aa, Dengue virus
NMLKRARNRVS

SEQ ID NO: 18504 - protein, 11 aa, Dengue virus
MLKRARNRVST

SEQ ID NO: 18505 - protein, 11 aa, Dengue virus
LKRARNRVSTV

SEQ ID NO: 18506 - protein, 11 aa, Dengue virus
KRARNRVSTVS

SEQ ID NO: 18507 - protein, 11 aa, Dengue virus
RARNRVSTVSQ

SEQ ID NO: 18508 - protein, 11 aa, Dengue virus
ARNRVSTVSQL

SEQ ID NO: 18509 - protein, 11 aa, Dengue virus
RNRVSTVSQLA

SEQ ID NO: 18510 - protein, 11 aa, Dengue virus
NRVSTVSQLAK

SEQ ID NO: 18511 - protein, 11 aa, Dengue virus
RVSTVSQLAKR

SEQ ID NO: 18512 - protein, 11 aa, Dengue virus
VSTVSQLAKRF

SEQ ID NO: 18513 - protein, 11 aa, Dengue virus
STVSQLAKRFS

SEQ ID NO: 18514 - protein, 11 aa, Dengue virus
TVSQLAKRFSK

SEQ ID NO: 18515 - protein, 11 aa, Dengue virus
VSQLAKRFSKG

SEQ ID NO: 18516 - protein, 11 aa, Dengue virus
SQLAKRFSKGL

SEQ ID NO: 18517 - protein, 11 aa, Dengue virus
QLAKRFSKGLL

SEQ ID NO: 18518 - protein, 11 aa, Dengue virus
LAKRFSKGLLS

SEQ ID NO: 18519 - protein, 11 aa, Dengue virus
AKRFSKGLLSG

SEQ ID NO: 18520 - protein, 11 aa, Dengue virus
KRFSKGLLSGQ

SEQ ID NO: 18521 - protein, 11 aa, Dengue virus
RFSKGLLSGQG

SEQ ID NO: 18522 - protein, 11 aa, Dengue virus
FSKGLLSGQGP

SEQ ID NO: 18523 - protein, 11 aa, Dengue virus
SKGLLSGQGPM

SEQ ID NO: 18524 - protein, 11 aa, Dengue virus
KGLLSGQGPMK

SEQ ID NO: 18525 - protein, 11 aa, Dengue virus
GLLSGQGPMKL

SEQ ID NO: 18526 - protein, 11 aa, Dengue virus
LLSGQGPMKLV

SEQ ID NO: 18527 - protein, 11 aa, Dengue virus
LSGQGPMKLVM

SEQ ID NO: 18528 - protein, 11 aa, Dengue virus
SGQGPMKLVMA

SEQ ID NO: 18529 - protein, 11 aa, Dengue virus
GQGPMKLVMAF

SEQ ID NO: 18530 - protein, 11 aa, Dengue virus
QGPMKLVMAFI

SEQ ID NO: 18531 - protein, 11 aa, Dengue virus
GPMKLVMAFIA

SEQ ID NO: 18532 - protein, 11 aa, Dengue virus
PMKLVMAFIAF

SEQ ID NO: 18533 - protein, 11 aa, Dengue virus
MKLVMAFIAFL

SEQ ID NO: 18534 - protein, 11 aa, Dengue virus
KLVMAFIAFLR

SEQ ID NO: 18535 - protein, 11 aa, Dengue virus
LVMAFIAFLRF

SEQ ID NO: 18536 - protein, 11 aa, Dengue virus
VMAFIAFLRFL

SEQ ID NO: 18537 - protein, 11 aa, Dengue virus
MAFIAFLRFLA

SEQ ID NO: 18538 - protein, 11 aa, Dengue virus
AFIAFLRFLAI

SEQ ID NO: 18539 - protein, 11 aa, Dengue virus
FIAFLRFLAIP

SEQ ID NO: 18540 - protein, 11 aa, Dengue virus
IAFLRFLAIPP

SEQ ID NO: 18541 - protein, 11 aa, Dengue virus
AFLRFLAIPPT

SEQ ID NO: 18542 - protein, 11 aa, Dengue virus
FLRFLAIPPTA

SEQ ID NO: 18543 - protein, 11 aa, Dengue virus
LRFLAIPPTAG

SEQ ID NO: 18544 - protein, 11 aa, Dengue virus
RFLAIPPTAGI

SEQ ID NO: 18545 - protein, 11 aa, Dengue virus
FLAIPPTAGIL

SEQ ID NO: 18546 - protein, 11 aa, Dengue virus
LAIPPTAGILA

SEQ ID NO: 18547 - protein, 11 aa, Dengue virus
AIPPTAGILAR

SEQ ID NO: 18548 - protein, 11 aa, Dengue virus
IPPTAGILARW

SEQ ID NO: 18549 - protein, 11 aa, Dengue virus
PPTAGILARWG

SEQ ID NO: 18550 - protein, 11 aa, Dengue virus
PTAGILARWGS

SEQ ID NO: 18551 - protein, 11 aa, Dengue virus
TAGILARWGSF

SEQ ID NO: 18552 - protein, 11 aa, Dengue virus
AGILARWGSFK

SEQ ID NO: 18553 - protein, 11 aa, Dengue virus
GILARWGSFKK

SEQ ID NO: 18554 - protein, 11 aa, Dengue virus
ILARWGSFKKN

SEQ ID NO: 18555 - protein, 11 aa, Dengue virus
LARWGSFKKNG

SEQ ID NO: 18556 - protein, 11 aa, Dengue virus
ARWGSFKKNGA

SEQ ID NO: 18557 - protein, 11 aa, Dengue virus
RWGSFKKNGAI

SEQ ID NO: 18558 - protein, 11 aa, Dengue virus
WGSFKKNGAIK

SEQ ID NO: 18559 - protein, 11 aa, Dengue virus
GSFKKNGAIKV

SEQ ID NO: 18560 - protein, 11 aa, Dengue virus
SFKKNGAIKVL

SEQ ID NO: 18561 - protein, 11 aa, Dengue virus
FKKNGAIKVLR

SEQ ID NO: 18562 - protein, 11 aa, Dengue virus
KKNGAIKVLRG

SEQ ID NO: 18563 - protein, 11 aa, Dengue virus
KNGAIKVLRGF

SEQ ID NO: 18564 - protein, 11 aa, Dengue virus
NGAIKVLRGFK

SEQ ID NO: 18565 - protein, 11 aa, Dengue virus
GAIKVLRGFKK

SEQ ID NO: 18566 - protein, 11 aa, Dengue virus
AIKVLRGFKKE

SEQ ID NO: 18567 - protein, 11 aa, Dengue virus
IKVLRGFKKEI

SEQ ID NO: 18568 - protein, 11 aa, Dengue virus
KVLRGFKKEIS

SEQ ID NO: 18569 - protein, 11 aa, Dengue virus
VLRGFKKEISN

SEQ ID NO: 18570 - protein, 11 aa, Dengue virus
LRGFKKEISNM

SEQ ID NO: 18571 - protein, 11 aa, Dengue virus
RGFKKEISNML

SEQ ID NO: 18572 - protein, 11 aa, Dengue virus
GFKKEISNMLN

SEQ ID NO: 18573 - protein, 11 aa, Dengue virus
PTALAFHLTTR

SEQ ID NO: 18574 - protein, 11 aa, Dengue virus
TALAFHLTTRG

SEQ ID NO: 18575 - protein, 11 aa, Dengue virus
ALAFHLTTRGG

SEQ ID NO: 18576 - protein, 11 aa, Dengue virus
LAFHLTTRGGE

SEQ ID NO: 18577 - protein, 11 aa, Dengue virus
AFHLTTRGGEP

SEQ ID NO: 18578 - protein, 11 aa, Dengue virus
FHLTTRGGEPH

SEQ ID NO: 18579 - protein, 11 aa, Dengue virus
HLTTRGGEPHM

SEQ ID NO: 18580 - protein, 11 aa, Dengue virus
LTTRGGEPHMI

SEQ ID NO: 18581 - protein, 11 aa, Dengue virus
TTRGGEPHMIV

SEQ ID NO: 18582 - protein, 11 aa, Dengue virus
TRGGEPHMIVS

SEQ ID NO: 18583 - protein, 11 aa, Dengue virus
RGGEPHMIVSK

SEQ ID NO: 18584 - protein, 11 aa, Dengue virus
GGEPHMIVSKQ

SEQ ID NO: 18585 - protein, 11 aa, Dengue virus
GEPHMIVSKQE

SEQ ID NO: 18586 - protein, 11 aa, Dengue virus
EPHMIVSKQER

SEQ ID NO: 18587 - protein, 11 aa, Dengue virus
PHMIVSKQERG

SEQ ID NO: 18588 - protein, 11 aa, Dengue virus
HMIVSKQERGK

SEQ ID NO: 18589 - protein, 11 aa, Dengue virus
MIVSKQERGKS

SEQ ID NO: 18590 - protein, 11 aa, Dengue virus
IVSKQERGKSL

SEQ ID NO: 18591 - protein, 11 aa, Dengue virus
VSKQERGKSLL

SEQ ID NO: 18592 - protein, 11 aa, Dengue virus
SKQERGKSLLF

SEQ ID NO: 18593 - protein, 11 aa, Dengue virus
KQERGKSLLFK

SEQ ID NO: 18594 - protein, 11 aa, Dengue virus
QERGKSLLFKT

SEQ ID NO: 18595 - protein, 11 aa, Dengue virus
ERGKSLLFKTS

SEQ ID NO: 18596 - protein, 11 aa, Dengue virus
RGKSLLFKTSA

SEQ ID NO: 18597 - protein, 11 aa, Dengue virus
GKSLLFKTSAG

SEQ ID NO: 18598 - protein, 11 aa, Dengue virus
KSLLFKTSAGV

SEQ ID NO: 18599 - protein, 11 aa, Dengue virus
SLLFKTSAGVN

SEQ ID NO: 18600 - protein, 11 aa, Dengue virus
LLFKTSAGVNM

SEQ ID NO: 18601 - protein, 11 aa, Dengue virus
LFKTSAGVNMC

SEQ ID NO: 18602 - protein, 11 aa, Dengue virus
FKTSAGVNMCT

SEQ ID NO: 18603 - protein, 11 aa, Dengue virus
KTSAGVNMCTL

SEQ ID NO: 18604 - protein, 11 aa, Dengue virus
TSAGVNMCTLI

SEQ ID NO: 18605 - protein, 11 aa, Dengue virus
SAGVNMCTLIA

SEQ ID NO: 18606 - protein, 11 aa, Dengue virus
AGVNMCTLIAM

SEQ ID NO: 18607 - protein, 11 aa, Dengue virus
GVNMCTLIAMD

SEQ ID NO: 18608 - protein, 11 aa, Dengue virus
VNMCTLIAMDL

SEQ ID NO: 18609 - protein, 11 aa, Dengue virus
NMCTLIAMDLG

SEQ ID NO: 18610 - protein, 11 aa, Dengue virus
MCTLIAMDLGE

SEQ ID NO: 18611 - protein, 11 aa, Dengue virus
CTLIAMDLGEL

SEQ ID NO: 18612 - protein, 11 aa, Dengue virus
TLIAMDLGELC

SEQ ID NO: 18613 - protein, 11 aa, Dengue virus
LIAMDLGELCE

SEQ ID NO: 18614 - protein, 11 aa, Dengue virus
IAMDLGELCED

SEQ ID NO: 18615 - protein, 11 aa, Dengue virus
AMDLGELCEDT

SEQ ID NO: 18616 - protein, 11 aa, Dengue virus
MDLGELCEDTM

SEQ ID NO: 18617 - protein, 11 aa, Dengue virus
DLGELCEDTMT

SEQ ID NO: 18618 - protein, 11 aa, Dengue virus
LGELCEDTMTY

SEQ ID NO: 18619 - protein, 11 aa, Dengue virus
GELCEDTMTYK

SEQ ID NO: 18620 - protein, 11 aa, Dengue virus
ELCEDTMTYKC

SEQ ID NO: 18621 - protein, 11 aa, Dengue virus
LCEDTMTYKCP

SEQ ID NO: 18622 - protein, 11 aa, Dengue virus
CEDTMTYKCPR

SEQ ID NO: 18623 - protein, 11 aa, Dengue virus
EDTMTYKCPRI

SEQ ID NO: 18624 - protein, 11 aa, Dengue virus
DTMTYKCPRIT

SEQ ID NO: 18625 - protein, 11 aa, Dengue virus
TMTYKCPRITE

SEQ ID NO: 18626 - protein, 11 aa, Dengue virus
TYKCPRITEAE

SEQ ID NO: 18627 - protein, 11 aa, Dengue virus
YKCPRITEAEP

SEQ ID NO: 18628 - protein, 11 aa, Dengue virus
KCPRITEAEPD

SEQ ID NO: 18629 - protein, 11 aa, Dengue virus
CPRITEAEPDD

SEQ ID NO: 18630 - protein, 11 aa, Dengue virus
PRITEAEPDDV

SEQ ID NO: 18631 - protein, 11 aa, Dengue virus
RITEAEPDDVD

SEQ ID NO: 18632 - protein, 11 aa, Dengue virus
ITEAEPDDVDC

SEQ ID NO: 18633 - protein, 11 aa, Dengue virus
TEAEPDDVDCW

SEQ ID NO: 18634 - protein, 11 aa, Dengue virus
EAEPDDVDCWC

SEQ ID NO: 18635 - protein, 11 aa, Dengue virus
AEPDDVDCWCN

SEQ ID NO: 18636 - protein, 11 aa, Dengue virus
EPDDVDCWCNA

SEQ ID NO: 18637 - protein, 11 aa, Dengue virus
PDDVDCWCNAT

SEQ ID NO: 18638 - protein, 11 aa, Dengue virus
DDVDCWCNATD

SEQ ID NO: 18639 - protein, 11 aa, Dengue virus
DVDCWCNATDT

SEQ ID NO: 18640 - protein, 11 aa, Dengue virus
VDCWCNATDTW

SEQ ID NO: 18641 - protein, 11 aa, Dengue virus
DCWCNATDTWV

SEQ ID NO: 18642 - protein, 11 aa, Dengue virus
CWCNATDTWVT

SEQ ID NO: 18643 - protein, 11 aa, Dengue virus
WCNATDTWVTY

SEQ ID NO: 18644 - protein, 11 aa, Dengue virus
CNATDTWVTYG

SEQ ID NO: 18645 - protein, 11 aa, Dengue virus
NATDTWVTYGT

SEQ ID NO: 18646 - protein, 11 aa, Dengue virus
ATDTWVTYGTC

SEQ ID NO: 18647 - protein, 11 aa, Dengue virus
TDTWVTYGTCS

SEQ ID NO: 18648 - protein, 11 aa, Dengue virus
DTWVTYGTCSQ

SEQ ID NO: 18649 - protein, 11 aa, Dengue virus
TWVTYGTCSQT

SEQ ID NO: 18650 - protein, 11 aa, Dengue virus
WVTYGTCSQTG

SEQ ID NO: 18651 - protein, 11 aa, Dengue virus
VTYGTCSQTGE

SEQ ID NO: 18652 - protein, 11 aa, Dengue virus
TYGTCSQTGEH

SEQ ID NO: 18653 - protein, 11 aa, Dengue virus
YGTCSQTGEHR

SEQ ID NO: 18654 - protein, 11 aa, Dengue virus
GTCSQTGEHRR

SEQ ID NO: 18655 - protein, 11 aa, Dengue virus
TCSQTGEHRRD

SEQ ID NO: 18656 - protein, 11 aa, Dengue virus
CSQTGEHRRDK

SEQ ID NO: 18657 - protein, 11 aa, Dengue virus
SQTGEHRRDKR

SEQ ID NO: 18658 - protein, 11 aa, Dengue virus
QTGEHRRDKRS

SEQ ID NO: 18659 - protein, 11 aa, Dengue virus
TGEHRRDKRSV

SEQ ID NO: 18660 - protein, 11 aa, Dengue virus
GEHRRDKRSVA

SEQ ID NO: 18661 - protein, 11 aa, Dengue virus
EHRRDKRSVAL

SEQ ID NO: 18662 - protein, 11 aa, Dengue virus
HRRDKRSVALA

SEQ ID NO: 18663 - protein, 11 aa, Dengue virus
RRDKRSVALAP

SEQ ID NO: 18664 - protein, 11 aa, Dengue virus
RDKRSVALAPH

SEQ ID NO: 18665 - protein, 11 aa, Dengue virus
DKRSVALAPHV

SEQ ID NO: 18666 - protein, 11 aa, Dengue virus
KRSVALAPHVG

SEQ ID NO: 18667 - protein, 11 aa, Dengue virus
RSVALAPHVGL

SEQ ID NO: 18668 - protein, 11 aa, Dengue virus
SVALAPHVGLG

SEQ ID NO: 18669 - protein, 11 aa, Dengue virus
VALAPHVGLGL

SEQ ID NO: 18670 - protein, 11 aa, Dengue virus
ALAPHVGLGLE

SEQ ID NO: 18671 - protein, 11 aa, Dengue virus
LAPHVGLGLET

SEQ ID NO: 18672 - protein, 11 aa, Dengue virus
APHVGLGLETR

SEQ ID NO: 18673 - protein, 11 aa, Dengue virus
PHVGLGLETRT

SEQ ID NO: 18674 - protein, 11 aa, Dengue virus
HVGLGLETRTE

SEQ ID NO: 18675 - protein, 11 aa, Dengue virus
VGLGLETRTET

SEQ ID NO: 18676 - protein, 11 aa, Dengue virus
GLGLETRTETW

SEQ ID NO: 18677 - protein, 11 aa, Dengue virus
LGLETRTETWM

SEQ ID NO: 18678 - protein, 11 aa, Dengue virus
GLETRTETWMS

SEQ ID NO: 18679 - protein, 11 aa, Dengue virus
LETRTETWMSS

SEQ ID NO: 18680 - protein, 11 aa, Dengue virus
ETRTETWMSSE

SEQ ID NO: 18681 - protein, 11 aa, Dengue virus
TRTETWMSSEG

SEQ ID NO: 18682 - protein, 11 aa, Dengue virus
RTETWMSSEGA

SEQ ID NO: 18683 - protein, 11 aa, Dengue virus
TETWMSSEGAW

SEQ ID NO: 18684 - protein, 11 aa, Dengue virus
ETWMSSEGAWK

SEQ ID NO: 18685 - protein, 11 aa, Dengue virus
TWMSSEGAWKQ

SEQ ID NO: 18686 - protein, 11 aa, Dengue virus
WMSSEGAWKQI

SEQ ID NO: 18687 - protein, 11 aa, Dengue virus
MSSEGAWKQIQ

SEQ ID NO: 18688 - protein, 11 aa, Dengue virus
SSEGAWKQIQR

SEQ ID NO: 18689 - protein, 11 aa, Dengue virus
SEGAWKQIQRV

SEQ ID NO: 18690 - protein, 11 aa, Dengue virus
EGAWKQIQRVE

SEQ ID NO: 18691 - protein, 11 aa, Dengue virus
GAWKQIQRVET

SEQ ID NO: 18692 - protein, 11 aa, Dengue virus
AWKQIQRVETW

SEQ ID NO: 18693 - protein, 11 aa, Dengue virus
WKQIQRVETWA

SEQ ID NO: 18694 - protein, 11 aa, Dengue virus
KQIQRVETWAL

SEQ ID NO: 18695 - protein, 11 aa, Dengue virus
QIQRVETWALR

SEQ ID NO: 18696 - protein, 11 aa, Dengue virus
IQRVETWALRH

SEQ ID NO: 18697 - protein, 11 aa, Dengue virus
QRVETWALRHP

SEQ ID NO: 18698 - protein, 11 aa, Dengue virus
RVETWALRHPG

SEQ ID NO: 18699 - protein, 11 aa, Dengue virus
VETWALRHPGF

SEQ ID NO: 18700 - protein, 11 aa, Dengue virus
ETWALRHPGFT

SEQ ID NO: 18701 - protein, 11 aa, Dengue virus
TWALRHPGFTV

SEQ ID NO: 18702 - protein, 11 aa, Dengue virus
WALRHPGFTVI

SEQ ID NO: 18703 - protein, 11 aa, Dengue virus
ALRHPGFTVIA

SEQ ID NO: 18704 - protein, 11 aa, Dengue virus
LRHPGFTVIAL

SEQ ID NO: 18705 - protein, 11 aa, Dengue virus
RHPGFTVIALF

SEQ ID NO: 18706 - protein, 11 aa, Dengue virus
HPGFTVIALFL

SEQ ID NO: 18707 - protein, 11 aa, Dengue virus
PGFTVIALFLA

SEQ ID NO: 18708 - protein, 11 aa, Dengue virus
ALFLAHAIGTS

SEQ ID NO: 18709 - protein, 11 aa, Dengue virus
LFLAHAIGTSI

SEQ ID NO: 18710 - protein, 11 aa, Dengue virus
FLAHAIGTSIT

SEQ ID NO: 18711 - protein, 11 aa, Dengue virus
LAHAIGTSITQ

SEQ ID NO: 18712 - protein, 11 aa, Dengue virus
AHAIGTSITQK

SEQ ID NO: 18713 - protein, 11 aa, Dengue virus
HAIGTSITQKG

SEQ ID NO: 18714 - protein, 11 aa, Dengue virus
AIGTSITQKGI

SEQ ID NO: 18715 - protein, 11 aa, Dengue virus
IGTSITQKGII

SEQ ID NO: 18716 - protein, 11 aa, Dengue virus
GTSITQKGIIF

SEQ ID NO: 18717 - protein, 11 aa, Dengue virus
TSITQKGIIFI

SEQ ID NO: 18718 - protein, 11 aa, Dengue virus
SITQKGIIFIL

SEQ ID NO: 18719 - protein, 11 aa, Dengue virus
ITQKGIIFILL

SEQ ID NO: 18720 - protein, 11 aa, Dengue virus
TQKGIIFILLM

SEQ ID NO: 18721 - protein, 11 aa, Dengue virus
QKGIIFILLML

SEQ ID NO: 18722 - protein, 11 aa, Dengue virus
KGIIFILLMLV

SEQ ID NO: 18723 - protein, 11 aa, Dengue virus
GIIFILLMLVT

SEQ ID NO: 18724 - protein, 11 aa, Dengue virus
IIFILLMLVTP

SEQ ID NO: 18725 - protein, 11 aa, Dengue virus
IFILLMLVTPS

SEQ ID NO: 18726 - protein, 11 aa, Dengue virus
FILLMLVTPSM

SEQ ID NO: 18727 - protein, 11 aa, Dengue virus
ILLMLVTPSMA

SEQ ID NO: 18728 - protein, 11 aa, Dengue virus
LLMLVTPSMAM

SEQ ID NO: 18729 - protein, 11 aa, Dengue virus
LMLVTPSMAMR

SEQ ID NO: 18730 - protein, 11 aa, Dengue virus
MLVTPSMAMRC

SEQ ID NO: 18731 - protein, 11 aa, Dengue virus
LVTPSMAMRCV

SEQ ID NO: 18732 - protein, 11 aa, Dengue virus
VTPSMAMRCVG

SEQ ID NO: 18733 - protein, 11 aa, Dengue virus
TPSMAMRCVGI

SEQ ID NO: 18734 - protein, 11 aa, Dengue virus
PSMAMRCVGIG

SEQ ID NO: 18735 - protein, 11 aa, Dengue virus
SMAMRCVGIGS

SEQ ID NO: 18736 - protein, 11 aa, Dengue virus
MAMRCVGIGSR

SEQ ID NO: 18737 - protein, 11 aa, Dengue virus
AMRCVGIGSRD

SEQ ID NO: 18738 - protein, 11 aa, Dengue virus
MRCVGIGSRDF

SEQ ID NO: 18739 - protein, 11 aa, Dengue virus
RCVGIGSRDFV

SEQ ID NO: 18740 - protein, 11 aa, Dengue virus
CVGIGSRDFVE

SEQ ID NO: 18741 - protein, 11 aa, Dengue virus
VGIGSRDFVEG

SEQ ID NO: 18742 - protein, 11 aa, Dengue virus
GIGSRDFVEGL

SEQ ID NO: 18743 - protein, 11 aa, Dengue virus
IGSRDFVEGLS

SEQ ID NO: 18744 - protein, 11 aa, Dengue virus
GSRDFVEGLSG

SEQ ID NO: 18745 - protein, 11 aa, Dengue virus
SRDFVEGLSGA

SEQ ID NO: 18746 - protein, 11 aa, Dengue virus
RDFVEGLSGAT

SEQ ID NO: 18747 - protein, 11 aa, Dengue virus
DFVEGLSGATW

SEQ ID NO: 18748 - protein, 11 aa, Dengue virus
FVEGLSGATWV

SEQ ID NO: 18749 - protein, 11 aa, Dengue virus
VEGLSGATWVD

SEQ ID NO: 18750 - protein, 11 aa, Dengue virus
EGLSGATWVDV

SEQ ID NO: 18751 - protein, 11 aa, Dengue virus
GLSGATWVDVV

SEQ ID NO: 18752 - protein, 11 aa, Dengue virus
LSGATWVDVVL

SEQ ID NO: 18753 - protein, 11 aa, Dengue virus
SGATWVDVVLE

SEQ ID NO: 18754 - protein, 11 aa, Dengue virus
GATWVDVVLEH

SEQ ID NO: 18755 - protein, 11 aa, Dengue virus
ATWVDVVLEHG

SEQ ID NO: 18756 - protein, 11 aa, Dengue virus
TWVDVVLEHGS

SEQ ID NO: 18757 - protein, 11 aa, Dengue virus
WVDVVLEHGSC

SEQ ID NO: 18758 - protein, 11 aa, Dengue virus
VDVVLEHGSCV

SEQ ID NO: 18759 - protein, 11 aa, Dengue virus
DVVLEHGSCVT

SEQ ID NO: 18760 - protein, 11 aa, Dengue virus
VVLEHGSCVTT

SEQ ID NO: 18761 - protein, 11 aa, Dengue virus
VLEHGSCVTTM

SEQ ID NO: 18762 - protein, 11 aa, Dengue virus
LEHGSCVTTMA

SEQ ID NO: 18763 - protein, 11 aa, Dengue virus
EHGSCVTTMAK

SEQ ID NO: 18764 - protein, 11 aa, Dengue virus
HGSCVTTMAKD

SEQ ID NO: 18765 - protein, 11 aa, Dengue virus
GSCVTTMAKDK

SEQ ID NO: 18766 - protein, 11 aa, Dengue virus
SCVTTMAKDKP

SEQ ID NO: 18767 - protein, 11 aa, Dengue virus
CVTTMAKDKPT

SEQ ID NO: 18768 - protein, 11 aa, Dengue virus
VTTMAKDKPTL

SEQ ID NO: 18769 - protein, 11 aa, Dengue virus
TTMAKDKPTLD

SEQ ID NO: 18770 - protein, 11 aa, Dengue virus
TMAKDKPTLDI

SEQ ID NO: 18771 - protein, 11 aa, Dengue virus
MAKDKPTLDIE

SEQ ID NO: 18772 - protein, 11 aa, Dengue virus
AKDKPTLDIEL

SEQ ID NO: 18773 - protein, 11 aa, Dengue virus
KDKPTLDIELL

SEQ ID NO: 18774 - protein, 11 aa, Dengue virus
DKPTLDIELLK

SEQ ID NO: 18775 - protein, 11 aa, Dengue virus
KPTLDIELLKT

SEQ ID NO: 18776 - protein, 11 aa, Dengue virus
PTLDIELLKTE

SEQ ID NO: 18777 - protein, 11 aa, Dengue virus
TLDIELLKTEV

SEQ ID NO: 18778 - protein, 11 aa, Dengue virus
LDIELLKTEVT

SEQ ID NO: 18779 - protein, 11 aa, Dengue virus
DIELLKTEVTN

SEQ ID NO: 18780 - protein, 11 aa, Dengue virus
IELLKTEVTNP

SEQ ID NO: 18781 - protein, 11 aa, Dengue virus
ELLKTEVTNPA

SEQ ID NO: 18782 - protein, 11 aa, Dengue virus
LLKTEVTNPAV

SEQ ID NO: 18783 - protein, 11 aa, Dengue virus
LKTEVTNPAVL

SEQ ID NO: 18784 - protein, 11 aa, Dengue virus
KTEVTNPAVLR

SEQ ID NO: 18785 - protein, 11 aa, Dengue virus
TEVTNPAVLRK

SEQ ID NO: 18786 - protein, 11 aa, Dengue virus
EVTNPAVLRKL

SEQ ID NO: 18787 - protein, 11 aa, Dengue virus
VTNPAVLRKLC

SEQ ID NO: 18788 - protein, 11 aa, Dengue virus
TNPAVLRKLCI

SEQ ID NO: 18789 - protein, 11 aa, Dengue virus
NPAVLRKLCIE

SEQ ID NO: 18790 - protein, 11 aa, Dengue virus
PAVLRKLCIEA

SEQ ID NO: 18791 - protein, 11 aa, Dengue virus
AVLRKLCIEAK

SEQ ID NO: 18792 - protein, 11 aa, Dengue virus
VLRKLCIEAKI

SEQ ID NO: 18793 - protein, 11 aa, Dengue virus
LRKLCIEAKIS

SEQ ID NO: 18794 - protein, 11 aa, Dengue virus
RKLCIEAKISN

SEQ ID NO: 18795 - protein, 11 aa, Dengue virus
KLCIEAKISNT

SEQ ID NO: 18796 - protein, 11 aa, Dengue virus
LCIEAKISNTT

SEQ ID NO: 18797 - protein, 11 aa, Dengue virus
CIEAKISNTTT

SEQ ID NO: 18798 - protein, 11 aa, Dengue virus
IEAKISNTTTD

SEQ ID NO: 18799 - protein, 11 aa, Dengue virus
EAKISNTTTDS

SEQ ID NO: 18800 - protein, 11 aa, Dengue virus
AKISNTTTDSR

SEQ ID NO: 18801 - protein, 11 aa, Dengue virus
KISNTTTDSRC

SEQ ID NO: 18802 - protein, 11 aa, Dengue virus
ISNTTTDSRCP

SEQ ID NO: 18803 - protein, 11 aa, Dengue virus
SNTTTDSRCPT

SEQ ID NO: 18804 - protein, 11 aa, Dengue virus
NTTTDSRCPTQ

SEQ ID NO: 18805 - protein, 11 aa, Dengue virus
TTTDSRCPTQG

SEQ ID NO: 18806 - protein, 11 aa, Dengue virus
TTDSRCPTQGE

SEQ ID NO: 18807 - protein, 11 aa, Dengue virus
TDSRCPTQGEA

SEQ ID NO: 18808 - protein, 11 aa, Dengue virus
DSRCPTQGEAT

SEQ ID NO: 18809 - protein, 11 aa, Dengue virus
SRCPTQGEATL

SEQ ID NO: 18810 - protein, 11 aa, Dengue virus
RCPTQGEATLV

SEQ ID NO: 18811 - protein, 11 aa, Dengue virus
CPTQGEATLVE

SEQ ID NO: 18812 - protein, 11 aa, Dengue virus
PTQGEATLVEE

SEQ ID NO: 18813 - protein, 11 aa, Dengue virus
TQGEATLVEEQ

SEQ ID NO: 18814 - protein, 11 aa, Dengue virus
QGEATLVEEQD

SEQ ID NO: 18815 - protein, 11 aa, Dengue virus
GEATLVEEQDA

SEQ ID NO: 18816 - protein, 11 aa, Dengue virus
EATLVEEQDAN

SEQ ID NO: 18817 - protein, 11 aa, Dengue virus
ATLVEEQDANF

SEQ ID NO: 18818 - protein, 11 aa, Dengue virus
TLVEEQDANFV

SEQ ID NO: 18819 - protein, 11 aa, Dengue virus
LVEEQDANFVC

SEQ ID NO: 18820 - protein, 11 aa, Dengue virus
VEEQDANFVCR

SEQ ID NO: 18821 - protein, 11 aa, Dengue virus
EEQDANFVCRR

SEQ ID NO: 18822 - protein, 11 aa, Dengue virus
EQDANFVCRRT

SEQ ID NO: 18823 - protein, 11 aa, Dengue virus
QDANFVCRRTF

SEQ ID NO: 18824 - protein, 11 aa, Dengue virus
DANFVCRRTFV

SEQ ID NO: 18825 - protein, 11 aa, Dengue virus
ANFVCRRTFVD

SEQ ID NO: 18826 - protein, 11 aa, Dengue virus
NFVCRRTFVDR

SEQ ID NO: 18827 - protein, 11 aa, Dengue virus
FVCRRTFVDRG

SEQ ID NO: 18828 - protein, 11 aa, Dengue virus
VCRRTFVDRGW

SEQ ID NO: 18829 - protein, 11 aa, Dengue virus
CRRTFVDRGWG

SEQ ID NO: 18830 - protein, 11 aa, Dengue virus
RRTFVDRGWGN

SEQ ID NO: 18831 - protein, 11 aa, Dengue virus
RTFVDRGWGNG

SEQ ID NO: 18832 - protein, 11 aa, Dengue virus
TFVDRGWGNGC

SEQ ID NO: 18833 - protein, 11 aa, Dengue virus
FVDRGWGNGCG

SEQ ID NO: 18834 - protein, 11 aa, Dengue virus
VDRGWGNGCGL

SEQ ID NO: 18835 - protein, 11 aa, Dengue virus
DRGWGNGCGLF

SEQ ID NO: 18836 - protein, 11 aa, Dengue virus
RGWGNGCGLFG

SEQ ID NO: 18837 - protein, 11 aa, Dengue virus
GWGNGCGLFGK

SEQ ID NO: 18838 - protein, 11 aa, Dengue virus
WGNGCGLFGKG

SEQ ID NO: 18839 - protein, 11 aa, Dengue virus
GNGCGLFGKGS

SEQ ID NO: 18840 - protein, 11 aa, Dengue virus
NGCGLFGKGSL

SEQ ID NO: 18841 - protein, 11 aa, Dengue virus
GCGLFGKGSLI

SEQ ID NO: 18842 - protein, 11 aa, Dengue virus
CGLFGKGSLIT

SEQ ID NO: 18843 - protein, 11 aa, Dengue virus
GLFGKGSLITC

SEQ ID NO: 18844 - protein, 11 aa, Dengue virus
LFGKGSLITCA

SEQ ID NO: 18845 - protein, 11 aa, Dengue virus
FGKGSLITCAK

SEQ ID NO: 18846 - protein, 11 aa, Dengue virus
GKGSLITCAKF

SEQ ID NO: 18847 - protein, 11 aa, Dengue virus
KGSLITCAKFK

SEQ ID NO: 18848 - protein, 11 aa, Dengue virus
GSLITCAKFKC

SEQ ID NO: 18849 - protein, 11 aa, Dengue virus
SLITCAKFKCV

SEQ ID NO: 18850 - protein, 11 aa, Dengue virus
LITCAKFKCVT

SEQ ID NO: 18851 - protein, 11 aa, Dengue virus
ITCAKFKCVTK

SEQ ID NO: 18852 - protein, 11 aa, Dengue virus
TCAKFKCVTKL

SEQ ID NO: 18853 - protein, 11 aa, Dengue virus
CAKFKCVTKLE

SEQ ID NO: 18854 - protein, 11 aa, Dengue virus
AKFKCVTKLEG

SEQ ID NO: 18855 - protein, 11 aa, Dengue virus
KFKCVTKLEGK

SEQ ID NO: 18856 - protein, 11 aa, Dengue virus
FKCVTKLEGKI

SEQ ID NO: 18857 - protein, 11 aa, Dengue virus
KCVTKLEGKIV

SEQ ID NO: 18858 - protein, 11 aa, Dengue virus
CVTKLEGKIVQ

SEQ ID NO: 18859 - protein, 11 aa, Dengue virus
TKLEGKIVQYE

SEQ ID NO: 18860 - protein, 11 aa, Dengue virus
KLEGKIVQYEN

SEQ ID NO: 18861 - protein, 11 aa, Dengue virus
LEGKIVQYENL

SEQ ID NO: 18862 - protein, 11 aa, Dengue virus
EGKIVQYENLK

SEQ ID NO: 18863 - protein, 11 aa, Dengue virus
GKIVQYENLKY

SEQ ID NO: 18864 - protein, 11 aa, Dengue virus
KIVQYENLKYS

SEQ ID NO: 18865 - protein, 11 aa, Dengue virus
IVQYENLKYSV

SEQ ID NO: 18866 - protein, 11 aa, Dengue virus
VQYENLKYSVI

SEQ ID NO: 18867 - protein, 11 aa, Dengue virus
QYENLKYSVIV

SEQ ID NO: 18868 - protein, 11 aa, Dengue virus
YENLKYSVIVT

SEQ ID NO: 18869 - protein, 11 aa, Dengue virus
ENLKYSVIVTV

SEQ ID NO: 18870 - protein, 11 aa, Dengue virus
NLKYSVIVTVH

SEQ ID NO: 18871 - protein, 11 aa, Dengue virus
LKYSVIVTVHT

SEQ ID NO: 18872 - protein, 11 aa, Dengue virus
KYSVIVTVHTG

SEQ ID NO: 18873 - protein, 11 aa, Dengue virus
YSVIVTVHTGD

SEQ ID NO: 18874 - protein, 11 aa, Dengue virus
SVIVTVHTGDQ

SEQ ID NO: 18875 - protein, 11 aa, Dengue virus
VIVTVHTGDQH

SEQ ID NO: 18876 - protein, 11 aa, Dengue virus
IVTVHTGDQHQ

SEQ ID NO: 18877 - protein, 11 aa, Dengue virus
VTVHTGDQHQV

SEQ ID NO: 18878 - protein, 11 aa, Dengue virus
TVHTGDQHQVG

SEQ ID NO: 18879 - protein, 11 aa, Dengue virus
VHTGDQHQVGN

SEQ ID NO: 18880 - protein, 11 aa, Dengue virus
HTGDQHQVGNE

SEQ ID NO: 18881 - protein, 11 aa, Dengue virus
TGDQHQVGNES

SEQ ID NO: 18882 - protein, 11 aa, Dengue virus
GDQHQVGNEST

SEQ ID NO: 18883 - protein, 11 aa, Dengue virus
DQHQVGNESTE

SEQ ID NO: 18884 - protein, 11 aa, Dengue virus
QHQVGNESTEH

SEQ ID NO: 18885 - protein, 11 aa, Dengue virus
HQVGNESTEHG

SEQ ID NO: 18886 - protein, 11 aa, Dengue virus
QVGNESTEHGT

SEQ ID NO: 18887 - protein, 11 aa, Dengue virus
VGNESTEHGTT

SEQ ID NO: 18888 - protein, 11 aa, Dengue virus
GNESTEHGTTA

SEQ ID NO: 18889 - protein, 11 aa, Dengue virus
NESTEHGTTAT

SEQ ID NO: 18890 - protein, 11 aa, Dengue virus
ESTEHGTTATI

SEQ ID NO: 18891 - protein, 11 aa, Dengue virus
STEHGTTATIT

SEQ ID NO: 18892 - protein, 11 aa, Dengue virus
TEHGTTATITP

SEQ ID NO: 18893 - protein, 11 aa, Dengue virus
EHGTTATITPQ

SEQ ID NO: 18894 - protein, 11 aa, Dengue virus
HGTTATITPQA

SEQ ID NO: 18895 - protein, 11 aa, Dengue virus
GTTATITPQAP

SEQ ID NO: 18896 - protein, 11 aa, Dengue virus
TTATITPQAPT

SEQ ID NO: 18897 - protein, 11 aa, Dengue virus
TATITPQAPTT

SEQ ID NO: 18898 - protein, 11 aa, Dengue virus
ATITPQAPTTE

SEQ ID NO: 18899 - protein, 11 aa, Dengue virus
TITPQAPTTEI

SEQ ID NO: 18900 - protein, 11 aa, Dengue virus
ITPQAPTTEIQ

SEQ ID NO: 18901 - protein, 11 aa, Dengue virus
TPQAPTTEIQL

SEQ ID NO: 18902 - protein, 11 aa, Dengue virus
PQAPTTEIQLT

SEQ ID NO: 18903 - protein, 11 aa, Dengue virus
QAPTTEIQLTD

SEQ ID NO: 18904 - protein, 11 aa, Dengue virus
APTTEIQLTDY

SEQ ID NO: 18905 - protein, 11 aa, Dengue virus
PTTEIQLTDYG

SEQ ID NO: 18906 - protein, 11 aa, Dengue virus
TTEIQLTDYGA

SEQ ID NO: 18907 - protein, 11 aa, Dengue virus
TEIQLTDYGAL

SEQ ID NO: 18908 - protein, 11 aa, Dengue virus
EIQLTDYGALT

SEQ ID NO: 18909 - protein, 11 aa, Dengue virus
IQLTDYGALTL

SEQ ID NO: 18910 - protein, 11 aa, Dengue virus
QLTDYGALTLD

SEQ ID NO: 18911 - protein, 11 aa, Dengue virus
LTDYGALTLDC

SEQ ID NO: 18912 - protein, 11 aa, Dengue virus
TDYGALTLDCS

SEQ ID NO: 18913 - protein, 11 aa, Dengue virus
DYGALTLDCSP

SEQ ID NO: 18914 - protein, 11 aa, Dengue virus
YGALTLDCSPR

SEQ ID NO: 18915 - protein, 11 aa, Dengue virus
GALTLDCSPRT

SEQ ID NO: 18916 - protein, 11 aa, Dengue virus
ALTLDCSPRTG

SEQ ID NO: 18917 - protein, 11 aa, Dengue virus
LTLDCSPRTGL

SEQ ID NO: 18918 - protein, 11 aa, Dengue virus
TLDCSPRTGLD

SEQ ID NO: 18919 - protein, 11 aa, Dengue virus
LDCSPRTGLDF

SEQ ID NO: 18920 - protein, 11 aa, Dengue virus
DCSPRTGLDFN

SEQ ID NO: 18921 - protein, 11 aa, Dengue virus
CSPRTGLDFNE

SEQ ID NO: 18922 - protein, 11 aa, Dengue virus
SPRTGLDFNEM

SEQ ID NO: 18923 - protein, 11 aa, Dengue virus
PRTGLDFNEMV

SEQ ID NO: 18924 - protein, 11 aa, Dengue virus
RTGLDFNEMVL

SEQ ID NO: 18925 - protein, 11 aa, Dengue virus
TGLDFNEMVLL

SEQ ID NO: 18926 - protein, 11 aa, Dengue virus
GLDFNEMVLLT

SEQ ID NO: 18927 - protein, 11 aa, Dengue virus
LDFNEMVLLTM

SEQ ID NO: 18928 - protein, 11 aa, Dengue virus
DFNEMVLLTMK

SEQ ID NO: 18929 - protein, 11 aa, Dengue virus
FNEMVLLTMKE

SEQ ID NO: 18930 - protein, 11 aa, Dengue virus
NEMVLLTMKEK

SEQ ID NO: 18931 - protein, 11 aa, Dengue virus
EMVLLTMKEKS

SEQ ID NO: 18932 - protein, 11 aa, Dengue virus
MVLLTMKEKSW

SEQ ID NO: 18933 - protein, 11 aa, Dengue virus
VLLTMKEKSWL

SEQ ID NO: 18934 - protein, 11 aa, Dengue virus
LLTMKEKSWLV

SEQ ID NO: 18935 - protein, 11 aa, Dengue virus
LTMKEKSWLVH

SEQ ID NO: 18936 - protein, 11 aa, Dengue virus
TMKEKSWLVHK

SEQ ID NO: 18937 - protein, 11 aa, Dengue virus
MKEKSWLVHKQ

SEQ ID NO: 18938 - protein, 11 aa, Dengue virus
KEKSWLVHKQW

SEQ ID NO: 18939 - protein, 11 aa, Dengue virus
EKSWLVHKQWF

SEQ ID NO: 18940 - protein, 11 aa, Dengue virus
KSWLVHKQWFL

SEQ ID NO: 18941 - protein, 11 aa, Dengue virus
SWLVHKQWFLD

SEQ ID NO: 18942 - protein, 11 aa, Dengue virus
WLVHKQWFLDL

SEQ ID NO: 18943 - protein, 11 aa, Dengue virus
LVHKQWFLDLP

SEQ ID NO: 18944 - protein, 11 aa, Dengue virus
VHKQWFLDLPL

SEQ ID NO: 18945 - protein, 11 aa, Dengue virus
HKQWFLDLPLP

SEQ ID NO: 18946 - protein, 11 aa, Dengue virus
KQWFLDLPLPW

SEQ ID NO: 18947 - protein, 11 aa, Dengue virus
QWFLDLPLPWT

SEQ ID NO: 18948 - protein, 11 aa, Dengue virus
WFLDLPLPWTS

SEQ ID NO: 18949 - protein, 11 aa, Dengue virus
FLDLPLPWTSG

SEQ ID NO: 18950 - protein, 11 aa, Dengue virus
LDLPLPWTSGA

SEQ ID NO: 18951 - protein, 11 aa, Dengue virus
DLPLPWTSGAS

SEQ ID NO: 18952 - protein, 11 aa, Dengue virus
LPLPWTSGAST

SEQ ID NO: 18953 - protein, 11 aa, Dengue virus
TSQETWNRQDL

SEQ ID NO: 18954 - protein, 11 aa, Dengue virus
SQETWNRQDLL

SEQ ID NO: 18955 - protein, 11 aa, Dengue virus
QETWNRQDLLV

SEQ ID NO: 18956 - protein, 11 aa, Dengue virus
ETWNRQDLLVT

SEQ ID NO: 18957 - protein, 11 aa, Dengue virus
TWNRQDLLVTF

SEQ ID NO: 18958 - protein, 11 aa, Dengue virus
WNRQDLLVTFK

SEQ ID NO: 18959 - protein, 11 aa, Dengue virus
NRQDLLVTFKT

SEQ ID NO: 18960 - protein, 11 aa, Dengue virus
RQDLLVTFKTA

SEQ ID NO: 18961 - protein, 11 aa, Dengue virus
QDLLVTFKTAH

SEQ ID NO: 18962 - protein, 11 aa, Dengue virus
DLLVTFKTAHA

SEQ ID NO: 18963 - protein, 11 aa, Dengue virus
LLVTFKTAHAK

SEQ ID NO: 18964 - protein, 11 aa, Dengue virus
LVTFKTAHAKK

SEQ ID NO: 18965 - protein, 11 aa, Dengue virus
VTFKTAHAKKQ

SEQ ID NO: 18966 - protein, 11 aa, Dengue virus
TFKTAHAKKQE

SEQ ID NO: 18967 - protein, 11 aa, Dengue virus
FKTAHAKKQEV

SEQ ID NO: 18968 - protein, 11 aa, Dengue virus
KTAHAKKQEVV

SEQ ID NO: 18969 - protein, 11 aa, Dengue virus
TAHAKKQEVVV

SEQ ID NO: 18970 - protein, 11 aa, Dengue virus
AHAKKQEVVVL

SEQ ID NO: 18971 - protein, 11 aa, Dengue virus
HAKKQEVVVLG

SEQ ID NO: 18972 - protein, 11 aa, Dengue virus
AKKQEVVVLGS

SEQ ID NO: 18973 - protein, 11 aa, Dengue virus
KKQEVVVLGSQ

SEQ ID NO: 18974 - protein, 11 aa, Dengue virus
KQEVVVLGSQE

SEQ ID NO: 18975 - protein, 11 aa, Dengue virus
QEVVVLGSQEG

SEQ ID NO: 18976 - protein, 11 aa, Dengue virus
EVVVLGSQEGA

SEQ ID NO: 18977 - protein, 11 aa, Dengue virus
VVVLGSQEGAM

SEQ ID NO: 18978 - protein, 11 aa, Dengue virus
VVLGSQEGAMH

SEQ ID NO: 18979 - protein, 11 aa, Dengue virus
VLGSQEGAMHT

SEQ ID NO: 18980 - protein, 11 aa, Dengue virus
LGSQEGAMHTA

SEQ ID NO: 18981 - protein, 11 aa, Dengue virus
GSQEGAMHTAL

SEQ ID NO: 18982 - protein, 11 aa, Dengue virus
SQEGAMHTALT

SEQ ID NO: 18983 - protein, 11 aa, Dengue virus
QEGAMHTALTG

SEQ ID NO: 18984 - protein, 11 aa, Dengue virus
EGAMHTALTGA

SEQ ID NO: 18985 - protein, 11 aa, Dengue virus
GAMHTALTGAT

SEQ ID NO: 18986 - protein, 11 aa, Dengue virus
AMHTALTGATE

SEQ ID NO: 18987 - protein, 11 aa, Dengue virus
MHTALTGATEI

SEQ ID NO: 18988 - protein, 11 aa, Dengue virus
HTALTGATEIQ

SEQ ID NO: 18989 - protein, 11 aa, Dengue virus
TALTGATEIQT

SEQ ID NO: 18990 - protein, 11 aa, Dengue virus
ALTGATEIQTS

SEQ ID NO: 18991 - protein, 11 aa, Dengue virus
LTGATEIQTSG

SEQ ID NO: 18992 - protein, 11 aa, Dengue virus
TGATEIQTSGT

SEQ ID NO: 18993 - protein, 11 aa, Dengue virus
GATEIQTSGTT

SEQ ID NO: 18994 - protein, 11 aa, Dengue virus
ATEIQTSGTTT

SEQ ID NO: 18995 - protein, 11 aa, Dengue virus
TEIQTSGTTTI

SEQ ID NO: 18996 - protein, 11 aa, Dengue virus
EIQTSGTTTIF

SEQ ID NO: 18997 - protein, 11 aa, Dengue virus
IQTSGTTTIFA

SEQ ID NO: 18998 - protein, 11 aa, Dengue virus
QTSGTTTIFAG

SEQ ID NO: 18999 - protein, 11 aa, Dengue virus
TSGTTTIFAGH

SEQ ID NO: 19000 - protein, 11 aa, Dengue virus
SGTTTIFAGHL

SEQ ID NO: 19001 - protein, 11 aa, Dengue virus
GTTTIFAGHLK

SEQ ID NO: 19002 - protein, 11 aa, Dengue virus
TTTIFAGHLKC

SEQ ID NO: 19003 - protein, 11 aa, Dengue virus
TTIFAGHLKCR

SEQ ID NO: 19004 - protein, 11 aa, Dengue virus
TIFAGHLKCRL

SEQ ID NO: 19005 - protein, 11 aa, Dengue virus
IFAGHLKCRLK

SEQ ID NO: 19006 - protein, 11 aa, Dengue virus
FAGHLKCRLKM

SEQ ID NO: 19007 - protein, 11 aa, Dengue virus
AGHLKCRLKMD

SEQ ID NO: 19008 - protein, 11 aa, Dengue virus
GHLKCRLKMDK

SEQ ID NO: 19009 - protein, 11 aa, Dengue virus
HLKCRLKMDKL

SEQ ID NO: 19010 - protein, 11 aa, Dengue virus
LKCRLKMDKLT

SEQ ID NO: 19011 - protein, 11 aa, Dengue virus
KCRLKMDKLTL

SEQ ID NO: 19012 - protein, 11 aa, Dengue virus
CRLKMDKLTLK

SEQ ID NO: 19013 - protein, 11 aa, Dengue virus
RLKMDKLTLKG

SEQ ID NO: 19014 - protein, 11 aa, Dengue virus
LKMDKLTLKGM

SEQ ID NO: 19015 - protein, 11 aa, Dengue virus
KMDKLTLKGMS

SEQ ID NO: 19016 - protein, 11 aa, Dengue virus
MDKLTLKGMSY

SEQ ID NO: 19017 - protein, 11 aa, Dengue virus
DKLTLKGMSYV

SEQ ID NO: 19018 - protein, 11 aa, Dengue virus
KLTLKGMSYVM

SEQ ID NO: 19019 - protein, 11 aa, Dengue virus
LTLKGMSYVMC

SEQ ID NO: 19020 - protein, 11 aa, Dengue virus
TLKGMSYVMCT

SEQ ID NO: 19021 - protein, 11 aa, Dengue virus
LKGMSYVMCTG

SEQ ID NO: 19022 - protein, 11 aa, Dengue virus
SYVMCTGSFKL

SEQ ID NO: 19023 - protein, 11 aa, Dengue virus
YVMCTGSFKLE

SEQ ID NO: 19024 - protein, 11 aa, Dengue virus
VMCTGSFKLEK

SEQ ID NO: 19025 - protein, 11 aa, Dengue virus
MCTGSFKLEKE

SEQ ID NO: 19026 - protein, 11 aa, Dengue virus
CTGSFKLEKEV

SEQ ID NO: 19027 - protein, 11 aa, Dengue virus
TGSFKLEKEVA

SEQ ID NO: 19028 - protein, 11 aa, Dengue virus
GSFKLEKEVAE

SEQ ID NO: 19029 - protein, 11 aa, Dengue virus
SFKLEKEVAET

SEQ ID NO: 19030 - protein, 11 aa, Dengue virus
FKLEKEVAETQ

SEQ ID NO: 19031 - protein, 11 aa, Dengue virus
KLEKEVAETQH

SEQ ID NO: 19032 - protein, 11 aa, Dengue virus
LEKEVAETQHG

SEQ ID NO: 19033 - protein, 11 aa, Dengue virus
EKEVAETQHGT

SEQ ID NO: 19034 - protein, 11 aa, Dengue virus
KEVAETQHGTV

SEQ ID NO: 19035 - protein, 11 aa, Dengue virus
EVAETQHGTVL

SEQ ID NO: 19036 - protein, 11 aa, Dengue virus
VAETQHGTVLV

SEQ ID NO: 19037 - protein, 11 aa, Dengue virus
AETQHGTVLVQ

SEQ ID NO: 19038 - protein, 11 aa, Dengue virus
ETQHGTVLVQI

SEQ ID NO: 19039 - protein, 11 aa, Dengue virus
TQHGTVLVQIK

SEQ ID NO: 19040 - protein, 11 aa, Dengue virus
QHGTVLVQIKY

SEQ ID NO: 19041 - protein, 11 aa, Dengue virus
HGTVLVQIKYE

SEQ ID NO: 19042 - protein, 11 aa, Dengue virus
GTVLVQIKYEG

SEQ ID NO: 19043 - protein, 11 aa, Dengue virus
TVLVQIKYEGT

SEQ ID NO: 19044 - protein, 11 aa, Dengue virus
VLVQIKYEGTD

SEQ ID NO: 19045 - protein, 11 aa, Dengue virus
LVQIKYEGTDA

SEQ ID NO: 19046 - protein, 11 aa, Dengue virus
VQIKYEGTDAP

SEQ ID NO: 19047 - protein, 11 aa, Dengue virus
QIKYEGTDAPC

SEQ ID NO: 19048 - protein, 11 aa, Dengue virus
IKYEGTDAPCK

SEQ ID NO: 19049 - protein, 11 aa, Dengue virus
KYEGTDAPCKI

SEQ ID NO: 19050 - protein, 11 aa, Dengue virus
YEGTDAPCKIP

SEQ ID NO: 19051 - protein, 11 aa, Dengue virus
EGTDAPCKIPF

SEQ ID NO: 19052 - protein, 11 aa, Dengue virus
GTDAPCKIPFS

SEQ ID NO: 19053 - protein, 11 aa, Dengue virus
TDAPCKIPFST

SEQ ID NO: 19054 - protein, 11 aa, Dengue virus
DAPCKIPFSTQ

SEQ ID NO: 19055 - protein, 11 aa, Dengue virus
APCKIPFSTQD

SEQ ID NO: 19056 - protein, 11 aa, Dengue virus
PCKIPFSTQDE

SEQ ID NO: 19057 - protein, 11 aa, Dengue virus
QDEKGVTQNGR

SEQ ID NO: 19058 - protein, 11 aa, Dengue virus
GVTQNGRLITA

SEQ ID NO: 19059 - protein, 11 aa, Dengue virus
VTQNGRLITAN

SEQ ID NO: 19060 - protein, 11 aa, Dengue virus
TQNGRLITANP

SEQ ID NO: 19061 - protein, 11 aa, Dengue virus
QNGRLITANPI

SEQ ID NO: 19062 - protein, 11 aa, Dengue virus
NGRLITANPIV

SEQ ID NO: 19063 - protein, 11 aa, Dengue virus
GRLITANPIVT

SEQ ID NO: 19064 - protein, 11 aa, Dengue virus
RLITANPIVTD

SEQ ID NO: 19065 - protein, 11 aa, Dengue virus
LITANPIVTDK

SEQ ID NO: 19066 - protein, 11 aa, Dengue virus
ITANPIVTDKE

SEQ ID NO: 19067 - protein, 11 aa, Dengue virus
TANPIVTDKEK

SEQ ID NO: 19068 - protein, 11 aa, Dengue virus
ANPIVTDKEKP

SEQ ID NO: 19069 - protein, 11 aa, Dengue virus
NPIVTDKEKPV

SEQ ID NO: 19070 - protein, 11 aa, Dengue virus
PIVTDKEKPVN

SEQ ID NO: 19071 - protein, 11 aa, Dengue virus
IVTDKEKPVNI

SEQ ID NO: 19072 - protein, 11 aa, Dengue virus
VTDKEKPVNIE

SEQ ID NO: 19073 - protein, 11 aa, Dengue virus
TDKEKPVNIEA

SEQ ID NO: 19074 - protein, 11 aa, Dengue virus
DKEKPVNIEAE

SEQ ID NO: 19075 - protein, 11 aa, Dengue virus
KEKPVNIEAEP

SEQ ID NO: 19076 - protein, 11 aa, Dengue virus
EKPVNIEAEPP

SEQ ID NO: 19077 - protein, 11 aa, Dengue virus
KPVNIEAEPPF

SEQ ID NO: 19078 - protein, 11 aa, Dengue virus
PVNIEAEPPFG

SEQ ID NO: 19079 - protein, 11 aa, Dengue virus
VNIEAEPPFGE

SEQ ID NO: 19080 - protein, 11 aa, Dengue virus
NIEAEPPFGES

SEQ ID NO: 19081 - protein, 11 aa, Dengue virus
IEAEPPFGESY

SEQ ID NO: 19082 - protein, 11 aa, Dengue virus
EAEPPFGESYI

SEQ ID NO: 19083 - protein, 11 aa, Dengue virus
AEPPFGESYIV

SEQ ID NO: 19084 - protein, 11 aa, Dengue virus
EPPFGESYIVI

SEQ ID NO: 19085 - protein, 11 aa, Dengue virus
PPFGESYIVIG

SEQ ID NO: 19086 - protein, 11 aa, Dengue virus
GAGEKALKLSW

SEQ ID NO: 19087 - protein, 11 aa, Dengue virus
AGEKALKLSWF

SEQ ID NO: 19088 - protein, 11 aa, Dengue virus
GEKALKLSWFK

SEQ ID NO: 19089 - protein, 11 aa, Dengue virus
EKALKLSWFKK

SEQ ID NO: 19090 - protein, 11 aa, Dengue virus
KALKLSWFKKG

SEQ ID NO: 19091 - protein, 11 aa, Dengue virus
ALKLSWFKKGS

SEQ ID NO: 19092 - protein, 11 aa, Dengue virus
LKLSWFKKGSS

SEQ ID NO: 19093 - protein, 11 aa, Dengue virus
KLSWFKKGSSI

SEQ ID NO: 19094 - protein, 11 aa, Dengue virus
LSWFKKGSSIG

SEQ ID NO: 19095 - protein, 11 aa, Dengue virus
SWFKKGSSIGK

SEQ ID NO: 19096 - protein, 11 aa, Dengue virus
WFKKGSSIGKM

SEQ ID NO: 19097 - protein, 11 aa, Dengue virus
FKKGSSIGKMF

SEQ ID NO: 19098 - protein, 11 aa, Dengue virus
KKGSSIGKMFE

SEQ ID NO: 19099 - protein, 11 aa, Dengue virus
KGSSIGKMFEA

SEQ ID NO: 19100 - protein, 11 aa, Dengue virus
GSSIGKMFEAT

SEQ ID NO: 19101 - protein, 11 aa, Dengue virus
SSIGKMFEATA

SEQ ID NO: 19102 - protein, 11 aa, Dengue virus
SIGKMFEATAR

SEQ ID NO: 19103 - protein, 11 aa, Dengue virus
IGKMFEATARG

SEQ ID NO: 19104 - protein, 11 aa, Dengue virus
GKMFEATARGA

SEQ ID NO: 19105 - protein, 11 aa, Dengue virus
KMFEATARGAR

SEQ ID NO: 19106 - protein, 11 aa, Dengue virus
MFEATARGARR

SEQ ID NO: 19107 - protein, 11 aa, Dengue virus
FEATARGARRM

SEQ ID NO: 19108 - protein, 11 aa, Dengue virus
EATARGARRMA

SEQ ID NO: 19109 - protein, 11 aa, Dengue virus
ATARGARRMAI

SEQ ID NO: 19110 - protein, 11 aa, Dengue virus
TARGARRMAIL

SEQ ID NO: 19111 - protein, 11 aa, Dengue virus
ARGARRMAILG

SEQ ID NO: 19112 - protein, 11 aa, Dengue virus
RGARRMAILGD

SEQ ID NO: 19113 - protein, 11 aa, Dengue virus
GARRMAILGDT

SEQ ID NO: 19114 - protein, 11 aa, Dengue virus
ARRMAILGDTA

SEQ ID NO: 19115 - protein, 11 aa, Dengue virus
RRMAILGDTAW

SEQ ID NO: 19116 - protein, 11 aa, Dengue virus
RMAILGDTAWD

SEQ ID NO: 19117 - protein, 11 aa, Dengue virus
MAILGDTAWDF

SEQ ID NO: 19118 - protein, 11 aa, Dengue virus
AILGDTAWDFG

SEQ ID NO: 19119 - protein, 11 aa, Dengue virus
ILGDTAWDFGS

SEQ ID NO: 19120 - protein, 11 aa, Dengue virus
LGDTAWDFGSI

SEQ ID NO: 19121 - protein, 11 aa, Dengue virus
GDTAWDFGSIG

SEQ ID NO: 19122 - protein, 11 aa, Dengue virus
DTAWDFGSIGG

SEQ ID NO: 19123 - protein, 11 aa, Dengue virus
TAWDFGSIGGV

SEQ ID NO: 19124 - protein, 11 aa, Dengue virus
AWDFGSIGGVF

SEQ ID NO: 19125 - protein, 11 aa, Dengue virus
WDFGSIGGVFT

SEQ ID NO: 19126 - protein, 11 aa, Dengue virus
DFGSIGGVFTS

SEQ ID NO: 19127 - protein, 11 aa, Dengue virus
GKLVHQIFGTA

SEQ ID NO: 19128 - protein, 11 aa, Dengue virus
KLVHQIFGTAY

SEQ ID NO: 19129 - protein, 11 aa, Dengue virus
LVHQIFGTAYG

SEQ ID NO: 19130 - protein, 11 aa, Dengue virus
VHQIFGTAYGV

SEQ ID NO: 19131 - protein, 11 aa, Dengue virus
HQIFGTAYGVL

SEQ ID NO: 19132 - protein, 11 aa, Dengue virus
QIFGTAYGVLF

SEQ ID NO: 19133 - protein, 11 aa, Dengue virus
IFGTAYGVLFS

SEQ ID NO: 19134 - protein, 11 aa, Dengue virus
FGTAYGVLFSG

SEQ ID NO: 19135 - protein, 11 aa, Dengue virus
GTAYGVLFSGV

SEQ ID NO: 19136 - protein, 11 aa, Dengue virus
TAYGVLFSGVS

SEQ ID NO: 19137 - protein, 11 aa, Dengue virus
AYGVLFSGVSW

SEQ ID NO: 19138 - protein, 11 aa, Dengue virus
YGVLFSGVSWT

SEQ ID NO: 19139 - protein, 11 aa, Dengue virus
GVLFSGVSWTM

SEQ ID NO: 19140 - protein, 11 aa, Dengue virus
VLFSGVSWTMK

SEQ ID NO: 19141 - protein, 11 aa, Dengue virus
LFSGVSWTMKI

SEQ ID NO: 19142 - protein, 11 aa, Dengue virus
FSGVSWTMKIG

SEQ ID NO: 19143 - protein, 11 aa, Dengue virus
SGVSWTMKIGI

SEQ ID NO: 19144 - protein, 11 aa, Dengue virus
GVSWTMKIGIG

SEQ ID NO: 19145 - protein, 11 aa, Dengue virus
VSWTMKIGIGV

SEQ ID NO: 19146 - protein, 11 aa, Dengue virus
SWTMKIGIGVL

SEQ ID NO: 19147 - protein, 11 aa, Dengue virus
WTMKIGIGVLL

SEQ ID NO: 19148 - protein, 11 aa, Dengue virus
TMKIGIGVLLT

SEQ ID NO: 19149 - protein, 11 aa, Dengue virus
MKIGIGVLLTW

SEQ ID NO: 19150 - protein, 11 aa, Dengue virus
KIGIGVLLTWL

SEQ ID NO: 19151 - protein, 11 aa, Dengue virus
IGIGVLLTWLG

SEQ ID NO: 19152 - protein, 11 aa, Dengue virus
GIGVLLTWLGL

SEQ ID NO: 19153 - protein, 11 aa, Dengue virus
IGVLLTWLGLN

SEQ ID NO: 19154 - protein, 11 aa, Dengue virus
GVLLTWLGLNS

SEQ ID NO: 19155 - protein, 11 aa, Dengue virus
VLLTWLGLNSR

SEQ ID NO: 19156 - protein, 11 aa, Dengue virus
LLTWLGLNSRS

SEQ ID NO: 19157 - protein, 11 aa, Dengue virus
LTWLGLNSRST

SEQ ID NO: 19158 - protein, 11 aa, Dengue virus
TWLGLNSRSTS

SEQ ID NO: 19159 - protein, 11 aa, Dengue virus
WLGLNSRSTSL

SEQ ID NO: 19160 - protein, 11 aa, Dengue virus
LGLNSRSTSLS

SEQ ID NO: 19161 - protein, 11 aa, Dengue virus
GLNSRSTSLSM

SEQ ID NO: 19162 - protein, 11 aa, Dengue virus
LNSRSTSLSMT

SEQ ID NO: 19163 - protein, 11 aa, Dengue virus
NSRSTSLSMTC

SEQ ID NO: 19164 - protein, 11 aa, Dengue virus
SRSTSLSMTCI

SEQ ID NO: 19165 - protein, 11 aa, Dengue virus
RSTSLSMTCIA

SEQ ID NO: 19166 - protein, 11 aa, Dengue virus
STSLSMTCIAV

SEQ ID NO: 19167 - protein, 11 aa, Dengue virus
TSLSMTCIAVG

SEQ ID NO: 19168 - protein, 11 aa, Dengue virus
SLSMTCIAVGL

SEQ ID NO: 19169 - protein, 11 aa, Dengue virus
SMTCIAVGLVT

SEQ ID NO: 19170 - protein, 11 aa, Dengue virus
MTCIAVGLVTL

SEQ ID NO: 19171 - protein, 11 aa, Dengue virus
TCIAVGLVTLY

SEQ ID NO: 19172 - protein, 11 aa, Dengue virus
CIAVGLVTLYL

SEQ ID NO: 19173 - protein, 11 aa, Dengue virus
IAVGLVTLYLG

SEQ ID NO: 19174 - protein, 11 aa, Dengue virus
AVGLVTLYLGV

SEQ ID NO: 19175 - protein, 11 aa, Dengue virus
VGLVTLYLGVM

SEQ ID NO: 19176 - protein, 11 aa, Dengue virus
GLVTLYLGVMV

SEQ ID NO: 19177 - protein, 11 aa, Dengue virus
LVTLYLGVMVQ

SEQ ID NO: 19178 - protein, 11 aa, Dengue virus
VTLYLGVMVQA

SEQ ID NO: 19179 - protein, 11 aa, Dengue virus
TLYLGVMVQAD

SEQ ID NO: 19180 - protein, 11 aa, Dengue virus
LYLGVMVQADS

SEQ ID NO: 19181 - protein, 11 aa, Dengue virus
YLGVMVQADSG

SEQ ID NO: 19182 - protein, 11 aa, Dengue virus
LGVMVQADSGC

SEQ ID NO: 19183 - protein, 11 aa, Dengue virus
GVMVQADSGCV

SEQ ID NO: 19184 - protein, 11 aa, Dengue virus
VMVQADSGCVI

SEQ ID NO: 19185 - protein, 11 aa, Dengue virus
MVQADSGCVIN

SEQ ID NO: 19186 - protein, 11 aa, Dengue virus
VQADSGCVINW

SEQ ID NO: 19187 - protein, 11 aa, Dengue virus
QADSGCVINWK

SEQ ID NO: 19188 - protein, 11 aa, Dengue virus
ADSGCVINWKG

SEQ ID NO: 19189 - protein, 11 aa, Dengue virus
DSGCVINWKGR

SEQ ID NO: 19190 - protein, 11 aa, Dengue virus
SGCVINWKGRE

SEQ ID NO: 19191 - protein, 11 aa, Dengue virus
GCVINWKGREL

SEQ ID NO: 19192 - protein, 11 aa, Dengue virus
CVINWKGRELK

SEQ ID NO: 19193 - protein, 11 aa, Dengue virus
VINWKGRELKC

SEQ ID NO: 19194 - protein, 11 aa, Dengue virus
INWKGRELKCG

SEQ ID NO: 19195 - protein, 11 aa, Dengue virus
NWKGRELKCGS

SEQ ID NO: 19196 - protein, 11 aa, Dengue virus
WKGRELKCGSG

SEQ ID NO: 19197 - protein, 11 aa, Dengue virus
KGRELKCGSGI

SEQ ID NO: 19198 - protein, 11 aa, Dengue virus
GRELKCGSGIF

SEQ ID NO: 19199 - protein, 11 aa, Dengue virus
RELKCGSGIFV

SEQ ID NO: 19200 - protein, 11 aa, Dengue virus
ELKCGSGIFVT

SEQ ID NO: 19201 - protein, 11 aa, Dengue virus
LKCGSGIFVTN

SEQ ID NO: 19202 - protein, 11 aa, Dengue virus
KCGSGIFVTNE

SEQ ID NO: 19203 - protein, 11 aa, Dengue virus
CGSGIFVTNEV

SEQ ID NO: 19204 - protein, 11 aa, Dengue virus
GSGIFVTNEVH

SEQ ID NO: 19205 - protein, 11 aa, Dengue virus
SGIFVTNEVHT

SEQ ID NO: 19206 - protein, 11 aa, Dengue virus
GIFVTNEVHTW

SEQ ID NO: 19207 - protein, 11 aa, Dengue virus
IFVTNEVHTWT

SEQ ID NO: 19208 - protein, 11 aa, Dengue virus
FVTNEVHTWTE

SEQ ID NO: 19209 - protein, 11 aa, Dengue virus
VTNEVHTWTEQ

SEQ ID NO: 19210 - protein, 11 aa, Dengue virus
TNEVHTWTEQY

SEQ ID NO: 19211 - protein, 11 aa, Dengue virus
NEVHTWTEQYK

SEQ ID NO: 19212 - protein, 11 aa, Dengue virus
EVHTWTEQYKF

SEQ ID NO: 19213 - protein, 11 aa, Dengue virus
VHTWTEQYKFQ

SEQ ID NO: 19214 - protein, 11 aa, Dengue virus
HTWTEQYKFQA

SEQ ID NO: 19215 - protein, 11 aa, Dengue virus
TWTEQYKFQAD

SEQ ID NO: 19216 - protein, 11 aa, Dengue virus
WTEQYKFQADS

SEQ ID NO: 19217 - protein, 11 aa, Dengue virus
TEQYKFQADSP

SEQ ID NO: 19218 - protein, 11 aa, Dengue virus
EQYKFQADSPK

SEQ ID NO: 19219 - protein, 11 aa, Dengue virus
QYKFQADSPKR

SEQ ID NO: 19220 - protein, 11 aa, Dengue virus
YKFQADSPKRL

SEQ ID NO: 19221 - protein, 11 aa, Dengue virus
KFQADSPKRLS

SEQ ID NO: 19222 - protein, 11 aa, Dengue virus
FQADSPKRLSA

SEQ ID NO: 19223 - protein, 11 aa, Dengue virus
QADSPKRLSAA

SEQ ID NO: 19224 - protein, 11 aa, Dengue virus
ADSPKRLSAAI

SEQ ID NO: 19225 - protein, 11 aa, Dengue virus
DSPKRLSAAIG

SEQ ID NO: 19226 - protein, 11 aa, Dengue virus
SPKRLSAAIGK

SEQ ID NO: 19227 - protein, 11 aa, Dengue virus
PKRLSAAIGKA

SEQ ID NO: 19228 - protein, 11 aa, Dengue virus
KRLSAAIGKAW

SEQ ID NO: 19229 - protein, 11 aa, Dengue virus
RLSAAIGKAWE

SEQ ID NO: 19230 - protein, 11 aa, Dengue virus
LSAAIGKAWEE

SEQ ID NO: 19231 - protein, 11 aa, Dengue virus
SAAIGKAWEEG

SEQ ID NO: 19232 - protein, 11 aa, Dengue virus
AAIGKAWEEGV

SEQ ID NO: 19233 - protein, 11 aa, Dengue virus
AIGKAWEEGVC

SEQ ID NO: 19234 - protein, 11 aa, Dengue virus
IGKAWEEGVCG

SEQ ID NO: 19235 - protein, 11 aa, Dengue virus
GKAWEEGVCGI

SEQ ID NO: 19236 - protein, 11 aa, Dengue virus
KAWEEGVCGIR

SEQ ID NO: 19237 - protein, 11 aa, Dengue virus
AWEEGVCGIRS

SEQ ID NO: 19238 - protein, 11 aa, Dengue virus
WEEGVCGIRSA

SEQ ID NO: 19239 - protein, 11 aa, Dengue virus
EEGVCGIRSAT

SEQ ID NO: 19240 - protein, 11 aa, Dengue virus
EGVCGIRSATR

SEQ ID NO: 19241 - protein, 11 aa, Dengue virus
GVCGIRSATRL

SEQ ID NO: 19242 - protein, 11 aa, Dengue virus
VCGIRSATRLE

SEQ ID NO: 19243 - protein, 11 aa, Dengue virus
CGIRSATRLEN

SEQ ID NO: 19244 - protein, 11 aa, Dengue virus
GIRSATRLENI

SEQ ID NO: 19245 - protein, 11 aa, Dengue virus
IRSATRLENIM

SEQ ID NO: 19246 - protein, 11 aa, Dengue virus
RSATRLENIMW

SEQ ID NO: 19247 - protein, 11 aa, Dengue virus
SATRLENIMWK

SEQ ID NO: 19248 - protein, 11 aa, Dengue virus
ATRLENIMWKQ

SEQ ID NO: 19249 - protein, 11 aa, Dengue virus
TRLENIMWKQI

SEQ ID NO: 19250 - protein, 11 aa, Dengue virus
RLENIMWKQIS

SEQ ID NO: 19251 - protein, 11 aa, Dengue virus
LENIMWKQISN

SEQ ID NO: 19252 - protein, 11 aa, Dengue virus
ENIMWKQISNE

SEQ ID NO: 19253 - protein, 11 aa, Dengue virus
NIMWKQISNEL

SEQ ID NO: 19254 - protein, 11 aa, Dengue virus
IMWKQISNELN

SEQ ID NO: 19255 - protein, 11 aa, Dengue virus
MWKQISNELNH

SEQ ID NO: 19256 - protein, 11 aa, Dengue virus
WKQISNELNHI

SEQ ID NO: 19257 - protein, 11 aa, Dengue virus
KQISNELNHIL

SEQ ID NO: 19258 - protein, 11 aa, Dengue virus
QISNELNHILL

SEQ ID NO: 19259 - protein, 11 aa, Dengue virus
ISNELNHILLE

SEQ ID NO: 19260 - protein, 11 aa, Dengue virus
SNELNHILLEN

SEQ ID NO: 19261 - protein, 11 aa, Dengue virus
NELNHILLEND

SEQ ID NO: 19262 - protein, 11 aa, Dengue virus
ELNHILLENDM

SEQ ID NO: 19263 - protein, 11 aa, Dengue virus
LNHILLENDMK

SEQ ID NO: 19264 - protein, 11 aa, Dengue virus
NHILLENDMKF

SEQ ID NO: 19265 - protein, 11 aa, Dengue virus
HILLENDMKFT

SEQ ID NO: 19266 - protein, 11 aa, Dengue virus
ILLENDMKFTV

SEQ ID NO: 19267 - protein, 11 aa, Dengue virus
LLENDMKFTVV

SEQ ID NO: 19268 - protein, 11 aa, Dengue virus
LENDMKFTVVV

SEQ ID NO: 19269 - protein, 11 aa, Dengue virus
ENDMKFTVVVG

SEQ ID NO: 19270 - protein, 11 aa, Dengue virus
NDMKFTVVVGD

SEQ ID NO: 19271 - protein, 11 aa, Dengue virus
QGKKMIRPQPM

SEQ ID NO: 19272 - protein, 11 aa, Dengue virus
GKKMIRPQPME

SEQ ID NO: 19273 - protein, 11 aa, Dengue virus
KKMIRPQPMEY

SEQ ID NO: 19274 - protein, 11 aa, Dengue virus
KMIRPQPMEYK

SEQ ID NO: 19275 - protein, 11 aa, Dengue virus
MIRPQPMEYKY

SEQ ID NO: 19276 - protein, 11 aa, Dengue virus
IRPQPMEYKYS

SEQ ID NO: 19277 - protein, 11 aa, Dengue virus
RPQPMEYKYSW

SEQ ID NO: 19278 - protein, 11 aa, Dengue virus
PQPMEYKYSWK

SEQ ID NO: 19279 - protein, 11 aa, Dengue virus
QPMEYKYSWKS

SEQ ID NO: 19280 - protein, 11 aa, Dengue virus
PMEYKYSWKSW

SEQ ID NO: 19281 - protein, 11 aa, Dengue virus
MEYKYSWKSWG

SEQ ID NO: 19282 - protein, 11 aa, Dengue virus
EYKYSWKSWGK

SEQ ID NO: 19283 - protein, 11 aa, Dengue virus
YKYSWKSWGKA

SEQ ID NO: 19284 - protein, 11 aa, Dengue virus
KYSWKSWGKAK

SEQ ID NO: 19285 - protein, 11 aa, Dengue virus
YSWKSWGKAKI

SEQ ID NO: 19286 - protein, 11 aa, Dengue virus
SWKSWGKAKII

SEQ ID NO: 19287 - protein, 11 aa, Dengue virus
WKSWGKAKIIG

SEQ ID NO: 19288 - protein, 11 aa, Dengue virus
KSWGKAKIIGA

SEQ ID NO: 19289 - protein, 11 aa, Dengue virus
SWGKAKIIGAD

SEQ ID NO: 19290 - protein, 11 aa, Dengue virus
WGKAKIIGADV

SEQ ID NO: 19291 - protein, 11 aa, Dengue virus
GKAKIIGADVQ

SEQ ID NO: 19292 - protein, 11 aa, Dengue virus
KAKIIGADVQN

SEQ ID NO: 19293 - protein, 11 aa, Dengue virus
TFIIDGPNTPE

SEQ ID NO: 19294 - protein, 11 aa, Dengue virus
FIIDGPNTPEC

SEQ ID NO: 19295 - protein, 11 aa, Dengue virus
IIDGPNTPECP

SEQ ID NO: 19296 - protein, 11 aa, Dengue virus
IDGPNTPECPD

SEQ ID NO: 19297 - protein, 11 aa, Dengue virus
ECPDDQRAWNI

SEQ ID NO: 19298 - protein, 11 aa, Dengue virus
CPDDQRAWNIW

SEQ ID NO: 19299 - protein, 11 aa, Dengue virus
PDDQRAWNIWE

SEQ ID NO: 19300 - protein, 11 aa, Dengue virus
DDQRAWNIWEV

SEQ ID NO: 19301 - protein, 11 aa, Dengue virus
DQRAWNIWEVE

SEQ ID NO: 19302 - protein, 11 aa, Dengue virus
QRAWNIWEVED

SEQ ID NO: 19303 - protein, 11 aa, Dengue virus
RAWNIWEVEDY

SEQ ID NO: 19304 - protein, 11 aa, Dengue virus
AWNIWEVEDYG

SEQ ID NO: 19305 - protein, 11 aa, Dengue virus
WNIWEVEDYGF

SEQ ID NO: 19306 - protein, 11 aa, Dengue virus
NIWEVEDYGFG

SEQ ID NO: 19307 - protein, 11 aa, Dengue virus
IWEVEDYGFGI

SEQ ID NO: 19308 - protein, 11 aa, Dengue virus
WEVEDYGFGIF

SEQ ID NO: 19309 - protein, 11 aa, Dengue virus
EVEDYGFGIFT

SEQ ID NO: 19310 - protein, 11 aa, Dengue virus
VEDYGFGIFTT

SEQ ID NO: 19311 - protein, 11 aa, Dengue virus
EDYGFGIFTTN

SEQ ID NO: 19312 - protein, 11 aa, Dengue virus
DYGFGIFTTNI

SEQ ID NO: 19313 - protein, 11 aa, Dengue virus
YGFGIFTTNIW

SEQ ID NO: 19314 - protein, 11 aa, Dengue virus
GFGIFTTNIWL

SEQ ID NO: 19315 - protein, 11 aa, Dengue virus
FGIFTTNIWLK

SEQ ID NO: 19316 - protein, 11 aa, Dengue virus
GIFTTNIWLKL

SEQ ID NO: 19317 - protein, 11 aa, Dengue virus
IFTTNIWLKLR

SEQ ID NO: 19318 - protein, 11 aa, Dengue virus
FTTNIWLKLRD

SEQ ID NO: 19319 - protein, 11 aa, Dengue virus
TTNIWLKLRDS

SEQ ID NO: 19320 - protein, 11 aa, Dengue virus
TNIWLKLRDSY

SEQ ID NO: 19321 - protein, 11 aa, Dengue virus
NIWLKLRDSYT

SEQ ID NO: 19322 - protein, 11 aa, Dengue virus
IWLKLRDSYTQ

SEQ ID NO: 19323 - protein, 11 aa, Dengue virus
RDSYTQVCDHR

SEQ ID NO: 19324 - protein, 11 aa, Dengue virus
DSYTQVCDHRL

SEQ ID NO: 19325 - protein, 11 aa, Dengue virus
SYTQVCDHRLM

SEQ ID NO: 19326 - protein, 11 aa, Dengue virus
YTQVCDHRLMS

SEQ ID NO: 19327 - protein, 11 aa, Dengue virus
TQVCDHRLMSA

SEQ ID NO: 19328 - protein, 11 aa, Dengue virus
QVCDHRLMSAA

SEQ ID NO: 19329 - protein, 11 aa, Dengue virus
VCDHRLMSAAI

SEQ ID NO: 19330 - protein, 11 aa, Dengue virus
CDHRLMSAAIK

SEQ ID NO: 19331 - protein, 11 aa, Dengue virus
DHRLMSAAIKD

SEQ ID NO: 19332 - protein, 11 aa, Dengue virus
HRLMSAAIKDS

SEQ ID NO: 19333 - protein, 11 aa, Dengue virus
RLMSAAIKDSK

SEQ ID NO: 19334 - protein, 11 aa, Dengue virus
LMSAAIKDSKA

SEQ ID NO: 19335 - protein, 11 aa, Dengue virus
MSAAIKDSKAV

SEQ ID NO: 19336 - protein, 11 aa, Dengue virus
SAAIKDSKAVH

SEQ ID NO: 19337 - protein, 11 aa, Dengue virus
AAIKDSKAVHA

SEQ ID NO: 19338 - protein, 11 aa, Dengue virus
AIKDSKAVHAD

SEQ ID NO: 19339 - protein, 11 aa, Dengue virus
IKDSKAVHADM

SEQ ID NO: 19340 - protein, 11 aa, Dengue virus
KDSKAVHADMG

SEQ ID NO: 19341 - protein, 11 aa, Dengue virus
DSKAVHADMGY

SEQ ID NO: 19342 - protein, 11 aa, Dengue virus
SKAVHADMGYW

SEQ ID NO: 19343 - protein, 11 aa, Dengue virus
KAVHADMGYWI

SEQ ID NO: 19344 - protein, 11 aa, Dengue virus
AVHADMGYWIE

SEQ ID NO: 19345 - protein, 11 aa, Dengue virus
VHADMGYWIES

SEQ ID NO: 19346 - protein, 11 aa, Dengue virus
HADMGYWIESE

SEQ ID NO: 19347 - protein, 11 aa, Dengue virus
ADMGYWIESEK

SEQ ID NO: 19348 - protein, 11 aa, Dengue virus
DMGYWIESEKN

SEQ ID NO: 19349 - protein, 11 aa, Dengue virus
MGYWIESEKNE

SEQ ID NO: 19350 - protein, 11 aa, Dengue virus
GYWIESEKNET

SEQ ID NO: 19351 - protein, 11 aa, Dengue virus
YWIESEKNETW

SEQ ID NO: 19352 - protein, 11 aa, Dengue virus
WIESEKNETWK

SEQ ID NO: 19353 - protein, 11 aa, Dengue virus
IESEKNETWKL

SEQ ID NO: 19354 - protein, 11 aa, Dengue virus
ESEKNETWKLA

SEQ ID NO: 19355 - protein, 11 aa, Dengue virus
NETWKLARASF

SEQ ID NO: 19356 - protein, 11 aa, Dengue virus
ETWKLARASFI

SEQ ID NO: 19357 - protein, 11 aa, Dengue virus
TWKLARASFIE

SEQ ID NO: 19358 - protein, 11 aa, Dengue virus
WKLARASFIEV

SEQ ID NO: 19359 - protein, 11 aa, Dengue virus
KLARASFIEVK

SEQ ID NO: 19360 - protein, 11 aa, Dengue virus
LARASFIEVKT

SEQ ID NO: 19361 - protein, 11 aa, Dengue virus
ARASFIEVKTC

SEQ ID NO: 19362 - protein, 11 aa, Dengue virus
RASFIEVKTCI

SEQ ID NO: 19363 - protein, 11 aa, Dengue virus
ASFIEVKTCIW

SEQ ID NO: 19364 - protein, 11 aa, Dengue virus
SFIEVKTCIWP

SEQ ID NO: 19365 - protein, 11 aa, Dengue virus
FIEVKTCIWPK

SEQ ID NO: 19366 - protein, 11 aa, Dengue virus
IEVKTCIWPKS

SEQ ID NO: 19367 - protein, 11 aa, Dengue virus
EVKTCIWPKSH

SEQ ID NO: 19368 - protein, 11 aa, Dengue virus
VKTCIWPKSHT

SEQ ID NO: 19369 - protein, 11 aa, Dengue virus
KTCIWPKSHTL

SEQ ID NO: 19370 - protein, 11 aa, Dengue virus
TCIWPKSHTLW

SEQ ID NO: 19371 - protein, 11 aa, Dengue virus
CIWPKSHTLWS

SEQ ID NO: 19372 - protein, 11 aa, Dengue virus
IWPKSHTLWSN

SEQ ID NO: 19373 - protein, 11 aa, Dengue virus
WPKSHTLWSNG

SEQ ID NO: 19374 - protein, 11 aa, Dengue virus
PKSHTLWSNGV

SEQ ID NO: 19375 - protein, 11 aa, Dengue virus
KSHTLWSNGVL

SEQ ID NO: 19376 - protein, 11 aa, Dengue virus
SHTLWSNGVLE

SEQ ID NO: 19377 - protein, 11 aa, Dengue virus
HTLWSNGVLES

SEQ ID NO: 19378 - protein, 11 aa, Dengue virus
TLWSNGVLESE

SEQ ID NO: 19379 - protein, 11 aa, Dengue virus
LWSNGVLESEM

SEQ ID NO: 19380 - protein, 11 aa, Dengue virus
WSNGVLESEMI

SEQ ID NO: 19381 - protein, 11 aa, Dengue virus
SNGVLESEMII

SEQ ID NO: 19382 - protein, 11 aa, Dengue virus
NGVLESEMIIP

SEQ ID NO: 19383 - protein, 11 aa, Dengue virus
GVLESEMIIPK

SEQ ID NO: 19384 - protein, 11 aa, Dengue virus
VLESEMIIPKI

SEQ ID NO: 19385 - protein, 11 aa, Dengue virus
LESEMIIPKIY

SEQ ID NO: 19386 - protein, 11 aa, Dengue virus
ESEMIIPKIYG

SEQ ID NO: 19387 - protein, 11 aa, Dengue virus
SEMIIPKIYGG

SEQ ID NO: 19388 - protein, 11 aa, Dengue virus
EMIIPKIYGGP

SEQ ID NO: 19389 - protein, 11 aa, Dengue virus
PKIYGGPISQH

SEQ ID NO: 19390 - protein, 11 aa, Dengue virus
KIYGGPISQHN

SEQ ID NO: 19391 - protein, 11 aa, Dengue virus
YGGPISQHNYR

SEQ ID NO: 19392 - protein, 11 aa, Dengue virus
GGPISQHNYRP

SEQ ID NO: 19393 - protein, 11 aa, Dengue virus
GPISQHNYRPG

SEQ ID NO: 19394 - protein, 11 aa, Dengue virus
PISQHNYRPGY

SEQ ID NO: 19395 - protein, 11 aa, Dengue virus
ISQHNYRPGYF

SEQ ID NO: 19396 - protein, 11 aa, Dengue virus
SQHNYRPGYFT

SEQ ID NO: 19397 - protein, 11 aa, Dengue virus
QHNYRPGYFTQ

SEQ ID NO: 19398 - protein, 11 aa, Dengue virus
HNYRPGYFTQT

SEQ ID NO: 19399 - protein, 11 aa, Dengue virus
NYRPGYFTQTA

SEQ ID NO: 19400 - protein, 11 aa, Dengue virus
YRPGYFTQTAG

SEQ ID NO: 19401 - protein, 11 aa, Dengue virus
RPGYFTQTAGP

SEQ ID NO: 19402 - protein, 11 aa, Dengue virus
PGYFTQTAGPW

SEQ ID NO: 19403 - protein, 11 aa, Dengue virus
GYFTQTAGPWH

SEQ ID NO: 19404 - protein, 11 aa, Dengue virus
YFTQTAGPWHL

SEQ ID NO: 19405 - protein, 11 aa, Dengue virus
FTQTAGPWHLG

SEQ ID NO: 19406 - protein, 11 aa, Dengue virus
TQTAGPWHLGK

SEQ ID NO: 19407 - protein, 11 aa, Dengue virus
QTAGPWHLGKL

SEQ ID NO: 19408 - protein, 11 aa, Dengue virus
TAGPWHLGKLE

SEQ ID NO: 19409 - protein, 11 aa, Dengue virus
AGPWHLGKLEL

SEQ ID NO: 19410 - protein, 11 aa, Dengue virus
GPWHLGKLELD

SEQ ID NO: 19411 - protein, 11 aa, Dengue virus
PWHLGKLELDF

SEQ ID NO: 19412 - protein, 11 aa, Dengue virus
WHLGKLELDFD

SEQ ID NO: 19413 - protein, 11 aa, Dengue virus
HLGKLELDFDL

SEQ ID NO: 19414 - protein, 11 aa, Dengue virus
LGKLELDFDLC

SEQ ID NO: 19415 - protein, 11 aa, Dengue virus
GKLELDFDLCE

SEQ ID NO: 19416 - protein, 11 aa, Dengue virus
KLELDFDLCEG

SEQ ID NO: 19417 - protein, 11 aa, Dengue virus
LELDFDLCEGT

SEQ ID NO: 19418 - protein, 11 aa, Dengue virus
ELDFDLCEGTT

SEQ ID NO: 19419 - protein, 11 aa, Dengue virus
LDFDLCEGTTV

SEQ ID NO: 19420 - protein, 11 aa, Dengue virus
DFDLCEGTTVV

SEQ ID NO: 19421 - protein, 11 aa, Dengue virus
FDLCEGTTVVV

SEQ ID NO: 19422 - protein, 11 aa, Dengue virus
DLCEGTTVVVD

SEQ ID NO: 19423 - protein, 11 aa, Dengue virus
LCEGTTVVVDE

SEQ ID NO: 19424 - protein, 11 aa, Dengue virus
CEGTTVVVDEH

SEQ ID NO: 19425 - protein, 11 aa, Dengue virus
EGTTVVVDEHC

SEQ ID NO: 19426 - protein, 11 aa, Dengue virus
GTTVVVDEHCG

SEQ ID NO: 19427 - protein, 11 aa, Dengue virus
TTVVVDEHCGN

SEQ ID NO: 19428 - protein, 11 aa, Dengue virus
TVVVDEHCGNR

SEQ ID NO: 19429 - protein, 11 aa, Dengue virus
VVVDEHCGNRG

SEQ ID NO: 19430 - protein, 11 aa, Dengue virus
VVDEHCGNRGP

SEQ ID NO: 19431 - protein, 11 aa, Dengue virus
VDEHCGNRGPS

SEQ ID NO: 19432 - protein, 11 aa, Dengue virus
DEHCGNRGPSL

SEQ ID NO: 19433 - protein, 11 aa, Dengue virus
EHCGNRGPSLR

SEQ ID NO: 19434 - protein, 11 aa, Dengue virus
HCGNRGPSLRT

SEQ ID NO: 19435 - protein, 11 aa, Dengue virus
CGNRGPSLRTT

SEQ ID NO: 19436 - protein, 11 aa, Dengue virus
GNRGPSLRTTT

SEQ ID NO: 19437 - protein, 11 aa, Dengue virus
NRGPSLRTTTV

SEQ ID NO: 19438 - protein, 11 aa, Dengue virus
RGPSLRTTTVT

SEQ ID NO: 19439 - protein, 11 aa, Dengue virus
GPSLRTTTVTG

SEQ ID NO: 19440 - protein, 11 aa, Dengue virus
PSLRTTTVTGK

SEQ ID NO: 19441 - protein, 11 aa, Dengue virus
SLRTTTVTGKI

SEQ ID NO: 19442 - protein, 11 aa, Dengue virus
LRTTTVTGKII

SEQ ID NO: 19443 - protein, 11 aa, Dengue virus
RTTTVTGKIIH

SEQ ID NO: 19444 - protein, 11 aa, Dengue virus
TTTVTGKIIHE

SEQ ID NO: 19445 - protein, 11 aa, Dengue virus
TTVTGKIIHEW

SEQ ID NO: 19446 - protein, 11 aa, Dengue virus
TVTGKIIHEWC

SEQ ID NO: 19447 - protein, 11 aa, Dengue virus
VTGKIIHEWCC

SEQ ID NO: 19448 - protein, 11 aa, Dengue virus
TGKIIHEWCCR

SEQ ID NO: 19449 - protein, 11 aa, Dengue virus
GKIIHEWCCRS

SEQ ID NO: 19450 - protein, 11 aa, Dengue virus
KIIHEWCCRSC

SEQ ID NO: 19451 - protein, 11 aa, Dengue virus
IIHEWCCRSCT

SEQ ID NO: 19452 - protein, 11 aa, Dengue virus
IHEWCCRSCTL

SEQ ID NO: 19453 - protein, 11 aa, Dengue virus
HEWCCRSCTLP

SEQ ID NO: 19454 - protein, 11 aa, Dengue virus
EWCCRSCTLPP

SEQ ID NO: 19455 - protein, 11 aa, Dengue virus
WCCRSCTLPPL

SEQ ID NO: 19456 - protein, 11 aa, Dengue virus
CCRSCTLPPLR

SEQ ID NO: 19457 - protein, 11 aa, Dengue virus
CRSCTLPPLRF

SEQ ID NO: 19458 - protein, 11 aa, Dengue virus
RSCTLPPLRFR

SEQ ID NO: 19459 - protein, 11 aa, Dengue virus
SCTLPPLRFRG

SEQ ID NO: 19460 - protein, 11 aa, Dengue virus
CTLPPLRFRGE

SEQ ID NO: 19461 - protein, 11 aa, Dengue virus
TLPPLRFRGED

SEQ ID NO: 19462 - protein, 11 aa, Dengue virus
LPPLRFRGEDG

SEQ ID NO: 19463 - protein, 11 aa, Dengue virus
PPLRFRGEDGC

SEQ ID NO: 19464 - protein, 11 aa, Dengue virus
PLRFRGEDGCW

SEQ ID NO: 19465 - protein, 11 aa, Dengue virus
LRFRGEDGCWY

SEQ ID NO: 19466 - protein, 11 aa, Dengue virus
RFRGEDGCWYG

SEQ ID NO: 19467 - protein, 11 aa, Dengue virus
FRGEDGCWYGM

SEQ ID NO: 19468 - protein, 11 aa, Dengue virus
RGEDGCWYGME

SEQ ID NO: 19469 - protein, 11 aa, Dengue virus
GEDGCWYGMEI

SEQ ID NO: 19470 - protein, 11 aa, Dengue virus
EDGCWYGMEIR

SEQ ID NO: 19471 - protein, 11 aa, Dengue virus
DGCWYGMEIRP

SEQ ID NO: 19472 - protein, 11 aa, Dengue virus
GCWYGMEIRPV

SEQ ID NO: 19473 - protein, 11 aa, Dengue virus
CWYGMEIRPVK

SEQ ID NO: 19474 - protein, 11 aa, Dengue virus
WYGMEIRPVKE

SEQ ID NO: 19475 - protein, 11 aa, Dengue virus
YGMEIRPVKEK

SEQ ID NO: 19476 - protein, 11 aa, Dengue virus
GMEIRPVKEKE

SEQ ID NO: 19477 - protein, 11 aa, Dengue virus
MEIRPVKEKEE

SEQ ID NO: 19478 - protein, 11 aa, Dengue virus
EIRPVKEKEEN

SEQ ID NO: 19479 - protein, 11 aa, Dengue virus
IRPVKEKEENL

SEQ ID NO: 19480 - protein, 11 aa, Dengue virus
RPVKEKEENLV

SEQ ID NO: 19481 - protein, 11 aa, Dengue virus
PVKEKEENLVK

SEQ ID NO: 19482 - protein, 11 aa, Dengue virus
VKEKEENLVKS

SEQ ID NO: 19483 - protein, 11 aa, Dengue virus
KEKEENLVKSM

SEQ ID NO: 19484 - protein, 11 aa, Dengue virus
EKEENLVKSMV

SEQ ID NO: 19485 - protein, 11 aa, Dengue virus
KEENLVKSMVS

SEQ ID NO: 19486 - protein, 11 aa, Dengue virus
EENLVKSMVSA

SEQ ID NO: 19487 - protein, 11 aa, Dengue virus
ENLVKSMVSAG

SEQ ID NO: 19488 - protein, 11 aa, Dengue virus
NLVKSMVSAGS

SEQ ID NO: 19489 - protein, 11 aa, Dengue virus
LVKSMVSAGSG

SEQ ID NO: 19490 - protein, 11 aa, Dengue virus
VKSMVSAGSGE

SEQ ID NO: 19491 - protein, 11 aa, Dengue virus
KSMVSAGSGEV

SEQ ID NO: 19492 - protein, 11 aa, Dengue virus
SMVSAGSGEVD

SEQ ID NO: 19493 - protein, 11 aa, Dengue virus
MVSAGSGEVDS

SEQ ID NO: 19494 - protein, 11 aa, Dengue virus
VSAGSGEVDSF

SEQ ID NO: 19495 - protein, 11 aa, Dengue virus
SAGSGEVDSFS

SEQ ID NO: 19496 - protein, 11 aa, Dengue virus
AGSGEVDSFSL

SEQ ID NO: 19497 - protein, 11 aa, Dengue virus
GSGEVDSFSLG

SEQ ID NO: 19498 - protein, 11 aa, Dengue virus
SGEVDSFSLGL

SEQ ID NO: 19499 - protein, 11 aa, Dengue virus
GEVDSFSLGLL

SEQ ID NO: 19500 - protein, 11 aa, Dengue virus
EVDSFSLGLLC

SEQ ID NO: 19501 - protein, 11 aa, Dengue virus
SIMIEEVMRSR

SEQ ID NO: 19502 - protein, 11 aa, Dengue virus
IMIEEVMRSRW

SEQ ID NO: 19503 - protein, 11 aa, Dengue virus
MIEEVMRSRWS

SEQ ID NO: 19504 - protein, 11 aa, Dengue virus
IEEVMRSRWSR

SEQ ID NO: 19505 - protein, 11 aa, Dengue virus
EEVMRSRWSRK

SEQ ID NO: 19506 - protein, 11 aa, Dengue virus
EVMRSRWSRKM

SEQ ID NO: 19507 - protein, 11 aa, Dengue virus
VMRSRWSRKML

SEQ ID NO: 19508 - protein, 11 aa, Dengue virus
MRSRWSRKMLM

SEQ ID NO: 19509 - protein, 11 aa, Dengue virus
RSRWSRKMLMT

SEQ ID NO: 19510 - protein, 11 aa, Dengue virus
SRWSRKMLMTG

SEQ ID NO: 19511 - protein, 11 aa, Dengue virus
RWSRKMLMTGT

SEQ ID NO: 19512 - protein, 11 aa, Dengue virus
WSRKMLMTGTL

SEQ ID NO: 19513 - protein, 11 aa, Dengue virus
GQLTWNDLIRL

SEQ ID NO: 19514 - protein, 11 aa, Dengue virus
QLTWNDLIRLC

SEQ ID NO: 19515 - protein, 11 aa, Dengue virus
LTWNDLIRLCI

SEQ ID NO: 19516 - protein, 11 aa, Dengue virus
TWNDLIRLCIM

SEQ ID NO: 19517 - protein, 11 aa, Dengue virus
WNDLIRLCIMV

SEQ ID NO: 19518 - protein, 11 aa, Dengue virus
NDLIRLCIMVG

SEQ ID NO: 19519 - protein, 11 aa, Dengue virus
DLIRLCIMVGA

SEQ ID NO: 19520 - protein, 11 aa, Dengue virus
LIRLCIMVGAN

SEQ ID NO: 19521 - protein, 11 aa, Dengue virus
IRLCIMVGANA

SEQ ID NO: 19522 - protein, 11 aa, Dengue virus
RLCIMVGANAS

SEQ ID NO: 19523 - protein, 11 aa, Dengue virus
LCIMVGANASD

SEQ ID NO: 19524 - protein, 11 aa, Dengue virus
CIMVGANASDR

SEQ ID NO: 19525 - protein, 11 aa, Dengue virus
IMVGANASDRM

SEQ ID NO: 19526 - protein, 11 aa, Dengue virus
MVGANASDRMG

SEQ ID NO: 19527 - protein, 11 aa, Dengue virus
GANASDRMGMG

SEQ ID NO: 19528 - protein, 11 aa, Dengue virus
DRMGMGTTYLA

SEQ ID NO: 19529 - protein, 11 aa, Dengue virus
RMGMGTTYLAL

SEQ ID NO: 19530 - protein, 11 aa, Dengue virus
MGMGTTYLALM

SEQ ID NO: 19531 - protein, 11 aa, Dengue virus
GMGTTYLALMA

SEQ ID NO: 19532 - protein, 11 aa, Dengue virus
MGTTYLALMAT

SEQ ID NO: 19533 - protein, 11 aa, Dengue virus
GTTYLALMATF

SEQ ID NO: 19534 - protein, 11 aa, Dengue virus
TTYLALMATFK

SEQ ID NO: 19535 - protein, 11 aa, Dengue virus
TYLALMATFKM

SEQ ID NO: 19536 - protein, 11 aa, Dengue virus
YLALMATFKMR

SEQ ID NO: 19537 - protein, 11 aa, Dengue virus
LALMATFKMRP

SEQ ID NO: 19538 - protein, 11 aa, Dengue virus
ALMATFKMRPM

SEQ ID NO: 19539 - protein, 11 aa, Dengue virus
LMATFKMRPMF

SEQ ID NO: 19540 - protein, 11 aa, Dengue virus
MATFKMRPMFA

SEQ ID NO: 19541 - protein, 11 aa, Dengue virus
ATFKMRPMFAV

SEQ ID NO: 19542 - protein, 11 aa, Dengue virus
TFKMRPMFAVG

SEQ ID NO: 19543 - protein, 11 aa, Dengue virus
FKMRPMFAVGL

SEQ ID NO: 19544 - protein, 11 aa, Dengue virus
KMRPMFAVGLL

SEQ ID NO: 19545 - protein, 11 aa, Dengue virus
MRPMFAVGLLF

SEQ ID NO: 19546 - protein, 11 aa, Dengue virus
RPMFAVGLLFR

SEQ ID NO: 19547 - protein, 11 aa, Dengue virus
PMFAVGLLFRR

SEQ ID NO: 19548 - protein, 11 aa, Dengue virus
MFAVGLLFRRL

SEQ ID NO: 19549 - protein, 11 aa, Dengue virus
FAVGLLFRRLT

SEQ ID NO: 19550 - protein, 11 aa, Dengue virus
AVGLLFRRLTS

SEQ ID NO: 19551 - protein, 11 aa, Dengue virus
VGLLFRRLTSR

SEQ ID NO: 19552 - protein, 11 aa, Dengue virus
GLLFRRLTSRE

SEQ ID NO: 19553 - protein, 11 aa, Dengue virus
LLFRRLTSREV

SEQ ID NO: 19554 - protein, 11 aa, Dengue virus
LFRRLTSREVL

SEQ ID NO: 19555 - protein, 11 aa, Dengue virus
FRRLTSREVLL

SEQ ID NO: 19556 - protein, 11 aa, Dengue virus
RRLTSREVLLL

SEQ ID NO: 19557 - protein, 11 aa, Dengue virus
RLTSREVLLLT

SEQ ID NO: 19558 - protein, 11 aa, Dengue virus
LTSREVLLLTI

SEQ ID NO: 19559 - protein, 11 aa, Dengue virus
TSREVLLLTIG

SEQ ID NO: 19560 - protein, 11 aa, Dengue virus
SREVLLLTIGL

SEQ ID NO: 19561 - protein, 11 aa, Dengue virus
REVLLLTIGLS

SEQ ID NO: 19562 - protein, 11 aa, Dengue virus
EVLLLTIGLSL

SEQ ID NO: 19563 - protein, 11 aa, Dengue virus
VLLLTIGLSLV

SEQ ID NO: 19564 - protein, 11 aa, Dengue virus
LLLTIGLSLVA

SEQ ID NO: 19565 - protein, 11 aa, Dengue virus
LLTIGLSLVAS

SEQ ID NO: 19566 - protein, 11 aa, Dengue virus
LTIGLSLVASV

SEQ ID NO: 19567 - protein, 11 aa, Dengue virus
TIGLSLVASVE

SEQ ID NO: 19568 - protein, 11 aa, Dengue virus
IGLSLVASVEL

SEQ ID NO: 19569 - protein, 11 aa, Dengue virus
GLSLVASVELP

SEQ ID NO: 19570 - protein, 11 aa, Dengue virus
SVELPNSLEEL

SEQ ID NO: 19571 - protein, 11 aa, Dengue virus
VELPNSLEELG

SEQ ID NO: 19572 - protein, 11 aa, Dengue virus
ELPNSLEELGD

SEQ ID NO: 19573 - protein, 11 aa, Dengue virus
LPNSLEELGDG

SEQ ID NO: 19574 - protein, 11 aa, Dengue virus
PNSLEELGDGL

SEQ ID NO: 19575 - protein, 11 aa, Dengue virus
NSLEELGDGLA

SEQ ID NO: 19576 - protein, 11 aa, Dengue virus
SLEELGDGLAM

SEQ ID NO: 19577 - protein, 11 aa, Dengue virus
LEELGDGLAMG

SEQ ID NO: 19578 - protein, 11 aa, Dengue virus
EELGDGLAMGI

SEQ ID NO: 19579 - protein, 11 aa, Dengue virus
ELGDGLAMGIM

SEQ ID NO: 19580 - protein, 11 aa, Dengue virus
LGDGLAMGIMI

SEQ ID NO: 19581 - protein, 11 aa, Dengue virus
GDGLAMGIMIL

SEQ ID NO: 19582 - protein, 11 aa, Dengue virus
DGLAMGIMILK

SEQ ID NO: 19583 - protein, 11 aa, Dengue virus
GLAMGIMILKL

SEQ ID NO: 19584 - protein, 11 aa, Dengue virus
LAMGIMILKLL

SEQ ID NO: 19585 - protein, 11 aa, Dengue virus
AMGIMILKLLT

SEQ ID NO: 19586 - protein, 11 aa, Dengue virus
MGIMILKLLTD

SEQ ID NO: 19587 - protein, 11 aa, Dengue virus
GIMILKLLTDF

SEQ ID NO: 19588 - protein, 11 aa, Dengue virus
IMILKLLTDFQ

SEQ ID NO: 19589 - protein, 11 aa, Dengue virus
MILKLLTDFQS

SEQ ID NO: 19590 - protein, 11 aa, Dengue virus
LKLLTDFQSHQ

SEQ ID NO: 19591 - protein, 11 aa, Dengue virus
KLLTDFQSHQL

SEQ ID NO: 19592 - protein, 11 aa, Dengue virus
LLTDFQSHQLW

SEQ ID NO: 19593 - protein, 11 aa, Dengue virus
VSLFPLCLSTT

SEQ ID NO: 19594 - protein, 11 aa, Dengue virus
SLFPLCLSTTS

SEQ ID NO: 19595 - protein, 11 aa, Dengue virus
LFPLCLSTTSQ

SEQ ID NO: 19596 - protein, 11 aa, Dengue virus
FPLCLSTTSQK

SEQ ID NO: 19597 - protein, 11 aa, Dengue virus
PLCLSTTSQKT

SEQ ID NO: 19598 - protein, 11 aa, Dengue virus
LCLSTTSQKTT

SEQ ID NO: 19599 - protein, 11 aa, Dengue virus
CLSTTSQKTTW

SEQ ID NO: 19600 - protein, 11 aa, Dengue virus
LSTTSQKTTWL

SEQ ID NO: 19601 - protein, 11 aa, Dengue virus
STTSQKTTWLP

SEQ ID NO: 19602 - protein, 11 aa, Dengue virus
TTSQKTTWLPV

SEQ ID NO: 19603 - protein, 11 aa, Dengue virus
TSQKTTWLPVL

SEQ ID NO: 19604 - protein, 11 aa, Dengue virus
SQKTTWLPVLL

SEQ ID NO: 19605 - protein, 11 aa, Dengue virus
QKTTWLPVLLG

SEQ ID NO: 19606 - protein, 11 aa, Dengue virus
KTTWLPVLLGS

SEQ ID NO: 19607 - protein, 11 aa, Dengue virus
TTWLPVLLGSL

SEQ ID NO: 19608 - protein, 11 aa, Dengue virus
TWLPVLLGSLG

SEQ ID NO: 19609 - protein, 11 aa, Dengue virus
WLPVLLGSLGC

SEQ ID NO: 19610 - protein, 11 aa, Dengue virus
LPVLLGSLGCK

SEQ ID NO: 19611 - protein, 11 aa, Dengue virus
PVLLGSLGCKP

SEQ ID NO: 19612 - protein, 11 aa, Dengue virus
VLLGSLGCKPL

SEQ ID NO: 19613 - protein, 11 aa, Dengue virus
LLGSLGCKPLT

SEQ ID NO: 19614 - protein, 11 aa, Dengue virus
LGSLGCKPLTM

SEQ ID NO: 19615 - protein, 11 aa, Dengue virus
GSLGCKPLTMF

SEQ ID NO: 19616 - protein, 11 aa, Dengue virus
SLGCKPLTMFL

SEQ ID NO: 19617 - protein, 11 aa, Dengue virus
LGCKPLTMFLI

SEQ ID NO: 19618 - protein, 11 aa, Dengue virus
GCKPLTMFLIA

SEQ ID NO: 19619 - protein, 11 aa, Dengue virus
CKPLTMFLIAE

SEQ ID NO: 19620 - protein, 11 aa, Dengue virus
ENKIWGRKSWP

SEQ ID NO: 19621 - protein, 11 aa, Dengue virus
NKIWGRKSWPL

SEQ ID NO: 19622 - protein, 11 aa, Dengue virus
KIWGRKSWPLN

SEQ ID NO: 19623 - protein, 11 aa, Dengue virus
IWGRKSWPLNE

SEQ ID NO: 19624 - protein, 11 aa, Dengue virus
WGRKSWPLNEG

SEQ ID NO: 19625 - protein, 11 aa, Dengue virus
GRKSWPLNEGI

SEQ ID NO: 19626 - protein, 11 aa, Dengue virus
RKSWPLNEGIM

SEQ ID NO: 19627 - protein, 11 aa, Dengue virus
KSWPLNEGIMA

SEQ ID NO: 19628 - protein, 11 aa, Dengue virus
SWPLNEGIMAV

SEQ ID NO: 19629 - protein, 11 aa, Dengue virus
WPLNEGIMAVG

SEQ ID NO: 19630 - protein, 11 aa, Dengue virus
PLNEGIMAVGI

SEQ ID NO: 19631 - protein, 11 aa, Dengue virus
LNEGIMAVGIV

SEQ ID NO: 19632 - protein, 11 aa, Dengue virus
NEGIMAVGIVS

SEQ ID NO: 19633 - protein, 11 aa, Dengue virus
EGIMAVGIVSI

SEQ ID NO: 19634 - protein, 11 aa, Dengue virus
GIMAVGIVSIL

SEQ ID NO: 19635 - protein, 11 aa, Dengue virus
IMAVGIVSILL

SEQ ID NO: 19636 - protein, 11 aa, Dengue virus
MAVGIVSILLS

SEQ ID NO: 19637 - protein, 11 aa, Dengue virus
AVGIVSILLSS

SEQ ID NO: 19638 - protein, 11 aa, Dengue virus
VGIVSILLSSL

SEQ ID NO: 19639 - protein, 11 aa, Dengue virus
GIVSILLSSLL

SEQ ID NO: 19640 - protein, 11 aa, Dengue virus
IVSILLSSLLK

SEQ ID NO: 19641 - protein, 11 aa, Dengue virus
VSILLSSLLKN

SEQ ID NO: 19642 - protein, 11 aa, Dengue virus
SILLSSLLKND

SEQ ID NO: 19643 - protein, 11 aa, Dengue virus
ILLSSLLKNDV

SEQ ID NO: 19644 - protein, 11 aa, Dengue virus
LLSSLLKNDVP

SEQ ID NO: 19645 - protein, 11 aa, Dengue virus
LSSLLKNDVPL

SEQ ID NO: 19646 - protein, 11 aa, Dengue virus
SSLLKNDVPLA

SEQ ID NO: 19647 - protein, 11 aa, Dengue virus
SLLKNDVPLAG

SEQ ID NO: 19648 - protein, 11 aa, Dengue virus
LLKNDVPLAGP

SEQ ID NO: 19649 - protein, 11 aa, Dengue virus
LKNDVPLAGPL

SEQ ID NO: 19650 - protein, 11 aa, Dengue virus
KNDVPLAGPLI

SEQ ID NO: 19651 - protein, 11 aa, Dengue virus
NDVPLAGPLIA

SEQ ID NO: 19652 - protein, 11 aa, Dengue virus
DVPLAGPLIAG

SEQ ID NO: 19653 - protein, 11 aa, Dengue virus
VPLAGPLIAGG

SEQ ID NO: 19654 - protein, 11 aa, Dengue virus
PLAGPLIAGGM

SEQ ID NO: 19655 - protein, 11 aa, Dengue virus
LAGPLIAGGML

SEQ ID NO: 19656 - protein, 11 aa, Dengue virus
AGPLIAGGMLI

SEQ ID NO: 19657 - protein, 11 aa, Dengue virus
GPLIAGGMLIA

SEQ ID NO: 19658 - protein, 11 aa, Dengue virus
PLIAGGMLIAC

SEQ ID NO: 19659 - protein, 11 aa, Dengue virus
LIAGGMLIACY

SEQ ID NO: 19660 - protein, 11 aa, Dengue virus
IAGGMLIACYV

SEQ ID NO: 19661 - protein, 11 aa, Dengue virus
AGGMLIACYVI

SEQ ID NO: 19662 - protein, 11 aa, Dengue virus
GGMLIACYVIS

SEQ ID NO: 19663 - protein, 11 aa, Dengue virus
GMLIACYVISG

SEQ ID NO: 19664 - protein, 11 aa, Dengue virus
MLIACYVISGS

SEQ ID NO: 19665 - protein, 11 aa, Dengue virus
LIACYVISGSS

SEQ ID NO: 19666 - protein, 11 aa, Dengue virus
IACYVISGSSA

SEQ ID NO: 19667 - protein, 11 aa, Dengue virus
ACYVISGSSAD

SEQ ID NO: 19668 - protein, 11 aa, Dengue virus
CYVISGSSADL

SEQ ID NO: 19669 - protein, 11 aa, Dengue virus
YVISGSSADLS

SEQ ID NO: 19670 - protein, 11 aa, Dengue virus
VISGSSADLSL

SEQ ID NO: 19671 - protein, 11 aa, Dengue virus
ISGSSADLSLE

SEQ ID NO: 19672 - protein, 11 aa, Dengue virus
SGSSADLSLEK

SEQ ID NO: 19673 - protein, 11 aa, Dengue virus
GSSADLSLEKA

SEQ ID NO: 19674 - protein, 11 aa, Dengue virus
SSADLSLEKAA

SEQ ID NO: 19675 - protein, 11 aa, Dengue virus
SADLSLEKAAE

SEQ ID NO: 19676 - protein, 11 aa, Dengue virus
ADLSLEKAAEV

SEQ ID NO: 19677 - protein, 11 aa, Dengue virus
DLSLEKAAEVS

SEQ ID NO: 19678 - protein, 11 aa, Dengue virus
LSLEKAAEVSW

SEQ ID NO: 19679 - protein, 11 aa, Dengue virus
SLEKAAEVSWE

SEQ ID NO: 19680 - protein, 11 aa, Dengue virus
AEVSWEEEAEH

SEQ ID NO: 19681 - protein, 11 aa, Dengue virus
EVSWEEEAEHS

SEQ ID NO: 19682 - protein, 11 aa, Dengue virus
VSWEEEAEHSG

SEQ ID NO: 19683 - protein, 11 aa, Dengue virus
SWEEEAEHSGA

SEQ ID NO: 19684 - protein, 11 aa, Dengue virus
WEEEAEHSGAS

SEQ ID NO: 19685 - protein, 11 aa, Dengue virus
EEEAEHSGASH

SEQ ID NO: 19686 - protein, 11 aa, Dengue virus
EEAEHSGASHN

SEQ ID NO: 19687 - protein, 11 aa, Dengue virus
EAEHSGASHNI

SEQ ID NO: 19688 - protein, 11 aa, Dengue virus
AEHSGASHNIL

SEQ ID NO: 19689 - protein, 11 aa, Dengue virus
EHSGASHNILV

SEQ ID NO: 19690 - protein, 11 aa, Dengue virus
HSGASHNILVE

SEQ ID NO: 19691 - protein, 11 aa, Dengue virus
SGASHNILVEV

SEQ ID NO: 19692 - protein, 11 aa, Dengue virus
GASHNILVEVQ

SEQ ID NO: 19693 - protein, 11 aa, Dengue virus
ASHNILVEVQD

SEQ ID NO: 19694 - protein, 11 aa, Dengue virus
SHNILVEVQDD

SEQ ID NO: 19695 - protein, 11 aa, Dengue virus
HNILVEVQDDG

SEQ ID NO: 19696 - protein, 11 aa, Dengue virus
NILVEVQDDGT

SEQ ID NO: 19697 - protein, 11 aa, Dengue virus
ILVEVQDDGTM

SEQ ID NO: 19698 - protein, 11 aa, Dengue virus
LVEVQDDGTMK

SEQ ID NO: 19699 - protein, 11 aa, Dengue virus
VEVQDDGTMKI

SEQ ID NO: 19700 - protein, 11 aa, Dengue virus
EVQDDGTMKIK

SEQ ID NO: 19701 - protein, 11 aa, Dengue virus
VQDDGTMKIKD

SEQ ID NO: 19702 - protein, 11 aa, Dengue virus
QDDGTMKIKDE

SEQ ID NO: 19703 - protein, 11 aa, Dengue virus
DDGTMKIKDEE

SEQ ID NO: 19704 - protein, 11 aa, Dengue virus
DGTMKIKDEER

SEQ ID NO: 19705 - protein, 11 aa, Dengue virus
GTMKIKDEERD

SEQ ID NO: 19706 - protein, 11 aa, Dengue virus
TMKIKDEERDD

SEQ ID NO: 19707 - protein, 11 aa, Dengue virus
MKIKDEERDDT

SEQ ID NO: 19708 - protein, 11 aa, Dengue virus
KIKDEERDDTL

SEQ ID NO: 19709 - protein, 11 aa, Dengue virus
IKDEERDDTLT

SEQ ID NO: 19710 - protein, 11 aa, Dengue virus
KDEERDDTLTI

SEQ ID NO: 19711 - protein, 11 aa, Dengue virus
DEERDDTLTIL

SEQ ID NO: 19712 - protein, 11 aa, Dengue virus
EERDDTLTILL

SEQ ID NO: 19713 - protein, 11 aa, Dengue virus
ERDDTLTILLK

SEQ ID NO: 19714 - protein, 11 aa, Dengue virus
RDDTLTILLKA

SEQ ID NO: 19715 - protein, 11 aa, Dengue virus
DDTLTILLKAT

SEQ ID NO: 19716 - protein, 11 aa, Dengue virus
DTLTILLKATL

SEQ ID NO: 19717 - protein, 11 aa, Dengue virus
TLTILLKATLL

SEQ ID NO: 19718 - protein, 11 aa, Dengue virus
LTILLKATLLA

SEQ ID NO: 19719 - protein, 11 aa, Dengue virus
TILLKATLLAV

SEQ ID NO: 19720 - protein, 11 aa, Dengue virus
ILLKATLLAVS

SEQ ID NO: 19721 - protein, 11 aa, Dengue virus
LLKATLLAVSG

SEQ ID NO: 19722 - protein, 11 aa, Dengue virus
LKATLLAVSGV

SEQ ID NO: 19723 - protein, 11 aa, Dengue virus
KATLLAVSGVY

SEQ ID NO: 19724 - protein, 11 aa, Dengue virus
ATLLAVSGVYP

SEQ ID NO: 19725 - protein, 11 aa, Dengue virus
LLAVSGVYPLS

SEQ ID NO: 19726 - protein, 11 aa, Dengue virus
LAVSGVYPLSI

SEQ ID NO: 19727 - protein, 11 aa, Dengue virus
AVSGVYPLSIP

SEQ ID NO: 19728 - protein, 11 aa, Dengue virus
VSGVYPLSIPA

SEQ ID NO: 19729 - protein, 11 aa, Dengue virus
SGVYPLSIPAT

SEQ ID NO: 19730 - protein, 11 aa, Dengue virus
GVYPLSIPATL

SEQ ID NO: 19731 - protein, 11 aa, Dengue virus
VYPLSIPATLF

SEQ ID NO: 19732 - protein, 11 aa, Dengue virus
YPLSIPATLFV

SEQ ID NO: 19733 - protein, 11 aa, Dengue virus
PLSIPATLFVW

SEQ ID NO: 19734 - protein, 11 aa, Dengue virus
SIPATLFVWYF

SEQ ID NO: 19735 - protein, 11 aa, Dengue virus
IPATLFVWYFW

SEQ ID NO: 19736 - protein, 11 aa, Dengue virus
PATLFVWYFWQ

SEQ ID NO: 19737 - protein, 11 aa, Dengue virus
KKKQRSGVLWD

SEQ ID NO: 19738 - protein, 11 aa, Dengue virus
KKQRSGVLWDT

SEQ ID NO: 19739 - protein, 11 aa, Dengue virus
KQRSGVLWDTP

SEQ ID NO: 19740 - protein, 11 aa, Dengue virus
QRSGVLWDTPS

SEQ ID NO: 19741 - protein, 11 aa, Dengue virus
RSGVLWDTPSP

SEQ ID NO: 19742 - protein, 11 aa, Dengue virus
SGVLWDTPSPP

SEQ ID NO: 19743 - protein, 11 aa, Dengue virus
GVLWDTPSPPE

SEQ ID NO: 19744 - protein, 11 aa, Dengue virus
VLWDTPSPPEV

SEQ ID NO: 19745 - protein, 11 aa, Dengue virus
LWDTPSPPEVE

SEQ ID NO: 19746 - protein, 11 aa, Dengue virus
WDTPSPPEVER

SEQ ID NO: 19747 - protein, 11 aa, Dengue virus
DTPSPPEVERA

SEQ ID NO: 19748 - protein, 11 aa, Dengue virus
TPSPPEVERAV

SEQ ID NO: 19749 - protein, 11 aa, Dengue virus
PSPPEVERAVL

SEQ ID NO: 19750 - protein, 11 aa, Dengue virus
SPPEVERAVLD

SEQ ID NO: 19751 - protein, 11 aa, Dengue virus
VERAVLDDGIY

SEQ ID NO: 19752 - protein, 11 aa, Dengue virus
ERAVLDDGIYR

SEQ ID NO: 19753 - protein, 11 aa, Dengue virus
RAVLDDGIYRI

SEQ ID NO: 19754 - protein, 11 aa, Dengue virus
AVLDDGIYRIM

SEQ ID NO: 19755 - protein, 11 aa, Dengue virus
VLDDGIYRIMQ

SEQ ID NO: 19756 - protein, 11 aa, Dengue virus
LDDGIYRIMQR

SEQ ID NO: 19757 - protein, 11 aa, Dengue virus
DDGIYRIMQRG

SEQ ID NO: 19758 - protein, 11 aa, Dengue virus
DGIYRIMQRGL

SEQ ID NO: 19759 - protein, 11 aa, Dengue virus
GIYRIMQRGLL

SEQ ID NO: 19760 - protein, 11 aa, Dengue virus
IYRIMQRGLLG

SEQ ID NO: 19761 - protein, 11 aa, Dengue virus
YRIMQRGLLGR

SEQ ID NO: 19762 - protein, 11 aa, Dengue virus
RIMQRGLLGRS

SEQ ID NO: 19763 - protein, 11 aa, Dengue virus
IMQRGLLGRSQ

SEQ ID NO: 19764 - protein, 11 aa, Dengue virus
MQRGLLGRSQV

SEQ ID NO: 19765 - protein, 11 aa, Dengue virus
QRGLLGRSQVG

SEQ ID NO: 19766 - protein, 11 aa, Dengue virus
RGLLGRSQVGV

SEQ ID NO: 19767 - protein, 11 aa, Dengue virus
GLLGRSQVGVG

SEQ ID NO: 19768 - protein, 11 aa, Dengue virus
LLGRSQVGVGV

SEQ ID NO: 19769 - protein, 11 aa, Dengue virus
LGRSQVGVGVF

SEQ ID NO: 19770 - protein, 11 aa, Dengue virus
GRSQVGVGVFQ

SEQ ID NO: 19771 - protein, 11 aa, Dengue virus
RSQVGVGVFQE

SEQ ID NO: 19772 - protein, 11 aa, Dengue virus
SQVGVGVFQEN

SEQ ID NO: 19773 - protein, 11 aa, Dengue virus
QVGVGVFQENV

SEQ ID NO: 19774 - protein, 11 aa, Dengue virus
VGVGVFQENVF

SEQ ID NO: 19775 - protein, 11 aa, Dengue virus
GVGVFQENVFH

SEQ ID NO: 19776 - protein, 11 aa, Dengue virus
VGVFQENVFHT

SEQ ID NO: 19777 - protein, 11 aa, Dengue virus
GVFQENVFHTM

SEQ ID NO: 19778 - protein, 11 aa, Dengue virus
VFQENVFHTMW

SEQ ID NO: 19779 - protein, 11 aa, Dengue virus
FQENVFHTMWH

SEQ ID NO: 19780 - protein, 11 aa, Dengue virus
QENVFHTMWHV

SEQ ID NO: 19781 - protein, 11 aa, Dengue virus
ENVFHTMWHVT

SEQ ID NO: 19782 - protein, 11 aa, Dengue virus
NVFHTMWHVTR

SEQ ID NO: 19783 - protein, 11 aa, Dengue virus
VFHTMWHVTRG

SEQ ID NO: 19784 - protein, 11 aa, Dengue virus
FHTMWHVTRGA

SEQ ID NO: 19785 - protein, 11 aa, Dengue virus
HTMWHVTRGAV

SEQ ID NO: 19786 - protein, 11 aa, Dengue virus
TMWHVTRGAVL

SEQ ID NO: 19787 - protein, 11 aa, Dengue virus
MWHVTRGAVLM

SEQ ID NO: 19788 - protein, 11 aa, Dengue virus
WHVTRGAVLMY

SEQ ID NO: 19789 - protein, 11 aa, Dengue virus
HVTRGAVLMYQ

SEQ ID NO: 19790 - protein, 11 aa, Dengue virus
VTRGAVLMYQG

SEQ ID NO: 19791 - protein, 11 aa, Dengue virus
TRGAVLMYQGK

SEQ ID NO: 19792 - protein, 11 aa, Dengue virus
RGAVLMYQGKR

SEQ ID NO: 19793 - protein, 11 aa, Dengue virus
GAVLMYQGKRL

SEQ ID NO: 19794 - protein, 11 aa, Dengue virus
AVLMYQGKRLE

SEQ ID NO: 19795 - protein, 11 aa, Dengue virus
VLMYQGKRLEP

SEQ ID NO: 19796 - protein, 11 aa, Dengue virus
LMYQGKRLEPS

SEQ ID NO: 19797 - protein, 11 aa, Dengue virus
MYQGKRLEPSW

SEQ ID NO: 19798 - protein, 11 aa, Dengue virus
YQGKRLEPSWA

SEQ ID NO: 19799 - protein, 11 aa, Dengue virus
QGKRLEPSWAS

SEQ ID NO: 19800 - protein, 11 aa, Dengue virus
GKRLEPSWASV

SEQ ID NO: 19801 - protein, 11 aa, Dengue virus
KRLEPSWASVK

SEQ ID NO: 19802 - protein, 11 aa, Dengue virus
RLEPSWASVKK

SEQ ID NO: 19803 - protein, 11 aa, Dengue virus
LEPSWASVKKD

SEQ ID NO: 19804 - protein, 11 aa, Dengue virus
EPSWASVKKDL

SEQ ID NO: 19805 - protein, 11 aa, Dengue virus
PSWASVKKDLI

SEQ ID NO: 19806 - protein, 11 aa, Dengue virus
SWASVKKDLIS

SEQ ID NO: 19807 - protein, 11 aa, Dengue virus
WASVKKDLISY

SEQ ID NO: 19808 - protein, 11 aa, Dengue virus
ASVKKDLISYG

SEQ ID NO: 19809 - protein, 11 aa, Dengue virus
SVKKDLISYGG

SEQ ID NO: 19810 - protein, 11 aa, Dengue virus
VKKDLISYGGG

SEQ ID NO: 19811 - protein, 11 aa, Dengue virus
KKDLISYGGGW

SEQ ID NO: 19812 - protein, 11 aa, Dengue virus
KDLISYGGGWR

SEQ ID NO: 19813 - protein, 11 aa, Dengue virus
DLISYGGGWRL

SEQ ID NO: 19814 - protein, 11 aa, Dengue virus
LISYGGGWRLQ

SEQ ID NO: 19815 - protein, 11 aa, Dengue virus
ISYGGGWRLQG

SEQ ID NO: 19816 - protein, 11 aa, Dengue virus
SYGGGWRLQGS

SEQ ID NO: 19817 - protein, 11 aa, Dengue virus
YGGGWRLQGSW

SEQ ID NO: 19818 - protein, 11 aa, Dengue virus
GGGWRLQGSWN

SEQ ID NO: 19819 - protein, 11 aa, Dengue virus
QGSWNTGEEVQ

SEQ ID NO: 19820 - protein, 11 aa, Dengue virus
GSWNTGEEVQV

SEQ ID NO: 19821 - protein, 11 aa, Dengue virus
SWNTGEEVQVI

SEQ ID NO: 19822 - protein, 11 aa, Dengue virus
WNTGEEVQVIA

SEQ ID NO: 19823 - protein, 11 aa, Dengue virus
NTGEEVQVIAV

SEQ ID NO: 19824 - protein, 11 aa, Dengue virus
TGEEVQVIAVE

SEQ ID NO: 19825 - protein, 11 aa, Dengue virus
GEEVQVIAVEP

SEQ ID NO: 19826 - protein, 11 aa, Dengue virus
EEVQVIAVEPG

SEQ ID NO: 19827 - protein, 11 aa, Dengue virus
EVQVIAVEPGK

SEQ ID NO: 19828 - protein, 11 aa, Dengue virus
VQVIAVEPGKN

SEQ ID NO: 19829 - protein, 11 aa, Dengue virus
QVIAVEPGKNP

SEQ ID NO: 19830 - protein, 11 aa, Dengue virus
VIAVEPGKNPK

SEQ ID NO: 19831 - protein, 11 aa, Dengue virus
IAVEPGKNPKN

SEQ ID NO: 19832 - protein, 11 aa, Dengue virus
AVEPGKNPKNV

SEQ ID NO: 19833 - protein, 11 aa, Dengue virus
VEPGKNPKNVQ

SEQ ID NO: 19834 - protein, 11 aa, Dengue virus
EPGKNPKNVQT

SEQ ID NO: 19835 - protein, 11 aa, Dengue virus
PGKNPKNVQTA

SEQ ID NO: 19836 - protein, 11 aa, Dengue virus
GKNPKNVQTAP

SEQ ID NO: 19837 - protein, 11 aa, Dengue virus
KNPKNVQTAPG

SEQ ID NO: 19838 - protein, 11 aa, Dengue virus
NPKNVQTAPGT

SEQ ID NO: 19839 - protein, 11 aa, Dengue virus
PKNVQTAPGTF

SEQ ID NO: 19840 - protein, 11 aa, Dengue virus
KNVQTAPGTFK

SEQ ID NO: 19841 - protein, 11 aa, Dengue virus
NVQTAPGTFKT

SEQ ID NO: 19842 - protein, 11 aa, Dengue virus
VQTAPGTFKTP

SEQ ID NO: 19843 - protein, 11 aa, Dengue virus
QTAPGTFKTPE

SEQ ID NO: 19844 - protein, 11 aa, Dengue virus
TAPGTFKTPEG

SEQ ID NO: 19845 - protein, 11 aa, Dengue virus
APGTFKTPEGE

SEQ ID NO: 19846 - protein, 11 aa, Dengue virus
PGTFKTPEGEV

SEQ ID NO: 19847 - protein, 11 aa, Dengue virus
GTFKTPEGEVG

SEQ ID NO: 19848 - protein, 11 aa, Dengue virus
TFKTPEGEVGA

SEQ ID NO: 19849 - protein, 11 aa, Dengue virus
FKTPEGEVGAI

SEQ ID NO: 19850 - protein, 11 aa, Dengue virus
KTPEGEVGAIA

SEQ ID NO: 19851 - protein, 11 aa, Dengue virus
TPEGEVGAIAL

SEQ ID NO: 19852 - protein, 11 aa, Dengue virus
PEGEVGAIALD

SEQ ID NO: 19853 - protein, 11 aa, Dengue virus
EGEVGAIALDF

SEQ ID NO: 19854 - protein, 11 aa, Dengue virus
GEVGAIALDFK

SEQ ID NO: 19855 - protein, 11 aa, Dengue virus
EVGAIALDFKP

SEQ ID NO: 19856 - protein, 11 aa, Dengue virus
VGAIALDFKPG

SEQ ID NO: 19857 - protein, 11 aa, Dengue virus
GAIALDFKPGT

SEQ ID NO: 19858 - protein, 11 aa, Dengue virus
AIALDFKPGTS

SEQ ID NO: 19859 - protein, 11 aa, Dengue virus
IALDFKPGTSG

SEQ ID NO: 19860 - protein, 11 aa, Dengue virus
ALDFKPGTSGS

SEQ ID NO: 19861 - protein, 11 aa, Dengue virus
LDFKPGTSGSP

SEQ ID NO: 19862 - protein, 11 aa, Dengue virus
DFKPGTSGSPI

SEQ ID NO: 19863 - protein, 11 aa, Dengue virus
FKPGTSGSPIV

SEQ ID NO: 19864 - protein, 11 aa, Dengue virus
KPGTSGSPIVN

SEQ ID NO: 19865 - protein, 11 aa, Dengue virus
PGTSGSPIVNR

SEQ ID NO: 19866 - protein, 11 aa, Dengue virus
GTSGSPIVNRE

SEQ ID NO: 19867 - protein, 11 aa, Dengue virus
TSGSPIVNREG

SEQ ID NO: 19868 - protein, 11 aa, Dengue virus
SGSPIVNREGK

SEQ ID NO: 19869 - protein, 11 aa, Dengue virus
GSPIVNREGKI

SEQ ID NO: 19870 - protein, 11 aa, Dengue virus
SPIVNREGKIV

SEQ ID NO: 19871 - protein, 11 aa, Dengue virus
PIVNREGKIVG

SEQ ID NO: 19872 - protein, 11 aa, Dengue virus
IVNREGKIVGL

SEQ ID NO: 19873 - protein, 11 aa, Dengue virus
VNREGKIVGLY

SEQ ID NO: 19874 - protein, 11 aa, Dengue virus
NREGKIVGLYG

SEQ ID NO: 19875 - protein, 11 aa, Dengue virus
REGKIVGLYGN

SEQ ID NO: 19876 - protein, 11 aa, Dengue virus
EGKIVGLYGNG

SEQ ID NO: 19877 - protein, 11 aa, Dengue virus
GKIVGLYGNGV

SEQ ID NO: 19878 - protein, 11 aa, Dengue virus
KIVGLYGNGVV

SEQ ID NO: 19879 - protein, 11 aa, Dengue virus
IVGLYGNGVVT

SEQ ID NO: 19880 - protein, 11 aa, Dengue virus
VGLYGNGVVTT

SEQ ID NO: 19881 - protein, 11 aa, Dengue virus
GLYGNGVVTTS

SEQ ID NO: 19882 - protein, 11 aa, Dengue virus
LYGNGVVTTSG

SEQ ID NO: 19883 - protein, 11 aa, Dengue virus
YGNGVVTTSGT

SEQ ID NO: 19884 - protein, 11 aa, Dengue virus
GNGVVTTSGTY

SEQ ID NO: 19885 - protein, 11 aa, Dengue virus
NGVVTTSGTYV

SEQ ID NO: 19886 - protein, 11 aa, Dengue virus
GVVTTSGTYVS

SEQ ID NO: 19887 - protein, 11 aa, Dengue virus
VVTTSGTYVSA

SEQ ID NO: 19888 - protein, 11 aa, Dengue virus
VTTSGTYVSAI

SEQ ID NO: 19889 - protein, 11 aa, Dengue virus
TTSGTYVSAIA

SEQ ID NO: 19890 - protein, 11 aa, Dengue virus
TSGTYVSAIAQ

SEQ ID NO: 19891 - protein, 11 aa, Dengue virus
SGTYVSAIAQA

SEQ ID NO: 19892 - protein, 11 aa, Dengue virus
GTYVSAIAQAK

SEQ ID NO: 19893 - protein, 11 aa, Dengue virus
TYVSAIAQAKA

SEQ ID NO: 19894 - protein, 11 aa, Dengue virus
YVSAIAQAKAS

SEQ ID NO: 19895 - protein, 11 aa, Dengue virus
VSAIAQAKASQ

SEQ ID NO: 19896 - protein, 11 aa, Dengue virus
SAIAQAKASQE

SEQ ID NO: 19897 - protein, 11 aa, Dengue virus
AIAQAKASQEG

SEQ ID NO: 19898 - protein, 11 aa, Dengue virus
IAQAKASQEGP

SEQ ID NO: 19899 - protein, 11 aa, Dengue virus
AQAKASQEGPL

SEQ ID NO: 19900 - protein, 11 aa, Dengue virus
QAKASQEGPLP

SEQ ID NO: 19901 - protein, 11 aa, Dengue virus
AKASQEGPLPE

SEQ ID NO: 19902 - protein, 11 aa, Dengue virus
KASQEGPLPEI

SEQ ID NO: 19903 - protein, 11 aa, Dengue virus
ASQEGPLPEIE

SEQ ID NO: 19904 - protein, 11 aa, Dengue virus
SQEGPLPEIED

SEQ ID NO: 19905 - protein, 11 aa, Dengue virus
QEGPLPEIEDE

SEQ ID NO: 19906 - protein, 11 aa, Dengue virus
EGPLPEIEDEV

SEQ ID NO: 19907 - protein, 11 aa, Dengue virus
GPLPEIEDEVF

SEQ ID NO: 19908 - protein, 11 aa, Dengue virus
PLPEIEDEVFR

SEQ ID NO: 19909 - protein, 11 aa, Dengue virus
LPEIEDEVFRK

SEQ ID NO: 19910 - protein, 11 aa, Dengue virus
PEIEDEVFRKR

SEQ ID NO: 19911 - protein, 11 aa, Dengue virus
EIEDEVFRKRN

SEQ ID NO: 19912 - protein, 11 aa, Dengue virus
IEDEVFRKRNL

SEQ ID NO: 19913 - protein, 11 aa, Dengue virus
EDEVFRKRNLT

SEQ ID NO: 19914 - protein, 11 aa, Dengue virus
DEVFRKRNLTI

SEQ ID NO: 19915 - protein, 11 aa, Dengue virus
EVFRKRNLTIM

SEQ ID NO: 19916 - protein, 11 aa, Dengue virus
VFRKRNLTIMD

SEQ ID NO: 19917 - protein, 11 aa, Dengue virus
FRKRNLTIMDL

SEQ ID NO: 19918 - protein, 11 aa, Dengue virus
RKRNLTIMDLH

SEQ ID NO: 19919 - protein, 11 aa, Dengue virus
KRNLTIMDLHP

SEQ ID NO: 19920 - protein, 11 aa, Dengue virus
RNLTIMDLHPG

SEQ ID NO: 19921 - protein, 11 aa, Dengue virus
NLTIMDLHPGS

SEQ ID NO: 19922 - protein, 11 aa, Dengue virus
LTIMDLHPGSG

SEQ ID NO: 19923 - protein, 11 aa, Dengue virus
TIMDLHPGSGK

SEQ ID NO: 19924 - protein, 11 aa, Dengue virus
IMDLHPGSGKT

SEQ ID NO: 19925 - protein, 11 aa, Dengue virus
MDLHPGSGKTR

SEQ ID NO: 19926 - protein, 11 aa, Dengue virus
DLHPGSGKTRR

SEQ ID NO: 19927 - protein, 11 aa, Dengue virus
LHPGSGKTRRY

SEQ ID NO: 19928 - protein, 11 aa, Dengue virus
HPGSGKTRRYL

SEQ ID NO: 19929 - protein, 11 aa, Dengue virus
PGSGKTRRYLP

SEQ ID NO: 19930 - protein, 11 aa, Dengue virus
GSGKTRRYLPA

SEQ ID NO: 19931 - protein, 11 aa, Dengue virus
SGKTRRYLPAI

SEQ ID NO: 19932 - protein, 11 aa, Dengue virus
GKTRRYLPAIV

SEQ ID NO: 19933 - protein, 11 aa, Dengue virus
KTRRYLPAIVR

SEQ ID NO: 19934 - protein, 11 aa, Dengue virus
TRRYLPAIVRE

SEQ ID NO: 19935 - protein, 11 aa, Dengue virus
RRYLPAIVREA

SEQ ID NO: 19936 - protein, 11 aa, Dengue virus
RYLPAIVREAI

SEQ ID NO: 19937 - protein, 11 aa, Dengue virus
YLPAIVREAIK

SEQ ID NO: 19938 - protein, 11 aa, Dengue virus
LPAIVREAIKR

SEQ ID NO: 19939 - protein, 11 aa, Dengue virus
PAIVREAIKRK

SEQ ID NO: 19940 - protein, 11 aa, Dengue virus
VREAIKRKLRT

SEQ ID NO: 19941 - protein, 11 aa, Dengue virus
REAIKRKLRTL

SEQ ID NO: 19942 - protein, 11 aa, Dengue virus
IKRKLRTLILA

SEQ ID NO: 19943 - protein, 11 aa, Dengue virus
KRKLRTLILAP

SEQ ID NO: 19944 - protein, 11 aa, Dengue virus
RKLRTLILAPT

SEQ ID NO: 19945 - protein, 11 aa, Dengue virus
KLRTLILAPTR

SEQ ID NO: 19946 - protein, 11 aa, Dengue virus
LRTLILAPTRV

SEQ ID NO: 19947 - protein, 11 aa, Dengue virus
RTLILAPTRVV

SEQ ID NO: 19948 - protein, 11 aa, Dengue virus
TLILAPTRVVA

SEQ ID NO: 19949 - protein, 11 aa, Dengue virus
LILAPTRVVAS

SEQ ID NO: 19950 - protein, 11 aa, Dengue virus
ILAPTRVVASE

SEQ ID NO: 19951 - protein, 11 aa, Dengue virus
LAPTRVVASEM

SEQ ID NO: 19952 - protein, 11 aa, Dengue virus
APTRVVASEMA

SEQ ID NO: 19953 - protein, 11 aa, Dengue virus
PTRVVASEMAE

SEQ ID NO: 19954 - protein, 11 aa, Dengue virus
TRVVASEMAEA

SEQ ID NO: 19955 - protein, 11 aa, Dengue virus
RVVASEMAEAL

SEQ ID NO: 19956 - protein, 11 aa, Dengue virus
VVASEMAEALK

SEQ ID NO: 19957 - protein, 11 aa, Dengue virus
VASEMAEALKG

SEQ ID NO: 19958 - protein, 11 aa, Dengue virus
ASEMAEALKGM

SEQ ID NO: 19959 - protein, 11 aa, Dengue virus
SEMAEALKGMP

SEQ ID NO: 19960 - protein, 11 aa, Dengue virus
EMAEALKGMPI

SEQ ID NO: 19961 - protein, 11 aa, Dengue virus
MAEALKGMPIR

SEQ ID NO: 19962 - protein, 11 aa, Dengue virus
AEALKGMPIRY

SEQ ID NO: 19963 - protein, 11 aa, Dengue virus
EALKGMPIRYQ

SEQ ID NO: 19964 - protein, 11 aa, Dengue virus
ALKGMPIRYQT

SEQ ID NO: 19965 - protein, 11 aa, Dengue virus
LKGMPIRYQTT

SEQ ID NO: 19966 - protein, 11 aa, Dengue virus
KGMPIRYQTTA

SEQ ID NO: 19967 - protein, 11 aa, Dengue virus
GMPIRYQTTAV

SEQ ID NO: 19968 - protein, 11 aa, Dengue virus
MPIRYQTTAVK

SEQ ID NO: 19969 - protein, 11 aa, Dengue virus
PIRYQTTAVKS

SEQ ID NO: 19970 - protein, 11 aa, Dengue virus
IRYQTTAVKSE

SEQ ID NO: 19971 - protein, 11 aa, Dengue virus
RYQTTAVKSEH

SEQ ID NO: 19972 - protein, 11 aa, Dengue virus
YQTTAVKSEHT

SEQ ID NO: 19973 - protein, 11 aa, Dengue virus
QTTAVKSEHTG

SEQ ID NO: 19974 - protein, 11 aa, Dengue virus
TTAVKSEHTGK

SEQ ID NO: 19975 - protein, 11 aa, Dengue virus
TAVKSEHTGKE

SEQ ID NO: 19976 - protein, 11 aa, Dengue virus
AVKSEHTGKEI

SEQ ID NO: 19977 - protein, 11 aa, Dengue virus
VKSEHTGKEIV

SEQ ID NO: 19978 - protein, 11 aa, Dengue virus
KSEHTGKEIVD

SEQ ID NO: 19979 - protein, 11 aa, Dengue virus
SEHTGKEIVDL

SEQ ID NO: 19980 - protein, 11 aa, Dengue virus
EHTGKEIVDLM

SEQ ID NO: 19981 - protein, 11 aa, Dengue virus
HTGKEIVDLMC

SEQ ID NO: 19982 - protein, 11 aa, Dengue virus
TGKEIVDLMCH

SEQ ID NO: 19983 - protein, 11 aa, Dengue virus
GKEIVDLMCHA

SEQ ID NO: 19984 - protein, 11 aa, Dengue virus
KEIVDLMCHAT

SEQ ID NO: 19985 - protein, 11 aa, Dengue virus
EIVDLMCHATF

SEQ ID NO: 19986 - protein, 11 aa, Dengue virus
IVDLMCHATFT

SEQ ID NO: 19987 - protein, 11 aa, Dengue virus
VDLMCHATFTM

SEQ ID NO: 19988 - protein, 11 aa, Dengue virus
DLMCHATFTMR

SEQ ID NO: 19989 - protein, 11 aa, Dengue virus
LMCHATFTMRL

SEQ ID NO: 19990 - protein, 11 aa, Dengue virus
MCHATFTMRLL

SEQ ID NO: 19991 - protein, 11 aa, Dengue virus
CHATFTMRLLS

SEQ ID NO: 19992 - protein, 11 aa, Dengue virus
HATFTMRLLSP

SEQ ID NO: 19993 - protein, 11 aa, Dengue virus
ATFTMRLLSPV

SEQ ID NO: 19994 - protein, 11 aa, Dengue virus
TFTMRLLSPVR

SEQ ID NO: 19995 - protein, 11 aa, Dengue virus
FTMRLLSPVRV

SEQ ID NO: 19996 - protein, 11 aa, Dengue virus
TMRLLSPVRVP

SEQ ID NO: 19997 - protein, 11 aa, Dengue virus
MRLLSPVRVPN

SEQ ID NO: 19998 - protein, 11 aa, Dengue virus
RLLSPVRVPNY

SEQ ID NO: 19999 - protein, 11 aa, Dengue virus
LLSPVRVPNYN

SEQ ID NO: 20000 - protein, 11 aa, Dengue virus
LSPVRVPNYNM

SEQ ID NO: 20001 - protein, 11 aa, Dengue virus
SPVRVPNYNMI

SEQ ID NO: 20002 - protein, 11 aa, Dengue virus
PVRVPNYNMII

SEQ ID NO: 20003 - protein, 11 aa, Dengue virus
VRVPNYNMIIM

SEQ ID NO: 20004 - protein, 11 aa, Dengue virus
RVPNYNMIIMD

SEQ ID NO: 20005 - protein, 11 aa, Dengue virus
VPNYNMIIMDE

SEQ ID NO: 20006 - protein, 11 aa, Dengue virus
PNYNMIIMDEA

SEQ ID NO: 20007 - protein, 11 aa, Dengue virus
NYNMIIMDEAH

SEQ ID NO: 20008 - protein, 11 aa, Dengue virus
YNMIIMDEAHF

SEQ ID NO: 20009 - protein, 11 aa, Dengue virus
NMIIMDEAHFT

SEQ ID NO: 20010 - protein, 11 aa, Dengue virus
MIIMDEAHFTD

SEQ ID NO: 20011 - protein, 11 aa, Dengue virus
IIMDEAHFTDP

SEQ ID NO: 20012 - protein, 11 aa, Dengue virus
IMDEAHFTDPS

SEQ ID NO: 20013 - protein, 11 aa, Dengue virus
MDEAHFTDPSS

SEQ ID NO: 20014 - protein, 11 aa, Dengue virus
DEAHFTDPSSI

SEQ ID NO: 20015 - protein, 11 aa, Dengue virus
EAHFTDPSSIA

SEQ ID NO: 20016 - protein, 11 aa, Dengue virus
AHFTDPSSIAA

SEQ ID NO: 20017 - protein, 11 aa, Dengue virus
HFTDPSSIAAR

SEQ ID NO: 20018 - protein, 11 aa, Dengue virus
FTDPSSIAARG

SEQ ID NO: 20019 - protein, 11 aa, Dengue virus
TDPSSIAARGY

SEQ ID NO: 20020 - protein, 11 aa, Dengue virus
DPSSIAARGYI

SEQ ID NO: 20021 - protein, 11 aa, Dengue virus
PSSIAARGYIS

SEQ ID NO: 20022 - protein, 11 aa, Dengue virus
SSIAARGYIST

SEQ ID NO: 20023 - protein, 11 aa, Dengue virus
SIAARGYISTR

SEQ ID NO: 20024 - protein, 11 aa, Dengue virus
IAARGYISTRV

SEQ ID NO: 20025 - protein, 11 aa, Dengue virus
AARGYISTRVG

SEQ ID NO: 20026 - protein, 11 aa, Dengue virus
ARGYISTRVGM

SEQ ID NO: 20027 - protein, 11 aa, Dengue virus
RGYISTRVGMG

SEQ ID NO: 20028 - protein, 11 aa, Dengue virus
GYISTRVGMGE

SEQ ID NO: 20029 - protein, 11 aa, Dengue virus
YISTRVGMGEA

SEQ ID NO: 20030 - protein, 11 aa, Dengue virus
ISTRVGMGEAA

SEQ ID NO: 20031 - protein, 11 aa, Dengue virus
STRVGMGEAAA

SEQ ID NO: 20032 - protein, 11 aa, Dengue virus
TRVGMGEAAAI

SEQ ID NO: 20033 - protein, 11 aa, Dengue virus
RVGMGEAAAIF

SEQ ID NO: 20034 - protein, 11 aa, Dengue virus
VGMGEAAAIFM

SEQ ID NO: 20035 - protein, 11 aa, Dengue virus
GMGEAAAIFMT

SEQ ID NO: 20036 - protein, 11 aa, Dengue virus
MGEAAAIFMTA

SEQ ID NO: 20037 - protein, 11 aa, Dengue virus
GEAAAIFMTAT

SEQ ID NO: 20038 - protein, 11 aa, Dengue virus
EAAAIFMTATP

SEQ ID NO: 20039 - protein, 11 aa, Dengue virus
AAAIFMTATPP

SEQ ID NO: 20040 - protein, 11 aa, Dengue virus
AAIFMTATPPG

SEQ ID NO: 20041 - protein, 11 aa, Dengue virus
AIFMTATPPGS

SEQ ID NO: 20042 - protein, 11 aa, Dengue virus
IFMTATPPGSV

SEQ ID NO: 20043 - protein, 11 aa, Dengue virus
FMTATPPGSVE

SEQ ID NO: 20044 - protein, 11 aa, Dengue virus
MTATPPGSVEA

SEQ ID NO: 20045 - protein, 11 aa, Dengue virus
TATPPGSVEAF

SEQ ID NO: 20046 - protein, 11 aa, Dengue virus
ATPPGSVEAFP

SEQ ID NO: 20047 - protein, 11 aa, Dengue virus
TPPGSVEAFPQ

SEQ ID NO: 20048 - protein, 11 aa, Dengue virus
PPGSVEAFPQS

SEQ ID NO: 20049 - protein, 11 aa, Dengue virus
PGSVEAFPQSN

SEQ ID NO: 20050 - protein, 11 aa, Dengue virus
GSVEAFPQSNA

SEQ ID NO: 20051 - protein, 11 aa, Dengue virus
SVEAFPQSNAV

SEQ ID NO: 20052 - protein, 11 aa, Dengue virus
VEAFPQSNAVI

SEQ ID NO: 20053 - protein, 11 aa, Dengue virus
EAFPQSNAVIQ

SEQ ID NO: 20054 - protein, 11 aa, Dengue virus
AFPQSNAVIQD

SEQ ID NO: 20055 - protein, 11 aa, Dengue virus
FPQSNAVIQDE

SEQ ID NO: 20056 - protein, 11 aa, Dengue virus
PQSNAVIQDEE

SEQ ID NO: 20057 - protein, 11 aa, Dengue virus
QSNAVIQDEER

SEQ ID NO: 20058 - protein, 11 aa, Dengue virus
SNAVIQDEERD

SEQ ID NO: 20059 - protein, 11 aa, Dengue virus
NAVIQDEERDI

SEQ ID NO: 20060 - protein, 11 aa, Dengue virus
AVIQDEERDIP

SEQ ID NO: 20061 - protein, 11 aa, Dengue virus
VIQDEERDIPE

SEQ ID NO: 20062 - protein, 11 aa, Dengue virus
IQDEERDIPER

SEQ ID NO: 20063 - protein, 11 aa, Dengue virus
QDEERDIPERS

SEQ ID NO: 20064 - protein, 11 aa, Dengue virus
DEERDIPERSW

SEQ ID NO: 20065 - protein, 11 aa, Dengue virus
EERDIPERSWN

SEQ ID NO: 20066 - protein, 11 aa, Dengue virus
ERDIPERSWNS

SEQ ID NO: 20067 - protein, 11 aa, Dengue virus
RDIPERSWNSG

SEQ ID NO: 20068 - protein, 11 aa, Dengue virus
DIPERSWNSGY

SEQ ID NO: 20069 - protein, 11 aa, Dengue virus
IPERSWNSGYE

SEQ ID NO: 20070 - protein, 11 aa, Dengue virus
PERSWNSGYEW

SEQ ID NO: 20071 - protein, 11 aa, Dengue virus
ERSWNSGYEWI

SEQ ID NO: 20072 - protein, 11 aa, Dengue virus
RSWNSGYEWIT

SEQ ID NO: 20073 - protein, 11 aa, Dengue virus
SWNSGYEWITD

SEQ ID NO: 20074 - protein, 11 aa, Dengue virus
WNSGYEWITDF

SEQ ID NO: 20075 - protein, 11 aa, Dengue virus
NSGYEWITDFP

SEQ ID NO: 20076 - protein, 11 aa, Dengue virus
SGYEWITDFPG

SEQ ID NO: 20077 - protein, 11 aa, Dengue virus
GYEWITDFPGK

SEQ ID NO: 20078 - protein, 11 aa, Dengue virus
YEWITDFPGKT

SEQ ID NO: 20079 - protein, 11 aa, Dengue virus
EWITDFPGKTV

SEQ ID NO: 20080 - protein, 11 aa, Dengue virus
WITDFPGKTVW

SEQ ID NO: 20081 - protein, 11 aa, Dengue virus
ITDFPGKTVWF

SEQ ID NO: 20082 - protein, 11 aa, Dengue virus
TDFPGKTVWFV

SEQ ID NO: 20083 - protein, 11 aa, Dengue virus
DFPGKTVWFVP

SEQ ID NO: 20084 - protein, 11 aa, Dengue virus
FPGKTVWFVPS

SEQ ID NO: 20085 - protein, 11 aa, Dengue virus
PGKTVWFVPSI

SEQ ID NO: 20086 - protein, 11 aa, Dengue virus
GKTVWFVPSIK

SEQ ID NO: 20087 - protein, 11 aa, Dengue virus
KTVWFVPSIKS

SEQ ID NO: 20088 - protein, 11 aa, Dengue virus
TVWFVPSIKSG

SEQ ID NO: 20089 - protein, 11 aa, Dengue virus
VWFVPSIKSGN

SEQ ID NO: 20090 - protein, 11 aa, Dengue virus
WFVPSIKSGND

SEQ ID NO: 20091 - protein, 11 aa, Dengue virus
FVPSIKSGNDI

SEQ ID NO: 20092 - protein, 11 aa, Dengue virus
VPSIKSGNDIA

SEQ ID NO: 20093 - protein, 11 aa, Dengue virus
PSIKSGNDIAN

SEQ ID NO: 20094 - protein, 11 aa, Dengue virus
SIKSGNDIANC

SEQ ID NO: 20095 - protein, 11 aa, Dengue virus
IKSGNDIANCL

SEQ ID NO: 20096 - protein, 11 aa, Dengue virus
KSGNDIANCLR

SEQ ID NO: 20097 - protein, 11 aa, Dengue virus
SGNDIANCLRK

SEQ ID NO: 20098 - protein, 11 aa, Dengue virus
GNDIANCLRKN

SEQ ID NO: 20099 - protein, 11 aa, Dengue virus
NDIANCLRKNG

SEQ ID NO: 20100 - protein, 11 aa, Dengue virus
DIANCLRKNGK

SEQ ID NO: 20101 - protein, 11 aa, Dengue virus
IANCLRKNGKR

SEQ ID NO: 20102 - protein, 11 aa, Dengue virus
ANCLRKNGKRV

SEQ ID NO: 20103 - protein, 11 aa, Dengue virus
NCLRKNGKRVI

SEQ ID NO: 20104 - protein, 11 aa, Dengue virus
CLRKNGKRVIQ

SEQ ID NO: 20105 - protein, 11 aa, Dengue virus
LRKNGKRVIQL

SEQ ID NO: 20106 - protein, 11 aa, Dengue virus
RKNGKRVIQLS

SEQ ID NO: 20107 - protein, 11 aa, Dengue virus
KNGKRVIQLSR

SEQ ID NO: 20108 - protein, 11 aa, Dengue virus
NGKRVIQLSRK

SEQ ID NO: 20109 - protein, 11 aa, Dengue virus
GKRVIQLSRKT

SEQ ID NO: 20110 - protein, 11 aa, Dengue virus
KRVIQLSRKTF

SEQ ID NO: 20111 - protein, 11 aa, Dengue virus
RVIQLSRKTFD

SEQ ID NO: 20112 - protein, 11 aa, Dengue virus
VIQLSRKTFDT

SEQ ID NO: 20113 - protein, 11 aa, Dengue virus
IQLSRKTFDTE

SEQ ID NO: 20114 - protein, 11 aa, Dengue virus
QLSRKTFDTEY

SEQ ID NO: 20115 - protein, 11 aa, Dengue virus
LSRKTFDTEYQ

SEQ ID NO: 20116 - protein, 11 aa, Dengue virus
SRKTFDTEYQK

SEQ ID NO: 20117 - protein, 11 aa, Dengue virus
RKTFDTEYQKT

SEQ ID NO: 20118 - protein, 11 aa, Dengue virus
KTFDTEYQKTK

SEQ ID NO: 20119 - protein, 11 aa, Dengue virus
TFDTEYQKTKN

SEQ ID NO: 20120 - protein, 11 aa, Dengue virus
FDTEYQKTKNN

SEQ ID NO: 20121 - protein, 11 aa, Dengue virus
DTEYQKTKNND

SEQ ID NO: 20122 - protein, 11 aa, Dengue virus
TEYQKTKNNDW

SEQ ID NO: 20123 - protein, 11 aa, Dengue virus
EYQKTKNNDWD

SEQ ID NO: 20124 - protein, 11 aa, Dengue virus
YQKTKNNDWDY

SEQ ID NO: 20125 - protein, 11 aa, Dengue virus
QKTKNNDWDYV

SEQ ID NO: 20126 - protein, 11 aa, Dengue virus
KTKNNDWDYVV

SEQ ID NO: 20127 - protein, 11 aa, Dengue virus
TKNNDWDYVVT

SEQ ID NO: 20128 - protein, 11 aa, Dengue virus
KNNDWDYVVTT

SEQ ID NO: 20129 - protein, 11 aa, Dengue virus
NNDWDYVVTTD

SEQ ID NO: 20130 - protein, 11 aa, Dengue virus
NDWDYVVTTDI

SEQ ID NO: 20131 - protein, 11 aa, Dengue virus
DWDYVVTTDIS

SEQ ID NO: 20132 - protein, 11 aa, Dengue virus
WDYVVTTDISE

SEQ ID NO: 20133 - protein, 11 aa, Dengue virus
DYVVTTDISEM

SEQ ID NO: 20134 - protein, 11 aa, Dengue virus
YVVTTDISEMG

SEQ ID NO: 20135 - protein, 11 aa, Dengue virus
VVTTDISEMGA

SEQ ID NO: 20136 - protein, 11 aa, Dengue virus
VTTDISEMGAN

SEQ ID NO: 20137 - protein, 11 aa, Dengue virus
TTDISEMGANF

SEQ ID NO: 20138 - protein, 11 aa, Dengue virus
TDISEMGANFR

SEQ ID NO: 20139 - protein, 11 aa, Dengue virus
DISEMGANFRA

SEQ ID NO: 20140 - protein, 11 aa, Dengue virus
ISEMGANFRAD

SEQ ID NO: 20141 - protein, 11 aa, Dengue virus
SEMGANFRADR

SEQ ID NO: 20142 - protein, 11 aa, Dengue virus
EMGANFRADRV

SEQ ID NO: 20143 - protein, 11 aa, Dengue virus
MGANFRADRVI

SEQ ID NO: 20144 - protein, 11 aa, Dengue virus
GANFRADRVID

SEQ ID NO: 20145 - protein, 11 aa, Dengue virus
ANFRADRVIDP

SEQ ID NO: 20146 - protein, 11 aa, Dengue virus
NFRADRVIDPR

SEQ ID NO: 20147 - protein, 11 aa, Dengue virus
FRADRVIDPRR

SEQ ID NO: 20148 - protein, 11 aa, Dengue virus
RADRVIDPRRC

SEQ ID NO: 20149 - protein, 11 aa, Dengue virus
ADRVIDPRRCL

SEQ ID NO: 20150 - protein, 11 aa, Dengue virus
DRVIDPRRCLK

SEQ ID NO: 20151 - protein, 11 aa, Dengue virus
RVIDPRRCLKP

SEQ ID NO: 20152 - protein, 11 aa, Dengue virus
VIDPRRCLKPV

SEQ ID NO: 20153 - protein, 11 aa, Dengue virus
IDPRRCLKPVI

SEQ ID NO: 20154 - protein, 11 aa, Dengue virus
DPRRCLKPVIL

SEQ ID NO: 20155 - protein, 11 aa, Dengue virus
PRRCLKPVILK

SEQ ID NO: 20156 - protein, 11 aa, Dengue virus
RRCLKPVILKD

SEQ ID NO: 20157 - protein, 11 aa, Dengue virus
RCLKPVILKDG

SEQ ID NO: 20158 - protein, 11 aa, Dengue virus
CLKPVILKDGP

SEQ ID NO: 20159 - protein, 11 aa, Dengue virus
LKPVILKDGPE

SEQ ID NO: 20160 - protein, 11 aa, Dengue virus
KPVILKDGPER

SEQ ID NO: 20161 - protein, 11 aa, Dengue virus
PVILKDGPERV

SEQ ID NO: 20162 - protein, 11 aa, Dengue virus
VILKDGPERVI

SEQ ID NO: 20163 - protein, 11 aa, Dengue virus
ILKDGPERVIL

SEQ ID NO: 20164 - protein, 11 aa, Dengue virus
LKDGPERVILA

SEQ ID NO: 20165 - protein, 11 aa, Dengue virus
KDGPERVILAG

SEQ ID NO: 20166 - protein, 11 aa, Dengue virus
DGPERVILAGP

SEQ ID NO: 20167 - protein, 11 aa, Dengue virus
GPERVILAGPM

SEQ ID NO: 20168 - protein, 11 aa, Dengue virus
PERVILAGPMP

SEQ ID NO: 20169 - protein, 11 aa, Dengue virus
ERVILAGPMPV

SEQ ID NO: 20170 - protein, 11 aa, Dengue virus
RVILAGPMPVT

SEQ ID NO: 20171 - protein, 11 aa, Dengue virus
VILAGPMPVTV

SEQ ID NO: 20172 - protein, 11 aa, Dengue virus
ILAGPMPVTVA

SEQ ID NO: 20173 - protein, 11 aa, Dengue virus
LAGPMPVTVAS

SEQ ID NO: 20174 - protein, 11 aa, Dengue virus
AGPMPVTVASA

SEQ ID NO: 20175 - protein, 11 aa, Dengue virus
GPMPVTVASAA

SEQ ID NO: 20176 - protein, 11 aa, Dengue virus
PMPVTVASAAQ

SEQ ID NO: 20177 - protein, 11 aa, Dengue virus
MPVTVASAAQR

SEQ ID NO: 20178 - protein, 11 aa, Dengue virus
PVTVASAAQRR

SEQ ID NO: 20179 - protein, 11 aa, Dengue virus
VTVASAAQRRG

SEQ ID NO: 20180 - protein, 11 aa, Dengue virus
TVASAAQRRGR

SEQ ID NO: 20181 - protein, 11 aa, Dengue virus
VASAAQRRGRI

SEQ ID NO: 20182 - protein, 11 aa, Dengue virus
ASAAQRRGRIG

SEQ ID NO: 20183 - protein, 11 aa, Dengue virus
SAAQRRGRIGR

SEQ ID NO: 20184 - protein, 11 aa, Dengue virus
AAQRRGRIGRN

SEQ ID NO: 20185 - protein, 11 aa, Dengue virus
AQRRGRIGRNH

SEQ ID NO: 20186 - protein, 11 aa, Dengue virus
QRRGRIGRNHN

SEQ ID NO: 20187 - protein, 11 aa, Dengue virus
RRGRIGRNHNK

SEQ ID NO: 20188 - protein, 11 aa, Dengue virus
RGRIGRNHNKE

SEQ ID NO: 20189 - protein, 11 aa, Dengue virus
GRIGRNHNKEG

SEQ ID NO: 20190 - protein, 11 aa, Dengue virus
RIGRNHNKEGD

SEQ ID NO: 20191 - protein, 11 aa, Dengue virus
IGRNHNKEGDQ

SEQ ID NO: 20192 - protein, 11 aa, Dengue virus
GRNHNKEGDQY

SEQ ID NO: 20193 - protein, 11 aa, Dengue virus
RNHNKEGDQYI

SEQ ID NO: 20194 - protein, 11 aa, Dengue virus
NHNKEGDQYIY

SEQ ID NO: 20195 - protein, 11 aa, Dengue virus
HNKEGDQYIYM

SEQ ID NO: 20196 - protein, 11 aa, Dengue virus
NKEGDQYIYMG

SEQ ID NO: 20197 - protein, 11 aa, Dengue virus
KEGDQYIYMGQ

SEQ ID NO: 20198 - protein, 11 aa, Dengue virus
EGDQYIYMGQP

SEQ ID NO: 20199 - protein, 11 aa, Dengue virus
GDQYIYMGQPL

SEQ ID NO: 20200 - protein, 11 aa, Dengue virus
DQYIYMGQPLN

SEQ ID NO: 20201 - protein, 11 aa, Dengue virus
QYIYMGQPLNN

SEQ ID NO: 20202 - protein, 11 aa, Dengue virus
YIYMGQPLNND

SEQ ID NO: 20203 - protein, 11 aa, Dengue virus
IYMGQPLNNDE

SEQ ID NO: 20204 - protein, 11 aa, Dengue virus
YMGQPLNNDED

SEQ ID NO: 20205 - protein, 11 aa, Dengue virus
MGQPLNNDEDH

SEQ ID NO: 20206 - protein, 11 aa, Dengue virus
GQPLNNDEDHA

SEQ ID NO: 20207 - protein, 11 aa, Dengue virus
QPLNNDEDHAH

SEQ ID NO: 20208 - protein, 11 aa, Dengue virus
PLNNDEDHAHW

SEQ ID NO: 20209 - protein, 11 aa, Dengue virus
LNNDEDHAHWT

SEQ ID NO: 20210 - protein, 11 aa, Dengue virus
NNDEDHAHWTE

SEQ ID NO: 20211 - protein, 11 aa, Dengue virus
NDEDHAHWTEA

SEQ ID NO: 20212 - protein, 11 aa, Dengue virus
DEDHAHWTEAK

SEQ ID NO: 20213 - protein, 11 aa, Dengue virus
EDHAHWTEAKM

SEQ ID NO: 20214 - protein, 11 aa, Dengue virus
DHAHWTEAKML

SEQ ID NO: 20215 - protein, 11 aa, Dengue virus
HAHWTEAKMLL

SEQ ID NO: 20216 - protein, 11 aa, Dengue virus
AHWTEAKMLLD

SEQ ID NO: 20217 - protein, 11 aa, Dengue virus
HWTEAKMLLDN

SEQ ID NO: 20218 - protein, 11 aa, Dengue virus
WTEAKMLLDNI

SEQ ID NO: 20219 - protein, 11 aa, Dengue virus
TEAKMLLDNIN

SEQ ID NO: 20220 - protein, 11 aa, Dengue virus
EAKMLLDNINT

SEQ ID NO: 20221 - protein, 11 aa, Dengue virus
AKMLLDNINTP

SEQ ID NO: 20222 - protein, 11 aa, Dengue virus
KMLLDNINTPE

SEQ ID NO: 20223 - protein, 11 aa, Dengue virus
MLLDNINTPEG

SEQ ID NO: 20224 - protein, 11 aa, Dengue virus
LLDNINTPEGI

SEQ ID NO: 20225 - protein, 11 aa, Dengue virus
LDNINTPEGII

SEQ ID NO: 20226 - protein, 11 aa, Dengue virus
DNINTPEGIIP

SEQ ID NO: 20227 - protein, 11 aa, Dengue virus
NINTPEGIIPA

SEQ ID NO: 20228 - protein, 11 aa, Dengue virus
INTPEGIIPAL

SEQ ID NO: 20229 - protein, 11 aa, Dengue virus
NTPEGIIPALF

SEQ ID NO: 20230 - protein, 11 aa, Dengue virus
TPEGIIPALFE

SEQ ID NO: 20231 - protein, 11 aa, Dengue virus
PEGIIPALFEP

SEQ ID NO: 20232 - protein, 11 aa, Dengue virus
EGIIPALFEPE

SEQ ID NO: 20233 - protein, 11 aa, Dengue virus
GIIPALFEPER

SEQ ID NO: 20234 - protein, 11 aa, Dengue virus
IIPALFEPERE

SEQ ID NO: 20235 - protein, 11 aa, Dengue virus
IPALFEPEREK

SEQ ID NO: 20236 - protein, 11 aa, Dengue virus
PALFEPEREKS

SEQ ID NO: 20237 - protein, 11 aa, Dengue virus
ALFEPEREKSA

SEQ ID NO: 20238 - protein, 11 aa, Dengue virus
LFEPEREKSAA

SEQ ID NO: 20239 - protein, 11 aa, Dengue virus
FEPEREKSAAI

SEQ ID NO: 20240 - protein, 11 aa, Dengue virus
EPEREKSAAID

SEQ ID NO: 20241 - protein, 11 aa, Dengue virus
PEREKSAAIDG

SEQ ID NO: 20242 - protein, 11 aa, Dengue virus
EREKSAAIDGE

SEQ ID NO: 20243 - protein, 11 aa, Dengue virus
REKSAAIDGEY

SEQ ID NO: 20244 - protein, 11 aa, Dengue virus
EKSAAIDGEYR

SEQ ID NO: 20245 - protein, 11 aa, Dengue virus
KSAAIDGEYRL

SEQ ID NO: 20246 - protein, 11 aa, Dengue virus
SAAIDGEYRLR

SEQ ID NO: 20247 - protein, 11 aa, Dengue virus
AAIDGEYRLRG

SEQ ID NO: 20248 - protein, 11 aa, Dengue virus
AIDGEYRLRGE

SEQ ID NO: 20249 - protein, 11 aa, Dengue virus
IDGEYRLRGEA

SEQ ID NO: 20250 - protein, 11 aa, Dengue virus
DGEYRLRGEAR

SEQ ID NO: 20251 - protein, 11 aa, Dengue virus
GEYRLRGEARK

SEQ ID NO: 20252 - protein, 11 aa, Dengue virus
EYRLRGEARKT

SEQ ID NO: 20253 - protein, 11 aa, Dengue virus
YRLRGEARKTF

SEQ ID NO: 20254 - protein, 11 aa, Dengue virus
RLRGEARKTFV

SEQ ID NO: 20255 - protein, 11 aa, Dengue virus
LRGEARKTFVE

SEQ ID NO: 20256 - protein, 11 aa, Dengue virus
RGEARKTFVEL

SEQ ID NO: 20257 - protein, 11 aa, Dengue virus
GEARKTFVELM

SEQ ID NO: 20258 - protein, 11 aa, Dengue virus
EARKTFVELMR

SEQ ID NO: 20259 - protein, 11 aa, Dengue virus
ARKTFVELMRR

SEQ ID NO: 20260 - protein, 11 aa, Dengue virus
RKTFVELMRRG

SEQ ID NO: 20261 - protein, 11 aa, Dengue virus
KTFVELMRRGD

SEQ ID NO: 20262 - protein, 11 aa, Dengue virus
TFVELMRRGDL

SEQ ID NO: 20263 - protein, 11 aa, Dengue virus
FVELMRRGDLP

SEQ ID NO: 20264 - protein, 11 aa, Dengue virus
VELMRRGDLPV

SEQ ID NO: 20265 - protein, 11 aa, Dengue virus
ELMRRGDLPVW

SEQ ID NO: 20266 - protein, 11 aa, Dengue virus
LMRRGDLPVWL

SEQ ID NO: 20267 - protein, 11 aa, Dengue virus
MRRGDLPVWLS

SEQ ID NO: 20268 - protein, 11 aa, Dengue virus
RRGDLPVWLSY

SEQ ID NO: 20269 - protein, 11 aa, Dengue virus
RGDLPVWLSYK

SEQ ID NO: 20270 - protein, 11 aa, Dengue virus
GDLPVWLSYKV

SEQ ID NO: 20271 - protein, 11 aa, Dengue virus
DLPVWLSYKVA

SEQ ID NO: 20272 - protein, 11 aa, Dengue virus
LPVWLSYKVAS

SEQ ID NO: 20273 - protein, 11 aa, Dengue virus
PVWLSYKVASE

SEQ ID NO: 20274 - protein, 11 aa, Dengue virus
VWLSYKVASEG

SEQ ID NO: 20275 - protein, 11 aa, Dengue virus
WLSYKVASEGF

SEQ ID NO: 20276 - protein, 11 aa, Dengue virus
LSYKVASEGFQ

SEQ ID NO: 20277 - protein, 11 aa, Dengue virus
SYKVASEGFQY

SEQ ID NO: 20278 - protein, 11 aa, Dengue virus
YKVASEGFQYS

SEQ ID NO: 20279 - protein, 11 aa, Dengue virus
KVASEGFQYSD

SEQ ID NO: 20280 - protein, 11 aa, Dengue virus
VASEGFQYSDR

SEQ ID NO: 20281 - protein, 11 aa, Dengue virus
ASEGFQYSDRR

SEQ ID NO: 20282 - protein, 11 aa, Dengue virus
SEGFQYSDRRW

SEQ ID NO: 20283 - protein, 11 aa, Dengue virus
EGFQYSDRRWC

SEQ ID NO: 20284 - protein, 11 aa, Dengue virus
GFQYSDRRWCF

SEQ ID NO: 20285 - protein, 11 aa, Dengue virus
FQYSDRRWCFD

SEQ ID NO: 20286 - protein, 11 aa, Dengue virus
QYSDRRWCFDG

SEQ ID NO: 20287 - protein, 11 aa, Dengue virus
YSDRRWCFDGE

SEQ ID NO: 20288 - protein, 11 aa, Dengue virus
SDRRWCFDGER

SEQ ID NO: 20289 - protein, 11 aa, Dengue virus
DRRWCFDGERN

SEQ ID NO: 20290 - protein, 11 aa, Dengue virus
RRWCFDGERNN

SEQ ID NO: 20291 - protein, 11 aa, Dengue virus
RWCFDGERNNQ

SEQ ID NO: 20292 - protein, 11 aa, Dengue virus
WCFDGERNNQV

SEQ ID NO: 20293 - protein, 11 aa, Dengue virus
CFDGERNNQVL

SEQ ID NO: 20294 - protein, 11 aa, Dengue virus
FDGERNNQVLE

SEQ ID NO: 20295 - protein, 11 aa, Dengue virus
DGERNNQVLEE

SEQ ID NO: 20296 - protein, 11 aa, Dengue virus
GERNNQVLEEN

SEQ ID NO: 20297 - protein, 11 aa, Dengue virus
ERNNQVLEENM

SEQ ID NO: 20298 - protein, 11 aa, Dengue virus
RNNQVLEENMD

SEQ ID NO: 20299 - protein, 11 aa, Dengue virus
NNQVLEENMDV

SEQ ID NO: 20300 - protein, 11 aa, Dengue virus
NQVLEENMDVE

SEQ ID NO: 20301 - protein, 11 aa, Dengue virus
QVLEENMDVEI

SEQ ID NO: 20302 - protein, 11 aa, Dengue virus
VLEENMDVEIW

SEQ ID NO: 20303 - protein, 11 aa, Dengue virus
LEENMDVEIWT

SEQ ID NO: 20304 - protein, 11 aa, Dengue virus
EENMDVEIWTK

SEQ ID NO: 20305 - protein, 11 aa, Dengue virus
ENMDVEIWTKE

SEQ ID NO: 20306 - protein, 11 aa, Dengue virus
NMDVEIWTKEG

SEQ ID NO: 20307 - protein, 11 aa, Dengue virus
ERKKLRPRWLD

SEQ ID NO: 20308 - protein, 11 aa, Dengue virus
RKKLRPRWLDA

SEQ ID NO: 20309 - protein, 11 aa, Dengue virus
KKLRPRWLDAR

SEQ ID NO: 20310 - protein, 11 aa, Dengue virus
KLRPRWLDART

SEQ ID NO: 20311 - protein, 11 aa, Dengue virus
LRPRWLDARTY

SEQ ID NO: 20312 - protein, 11 aa, Dengue virus
RPRWLDARTYS

SEQ ID NO: 20313 - protein, 11 aa, Dengue virus
PRWLDARTYSD

SEQ ID NO: 20314 - protein, 11 aa, Dengue virus
RWLDARTYSDP

SEQ ID NO: 20315 - protein, 11 aa, Dengue virus
WLDARTYSDPL

SEQ ID NO: 20316 - protein, 11 aa, Dengue virus
LDARTYSDPLA

SEQ ID NO: 20317 - protein, 11 aa, Dengue virus
DARTYSDPLAL

SEQ ID NO: 20318 - protein, 11 aa, Dengue virus
ARTYSDPLALR

SEQ ID NO: 20319 - protein, 11 aa, Dengue virus
RTYSDPLALRE

SEQ ID NO: 20320 - protein, 11 aa, Dengue virus
TYSDPLALREF

SEQ ID NO: 20321 - protein, 11 aa, Dengue virus
YSDPLALREFK

SEQ ID NO: 20322 - protein, 11 aa, Dengue virus
SDPLALREFKE

SEQ ID NO: 20323 - protein, 11 aa, Dengue virus
DPLALREFKEF

SEQ ID NO: 20324 - protein, 11 aa, Dengue virus
PLALREFKEFA

SEQ ID NO: 20325 - protein, 11 aa, Dengue virus
LALREFKEFAA

SEQ ID NO: 20326 - protein, 11 aa, Dengue virus
ALREFKEFAAG

SEQ ID NO: 20327 - protein, 11 aa, Dengue virus
LREFKEFAAGR

SEQ ID NO: 20328 - protein, 11 aa, Dengue virus
REFKEFAAGRR

SEQ ID NO: 20329 - protein, 11 aa, Dengue virus
EFKEFAAGRRS

SEQ ID NO: 20330 - protein, 11 aa, Dengue virus
FKEFAAGRRSV

SEQ ID NO: 20331 - protein, 11 aa, Dengue virus
KEFAAGRRSVS

SEQ ID NO: 20332 - protein, 11 aa, Dengue virus
EFAAGRRSVSG

SEQ ID NO: 20333 - protein, 11 aa, Dengue virus
FAAGRRSVSGD

SEQ ID NO: 20334 - protein, 11 aa, Dengue virus
AAGRRSVSGDL

SEQ ID NO: 20335 - protein, 11 aa, Dengue virus
AGRRSVSGDLI

SEQ ID NO: 20336 - protein, 11 aa, Dengue virus
GRRSVSGDLIL

SEQ ID NO: 20337 - protein, 11 aa, Dengue virus
RRSVSGDLILE

SEQ ID NO: 20338 - protein, 11 aa, Dengue virus
RSVSGDLILEI

SEQ ID NO: 20339 - protein, 11 aa, Dengue virus
SVSGDLILEIG

SEQ ID NO: 20340 - protein, 11 aa, Dengue virus
VSGDLILEIGK

SEQ ID NO: 20341 - protein, 11 aa, Dengue virus
SGDLILEIGKL

SEQ ID NO: 20342 - protein, 11 aa, Dengue virus
GDLILEIGKLP

SEQ ID NO: 20343 - protein, 11 aa, Dengue virus
DLILEIGKLPQ

SEQ ID NO: 20344 - protein, 11 aa, Dengue virus
LILEIGKLPQH

SEQ ID NO: 20345 - protein, 11 aa, Dengue virus
ILEIGKLPQHL

SEQ ID NO: 20346 - protein, 11 aa, Dengue virus
LEIGKLPQHLT

SEQ ID NO: 20347 - protein, 11 aa, Dengue virus
EIGKLPQHLTQ

SEQ ID NO: 20348 - protein, 11 aa, Dengue virus
IGKLPQHLTQR

SEQ ID NO: 20349 - protein, 11 aa, Dengue virus
GKLPQHLTQRA

SEQ ID NO: 20350 - protein, 11 aa, Dengue virus
KLPQHLTQRAQ

SEQ ID NO: 20351 - protein, 11 aa, Dengue virus
LPQHLTQRAQN

SEQ ID NO: 20352 - protein, 11 aa, Dengue virus
PQHLTQRAQNA

SEQ ID NO: 20353 - protein, 11 aa, Dengue virus
QHLTQRAQNAL

SEQ ID NO: 20354 - protein, 11 aa, Dengue virus
HLTQRAQNALD

SEQ ID NO: 20355 - protein, 11 aa, Dengue virus
LTQRAQNALDN

SEQ ID NO: 20356 - protein, 11 aa, Dengue virus
TQRAQNALDNL

SEQ ID NO: 20357 - protein, 11 aa, Dengue virus
QRAQNALDNLV

SEQ ID NO: 20358 - protein, 11 aa, Dengue virus
RAQNALDNLVM

SEQ ID NO: 20359 - protein, 11 aa, Dengue virus
AQNALDNLVML

SEQ ID NO: 20360 - protein, 11 aa, Dengue virus
QNALDNLVMLH

SEQ ID NO: 20361 - protein, 11 aa, Dengue virus
NALDNLVMLHN

SEQ ID NO: 20362 - protein, 11 aa, Dengue virus
ALDNLVMLHNS

SEQ ID NO: 20363 - protein, 11 aa, Dengue virus
LDNLVMLHNSE

SEQ ID NO: 20364 - protein, 11 aa, Dengue virus
DNLVMLHNSEQ

SEQ ID NO: 20365 - protein, 11 aa, Dengue virus
NLVMLHNSEQG

SEQ ID NO: 20366 - protein, 11 aa, Dengue virus
LVMLHNSEQGG

SEQ ID NO: 20367 - protein, 11 aa, Dengue virus
VMLHNSEQGGR

SEQ ID NO: 20368 - protein, 11 aa, Dengue virus
MLHNSEQGGRA

SEQ ID NO: 20369 - protein, 11 aa, Dengue virus
LHNSEQGGRAY

SEQ ID NO: 20370 - protein, 11 aa, Dengue virus
HNSEQGGRAYR

SEQ ID NO: 20371 - protein, 11 aa, Dengue virus
NSEQGGRAYRH

SEQ ID NO: 20372 - protein, 11 aa, Dengue virus
SEQGGRAYRHA

SEQ ID NO: 20373 - protein, 11 aa, Dengue virus
EQGGRAYRHAM

SEQ ID NO: 20374 - protein, 11 aa, Dengue virus
QGGRAYRHAME

SEQ ID NO: 20375 - protein, 11 aa, Dengue virus
GGRAYRHAMEE

SEQ ID NO: 20376 - protein, 11 aa, Dengue virus
GRAYRHAMEEL

SEQ ID NO: 20377 - protein, 11 aa, Dengue virus
RAYRHAMEELP

SEQ ID NO: 20378 - protein, 11 aa, Dengue virus
AYRHAMEELPD

SEQ ID NO: 20379 - protein, 11 aa, Dengue virus
YRHAMEELPDT

SEQ ID NO: 20380 - protein, 11 aa, Dengue virus
RHAMEELPDTI

SEQ ID NO: 20381 - protein, 11 aa, Dengue virus
HAMEELPDTIE

SEQ ID NO: 20382 - protein, 11 aa, Dengue virus
AMEELPDTIET

SEQ ID NO: 20383 - protein, 11 aa, Dengue virus
MEELPDTIETL

SEQ ID NO: 20384 - protein, 11 aa, Dengue virus
EELPDTIETLM

SEQ ID NO: 20385 - protein, 11 aa, Dengue virus
ELPDTIETLML

SEQ ID NO: 20386 - protein, 11 aa, Dengue virus
LPDTIETLMLL

SEQ ID NO: 20387 - protein, 11 aa, Dengue virus
PDTIETLMLLA

SEQ ID NO: 20388 - protein, 11 aa, Dengue virus
DTIETLMLLAL

SEQ ID NO: 20389 - protein, 11 aa, Dengue virus
TIETLMLLALI

SEQ ID NO: 20390 - protein, 11 aa, Dengue virus
IETLMLLALIA

SEQ ID NO: 20391 - protein, 11 aa, Dengue virus
ETLMLLALIAV

SEQ ID NO: 20392 - protein, 11 aa, Dengue virus
TLMLLALIAVL

SEQ ID NO: 20393 - protein, 11 aa, Dengue virus
LMLLALIAVLT

SEQ ID NO: 20394 - protein, 11 aa, Dengue virus
MLLALIAVLTG

SEQ ID NO: 20395 - protein, 11 aa, Dengue virus
LLALIAVLTGG

SEQ ID NO: 20396 - protein, 11 aa, Dengue virus
LALIAVLTGGV

SEQ ID NO: 20397 - protein, 11 aa, Dengue virus
ALIAVLTGGVT

SEQ ID NO: 20398 - protein, 11 aa, Dengue virus
LIAVLTGGVTL

SEQ ID NO: 20399 - protein, 11 aa, Dengue virus
IAVLTGGVTLF

SEQ ID NO: 20400 - protein, 11 aa, Dengue virus
AVLTGGVTLFF

SEQ ID NO: 20401 - protein, 11 aa, Dengue virus
VLTGGVTLFFL

SEQ ID NO: 20402 - protein, 11 aa, Dengue virus
LTGGVTLFFLS

SEQ ID NO: 20403 - protein, 11 aa, Dengue virus
TGGVTLFFLSG

SEQ ID NO: 20404 - protein, 11 aa, Dengue virus
GGVTLFFLSGR

SEQ ID NO: 20405 - protein, 11 aa, Dengue virus
GVTLFFLSGRG

SEQ ID NO: 20406 - protein, 11 aa, Dengue virus
VTLFFLSGRGL

SEQ ID NO: 20407 - protein, 11 aa, Dengue virus
TLFFLSGRGLG

SEQ ID NO: 20408 - protein, 11 aa, Dengue virus
LFFLSGRGLGK

SEQ ID NO: 20409 - protein, 11 aa, Dengue virus
FFLSGRGLGKT

SEQ ID NO: 20410 - protein, 11 aa, Dengue virus
FLSGRGLGKTS

SEQ ID NO: 20411 - protein, 11 aa, Dengue virus
LSGRGLGKTSI

SEQ ID NO: 20412 - protein, 11 aa, Dengue virus
SGRGLGKTSIG

SEQ ID NO: 20413 - protein, 11 aa, Dengue virus
GRGLGKTSIGL

SEQ ID NO: 20414 - protein, 11 aa, Dengue virus
RGLGKTSIGLL

SEQ ID NO: 20415 - protein, 11 aa, Dengue virus
GLGKTSIGLLC

SEQ ID NO: 20416 - protein, 11 aa, Dengue virus
LGKTSIGLLCV

SEQ ID NO: 20417 - protein, 11 aa, Dengue virus
GKTSIGLLCVM

SEQ ID NO: 20418 - protein, 11 aa, Dengue virus
KTSIGLLCVMA

SEQ ID NO: 20419 - protein, 11 aa, Dengue virus
TSIGLLCVMAS

SEQ ID NO: 20420 - protein, 11 aa, Dengue virus
SIGLLCVMASS

SEQ ID NO: 20421 - protein, 11 aa, Dengue virus
SSVLLWMASVE

SEQ ID NO: 20422 - protein, 11 aa, Dengue virus
SVLLWMASVEP

SEQ ID NO: 20423 - protein, 11 aa, Dengue virus
VLLWMASVEPH

SEQ ID NO: 20424 - protein, 11 aa, Dengue virus
LLWMASVEPHW

SEQ ID NO: 20425 - protein, 11 aa, Dengue virus
LWMASVEPHWI

SEQ ID NO: 20426 - protein, 11 aa, Dengue virus
WMASVEPHWIA

SEQ ID NO: 20427 - protein, 11 aa, Dengue virus
MASVEPHWIAA

SEQ ID NO: 20428 - protein, 11 aa, Dengue virus
ASVEPHWIAAS

SEQ ID NO: 20429 - protein, 11 aa, Dengue virus
SVEPHWIAASI

SEQ ID NO: 20430 - protein, 11 aa, Dengue virus
VEPHWIAASII

SEQ ID NO: 20431 - protein, 11 aa, Dengue virus
EPHWIAASIIL

SEQ ID NO: 20432 - protein, 11 aa, Dengue virus
PHWIAASIILE

SEQ ID NO: 20433 - protein, 11 aa, Dengue virus
HWIAASIILEF

SEQ ID NO: 20434 - protein, 11 aa, Dengue virus
WIAASIILEFF

SEQ ID NO: 20435 - protein, 11 aa, Dengue virus
IAASIILEFFL

SEQ ID NO: 20436 - protein, 11 aa, Dengue virus
AASIILEFFLM

SEQ ID NO: 20437 - protein, 11 aa, Dengue virus
ASIILEFFLMV

SEQ ID NO: 20438 - protein, 11 aa, Dengue virus
SIILEFFLMVL

SEQ ID NO: 20439 - protein, 11 aa, Dengue virus
IILEFFLMVLL

SEQ ID NO: 20440 - protein, 11 aa, Dengue virus
ILEFFLMVLLI

SEQ ID NO: 20441 - protein, 11 aa, Dengue virus
LEFFLMVLLIP

SEQ ID NO: 20442 - protein, 11 aa, Dengue virus
EFFLMVLLIPE

SEQ ID NO: 20443 - protein, 11 aa, Dengue virus
FFLMVLLIPEP

SEQ ID NO: 20444 - protein, 11 aa, Dengue virus
FLMVLLIPEPD

SEQ ID NO: 20445 - protein, 11 aa, Dengue virus
LMVLLIPEPDR

SEQ ID NO: 20446 - protein, 11 aa, Dengue virus
MVLLIPEPDRQ

SEQ ID NO: 20447 - protein, 11 aa, Dengue virus
VLLIPEPDRQR

SEQ ID NO: 20448 - protein, 11 aa, Dengue virus
LLIPEPDRQRT

SEQ ID NO: 20449 - protein, 11 aa, Dengue virus
LIPEPDRQRTP

SEQ ID NO: 20450 - protein, 11 aa, Dengue virus
IPEPDRQRTPQ

SEQ ID NO: 20451 - protein, 11 aa, Dengue virus
PEPDRQRTPQD

SEQ ID NO: 20452 - protein, 11 aa, Dengue virus
EPDRQRTPQDN

SEQ ID NO: 20453 - protein, 11 aa, Dengue virus
PDRQRTPQDNQ

SEQ ID NO: 20454 - protein, 11 aa, Dengue virus
DRQRTPQDNQL

SEQ ID NO: 20455 - protein, 11 aa, Dengue virus
RQRTPQDNQLA

SEQ ID NO: 20456 - protein, 11 aa, Dengue virus
QRTPQDNQLAY

SEQ ID NO: 20457 - protein, 11 aa, Dengue virus
RTPQDNQLAYV

SEQ ID NO: 20458 - protein, 11 aa, Dengue virus
TPQDNQLAYVV

SEQ ID NO: 20459 - protein, 11 aa, Dengue virus
PQDNQLAYVVI

SEQ ID NO: 20460 - protein, 11 aa, Dengue virus
QDNQLAYVVIG

SEQ ID NO: 20461 - protein, 11 aa, Dengue virus
DNQLAYVVIGL

SEQ ID NO: 20462 - protein, 11 aa, Dengue virus
NQLAYVVIGLL

SEQ ID NO: 20463 - protein, 11 aa, Dengue virus
QLAYVVIGLLF

SEQ ID NO: 20464 - protein, 11 aa, Dengue virus
LAYVVIGLLFM

SEQ ID NO: 20465 - protein, 11 aa, Dengue virus
AYVVIGLLFMI

SEQ ID NO: 20466 - protein, 11 aa, Dengue virus
YVVIGLLFMIL

SEQ ID NO: 20467 - protein, 11 aa, Dengue virus
VVIGLLFMILT

SEQ ID NO: 20468 - protein, 11 aa, Dengue virus
VIGLLFMILTV

SEQ ID NO: 20469 - protein, 11 aa, Dengue virus
IGLLFMILTVA

SEQ ID NO: 20470 - protein, 11 aa, Dengue virus
GLLFMILTVAA

SEQ ID NO: 20471 - protein, 11 aa, Dengue virus
LLFMILTVAAN

SEQ ID NO: 20472 - protein, 11 aa, Dengue virus
LFMILTVAANE

SEQ ID NO: 20473 - protein, 11 aa, Dengue virus
FMILTVAANEM

SEQ ID NO: 20474 - protein, 11 aa, Dengue virus
MILTVAANEMG

SEQ ID NO: 20475 - protein, 11 aa, Dengue virus
ILTVAANEMGL

SEQ ID NO: 20476 - protein, 11 aa, Dengue virus
LTVAANEMGLL

SEQ ID NO: 20477 - protein, 11 aa, Dengue virus
TVAANEMGLLE

SEQ ID NO: 20478 - protein, 11 aa, Dengue virus
VAANEMGLLET

SEQ ID NO: 20479 - protein, 11 aa, Dengue virus
AANEMGLLETT

SEQ ID NO: 20480 - protein, 11 aa, Dengue virus
ANEMGLLETTK

SEQ ID NO: 20481 - protein, 11 aa, Dengue virus
NEMGLLETTKK

SEQ ID NO: 20482 - protein, 11 aa, Dengue virus
EMGLLETTKKD

SEQ ID NO: 20483 - protein, 11 aa, Dengue virus
MGLLETTKKDL

SEQ ID NO: 20484 - protein, 11 aa, Dengue virus
GLLETTKKDLG

SEQ ID NO: 20485 - protein, 11 aa, Dengue virus
LLETTKKDLGI

SEQ ID NO: 20486 - protein, 11 aa, Dengue virus
LETTKKDLGIG

SEQ ID NO: 20487 - protein, 11 aa, Dengue virus
ETTKKDLGIGH

SEQ ID NO: 20488 - protein, 11 aa, Dengue virus
TTKKDLGIGHV

SEQ ID NO: 20489 - protein, 11 aa, Dengue virus
TKKDLGIGHVA

SEQ ID NO: 20490 - protein, 11 aa, Dengue virus
AMLDVDLHPAS

SEQ ID NO: 20491 - protein, 11 aa, Dengue virus
MLDVDLHPASA

SEQ ID NO: 20492 - protein, 11 aa, Dengue virus
LDVDLHPASAW

SEQ ID NO: 20493 - protein, 11 aa, Dengue virus
DVDLHPASAWT

SEQ ID NO: 20494 - protein, 11 aa, Dengue virus
VDLHPASAWTL

SEQ ID NO: 20495 - protein, 11 aa, Dengue virus
DLHPASAWTLY

SEQ ID NO: 20496 - protein, 11 aa, Dengue virus
LHPASAWTLYA

SEQ ID NO: 20497 - protein, 11 aa, Dengue virus
HPASAWTLYAV

SEQ ID NO: 20498 - protein, 11 aa, Dengue virus
PASAWTLYAVA

SEQ ID NO: 20499 - protein, 11 aa, Dengue virus
ASAWTLYAVAT

SEQ ID NO: 20500 - protein, 11 aa, Dengue virus
SAWTLYAVATT

SEQ ID NO: 20501 - protein, 11 aa, Dengue virus
AWTLYAVATTI

SEQ ID NO: 20502 - protein, 11 aa, Dengue virus
WTLYAVATTII

SEQ ID NO: 20503 - protein, 11 aa, Dengue virus
TLYAVATTIIT

SEQ ID NO: 20504 - protein, 11 aa, Dengue virus
LYAVATTIITP

SEQ ID NO: 20505 - protein, 11 aa, Dengue virus
YAVATTIITPM

SEQ ID NO: 20506 - protein, 11 aa, Dengue virus
AVATTIITPMM

SEQ ID NO: 20507 - protein, 11 aa, Dengue virus
VATTIITPMMR

SEQ ID NO: 20508 - protein, 11 aa, Dengue virus
ATTIITPMMRH

SEQ ID NO: 20509 - protein, 11 aa, Dengue virus
TTIITPMMRHT

SEQ ID NO: 20510 - protein, 11 aa, Dengue virus
TIITPMMRHTI

SEQ ID NO: 20511 - protein, 11 aa, Dengue virus
IITPMMRHTIE

SEQ ID NO: 20512 - protein, 11 aa, Dengue virus
ITPMMRHTIEN

SEQ ID NO: 20513 - protein, 11 aa, Dengue virus
TPMMRHTIENT

SEQ ID NO: 20514 - protein, 11 aa, Dengue virus
PMMRHTIENTT

SEQ ID NO: 20515 - protein, 11 aa, Dengue virus
MMRHTIENTTA

SEQ ID NO: 20516 - protein, 11 aa, Dengue virus
MRHTIENTTAN

SEQ ID NO: 20517 - protein, 11 aa, Dengue virus
RHTIENTTANI

SEQ ID NO: 20518 - protein, 11 aa, Dengue virus
HTIENTTANIS

SEQ ID NO: 20519 - protein, 11 aa, Dengue virus
TIENTTANISL

SEQ ID NO: 20520 - protein, 11 aa, Dengue virus
IENTTANISLT

SEQ ID NO: 20521 - protein, 11 aa, Dengue virus
ENTTANISLTA

SEQ ID NO: 20522 - protein, 11 aa, Dengue virus
NTTANISLTAI

SEQ ID NO: 20523 - protein, 11 aa, Dengue virus
TTANISLTAIA

SEQ ID NO: 20524 - protein, 11 aa, Dengue virus
TANISLTAIAN

SEQ ID NO: 20525 - protein, 11 aa, Dengue virus
ANISLTAIANQ

SEQ ID NO: 20526 - protein, 11 aa, Dengue virus
NISLTAIANQA

SEQ ID NO: 20527 - protein, 11 aa, Dengue virus
ISLTAIANQAA

SEQ ID NO: 20528 - protein, 11 aa, Dengue virus
SLTAIANQAAI

SEQ ID NO: 20529 - protein, 11 aa, Dengue virus
LTAIANQAAIL

SEQ ID NO: 20530 - protein, 11 aa, Dengue virus
TAIANQAAILM

SEQ ID NO: 20531 - protein, 11 aa, Dengue virus
AIANQAAILMG

SEQ ID NO: 20532 - protein, 11 aa, Dengue virus
IANQAAILMGL

SEQ ID NO: 20533 - protein, 11 aa, Dengue virus
ANQAAILMGLD

SEQ ID NO: 20534 - protein, 11 aa, Dengue virus
NQAAILMGLDK

SEQ ID NO: 20535 - protein, 11 aa, Dengue virus
QAAILMGLDKG

SEQ ID NO: 20536 - protein, 11 aa, Dengue virus
AAILMGLDKGW

SEQ ID NO: 20537 - protein, 11 aa, Dengue virus
AILMGLDKGWP

SEQ ID NO: 20538 - protein, 11 aa, Dengue virus
ILMGLDKGWPI

SEQ ID NO: 20539 - protein, 11 aa, Dengue virus
LMGLDKGWPIS

SEQ ID NO: 20540 - protein, 11 aa, Dengue virus
MGLDKGWPISK

SEQ ID NO: 20541 - protein, 11 aa, Dengue virus
GLDKGWPISKM

SEQ ID NO: 20542 - protein, 11 aa, Dengue virus
LDKGWPISKMD

SEQ ID NO: 20543 - protein, 11 aa, Dengue virus
DKGWPISKMDI

SEQ ID NO: 20544 - protein, 11 aa, Dengue virus
KGWPISKMDIG

SEQ ID NO: 20545 - protein, 11 aa, Dengue virus
GWPISKMDIGV

SEQ ID NO: 20546 - protein, 11 aa, Dengue virus
WPISKMDIGVP

SEQ ID NO: 20547 - protein, 11 aa, Dengue virus
PISKMDIGVPL

SEQ ID NO: 20548 - protein, 11 aa, Dengue virus
ISKMDIGVPLL

SEQ ID NO: 20549 - protein, 11 aa, Dengue virus
SKMDIGVPLLA

SEQ ID NO: 20550 - protein, 11 aa, Dengue virus
KMDIGVPLLAL

SEQ ID NO: 20551 - protein, 11 aa, Dengue virus
MDIGVPLLALG

SEQ ID NO: 20552 - protein, 11 aa, Dengue virus
DIGVPLLALGC

SEQ ID NO: 20553 - protein, 11 aa, Dengue virus
IGVPLLALGCY

SEQ ID NO: 20554 - protein, 11 aa, Dengue virus
GVPLLALGCYS

SEQ ID NO: 20555 - protein, 11 aa, Dengue virus
VPLLALGCYSQ

SEQ ID NO: 20556 - protein, 11 aa, Dengue virus
PLLALGCYSQV

SEQ ID NO: 20557 - protein, 11 aa, Dengue virus
LLALGCYSQVN

SEQ ID NO: 20558 - protein, 11 aa, Dengue virus
LALGCYSQVNP

SEQ ID NO: 20559 - protein, 11 aa, Dengue virus
ALGCYSQVNPL

SEQ ID NO: 20560 - protein, 11 aa, Dengue virus
LGCYSQVNPLT

SEQ ID NO: 20561 - protein, 11 aa, Dengue virus
GCYSQVNPLTL

SEQ ID NO: 20562 - protein, 11 aa, Dengue virus
CYSQVNPLTLT

SEQ ID NO: 20563 - protein, 11 aa, Dengue virus
YSQVNPLTLTA

SEQ ID NO: 20564 - protein, 11 aa, Dengue virus
SQVNPLTLTAA

SEQ ID NO: 20565 - protein, 11 aa, Dengue virus
QVNPLTLTAAV

SEQ ID NO: 20566 - protein, 11 aa, Dengue virus
VNPLTLTAAVL

SEQ ID NO: 20567 - protein, 11 aa, Dengue virus
NPLTLTAAVLM

SEQ ID NO: 20568 - protein, 11 aa, Dengue virus
PLTLTAAVLML

SEQ ID NO: 20569 - protein, 11 aa, Dengue virus
LTLTAAVLMLV

SEQ ID NO: 20570 - protein, 11 aa, Dengue virus
TLTAAVLMLVA

SEQ ID NO: 20571 - protein, 11 aa, Dengue virus
LTAAVLMLVAH

SEQ ID NO: 20572 - protein, 11 aa, Dengue virus
TAAVLMLVAHY

SEQ ID NO: 20573 - protein, 11 aa, Dengue virus
AAVLMLVAHYA

SEQ ID NO: 20574 - protein, 11 aa, Dengue virus
AVLMLVAHYAI

SEQ ID NO: 20575 - protein, 11 aa, Dengue virus
VLMLVAHYAII

SEQ ID NO: 20576 - protein, 11 aa, Dengue virus
LMLVAHYAIIG

SEQ ID NO: 20577 - protein, 11 aa, Dengue virus
MLVAHYAIIGP

SEQ ID NO: 20578 - protein, 11 aa, Dengue virus
LVAHYAIIGPG

SEQ ID NO: 20579 - protein, 11 aa, Dengue virus
VAHYAIIGPGL

SEQ ID NO: 20580 - protein, 11 aa, Dengue virus
AHYAIIGPGLQ

SEQ ID NO: 20581 - protein, 11 aa, Dengue virus
HYAIIGPGLQA

SEQ ID NO: 20582 - protein, 11 aa, Dengue virus
YAIIGPGLQAK

SEQ ID NO: 20583 - protein, 11 aa, Dengue virus
AIIGPGLQAKA

SEQ ID NO: 20584 - protein, 11 aa, Dengue virus
IIGPGLQAKAT

SEQ ID NO: 20585 - protein, 11 aa, Dengue virus
IGPGLQAKATR

SEQ ID NO: 20586 - protein, 11 aa, Dengue virus
GPGLQAKATRE

SEQ ID NO: 20587 - protein, 11 aa, Dengue virus
PGLQAKATREA

SEQ ID NO: 20588 - protein, 11 aa, Dengue virus
GLQAKATREAQ

SEQ ID NO: 20589 - protein, 11 aa, Dengue virus
LQAKATREAQK

SEQ ID NO: 20590 - protein, 11 aa, Dengue virus
QAKATREAQKR

SEQ ID NO: 20591 - protein, 11 aa, Dengue virus
AKATREAQKRT

SEQ ID NO: 20592 - protein, 11 aa, Dengue virus
KATREAQKRTA

SEQ ID NO: 20593 - protein, 11 aa, Dengue virus
ATREAQKRTAA

SEQ ID NO: 20594 - protein, 11 aa, Dengue virus
TREAQKRTAAG

SEQ ID NO: 20595 - protein, 11 aa, Dengue virus
REAQKRTAAGI

SEQ ID NO: 20596 - protein, 11 aa, Dengue virus
EAQKRTAAGIM

SEQ ID NO: 20597 - protein, 11 aa, Dengue virus
AQKRTAAGIMK

SEQ ID NO: 20598 - protein, 11 aa, Dengue virus
QKRTAAGIMKN

SEQ ID NO: 20599 - protein, 11 aa, Dengue virus
KRTAAGIMKNP

SEQ ID NO: 20600 - protein, 11 aa, Dengue virus
RTAAGIMKNPT

SEQ ID NO: 20601 - protein, 11 aa, Dengue virus
TAAGIMKNPTV

SEQ ID NO: 20602 - protein, 11 aa, Dengue virus
AAGIMKNPTVD

SEQ ID NO: 20603 - protein, 11 aa, Dengue virus
AGIMKNPTVDG

SEQ ID NO: 20604 - protein, 11 aa, Dengue virus
GIMKNPTVDGI

SEQ ID NO: 20605 - protein, 11 aa, Dengue virus
IMKNPTVDGIV

SEQ ID NO: 20606 - protein, 11 aa, Dengue virus
MKNPTVDGIVA

SEQ ID NO: 20607 - protein, 11 aa, Dengue virus
KNPTVDGIVAI

SEQ ID NO: 20608 - protein, 11 aa, Dengue virus
NPTVDGIVAID

SEQ ID NO: 20609 - protein, 11 aa, Dengue virus
PTVDGIVAIDL

SEQ ID NO: 20610 - protein, 11 aa, Dengue virus
TVDGIVAIDLD

SEQ ID NO: 20611 - protein, 11 aa, Dengue virus
VDGIVAIDLDP

SEQ ID NO: 20612 - protein, 11 aa, Dengue virus
DGIVAIDLDPV

SEQ ID NO: 20613 - protein, 11 aa, Dengue virus
GIVAIDLDPVV

SEQ ID NO: 20614 - protein, 11 aa, Dengue virus
IVAIDLDPVVY

SEQ ID NO: 20615 - protein, 11 aa, Dengue virus
VAIDLDPVVYD

SEQ ID NO: 20616 - protein, 11 aa, Dengue virus
AIDLDPVVYDA

SEQ ID NO: 20617 - protein, 11 aa, Dengue virus
IDLDPVVYDAK

SEQ ID NO: 20618 - protein, 11 aa, Dengue virus
DLDPVVYDAKF

SEQ ID NO: 20619 - protein, 11 aa, Dengue virus
LDPVVYDAKFE

SEQ ID NO: 20620 - protein, 11 aa, Dengue virus
DPVVYDAKFEK

SEQ ID NO: 20621 - protein, 11 aa, Dengue virus
PVVYDAKFEKQ

SEQ ID NO: 20622 - protein, 11 aa, Dengue virus
VVYDAKFEKQL

SEQ ID NO: 20623 - protein, 11 aa, Dengue virus
VYDAKFEKQLG

SEQ ID NO: 20624 - protein, 11 aa, Dengue virus
YDAKFEKQLGQ

SEQ ID NO: 20625 - protein, 11 aa, Dengue virus
DAKFEKQLGQI

SEQ ID NO: 20626 - protein, 11 aa, Dengue virus
AKFEKQLGQIM

SEQ ID NO: 20627 - protein, 11 aa, Dengue virus
KFEKQLGQIML

SEQ ID NO: 20628 - protein, 11 aa, Dengue virus
FEKQLGQIMLL

SEQ ID NO: 20629 - protein, 11 aa, Dengue virus
EKQLGQIMLLI

SEQ ID NO: 20630 - protein, 11 aa, Dengue virus
KQLGQIMLLIL

SEQ ID NO: 20631 - protein, 11 aa, Dengue virus
QLGQIMLLILC

SEQ ID NO: 20632 - protein, 11 aa, Dengue virus
LGQIMLLILCT

SEQ ID NO: 20633 - protein, 11 aa, Dengue virus
GQIMLLILCTS

SEQ ID NO: 20634 - protein, 11 aa, Dengue virus
QIMLLILCTSQ

SEQ ID NO: 20635 - protein, 11 aa, Dengue virus
IMLLILCTSQI

SEQ ID NO: 20636 - protein, 11 aa, Dengue virus
MLLILCTSQIL

SEQ ID NO: 20637 - protein, 11 aa, Dengue virus
LLILCTSQILL

SEQ ID NO: 20638 - protein, 11 aa, Dengue virus
LILCTSQILLM

SEQ ID NO: 20639 - protein, 11 aa, Dengue virus
ILCTSQILLMR

SEQ ID NO: 20640 - protein, 11 aa, Dengue virus
LCTSQILLMRT

SEQ ID NO: 20641 - protein, 11 aa, Dengue virus
CTSQILLMRTT

SEQ ID NO: 20642 - protein, 11 aa, Dengue virus
TSQILLMRTTW

SEQ ID NO: 20643 - protein, 11 aa, Dengue virus
SQILLMRTTWA

SEQ ID NO: 20644 - protein, 11 aa, Dengue virus
QILLMRTTWAL

SEQ ID NO: 20645 - protein, 11 aa, Dengue virus
ILLMRTTWALC

SEQ ID NO: 20646 - protein, 11 aa, Dengue virus
LLMRTTWALCE

SEQ ID NO: 20647 - protein, 11 aa, Dengue virus
LMRTTWALCES

SEQ ID NO: 20648 - protein, 11 aa, Dengue virus
MRTTWALCESI

SEQ ID NO: 20649 - protein, 11 aa, Dengue virus
RTTWALCESIT

SEQ ID NO: 20650 - protein, 11 aa, Dengue virus
TTWALCESITL

SEQ ID NO: 20651 - protein, 11 aa, Dengue virus
TWALCESITLA

SEQ ID NO: 20652 - protein, 11 aa, Dengue virus
WALCESITLAT

SEQ ID NO: 20653 - protein, 11 aa, Dengue virus
ALCESITLATG

SEQ ID NO: 20654 - protein, 11 aa, Dengue virus
LCESITLATGP

SEQ ID NO: 20655 - protein, 11 aa, Dengue virus
CESITLATGPL

SEQ ID NO: 20656 - protein, 11 aa, Dengue virus
ESITLATGPLT

SEQ ID NO: 20657 - protein, 11 aa, Dengue virus
SITLATGPLTT

SEQ ID NO: 20658 - protein, 11 aa, Dengue virus
ITLATGPLTTL

SEQ ID NO: 20659 - protein, 11 aa, Dengue virus
TLATGPLTTLW

SEQ ID NO: 20660 - protein, 11 aa, Dengue virus
LATGPLTTLWE

SEQ ID NO: 20661 - protein, 11 aa, Dengue virus
ATGPLTTLWEG

SEQ ID NO: 20662 - protein, 11 aa, Dengue virus
TGPLTTLWEGS

SEQ ID NO: 20663 - protein, 11 aa, Dengue virus
GPLTTLWEGSP

SEQ ID NO: 20664 - protein, 11 aa, Dengue virus
PLTTLWEGSPG

SEQ ID NO: 20665 - protein, 11 aa, Dengue virus
LTTLWEGSPGK

SEQ ID NO: 20666 - protein, 11 aa, Dengue virus
TTLWEGSPGKF

SEQ ID NO: 20667 - protein, 11 aa, Dengue virus
TLWEGSPGKFW

SEQ ID NO: 20668 - protein, 11 aa, Dengue virus
LWEGSPGKFWN

SEQ ID NO: 20669 - protein, 11 aa, Dengue virus
WEGSPGKFWNT

SEQ ID NO: 20670 - protein, 11 aa, Dengue virus
EGSPGKFWNTT

SEQ ID NO: 20671 - protein, 11 aa, Dengue virus
GSPGKFWNTTI

SEQ ID NO: 20672 - protein, 11 aa, Dengue virus
SPGKFWNTTIA

SEQ ID NO: 20673 - protein, 11 aa, Dengue virus
PGKFWNTTIAV

SEQ ID NO: 20674 - protein, 11 aa, Dengue virus
GKFWNTTIAVS

SEQ ID NO: 20675 - protein, 11 aa, Dengue virus
KFWNTTIAVSM

SEQ ID NO: 20676 - protein, 11 aa, Dengue virus
FWNTTIAVSMA

SEQ ID NO: 20677 - protein, 11 aa, Dengue virus
WNTTIAVSMAN

SEQ ID NO: 20678 - protein, 11 aa, Dengue virus
NTTIAVSMANI

SEQ ID NO: 20679 - protein, 11 aa, Dengue virus
TTIAVSMANIF

SEQ ID NO: 20680 - protein, 11 aa, Dengue virus
TIAVSMANIFR

SEQ ID NO: 20681 - protein, 11 aa, Dengue virus
IAVSMANIFRG

SEQ ID NO: 20682 - protein, 11 aa, Dengue virus
AVSMANIFRGS

SEQ ID NO: 20683 - protein, 11 aa, Dengue virus
VSMANIFRGSY

SEQ ID NO: 20684 - protein, 11 aa, Dengue virus
SMANIFRGSYL

SEQ ID NO: 20685 - protein, 11 aa, Dengue virus
MANIFRGSYLA

SEQ ID NO: 20686 - protein, 11 aa, Dengue virus
ANIFRGSYLAG

SEQ ID NO: 20687 - protein, 11 aa, Dengue virus
NIFRGSYLAGA

SEQ ID NO: 20688 - protein, 11 aa, Dengue virus
IFRGSYLAGAG

SEQ ID NO: 20689 - protein, 11 aa, Dengue virus
FRGSYLAGAGL

SEQ ID NO: 20690 - protein, 11 aa, Dengue virus
RGSYLAGAGLA

SEQ ID NO: 20691 - protein, 11 aa, Dengue virus
GSYLAGAGLAF

SEQ ID NO: 20692 - protein, 11 aa, Dengue virus
SYLAGAGLAFS

SEQ ID NO: 20693 - protein, 11 aa, Dengue virus
YLAGAGLAFSL

SEQ ID NO: 20694 - protein, 11 aa, Dengue virus
LAGAGLAFSLM

SEQ ID NO: 20695 - protein, 11 aa, Dengue virus
AGAGLAFSLMK

SEQ ID NO: 20696 - protein, 11 aa, Dengue virus
GAGLAFSLMKS

SEQ ID NO: 20697 - protein, 11 aa, Dengue virus
AGLAFSLMKSL

SEQ ID NO: 20698 - protein, 11 aa, Dengue virus
GLAFSLMKSLG

SEQ ID NO: 20699 - protein, 11 aa, Dengue virus
LAFSLMKSLGG

SEQ ID NO: 20700 - protein, 11 aa, Dengue virus
AFSLMKSLGGG

SEQ ID NO: 20701 - protein, 11 aa, Dengue virus
FSLMKSLGGGR

SEQ ID NO: 20702 - protein, 11 aa, Dengue virus
SLMKSLGGGRR

SEQ ID NO: 20703 - protein, 11 aa, Dengue virus
LMKSLGGGRRG

SEQ ID NO: 20704 - protein, 11 aa, Dengue virus
MKSLGGGRRGT

SEQ ID NO: 20705 - protein, 11 aa, Dengue virus
KSLGGGRRGTG

SEQ ID NO: 20706 - protein, 11 aa, Dengue virus
SLGGGRRGTGA

SEQ ID NO: 20707 - protein, 11 aa, Dengue virus
LGGGRRGTGAQ

SEQ ID NO: 20708 - protein, 11 aa, Dengue virus
GGGRRGTGAQG

SEQ ID NO: 20709 - protein, 11 aa, Dengue virus
GGRRGTGAQGE

SEQ ID NO: 20710 - protein, 11 aa, Dengue virus
GRRGTGAQGET

SEQ ID NO: 20711 - protein, 11 aa, Dengue virus
RRGTGAQGETL

SEQ ID NO: 20712 - protein, 11 aa, Dengue virus
RGTGAQGETLG

SEQ ID NO: 20713 - protein, 11 aa, Dengue virus
GTGAQGETLGE

SEQ ID NO: 20714 - protein, 11 aa, Dengue virus
TGAQGETLGEK

SEQ ID NO: 20715 - protein, 11 aa, Dengue virus
GAQGETLGEKW

SEQ ID NO: 20716 - protein, 11 aa, Dengue virus
AQGETLGEKWK

SEQ ID NO: 20717 - protein, 11 aa, Dengue virus
QGETLGEKWKR

SEQ ID NO: 20718 - protein, 11 aa, Dengue virus
GETLGEKWKRQ

SEQ ID NO: 20719 - protein, 11 aa, Dengue virus
ETLGEKWKRQL

SEQ ID NO: 20720 - protein, 11 aa, Dengue virus
TLGEKWKRQLN

SEQ ID NO: 20721 - protein, 11 aa, Dengue virus
LGEKWKRQLNQ

SEQ ID NO: 20722 - protein, 11 aa, Dengue virus
GEKWKRQLNQL

SEQ ID NO: 20723 - protein, 11 aa, Dengue virus
EKWKRQLNQLS

SEQ ID NO: 20724 - protein, 11 aa, Dengue virus
KWKRQLNQLSK

SEQ ID NO: 20725 - protein, 11 aa, Dengue virus
WKRQLNQLSKS

SEQ ID NO: 20726 - protein, 11 aa, Dengue virus
KRQLNQLSKSE

SEQ ID NO: 20727 - protein, 11 aa, Dengue virus
RQLNQLSKSEF

SEQ ID NO: 20728 - protein, 11 aa, Dengue virus
QLNQLSKSEFN

SEQ ID NO: 20729 - protein, 11 aa, Dengue virus
LNQLSKSEFNT

SEQ ID NO: 20730 - protein, 11 aa, Dengue virus
NQLSKSEFNTY

SEQ ID NO: 20731 - protein, 11 aa, Dengue virus
QLSKSEFNTYK

SEQ ID NO: 20732 - protein, 11 aa, Dengue virus
LSKSEFNTYKR

SEQ ID NO: 20733 - protein, 11 aa, Dengue virus
SKSEFNTYKRS

SEQ ID NO: 20734 - protein, 11 aa, Dengue virus
KSEFNTYKRSG

SEQ ID NO: 20735 - protein, 11 aa, Dengue virus
SEFNTYKRSGI

SEQ ID NO: 20736 - protein, 11 aa, Dengue virus
EFNTYKRSGIM

SEQ ID NO: 20737 - protein, 11 aa, Dengue virus
FNTYKRSGIME

SEQ ID NO: 20738 - protein, 11 aa, Dengue virus
NTYKRSGIMEV

SEQ ID NO: 20739 - protein, 11 aa, Dengue virus
TYKRSGIMEVD

SEQ ID NO: 20740 - protein, 11 aa, Dengue virus
YKRSGIMEVDR

SEQ ID NO: 20741 - protein, 11 aa, Dengue virus
KRSGIMEVDRS

SEQ ID NO: 20742 - protein, 11 aa, Dengue virus
RSGIMEVDRSE

SEQ ID NO: 20743 - protein, 11 aa, Dengue virus
SGIMEVDRSEA

SEQ ID NO: 20744 - protein, 11 aa, Dengue virus
GIMEVDRSEAK

SEQ ID NO: 20745 - protein, 11 aa, Dengue virus
IMEVDRSEAKE

SEQ ID NO: 20746 - protein, 11 aa, Dengue virus
MEVDRSEAKEG

SEQ ID NO: 20747 - protein, 11 aa, Dengue virus
EVDRSEAKEGL

SEQ ID NO: 20748 - protein, 11 aa, Dengue virus
VDRSEAKEGLK

SEQ ID NO: 20749 - protein, 11 aa, Dengue virus
DRSEAKEGLKR

SEQ ID NO: 20750 - protein, 11 aa, Dengue virus
RSEAKEGLKRG

SEQ ID NO: 20751 - protein, 11 aa, Dengue virus
SEAKEGLKRGE

SEQ ID NO: 20752 - protein, 11 aa, Dengue virus
EAKEGLKRGET

SEQ ID NO: 20753 - protein, 11 aa, Dengue virus
AKEGLKRGETT

SEQ ID NO: 20754 - protein, 11 aa, Dengue virus
KEGLKRGETTK

SEQ ID NO: 20755 - protein, 11 aa, Dengue virus
EGLKRGETTKH

SEQ ID NO: 20756 - protein, 11 aa, Dengue virus
GLKRGETTKHA

SEQ ID NO: 20757 - protein, 11 aa, Dengue virus
LKRGETTKHAV

SEQ ID NO: 20758 - protein, 11 aa, Dengue virus
KRGETTKHAVS

SEQ ID NO: 20759 - protein, 11 aa, Dengue virus
RGETTKHAVSR

SEQ ID NO: 20760 - protein, 11 aa, Dengue virus
GETTKHAVSRG

SEQ ID NO: 20761 - protein, 11 aa, Dengue virus
ETTKHAVSRGT

SEQ ID NO: 20762 - protein, 11 aa, Dengue virus
TTKHAVSRGTA

SEQ ID NO: 20763 - protein, 11 aa, Dengue virus
TKHAVSRGTAK

SEQ ID NO: 20764 - protein, 11 aa, Dengue virus
KHAVSRGTAKL

SEQ ID NO: 20765 - protein, 11 aa, Dengue virus
HAVSRGTAKLR

SEQ ID NO: 20766 - protein, 11 aa, Dengue virus
AVSRGTAKLRW

SEQ ID NO: 20767 - protein, 11 aa, Dengue virus
VSRGTAKLRWF

SEQ ID NO: 20768 - protein, 11 aa, Dengue virus
SRGTAKLRWFV

SEQ ID NO: 20769 - protein, 11 aa, Dengue virus
RGTAKLRWFVE

SEQ ID NO: 20770 - protein, 11 aa, Dengue virus
GTAKLRWFVER

SEQ ID NO: 20771 - protein, 11 aa, Dengue virus
TAKLRWFVERN

SEQ ID NO: 20772 - protein, 11 aa, Dengue virus
AKLRWFVERNL

SEQ ID NO: 20773 - protein, 11 aa, Dengue virus
KLRWFVERNLV

SEQ ID NO: 20774 - protein, 11 aa, Dengue virus
LRWFVERNLVK

SEQ ID NO: 20775 - protein, 11 aa, Dengue virus
RWFVERNLVKP

SEQ ID NO: 20776 - protein, 11 aa, Dengue virus
WFVERNLVKPE

SEQ ID NO: 20777 - protein, 11 aa, Dengue virus
FVERNLVKPEG

SEQ ID NO: 20778 - protein, 11 aa, Dengue virus
VERNLVKPEGK

SEQ ID NO: 20779 - protein, 11 aa, Dengue virus
ERNLVKPEGKV

SEQ ID NO: 20780 - protein, 11 aa, Dengue virus
RNLVKPEGKVI

SEQ ID NO: 20781 - protein, 11 aa, Dengue virus
NLVKPEGKVID

SEQ ID NO: 20782 - protein, 11 aa, Dengue virus
LVKPEGKVIDL

SEQ ID NO: 20783 - protein, 11 aa, Dengue virus
VKPEGKVIDLG

SEQ ID NO: 20784 - protein, 11 aa, Dengue virus
KPEGKVIDLGC

SEQ ID NO: 20785 - protein, 11 aa, Dengue virus
PEGKVIDLGCG

SEQ ID NO: 20786 - protein, 11 aa, Dengue virus
EGKVIDLGCGR

SEQ ID NO: 20787 - protein, 11 aa, Dengue virus
GKVIDLGCGRG

SEQ ID NO: 20788 - protein, 11 aa, Dengue virus
KVIDLGCGRGG

SEQ ID NO: 20789 - protein, 11 aa, Dengue virus
VIDLGCGRGGW

SEQ ID NO: 20790 - protein, 11 aa, Dengue virus
IDLGCGRGGWS

SEQ ID NO: 20791 - protein, 11 aa, Dengue virus
DLGCGRGGWSY

SEQ ID NO: 20792 - protein, 11 aa, Dengue virus
LGCGRGGWSYY

SEQ ID NO: 20793 - protein, 11 aa, Dengue virus
GCGRGGWSYYC

SEQ ID NO: 20794 - protein, 11 aa, Dengue virus
CGRGGWSYYCA

SEQ ID NO: 20795 - protein, 11 aa, Dengue virus
GRGGWSYYCAG

SEQ ID NO: 20796 - protein, 11 aa, Dengue virus
RGGWSYYCAGL

SEQ ID NO: 20797 - protein, 11 aa, Dengue virus
GGWSYYCAGLK

SEQ ID NO: 20798 - protein, 11 aa, Dengue virus
GWSYYCAGLKK

SEQ ID NO: 20799 - protein, 11 aa, Dengue virus
WSYYCAGLKKV

SEQ ID NO: 20800 - protein, 11 aa, Dengue virus
SYYCAGLKKVT

SEQ ID NO: 20801 - protein, 11 aa, Dengue virus
YYCAGLKKVTE

SEQ ID NO: 20802 - protein, 11 aa, Dengue virus
YCAGLKKVTEV

SEQ ID NO: 20803 - protein, 11 aa, Dengue virus
CAGLKKVTEVK

SEQ ID NO: 20804 - protein, 11 aa, Dengue virus
AGLKKVTEVKG

SEQ ID NO: 20805 - protein, 11 aa, Dengue virus
GLKKVTEVKGY

SEQ ID NO: 20806 - protein, 11 aa, Dengue virus
LKKVTEVKGYT

SEQ ID NO: 20807 - protein, 11 aa, Dengue virus
KKVTEVKGYTK

SEQ ID NO: 20808 - protein, 11 aa, Dengue virus
KVTEVKGYTKG

SEQ ID NO: 20809 - protein, 11 aa, Dengue virus
VTEVKGYTKGG

SEQ ID NO: 20810 - protein, 11 aa, Dengue virus
TEVKGYTKGGP

SEQ ID NO: 20811 - protein, 11 aa, Dengue virus
EVKGYTKGGPG

SEQ ID NO: 20812 - protein, 11 aa, Dengue virus
VKGYTKGGPGH

SEQ ID NO: 20813 - protein, 11 aa, Dengue virus
KGYTKGGPGHE

SEQ ID NO: 20814 - protein, 11 aa, Dengue virus
GYTKGGPGHEE

SEQ ID NO: 20815 - protein, 11 aa, Dengue virus
YTKGGPGHEEP

SEQ ID NO: 20816 - protein, 11 aa, Dengue virus
TKGGPGHEEPI

SEQ ID NO: 20817 - protein, 11 aa, Dengue virus
KGGPGHEEPIP

SEQ ID NO: 20818 - protein, 11 aa, Dengue virus
GGPGHEEPIPM

SEQ ID NO: 20819 - protein, 11 aa, Dengue virus
GPGHEEPIPMA

SEQ ID NO: 20820 - protein, 11 aa, Dengue virus
PGHEEPIPMAT

SEQ ID NO: 20821 - protein, 11 aa, Dengue virus
GHEEPIPMATY

SEQ ID NO: 20822 - protein, 11 aa, Dengue virus
HEEPIPMATYG

SEQ ID NO: 20823 - protein, 11 aa, Dengue virus
EEPIPMATYGW

SEQ ID NO: 20824 - protein, 11 aa, Dengue virus
EPIPMATYGWN

SEQ ID NO: 20825 - protein, 11 aa, Dengue virus
PIPMATYGWNL

SEQ ID NO: 20826 - protein, 11 aa, Dengue virus
IPMATYGWNLV

SEQ ID NO: 20827 - protein, 11 aa, Dengue virus
PMATYGWNLVK

SEQ ID NO: 20828 - protein, 11 aa, Dengue virus
MATYGWNLVKL

SEQ ID NO: 20829 - protein, 11 aa, Dengue virus
ATYGWNLVKLH

SEQ ID NO: 20830 - protein, 11 aa, Dengue virus
TYGWNLVKLHS

SEQ ID NO: 20831 - protein, 11 aa, Dengue virus
YGWNLVKLHSG

SEQ ID NO: 20832 - protein, 11 aa, Dengue virus
GWNLVKLHSGK

SEQ ID NO: 20833 - protein, 11 aa, Dengue virus
WNLVKLHSGKD

SEQ ID NO: 20834 - protein, 11 aa, Dengue virus
NLVKLHSGKDV

SEQ ID NO: 20835 - protein, 11 aa, Dengue virus
LVKLHSGKDVF

SEQ ID NO: 20836 - protein, 11 aa, Dengue virus
VKLHSGKDVFF

SEQ ID NO: 20837 - protein, 11 aa, Dengue virus
SGKDVFFIPPE

SEQ ID NO: 20838 - protein, 11 aa, Dengue virus
GKDVFFIPPEK

SEQ ID NO: 20839 - protein, 11 aa, Dengue virus
KDVFFIPPEKC

SEQ ID NO: 20840 - protein, 11 aa, Dengue virus
DVFFIPPEKCD

SEQ ID NO: 20841 - protein, 11 aa, Dengue virus
VFFIPPEKCDT

SEQ ID NO: 20842 - protein, 11 aa, Dengue virus
FFIPPEKCDTL

SEQ ID NO: 20843 - protein, 11 aa, Dengue virus
FIPPEKCDTLL

SEQ ID NO: 20844 - protein, 11 aa, Dengue virus
IPPEKCDTLLC

SEQ ID NO: 20845 - protein, 11 aa, Dengue virus
PPEKCDTLLCD

SEQ ID NO: 20846 - protein, 11 aa, Dengue virus
PEKCDTLLCDI

SEQ ID NO: 20847 - protein, 11 aa, Dengue virus
EKCDTLLCDIG

SEQ ID NO: 20848 - protein, 11 aa, Dengue virus
KCDTLLCDIGE

SEQ ID NO: 20849 - protein, 11 aa, Dengue virus
CDTLLCDIGES

SEQ ID NO: 20850 - protein, 11 aa, Dengue virus
DTLLCDIGESS

SEQ ID NO: 20851 - protein, 11 aa, Dengue virus
TLLCDIGESSP

SEQ ID NO: 20852 - protein, 11 aa, Dengue virus
LLCDIGESSPN

SEQ ID NO: 20853 - protein, 11 aa, Dengue virus
LCDIGESSPNP

SEQ ID NO: 20854 - protein, 11 aa, Dengue virus
CDIGESSPNPT

SEQ ID NO: 20855 - protein, 11 aa, Dengue virus
DIGESSPNPTI

SEQ ID NO: 20856 - protein, 11 aa, Dengue virus
IGESSPNPTIE

SEQ ID NO: 20857 - protein, 11 aa, Dengue virus
GESSPNPTIEE

SEQ ID NO: 20858 - protein, 11 aa, Dengue virus
ESSPNPTIEEG

SEQ ID NO: 20859 - protein, 11 aa, Dengue virus
SSPNPTIEEGR

SEQ ID NO: 20860 - protein, 11 aa, Dengue virus
SPNPTIEEGRT

SEQ ID NO: 20861 - protein, 11 aa, Dengue virus
PNPTIEEGRTL

SEQ ID NO: 20862 - protein, 11 aa, Dengue virus
NPTIEEGRTLR

SEQ ID NO: 20863 - protein, 11 aa, Dengue virus
PTIEEGRTLRV

SEQ ID NO: 20864 - protein, 11 aa, Dengue virus
TIEEGRTLRVL

SEQ ID NO: 20865 - protein, 11 aa, Dengue virus
IEEGRTLRVLK

SEQ ID NO: 20866 - protein, 11 aa, Dengue virus
EEGRTLRVLKM

SEQ ID NO: 20867 - protein, 11 aa, Dengue virus
EGRTLRVLKMV

SEQ ID NO: 20868 - protein, 11 aa, Dengue virus
GRTLRVLKMVE

SEQ ID NO: 20869 - protein, 11 aa, Dengue virus
RTLRVLKMVEP

SEQ ID NO: 20870 - protein, 11 aa, Dengue virus
TLRVLKMVEPW

SEQ ID NO: 20871 - protein, 11 aa, Dengue virus
LRVLKMVEPWL

SEQ ID NO: 20872 - protein, 11 aa, Dengue virus
RVLKMVEPWLR

SEQ ID NO: 20873 - protein, 11 aa, Dengue virus
VLKMVEPWLRG

SEQ ID NO: 20874 - protein, 11 aa, Dengue virus
LKMVEPWLRGN

SEQ ID NO: 20875 - protein, 11 aa, Dengue virus
QFCIKILNPYM

SEQ ID NO: 20876 - protein, 11 aa, Dengue virus
FCIKILNPYMP

SEQ ID NO: 20877 - protein, 11 aa, Dengue virus
CIKILNPYMPS

SEQ ID NO: 20878 - protein, 11 aa, Dengue virus
IKILNPYMPSV

SEQ ID NO: 20879 - protein, 11 aa, Dengue virus
KILNPYMPSVV

SEQ ID NO: 20880 - protein, 11 aa, Dengue virus
ILNPYMPSVVE

SEQ ID NO: 20881 - protein, 11 aa, Dengue virus
LNPYMPSVVET

SEQ ID NO: 20882 - protein, 11 aa, Dengue virus
NPYMPSVVETL

SEQ ID NO: 20883 - protein, 11 aa, Dengue virus
PYMPSVVETLE

SEQ ID NO: 20884 - protein, 11 aa, Dengue virus
YMPSVVETLEQ

SEQ ID NO: 20885 - protein, 11 aa, Dengue virus
MPSVVETLEQM

SEQ ID NO: 20886 - protein, 11 aa, Dengue virus
PSVVETLEQMQ

SEQ ID NO: 20887 - protein, 11 aa, Dengue virus
SVVETLEQMQR

SEQ ID NO: 20888 - protein, 11 aa, Dengue virus
VVETLEQMQRK

SEQ ID NO: 20889 - protein, 11 aa, Dengue virus
VETLEQMQRKH

SEQ ID NO: 20890 - protein, 11 aa, Dengue virus
ETLEQMQRKHG

SEQ ID NO: 20891 - protein, 11 aa, Dengue virus
TLEQMQRKHGG

SEQ ID NO: 20892 - protein, 11 aa, Dengue virus
LEQMQRKHGGM

SEQ ID NO: 20893 - protein, 11 aa, Dengue virus
EQMQRKHGGML

SEQ ID NO: 20894 - protein, 11 aa, Dengue virus
QMQRKHGGMLV

SEQ ID NO: 20895 - protein, 11 aa, Dengue virus
MQRKHGGMLVR

SEQ ID NO: 20896 - protein, 11 aa, Dengue virus
QRKHGGMLVRN

SEQ ID NO: 20897 - protein, 11 aa, Dengue virus
RKHGGMLVRNP

SEQ ID NO: 20898 - protein, 11 aa, Dengue virus
KHGGMLVRNPL

SEQ ID NO: 20899 - protein, 11 aa, Dengue virus
HGGMLVRNPLS

SEQ ID NO: 20900 - protein, 11 aa, Dengue virus
GGMLVRNPLSR

SEQ ID NO: 20901 - protein, 11 aa, Dengue virus
GMLVRNPLSRN

SEQ ID NO: 20902 - protein, 11 aa, Dengue virus
MLVRNPLSRNS

SEQ ID NO: 20903 - protein, 11 aa, Dengue virus
LVRNPLSRNST

SEQ ID NO: 20904 - protein, 11 aa, Dengue virus
VRNPLSRNSTH

SEQ ID NO: 20905 - protein, 11 aa, Dengue virus
RNPLSRNSTHE

SEQ ID NO: 20906 - protein, 11 aa, Dengue virus
NPLSRNSTHEM

SEQ ID NO: 20907 - protein, 11 aa, Dengue virus
PLSRNSTHEMY

SEQ ID NO: 20908 - protein, 11 aa, Dengue virus
LSRNSTHEMYW

SEQ ID NO: 20909 - protein, 11 aa, Dengue virus
SRNSTHEMYWV

SEQ ID NO: 20910 - protein, 11 aa, Dengue virus
RNSTHEMYWVS

SEQ ID NO: 20911 - protein, 11 aa, Dengue virus
NSTHEMYWVSC

SEQ ID NO: 20912 - protein, 11 aa, Dengue virus
STHEMYWVSCG

SEQ ID NO: 20913 - protein, 11 aa, Dengue virus
THEMYWVSCGT

SEQ ID NO: 20914 - protein, 11 aa, Dengue virus
HEMYWVSCGTG

SEQ ID NO: 20915 - protein, 11 aa, Dengue virus
EMYWVSCGTGN

SEQ ID NO: 20916 - protein, 11 aa, Dengue virus
MYWVSCGTGNI

SEQ ID NO: 20917 - protein, 11 aa, Dengue virus
YWVSCGTGNIV

SEQ ID NO: 20918 - protein, 11 aa, Dengue virus
WVSCGTGNIVS

SEQ ID NO: 20919 - protein, 11 aa, Dengue virus
VSCGTGNIVSA

SEQ ID NO: 20920 - protein, 11 aa, Dengue virus
SCGTGNIVSAV

SEQ ID NO: 20921 - protein, 11 aa, Dengue virus
CGTGNIVSAVN

SEQ ID NO: 20922 - protein, 11 aa, Dengue virus
GTGNIVSAVNM

SEQ ID NO: 20923 - protein, 11 aa, Dengue virus
TGNIVSAVNMT

SEQ ID NO: 20924 - protein, 11 aa, Dengue virus
GNIVSAVNMTS

SEQ ID NO: 20925 - protein, 11 aa, Dengue virus
NIVSAVNMTSR

SEQ ID NO: 20926 - protein, 11 aa, Dengue virus
IVSAVNMTSRM

SEQ ID NO: 20927 - protein, 11 aa, Dengue virus
VSAVNMTSRML

SEQ ID NO: 20928 - protein, 11 aa, Dengue virus
SAVNMTSRMLL

SEQ ID NO: 20929 - protein, 11 aa, Dengue virus
AVNMTSRMLLN

SEQ ID NO: 20930 - protein, 11 aa, Dengue virus
VNMTSRMLLNR

SEQ ID NO: 20931 - protein, 11 aa, Dengue virus
NMTSRMLLNRF

SEQ ID NO: 20932 - protein, 11 aa, Dengue virus
MTSRMLLNRFT

SEQ ID NO: 20933 - protein, 11 aa, Dengue virus
TSRMLLNRFTM

SEQ ID NO: 20934 - protein, 11 aa, Dengue virus
SRMLLNRFTMA

SEQ ID NO: 20935 - protein, 11 aa, Dengue virus
RMLLNRFTMAH

SEQ ID NO: 20936 - protein, 11 aa, Dengue virus
MLLNRFTMAHR

SEQ ID NO: 20937 - protein, 11 aa, Dengue virus
LLNRFTMAHRK

SEQ ID NO: 20938 - protein, 11 aa, Dengue virus
LNRFTMAHRKP

SEQ ID NO: 20939 - protein, 11 aa, Dengue virus
NRFTMAHRKPT

SEQ ID NO: 20940 - protein, 11 aa, Dengue virus
RFTMAHRKPTY

SEQ ID NO: 20941 - protein, 11 aa, Dengue virus
FTMAHRKPTYE

SEQ ID NO: 20942 - protein, 11 aa, Dengue virus
TMAHRKPTYER

SEQ ID NO: 20943 - protein, 11 aa, Dengue virus
MAHRKPTYERD

SEQ ID NO: 20944 - protein, 11 aa, Dengue virus
AHRKPTYERDV

SEQ ID NO: 20945 - protein, 11 aa, Dengue virus
HRKPTYERDVD

SEQ ID NO: 20946 - protein, 11 aa, Dengue virus
RKPTYERDVDL

SEQ ID NO: 20947 - protein, 11 aa, Dengue virus
KPTYERDVDLG

SEQ ID NO: 20948 - protein, 11 aa, Dengue virus
PTYERDVDLGA

SEQ ID NO: 20949 - protein, 11 aa, Dengue virus
TYERDVDLGAG

SEQ ID NO: 20950 - protein, 11 aa, Dengue virus
YERDVDLGAGT

SEQ ID NO: 20951 - protein, 11 aa, Dengue virus
ERDVDLGAGTR

SEQ ID NO: 20952 - protein, 11 aa, Dengue virus
RDVDLGAGTRH

SEQ ID NO: 20953 - protein, 11 aa, Dengue virus
DVDLGAGTRHV

SEQ ID NO: 20954 - protein, 11 aa, Dengue virus
VDLGAGTRHVA

SEQ ID NO: 20955 - protein, 11 aa, Dengue virus
DLGAGTRHVAV

SEQ ID NO: 20956 - protein, 11 aa, Dengue virus
LGAGTRHVAVE

SEQ ID NO: 20957 - protein, 11 aa, Dengue virus
GAGTRHVAVEP

SEQ ID NO: 20958 - protein, 11 aa, Dengue virus
AGTRHVAVEPE

SEQ ID NO: 20959 - protein, 11 aa, Dengue virus
GTRHVAVEPEV

SEQ ID NO: 20960 - protein, 11 aa, Dengue virus
TRHVAVEPEVA

SEQ ID NO: 20961 - protein, 11 aa, Dengue virus
RHVAVEPEVAN

SEQ ID NO: 20962 - protein, 11 aa, Dengue virus
VEPEVANLDII

SEQ ID NO: 20963 - protein, 11 aa, Dengue virus
EPEVANLDIIG

SEQ ID NO: 20964 - protein, 11 aa, Dengue virus
PEVANLDIIGQ

SEQ ID NO: 20965 - protein, 11 aa, Dengue virus
EVANLDIIGQR

SEQ ID NO: 20966 - protein, 11 aa, Dengue virus
VANLDIIGQRI

SEQ ID NO: 20967 - protein, 11 aa, Dengue virus
ANLDIIGQRIE

SEQ ID NO: 20968 - protein, 11 aa, Dengue virus
NLDIIGQRIEN

SEQ ID NO: 20969 - protein, 11 aa, Dengue virus
LDIIGQRIENI

SEQ ID NO: 20970 - protein, 11 aa, Dengue virus
DIIGQRIENIK

SEQ ID NO: 20971 - protein, 11 aa, Dengue virus
IIGQRIENIKH

SEQ ID NO: 20972 - protein, 11 aa, Dengue virus
IGQRIENIKHE

SEQ ID NO: 20973 - protein, 11 aa, Dengue virus
GQRIENIKHEH

SEQ ID NO: 20974 - protein, 11 aa, Dengue virus
QRIENIKHEHK

SEQ ID NO: 20975 - protein, 11 aa, Dengue virus
RIENIKHEHKS

SEQ ID NO: 20976 - protein, 11 aa, Dengue virus
IENIKHEHKST

SEQ ID NO: 20977 - protein, 11 aa, Dengue virus
ENIKHEHKSTW

SEQ ID NO: 20978 - protein, 11 aa, Dengue virus
NIKHEHKSTWH

SEQ ID NO: 20979 - protein, 11 aa, Dengue virus
IKHEHKSTWHY

SEQ ID NO: 20980 - protein, 11 aa, Dengue virus
KHEHKSTWHYD

SEQ ID NO: 20981 - protein, 11 aa, Dengue virus
HEHKSTWHYDE

SEQ ID NO: 20982 - protein, 11 aa, Dengue virus
EHKSTWHYDED

SEQ ID NO: 20983 - protein, 11 aa, Dengue virus
HKSTWHYDEDN

SEQ ID NO: 20984 - protein, 11 aa, Dengue virus
KSTWHYDEDNP

SEQ ID NO: 20985 - protein, 11 aa, Dengue virus
STWHYDEDNPY

SEQ ID NO: 20986 - protein, 11 aa, Dengue virus
TWHYDEDNPYK

SEQ ID NO: 20987 - protein, 11 aa, Dengue virus
WHYDEDNPYKT

SEQ ID NO: 20988 - protein, 11 aa, Dengue virus
HYDEDNPYKTW

SEQ ID NO: 20989 - protein, 11 aa, Dengue virus
YDEDNPYKTWA

SEQ ID NO: 20990 - protein, 11 aa, Dengue virus
DEDNPYKTWAY

SEQ ID NO: 20991 - protein, 11 aa, Dengue virus
EDNPYKTWAYH

SEQ ID NO: 20992 - protein, 11 aa, Dengue virus
DNPYKTWAYHG

SEQ ID NO: 20993 - protein, 11 aa, Dengue virus
NPYKTWAYHGS

SEQ ID NO: 20994 - protein, 11 aa, Dengue virus
PYKTWAYHGSY

SEQ ID NO: 20995 - protein, 11 aa, Dengue virus
YKTWAYHGSYE

SEQ ID NO: 20996 - protein, 11 aa, Dengue virus
KTWAYHGSYEV

SEQ ID NO: 20997 - protein, 11 aa, Dengue virus
TWAYHGSYEVK

SEQ ID NO: 20998 - protein, 11 aa, Dengue virus
WAYHGSYEVKP

SEQ ID NO: 20999 - protein, 11 aa, Dengue virus
AYHGSYEVKPS

SEQ ID NO: 21000 - protein, 11 aa, Dengue virus
YHGSYEVKPSG

SEQ ID NO: 21001 - protein, 11 aa, Dengue virus
HGSYEVKPSGS

SEQ ID NO: 21002 - protein, 11 aa, Dengue virus
GSYEVKPSGSA

SEQ ID NO: 21003 - protein, 11 aa, Dengue virus
SYEVKPSGSAS

SEQ ID NO: 21004 - protein, 11 aa, Dengue virus
YEVKPSGSASS

SEQ ID NO: 21005 - protein, 11 aa, Dengue virus
EVKPSGSASSM

SEQ ID NO: 21006 - protein, 11 aa, Dengue virus
VKPSGSASSMV

SEQ ID NO: 21007 - protein, 11 aa, Dengue virus
KPSGSASSMVN

SEQ ID NO: 21008 - protein, 11 aa, Dengue virus
PSGSASSMVNG

SEQ ID NO: 21009 - protein, 11 aa, Dengue virus
SGSASSMVNGV

SEQ ID NO: 21010 - protein, 11 aa, Dengue virus
GSASSMVNGVV

SEQ ID NO: 21011 - protein, 11 aa, Dengue virus
SASSMVNGVVK

SEQ ID NO: 21012 - protein, 11 aa, Dengue virus
ASSMVNGVVKL

SEQ ID NO: 21013 - protein, 11 aa, Dengue virus
SSMVNGVVKLL

SEQ ID NO: 21014 - protein, 11 aa, Dengue virus
SMVNGVVKLLT

SEQ ID NO: 21015 - protein, 11 aa, Dengue virus
MVNGVVKLLTK

SEQ ID NO: 21016 - protein, 11 aa, Dengue virus
VNGVVKLLTKP

SEQ ID NO: 21017 - protein, 11 aa, Dengue virus
NGVVKLLTKPW

SEQ ID NO: 21018 - protein, 11 aa, Dengue virus
GVVKLLTKPWD

SEQ ID NO: 21019 - protein, 11 aa, Dengue virus
VVKLLTKPWDV

SEQ ID NO: 21020 - protein, 11 aa, Dengue virus
VKLLTKPWDVI

SEQ ID NO: 21021 - protein, 11 aa, Dengue virus
KLLTKPWDVIP

SEQ ID NO: 21022 - protein, 11 aa, Dengue virus
LLTKPWDVIPM

SEQ ID NO: 21023 - protein, 11 aa, Dengue virus
LTKPWDVIPMV

SEQ ID NO: 21024 - protein, 11 aa, Dengue virus
TKPWDVIPMVT

SEQ ID NO: 21025 - protein, 11 aa, Dengue virus
KPWDVIPMVTQ

SEQ ID NO: 21026 - protein, 11 aa, Dengue virus
PWDVIPMVTQI

SEQ ID NO: 21027 - protein, 11 aa, Dengue virus
WDVIPMVTQIA

SEQ ID NO: 21028 - protein, 11 aa, Dengue virus
DVIPMVTQIAM

SEQ ID NO: 21029 - protein, 11 aa, Dengue virus
VIPMVTQIAMT

SEQ ID NO: 21030 - protein, 11 aa, Dengue virus
IPMVTQIAMTD

SEQ ID NO: 21031 - protein, 11 aa, Dengue virus
PMVTQIAMTDT

SEQ ID NO: 21032 - protein, 11 aa, Dengue virus
MVTQIAMTDTT

SEQ ID NO: 21033 - protein, 11 aa, Dengue virus
VTQIAMTDTTP

SEQ ID NO: 21034 - protein, 11 aa, Dengue virus
TQIAMTDTTPF

SEQ ID NO: 21035 - protein, 11 aa, Dengue virus
QIAMTDTTPFG

SEQ ID NO: 21036 - protein, 11 aa, Dengue virus
IAMTDTTPFGQ

SEQ ID NO: 21037 - protein, 11 aa, Dengue virus
AMTDTTPFGQQ

SEQ ID NO: 21038 - protein, 11 aa, Dengue virus
MTDTTPFGQQR

SEQ ID NO: 21039 - protein, 11 aa, Dengue virus
TDTTPFGQQRV

SEQ ID NO: 21040 - protein, 11 aa, Dengue virus
DTTPFGQQRVF

SEQ ID NO: 21041 - protein, 11 aa, Dengue virus
TTPFGQQRVFK

SEQ ID NO: 21042 - protein, 11 aa, Dengue virus
TPFGQQRVFKE

SEQ ID NO: 21043 - protein, 11 aa, Dengue virus
PFGQQRVFKEK

SEQ ID NO: 21044 - protein, 11 aa, Dengue virus
FGQQRVFKEKV

SEQ ID NO: 21045 - protein, 11 aa, Dengue virus
GQQRVFKEKVD

SEQ ID NO: 21046 - protein, 11 aa, Dengue virus
QQRVFKEKVDT

SEQ ID NO: 21047 - protein, 11 aa, Dengue virus
QRVFKEKVDTR

SEQ ID NO: 21048 - protein, 11 aa, Dengue virus
RVFKEKVDTRT

SEQ ID NO: 21049 - protein, 11 aa, Dengue virus
VFKEKVDTRTP

SEQ ID NO: 21050 - protein, 11 aa, Dengue virus
FKEKVDTRTPK

SEQ ID NO: 21051 - protein, 11 aa, Dengue virus
KEKVDTRTPKA

SEQ ID NO: 21052 - protein, 11 aa, Dengue virus
EKVDTRTPKAK

SEQ ID NO: 21053 - protein, 11 aa, Dengue virus
KVDTRTPKAKR

SEQ ID NO: 21054 - protein, 11 aa, Dengue virus
VDTRTPKAKRG

SEQ ID NO: 21055 - protein, 11 aa, Dengue virus
DTRTPKAKRGT

SEQ ID NO: 21056 - protein, 11 aa, Dengue virus
TRTPKAKRGTA

SEQ ID NO: 21057 - protein, 11 aa, Dengue virus
RTPKAKRGTAQ

SEQ ID NO: 21058 - protein, 11 aa, Dengue virus
TPKAKRGTAQI

SEQ ID NO: 21059 - protein, 11 aa, Dengue virus
PKAKRGTAQIM

SEQ ID NO: 21060 - protein, 11 aa, Dengue virus
KRGTAQIMEVT

SEQ ID NO: 21061 - protein, 11 aa, Dengue virus
RGTAQIMEVTA

SEQ ID NO: 21062 - protein, 11 aa, Dengue virus
QIMEVTAKWLW

SEQ ID NO: 21063 - protein, 11 aa, Dengue virus
IMEVTAKWLWG

SEQ ID NO: 21064 - protein, 11 aa, Dengue virus
MEVTAKWLWGF

SEQ ID NO: 21065 - protein, 11 aa, Dengue virus
EVTAKWLWGFL

SEQ ID NO: 21066 - protein, 11 aa, Dengue virus
VTAKWLWGFLS

SEQ ID NO: 21067 - protein, 11 aa, Dengue virus
TAKWLWGFLSR

SEQ ID NO: 21068 - protein, 11 aa, Dengue virus
AKWLWGFLSRN

SEQ ID NO: 21069 - protein, 11 aa, Dengue virus
KWLWGFLSRNK

SEQ ID NO: 21070 - protein, 11 aa, Dengue virus
WLWGFLSRNKK

SEQ ID NO: 21071 - protein, 11 aa, Dengue virus
LWGFLSRNKKP

SEQ ID NO: 21072 - protein, 11 aa, Dengue virus
WGFLSRNKKPR

SEQ ID NO: 21073 - protein, 11 aa, Dengue virus
GFLSRNKKPRI

SEQ ID NO: 21074 - protein, 11 aa, Dengue virus
FLSRNKKPRIC

SEQ ID NO: 21075 - protein, 11 aa, Dengue virus
LSRNKKPRICT

SEQ ID NO: 21076 - protein, 11 aa, Dengue virus
SRNKKPRICTR

SEQ ID NO: 21077 - protein, 11 aa, Dengue virus
RNKKPRICTRE

SEQ ID NO: 21078 - protein, 11 aa, Dengue virus
NKKPRICTREE

SEQ ID NO: 21079 - protein, 11 aa, Dengue virus
KKPRICTREEF

SEQ ID NO: 21080 - protein, 11 aa, Dengue virus
KPRICTREEFT

SEQ ID NO: 21081 - protein, 11 aa, Dengue virus
PRICTREEFTR

SEQ ID NO: 21082 - protein, 11 aa, Dengue virus
RICTREEFTRK

SEQ ID NO: 21083 - protein, 11 aa, Dengue virus
ICTREEFTRKV

SEQ ID NO: 21084 - protein, 11 aa, Dengue virus
CTREEFTRKVR

SEQ ID NO: 21085 - protein, 11 aa, Dengue virus
TREEFTRKVRS

SEQ ID NO: 21086 - protein, 11 aa, Dengue virus
REEFTRKVRSN

SEQ ID NO: 21087 - protein, 11 aa, Dengue virus
EEFTRKVRSNA

SEQ ID NO: 21088 - protein, 11 aa, Dengue virus
EFTRKVRSNAA

SEQ ID NO: 21089 - protein, 11 aa, Dengue virus
FTRKVRSNAAI

SEQ ID NO: 21090 - protein, 11 aa, Dengue virus
TRKVRSNAAIG

SEQ ID NO: 21091 - protein, 11 aa, Dengue virus
RKVRSNAAIGA

SEQ ID NO: 21092 - protein, 11 aa, Dengue virus
KVRSNAAIGAV

SEQ ID NO: 21093 - protein, 11 aa, Dengue virus
VRSNAAIGAVF

SEQ ID NO: 21094 - protein, 11 aa, Dengue virus
RSNAAIGAVFV

SEQ ID NO: 21095 - protein, 11 aa, Dengue virus
SNAAIGAVFVD

SEQ ID NO: 21096 - protein, 11 aa, Dengue virus
NAAIGAVFVDE

SEQ ID NO: 21097 - protein, 11 aa, Dengue virus
AAIGAVFVDEN

SEQ ID NO: 21098 - protein, 11 aa, Dengue virus
AIGAVFVDENQ

SEQ ID NO: 21099 - protein, 11 aa, Dengue virus
IGAVFVDENQW

SEQ ID NO: 21100 - protein, 11 aa, Dengue virus
GAVFVDENQWN

SEQ ID NO: 21101 - protein, 11 aa, Dengue virus
AVFVDENQWNS

SEQ ID NO: 21102 - protein, 11 aa, Dengue virus
VFVDENQWNSA

SEQ ID NO: 21103 - protein, 11 aa, Dengue virus
FVDENQWNSAK

SEQ ID NO: 21104 - protein, 11 aa, Dengue virus
VDENQWNSAKE

SEQ ID NO: 21105 - protein, 11 aa, Dengue virus
DENQWNSAKEA

SEQ ID NO: 21106 - protein, 11 aa, Dengue virus
ENQWNSAKEAV

SEQ ID NO: 21107 - protein, 11 aa, Dengue virus
NQWNSAKEAVE

SEQ ID NO: 21108 - protein, 11 aa, Dengue virus
QWNSAKEAVED

SEQ ID NO: 21109 - protein, 11 aa, Dengue virus
WNSAKEAVEDE

SEQ ID NO: 21110 - protein, 11 aa, Dengue virus
NSAKEAVEDER

SEQ ID NO: 21111 - protein, 11 aa, Dengue virus
SAKEAVEDERF

SEQ ID NO: 21112 - protein, 11 aa, Dengue virus
AKEAVEDERFW

SEQ ID NO: 21113 - protein, 11 aa, Dengue virus
KEAVEDERFWD

SEQ ID NO: 21114 - protein, 11 aa, Dengue virus
EAVEDERFWDL

SEQ ID NO: 21115 - protein, 11 aa, Dengue virus
AVEDERFWDLV

SEQ ID NO: 21116 - protein, 11 aa, Dengue virus
LVHRERELHKQ

SEQ ID NO: 21117 - protein, 11 aa, Dengue virus
VHRERELHKQG

SEQ ID NO: 21118 - protein, 11 aa, Dengue virus
HRERELHKQGK

SEQ ID NO: 21119 - protein, 11 aa, Dengue virus
RERELHKQGKC

SEQ ID NO: 21120 - protein, 11 aa, Dengue virus
ERELHKQGKCA

SEQ ID NO: 21121 - protein, 11 aa, Dengue virus
RELHKQGKCAT

SEQ ID NO: 21122 - protein, 11 aa, Dengue virus
ELHKQGKCATC

SEQ ID NO: 21123 - protein, 11 aa, Dengue virus
LHKQGKCATCV

SEQ ID NO: 21124 - protein, 11 aa, Dengue virus
HKQGKCATCVY

SEQ ID NO: 21125 - protein, 11 aa, Dengue virus
KQGKCATCVYN

SEQ ID NO: 21126 - protein, 11 aa, Dengue virus
QGKCATCVYNM

SEQ ID NO: 21127 - protein, 11 aa, Dengue virus
GKCATCVYNMM

SEQ ID NO: 21128 - protein, 11 aa, Dengue virus
KCATCVYNMMG

SEQ ID NO: 21129 - protein, 11 aa, Dengue virus
CATCVYNMMGK

SEQ ID NO: 21130 - protein, 11 aa, Dengue virus
ATCVYNMMGKR

SEQ ID NO: 21131 - protein, 11 aa, Dengue virus
TCVYNMMGKRE

SEQ ID NO: 21132 - protein, 11 aa, Dengue virus
CVYNMMGKREK

SEQ ID NO: 21133 - protein, 11 aa, Dengue virus
VYNMMGKREKK

SEQ ID NO: 21134 - protein, 11 aa, Dengue virus
YNMMGKREKKL

SEQ ID NO: 21135 - protein, 11 aa, Dengue virus
NMMGKREKKLG

SEQ ID NO: 21136 - protein, 11 aa, Dengue virus
MMGKREKKLGE

SEQ ID NO: 21137 - protein, 11 aa, Dengue virus
MGKREKKLGEF

SEQ ID NO: 21138 - protein, 11 aa, Dengue virus
GKREKKLGEFG

SEQ ID NO: 21139 - protein, 11 aa, Dengue virus
KREKKLGEFGK

SEQ ID NO: 21140 - protein, 11 aa, Dengue virus
REKKLGEFGKA

SEQ ID NO: 21141 - protein, 11 aa, Dengue virus
EKKLGEFGKAK

SEQ ID NO: 21142 - protein, 11 aa, Dengue virus
KKLGEFGKAKG

SEQ ID NO: 21143 - protein, 11 aa, Dengue virus
KLGEFGKAKGS

SEQ ID NO: 21144 - protein, 11 aa, Dengue virus
LGEFGKAKGSR

SEQ ID NO: 21145 - protein, 11 aa, Dengue virus
GEFGKAKGSRA

SEQ ID NO: 21146 - protein, 11 aa, Dengue virus
EFGKAKGSRAI

SEQ ID NO: 21147 - protein, 11 aa, Dengue virus
FGKAKGSRAIW

SEQ ID NO: 21148 - protein, 11 aa, Dengue virus
GKAKGSRAIWY

SEQ ID NO: 21149 - protein, 11 aa, Dengue virus
KAKGSRAIWYM

SEQ ID NO: 21150 - protein, 11 aa, Dengue virus
AKGSRAIWYMW

SEQ ID NO: 21151 - protein, 11 aa, Dengue virus
KGSRAIWYMWL

SEQ ID NO: 21152 - protein, 11 aa, Dengue virus
GSRAIWYMWLG

SEQ ID NO: 21153 - protein, 11 aa, Dengue virus
SRAIWYMWLGA

SEQ ID NO: 21154 - protein, 11 aa, Dengue virus
RAIWYMWLGAR

SEQ ID NO: 21155 - protein, 11 aa, Dengue virus
AIWYMWLGARF

SEQ ID NO: 21156 - protein, 11 aa, Dengue virus
IWYMWLGARFL

SEQ ID NO: 21157 - protein, 11 aa, Dengue virus
WYMWLGARFLE

SEQ ID NO: 21158 - protein, 11 aa, Dengue virus
YMWLGARFLEF

SEQ ID NO: 21159 - protein, 11 aa, Dengue virus
MWLGARFLEFE

SEQ ID NO: 21160 - protein, 11 aa, Dengue virus
WLGARFLEFEA

SEQ ID NO: 21161 - protein, 11 aa, Dengue virus
LGARFLEFEAL

SEQ ID NO: 21162 - protein, 11 aa, Dengue virus
GARFLEFEALG

SEQ ID NO: 21163 - protein, 11 aa, Dengue virus
ARFLEFEALGF

SEQ ID NO: 21164 - protein, 11 aa, Dengue virus
RFLEFEALGFM

SEQ ID NO: 21165 - protein, 11 aa, Dengue virus
FLEFEALGFMN

SEQ ID NO: 21166 - protein, 11 aa, Dengue virus
LEFEALGFMNE

SEQ ID NO: 21167 - protein, 11 aa, Dengue virus
EFEALGFMNED

SEQ ID NO: 21168 - protein, 11 aa, Dengue virus
FEALGFMNEDH

SEQ ID NO: 21169 - protein, 11 aa, Dengue virus
EALGFMNEDHW

SEQ ID NO: 21170 - protein, 11 aa, Dengue virus
ALGFMNEDHWF

SEQ ID NO: 21171 - protein, 11 aa, Dengue virus
LGFMNEDHWFS

SEQ ID NO: 21172 - protein, 11 aa, Dengue virus
GFMNEDHWFSR

SEQ ID NO: 21173 - protein, 11 aa, Dengue virus
FMNEDHWFSRE

SEQ ID NO: 21174 - protein, 11 aa, Dengue virus
MNEDHWFSREN

SEQ ID NO: 21175 - protein, 11 aa, Dengue virus
NEDHWFSRENS

SEQ ID NO: 21176 - protein, 11 aa, Dengue virus
EDHWFSRENSL

SEQ ID NO: 21177 - protein, 11 aa, Dengue virus
DHWFSRENSLS

SEQ ID NO: 21178 - protein, 11 aa, Dengue virus
HWFSRENSLSG

SEQ ID NO: 21179 - protein, 11 aa, Dengue virus
WFSRENSLSGV

SEQ ID NO: 21180 - protein, 11 aa, Dengue virus
FSRENSLSGVE

SEQ ID NO: 21181 - protein, 11 aa, Dengue virus
SRENSLSGVEG

SEQ ID NO: 21182 - protein, 11 aa, Dengue virus
RENSLSGVEGE

SEQ ID NO: 21183 - protein, 11 aa, Dengue virus
ENSLSGVEGEG

SEQ ID NO: 21184 - protein, 11 aa, Dengue virus
NSLSGVEGEGL

SEQ ID NO: 21185 - protein, 11 aa, Dengue virus
SLSGVEGEGLH

SEQ ID NO: 21186 - protein, 11 aa, Dengue virus
LSGVEGEGLHK

SEQ ID NO: 21187 - protein, 11 aa, Dengue virus
SGVEGEGLHKL

SEQ ID NO: 21188 - protein, 11 aa, Dengue virus
GVEGEGLHKLG

SEQ ID NO: 21189 - protein, 11 aa, Dengue virus
VEGEGLHKLGY

SEQ ID NO: 21190 - protein, 11 aa, Dengue virus
EGEGLHKLGYI

SEQ ID NO: 21191 - protein, 11 aa, Dengue virus
GEGLHKLGYIL

SEQ ID NO: 21192 - protein, 11 aa, Dengue virus
EGLHKLGYILR

SEQ ID NO: 21193 - protein, 11 aa, Dengue virus
GLHKLGYILRD

SEQ ID NO: 21194 - protein, 11 aa, Dengue virus
LHKLGYILRDI

SEQ ID NO: 21195 - protein, 11 aa, Dengue virus
HKLGYILRDIS

SEQ ID NO: 21196 - protein, 11 aa, Dengue virus
KLGYILRDISK

SEQ ID NO: 21197 - protein, 11 aa, Dengue virus
LGYILRDISKI

SEQ ID NO: 21198 - protein, 11 aa, Dengue virus
GYILRDISKIP

SEQ ID NO: 21199 - protein, 11 aa, Dengue virus
YILRDISKIPG

SEQ ID NO: 21200 - protein, 11 aa, Dengue virus
ILRDISKIPGG

SEQ ID NO: 21201 - protein, 11 aa, Dengue virus
LRDISKIPGGN

SEQ ID NO: 21202 - protein, 11 aa, Dengue virus
RDISKIPGGNM

SEQ ID NO: 21203 - protein, 11 aa, Dengue virus
DISKIPGGNMY

SEQ ID NO: 21204 - protein, 11 aa, Dengue virus
ISKIPGGNMYA

SEQ ID NO: 21205 - protein, 11 aa, Dengue virus
SKIPGGNMYAD

SEQ ID NO: 21206 - protein, 11 aa, Dengue virus
KIPGGNMYADD

SEQ ID NO: 21207 - protein, 11 aa, Dengue virus
IPGGNMYADDT

SEQ ID NO: 21208 - protein, 11 aa, Dengue virus
PGGNMYADDTA

SEQ ID NO: 21209 - protein, 11 aa, Dengue virus
GGNMYADDTAG

SEQ ID NO: 21210 - protein, 11 aa, Dengue virus
GNMYADDTAGW

SEQ ID NO: 21211 - protein, 11 aa, Dengue virus
NMYADDTAGWD

SEQ ID NO: 21212 - protein, 11 aa, Dengue virus
MYADDTAGWDT

SEQ ID NO: 21213 - protein, 11 aa, Dengue virus
YADDTAGWDTR

SEQ ID NO: 21214 - protein, 11 aa, Dengue virus
ADDTAGWDTRI

SEQ ID NO: 21215 - protein, 11 aa, Dengue virus
DDTAGWDTRIT

SEQ ID NO: 21216 - protein, 11 aa, Dengue virus
DTAGWDTRITE

SEQ ID NO: 21217 - protein, 11 aa, Dengue virus
TAGWDTRITED

SEQ ID NO: 21218 - protein, 11 aa, Dengue virus
AGWDTRITEDD

SEQ ID NO: 21219 - protein, 11 aa, Dengue virus
GWDTRITEDDL

SEQ ID NO: 21220 - protein, 11 aa, Dengue virus
WDTRITEDDLQ

SEQ ID NO: 21221 - protein, 11 aa, Dengue virus
DTRITEDDLQN

SEQ ID NO: 21222 - protein, 11 aa, Dengue virus
TRITEDDLQNE

SEQ ID NO: 21223 - protein, 11 aa, Dengue virus
RITEDDLQNEA

SEQ ID NO: 21224 - protein, 11 aa, Dengue virus
ITEDDLQNEAK

SEQ ID NO: 21225 - protein, 11 aa, Dengue virus
TEDDLQNEAKI

SEQ ID NO: 21226 - protein, 11 aa, Dengue virus
EDDLQNEAKIT

SEQ ID NO: 21227 - protein, 11 aa, Dengue virus
DDLQNEAKITD

SEQ ID NO: 21228 - protein, 11 aa, Dengue virus
DLQNEAKITDI

SEQ ID NO: 21229 - protein, 11 aa, Dengue virus
LQNEAKITDIM

SEQ ID NO: 21230 - protein, 11 aa, Dengue virus
QNEAKITDIME

SEQ ID NO: 21231 - protein, 11 aa, Dengue virus
NEAKITDIMEP

SEQ ID NO: 21232 - protein, 11 aa, Dengue virus
EAKITDIMEPE

SEQ ID NO: 21233 - protein, 11 aa, Dengue virus
AKITDIMEPEH

SEQ ID NO: 21234 - protein, 11 aa, Dengue virus
KITDIMEPEHA

SEQ ID NO: 21235 - protein, 11 aa, Dengue virus
ITDIMEPEHAL

SEQ ID NO: 21236 - protein, 11 aa, Dengue virus
TDIMEPEHALL

SEQ ID NO: 21237 - protein, 11 aa, Dengue virus
DIMEPEHALLA

SEQ ID NO: 21238 - protein, 11 aa, Dengue virus
IMEPEHALLAK

SEQ ID NO: 21239 - protein, 11 aa, Dengue virus
MEPEHALLAKS

SEQ ID NO: 21240 - protein, 11 aa, Dengue virus
EPEHALLAKSI

SEQ ID NO: 21241 - protein, 11 aa, Dengue virus
PEHALLAKSIF

SEQ ID NO: 21242 - protein, 11 aa, Dengue virus
EHALLAKSIFK

SEQ ID NO: 21243 - protein, 11 aa, Dengue virus
HALLAKSIFKL

SEQ ID NO: 21244 - protein, 11 aa, Dengue virus
ALLAKSIFKLT

SEQ ID NO: 21245 - protein, 11 aa, Dengue virus
LLAKSIFKLTY

SEQ ID NO: 21246 - protein, 11 aa, Dengue virus
LAKSIFKLTYQ

SEQ ID NO: 21247 - protein, 11 aa, Dengue virus
AKSIFKLTYQN

SEQ ID NO: 21248 - protein, 11 aa, Dengue virus
KSIFKLTYQNK

SEQ ID NO: 21249 - protein, 11 aa, Dengue virus
SIFKLTYQNKV

SEQ ID NO: 21250 - protein, 11 aa, Dengue virus
IFKLTYQNKVV

SEQ ID NO: 21251 - protein, 11 aa, Dengue virus
FKLTYQNKVVR

SEQ ID NO: 21252 - protein, 11 aa, Dengue virus
KLTYQNKVVRV

SEQ ID NO: 21253 - protein, 11 aa, Dengue virus
LTYQNKVVRVQ

SEQ ID NO: 21254 - protein, 11 aa, Dengue virus
TYQNKVVRVQR

SEQ ID NO: 21255 - protein, 11 aa, Dengue virus
YQNKVVRVQRP

SEQ ID NO: 21256 - protein, 11 aa, Dengue virus
QNKVVRVQRPA

SEQ ID NO: 21257 - protein, 11 aa, Dengue virus
NKVVRVQRPAK

SEQ ID NO: 21258 - protein, 11 aa, Dengue virus
KVVRVQRPAKN

SEQ ID NO: 21259 - protein, 11 aa, Dengue virus
VVRVQRPAKNG

SEQ ID NO: 21260 - protein, 11 aa, Dengue virus
VRVQRPAKNGT

SEQ ID NO: 21261 - protein, 11 aa, Dengue virus
RVQRPAKNGTV

SEQ ID NO: 21262 - protein, 11 aa, Dengue virus
VQRPAKNGTVM

SEQ ID NO: 21263 - protein, 11 aa, Dengue virus
QRPAKNGTVMD

SEQ ID NO: 21264 - protein, 11 aa, Dengue virus
RPAKNGTVMDV

SEQ ID NO: 21265 - protein, 11 aa, Dengue virus
PAKNGTVMDVI

SEQ ID NO: 21266 - protein, 11 aa, Dengue virus
AKNGTVMDVIS

SEQ ID NO: 21267 - protein, 11 aa, Dengue virus
KNGTVMDVISR

SEQ ID NO: 21268 - protein, 11 aa, Dengue virus
NGTVMDVISRR

SEQ ID NO: 21269 - protein, 11 aa, Dengue virus
GTVMDVISRRD

SEQ ID NO: 21270 - protein, 11 aa, Dengue virus
TVMDVISRRDQ

SEQ ID NO: 21271 - protein, 11 aa, Dengue virus
VMDVISRRDQR

SEQ ID NO: 21272 - protein, 11 aa, Dengue virus
MDVISRRDQRG

SEQ ID NO: 21273 - protein, 11 aa, Dengue virus
DVISRRDQRGS

SEQ ID NO: 21274 - protein, 11 aa, Dengue virus
VISRRDQRGSG

SEQ ID NO: 21275 - protein, 11 aa, Dengue virus
ISRRDQRGSGQ

SEQ ID NO: 21276 - protein, 11 aa, Dengue virus
SRRDQRGSGQV

SEQ ID NO: 21277 - protein, 11 aa, Dengue virus
RRDQRGSGQVG

SEQ ID NO: 21278 - protein, 11 aa, Dengue virus
RDQRGSGQVGT

SEQ ID NO: 21279 - protein, 11 aa, Dengue virus
DQRGSGQVGTY

SEQ ID NO: 21280 - protein, 11 aa, Dengue virus
QRGSGQVGTYG

SEQ ID NO: 21281 - protein, 11 aa, Dengue virus
RGSGQVGTYGL

SEQ ID NO: 21282 - protein, 11 aa, Dengue virus
GSGQVGTYGLN

SEQ ID NO: 21283 - protein, 11 aa, Dengue virus
SGQVGTYGLNT

SEQ ID NO: 21284 - protein, 11 aa, Dengue virus
GQVGTYGLNTF

SEQ ID NO: 21285 - protein, 11 aa, Dengue virus
QVGTYGLNTFT

SEQ ID NO: 21286 - protein, 11 aa, Dengue virus
VGTYGLNTFTN

SEQ ID NO: 21287 - protein, 11 aa, Dengue virus
GTYGLNTFTNM

SEQ ID NO: 21288 - protein, 11 aa, Dengue virus
TYGLNTFTNME

SEQ ID NO: 21289 - protein, 11 aa, Dengue virus
YGLNTFTNMEA

SEQ ID NO: 21290 - protein, 11 aa, Dengue virus
GLNTFTNMEAQ

SEQ ID NO: 21291 - protein, 11 aa, Dengue virus
LNTFTNMEAQL

SEQ ID NO: 21292 - protein, 11 aa, Dengue virus
NTFTNMEAQLI

SEQ ID NO: 21293 - protein, 11 aa, Dengue virus
TFTNMEAQLIR

SEQ ID NO: 21294 - protein, 11 aa, Dengue virus
FTNMEAQLIRQ

SEQ ID NO: 21295 - protein, 11 aa, Dengue virus
TNMEAQLIRQM

SEQ ID NO: 21296 - protein, 11 aa, Dengue virus
NMEAQLIRQME

SEQ ID NO: 21297 - protein, 11 aa, Dengue virus
MEAQLIRQMES

SEQ ID NO: 21298 - protein, 11 aa, Dengue virus
EAQLIRQMESE

SEQ ID NO: 21299 - protein, 11 aa, Dengue virus
AQLIRQMESEG

SEQ ID NO: 21300 - protein, 11 aa, Dengue virus
QLIRQMESEGI

SEQ ID NO: 21301 - protein, 11 aa, Dengue virus
LIRQMESEGIF

SEQ ID NO: 21302 - protein, 11 aa, Dengue virus
IRQMESEGIFS

SEQ ID NO: 21303 - protein, 11 aa, Dengue virus
RQMESEGIFSP

SEQ ID NO: 21304 - protein, 11 aa, Dengue virus
ERLKRMAISGD

SEQ ID NO: 21305 - protein, 11 aa, Dengue virus
RLKRMAISGDD

SEQ ID NO: 21306 - protein, 11 aa, Dengue virus
LKRMAISGDDC

SEQ ID NO: 21307 - protein, 11 aa, Dengue virus
KRMAISGDDCV

SEQ ID NO: 21308 - protein, 11 aa, Dengue virus
RMAISGDDCVV

SEQ ID NO: 21309 - protein, 11 aa, Dengue virus
MAISGDDCVVK

SEQ ID NO: 21310 - protein, 11 aa, Dengue virus
AISGDDCVVKP

SEQ ID NO: 21311 - protein, 11 aa, Dengue virus
ISGDDCVVKPI

SEQ ID NO: 21312 - protein, 11 aa, Dengue virus
SGDDCVVKPID

SEQ ID NO: 21313 - protein, 11 aa, Dengue virus
GDDCVVKPIDD

SEQ ID NO: 21314 - protein, 11 aa, Dengue virus
DDCVVKPIDDR

SEQ ID NO: 21315 - protein, 11 aa, Dengue virus
DCVVKPIDDRF

SEQ ID NO: 21316 - protein, 11 aa, Dengue virus
CVVKPIDDRFA

SEQ ID NO: 21317 - protein, 11 aa, Dengue virus
VVKPIDDRFAT

SEQ ID NO: 21318 - protein, 11 aa, Dengue virus
VKPIDDRFATA

SEQ ID NO: 21319 - protein, 11 aa, Dengue virus
KPIDDRFATAL

SEQ ID NO: 21320 - protein, 11 aa, Dengue virus
DDRFATALTAL

SEQ ID NO: 21321 - protein, 11 aa, Dengue virus
DRFATALTALN

SEQ ID NO: 21322 - protein, 11 aa, Dengue virus
RFATALTALND

SEQ ID NO: 21323 - protein, 11 aa, Dengue virus
FATALTALNDM

SEQ ID NO: 21324 - protein, 11 aa, Dengue virus
ATALTALNDMG

SEQ ID NO: 21325 - protein, 11 aa, Dengue virus
TALTALNDMGK

SEQ ID NO: 21326 - protein, 11 aa, Dengue virus
ALTALNDMGKV

SEQ ID NO: 21327 - protein, 11 aa, Dengue virus
LTALNDMGKVR

SEQ ID NO: 21328 - protein, 11 aa, Dengue virus
TALNDMGKVRK

SEQ ID NO: 21329 - protein, 11 aa, Dengue virus
ALNDMGKVRKD

SEQ ID NO: 21330 - protein, 11 aa, Dengue virus
LNDMGKVRKDI

SEQ ID NO: 21331 - protein, 11 aa, Dengue virus
NDMGKVRKDIP

SEQ ID NO: 21332 - protein, 11 aa, Dengue virus
DMGKVRKDIPQ

SEQ ID NO: 21333 - protein, 11 aa, Dengue virus
MGKVRKDIPQW

SEQ ID NO: 21334 - protein, 11 aa, Dengue virus
GKVRKDIPQWE

SEQ ID NO: 21335 - protein, 11 aa, Dengue virus
KVRKDIPQWEP

SEQ ID NO: 21336 - protein, 11 aa, Dengue virus
VRKDIPQWEPS

SEQ ID NO: 21337 - protein, 11 aa, Dengue virus
RKDIPQWEPSK

SEQ ID NO: 21338 - protein, 11 aa, Dengue virus
KDIPQWEPSKG

SEQ ID NO: 21339 - protein, 11 aa, Dengue virus
DIPQWEPSKGW

SEQ ID NO: 21340 - protein, 11 aa, Dengue virus
IPQWEPSKGWN

SEQ ID NO: 21341 - protein, 11 aa, Dengue virus
PQWEPSKGWND

SEQ ID NO: 21342 - protein, 11 aa, Dengue virus
QWEPSKGWNDW

SEQ ID NO: 21343 - protein, 11 aa, Dengue virus
WEPSKGWNDWQ

SEQ ID NO: 21344 - protein, 11 aa, Dengue virus
EPSKGWNDWQQ

SEQ ID NO: 21345 - protein, 11 aa, Dengue virus
PSKGWNDWQQV

SEQ ID NO: 21346 - protein, 11 aa, Dengue virus
SKGWNDWQQVP

SEQ ID NO: 21347 - protein, 11 aa, Dengue virus
KGWNDWQQVPF

SEQ ID NO: 21348 - protein, 11 aa, Dengue virus
GWNDWQQVPFC

SEQ ID NO: 21349 - protein, 11 aa, Dengue virus
WNDWQQVPFCS

SEQ ID NO: 21350 - protein, 11 aa, Dengue virus
NDWQQVPFCSH

SEQ ID NO: 21351 - protein, 11 aa, Dengue virus
DWQQVPFCSHH

SEQ ID NO: 21352 - protein, 11 aa, Dengue virus
WQQVPFCSHHF

SEQ ID NO: 21353 - protein, 11 aa, Dengue virus
QQVPFCSHHFH

SEQ ID NO: 21354 - protein, 11 aa, Dengue virus
QVPFCSHHFHQ

SEQ ID NO: 21355 - protein, 11 aa, Dengue virus
VPFCSHHFHQL

SEQ ID NO: 21356 - protein, 11 aa, Dengue virus
PFCSHHFHQLI

SEQ ID NO: 21357 - protein, 11 aa, Dengue virus
FCSHHFHQLIM

SEQ ID NO: 21358 - protein, 11 aa, Dengue virus
CSHHFHQLIMK

SEQ ID NO: 21359 - protein, 11 aa, Dengue virus
SHHFHQLIMKD

SEQ ID NO: 21360 - protein, 11 aa, Dengue virus
HHFHQLIMKDG

SEQ ID NO: 21361 - protein, 11 aa, Dengue virus
HFHQLIMKDGR

SEQ ID NO: 21362 - protein, 11 aa, Dengue virus
FHQLIMKDGRE

SEQ ID NO: 21363 - protein, 11 aa, Dengue virus
HQLIMKDGREI

SEQ ID NO: 21364 - protein, 11 aa, Dengue virus
QLIMKDGREIV

SEQ ID NO: 21365 - protein, 11 aa, Dengue virus
LIMKDGREIVV

SEQ ID NO: 21366 - protein, 11 aa, Dengue virus
IMKDGREIVVP

SEQ ID NO: 21367 - protein, 11 aa, Dengue virus
MKDGREIVVPC

SEQ ID NO: 21368 - protein, 11 aa, Dengue virus
KDGREIVVPCR

SEQ ID NO: 21369 - protein, 11 aa, Dengue virus
DGREIVVPCRN

SEQ ID NO: 21370 - protein, 11 aa, Dengue virus
GREIVVPCRNQ

SEQ ID NO: 21371 - protein, 11 aa, Dengue virus
REIVVPCRNQD

SEQ ID NO: 21372 - protein, 11 aa, Dengue virus
EIVVPCRNQDE

SEQ ID NO: 21373 - protein, 11 aa, Dengue virus
IVVPCRNQDEL

SEQ ID NO: 21374 - protein, 11 aa, Dengue virus
VVPCRNQDELV

SEQ ID NO: 21375 - protein, 11 aa, Dengue virus
VPCRNQDELVG

SEQ ID NO: 21376 - protein, 11 aa, Dengue virus
PCRNQDELVGR

SEQ ID NO: 21377 - protein, 11 aa, Dengue virus
CRNQDELVGRA

SEQ ID NO: 21378 - protein, 11 aa, Dengue virus
RNQDELVGRAR

SEQ ID NO: 21379 - protein, 11 aa, Dengue virus
NQDELVGRARV

SEQ ID NO: 21380 - protein, 11 aa, Dengue virus
QDELVGRARVS

SEQ ID NO: 21381 - protein, 11 aa, Dengue virus
DELVGRARVSQ

SEQ ID NO: 21382 - protein, 11 aa, Dengue virus
ELVGRARVSQG

SEQ ID NO: 21383 - protein, 11 aa, Dengue virus
LVGRARVSQGA

SEQ ID NO: 21384 - protein, 11 aa, Dengue virus
VGRARVSQGAG

SEQ ID NO: 21385 - protein, 11 aa, Dengue virus
GRARVSQGAGW

SEQ ID NO: 21386 - protein, 11 aa, Dengue virus
RARVSQGAGWS

SEQ ID NO: 21387 - protein, 11 aa, Dengue virus
ARVSQGAGWSL

SEQ ID NO: 21388 - protein, 11 aa, Dengue virus
RVSQGAGWSLR

SEQ ID NO: 21389 - protein, 11 aa, Dengue virus
VSQGAGWSLRE

SEQ ID NO: 21390 - protein, 11 aa, Dengue virus
SQGAGWSLRET

SEQ ID NO: 21391 - protein, 11 aa, Dengue virus
QGAGWSLRETA

SEQ ID NO: 21392 - protein, 11 aa, Dengue virus
GAGWSLRETAC

SEQ ID NO: 21393 - protein, 11 aa, Dengue virus
AGWSLRETACL

SEQ ID NO: 21394 - protein, 11 aa, Dengue virus
GWSLRETACLG

SEQ ID NO: 21395 - protein, 11 aa, Dengue virus
WSLRETACLGK

SEQ ID NO: 21396 - protein, 11 aa, Dengue virus
SLRETACLGKS

SEQ ID NO: 21397 - protein, 11 aa, Dengue virus
LRETACLGKSY

SEQ ID NO: 21398 - protein, 11 aa, Dengue virus
RETACLGKSYA

SEQ ID NO: 21399 - protein, 11 aa, Dengue virus
ETACLGKSYAQ

SEQ ID NO: 21400 - protein, 11 aa, Dengue virus
TACLGKSYAQM

SEQ ID NO: 21401 - protein, 11 aa, Dengue virus
ACLGKSYAQMW

SEQ ID NO: 21402 - protein, 11 aa, Dengue virus
CLGKSYAQMWQ

SEQ ID NO: 21403 - protein, 11 aa, Dengue virus
LGKSYAQMWQL

SEQ ID NO: 21404 - protein, 11 aa, Dengue virus
GKSYAQMWQLM

SEQ ID NO: 21405 - protein, 11 aa, Dengue virus
KSYAQMWQLMY

SEQ ID NO: 21406 - protein, 11 aa, Dengue virus
SYAQMWQLMYF

SEQ ID NO: 21407 - protein, 11 aa, Dengue virus
YAQMWQLMYFH

SEQ ID NO: 21408 - protein, 11 aa, Dengue virus
AQMWQLMYFHR

SEQ ID NO: 21409 - protein, 11 aa, Dengue virus
QMWQLMYFHRR

SEQ ID NO: 21410 - protein, 11 aa, Dengue virus
MWQLMYFHRRD

SEQ ID NO: 21411 - protein, 11 aa, Dengue virus
WQLMYFHRRDL

SEQ ID NO: 21412 - protein, 11 aa, Dengue virus
QLMYFHRRDLR

SEQ ID NO: 21413 - protein, 11 aa, Dengue virus
LMYFHRRDLRL

SEQ ID NO: 21414 - protein, 11 aa, Dengue virus
MYFHRRDLRLA

SEQ ID NO: 21415 - protein, 11 aa, Dengue virus
YFHRRDLRLAA

SEQ ID NO: 21416 - protein, 11 aa, Dengue virus
FHRRDLRLAAN

SEQ ID NO: 21417 - protein, 11 aa, Dengue virus
HRRDLRLAANA

SEQ ID NO: 21418 - protein, 11 aa, Dengue virus
RRDLRLAANAI

SEQ ID NO: 21419 - protein, 11 aa, Dengue virus
RDLRLAANAIC

SEQ ID NO: 21420 - protein, 11 aa, Dengue virus
DLRLAANAICS

SEQ ID NO: 21421 - protein, 11 aa, Dengue virus
LRLAANAICSA

SEQ ID NO: 21422 - protein, 11 aa, Dengue virus
RLAANAICSAV

SEQ ID NO: 21423 - protein, 11 aa, Dengue virus
LAANAICSAVP

SEQ ID NO: 21424 - protein, 11 aa, Dengue virus
AANAICSAVPV

SEQ ID NO: 21425 - protein, 11 aa, Dengue virus
PVDWVPTSRTT

SEQ ID NO: 21426 - protein, 11 aa, Dengue virus
VDWVPTSRTTW

SEQ ID NO: 21427 - protein, 11 aa, Dengue virus
DWVPTSRTTWS

SEQ ID NO: 21428 - protein, 11 aa, Dengue virus
WVPTSRTTWSI

SEQ ID NO: 21429 - protein, 11 aa, Dengue virus
VPTSRTTWSIH

SEQ ID NO: 21430 - protein, 11 aa, Dengue virus
PTSRTTWSIHA

SEQ ID NO: 21431 - protein, 11 aa, Dengue virus
TSRTTWSIHAH

SEQ ID NO: 21432 - protein, 11 aa, Dengue virus
SRTTWSIHAHH

SEQ ID NO: 21433 - protein, 11 aa, Dengue virus
RTTWSIHAHHQ

SEQ ID NO: 21434 - protein, 11 aa, Dengue virus
TTWSIHAHHQW

SEQ ID NO: 21435 - protein, 11 aa, Dengue virus
TWSIHAHHQWM

SEQ ID NO: 21436 - protein, 11 aa, Dengue virus
WSIHAHHQWMT

SEQ ID NO: 21437 - protein, 11 aa, Dengue virus
SIHAHHQWMTT

SEQ ID NO: 21438 - protein, 11 aa, Dengue virus
IHAHHQWMTTE

SEQ ID NO: 21439 - protein, 11 aa, Dengue virus
HAHHQWMTTED

SEQ ID NO: 21440 - protein, 11 aa, Dengue virus
AHHQWMTTEDM

SEQ ID NO: 21441 - protein, 11 aa, Dengue virus
HHQWMTTEDML

SEQ ID NO: 21442 - protein, 11 aa, Dengue virus
HQWMTTEDMLS

SEQ ID NO: 21443 - protein, 11 aa, Dengue virus
QWMTTEDMLSV

SEQ ID NO: 21444 - protein, 11 aa, Dengue virus
WMTTEDMLSVW

SEQ ID NO: 21445 - protein, 11 aa, Dengue virus
MTTEDMLSVWN

SEQ ID NO: 21446 - protein, 11 aa, Dengue virus
TTEDMLSVWNR

SEQ ID NO: 21447 - protein, 11 aa, Dengue virus
TEDMLSVWNRV

SEQ ID NO: 21448 - protein, 11 aa, Dengue virus
EDMLSVWNRVW

SEQ ID NO: 21449 - protein, 11 aa, Dengue virus
DMLSVWNRVWI

SEQ ID NO: 21450 - protein, 11 aa, Dengue virus
MLSVWNRVWIE

SEQ ID NO: 21451 - protein, 11 aa, Dengue virus
LSVWNRVWIEE

SEQ ID NO: 21452 - protein, 11 aa, Dengue virus
SVWNRVWIEEN

SEQ ID NO: 21453 - protein, 11 aa, Dengue virus
VWNRVWIEENP

SEQ ID NO: 21454 - protein, 11 aa, Dengue virus
WNRVWIEENPW

SEQ ID NO: 21455 - protein, 11 aa, Dengue virus
NRVWIEENPWM

SEQ ID NO: 21456 - protein, 11 aa, Dengue virus
RVWIEENPWME

SEQ ID NO: 21457 - protein, 11 aa, Dengue virus
VWIEENPWMED

SEQ ID NO: 21458 - protein, 11 aa, Dengue virus
WIEENPWMEDK

SEQ ID NO: 21459 - protein, 11 aa, Dengue virus
IEENPWMEDKT

SEQ ID NO: 21460 - protein, 11 aa, Dengue virus
EENPWMEDKTH

SEQ ID NO: 21461 - protein, 11 aa, Dengue virus
ENPWMEDKTHI

SEQ ID NO: 21462 - protein, 11 aa, Dengue virus
NPWMEDKTHIS

SEQ ID NO: 21463 - protein, 11 aa, Dengue virus
PWMEDKTHISS

SEQ ID NO: 21464 - protein, 11 aa, Dengue virus
WMEDKTHISSW

SEQ ID NO: 21465 - protein, 11 aa, Dengue virus
MEDKTHISSWG

SEQ ID NO: 21466 - protein, 11 aa, Dengue virus
ISSWGDVPYLG

SEQ ID NO: 21467 - protein, 11 aa, Dengue virus
SSWGDVPYLGK

SEQ ID NO: 21468 - protein, 11 aa, Dengue virus
SWGDVPYLGKR

SEQ ID NO: 21469 - protein, 11 aa, Dengue virus
WGDVPYLGKRE

SEQ ID NO: 21470 - protein, 11 aa, Dengue virus
GDVPYLGKRED

SEQ ID NO: 21471 - protein, 11 aa, Dengue virus
DVPYLGKREDQ

SEQ ID NO: 21472 - protein, 11 aa, Dengue virus
VPYLGKREDQW

SEQ ID NO: 21473 - protein, 11 aa, Dengue virus
PYLGKREDQWC

SEQ ID NO: 21474 - protein, 11 aa, Dengue virus
YLGKREDQWCG

SEQ ID NO: 21475 - protein, 11 aa, Dengue virus
LGKREDQWCGS

SEQ ID NO: 21476 - protein, 11 aa, Dengue virus
GKREDQWCGSL

SEQ ID NO: 21477 - protein, 11 aa, Dengue virus
KREDQWCGSLI

SEQ ID NO: 21478 - protein, 11 aa, Dengue virus
REDQWCGSLIG

SEQ ID NO: 21479 - protein, 11 aa, Dengue virus
EDQWCGSLIGL

SEQ ID NO: 21480 - protein, 11 aa, Dengue virus
DQWCGSLIGLT

SEQ ID NO: 21481 - protein, 11 aa, Dengue virus
QWCGSLIGLTA

SEQ ID NO: 21482 - protein, 11 aa, Dengue virus
WCGSLIGLTAR

SEQ ID NO: 21483 - protein, 11 aa, Dengue virus
CGSLIGLTARA

SEQ ID NO: 21484 - protein, 11 aa, Dengue virus
GSLIGLTARAT

SEQ ID NO: 21485 - protein, 11 aa, Dengue virus
SLIGLTARATW

SEQ ID NO: 21486 - protein, 11 aa, Dengue virus
LIGLTARATWA

SEQ ID NO: 21487 - protein, 11 aa, Dengue virus
IGLTARATWAT

SEQ ID NO: 21488 - protein, 11 aa, Dengue virus
GLTARATWATN

SEQ ID NO: 21489 - protein, 11 aa, Dengue virus
LTARATWATNI

SEQ ID NO: 21490 - protein, 11 aa, Dengue virus
TARATWATNIQ

SEQ ID NO: 21491 - protein, 11 aa, Dengue virus
ARATWATNIQV

SEQ ID NO: 21492 - protein, 11 aa, Dengue virus
RATWATNIQVA

SEQ ID NO: 21493 - protein, 11 aa, Dengue virus
ATWATNIQVAI

SEQ ID NO: 21494 - protein, 11 aa, Dengue virus
TWATNIQVAIN

SEQ ID NO: 21495 - protein, 11 aa, Dengue virus
WATNIQVAINQ

SEQ ID NO: 21496 - protein, 11 aa, Dengue virus
ATNIQVAINQV

SEQ ID NO: 21497 - protein, 11 aa, Dengue virus
TNIQVAINQVR

SEQ ID NO: 21498 - protein, 11 aa, Dengue virus
NIQVAINQVRR

SEQ ID NO: 21499 - protein, 11 aa, Dengue virus
IQVAINQVRRL

SEQ ID NO: 21500 - protein, 11 aa, Dengue virus
QVAINQVRRLI

SEQ ID NO: 21501 - protein, 11 aa, Dengue virus
VAINQVRRLIG

SEQ ID NO: 21502 - protein, 11 aa, Dengue virus
AINQVRRLIGN

SEQ ID NO: 21503 - protein, 11 aa, Dengue virus
INQVRRLIGNE

SEQ ID NO: 21504 - protein, 11 aa, Dengue virus
NQVRRLIGNEN

SEQ ID NO: 21505 - protein, 11 aa, Dengue virus
QVRRLIGNENY

SEQ ID NO: 21506 - protein, 11 aa, Dengue virus
VRRLIGNENYL

SEQ ID NO: 21507 - protein, 11 aa, Dengue virus
RRLIGNENYLD

SEQ ID NO: 21508 - protein, 11 aa, Dengue virus
RLIGNENYLDY

SEQ ID NO: 21509 - protein, 11 aa, Dengue virus
LIGNENYLDYM

SEQ ID NO: 21510 - protein, 11 aa, Dengue virus
IGNENYLDYMT

SEQ ID NO: 21511 - protein, 11 aa, Dengue virus
GNENYLDYMTS

SEQ ID NO: 21512 - protein, 11 aa, Dengue virus
NENYLDYMTSM

SEQ ID NO: 21513 - protein, 11 aa, Dengue virus
ENYLDYMTSMK

SEQ ID NO: 21514 - protein, 11 aa, Dengue virus
NYLDYMTSMKR

SEQ ID NO: 21515 - protein, 11 aa, Dengue virus
YLDYMTSMKRF

SEQ ID NO: 21516 - protein, 11 aa, Dengue virus
LDYMTSMKRFK

SEQ ID NO: 21517 - protein, 11 aa, Dengue virus
DYMTSMKRFKN

SEQ ID NO: 21518 - protein, 11 aa, Dengue virus
YMTSMKRFKNE

SEQ ID NO: 21519 - protein, 11 aa, Dengue virus
MNNQRKKTGRP

SEQ ID NO: 21520 - protein, 11 aa, Dengue virus
NNQRKKTGRPS

SEQ ID NO: 21521 - protein, 11 aa, Dengue virus
NQRKKTGRPSF

SEQ ID NO: 21522 - protein, 11 aa, Dengue virus
QRKKTGRPSFN

SEQ ID NO: 21523 - protein, 11 aa, Dengue virus
RKKTGRPSFNM

SEQ ID NO: 21524 - protein, 11 aa, Dengue virus
KKTGRPSFNML

SEQ ID NO: 21525 - protein, 11 aa, Dengue virus
KTGRPSFNMLK

SEQ ID NO: 21526 - protein, 11 aa, Dengue virus
TGRPSFNMLKR

SEQ ID NO: 21527 - protein, 11 aa, Dengue virus
GRPSFNMLKRA

SEQ ID NO: 21528 - protein, 11 aa, Dengue virus
QPSFNMLKRAR

SEQ ID NO: 21529 - protein, 11 aa, Dengue virus
LKRARNRVSTG

SEQ ID NO: 21530 - protein, 11 aa, Dengue virus
KRARNRVSTGS

SEQ ID NO: 21531 - protein, 11 aa, Dengue virus
RARNRVSTGSQ

SEQ ID NO: 21532 - protein, 11 aa, Dengue virus
ARNRVSTGSQL

SEQ ID NO: 21533 - protein, 11 aa, Dengue virus
RNRVSTGSQLA

SEQ ID NO: 21534 - protein, 11 aa, Dengue virus
NRVSTGSQLAK

SEQ ID NO: 21535 - protein, 11 aa, Dengue virus
RVSTGSQLAKR

SEQ ID NO: 21536 - protein, 11 aa, Dengue virus
VSTGSQLAKRF

SEQ ID NO: 21537 - protein, 11 aa, Dengue virus
STGSQLAKRFS

SEQ ID NO: 21538 - protein, 11 aa, Dengue virus
TGSQLAKRFSK

SEQ ID NO: 21539 - protein, 11 aa, Dengue virus
GSQLAKRFSKG

SEQ ID NO: 21540 - protein, 11 aa, Dengue virus
GLLSGQGPMKM

SEQ ID NO: 21541 - protein, 11 aa, Dengue virus
LLSGQGPMKMV

SEQ ID NO: 21542 - protein, 11 aa, Dengue virus
LSGQGPMKMVM

SEQ ID NO: 21543 - protein, 11 aa, Dengue virus
SGQGPMKMVMA

SEQ ID NO: 21544 - protein, 11 aa, Dengue virus
GQGPMKMVMAF

SEQ ID NO: 21545 - protein, 11 aa, Dengue virus
QGPMKMVMAFI

SEQ ID NO: 21546 - protein, 11 aa, Dengue virus
GPMKMVMAFIA

SEQ ID NO: 21547 - protein, 11 aa, Dengue virus
PMKMVMAFIAF

SEQ ID NO: 21548 - protein, 11 aa, Dengue virus
MKMVMAFIAFL

SEQ ID NO: 21549 - protein, 11 aa, Dengue virus
KMVMAFIAFLR

SEQ ID NO: 21550 - protein, 11 aa, Dengue virus
MVMAFIAFLRF

SEQ ID NO: 21551 - protein, 11 aa, Dengue virus
PPTAGILARWS

SEQ ID NO: 21552 - protein, 11 aa, Dengue virus
PTAGILARWSS

SEQ ID NO: 21553 - protein, 11 aa, Dengue virus
TAGILARWSSF

SEQ ID NO: 21554 - protein, 11 aa, Dengue virus
AGILARWSSFK

SEQ ID NO: 21555 - protein, 11 aa, Dengue virus
GILARWSSFKK

SEQ ID NO: 21556 - protein, 11 aa, Dengue virus
ILARWGSFKKS

SEQ ID NO: 21557 - protein, 11 aa, Dengue virus
LARWGSFKKSG

SEQ ID NO: 21558 - protein, 11 aa, Dengue virus
ARWGSFKKSGA

SEQ ID NO: 21559 - protein, 11 aa, Dengue virus
RWGSFKKSGAI

SEQ ID NO: 21560 - protein, 11 aa, Dengue virus
WGSFKKSGAIK

SEQ ID NO: 21561 - protein, 11 aa, Dengue virus
GSFKKSGAIKV

SEQ ID NO: 21562 - protein, 11 aa, Dengue virus
SFKKSGAIKVL

SEQ ID NO: 21563 - protein, 11 aa, Dengue virus
FKKSGAIKVLR

SEQ ID NO: 21564 - protein, 11 aa, Dengue virus
KKSGAIKVLRG

SEQ ID NO: 21565 - protein, 11 aa, Dengue virus
KSGAIKVLRGF

SEQ ID NO: 21566 - protein, 11 aa, Dengue virus
SGAIKVLRGFK

SEQ ID NO: 21567 - protein, 11 aa, Dengue virus
GAIKVLRGFKR

SEQ ID NO: 21568 - protein, 11 aa, Dengue virus
AIKVLRGFKRE

SEQ ID NO: 21569 - protein, 11 aa, Dengue virus
IKVLRGFKKEV

SEQ ID NO: 21570 - protein, 11 aa, Dengue virus
KVLRGFKKEVS

SEQ ID NO: 21571 - protein, 11 aa, Dengue virus
VLRGFKKEISS

SEQ ID NO: 21572 - protein, 11 aa, Dengue virus
LRGFKKEISSM

SEQ ID NO: 21573 - protein, 11 aa, Dengue virus
RGFKKEISSML

SEQ ID NO: 21574 - protein, 11 aa, Dengue virus
GFKKEISSMLN

SEQ ID NO: 21575 - protein, 11 aa, Dengue virus
PTVLTFHLTTR

SEQ ID NO: 21576 - protein, 11 aa, Dengue virus
TVLTFHLTTRG

SEQ ID NO: 21577 - protein, 11 aa, Dengue virus
VLTFHLTTRGG

SEQ ID NO: 21578 - protein, 11 aa, Dengue virus
LTFHLTTRGGE

SEQ ID NO: 21579 - protein, 11 aa, Dengue virus
TFHLTTRGGEP

SEQ ID NO: 21580 - protein, 11 aa, Dengue virus
LTTRGGEPHMV

SEQ ID NO: 21581 - protein, 11 aa, Dengue virus
TTRGGEPHMVV

SEQ ID NO: 21582 - protein, 11 aa, Dengue virus
TRGGEPHMIVT

SEQ ID NO: 21583 - protein, 11 aa, Dengue virus
RGGEPHMIVTK

SEQ ID NO: 21584 - protein, 11 aa, Dengue virus
GGEPHMIVTKQ

SEQ ID NO: 21585 - protein, 11 aa, Dengue virus
GEPHMIVTKQE

SEQ ID NO: 21586 - protein, 11 aa, Dengue virus
EPHMIVTKQER

SEQ ID NO: 21587 - protein, 11 aa, Dengue virus
PHMIVTKQERG

SEQ ID NO: 21588 - protein, 11 aa, Dengue virus
HMIVTKQERGK

SEQ ID NO: 21589 - protein, 11 aa, Dengue virus
MIVTKQERGKS

SEQ ID NO: 21590 - protein, 11 aa, Dengue virus
IVTKQERGKSL

SEQ ID NO: 21591 - protein, 11 aa, Dengue virus
VTKQERGKSLL

SEQ ID NO: 21592 - protein, 11 aa, Dengue virus
TKQERGKSLLF

SEQ ID NO: 21593 - protein, 11 aa, Dengue virus
RGKSLLFKTSV

SEQ ID NO: 21594 - protein, 11 aa, Dengue virus
GKSLLFKTSVG

SEQ ID NO: 21595 - protein, 11 aa, Dengue virus
KSLLFKTSVGV

SEQ ID NO: 21596 - protein, 11 aa, Dengue virus
SLLFKTSVGVN

SEQ ID NO: 21597 - protein, 11 aa, Dengue virus
LLFKTSVGVNM

SEQ ID NO: 21598 - protein, 11 aa, Dengue virus
LFKTSVGVNMC

SEQ ID NO: 21599 - protein, 11 aa, Dengue virus
FKTSVGVNMCT

SEQ ID NO: 21600 - protein, 11 aa, Dengue virus
KTSVGVNMCTL

SEQ ID NO: 21601 - protein, 11 aa, Dengue virus
TSVGVNMCTLI

SEQ ID NO: 21602 - protein, 11 aa, Dengue virus
SVGVNMCTLIA

SEQ ID NO: 21603 - protein, 11 aa, Dengue virus
VGVNMCTLIAM

SEQ ID NO: 21604 - protein, 11 aa, Dengue virus
GINMCTLIAMD

SEQ ID NO: 21605 - protein, 11 aa, Dengue virus
INMCTLIAMDL

SEQ ID NO: 21606 - protein, 11 aa, Dengue virus
CTLIAMDLGEF

SEQ ID NO: 21607 - protein, 11 aa, Dengue virus
TLIAMDLGEFC

SEQ ID NO: 21608 - protein, 11 aa, Dengue virus
LIAMDLGEFCE

SEQ ID NO: 21609 - protein, 11 aa, Dengue virus
IAMDLGEFCED

SEQ ID NO: 21610 - protein, 11 aa, Dengue virus
AMDLGEFCEDT

SEQ ID NO: 21611 - protein, 11 aa, Dengue virus
MDLGEFCEDTM

SEQ ID NO: 21612 - protein, 11 aa, Dengue virus
DLGEFCEDTMT

SEQ ID NO: 21613 - protein, 11 aa, Dengue virus
LGEFCEDTMTY

SEQ ID NO: 21614 - protein, 11 aa, Dengue virus
GEFCEDTMTYK

SEQ ID NO: 21615 - protein, 11 aa, Dengue virus
EFCEDTMTYKC

SEQ ID NO: 21616 - protein, 11 aa, Dengue virus
FCEDTMTYKCP

SEQ ID NO: 21617 - protein, 11 aa, Dengue virus
CEDTMTYKCPQ

SEQ ID NO: 21618 - protein, 11 aa, Dengue virus
EDTMTYKCPQI

SEQ ID NO: 21619 - protein, 11 aa, Dengue virus
DTMTYKCPQIT

SEQ ID NO: 21620 - protein, 11 aa, Dengue virus
TMTYKCPQITE

SEQ ID NO: 21621 - protein, 11 aa, Dengue virus
TYKCPRITETE

SEQ ID NO: 21622 - protein, 11 aa, Dengue virus
YKCPRITETEP

SEQ ID NO: 21623 - protein, 11 aa, Dengue virus
KCPRITETEPD

SEQ ID NO: 21624 - protein, 11 aa, Dengue virus
CPRITETEPDD

SEQ ID NO: 21625 - protein, 11 aa, Dengue virus
PRITETEPDDV

SEQ ID NO: 21626 - protein, 11 aa, Dengue virus
RITETEPDDVD

SEQ ID NO: 21627 - protein, 11 aa, Dengue virus
ITETEPDDVDC

SEQ ID NO: 21628 - protein, 11 aa, Dengue virus
TETEPDDVDCW

SEQ ID NO: 21629 - protein, 11 aa, Dengue virus
ETEPDDVDCWC

SEQ ID NO: 21630 - protein, 11 aa, Dengue virus
TEPDDVDCWCN

SEQ ID NO: 21631 - protein, 11 aa, Dengue virus
EPDDVDCWCNT

SEQ ID NO: 21632 - protein, 11 aa, Dengue virus
PDDVDCWCNTT

SEQ ID NO: 21633 - protein, 11 aa, Dengue virus
DDVDCWCNATE

SEQ ID NO: 21634 - protein, 11 aa, Dengue virus
DVDCWCNATET

SEQ ID NO: 21635 - protein, 11 aa, Dengue virus
VDCWCNATETW

SEQ ID NO: 21636 - protein, 11 aa, Dengue virus
DCWCNATETWV

SEQ ID NO: 21637 - protein, 11 aa, Dengue virus
CWCNATETWVT

SEQ ID NO: 21638 - protein, 11 aa, Dengue virus
WCNATETWVTY

SEQ ID NO: 21639 - protein, 11 aa, Dengue virus
CNATETWVTYG

SEQ ID NO: 21640 - protein, 11 aa, Dengue virus
NATETWVTYGT

SEQ ID NO: 21641 - protein, 11 aa, Dengue virus
ATETWVTYGTC

SEQ ID NO: 21642 - protein, 11 aa, Dengue virus
TETWVTYGTCS

SEQ ID NO: 21643 - protein, 11 aa, Dengue virus
ETWVTYGTCSQ

SEQ ID NO: 21644 - protein, 11 aa, Dengue virus
TWVTYGTCTQI

SEQ ID NO: 21645 - protein, 11 aa, Dengue virus
VTYGTCSQTGG

SEQ ID NO: 21646 - protein, 11 aa, Dengue virus
TYGTCTQIGEH

SEQ ID NO: 21647 - protein, 11 aa, Dengue virus
YGTCTQIGEHR

SEQ ID NO: 21648 - protein, 11 aa, Dengue virus
GTCTQIGEHRR

SEQ ID NO: 21649 - protein, 11 aa, Dengue virus
TCSQTGEHRRE

SEQ ID NO: 21650 - protein, 11 aa, Dengue virus
CSQTGEHRREK

SEQ ID NO: 21651 - protein, 11 aa, Dengue virus
SQTGEHRREKR

SEQ ID NO: 21652 - protein, 11 aa, Dengue virus
QTGEHRREKRS

SEQ ID NO: 21653 - protein, 11 aa, Dengue virus
TGEHRREKRSV

SEQ ID NO: 21654 - protein, 11 aa, Dengue virus
GEHRREKRSVA

SEQ ID NO: 21655 - protein, 11 aa, Dengue virus
EHRREKRSVAL

SEQ ID NO: 21656 - protein, 11 aa, Dengue virus
HRREKRSVALA

SEQ ID NO: 21657 - protein, 11 aa, Dengue virus
RREKRSVALAP

SEQ ID NO: 21658 - protein, 11 aa, Dengue virus
REKRSVALAPH

SEQ ID NO: 21659 - protein, 11 aa, Dengue virus
EKRSVALAPHV

SEQ ID NO: 21660 - protein, 11 aa, Dengue virus
PHVGLGLETRA

SEQ ID NO: 21661 - protein, 11 aa, Dengue virus
HVGLGLETRAE

SEQ ID NO: 21662 - protein, 11 aa, Dengue virus
VGLGLETRAET

SEQ ID NO: 21663 - protein, 11 aa, Dengue virus
GLGLETRAETW

SEQ ID NO: 21664 - protein, 11 aa, Dengue virus
LGLETRAETWM

SEQ ID NO: 21665 - protein, 11 aa, Dengue virus
GLETRAETWMS

SEQ ID NO: 21666 - protein, 11 aa, Dengue virus
LETRAETWMSS

SEQ ID NO: 21667 - protein, 11 aa, Dengue virus
ETRAETWMSSE

SEQ ID NO: 21668 - protein, 11 aa, Dengue virus
TRAETWMSSEG

SEQ ID NO: 21669 - protein, 11 aa, Dengue virus
RAETWMSSEGA

SEQ ID NO: 21670 - protein, 11 aa, Dengue virus
AETWMSSEGAW

SEQ ID NO: 21671 - protein, 11 aa, Dengue virus
ETWMSSEGAWR

SEQ ID NO: 21672 - protein, 11 aa, Dengue virus
TWMSSEGAWRQ

SEQ ID NO: 21673 - protein, 11 aa, Dengue virus
WMSSEGAWRQI

SEQ ID NO: 21674 - protein, 11 aa, Dengue virus
MSSEGAWRQIQ

SEQ ID NO: 21675 - protein, 11 aa, Dengue virus
SSEGAWKQIQK

SEQ ID NO: 21676 - protein, 11 aa, Dengue virus
SEGAWKQIQKV

SEQ ID NO: 21677 - protein, 11 aa, Dengue virus
EGAWKQIQKVE

SEQ ID NO: 21678 - protein, 11 aa, Dengue virus
GAWKQIQKVET

SEQ ID NO: 21679 - protein, 11 aa, Dengue virus
AWKQIQKVETW

SEQ ID NO: 21680 - protein, 11 aa, Dengue virus
WKQIQKVETWA

SEQ ID NO: 21681 - protein, 11 aa, Dengue virus
KQIQKVETWAL

SEQ ID NO: 21682 - protein, 11 aa, Dengue virus
QIQKVETWALR

SEQ ID NO: 21683 - protein, 11 aa, Dengue virus
IQKVETWALRH

SEQ ID NO: 21684 - protein, 11 aa, Dengue virus
QKVETWALRHP

SEQ ID NO: 21685 - protein, 11 aa, Dengue virus
KVETWALRHPG

SEQ ID NO: 21686 - protein, 11 aa, Dengue virus
ETWVLRHPGFT

SEQ ID NO: 21687 - protein, 11 aa, Dengue virus
TWVLRHPGFTV

SEQ ID NO: 21688 - protein, 11 aa, Dengue virus
WALRHPGFTVT

SEQ ID NO: 21689 - protein, 11 aa, Dengue virus
ALRHPGFTVTA

SEQ ID NO: 21690 - protein, 11 aa, Dengue virus
LRHPGFTVIAF

SEQ ID NO: 21691 - protein, 11 aa, Dengue virus
RHPGFTVIAFF

SEQ ID NO: 21692 - protein, 11 aa, Dengue virus
HPGFTVIAFFL

SEQ ID NO: 21693 - protein, 11 aa, Dengue virus
PGFTVIAFFLA

SEQ ID NO: 21694 - protein, 11 aa, Dengue virus
AFFLAHAIGTS

SEQ ID NO: 21695 - protein, 11 aa, Dengue virus
FFLAHAIGTSI

SEQ ID NO: 21696 - protein, 11 aa, Dengue virus
FLAHVIGTSIT

SEQ ID NO: 21697 - protein, 11 aa, Dengue virus
LAHVIGTSITQ

SEQ ID NO: 21698 - protein, 11 aa, Dengue virus
AHVIGTSITQK

SEQ ID NO: 21699 - protein, 11 aa, Dengue virus
HVIGTSITQKG

SEQ ID NO: 21700 - protein, 11 aa, Dengue virus
VIGTSITQKGI

SEQ ID NO: 21701 - protein, 11 aa, Dengue virus
KGIIFILLMLA

SEQ ID NO: 21702 - protein, 11 aa, Dengue virus
GIIFILLMLAT

SEQ ID NO: 21703 - protein, 11 aa, Dengue virus
IIFILLMLATP

SEQ ID NO: 21704 - protein, 11 aa, Dengue virus
IFILLMLATPS

SEQ ID NO: 21705 - protein, 11 aa, Dengue virus
FILLMLATPSM

SEQ ID NO: 21706 - protein, 11 aa, Dengue virus
ILLMLATPSMA

SEQ ID NO: 21707 - protein, 11 aa, Dengue virus
LLMLATPSMAM

SEQ ID NO: 21708 - protein, 11 aa, Dengue virus
LMLATPSMAMR

SEQ ID NO: 21709 - protein, 11 aa, Dengue virus
MLATPSMAMRC

SEQ ID NO: 21710 - protein, 11 aa, Dengue virus
SMAMRCVGIGN

SEQ ID NO: 21711 - protein, 11 aa, Dengue virus
MAMRCVGIGNR

SEQ ID NO: 21712 - protein, 11 aa, Dengue virus
AMRCVGIGNRD

SEQ ID NO: 21713 - protein, 11 aa, Dengue virus
MRCVGIGNRDF

SEQ ID NO: 21714 - protein, 11 aa, Dengue virus
RCVGIGNRDFV

SEQ ID NO: 21715 - protein, 11 aa, Dengue virus
CVGIGNRDFVE

SEQ ID NO: 21716 - protein, 11 aa, Dengue virus
VGIGNRDFVEG

SEQ ID NO: 21717 - protein, 11 aa, Dengue virus
GIGNRDFVEGL

SEQ ID NO: 21718 - protein, 11 aa, Dengue virus
IGNRDFVEGLS

SEQ ID NO: 21719 - protein, 11 aa, Dengue virus
GNRDFVEGLSG

SEQ ID NO: 21720 - protein, 11 aa, Dengue virus
NRDFVEGLSGA

SEQ ID NO: 21721 - protein, 11 aa, Dengue virus
HGSCVTTMAKN

SEQ ID NO: 21722 - protein, 11 aa, Dengue virus
GSCVTTMAKNK

SEQ ID NO: 21723 - protein, 11 aa, Dengue virus
SCVTTMAKNKP

SEQ ID NO: 21724 - protein, 11 aa, Dengue virus
CVTTMAKNKPT

SEQ ID NO: 21725 - protein, 11 aa, Dengue virus
VTTMAKNKPTL

SEQ ID NO: 21726 - protein, 11 aa, Dengue virus
TTMAKNKPTLD

SEQ ID NO: 21727 - protein, 11 aa, Dengue virus
TMAKNKPTLDI

SEQ ID NO: 21728 - protein, 11 aa, Dengue virus
MAKNKPTLDIE

SEQ ID NO: 21729 - protein, 11 aa, Dengue virus
AKNKPTLDIEL

SEQ ID NO: 21730 - protein, 11 aa, Dengue virus
KNKPTLDIELL

SEQ ID NO: 21731 - protein, 11 aa, Dengue virus
NKPTLDIELLK

SEQ ID NO: 21732 - protein, 11 aa, Dengue virus
DIELLKTEVTD

SEQ ID NO: 21733 - protein, 11 aa, Dengue virus
IELLKTEVTDP

SEQ ID NO: 21734 - protein, 11 aa, Dengue virus
ELLKTEVTDPA

SEQ ID NO: 21735 - protein, 11 aa, Dengue virus
LLKTEVTNPAI

SEQ ID NO: 21736 - protein, 11 aa, Dengue virus
LKTEVTNPAIL

SEQ ID NO: 21737 - protein, 11 aa, Dengue virus
KTEVTNPAILR

SEQ ID NO: 21738 - protein, 11 aa, Dengue virus
TEVTNPAILRK

SEQ ID NO: 21739 - protein, 11 aa, Dengue virus
EVTNPAILRKL

SEQ ID NO: 21740 - protein, 11 aa, Dengue virus
VTNPAILRKLC

SEQ ID NO: 21741 - protein, 11 aa, Dengue virus
TNPAILRKLCI

SEQ ID NO: 21742 - protein, 11 aa, Dengue virus
NPAILRKLCIE

SEQ ID NO: 21743 - protein, 11 aa, Dengue virus
PAILRKLCIEA

SEQ ID NO: 21744 - protein, 11 aa, Dengue virus
AILRKLCIEAK

SEQ ID NO: 21745 - protein, 11 aa, Dengue virus
ILRKLCIEAKI

SEQ ID NO: 21746 - protein, 11 aa, Dengue virus
RCPTQGEATLM

SEQ ID NO: 21747 - protein, 11 aa, Dengue virus
CPTQGEATLME

SEQ ID NO: 21748 - protein, 11 aa, Dengue virus
PTQGEATLMEE

SEQ ID NO: 21749 - protein, 11 aa, Dengue virus
TQGEATLMEEQ

SEQ ID NO: 21750 - protein, 11 aa, Dengue virus
QGEATLMEEQD

SEQ ID NO: 21751 - protein, 11 aa, Dengue virus
GEATLMEEQDA

SEQ ID NO: 21752 - protein, 11 aa, Dengue virus
EATLMEEQDAN

SEQ ID NO: 21753 - protein, 11 aa, Dengue virus
ATLMEEQDANF

SEQ ID NO: 21754 - protein, 11 aa, Dengue virus
TLMEEQDANFV

SEQ ID NO: 21755 - protein, 11 aa, Dengue virus
LMEEQDANFVC

SEQ ID NO: 21756 - protein, 11 aa, Dengue virus
MEEQDANFVCR

SEQ ID NO: 21757 - protein, 11 aa, Dengue virus
EEQDTNFVCRR

SEQ ID NO: 21758 - protein, 11 aa, Dengue virus
EQDTNFVCRRT

SEQ ID NO: 21759 - protein, 11 aa, Dengue virus
QDTNFVCRRTF

SEQ ID NO: 21760 - protein, 11 aa, Dengue virus
DTNFVCRRTFV

SEQ ID NO: 21761 - protein, 11 aa, Dengue virus
TNFVCRRTFVD

SEQ ID NO: 21762 - protein, 11 aa, Dengue virus
NFVCRRTLVDR

SEQ ID NO: 21763 - protein, 11 aa, Dengue virus
FVCRRTLVDRG

SEQ ID NO: 21764 - protein, 11 aa, Dengue virus
VCRRTLVDRGW

SEQ ID NO: 21765 - protein, 11 aa, Dengue virus
CRRTLVDRGWG

SEQ ID NO: 21766 - protein, 11 aa, Dengue virus
RRTLVDRGWGN

SEQ ID NO: 21767 - protein, 11 aa, Dengue virus
RTLVDRGWGNG

SEQ ID NO: 21768 - protein, 11 aa, Dengue virus
TLVDRGWGNGC

SEQ ID NO: 21769 - protein, 11 aa, Dengue virus
LVDRGWGNGCG

SEQ ID NO: 21770 - protein, 11 aa, Dengue virus
GCGLFGKGSLL

SEQ ID NO: 21771 - protein, 11 aa, Dengue virus
CGLFGKGSLLT

SEQ ID NO: 21772 - protein, 11 aa, Dengue virus
GLFGKGSLLTC

SEQ ID NO: 21773 - protein, 11 aa, Dengue virus
LFGKGSLLTCA

SEQ ID NO: 21774 - protein, 11 aa, Dengue virus
FGKGSLLTCAK

SEQ ID NO: 21775 - protein, 11 aa, Dengue virus
GKGSLLTCAKF

SEQ ID NO: 21776 - protein, 11 aa, Dengue virus
KGSLLTCAKFK

SEQ ID NO: 21777 - protein, 11 aa, Dengue virus
GSLLTCAKFKC

SEQ ID NO: 21778 - protein, 11 aa, Dengue virus
SLLTCAKFKCV

SEQ ID NO: 21779 - protein, 11 aa, Dengue virus
LLTCAKFKCVT

SEQ ID NO: 21780 - protein, 11 aa, Dengue virus
LTCAKFKCVTK

SEQ ID NO: 21781 - protein, 11 aa, Dengue virus
FKCVTKLEGKT

SEQ ID NO: 21782 - protein, 11 aa, Dengue virus
KCVTKLEGKTV

SEQ ID NO: 21783 - protein, 11 aa, Dengue virus
CVTKLEGKTVQ

SEQ ID NO: 21784 - protein, 11 aa, Dengue virus
TKLEGKTVQYE

SEQ ID NO: 21785 - protein, 11 aa, Dengue virus
KLEGKTVQYEN

SEQ ID NO: 21786 - protein, 11 aa, Dengue virus
LEGKTVQYENL

SEQ ID NO: 21787 - protein, 11 aa, Dengue virus
EGKTVQYENLK

SEQ ID NO: 21788 - protein, 11 aa, Dengue virus
GKTVQYENLKY

SEQ ID NO: 21789 - protein, 11 aa, Dengue virus
KTVQYENLKYS

SEQ ID NO: 21790 - protein, 11 aa, Dengue virus
TVQYENLKYSV

SEQ ID NO: 21791 - protein, 11 aa, Dengue virus
VQHENLKYSVI

SEQ ID NO: 21792 - protein, 11 aa, Dengue virus
QHENLKYSVIV

SEQ ID NO: 21793 - protein, 11 aa, Dengue virus
HENLKYSVIVT

SEQ ID NO: 21794 - protein, 11 aa, Dengue virus
TGDQHQVGNET

SEQ ID NO: 21795 - protein, 11 aa, Dengue virus
GDQHQVGNETT

SEQ ID NO: 21796 - protein, 11 aa, Dengue virus
DQHQVGNETTE

SEQ ID NO: 21797 - protein, 11 aa, Dengue virus
QHQVGNETTEH

SEQ ID NO: 21798 - protein, 11 aa, Dengue virus
HQVGNETTEHG

SEQ ID NO: 21799 - protein, 11 aa, Dengue virus
QVGNETTEHGT

SEQ ID NO: 21800 - protein, 11 aa, Dengue virus
VGNETTEHGTI

SEQ ID NO: 21801 - protein, 11 aa, Dengue virus
GNETTEHGTIA

SEQ ID NO: 21802 - protein, 11 aa, Dengue virus
NETTEHGTIAT

SEQ ID NO: 21803 - protein, 11 aa, Dengue virus
ETTEHGTIATI

SEQ ID NO: 21804 - protein, 11 aa, Dengue virus
TTEHGTIATIT

SEQ ID NO: 21805 - protein, 11 aa, Dengue virus
TEHGTIATITP

SEQ ID NO: 21806 - protein, 11 aa, Dengue virus
EHGTIATITPQ

SEQ ID NO: 21807 - protein, 11 aa, Dengue virus
HGTIATITPQA

SEQ ID NO: 21808 - protein, 11 aa, Dengue virus
GTIATITPQAP

SEQ ID NO: 21809 - protein, 11 aa, Dengue virus
TIATITPQAPT

SEQ ID NO: 21810 - protein, 11 aa, Dengue virus
IATITPQAPTS

SEQ ID NO: 21811 - protein, 11 aa, Dengue virus
ATITPQAPTSE

SEQ ID NO: 21812 - protein, 11 aa, Dengue virus
TITPQAPTSEI

SEQ ID NO: 21813 - protein, 11 aa, Dengue virus
ITPQAPTSEIQ

SEQ ID NO: 21814 - protein, 11 aa, Dengue virus
TPQAPTSEIQL

SEQ ID NO: 21815 - protein, 11 aa, Dengue virus
PQAPTSEIQLT

SEQ ID NO: 21816 - protein, 11 aa, Dengue virus
QAPTSEIQLTD

SEQ ID NO: 21817 - protein, 11 aa, Dengue virus
APTSEIQLTDY

SEQ ID NO: 21818 - protein, 11 aa, Dengue virus
PTSEIQLTDYG

SEQ ID NO: 21819 - protein, 11 aa, Dengue virus
TSEIQLTDYGA

SEQ ID NO: 21820 - protein, 11 aa, Dengue virus
SEIQLTDYGAL

SEQ ID NO: 21821 - protein, 11 aa, Dengue virus
EIQLTDYGTLT

SEQ ID NO: 21822 - protein, 11 aa, Dengue virus
IQLTDYGTLTL

SEQ ID NO: 21823 - protein, 11 aa, Dengue virus
QLTDYGTLTLD

SEQ ID NO: 21824 - protein, 11 aa, Dengue virus
LTDYGTLTLDC

SEQ ID NO: 21825 - protein, 11 aa, Dengue virus
TDYGTLTLDCS

SEQ ID NO: 21826 - protein, 11 aa, Dengue virus
DYGTLTLDCSP

SEQ ID NO: 21827 - protein, 11 aa, Dengue virus
YGTLTLDCSPR

SEQ ID NO: 21828 - protein, 11 aa, Dengue virus
GTLTLDCSPRT

SEQ ID NO: 21829 - protein, 11 aa, Dengue virus
TLTLDCSPRTG

SEQ ID NO: 21830 - protein, 11 aa, Dengue virus
DFNEMVLLTME

SEQ ID NO: 21831 - protein, 11 aa, Dengue virus
FNEMVLLTMKK

SEQ ID NO: 21832 - protein, 11 aa, Dengue virus
NEMVLLTMKKK

SEQ ID NO: 21833 - protein, 11 aa, Dengue virus
EMVLLTMKKKS

SEQ ID NO: 21834 - protein, 11 aa, Dengue virus
MVLLTMKKKSW

SEQ ID NO: 21835 - protein, 11 aa, Dengue virus
VLLTMKKKSWL

SEQ ID NO: 21836 - protein, 11 aa, Dengue virus
LLTMKKKSWLV

SEQ ID NO: 21837 - protein, 11 aa, Dengue virus
LTMKKKSWLVH

SEQ ID NO: 21838 - protein, 11 aa, Dengue virus
TMKKKSWLVHK

SEQ ID NO: 21839 - protein, 11 aa, Dengue virus
MKKKSWLVHKQ

SEQ ID NO: 21840 - protein, 11 aa, Dengue virus
KKKSWLVHKQW

SEQ ID NO: 21841 - protein, 11 aa, Dengue virus
KKSWLVHKQWF

SEQ ID NO: 21842 - protein, 11 aa, Dengue virus
KAWLVHKQWFL

SEQ ID NO: 21843 - protein, 11 aa, Dengue virus
DLPLPWTSGAT

SEQ ID NO: 21844 - protein, 11 aa, Dengue virus
LPLPWTSGATT

SEQ ID NO: 21845 - protein, 11 aa, Dengue virus
TSQETWNRKDL

SEQ ID NO: 21846 - protein, 11 aa, Dengue virus
SQETWNRKDLL

SEQ ID NO: 21847 - protein, 11 aa, Dengue virus
QETWNRKDLLV

SEQ ID NO: 21848 - protein, 11 aa, Dengue virus
ETWNRKDLLVT

SEQ ID NO: 21849 - protein, 11 aa, Dengue virus
TWNRKDLLVTF

SEQ ID NO: 21850 - protein, 11 aa, Dengue virus
WNRKDLLVTFK

SEQ ID NO: 21851 - protein, 11 aa, Dengue virus
NRKDLLVTFKT

SEQ ID NO: 21852 - protein, 11 aa, Dengue virus
RKDLLVTFKTA

SEQ ID NO: 21853 - protein, 11 aa, Dengue virus
KDLLVTFKTAH

SEQ ID NO: 21854 - protein, 11 aa, Dengue virus
ALTGATEIQTT

SEQ ID NO: 21855 - protein, 11 aa, Dengue virus
LTGATEIQTTG

SEQ ID NO: 21856 - protein, 11 aa, Dengue virus
TGATEIQTTGT

SEQ ID NO: 21857 - protein, 11 aa, Dengue virus
GATEIQTTGTT

SEQ ID NO: 21858 - protein, 11 aa, Dengue virus
ATEIQTTGTTT

SEQ ID NO: 21859 - protein, 11 aa, Dengue virus
TEIQTTGTTTI

SEQ ID NO: 21860 - protein, 11 aa, Dengue virus
EIQTTGTTTIF

SEQ ID NO: 21861 - protein, 11 aa, Dengue virus
IQTTGTTTIFA

SEQ ID NO: 21862 - protein, 11 aa, Dengue virus
QTTGTTTIFAG

SEQ ID NO: 21863 - protein, 11 aa, Dengue virus
TTGTTTIFAGH

SEQ ID NO: 21864 - protein, 11 aa, Dengue virus
TGTTTIFAGHL

SEQ ID NO: 21865 - protein, 11 aa, Dengue virus
CRLKMDKLTLR

SEQ ID NO: 21866 - protein, 11 aa, Dengue virus
RLKMDKLTLRG

SEQ ID NO: 21867 - protein, 11 aa, Dengue virus
LKMDKLTLKGT

SEQ ID NO: 21868 - protein, 11 aa, Dengue virus
KMDKLTLKGTS

SEQ ID NO: 21869 - protein, 11 aa, Dengue virus
MDKLTLKGTSY

SEQ ID NO: 21870 - protein, 11 aa, Dengue virus
DKLTLKGTSYV

SEQ ID NO: 21871 - protein, 11 aa, Dengue virus
KLTLKGTSYVM

SEQ ID NO: 21872 - protein, 11 aa, Dengue virus
LTLKGTSYVMC

SEQ ID NO: 21873 - protein, 11 aa, Dengue virus
TLKGTSYVMCT

SEQ ID NO: 21874 - protein, 11 aa, Dengue virus
LKGTSYVMCTG

SEQ ID NO: 21875 - protein, 11 aa, Dengue virus
SYVMCTGLFKL

SEQ ID NO: 21876 - protein, 11 aa, Dengue virus
YVMCTGPFKLE

SEQ ID NO: 21877 - protein, 11 aa, Dengue virus
VMCTGLFKLEK

SEQ ID NO: 21878 - protein, 11 aa, Dengue virus
MCTGPFKLEKE

SEQ ID NO: 21879 - protein, 11 aa, Dengue virus
CTGSFKLEKEL

SEQ ID NO: 21880 - protein, 11 aa, Dengue virus
TGSFKLEKELA

SEQ ID NO: 21881 - protein, 11 aa, Dengue virus
GSFKLEKELAE

SEQ ID NO: 21882 - protein, 11 aa, Dengue virus
SFKLEKELAET

SEQ ID NO: 21883 - protein, 11 aa, Dengue virus
FKLEKELAETQ

SEQ ID NO: 21884 - protein, 11 aa, Dengue virus
KLEKELAETQH

SEQ ID NO: 21885 - protein, 11 aa, Dengue virus
LEKELAETQHG

SEQ ID NO: 21886 - protein, 11 aa, Dengue virus
EKELAETQHGT

SEQ ID NO: 21887 - protein, 11 aa, Dengue virus
KELAETQHGTV

SEQ ID NO: 21888 - protein, 11 aa, Dengue virus
ELAETQHGTVL

SEQ ID NO: 21889 - protein, 11 aa, Dengue virus
LAETQHGTVLV

SEQ ID NO: 21890 - protein, 11 aa, Dengue virus
ETQHGTVLVQV

SEQ ID NO: 21891 - protein, 11 aa, Dengue virus
TQHGTVLVQVK

SEQ ID NO: 21892 - protein, 11 aa, Dengue virus
QHGTVLVQVKY

SEQ ID NO: 21893 - protein, 11 aa, Dengue virus
HGTVLVQVKYE

SEQ ID NO: 21894 - protein, 11 aa, Dengue virus
GTVLVQVKYEG

SEQ ID NO: 21895 - protein, 11 aa, Dengue virus
TVLVQVKYEGT

SEQ ID NO: 21896 - protein, 11 aa, Dengue virus
VLVQVKYEGTD

SEQ ID NO: 21897 - protein, 11 aa, Dengue virus
LVQVKYEGTDA

SEQ ID NO: 21898 - protein, 11 aa, Dengue virus
VQVKYEGTDAP

SEQ ID NO: 21899 - protein, 11 aa, Dengue virus
QVKYEGTDAPC

SEQ ID NO: 21900 - protein, 11 aa, Dengue virus
VKYEGTDAPCK

SEQ ID NO: 21901 - protein, 11 aa, Dengue virus
RYEGTDAPCKI

SEQ ID NO: 21902 - protein, 11 aa, Dengue virus
GTDAPCKIPFL

SEQ ID NO: 21903 - protein, 11 aa, Dengue virus
TDAPCKIPFLT

SEQ ID NO: 21904 - protein, 11 aa, Dengue virus
DAPCKIPFLTQ

SEQ ID NO: 21905 - protein, 11 aa, Dengue virus
APCKIPFLTQD

SEQ ID NO: 21906 - protein, 11 aa, Dengue virus
PCKIPFLTQDE

SEQ ID NO: 21907 - protein, 11 aa, Dengue virus
QDEKGVIQNGR

SEQ ID NO: 21908 - protein, 11 aa, Dengue virus
GVIQNGRLITA

SEQ ID NO: 21909 - protein, 11 aa, Dengue virus
VIQNGRLITAN

SEQ ID NO: 21910 - protein, 11 aa, Dengue virus
IQNGRLITANP

SEQ ID NO: 21911 - protein, 11 aa, Dengue virus
QNGRLVTANPI

SEQ ID NO: 21912 - protein, 11 aa, Dengue virus
NGRLVTANPIV

SEQ ID NO: 21913 - protein, 11 aa, Dengue virus
GRLVTANPIVT

SEQ ID NO: 21914 - protein, 11 aa, Dengue virus
RLVTANPIVTD

SEQ ID NO: 21915 - protein, 11 aa, Dengue virus
LVTANPIVTDK

SEQ ID NO: 21916 - protein, 11 aa, Dengue virus
VTANPIVTDKE

SEQ ID NO: 21917 - protein, 11 aa, Dengue virus
TANPIVTDKDK

SEQ ID NO: 21918 - protein, 11 aa, Dengue virus
ANPIVTDKDKP

SEQ ID NO: 21919 - protein, 11 aa, Dengue virus
NPIVTDKDKPV

SEQ ID NO: 21920 - protein, 11 aa, Dengue virus
PIVTDKDKPVN

SEQ ID NO: 21921 - protein, 11 aa, Dengue virus
IVTDKDKPVNI

SEQ ID NO: 21922 - protein, 11 aa, Dengue virus
VTDKDKPVNIE

SEQ ID NO: 21923 - protein, 11 aa, Dengue virus
TDKEKPVNIET

SEQ ID NO: 21924 - protein, 11 aa, Dengue virus
DKEKPVNIETE

SEQ ID NO: 21925 - protein, 11 aa, Dengue virus
KEKPVNIETEP

SEQ ID NO: 21926 - protein, 11 aa, Dengue virus
EKPVNIETEPP

SEQ ID NO: 21927 - protein, 11 aa, Dengue virus
KPVNIETEPPF

SEQ ID NO: 21928 - protein, 11 aa, Dengue virus
PVNIETEPPFG

SEQ ID NO: 21929 - protein, 11 aa, Dengue virus
VNIETEPPFGE

SEQ ID NO: 21930 - protein, 11 aa, Dengue virus
NIETEPPFGES

SEQ ID NO: 21931 - protein, 11 aa, Dengue virus
IETEPPFGESY

SEQ ID NO: 21932 - protein, 11 aa, Dengue virus
ETEPPFGESYI

SEQ ID NO: 21933 - protein, 11 aa, Dengue virus
TEPPFGESYIV

SEQ ID NO: 21934 - protein, 11 aa, Dengue virus
EPPFGESYIVV

SEQ ID NO: 21935 - protein, 11 aa, Dengue virus
PPFGESYIVVG

SEQ ID NO: 21936 - protein, 11 aa, Dengue virus
GVGEKALKLSW

SEQ ID NO: 21937 - protein, 11 aa, Dengue virus
VGEKALKLSWF

SEQ ID NO: 21938 - protein, 11 aa, Dengue virus
GEKTLKLSWFK

SEQ ID NO: 21939 - protein, 11 aa, Dengue virus
EKALKLSWFKR

SEQ ID NO: 21940 - protein, 11 aa, Dengue virus
KALKLSWFKRG

SEQ ID NO: 21941 - protein, 11 aa, Dengue virus
ALKLSWFKRGS

SEQ ID NO: 21942 - protein, 11 aa, Dengue virus
LKLSWFKRGSS

SEQ ID NO: 21943 - protein, 11 aa, Dengue virus
KLSWFKRGSSI

SEQ ID NO: 21944 - protein, 11 aa, Dengue virus
LSWFKRGSSIG

SEQ ID NO: 21945 - protein, 11 aa, Dengue virus
SWFKRGSSIGK

SEQ ID NO: 21946 - protein, 11 aa, Dengue virus
WFKRGSSIGKM

SEQ ID NO: 21947 - protein, 11 aa, Dengue virus
FKRGSSIGKMF

SEQ ID NO: 21948 - protein, 11 aa, Dengue virus
KRGSSIGKMFE

SEQ ID NO: 21949 - protein, 11 aa, Dengue virus
RGSSIGKMFEA

SEQ ID NO: 21950 - protein, 11 aa, Dengue virus
GSTIGKMFEAT

SEQ ID NO: 21951 - protein, 11 aa, Dengue virus
STIGKMFEATA

SEQ ID NO: 21952 - protein, 11 aa, Dengue virus
TIGKMFEATAR

SEQ ID NO: 21953 - protein, 11 aa, Dengue virus
IGKMFVATARG

SEQ ID NO: 21954 - protein, 11 aa, Dengue virus
GKMFVATARGA

SEQ ID NO: 21955 - protein, 11 aa, Dengue virus
KMFVATARGAR

SEQ ID NO: 21956 - protein, 11 aa, Dengue virus
FVATARGARRM

SEQ ID NO: 21957 - protein, 11 aa, Dengue virus
LGDTAWDFGSV

SEQ ID NO: 21958 - protein, 11 aa, Dengue virus
GDTAWDFGSVG

SEQ ID NO: 21959 - protein, 11 aa, Dengue virus
DTAWDFGSVGG

SEQ ID NO: 21960 - protein, 11 aa, Dengue virus
TAWDFGSVGGV

SEQ ID NO: 21961 - protein, 11 aa, Dengue virus
AWDFGSVGGVF

SEQ ID NO: 21962 - protein, 11 aa, Dengue virus
WDFGSVGGVFT

SEQ ID NO: 21963 - protein, 11 aa, Dengue virus
DFGSVGGVFTS

SEQ ID NO: 21964 - protein, 11 aa, Dengue virus
GKLVHQVFGTA

SEQ ID NO: 21965 - protein, 11 aa, Dengue virus
KLVHQVFGTAY

SEQ ID NO: 21966 - protein, 11 aa, Dengue virus
LVHQVFGTAYG

SEQ ID NO: 21967 - protein, 11 aa, Dengue virus
VHQVFGTAYGV

SEQ ID NO: 21968 - protein, 11 aa, Dengue virus
HQVFGTAYGVL

SEQ ID NO: 21969 - protein, 11 aa, Dengue virus
QVFGTAYGVLF

SEQ ID NO: 21970 - protein, 11 aa, Dengue virus
VFGTAYGVLFS

SEQ ID NO: 21971 - protein, 11 aa, Dengue virus
FGAAYGVLFSG

SEQ ID NO: 21972 - protein, 11 aa, Dengue virus
GAAYGVLFSGV

SEQ ID NO: 21973 - protein, 11 aa, Dengue virus
AAYGVLFSGVS

SEQ ID NO: 21974 - protein, 11 aa, Dengue virus
SGVSWTMKIGL

SEQ ID NO: 21975 - protein, 11 aa, Dengue virus
GVSWTMKIGLG

SEQ ID NO: 21976 - protein, 11 aa, Dengue virus
VSWTMKIGIGI

SEQ ID NO: 21977 - protein, 11 aa, Dengue virus
SWTMKIGIGIL

SEQ ID NO: 21978 - protein, 11 aa, Dengue virus
WTMKIGIGILL

SEQ ID NO: 21979 - protein, 11 aa, Dengue virus
TMKIGIGILLT

SEQ ID NO: 21980 - protein, 11 aa, Dengue virus
MKIGIGILLTW

SEQ ID NO: 21981 - protein, 11 aa, Dengue virus
KIGIGILLTWL

SEQ ID NO: 21982 - protein, 11 aa, Dengue virus
IGIGILLTWLG

SEQ ID NO: 21983 - protein, 11 aa, Dengue virus
GIGILLTWLGL

SEQ ID NO: 21984 - protein, 11 aa, Dengue virus
IGILLTWLGLN

SEQ ID NO: 21985 - protein, 11 aa, Dengue virus
GILLTWLGLNS

SEQ ID NO: 21986 - protein, 11 aa, Dengue virus
ILLTWLGLNSR

SEQ ID NO: 21987 - protein, 11 aa, Dengue virus
LLTWLGLNSRN

SEQ ID NO: 21988 - protein, 11 aa, Dengue virus
LTWLGLNSRNT

SEQ ID NO: 21989 - protein, 11 aa, Dengue virus
TWLGLNSRNTS

SEQ ID NO: 21990 - protein, 11 aa, Dengue virus
WLGLNSRSTSF

SEQ ID NO: 21991 - protein, 11 aa, Dengue virus
LGLNSRSTSFS

SEQ ID NO: 21992 - protein, 11 aa, Dengue virus
GLNSRSTSFSM

SEQ ID NO: 21993 - protein, 11 aa, Dengue virus
LNSRSTSFSMT

SEQ ID NO: 21994 - protein, 11 aa, Dengue virus
NSRSTSFSMTC

SEQ ID NO: 21995 - protein, 11 aa, Dengue virus
SRSTSFSMTCI

SEQ ID NO: 21996 - protein, 11 aa, Dengue virus
RSTSFSMTCIA

SEQ ID NO: 21997 - protein, 11 aa, Dengue virus
STSFSMTCIAV

SEQ ID NO: 21998 - protein, 11 aa, Dengue virus
TSFSMTCIAVG

SEQ ID NO: 21999 - protein, 11 aa, Dengue virus
SLSMTCIAVGM

SEQ ID NO: 22000 - protein, 11 aa, Dengue virus
SMTCIAVGMVT

SEQ ID NO: 22001 - protein, 11 aa, Dengue virus
MTCIAVGMVTL

SEQ ID NO: 22002 - protein, 11 aa, Dengue virus
TCIAVGMVTLY

SEQ ID NO: 22003 - protein, 11 aa, Dengue virus
CIAVGMVTLYL

SEQ ID NO: 22004 - protein, 11 aa, Dengue virus
IAVGMVTLYLG

SEQ ID NO: 22005 - protein, 11 aa, Dengue virus
AVGMVTLYLGV

SEQ ID NO: 22006 - protein, 11 aa, Dengue virus
VGMVTLYLGVM

SEQ ID NO: 22007 - protein, 11 aa, Dengue virus
GMVTLYLGVMV

SEQ ID NO: 22008 - protein, 11 aa, Dengue virus
MVTLYLGVMVQ

SEQ ID NO: 22009 - protein, 11 aa, Dengue virus
ITLYLGVMVQA

SEQ ID NO: 22010 - protein, 11 aa, Dengue virus
TLYLGAMVQAD

SEQ ID NO: 22011 - protein, 11 aa, Dengue virus
LYLGAMVQADS

SEQ ID NO: 22012 - protein, 11 aa, Dengue virus
YLGAMVQADSG

SEQ ID NO: 22013 - protein, 11 aa, Dengue virus
LGAMVQADSGC

SEQ ID NO: 22014 - protein, 11 aa, Dengue virus
GAMVQADSGCV

SEQ ID NO: 22015 - protein, 11 aa, Dengue virus
VMVQADSGCVV

SEQ ID NO: 22016 - protein, 11 aa, Dengue virus
MVQADSGCVVN

SEQ ID NO: 22017 - protein, 11 aa, Dengue virus
VQADSGCVVNW

SEQ ID NO: 22018 - protein, 11 aa, Dengue virus
QADSGCVVNWK

SEQ ID NO: 22019 - protein, 11 aa, Dengue virus
ADSGCVVNWKG

SEQ ID NO: 22020 - protein, 11 aa, Dengue virus
DSGCVVNWKGR

SEQ ID NO: 22021 - protein, 11 aa, Dengue virus
SGCVVNWKGRE

SEQ ID NO: 22022 - protein, 11 aa, Dengue virus
GCVVNWKGREL

SEQ ID NO: 22023 - protein, 11 aa, Dengue virus
CVVNWKGRELK

SEQ ID NO: 22024 - protein, 11 aa, Dengue virus
VVNWKGRELKC

SEQ ID NO: 22025 - protein, 11 aa, Dengue virus
SPKRLSAAIGR

SEQ ID NO: 22026 - protein, 11 aa, Dengue virus
PKRLSAAIGRA

SEQ ID NO: 22027 - protein, 11 aa, Dengue virus
KRLSAAIGRAW

SEQ ID NO: 22028 - protein, 11 aa, Dengue virus
RLSAAIGRAWE

SEQ ID NO: 22029 - protein, 11 aa, Dengue virus
LSAAIGRAWEE

SEQ ID NO: 22030 - protein, 11 aa, Dengue virus
SAAIGRAWEEG

SEQ ID NO: 22031 - protein, 11 aa, Dengue virus
AAIGRAWEEGV

SEQ ID NO: 22032 - protein, 11 aa, Dengue virus
AIGRAWEEGVC

SEQ ID NO: 22033 - protein, 11 aa, Dengue virus
IGRAWEEGVCG

SEQ ID NO: 22034 - protein, 11 aa, Dengue virus
GRAWEEGVCGI

SEQ ID NO: 22035 - protein, 11 aa, Dengue virus
RAWEEGVCGIR

SEQ ID NO: 22036 - protein, 11 aa, Dengue virus
WEEGVCGIRST

SEQ ID NO: 22037 - protein, 11 aa, Dengue virus
EEGVCGIRSTT

SEQ ID NO: 22038 - protein, 11 aa, Dengue virus
EGVCGIRSTTR

SEQ ID NO: 22039 - protein, 11 aa, Dengue virus
GVCGIRSTTRL

SEQ ID NO: 22040 - protein, 11 aa, Dengue virus
VCGIRSTTRLE

SEQ ID NO: 22041 - protein, 11 aa, Dengue virus
CGIRSTTRLEN

SEQ ID NO: 22042 - protein, 11 aa, Dengue virus
GIRSTTRLENI

SEQ ID NO: 22043 - protein, 11 aa, Dengue virus
IRSTTRLENIM

SEQ ID NO: 22044 - protein, 11 aa, Dengue virus
RSTTRLENIMW

SEQ ID NO: 22045 - protein, 11 aa, Dengue virus
SATRLENIMWR

SEQ ID NO: 22046 - protein, 11 aa, Dengue virus
ATRLENIMWRQ

SEQ ID NO: 22047 - protein, 11 aa, Dengue virus
TRLENIMWRQI

SEQ ID NO: 22048 - protein, 11 aa, Dengue virus
RLENIMWRQIS

SEQ ID NO: 22049 - protein, 11 aa, Dengue virus
LENIMWRQISN

SEQ ID NO: 22050 - protein, 11 aa, Dengue virus
ENIMWRQISNE

SEQ ID NO: 22051 - protein, 11 aa, Dengue virus
NIMWRQISNEL

SEQ ID NO: 22052 - protein, 11 aa, Dengue virus
IMWRQISNELN

SEQ ID NO: 22053 - protein, 11 aa, Dengue virus
MWRQISNELNH

SEQ ID NO: 22054 - protein, 11 aa, Dengue virus
WRQISNELNHI

SEQ ID NO: 22055 - protein, 11 aa, Dengue virus
RQISNELNHIL

SEQ ID NO: 22056 - protein, 11 aa, Dengue virus
QISNELNYILL

SEQ ID NO: 22057 - protein, 11 aa, Dengue virus
ISNELNYILLE

SEQ ID NO: 22058 - protein, 11 aa, Dengue virus
SNELNYILLEN

SEQ ID NO: 22059 - protein, 11 aa, Dengue virus
NELNHILLENG

SEQ ID NO: 22060 - protein, 11 aa, Dengue virus
ELNHILLENGM

SEQ ID NO: 22061 - protein, 11 aa, Dengue virus
LNHILLENGMK

SEQ ID NO: 22062 - protein, 11 aa, Dengue virus
NHILLENDMKL

SEQ ID NO: 22063 - protein, 11 aa, Dengue virus
HILLENDMKLT

SEQ ID NO: 22064 - protein, 11 aa, Dengue virus
ILLENDMKLTV

SEQ ID NO: 22065 - protein, 11 aa, Dengue virus
LLENDMKLTVV

SEQ ID NO: 22066 - protein, 11 aa, Dengue virus
LENDMKLTVVV

SEQ ID NO: 22067 - protein, 11 aa, Dengue virus
ENDMKLTVVVG

SEQ ID NO: 22068 - protein, 11 aa, Dengue virus
NDMKLTVVVGD

SEQ ID NO: 22069 - protein, 11 aa, Dengue virus
QGKKTIRPQPM

SEQ ID NO: 22070 - protein, 11 aa, Dengue virus
GKKTIRPQPME

SEQ ID NO: 22071 - protein, 11 aa, Dengue virus
KKMIRPQPMEH

SEQ ID NO: 22072 - protein, 11 aa, Dengue virus
KMIRPQPMEHK

SEQ ID NO: 22073 - protein, 11 aa, Dengue virus
MIRPQPMEHKY

SEQ ID NO: 22074 - protein, 11 aa, Dengue virus
IRPQPMEHKYS

SEQ ID NO: 22075 - protein, 11 aa, Dengue virus
RPQPMEHKYSW

SEQ ID NO: 22076 - protein, 11 aa, Dengue virus
PQPMEHKYSWK

SEQ ID NO: 22077 - protein, 11 aa, Dengue virus
QPMEHKYSWKS

SEQ ID NO: 22078 - protein, 11 aa, Dengue virus
PMEHKYSWKSW

SEQ ID NO: 22079 - protein, 11 aa, Dengue virus
MEHKYSWKSWG

SEQ ID NO: 22080 - protein, 11 aa, Dengue virus
EHKYSWKSWGK

SEQ ID NO: 22081 - protein, 11 aa, Dengue virus
HKYSWKSWGKA

SEQ ID NO: 22082 - protein, 11 aa, Dengue virus
RYSWKSWGKAK

SEQ ID NO: 22083 - protein, 11 aa, Dengue virus
YSWKIWGKAKI

SEQ ID NO: 22084 - protein, 11 aa, Dengue virus
SWKIWGKAKII

SEQ ID NO: 22085 - protein, 11 aa, Dengue virus
WKIWGKAKIIG

SEQ ID NO: 22086 - protein, 11 aa, Dengue virus
KIWGKAKIIGA

SEQ ID NO: 22087 - protein, 11 aa, Dengue virus
IWGKAKIIGAD

SEQ ID NO: 22088 - protein, 11 aa, Dengue virus
WGKAKIIGADI

SEQ ID NO: 22089 - protein, 11 aa, Dengue virus
GKAKIIGADIQ

SEQ ID NO: 22090 - protein, 11 aa, Dengue virus
KAKIIGADIQN

SEQ ID NO: 22091 - protein, 11 aa, Dengue virus
TFIIDGPDTPE

SEQ ID NO: 22092 - protein, 11 aa, Dengue virus
FIIDGPDTPEC

SEQ ID NO: 22093 - protein, 11 aa, Dengue virus
IIDGPDTPECP

SEQ ID NO: 22094 - protein, 11 aa, Dengue virus
IDGPDTPECPD

SEQ ID NO: 22095 - protein, 11 aa, Dengue virus
ECPDNQRAWNI

SEQ ID NO: 22096 - protein, 11 aa, Dengue virus
CPDNQRAWNIW

SEQ ID NO: 22097 - protein, 11 aa, Dengue virus
PDNQRAWNIWE

SEQ ID NO: 22098 - protein, 11 aa, Dengue virus
DNQRAWNIWEV

SEQ ID NO: 22099 - protein, 11 aa, Dengue virus
NQRAWNIWEVE

SEQ ID NO: 22100 - protein, 11 aa, Dengue virus
IWEVEDYGFGV

SEQ ID NO: 22101 - protein, 11 aa, Dengue virus
WEVEDYGFGVF

SEQ ID NO: 22102 - protein, 11 aa, Dengue virus
EVEDYGFGVFT

SEQ ID NO: 22103 - protein, 11 aa, Dengue virus
VEDYGFGVFTT

SEQ ID NO: 22104 - protein, 11 aa, Dengue virus
EDYGFGVFTTN

SEQ ID NO: 22105 - protein, 11 aa, Dengue virus
DYGFGVFTTNI

SEQ ID NO: 22106 - protein, 11 aa, Dengue virus
YGFGVFTTNIW

SEQ ID NO: 22107 - protein, 11 aa, Dengue virus
GFGVFTTNIWL

SEQ ID NO: 22108 - protein, 11 aa, Dengue virus
FGVFTTNIWLK

SEQ ID NO: 22109 - protein, 11 aa, Dengue virus
GVFTTNIWLKL

SEQ ID NO: 22110 - protein, 11 aa, Dengue virus
VFTTNIWLKLR

SEQ ID NO: 22111 - protein, 11 aa, Dengue virus
FTTNIWLKMRD

SEQ ID NO: 22112 - protein, 11 aa, Dengue virus
TTNIWLKMRDS

SEQ ID NO: 22113 - protein, 11 aa, Dengue virus
TNIWLKLRDSH

SEQ ID NO: 22114 - protein, 11 aa, Dengue virus
NIWLKLRDSHT

SEQ ID NO: 22115 - protein, 11 aa, Dengue virus
IWLKLRDSHTQ

SEQ ID NO: 22116 - protein, 11 aa, Dengue virus
RDSYTQMCDHR

SEQ ID NO: 22117 - protein, 11 aa, Dengue virus
DSYTQMCDHRL

SEQ ID NO: 22118 - protein, 11 aa, Dengue virus
SYTQMCDHRLM

SEQ ID NO: 22119 - protein, 11 aa, Dengue virus
YTQMCDHRLMS

SEQ ID NO: 22120 - protein, 11 aa, Dengue virus
TQMCDHRLMSA

SEQ ID NO: 22121 - protein, 11 aa, Dengue virus
QMCDHRLMSAA

SEQ ID NO: 22122 - protein, 11 aa, Dengue virus
MCDHRLMSAAI

SEQ ID NO: 22123 - protein, 11 aa, Dengue virus
ADMGYWIESER

SEQ ID NO: 22124 - protein, 11 aa, Dengue virus
DMGYWIESERN

SEQ ID NO: 22125 - protein, 11 aa, Dengue virus
MGYWIESERNE

SEQ ID NO: 22126 - protein, 11 aa, Dengue virus
GYWIESERNET

SEQ ID NO: 22127 - protein, 11 aa, Dengue virus
YWIESERNETW

SEQ ID NO: 22128 - protein, 11 aa, Dengue virus
WIESERNETWK

SEQ ID NO: 22129 - protein, 11 aa, Dengue virus
IESERNETWKL

SEQ ID NO: 22130 - protein, 11 aa, Dengue virus
ESERNETWKLA

SEQ ID NO: 22131 - protein, 11 aa, Dengue virus
NETWKLAKASF

SEQ ID NO: 22132 - protein, 11 aa, Dengue virus
ETWKLAKASFI

SEQ ID NO: 22133 - protein, 11 aa, Dengue virus
TWKLAKASFIE

SEQ ID NO: 22134 - protein, 11 aa, Dengue virus
WKLAKASFIEV

SEQ ID NO: 22135 - protein, 11 aa, Dengue virus
KLAKASFIEVK

SEQ ID NO: 22136 - protein, 11 aa, Dengue virus
LAKASFIEVKT

SEQ ID NO: 22137 - protein, 11 aa, Dengue virus
AKASFIEVKTC

SEQ ID NO: 22138 - protein, 11 aa, Dengue virus
RASFIEVKTCT

SEQ ID NO: 22139 - protein, 11 aa, Dengue virus
ASFIEVKTCTW

SEQ ID NO: 22140 - protein, 11 aa, Dengue virus
SFIEVKTCTWP

SEQ ID NO: 22141 - protein, 11 aa, Dengue virus
FIEVKTCTWPK

SEQ ID NO: 22142 - protein, 11 aa, Dengue virus
IEVKTCTWPKS

SEQ ID NO: 22143 - protein, 11 aa, Dengue virus
EVKTCTWPKSH

SEQ ID NO: 22144 - protein, 11 aa, Dengue virus
VKTCTWPKSHT

SEQ ID NO: 22145 - protein, 11 aa, Dengue virus
KTCTWPKSHTL

SEQ ID NO: 22146 - protein, 11 aa, Dengue virus
TCTWPKSHTLW

SEQ ID NO: 22147 - protein, 11 aa, Dengue virus
CTWPKSHTLWS

SEQ ID NO: 22148 - protein, 11 aa, Dengue virus
TWPKSHTLWSN

SEQ ID NO: 22149 - protein, 11 aa, Dengue virus
WSNGVLESEMV

SEQ ID NO: 22150 - protein, 11 aa, Dengue virus
SNGVLESEMVI

SEQ ID NO: 22151 - protein, 11 aa, Dengue virus
NGVLESEMVIP

SEQ ID NO: 22152 - protein, 11 aa, Dengue virus
GVLESEMVIPK

SEQ ID NO: 22153 - protein, 11 aa, Dengue virus
VLESEMVIPKI

SEQ ID NO: 22154 - protein, 11 aa, Dengue virus
LESEMIIPKIH

SEQ ID NO: 22155 - protein, 11 aa, Dengue virus
ESEMIIPKIHG

SEQ ID NO: 22156 - protein, 11 aa, Dengue virus
SEMIIPKIHGG

SEQ ID NO: 22157 - protein, 11 aa, Dengue virus
EMIIPKIHGGP

SEQ ID NO: 22158 - protein, 11 aa, Dengue virus
PKIHGGPISQH

SEQ ID NO: 22159 - protein, 11 aa, Dengue virus
KIHGGPISQHN

SEQ ID NO: 22160 - protein, 11 aa, Dengue virus
HGGPISQHNYR

SEQ ID NO: 22161 - protein, 11 aa, Dengue virus
GGPTSQHNYRP

SEQ ID NO: 22162 - protein, 11 aa, Dengue virus
GPTSQHNYRPG

SEQ ID NO: 22163 - protein, 11 aa, Dengue virus
PTSQHNYRPGY

SEQ ID NO: 22164 - protein, 11 aa, Dengue virus
TSQHNYRPGYF

SEQ ID NO: 22165 - protein, 11 aa, Dengue virus
SQHNHRPGYFT

SEQ ID NO: 22166 - protein, 11 aa, Dengue virus
QHNHRPGYFTQ

SEQ ID NO: 22167 - protein, 11 aa, Dengue virus
HNYRPGYFTQA

SEQ ID NO: 22168 - protein, 11 aa, Dengue virus
NYRPGYFTQAA

SEQ ID NO: 22169 - protein, 11 aa, Dengue virus
YRPGYFTQAAG

SEQ ID NO: 22170 - protein, 11 aa, Dengue virus
RPGYFTQAAGP

SEQ ID NO: 22171 - protein, 11 aa, Dengue virus
PGYFTQAAGPW

SEQ ID NO: 22172 - protein, 11 aa, Dengue virus
GYFTQAAGPWH

SEQ ID NO: 22173 - protein, 11 aa, Dengue virus
YFTQAAGPWHL

SEQ ID NO: 22174 - protein, 11 aa, Dengue virus
FTQAAGPWHLG

SEQ ID NO: 22175 - protein, 11 aa, Dengue virus
TQAAGPWHLGK

SEQ ID NO: 22176 - protein, 11 aa, Dengue virus
QAAGPWHLGKL

SEQ ID NO: 22177 - protein, 11 aa, Dengue virus
AAGPWHLGKLE

SEQ ID NO: 22178 - protein, 11 aa, Dengue virus
WHLGKLELDFN

SEQ ID NO: 22179 - protein, 11 aa, Dengue virus
HLGKLELDFNL

SEQ ID NO: 22180 - protein, 11 aa, Dengue virus
LGKLELDFNLC

SEQ ID NO: 22181 - protein, 11 aa, Dengue virus
GKLELDFNLCE

SEQ ID NO: 22182 - protein, 11 aa, Dengue virus
KLELDFNLCEG

SEQ ID NO: 22183 - protein, 11 aa, Dengue virus
LELDFNLCEGT

SEQ ID NO: 22184 - protein, 11 aa, Dengue virus
ELDFNLCEGTT

SEQ ID NO: 22185 - protein, 11 aa, Dengue virus
LDFNLCEGTTV

SEQ ID NO: 22186 - protein, 11 aa, Dengue virus
DFNLCEGTTVV

SEQ ID NO: 22187 - protein, 11 aa, Dengue virus
FNLCEGTTVVV

SEQ ID NO: 22188 - protein, 11 aa, Dengue virus
NLCEGTTVVVD

SEQ ID NO: 22189 - protein, 11 aa, Dengue virus
FCEGTTVVVDE

SEQ ID NO: 22190 - protein, 11 aa, Dengue virus
TTVVVDEHCGS

SEQ ID NO: 22191 - protein, 11 aa, Dengue virus
TVVVDEHCGSR

SEQ ID NO: 22192 - protein, 11 aa, Dengue virus
VVVDEHCGSRG

SEQ ID NO: 22193 - protein, 11 aa, Dengue virus
VVDEHCGSRGP

SEQ ID NO: 22194 - protein, 11 aa, Dengue virus
VDEHCGYRGPS

SEQ ID NO: 22195 - protein, 11 aa, Dengue virus
DEHCGSRGPSL

SEQ ID NO: 22196 - protein, 11 aa, Dengue virus
EHCGSRGPSLR

SEQ ID NO: 22197 - protein, 11 aa, Dengue virus
HCGSRGPSLRT

SEQ ID NO: 22198 - protein, 11 aa, Dengue virus
CGYRGPSLRTT

SEQ ID NO: 22199 - protein, 11 aa, Dengue virus
GSRGPSLRTTT

SEQ ID NO: 22200 - protein, 11 aa, Dengue virus
SRGPSLRTTTV

SEQ ID NO: 22201 - protein, 11 aa, Dengue virus
SLRTTTVTGKT

SEQ ID NO: 22202 - protein, 11 aa, Dengue virus
LRTTTVTGKTI

SEQ ID NO: 22203 - protein, 11 aa, Dengue virus
RTTTVTGKTIH

SEQ ID NO: 22204 - protein, 11 aa, Dengue virus
TTTVTGKTIHE

SEQ ID NO: 22205 - protein, 11 aa, Dengue virus
TTVTGKTIHEW

SEQ ID NO: 22206 - protein, 11 aa, Dengue virus
TVTGKTIHEWC

SEQ ID NO: 22207 - protein, 11 aa, Dengue virus
VTGKTIHEWCC

SEQ ID NO: 22208 - protein, 11 aa, Dengue virus
TGKTIHEWCCR

SEQ ID NO: 22209 - protein, 11 aa, Dengue virus
GKTIHEWCCRS

SEQ ID NO: 22210 - protein, 11 aa, Dengue virus
KTIHEWCCRSC

SEQ ID NO: 22211 - protein, 11 aa, Dengue virus
TIHEWCCRSCT

SEQ ID NO: 22212 - protein, 11 aa, Dengue virus
RSCTLPPLRFK

SEQ ID NO: 22213 - protein, 11 aa, Dengue virus
SCTLPPLRFKG

SEQ ID NO: 22214 - protein, 11 aa, Dengue virus
CTLPPLRFKGE

SEQ ID NO: 22215 - protein, 11 aa, Dengue virus
TLPPLRFKGED

SEQ ID NO: 22216 - protein, 11 aa, Dengue virus
LPPLRFKGEDG

SEQ ID NO: 22217 - protein, 11 aa, Dengue virus
PPLRFKGEDGC

SEQ ID NO: 22218 - protein, 11 aa, Dengue virus
PLRFKGEDGCW

SEQ ID NO: 22219 - protein, 11 aa, Dengue virus
LRFKGEDGCWY

SEQ ID NO: 22220 - protein, 11 aa, Dengue virus
RFKGEDGCWYG

SEQ ID NO: 22221 - protein, 11 aa, Dengue virus
FKGEDGCWYGM

SEQ ID NO: 22222 - protein, 11 aa, Dengue virus
KGEDGCWYGME

SEQ ID NO: 22223 - protein, 11 aa, Dengue virus
WYGMEIRPVKD

SEQ ID NO: 22224 - protein, 11 aa, Dengue virus
YGMEIRPVKDK

SEQ ID NO: 22225 - protein, 11 aa, Dengue virus
GMEIRPVKDKE

SEQ ID NO: 22226 - protein, 11 aa, Dengue virus
MEIRPVKDKEE

SEQ ID NO: 22227 - protein, 11 aa, Dengue virus
EIRPVKDKEEN

SEQ ID NO: 22228 - protein, 11 aa, Dengue virus
IRPVKDKEENL

SEQ ID NO: 22229 - protein, 11 aa, Dengue virus
RPVKDKEENLV

SEQ ID NO: 22230 - protein, 11 aa, Dengue virus
PVKEKEENLVR

SEQ ID NO: 22231 - protein, 11 aa, Dengue virus
VKEKEENLVRS

SEQ ID NO: 22232 - protein, 11 aa, Dengue virus
KEKEENLVRSM

SEQ ID NO: 22233 - protein, 11 aa, Dengue virus
EKEENLVRSMV

SEQ ID NO: 22234 - protein, 11 aa, Dengue virus
KEENLVRSMVS

SEQ ID NO: 22235 - protein, 11 aa, Dengue virus
EENLVRSMVSA

SEQ ID NO: 22236 - protein, 11 aa, Dengue virus
ENLVRSMVSAG

SEQ ID NO: 22237 - protein, 11 aa, Dengue virus
NLVRSMVSAGS

SEQ ID NO: 22238 - protein, 11 aa, Dengue virus
LVRSMVSAGSG

SEQ ID NO: 22239 - protein, 11 aa, Dengue virus
VRSMVSAGSGE

SEQ ID NO: 22240 - protein, 11 aa, Dengue virus
RSMVSAGSGEV

SEQ ID NO: 22241 - protein, 11 aa, Dengue virus
SMVSAGLGEVD

SEQ ID NO: 22242 - protein, 11 aa, Dengue virus
MVSAGLGEVDS

SEQ ID NO: 22243 - protein, 11 aa, Dengue virus
VSAGLGEVDSF

SEQ ID NO: 22244 - protein, 11 aa, Dengue virus
SAGLGEVDSFS

SEQ ID NO: 22245 - protein, 11 aa, Dengue virus
AGLGEVDSFSL

SEQ ID NO: 22246 - protein, 11 aa, Dengue virus
GLGEVDSFSLG

SEQ ID NO: 22247 - protein, 11 aa, Dengue virus
SGEVDSFSLGI

SEQ ID NO: 22248 - protein, 11 aa, Dengue virus
GEVDSFSLGIL

SEQ ID NO: 22249 - protein, 11 aa, Dengue virus
EVDSFSLGILC

SEQ ID NO: 22250 - protein, 11 aa, Dengue virus
SILIEEVMRSR

SEQ ID NO: 22251 - protein, 11 aa, Dengue virus
ILIEEVMRSRW

SEQ ID NO: 22252 - protein, 11 aa, Dengue virus
LIEEVMRSRWS

SEQ ID NO: 22253 - protein, 11 aa, Dengue virus
IEEVMRSRWSK

SEQ ID NO: 22254 - protein, 11 aa, Dengue virus
EEVMRSRWSRR

SEQ ID NO: 22255 - protein, 11 aa, Dengue virus
EVMRSRWSRRM

SEQ ID NO: 22256 - protein, 11 aa, Dengue virus
VMRSRWSRRML

SEQ ID NO: 22257 - protein, 11 aa, Dengue virus
MRSRWSRRMLM

SEQ ID NO: 22258 - protein, 11 aa, Dengue virus
RSRWSRRMLMT

SEQ ID NO: 22259 - protein, 11 aa, Dengue virus
SRWSRRMLMTG

SEQ ID NO: 22260 - protein, 11 aa, Dengue virus
RWSRRMLMTGT

SEQ ID NO: 22261 - protein, 11 aa, Dengue virus
WSRRMLMTGTL

SEQ ID NO: 22262 - protein, 11 aa, Dengue virus
GQLTWNDLIRS

SEQ ID NO: 22263 - protein, 11 aa, Dengue virus
QLTWNDLIRSC

SEQ ID NO: 22264 - protein, 11 aa, Dengue virus
LTWNDLIRSCI

SEQ ID NO: 22265 - protein, 11 aa, Dengue virus
TWNDLIRSCIM

SEQ ID NO: 22266 - protein, 11 aa, Dengue virus
WNDLIRSCIMV

SEQ ID NO: 22267 - protein, 11 aa, Dengue virus
NDLIRSCIMVG

SEQ ID NO: 22268 - protein, 11 aa, Dengue virus
DLIRSCIMVGA

SEQ ID NO: 22269 - protein, 11 aa, Dengue virus
LIRSCIMVGAN

SEQ ID NO: 22270 - protein, 11 aa, Dengue virus
IRSCIMVGANA

SEQ ID NO: 22271 - protein, 11 aa, Dengue virus
RSCIMVGANAS

SEQ ID NO: 22272 - protein, 11 aa, Dengue virus
SCIMVGANASD

SEQ ID NO: 22273 - protein, 11 aa, Dengue virus
CIMVGANASDK

SEQ ID NO: 22274 - protein, 11 aa, Dengue virus
IMVGANASDKM

SEQ ID NO: 22275 - protein, 11 aa, Dengue virus
MVGANASDKMG

SEQ ID NO: 22276 - protein, 11 aa, Dengue virus
GANASDKMGMG

SEQ ID NO: 22277 - protein, 11 aa, Dengue virus
DKMGMGTTYLA

SEQ ID NO: 22278 - protein, 11 aa, Dengue virus
KMGMGTTYLAL

SEQ ID NO: 22279 - protein, 11 aa, Dengue virus
MGMGMTYLALM

SEQ ID NO: 22280 - protein, 11 aa, Dengue virus
GMGMTYLALMA

SEQ ID NO: 22281 - protein, 11 aa, Dengue virus
MGMTYLALMAT

SEQ ID NO: 22282 - protein, 11 aa, Dengue virus
GMTYLALMATF

SEQ ID NO: 22283 - protein, 11 aa, Dengue virus
TTYLALMATFR

SEQ ID NO: 22284 - protein, 11 aa, Dengue virus
TYLALMATFRM

SEQ ID NO: 22285 - protein, 11 aa, Dengue virus
YLALMATFRMR

SEQ ID NO: 22286 - protein, 11 aa, Dengue virus
LALMATFRMRP

SEQ ID NO: 22287 - protein, 11 aa, Dengue virus
ALMATFRMRPM

SEQ ID NO: 22288 - protein, 11 aa, Dengue virus
LMATFRMRPMF

SEQ ID NO: 22289 - protein, 11 aa, Dengue virus
MATFRMRPMFA

SEQ ID NO: 22290 - protein, 11 aa, Dengue virus
ATFRMRPMFAV

SEQ ID NO: 22291 - protein, 11 aa, Dengue virus
TFRMRPMFAVG

SEQ ID NO: 22292 - protein, 11 aa, Dengue virus
FRMRPMFAVGL

SEQ ID NO: 22293 - protein, 11 aa, Dengue virus
RMRPMFAVGLL

SEQ ID NO: 22294 - protein, 11 aa, Dengue virus
MRPMLAVGLLF

SEQ ID NO: 22295 - protein, 11 aa, Dengue virus
RPMLAVGLLFR

SEQ ID NO: 22296 - protein, 11 aa, Dengue virus
PMLAVGLLFRR

SEQ ID NO: 22297 - protein, 11 aa, Dengue virus
MLAVGLLFRRL

SEQ ID NO: 22298 - protein, 11 aa, Dengue virus
LAVGLLFRRLT

SEQ ID NO: 22299 - protein, 11 aa, Dengue virus
AVGLLIRRLTS

SEQ ID NO: 22300 - protein, 11 aa, Dengue virus
VGLLIRRLTSR

SEQ ID NO: 22301 - protein, 11 aa, Dengue virus
GLLIRRLTSRE

SEQ ID NO: 22302 - protein, 11 aa, Dengue virus
LLIRRLTSREV

SEQ ID NO: 22303 - protein, 11 aa, Dengue virus
LIRRLTSREVL

SEQ ID NO: 22304 - protein, 11 aa, Dengue virus
IRRLTSREVLL

SEQ ID NO: 22305 - protein, 11 aa, Dengue virus
LTSREVLLLTV

SEQ ID NO: 22306 - protein, 11 aa, Dengue virus
TSREVLLLTVG

SEQ ID NO: 22307 - protein, 11 aa, Dengue virus
SREVLLLTVGL

SEQ ID NO: 22308 - protein, 11 aa, Dengue virus
REVLLLTVGLS

SEQ ID NO: 22309 - protein, 11 aa, Dengue virus
EVLLLTVGLSL

SEQ ID NO: 22310 - protein, 11 aa, Dengue virus
VLLLTVGLSLV

SEQ ID NO: 22311 - protein, 11 aa, Dengue virus
LLLTVGLSLVA

SEQ ID NO: 22312 - protein, 11 aa, Dengue virus
LLTVGLSLVAS

SEQ ID NO: 22313 - protein, 11 aa, Dengue virus
LTVGLSLVASV

SEQ ID NO: 22314 - protein, 11 aa, Dengue virus
TVGLSLVASVE

SEQ ID NO: 22315 - protein, 11 aa, Dengue virus
VGLSLVASVEL

SEQ ID NO: 22316 - protein, 11 aa, Dengue virus
GLSLVAFVELP

SEQ ID NO: 22317 - protein, 11 aa, Dengue virus
SVELPSSLEEL

SEQ ID NO: 22318 - protein, 11 aa, Dengue virus
VELPSSLEELG

SEQ ID NO: 22319 - protein, 11 aa, Dengue virus
ELPSSLEELGD

SEQ ID NO: 22320 - protein, 11 aa, Dengue virus
LPSSLEELGDG

SEQ ID NO: 22321 - protein, 11 aa, Dengue virus
PSSLEELGDGL

SEQ ID NO: 22322 - protein, 11 aa, Dengue virus
SSLEELGDGLA

SEQ ID NO: 22323 - protein, 11 aa, Dengue virus
SLEELGDGLAI

SEQ ID NO: 22324 - protein, 11 aa, Dengue virus
LEELGDGLAIG

SEQ ID NO: 22325 - protein, 11 aa, Dengue virus
EELGDGLAIGI

SEQ ID NO: 22326 - protein, 11 aa, Dengue virus
ELGDGLAIGIM

SEQ ID NO: 22327 - protein, 11 aa, Dengue virus
LGDGLAMGIMM

SEQ ID NO: 22328 - protein, 11 aa, Dengue virus
GDGLAMGIMML

SEQ ID NO: 22329 - protein, 11 aa, Dengue virus
DGLAMGIMMLK

SEQ ID NO: 22330 - protein, 11 aa, Dengue virus
GLAMGIMMLKL

SEQ ID NO: 22331 - protein, 11 aa, Dengue virus
LAMGIMMLKLL

SEQ ID NO: 22332 - protein, 11 aa, Dengue virus
AMGIMMLKLLT

SEQ ID NO: 22333 - protein, 11 aa, Dengue virus
MGIMMLKLLTE

SEQ ID NO: 22334 - protein, 11 aa, Dengue virus
GIMMLKLLTEF

SEQ ID NO: 22335 - protein, 11 aa, Dengue virus
IMMLKLLTEFQ

SEQ ID NO: 22336 - protein, 11 aa, Dengue virus
MMLKLLTEFQP

SEQ ID NO: 22337 - protein, 11 aa, Dengue virus
LKLLTEFQPHQ

SEQ ID NO: 22338 - protein, 11 aa, Dengue virus
KLLTEFQPHQL

SEQ ID NO: 22339 - protein, 11 aa, Dengue virus
LLTEFQPHQLW

SEQ ID NO: 22340 - protein, 11 aa, Dengue virus
VSLLPLCLSTT

SEQ ID NO: 22341 - protein, 11 aa, Dengue virus
SLLPLCLSTTS

SEQ ID NO: 22342 - protein, 11 aa, Dengue virus
LLPLCLSTTSQ

SEQ ID NO: 22343 - protein, 11 aa, Dengue virus
LPLCLSTTSQK

SEQ ID NO: 22344 - protein, 11 aa, Dengue virus
PLCMSTTSQKT

SEQ ID NO: 22345 - protein, 11 aa, Dengue virus
LCMSTTSQKTT

SEQ ID NO: 22346 - protein, 11 aa, Dengue virus
TTWLPVLLGSF

SEQ ID NO: 22347 - protein, 11 aa, Dengue virus
TWLPVLLGSFG

SEQ ID NO: 22348 - protein, 11 aa, Dengue virus
WLPVLLGSFGC

SEQ ID NO: 22349 - protein, 11 aa, Dengue virus
LPVLLGSFGCK

SEQ ID NO: 22350 - protein, 11 aa, Dengue virus
PVLLGSFGCKP

SEQ ID NO: 22351 - protein, 11 aa, Dengue virus
VLLGSFGCKPL

SEQ ID NO: 22352 - protein, 11 aa, Dengue virus
LLGSFGCKPLT

SEQ ID NO: 22353 - protein, 11 aa, Dengue virus
LGSFGCKPLTM

SEQ ID NO: 22354 - protein, 11 aa, Dengue virus
GSFGCKPLTMF

SEQ ID NO: 22355 - protein, 11 aa, Dengue virus
SFGCKPLTMFL

SEQ ID NO: 22356 - protein, 11 aa, Dengue virus
FGCKPLTMFLI

SEQ ID NO: 22357 - protein, 11 aa, Dengue virus
GCKPLTMFLIT

SEQ ID NO: 22358 - protein, 11 aa, Dengue virus
CKPLTMFLITE

SEQ ID NO: 22359 - protein, 11 aa, Dengue virus
ENKIWGRRSWP

SEQ ID NO: 22360 - protein, 11 aa, Dengue virus
NKIWGRRSWPL

SEQ ID NO: 22361 - protein, 11 aa, Dengue virus
KIWGRRSWPLN

SEQ ID NO: 22362 - protein, 11 aa, Dengue virus
IWGRRSWPLNE

SEQ ID NO: 22363 - protein, 11 aa, Dengue virus
WGRRSWPLNEG

SEQ ID NO: 22364 - protein, 11 aa, Dengue virus
GRRSWPLNEGI

SEQ ID NO: 22365 - protein, 11 aa, Dengue virus
RRSWPLNEGIM

SEQ ID NO: 22366 - protein, 11 aa, Dengue virus
RSWPLNEGIMA

SEQ ID NO: 22367 - protein, 11 aa, Dengue virus
SWPLNEGIMAI

SEQ ID NO: 22368 - protein, 11 aa, Dengue virus
WPLNEGIMAIG

SEQ ID NO: 22369 - protein, 11 aa, Dengue virus
PLNEGIMAIGI

SEQ ID NO: 22370 - protein, 11 aa, Dengue virus
LNEGIMAIGIV

SEQ ID NO: 22371 - protein, 11 aa, Dengue virus
NEGIMAIGIVS

SEQ ID NO: 22372 - protein, 11 aa, Dengue virus
EGIMAIGIVSI

SEQ ID NO: 22373 - protein, 11 aa, Dengue virus
GIMAIGIVSIL

SEQ ID NO: 22374 - protein, 11 aa, Dengue virus
IMAIGIVSILL

SEQ ID NO: 22375 - protein, 11 aa, Dengue virus
MAIGIVSILLS

SEQ ID NO: 22376 - protein, 11 aa, Dengue virus
AIGIVSILLSS

SEQ ID NO: 22377 - protein, 11 aa, Dengue virus
IGIVSILLSSL

SEQ ID NO: 22378 - protein, 11 aa, Dengue virus
GVVSILLSSLL

SEQ ID NO: 22379 - protein, 11 aa, Dengue virus
VVSILLSSLLK

SEQ ID NO: 22380 - protein, 11 aa, Dengue virus
VSILLSALLKN

SEQ ID NO: 22381 - protein, 11 aa, Dengue virus
SILLSALLKND

SEQ ID NO: 22382 - protein, 11 aa, Dengue virus
ILLSALLKNDV

SEQ ID NO: 22383 - protein, 11 aa, Dengue virus
LLSALLKNDVP

SEQ ID NO: 22384 - protein, 11 aa, Dengue virus
LSALLKNDVPL

SEQ ID NO: 22385 - protein, 11 aa, Dengue virus
SALLKNDVPLA

SEQ ID NO: 22386 - protein, 11 aa, Dengue virus
ALLKNDVPLAG

SEQ ID NO: 22387 - protein, 11 aa, Dengue virus
ISGSSADLLLE

SEQ ID NO: 22388 - protein, 11 aa, Dengue virus
SGSSADLLLEK

SEQ ID NO: 22389 - protein, 11 aa, Dengue virus
GSSADLLLEKA

SEQ ID NO: 22390 - protein, 11 aa, Dengue virus
SSADLLLEKAA

SEQ ID NO: 22391 - protein, 11 aa, Dengue virus
SADLSLEKAAV

SEQ ID NO: 22392 - protein, 11 aa, Dengue virus
ADLSLEKAAVV

SEQ ID NO: 22393 - protein, 11 aa, Dengue virus
DLSLEKAAVVS

SEQ ID NO: 22394 - protein, 11 aa, Dengue virus
LSLEKAAVVSW

SEQ ID NO: 22395 - protein, 11 aa, Dengue virus
SLEKAAVVSWE

SEQ ID NO: 22396 - protein, 11 aa, Dengue virus
AEVSWEQEAEH

SEQ ID NO: 22397 - protein, 11 aa, Dengue virus
EVSWEQEAEHS

SEQ ID NO: 22398 - protein, 11 aa, Dengue virus
VSWEQEAEHSG

SEQ ID NO: 22399 - protein, 11 aa, Dengue virus
SWEQEAEHSGT

SEQ ID NO: 22400 - protein, 11 aa, Dengue virus
WEQEAEHSGTS

SEQ ID NO: 22401 - protein, 11 aa, Dengue virus
EQEAEHSGTSH

SEQ ID NO: 22402 - protein, 11 aa, Dengue virus
QEAEHSGTSHN

SEQ ID NO: 22403 - protein, 11 aa, Dengue virus
EAEHSGTSHNI

SEQ ID NO: 22404 - protein, 11 aa, Dengue virus
AEHSGTSHNIL

SEQ ID NO: 22405 - protein, 11 aa, Dengue virus
EHSGTSHNILV

SEQ ID NO: 22406 - protein, 11 aa, Dengue virus
HSGTSHNILVE

SEQ ID NO: 22407 - protein, 11 aa, Dengue virus
SGTSHNILVEV

SEQ ID NO: 22408 - protein, 11 aa, Dengue virus
GTSHNILVEVQ

SEQ ID NO: 22409 - protein, 11 aa, Dengue virus
TSHNILVEVQD

SEQ ID NO: 22410 - protein, 11 aa, Dengue virus
SHNILVEIQDD

SEQ ID NO: 22411 - protein, 11 aa, Dengue virus
HNILVEIQDDG

SEQ ID NO: 22412 - protein, 11 aa, Dengue virus
NILVEIQDDGT

SEQ ID NO: 22413 - protein, 11 aa, Dengue virus
ILVEIQDDGTM

SEQ ID NO: 22414 - protein, 11 aa, Dengue virus
LVEIQDDGTMK

SEQ ID NO: 22415 - protein, 11 aa, Dengue virus
VEIQDDGTMKI

SEQ ID NO: 22416 - protein, 11 aa, Dengue virus
EIQDDGTMKIK

SEQ ID NO: 22417 - protein, 11 aa, Dengue virus
IQDDGTMKIKD

SEQ ID NO: 22418 - protein, 11 aa, Dengue virus
DGTMKIKDEEK

SEQ ID NO: 22419 - protein, 11 aa, Dengue virus
GTMKIKDEEKD

SEQ ID NO: 22420 - protein, 11 aa, Dengue virus
TMKIKDEEKDD

SEQ ID NO: 22421 - protein, 11 aa, Dengue virus
MKIKDEEKDDT

SEQ ID NO: 22422 - protein, 11 aa, Dengue virus
KIKDEERDDTI

SEQ ID NO: 22423 - protein, 11 aa, Dengue virus
IKDEERDDTIT

SEQ ID NO: 22424 - protein, 11 aa, Dengue virus
KDEERDDTITI

SEQ ID NO: 22425 - protein, 11 aa, Dengue virus
DEERDDTITIL

SEQ ID NO: 22426 - protein, 11 aa, Dengue virus
EERDDTITILL

SEQ ID NO: 22427 - protein, 11 aa, Dengue virus
ERDDTITILLK

SEQ ID NO: 22428 - protein, 11 aa, Dengue virus
RDDTITILLKA

SEQ ID NO: 22429 - protein, 11 aa, Dengue virus
DDTITILLKAT

SEQ ID NO: 22430 - protein, 11 aa, Dengue virus
DTITILLKATL

SEQ ID NO: 22431 - protein, 11 aa, Dengue virus
TITILLKATLL

SEQ ID NO: 22432 - protein, 11 aa, Dengue virus
ITILLKATLLA

SEQ ID NO: 22433 - protein, 11 aa, Dengue virus
TILLKATLLAI

SEQ ID NO: 22434 - protein, 11 aa, Dengue virus
ILLKATLLAIS

SEQ ID NO: 22435 - protein, 11 aa, Dengue virus
LLKATLLAISG

SEQ ID NO: 22436 - protein, 11 aa, Dengue virus
LKATLLAISGV

SEQ ID NO: 22437 - protein, 11 aa, Dengue virus
KATLLAISGVY

SEQ ID NO: 22438 - protein, 11 aa, Dengue virus
ATLLAISGVYP

SEQ ID NO: 22439 - protein, 11 aa, Dengue virus
LLAVSGVYPMS

SEQ ID NO: 22440 - protein, 11 aa, Dengue virus
LAVSGVYPMSI

SEQ ID NO: 22441 - protein, 11 aa, Dengue virus
AVSGVYPMSIP

SEQ ID NO: 22442 - protein, 11 aa, Dengue virus
VSGVYPMSIPA

SEQ ID NO: 22443 - protein, 11 aa, Dengue virus
SGVYPMSIPAT

SEQ ID NO: 22444 - protein, 11 aa, Dengue virus
GVYPMSIPATL

SEQ ID NO: 22445 - protein, 11 aa, Dengue virus
VYPMSIPATLF

SEQ ID NO: 22446 - protein, 11 aa, Dengue virus
YPMSIPATLFV

SEQ ID NO: 22447 - protein, 11 aa, Dengue virus
PMSIPATLFVW

SEQ ID NO: 22448 - protein, 11 aa, Dengue virus
SIPATLFVWHF

SEQ ID NO: 22449 - protein, 11 aa, Dengue virus
IPATLFVWHFW

SEQ ID NO: 22450 - protein, 11 aa, Dengue virus
PATLFVWHFWQ

SEQ ID NO: 22451 - protein, 11 aa, Dengue virus
GVLWDTPSPPK

SEQ ID NO: 22452 - protein, 11 aa, Dengue virus
VLWDTPSPPKV

SEQ ID NO: 22453 - protein, 11 aa, Dengue virus
LWDTPSPPEVG

SEQ ID NO: 22454 - protein, 11 aa, Dengue virus
WDTPSPPEVGR

SEQ ID NO: 22455 - protein, 11 aa, Dengue virus
DTPSPPEVGRA

SEQ ID NO: 22456 - protein, 11 aa, Dengue virus
TPSPPEVGRAV

SEQ ID NO: 22457 - protein, 11 aa, Dengue virus
PSPPEVGRAVL

SEQ ID NO: 22458 - protein, 11 aa, Dengue virus
SPPEVGRAVLD

SEQ ID NO: 22459 - protein, 11 aa, Dengue virus
VGRAVLDDGIY

SEQ ID NO: 22460 - protein, 11 aa, Dengue virus
GRAVLDDGIYR

SEQ ID NO: 22461 - protein, 11 aa, Dengue virus
KAVLDDGIYRI

SEQ ID NO: 22462 - protein, 11 aa, Dengue virus
AVLDDGIYRIL

SEQ ID NO: 22463 - protein, 11 aa, Dengue virus
VLDDGIYRILQ

SEQ ID NO: 22464 - protein, 11 aa, Dengue virus
LDDGIYRILQR

SEQ ID NO: 22465 - protein, 11 aa, Dengue virus
DDGIYRILQRG

SEQ ID NO: 22466 - protein, 11 aa, Dengue virus
DGIYRILQRGL

SEQ ID NO: 22467 - protein, 11 aa, Dengue virus
GIYRILQRGLL

SEQ ID NO: 22468 - protein, 11 aa, Dengue virus
IYRILQRGLLG

SEQ ID NO: 22469 - protein, 11 aa, Dengue virus
YRILQRGLLGR

SEQ ID NO: 22470 - protein, 11 aa, Dengue virus
RILQRGLLGRS

SEQ ID NO: 22471 - protein, 11 aa, Dengue virus
ILQRGLLGRSQ

SEQ ID NO: 22472 - protein, 11 aa, Dengue virus
LQRGLLGRSQV

SEQ ID NO: 22473 - protein, 11 aa, Dengue virus
RSQVGVGVFQD

SEQ ID NO: 22474 - protein, 11 aa, Dengue virus
SQVGVGVFQDG

SEQ ID NO: 22475 - protein, 11 aa, Dengue virus
QVGVGVFQDGV

SEQ ID NO: 22476 - protein, 11 aa, Dengue virus
VGVGVFQDGVF

SEQ ID NO: 22477 - protein, 11 aa, Dengue virus
GVGVFQDGVFH

SEQ ID NO: 22478 - protein, 11 aa, Dengue virus
VGVFQDGVFHT

SEQ ID NO: 22479 - protein, 11 aa, Dengue virus
GVFQDGVFHTM

SEQ ID NO: 22480 - protein, 11 aa, Dengue virus
VFQDGVFHTMW

SEQ ID NO: 22481 - protein, 11 aa, Dengue virus
FQDGVFHTMWH

SEQ ID NO: 22482 - protein, 11 aa, Dengue virus
QDGVFHTMWHV

SEQ ID NO: 22483 - protein, 11 aa, Dengue virus
DGVFHTMWHVT

SEQ ID NO: 22484 - protein, 11 aa, Dengue virus
GVFHTMWHVTR

SEQ ID NO: 22485 - protein, 11 aa, Dengue virus
DLISYGGGWRF

SEQ ID NO: 22486 - protein, 11 aa, Dengue virus
LISYGGGWRFQ

SEQ ID NO: 22487 - protein, 11 aa, Dengue virus
ISYGGGWRFQG

SEQ ID NO: 22488 - protein, 11 aa, Dengue virus
SYGGGWRFQGS

SEQ ID NO: 22489 - protein, 11 aa, Dengue virus
YGGGWRFQGSW

SEQ ID NO: 22490 - protein, 11 aa, Dengue virus
GGGWRFQGSWN

SEQ ID NO: 22491 - protein, 11 aa, Dengue virus
RGSWNTGEEVQ

SEQ ID NO: 22492 - protein, 11 aa, Dengue virus
GSWNAGEEVQV

SEQ ID NO: 22493 - protein, 11 aa, Dengue virus
SWNAGEEVQVI

SEQ ID NO: 22494 - protein, 11 aa, Dengue virus
WNAGEEVQVIA

SEQ ID NO: 22495 - protein, 11 aa, Dengue virus
NAGEEVQVIAV

SEQ ID NO: 22496 - protein, 11 aa, Dengue virus
AGEEVQVIAVE

SEQ ID NO: 22497 - protein, 11 aa, Dengue virus
PGKNPKNVQTT

SEQ ID NO: 22498 - protein, 11 aa, Dengue virus
GKNPKNVQTTP

SEQ ID NO: 22499 - protein, 11 aa, Dengue virus
KNPKNVQTTPG

SEQ ID NO: 22500 - protein, 11 aa, Dengue virus
NPKNVQTTPGT

SEQ ID NO: 22501 - protein, 11 aa, Dengue virus
PKNVQTTPGTF

SEQ ID NO: 22502 - protein, 11 aa, Dengue virus
KNVQTTPGTFK

SEQ ID NO: 22503 - protein, 11 aa, Dengue virus
NVQTTPGTFKT

SEQ ID NO: 22504 - protein, 11 aa, Dengue virus
VQTTPGTFKTP

SEQ ID NO: 22505 - protein, 11 aa, Dengue virus
QTTPGTFKTPE

SEQ ID NO: 22506 - protein, 11 aa, Dengue virus
TTPGTFKTPEG

SEQ ID NO: 22507 - protein, 11 aa, Dengue virus
TPGTFKTPEGE

SEQ ID NO: 22508 - protein, 11 aa, Dengue virus
PGTFKTSEGEV

SEQ ID NO: 22509 - protein, 11 aa, Dengue virus
GTFKTSEGEVG

SEQ ID NO: 22510 - protein, 11 aa, Dengue virus
TFKTSEGEVGA

SEQ ID NO: 22511 - protein, 11 aa, Dengue virus
FKTSEGEVGAI

SEQ ID NO: 22512 - protein, 11 aa, Dengue virus
KTSEGEVGAIA

SEQ ID NO: 22513 - protein, 11 aa, Dengue virus
TSEGEVGAIAL

SEQ ID NO: 22514 - protein, 11 aa, Dengue virus
SEGEVGAIALD

SEQ ID NO: 22515 - protein, 11 aa, Dengue virus
SPIVNRERKIV

SEQ ID NO: 22516 - protein, 11 aa, Dengue virus
PIVNREGKVVG

SEQ ID NO: 22517 - protein, 11 aa, Dengue virus
IVNREGKVVGL

SEQ ID NO: 22518 - protein, 11 aa, Dengue virus
VNRERKIVGLY

SEQ ID NO: 22519 - protein, 11 aa, Dengue virus
NREGKVVGLYG

SEQ ID NO: 22520 - protein, 11 aa, Dengue virus
SGTYVSAIAQT

SEQ ID NO: 22521 - protein, 11 aa, Dengue virus
GTYVSAIAQAR

SEQ ID NO: 22522 - protein, 11 aa, Dengue virus
TYVSAIAQAKT

SEQ ID NO: 22523 - protein, 11 aa, Dengue virus
YVSAIAQAKTS

SEQ ID NO: 22524 - protein, 11 aa, Dengue virus
VSAIAQAKTSQ

SEQ ID NO: 22525 - protein, 11 aa, Dengue virus
SAIAQAKTSQE

SEQ ID NO: 22526 - protein, 11 aa, Dengue virus
AIAQAKTSQEG

SEQ ID NO: 22527 - protein, 11 aa, Dengue virus
IAQAKTSQEGP

SEQ ID NO: 22528 - protein, 11 aa, Dengue virus
AQAKTSQEGPL

SEQ ID NO: 22529 - protein, 11 aa, Dengue virus
QAKTSQEGPLP

SEQ ID NO: 22530 - protein, 11 aa, Dengue virus
AKTSQEGPLPE

SEQ ID NO: 22531 - protein, 11 aa, Dengue virus
KTSQEGPLPEI

SEQ ID NO: 22532 - protein, 11 aa, Dengue virus
TSQEGPLPEIE

SEQ ID NO: 22533 - protein, 11 aa, Dengue virus
SQEGPLPEIEE

SEQ ID NO: 22534 - protein, 11 aa, Dengue virus
QEGPLPEIEEE

SEQ ID NO: 22535 - protein, 11 aa, Dengue virus
EGPLPEIEEEV

SEQ ID NO: 22536 - protein, 11 aa, Dengue virus
GPLPEIEEEVF

SEQ ID NO: 22537 - protein, 11 aa, Dengue virus
PLPEIEDEVFK

SEQ ID NO: 22538 - protein, 11 aa, Dengue virus
LPEIEDEVFKK

SEQ ID NO: 22539 - protein, 11 aa, Dengue virus
PEIEDEVFKKR

SEQ ID NO: 22540 - protein, 11 aa, Dengue virus
EIEDEVFKKRN

SEQ ID NO: 22541 - protein, 11 aa, Dengue virus
IEDEVFKKRNL

SEQ ID NO: 22542 - protein, 11 aa, Dengue virus
EDEVFKKRNLT

SEQ ID NO: 22543 - protein, 11 aa, Dengue virus
DEVFKKRNLTI

SEQ ID NO: 22544 - protein, 11 aa, Dengue virus
EVFKKRNLTIM

SEQ ID NO: 22545 - protein, 11 aa, Dengue virus
VFKKRNLTIMD

SEQ ID NO: 22546 - protein, 11 aa, Dengue virus
FKKRNLTIMDL

SEQ ID NO: 22547 - protein, 11 aa, Dengue virus
KKRNLTIMDLH

SEQ ID NO: 22548 - protein, 11 aa, Dengue virus
SGKTRRYLPAM

SEQ ID NO: 22549 - protein, 11 aa, Dengue virus
GKTRRYLPAMV

SEQ ID NO: 22550 - protein, 11 aa, Dengue virus
KTRRYLPAMVR

SEQ ID NO: 22551 - protein, 11 aa, Dengue virus
TRRYLPAMVRE

SEQ ID NO: 22552 - protein, 11 aa, Dengue virus
RRYLPAMVREA

SEQ ID NO: 22553 - protein, 11 aa, Dengue virus
RYLPAMVREAI

SEQ ID NO: 22554 - protein, 11 aa, Dengue virus
YLPAMVREAIK

SEQ ID NO: 22555 - protein, 11 aa, Dengue virus
LPAMVREAIKR

SEQ ID NO: 22556 - protein, 11 aa, Dengue virus
PAIVREAIKRR

SEQ ID NO: 22557 - protein, 11 aa, Dengue virus
VREAIKRRLRT

SEQ ID NO: 22558 - protein, 11 aa, Dengue virus
REAIKRRLRTL

SEQ ID NO: 22559 - protein, 11 aa, Dengue virus
IKRRLRTLILA

SEQ ID NO: 22560 - protein, 11 aa, Dengue virus
KRRLRTLILAP

SEQ ID NO: 22561 - protein, 11 aa, Dengue virus
RRLRTLILAPT

SEQ ID NO: 22562 - protein, 11 aa, Dengue virus
RLRTLILAPTR

SEQ ID NO: 22563 - protein, 11 aa, Dengue virus
LRTLVLAPTRV

SEQ ID NO: 22564 - protein, 11 aa, Dengue virus
RTLVLAPTRVV

SEQ ID NO: 22565 - protein, 11 aa, Dengue virus
TLVLAPTRVVA

SEQ ID NO: 22566 - protein, 11 aa, Dengue virus
LVLAPTRVVAS

SEQ ID NO: 22567 - protein, 11 aa, Dengue virus
VLAPTRVVASE

SEQ ID NO: 22568 - protein, 11 aa, Dengue virus
ASEMAEALKGV

SEQ ID NO: 22569 - protein, 11 aa, Dengue virus
SEMAEALKGVP

SEQ ID NO: 22570 - protein, 11 aa, Dengue virus
EMAEALKGVPI

SEQ ID NO: 22571 - protein, 11 aa, Dengue virus
MAEALKGVPIR

SEQ ID NO: 22572 - protein, 11 aa, Dengue virus
AEALKGVPIRY

SEQ ID NO: 22573 - protein, 11 aa, Dengue virus
EALKGVPIRYQ

SEQ ID NO: 22574 - protein, 11 aa, Dengue virus
ALKGVPIRYQT

SEQ ID NO: 22575 - protein, 11 aa, Dengue virus
LKGVPIRYQTT

SEQ ID NO: 22576 - protein, 11 aa, Dengue virus
KGVPIRYQTTA

SEQ ID NO: 22577 - protein, 11 aa, Dengue virus
GVPIRYQTTAV

SEQ ID NO: 22578 - protein, 11 aa, Dengue virus
VPIRYQTTAVK

SEQ ID NO: 22579 - protein, 11 aa, Dengue virus
TTAVKSEHTGR

SEQ ID NO: 22580 - protein, 11 aa, Dengue virus
TAVKSEHTGRE

SEQ ID NO: 22581 - protein, 11 aa, Dengue virus
AVKSEHTGREI

SEQ ID NO: 22582 - protein, 11 aa, Dengue virus
VKSEHTGREIV

SEQ ID NO: 22583 - protein, 11 aa, Dengue virus
KSEHTGREIVD

SEQ ID NO: 22584 - protein, 11 aa, Dengue virus
SEHTGREIVDL

SEQ ID NO: 22585 - protein, 11 aa, Dengue virus
EHTGREIVDLM

SEQ ID NO: 22586 - protein, 11 aa, Dengue virus
HTGREIVDLMC

SEQ ID NO: 22587 - protein, 11 aa, Dengue virus
TGREIVDLMCH

SEQ ID NO: 22588 - protein, 11 aa, Dengue virus
GREIVDLMCHA

SEQ ID NO: 22589 - protein, 11 aa, Dengue virus
REIVDLMCHAT

SEQ ID NO: 22590 - protein, 11 aa, Dengue virus
IMDEAHFTDPA

SEQ ID NO: 22591 - protein, 11 aa, Dengue virus
MDEAHFTDPAS

SEQ ID NO: 22592 - protein, 11 aa, Dengue virus
DEAHFTDPASI

SEQ ID NO: 22593 - protein, 11 aa, Dengue virus
EAHFTDPASIA

SEQ ID NO: 22594 - protein, 11 aa, Dengue virus
AHFTDPASIAA

SEQ ID NO: 22595 - protein, 11 aa, Dengue virus
HFTDPASIAAR

SEQ ID NO: 22596 - protein, 11 aa, Dengue virus
FTDPASIAARG

SEQ ID NO: 22597 - protein, 11 aa, Dengue virus
TDPASIAARGY

SEQ ID NO: 22598 - protein, 11 aa, Dengue virus
DPASIAARGYI

SEQ ID NO: 22599 - protein, 11 aa, Dengue virus
PASIAARGYIS

SEQ ID NO: 22600 - protein, 11 aa, Dengue virus
ASIAARGYIST

SEQ ID NO: 22601 - protein, 11 aa, Dengue virus
IFMTATPPGSM

SEQ ID NO: 22602 - protein, 11 aa, Dengue virus
FMTATPPGSME

SEQ ID NO: 22603 - protein, 11 aa, Dengue virus
MTATPPGSMEA

SEQ ID NO: 22604 - protein, 11 aa, Dengue virus
TATPPGSMEAF

SEQ ID NO: 22605 - protein, 11 aa, Dengue virus
ATPPGSMEAFP

SEQ ID NO: 22606 - protein, 11 aa, Dengue virus
TPPGSMEAFPQ

SEQ ID NO: 22607 - protein, 11 aa, Dengue virus
PPGSMEAFPQS

SEQ ID NO: 22608 - protein, 11 aa, Dengue virus
PGSMEAFPQSN

SEQ ID NO: 22609 - protein, 11 aa, Dengue virus
GSMEAFPQSNA

SEQ ID NO: 22610 - protein, 11 aa, Dengue virus
SMEAFPQSNAV

SEQ ID NO: 22611 - protein, 11 aa, Dengue virus
MEAFPQSNAVI

SEQ ID NO: 22612 - protein, 11 aa, Dengue virus
EAFPQSNAIIQ

SEQ ID NO: 22613 - protein, 11 aa, Dengue virus
AFPQSNAIIQD

SEQ ID NO: 22614 - protein, 11 aa, Dengue virus
FPQSNAIIQDE

SEQ ID NO: 22615 - protein, 11 aa, Dengue virus
PQSNAIIQDEE

SEQ ID NO: 22616 - protein, 11 aa, Dengue virus
QSNAVIQDEEK

SEQ ID NO: 22617 - protein, 11 aa, Dengue virus
SNAVIQDEEKD

SEQ ID NO: 22618 - protein, 11 aa, Dengue virus
NAVIQDEEKDI

SEQ ID NO: 22619 - protein, 11 aa, Dengue virus
AVIQDEEKDIP

SEQ ID NO: 22620 - protein, 11 aa, Dengue virus
VIQDEEKDIPE

SEQ ID NO: 22621 - protein, 11 aa, Dengue virus
IQDEEKDIPER

SEQ ID NO: 22622 - protein, 11 aa, Dengue virus
QDEEKDIPERS

SEQ ID NO: 22623 - protein, 11 aa, Dengue virus
DEEKDIPERSW

SEQ ID NO: 22624 - protein, 11 aa, Dengue virus
EEKDIPERSWN

SEQ ID NO: 22625 - protein, 11 aa, Dengue virus
EKDIPERSWNS

SEQ ID NO: 22626 - protein, 11 aa, Dengue virus
KDIPERSWNSG

SEQ ID NO: 22627 - protein, 11 aa, Dengue virus
DIPERSWNSGH

SEQ ID NO: 22628 - protein, 11 aa, Dengue virus
IPERSWNSGYD

SEQ ID NO: 22629 - protein, 11 aa, Dengue virus
PERSWNSGYDW

SEQ ID NO: 22630 - protein, 11 aa, Dengue virus
ERSWNSGYDWI

SEQ ID NO: 22631 - protein, 11 aa, Dengue virus
RSWNSGYDWIT

SEQ ID NO: 22632 - protein, 11 aa, Dengue virus
SWNSGYDWITD

SEQ ID NO: 22633 - protein, 11 aa, Dengue virus
WNSGYDWITDF

SEQ ID NO: 22634 - protein, 11 aa, Dengue virus
NSGYDWITDFP

SEQ ID NO: 22635 - protein, 11 aa, Dengue virus
SGYDWITDFPG

SEQ ID NO: 22636 - protein, 11 aa, Dengue virus
GYDWITDFPGK

SEQ ID NO: 22637 - protein, 11 aa, Dengue virus
YDWITDFPGKT

SEQ ID NO: 22638 - protein, 11 aa, Dengue virus
DWITDFPGKTV

SEQ ID NO: 22639 - protein, 11 aa, Dengue virus
KTVWFVPSIKA

SEQ ID NO: 22640 - protein, 11 aa, Dengue virus
TVWFVPSIKAG

SEQ ID NO: 22641 - protein, 11 aa, Dengue virus
VWFVPSIKAGN

SEQ ID NO: 22642 - protein, 11 aa, Dengue virus
WFVPSIKAGND

SEQ ID NO: 22643 - protein, 11 aa, Dengue virus
FVPSIKAGNDI

SEQ ID NO: 22644 - protein, 11 aa, Dengue virus
VPSIKAGNDIA

SEQ ID NO: 22645 - protein, 11 aa, Dengue virus
PSIKAGNDIAN

SEQ ID NO: 22646 - protein, 11 aa, Dengue virus
SIKAGNDIANC

SEQ ID NO: 22647 - protein, 11 aa, Dengue virus
IKAGNDIANCL

SEQ ID NO: 22648 - protein, 11 aa, Dengue virus
KAGNDIANCLR

SEQ ID NO: 22649 - protein, 11 aa, Dengue virus
AGNDIANCLRK

SEQ ID NO: 22650 - protein, 11 aa, Dengue virus
NCLRKNGKRVV

SEQ ID NO: 22651 - protein, 11 aa, Dengue virus
CLRKNGKRVVQ

SEQ ID NO: 22652 - protein, 11 aa, Dengue virus
LRKNGKRVVQL

SEQ ID NO: 22653 - protein, 11 aa, Dengue virus
RKNGKRVVQLS

SEQ ID NO: 22654 - protein, 11 aa, Dengue virus
KNGKRVVQLSR

SEQ ID NO: 22655 - protein, 11 aa, Dengue virus
NGKRVVQLSRK

SEQ ID NO: 22656 - protein, 11 aa, Dengue virus
GKRVVQLSRKT

SEQ ID NO: 22657 - protein, 11 aa, Dengue virus
KRVVQLSRKTF

SEQ ID NO: 22658 - protein, 11 aa, Dengue virus
RVVQLSRKTFD

SEQ ID NO: 22659 - protein, 11 aa, Dengue virus
VVQLSRKTFDT

SEQ ID NO: 22660 - protein, 11 aa, Dengue virus
VQLSRKTFDTE

SEQ ID NO: 22661 - protein, 11 aa, Dengue virus
KTFDTEYQKTR

SEQ ID NO: 22662 - protein, 11 aa, Dengue virus
TFDTEYQKTRN

SEQ ID NO: 22663 - protein, 11 aa, Dengue virus
FDTEYQKTRNN

SEQ ID NO: 22664 - protein, 11 aa, Dengue virus
DTEYQKTRNND

SEQ ID NO: 22665 - protein, 11 aa, Dengue virus
TEYQKTRNNDW

SEQ ID NO: 22666 - protein, 11 aa, Dengue virus
EYQKTRNNDWD

SEQ ID NO: 22667 - protein, 11 aa, Dengue virus
YQKTRNNDWDY

SEQ ID NO: 22668 - protein, 11 aa, Dengue virus
QKTRNNDWDYV

SEQ ID NO: 22669 - protein, 11 aa, Dengue virus
KTRNNDWDYVV

SEQ ID NO: 22670 - protein, 11 aa, Dengue virus
TRNNDWDYVVT

SEQ ID NO: 22671 - protein, 11 aa, Dengue virus
RNNDWDYVVTT

SEQ ID NO: 22672 - protein, 11 aa, Dengue virus
AQRRGRIGRNQ

SEQ ID NO: 22673 - protein, 11 aa, Dengue virus
QRRGRIGRNQN

SEQ ID NO: 22674 - protein, 11 aa, Dengue virus
RRGRIGRNQNK

SEQ ID NO: 22675 - protein, 11 aa, Dengue virus
RGRIGRNQNKE

SEQ ID NO: 22676 - protein, 11 aa, Dengue virus
GRIGRNQNKEG

SEQ ID NO: 22677 - protein, 11 aa, Dengue virus
RIGRNQNKEGD

SEQ ID NO: 22678 - protein, 11 aa, Dengue virus
IGRNQNKEGDQ

SEQ ID NO: 22679 - protein, 11 aa, Dengue virus
GRNQNKEGDQY

SEQ ID NO: 22680 - protein, 11 aa, Dengue virus
RNQNKEGDQYV

SEQ ID NO: 22681 - protein, 11 aa, Dengue virus
NQNKEGDQYVY

SEQ ID NO: 22682 - protein, 11 aa, Dengue virus
QNKEGDQYVYM

SEQ ID NO: 22683 - protein, 11 aa, Dengue virus
NKEGDQYVYMG

SEQ ID NO: 22684 - protein, 11 aa, Dengue virus
KEGDQYVYMGQ

SEQ ID NO: 22685 - protein, 11 aa, Dengue virus
EGDQYVYMGQP

SEQ ID NO: 22686 - protein, 11 aa, Dengue virus
GDQYVYMGQPL

SEQ ID NO: 22687 - protein, 11 aa, Dengue virus
DQYVYMGQPLN

SEQ ID NO: 22688 - protein, 11 aa, Dengue virus
QYVYMGQPLNN

SEQ ID NO: 22689 - protein, 11 aa, Dengue virus
YVYMGQPLNND

SEQ ID NO: 22690 - protein, 11 aa, Dengue virus
VYMGQPLNNDE

SEQ ID NO: 22691 - protein, 11 aa, Dengue virus
YMGQPLKNDED

SEQ ID NO: 22692 - protein, 11 aa, Dengue virus
MGQPLKNDEDH

SEQ ID NO: 22693 - protein, 11 aa, Dengue virus
GQPLKNDEDHA

SEQ ID NO: 22694 - protein, 11 aa, Dengue virus
QPLKNDEDHAH

SEQ ID NO: 22695 - protein, 11 aa, Dengue virus
PLKNDEDHAHW

SEQ ID NO: 22696 - protein, 11 aa, Dengue virus
LKNDEDHAHWT

SEQ ID NO: 22697 - protein, 11 aa, Dengue virus
FEPEREKSAAV

SEQ ID NO: 22698 - protein, 11 aa, Dengue virus
EPEREKSAAVD

SEQ ID NO: 22699 - protein, 11 aa, Dengue virus
PEREKSAAVDG

SEQ ID NO: 22700 - protein, 11 aa, Dengue virus
EREKSAAVDGE

SEQ ID NO: 22701 - protein, 11 aa, Dengue virus
REKSAAVDGEY

SEQ ID NO: 22702 - protein, 11 aa, Dengue virus
EKSAAVDGEYR

SEQ ID NO: 22703 - protein, 11 aa, Dengue virus
KSAAVDGEYRL

SEQ ID NO: 22704 - protein, 11 aa, Dengue virus
SAAVDGEYRLR

SEQ ID NO: 22705 - protein, 11 aa, Dengue virus
AAVDGEYRLRG

SEQ ID NO: 22706 - protein, 11 aa, Dengue virus
AVDGEYRLRGE

SEQ ID NO: 22707 - protein, 11 aa, Dengue virus
VDGEYRLRGEA

SEQ ID NO: 22708 - protein, 11 aa, Dengue virus
RRGDLPVWLSH

SEQ ID NO: 22709 - protein, 11 aa, Dengue virus
RGDLPVWLSHK

SEQ ID NO: 22710 - protein, 11 aa, Dengue virus
GDLPVWLSHKV

SEQ ID NO: 22711 - protein, 11 aa, Dengue virus
DLPVWLSHKVA

SEQ ID NO: 22712 - protein, 11 aa, Dengue virus
LPVWLSHKVAS

SEQ ID NO: 22713 - protein, 11 aa, Dengue virus
PVWLSHKVASE

SEQ ID NO: 22714 - protein, 11 aa, Dengue virus
VWLSHKVASEG

SEQ ID NO: 22715 - protein, 11 aa, Dengue virus
WLSHKVASEGF

SEQ ID NO: 22716 - protein, 11 aa, Dengue virus
LSHKVASEGFQ

SEQ ID NO: 22717 - protein, 11 aa, Dengue virus
SHKVASEGFQY

SEQ ID NO: 22718 - protein, 11 aa, Dengue virus
HKVASEGFQYS

SEQ ID NO: 22719 - protein, 11 aa, Dengue virus
FKEFAAGRRSI

SEQ ID NO: 22720 - protein, 11 aa, Dengue virus
KEFAAGRRSIS

SEQ ID NO: 22721 - protein, 11 aa, Dengue virus
EFAAGRRSISG

SEQ ID NO: 22722 - protein, 11 aa, Dengue virus
FAAGRRSISGD

SEQ ID NO: 22723 - protein, 11 aa, Dengue virus
AAGRRSISGDL

SEQ ID NO: 22724 - protein, 11 aa, Dengue virus
AGRRSISGDLI

SEQ ID NO: 22725 - protein, 11 aa, Dengue virus
GRRSVSGDLIS

SEQ ID NO: 22726 - protein, 11 aa, Dengue virus
RRSVSGDLISE

SEQ ID NO: 22727 - protein, 11 aa, Dengue virus
RSVSGDLISEI

SEQ ID NO: 22728 - protein, 11 aa, Dengue virus
SVSGDLISEIG

SEQ ID NO: 22729 - protein, 11 aa, Dengue virus
VSGDLISEIGK

SEQ ID NO: 22730 - protein, 11 aa, Dengue virus
SGDLISEIGKL

SEQ ID NO: 22731 - protein, 11 aa, Dengue virus
GDLISEIGKLP

SEQ ID NO: 22732 - protein, 11 aa, Dengue virus
EIGKLPQHLTL

SEQ ID NO: 22733 - protein, 11 aa, Dengue virus
IGKLPQHLTLR

SEQ ID NO: 22734 - protein, 11 aa, Dengue virus
GKLPQHLTLRA

SEQ ID NO: 22735 - protein, 11 aa, Dengue virus
KLPQHLTLRAQ

SEQ ID NO: 22736 - protein, 11 aa, Dengue virus
LPQHLTLRAQN

SEQ ID NO: 22737 - protein, 11 aa, Dengue virus
PQHLTLRAQNA

SEQ ID NO: 22738 - protein, 11 aa, Dengue virus
QHLTLRAQNAL

SEQ ID NO: 22739 - protein, 11 aa, Dengue virus
HLTLRAQNALD

SEQ ID NO: 22740 - protein, 11 aa, Dengue virus
LTLRAQNALDN

SEQ ID NO: 22741 - protein, 11 aa, Dengue virus
TLRAQNALDNL

SEQ ID NO: 22742 - protein, 11 aa, Dengue virus
LRAQNALDNLV

SEQ ID NO: 22743 - protein, 11 aa, Dengue virus
KAQNALDNLVM

SEQ ID NO: 22744 - protein, 11 aa, Dengue virus
VMLHNSEQGGK

SEQ ID NO: 22745 - protein, 11 aa, Dengue virus
MLHNSEQGGKA

SEQ ID NO: 22746 - protein, 11 aa, Dengue virus
LHNSEQGGKAY

SEQ ID NO: 22747 - protein, 11 aa, Dengue virus
HNSEQGGKAYR

SEQ ID NO: 22748 - protein, 11 aa, Dengue virus
NSEQGGKAYRH

SEQ ID NO: 22749 - protein, 11 aa, Dengue virus
SEQGGKAYRHA

SEQ ID NO: 22750 - protein, 11 aa, Dengue virus
EQGGKAYRHAM

SEQ ID NO: 22751 - protein, 11 aa, Dengue virus
QGGKAYRHAME

SEQ ID NO: 22752 - protein, 11 aa, Dengue virus
GGKAYRHAMEE

SEQ ID NO: 22753 - protein, 11 aa, Dengue virus
GKAYRHAMEEL

SEQ ID NO: 22754 - protein, 11 aa, Dengue virus
KAYRHAMEELP

SEQ ID NO: 22755 - protein, 11 aa, Dengue virus
AYRHALEELPD

SEQ ID NO: 22756 - protein, 11 aa, Dengue virus
YRHALEELPDT

SEQ ID NO: 22757 - protein, 11 aa, Dengue virus
RHALEELPDTI

SEQ ID NO: 22758 - protein, 11 aa, Dengue virus
HALEELPDTIE

SEQ ID NO: 22759 - protein, 11 aa, Dengue virus
ALEELPDTIET

SEQ ID NO: 22760 - protein, 11 aa, Dengue virus
MEELPDTIETI

SEQ ID NO: 22761 - protein, 11 aa, Dengue virus
EELPDTIETIM

SEQ ID NO: 22762 - protein, 11 aa, Dengue virus
ELPDTIETIML

SEQ ID NO: 22763 - protein, 11 aa, Dengue virus
LPDTIETIMLL

SEQ ID NO: 22764 - protein, 11 aa, Dengue virus
PDTIETIMLLA

SEQ ID NO: 22765 - protein, 11 aa, Dengue virus
DTIETIMLLAL

SEQ ID NO: 22766 - protein, 11 aa, Dengue virus
TIETIMLLALI

SEQ ID NO: 22767 - protein, 11 aa, Dengue virus
IETIMLLALIA

SEQ ID NO: 22768 - protein, 11 aa, Dengue virus
ETIMLLALIAV

SEQ ID NO: 22769 - protein, 11 aa, Dengue virus
TIMLLALIAVL

SEQ ID NO: 22770 - protein, 11 aa, Dengue virus
IMLLALIAVLT

SEQ ID NO: 22771 - protein, 11 aa, Dengue virus
ALIAVLTGGVM

SEQ ID NO: 22772 - protein, 11 aa, Dengue virus
LIAVLTGGVML

SEQ ID NO: 22773 - protein, 11 aa, Dengue virus
IAVLTGGVMLF

SEQ ID NO: 22774 - protein, 11 aa, Dengue virus
AVLTGGVMLFF

SEQ ID NO: 22775 - protein, 11 aa, Dengue virus
VLTGGVMLFFL

SEQ ID NO: 22776 - protein, 11 aa, Dengue virus
LTGGVMLFFLS

SEQ ID NO: 22777 - protein, 11 aa, Dengue virus
TGGVMLFFLSG

SEQ ID NO: 22778 - protein, 11 aa, Dengue virus
GGVTLFFLSGK

SEQ ID NO: 22779 - protein, 11 aa, Dengue virus
GVTLFFLSGKG

SEQ ID NO: 22780 - protein, 11 aa, Dengue virus
VTLFFLSGKGL

SEQ ID NO: 22781 - protein, 11 aa, Dengue virus
TLFFLSGKGLG

SEQ ID NO: 22782 - protein, 11 aa, Dengue virus
LFFLSGKGLGK

SEQ ID NO: 22783 - protein, 11 aa, Dengue virus
FFLSGKGLGKT

SEQ ID NO: 22784 - protein, 11 aa, Dengue virus
FLSGKGLGKTS

SEQ ID NO: 22785 - protein, 11 aa, Dengue virus
LSGKGLGKTSI

SEQ ID NO: 22786 - protein, 11 aa, Dengue virus
SGKGLGKTSIG

SEQ ID NO: 22787 - protein, 11 aa, Dengue virus
GKGLGKTSIGL

SEQ ID NO: 22788 - protein, 11 aa, Dengue virus
KGLGKTSIGLL

SEQ ID NO: 22789 - protein, 11 aa, Dengue virus
GKTSIGLLCVT

SEQ ID NO: 22790 - protein, 11 aa, Dengue virus
KTSIGLLCVTA

SEQ ID NO: 22791 - protein, 11 aa, Dengue virus
TSIGLLCVTAS

SEQ ID NO: 22792 - protein, 11 aa, Dengue virus
SIGLLCVTASS

SEQ ID NO: 22793 - protein, 11 aa, Dengue virus
SSALLWMASVE

SEQ ID NO: 22794 - protein, 11 aa, Dengue virus
SALLWMASVEP

SEQ ID NO: 22795 - protein, 11 aa, Dengue virus
ALLWMASVEPH

SEQ ID NO: 22796 - protein, 11 aa, Dengue virus
LLWMANVEPHW

SEQ ID NO: 22797 - protein, 11 aa, Dengue virus
LWMANVEPHWI

SEQ ID NO: 22798 - protein, 11 aa, Dengue virus
WMANVEPHWIA

SEQ ID NO: 22799 - protein, 11 aa, Dengue virus
MANVEPHWIAA

SEQ ID NO: 22800 - protein, 11 aa, Dengue virus
ANVEPHWIAAS

SEQ ID NO: 22801 - protein, 11 aa, Dengue virus
NVEPHWIAASI

SEQ ID NO: 22802 - protein, 11 aa, Dengue virus
LAYVVIGLLFI

SEQ ID NO: 22803 - protein, 11 aa, Dengue virus
AYVVIGLLFII

SEQ ID NO: 22804 - protein, 11 aa, Dengue virus
YVVIGLLFVIL

SEQ ID NO: 22805 - protein, 11 aa, Dengue virus
VVIGLLFVILT

SEQ ID NO: 22806 - protein, 11 aa, Dengue virus
VIGLLFVILTV

SEQ ID NO: 22807 - protein, 11 aa, Dengue virus
IGLLFIILTVA

SEQ ID NO: 22808 - protein, 11 aa, Dengue virus
GLLFIILTVAA

SEQ ID NO: 22809 - protein, 11 aa, Dengue virus
LLFIILTVAAN

SEQ ID NO: 22810 - protein, 11 aa, Dengue virus
LFIILTVAANE

SEQ ID NO: 22811 - protein, 11 aa, Dengue virus
FIILTVAANEM

SEQ ID NO: 22812 - protein, 11 aa, Dengue virus
IILTVAANEMG

SEQ ID NO: 22813 - protein, 11 aa, Dengue virus
ETTKKDLGIGY

SEQ ID NO: 22814 - protein, 11 aa, Dengue virus
TTKKDLGIGYV

SEQ ID NO: 22815 - protein, 11 aa, Dengue virus
TKKDLGIGYVA

SEQ ID NO: 22816 - protein, 11 aa, Dengue virus
TMLDVDLHPAS

SEQ ID NO: 22817 - protein, 11 aa, Dengue virus
MLDVDLRPASA

SEQ ID NO: 22818 - protein, 11 aa, Dengue virus
LDVDLRPASAW

SEQ ID NO: 22819 - protein, 11 aa, Dengue virus
DVDLRPASAWT

SEQ ID NO: 22820 - protein, 11 aa, Dengue virus
VDLRPASAWTL

SEQ ID NO: 22821 - protein, 11 aa, Dengue virus
DLRPASAWTLY

SEQ ID NO: 22822 - protein, 11 aa, Dengue virus
LRPASAWTLYA

SEQ ID NO: 22823 - protein, 11 aa, Dengue virus
RPASAWTLYAV

SEQ ID NO: 22824 - protein, 11 aa, Dengue virus
AWTLYAVATTV

SEQ ID NO: 22825 - protein, 11 aa, Dengue virus
WTLYAVATTVI

SEQ ID NO: 22826 - protein, 11 aa, Dengue virus
TLYAVATTVIT

SEQ ID NO: 22827 - protein, 11 aa, Dengue virus
LYAVATTVITP

SEQ ID NO: 22828 - protein, 11 aa, Dengue virus
YAVATTVITPM

SEQ ID NO: 22829 - protein, 11 aa, Dengue virus
AVATTVITPMM

SEQ ID NO: 22830 - protein, 11 aa, Dengue virus
VATTVITPMMR

SEQ ID NO: 22831 - protein, 11 aa, Dengue virus
ATTVITPMMRH

SEQ ID NO: 22832 - protein, 11 aa, Dengue virus
TTVITPMMRHT

SEQ ID NO: 22833 - protein, 11 aa, Dengue virus
TVITPMMRHTI

SEQ ID NO: 22834 - protein, 11 aa, Dengue virus
VITPMMRHTIE

SEQ ID NO: 22835 - protein, 11 aa, Dengue virus
DKGWPISKMDL

SEQ ID NO: 22836 - protein, 11 aa, Dengue virus
KGWPISKMDLG

SEQ ID NO: 22837 - protein, 11 aa, Dengue virus
GWPISKMDLGV

SEQ ID NO: 22838 - protein, 11 aa, Dengue virus
WPISKMDLGVP

SEQ ID NO: 22839 - protein, 11 aa, Dengue virus
PISKMDLGVPL

SEQ ID NO: 22840 - protein, 11 aa, Dengue virus
ISKMDLGVPLL

SEQ ID NO: 22841 - protein, 11 aa, Dengue virus
KMDLGVPLLAL

SEQ ID NO: 22842 - protein, 11 aa, Dengue virus
CYSQVNPLTLI

SEQ ID NO: 22843 - protein, 11 aa, Dengue virus
YSQVNPLTLIA

SEQ ID NO: 22844 - protein, 11 aa, Dengue virus
SQVNPLTLIAA

SEQ ID NO: 22845 - protein, 11 aa, Dengue virus
QVNPLTLIAAV

SEQ ID NO: 22846 - protein, 11 aa, Dengue virus
VNPLTLIAAVL

SEQ ID NO: 22847 - protein, 11 aa, Dengue virus
NPLTLIAAVLM

SEQ ID NO: 22848 - protein, 11 aa, Dengue virus
PLTLIAAVLML

SEQ ID NO: 22849 - protein, 11 aa, Dengue virus
LTLIAAVLMLV

SEQ ID NO: 22850 - protein, 11 aa, Dengue virus
TLIAAVLMLVA

SEQ ID NO: 22851 - protein, 11 aa, Dengue virus
LIAAVLMLVAH

SEQ ID NO: 22852 - protein, 11 aa, Dengue virus
IAAVLMLVAHY

SEQ ID NO: 22853 - protein, 11 aa, Dengue virus
AAVLMLLAHYA

SEQ ID NO: 22854 - protein, 11 aa, Dengue virus
AVLMLLAHYAI

SEQ ID NO: 22855 - protein, 11 aa, Dengue virus
VLMLLAHYAII

SEQ ID NO: 22856 - protein, 11 aa, Dengue virus
LMLLAHYAIIG

SEQ ID NO: 22857 - protein, 11 aa, Dengue virus
TAAGIMKNPTI

SEQ ID NO: 22858 - protein, 11 aa, Dengue virus
AAGIMKNPTID

SEQ ID NO: 22859 - protein, 11 aa, Dengue virus
AGIMKNPTIDG

SEQ ID NO: 22860 - protein, 11 aa, Dengue virus
GIMKNPTIDGI

SEQ ID NO: 22861 - protein, 11 aa, Dengue virus
IMKNPTIDGIV

SEQ ID NO: 22862 - protein, 11 aa, Dengue virus
MKNPTIDGIVA

SEQ ID NO: 22863 - protein, 11 aa, Dengue virus
KNPTIDGIVAI

SEQ ID NO: 22864 - protein, 11 aa, Dengue virus
NPTIDGIVAID

SEQ ID NO: 22865 - protein, 11 aa, Dengue virus
PTIDGIVAIDL

SEQ ID NO: 22866 - protein, 11 aa, Dengue virus
TIDGIVAIDLD

SEQ ID NO: 22867 - protein, 11 aa, Dengue virus
IDGIVAIDLDP

SEQ ID NO: 22868 - protein, 11 aa, Dengue virus
DGIVTIDLDPV

SEQ ID NO: 22869 - protein, 11 aa, Dengue virus
GIVTIDLDPVV

SEQ ID NO: 22870 - protein, 11 aa, Dengue virus
IVTIDLDPVVY

SEQ ID NO: 22871 - protein, 11 aa, Dengue virus
VTIDLDPVVYD

SEQ ID NO: 22872 - protein, 11 aa, Dengue virus
AIDLDPVVYDT

SEQ ID NO: 22873 - protein, 11 aa, Dengue virus
IDLDPVVYDTK

SEQ ID NO: 22874 - protein, 11 aa, Dengue virus
DLDPVVYDTKF

SEQ ID NO: 22875 - protein, 11 aa, Dengue virus
LDPVVYDTKFE

SEQ ID NO: 22876 - protein, 11 aa, Dengue virus
DPVVYDTKFEK

SEQ ID NO: 22877 - protein, 11 aa, Dengue virus
PVVYDTKFEKQ

SEQ ID NO: 22878 - protein, 11 aa, Dengue virus
VVYDTKFEKQL

SEQ ID NO: 22879 - protein, 11 aa, Dengue virus
VYDTKFEKQLG

SEQ ID NO: 22880 - protein, 11 aa, Dengue virus
YDTKFEKQLGQ

SEQ ID NO: 22881 - protein, 11 aa, Dengue virus
DTKFEKQLGQI

SEQ ID NO: 22882 - protein, 11 aa, Dengue virus
TKFEKQLGQIM

SEQ ID NO: 22883 - protein, 11 aa, Dengue virus
EKQLGQVMLLI

SEQ ID NO: 22884 - protein, 11 aa, Dengue virus
KQLGQVMLLIL

SEQ ID NO: 22885 - protein, 11 aa, Dengue virus
QLGQVMLLILC

SEQ ID NO: 22886 - protein, 11 aa, Dengue virus
LGQVMLLILCT

SEQ ID NO: 22887 - protein, 11 aa, Dengue virus
GQVMLLILCTS

SEQ ID NO: 22888 - protein, 11 aa, Dengue virus
QVMLLILCTSQ

SEQ ID NO: 22889 - protein, 11 aa, Dengue virus
VMLLILCTSQI

SEQ ID NO: 22890 - protein, 11 aa, Dengue virus
LNQLSKSEFNI

SEQ ID NO: 22891 - protein, 11 aa, Dengue virus
NQLSKSEFNIY

SEQ ID NO: 22892 - protein, 11 aa, Dengue virus
QLSKSEFNIYK

SEQ ID NO: 22893 - protein, 11 aa, Dengue virus
LSKSEFNIYKR

SEQ ID NO: 22894 - protein, 11 aa, Dengue virus
SKSEFNIYKRS

SEQ ID NO: 22895 - protein, 11 aa, Dengue virus
KSEFNIYKRSG

SEQ ID NO: 22896 - protein, 11 aa, Dengue virus
SEFNIYKRSGI

SEQ ID NO: 22897 - protein, 11 aa, Dengue virus
EFNIYKRSGIM

SEQ ID NO: 22898 - protein, 11 aa, Dengue virus
FNIYKRSGIME

SEQ ID NO: 22899 - protein, 11 aa, Dengue virus
NIYKRSGIMEV

SEQ ID NO: 22900 - protein, 11 aa, Dengue virus
IYKRSGIMEVD

SEQ ID NO: 22901 - protein, 11 aa, Dengue virus
YKRSGIIEVDR

SEQ ID NO: 22902 - protein, 11 aa, Dengue virus
KRSGIIEVDRS

SEQ ID NO: 22903 - protein, 11 aa, Dengue virus
RSGIIEVDRSE

SEQ ID NO: 22904 - protein, 11 aa, Dengue virus
SGIIEVDRSEA

SEQ ID NO: 22905 - protein, 11 aa, Dengue virus
GIIEVDRSEAK

SEQ ID NO: 22906 - protein, 11 aa, Dengue virus
IIEVDRSEAKE

SEQ ID NO: 22907 - protein, 11 aa, Dengue virus
IEVDRSEAKEG

SEQ ID NO: 22908 - protein, 11 aa, Dengue virus
VDRSEAKEGLR

SEQ ID NO: 22909 - protein, 11 aa, Dengue virus
DRSEAKEGLRR

SEQ ID NO: 22910 - protein, 11 aa, Dengue virus
RSEAKEGLRRG

SEQ ID NO: 22911 - protein, 11 aa, Dengue virus
SEAKEGLRRGE

SEQ ID NO: 22912 - protein, 11 aa, Dengue virus
EAKEGLRRGET

SEQ ID NO: 22913 - protein, 11 aa, Dengue virus
AKEGLRRGETT

SEQ ID NO: 22914 - protein, 11 aa, Dengue virus
KEGLKRGETTR

SEQ ID NO: 22915 - protein, 11 aa, Dengue virus
EGLKRGETTRH

SEQ ID NO: 22916 - protein, 11 aa, Dengue virus
GLKRGETTRHA

SEQ ID NO: 22917 - protein, 11 aa, Dengue virus
LKRGETTRHAV

SEQ ID NO: 22918 - protein, 11 aa, Dengue virus
KRGETTRHAVS

SEQ ID NO: 22919 - protein, 11 aa, Dengue virus
RGETTRHAVSR

SEQ ID NO: 22920 - protein, 11 aa, Dengue virus
GETTRHAVSRG

SEQ ID NO: 22921 - protein, 11 aa, Dengue virus
ETTRHAVSRGT

SEQ ID NO: 22922 - protein, 11 aa, Dengue virus
TTRHAVSRGTA

SEQ ID NO: 22923 - protein, 11 aa, Dengue virus
TRHAVSRGTAK

SEQ ID NO: 22924 - protein, 11 aa, Dengue virus
RHAVSRGTAKL

SEQ ID NO: 22925 - protein, 11 aa, Dengue virus
TEVKGYTKGGL

SEQ ID NO: 22926 - protein, 11 aa, Dengue virus
EVKGYTKGGLG

SEQ ID NO: 22927 - protein, 11 aa, Dengue virus
VKGYTKGGLGH

SEQ ID NO: 22928 - protein, 11 aa, Dengue virus
KGYTKGGAGHE

SEQ ID NO: 22929 - protein, 11 aa, Dengue virus
GYTKGGAGHEE

SEQ ID NO: 22930 - protein, 11 aa, Dengue virus
YTKGGAGHEEP

SEQ ID NO: 22931 - protein, 11 aa, Dengue virus
TKGGPGHEEPV

SEQ ID NO: 22932 - protein, 11 aa, Dengue virus
KGGPGHEEPVP

SEQ ID NO: 22933 - protein, 11 aa, Dengue virus
GGPGHEEPVPM

SEQ ID NO: 22934 - protein, 11 aa, Dengue virus
GPGHEEPVPMA

SEQ ID NO: 22935 - protein, 11 aa, Dengue virus
PGHEEPVPMAT

SEQ ID NO: 22936 - protein, 11 aa, Dengue virus
GHEEPVPMATY

SEQ ID NO: 22937 - protein, 11 aa, Dengue virus
HEEPVPMATYG

SEQ ID NO: 22938 - protein, 11 aa, Dengue virus
EEPVPMATYGW

SEQ ID NO: 22939 - protein, 11 aa, Dengue virus
EPVPMATYGWN

SEQ ID NO: 22940 - protein, 11 aa, Dengue virus
PVPMATYGWNL

SEQ ID NO: 22941 - protein, 11 aa, Dengue virus
VPMATYGWNLV

SEQ ID NO: 22942 - protein, 11 aa, Dengue virus
PMATYGWNLVR

SEQ ID NO: 22943 - protein, 11 aa, Dengue virus
MATYGWNLVRL

SEQ ID NO: 22944 - protein, 11 aa, Dengue virus
ATYGWNLVKLY

SEQ ID NO: 22945 - protein, 11 aa, Dengue virus
TYGWNLVKLYS

SEQ ID NO: 22946 - protein, 11 aa, Dengue virus
YGWNLVKLYSG

SEQ ID NO: 22947 - protein, 11 aa, Dengue virus
GWNLVKLYSGK

SEQ ID NO: 22948 - protein, 11 aa, Dengue virus
WNLVKLYSGKD

SEQ ID NO: 22949 - protein, 11 aa, Dengue virus
NLVKLYSGKDV

SEQ ID NO: 22950 - protein, 11 aa, Dengue virus
LVKLYSGKDVF

SEQ ID NO: 22951 - protein, 11 aa, Dengue virus
VKLYSGKDVFF

SEQ ID NO: 22952 - protein, 11 aa, Dengue virus
SGKDVFFTPPE

SEQ ID NO: 22953 - protein, 11 aa, Dengue virus
GKDVFFTPPEK

SEQ ID NO: 22954 - protein, 11 aa, Dengue virus
KDVFFTPPEKC

SEQ ID NO: 22955 - protein, 11 aa, Dengue virus
DVFFTPPEKCD

SEQ ID NO: 22956 - protein, 11 aa, Dengue virus
VFFTPPEKCDT

SEQ ID NO: 22957 - protein, 11 aa, Dengue virus
FFTPPEKCDTL

SEQ ID NO: 22958 - protein, 11 aa, Dengue virus
FTPPEKCDTLL

SEQ ID NO: 22959 - protein, 11 aa, Dengue virus
TPPEKCDTLLC

SEQ ID NO: 22960 - protein, 11 aa, Dengue virus
RVLKMVEPWLK

SEQ ID NO: 22961 - protein, 11 aa, Dengue virus
VLKMVEPWLKG

SEQ ID NO: 22962 - protein, 11 aa, Dengue virus
LKMVEPWLKGN

SEQ ID NO: 22963 - protein, 11 aa, Dengue virus
LNPYMPSVVEA

SEQ ID NO: 22964 - protein, 11 aa, Dengue virus
NPYMPSVVEAL

SEQ ID NO: 22965 - protein, 11 aa, Dengue virus
PYMPSVVEALE

SEQ ID NO: 22966 - protein, 11 aa, Dengue virus
YMPSVVEALEQ

SEQ ID NO: 22967 - protein, 11 aa, Dengue virus
MPSVVEALEQM

SEQ ID NO: 22968 - protein, 11 aa, Dengue virus
PSVVEALEQMQ

SEQ ID NO: 22969 - protein, 11 aa, Dengue virus
SVVEALEQMQR

SEQ ID NO: 22970 - protein, 11 aa, Dengue virus
VVEALEQMQRK

SEQ ID NO: 22971 - protein, 11 aa, Dengue virus
VEALEQMQRKH

SEQ ID NO: 22972 - protein, 11 aa, Dengue virus
EALEQMQRKHG

SEQ ID NO: 22973 - protein, 11 aa, Dengue virus
ALEQMQRKHGG

SEQ ID NO: 22974 - protein, 11 aa, Dengue virus
LEQMQRKYGGM

SEQ ID NO: 22975 - protein, 11 aa, Dengue virus
EQMQRKYGGML

SEQ ID NO: 22976 - protein, 11 aa, Dengue virus
QMQRKYGGMLV

SEQ ID NO: 22977 - protein, 11 aa, Dengue virus
MQRKYGGMLVR

SEQ ID NO: 22978 - protein, 11 aa, Dengue virus
QRKYGGMLVRN

SEQ ID NO: 22979 - protein, 11 aa, Dengue virus
RKYGGMLVRNP

SEQ ID NO: 22980 - protein, 11 aa, Dengue virus
KYGGMLVRNPL

SEQ ID NO: 22981 - protein, 11 aa, Dengue virus
SRMLLNRFTMT

SEQ ID NO: 22982 - protein, 11 aa, Dengue virus
RMLLNRFTMTH

SEQ ID NO: 22983 - protein, 11 aa, Dengue virus
MLLNRFTMTHR

SEQ ID NO: 22984 - protein, 11 aa, Dengue virus
LLNRFTMTHRK

SEQ ID NO: 22985 - protein, 11 aa, Dengue virus
LNRFTMTHRKP

SEQ ID NO: 22986 - protein, 11 aa, Dengue virus
NRFTMTHRKPT

SEQ ID NO: 22987 - protein, 11 aa, Dengue virus
RFTMTHRKPTY

SEQ ID NO: 22988 - protein, 11 aa, Dengue virus
FTMTHRKPTYE

SEQ ID NO: 22989 - protein, 11 aa, Dengue virus
TMAHRKPTYEK

SEQ ID NO: 22990 - protein, 11 aa, Dengue virus
MAHRKPTYEKD

SEQ ID NO: 22991 - protein, 11 aa, Dengue virus
THRKPTYERDV

SEQ ID NO: 22992 - protein, 11 aa, Dengue virus
HRKPTYEKDVD

SEQ ID NO: 22993 - protein, 11 aa, Dengue virus
RKPTYEKDVDL

SEQ ID NO: 22994 - protein, 11 aa, Dengue virus
KPTYEKDVDLG

SEQ ID NO: 22995 - protein, 11 aa, Dengue virus
PTYERDVDLGT

SEQ ID NO: 22996 - protein, 11 aa, Dengue virus
TYERDVDLGTG

SEQ ID NO: 22997 - protein, 11 aa, Dengue virus
YERDVDLGTGT

SEQ ID NO: 22998 - protein, 11 aa, Dengue virus
ERDVDLGTGTR

SEQ ID NO: 22999 - protein, 11 aa, Dengue virus
RDVDLGTGTRH

SEQ ID NO: 23000 - protein, 11 aa, Dengue virus
DVDLGTGTRHV

SEQ ID NO: 23001 - protein, 11 aa, Dengue virus
VDLGTGTRHVA

SEQ ID NO: 23002 - protein, 11 aa, Dengue virus
DLGTGTRHVAV

SEQ ID NO: 23003 - protein, 11 aa, Dengue virus
LGTGTRHVAVE

SEQ ID NO: 23004 - protein, 11 aa, Dengue virus
GTGTRHVAVEP

SEQ ID NO: 23005 - protein, 11 aa, Dengue virus
TGTRHVAVEPE

SEQ ID NO: 23006 - protein, 11 aa, Dengue virus
GTRHVAVEPEI

SEQ ID NO: 23007 - protein, 11 aa, Dengue virus
TRHVAVEPEIA

SEQ ID NO: 23008 - protein, 11 aa, Dengue virus
RHVAVEPEIAN

SEQ ID NO: 23009 - protein, 11 aa, Dengue virus
VEPEIANLDII

SEQ ID NO: 23010 - protein, 11 aa, Dengue virus
EPEIANLDIIG

SEQ ID NO: 23011 - protein, 11 aa, Dengue virus
PEIANLDIIGQ

SEQ ID NO: 23012 - protein, 11 aa, Dengue virus
EIANLDIIGQR

SEQ ID NO: 23013 - protein, 11 aa, Dengue virus
IANLDIIGQRI

SEQ ID NO: 23014 - protein, 11 aa, Dengue virus
ANIDIIGQRIE

SEQ ID NO: 23015 - protein, 11 aa, Dengue virus
IIGQRIENIKN

SEQ ID NO: 23016 - protein, 11 aa, Dengue virus
IGQRIENIKNE

SEQ ID NO: 23017 - protein, 11 aa, Dengue virus
GQRIENIKNEH

SEQ ID NO: 23018 - protein, 11 aa, Dengue virus
QRIENIKNEHK

SEQ ID NO: 23019 - protein, 11 aa, Dengue virus
RIENIKNEHKS

SEQ ID NO: 23020 - protein, 11 aa, Dengue virus
IENIKNEHKST

SEQ ID NO: 23021 - protein, 11 aa, Dengue virus
ENIKNEHKSTW

SEQ ID NO: 23022 - protein, 11 aa, Dengue virus
NIKNEHKSTWH

SEQ ID NO: 23023 - protein, 11 aa, Dengue virus
IKNEHKSTWHY

SEQ ID NO: 23024 - protein, 11 aa, Dengue virus
KNEHKSTWHYD

SEQ ID NO: 23025 - protein, 11 aa, Dengue virus
NEHKSTWHYDE

SEQ ID NO: 23026 - protein, 11 aa, Dengue virus
SASSMVNGVVR

SEQ ID NO: 23027 - protein, 11 aa, Dengue virus
ASSMVNGVVRL

SEQ ID NO: 23028 - protein, 11 aa, Dengue virus
SSMVNGVVRLL

SEQ ID NO: 23029 - protein, 11 aa, Dengue virus
SMVNGVVRLLT

SEQ ID NO: 23030 - protein, 11 aa, Dengue virus
MVNGVVRLLTK

SEQ ID NO: 23031 - protein, 11 aa, Dengue virus
VNGVVRLLTKP

SEQ ID NO: 23032 - protein, 11 aa, Dengue virus
NGVVRLLTKPW

SEQ ID NO: 23033 - protein, 11 aa, Dengue virus
GVVRLLTKPWD

SEQ ID NO: 23034 - protein, 11 aa, Dengue virus
VVRLLTKPWDV

SEQ ID NO: 23035 - protein, 11 aa, Dengue virus
VRLLTKPWDVI

SEQ ID NO: 23036 - protein, 11 aa, Dengue virus
RLLTKPWDVIP

SEQ ID NO: 23037 - protein, 11 aa, Dengue virus
FKEKVDTRTPR

SEQ ID NO: 23038 - protein, 11 aa, Dengue virus
KEKVDTRTPRA

SEQ ID NO: 23039 - protein, 11 aa, Dengue virus
EKVDTRTPRAK

SEQ ID NO: 23040 - protein, 11 aa, Dengue virus
KVDTRTPRAKR

SEQ ID NO: 23041 - protein, 11 aa, Dengue virus
VDTRTPRAKRG

SEQ ID NO: 23042 - protein, 11 aa, Dengue virus
DTRTPRAKRGT

SEQ ID NO: 23043 - protein, 11 aa, Dengue virus
TRTPRAKRGTT

SEQ ID NO: 23044 - protein, 11 aa, Dengue virus
RTPRAKRGTTQ

SEQ ID NO: 23045 - protein, 11 aa, Dengue virus
TPRAKRGTTQI

SEQ ID NO: 23046 - protein, 11 aa, Dengue virus
PRAKRGTTQIM

SEQ ID NO: 23047 - protein, 11 aa, Dengue virus
KRGTTQIMEVT

SEQ ID NO: 23048 - protein, 11 aa, Dengue virus
RGTTQIMEVTA

SEQ ID NO: 23049 - protein, 11 aa, Dengue virus
QIMEVTARWLW

SEQ ID NO: 23050 - protein, 11 aa, Dengue virus
IMEVTARWLWG

SEQ ID NO: 23051 - protein, 11 aa, Dengue virus
MEVTARWLWGF

SEQ ID NO: 23052 - protein, 11 aa, Dengue virus
EVTARWLWGFL

SEQ ID NO: 23053 - protein, 11 aa, Dengue virus
VTARWLWGFLS

SEQ ID NO: 23054 - protein, 11 aa, Dengue virus
TARWLWGFLSR

SEQ ID NO: 23055 - protein, 11 aa, Dengue virus
ARWLWGFLSRN

SEQ ID NO: 23056 - protein, 11 aa, Dengue virus
RWLWGFLSRNK

SEQ ID NO: 23057 - protein, 11 aa, Dengue virus
WLWSFLSRNKK

SEQ ID NO: 23058 - protein, 11 aa, Dengue virus
LWSFLSRNKKP

SEQ ID NO: 23059 - protein, 11 aa, Dengue virus
WSFLSRNKKPR

SEQ ID NO: 23060 - protein, 11 aa, Dengue virus
SFLSRNKKPRI

SEQ ID NO: 23061 - protein, 11 aa, Dengue virus
RSNAAIGAVFI

SEQ ID NO: 23062 - protein, 11 aa, Dengue virus
SNAAIGAVFID

SEQ ID NO: 23063 - protein, 11 aa, Dengue virus
NAAIGAVFIDE

SEQ ID NO: 23064 - protein, 11 aa, Dengue virus
AAIGAVFIDEN

SEQ ID NO: 23065 - protein, 11 aa, Dengue virus
AIGAVFIDENQ

SEQ ID NO: 23066 - protein, 11 aa, Dengue virus
IGAVFIDENQW

SEQ ID NO: 23067 - protein, 11 aa, Dengue virus
GAVFIDENQWN

SEQ ID NO: 23068 - protein, 11 aa, Dengue virus
AVFIDENQWNS

SEQ ID NO: 23069 - protein, 11 aa, Dengue virus
VFIDENQWNSA

SEQ ID NO: 23070 - protein, 11 aa, Dengue virus
FIDENQWNSAK

SEQ ID NO: 23071 - protein, 11 aa, Dengue virus
IDENQWNSAKE

SEQ ID NO: 23072 - protein, 11 aa, Dengue virus
WNSAKEAVEDD

SEQ ID NO: 23073 - protein, 11 aa, Dengue virus
NSAKEAVEDDR

SEQ ID NO: 23074 - protein, 11 aa, Dengue virus
SAKEAVEDDRF

SEQ ID NO: 23075 - protein, 11 aa, Dengue virus
AKEAVEDDRFW

SEQ ID NO: 23076 - protein, 11 aa, Dengue virus
KEAVEDDRFWD

SEQ ID NO: 23077 - protein, 11 aa, Dengue virus
EAVEDDRFWDL

SEQ ID NO: 23078 - protein, 11 aa, Dengue virus
AVEDDRFWDLV

SEQ ID NO: 23079 - protein, 11 aa, Dengue virus
LVQKERELHKQ

SEQ ID NO: 23080 - protein, 11 aa, Dengue virus
VQKERELHKQG

SEQ ID NO: 23081 - protein, 11 aa, Dengue virus
QKERELHKQGK

SEQ ID NO: 23082 - protein, 11 aa, Dengue virus
KERELHKQGKC

SEQ ID NO: 23083 - protein, 11 aa, Dengue virus
EDHWFSRENSF

SEQ ID NO: 23084 - protein, 11 aa, Dengue virus
DHWFSRENSFS

SEQ ID NO: 23085 - protein, 11 aa, Dengue virus
HWFSRENSFSG

SEQ ID NO: 23086 - protein, 11 aa, Dengue virus
WFSRENSFSGV

SEQ ID NO: 23087 - protein, 11 aa, Dengue virus
FSRENSFSGVE

SEQ ID NO: 23088 - protein, 11 aa, Dengue virus
SRENSFSGVEG

SEQ ID NO: 23089 - protein, 11 aa, Dengue virus
RENSFSGVEGE

SEQ ID NO: 23090 - protein, 11 aa, Dengue virus
ENSFSGVEGEG

SEQ ID NO: 23091 - protein, 11 aa, Dengue virus
NSFSGVEGEGL

SEQ ID NO: 23092 - protein, 11 aa, Dengue virus
SFSGVEGEGLH

SEQ ID NO: 23093 - protein, 11 aa, Dengue virus
FSGVEGEGLHK

SEQ ID NO: 23094 - protein, 11 aa, Dengue virus
SGVEGEGLHRL

SEQ ID NO: 23095 - protein, 11 aa, Dengue virus
GVEGEGLHRLG

SEQ ID NO: 23096 - protein, 11 aa, Dengue virus
VEGEGLHRLGY

SEQ ID NO: 23097 - protein, 11 aa, Dengue virus
EGEGLHRLGYI

SEQ ID NO: 23098 - protein, 11 aa, Dengue virus
GEGLHRLGYIL

SEQ ID NO: 23099 - protein, 11 aa, Dengue virus
EGLHRLGYILR

SEQ ID NO: 23100 - protein, 11 aa, Dengue virus
GLHRLGYILRD

SEQ ID NO: 23101 - protein, 11 aa, Dengue virus
LHRLGYILRDI

SEQ ID NO: 23102 - protein, 11 aa, Dengue virus
HRLGYILRDIS

SEQ ID NO: 23103 - protein, 11 aa, Dengue virus
KLGYILRDISN

SEQ ID NO: 23104 - protein, 11 aa, Dengue virus
LGYILRDISNI

SEQ ID NO: 23105 - protein, 11 aa, Dengue virus
GYILRDISNIP

SEQ ID NO: 23106 - protein, 11 aa, Dengue virus
YILRDISNIPG

SEQ ID NO: 23107 - protein, 11 aa, Dengue virus
ILRDISNIPGG

SEQ ID NO: 23108 - protein, 11 aa, Dengue virus
LRDISNIPGGN

SEQ ID NO: 23109 - protein, 11 aa, Dengue virus
RDISNIPGGNM

SEQ ID NO: 23110 - protein, 11 aa, Dengue virus
DISNIPGGNMY

SEQ ID NO: 23111 - protein, 11 aa, Dengue virus
ISNIPGGNMYA

SEQ ID NO: 23112 - protein, 11 aa, Dengue virus
SNIPGGNMYAD

SEQ ID NO: 23113 - protein, 11 aa, Dengue virus
NIPGGNMYADD

SEQ ID NO: 23114 - protein, 11 aa, Dengue virus
IPGGSMYADDT

SEQ ID NO: 23115 - protein, 11 aa, Dengue virus
PGGSMYADDTA

SEQ ID NO: 23116 - protein, 11 aa, Dengue virus
GGSMYADDTAG

SEQ ID NO: 23117 - protein, 11 aa, Dengue virus
GSMYADDTAGW

SEQ ID NO: 23118 - protein, 11 aa, Dengue virus
SMYADDTAGWD

SEQ ID NO: 23119 - protein, 11 aa, Dengue virus
WDTRVTEDDLQ

SEQ ID NO: 23120 - protein, 11 aa, Dengue virus
DTRVTEDDLQN

SEQ ID NO: 23121 - protein, 11 aa, Dengue virus
TRVTEDDLQNE

SEQ ID NO: 23122 - protein, 11 aa, Dengue virus
RVTEDDLQNEA

SEQ ID NO: 23123 - protein, 11 aa, Dengue virus
ITEDDLQNEAR

SEQ ID NO: 23124 - protein, 11 aa, Dengue virus
TEDDLQNEARI

SEQ ID NO: 23125 - protein, 11 aa, Dengue virus
EDDLQNEARIT

SEQ ID NO: 23126 - protein, 11 aa, Dengue virus
DDLQNEARITD

SEQ ID NO: 23127 - protein, 11 aa, Dengue virus
DLQNEARITDI

SEQ ID NO: 23128 - protein, 11 aa, Dengue virus
LQNEARITDIM

SEQ ID NO: 23129 - protein, 11 aa, Dengue virus
QNEARITDIME

SEQ ID NO: 23130 - protein, 11 aa, Dengue virus
NEARITDIMEP

SEQ ID NO: 23131 - protein, 11 aa, Dengue virus
EARITDIMEPE

SEQ ID NO: 23132 - protein, 11 aa, Dengue virus
ARITDIMEPEH

SEQ ID NO: 23133 - protein, 11 aa, Dengue virus
RITDIMEPEHA

SEQ ID NO: 23134 - protein, 11 aa, Dengue virus
ITEIMEPEHAL

SEQ ID NO: 23135 - protein, 11 aa, Dengue virus
TEIMEPEHALL

SEQ ID NO: 23136 - protein, 11 aa, Dengue virus
EIMEPEHALLA

SEQ ID NO: 23137 - protein, 11 aa, Dengue virus
IMEPEHALLAT

SEQ ID NO: 23138 - protein, 11 aa, Dengue virus
MEPEHALLATS

SEQ ID NO: 23139 - protein, 11 aa, Dengue virus
EPEHALLATSI

SEQ ID NO: 23140 - protein, 11 aa, Dengue virus
PEHALLATSIF

SEQ ID NO: 23141 - protein, 11 aa, Dengue virus
EHALLATSIFK

SEQ ID NO: 23142 - protein, 11 aa, Dengue virus
HALLATSIFKL

SEQ ID NO: 23143 - protein, 11 aa, Dengue virus
ALLATSIFKLT

SEQ ID NO: 23144 - protein, 11 aa, Dengue virus
LLATSIFKLTY

SEQ ID NO: 23145 - protein, 11 aa, Dengue virus
LATSIFKLTYQ

SEQ ID NO: 23146 - protein, 11 aa, Dengue virus
ATSIFKLTYQN

SEQ ID NO: 23147 - protein, 11 aa, Dengue virus
TSIFKLTYQNK

SEQ ID NO: 23148 - protein, 11 aa, Dengue virus
AIFKLTYQNKV

SEQ ID NO: 23149 - protein, 11 aa, Dengue virus
QNKVVRVQRPT

SEQ ID NO: 23150 - protein, 11 aa, Dengue virus
NKVVRVQRPAR

SEQ ID NO: 23151 - protein, 11 aa, Dengue virus
KVVRVQRPAKS

SEQ ID NO: 23152 - protein, 11 aa, Dengue virus
VVRVQRPAKSG

SEQ ID NO: 23153 - protein, 11 aa, Dengue virus
VRVQRPAKSGT

SEQ ID NO: 23154 - protein, 11 aa, Dengue virus
RVQRPAKSGTV

SEQ ID NO: 23155 - protein, 11 aa, Dengue virus
VQRPAKSGTVM

SEQ ID NO: 23156 - protein, 11 aa, Dengue virus
QRPAKSGTVMD

SEQ ID NO: 23157 - protein, 11 aa, Dengue virus
RPAKSGTVMDV

SEQ ID NO: 23158 - protein, 11 aa, Dengue virus
PAKSGTVMDVI

SEQ ID NO: 23159 - protein, 11 aa, Dengue virus
AKSGTVMDVIS

SEQ ID NO: 23160 - protein, 11 aa, Dengue virus
KSGTVMDVISR

SEQ ID NO: 23161 - protein, 11 aa, Dengue virus
SGTVMDVISRR

SEQ ID NO: 23162 - protein, 11 aa, Dengue virus
TYGLNTFTNMG

SEQ ID NO: 23163 - protein, 11 aa, Dengue virus
YGLNTFTNMEV

SEQ ID NO: 23164 - protein, 11 aa, Dengue virus
GLNTFTNMEVQ

SEQ ID NO: 23165 - protein, 11 aa, Dengue virus
LNTFTNMEVQL

SEQ ID NO: 23166 - protein, 11 aa, Dengue virus
NTFTNMEVQLI

SEQ ID NO: 23167 - protein, 11 aa, Dengue virus
TFTNMEVQLIR

SEQ ID NO: 23168 - protein, 11 aa, Dengue virus
FTNMEVQLIRQ

SEQ ID NO: 23169 - protein, 11 aa, Dengue virus
TNMEVQLIRQM

SEQ ID NO: 23170 - protein, 11 aa, Dengue virus
NMEVQLIRQME

SEQ ID NO: 23171 - protein, 11 aa, Dengue virus
MEVQLIRQMES

SEQ ID NO: 23172 - protein, 11 aa, Dengue virus
EVQLIRQMESE

SEQ ID NO: 23173 - protein, 11 aa, Dengue virus
VQLIRQMESEG

SEQ ID NO: 23174 - protein, 11 aa, Dengue virus
QLIRQMESEEI

SEQ ID NO: 23175 - protein, 11 aa, Dengue virus
LIRQMESEEIF

SEQ ID NO: 23176 - protein, 11 aa, Dengue virus
IRQMESEGIFL

SEQ ID NO: 23177 - protein, 11 aa, Dengue virus
RQMESEGIFLP

SEQ ID NO: 23178 - protein, 11 aa, Dengue virus
ERLRRMAISGD

SEQ ID NO: 23179 - protein, 11 aa, Dengue virus
RLRRMAISGDD

SEQ ID NO: 23180 - protein, 11 aa, Dengue virus
LRRMAISGDDC

SEQ ID NO: 23181 - protein, 11 aa, Dengue virus
RRMAISGDDCV

SEQ ID NO: 23182 - protein, 11 aa, Dengue virus
ISGDDCVVKPT

SEQ ID NO: 23183 - protein, 11 aa, Dengue virus
SGDDCVVKPTD

SEQ ID NO: 23184 - protein, 11 aa, Dengue virus
GDDCVVKPTDD

SEQ ID NO: 23185 - protein, 11 aa, Dengue virus
DDCVVKPTDDR

SEQ ID NO: 23186 - protein, 11 aa, Dengue virus
DCVVKPTDDRF

SEQ ID NO: 23187 - protein, 11 aa, Dengue virus
CVVKPTDDRFA

SEQ ID NO: 23188 - protein, 11 aa, Dengue virus
VVKPTDDRFAT

SEQ ID NO: 23189 - protein, 11 aa, Dengue virus
VKPTDDRFATA

SEQ ID NO: 23190 - protein, 11 aa, Dengue virus
KPTDDRFATAL

SEQ ID NO: 23191 - protein, 11 aa, Dengue virus
DDRFATALIAL

SEQ ID NO: 23192 - protein, 11 aa, Dengue virus
DRFATALIALN

SEQ ID NO: 23193 - protein, 11 aa, Dengue virus
RFATALIALND

SEQ ID NO: 23194 - protein, 11 aa, Dengue virus
FATALIALNDM

SEQ ID NO: 23195 - protein, 11 aa, Dengue virus
ATALIALNDMG

SEQ ID NO: 23196 - protein, 11 aa, Dengue virus
TALIALNDMGK

SEQ ID NO: 23197 - protein, 11 aa, Dengue virus
ALIALNDMGKV

SEQ ID NO: 23198 - protein, 11 aa, Dengue virus
LIALNDMGKVR

SEQ ID NO: 23199 - protein, 11 aa, Dengue virus
IALNDMGKVRK

SEQ ID NO: 23200 - protein, 11 aa, Dengue virus
LNDMGKVRKDV

SEQ ID NO: 23201 - protein, 11 aa, Dengue virus
NDMGKVRKDVP

SEQ ID NO: 23202 - protein, 11 aa, Dengue virus
DMGKVRKDVPQ

SEQ ID NO: 23203 - protein, 11 aa, Dengue virus
MGKVRKDVPQW

SEQ ID NO: 23204 - protein, 11 aa, Dengue virus
GKVRKDVPQWE

SEQ ID NO: 23205 - protein, 11 aa, Dengue virus
KVRKDVPQWEP

SEQ ID NO: 23206 - protein, 11 aa, Dengue virus
VRKDVPQWEPS

SEQ ID NO: 23207 - protein, 11 aa, Dengue virus
RKDVPQWEPSK

SEQ ID NO: 23208 - protein, 11 aa, Dengue virus
KDVPQWEPSKG

SEQ ID NO: 23209 - protein, 11 aa, Dengue virus
DVPQWEPSKGW

SEQ ID NO: 23210 - protein, 11 aa, Dengue virus
VPQWEPSKGWN

SEQ ID NO: 23211 - protein, 11 aa, Dengue virus
VSQGAGWSLKE

SEQ ID NO: 23212 - protein, 11 aa, Dengue virus
GAGWSLKETAC

SEQ ID NO: 23213 - protein, 11 aa, Dengue virus
AGWSLKETACL

SEQ ID NO: 23214 - protein, 11 aa, Dengue virus
GWSLKETACLG

SEQ ID NO: 23215 - protein, 11 aa, Dengue virus
WSLKETACLGK

SEQ ID NO: 23216 - protein, 11 aa, Dengue virus
SLKETACLGKS

SEQ ID NO: 23217 - protein, 11 aa, Dengue virus
RLAANAICSAD

SEQ ID NO: 23218 - protein, 11 aa, Dengue virus
LAANAICSADP

SEQ ID NO: 23219 - protein, 11 aa, Dengue virus
AANAICSAVPI

SEQ ID NO: 23220 - protein, 11 aa, Dengue virus
PVDWIPTSRTT

SEQ ID NO: 23221 - protein, 11 aa, Dengue virus
VDWIPTSRTTW

SEQ ID NO: 23222 - protein, 11 aa, Dengue virus
DWIPTSRTTWS

SEQ ID NO: 23223 - protein, 11 aa, Dengue virus
WIPTSRTTWSI

SEQ ID NO: 23224 - protein, 11 aa, Dengue virus
IPTSRTTWSIH

SEQ ID NO: 23225 - protein, 11 aa, Dengue virus
EENPWMEDKTR

SEQ ID NO: 23226 - protein, 11 aa, Dengue virus
ENPWMEDKTHV

SEQ ID NO: 23227 - protein, 11 aa, Dengue virus
NPWMEDKTHVS

SEQ ID NO: 23228 - protein, 11 aa, Dengue virus
PWMEDKTHVSS

SEQ ID NO: 23229 - protein, 11 aa, Dengue virus
WMEDKTHVSSW

SEQ ID NO: 23230 - protein, 11 aa, Dengue virus
MEDKTHVSSWE

SEQ ID NO: 23231 - protein, 11 aa, Dengue virus
VSSWEEVPYLG

SEQ ID NO: 23232 - protein, 11 aa, Dengue virus
SSWEDVPYLGK

SEQ ID NO: 23233 - protein, 11 aa, Dengue virus
SWEDVPYLGKR

SEQ ID NO: 23234 - protein, 11 aa, Dengue virus
WEDVPYLGKRE

SEQ ID NO: 23235 - protein, 11 aa, Dengue virus
EDVPYLGKRED

SEQ ID NO: 23236 - protein, 11 aa, Dengue virus
EVPYLGKREDQ

SEQ ID NO: 23237 - protein, 11 aa, Dengue virus
IGLTARATWAS

SEQ ID NO: 23238 - protein, 11 aa, Dengue virus
GLTARATWASN

SEQ ID NO: 23239 - protein, 11 aa, Dengue virus
LTARATWASNI

SEQ ID NO: 23240 - protein, 11 aa, Dengue virus
TARATWASNIQ

SEQ ID NO: 23241 - protein, 11 aa, Dengue virus
ARATWASNIQV

SEQ ID NO: 23242 - protein, 11 aa, Dengue virus
RATWASNIQVA

SEQ ID NO: 23243 - protein, 11 aa, Dengue virus
ATWASNIQVAI

SEQ ID NO: 23244 - protein, 11 aa, Dengue virus
TWASNIQVAIN

SEQ ID NO: 23245 - protein, 11 aa, Dengue virus
WASNIQVAINQ

SEQ ID NO: 23246 - protein, 11 aa, Dengue virus
ASNIQVAINQV

SEQ ID NO: 23247 - protein, 11 aa, Dengue virus
SNIQVAINQVR

SEQ ID NO: 23248 - protein, 11 aa, Dengue virus
QVAINQVRRLL

SEQ ID NO: 23249 - protein, 11 aa, Dengue virus
VAINQVRRLLG

SEQ ID NO: 23250 - protein, 11 aa, Dengue virus
AINQVRRLLGN

SEQ ID NO: 23251 - protein, 11 aa, Dengue virus
INQVRRLLGNE

SEQ ID NO: 23252 - protein, 11 aa, Dengue virus
NQVRRLLGNEN

SEQ ID NO: 23253 - protein, 11 aa, Dengue virus
QVRRLLGNENY

SEQ ID NO: 23254 - protein, 11 aa, Dengue virus
VRRLLGNENYL

SEQ ID NO: 23255 - protein, 11 aa, Dengue virus
RRLLGNENYLD

SEQ ID NO: 23256 - protein, 11 aa, Dengue virus
RLLGNENYLDY

SEQ ID NO: 23257 - protein, 11 aa, Dengue virus
LLGNENYLDYM

SEQ ID NO: 23258 - protein, 11 aa, Dengue virus
LGNENYLDYMT

SEQ ID NO: 23259 - protein, 11 aa, Dengue virus
GNENYSDYMTS

SEQ ID NO: 23260 - protein, 11 aa, Dengue virus
NENYSDYMTSM

SEQ ID NO: 23261 - protein, 11 aa, Dengue virus
ENYSDYMTSMK

SEQ ID NO: 23262 - protein, 11 aa, Dengue virus
NYSDYMTSMKR

SEQ ID NO: 23263 - protein, 11 aa, Dengue virus
YSDYMTSMKRF

SEQ ID NO: 23264 - protein, 11 aa, Dengue virus
SDYMTSMKRFK

SEQ ID NO: 23265 - protein, 11 aa, Dengue virus
DYMISMKRFKN

SEQ ID NO: 23266 - protein, 11 aa, Dengue virus
YMISMKRFKNE

SEQ ID NO: 23267 - protein, 11 aa, Dengue virus
MNNQRKKTGQP

SEQ ID NO: 23268 - protein, 11 aa, Dengue virus
NNQRKKTGQPS

SEQ ID NO: 23269 - protein, 11 aa, Dengue virus
NQRKKTGQPSF

SEQ ID NO: 23270 - protein, 11 aa, Dengue virus
QRKKTGQPSFN

SEQ ID NO: 23271 - protein, 11 aa, Dengue virus
RKKTGQPSFNM

SEQ ID NO: 23272 - protein, 11 aa, Dengue virus
KKTGQPSFNML

SEQ ID NO: 23273 - protein, 11 aa, Dengue virus
KTGQPSFNMLK

SEQ ID NO: 23274 - protein, 11 aa, Dengue virus
TGQPSFNMLKR

SEQ ID NO: 23275 - protein, 11 aa, Dengue virus
GQPSFNMLKRA

SEQ ID NO: 23276 - protein, 11 aa, Dengue virus
GLLSGQGPMKF

SEQ ID NO: 23277 - protein, 11 aa, Dengue virus
LLSGQGPMKFV

SEQ ID NO: 23278 - protein, 11 aa, Dengue virus
LSGQGPMKFVM

SEQ ID NO: 23279 - protein, 11 aa, Dengue virus
SGQGPMKFVMA

SEQ ID NO: 23280 - protein, 11 aa, Dengue virus
GQGPMKFVMAF

SEQ ID NO: 23281 - protein, 11 aa, Dengue virus
QGPMKFVMAFI

SEQ ID NO: 23282 - protein, 11 aa, Dengue virus
GPMKFVMAFIA

SEQ ID NO: 23283 - protein, 11 aa, Dengue virus
PMKFVMAFIAF

SEQ ID NO: 23284 - protein, 11 aa, Dengue virus
MKFVMAFIAFL

SEQ ID NO: 23285 - protein, 11 aa, Dengue virus
KFVMAFIAFLR

SEQ ID NO: 23286 - protein, 11 aa, Dengue virus
FVMAFIAFLRF

SEQ ID NO: 23287 - protein, 11 aa, Dengue virus
ILARWSSFKKN

SEQ ID NO: 23288 - protein, 11 aa, Dengue virus
LARWSSFKKNG

SEQ ID NO: 23289 - protein, 11 aa, Dengue virus
ARWSSFKKNGA

SEQ ID NO: 23290 - protein, 11 aa, Dengue virus
RWSSFKKNGAI

SEQ ID NO: 23291 - protein, 11 aa, Dengue virus
WSSFKKNGAIK

SEQ ID NO: 23292 - protein, 11 aa, Dengue virus
SSFKKNGAIKV

SEQ ID NO: 23293 - protein, 11 aa, Dengue virus
FKKNGAIRVLR

SEQ ID NO: 23294 - protein, 11 aa, Dengue virus
KKNGAIRVLRG

SEQ ID NO: 23295 - protein, 11 aa, Dengue virus
KNGAIRVLRGF

SEQ ID NO: 23296 - protein, 11 aa, Dengue virus
NGAIRVLRGFK

SEQ ID NO: 23297 - protein, 11 aa, Dengue virus
GAIRVLRGFKK

SEQ ID NO: 23298 - protein, 11 aa, Dengue virus
IKVLRGFKREI

SEQ ID NO: 23299 - protein, 11 aa, Dengue virus
KVLRGFKREIS

SEQ ID NO: 23300 - protein, 11 aa, Dengue virus
VLRGFKKEVSN

SEQ ID NO: 23301 - protein, 11 aa, Dengue virus
LRGFKKEVSNM

SEQ ID NO: 23302 - protein, 11 aa, Dengue virus
RGFKKEVSNML

SEQ ID NO: 23303 - protein, 11 aa, Dengue virus
GFKKEVSNMLN

SEQ ID NO: 23304 - protein, 11 aa, Dengue virus
PTVLAFHLTTR

SEQ ID NO: 23305 - protein, 11 aa, Dengue virus
TVLAFHLTTRG

SEQ ID NO: 23306 - protein, 11 aa, Dengue virus
VLAFHLTTRGG

SEQ ID NO: 23307 - protein, 11 aa, Dengue virus
TRGGEPHMVVS

SEQ ID NO: 23308 - protein, 11 aa, Dengue virus
RGGEPHMVVSK

SEQ ID NO: 23309 - protein, 11 aa, Dengue virus
GGEPHMVVSKQ

SEQ ID NO: 23310 - protein, 11 aa, Dengue virus
GEPHMVVSKQE

SEQ ID NO: 23311 - protein, 11 aa, Dengue virus
EPHMVVSKQER

SEQ ID NO: 23312 - protein, 11 aa, Dengue virus
PHMVVSKQERG

SEQ ID NO: 23313 - protein, 11 aa, Dengue virus
HMVVSKQERGK

SEQ ID NO: 23314 - protein, 11 aa, Dengue virus
MVVSKQERGKS

SEQ ID NO: 23315 - protein, 11 aa, Dengue virus
VVSKQERGKSL

SEQ ID NO: 23316 - protein, 11 aa, Dengue virus
VGKQERGKSLL

SEQ ID NO: 23317 - protein, 11 aa, Dengue virus
GKQERGKSLLF

SEQ ID NO: 23318 - protein, 11 aa, Dengue virus
RGKSLLFKTST

SEQ ID NO: 23319 - protein, 11 aa, Dengue virus
GKSLLFKTSTG

SEQ ID NO: 23320 - protein, 11 aa, Dengue virus
KSLLFKTSAGI

SEQ ID NO: 23321 - protein, 11 aa, Dengue virus
SLLFKTSAGIN

SEQ ID NO: 23322 - protein, 11 aa, Dengue virus
LLFKTSAGINM

SEQ ID NO: 23323 - protein, 11 aa, Dengue virus
LFKTSAGINMC

SEQ ID NO: 23324 - protein, 11 aa, Dengue virus
FKTSAGINMCT

SEQ ID NO: 23325 - protein, 11 aa, Dengue virus
KTSAGINMCTL

SEQ ID NO: 23326 - protein, 11 aa, Dengue virus
TSAGINMCTLI

SEQ ID NO: 23327 - protein, 11 aa, Dengue virus
SAGINMCTLIA

SEQ ID NO: 23328 - protein, 11 aa, Dengue virus
AGINMCTLIAM

SEQ ID NO: 23329 - protein, 11 aa, Dengue virus
LIAMDLGELCD

SEQ ID NO: 23330 - protein, 11 aa, Dengue virus
IAMDLGELCDD

SEQ ID NO: 23331 - protein, 11 aa, Dengue virus
AMDLGELCDDT

SEQ ID NO: 23332 - protein, 11 aa, Dengue virus
MDLGELCDDTM

SEQ ID NO: 23333 - protein, 11 aa, Dengue virus
DLGELCDDTMT

SEQ ID NO: 23334 - protein, 11 aa, Dengue virus
LGELCDDTMTY

SEQ ID NO: 23335 - protein, 11 aa, Dengue virus
GELCDDTMTYK

SEQ ID NO: 23336 - protein, 11 aa, Dengue virus
ELCDDTMTYKC

SEQ ID NO: 23337 - protein, 11 aa, Dengue virus
LCDDTMTYKCP

SEQ ID NO: 23338 - protein, 11 aa, Dengue virus
CDDTMTYKCPR

SEQ ID NO: 23339 - protein, 11 aa, Dengue virus
DDTMTYKCPRI

SEQ ID NO: 23340 - protein, 11 aa, Dengue virus
DTMTYKCPRIS

SEQ ID NO: 23341 - protein, 11 aa, Dengue virus
TMTYKCPRISE

SEQ ID NO: 23342 - protein, 11 aa, Dengue virus
TYKCPQITEAE

SEQ ID NO: 23343 - protein, 11 aa, Dengue virus
YKCPQITEAEP

SEQ ID NO: 23344 - protein, 11 aa, Dengue virus
KCPQITEAEPD

SEQ ID NO: 23345 - protein, 11 aa, Dengue virus
CPQITEAEPDD

SEQ ID NO: 23346 - protein, 11 aa, Dengue virus
PQITEAEPDDV

SEQ ID NO: 23347 - protein, 11 aa, Dengue virus
QITEAEPDDVD

SEQ ID NO: 23348 - protein, 11 aa, Dengue virus
ITEVEPDDVDC

SEQ ID NO: 23349 - protein, 11 aa, Dengue virus
TEVEPDDVDCW

SEQ ID NO: 23350 - protein, 11 aa, Dengue virus
EVEPDDVDCWC

SEQ ID NO: 23351 - protein, 11 aa, Dengue virus
VEPDDVDCWCN

SEQ ID NO: 23352 - protein, 11 aa, Dengue virus
DDVDCWCNTTD

SEQ ID NO: 23353 - protein, 11 aa, Dengue virus
DVDCWCNTTDT

SEQ ID NO: 23354 - protein, 11 aa, Dengue virus
VDCWCNTTDTW

SEQ ID NO: 23355 - protein, 11 aa, Dengue virus
DCWCNTTDTWV

SEQ ID NO: 23356 - protein, 11 aa, Dengue virus
CWCNTTDTWVT

SEQ ID NO: 23357 - protein, 11 aa, Dengue virus
WCNTTDTWVTY

SEQ ID NO: 23358 - protein, 11 aa, Dengue virus
CNTTDTWVTYG

SEQ ID NO: 23359 - protein, 11 aa, Dengue virus
NTTDTWVTYGT

SEQ ID NO: 23360 - protein, 11 aa, Dengue virus
TTDTWVTYGTC

SEQ ID NO: 23361 - protein, 11 aa, Dengue virus
DTWVTYGTCTQ

SEQ ID NO: 23362 - protein, 11 aa, Dengue virus
TYGTCSQTGGH

SEQ ID NO: 23363 - protein, 11 aa, Dengue virus
YGTCSQTGGHR

SEQ ID NO: 23364 - protein, 11 aa, Dengue virus
GTCSQTGGHRR

SEQ ID NO: 23365 - protein, 11 aa, Dengue virus
TCTQIGEHRRD

SEQ ID NO: 23366 - protein, 11 aa, Dengue virus
CTQIGEHRRDK

SEQ ID NO: 23367 - protein, 11 aa, Dengue virus
TQIGEHRRDKR

SEQ ID NO: 23368 - protein, 11 aa, Dengue virus
QIGEHRRDKRS

SEQ ID NO: 23369 - protein, 11 aa, Dengue virus
IGEHRRDKRSV

SEQ ID NO: 23370 - protein, 11 aa, Dengue virus
SSEGAWRQIQK

SEQ ID NO: 23371 - protein, 11 aa, Dengue virus
SEGAWRQIQKV

SEQ ID NO: 23372 - protein, 11 aa, Dengue virus
EGAWRQIQKVE

SEQ ID NO: 23373 - protein, 11 aa, Dengue virus
GAWRQIQKVET

SEQ ID NO: 23374 - protein, 11 aa, Dengue virus
AWRQIQKVETW

SEQ ID NO: 23375 - protein, 11 aa, Dengue virus
WRQIQKVETWA

SEQ ID NO: 23376 - protein, 11 aa, Dengue virus
RQIQKVETWAL

SEQ ID NO: 23377 - protein, 11 aa, Dengue virus
QIQRVETWVLR

SEQ ID NO: 23378 - protein, 11 aa, Dengue virus
IQRVETWVLRH

SEQ ID NO: 23379 - protein, 11 aa, Dengue virus
WVLRHPGFTVI

SEQ ID NO: 23380 - protein, 11 aa, Dengue virus
VLRHPGFTVIA

SEQ ID NO: 23381 - protein, 11 aa, Dengue virus
LRHPGFTVTAL

SEQ ID NO: 23382 - protein, 11 aa, Dengue virus
RHPGFTVTALF

SEQ ID NO: 23383 - protein, 11 aa, Dengue virus
HPGFTVTALFL

SEQ ID NO: 23384 - protein, 11 aa, Dengue virus
PGFTVTALFLA

SEQ ID NO: 23385 - protein, 11 aa, Dengue virus
ALFLAHVIGTS

SEQ ID NO: 23386 - protein, 11 aa, Dengue virus
LFLAHVIGTSI

SEQ ID NO: 23387 - protein, 11 aa, Dengue virus
DIELLKTEVAN

SEQ ID NO: 23388 - protein, 11 aa, Dengue virus
IELLKTEVANP

SEQ ID NO: 23389 - protein, 11 aa, Dengue virus
ELLKTEVANPA

SEQ ID NO: 23390 - protein, 11 aa, Dengue virus
LLKTEVTDPAV

SEQ ID NO: 23391 - protein, 11 aa, Dengue virus
LKTEVTDPAVL

SEQ ID NO: 23392 - protein, 11 aa, Dengue virus
KTEVTDPAVLR

SEQ ID NO: 23393 - protein, 11 aa, Dengue virus
TEVTDPAVLRK

SEQ ID NO: 23394 - protein, 11 aa, Dengue virus
EVTDPAVLRKL

SEQ ID NO: 23395 - protein, 11 aa, Dengue virus
VTDPAVLRKLC

SEQ ID NO: 23396 - protein, 11 aa, Dengue virus
TDPAVLRKLCI

SEQ ID NO: 23397 - protein, 11 aa, Dengue virus
DPAVLRKLCIE

SEQ ID NO: 23398 - protein, 11 aa, Dengue virus
GEATLVEEQDT

SEQ ID NO: 23399 - protein, 11 aa, Dengue virus
EATLVEEQDTN

SEQ ID NO: 23400 - protein, 11 aa, Dengue virus
ATLVEEQDTNF

SEQ ID NO: 23401 - protein, 11 aa, Dengue virus
TLVEEQDTNFV

SEQ ID NO: 23402 - protein, 11 aa, Dengue virus
LVEEQDTNFVC

SEQ ID NO: 23403 - protein, 11 aa, Dengue virus
VEEQDTNFVCR

SEQ ID NO: 23404 - protein, 11 aa, Dengue virus
EEQDSNFVCRR

SEQ ID NO: 23405 - protein, 11 aa, Dengue virus
EQDSNFVCRRT

SEQ ID NO: 23406 - protein, 11 aa, Dengue virus
QDSNFVCRRTF

SEQ ID NO: 23407 - protein, 11 aa, Dengue virus
DSNFVCRRTFV

SEQ ID NO: 23408 - protein, 11 aa, Dengue virus
SNFVCRRTFVD

SEQ ID NO: 23409 - protein, 11 aa, Dengue virus
LFGKGSLMTCA

SEQ ID NO: 23410 - protein, 11 aa, Dengue virus
FGKGSLMTCAK

SEQ ID NO: 23411 - protein, 11 aa, Dengue virus
GKGSLMTCAKF

SEQ ID NO: 23412 - protein, 11 aa, Dengue virus
KGSLMTCAKFK

SEQ ID NO: 23413 - protein, 11 aa, Dengue virus
GSLMTCAKFKC

SEQ ID NO: 23414 - protein, 11 aa, Dengue virus
SLMTCAKFKCV

SEQ ID NO: 23415 - protein, 11 aa, Dengue virus
LMTCAKFKCVT

SEQ ID NO: 23416 - protein, 11 aa, Dengue virus
MTCAKFKCVTK

SEQ ID NO: 23417 - protein, 11 aa, Dengue virus
KCVTKLEGKIA

SEQ ID NO: 23418 - protein, 11 aa, Dengue virus
CVTKLEGKIAQ

SEQ ID NO: 23419 - protein, 11 aa, Dengue virus
TKLEGKIAQYE

SEQ ID NO: 23420 - protein, 11 aa, Dengue virus
KLEGKIAQYEN

SEQ ID NO: 23421 - protein, 11 aa, Dengue virus
LEGKIAQYENL

SEQ ID NO: 23422 - protein, 11 aa, Dengue virus
EGKIAQYENLK

SEQ ID NO: 23423 - protein, 11 aa, Dengue virus
GKIAQYENLKY

SEQ ID NO: 23424 - protein, 11 aa, Dengue virus
KIAQYENLKYS

SEQ ID NO: 23425 - protein, 11 aa, Dengue virus
IAQYENLKYSV

SEQ ID NO: 23426 - protein, 11 aa, Dengue virus
AQYENLKYSVI

SEQ ID NO: 23427 - protein, 11 aa, Dengue virus
DQHQVGNETTD

SEQ ID NO: 23428 - protein, 11 aa, Dengue virus
QHQVGNETTDH

SEQ ID NO: 23429 - protein, 11 aa, Dengue virus
HQVGNETTDHG

SEQ ID NO: 23430 - protein, 11 aa, Dengue virus
QVGNETTDHGT

SEQ ID NO: 23431 - protein, 11 aa, Dengue virus
VGNETTEHGTT

SEQ ID NO: 23432 - protein, 11 aa, Dengue virus
GNETTEHGTTA

SEQ ID NO: 23433 - protein, 11 aa, Dengue virus
NETTEHGTTAT

SEQ ID NO: 23434 - protein, 11 aa, Dengue virus
ETTEHGTTATI

SEQ ID NO: 23435 - protein, 11 aa, Dengue virus
TTEHGTTATIT

SEQ ID NO: 23436 - protein, 11 aa, Dengue virus
TDHGTTATITP

SEQ ID NO: 23437 - protein, 11 aa, Dengue virus
DHGTTATITPQ

SEQ ID NO: 23438 - protein, 11 aa, Dengue virus
TTATITPQAPS

SEQ ID NO: 23439 - protein, 11 aa, Dengue virus
TATITPQAPST

SEQ ID NO: 23440 - protein, 11 aa, Dengue virus
ATITPQAPSTE

SEQ ID NO: 23441 - protein, 11 aa, Dengue virus
TITPQAPSTEI

SEQ ID NO: 23442 - protein, 11 aa, Dengue virus
ITPQAPSTEIQ

SEQ ID NO: 23443 - protein, 11 aa, Dengue virus
TPQAPSTEIQL

SEQ ID NO: 23444 - protein, 11 aa, Dengue virus
PQAPSTEIQLT

SEQ ID NO: 23445 - protein, 11 aa, Dengue virus
QAPSTEIQLTD

SEQ ID NO: 23446 - protein, 11 aa, Dengue virus
APSTEIQLTDY

SEQ ID NO: 23447 - protein, 11 aa, Dengue virus
PSTEIQLTDYG

SEQ ID NO: 23448 - protein, 11 aa, Dengue virus
STEIQLTDYGA

SEQ ID NO: 23449 - protein, 11 aa, Dengue virus
SEIQLTDYGTL

SEQ ID NO: 23450 - protein, 11 aa, Dengue virus
EIQLTDYGVLT

SEQ ID NO: 23451 - protein, 11 aa, Dengue virus
IQLTDYGVLTL

SEQ ID NO: 23452 - protein, 11 aa, Dengue virus
QLTDYGVLTLD

SEQ ID NO: 23453 - protein, 11 aa, Dengue virus
LTDYGVLTLDC

SEQ ID NO: 23454 - protein, 11 aa, Dengue virus
TDYGVLTLDCS

SEQ ID NO: 23455 - protein, 11 aa, Dengue virus
FNEMVLLTMEK

SEQ ID NO: 23456 - protein, 11 aa, Dengue virus
NEMVLLTMKGK

SEQ ID NO: 23457 - protein, 11 aa, Dengue virus
EMVLLTMKEKA

SEQ ID NO: 23458 - protein, 11 aa, Dengue virus
MVLLTMKEKAW

SEQ ID NO: 23459 - protein, 11 aa, Dengue virus
VLLTMKEKAWL

SEQ ID NO: 23460 - protein, 11 aa, Dengue virus
LLTMKEKAWLV

SEQ ID NO: 23461 - protein, 11 aa, Dengue virus
LTMKEKAWLVH

SEQ ID NO: 23462 - protein, 11 aa, Dengue virus
TMKEKAWLVHK

SEQ ID NO: 23463 - protein, 11 aa, Dengue virus
MKEKAWLVHKQ

SEQ ID NO: 23464 - protein, 11 aa, Dengue virus
KEKAWLVHKQW

SEQ ID NO: 23465 - protein, 11 aa, Dengue virus
EKAWLVHKQWF

SEQ ID NO: 23466 - protein, 11 aa, Dengue virus
DLPLPWTSGAL

SEQ ID NO: 23467 - protein, 11 aa, Dengue virus
LPLPWTSGALT

SEQ ID NO: 23468 - protein, 11 aa, Dengue virus
TLQETWNRQDL

SEQ ID NO: 23469 - protein, 11 aa, Dengue virus
LQETWNRQDLL

SEQ ID NO: 23470 - protein, 11 aa, Dengue virus
IQMSGTTTIFA

SEQ ID NO: 23471 - protein, 11 aa, Dengue virus
QMSGTTTIFAG

SEQ ID NO: 23472 - protein, 11 aa, Dengue virus
MSGTTTIFAGH

SEQ ID NO: 23473 - protein, 11 aa, Dengue virus
LKMDKLTLRGM

SEQ ID NO: 23474 - protein, 11 aa, Dengue virus
KMDKLTLRGMS

SEQ ID NO: 23475 - protein, 11 aa, Dengue virus
MDKLTLRGMSY

SEQ ID NO: 23476 - protein, 11 aa, Dengue virus
DKLTLRGMSYV

SEQ ID NO: 23477 - protein, 11 aa, Dengue virus
KLTLRGMSYVM

SEQ ID NO: 23478 - protein, 11 aa, Dengue virus
LTLRGMSYVMC

SEQ ID NO: 23479 - protein, 11 aa, Dengue virus
TLRGMSYVMCT

SEQ ID NO: 23480 - protein, 11 aa, Dengue virus
LRGMSYVMCTG

SEQ ID NO: 23481 - protein, 11 aa, Dengue virus
SYVMCTGPFKL

SEQ ID NO: 23482 - protein, 11 aa, Dengue virus
YVMCTGLFKLE

SEQ ID NO: 23483 - protein, 11 aa, Dengue virus
VMCTGPFKLEK

SEQ ID NO: 23484 - protein, 11 aa, Dengue virus
MCTGLFKLEKE

SEQ ID NO: 23485 - protein, 11 aa, Dengue virus
CTGPFKLEKEV

SEQ ID NO: 23486 - protein, 11 aa, Dengue virus
TGPFKLEKEVA

SEQ ID NO: 23487 - protein, 11 aa, Dengue virus
GLFKLEKEVAE

SEQ ID NO: 23488 - protein, 11 aa, Dengue virus
LFKLEKEVAET

SEQ ID NO: 23489 - protein, 11 aa, Dengue virus
TQHGTVLVQIR

SEQ ID NO: 23490 - protein, 11 aa, Dengue virus
QHGTVLVQIRY

SEQ ID NO: 23491 - protein, 11 aa, Dengue virus
HGTVLVQIRYE

SEQ ID NO: 23492 - protein, 11 aa, Dengue virus
GTVLVQIRYEG

SEQ ID NO: 23493 - protein, 11 aa, Dengue virus
TVLVQIRYEGT

SEQ ID NO: 23494 - protein, 11 aa, Dengue virus
VLVQIRYEGTD

SEQ ID NO: 23495 - protein, 11 aa, Dengue virus
LVQIRYEGTDA

SEQ ID NO: 23496 - protein, 11 aa, Dengue virus
VQIRYEGTDAP

SEQ ID NO: 23497 - protein, 11 aa, Dengue virus
QIRYEGTDAPC

SEQ ID NO: 23498 - protein, 11 aa, Dengue virus
IRYEGTDAPCK

SEQ ID NO: 23499 - protein, 11 aa, Dengue virus
GADAPCKIPFS

SEQ ID NO: 23500 - protein, 11 aa, Dengue virus
TDAPCKIPFSS

SEQ ID NO: 23501 - protein, 11 aa, Dengue virus
DAPCKIPFSSQ

SEQ ID NO: 23502 - protein, 11 aa, Dengue virus
APCKIPFSSQD

SEQ ID NO: 23503 - protein, 11 aa, Dengue virus
PCKIPFSSQDE

SEQ ID NO: 23504 - protein, 11 aa, Dengue virus
QDEKGATQNGR

SEQ ID NO: 23505 - protein, 11 aa, Dengue virus
GATQNGRLITA

SEQ ID NO: 23506 - protein, 11 aa, Dengue virus
ATQNGRLITAN

SEQ ID NO: 23507 - protein, 11 aa, Dengue virus
TQNGRLVTANP

SEQ ID NO: 23508 - protein, 11 aa, Dengue virus
QNGRVITANPI

SEQ ID NO: 23509 - protein, 11 aa, Dengue virus
NGRVITANPIV

SEQ ID NO: 23510 - protein, 11 aa, Dengue virus
GRVITANPIVT

SEQ ID NO: 23511 - protein, 11 aa, Dengue virus
RVITANPIVTD

SEQ ID NO: 23512 - protein, 11 aa, Dengue virus
VITANPIVTDK

SEQ ID NO: 23513 - protein, 11 aa, Dengue virus
ITANPIVTDKD

SEQ ID NO: 23514 - protein, 11 aa, Dengue virus
TANPIVTDREK

SEQ ID NO: 23515 - protein, 11 aa, Dengue virus
ANPIVTDREKP

SEQ ID NO: 23516 - protein, 11 aa, Dengue virus
NPIVTDREKPV

SEQ ID NO: 23517 - protein, 11 aa, Dengue virus
PIVTDREKPVN

SEQ ID NO: 23518 - protein, 11 aa, Dengue virus
IVTDREKPVNI

SEQ ID NO: 23519 - protein, 11 aa, Dengue virus
VTDREKPVNIE

SEQ ID NO: 23520 - protein, 11 aa, Dengue virus
TDKDKPVNIEA

SEQ ID NO: 23521 - protein, 11 aa, Dengue virus
DKDKPVNIEAE

SEQ ID NO: 23522 - protein, 11 aa, Dengue virus
KDKPVNIEAEP

SEQ ID NO: 23523 - protein, 11 aa, Dengue virus
DKPVNIEAEPP

SEQ ID NO: 23524 - protein, 11 aa, Dengue virus
AEPPFGESYII

SEQ ID NO: 23525 - protein, 11 aa, Dengue virus
EPPFGESYIII

SEQ ID NO: 23526 - protein, 11 aa, Dengue virus
PPFGESYIIIG

SEQ ID NO: 23527 - protein, 11 aa, Dengue virus
GAGEKTLKLSW

SEQ ID NO: 23528 - protein, 11 aa, Dengue virus
AGEKTLKLSWF

SEQ ID NO: 23529 - protein, 11 aa, Dengue virus
GEKALKLSWFR

SEQ ID NO: 23530 - protein, 11 aa, Dengue virus
EKTLKLSWFKK

SEQ ID NO: 23531 - protein, 11 aa, Dengue virus
KTLKLSWFKKG

SEQ ID NO: 23532 - protein, 11 aa, Dengue virus
TLKLSWFKKGS

SEQ ID NO: 23533 - protein, 11 aa, Dengue virus
LKLSWFKKGST

SEQ ID NO: 23534 - protein, 11 aa, Dengue virus
KLSWFKKGSTI

SEQ ID NO: 23535 - protein, 11 aa, Dengue virus
LSWFKKGSTIG

SEQ ID NO: 23536 - protein, 11 aa, Dengue virus
SWFKKGSTIGK

SEQ ID NO: 23537 - protein, 11 aa, Dengue virus
WFKKGSTIGKM

SEQ ID NO: 23538 - protein, 11 aa, Dengue virus
FKKGSTIGKMF

SEQ ID NO: 23539 - protein, 11 aa, Dengue virus
KKGSTIGKMFE

SEQ ID NO: 23540 - protein, 11 aa, Dengue virus
KGSTIGKMFEA

SEQ ID NO: 23541 - protein, 11 aa, Dengue virus
GSSIGKMFVAT

SEQ ID NO: 23542 - protein, 11 aa, Dengue virus
SSIGKMFVATA

SEQ ID NO: 23543 - protein, 11 aa, Dengue virus
SIGKMFVATAR

SEQ ID NO: 23544 - protein, 11 aa, Dengue virus
TAWDFGSIGGL

SEQ ID NO: 23545 - protein, 11 aa, Dengue virus
AWDFGSIGGLF

SEQ ID NO: 23546 - protein, 11 aa, Dengue virus
WDFGSIGGLFT

SEQ ID NO: 23547 - protein, 11 aa, Dengue virus
DFGSIGGLFTS

SEQ ID NO: 23548 - protein, 11 aa, Dengue virus
GKLIHQIFGTA

SEQ ID NO: 23549 - protein, 11 aa, Dengue virus
KLIHQIFGTAY

SEQ ID NO: 23550 - protein, 11 aa, Dengue virus
LIHQIFGTAYG

SEQ ID NO: 23551 - protein, 11 aa, Dengue virus
IHQIFGTAYGV

SEQ ID NO: 23552 - protein, 11 aa, Dengue virus
HQVFGAAYGVL

SEQ ID NO: 23553 - protein, 11 aa, Dengue virus
QVFGAAYGVLF

SEQ ID NO: 23554 - protein, 11 aa, Dengue virus
VFGAAYGVLFS

SEQ ID NO: 23555 - protein, 11 aa, Dengue virus
VSWTMKIGLGV

SEQ ID NO: 23556 - protein, 11 aa, Dengue virus
SWTMKIGLGVL

SEQ ID NO: 23557 - protein, 11 aa, Dengue virus
WTMKIGLGVLL

SEQ ID NO: 23558 - protein, 11 aa, Dengue virus
TMKIGLGVLLT

SEQ ID NO: 23559 - protein, 11 aa, Dengue virus
MKIGLGVLLTW

SEQ ID NO: 23560 - protein, 11 aa, Dengue virus
KIGLGVLLTWL

SEQ ID NO: 23561 - protein, 11 aa, Dengue virus
IGLGVLLTWLG

SEQ ID NO: 23562 - protein, 11 aa, Dengue virus
GLGVLLTWLGL

SEQ ID NO: 23563 - protein, 11 aa, Dengue virus
LGVLLTWLGLN

SEQ ID NO: 23564 - protein, 11 aa, Dengue virus
LTWLGLNSRSA

SEQ ID NO: 23565 - protein, 11 aa, Dengue virus
TWLGLNSRSAS

SEQ ID NO: 23566 - protein, 11 aa, Dengue virus
WLGLNSRNTSL

SEQ ID NO: 23567 - protein, 11 aa, Dengue virus
LGLNSRSASLS

SEQ ID NO: 23568 - protein, 11 aa, Dengue virus
GLNSRSASLSM

SEQ ID NO: 23569 - protein, 11 aa, Dengue virus
LNSRSASLSMT

SEQ ID NO: 23570 - protein, 11 aa, Dengue virus
NSRSASLSMTC

SEQ ID NO: 23571 - protein, 11 aa, Dengue virus
SRSASLSMTCI

SEQ ID NO: 23572 - protein, 11 aa, Dengue virus
RSASLSMTCIA

SEQ ID NO: 23573 - protein, 11 aa, Dengue virus
SASLSMTCIAV

SEQ ID NO: 23574 - protein, 11 aa, Dengue virus
ASLSMTCIAVG

SEQ ID NO: 23575 - protein, 11 aa, Dengue virus
SFSMTCIAVGL

SEQ ID NO: 23576 - protein, 11 aa, Dengue virus
SMTCIAVGLIT

SEQ ID NO: 23577 - protein, 11 aa, Dengue virus
MTCIAVGLITL

SEQ ID NO: 23578 - protein, 11 aa, Dengue virus
TCIAVGLITLY

SEQ ID NO: 23579 - protein, 11 aa, Dengue virus
CIAVGLITLYL

SEQ ID NO: 23580 - protein, 11 aa, Dengue virus
IAVGLITLYLG

SEQ ID NO: 23581 - protein, 11 aa, Dengue virus
AVGLITLYLGV

SEQ ID NO: 23582 - protein, 11 aa, Dengue virus
VGLITLYLGVM

SEQ ID NO: 23583 - protein, 11 aa, Dengue virus
GLITLYLGVMV

SEQ ID NO: 23584 - protein, 11 aa, Dengue virus
LITLYLGVMVQ

SEQ ID NO: 23585 - protein, 11 aa, Dengue virus
VTLYLGAMVQA

SEQ ID NO: 23586 - protein, 11 aa, Dengue virus
AMVQADSGCVI

SEQ ID NO: 23587 - protein, 11 aa, Dengue virus
WEEGVCGIRSV

SEQ ID NO: 23588 - protein, 11 aa, Dengue virus
EEGVCGIRSVT

SEQ ID NO: 23589 - protein, 11 aa, Dengue virus
EGVCGIRSVTR

SEQ ID NO: 23590 - protein, 11 aa, Dengue virus
GVCGIRSVTRL

SEQ ID NO: 23591 - protein, 11 aa, Dengue virus
VCGIRSVTRLE

SEQ ID NO: 23592 - protein, 11 aa, Dengue virus
CGIRSVTRLEN

SEQ ID NO: 23593 - protein, 11 aa, Dengue virus
GIRSVTRLENI

SEQ ID NO: 23594 - protein, 11 aa, Dengue virus
IRSVTRLENIM

SEQ ID NO: 23595 - protein, 11 aa, Dengue virus
RSVTRLENIMW

SEQ ID NO: 23596 - protein, 11 aa, Dengue virus
STTRLENIMWK

SEQ ID NO: 23597 - protein, 11 aa, Dengue virus
TTRLENIMWKQ

SEQ ID NO: 23598 - protein, 11 aa, Dengue virus
MWKQISNELNY

SEQ ID NO: 23599 - protein, 11 aa, Dengue virus
WKQISNELNYI

SEQ ID NO: 23600 - protein, 11 aa, Dengue virus
KQISNELNYIL

SEQ ID NO: 23601 - protein, 11 aa, Dengue virus
NELNYILLEND

SEQ ID NO: 23602 - protein, 11 aa, Dengue virus
ELNYILLENDM

SEQ ID NO: 23603 - protein, 11 aa, Dengue virus
LNYILLENDMK

SEQ ID NO: 23604 - protein, 11 aa, Dengue virus
NHILLENGMKF

SEQ ID NO: 23605 - protein, 11 aa, Dengue virus
HILLENGMKFT

SEQ ID NO: 23606 - protein, 11 aa, Dengue virus
ILLENGMKFTV

SEQ ID NO: 23607 - protein, 11 aa, Dengue virus
LLENGMKFTVV

SEQ ID NO: 23608 - protein, 11 aa, Dengue virus
LENGMKFTVVV

SEQ ID NO: 23609 - protein, 11 aa, Dengue virus
ENGMKFTVVVG

SEQ ID NO: 23610 - protein, 11 aa, Dengue virus
NGMKFTVVVGD

SEQ ID NO: 23611 - protein, 11 aa, Dengue virus
QGKKMVRPQPM

SEQ ID NO: 23612 - protein, 11 aa, Dengue virus
GKKMVRPQPME

SEQ ID NO: 23613 - protein, 11 aa, Dengue virus
KKTIRPQPMEH

SEQ ID NO: 23614 - protein, 11 aa, Dengue virus
KMIRPQPMEHR

SEQ ID NO: 23615 - protein, 11 aa, Dengue virus
MIRPQPMEHRY

SEQ ID NO: 23616 - protein, 11 aa, Dengue virus
IRPQPMEHRYS

SEQ ID NO: 23617 - protein, 11 aa, Dengue virus
RPQPMEHRYSW

SEQ ID NO: 23618 - protein, 11 aa, Dengue virus
PQPMEHRYSWK

SEQ ID NO: 23619 - protein, 11 aa, Dengue virus
QPMEHRYSWKS

SEQ ID NO: 23620 - protein, 11 aa, Dengue virus
PMEHRYSWKSW

SEQ ID NO: 23621 - protein, 11 aa, Dengue virus
MEHRYSWKSWG

SEQ ID NO: 23622 - protein, 11 aa, Dengue virus
EHRYSWKSWGK

SEQ ID NO: 23623 - protein, 11 aa, Dengue virus
HRYSWKSWGKA

SEQ ID NO: 23624 - protein, 11 aa, Dengue virus
KYSWRSWGKAK

SEQ ID NO: 23625 - protein, 11 aa, Dengue virus
YSWRSWGKAKI

SEQ ID NO: 23626 - protein, 11 aa, Dengue virus
SWRSWGKAKII

SEQ ID NO: 23627 - protein, 11 aa, Dengue virus
WRSWGKAKIIG

SEQ ID NO: 23628 - protein, 11 aa, Dengue virus
RSWGKAKIIGA

SEQ ID NO: 23629 - protein, 11 aa, Dengue virus
SWGKAKVIGAD

SEQ ID NO: 23630 - protein, 11 aa, Dengue virus
WGKAKIIGADA

SEQ ID NO: 23631 - protein, 11 aa, Dengue virus
GKAKIIGADAQ

SEQ ID NO: 23632 - protein, 11 aa, Dengue virus
KAKIIGADAQN

SEQ ID NO: 23633 - protein, 11 aa, Dengue virus
IIDGPNTPECS

SEQ ID NO: 23634 - protein, 11 aa, Dengue virus
IDGPNTPECSD

SEQ ID NO: 23635 - protein, 11 aa, Dengue virus
ECPDGQRAWNI

SEQ ID NO: 23636 - protein, 11 aa, Dengue virus
CPDGQRAWNIW

SEQ ID NO: 23637 - protein, 11 aa, Dengue virus
PDGQRAWNIWE

SEQ ID NO: 23638 - protein, 11 aa, Dengue virus
DGQRAWNIWEV

SEQ ID NO: 23639 - protein, 11 aa, Dengue virus
GQRAWNIWEVE

SEQ ID NO: 23640 - protein, 11 aa, Dengue virus
FGIFTTNIWLR

SEQ ID NO: 23641 - protein, 11 aa, Dengue virus
GIFTTNIWLKM

SEQ ID NO: 23642 - protein, 11 aa, Dengue virus
IFTTNIWLKMR

SEQ ID NO: 23643 - protein, 11 aa, Dengue virus
FTTNIWLRLRD

SEQ ID NO: 23644 - protein, 11 aa, Dengue virus
TTNIWLRLRDS

SEQ ID NO: 23645 - protein, 11 aa, Dengue virus
TNIWLKMRDSY

SEQ ID NO: 23646 - protein, 11 aa, Dengue virus
NIWLKMRDSYT

SEQ ID NO: 23647 - protein, 11 aa, Dengue virus
IWLKMRDSYTQ

SEQ ID NO: 23648 - protein, 11 aa, Dengue virus
RDSHTQVCDHR

SEQ ID NO: 23649 - protein, 11 aa, Dengue virus
DSHTQVCDHRL

SEQ ID NO: 23650 - protein, 11 aa, Dengue virus
SHTQVCDHRLM

SEQ ID NO: 23651 - protein, 11 aa, Dengue virus
HTQVCDHRLMS

SEQ ID NO: 23652 - protein, 11 aa, Dengue virus
TQACDHRLMSA

SEQ ID NO: 23653 - protein, 11 aa, Dengue virus
QACDHRLMSAA

SEQ ID NO: 23654 - protein, 11 aa, Dengue virus
ACDHRLMSAAI

SEQ ID NO: 23655 - protein, 11 aa, Dengue virus
ESEKNEPWKLA

SEQ ID NO: 23656 - protein, 11 aa, Dengue virus
NETWKLAGASF

SEQ ID NO: 23657 - protein, 11 aa, Dengue virus
ETWKLAGASFI

SEQ ID NO: 23658 - protein, 11 aa, Dengue virus
TWKLAGASFIE

SEQ ID NO: 23659 - protein, 11 aa, Dengue virus
WKLAGASFIEV

SEQ ID NO: 23660 - protein, 11 aa, Dengue virus
KLAGASFIEVK

SEQ ID NO: 23661 - protein, 11 aa, Dengue virus
LAGASFIEVKT

SEQ ID NO: 23662 - protein, 11 aa, Dengue virus
AGASFIEVKTC

SEQ ID NO: 23663 - protein, 11 aa, Dengue virus
RASFIEVKTCV

SEQ ID NO: 23664 - protein, 11 aa, Dengue virus
ASFIEVKTCVW

SEQ ID NO: 23665 - protein, 11 aa, Dengue virus
SFIEVKTCVWP

SEQ ID NO: 23666 - protein, 11 aa, Dengue virus
FIEVKTCVWPK

SEQ ID NO: 23667 - protein, 11 aa, Dengue virus
IEVKTCVWPKS

SEQ ID NO: 23668 - protein, 11 aa, Dengue virus
EVKTCVWPKSH

SEQ ID NO: 23669 - protein, 11 aa, Dengue virus
VKTCVWPKSHT

SEQ ID NO: 23670 - protein, 11 aa, Dengue virus
KTCVWPKSHTL

SEQ ID NO: 23671 - protein, 11 aa, Dengue virus
TCVWPKSHTLW

SEQ ID NO: 23672 - protein, 11 aa, Dengue virus
CVWPKSHTLWS

SEQ ID NO: 23673 - protein, 11 aa, Dengue virus
VWPKSHTLWSN

SEQ ID NO: 23674 - protein, 11 aa, Dengue virus
VLESEMIIPKM

SEQ ID NO: 23675 - protein, 11 aa, Dengue virus
LESEMVIPKIY

SEQ ID NO: 23676 - protein, 11 aa, Dengue virus
ESEMVIPKIYG

SEQ ID NO: 23677 - protein, 11 aa, Dengue virus
SEMVIPKIYGG

SEQ ID NO: 23678 - protein, 11 aa, Dengue virus
EMVIPKIYGGP

SEQ ID NO: 23679 - protein, 11 aa, Dengue virus
PKIYGGPTSQH

SEQ ID NO: 23680 - protein, 11 aa, Dengue virus
KIYGGPTSQHN

SEQ ID NO: 23681 - protein, 11 aa, Dengue virus
YGGPTSQHNYR

SEQ ID NO: 23682 - protein, 11 aa, Dengue virus
GGPISQHNHRP

SEQ ID NO: 23683 - protein, 11 aa, Dengue virus
GPISQHNHRPG

SEQ ID NO: 23684 - protein, 11 aa, Dengue virus
PISQHNHRPGY

SEQ ID NO: 23685 - protein, 11 aa, Dengue virus
ISQHNHRPGYF

SEQ ID NO: 23686 - protein, 11 aa, Dengue virus
HNHRPGYFTQT

SEQ ID NO: 23687 - protein, 11 aa, Dengue virus
NHRPGYFTQTA

SEQ ID NO: 23688 - protein, 11 aa, Dengue virus
HRPGYFTQTAG

SEQ ID NO: 23689 - protein, 11 aa, Dengue virus
HLGKLELDFDF

SEQ ID NO: 23690 - protein, 11 aa, Dengue virus
LGKLELDFDFC

SEQ ID NO: 23691 - protein, 11 aa, Dengue virus
GKLELDFDFCE

SEQ ID NO: 23692 - protein, 11 aa, Dengue virus
KLELDFDFCEG

SEQ ID NO: 23693 - protein, 11 aa, Dengue virus
LELDFDFCEGT

SEQ ID NO: 23694 - protein, 11 aa, Dengue virus
ELDFDFCEGTT

SEQ ID NO: 23695 - protein, 11 aa, Dengue virus
LDFDFCEGTTV

SEQ ID NO: 23696 - protein, 11 aa, Dengue virus
DFDFCEGTTVV

SEQ ID NO: 23697 - protein, 11 aa, Dengue virus
FDFCEGTTVVV

SEQ ID NO: 23698 - protein, 11 aa, Dengue virus
DFCEGTTVVVD

SEQ ID NO: 23699 - protein, 11 aa, Dengue virus
TTVVVDEHCGY

SEQ ID NO: 23700 - protein, 11 aa, Dengue virus
TVVVDEHCGYR

SEQ ID NO: 23701 - protein, 11 aa, Dengue virus
VVVDEHCGYRG

SEQ ID NO: 23702 - protein, 11 aa, Dengue virus
VVDEHCGYRGP

SEQ ID NO: 23703 - protein, 11 aa, Dengue virus
VDEHCGSRGPS

SEQ ID NO: 23704 - protein, 11 aa, Dengue virus
DEHCGYRGPSL

SEQ ID NO: 23705 - protein, 11 aa, Dengue virus
EHCGYRGPSLR

SEQ ID NO: 23706 - protein, 11 aa, Dengue virus
HCGYRGPSLRT

SEQ ID NO: 23707 - protein, 11 aa, Dengue virus
CGSRGPSLRTT

SEQ ID NO: 23708 - protein, 11 aa, Dengue virus
GYRGPSLRTTT

SEQ ID NO: 23709 - protein, 11 aa, Dengue virus
YRGPSLRTTTV

SEQ ID NO: 23710 - protein, 11 aa, Dengue virus
PVKDKEENLVK

SEQ ID NO: 23711 - protein, 11 aa, Dengue virus
VKDKEENLVKS

SEQ ID NO: 23712 - protein, 11 aa, Dengue virus
KDKEENLVKSM

SEQ ID NO: 23713 - protein, 11 aa, Dengue virus
DKEENLVKSMV

SEQ ID NO: 23714 - protein, 11 aa, Dengue virus
NLVKSMVSAGL

SEQ ID NO: 23715 - protein, 11 aa, Dengue virus
LVKSMVSAGLG

SEQ ID NO: 23716 - protein, 11 aa, Dengue virus
VKSMVSAGLGE

SEQ ID NO: 23717 - protein, 11 aa, Dengue virus
KSMVSAGLGEV

SEQ ID NO: 23718 - protein, 11 aa, Dengue virus
MVSAGSGEVDN

SEQ ID NO: 23719 - protein, 11 aa, Dengue virus
VSAGSGEVDNF

SEQ ID NO: 23720 - protein, 11 aa, Dengue virus
SAGSGEVDNFS

SEQ ID NO: 23721 - protein, 11 aa, Dengue virus
AGSGEVDNFSL

SEQ ID NO: 23722 - protein, 11 aa, Dengue virus
GSGEVDNFSLG

SEQ ID NO: 23723 - protein, 11 aa, Dengue virus
LGEVDSFSLGL

SEQ ID NO: 23724 - protein, 11 aa, Dengue virus
GEVDNFSLGIL

SEQ ID NO: 23725 - protein, 11 aa, Dengue virus
EVDNFSLGILC

SEQ ID NO: 23726 - protein, 11 aa, Dengue virus
SIIIEEVMRSR

SEQ ID NO: 23727 - protein, 11 aa, Dengue virus
IIIEEVMRSRW

SEQ ID NO: 23728 - protein, 11 aa, Dengue virus
IIEEVMRSRWS

SEQ ID NO: 23729 - protein, 11 aa, Dengue virus
TEEVMRSRWSR

SEQ ID NO: 23730 - protein, 11 aa, Dengue virus
EEVMRSRWSKK

SEQ ID NO: 23731 - protein, 11 aa, Dengue virus
EVMRSRWSKKM

SEQ ID NO: 23732 - protein, 11 aa, Dengue virus
VMRSRWSKKML

SEQ ID NO: 23733 - protein, 11 aa, Dengue virus
MRSRWSKKMLM

SEQ ID NO: 23734 - protein, 11 aa, Dengue virus
RSRWSKKMLMT

SEQ ID NO: 23735 - protein, 11 aa, Dengue virus
SRWSKKMLMTG

SEQ ID NO: 23736 - protein, 11 aa, Dengue virus
RWSKKMLMTGT

SEQ ID NO: 23737 - protein, 11 aa, Dengue virus
WSKKMLMTGTL

SEQ ID NO: 23738 - protein, 11 aa, Dengue virus
GQLTWSDLIRL

SEQ ID NO: 23739 - protein, 11 aa, Dengue virus
QLTWSDLIRLC

SEQ ID NO: 23740 - protein, 11 aa, Dengue virus
LTWSDLIRLCI

SEQ ID NO: 23741 - protein, 11 aa, Dengue virus
TWSDLIRLCIM

SEQ ID NO: 23742 - protein, 11 aa, Dengue virus
WSDLIRLCIMV

SEQ ID NO: 23743 - protein, 11 aa, Dengue virus
SDLIRLCIMVG

SEQ ID NO: 23744 - protein, 11 aa, Dengue virus
DLTRLCIMVGA

SEQ ID NO: 23745 - protein, 11 aa, Dengue virus
LTRLCIMVGAN

SEQ ID NO: 23746 - protein, 11 aa, Dengue virus
TRLCIMVGANA

SEQ ID NO: 23747 - protein, 11 aa, Dengue virus
RLCIMVGANAF

SEQ ID NO: 23748 - protein, 11 aa, Dengue virus
LCIMVGANAFD

SEQ ID NO: 23749 - protein, 11 aa, Dengue virus
CIMVGANAFDR

SEQ ID NO: 23750 - protein, 11 aa, Dengue virus
IMVGANAFDRM

SEQ ID NO: 23751 - protein, 11 aa, Dengue virus
MVGANAFDRMG

SEQ ID NO: 23752 - protein, 11 aa, Dengue virus
GANAFDRMGMG

SEQ ID NO: 23753 - protein, 11 aa, Dengue virus
DNMGMGTTYLA

SEQ ID NO: 23754 - protein, 11 aa, Dengue virus
NMGMGTTYLAL

SEQ ID NO: 23755 - protein, 11 aa, Dengue virus
MGMGTTHLALM

SEQ ID NO: 23756 - protein, 11 aa, Dengue virus
GMGTTHLALMA

SEQ ID NO: 23757 - protein, 11 aa, Dengue virus
MGTTHLALMAT

SEQ ID NO: 23758 - protein, 11 aa, Dengue virus
GTTHLALMATF

SEQ ID NO: 23759 - protein, 11 aa, Dengue virus
MTYLALMATFK

SEQ ID NO: 23760 - protein, 11 aa, Dengue virus
TYLALMATFKI

SEQ ID NO: 23761 - protein, 11 aa, Dengue virus
YLALMATFKIR

SEQ ID NO: 23762 - protein, 11 aa, Dengue virus
LALMATFKIRP

SEQ ID NO: 23763 - protein, 11 aa, Dengue virus
ALMATFKIRPM

SEQ ID NO: 23764 - protein, 11 aa, Dengue virus
LMATFKMRPML

SEQ ID NO: 23765 - protein, 11 aa, Dengue virus
MATFKMRPMLA

SEQ ID NO: 23766 - protein, 11 aa, Dengue virus
ATFKMRPMLAV

SEQ ID NO: 23767 - protein, 11 aa, Dengue virus
TFKMRPMLAVG

SEQ ID NO: 23768 - protein, 11 aa, Dengue virus
FKMRPMLAVGL

SEQ ID NO: 23769 - protein, 11 aa, Dengue virus
KMRPMLAVGLL

SEQ ID NO: 23770 - protein, 11 aa, Dengue virus
MRPMFAVGLLI

SEQ ID NO: 23771 - protein, 11 aa, Dengue virus
RPMFAVGLLIR

SEQ ID NO: 23772 - protein, 11 aa, Dengue virus
PMFAVGLLIRR

SEQ ID NO: 23773 - protein, 11 aa, Dengue virus
MFAVGLLIRRL

SEQ ID NO: 23774 - protein, 11 aa, Dengue virus
FAVGLLIRRLT

SEQ ID NO: 23775 - protein, 11 aa, Dengue virus
AVGLLFRKLTS

SEQ ID NO: 23776 - protein, 11 aa, Dengue virus
VGLLFRKLTSR

SEQ ID NO: 23777 - protein, 11 aa, Dengue virus
GLLFRKLTSRE

SEQ ID NO: 23778 - protein, 11 aa, Dengue virus
LLFRKLTSREV

SEQ ID NO: 23779 - protein, 11 aa, Dengue virus
LFRKLTSREVL

SEQ ID NO: 23780 - protein, 11 aa, Dengue virus
FRKLTSREVLL

SEQ ID NO: 23781 - protein, 11 aa, Dengue virus
LLTIGLSLVAF

SEQ ID NO: 23782 - protein, 11 aa, Dengue virus
LTIGLSLVAFV

SEQ ID NO: 23783 - protein, 11 aa, Dengue virus
TIGLSLVAFVE

SEQ ID NO: 23784 - protein, 11 aa, Dengue virus
IGLSLVAFVEL

SEQ ID NO: 23785 - protein, 11 aa, Dengue virus
GLSLVASAELP

SEQ ID NO: 23786 - protein, 11 aa, Dengue virus
SVELPNSLDEL

SEQ ID NO: 23787 - protein, 11 aa, Dengue virus
VELPNSLDELG

SEQ ID NO: 23788 - protein, 11 aa, Dengue virus
ELPNSLDELGD

SEQ ID NO: 23789 - protein, 11 aa, Dengue virus
LPNSLDELGDG

SEQ ID NO: 23790 - protein, 11 aa, Dengue virus
PNSLDELGDGL

SEQ ID NO: 23791 - protein, 11 aa, Dengue virus
NSLDELGDGLA

SEQ ID NO: 23792 - protein, 11 aa, Dengue virus
SLDELGDGLAM

SEQ ID NO: 23793 - protein, 11 aa, Dengue virus
LGDGLAIGIMM

SEQ ID NO: 23794 - protein, 11 aa, Dengue virus
GDGLAIGIMML

SEQ ID NO: 23795 - protein, 11 aa, Dengue virus
DGLAIGIMMLK

SEQ ID NO: 23796 - protein, 11 aa, Dengue virus
GLAIGIMMLKL

SEQ ID NO: 23797 - protein, 11 aa, Dengue virus
LAIGIMMLKLL

SEQ ID NO: 23798 - protein, 11 aa, Dengue virus
AIGIMMLKLLT

SEQ ID NO: 23799 - protein, 11 aa, Dengue virus
MGIMMLKLLTD

SEQ ID NO: 23800 - protein, 11 aa, Dengue virus
GIMMLKLLTDF

SEQ ID NO: 23801 - protein, 11 aa, Dengue virus
IMMLKLLTDFQ

SEQ ID NO: 23802 - protein, 11 aa, Dengue virus
MMLKLLTDFQS

SEQ ID NO: 23803 - protein, 11 aa, Dengue virus
LKLLTDFQSYQ

SEQ ID NO: 23804 - protein, 11 aa, Dengue virus
KLLTDFQSYQL

SEQ ID NO: 23805 - protein, 11 aa, Dengue virus
LLTDFQSYQLW

SEQ ID NO: 23806 - protein, 11 aa, Dengue virus
ASLFPLCLSTT

SEQ ID NO: 23807 - protein, 11 aa, Dengue virus
SLIPLCLSTTS

SEQ ID NO: 23808 - protein, 11 aa, Dengue virus
LIPLCLSTTSQ

SEQ ID NO: 23809 - protein, 11 aa, Dengue virus
IPLCLSTTSQK

SEQ ID NO: 23810 - protein, 11 aa, Dengue virus
LLGSLGCKPLP

SEQ ID NO: 23811 - protein, 11 aa, Dengue virus
LGSLGCKPLPM

SEQ ID NO: 23812 - protein, 11 aa, Dengue virus
GSLGCKPLPMF

SEQ ID NO: 23813 - protein, 11 aa, Dengue virus
SLGCKPLPMFL

SEQ ID NO: 23814 - protein, 11 aa, Dengue virus
LGCKPLPMFLI

SEQ ID NO: 23815 - protein, 11 aa, Dengue virus
GCKPLPMFLIT

SEQ ID NO: 23816 - protein, 11 aa, Dengue virus
CKPLPMFLITE

SEQ ID NO: 23817 - protein, 11 aa, Dengue virus
ETKIWGRKSWP

SEQ ID NO: 23818 - protein, 11 aa, Dengue virus
TKIWGRKSWPL

SEQ ID NO: 23819 - protein, 11 aa, Dengue virus
KIWGRKSWPIN

SEQ ID NO: 23820 - protein, 11 aa, Dengue virus
IWGRKSWPINE

SEQ ID NO: 23821 - protein, 11 aa, Dengue virus
WGRKSWPINEG

SEQ ID NO: 23822 - protein, 11 aa, Dengue virus
GRKSWPINEGI

SEQ ID NO: 23823 - protein, 11 aa, Dengue virus
RKSWPINEGIM

SEQ ID NO: 23824 - protein, 11 aa, Dengue virus
KSWPINEGIMA

SEQ ID NO: 23825 - protein, 11 aa, Dengue virus
SWPINEGIMAV

SEQ ID NO: 23826 - protein, 11 aa, Dengue virus
WPINEGIMAVG

SEQ ID NO: 23827 - protein, 11 aa, Dengue virus
PLNEGIMAVGV

SEQ ID NO: 23828 - protein, 11 aa, Dengue virus
LNEGIMAVGVV

SEQ ID NO: 23829 - protein, 11 aa, Dengue virus
NEGIMAVGVVS

SEQ ID NO: 23830 - protein, 11 aa, Dengue virus
EGIMAVGVVSI

SEQ ID NO: 23831 - protein, 11 aa, Dengue virus
GIMAVGVVSIL

SEQ ID NO: 23832 - protein, 11 aa, Dengue virus
IMAVGVVSILL

SEQ ID NO: 23833 - protein, 11 aa, Dengue virus
MAVGVVSILLS

SEQ ID NO: 23834 - protein, 11 aa, Dengue virus
AVGVVSILLSS

SEQ ID NO: 23835 - protein, 11 aa, Dengue virus
VGVVSILLSSL

SEQ ID NO: 23836 - protein, 11 aa, Dengue virus
GIVSILLSALL

SEQ ID NO: 23837 - protein, 11 aa, Dengue virus
IVSILLSALLK

SEQ ID NO: 23838 - protein, 11 aa, Dengue virus
GSSADLSLDKA

SEQ ID NO: 23839 - protein, 11 aa, Dengue virus
SSADLSLDKAA

SEQ ID NO: 23840 - protein, 11 aa, Dengue virus
SADLSLEKAAK

SEQ ID NO: 23841 - protein, 11 aa, Dengue virus
ADLSLEKAAKV

SEQ ID NO: 23842 - protein, 11 aa, Dengue virus
DLSLEKAAKVS

SEQ ID NO: 23843 - protein, 11 aa, Dengue virus
LSLEKAAKVSW

SEQ ID NO: 23844 - protein, 11 aa, Dengue virus
SLEKAAKVSWE

SEQ ID NO: 23845 - protein, 11 aa, Dengue virus
AVVSWEEEAEH

SEQ ID NO: 23846 - protein, 11 aa, Dengue virus
VVSWEEEAEHS

SEQ ID NO: 23847 - protein, 11 aa, Dengue virus
VSWEKEAEHSG

SEQ ID NO: 23848 - protein, 11 aa, Dengue virus
SWEEEAEHSGT

SEQ ID NO: 23849 - protein, 11 aa, Dengue virus
WEEEAEHSGTS

SEQ ID NO: 23850 - protein, 11 aa, Dengue virus
EEEAEHSGTSH

SEQ ID NO: 23851 - protein, 11 aa, Dengue virus
EEAEHSGTSHN

SEQ ID NO: 23852 - protein, 11 aa, Dengue virus
AEHSGASHNIF

SEQ ID NO: 23853 - protein, 11 aa, Dengue virus
EHSGASHNIFV

SEQ ID NO: 23854 - protein, 11 aa, Dengue virus
HSGASHNILVV

SEQ ID NO: 23855 - protein, 11 aa, Dengue virus
SGASHNILVEI

SEQ ID NO: 23856 - protein, 11 aa, Dengue virus
GASHNILVEIQ

SEQ ID NO: 23857 - protein, 11 aa, Dengue virus
ASHNILVEIQD

SEQ ID NO: 23858 - protein, 11 aa, Dengue virus
SHNILVVVQDD

SEQ ID NO: 23859 - protein, 11 aa, Dengue virus
HNILVVVQDDG

SEQ ID NO: 23860 - protein, 11 aa, Dengue virus
NILVVVQDDGT

SEQ ID NO: 23861 - protein, 11 aa, Dengue virus
ILVVVQDDGTM

SEQ ID NO: 23862 - protein, 11 aa, Dengue virus
LVVVQDDGTMK

SEQ ID NO: 23863 - protein, 11 aa, Dengue virus
VVVQDDGTMKI

SEQ ID NO: 23864 - protein, 11 aa, Dengue virus
VVQDDGTMKIK

SEQ ID NO: 23865 - protein, 11 aa, Dengue virus
KIKDEEKDDTL

SEQ ID NO: 23866 - protein, 11 aa, Dengue virus
IKDEEKDDTLT

SEQ ID NO: 23867 - protein, 11 aa, Dengue virus
KDEEKDDTLTI

SEQ ID NO: 23868 - protein, 11 aa, Dengue virus
DEEKDDTLTIL

SEQ ID NO: 23869 - protein, 11 aa, Dengue virus
EEKDDTLTILL

SEQ ID NO: 23870 - protein, 11 aa, Dengue virus
EKDDTLTILLK

SEQ ID NO: 23871 - protein, 11 aa, Dengue virus
KDDTLTILLKA

SEQ ID NO: 23872 - protein, 11 aa, Dengue virus
LKATLLAVSGM

SEQ ID NO: 23873 - protein, 11 aa, Dengue virus
KATLLAVSGMY

SEQ ID NO: 23874 - protein, 11 aa, Dengue virus
ATLLAVSGMYP

SEQ ID NO: 23875 - protein, 11 aa, Dengue virus
LLAISGVYPMS

SEQ ID NO: 23876 - protein, 11 aa, Dengue virus
LAISGVYPMSI

SEQ ID NO: 23877 - protein, 11 aa, Dengue virus
AISGVYPMSIP

SEQ ID NO: 23878 - protein, 11 aa, Dengue virus
ISGVYPMSIPA

SEQ ID NO: 23879 - protein, 11 aa, Dengue virus
YPLSIPATLFL

SEQ ID NO: 23880 - protein, 11 aa, Dengue virus
PLSIPATLFLW

SEQ ID NO: 23881 - protein, 11 aa, Dengue virus
SIPATLFLWYF

SEQ ID NO: 23882 - protein, 11 aa, Dengue virus
IPATLFLWYFW

SEQ ID NO: 23883 - protein, 11 aa, Dengue virus
PATLFLWYFWQ

SEQ ID NO: 23884 - protein, 11 aa, Dengue virus
LWDTPSPPKVE

SEQ ID NO: 23885 - protein, 11 aa, Dengue virus
WDTPSPPEVEK

SEQ ID NO: 23886 - protein, 11 aa, Dengue virus
DTPSPPEVEKA

SEQ ID NO: 23887 - protein, 11 aa, Dengue virus
TPSPPEVEKAV

SEQ ID NO: 23888 - protein, 11 aa, Dengue virus
PSPPEVEKAVL

SEQ ID NO: 23889 - protein, 11 aa, Dengue virus
SPPEVEKAVLD

SEQ ID NO: 23890 - protein, 11 aa, Dengue virus
VEKAVLDDGIY

SEQ ID NO: 23891 - protein, 11 aa, Dengue virus
EKAVLDDGIYR

SEQ ID NO: 23892 - protein, 11 aa, Dengue virus
SQVGVGVFQEG

SEQ ID NO: 23893 - protein, 11 aa, Dengue virus
QVGVGVFQEGV

SEQ ID NO: 23894 - protein, 11 aa, Dengue virus
VGVGVFQEGVF

SEQ ID NO: 23895 - protein, 11 aa, Dengue virus
GVGVFQEGVFH

SEQ ID NO: 23896 - protein, 11 aa, Dengue virus
VGVFQEGVFHT

SEQ ID NO: 23897 - protein, 11 aa, Dengue virus
GVFQEGVFHTM

SEQ ID NO: 23898 - protein, 11 aa, Dengue virus
VFQEGVFHTMW

SEQ ID NO: 23899 - protein, 11 aa, Dengue virus
FQEGVFHTMWH

SEQ ID NO: 23900 - protein, 11 aa, Dengue virus
QEGVFHTMWHV

SEQ ID NO: 23901 - protein, 11 aa, Dengue virus
EGVFHTMWHVT

SEQ ID NO: 23902 - protein, 11 aa, Dengue virus
LISYGGGWRLR

SEQ ID NO: 23903 - protein, 11 aa, Dengue virus
ISYGGGWRLRG

SEQ ID NO: 23904 - protein, 11 aa, Dengue virus
SYGGGWRLRGS

SEQ ID NO: 23905 - protein, 11 aa, Dengue virus
YGGGWRLRGSW

SEQ ID NO: 23906 - protein, 11 aa, Dengue virus
GGGWRLRGSWN

SEQ ID NO: 23907 - protein, 11 aa, Dengue virus
QGSWNAGEEVQ

SEQ ID NO: 23908 - protein, 11 aa, Dengue virus
GLWNTGEEVQV

SEQ ID NO: 23909 - protein, 11 aa, Dengue virus
LWNTGEEVQVI

SEQ ID NO: 23910 - protein, 11 aa, Dengue virus
PGKNPKNVQTM

SEQ ID NO: 23911 - protein, 11 aa, Dengue virus
GKNPKNVQTMP

SEQ ID NO: 23912 - protein, 11 aa, Dengue virus
KNPKNVQTMPG

SEQ ID NO: 23913 - protein, 11 aa, Dengue virus
NPKNVQTMPGT

SEQ ID NO: 23914 - protein, 11 aa, Dengue virus
PKNVQTMPGTF

SEQ ID NO: 23915 - protein, 11 aa, Dengue virus
KNVQTMPGTFK

SEQ ID NO: 23916 - protein, 11 aa, Dengue virus
NVQTMPGTFKT

SEQ ID NO: 23917 - protein, 11 aa, Dengue virus
VQTAPGTFKTS

SEQ ID NO: 23918 - protein, 11 aa, Dengue virus
QTAPGTFKTSE

SEQ ID NO: 23919 - protein, 11 aa, Dengue virus
TAPGTFKTSEG

SEQ ID NO: 23920 - protein, 11 aa, Dengue virus
APGTFKTSEGE

SEQ ID NO: 23921 - protein, 11 aa, Dengue virus
TYVSAIAQARA

SEQ ID NO: 23922 - protein, 11 aa, Dengue virus
YVSAIAQARAS

SEQ ID NO: 23923 - protein, 11 aa, Dengue virus
VSAIAQARASQ

SEQ ID NO: 23924 - protein, 11 aa, Dengue virus
SAIAQARASQE

SEQ ID NO: 23925 - protein, 11 aa, Dengue virus
AIAQARASQEG

SEQ ID NO: 23926 - protein, 11 aa, Dengue virus
IAQARASQEGP

SEQ ID NO: 23927 - protein, 11 aa, Dengue virus
AQARASQEGPL

SEQ ID NO: 23928 - protein, 11 aa, Dengue virus
QARASQEGPLP

SEQ ID NO: 23929 - protein, 11 aa, Dengue virus
ARASQEGPLPE

SEQ ID NO: 23930 - protein, 11 aa, Dengue virus
RASQEGPLPEI

SEQ ID NO: 23931 - protein, 11 aa, Dengue virus
SQEGPLPEIEN

SEQ ID NO: 23932 - protein, 11 aa, Dengue virus
QEGPLPEIENE

SEQ ID NO: 23933 - protein, 11 aa, Dengue virus
EGPLPEIENEV

SEQ ID NO: 23934 - protein, 11 aa, Dengue virus
GPLPEIENEVF

SEQ ID NO: 23935 - protein, 11 aa, Dengue virus
PLPEIEEEVFK

SEQ ID NO: 23936 - protein, 11 aa, Dengue virus
LPEIEEEVFKK

SEQ ID NO: 23937 - protein, 11 aa, Dengue virus
PEIEEEVFKKR

SEQ ID NO: 23938 - protein, 11 aa, Dengue virus
EIEEEVFKKRN

SEQ ID NO: 23939 - protein, 11 aa, Dengue virus
IEEEVFKKRNL

SEQ ID NO: 23940 - protein, 11 aa, Dengue virus
EEEVFKKRNLT

SEQ ID NO: 23941 - protein, 11 aa, Dengue virus
EEVFKKRNLTI

SEQ ID NO: 23942 - protein, 11 aa, Dengue virus
KVFRKRNLTIM

SEQ ID NO: 23943 - protein, 11 aa, Dengue virus
YLPAIVREAIR

SEQ ID NO: 23944 - protein, 11 aa, Dengue virus
LPAIVREAIRR

SEQ ID NO: 23945 - protein, 11 aa, Dengue virus
PAMVREAIKRK

SEQ ID NO: 23946 - protein, 11 aa, Dengue virus
VREAIKRKMRT

SEQ ID NO: 23947 - protein, 11 aa, Dengue virus
REAIKRKMRTL

SEQ ID NO: 23948 - protein, 11 aa, Dengue virus
IKRKLRTLVLA

SEQ ID NO: 23949 - protein, 11 aa, Dengue virus
KRKLRTLVLAP

SEQ ID NO: 23950 - protein, 11 aa, Dengue virus
RKLRTLVLAPT

SEQ ID NO: 23951 - protein, 11 aa, Dengue virus
KLRTLVLAPTR

SEQ ID NO: 23952 - protein, 11 aa, Dengue virus
SVEAFPQSNAI

SEQ ID NO: 23953 - protein, 11 aa, Dengue virus
VEAFPQSNAII

SEQ ID NO: 23954 - protein, 11 aa, Dengue virus
QSNAIIQDEER

SEQ ID NO: 23955 - protein, 11 aa, Dengue virus
SNAIIQDEERD

SEQ ID NO: 23956 - protein, 11 aa, Dengue virus
NAIIQDEERDI

SEQ ID NO: 23957 - protein, 11 aa, Dengue virus
AIIQDEERDIP

SEQ ID NO: 23958 - protein, 11 aa, Dengue virus
IIQDEERDIPE

SEQ ID NO: 23959 - protein, 11 aa, Dengue virus
IPERSWNSGHE

SEQ ID NO: 23960 - protein, 11 aa, Dengue virus
PERSWNSGHEW

SEQ ID NO: 23961 - protein, 11 aa, Dengue virus
ERSWNSGHEWI

SEQ ID NO: 23962 - protein, 11 aa, Dengue virus
RSWNSGHEWIT

SEQ ID NO: 23963 - protein, 11 aa, Dengue virus
SWNSGHEWITD

SEQ ID NO: 23964 - protein, 11 aa, Dengue virus
WNSGHEWITDF

SEQ ID NO: 23965 - protein, 11 aa, Dengue virus
NSGHEWITDFP

SEQ ID NO: 23966 - protein, 11 aa, Dengue virus
SGHEWITDFPG

SEQ ID NO: 23967 - protein, 11 aa, Dengue virus
GHEWITDFPGK

SEQ ID NO: 23968 - protein, 11 aa, Dengue virus
HEWITDFPGKT

SEQ ID NO: 23969 - protein, 11 aa, Dengue virus
AQRRGRIGRNP

SEQ ID NO: 23970 - protein, 11 aa, Dengue virus
QRRGRIGRNPN

SEQ ID NO: 23971 - protein, 11 aa, Dengue virus
RRGRIGRNPNK

SEQ ID NO: 23972 - protein, 11 aa, Dengue virus
RGRIGRNPNKE

SEQ ID NO: 23973 - protein, 11 aa, Dengue virus
GRIGRNYNKEG

SEQ ID NO: 23974 - protein, 11 aa, Dengue virus
RIGRNYNKEGD

SEQ ID NO: 23975 - protein, 11 aa, Dengue virus
IGRNPNKEGDQ

SEQ ID NO: 23976 - protein, 11 aa, Dengue virus
GRNYNKEGDQY

SEQ ID NO: 23977 - protein, 11 aa, Dengue virus
RNQNKEGDQYI

SEQ ID NO: 23978 - protein, 11 aa, Dengue virus
NQNKEGDQYIY

SEQ ID NO: 23979 - protein, 11 aa, Dengue virus
QNKEGDQYIYM

SEQ ID NO: 23980 - protein, 11 aa, Dengue virus
DQYIYMGQPLK

SEQ ID NO: 23981 - protein, 11 aa, Dengue virus
QYIYMGQPLKN

SEQ ID NO: 23982 - protein, 11 aa, Dengue virus
YIYMGQPLKND

SEQ ID NO: 23983 - protein, 11 aa, Dengue virus
IYMGQPLKNDE

SEQ ID NO: 23984 - protein, 11 aa, Dengue virus
GRRSISGDLIL

SEQ ID NO: 23985 - protein, 11 aa, Dengue virus
RRSISGDLILE

SEQ ID NO: 23986 - protein, 11 aa, Dengue virus
RSISGDLILEI

SEQ ID NO: 23987 - protein, 11 aa, Dengue virus
SISGDLILEIG

SEQ ID NO: 23988 - protein, 11 aa, Dengue virus
ISGDLILEIGK

SEQ ID NO: 23989 - protein, 11 aa, Dengue virus
IGKLPQHLTQK

SEQ ID NO: 23990 - protein, 11 aa, Dengue virus
GKLPQHLTQKA

SEQ ID NO: 23991 - protein, 11 aa, Dengue virus
KLPQHLTQKAQ

SEQ ID NO: 23992 - protein, 11 aa, Dengue virus
LPQHLTQKAQN

SEQ ID NO: 23993 - protein, 11 aa, Dengue virus
PQHLTQKAQNA

SEQ ID NO: 23994 - protein, 11 aa, Dengue virus
QHLTQKAQNAL

SEQ ID NO: 23995 - protein, 11 aa, Dengue virus
HLTQKAQNALD

SEQ ID NO: 23996 - protein, 11 aa, Dengue virus
LTQKAQNALDN

SEQ ID NO: 23997 - protein, 11 aa, Dengue virus
TQKAQNALDNL

SEQ ID NO: 23998 - protein, 11 aa, Dengue virus
QKAQNALDNLV

SEQ ID NO: 23999 - protein, 11 aa, Dengue virus
EQGGRAYRHAL

SEQ ID NO: 24000 - protein, 11 aa, Dengue virus
QGGRAYRHALE

SEQ ID NO: 24001 - protein, 11 aa, Dengue virus
GGRAYRHALEE

SEQ ID NO: 24002 - protein, 11 aa, Dengue virus
GRAYRHALEEL

SEQ ID NO: 24003 - protein, 11 aa, Dengue virus
RAYRHALEELP

SEQ ID NO: 24004 - protein, 11 aa, Dengue virus
LEELPDTIETL

SEQ ID NO: 24005 - protein, 11 aa, Dengue virus
GGVMLFFLSGK

SEQ ID NO: 24006 - protein, 11 aa, Dengue virus
GVMLFFLSGKG

SEQ ID NO: 24007 - protein, 11 aa, Dengue virus
VMLFFLSGKGL

SEQ ID NO: 24008 - protein, 11 aa, Dengue virus
MLFFLSGKGLG

SEQ ID NO: 24009 - protein, 11 aa, Dengue virus
GKTSIGLLCVI

SEQ ID NO: 24010 - protein, 11 aa, Dengue virus
KTSIGLLCVTS

SEQ ID NO: 24011 - protein, 11 aa, Dengue virus
TSIGLLCVTSS

SEQ ID NO: 24012 - protein, 11 aa, Dengue virus
SIGLLCVTSSS

SEQ ID NO: 24013 - protein, 11 aa, Dengue virus
SSALLWMANVE

SEQ ID NO: 24014 - protein, 11 aa, Dengue virus
SALLWMANVEP

SEQ ID NO: 24015 - protein, 11 aa, Dengue virus
ALLWMANVEPH

SEQ ID NO: 24016 - protein, 11 aa, Dengue virus
LAYVVIGLLFV

SEQ ID NO: 24017 - protein, 11 aa, Dengue virus
AYVVIGLLFVI

SEQ ID NO: 24018 - protein, 11 aa, Dengue virus
YVVIGLLFIIL

SEQ ID NO: 24019 - protein, 11 aa, Dengue virus
VVIGLLFIILT

SEQ ID NO: 24020 - protein, 11 aa, Dengue virus
VIGLLFIILTV

SEQ ID NO: 24021 - protein, 11 aa, Dengue virus
IGLLFVILTVA

SEQ ID NO: 24022 - protein, 11 aa, Dengue virus
GLLFVILTVAA

SEQ ID NO: 24023 - protein, 11 aa, Dengue virus
LLFVILTVAAN

SEQ ID NO: 24024 - protein, 11 aa, Dengue virus
LFVILTVAANE

SEQ ID NO: 24025 - protein, 11 aa, Dengue virus
FVILTVAANEM

SEQ ID NO: 24026 - protein, 11 aa, Dengue virus
VILTVAANEMG

SEQ ID NO: 24027 - protein, 11 aa, Dengue virus
TTKKDLGIGHA

SEQ ID NO: 24028 - protein, 11 aa, Dengue virus
TKKDLGIGHAA

SEQ ID NO: 24029 - protein, 11 aa, Dengue virus
TMLDVDLRPAS

SEQ ID NO: 24030 - protein, 11 aa, Dengue virus
VNPLTLTATVL

SEQ ID NO: 24031 - protein, 11 aa, Dengue virus
NPLTLTATVLM

SEQ ID NO: 24032 - protein, 11 aa, Dengue virus
PLTLTATVLML

SEQ ID NO: 24033 - protein, 11 aa, Dengue virus
LTLTAAVLMLL

SEQ ID NO: 24034 - protein, 11 aa, Dengue virus
TLTAAVLMLLA

SEQ ID NO: 24035 - protein, 11 aa, Dengue virus
LTAAVLMLLAH

SEQ ID NO: 24036 - protein, 11 aa, Dengue virus
TAAVLMLLAHY

SEQ ID NO: 24037 - protein, 11 aa, Dengue virus
ATVLMLVAHYA

SEQ ID NO: 24038 - protein, 11 aa, Dengue virus
TVLMLVAHYAI

SEQ ID NO: 24039 - protein, 11 aa, Dengue virus
MKNPTVDGIVT

SEQ ID NO: 24040 - protein, 11 aa, Dengue virus
KNPTVDGIVTI

SEQ ID NO: 24041 - protein, 11 aa, Dengue virus
NPTVDGIVTID

SEQ ID NO: 24042 - protein, 11 aa, Dengue virus
PTVDGIVTIDL

SEQ ID NO: 24043 - protein, 11 aa, Dengue virus
TVDGIVTIDLD

SEQ ID NO: 24044 - protein, 11 aa, Dengue virus
VDGIVTIDLDP

SEQ ID NO: 24045 - protein, 11 aa, Dengue virus
TIDLDPVVYDA

SEQ ID NO: 24046 - protein, 11 aa, Dengue virus
DAKFEKQLGQV

SEQ ID NO: 24047 - protein, 11 aa, Dengue virus
AKFEKQLGQVM

SEQ ID NO: 24048 - protein, 11 aa, Dengue virus
QLSKPEFNTYK

SEQ ID NO: 24049 - protein, 11 aa, Dengue virus
LSKSEFNTYKK

SEQ ID NO: 24050 - protein, 11 aa, Dengue virus
SKSEFNTYKKS

SEQ ID NO: 24051 - protein, 11 aa, Dengue virus
KSEFNTYKKSG

SEQ ID NO: 24052 - protein, 11 aa, Dengue virus
SEFNTYKKSGI

SEQ ID NO: 24053 - protein, 11 aa, Dengue virus
EFNTYKRSGII

SEQ ID NO: 24054 - protein, 11 aa, Dengue virus
FNTYKRSGIIE

SEQ ID NO: 24055 - protein, 11 aa, Dengue virus
NTYKRSGIIEV

SEQ ID NO: 24056 - protein, 11 aa, Dengue virus
TYKRSGIIEVD

SEQ ID NO: 24057 - protein, 11 aa, Dengue virus
YKKSGIMEVDR

SEQ ID NO: 24058 - protein, 11 aa, Dengue virus
KKSGIMEVDRS

SEQ ID NO: 24059 - protein, 11 aa, Dengue virus
KSGIMEVDRSE

SEQ ID NO: 24060 - protein, 11 aa, Dengue virus
SGIVEVDRSEA

SEQ ID NO: 24061 - protein, 11 aa, Dengue virus
GIVEVDRSEAK

SEQ ID NO: 24062 - protein, 11 aa, Dengue virus
IVEVDRSEAKE

SEQ ID NO: 24063 - protein, 11 aa, Dengue virus
VEVDRSEAKEG

SEQ ID NO: 24064 - protein, 11 aa, Dengue virus
EAKEGLKRGEI

SEQ ID NO: 24065 - protein, 11 aa, Dengue virus
AKEGLKRGEIT

SEQ ID NO: 24066 - protein, 11 aa, Dengue virus
KEGLRRGETTK

SEQ ID NO: 24067 - protein, 11 aa, Dengue virus
EGLRRGETTKH

SEQ ID NO: 24068 - protein, 11 aa, Dengue virus
GLRRGETTKHA

SEQ ID NO: 24069 - protein, 11 aa, Dengue virus
LRRGETTKHAV

SEQ ID NO: 24070 - protein, 11 aa, Dengue virus
RRGETTKHAVS

SEQ ID NO: 24071 - protein, 11 aa, Dengue virus
RGEITKHAVSR

SEQ ID NO: 24072 - protein, 11 aa, Dengue virus
GEITKHAVSRG

SEQ ID NO: 24073 - protein, 11 aa, Dengue virus
EITKHAVSRGT

SEQ ID NO: 24074 - protein, 11 aa, Dengue virus
ITKHAVSRGTA

SEQ ID NO: 24075 - protein, 11 aa, Dengue virus
IKHAVSRGTAK

SEQ ID NO: 24076 - protein, 11 aa, Dengue virus
GYTKGGLGHEE

SEQ ID NO: 24077 - protein, 11 aa, Dengue virus
YTKGGLGHEEP

SEQ ID NO: 24078 - protein, 11 aa, Dengue virus
TKGGAGHEEPI

SEQ ID NO: 24079 - protein, 11 aa, Dengue virus
KGGAGHEEPIP

SEQ ID NO: 24080 - protein, 11 aa, Dengue virus
GGAGHEEPIPM

SEQ ID NO: 24081 - protein, 11 aa, Dengue virus
GAGHEEPIPMA

SEQ ID NO: 24082 - protein, 11 aa, Dengue virus
AGHEEPIPMAT

SEQ ID NO: 24083 - protein, 11 aa, Dengue virus
ATYGWNLVRLH

SEQ ID NO: 24084 - protein, 11 aa, Dengue virus
TYGWNLVRLHS

SEQ ID NO: 24085 - protein, 11 aa, Dengue virus
YGWNLVRLHSG

SEQ ID NO: 24086 - protein, 11 aa, Dengue virus
GWNLVRLHSGK

SEQ ID NO: 24087 - protein, 11 aa, Dengue virus
WNLVRLHSGKD

SEQ ID NO: 24088 - protein, 11 aa, Dengue virus
NLVRLHSGKDV

SEQ ID NO: 24089 - protein, 11 aa, Dengue virus
LVRLHSGKDVF

SEQ ID NO: 24090 - protein, 11 aa, Dengue virus
VRLHSGKDVFF

SEQ ID NO: 24091 - protein, 11 aa, Dengue virus
SGKDVFFMPPE

SEQ ID NO: 24092 - protein, 11 aa, Dengue virus
GKDVFFMPPEK

SEQ ID NO: 24093 - protein, 11 aa, Dengue virus
KDVFFMPPEKC

SEQ ID NO: 24094 - protein, 11 aa, Dengue virus
DVFFMPPEKCD

SEQ ID NO: 24095 - protein, 11 aa, Dengue virus
VFFMPPEKCDT

SEQ ID NO: 24096 - protein, 11 aa, Dengue virus
FFMPPEKCDTL

SEQ ID NO: 24097 - protein, 11 aa, Dengue virus
FMPPEKCDTLL

SEQ ID NO: 24098 - protein, 11 aa, Dengue virus
MPPEKCDTLLC

SEQ ID NO: 24099 - protein, 11 aa, Dengue virus
YMPSVVETLEH

SEQ ID NO: 24100 - protein, 11 aa, Dengue virus
MPSVVETLERM

SEQ ID NO: 24101 - protein, 11 aa, Dengue virus
PSVVETLEHMQ

SEQ ID NO: 24102 - protein, 11 aa, Dengue virus
SVVETLERMQR

SEQ ID NO: 24103 - protein, 11 aa, Dengue virus
VVETLEQMQRR

SEQ ID NO: 24104 - protein, 11 aa, Dengue virus
VETLEQMQRKY

SEQ ID NO: 24105 - protein, 11 aa, Dengue virus
ETLEQMQRKYG

SEQ ID NO: 24106 - protein, 11 aa, Dengue virus
TLEQMQRKYGG

SEQ ID NO: 24107 - protein, 11 aa, Dengue virus
LEQMQRRHGGM

SEQ ID NO: 24108 - protein, 11 aa, Dengue virus
EQMQRRHGGML

SEQ ID NO: 24109 - protein, 11 aa, Dengue virus
QMQRRHGGMLV

SEQ ID NO: 24110 - protein, 11 aa, Dengue virus
RFTMAHRKPTF

SEQ ID NO: 24111 - protein, 11 aa, Dengue virus
FTMAHRKPTFE

SEQ ID NO: 24112 - protein, 11 aa, Dengue virus
TMTHRKPTYER

SEQ ID NO: 24113 - protein, 11 aa, Dengue virus
MTHRKPTYERD

SEQ ID NO: 24114 - protein, 11 aa, Dengue virus
AHRKPTYEKDV

SEQ ID NO: 24115 - protein, 11 aa, Dengue virus
HRKPTFERDVD

SEQ ID NO: 24116 - protein, 11 aa, Dengue virus
RKPTFERDVDL

SEQ ID NO: 24117 - protein, 11 aa, Dengue virus
KPTFERDVDLG

SEQ ID NO: 24118 - protein, 11 aa, Dengue virus
PTYEKDVDLGA

SEQ ID NO: 24119 - protein, 11 aa, Dengue virus
TYEKDVDLGAG

SEQ ID NO: 24120 - protein, 11 aa, Dengue virus
YEKDVDLGAGT

SEQ ID NO: 24121 - protein, 11 aa, Dengue virus
EKDVDLGAGTR

SEQ ID NO: 24122 - protein, 11 aa, Dengue virus
KDVDLGAGTRH

SEQ ID NO: 24123 - protein, 11 aa, Dengue virus
VDLGAGTRHVT

SEQ ID NO: 24124 - protein, 11 aa, Dengue virus
DLGAGTRHVTV

SEQ ID NO: 24125 - protein, 11 aa, Dengue virus
LGAGTRHVTVE

SEQ ID NO: 24126 - protein, 11 aa, Dengue virus
GAGTRHVTVEP

SEQ ID NO: 24127 - protein, 11 aa, Dengue virus
AGTRHVTVEPE

SEQ ID NO: 24128 - protein, 11 aa, Dengue virus
GTRHVAVEPEE

SEQ ID NO: 24129 - protein, 11 aa, Dengue virus
TRHVAVEPEEA

SEQ ID NO: 24130 - protein, 11 aa, Dengue virus
RHVAVEPEEAN

SEQ ID NO: 24131 - protein, 11 aa, Dengue virus
VEPEEANLDII

SEQ ID NO: 24132 - protein, 11 aa, Dengue virus
EPEEANLDIIG

SEQ ID NO: 24133 - protein, 11 aa, Dengue virus
PEEANLDIIGQ

SEQ ID NO: 24134 - protein, 11 aa, Dengue virus
EEANLDIIGQR

SEQ ID NO: 24135 - protein, 11 aa, Dengue virus
EANLDIIGQRI

SEQ ID NO: 24136 - protein, 11 aa, Dengue virus
KVDTRTPKAKQ

SEQ ID NO: 24137 - protein, 11 aa, Dengue virus
VDTRTPKAKQG

SEQ ID NO: 24138 - protein, 11 aa, Dengue virus
DTRTPKAKQGT

SEQ ID NO: 24139 - protein, 11 aa, Dengue virus
TRTPRAKRGTA

SEQ ID NO: 24140 - protein, 11 aa, Dengue virus
RTPRAKRGTAQ

SEQ ID NO: 24141 - protein, 11 aa, Dengue virus
TPRAKRGTAQI

SEQ ID NO: 24142 - protein, 11 aa, Dengue virus
PRAKRGTAQIM

SEQ ID NO: 24143 - protein, 11 aa, Dengue virus
KRGTVQIMEVT

SEQ ID NO: 24144 - protein, 11 aa, Dengue virus
RGTVQIMEVTA

SEQ ID NO: 24145 - protein, 11 aa, Dengue virus
QIMEMTAKWLW

SEQ ID NO: 24146 - protein, 11 aa, Dengue virus
IMEMTAKWLWG

SEQ ID NO: 24147 - protein, 11 aa, Dengue virus
MEMTAKWLWGF

SEQ ID NO: 24148 - protein, 11 aa, Dengue virus
EMTAKWLWGFL

SEQ ID NO: 24149 - protein, 11 aa, Dengue virus
MTAKWLWGFLS

SEQ ID NO: 24150 - protein, 11 aa, Dengue virus
TARWLWSFLSR

SEQ ID NO: 24151 - protein, 11 aa, Dengue virus
ARWLWSFLSRN

SEQ ID NO: 24152 - protein, 11 aa, Dengue virus
RWLWSFLSRNK

SEQ ID NO: 24153 - protein, 11 aa, Dengue virus
KEAVEDERFWE

SEQ ID NO: 24154 - protein, 11 aa, Dengue virus
EAVEDERFWEL

SEQ ID NO: 24155 - protein, 11 aa, Dengue virus
AVEDERFWELV

SEQ ID NO: 24156 - protein, 11 aa, Dengue virus
LVRRERELHKQ

SEQ ID NO: 24157 - protein, 11 aa, Dengue virus
VRRERELHKQG

SEQ ID NO: 24158 - protein, 11 aa, Dengue virus
RRERELHKQGK

SEQ ID NO: 24159 - protein, 11 aa, Dengue virus
LSGVEGEGLHR

SEQ ID NO: 24160 - protein, 11 aa, Dengue virus
KLGYILRDISR

SEQ ID NO: 24161 - protein, 11 aa, Dengue virus
LGYILRDISRI

SEQ ID NO: 24162 - protein, 11 aa, Dengue virus
GYILRDISRIP

SEQ ID NO: 24163 - protein, 11 aa, Dengue virus
YILRDISRIPG

SEQ ID NO: 24164 - protein, 11 aa, Dengue virus
ILRDISRIPGG

SEQ ID NO: 24165 - protein, 11 aa, Dengue virus
LRDISRIPGGN

SEQ ID NO: 24166 - protein, 11 aa, Dengue virus
RDISRIPGGNM

SEQ ID NO: 24167 - protein, 11 aa, Dengue virus
DISRIPGGNMY

SEQ ID NO: 24168 - protein, 11 aa, Dengue virus
ISRIPGGNMYA

SEQ ID NO: 24169 - protein, 11 aa, Dengue virus
SRIPGGNMYAD

SEQ ID NO: 24170 - protein, 11 aa, Dengue virus
RIPGGNMYADD

SEQ ID NO: 24171 - protein, 11 aa, Dengue virus
ISGGNMYADDT

SEQ ID NO: 24172 - protein, 11 aa, Dengue virus
SGGNMYADDTA

SEQ ID NO: 24173 - protein, 11 aa, Dengue virus
VTEDDLQNEAK

SEQ ID NO: 24174 - protein, 11 aa, Dengue virus
TEDDLRNEAKI

SEQ ID NO: 24175 - protein, 11 aa, Dengue virus
EDDLRNEAKIT

SEQ ID NO: 24176 - protein, 11 aa, Dengue virus
DDLQNEAKITE

SEQ ID NO: 24177 - protein, 11 aa, Dengue virus
DLQNEAKITEI

SEQ ID NO: 24178 - protein, 11 aa, Dengue virus
LQNEAKITEIM

SEQ ID NO: 24179 - protein, 11 aa, Dengue virus
QNEAKITEIME

SEQ ID NO: 24180 - protein, 11 aa, Dengue virus
NEAKITEIMEP

SEQ ID NO: 24181 - protein, 11 aa, Dengue virus
EAKITEIMEPE

SEQ ID NO: 24182 - protein, 11 aa, Dengue virus
AKITEIMEPEH

SEQ ID NO: 24183 - protein, 11 aa, Dengue virus
KITEIMEPEHA

SEQ ID NO: 24184 - protein, 11 aa, Dengue virus
ITDIMEAEHAL

SEQ ID NO: 24185 - protein, 11 aa, Dengue virus
IMEPEHALLAR

SEQ ID NO: 24186 - protein, 11 aa, Dengue virus
MEPEHALLAKA

SEQ ID NO: 24187 - protein, 11 aa, Dengue virus
EPEHALLAKAI

SEQ ID NO: 24188 - protein, 11 aa, Dengue virus
PEHALLAKAIF

SEQ ID NO: 24189 - protein, 11 aa, Dengue virus
EHALLAKAIFK

SEQ ID NO: 24190 - protein, 11 aa, Dengue virus
HALLAKAIFKL

SEQ ID NO: 24191 - protein, 11 aa, Dengue virus
ALLAKAIFKLT

SEQ ID NO: 24192 - protein, 11 aa, Dengue virus
LLAKAIFKLTY

SEQ ID NO: 24193 - protein, 11 aa, Dengue virus
LAKAIFKLTYQ

SEQ ID NO: 24194 - protein, 11 aa, Dengue virus
AKAIFKLTYQN

SEQ ID NO: 24195 - protein, 11 aa, Dengue virus
KAIFKLTYQNK

SEQ ID NO: 24196 - protein, 11 aa, Dengue virus
NKVVRVQRPTK

SEQ ID NO: 24197 - protein, 11 aa, Dengue virus
KVVRVQRPARN

SEQ ID NO: 24198 - protein, 11 aa, Dengue virus
VVRVQRPARNG

SEQ ID NO: 24199 - protein, 11 aa, Dengue virus
VRVQRPARNGT

SEQ ID NO: 24200 - protein, 11 aa, Dengue virus
RVQRPARNGTV

SEQ ID NO: 24201 - protein, 11 aa, Dengue virus
VQRPARNGTVM

SEQ ID NO: 24202 - protein, 11 aa, Dengue virus
QRPARNGTVMD

SEQ ID NO: 24203 - protein, 11 aa, Dengue virus
RPARNGTVMDV

SEQ ID NO: 24204 - protein, 11 aa, Dengue virus
PARNGTVMDVI

SEQ ID NO: 24205 - protein, 11 aa, Dengue virus
ARNGTVMDVIS

SEQ ID NO: 24206 - protein, 11 aa, Dengue virus
RNGTVMDVISR

SEQ ID NO: 24207 - protein, 11 aa, Dengue virus
YGLNTFTNMGA

SEQ ID NO: 24208 - protein, 11 aa, Dengue virus
GLNTFTNMGAQ

SEQ ID NO: 24209 - protein, 11 aa, Dengue virus
LNTFTNMGAQL

SEQ ID NO: 24210 - protein, 11 aa, Dengue virus
NTFTNMGAQLI

SEQ ID NO: 24211 - protein, 11 aa, Dengue virus
TFTNMGAQLIR

SEQ ID NO: 24212 - protein, 11 aa, Dengue virus
FTNMGAQLIRQ

SEQ ID NO: 24213 - protein, 11 aa, Dengue virus
TNMGAQLIRQM

SEQ ID NO: 24214 - protein, 11 aa, Dengue virus
NMGAQLIRQME

SEQ ID NO: 24215 - protein, 11 aa, Dengue virus
MGAQLIRQMES

SEQ ID NO: 24216 - protein, 11 aa, Dengue virus
GAQLIRQMESE

SEQ ID NO: 24217 - protein, 11 aa, Dengue virus
AQLIRQMESEE

SEQ ID NO: 24218 - protein, 11 aa, Dengue virus
IRQMESEGIFF

SEQ ID NO: 24219 - protein, 11 aa, Dengue virus
RQMESEGIFFP

SEQ ID NO: 24220 - protein, 11 aa, Dengue virus
ISGDDCVVKPV

SEQ ID NO: 24221 - protein, 11 aa, Dengue virus
SGDDCVVKPVD

SEQ ID NO: 24222 - protein, 11 aa, Dengue virus
GDDCVVKPVDD

SEQ ID NO: 24223 - protein, 11 aa, Dengue virus
DDCVVKPVDDR

SEQ ID NO: 24224 - protein, 11 aa, Dengue virus
DCVVKPVDDRF

SEQ ID NO: 24225 - protein, 11 aa, Dengue virus
CVVKPVDDRFA

SEQ ID NO: 24226 - protein, 11 aa, Dengue virus
VVKPVDDRFAT

SEQ ID NO: 24227 - protein, 11 aa, Dengue virus
VKPVDDRFATA

SEQ ID NO: 24228 - protein, 11 aa, Dengue virus
KPVDDRFATAL

SEQ ID NO: 24229 - protein, 11 aa, Dengue virus
DDRFATALSAL

SEQ ID NO: 24230 - protein, 11 aa, Dengue virus
DRFATALSALN

SEQ ID NO: 24231 - protein, 11 aa, Dengue virus
RFATALSALND

SEQ ID NO: 24232 - protein, 11 aa, Dengue virus
FATALSALNDM

SEQ ID NO: 24233 - protein, 11 aa, Dengue virus
ATALSALNDMG

SEQ ID NO: 24234 - protein, 11 aa, Dengue virus
TALSALNDMGK

SEQ ID NO: 24235 - protein, 11 aa, Dengue virus
ALSALNDMGKV

SEQ ID NO: 24236 - protein, 11 aa, Dengue virus
LSALNDMGKVR

SEQ ID NO: 24237 - protein, 11 aa, Dengue virus
SALNDMGKVRK

SEQ ID NO: 24238 - protein, 11 aa, Dengue virus
AANAICSADPV

SEQ ID NO: 24239 - protein, 11 aa, Dengue virus
PVEWVPTSRTT

SEQ ID NO: 24240 - protein, 11 aa, Dengue virus
VEWVPTSRTTW

SEQ ID NO: 24241 - protein, 11 aa, Dengue virus
EWVPTSRTTWS

SEQ ID NO: 24242 - protein, 11 aa, Dengue virus
ENPWMEDKTRI

SEQ ID NO: 24243 - protein, 11 aa, Dengue virus
NPWMEDKTRIS

SEQ ID NO: 24244 - protein, 11 aa, Dengue virus
PWMEDKTRISS

SEQ ID NO: 24245 - protein, 11 aa, Dengue virus
WMEDKTRISSW

SEQ ID NO: 24246 - protein, 11 aa, Dengue virus
MEDKTHVSSWG

SEQ ID NO: 24247 - protein, 11 aa, Dengue virus
ISSWEDVPYLG

SEQ ID NO: 24248 - protein, 11 aa, Dengue virus
SSWEEVPYLGK

SEQ ID NO: 24249 - protein, 11 aa, Dengue virus
SWEEVPYLGKR

SEQ ID NO: 24250 - protein, 11 aa, Dengue virus
WEEVPYLGKRE

SEQ ID NO: 24251 - protein, 11 aa, Dengue virus
EEVPYLGKRED

SEQ ID NO: 24252 - protein, 11 aa, Dengue virus
TWATNVQVAIN

SEQ ID NO: 24253 - protein, 11 aa, Dengue virus
WATNVQVAINQ

SEQ ID NO: 24254 - protein, 11 aa, Dengue virus
ATNVQVAINQV

SEQ ID NO: 24255 - protein, 11 aa, Dengue virus
VRRLIGNENYS

SEQ ID NO: 24256 - protein, 11 aa, Dengue virus
RRLIGNENYSD

SEQ ID NO: 24257 - protein, 11 aa, Dengue virus
RLIGNENYSDY

SEQ ID NO: 24258 - protein, 11 aa, Dengue virus
LIGNENYSDYM

SEQ ID NO: 24259 - protein, 11 aa, Dengue virus
IGNENYSDYMT

SEQ ID NO: 24260 - protein, 11 aa, Dengue virus
GNENYLDFMTS

SEQ ID NO: 24261 - protein, 11 aa, Dengue virus
NENYLDFMTSM

SEQ ID NO: 24262 - protein, 11 aa, Dengue virus
ENYLDFMTSMK

SEQ ID NO: 24263 - protein, 11 aa, Dengue virus
NYLDFMTSMKR

SEQ ID NO: 24264 - protein, 11 aa, Dengue virus
YLDFMTSMKRF

SEQ ID NO: 24265 - protein, 11 aa, Dengue virus
LDFMTSMKRFK

SEQ ID NO: 24266 - protein, 11 aa, Dengue virus
DFMTSMKRFKN

SEQ ID NO: 24267 - protein, 11 aa, Dengue virus
YMTSMKRFKND

SEQ ID NO: 24268 - protein, 11 aa, Dengue virus
MINQRKKTGRP

SEQ ID NO: 24269 - protein, 11 aa, Dengue virus
INQRKKTGRPS

SEQ ID NO: 24270 - protein, 11 aa, Dengue virus
VLRGFKREISN

SEQ ID NO: 24271 - protein, 11 aa, Dengue virus
LRGFKREISNM

SEQ ID NO: 24272 - protein, 11 aa, Dengue virus
RGFKREISNML

SEQ ID NO: 24273 - protein, 11 aa, Dengue virus
GFKREISNMLN

SEQ ID NO: 24274 - protein, 11 aa, Dengue virus
PTALTFHLTTR

SEQ ID NO: 24275 - protein, 11 aa, Dengue virus
TALTFHLTTRG

SEQ ID NO: 24276 - protein, 11 aa, Dengue virus
ALTFHLTTRGG

SEQ ID NO: 24277 - protein, 11 aa, Dengue virus
TRGGEPHMIVG

SEQ ID NO: 24278 - protein, 11 aa, Dengue virus
RGGEPHMIVGK

SEQ ID NO: 24279 - protein, 11 aa, Dengue virus
GGEPHMIVGKQ

SEQ ID NO: 24280 - protein, 11 aa, Dengue virus
GEPHMIVGKQE

SEQ ID NO: 24281 - protein, 11 aa, Dengue virus
EPHMIVGKQER

SEQ ID NO: 24282 - protein, 11 aa, Dengue virus
PHMIVGKQERG

SEQ ID NO: 24283 - protein, 11 aa, Dengue virus
HMIVGKQERGK

SEQ ID NO: 24284 - protein, 11 aa, Dengue virus
MIVGKQERGKS

SEQ ID NO: 24285 - protein, 11 aa, Dengue virus
IVGKQERGKSL

SEQ ID NO: 24286 - protein, 11 aa, Dengue virus
KSLLFKTSTGV

SEQ ID NO: 24287 - protein, 11 aa, Dengue virus
SLLFKTSTGVN

SEQ ID NO: 24288 - protein, 11 aa, Dengue virus
LLFKTSTGVNM

SEQ ID NO: 24289 - protein, 11 aa, Dengue virus
LFKTSTGVNMC

SEQ ID NO: 24290 - protein, 11 aa, Dengue virus
FKTSTGVNMCT

SEQ ID NO: 24291 - protein, 11 aa, Dengue virus
KTSTGVNMCTL

SEQ ID NO: 24292 - protein, 11 aa, Dengue virus
TSTGVNMCTLI

SEQ ID NO: 24293 - protein, 11 aa, Dengue virus
STGVNMCTLIA

SEQ ID NO: 24294 - protein, 11 aa, Dengue virus
TGVNMCTLIAM

SEQ ID NO: 24295 - protein, 11 aa, Dengue virus
MDLGELCEDTI

SEQ ID NO: 24296 - protein, 11 aa, Dengue virus
DLGELCEDTIT

SEQ ID NO: 24297 - protein, 11 aa, Dengue virus
LGELCEDTITY

SEQ ID NO: 24298 - protein, 11 aa, Dengue virus
GELCEDTITYK

SEQ ID NO: 24299 - protein, 11 aa, Dengue virus
ELCEDTITYKC

SEQ ID NO: 24300 - protein, 11 aa, Dengue virus
LCEDTITYKCP

SEQ ID NO: 24301 - protein, 11 aa, Dengue virus
CEDTITYKCPR

SEQ ID NO: 24302 - protein, 11 aa, Dengue virus
EDTITYKCPRI

SEQ ID NO: 24303 - protein, 11 aa, Dengue virus
DTITYKCPRIT

SEQ ID NO: 24304 - protein, 11 aa, Dengue virus
TITYKCPRITE

SEQ ID NO: 24305 - protein, 11 aa, Dengue virus
TYKCPRITEVE

SEQ ID NO: 24306 - protein, 11 aa, Dengue virus
YKCPRITEVEP

SEQ ID NO: 24307 - protein, 11 aa, Dengue virus
KCPRITEVEPD

SEQ ID NO: 24308 - protein, 11 aa, Dengue virus
CPRITEVEPDD

SEQ ID NO: 24309 - protein, 11 aa, Dengue virus
PRITEVEPDDV

SEQ ID NO: 24310 - protein, 11 aa, Dengue virus
RITEVEPDDVD

SEQ ID NO: 24311 - protein, 11 aa, Dengue virus
ISEAEPDDVDC

SEQ ID NO: 24312 - protein, 11 aa, Dengue virus
SEAEPDDVDCW

SEQ ID NO: 24313 - protein, 11 aa, Dengue virus
TCSRTGEHRRD

SEQ ID NO: 24314 - protein, 11 aa, Dengue virus
CSRTGEHRRDK

SEQ ID NO: 24315 - protein, 11 aa, Dengue virus
SRTGEHRRDKR

SEQ ID NO: 24316 - protein, 11 aa, Dengue virus
RTGEHRRDKRS

SEQ ID NO: 24317 - protein, 11 aa, Dengue virus
WKQIQRVETWV

SEQ ID NO: 24318 - protein, 11 aa, Dengue virus
KQIQRVETWVL

SEQ ID NO: 24319 - protein, 11 aa, Dengue virus
WALRHPGFTVM

SEQ ID NO: 24320 - protein, 11 aa, Dengue virus
ALRHPGFTVMA

SEQ ID NO: 24321 - protein, 11 aa, Dengue virus
LRHPGFTVMAL

SEQ ID NO: 24322 - protein, 11 aa, Dengue virus
RHPGFTVMALF

SEQ ID NO: 24323 - protein, 11 aa, Dengue virus
HPGFTVMALFL

SEQ ID NO: 24324 - protein, 11 aa, Dengue virus
PGFTVMALFLA

SEQ ID NO: 24325 - protein, 11 aa, Dengue virus
KTEVTSPAILR

SEQ ID NO: 24326 - protein, 11 aa, Dengue virus
TEVTSPAILRK

SEQ ID NO: 24327 - protein, 11 aa, Dengue virus
EVTSPAILRKL

SEQ ID NO: 24328 - protein, 11 aa, Dengue virus
VANPAVLRKLC

SEQ ID NO: 24329 - protein, 11 aa, Dengue virus
TSPAILRKLCI

SEQ ID NO: 24330 - protein, 11 aa, Dengue virus
GEATLVEEQDS

SEQ ID NO: 24331 - protein, 11 aa, Dengue virus
EATLVEEQDSN

SEQ ID NO: 24332 - protein, 11 aa, Dengue virus
ATLVEEQDSNF

SEQ ID NO: 24333 - protein, 11 aa, Dengue virus
TLVEEQDSNFV

SEQ ID NO: 24334 - protein, 11 aa, Dengue virus
LVEEQDSNFVC

SEQ ID NO: 24335 - protein, 11 aa, Dengue virus
VEEQDSNFVCR

SEQ ID NO: 24336 - protein, 11 aa, Dengue virus
QDANFVCRRTL

SEQ ID NO: 24337 - protein, 11 aa, Dengue virus
DANFVCRRTLV

SEQ ID NO: 24338 - protein, 11 aa, Dengue virus
ANFVCRRTLVD

SEQ ID NO: 24339 - protein, 11 aa, Dengue virus
KCVTRLEGKIV

SEQ ID NO: 24340 - protein, 11 aa, Dengue virus
CVTKLEGKVVQ

SEQ ID NO: 24341 - protein, 11 aa, Dengue virus
TKLEGKTVQHE

SEQ ID NO: 24342 - protein, 11 aa, Dengue virus
KLEGKTVQHEN

SEQ ID NO: 24343 - protein, 11 aa, Dengue virus
LEGKTVQHENL

SEQ ID NO: 24344 - protein, 11 aa, Dengue virus
EGKTVQHENLK

SEQ ID NO: 24345 - protein, 11 aa, Dengue virus
GKTVQHENLKY

SEQ ID NO: 24346 - protein, 11 aa, Dengue virus
KTVQHENLKYS

SEQ ID NO: 24347 - protein, 11 aa, Dengue virus
TVQHENLKYSV

SEQ ID NO: 24348 - protein, 11 aa, Dengue virus
VGNESTEHGTI

SEQ ID NO: 24349 - protein, 11 aa, Dengue virus
GNESTEHGTIA

SEQ ID NO: 24350 - protein, 11 aa, Dengue virus
NESTEHGTIAT

SEQ ID NO: 24351 - protein, 11 aa, Dengue virus
ESTEHGTIATI

SEQ ID NO: 24352 - protein, 11 aa, Dengue virus
STEHGTIATIT

SEQ ID NO: 24353 - protein, 11 aa, Dengue virus
TIATITPQAPS

SEQ ID NO: 24354 - protein, 11 aa, Dengue virus
TATITPQAPTS

SEQ ID NO: 24355 - protein, 11 aa, Dengue virus
TSEIQLTDYGT

SEQ ID NO: 24356 - protein, 11 aa, Dengue virus
TEIQLTDYGVL

SEQ ID NO: 24357 - protein, 11 aa, Dengue virus
FNEMVLLTMKG

SEQ ID NO: 24358 - protein, 11 aa, Dengue virus
NEMVLLTMEKK

SEQ ID NO: 24359 - protein, 11 aa, Dengue virus
EMVLLTMKGKS

SEQ ID NO: 24360 - protein, 11 aa, Dengue virus
MVLLTMKGKSW

SEQ ID NO: 24361 - protein, 11 aa, Dengue virus
VLLTMEKKSWL

SEQ ID NO: 24362 - protein, 11 aa, Dengue virus
LLTMEKKSWLV

SEQ ID NO: 24363 - protein, 11 aa, Dengue virus
LTMEKKSWLVH

SEQ ID NO: 24364 - protein, 11 aa, Dengue virus
TMEKKSWLVHK

SEQ ID NO: 24365 - protein, 11 aa, Dengue virus
MEKKSWLVHKQ

SEQ ID NO: 24366 - protein, 11 aa, Dengue virus
EKKSWLVHKQW

SEQ ID NO: 24367 - protein, 11 aa, Dengue virus
TTQETWNRQDL

SEQ ID NO: 24368 - protein, 11 aa, Dengue virus
TQETWNRQDLL

SEQ ID NO: 24369 - protein, 11 aa, Dengue virus
LKMDKLTLKGI

SEQ ID NO: 24370 - protein, 11 aa, Dengue virus
KMDKLTLKGIS

SEQ ID NO: 24371 - protein, 11 aa, Dengue virus
MDKLTLKGISY

SEQ ID NO: 24372 - protein, 11 aa, Dengue virus
DKLTLKGISYV

SEQ ID NO: 24373 - protein, 11 aa, Dengue virus
KLTLKGISYVM

SEQ ID NO: 24374 - protein, 11 aa, Dengue virus
LTLKGISYVMC

SEQ ID NO: 24375 - protein, 11 aa, Dengue virus
TLKGISYVMCT

SEQ ID NO: 24376 - protein, 11 aa, Dengue virus
LKGISYVMCTG

SEQ ID NO: 24377 - protein, 11 aa, Dengue virus
CTGLFKLEKEV

SEQ ID NO: 24378 - protein, 11 aa, Dengue virus
TGLFKLEKEVA

SEQ ID NO: 24379 - protein, 11 aa, Dengue virus
GPFKLEKEVAE

SEQ ID NO: 24380 - protein, 11 aa, Dengue virus
TVLVQVRYEGT

SEQ ID NO: 24381 - protein, 11 aa, Dengue virus
VLVQVRYEGTD

SEQ ID NO: 24382 - protein, 11 aa, Dengue virus
LVQVRYEGTDA

SEQ ID NO: 24383 - protein, 11 aa, Dengue virus
VQVRYEGTDAP

SEQ ID NO: 24384 - protein, 11 aa, Dengue virus
TDAPCKIPFSA

SEQ ID NO: 24385 - protein, 11 aa, Dengue virus
DAPCKIPFSAQ

SEQ ID NO: 24386 - protein, 11 aa, Dengue virus
APCKIPFSAQD

SEQ ID NO: 24387 - protein, 11 aa, Dengue virus
PCKIPFSAQDE

SEQ ID NO: 24388 - protein, 11 aa, Dengue virus
QDGKGVTQNGR

SEQ ID NO: 24389 - protein, 11 aa, Dengue virus
GVTQNGRLVTA

SEQ ID NO: 24390 - protein, 11 aa, Dengue virus
VTQNGRLVTAN

SEQ ID NO: 24391 - protein, 11 aa, Dengue virus
TQNGRVITANP

SEQ ID NO: 24392 - protein, 11 aa, Dengue virus
LITANPIVTDR

SEQ ID NO: 24393 - protein, 11 aa, Dengue virus
ITANPIVTDRE

SEQ ID NO: 24394 - protein, 11 aa, Dengue virus
ANPIVTDKEKL

SEQ ID NO: 24395 - protein, 11 aa, Dengue virus
NPIVTDKEKPI

SEQ ID NO: 24396 - protein, 11 aa, Dengue virus
PIVTDKEKPIN

SEQ ID NO: 24397 - protein, 11 aa, Dengue virus
IVTDKEKPINI

SEQ ID NO: 24398 - protein, 11 aa, Dengue virus
VTDKEKPINIE

SEQ ID NO: 24399 - protein, 11 aa, Dengue virus
TDREKPVNIEA

SEQ ID NO: 24400 - protein, 11 aa, Dengue virus
DREKPVNIEAE

SEQ ID NO: 24401 - protein, 11 aa, Dengue virus
REKPVNIEAEP

SEQ ID NO: 24402 - protein, 11 aa, Dengue virus
TEPPFGESYII

SEQ ID NO: 24403 - protein, 11 aa, Dengue virus
EPPFGESYIIV

SEQ ID NO: 24404 - protein, 11 aa, Dengue virus
PPFGESYIIVG

SEQ ID NO: 24405 - protein, 11 aa, Dengue virus
AGEKALKLSWV

SEQ ID NO: 24406 - protein, 11 aa, Dengue virus
GEEALKLSWFK

SEQ ID NO: 24407 - protein, 11 aa, Dengue virus
EKALKLSWFRK

SEQ ID NO: 24408 - protein, 11 aa, Dengue virus
KALKLSWFRKG

SEQ ID NO: 24409 - protein, 11 aa, Dengue virus
LKLSWFKKGSN

SEQ ID NO: 24410 - protein, 11 aa, Dengue virus
KLSWFRKGSSI

SEQ ID NO: 24411 - protein, 11 aa, Dengue virus
LSWFRKGSSIG

SEQ ID NO: 24412 - protein, 11 aa, Dengue virus
SWFKKGSNIGK

SEQ ID NO: 24413 - protein, 11 aa, Dengue virus
FRKGSSIGKMF

SEQ ID NO: 24414 - protein, 11 aa, Dengue virus
KKGSNIGKMFE

SEQ ID NO: 24415 - protein, 11 aa, Dengue virus
KGSNIGKMFEA

SEQ ID NO: 24416 - protein, 11 aa, Dengue virus
GSNIGKMFEAT

SEQ ID NO: 24417 - protein, 11 aa, Dengue virus
SNIGKMFEATA

SEQ ID NO: 24418 - protein, 11 aa, Dengue virus
NIGKMFEATAR

SEQ ID NO: 24419 - protein, 11 aa, Dengue virus
GKLVHQVFGAA

SEQ ID NO: 24420 - protein, 11 aa, Dengue virus
KLVHQVFGAAY

SEQ ID NO: 24421 - protein, 11 aa, Dengue virus
LVHQVFGAAYG

SEQ ID NO: 24422 - protein, 11 aa, Dengue virus
VHQVFGAAYGV

SEQ ID NO: 24423 - protein, 11 aa, Dengue virus
WLGLNSRSASL

SEQ ID NO: 24424 - protein, 11 aa, Dengue virus
LGLNSRNTSLS

SEQ ID NO: 24425 - protein, 11 aa, Dengue virus
GLNSRNTSLSV

SEQ ID NO: 24426 - protein, 11 aa, Dengue virus
LNSRNTSLSVM

SEQ ID NO: 24427 - protein, 11 aa, Dengue virus
NSRNTSLSVMC

SEQ ID NO: 24428 - protein, 11 aa, Dengue virus
SRNTSLSVMCI

SEQ ID NO: 24429 - protein, 11 aa, Dengue virus
RSTSLSMTCIV

SEQ ID NO: 24430 - protein, 11 aa, Dengue virus
STSLSMTCIVV

SEQ ID NO: 24431 - protein, 11 aa, Dengue virus
TSLSVMCIAVG

SEQ ID NO: 24432 - protein, 11 aa, Dengue virus
SLSVMCIAVGM

SEQ ID NO: 24433 - protein, 11 aa, Dengue virus
SVMCIAVGMVT

SEQ ID NO: 24434 - protein, 11 aa, Dengue virus
VMCIAVGMVTL

SEQ ID NO: 24435 - protein, 11 aa, Dengue virus
MCIAVGMVTLY

SEQ ID NO: 24436 - protein, 11 aa, Dengue virus
CIVVGMVTLYL

SEQ ID NO: 24437 - protein, 11 aa, Dengue virus
IVVGMVTLYLG

SEQ ID NO: 24438 - protein, 11 aa, Dengue virus
VVGMVTLYLGV

SEQ ID NO: 24439 - protein, 11 aa, Dengue virus
VGLVTLYLGAM

SEQ ID NO: 24440 - protein, 11 aa, Dengue virus
GLVTLYLGAMV

SEQ ID NO: 24441 - protein, 11 aa, Dengue virus
LVTLYLGAMVQ

SEQ ID NO: 24442 - protein, 11 aa, Dengue virus
GIRSATRLENV

SEQ ID NO: 24443 - protein, 11 aa, Dengue virus
IRSATRLENVM

SEQ ID NO: 24444 - protein, 11 aa, Dengue virus
SVTRLENIMWK

SEQ ID NO: 24445 - protein, 11 aa, Dengue virus
VTRLENIMWKQ

SEQ ID NO: 24446 - protein, 11 aa, Dengue virus
ELNHILLENDI

SEQ ID NO: 24447 - protein, 11 aa, Dengue virus
LNHILLENDIK

SEQ ID NO: 24448 - protein, 11 aa, Dengue virus
NYILLENDMKF

SEQ ID NO: 24449 - protein, 11 aa, Dengue virus
YILLENDMKFT

SEQ ID NO: 24450 - protein, 11 aa, Dengue virus
ILLENDIKFTV

SEQ ID NO: 24451 - protein, 11 aa, Dengue virus
LLENDIKFTVV

SEQ ID NO: 24452 - protein, 11 aa, Dengue virus
LENDIKFTVVV

SEQ ID NO: 24453 - protein, 11 aa, Dengue virus
ENDIKFTVVVG

SEQ ID NO: 24454 - protein, 11 aa, Dengue virus
NDIKFTVVVGN

SEQ ID NO: 24455 - protein, 11 aa, Dengue virus
QGRKMIRPQPM

SEQ ID NO: 24456 - protein, 11 aa, Dengue virus
GRKMIRPQPME

SEQ ID NO: 24457 - protein, 11 aa, Dengue virus
KKMVRPQPMEH

SEQ ID NO: 24458 - protein, 11 aa, Dengue virus
KTIRPQPMEHK

SEQ ID NO: 24459 - protein, 11 aa, Dengue virus
TIRPQPMEHKY

SEQ ID NO: 24460 - protein, 11 aa, Dengue virus
QPMEYKYSWKI

SEQ ID NO: 24461 - protein, 11 aa, Dengue virus
PMEYKYSWRSW

SEQ ID NO: 24462 - protein, 11 aa, Dengue virus
MEYKYSWKIWG

SEQ ID NO: 24463 - protein, 11 aa, Dengue virus
EYKYSWKIWGK

SEQ ID NO: 24464 - protein, 11 aa, Dengue virus
YKYSWKIWGKA

SEQ ID NO: 24465 - protein, 11 aa, Dengue virus
KYSWKIWGKAK

SEQ ID NO: 24466 - protein, 11 aa, Dengue virus
WKNWGKAKIIG

SEQ ID NO: 24467 - protein, 11 aa, Dengue virus
KNWGKAKIIGA

SEQ ID NO: 24468 - protein, 11 aa, Dengue virus
WGKAKIIGADT

SEQ ID NO: 24469 - protein, 11 aa, Dengue virus
GKAKIIGADTQ

SEQ ID NO: 24470 - protein, 11 aa, Dengue virus
KAKIIGADTQN

SEQ ID NO: 24471 - protein, 11 aa, Dengue virus
IDGPDTPECPN

SEQ ID NO: 24472 - protein, 11 aa, Dengue virus
ECPDEQRAWNI

SEQ ID NO: 24473 - protein, 11 aa, Dengue virus
CPDEQRAWNIW

SEQ ID NO: 24474 - protein, 11 aa, Dengue virus
PDEQRAWNIWE

SEQ ID NO: 24475 - protein, 11 aa, Dengue virus
DEQRAWNIWEV

SEQ ID NO: 24476 - protein, 11 aa, Dengue virus
EQRAWNIWEVE

SEQ ID NO: 24477 - protein, 11 aa, Dengue virus
GIFTTNIWLRL

SEQ ID NO: 24478 - protein, 11 aa, Dengue virus
IFTTNIWLRLR

SEQ ID NO: 24479 - protein, 11 aa, Dengue virus
RDSYTQACDHR

SEQ ID NO: 24480 - protein, 11 aa, Dengue virus
DSYTQACDHRL

SEQ ID NO: 24481 - protein, 11 aa, Dengue virus
SYTQACDHRLM

SEQ ID NO: 24482 - protein, 11 aa, Dengue virus
YTQACDHRLMS

SEQ ID NO: 24483 - protein, 11 aa, Dengue virus
NEPWKLARASF

SEQ ID NO: 24484 - protein, 11 aa, Dengue virus
ETWKLERASFI

SEQ ID NO: 24485 - protein, 11 aa, Dengue virus
KASFIEVKTCI

SEQ ID NO: 24486 - protein, 11 aa, Dengue virus
LESEMIIPKMY

SEQ ID NO: 24487 - protein, 11 aa, Dengue virus
ESEMIIPKMYG

SEQ ID NO: 24488 - protein, 11 aa, Dengue virus
SEMIIPKMYGG

SEQ ID NO: 24489 - protein, 11 aa, Dengue virus
EMIIPKMYGGP

SEQ ID NO: 24490 - protein, 11 aa, Dengue virus
PKMYGGPISQH

SEQ ID NO: 24491 - protein, 11 aa, Dengue virus
KMYGGPISQHN

SEQ ID NO: 24492 - protein, 11 aa, Dengue virus
YGGPISQHNHR

SEQ ID NO: 24493 - protein, 11 aa, Dengue virus
MSQHNYRPGYF

SEQ ID NO: 24494 - protein, 11 aa, Dengue virus
IVDEHCGNRGP

SEQ ID NO: 24495 - protein, 11 aa, Dengue virus
SGEVDNFSLGI

SEQ ID NO: 24496 - protein, 11 aa, Dengue virus
SIMTEEVMRSR

SEQ ID NO: 24497 - protein, 11 aa, Dengue virus
IMTEEVMRSRW

SEQ ID NO: 24498 - protein, 11 aa, Dengue virus
MTEEVMRSRWS

SEQ ID NO: 24499 - protein, 11 aa, Dengue virus
RSRWSRKMLMA

SEQ ID NO: 24500 - protein, 11 aa, Dengue virus
SRWSRKMLMAG

SEQ ID NO: 24501 - protein, 11 aa, Dengue virus
RWSRKMLMTGI

SEQ ID NO: 24502 - protein, 11 aa, Dengue virus
WSRKMLMTGIL

SEQ ID NO: 24503 - protein, 11 aa, Dengue virus
GQLTWNDLTRL

SEQ ID NO: 24504 - protein, 11 aa, Dengue virus
QLTWNDLTRLC

SEQ ID NO: 24505 - protein, 11 aa, Dengue virus
LTWNDLTRLCI

SEQ ID NO: 24506 - protein, 11 aa, Dengue virus
TWNDLTRLCIM

SEQ ID NO: 24507 - protein, 11 aa, Dengue virus
WNDLTRLCIMV

SEQ ID NO: 24508 - protein, 11 aa, Dengue virus
NDLTRLCIMVG

SEQ ID NO: 24509 - protein, 11 aa, Dengue virus
IRLCIMVGANV

SEQ ID NO: 24510 - protein, 11 aa, Dengue virus
RLCIMVGANVS

SEQ ID NO: 24511 - protein, 11 aa, Dengue virus
LCIMVGANVSD

SEQ ID NO: 24512 - protein, 11 aa, Dengue virus
CIMVGANASDN

SEQ ID NO: 24513 - protein, 11 aa, Dengue virus
IMVGANASDNM

SEQ ID NO: 24514 - protein, 11 aa, Dengue virus
MVGANASDNMG

SEQ ID NO: 24515 - protein, 11 aa, Dengue virus
GANASDNMGMG

SEQ ID NO: 24516 - protein, 11 aa, Dengue virus
DRMGMGMTYLA

SEQ ID NO: 24517 - protein, 11 aa, Dengue virus
RMGMGMTYLAL

SEQ ID NO: 24518 - protein, 11 aa, Dengue virus
TTHLALMATFK

SEQ ID NO: 24519 - protein, 11 aa, Dengue virus
LMATFKIRPMF

SEQ ID NO: 24520 - protein, 11 aa, Dengue virus
MATFKIRPMFA

SEQ ID NO: 24521 - protein, 11 aa, Dengue virus
ATFKIRPMFAV

SEQ ID NO: 24522 - protein, 11 aa, Dengue virus
TFKIRPMFAVG

SEQ ID NO: 24523 - protein, 11 aa, Dengue virus
FKIRPMFAVGL

SEQ ID NO: 24524 - protein, 11 aa, Dengue virus
KIRPMFAVGLL

SEQ ID NO: 24525 - protein, 11 aa, Dengue virus
IRPMFAVGLLF

SEQ ID NO: 24526 - protein, 11 aa, Dengue virus
RPMFAVGLLLR

SEQ ID NO: 24527 - protein, 11 aa, Dengue virus
PMFAVGLLFRK

SEQ ID NO: 24528 - protein, 11 aa, Dengue virus
MFAVGLLFRKL

SEQ ID NO: 24529 - protein, 11 aa, Dengue virus
FAVGLLFRKLT

SEQ ID NO: 24530 - protein, 11 aa, Dengue virus
AVGLLLRRLTS

SEQ ID NO: 24531 - protein, 11 aa, Dengue virus
VGLLLRRLTSR

SEQ ID NO: 24532 - protein, 11 aa, Dengue virus
LLLRRLTSREV

SEQ ID NO: 24533 - protein, 11 aa, Dengue virus
LTIGLSLVASA

SEQ ID NO: 24534 - protein, 11 aa, Dengue virus
TIGLSLMASME

SEQ ID NO: 24535 - protein, 11 aa, Dengue virus
IGLSLMASMEL

SEQ ID NO: 24536 - protein, 11 aa, Dengue virus
GLSLVASVEIP

SEQ ID NO: 24537 - protein, 11 aa, Dengue virus
FVELPNSLEEL

SEQ ID NO: 24538 - protein, 11 aa, Dengue virus
IGIMMLKLLTD

SEQ ID NO: 24539 - protein, 11 aa, Dengue virus
MMLKLLTDFQP

SEQ ID NO: 24540 - protein, 11 aa, Dengue virus
LKLLTDFQPHQ

SEQ ID NO: 24541 - protein, 11 aa, Dengue virus
KLLTDFQPHQL

SEQ ID NO: 24542 - protein, 11 aa, Dengue virus
LLTDFQPHQLW

SEQ ID NO: 24543 - protein, 11 aa, Dengue virus
VSLIPLCLSTT

SEQ ID NO: 24544 - protein, 11 aa, Dengue virus
SLFPLCMSTTS

SEQ ID NO: 24545 - protein, 11 aa, Dengue virus
LFPLCMSTTSQ

SEQ ID NO: 24546 - protein, 11 aa, Dengue virus
FPLCMSTTSQK

SEQ ID NO: 24547 - protein, 11 aa, Dengue virus
LLGSLGCKPLA

SEQ ID NO: 24548 - protein, 11 aa, Dengue virus
GSLGCKPLAMF

SEQ ID NO: 24549 - protein, 11 aa, Dengue virus
SLGCKPLAMFL

SEQ ID NO: 24550 - protein, 11 aa, Dengue virus
LGCKPLAMFLI

SEQ ID NO: 24551 - protein, 11 aa, Dengue virus
GCKPLAMFLIA

SEQ ID NO: 24552 - protein, 11 aa, Dengue virus
CKPLTMFLIVE

SEQ ID NO: 24553 - protein, 11 aa, Dengue virus
ENEIWGRKSWP

SEQ ID NO: 24554 - protein, 11 aa, Dengue virus
NKIWGRKSWPI

SEQ ID NO: 24555 - protein, 11 aa, Dengue virus
EIWGRKSWPLN

SEQ ID NO: 24556 - protein, 11 aa, Dengue virus
PINEGIMAVGI

SEQ ID NO: 24557 - protein, 11 aa, Dengue virus
INEGIMAVGIV

SEQ ID NO: 24558 - protein, 11 aa, Dengue virus
AVGIVSILLSA

SEQ ID NO: 24559 - protein, 11 aa, Dengue virus
VGIVSILLSAL

SEQ ID NO: 24560 - protein, 11 aa, Dengue virus
SADLLLEKAAE

SEQ ID NO: 24561 - protein, 11 aa, Dengue virus
ADLLLEKAAEV

SEQ ID NO: 24562 - protein, 11 aa, Dengue virus
DLLLEKAAEVS

SEQ ID NO: 24563 - protein, 11 aa, Dengue virus
LLLEKAAEVSW

SEQ ID NO: 24564 - protein, 11 aa, Dengue virus
LLEKAAEVSWE

SEQ ID NO: 24565 - protein, 11 aa, Dengue virus
AKVSWEEEAEH

SEQ ID NO: 24566 - protein, 11 aa, Dengue virus
KVSWEEEAEHS

SEQ ID NO: 24567 - protein, 11 aa, Dengue virus
SWEQEAEHSGA

SEQ ID NO: 24568 - protein, 11 aa, Dengue virus
WEQEAEHSGAS

SEQ ID NO: 24569 - protein, 11 aa, Dengue virus
EQEAEHSGASH

SEQ ID NO: 24570 - protein, 11 aa, Dengue virus
QEAEHSGASHN

SEQ ID NO: 24571 - protein, 11 aa, Dengue virus
AEHSGASHNIS

SEQ ID NO: 24572 - protein, 11 aa, Dengue virus
HSGASHNIFVE

SEQ ID NO: 24573 - protein, 11 aa, Dengue virus
SGASHNILVVV

SEQ ID NO: 24574 - protein, 11 aa, Dengue virus
GASHNILVVVQ

SEQ ID NO: 24575 - protein, 11 aa, Dengue virus
ASHNILVVVQD

SEQ ID NO: 24576 - protein, 11 aa, Dengue virus
NILVEVQDDGP

SEQ ID NO: 24577 - protein, 11 aa, Dengue virus
ILVEVQDDGPM

SEQ ID NO: 24578 - protein, 11 aa, Dengue virus
LVEVQDDGPMK

SEQ ID NO: 24579 - protein, 11 aa, Dengue virus
KDEERDDMLTI

SEQ ID NO: 24580 - protein, 11 aa, Dengue virus
LLAVSGMYPLS

SEQ ID NO: 24581 - protein, 11 aa, Dengue virus
LAISGVYPLSI

SEQ ID NO: 24582 - protein, 11 aa, Dengue virus
AVSGMYPLSIP

SEQ ID NO: 24583 - protein, 11 aa, Dengue virus
ISGVYPLSIPA

SEQ ID NO: 24584 - protein, 11 aa, Dengue virus
WDTPSPPKVER

SEQ ID NO: 24585 - protein, 11 aa, Dengue virus
DTPSPPKVERA

SEQ ID NO: 24586 - protein, 11 aa, Dengue virus
TPSPPKVERAV

SEQ ID NO: 24587 - protein, 11 aa, Dengue virus
PSPPKVERAVL

SEQ ID NO: 24588 - protein, 11 aa, Dengue virus
SPPKVERAVLD

SEQ ID NO: 24589 - protein, 11 aa, Dengue virus
VERAVLDNGIY

SEQ ID NO: 24590 - protein, 11 aa, Dengue virus
ERAVLDNGIYR

SEQ ID NO: 24591 - protein, 11 aa, Dengue virus
QGLWNTGEEVQ

SEQ ID NO: 24592 - protein, 11 aa, Dengue virus
VQTMPGTFKTP

SEQ ID NO: 24593 - protein, 11 aa, Dengue virus
QTMPGTFKTPE

SEQ ID NO: 24594 - protein, 11 aa, Dengue virus
TMPGTFKTPEG

SEQ ID NO: 24595 - protein, 11 aa, Dengue virus
MPGTFKTPEGE

SEQ ID NO: 24596 - protein, 11 aa, Dengue virus
YVSAIAQTKAS

SEQ ID NO: 24597 - protein, 11 aa, Dengue virus
VSAIAQTKASQ

SEQ ID NO: 24598 - protein, 11 aa, Dengue virus
SAIAQTKASQE

SEQ ID NO: 24599 - protein, 11 aa, Dengue virus
AIAQTKASQEG

SEQ ID NO: 24600 - protein, 11 aa, Dengue virus
IAQTKASQEGP

SEQ ID NO: 24601 - protein, 11 aa, Dengue virus
AQTKASQEGPL

SEQ ID NO: 24602 - protein, 11 aa, Dengue virus
QTKASQEGPLP

SEQ ID NO: 24603 - protein, 11 aa, Dengue virus
TKASQEGPLPE

SEQ ID NO: 24604 - protein, 11 aa, Dengue virus
QEGPLPEIEDK

SEQ ID NO: 24605 - protein, 11 aa, Dengue virus
EGPLPEIEDKV

SEQ ID NO: 24606 - protein, 11 aa, Dengue virus
GPLPEIEDKVF

SEQ ID NO: 24607 - protein, 11 aa, Dengue virus
PLPEIENEVFR

SEQ ID NO: 24608 - protein, 11 aa, Dengue virus
LPEIENEVFRK

SEQ ID NO: 24609 - protein, 11 aa, Dengue virus
PEIENEVFRKR

SEQ ID NO: 24610 - protein, 11 aa, Dengue virus
EIENEVFRKRN

SEQ ID NO: 24611 - protein, 11 aa, Dengue virus
IENEVFRKRNL

SEQ ID NO: 24612 - protein, 11 aa, Dengue virus
ENEVFRKRNLT

SEQ ID NO: 24613 - protein, 11 aa, Dengue virus
NEVFRKRNLTI

SEQ ID NO: 24614 - protein, 11 aa, Dengue virus
PAIVREAIRRN

SEQ ID NO: 24615 - protein, 11 aa, Dengue virus
VREAIRRNVRT

SEQ ID NO: 24616 - protein, 11 aa, Dengue virus
REAIRRNVRTL

SEQ ID NO: 24617 - protein, 11 aa, Dengue virus
IKRRLRTLVLA

SEQ ID NO: 24618 - protein, 11 aa, Dengue virus
KRRLRTLVLAP

SEQ ID NO: 24619 - protein, 11 aa, Dengue virus
RRLRTLVLAPT

SEQ ID NO: 24620 - protein, 11 aa, Dengue virus
RLRTLVLAPTR

SEQ ID NO: 24621 - protein, 11 aa, Dengue virus
SAEAFPQSNAV

SEQ ID NO: 24622 - protein, 11 aa, Dengue virus
AEAFPQSNAVI

SEQ ID NO: 24623 - protein, 11 aa, Dengue virus
RNHNKEGDQYV

SEQ ID NO: 24624 - protein, 11 aa, Dengue virus
NHNKEGDQYVY

SEQ ID NO: 24625 - protein, 11 aa, Dengue virus
HNKEGDQYVYM

SEQ ID NO: 24626 - protein, 11 aa, Dengue virus
GRKSVSGDLIL

SEQ ID NO: 24627 - protein, 11 aa, Dengue virus
RRSVSSDLILE

SEQ ID NO: 24628 - protein, 11 aa, Dengue virus
KSVSGDLILEI

SEQ ID NO: 24629 - protein, 11 aa, Dengue virus
IGKLPQHLTLK

SEQ ID NO: 24630 - protein, 11 aa, Dengue virus
GKLPQHLTLKA

SEQ ID NO: 24631 - protein, 11 aa, Dengue virus
KLPQHLTLKAQ

SEQ ID NO: 24632 - protein, 11 aa, Dengue virus
LPQHLTLKAQN

SEQ ID NO: 24633 - protein, 11 aa, Dengue virus
PQHLTLKAQNA

SEQ ID NO: 24634 - protein, 11 aa, Dengue virus
QHLTLKAQNAL

SEQ ID NO: 24635 - protein, 11 aa, Dengue virus
HLTLKAQNALD

SEQ ID NO: 24636 - protein, 11 aa, Dengue virus
LTLKAQNALDN

SEQ ID NO: 24637 - protein, 11 aa, Dengue virus
TLKAQNALDNL

SEQ ID NO: 24638 - protein, 11 aa, Dengue virus
LKAQNALDNLV

SEQ ID NO: 24639 - protein, 11 aa, Dengue virus
KTSIGLLCVIA

SEQ ID NO: 24640 - protein, 11 aa, Dengue virus
TSIGLLCVIAS

SEQ ID NO: 24641 - protein, 11 aa, Dengue virus
SIGLLCVMSSS

SEQ ID NO: 24642 - protein, 11 aa, Dengue virus
SSVLLWIASVE

SEQ ID NO: 24643 - protein, 11 aa, Dengue virus
SALLWIASVEP

SEQ ID NO: 24644 - protein, 11 aa, Dengue virus
VLLWIASVEPH

SEQ ID NO: 24645 - protein, 11 aa, Dengue virus
TKKDLGIGHAV

SEQ ID NO: 24646 - protein, 11 aa, Dengue virus
TMLDIDLHPAS

SEQ ID NO: 24647 - protein, 11 aa, Dengue virus
LTLTATVLMLV

SEQ ID NO: 24648 - protein, 11 aa, Dengue virus
TLTATVLMLVA

SEQ ID NO: 24649 - protein, 11 aa, Dengue virus
LTATVLMLVAH

SEQ ID NO: 24650 - protein, 11 aa, Dengue virus
TATVLMLVAHY

SEQ ID NO: 24651 - protein, 11 aa, Dengue virus
LSKPEFNTYKR

SEQ ID NO: 24652 - protein, 11 aa, Dengue virus
SKPEFNTYKRS

SEQ ID NO: 24653 - protein, 11 aa, Dengue virus
EFNTYKKSGIM

SEQ ID NO: 24654 - protein, 11 aa, Dengue virus
FNTYKKSGIME

SEQ ID NO: 24655 - protein, 11 aa, Dengue virus
NTYKKSGIMEV

SEQ ID NO: 24656 - protein, 11 aa, Dengue virus
TYKKSGIMEVD

SEQ ID NO: 24657 - protein, 11 aa, Dengue virus
KRSGIVEVDRS

SEQ ID NO: 24658 - protein, 11 aa, Dengue virus
RSGIVEVDRSE

SEQ ID NO: 24659 - protein, 11 aa, Dengue virus
KEGLKRGEITK

SEQ ID NO: 24660 - protein, 11 aa, Dengue virus
EGLKRGEITKH

SEQ ID NO: 24661 - protein, 11 aa, Dengue virus
GLKRGEITKHA

SEQ ID NO: 24662 - protein, 11 aa, Dengue virus
LKRGEITKHAV

SEQ ID NO: 24663 - protein, 11 aa, Dengue virus
KRGEITKHAVS

SEQ ID NO: 24664 - protein, 11 aa, Dengue virus
ETIKHAVSRGT

SEQ ID NO: 24665 - protein, 11 aa, Dengue virus
TIKHAVSRGTA

SEQ ID NO: 24666 - protein, 11 aa, Dengue virus
TKGGLGHEEPI

SEQ ID NO: 24667 - protein, 11 aa, Dengue virus
KGGLGHEEPIP

SEQ ID NO: 24668 - protein, 11 aa, Dengue virus
GGLGHEEPIPM

SEQ ID NO: 24669 - protein, 11 aa, Dengue virus
GLGHEEPIPMA

SEQ ID NO: 24670 - protein, 11 aa, Dengue virus
LGHEEPIPMAT

SEQ ID NO: 24671 - protein, 11 aa, Dengue virus
TYGWNLVKLPS

SEQ ID NO: 24672 - protein, 11 aa, Dengue virus
NLVKLHSGKDA

SEQ ID NO: 24673 - protein, 11 aa, Dengue virus
LVKLHSGKDAF

SEQ ID NO: 24674 - protein, 11 aa, Dengue virus
VKLHSGKDAFF

SEQ ID NO: 24675 - protein, 11 aa, Dengue virus
SGKDVFFVPPE

SEQ ID NO: 24676 - protein, 11 aa, Dengue virus
GKDVFFVPPEK

SEQ ID NO: 24677 - protein, 11 aa, Dengue virus
KDVFFVPPEKC

SEQ ID NO: 24678 - protein, 11 aa, Dengue virus
DVFFVPPEKCD

SEQ ID NO: 24679 - protein, 11 aa, Dengue virus
VFFVPPEKCDT

SEQ ID NO: 24680 - protein, 11 aa, Dengue virus
FFVPPEKCDTL

SEQ ID NO: 24681 - protein, 11 aa, Dengue virus
FVPPEKCDTLL

SEQ ID NO: 24682 - protein, 11 aa, Dengue virus
VPPEKCDTLLC

SEQ ID NO: 24683 - protein, 11 aa, Dengue virus
VVETLERMQRK

SEQ ID NO: 24684 - protein, 11 aa, Dengue virus
VETLEQMQRRH

SEQ ID NO: 24685 - protein, 11 aa, Dengue virus
ETLEQMQRRHG

SEQ ID NO: 24686 - protein, 11 aa, Dengue virus
TLEQMQRRHGG

SEQ ID NO: 24687 - protein, 11 aa, Dengue virus
ERMQRKHGGML

SEQ ID NO: 24688 - protein, 11 aa, Dengue virus
RMQRKHGGMLV

SEQ ID NO: 24689 - protein, 11 aa, Dengue virus
TMAHRKPTFER

SEQ ID NO: 24690 - protein, 11 aa, Dengue virus
MAHRKPTFERD

SEQ ID NO: 24691 - protein, 11 aa, Dengue virus
AHRKPTFERDV

SEQ ID NO: 24692 - protein, 11 aa, Dengue virus
PTFERDVDLGA

SEQ ID NO: 24693 - protein, 11 aa, Dengue virus
TFERDVDLGAG

SEQ ID NO: 24694 - protein, 11 aa, Dengue virus
FERDVDLGAGT

SEQ ID NO: 24695 - protein, 11 aa, Dengue virus
GTRHVTVEPEV

SEQ ID NO: 24696 - protein, 11 aa, Dengue virus
TRHVTVEPEVA

SEQ ID NO: 24697 - protein, 11 aa, Dengue virus
RHVTVEPEVAN

SEQ ID NO: 24698 - protein, 11 aa, Dengue virus
VEPEVANIDII

SEQ ID NO: 24699 - protein, 11 aa, Dengue virus
EPEVPNLDIIG

SEQ ID NO: 24700 - protein, 11 aa, Dengue virus
PEVPNLDIIGQ

SEQ ID NO: 24701 - protein, 11 aa, Dengue virus
EVPNLDIIGQR

SEQ ID NO: 24702 - protein, 11 aa, Dengue virus
VPNLDIIGQRI

SEQ ID NO: 24703 - protein, 11 aa, Dengue virus
TRTPKAKRGTV

SEQ ID NO: 24704 - protein, 11 aa, Dengue virus
RTPKAKRGTVQ

SEQ ID NO: 24705 - protein, 11 aa, Dengue virus
TPKAKRGTVQI

SEQ ID NO: 24706 - protein, 11 aa, Dengue virus
PKAKRGTVQIM

SEQ ID NO: 24707 - protein, 11 aa, Dengue virus
KQGTAQIMEVT

SEQ ID NO: 24708 - protein, 11 aa, Dengue virus
QGTAQIMEVTA

SEQ ID NO: 24709 - protein, 11 aa, Dengue virus
IMEVTAKWLWD

SEQ ID NO: 24710 - protein, 11 aa, Dengue virus
MEVTAKWLWDF

SEQ ID NO: 24711 - protein, 11 aa, Dengue virus
EVTARWLWSFL

SEQ ID NO: 24712 - protein, 11 aa, Dengue virus
VTARWLWSFLS

SEQ ID NO: 24713 - protein, 11 aa, Dengue virus
AKWLWDFLSRN

SEQ ID NO: 24714 - protein, 11 aa, Dengue virus
KEAVEDERFWN

SEQ ID NO: 24715 - protein, 11 aa, Dengue virus
EAVEDERFWNL

SEQ ID NO: 24716 - protein, 11 aa, Dengue virus
AVEDERFWNLV

SEQ ID NO: 24717 - protein, 11 aa, Dengue virus
LVKKERELHKQ

SEQ ID NO: 24718 - protein, 11 aa, Dengue virus
VKKERELHKQG

SEQ ID NO: 24719 - protein, 11 aa, Dengue virus
KKERELHKQGK

SEQ ID NO: 24720 - protein, 11 aa, Dengue virus
RLGYILRDISK

SEQ ID NO: 24721 - protein, 11 aa, Dengue virus
LRDISKIPGGS

SEQ ID NO: 24722 - protein, 11 aa, Dengue virus
RDISKISGGNM

SEQ ID NO: 24723 - protein, 11 aa, Dengue virus
DISKIPGGSMY

SEQ ID NO: 24724 - protein, 11 aa, Dengue virus
ISKISGGNMYA

SEQ ID NO: 24725 - protein, 11 aa, Dengue virus
SKISGGNMYAD

SEQ ID NO: 24726 - protein, 11 aa, Dengue virus
KISGGNMYADD

SEQ ID NO: 24727 - protein, 11 aa, Dengue virus
DDLRNEAKITD

SEQ ID NO: 24728 - protein, 11 aa, Dengue virus
DLRNEAKITDI

SEQ ID NO: 24729 - protein, 11 aa, Dengue virus
LRNEAKITDIM

SEQ ID NO: 24730 - protein, 11 aa, Dengue virus
RNEAKITDIME

SEQ ID NO: 24731 - protein, 11 aa, Dengue virus
NEARITDTMEP

SEQ ID NO: 24732 - protein, 11 aa, Dengue virus
EAKITDIMKPE

SEQ ID NO: 24733 - protein, 11 aa, Dengue virus
AKITDIMKPEH

SEQ ID NO: 24734 - protein, 11 aa, Dengue virus
RITDIMEAEHA

SEQ ID NO: 24735 - protein, 11 aa, Dengue virus
IMEAEHALLAK

SEQ ID NO: 24736 - protein, 11 aa, Dengue virus
MEPEHALLARS

SEQ ID NO: 24737 - protein, 11 aa, Dengue virus
EPEHALLARSI

SEQ ID NO: 24738 - protein, 11 aa, Dengue virus
PEHALLARSIF

SEQ ID NO: 24739 - protein, 11 aa, Dengue virus
EHALLARSIFK

SEQ ID NO: 24740 - protein, 11 aa, Dengue virus
HALLARSIFKL

SEQ ID NO: 24741 - protein, 11 aa, Dengue virus
ALLARSIFKLT

SEQ ID NO: 24742 - protein, 11 aa, Dengue virus
LLARSIFKLTY

SEQ ID NO: 24743 - protein, 11 aa, Dengue virus
LARSIFKLTYQ

SEQ ID NO: 24744 - protein, 11 aa, Dengue virus
ARSIFKLTYQN

SEQ ID NO: 24745 - protein, 11 aa, Dengue virus
RSIFKLTYQNK

SEQ ID NO: 24746 - protein, 11 aa, Dengue virus
KVVRVQRPTKN

SEQ ID NO: 24747 - protein, 11 aa, Dengue virus
VVRVQRPTKNG

SEQ ID NO: 24748 - protein, 11 aa, Dengue virus
VRVQRPTKNGT

SEQ ID NO: 24749 - protein, 11 aa, Dengue virus
RVQRPTKNGTV

SEQ ID NO: 24750 - protein, 11 aa, Dengue virus
VQRPTKNGTVM

SEQ ID NO: 24751 - protein, 11 aa, Dengue virus
QRPTKNGTVMD

SEQ ID NO: 24752 - protein, 11 aa, Dengue virus
RPTKNGTVMDV

SEQ ID NO: 24753 - protein, 11 aa, Dengue virus
PTKNGTVMDVI

SEQ ID NO: 24754 - protein, 11 aa, Dengue virus
TKNGTVMDVIS

SEQ ID NO: 24755 - protein, 11 aa, Dengue virus
IRQMESEEIFS

SEQ ID NO: 24756 - protein, 11 aa, Dengue virus
RQMESEEIFSP

SEQ ID NO: 24757 - protein, 11 aa, Dengue virus
VVKPIDDRFAA

SEQ ID NO: 24758 - protein, 11 aa, Dengue virus
VKPIDDRFAAA

SEQ ID NO: 24759 - protein, 11 aa, Dengue virus
KPIDDRFAAAL

SEQ ID NO: 24760 - protein, 11 aa, Dengue virus
DDRFAAALTAL

SEQ ID NO: 24761 - protein, 11 aa, Dengue virus
DRFAAALTALN

SEQ ID NO: 24762 - protein, 11 aa, Dengue virus
RFAAALTALND

SEQ ID NO: 24763 - protein, 11 aa, Dengue virus
FAAALTALNDM

SEQ ID NO: 24764 - protein, 11 aa, Dengue virus
AAALTALNDMG

SEQ ID NO: 24765 - protein, 11 aa, Dengue virus
AALTALNDMGK

SEQ ID NO: 24766 - protein, 11 aa, Dengue virus
AANANCSAVPV

SEQ ID NO: 24767 - protein, 11 aa, Dengue virus
PVNWVPTSRTT

SEQ ID NO: 24768 - protein, 11 aa, Dengue virus
IDWVPTSRTTW

SEQ ID NO: 24769 - protein, 11 aa, Dengue virus
MEDKTHISSWE

SEQ ID NO: 24770 - protein, 11 aa, Dengue virus
VSSWGDVPYLG

SEQ ID NO: 24771 - protein, 11 aa, Dengue virus
RLIGNENYLDF

SEQ ID NO: 24772 - protein, 11 aa, Dengue virus
LIGNENYLDFM

SEQ ID NO: 24773 - protein, 11 aa, Dengue virus
IGNENYLDFMT

SEQ ID NO: 24774 - protein, 11 aa, Dengue virus
GNENYLDYMIS

SEQ ID NO: 24775 - protein, 11 aa, Dengue virus
NENYLDYMISM

SEQ ID NO: 24776 - protein, 11 aa, Dengue virus
ENYLDYMISMK

SEQ ID NO: 24777 - protein, 11 aa, Dengue virus
NYLDYMISMKR

SEQ ID NO: 24778 - protein, 11 aa, Dengue virus
YLDYMISMKRF

SEQ ID NO: 24779 - protein, 11 aa, Dengue virus
LDYMISMKRFK

SEQ ID NO: 24780 - protein, 11 aa, Dengue virus
FMTSMKRFKNE

SEQ ID NO: 24781 - protein, 11 aa, Dengue virus
PTTLAFHLTTR

SEQ ID NO: 24782 - protein, 11 aa, Dengue virus
TTLAFHLTTRG

SEQ ID NO: 24783 - protein, 11 aa, Dengue virus
TSAGVNMCTLV

SEQ ID NO: 24784 - protein, 11 aa, Dengue virus
SAGVNMCTLVA

SEQ ID NO: 24785 - protein, 11 aa, Dengue virus
TYKCPRISEAE

SEQ ID NO: 24786 - protein, 11 aa, Dengue virus
YKCPRISEAEP

SEQ ID NO: 24787 - protein, 11 aa, Dengue virus
KCPRISEAEPD

SEQ ID NO: 24788 - protein, 11 aa, Dengue virus
CPRISEAEPDD

SEQ ID NO: 24789 - protein, 11 aa, Dengue virus
PRISEAEPDDV

SEQ ID NO: 24790 - protein, 11 aa, Dengue virus
RISEAEPDDVD

SEQ ID NO: 24791 - protein, 11 aa, Dengue virus
CSQIGEHRRDK

SEQ ID NO: 24792 - protein, 11 aa, Dengue virus
SQIGEHRRDKR

SEQ ID NO: 24793 - protein, 11 aa, Dengue virus
LRHPGFTMIAL

SEQ ID NO: 24794 - protein, 11 aa, Dengue virus
RHPGFTMIALF

SEQ ID NO: 24795 - protein, 11 aa, Dengue virus
HPGFTMIALFL

SEQ ID NO: 24796 - protein, 11 aa, Dengue virus
PGFTMIALFLA

SEQ ID NO: 24797 - protein, 11 aa, Dengue virus
ANPAVLRKLCI

SEQ ID NO: 24798 - protein, 11 aa, Dengue virus
TKLEGKIVQHE

SEQ ID NO: 24799 - protein, 11 aa, Dengue virus
KLEGKIVQHEN

SEQ ID NO: 24800 - protein, 11 aa, Dengue virus
LEGKIVQHENL

SEQ ID NO: 24801 - protein, 11 aa, Dengue virus
KIVQHENLKYS

SEQ ID NO: 24802 - protein, 11 aa, Dengue virus
IVQHENLKYSV

SEQ ID NO: 24803 - protein, 11 aa, Dengue virus
VGNETTDHGTT

SEQ ID NO: 24804 - protein, 11 aa, Dengue virus
GNETTDHGTTA

SEQ ID NO: 24805 - protein, 11 aa, Dengue virus
NETTDHGTTAT

SEQ ID NO: 24806 - protein, 11 aa, Dengue virus
ETTDHGTTATI

SEQ ID NO: 24807 - protein, 11 aa, Dengue virus
TTDHGTTATIT

SEQ ID NO: 24808 - protein, 11 aa, Dengue virus
IATITPQAPST

SEQ ID NO: 24809 - protein, 11 aa, Dengue virus
TTEIQLTDYGV

SEQ ID NO: 24810 - protein, 11 aa, Dengue virus
EMVLLTMEKKS

SEQ ID NO: 24811 - protein, 11 aa, Dengue virus
MVLLTMEKKSW

SEQ ID NO: 24812 - protein, 11 aa, Dengue virus
ASQETWNRKDL

SEQ ID NO: 24813 - protein, 11 aa, Dengue virus
LKMDKLTLKGV

SEQ ID NO: 24814 - protein, 11 aa, Dengue virus
KMDKLTLKGVS

SEQ ID NO: 24815 - protein, 11 aa, Dengue virus
MDKLTLKGVSY

SEQ ID NO: 24816 - protein, 11 aa, Dengue virus
DKLTLKGVSYV

SEQ ID NO: 24817 - protein, 11 aa, Dengue virus
KLTLKGVSYVM

SEQ ID NO: 24818 - protein, 11 aa, Dengue virus
LTLKGVSYVMC

SEQ ID NO: 24819 - protein, 11 aa, Dengue virus
TLKGVSYVMCT

SEQ ID NO: 24820 - protein, 11 aa, Dengue virus
LKGVSYVMCTG

SEQ ID NO: 24821 - protein, 11 aa, Dengue virus
ADAPCKIPFST

SEQ ID NO: 24822 - protein, 11 aa, Dengue virus
APCKIPFSTQN

SEQ ID NO: 24823 - protein, 11 aa, Dengue virus
PCKIPFSTQDG

SEQ ID NO: 24824 - protein, 11 aa, Dengue virus
QDERGVTQNGR

SEQ ID NO: 24825 - protein, 11 aa, Dengue virus
GVTQNGRVITA

SEQ ID NO: 24826 - protein, 11 aa, Dengue virus
VTQNGRVITAN

SEQ ID NO: 24827 - protein, 11 aa, Dengue virus
PIVTDKEKLVN

SEQ ID NO: 24828 - protein, 11 aa, Dengue virus
IVIDKEKPVNI

SEQ ID NO: 24829 - protein, 11 aa, Dengue virus
TDKEKPINIEA

SEQ ID NO: 24830 - protein, 11 aa, Dengue virus
AEPPFGESYIT

SEQ ID NO: 24831 - protein, 11 aa, Dengue virus
EPPFGESYITI

SEQ ID NO: 24832 - protein, 11 aa, Dengue virus
PPFGESYITIG

SEQ ID NO: 24833 - protein, 11 aa, Dengue virus
EEALKLSWFKK

SEQ ID NO: 24834 - protein, 11 aa, Dengue virus
KKGSSIGKMFV

SEQ ID NO: 24835 - protein, 11 aa, Dengue virus
GKLIHQVFGTA

SEQ ID NO: 24836 - protein, 11 aa, Dengue virus
KLIHQVFGTAY

SEQ ID NO: 24837 - protein, 11 aa, Dengue virus
LIHQVFGTAYG

SEQ ID NO: 24838 - protein, 11 aa, Dengue virus
IHQVFGTAYGV

SEQ ID NO: 24839 - protein, 11 aa, Dengue virus
RNTSLSVMCIA

SEQ ID NO: 24840 - protein, 11 aa, Dengue virus
NTSLSVMCIAV

SEQ ID NO: 24841 - protein, 11 aa, Dengue virus
TSLSMTCIVVG

SEQ ID NO: 24842 - protein, 11 aa, Dengue virus
SLSMTCIVVGM

SEQ ID NO: 24843 - protein, 11 aa, Dengue virus
SMTCIVVGMVT

SEQ ID NO: 24844 - protein, 11 aa, Dengue virus
MTCIVVGMVTL

SEQ ID NO: 24845 - protein, 11 aa, Dengue virus
TCIVVGMVTLY

SEQ ID NO: 24846 - protein, 11 aa, Dengue virus
NHILLENDIKF

SEQ ID NO: 24847 - protein, 11 aa, Dengue virus
HILLENDIKFT

SEQ ID NO: 24848 - protein, 11 aa, Dengue virus
KKSIRPQPMEH

SEQ ID NO: 24849 - protein, 11 aa, Dengue virus
KMVRPQPMEHK

SEQ ID NO: 24850 - protein, 11 aa, Dengue virus
MVRPQPMEHKY

SEQ ID NO: 24851 - protein, 11 aa, Dengue virus
QPMEYKYSWRS

SEQ ID NO: 24852 - protein, 11 aa, Dengue virus
PMEYKYSWKIW

SEQ ID NO: 24853 - protein, 11 aa, Dengue virus
MEYKYSWRSWG

SEQ ID NO: 24854 - protein, 11 aa, Dengue virus
EYKYSWRSWGK

SEQ ID NO: 24855 - protein, 11 aa, Dengue virus
YKYSWRSWGKA

SEQ ID NO: 24856 - protein, 11 aa, Dengue virus
IDGPNTSECPD

SEQ ID NO: 24857 - protein, 11 aa, Dengue virus
ECSDDQRAWNI

SEQ ID NO: 24858 - protein, 11 aa, Dengue virus
CSDDQRAWNIW

SEQ ID NO: 24859 - protein, 11 aa, Dengue virus
SDDQRAWNIWE

SEQ ID NO: 24860 - protein, 11 aa, Dengue virus
RDSHTQMCDHR

SEQ ID NO: 24861 - protein, 11 aa, Dengue virus
DSHTQMCDHRL

SEQ ID NO: 24862 - protein, 11 aa, Dengue virus
SHTQMCDHRLM

SEQ ID NO: 24863 - protein, 11 aa, Dengue virus
HTQMCDHRLMS

SEQ ID NO: 24864 - protein, 11 aa, Dengue virus
PKIYGGPMSQH

SEQ ID NO: 24865 - protein, 11 aa, Dengue virus
KIYGGPMSQHN

SEQ ID NO: 24866 - protein, 11 aa, Dengue virus
RWSRKMLMAGT

SEQ ID NO: 24867 - protein, 11 aa, Dengue virus
WSRKMLMAGTL

SEQ ID NO: 24868 - protein, 11 aa, Dengue virus
GQLTWKDLIRL

SEQ ID NO: 24869 - protein, 11 aa, Dengue virus
QLTWKDLIRLC

SEQ ID NO: 24870 - protein, 11 aa, Dengue virus
LTWKDLIRLCI

SEQ ID NO: 24871 - protein, 11 aa, Dengue virus
CIMVGANVSDR

SEQ ID NO: 24872 - protein, 11 aa, Dengue virus
IMVGANVSDRM

SEQ ID NO: 24873 - protein, 11 aa, Dengue virus
MVGANVSDRMG

SEQ ID NO: 24874 - protein, 11 aa, Dengue virus
GANVSDRMGMG

SEQ ID NO: 24875 - protein, 11 aa, Dengue virus
DRMGMGTTHLA

SEQ ID NO: 24876 - protein, 11 aa, Dengue virus
RMGMGTTHLAL

SEQ ID NO: 24877 - protein, 11 aa, Dengue virus
MRPMFAVGLLL

SEQ ID NO: 24878 - protein, 11 aa, Dengue virus
PMFAVGLLLRR

SEQ ID NO: 24879 - protein, 11 aa, Dengue virus
MFAVGLLLRRL

SEQ ID NO: 24880 - protein, 11 aa, Dengue virus
FAVGLLLRRLT

SEQ ID NO: 24881 - protein, 11 aa, Dengue virus
IGLSLVASVEI

SEQ ID NO: 24882 - protein, 11 aa, Dengue virus
CVELPNSLEEL

SEQ ID NO: 24883 - protein, 11 aa, Dengue virus
MILKLLTDFQP

SEQ ID NO: 24884 - protein, 11 aa, Dengue virus
VSLFPLCMSTT

SEQ ID NO: 24885 - protein, 11 aa, Dengue virus
SLGCKPLTMFF

SEQ ID NO: 24886 - protein, 11 aa, Dengue virus
LGCKPLTMFFI

SEQ ID NO: 24887 - protein, 11 aa, Dengue virus
GCKPLTMFLIV

SEQ ID NO: 24888 - protein, 11 aa, Dengue virus
CKPLAMFLIAE

SEQ ID NO: 24889 - protein, 11 aa, Dengue virus
NEIWGRKSWPL

SEQ ID NO: 24890 - protein, 11 aa, Dengue virus
SADLSLEKTAE

SEQ ID NO: 24891 - protein, 11 aa, Dengue virus
ADLSLEKTAEV

SEQ ID NO: 24892 - protein, 11 aa, Dengue virus
DLSLEKTAEVS

SEQ ID NO: 24893 - protein, 11 aa, Dengue virus
LSLEKTAEVSW

SEQ ID NO: 24894 - protein, 11 aa, Dengue virus
SLDKAAEVSWE

SEQ ID NO: 24895 - protein, 11 aa, Dengue virus
AEVSWEKEAEH

SEQ ID NO: 24896 - protein, 11 aa, Dengue virus
EVSWEKEAEHS

SEQ ID NO: 24897 - protein, 11 aa, Dengue virus
SWEKEAEHSGA

SEQ ID NO: 24898 - protein, 11 aa, Dengue virus
WEKEAEHSGAS

SEQ ID NO: 24899 - protein, 11 aa, Dengue virus
EKEAEHSGASH

SEQ ID NO: 24900 - protein, 11 aa, Dengue virus
KEAEHSGASHN

SEQ ID NO: 24901 - protein, 11 aa, Dengue virus
SGASHNISVEV

SEQ ID NO: 24902 - protein, 11 aa, Dengue virus
GASHNISVEVQ

SEQ ID NO: 24903 - protein, 11 aa, Dengue virus
ASHNISVEVQD

SEQ ID NO: 24904 - protein, 11 aa, Dengue virus
NIFVEVQDDGT

SEQ ID NO: 24905 - protein, 11 aa, Dengue virus
LLAISGVYPLS

SEQ ID NO: 24906 - protein, 11 aa, Dengue virus
LAVSGMYPLSI

SEQ ID NO: 24907 - protein, 11 aa, Dengue virus
AISGVYPLSIP

SEQ ID NO: 24908 - protein, 11 aa, Dengue virus
WDTPSPPVVER

SEQ ID NO: 24909 - protein, 11 aa, Dengue virus
DTPSPPVVERA

SEQ ID NO: 24910 - protein, 11 aa, Dengue virus
TPSPPVVERAV

SEQ ID NO: 24911 - protein, 11 aa, Dengue virus
PSPPVVERAVL

SEQ ID NO: 24912 - protein, 11 aa, Dengue virus
SPPVVERAVLD

SEQ ID NO: 24913 - protein, 11 aa, Dengue virus
DKVFRKRNLTI

SEQ ID NO: 24914 - protein, 11 aa, Dengue virus
PAIIREAIKRK

SEQ ID NO: 24915 - protein, 11 aa, Dengue virus
VREAMKRKLRT

SEQ ID NO: 24916 - protein, 11 aa, Dengue virus
IKRKMRTLILA

SEQ ID NO: 24917 - protein, 11 aa, Dengue virus
RNYNKEGDQYI

SEQ ID NO: 24918 - protein, 11 aa, Dengue virus
NYNKEGDQYIY

SEQ ID NO: 24919 - protein, 11 aa, Dengue virus
KTSIGLLCVMS

SEQ ID NO: 24920 - protein, 11 aa, Dengue virus
TSIGLLCVMSS

SEQ ID NO: 24921 - protein, 11 aa, Dengue virus
SIGLLCVIASS

SEQ ID NO: 24922 - protein, 11 aa, Dengue virus
TKKDLGIGHVV

SEQ ID NO: 24923 - protein, 11 aa, Dengue virus
EFNIYKRSGIV

SEQ ID NO: 24924 - protein, 11 aa, Dengue virus
FNIYKRSGIVE

SEQ ID NO: 24925 - protein, 11 aa, Dengue virus
NIYKRSGIVEV

SEQ ID NO: 24926 - protein, 11 aa, Dengue virus
IYKRSGIVEVD

SEQ ID NO: 24927 - protein, 11 aa, Dengue virus
KEGLKRGETIK

SEQ ID NO: 24928 - protein, 11 aa, Dengue virus
KDVFFTPPERC

SEQ ID NO: 24929 - protein, 11 aa, Dengue virus
DVFFTPPERCD

SEQ ID NO: 24930 - protein, 11 aa, Dengue virus
AFFIPPEKCDT

SEQ ID NO: 24931 - protein, 11 aa, Dengue virus
VETLEHMQRKH

SEQ ID NO: 24932 - protein, 11 aa, Dengue virus
ETLEHMQRKHG

SEQ ID NO: 24933 - protein, 11 aa, Dengue virus
TLEHMQRKHGG

SEQ ID NO: 24934 - protein, 11 aa, Dengue virus
TRHVAVEPEVP

SEQ ID NO: 24935 - protein, 11 aa, Dengue virus
RHVAVEPEVPN

SEQ ID NO: 24936 - protein, 11 aa, Dengue virus
VEPEVPNLDII

SEQ ID NO: 24937 - protein, 11 aa, Dengue virus
TRTPKAKQGTA

SEQ ID NO: 24938 - protein, 11 aa, Dengue virus
RTPKAKQGTAQ

SEQ ID NO: 24939 - protein, 11 aa, Dengue virus
TPKAKQGTAQI

SEQ ID NO: 24940 - protein, 11 aa, Dengue virus
PKAKQGTAQIM

SEQ ID NO: 24941 - protein, 11 aa, Dengue virus
KRGTAQIMEMT

SEQ ID NO: 24942 - protein, 11 aa, Dengue virus
RGTAQIMEMTA

SEQ ID NO: 24943 - protein, 11 aa, Dengue virus
VMEVTARWLWG

SEQ ID NO: 24944 - protein, 11 aa, Dengue virus
LVHKERELHKQ

SEQ ID NO: 24945 - protein, 11 aa, Dengue virus
VHKERELHKQG

SEQ ID NO: 24946 - protein, 11 aa, Dengue virus
RDISKIPGGSM

SEQ ID NO: 24947 - protein, 11 aa, Dengue virus
DISKISGGNMY

SEQ ID NO: 24948 - protein, 11 aa, Dengue virus
ISKIPGGSMYA

SEQ ID NO: 24949 - protein, 11 aa, Dengue virus
SKIPGGSMYAD

SEQ ID NO: 24950 - protein, 11 aa, Dengue virus
KIPGGSMYADD

SEQ ID NO: 24951 - protein, 11 aa, Dengue virus
EAKITDIMEAE

SEQ ID NO: 24952 - protein, 11 aa, Dengue virus
ARITDIMEAEH

SEQ ID NO: 24953 - protein, 11 aa, Dengue virus
EAEHALLATSI

SEQ ID NO: 24954 - protein, 11 aa, Dengue virus
PIDWVPTSRTT

SEQ ID NO: 24955 - protein, 11 aa, Dengue virus
VNWVPTSRTTW

SEQ ID NO: 24956 - protein, 11 aa, Dengue virus
MEDKTRISSWE

SEQ ID NO: 24957 - protein, 11 aa, Dengue virus
VSSWEDVPYLG

SEQ ID NO: 24958 - protein, 11 aa, Dengue virus
IGNENYLDYMI

SEQ ID NO: 24959 - protein, 8 aa, Dengue virus
MNNQRKKA

SEQ ID NO: 24960 - protein, 8 aa, Dengue virus
NNQRKKAR

SEQ ID NO: 24961 - protein, 8 aa, Dengue virus
NQRKKARS

SEQ ID NO: 24962 - protein, 8 aa, Dengue virus
STPFNMLK

SEQ ID NO: 24963 - protein, 8 aa, Dengue virus
TPFNMLKR

SEQ ID NO: 24964 - protein, 8 aa, Dengue virus
PFNMLKRE

SEQ ID NO: 24965 - protein, 8 aa, Dengue virus
FNMLKRER

SEQ ID NO: 24966 - protein, 8 aa, Dengue virus
NMLKRERN

SEQ ID NO: 24967 - protein, 8 aa, Dengue virus
MLKRERNR

SEQ ID NO: 24968 - protein, 8 aa, Dengue virus
LKRERNRV

SEQ ID NO: 24969 - protein, 8 aa, Dengue virus
KRERNRVS

SEQ ID NO: 24970 - protein, 8 aa, Dengue virus
RERNRVST

SEQ ID NO: 24971 - protein, 8 aa, Dengue virus
ERNRVSTV

SEQ ID NO: 24972 - protein, 8 aa, Dengue virus
RNRVSTVQ

SEQ ID NO: 24973 - protein, 8 aa, Dengue virus
NRVSTVQQ

SEQ ID NO: 24974 - protein, 8 aa, Dengue virus
RVSTVQQL

SEQ ID NO: 24975 - protein, 8 aa, Dengue virus
VSTVQQLT

SEQ ID NO: 24976 - protein, 8 aa, Dengue virus
STVQQLTK

SEQ ID NO: 24977 - protein, 8 aa, Dengue virus
TVQQLTKR

SEQ ID NO: 24978 - protein, 8 aa, Dengue virus
VQQLTKRF

SEQ ID NO: 24979 - protein, 8 aa, Dengue virus
QQLTKRFS

SEQ ID NO: 24980 - protein, 8 aa, Dengue virus
QLTKRFSL

SEQ ID NO: 24981 - protein, 8 aa, Dengue virus
LTKRFSLG

SEQ ID NO: 24982 - protein, 8 aa, Dengue virus
TKRFSLGM

SEQ ID NO: 24983 - protein, 8 aa, Dengue virus
KRFSLGML

SEQ ID NO: 24984 - protein, 8 aa, Dengue virus
RFSLGMLQ

SEQ ID NO: 24985 - protein, 8 aa, Dengue virus
FSLGMLQG

SEQ ID NO: 24986 - protein, 8 aa, Dengue virus
SLGMLQGR

SEQ ID NO: 24987 - protein, 8 aa, Dengue virus
LGMLQGRG

SEQ ID NO: 24988 - protein, 8 aa, Dengue virus
GMLQGRGP

SEQ ID NO: 24989 - protein, 8 aa, Dengue virus
MLQGRGPL

SEQ ID NO: 24990 - protein, 8 aa, Dengue virus
LQGRGPLK

SEQ ID NO: 24991 - protein, 8 aa, Dengue virus
QGRGPLKL

SEQ ID NO: 24992 - protein, 8 aa, Dengue virus
GRGPLKLF

SEQ ID NO: 24993 - protein, 8 aa, Dengue virus
RGPLKLFM

SEQ ID NO: 24994 - protein, 8 aa, Dengue virus
GPLKLFMA

SEQ ID NO: 24995 - protein, 8 aa, Dengue virus
PLKLFMAL

SEQ ID NO: 24996 - protein, 8 aa, Dengue virus
LKLFMALV

SEQ ID NO: 24997 - protein, 8 aa, Dengue virus
KLFMALVA

SEQ ID NO: 24998 - protein, 8 aa, Dengue virus
LFMALVAF

SEQ ID NO: 24999 - protein, 8 aa, Dengue virus
FMALVAFL

SEQ ID NO: 25000 - protein, 8 aa, Dengue virus
MALVAFLR

SEQ ID NO: 25001 - protein, 8 aa, Dengue virus
ALVAFLRF

SEQ ID NO: 25002 - protein, 8 aa, Dengue virus
LVAFLRFL

SEQ ID NO: 25003 - protein, 8 aa, Dengue virus
VAFLRFLT

SEQ ID NO: 25004 - protein, 8 aa, Dengue virus
AFLRFLTI

SEQ ID NO: 25005 - protein, 8 aa, Dengue virus
FLRFLTIP

SEQ ID NO: 25006 - protein, 8 aa, Dengue virus
LRFLTIPP

SEQ ID NO: 25007 - protein, 8 aa, Dengue virus
RFLTIPPT

SEQ ID NO: 25008 - protein, 8 aa, Dengue virus
FLTIPPTA

SEQ ID NO: 25009 - protein, 8 aa, Dengue virus
LTIPPTAG

SEQ ID NO: 25010 - protein, 8 aa, Dengue virus
TIPPTAGI

SEQ ID NO: 25011 - protein, 8 aa, Dengue virus
IPPTAGIL

SEQ ID NO: 25012 - protein, 8 aa, Dengue virus
PPTAGILK

SEQ ID NO: 25013 - protein, 8 aa, Dengue virus
PTAGILKR

SEQ ID NO: 25014 - protein, 8 aa, Dengue virus
TAGILKRW

SEQ ID NO: 25015 - protein, 8 aa, Dengue virus
AGILKRWG

SEQ ID NO: 25016 - protein, 8 aa, Dengue virus
GILKRWGT

SEQ ID NO: 25017 - protein, 8 aa, Dengue virus
ILKRWGTI

SEQ ID NO: 25018 - protein, 8 aa, Dengue virus
LKRWGTIK

SEQ ID NO: 25019 - protein, 8 aa, Dengue virus
KRWGTIKK

SEQ ID NO: 25020 - protein, 8 aa, Dengue virus
RWGTIKKS

SEQ ID NO: 25021 - protein, 8 aa, Dengue virus
WGTIKKSK

SEQ ID NO: 25022 - protein, 8 aa, Dengue virus
GTIKKSKA

SEQ ID NO: 25023 - protein, 8 aa, Dengue virus
TIKKSKAI

SEQ ID NO: 25024 - protein, 8 aa, Dengue virus
IKKSKAIN

SEQ ID NO: 25025 - protein, 8 aa, Dengue virus
KKSKAINV

SEQ ID NO: 25026 - protein, 8 aa, Dengue virus
KSKAINVL

SEQ ID NO: 25027 - protein, 8 aa, Dengue virus
SKAINVLR

SEQ ID NO: 25028 - protein, 8 aa, Dengue virus
KAINVLRG

SEQ ID NO: 25029 - protein, 8 aa, Dengue virus
AINVLRGF

SEQ ID NO: 25030 - protein, 8 aa, Dengue virus
INVLRGFR

SEQ ID NO: 25031 - protein, 8 aa, Dengue virus
NVLRGFRK

SEQ ID NO: 25032 - protein, 8 aa, Dengue virus
VLRGFRKE

SEQ ID NO: 25033 - protein, 8 aa, Dengue virus
LRGFRKEI

SEQ ID NO: 25034 - protein, 8 aa, Dengue virus
RGFRKEIG

SEQ ID NO: 25035 - protein, 8 aa, Dengue virus
GFRKEIGR

SEQ ID NO: 25036 - protein, 8 aa, Dengue virus
FRKEIGRM

SEQ ID NO: 25037 - protein, 8 aa, Dengue virus
RKEIGRML

SEQ ID NO: 25038 - protein, 8 aa, Dengue virus
KEIGRMLN

SEQ ID NO: 25039 - protein, 8 aa, Dengue virus
EIGRMLNI

SEQ ID NO: 25040 - protein, 8 aa, Dengue virus
IGRMLNIL

SEQ ID NO: 25041 - protein, 8 aa, Dengue virus
GRMLNILN

SEQ ID NO: 25042 - protein, 8 aa, Dengue virus
RMLNILNR

SEQ ID NO: 25043 - protein, 8 aa, Dengue virus
MLNILNRR

SEQ ID NO: 25044 - protein, 8 aa, Dengue virus
LNILNRRR

SEQ ID NO: 25045 - protein, 8 aa, Dengue virus
NILNRRRR

SEQ ID NO: 25046 - protein, 8 aa, Dengue virus
ILNRRRRT

SEQ ID NO: 25047 - protein, 8 aa, Dengue virus
LNRRRRTA

SEQ ID NO: 25048 - protein, 8 aa, Dengue virus
NRRRRTAG

SEQ ID NO: 25049 - protein, 8 aa, Dengue virus
IPTAMAFH

SEQ ID NO: 25050 - protein, 8 aa, Dengue virus
PTAMAFHL

SEQ ID NO: 25051 - protein, 8 aa, Dengue virus
TAMAFHLT

SEQ ID NO: 25052 - protein, 8 aa, Dengue virus
AMAFHLTT

SEQ ID NO: 25053 - protein, 8 aa, Dengue virus
MAFHLTTR

SEQ ID NO: 25054 - protein, 8 aa, Dengue virus
AFHLTTRN

SEQ ID NO: 25055 - protein, 8 aa, Dengue virus
FHLTTRNG

SEQ ID NO: 25056 - protein, 8 aa, Dengue virus
HLTTRNGE

SEQ ID NO: 25057 - protein, 8 aa, Dengue virus
LTTRNGEP

SEQ ID NO: 25058 - protein, 8 aa, Dengue virus
TTRNGEPH

SEQ ID NO: 25059 - protein, 8 aa, Dengue virus
TRNGEPHM

SEQ ID NO: 25060 - protein, 8 aa, Dengue virus
RNGEPHMI

SEQ ID NO: 25061 - protein, 8 aa, Dengue virus
NGEPHMIV

SEQ ID NO: 25062 - protein, 8 aa, Dengue virus
GEPHMIVG

SEQ ID NO: 25063 - protein, 8 aa, Dengue virus
EPHMIVGR

SEQ ID NO: 25064 - protein, 8 aa, Dengue virus
PHMIVGRQ

SEQ ID NO: 25065 - protein, 8 aa, Dengue virus
HMIVGRQE

SEQ ID NO: 25066 - protein, 8 aa, Dengue virus
MIVGRQEK

SEQ ID NO: 25067 - protein, 8 aa, Dengue virus
IVGRQEKG

SEQ ID NO: 25068 - protein, 8 aa, Dengue virus
VGRQEKGK

SEQ ID NO: 25069 - protein, 8 aa, Dengue virus
GRQEKGKS

SEQ ID NO: 25070 - protein, 8 aa, Dengue virus
RQEKGKSL

SEQ ID NO: 25071 - protein, 8 aa, Dengue virus
QEKGKSLL

SEQ ID NO: 25072 - protein, 8 aa, Dengue virus
EKGKSLLF

SEQ ID NO: 25073 - protein, 8 aa, Dengue virus
KGKSLLFK

SEQ ID NO: 25074 - protein, 8 aa, Dengue virus
GKSLLFKT

SEQ ID NO: 25075 - protein, 8 aa, Dengue virus
KSLLFKTE

SEQ ID NO: 25076 - protein, 8 aa, Dengue virus
SLLFKTED

SEQ ID NO: 25077 - protein, 8 aa, Dengue virus
LLFKTEDG

SEQ ID NO: 25078 - protein, 8 aa, Dengue virus
DGVNMCTL

SEQ ID NO: 25079 - protein, 8 aa, Dengue virus
GVNMCTLM

SEQ ID NO: 25080 - protein, 8 aa, Dengue virus
VNMCTLMA

SEQ ID NO: 25081 - protein, 8 aa, Dengue virus
NMCTLMAI

SEQ ID NO: 25082 - protein, 8 aa, Dengue virus
MCTLMAID

SEQ ID NO: 25083 - protein, 8 aa, Dengue virus
CTLMAIDL

SEQ ID NO: 25084 - protein, 8 aa, Dengue virus
TLMAIDLG

SEQ ID NO: 25085 - protein, 8 aa, Dengue virus
LMAIDLGE

SEQ ID NO: 25086 - protein, 8 aa, Dengue virus
MAIDLGEL

SEQ ID NO: 25087 - protein, 8 aa, Dengue virus
AIDLGELC

SEQ ID NO: 25088 - protein, 8 aa, Dengue virus
IDLGELCE

SEQ ID NO: 25089 - protein, 8 aa, Dengue virus
DLGELCED

SEQ ID NO: 25090 - protein, 8 aa, Dengue virus
LGELCEDT

SEQ ID NO: 25091 - protein, 8 aa, Dengue virus
GELCEDTI

SEQ ID NO: 25092 - protein, 8 aa, Dengue virus
ELCEDTIT

SEQ ID NO: 25093 - protein, 8 aa, Dengue virus
LCEDTITY

SEQ ID NO: 25094 - protein, 8 aa, Dengue virus
CEDTITYK

SEQ ID NO: 25095 - protein, 8 aa, Dengue virus
EDTITYKC

SEQ ID NO: 25096 - protein, 8 aa, Dengue virus
DTITYKCP

SEQ ID NO: 25097 - protein, 8 aa, Dengue virus
TITYKCPL

SEQ ID NO: 25098 - protein, 8 aa, Dengue virus
ITYKCPLL

SEQ ID NO: 25099 - protein, 8 aa, Dengue virus
TYKCPLLR

SEQ ID NO: 25100 - protein, 8 aa, Dengue virus
YKCPLLRQ

SEQ ID NO: 25101 - protein, 8 aa, Dengue virus
KCPLLRQN

SEQ ID NO: 25102 - protein, 8 aa, Dengue virus
CPLLRQNE

SEQ ID NO: 25103 - protein, 8 aa, Dengue virus
PLLRQNEP

SEQ ID NO: 25104 - protein, 8 aa, Dengue virus
LLRQNEPE

SEQ ID NO: 25105 - protein, 8 aa, Dengue virus
LRQNEPED

SEQ ID NO: 25106 - protein, 8 aa, Dengue virus
RQNEPEDI

SEQ ID NO: 25107 - protein, 8 aa, Dengue virus
QNEPEDID

SEQ ID NO: 25108 - protein, 8 aa, Dengue virus
NEPEDIDC

SEQ ID NO: 25109 - protein, 8 aa, Dengue virus
EPEDIDCW

SEQ ID NO: 25110 - protein, 8 aa, Dengue virus
PEDIDCWC

SEQ ID NO: 25111 - protein, 8 aa, Dengue virus
EDIDCWCN

SEQ ID NO: 25112 - protein, 8 aa, Dengue virus
DIDCWCNS

SEQ ID NO: 25113 - protein, 8 aa, Dengue virus
IDCWCNST

SEQ ID NO: 25114 - protein, 8 aa, Dengue virus
DCWCNSTS

SEQ ID NO: 25115 - protein, 8 aa, Dengue virus
CWCNSTST

SEQ ID NO: 25116 - protein, 8 aa, Dengue virus
WCNSTSTW

SEQ ID NO: 25117 - protein, 8 aa, Dengue virus
CNSTSTWV

SEQ ID NO: 25118 - protein, 8 aa, Dengue virus
NSTSTWVT

SEQ ID NO: 25119 - protein, 8 aa, Dengue virus
STSTWVTY

SEQ ID NO: 25120 - protein, 8 aa, Dengue virus
TSTWVTYG

SEQ ID NO: 25121 - protein, 8 aa, Dengue virus
STWVTYGT

SEQ ID NO: 25122 - protein, 8 aa, Dengue virus
TWVTYGTC

SEQ ID NO: 25123 - protein, 8 aa, Dengue virus
WVTYGTCT

SEQ ID NO: 25124 - protein, 8 aa, Dengue virus
TTGEHRRE

SEQ ID NO: 25125 - protein, 8 aa, Dengue virus
TGEHRREK

SEQ ID NO: 25126 - protein, 8 aa, Dengue virus
GEHRREKR

SEQ ID NO: 25127 - protein, 8 aa, Dengue virus
EHRREKRS

SEQ ID NO: 25128 - protein, 8 aa, Dengue virus
HRREKRSV

SEQ ID NO: 25129 - protein, 8 aa, Dengue virus
RREKRSVA

SEQ ID NO: 25130 - protein, 8 aa, Dengue virus
REKRSVAL

SEQ ID NO: 25131 - protein, 8 aa, Dengue virus
EKRSVALV

SEQ ID NO: 25132 - protein, 8 aa, Dengue virus
KRSVALVP

SEQ ID NO: 25133 - protein, 8 aa, Dengue virus
RSVALVPH

SEQ ID NO: 25134 - protein, 8 aa, Dengue virus
SVALVPHV

SEQ ID NO: 25135 - protein, 8 aa, Dengue virus
VALVPHVG

SEQ ID NO: 25136 - protein, 8 aa, Dengue virus
ALVPHVGM

SEQ ID NO: 25137 - protein, 8 aa, Dengue virus
LVPHVGMG

SEQ ID NO: 25138 - protein, 8 aa, Dengue virus
VPHVGMGL

SEQ ID NO: 25139 - protein, 8 aa, Dengue virus
PHVGMGLE

SEQ ID NO: 25140 - protein, 8 aa, Dengue virus
HVGMGLET

SEQ ID NO: 25141 - protein, 8 aa, Dengue virus
VGMGLETR

SEQ ID NO: 25142 - protein, 8 aa, Dengue virus
GMGLETRT

SEQ ID NO: 25143 - protein, 8 aa, Dengue virus
MGLETRTE

SEQ ID NO: 25144 - protein, 8 aa, Dengue virus
GLETRTET

SEQ ID NO: 25145 - protein, 8 aa, Dengue virus
LETRTETW

SEQ ID NO: 25146 - protein, 8 aa, Dengue virus
ETRTETWM

SEQ ID NO: 25147 - protein, 8 aa, Dengue virus
TRTETWMS

SEQ ID NO: 25148 - protein, 8 aa, Dengue virus
RTETWMSS

SEQ ID NO: 25149 - protein, 8 aa, Dengue virus
TETWMSSE

SEQ ID NO: 25150 - protein, 8 aa, Dengue virus
ETWMSSEG

SEQ ID NO: 25151 - protein, 8 aa, Dengue virus
TWMSSEGA

SEQ ID NO: 25152 - protein, 8 aa, Dengue virus
WMSSEGAW

SEQ ID NO: 25153 - protein, 8 aa, Dengue virus
MSSEGAWK

SEQ ID NO: 25154 - protein, 8 aa, Dengue virus
SSEGAWKH

SEQ ID NO: 25155 - protein, 8 aa, Dengue virus
SEGAWKHV

SEQ ID NO: 25156 - protein, 8 aa, Dengue virus
EGAWKHVQ

SEQ ID NO: 25157 - protein, 8 aa, Dengue virus
GAWKHVQR

SEQ ID NO: 25158 - protein, 8 aa, Dengue virus
AWKHVQRI

SEQ ID NO: 25159 - protein, 8 aa, Dengue virus
WKHVQRIE

SEQ ID NO: 25160 - protein, 8 aa, Dengue virus
KHVQRIET

SEQ ID NO: 25161 - protein, 8 aa, Dengue virus
HVQRIETW

SEQ ID NO: 25162 - protein, 8 aa, Dengue virus
VQRIETWI

SEQ ID NO: 25163 - protein, 8 aa, Dengue virus
QRIETWIL

SEQ ID NO: 25164 - protein, 8 aa, Dengue virus
RIETWILR

SEQ ID NO: 25165 - protein, 8 aa, Dengue virus
IETWILRH

SEQ ID NO: 25166 - protein, 8 aa, Dengue virus
ETWILRHP

SEQ ID NO: 25167 - protein, 8 aa, Dengue virus
TWILRHPG

SEQ ID NO: 25168 - protein, 8 aa, Dengue virus
WILRHPGF

SEQ ID NO: 25169 - protein, 8 aa, Dengue virus
ILRHPGFT

SEQ ID NO: 25170 - protein, 8 aa, Dengue virus
LRHPGFTI

SEQ ID NO: 25171 - protein, 8 aa, Dengue virus
RHPGFTIM

SEQ ID NO: 25172 - protein, 8 aa, Dengue virus
HPGFTIMA

SEQ ID NO: 25173 - protein, 8 aa, Dengue virus
PGFTIMAA

SEQ ID NO: 25174 - protein, 8 aa, Dengue virus
MAAILAYT

SEQ ID NO: 25175 - protein, 8 aa, Dengue virus
AAILAYTI

SEQ ID NO: 25176 - protein, 8 aa, Dengue virus
AILAYTIG

SEQ ID NO: 25177 - protein, 8 aa, Dengue virus
ILAYTIGT

SEQ ID NO: 25178 - protein, 8 aa, Dengue virus
LAYTIGTT

SEQ ID NO: 25179 - protein, 8 aa, Dengue virus
AYTIGTTH

SEQ ID NO: 25180 - protein, 8 aa, Dengue virus
YTIGTTHF

SEQ ID NO: 25181 - protein, 8 aa, Dengue virus
TIGTTHFQ

SEQ ID NO: 25182 - protein, 8 aa, Dengue virus
IGTTHFQR

SEQ ID NO: 25183 - protein, 8 aa, Dengue virus
GTTHFQRA

SEQ ID NO: 25184 - protein, 8 aa, Dengue virus
TTHFQRAL

SEQ ID NO: 25185 - protein, 8 aa, Dengue virus
THFQRALI

SEQ ID NO: 25186 - protein, 8 aa, Dengue virus
HFQRALIF

SEQ ID NO: 25187 - protein, 8 aa, Dengue virus
FQRALIFI

SEQ ID NO: 25188 - protein, 8 aa, Dengue virus
QRALIFIL

SEQ ID NO: 25189 - protein, 8 aa, Dengue virus
RALIFILL

SEQ ID NO: 25190 - protein, 8 aa, Dengue virus
ALIFILLT

SEQ ID NO: 25191 - protein, 8 aa, Dengue virus
LIFILLTA

SEQ ID NO: 25192 - protein, 8 aa, Dengue virus
IFILLTAV

SEQ ID NO: 25193 - protein, 8 aa, Dengue virus
FILLTAVA

SEQ ID NO: 25194 - protein, 8 aa, Dengue virus
ILLTAVAP

SEQ ID NO: 25195 - protein, 8 aa, Dengue virus
LLTAVAPS

SEQ ID NO: 25196 - protein, 8 aa, Dengue virus
LTAVAPSM

SEQ ID NO: 25197 - protein, 8 aa, Dengue virus
TAVAPSMT

SEQ ID NO: 25198 - protein, 8 aa, Dengue virus
AVAPSMTM

SEQ ID NO: 25199 - protein, 8 aa, Dengue virus
VAPSMTMR

SEQ ID NO: 25200 - protein, 8 aa, Dengue virus
APSMTMRC

SEQ ID NO: 25201 - protein, 8 aa, Dengue virus
PSMTMRCI

SEQ ID NO: 25202 - protein, 8 aa, Dengue virus
SMTMRCIG

SEQ ID NO: 25203 - protein, 8 aa, Dengue virus
MTMRCIGI

SEQ ID NO: 25204 - protein, 8 aa, Dengue virus
TMRCIGIS

SEQ ID NO: 25205 - protein, 8 aa, Dengue virus
MRCIGISN

SEQ ID NO: 25206 - protein, 8 aa, Dengue virus
RCIGISNR

SEQ ID NO: 25207 - protein, 8 aa, Dengue virus
CIGISNRD

SEQ ID NO: 25208 - protein, 8 aa, Dengue virus
IGISNRDF

SEQ ID NO: 25209 - protein, 8 aa, Dengue virus
GISNRDFV

SEQ ID NO: 25210 - protein, 8 aa, Dengue virus
ISNRDFVE

SEQ ID NO: 25211 - protein, 8 aa, Dengue virus
SNRDFVEG

SEQ ID NO: 25212 - protein, 8 aa, Dengue virus
NRDFVEGV

SEQ ID NO: 25213 - protein, 8 aa, Dengue virus
RDFVEGVS

SEQ ID NO: 25214 - protein, 8 aa, Dengue virus
DFVEGVSG

SEQ ID NO: 25215 - protein, 8 aa, Dengue virus
FVEGVSGG

SEQ ID NO: 25216 - protein, 8 aa, Dengue virus
VEGVSGGS

SEQ ID NO: 25217 - protein, 8 aa, Dengue virus
EGVSGGSW

SEQ ID NO: 25218 - protein, 8 aa, Dengue virus
GVSGGSWV

SEQ ID NO: 25219 - protein, 8 aa, Dengue virus
VSGGSWVD

SEQ ID NO: 25220 - protein, 8 aa, Dengue virus
SGGSWVDI

SEQ ID NO: 25221 - protein, 8 aa, Dengue virus
GGSWVDIV

SEQ ID NO: 25222 - protein, 8 aa, Dengue virus
GSWVDIVL

SEQ ID NO: 25223 - protein, 8 aa, Dengue virus
SWVDIVLE

SEQ ID NO: 25224 - protein, 8 aa, Dengue virus
WVDIVLEH

SEQ ID NO: 25225 - protein, 8 aa, Dengue virus
VDIVLEHG

SEQ ID NO: 25226 - protein, 8 aa, Dengue virus
DIVLEHGS

SEQ ID NO: 25227 - protein, 8 aa, Dengue virus
IVLEHGSC

SEQ ID NO: 25228 - protein, 8 aa, Dengue virus
VLEHGSCV

SEQ ID NO: 25229 - protein, 8 aa, Dengue virus
LEHGSCVT

SEQ ID NO: 25230 - protein, 8 aa, Dengue virus
EHGSCVTT

SEQ ID NO: 25231 - protein, 8 aa, Dengue virus
HGSCVTTM

SEQ ID NO: 25232 - protein, 8 aa, Dengue virus
GSCVTTMA

SEQ ID NO: 25233 - protein, 8 aa, Dengue virus
SCVTTMAK

SEQ ID NO: 25234 - protein, 8 aa, Dengue virus
CVTTMAKN

SEQ ID NO: 25235 - protein, 8 aa, Dengue virus
VTTMAKNK

SEQ ID NO: 25236 - protein, 8 aa, Dengue virus
TTMAKNKP

SEQ ID NO: 25237 - protein, 8 aa, Dengue virus
TMAKNKPT

SEQ ID NO: 25238 - protein, 8 aa, Dengue virus
MAKNKPTL

SEQ ID NO: 25239 - protein, 8 aa, Dengue virus
AKNKPTLD

SEQ ID NO: 25240 - protein, 8 aa, Dengue virus
KNKPTLDF

SEQ ID NO: 25241 - protein, 8 aa, Dengue virus
NKPTLDFE

SEQ ID NO: 25242 - protein, 8 aa, Dengue virus
KPTLDFEL

SEQ ID NO: 25243 - protein, 8 aa, Dengue virus
PTLDFELI

SEQ ID NO: 25244 - protein, 8 aa, Dengue virus
TLDFELIK

SEQ ID NO: 25245 - protein, 8 aa, Dengue virus
LDFELIKT

SEQ ID NO: 25246 - protein, 8 aa, Dengue virus
DFELIKTE

SEQ ID NO: 25247 - protein, 8 aa, Dengue virus
FELIKTEA

SEQ ID NO: 25248 - protein, 8 aa, Dengue virus
ELIKTEAK

SEQ ID NO: 25249 - protein, 8 aa, Dengue virus
LIKTEAKQ

SEQ ID NO: 25250 - protein, 8 aa, Dengue virus
KTEAKQPA

SEQ ID NO: 25251 - protein, 8 aa, Dengue virus
TEAKQPAT

SEQ ID NO: 25252 - protein, 8 aa, Dengue virus
EAKQPATL

SEQ ID NO: 25253 - protein, 8 aa, Dengue virus
AKQPATLR

SEQ ID NO: 25254 - protein, 8 aa, Dengue virus
KQPATLRK

SEQ ID NO: 25255 - protein, 8 aa, Dengue virus
QPATLRKY

SEQ ID NO: 25256 - protein, 8 aa, Dengue virus
PATLRKYC

SEQ ID NO: 25257 - protein, 8 aa, Dengue virus
ATLRKYCI

SEQ ID NO: 25258 - protein, 8 aa, Dengue virus
TLRKYCIE

SEQ ID NO: 25259 - protein, 8 aa, Dengue virus
LRKYCIEA

SEQ ID NO: 25260 - protein, 8 aa, Dengue virus
RKYCIEAK

SEQ ID NO: 25261 - protein, 8 aa, Dengue virus
KYCIEAKL

SEQ ID NO: 25262 - protein, 8 aa, Dengue virus
YCIEAKLT

SEQ ID NO: 25263 - protein, 8 aa, Dengue virus
CIEAKLTN

SEQ ID NO: 25264 - protein, 8 aa, Dengue virus
IEAKLTNT

SEQ ID NO: 25265 - protein, 8 aa, Dengue virus
EAKLTNTT

SEQ ID NO: 25266 - protein, 8 aa, Dengue virus
AKLTNTTT

SEQ ID NO: 25267 - protein, 8 aa, Dengue virus
KLTNTTTE

SEQ ID NO: 25268 - protein, 8 aa, Dengue virus
LTNTTTES

SEQ ID NO: 25269 - protein, 8 aa, Dengue virus
TNTTTESR

SEQ ID NO: 25270 - protein, 8 aa, Dengue virus
NTTTESRC

SEQ ID NO: 25271 - protein, 8 aa, Dengue virus
TTTESRCP

SEQ ID NO: 25272 - protein, 8 aa, Dengue virus
TTESRCPT

SEQ ID NO: 25273 - protein, 8 aa, Dengue virus
TESRCPTQ

SEQ ID NO: 25274 - protein, 8 aa, Dengue virus
ESRCPTQG

SEQ ID NO: 25275 - protein, 8 aa, Dengue virus
SRCPTQGE

SEQ ID NO: 25276 - protein, 8 aa, Dengue virus
RCPTQGEP

SEQ ID NO: 25277 - protein, 8 aa, Dengue virus
CPTQGEPS

SEQ ID NO: 25278 - protein, 8 aa, Dengue virus
PTQGEPSL

SEQ ID NO: 25279 - protein, 8 aa, Dengue virus
TQGEPSLN

SEQ ID NO: 25280 - protein, 8 aa, Dengue virus
QGEPSLNE

SEQ ID NO: 25281 - protein, 8 aa, Dengue virus
GEPSLNEE

SEQ ID NO: 25282 - protein, 8 aa, Dengue virus
EPSLNEEQ

SEQ ID NO: 25283 - protein, 8 aa, Dengue virus
PSLNEEQD

SEQ ID NO: 25284 - protein, 8 aa, Dengue virus
SLNEEQDK

SEQ ID NO: 25285 - protein, 8 aa, Dengue virus
LNEEQDKR

SEQ ID NO: 25286 - protein, 8 aa, Dengue virus
NEEQDKRF

SEQ ID NO: 25287 - protein, 8 aa, Dengue virus
EEQDKRFV

SEQ ID NO: 25288 - protein, 8 aa, Dengue virus
EQDKRFVC

SEQ ID NO: 25289 - protein, 8 aa, Dengue virus
QDKRFVCK

SEQ ID NO: 25290 - protein, 8 aa, Dengue virus
DKRFVCKH

SEQ ID NO: 25291 - protein, 8 aa, Dengue virus
KRFVCKHS

SEQ ID NO: 25292 - protein, 8 aa, Dengue virus
RFVCKHSM

SEQ ID NO: 25293 - protein, 8 aa, Dengue virus
FVCKHSMV

SEQ ID NO: 25294 - protein, 8 aa, Dengue virus
VCKHSMVD

SEQ ID NO: 25295 - protein, 8 aa, Dengue virus
CKHSMVDR

SEQ ID NO: 25296 - protein, 8 aa, Dengue virus
KHSMVDRG

SEQ ID NO: 25297 - protein, 8 aa, Dengue virus
HSMVDRGW

SEQ ID NO: 25298 - protein, 8 aa, Dengue virus
SMVDRGWG

SEQ ID NO: 25299 - protein, 8 aa, Dengue virus
MVDRGWGN

SEQ ID NO: 25300 - protein, 8 aa, Dengue virus
VDRGWGNG

SEQ ID NO: 25301 - protein, 8 aa, Dengue virus
DRGWGNGC

SEQ ID NO: 25302 - protein, 8 aa, Dengue virus
RGWGNGCG

SEQ ID NO: 25303 - protein, 8 aa, Dengue virus
GWGNGCGL

SEQ ID NO: 25304 - protein, 8 aa, Dengue virus
WGNGCGLF

SEQ ID NO: 25305 - protein, 8 aa, Dengue virus
GNGCGLFG

SEQ ID NO: 25306 - protein, 8 aa, Dengue virus
NGCGLFGK

SEQ ID NO: 25307 - protein, 8 aa, Dengue virus
GCGLFGKG

SEQ ID NO: 25308 - protein, 8 aa, Dengue virus
CGLFGKGG

SEQ ID NO: 25309 - protein, 8 aa, Dengue virus
GLFGKGGI

SEQ ID NO: 25310 - protein, 8 aa, Dengue virus
LFGKGGIV

SEQ ID NO: 25311 - protein, 8 aa, Dengue virus
FGKGGIVT

SEQ ID NO: 25312 - protein, 8 aa, Dengue virus
GKGGIVTC

SEQ ID NO: 25313 - protein, 8 aa, Dengue virus
KGGIVTCA

SEQ ID NO: 25314 - protein, 8 aa, Dengue virus
GGIVTCAM

SEQ ID NO: 25315 - protein, 8 aa, Dengue virus
GIVTCAMF

SEQ ID NO: 25316 - protein, 8 aa, Dengue virus
IVTCAMFT

SEQ ID NO: 25317 - protein, 8 aa, Dengue virus
VTCAMFTC

SEQ ID NO: 25318 - protein, 8 aa, Dengue virus
TCAMFTCK

SEQ ID NO: 25319 - protein, 8 aa, Dengue virus
CAMFTCKK

SEQ ID NO: 25320 - protein, 8 aa, Dengue virus
AMFTCKKN

SEQ ID NO: 25321 - protein, 8 aa, Dengue virus
MFTCKKNM

SEQ ID NO: 25322 - protein, 8 aa, Dengue virus
FTCKKNME

SEQ ID NO: 25323 - protein, 8 aa, Dengue virus
TCKKNMEG

SEQ ID NO: 25324 - protein, 8 aa, Dengue virus
CKKNMEGK

SEQ ID NO: 25325 - protein, 8 aa, Dengue virus
KKNMEGKV

SEQ ID NO: 25326 - protein, 8 aa, Dengue virus
KNMEGKVV

SEQ ID NO: 25327 - protein, 8 aa, Dengue virus
NMEGKIVQ

SEQ ID NO: 25328 - protein, 8 aa, Dengue virus
MEGKIVQP

SEQ ID NO: 25329 - protein, 8 aa, Dengue virus
EGKIVQPE

SEQ ID NO: 25330 - protein, 8 aa, Dengue virus
GKIVQPEN

SEQ ID NO: 25331 - protein, 8 aa, Dengue virus
KIVQPENL

SEQ ID NO: 25332 - protein, 8 aa, Dengue virus
IVQPENLE

SEQ ID NO: 25333 - protein, 8 aa, Dengue virus
VQPENLEY

SEQ ID NO: 25334 - protein, 8 aa, Dengue virus
QPENLEYT

SEQ ID NO: 25335 - protein, 8 aa, Dengue virus
PENLEYTI

SEQ ID NO: 25336 - protein, 8 aa, Dengue virus
ENLEYTIV

SEQ ID NO: 25337 - protein, 8 aa, Dengue virus
NLEYTIVI

SEQ ID NO: 25338 - protein, 8 aa, Dengue virus
LEYTIVIT

SEQ ID NO: 25339 - protein, 8 aa, Dengue virus
EYTIVITP

SEQ ID NO: 25340 - protein, 8 aa, Dengue virus
YTIVITPH

SEQ ID NO: 25341 - protein, 8 aa, Dengue virus
TIVITPHS

SEQ ID NO: 25342 - protein, 8 aa, Dengue virus
IVITPHSG

SEQ ID NO: 25343 - protein, 8 aa, Dengue virus
VITPHSGE

SEQ ID NO: 25344 - protein, 8 aa, Dengue virus
ITPHSGEE

SEQ ID NO: 25345 - protein, 8 aa, Dengue virus
TPHSGEEH

SEQ ID NO: 25346 - protein, 8 aa, Dengue virus
PHSGEEHA

SEQ ID NO: 25347 - protein, 8 aa, Dengue virus
HSGEEHAV

SEQ ID NO: 25348 - protein, 8 aa, Dengue virus
SGEEHAVG

SEQ ID NO: 25349 - protein, 8 aa, Dengue virus
GEEHAVGN

SEQ ID NO: 25350 - protein, 8 aa, Dengue virus
EEHAVGND

SEQ ID NO: 25351 - protein, 8 aa, Dengue virus
EHAVGNDT

SEQ ID NO: 25352 - protein, 8 aa, Dengue virus
HAVGNDTG

SEQ ID NO: 25353 - protein, 8 aa, Dengue virus
AVGNDTGK

SEQ ID NO: 25354 - protein, 8 aa, Dengue virus
VGNDTGKH

SEQ ID NO: 25355 - protein, 8 aa, Dengue virus
GNDTGKHG

SEQ ID NO: 25356 - protein, 8 aa, Dengue virus
NDTGKHGK

SEQ ID NO: 25357 - protein, 8 aa, Dengue virus
DTGKHGKE

SEQ ID NO: 25358 - protein, 8 aa, Dengue virus
TGKHGKEI

SEQ ID NO: 25359 - protein, 8 aa, Dengue virus
GKHGKEIK

SEQ ID NO: 25360 - protein, 8 aa, Dengue virus
KHGKEIKI

SEQ ID NO: 25361 - protein, 8 aa, Dengue virus
HGKEIKIT

SEQ ID NO: 25362 - protein, 8 aa, Dengue virus
GKEIKITP

SEQ ID NO: 25363 - protein, 8 aa, Dengue virus
KEIKITPQ

SEQ ID NO: 25364 - protein, 8 aa, Dengue virus
EIKITPQS

SEQ ID NO: 25365 - protein, 8 aa, Dengue virus
IKITPQSS

SEQ ID NO: 25366 - protein, 8 aa, Dengue virus
TEAELTGY

SEQ ID NO: 25367 - protein, 8 aa, Dengue virus
EAELTGYG

SEQ ID NO: 25368 - protein, 8 aa, Dengue virus
AELTGYGT

SEQ ID NO: 25369 - protein, 8 aa, Dengue virus
ELTGYGTV

SEQ ID NO: 25370 - protein, 8 aa, Dengue virus
LTGYGTVT

SEQ ID NO: 25371 - protein, 8 aa, Dengue virus
TGYGTVTM

SEQ ID NO: 25372 - protein, 8 aa, Dengue virus
GYGTVTME

SEQ ID NO: 25373 - protein, 8 aa, Dengue virus
YGTVTMEC

SEQ ID NO: 25374 - protein, 8 aa, Dengue virus
GTVTMECS

SEQ ID NO: 25375 - protein, 8 aa, Dengue virus
TVTMECSP

SEQ ID NO: 25376 - protein, 8 aa, Dengue virus
VTMECSPR

SEQ ID NO: 25377 - protein, 8 aa, Dengue virus
TMECSPRT

SEQ ID NO: 25378 - protein, 8 aa, Dengue virus
MECSPRTG

SEQ ID NO: 25379 - protein, 8 aa, Dengue virus
ECSPRTGL

SEQ ID NO: 25380 - protein, 8 aa, Dengue virus
CSPRTGLD

SEQ ID NO: 25381 - protein, 8 aa, Dengue virus
SPRTGLDF

SEQ ID NO: 25382 - protein, 8 aa, Dengue virus
PRTGLDFN

SEQ ID NO: 25383 - protein, 8 aa, Dengue virus
RTGLDFNE

SEQ ID NO: 25384 - protein, 8 aa, Dengue virus
TGLDFNEM

SEQ ID NO: 25385 - protein, 8 aa, Dengue virus
GLDFNEMV

SEQ ID NO: 25386 - protein, 8 aa, Dengue virus
LDFNEMVL

SEQ ID NO: 25387 - protein, 8 aa, Dengue virus
DFNEMVLL

SEQ ID NO: 25388 - protein, 8 aa, Dengue virus
FNEMVLLQ

SEQ ID NO: 25389 - protein, 8 aa, Dengue virus
NEMVLLQM

SEQ ID NO: 25390 - protein, 8 aa, Dengue virus
EMVLLQME

SEQ ID NO: 25391 - protein, 8 aa, Dengue virus
MEDKAWLV

SEQ ID NO: 25392 - protein, 8 aa, Dengue virus
EDKAWLVH

SEQ ID NO: 25393 - protein, 8 aa, Dengue virus
DKAWLVHR

SEQ ID NO: 25394 - protein, 8 aa, Dengue virus
KAWLVHRQ

SEQ ID NO: 25395 - protein, 8 aa, Dengue virus
AWLVHRQW

SEQ ID NO: 25396 - protein, 8 aa, Dengue virus
WLVHRQWF

SEQ ID NO: 25397 - protein, 8 aa, Dengue virus
LVHRQWFL

SEQ ID NO: 25398 - protein, 8 aa, Dengue virus
VHRQWFLD

SEQ ID NO: 25399 - protein, 8 aa, Dengue virus
HRQWFLDL

SEQ ID NO: 25400 - protein, 8 aa, Dengue virus
RQWFLDLP

SEQ ID NO: 25401 - protein, 8 aa, Dengue virus
QWFLDLPL

SEQ ID NO: 25402 - protein, 8 aa, Dengue virus
WFLDLPLP

SEQ ID NO: 25403 - protein, 8 aa, Dengue virus
FLDLPLPW

SEQ ID NO: 25404 - protein, 8 aa, Dengue virus
LDLPLPWL

SEQ ID NO: 25405 - protein, 8 aa, Dengue virus
DLPLPWLP

SEQ ID NO: 25406 - protein, 8 aa, Dengue virus
LPLPWLPG

SEQ ID NO: 25407 - protein, 8 aa, Dengue virus
PLPWLPGA

SEQ ID NO: 25408 - protein, 8 aa, Dengue virus
LPWLPGAD

SEQ ID NO: 25409 - protein, 8 aa, Dengue virus
PWLPGADT

SEQ ID NO: 25410 - protein, 8 aa, Dengue virus
WLPGADTQ

SEQ ID NO: 25411 - protein, 8 aa, Dengue virus
LPGADTQG

SEQ ID NO: 25412 - protein, 8 aa, Dengue virus
PGADTQGS

SEQ ID NO: 25413 - protein, 8 aa, Dengue virus
GADTQGSN

SEQ ID NO: 25414 - protein, 8 aa, Dengue virus
ADTQGSNW

SEQ ID NO: 25415 - protein, 8 aa, Dengue virus
DTQGSNWI

SEQ ID NO: 25416 - protein, 8 aa, Dengue virus
TQGSNWIQ

SEQ ID NO: 25417 - protein, 8 aa, Dengue virus
QGSNWIQK

SEQ ID NO: 25418 - protein, 8 aa, Dengue virus
GSNWIQKE

SEQ ID NO: 25419 - protein, 8 aa, Dengue virus
SNWIQKET

SEQ ID NO: 25420 - protein, 8 aa, Dengue virus
NWIQKETL

SEQ ID NO: 25421 - protein, 8 aa, Dengue virus
WIQKETLV

SEQ ID NO: 25422 - protein, 8 aa, Dengue virus
IQKETLVT

SEQ ID NO: 25423 - protein, 8 aa, Dengue virus
QKETLVTF

SEQ ID NO: 25424 - protein, 8 aa, Dengue virus
KETLVTFK

SEQ ID NO: 25425 - protein, 8 aa, Dengue virus
ETLVTFKN

SEQ ID NO: 25426 - protein, 8 aa, Dengue virus
TLVTFKNP

SEQ ID NO: 25427 - protein, 8 aa, Dengue virus
LVTFKNPH

SEQ ID NO: 25428 - protein, 8 aa, Dengue virus
VTFKNPHA

SEQ ID NO: 25429 - protein, 8 aa, Dengue virus
TFKNPHAK

SEQ ID NO: 25430 - protein, 8 aa, Dengue virus
FKNPHAKK

SEQ ID NO: 25431 - protein, 8 aa, Dengue virus
KNPHAKKQ

SEQ ID NO: 25432 - protein, 8 aa, Dengue virus
NPHAKKQD

SEQ ID NO: 25433 - protein, 8 aa, Dengue virus
PHAKKQDV

SEQ ID NO: 25434 - protein, 8 aa, Dengue virus
HAKKQDVV

SEQ ID NO: 25435 - protein, 8 aa, Dengue virus
AKKQDVVV

SEQ ID NO: 25436 - protein, 8 aa, Dengue virus
KKQDVVVL

SEQ ID NO: 25437 - protein, 8 aa, Dengue virus
KQDVVVLG

SEQ ID NO: 25438 - protein, 8 aa, Dengue virus
QDVVVLGS

SEQ ID NO: 25439 - protein, 8 aa, Dengue virus
DVVVLGSQ

SEQ ID NO: 25440 - protein, 8 aa, Dengue virus
VVVLGSQE

SEQ ID NO: 25441 - protein, 8 aa, Dengue virus
VVLGSQEG

SEQ ID NO: 25442 - protein, 8 aa, Dengue virus
VLGSQEGA

SEQ ID NO: 25443 - protein, 8 aa, Dengue virus
LGSQEGAM

SEQ ID NO: 25444 - protein, 8 aa, Dengue virus
GSQEGAMH

SEQ ID NO: 25445 - protein, 8 aa, Dengue virus
SQEGAMHT

SEQ ID NO: 25446 - protein, 8 aa, Dengue virus
QEGAMHTA

SEQ ID NO: 25447 - protein, 8 aa, Dengue virus
EGAMHTAL

SEQ ID NO: 25448 - protein, 8 aa, Dengue virus
GAMHTALT

SEQ ID NO: 25449 - protein, 8 aa, Dengue virus
AMHTALTG

SEQ ID NO: 25450 - protein, 8 aa, Dengue virus
MHTALTGA

SEQ ID NO: 25451 - protein, 8 aa, Dengue virus
HTALTGAT

SEQ ID NO: 25452 - protein, 8 aa, Dengue virus
TALTGATE

SEQ ID NO: 25453 - protein, 8 aa, Dengue virus
ALTGATEI

SEQ ID NO: 25454 - protein, 8 aa, Dengue virus
LTGATEIQ

SEQ ID NO: 25455 - protein, 8 aa, Dengue virus
TGATEIQM

SEQ ID NO: 25456 - protein, 8 aa, Dengue virus
GATEIQMS

SEQ ID NO: 25457 - protein, 8 aa, Dengue virus
ATEIQMSS

SEQ ID NO: 25458 - protein, 8 aa, Dengue virus
TEIQMSSG

SEQ ID NO: 25459 - protein, 8 aa, Dengue virus
EIQMSSGN

SEQ ID NO: 25460 - protein, 8 aa, Dengue virus
IQMSSGNL

SEQ ID NO: 25461 - protein, 8 aa, Dengue virus
QMSSGNLL

SEQ ID NO: 25462 - protein, 8 aa, Dengue virus
MSSGNLLF

SEQ ID NO: 25463 - protein, 8 aa, Dengue virus
SSGNLLFT

SEQ ID NO: 25464 - protein, 8 aa, Dengue virus
SGNLLFTG

SEQ ID NO: 25465 - protein, 8 aa, Dengue virus
GNLLFTGH

SEQ ID NO: 25466 - protein, 8 aa, Dengue virus
NLLFTGHL

SEQ ID NO: 25467 - protein, 8 aa, Dengue virus
LLFTGHLK

SEQ ID NO: 25468 - protein, 8 aa, Dengue virus
LFTGHLKC

SEQ ID NO: 25469 - protein, 8 aa, Dengue virus
FTGHLKCR

SEQ ID NO: 25470 - protein, 8 aa, Dengue virus
TGHLKCRL

SEQ ID NO: 25471 - protein, 8 aa, Dengue virus
GHLKCRLR

SEQ ID NO: 25472 - protein, 8 aa, Dengue virus
HLKCRLRM

SEQ ID NO: 25473 - protein, 8 aa, Dengue virus
LKCRLRMD

SEQ ID NO: 25474 - protein, 8 aa, Dengue virus
KCRLRMDK

SEQ ID NO: 25475 - protein, 8 aa, Dengue virus
CRLRMDKL

SEQ ID NO: 25476 - protein, 8 aa, Dengue virus
RLRMDKLQ

SEQ ID NO: 25477 - protein, 8 aa, Dengue virus
LRMDKLQL

SEQ ID NO: 25478 - protein, 8 aa, Dengue virus
RMDKLQLK

SEQ ID NO: 25479 - protein, 8 aa, Dengue virus
MDKLQLKG

SEQ ID NO: 25480 - protein, 8 aa, Dengue virus
DKLQLKGM

SEQ ID NO: 25481 - protein, 8 aa, Dengue virus
KLQLKGMS

SEQ ID NO: 25482 - protein, 8 aa, Dengue virus
LQLKGMSY

SEQ ID NO: 25483 - protein, 8 aa, Dengue virus
QLKGMSYS

SEQ ID NO: 25484 - protein, 8 aa, Dengue virus
LKGMSYSM

SEQ ID NO: 25485 - protein, 8 aa, Dengue virus
KGMSYSMC

SEQ ID NO: 25486 - protein, 8 aa, Dengue virus
GMSYSMCT

SEQ ID NO: 25487 - protein, 8 aa, Dengue virus
MSYSMCTG

SEQ ID NO: 25488 - protein, 8 aa, Dengue virus
SYSMCTGK

SEQ ID NO: 25489 - protein, 8 aa, Dengue virus
YSMCTGKF

SEQ ID NO: 25490 - protein, 8 aa, Dengue virus
SMCTGKFK

SEQ ID NO: 25491 - protein, 8 aa, Dengue virus
MCTGKFKI

SEQ ID NO: 25492 - protein, 8 aa, Dengue virus
CTGKFKIV

SEQ ID NO: 25493 - protein, 8 aa, Dengue virus
TGKFKIVK

SEQ ID NO: 25494 - protein, 8 aa, Dengue virus
GKFKIVKE

SEQ ID NO: 25495 - protein, 8 aa, Dengue virus
KFKIVKEI

SEQ ID NO: 25496 - protein, 8 aa, Dengue virus
FKIVKEIA

SEQ ID NO: 25497 - protein, 8 aa, Dengue virus
KIVKEIAE

SEQ ID NO: 25498 - protein, 8 aa, Dengue virus
IVKEIAET

SEQ ID NO: 25499 - protein, 8 aa, Dengue virus
VKEIAETQ

SEQ ID NO: 25500 - protein, 8 aa, Dengue virus
KEIAETQH

SEQ ID NO: 25501 - protein, 8 aa, Dengue virus
EIAETQHG

SEQ ID NO: 25502 - protein, 8 aa, Dengue virus
IAETQHGT

SEQ ID NO: 25503 - protein, 8 aa, Dengue virus
AETQHGTI

SEQ ID NO: 25504 - protein, 8 aa, Dengue virus
ETQHGTIV

SEQ ID NO: 25505 - protein, 8 aa, Dengue virus
TQHGTIVI

SEQ ID NO: 25506 - protein, 8 aa, Dengue virus
QHGTIVIR

SEQ ID NO: 25507 - protein, 8 aa, Dengue virus
HGTIVIRV

SEQ ID NO: 25508 - protein, 8 aa, Dengue virus
GTIVIRVQ

SEQ ID NO: 25509 - protein, 8 aa, Dengue virus
TIVIRVQY

SEQ ID NO: 25510 - protein, 8 aa, Dengue virus
IVIRVQYE

SEQ ID NO: 25511 - protein, 8 aa, Dengue virus
VIRVQYEG

SEQ ID NO: 25512 - protein, 8 aa, Dengue virus
IRVQYEGD

SEQ ID NO: 25513 - protein, 8 aa, Dengue virus
RVQYEGDG

SEQ ID NO: 25514 - protein, 8 aa, Dengue virus
VQYEGDGS

SEQ ID NO: 25515 - protein, 8 aa, Dengue virus
QYEGDGSP

SEQ ID NO: 25516 - protein, 8 aa, Dengue virus
YEGDGSPC

SEQ ID NO: 25517 - protein, 8 aa, Dengue virus
EGDGSPCK

SEQ ID NO: 25518 - protein, 8 aa, Dengue virus
GDGSPCKI

SEQ ID NO: 25519 - protein, 8 aa, Dengue virus
DGSPCKIP

SEQ ID NO: 25520 - protein, 8 aa, Dengue virus
GSPCKIPF

SEQ ID NO: 25521 - protein, 8 aa, Dengue virus
SPCKIPFE

SEQ ID NO: 25522 - protein, 8 aa, Dengue virus
PCKIPFEI

SEQ ID NO: 25523 - protein, 8 aa, Dengue virus
CKIPFEIM

SEQ ID NO: 25524 - protein, 8 aa, Dengue virus
KIPFEIMD

SEQ ID NO: 25525 - protein, 8 aa, Dengue virus
IPFEIMDL

SEQ ID NO: 25526 - protein, 8 aa, Dengue virus
PFEIMDLE

SEQ ID NO: 25527 - protein, 8 aa, Dengue virus
FEIMDLEK

SEQ ID NO: 25528 - protein, 8 aa, Dengue virus
EIMDLEKR

SEQ ID NO: 25529 - protein, 8 aa, Dengue virus
IMDLEKRH

SEQ ID NO: 25530 - protein, 8 aa, Dengue virus
DLEKRHVL

SEQ ID NO: 25531 - protein, 8 aa, Dengue virus
LEKRHVLG

SEQ ID NO: 25532 - protein, 8 aa, Dengue virus
EKRHVLGR

SEQ ID NO: 25533 - protein, 8 aa, Dengue virus
KRHVLGRL

SEQ ID NO: 25534 - protein, 8 aa, Dengue virus
RHVLGRLI

SEQ ID NO: 25535 - protein, 8 aa, Dengue virus
HVLGRLIT

SEQ ID NO: 25536 - protein, 8 aa, Dengue virus
VLGRLITV

SEQ ID NO: 25537 - protein, 8 aa, Dengue virus
LGRLITVN

SEQ ID NO: 25538 - protein, 8 aa, Dengue virus
GRLITVNP

SEQ ID NO: 25539 - protein, 8 aa, Dengue virus
RLITVNPI

SEQ ID NO: 25540 - protein, 8 aa, Dengue virus
LITVNPIV

SEQ ID NO: 25541 - protein, 8 aa, Dengue virus
ITVNPIVT

SEQ ID NO: 25542 - protein, 8 aa, Dengue virus
EKDSPVNI

SEQ ID NO: 25543 - protein, 8 aa, Dengue virus
KDSPVNIE

SEQ ID NO: 25544 - protein, 8 aa, Dengue virus
DSPVNIEA

SEQ ID NO: 25545 - protein, 8 aa, Dengue virus
SPVNIEAE

SEQ ID NO: 25546 - protein, 8 aa, Dengue virus
PVNIEAEP

SEQ ID NO: 25547 - protein, 8 aa, Dengue virus
VNIEAEPP

SEQ ID NO: 25548 - protein, 8 aa, Dengue virus
NIEAEPPF

SEQ ID NO: 25549 - protein, 8 aa, Dengue virus
IEAEPPFG

SEQ ID NO: 25550 - protein, 8 aa, Dengue virus
EAEPPFGD

SEQ ID NO: 25551 - protein, 8 aa, Dengue virus
AEPPFGDS

SEQ ID NO: 25552 - protein, 8 aa, Dengue virus
EPPFGDSY

SEQ ID NO: 25553 - protein, 8 aa, Dengue virus
PPFGDSYI

SEQ ID NO: 25554 - protein, 8 aa, Dengue virus
PFGDSYII

SEQ ID NO: 25555 - protein, 8 aa, Dengue virus
FGDSYIII

SEQ ID NO: 25556 - protein, 8 aa, Dengue virus
GDSYIIIG

SEQ ID NO: 25557 - protein, 8 aa, Dengue virus
DSYIIIGV

SEQ ID NO: 25558 - protein, 8 aa, Dengue virus
SYIIIGVE

SEQ ID NO: 25559 - protein, 8 aa, Dengue virus
YIIIGVEP

SEQ ID NO: 25560 - protein, 8 aa, Dengue virus
IIIGVEPG

SEQ ID NO: 25561 - protein, 8 aa, Dengue virus
IIGVEPGQ

SEQ ID NO: 25562 - protein, 8 aa, Dengue virus
IGVEPGQL

SEQ ID NO: 25563 - protein, 8 aa, Dengue virus
GVEPGQLK

SEQ ID NO: 25564 - protein, 8 aa, Dengue virus
VEPGQLKL

SEQ ID NO: 25565 - protein, 8 aa, Dengue virus
EPGQLKLN

SEQ ID NO: 25566 - protein, 8 aa, Dengue virus
PGQLKLNW

SEQ ID NO: 25567 - protein, 8 aa, Dengue virus
GQLKLNWF

SEQ ID NO: 25568 - protein, 8 aa, Dengue virus
QLKLNWFK

SEQ ID NO: 25569 - protein, 8 aa, Dengue virus
LKLNWFKK

SEQ ID NO: 25570 - protein, 8 aa, Dengue virus
KLNWFKKG

SEQ ID NO: 25571 - protein, 8 aa, Dengue virus
LNWFKKGS

SEQ ID NO: 25572 - protein, 8 aa, Dengue virus
NWFKKGSS

SEQ ID NO: 25573 - protein, 8 aa, Dengue virus
WFKKGSSI

SEQ ID NO: 25574 - protein, 8 aa, Dengue virus
FKKGSSIG

SEQ ID NO: 25575 - protein, 8 aa, Dengue virus
KKGSSIGQ

SEQ ID NO: 25576 - protein, 8 aa, Dengue virus
KGSSIGQM

SEQ ID NO: 25577 - protein, 8 aa, Dengue virus
GSSIGQMF

SEQ ID NO: 25578 - protein, 8 aa, Dengue virus
SSIGQMFE

SEQ ID NO: 25579 - protein, 8 aa, Dengue virus
SIGQMFET

SEQ ID NO: 25580 - protein, 8 aa, Dengue virus
IGQMFETT

SEQ ID NO: 25581 - protein, 8 aa, Dengue virus
GQMFETTM

SEQ ID NO: 25582 - protein, 8 aa, Dengue virus
QMFETTMR

SEQ ID NO: 25583 - protein, 8 aa, Dengue virus
MFETTMRG

SEQ ID NO: 25584 - protein, 8 aa, Dengue virus
FETTMRGA

SEQ ID NO: 25585 - protein, 8 aa, Dengue virus
ETTMRGAK

SEQ ID NO: 25586 - protein, 8 aa, Dengue virus
TTMRGAKR

SEQ ID NO: 25587 - protein, 8 aa, Dengue virus
TMRGAKRM

SEQ ID NO: 25588 - protein, 8 aa, Dengue virus
MRGAKRMA

SEQ ID NO: 25589 - protein, 8 aa, Dengue virus
RGAKRMAI

SEQ ID NO: 25590 - protein, 8 aa, Dengue virus
GAKRMAIL

SEQ ID NO: 25591 - protein, 8 aa, Dengue virus
AKRMAILG

SEQ ID NO: 25592 - protein, 8 aa, Dengue virus
KRMAILGD

SEQ ID NO: 25593 - protein, 8 aa, Dengue virus
RMAILGDT

SEQ ID NO: 25594 - protein, 8 aa, Dengue virus
MAILGDTA

SEQ ID NO: 25595 - protein, 8 aa, Dengue virus
AILGDTAW

SEQ ID NO: 25596 - protein, 8 aa, Dengue virus
ILGDTAWD

SEQ ID NO: 25597 - protein, 8 aa, Dengue virus
LGDTAWDF

SEQ ID NO: 25598 - protein, 8 aa, Dengue virus
GDTAWDFG

SEQ ID NO: 25599 - protein, 8 aa, Dengue virus
DTAWDFGS

SEQ ID NO: 25600 - protein, 8 aa, Dengue virus
TAWDFGSL

SEQ ID NO: 25601 - protein, 8 aa, Dengue virus
AWDFGSLG

SEQ ID NO: 25602 - protein, 8 aa, Dengue virus
WDFGSLGG

SEQ ID NO: 25603 - protein, 8 aa, Dengue virus
DFGSLGGV

SEQ ID NO: 25604 - protein, 8 aa, Dengue virus
FGSLGGVF

SEQ ID NO: 25605 - protein, 8 aa, Dengue virus
GSLGGVFT

SEQ ID NO: 25606 - protein, 8 aa, Dengue virus
SLGGVFTS

SEQ ID NO: 25607 - protein, 8 aa, Dengue virus
LGGVFTSI

SEQ ID NO: 25608 - protein, 8 aa, Dengue virus
GGVFTSIG

SEQ ID NO: 25609 - protein, 8 aa, Dengue virus
GVFTSIGK

SEQ ID NO: 25610 - protein, 8 aa, Dengue virus
VFTSIGKA

SEQ ID NO: 25611 - protein, 8 aa, Dengue virus
FTSIGKAL

SEQ ID NO: 25612 - protein, 8 aa, Dengue virus
TSIGKALH

SEQ ID NO: 25613 - protein, 8 aa, Dengue virus
SIGKALHQ

SEQ ID NO: 25614 - protein, 8 aa, Dengue virus
IGKALHQV

SEQ ID NO: 25615 - protein, 8 aa, Dengue virus
GKALHQVF

SEQ ID NO: 25616 - protein, 8 aa, Dengue virus
KALHQVFG

SEQ ID NO: 25617 - protein, 8 aa, Dengue virus
ALHQVFGA

SEQ ID NO: 25618 - protein, 8 aa, Dengue virus
LHQVFGAI

SEQ ID NO: 25619 - protein, 8 aa, Dengue virus
HQVFGAIY

SEQ ID NO: 25620 - protein, 8 aa, Dengue virus
QVFGAIYG

SEQ ID NO: 25621 - protein, 8 aa, Dengue virus
VFGAIYGA

SEQ ID NO: 25622 - protein, 8 aa, Dengue virus
FGAIYGAA

SEQ ID NO: 25623 - protein, 8 aa, Dengue virus
GAIYGAAF

SEQ ID NO: 25624 - protein, 8 aa, Dengue virus
AIYGAAFS

SEQ ID NO: 25625 - protein, 8 aa, Dengue virus
IYGAAFSG

SEQ ID NO: 25626 - protein, 8 aa, Dengue virus
YGAAFSGV

SEQ ID NO: 25627 - protein, 8 aa, Dengue virus
GAAFSGVS

SEQ ID NO: 25628 - protein, 8 aa, Dengue virus
AAFSGVSW

SEQ ID NO: 25629 - protein, 8 aa, Dengue virus
AFSGVSWT

SEQ ID NO: 25630 - protein, 8 aa, Dengue virus
FSGVSWTM

SEQ ID NO: 25631 - protein, 8 aa, Dengue virus
SGVSWTMK

SEQ ID NO: 25632 - protein, 8 aa, Dengue virus
GVSWTMKI

SEQ ID NO: 25633 - protein, 8 aa, Dengue virus
VSWTMKIL

SEQ ID NO: 25634 - protein, 8 aa, Dengue virus
SWTMKILI

SEQ ID NO: 25635 - protein, 8 aa, Dengue virus
WTMKILIG

SEQ ID NO: 25636 - protein, 8 aa, Dengue virus
TMKILIGV

SEQ ID NO: 25637 - protein, 8 aa, Dengue virus
MKILIGVI

SEQ ID NO: 25638 - protein, 8 aa, Dengue virus
KILIGVII

SEQ ID NO: 25639 - protein, 8 aa, Dengue virus
ILIGVIIT

SEQ ID NO: 25640 - protein, 8 aa, Dengue virus
LIGVIITW

SEQ ID NO: 25641 - protein, 8 aa, Dengue virus
IGVIITWI

SEQ ID NO: 25642 - protein, 8 aa, Dengue virus
GVIITWIG

SEQ ID NO: 25643 - protein, 8 aa, Dengue virus
VIITWIGM

SEQ ID NO: 25644 - protein, 8 aa, Dengue virus
IITWIGMN

SEQ ID NO: 25645 - protein, 8 aa, Dengue virus
ITWIGMNS

SEQ ID NO: 25646 - protein, 8 aa, Dengue virus
TWIGMNSR

SEQ ID NO: 25647 - protein, 8 aa, Dengue virus
WIGMNSRS

SEQ ID NO: 25648 - protein, 8 aa, Dengue virus
IGMNSRST

SEQ ID NO: 25649 - protein, 8 aa, Dengue virus
GMNSRSTS

SEQ ID NO: 25650 - protein, 8 aa, Dengue virus
MNSRSTSL

SEQ ID NO: 25651 - protein, 8 aa, Dengue virus
NSRSTSLS

SEQ ID NO: 25652 - protein, 8 aa, Dengue virus
SRSTSLSV

SEQ ID NO: 25653 - protein, 8 aa, Dengue virus
RSTSLSVS

SEQ ID NO: 25654 - protein, 8 aa, Dengue virus
STSLSVSL

SEQ ID NO: 25655 - protein, 8 aa, Dengue virus
TSLSVSLV

SEQ ID NO: 25656 - protein, 8 aa, Dengue virus
SLSVSLVL

SEQ ID NO: 25657 - protein, 8 aa, Dengue virus
LSVSLVLV

SEQ ID NO: 25658 - protein, 8 aa, Dengue virus
SVSLVLVG

SEQ ID NO: 25659 - protein, 8 aa, Dengue virus
VSLVLVGV

SEQ ID NO: 25660 - protein, 8 aa, Dengue virus
SLVLVGVV

SEQ ID NO: 25661 - protein, 8 aa, Dengue virus
LVLVGVVT

SEQ ID NO: 25662 - protein, 8 aa, Dengue virus
VLVGVVTL

SEQ ID NO: 25663 - protein, 8 aa, Dengue virus
LVGVVTLY

SEQ ID NO: 25664 - protein, 8 aa, Dengue virus
VGVVTLYL

SEQ ID NO: 25665 - protein, 8 aa, Dengue virus
GVVTLYLG

SEQ ID NO: 25666 - protein, 8 aa, Dengue virus
VVTLYLGA

SEQ ID NO: 25667 - protein, 8 aa, Dengue virus
VTLYLGVM

SEQ ID NO: 25668 - protein, 8 aa, Dengue virus
TLYLGVMV

SEQ ID NO: 25669 - protein, 8 aa, Dengue virus
LYLGVMVQ

SEQ ID NO: 25670 - protein, 8 aa, Dengue virus
YLGVMVQA

SEQ ID NO: 25671 - protein, 8 aa, Dengue virus
LGVMVQAD

SEQ ID NO: 25672 - protein, 8 aa, Dengue virus
GVMVQADS

SEQ ID NO: 25673 - protein, 8 aa, Dengue virus
VMVQADSG

SEQ ID NO: 25674 - protein, 8 aa, Dengue virus
MVQADSGC

SEQ ID NO: 25675 - protein, 8 aa, Dengue virus
VQADSGCV

SEQ ID NO: 25676 - protein, 8 aa, Dengue virus
QADSGCVV

SEQ ID NO: 25677 - protein, 8 aa, Dengue virus
ADSGCVVS

SEQ ID NO: 25678 - protein, 8 aa, Dengue virus
DSGCVVSW

SEQ ID NO: 25679 - protein, 8 aa, Dengue virus
SGCVVSWK

SEQ ID NO: 25680 - protein, 8 aa, Dengue virus
GCVVSWKN

SEQ ID NO: 25681 - protein, 8 aa, Dengue virus
CVVSWKNK

SEQ ID NO: 25682 - protein, 8 aa, Dengue virus
VVSWKNKE

SEQ ID NO: 25683 - protein, 8 aa, Dengue virus
VSWKNKEL

SEQ ID NO: 25684 - protein, 8 aa, Dengue virus
SWKNKELK

SEQ ID NO: 25685 - protein, 8 aa, Dengue virus
WKNKELKC

SEQ ID NO: 25686 - protein, 8 aa, Dengue virus
KNKELKCG

SEQ ID NO: 25687 - protein, 8 aa, Dengue virus
NKELKCGS

SEQ ID NO: 25688 - protein, 8 aa, Dengue virus
KELKCGSG

SEQ ID NO: 25689 - protein, 8 aa, Dengue virus
ELKCGSGI

SEQ ID NO: 25690 - protein, 8 aa, Dengue virus
LKCGSGIF

SEQ ID NO: 25691 - protein, 8 aa, Dengue virus
KCGSGIFI

SEQ ID NO: 25692 - protein, 8 aa, Dengue virus
CGSGIFIT

SEQ ID NO: 25693 - protein, 8 aa, Dengue virus
GSGIFITD

SEQ ID NO: 25694 - protein, 8 aa, Dengue virus
SGIFITDN

SEQ ID NO: 25695 - protein, 8 aa, Dengue virus
GIFITDNV

SEQ ID NO: 25696 - protein, 8 aa, Dengue virus
IFITDNVH

SEQ ID NO: 25697 - protein, 8 aa, Dengue virus
FITDNVHT

SEQ ID NO: 25698 - protein, 8 aa, Dengue virus
ITDNVHTW

SEQ ID NO: 25699 - protein, 8 aa, Dengue virus
TDNVHTWT

SEQ ID NO: 25700 - protein, 8 aa, Dengue virus
DNVHTWTE

SEQ ID NO: 25701 - protein, 8 aa, Dengue virus
NVHTWTEQ

SEQ ID NO: 25702 - protein, 8 aa, Dengue virus
VHTWTEQY

SEQ ID NO: 25703 - protein, 8 aa, Dengue virus
HTWTEQYK

SEQ ID NO: 25704 - protein, 8 aa, Dengue virus
TWTEQYKF

SEQ ID NO: 25705 - protein, 8 aa, Dengue virus
WTEQYKFQ

SEQ ID NO: 25706 - protein, 8 aa, Dengue virus
TEQYKFQP

SEQ ID NO: 25707 - protein, 8 aa, Dengue virus
EQYKFQPE

SEQ ID NO: 25708 - protein, 8 aa, Dengue virus
QYKFQPES

SEQ ID NO: 25709 - protein, 8 aa, Dengue virus
YKFQPESP

SEQ ID NO: 25710 - protein, 8 aa, Dengue virus
KFQPESPS

SEQ ID NO: 25711 - protein, 8 aa, Dengue virus
FQPESPSK

SEQ ID NO: 25712 - protein, 8 aa, Dengue virus
QPESPSKL

SEQ ID NO: 25713 - protein, 8 aa, Dengue virus
PESPSKLA

SEQ ID NO: 25714 - protein, 8 aa, Dengue virus
ESPSKLAS

SEQ ID NO: 25715 - protein, 8 aa, Dengue virus
SPSKLASA

SEQ ID NO: 25716 - protein, 8 aa, Dengue virus
PSKLASAI

SEQ ID NO: 25717 - protein, 8 aa, Dengue virus
SKLASAIQ

SEQ ID NO: 25718 - protein, 8 aa, Dengue virus
KLASAIQK

SEQ ID NO: 25719 - protein, 8 aa, Dengue virus
LASAIQKA

SEQ ID NO: 25720 - protein, 8 aa, Dengue virus
ASAIQKAH

SEQ ID NO: 25721 - protein, 8 aa, Dengue virus
SAIQKAHE

SEQ ID NO: 25722 - protein, 8 aa, Dengue virus
AIQKAHEE

SEQ ID NO: 25723 - protein, 8 aa, Dengue virus
IQKAHEEG

SEQ ID NO: 25724 - protein, 8 aa, Dengue virus
QKAHEEGI

SEQ ID NO: 25725 - protein, 8 aa, Dengue virus
KAHEEGIC

SEQ ID NO: 25726 - protein, 8 aa, Dengue virus
AHEEGICG

SEQ ID NO: 25727 - protein, 8 aa, Dengue virus
HEEGICGI

SEQ ID NO: 25728 - protein, 8 aa, Dengue virus
EEGICGIR

SEQ ID NO: 25729 - protein, 8 aa, Dengue virus
EGICGIRS

SEQ ID NO: 25730 - protein, 8 aa, Dengue virus
GICGIRSV

SEQ ID NO: 25731 - protein, 8 aa, Dengue virus
ICGIRSVT

SEQ ID NO: 25732 - protein, 8 aa, Dengue virus
CGIRSVTR

SEQ ID NO: 25733 - protein, 8 aa, Dengue virus
GIRSVTRL

SEQ ID NO: 25734 - protein, 8 aa, Dengue virus
IRSVTRLE

SEQ ID NO: 25735 - protein, 8 aa, Dengue virus
RSVTRLEN

SEQ ID NO: 25736 - protein, 8 aa, Dengue virus
SVTRLENL

SEQ ID NO: 25737 - protein, 8 aa, Dengue virus
VTRLENLM

SEQ ID NO: 25738 - protein, 8 aa, Dengue virus
TRLENLMW

SEQ ID NO: 25739 - protein, 8 aa, Dengue virus
RLENLMWK

SEQ ID NO: 25740 - protein, 8 aa, Dengue virus
LENLMWKQ

SEQ ID NO: 25741 - protein, 8 aa, Dengue virus
ENLMWKQI

SEQ ID NO: 25742 - protein, 8 aa, Dengue virus
NLMWKQIT

SEQ ID NO: 25743 - protein, 8 aa, Dengue virus
LMWKQITP

SEQ ID NO: 25744 - protein, 8 aa, Dengue virus
MWKQITPE

SEQ ID NO: 25745 - protein, 8 aa, Dengue virus
WKQITPEL

SEQ ID NO: 25746 - protein, 8 aa, Dengue virus
KQITPELN

SEQ ID NO: 25747 - protein, 8 aa, Dengue virus
QITPELNH

SEQ ID NO: 25748 - protein, 8 aa, Dengue virus
ITPELNHI

SEQ ID NO: 25749 - protein, 8 aa, Dengue virus
TPELNHIL

SEQ ID NO: 25750 - protein, 8 aa, Dengue virus
PELNHILS

SEQ ID NO: 25751 - protein, 8 aa, Dengue virus
ELNHILSE

SEQ ID NO: 25752 - protein, 8 aa, Dengue virus
LNHILSEN

SEQ ID NO: 25753 - protein, 8 aa, Dengue virus
NHILSENE

SEQ ID NO: 25754 - protein, 8 aa, Dengue virus
HILSENEV

SEQ ID NO: 25755 - protein, 8 aa, Dengue virus
ILSENEVK

SEQ ID NO: 25756 - protein, 8 aa, Dengue virus
LSENEVKL

SEQ ID NO: 25757 - protein, 8 aa, Dengue virus
SENEVKLT

SEQ ID NO: 25758 - protein, 8 aa, Dengue virus
ENEVKLTI

SEQ ID NO: 25759 - protein, 8 aa, Dengue virus
NEVKLTIM

SEQ ID NO: 25760 - protein, 8 aa, Dengue virus
EVKLTIMT

SEQ ID NO: 25761 - protein, 8 aa, Dengue virus
VKLTIMTG

SEQ ID NO: 25762 - protein, 8 aa, Dengue virus
KLTIMTGD

SEQ ID NO: 25763 - protein, 8 aa, Dengue virus
LTIMTGDI

SEQ ID NO: 25764 - protein, 8 aa, Dengue virus
TIMTGDIK

SEQ ID NO: 25765 - protein, 8 aa, Dengue virus
IMTGDIKG

SEQ ID NO: 25766 - protein, 8 aa, Dengue virus
MTGDIKGI

SEQ ID NO: 25767 - protein, 8 aa, Dengue virus
TGDIKGIM

SEQ ID NO: 25768 - protein, 8 aa, Dengue virus
GDIKGIMQ

SEQ ID NO: 25769 - protein, 8 aa, Dengue virus
IKGIMQAG

SEQ ID NO: 25770 - protein, 8 aa, Dengue virus
KGIMQAGK

SEQ ID NO: 25771 - protein, 8 aa, Dengue virus
GIMQAGKR

SEQ ID NO: 25772 - protein, 8 aa, Dengue virus
IMQAGKRS

SEQ ID NO: 25773 - protein, 8 aa, Dengue virus
MQAGKRSL

SEQ ID NO: 25774 - protein, 8 aa, Dengue virus
GKRSLRPQ

SEQ ID NO: 25775 - protein, 8 aa, Dengue virus
KRSLRPQP

SEQ ID NO: 25776 - protein, 8 aa, Dengue virus
RSLRPQPT

SEQ ID NO: 25777 - protein, 8 aa, Dengue virus
SLRPQPTE

SEQ ID NO: 25778 - protein, 8 aa, Dengue virus
LRPQPTEL

SEQ ID NO: 25779 - protein, 8 aa, Dengue virus
RPQPTELK

SEQ ID NO: 25780 - protein, 8 aa, Dengue virus
PQPTELKY

SEQ ID NO: 25781 - protein, 8 aa, Dengue virus
QPTELKYS

SEQ ID NO: 25782 - protein, 8 aa, Dengue virus
PTELKYSW

SEQ ID NO: 25783 - protein, 8 aa, Dengue virus
TELKYSWK

SEQ ID NO: 25784 - protein, 8 aa, Dengue virus
ELKYSWKT

SEQ ID NO: 25785 - protein, 8 aa, Dengue virus
LKYSWKTW

SEQ ID NO: 25786 - protein, 8 aa, Dengue virus
KYSWKTWG

SEQ ID NO: 25787 - protein, 8 aa, Dengue virus
YSWKTWGK

SEQ ID NO: 25788 - protein, 8 aa, Dengue virus
SWKTWGKA

SEQ ID NO: 25789 - protein, 8 aa, Dengue virus
WKTWGKAK

SEQ ID NO: 25790 - protein, 8 aa, Dengue virus
KTWGKAKM

SEQ ID NO: 25791 - protein, 8 aa, Dengue virus
TWGKAKML

SEQ ID NO: 25792 - protein, 8 aa, Dengue virus
WGKAKMLS

SEQ ID NO: 25793 - protein, 8 aa, Dengue virus
GKAKMLST

SEQ ID NO: 25794 - protein, 8 aa, Dengue virus
KAKMLSTE

SEQ ID NO: 25795 - protein, 8 aa, Dengue virus
HNQTFLID

SEQ ID NO: 25796 - protein, 8 aa, Dengue virus
NQTFLIDG

SEQ ID NO: 25797 - protein, 8 aa, Dengue virus
QTFLIDGP

SEQ ID NO: 25798 - protein, 8 aa, Dengue virus
TFLIDGPE

SEQ ID NO: 25799 - protein, 8 aa, Dengue virus
FLIDGPET

SEQ ID NO: 25800 - protein, 8 aa, Dengue virus
LIDGPETA

SEQ ID NO: 25801 - protein, 8 aa, Dengue virus
IDGPETAE

SEQ ID NO: 25802 - protein, 8 aa, Dengue virus
DGPETAEC

SEQ ID NO: 25803 - protein, 8 aa, Dengue virus
GPETAECP

SEQ ID NO: 25804 - protein, 8 aa, Dengue virus
PETAECPN

SEQ ID NO: 25805 - protein, 8 aa, Dengue virus
ETAECPNT

SEQ ID NO: 25806 - protein, 8 aa, Dengue virus
TAECPNTN

SEQ ID NO: 25807 - protein, 8 aa, Dengue virus
AECPNTNR

SEQ ID NO: 25808 - protein, 8 aa, Dengue virus
ECPNTNRA

SEQ ID NO: 25809 - protein, 8 aa, Dengue virus
CPNTNRAW

SEQ ID NO: 25810 - protein, 8 aa, Dengue virus
PNTNRAWN

SEQ ID NO: 25811 - protein, 8 aa, Dengue virus
NTNRAWNS

SEQ ID NO: 25812 - protein, 8 aa, Dengue virus
TNRAWNSL

SEQ ID NO: 25813 - protein, 8 aa, Dengue virus
NRAWNSLE

SEQ ID NO: 25814 - protein, 8 aa, Dengue virus
RAWNSLEV

SEQ ID NO: 25815 - protein, 8 aa, Dengue virus
AWNSLEVE

SEQ ID NO: 25816 - protein, 8 aa, Dengue virus
WNSLEVED

SEQ ID NO: 25817 - protein, 8 aa, Dengue virus
NSLEVEDY

SEQ ID NO: 25818 - protein, 8 aa, Dengue virus
SLEVEDYG

SEQ ID NO: 25819 - protein, 8 aa, Dengue virus
LEVEDYGF

SEQ ID NO: 25820 - protein, 8 aa, Dengue virus
EVEDYGFG

SEQ ID NO: 25821 - protein, 8 aa, Dengue virus
VEDYGFGV

SEQ ID NO: 25822 - protein, 8 aa, Dengue virus
EDYGFGVF

SEQ ID NO: 25823 - protein, 8 aa, Dengue virus
DYGFGVFT

SEQ ID NO: 25824 - protein, 8 aa, Dengue virus
YGFGVFTT

SEQ ID NO: 25825 - protein, 8 aa, Dengue virus
GFGVFTTN

SEQ ID NO: 25826 - protein, 8 aa, Dengue virus
FGVFTTNI

SEQ ID NO: 25827 - protein, 8 aa, Dengue virus
GVFTTNIW

SEQ ID NO: 25828 - protein, 8 aa, Dengue virus
VFTTNIWL

SEQ ID NO: 25829 - protein, 8 aa, Dengue virus
FTTNIWLK

SEQ ID NO: 25830 - protein, 8 aa, Dengue virus
TTNIWLKL

SEQ ID NO: 25831 - protein, 8 aa, Dengue virus
TNIWLKLR

SEQ ID NO: 25832 - protein, 8 aa, Dengue virus
NIWLKLRE

SEQ ID NO: 25833 - protein, 8 aa, Dengue virus
IWLKLREK

SEQ ID NO: 25834 - protein, 8 aa, Dengue virus
WLKLREKQ

SEQ ID NO: 25835 - protein, 8 aa, Dengue virus
LKLREKQD

SEQ ID NO: 25836 - protein, 8 aa, Dengue virus
FCDSKLMS

SEQ ID NO: 25837 - protein, 8 aa, Dengue virus
CDSKLMSA

SEQ ID NO: 25838 - protein, 8 aa, Dengue virus
DSKLMSAA

SEQ ID NO: 25839 - protein, 8 aa, Dengue virus
SKLMSAAI

SEQ ID NO: 25840 - protein, 8 aa, Dengue virus
KLMSAAIK

SEQ ID NO: 25841 - protein, 8 aa, Dengue virus
LMSAAIKD

SEQ ID NO: 25842 - protein, 8 aa, Dengue virus
MSAAIKDN

SEQ ID NO: 25843 - protein, 8 aa, Dengue virus
SAAIKDNR

SEQ ID NO: 25844 - protein, 8 aa, Dengue virus
AAIKDNRA

SEQ ID NO: 25845 - protein, 8 aa, Dengue virus
AIKDNRAV

SEQ ID NO: 25846 - protein, 8 aa, Dengue virus
IKDNRAVH

SEQ ID NO: 25847 - protein, 8 aa, Dengue virus
KDNRAVHA

SEQ ID NO: 25848 - protein, 8 aa, Dengue virus
DNRAVHAD

SEQ ID NO: 25849 - protein, 8 aa, Dengue virus
NRAVHADM

SEQ ID NO: 25850 - protein, 8 aa, Dengue virus
RAVHADMG

SEQ ID NO: 25851 - protein, 8 aa, Dengue virus
AVHADMGY

SEQ ID NO: 25852 - protein, 8 aa, Dengue virus
VHADMGYW

SEQ ID NO: 25853 - protein, 8 aa, Dengue virus
HADMGYWI

SEQ ID NO: 25854 - protein, 8 aa, Dengue virus
ADMGYWIE

SEQ ID NO: 25855 - protein, 8 aa, Dengue virus
DMGYWIES

SEQ ID NO: 25856 - protein, 8 aa, Dengue virus
MGYWIESA

SEQ ID NO: 25857 - protein, 8 aa, Dengue virus
GYWIESAL

SEQ ID NO: 25858 - protein, 8 aa, Dengue virus
YWIESALN

SEQ ID NO: 25859 - protein, 8 aa, Dengue virus
WIESALND

SEQ ID NO: 25860 - protein, 8 aa, Dengue virus
IESALNDT

SEQ ID NO: 25861 - protein, 8 aa, Dengue virus
ESALNDTW

SEQ ID NO: 25862 - protein, 8 aa, Dengue virus
SALNDTWK

SEQ ID NO: 25863 - protein, 8 aa, Dengue virus
ALNDTWKM

SEQ ID NO: 25864 - protein, 8 aa, Dengue virus
LNDTWKME

SEQ ID NO: 25865 - protein, 8 aa, Dengue virus
NDTWKMEK

SEQ ID NO: 25866 - protein, 8 aa, Dengue virus
DTWKMEKA

SEQ ID NO: 25867 - protein, 8 aa, Dengue virus
TWKMEKAS

SEQ ID NO: 25868 - protein, 8 aa, Dengue virus
WKMEKASF

SEQ ID NO: 25869 - protein, 8 aa, Dengue virus
KMEKASFI

SEQ ID NO: 25870 - protein, 8 aa, Dengue virus
MEKASFIE

SEQ ID NO: 25871 - protein, 8 aa, Dengue virus
EKASFIEV

SEQ ID NO: 25872 - protein, 8 aa, Dengue virus
KASFIEVK

SEQ ID NO: 25873 - protein, 8 aa, Dengue virus
ASFIEVKS

SEQ ID NO: 25874 - protein, 8 aa, Dengue virus
SFIEVKSC

SEQ ID NO: 25875 - protein, 8 aa, Dengue virus
FIEVKSCH

SEQ ID NO: 25876 - protein, 8 aa, Dengue virus
IEVKSCHW

SEQ ID NO: 25877 - protein, 8 aa, Dengue virus
EVKSCHWP

SEQ ID NO: 25878 - protein, 8 aa, Dengue virus
VKSCHWPK

SEQ ID NO: 25879 - protein, 8 aa, Dengue virus
KSCHWPKS

SEQ ID NO: 25880 - protein, 8 aa, Dengue virus
SCHWPKSH

SEQ ID NO: 25881 - protein, 8 aa, Dengue virus
CHWPKSHT

SEQ ID NO: 25882 - protein, 8 aa, Dengue virus
HWPKSHTL

SEQ ID NO: 25883 - protein, 8 aa, Dengue virus
WPKSHTLW

SEQ ID NO: 25884 - protein, 8 aa, Dengue virus
PKSHTLWS

SEQ ID NO: 25885 - protein, 8 aa, Dengue virus
KSHTLWSN

SEQ ID NO: 25886 - protein, 8 aa, Dengue virus
SHTLWSNG

SEQ ID NO: 25887 - protein, 8 aa, Dengue virus
HTLWSNGV

SEQ ID NO: 25888 - protein, 8 aa, Dengue virus
TLWSNGVL

SEQ ID NO: 25889 - protein, 8 aa, Dengue virus
LWSNGVLE

SEQ ID NO: 25890 - protein, 8 aa, Dengue virus
WSNGVLES

SEQ ID NO: 25891 - protein, 8 aa, Dengue virus
SNGVLESE

SEQ ID NO: 25892 - protein, 8 aa, Dengue virus
NGVLESEM

SEQ ID NO: 25893 - protein, 8 aa, Dengue virus
GVLESEMI

SEQ ID NO: 25894 - protein, 8 aa, Dengue virus
VLESEMII

SEQ ID NO: 25895 - protein, 8 aa, Dengue virus
LESEMIIP

SEQ ID NO: 25896 - protein, 8 aa, Dengue virus
ESEMIIPK

SEQ ID NO: 25897 - protein, 8 aa, Dengue virus
SEMIIPKN

SEQ ID NO: 25898 - protein, 8 aa, Dengue virus
IPKNFAGP

SEQ ID NO: 25899 - protein, 8 aa, Dengue virus
PKNFAGPV

SEQ ID NO: 25900 - protein, 8 aa, Dengue virus
KNFAGPVS

SEQ ID NO: 25901 - protein, 8 aa, Dengue virus
NFAGPVSQ

SEQ ID NO: 25902 - protein, 8 aa, Dengue virus
FAGPVSQH

SEQ ID NO: 25903 - protein, 8 aa, Dengue virus
AGPVSQHN

SEQ ID NO: 25904 - protein, 8 aa, Dengue virus
GPVSQHNY

SEQ ID NO: 25905 - protein, 8 aa, Dengue virus
PVSQHNYR

SEQ ID NO: 25906 - protein, 8 aa, Dengue virus
VSQHNYRP

SEQ ID NO: 25907 - protein, 8 aa, Dengue virus
SQHNYRPG

SEQ ID NO: 25908 - protein, 8 aa, Dengue virus
QHNYRPGY

SEQ ID NO: 25909 - protein, 8 aa, Dengue virus
HNYRPGYH

SEQ ID NO: 25910 - protein, 8 aa, Dengue virus
NYRPGYHT

SEQ ID NO: 25911 - protein, 8 aa, Dengue virus
YRPGYHTQ

SEQ ID NO: 25912 - protein, 8 aa, Dengue virus
RPGYHTQT

SEQ ID NO: 25913 - protein, 8 aa, Dengue virus
PGYHTQTA

SEQ ID NO: 25914 - protein, 8 aa, Dengue virus
GYHTQTAG

SEQ ID NO: 25915 - protein, 8 aa, Dengue virus
YHTQTAGP

SEQ ID NO: 25916 - protein, 8 aa, Dengue virus
HTQTAGPW

SEQ ID NO: 25917 - protein, 8 aa, Dengue virus
TQTAGPWH

SEQ ID NO: 25918 - protein, 8 aa, Dengue virus
QTAGPWHL

SEQ ID NO: 25919 - protein, 8 aa, Dengue virus
TAGPWHLG

SEQ ID NO: 25920 - protein, 8 aa, Dengue virus
AGPWHLGK

SEQ ID NO: 25921 - protein, 8 aa, Dengue virus
GPWHLGKL

SEQ ID NO: 25922 - protein, 8 aa, Dengue virus
PWHLGKLE

SEQ ID NO: 25923 - protein, 8 aa, Dengue virus
WHLGKLEM

SEQ ID NO: 25924 - protein, 8 aa, Dengue virus
HLGKLEMD

SEQ ID NO: 25925 - protein, 8 aa, Dengue virus
LGKLEMDF

SEQ ID NO: 25926 - protein, 8 aa, Dengue virus
GKLEMDFD

SEQ ID NO: 25927 - protein, 8 aa, Dengue virus
KLEMDFDF

SEQ ID NO: 25928 - protein, 8 aa, Dengue virus
LEMDFDFC

SEQ ID NO: 25929 - protein, 8 aa, Dengue virus
EMDFDFCE

SEQ ID NO: 25930 - protein, 8 aa, Dengue virus
MDFDFCEG

SEQ ID NO: 25931 - protein, 8 aa, Dengue virus
DFDFCEGT

SEQ ID NO: 25932 - protein, 8 aa, Dengue virus
FDFCEGTT

SEQ ID NO: 25933 - protein, 8 aa, Dengue virus
DFCEGTTV

SEQ ID NO: 25934 - protein, 8 aa, Dengue virus
FCEGTTVV

SEQ ID NO: 25935 - protein, 8 aa, Dengue virus
CEGTTVVV

SEQ ID NO: 25936 - protein, 8 aa, Dengue virus
EGTTVVVT

SEQ ID NO: 25937 - protein, 8 aa, Dengue virus
GTTVVVTE

SEQ ID NO: 25938 - protein, 8 aa, Dengue virus
TTVVVTED

SEQ ID NO: 25939 - protein, 8 aa, Dengue virus
TVVVTEDC

SEQ ID NO: 25940 - protein, 8 aa, Dengue virus
VVVTEDCG

SEQ ID NO: 25941 - protein, 8 aa, Dengue virus
VVTEDCGN

SEQ ID NO: 25942 - protein, 8 aa, Dengue virus
VTEDCGNR

SEQ ID NO: 25943 - protein, 8 aa, Dengue virus
TEDCGNRG

SEQ ID NO: 25944 - protein, 8 aa, Dengue virus
EDCGNRGP

SEQ ID NO: 25945 - protein, 8 aa, Dengue virus
DCGNRGPS

SEQ ID NO: 25946 - protein, 8 aa, Dengue virus
CGNRGPSL

SEQ ID NO: 25947 - protein, 8 aa, Dengue virus
GNRGPSLR

SEQ ID NO: 25948 - protein, 8 aa, Dengue virus
NRGPSLRT

SEQ ID NO: 25949 - protein, 8 aa, Dengue virus
RGPSLRTT

SEQ ID NO: 25950 - protein, 8 aa, Dengue virus
GPSLRTTT

SEQ ID NO: 25951 - protein, 8 aa, Dengue virus
PSLRTTTA

SEQ ID NO: 25952 - protein, 8 aa, Dengue virus
SLRTTTAS

SEQ ID NO: 25953 - protein, 8 aa, Dengue virus
LRTTTASG

SEQ ID NO: 25954 - protein, 8 aa, Dengue virus
RTTTASGK

SEQ ID NO: 25955 - protein, 8 aa, Dengue virus
TTTASGKL

SEQ ID NO: 25956 - protein, 8 aa, Dengue virus
TTASGKLI

SEQ ID NO: 25957 - protein, 8 aa, Dengue virus
TASGKLIT

SEQ ID NO: 25958 - protein, 8 aa, Dengue virus
ASGKLITE

SEQ ID NO: 25959 - protein, 8 aa, Dengue virus
SGKLITEW

SEQ ID NO: 25960 - protein, 8 aa, Dengue virus
GKLITEWC

SEQ ID NO: 25961 - protein, 8 aa, Dengue virus
KLITEWCC

SEQ ID NO: 25962 - protein, 8 aa, Dengue virus
LITEWCCR

SEQ ID NO: 25963 - protein, 8 aa, Dengue virus
ITEWCCRS

SEQ ID NO: 25964 - protein, 8 aa, Dengue virus
TEWCCRSC

SEQ ID NO: 25965 - protein, 8 aa, Dengue virus
EWCCRSCT

SEQ ID NO: 25966 - protein, 8 aa, Dengue virus
WCCRSCTL

SEQ ID NO: 25967 - protein, 8 aa, Dengue virus
CCRSCTLP

SEQ ID NO: 25968 - protein, 8 aa, Dengue virus
CRSCTLPP

SEQ ID NO: 25969 - protein, 8 aa, Dengue virus
RSCTLPPL

SEQ ID NO: 25970 - protein, 8 aa, Dengue virus
SCTLPPLR

SEQ ID NO: 25971 - protein, 8 aa, Dengue virus
CTLPPLRY

SEQ ID NO: 25972 - protein, 8 aa, Dengue virus
TLPPLRYR

SEQ ID NO: 25973 - protein, 8 aa, Dengue virus
LPPLRYRG

SEQ ID NO: 25974 - protein, 8 aa, Dengue virus
PPLRYRGE

SEQ ID NO: 25975 - protein, 8 aa, Dengue virus
PLRYRGED

SEQ ID NO: 25976 - protein, 8 aa, Dengue virus
LRYRGEDG

SEQ ID NO: 25977 - protein, 8 aa, Dengue virus
RYRGEDGC

SEQ ID NO: 25978 - protein, 8 aa, Dengue virus
YRGEDGCW

SEQ ID NO: 25979 - protein, 8 aa, Dengue virus
RGEDGCWY

SEQ ID NO: 25980 - protein, 8 aa, Dengue virus
GEDGCWYG

SEQ ID NO: 25981 - protein, 8 aa, Dengue virus
EDGCWYGM

SEQ ID NO: 25982 - protein, 8 aa, Dengue virus
DGCWYGME

SEQ ID NO: 25983 - protein, 8 aa, Dengue virus
GCWYGMEI

SEQ ID NO: 25984 - protein, 8 aa, Dengue virus
CWYGMEIR

SEQ ID NO: 25985 - protein, 8 aa, Dengue virus
WYGMEIRP

SEQ ID NO: 25986 - protein, 8 aa, Dengue virus
YGMEIRPL

SEQ ID NO: 25987 - protein, 8 aa, Dengue virus
GMEIRPLK

SEQ ID NO: 25988 - protein, 8 aa, Dengue virus
MEIRPLKE

SEQ ID NO: 25989 - protein, 8 aa, Dengue virus
EIRPLKEK

SEQ ID NO: 25990 - protein, 8 aa, Dengue virus
IRPLKEKE

SEQ ID NO: 25991 - protein, 8 aa, Dengue virus
RPLKEKEE

SEQ ID NO: 25992 - protein, 8 aa, Dengue virus
PLKEKEEN

SEQ ID NO: 25993 - protein, 8 aa, Dengue virus
LKEKEENL

SEQ ID NO: 25994 - protein, 8 aa, Dengue virus
KEKEENLV

SEQ ID NO: 25995 - protein, 8 aa, Dengue virus
EKEENLVN

SEQ ID NO: 25996 - protein, 8 aa, Dengue virus
KEENLVNS

SEQ ID NO: 25997 - protein, 8 aa, Dengue virus
EENLVNSL

SEQ ID NO: 25998 - protein, 8 aa, Dengue virus
ENLVNSLV

SEQ ID NO: 25999 - protein, 8 aa, Dengue virus
NLVNSLVT

SEQ ID NO: 26000 - protein, 8 aa, Dengue virus
LVNSLVTA

SEQ ID NO: 26001 - protein, 8 aa, Dengue virus
VNSLVTAG

SEQ ID NO: 26002 - protein, 8 aa, Dengue virus
NSLVTAGH

SEQ ID NO: 26003 - protein, 8 aa, Dengue virus
SLVTAGHG

SEQ ID NO: 26004 - protein, 8 aa, Dengue virus
LVTAGHGQ

SEQ ID NO: 26005 - protein, 8 aa, Dengue virus
VTAGHGQI

SEQ ID NO: 26006 - protein, 8 aa, Dengue virus
TAGHGQID

SEQ ID NO: 26007 - protein, 8 aa, Dengue virus
AGHGQIDN

SEQ ID NO: 26008 - protein, 8 aa, Dengue virus
GHGQIDNF

SEQ ID NO: 26009 - protein, 8 aa, Dengue virus
HGQIDNFS

SEQ ID NO: 26010 - protein, 8 aa, Dengue virus
GQIDNFSL

SEQ ID NO: 26011 - protein, 8 aa, Dengue virus
QIDNFSLG

SEQ ID NO: 26012 - protein, 8 aa, Dengue virus
IDNFSLGV

SEQ ID NO: 26013 - protein, 8 aa, Dengue virus
DNFSLGVL

SEQ ID NO: 26014 - protein, 8 aa, Dengue virus
NFSLGVLG

SEQ ID NO: 26015 - protein, 8 aa, Dengue virus
FSLGVLGM

SEQ ID NO: 26016 - protein, 8 aa, Dengue virus
SLGVLGMA

SEQ ID NO: 26017 - protein, 8 aa, Dengue virus
LGVLGMAL

SEQ ID NO: 26018 - protein, 8 aa, Dengue virus
GVLGMALF

SEQ ID NO: 26019 - protein, 8 aa, Dengue virus
VLGMALFL

SEQ ID NO: 26020 - protein, 8 aa, Dengue virus
LGMALFLE

SEQ ID NO: 26021 - protein, 8 aa, Dengue virus
GMALFLEE

SEQ ID NO: 26022 - protein, 8 aa, Dengue virus
MALFLEEM

SEQ ID NO: 26023 - protein, 8 aa, Dengue virus
ALFLEEML

SEQ ID NO: 26024 - protein, 8 aa, Dengue virus
LFLEEMLR

SEQ ID NO: 26025 - protein, 8 aa, Dengue virus
FLEEMLRT

SEQ ID NO: 26026 - protein, 8 aa, Dengue virus
LEEMLRTR

SEQ ID NO: 26027 - protein, 8 aa, Dengue virus
EEMLRTRV

SEQ ID NO: 26028 - protein, 8 aa, Dengue virus
EMLRTRVG

SEQ ID NO: 26029 - protein, 8 aa, Dengue virus
MLRTRVGT

SEQ ID NO: 26030 - protein, 8 aa, Dengue virus
LRTRVGTK

SEQ ID NO: 26031 - protein, 8 aa, Dengue virus
RTRVGTKH

SEQ ID NO: 26032 - protein, 8 aa, Dengue virus
TRVGTKHA

SEQ ID NO: 26033 - protein, 8 aa, Dengue virus
SFVTLITG

SEQ ID NO: 26034 - protein, 8 aa, Dengue virus
FVTLITGN

SEQ ID NO: 26035 - protein, 8 aa, Dengue virus
VTLITGNM

SEQ ID NO: 26036 - protein, 8 aa, Dengue virus
TLITGNMS

SEQ ID NO: 26037 - protein, 8 aa, Dengue virus
LITGNMSF

SEQ ID NO: 26038 - protein, 8 aa, Dengue virus
ITGNMSFR

SEQ ID NO: 26039 - protein, 8 aa, Dengue virus
TGNMSFRD

SEQ ID NO: 26040 - protein, 8 aa, Dengue virus
GNMSFRDL

SEQ ID NO: 26041 - protein, 8 aa, Dengue virus
NMSFRDLG

SEQ ID NO: 26042 - protein, 8 aa, Dengue virus
MSFRDLGR

SEQ ID NO: 26043 - protein, 8 aa, Dengue virus
SFRDLGRV

SEQ ID NO: 26044 - protein, 8 aa, Dengue virus
FRDLGRVM

SEQ ID NO: 26045 - protein, 8 aa, Dengue virus
RDLGRVMV

SEQ ID NO: 26046 - protein, 8 aa, Dengue virus
DLGRVMVM

SEQ ID NO: 26047 - protein, 8 aa, Dengue virus
LGRVMVMV

SEQ ID NO: 26048 - protein, 8 aa, Dengue virus
GRVMVMVG

SEQ ID NO: 26049 - protein, 8 aa, Dengue virus
RVMVMVGA

SEQ ID NO: 26050 - protein, 8 aa, Dengue virus
MTDDIGMG

SEQ ID NO: 26051 - protein, 8 aa, Dengue virus
TDDIGMGV

SEQ ID NO: 26052 - protein, 8 aa, Dengue virus
DDIGMGVT

SEQ ID NO: 26053 - protein, 8 aa, Dengue virus
DIGMGVTY

SEQ ID NO: 26054 - protein, 8 aa, Dengue virus
IGMGVTYL

SEQ ID NO: 26055 - protein, 8 aa, Dengue virus
GMGVTYLA

SEQ ID NO: 26056 - protein, 8 aa, Dengue virus
MGVTYLAL

SEQ ID NO: 26057 - protein, 8 aa, Dengue virus
GVTYLALL

SEQ ID NO: 26058 - protein, 8 aa, Dengue virus
VTYLALLA

SEQ ID NO: 26059 - protein, 8 aa, Dengue virus
TYLALLAA

SEQ ID NO: 26060 - protein, 8 aa, Dengue virus
YLALLAAF

SEQ ID NO: 26061 - protein, 8 aa, Dengue virus
LALLAAFK

SEQ ID NO: 26062 - protein, 8 aa, Dengue virus
ALLAAFKV

SEQ ID NO: 26063 - protein, 8 aa, Dengue virus
LLAAFKVR

SEQ ID NO: 26064 - protein, 8 aa, Dengue virus
LAAFKVRP

SEQ ID NO: 26065 - protein, 8 aa, Dengue virus
AAFKVRPT

SEQ ID NO: 26066 - protein, 8 aa, Dengue virus
AFKVRPTF

SEQ ID NO: 26067 - protein, 8 aa, Dengue virus
FKVRPTFA

SEQ ID NO: 26068 - protein, 8 aa, Dengue virus
KVRPTFAA

SEQ ID NO: 26069 - protein, 8 aa, Dengue virus
VRPTFAAG

SEQ ID NO: 26070 - protein, 8 aa, Dengue virus
RPTFAAGL

SEQ ID NO: 26071 - protein, 8 aa, Dengue virus
PTFAAGLL

SEQ ID NO: 26072 - protein, 8 aa, Dengue virus
TFAAGLLL

SEQ ID NO: 26073 - protein, 8 aa, Dengue virus
FAAGLLLR

SEQ ID NO: 26074 - protein, 8 aa, Dengue virus
AAGLLLRK

SEQ ID NO: 26075 - protein, 8 aa, Dengue virus
AGLLLRKL

SEQ ID NO: 26076 - protein, 8 aa, Dengue virus
GLLLRKLT

SEQ ID NO: 26077 - protein, 8 aa, Dengue virus
LLLRKLTS

SEQ ID NO: 26078 - protein, 8 aa, Dengue virus
LLRKLTSK

SEQ ID NO: 26079 - protein, 8 aa, Dengue virus
LRKLTSKE

SEQ ID NO: 26080 - protein, 8 aa, Dengue virus
RKLTSKEL

SEQ ID NO: 26081 - protein, 8 aa, Dengue virus
KLTSKELM

SEQ ID NO: 26082 - protein, 8 aa, Dengue virus
LTSKELMM

SEQ ID NO: 26083 - protein, 8 aa, Dengue virus
TSKELMMA

SEQ ID NO: 26084 - protein, 8 aa, Dengue virus
SKELMMAT

SEQ ID NO: 26085 - protein, 8 aa, Dengue virus
KELMMATI

SEQ ID NO: 26086 - protein, 8 aa, Dengue virus
ELMMATIG

SEQ ID NO: 26087 - protein, 8 aa, Dengue virus
LMMATIGI

SEQ ID NO: 26088 - protein, 8 aa, Dengue virus
TIGIALLS

SEQ ID NO: 26089 - protein, 8 aa, Dengue virus
IGIALLSQ

SEQ ID NO: 26090 - protein, 8 aa, Dengue virus
GIALLSQS

SEQ ID NO: 26091 - protein, 8 aa, Dengue virus
PETILELT

SEQ ID NO: 26092 - protein, 8 aa, Dengue virus
ETILELTD

SEQ ID NO: 26093 - protein, 8 aa, Dengue virus
TILELTDA

SEQ ID NO: 26094 - protein, 8 aa, Dengue virus
ILELTDAL

SEQ ID NO: 26095 - protein, 8 aa, Dengue virus
LELTDALA

SEQ ID NO: 26096 - protein, 8 aa, Dengue virus
ELTDALAL

SEQ ID NO: 26097 - protein, 8 aa, Dengue virus
LTDALALG

SEQ ID NO: 26098 - protein, 8 aa, Dengue virus
TDALALGM

SEQ ID NO: 26099 - protein, 8 aa, Dengue virus
DALALGMM

SEQ ID NO: 26100 - protein, 8 aa, Dengue virus
ALALGMMV

SEQ ID NO: 26101 - protein, 8 aa, Dengue virus
LALGMMVL

SEQ ID NO: 26102 - protein, 8 aa, Dengue virus
ALGMMVLK

SEQ ID NO: 26103 - protein, 8 aa, Dengue virus
VRNMEKYQ

SEQ ID NO: 26104 - protein, 8 aa, Dengue virus
RNMEKYQL

SEQ ID NO: 26105 - protein, 8 aa, Dengue virus
NMEKYQLA

SEQ ID NO: 26106 - protein, 8 aa, Dengue virus
MEKYQLAV

SEQ ID NO: 26107 - protein, 8 aa, Dengue virus
EKYQLAVT

SEQ ID NO: 26108 - protein, 8 aa, Dengue virus
KYQLAVTI

SEQ ID NO: 26109 - protein, 8 aa, Dengue virus
YQLAVTIM

SEQ ID NO: 26110 - protein, 8 aa, Dengue virus
QLAVTIMA

SEQ ID NO: 26111 - protein, 8 aa, Dengue virus
MAISCVPN

SEQ ID NO: 26112 - protein, 8 aa, Dengue virus
AISCVPNA

SEQ ID NO: 26113 - protein, 8 aa, Dengue virus
ISCVPNAV

SEQ ID NO: 26114 - protein, 8 aa, Dengue virus
SCVPNAVI

SEQ ID NO: 26115 - protein, 8 aa, Dengue virus
CVPNAVIL

SEQ ID NO: 26116 - protein, 8 aa, Dengue virus
VPNAVILQ

SEQ ID NO: 26117 - protein, 8 aa, Dengue virus
PNAVILQN

SEQ ID NO: 26118 - protein, 8 aa, Dengue virus
NAVILQNA

SEQ ID NO: 26119 - protein, 8 aa, Dengue virus
AVILQNAW

SEQ ID NO: 26120 - protein, 8 aa, Dengue virus
ILQNAWKV

SEQ ID NO: 26121 - protein, 8 aa, Dengue virus
QNAWKVSC

SEQ ID NO: 26122 - protein, 8 aa, Dengue virus
NAWKVSCT

SEQ ID NO: 26123 - protein, 8 aa, Dengue virus
AWKVSCTI

SEQ ID NO: 26124 - protein, 8 aa, Dengue virus
WKVSCTIL

SEQ ID NO: 26125 - protein, 8 aa, Dengue virus
KVSCTILA

SEQ ID NO: 26126 - protein, 8 aa, Dengue virus
CTILAAVS

SEQ ID NO: 26127 - protein, 8 aa, Dengue virus
TILAAVSV

SEQ ID NO: 26128 - protein, 8 aa, Dengue virus
ILAAVSVS

SEQ ID NO: 26129 - protein, 8 aa, Dengue virus
LAAVSVSP

SEQ ID NO: 26130 - protein, 8 aa, Dengue virus
AAVSVSPL

SEQ ID NO: 26131 - protein, 8 aa, Dengue virus
VSVSPLLL

SEQ ID NO: 26132 - protein, 8 aa, Dengue virus
SVSPLLLT

SEQ ID NO: 26133 - protein, 8 aa, Dengue virus
VSPLLLTS

SEQ ID NO: 26134 - protein, 8 aa, Dengue virus
SPLLLTSS

SEQ ID NO: 26135 - protein, 8 aa, Dengue virus
PLLLTSSQ

SEQ ID NO: 26136 - protein, 8 aa, Dengue virus
LLLTSSQQ

SEQ ID NO: 26137 - protein, 8 aa, Dengue virus
LLTSSQQK

SEQ ID NO: 26138 - protein, 8 aa, Dengue virus
LTSSQQKA

SEQ ID NO: 26139 - protein, 8 aa, Dengue virus
TSSQQKAD

SEQ ID NO: 26140 - protein, 8 aa, Dengue virus
SSQQKADW

SEQ ID NO: 26141 - protein, 8 aa, Dengue virus
SQQKADWI

SEQ ID NO: 26142 - protein, 8 aa, Dengue virus
QQKADWIP

SEQ ID NO: 26143 - protein, 8 aa, Dengue virus
QKADWIPL

SEQ ID NO: 26144 - protein, 8 aa, Dengue virus
KADWIPLA

SEQ ID NO: 26145 - protein, 8 aa, Dengue virus
ADWIPLAL

SEQ ID NO: 26146 - protein, 8 aa, Dengue virus
DWIPLALT

SEQ ID NO: 26147 - protein, 8 aa, Dengue virus
WIPLALTI

SEQ ID NO: 26148 - protein, 8 aa, Dengue virus
IPLALTIK

SEQ ID NO: 26149 - protein, 8 aa, Dengue virus
PLALTIKG

SEQ ID NO: 26150 - protein, 8 aa, Dengue virus
LALTIKGL

SEQ ID NO: 26151 - protein, 8 aa, Dengue virus
ALTIKGLN

SEQ ID NO: 26152 - protein, 8 aa, Dengue virus
LTIKGLNP

SEQ ID NO: 26153 - protein, 8 aa, Dengue virus
TIKGLNPT

SEQ ID NO: 26154 - protein, 8 aa, Dengue virus
IKGLNPTA

SEQ ID NO: 26155 - protein, 8 aa, Dengue virus
KGLNPTAI

SEQ ID NO: 26156 - protein, 8 aa, Dengue virus
GLNPTAIF

SEQ ID NO: 26157 - protein, 8 aa, Dengue virus
LNPTAIFL

SEQ ID NO: 26158 - protein, 8 aa, Dengue virus
NPTAIFLT

SEQ ID NO: 26159 - protein, 8 aa, Dengue virus
PTAIFLTT

SEQ ID NO: 26160 - protein, 8 aa, Dengue virus
TAIFLTTL

SEQ ID NO: 26161 - protein, 8 aa, Dengue virus
AIFLTTLS

SEQ ID NO: 26162 - protein, 8 aa, Dengue virus
IFLTTLSR

SEQ ID NO: 26163 - protein, 8 aa, Dengue virus
FLTTLSRT

SEQ ID NO: 26164 - protein, 8 aa, Dengue virus
LTTLSRTS

SEQ ID NO: 26165 - protein, 8 aa, Dengue virus
TTLSRTSK

SEQ ID NO: 26166 - protein, 8 aa, Dengue virus
TLSRTSKK

SEQ ID NO: 26167 - protein, 8 aa, Dengue virus
LSRTSKKR

SEQ ID NO: 26168 - protein, 8 aa, Dengue virus
SRTSKKRS

SEQ ID NO: 26169 - protein, 8 aa, Dengue virus
RTSKKRSW

SEQ ID NO: 26170 - protein, 8 aa, Dengue virus
TSKKRSWP

SEQ ID NO: 26171 - protein, 8 aa, Dengue virus
SKKRSWPL

SEQ ID NO: 26172 - protein, 8 aa, Dengue virus
KKRSWPLN

SEQ ID NO: 26173 - protein, 8 aa, Dengue virus
KRSWPLNE

SEQ ID NO: 26174 - protein, 8 aa, Dengue virus
RSWPLNEA

SEQ ID NO: 26175 - protein, 8 aa, Dengue virus
SWPLNEAI

SEQ ID NO: 26176 - protein, 8 aa, Dengue virus
WPLNEAIM

SEQ ID NO: 26177 - protein, 8 aa, Dengue virus
PLNEAIMA

SEQ ID NO: 26178 - protein, 8 aa, Dengue virus
LNEAIMAV

SEQ ID NO: 26179 - protein, 8 aa, Dengue virus
NEAIMAVG

SEQ ID NO: 26180 - protein, 8 aa, Dengue virus
EAIMAVGM

SEQ ID NO: 26181 - protein, 8 aa, Dengue virus
AIMAVGMV

SEQ ID NO: 26182 - protein, 8 aa, Dengue virus
IMAVGMVS

SEQ ID NO: 26183 - protein, 8 aa, Dengue virus
MAVGMVSI

SEQ ID NO: 26184 - protein, 8 aa, Dengue virus
AVGMVSIL

SEQ ID NO: 26185 - protein, 8 aa, Dengue virus
VGMVSILA

SEQ ID NO: 26186 - protein, 8 aa, Dengue virus
GMVSILAS

SEQ ID NO: 26187 - protein, 8 aa, Dengue virus
MVSILASS

SEQ ID NO: 26188 - protein, 8 aa, Dengue virus
VSILASSL

SEQ ID NO: 26189 - protein, 8 aa, Dengue virus
SILASSLL

SEQ ID NO: 26190 - protein, 8 aa, Dengue virus
ILASSLLK

SEQ ID NO: 26191 - protein, 8 aa, Dengue virus
LASSLLKN

SEQ ID NO: 26192 - protein, 8 aa, Dengue virus
ASSLLKND

SEQ ID NO: 26193 - protein, 8 aa, Dengue virus
SSLLKNDI

SEQ ID NO: 26194 - protein, 8 aa, Dengue virus
SLLKNDIP

SEQ ID NO: 26195 - protein, 8 aa, Dengue virus
LLKNDIPM

SEQ ID NO: 26196 - protein, 8 aa, Dengue virus
LKNDIPMT

SEQ ID NO: 26197 - protein, 8 aa, Dengue virus
KNDIPMTG

SEQ ID NO: 26198 - protein, 8 aa, Dengue virus
NDIPMTGP

SEQ ID NO: 26199 - protein, 8 aa, Dengue virus
DIPMTGPL

SEQ ID NO: 26200 - protein, 8 aa, Dengue virus
IPMTGPLV

SEQ ID NO: 26201 - protein, 8 aa, Dengue virus
PMTGPLVA

SEQ ID NO: 26202 - protein, 8 aa, Dengue virus
MTGPLVAG

SEQ ID NO: 26203 - protein, 8 aa, Dengue virus
TGPLVAGG

SEQ ID NO: 26204 - protein, 8 aa, Dengue virus
GPLVAGGL

SEQ ID NO: 26205 - protein, 8 aa, Dengue virus
PLVAGGLL

SEQ ID NO: 26206 - protein, 8 aa, Dengue virus
LVAGGLLT

SEQ ID NO: 26207 - protein, 8 aa, Dengue virus
VAGGLLTV

SEQ ID NO: 26208 - protein, 8 aa, Dengue virus
AGGLLTVC

SEQ ID NO: 26209 - protein, 8 aa, Dengue virus
GGLLTVCY

SEQ ID NO: 26210 - protein, 8 aa, Dengue virus
GLLTVCYV

SEQ ID NO: 26211 - protein, 8 aa, Dengue virus
LLTVCYVL

SEQ ID NO: 26212 - protein, 8 aa, Dengue virus
LTVCYVLT

SEQ ID NO: 26213 - protein, 8 aa, Dengue virus
TVCYVLTG

SEQ ID NO: 26214 - protein, 8 aa, Dengue virus
VCYVLTGR

SEQ ID NO: 26215 - protein, 8 aa, Dengue virus
CYVLTGRS

SEQ ID NO: 26216 - protein, 8 aa, Dengue virus
YVLTGRSA

SEQ ID NO: 26217 - protein, 8 aa, Dengue virus
VLTGRSAD

SEQ ID NO: 26218 - protein, 8 aa, Dengue virus
LTGRSADL

SEQ ID NO: 26219 - protein, 8 aa, Dengue virus
TGRSADLE

SEQ ID NO: 26220 - protein, 8 aa, Dengue virus
GRSADLEL

SEQ ID NO: 26221 - protein, 8 aa, Dengue virus
RSADLELE

SEQ ID NO: 26222 - protein, 8 aa, Dengue virus
SADLELER

SEQ ID NO: 26223 - protein, 8 aa, Dengue virus
ADLELERA

SEQ ID NO: 26224 - protein, 8 aa, Dengue virus
DLELERAA

SEQ ID NO: 26225 - protein, 8 aa, Dengue virus
LELERAAD

SEQ ID NO: 26226 - protein, 8 aa, Dengue virus
ELERAADV

SEQ ID NO: 26227 - protein, 8 aa, Dengue virus
VKWEDQAE

SEQ ID NO: 26228 - protein, 8 aa, Dengue virus
KWEDQAEI

SEQ ID NO: 26229 - protein, 8 aa, Dengue virus
WEDQAEIS

SEQ ID NO: 26230 - protein, 8 aa, Dengue virus
EDQAEISG

SEQ ID NO: 26231 - protein, 8 aa, Dengue virus
DQAEISGS

SEQ ID NO: 26232 - protein, 8 aa, Dengue virus
QAEISGSS

SEQ ID NO: 26233 - protein, 8 aa, Dengue virus
AEISGSSP

SEQ ID NO: 26234 - protein, 8 aa, Dengue virus
EISGSSPI

SEQ ID NO: 26235 - protein, 8 aa, Dengue virus
ISGSSPIL

SEQ ID NO: 26236 - protein, 8 aa, Dengue virus
SGSSPILS

SEQ ID NO: 26237 - protein, 8 aa, Dengue virus
GSSPILSI

SEQ ID NO: 26238 - protein, 8 aa, Dengue virus
SSPILSIT

SEQ ID NO: 26239 - protein, 8 aa, Dengue virus
SPILSITI

SEQ ID NO: 26240 - protein, 8 aa, Dengue virus
PILSITIS

SEQ ID NO: 26241 - protein, 8 aa, Dengue virus
ILSITISE

SEQ ID NO: 26242 - protein, 8 aa, Dengue virus
LSITISED

SEQ ID NO: 26243 - protein, 8 aa, Dengue virus
SITISEDG

SEQ ID NO: 26244 - protein, 8 aa, Dengue virus
ITISEDGS

SEQ ID NO: 26245 - protein, 8 aa, Dengue virus
TISEDGSM

SEQ ID NO: 26246 - protein, 8 aa, Dengue virus
ISEDGSMS

SEQ ID NO: 26247 - protein, 8 aa, Dengue virus
SEDGSMSI

SEQ ID NO: 26248 - protein, 8 aa, Dengue virus
EDGSMSIK

SEQ ID NO: 26249 - protein, 8 aa, Dengue virus
DGSMSIKN

SEQ ID NO: 26250 - protein, 8 aa, Dengue virus
GSMSIKNE

SEQ ID NO: 26251 - protein, 8 aa, Dengue virus
SMSIKNEE

SEQ ID NO: 26252 - protein, 8 aa, Dengue virus
MSIKNEEE

SEQ ID NO: 26253 - protein, 8 aa, Dengue virus
SIKNEEEE

SEQ ID NO: 26254 - protein, 8 aa, Dengue virus
IKNEEEEQ

SEQ ID NO: 26255 - protein, 8 aa, Dengue virus
KNEEEEQT

SEQ ID NO: 26256 - protein, 8 aa, Dengue virus
NEEEEQTL

SEQ ID NO: 26257 - protein, 8 aa, Dengue virus
EEEEQTLT

SEQ ID NO: 26258 - protein, 8 aa, Dengue virus
EEEQTLTI

SEQ ID NO: 26259 - protein, 8 aa, Dengue virus
EEQTLTIL

SEQ ID NO: 26260 - protein, 8 aa, Dengue virus
EQTLTILI

SEQ ID NO: 26261 - protein, 8 aa, Dengue virus
QTLTILIR

SEQ ID NO: 26262 - protein, 8 aa, Dengue virus
TLTILIRT

SEQ ID NO: 26263 - protein, 8 aa, Dengue virus
LTILIRTG

SEQ ID NO: 26264 - protein, 8 aa, Dengue virus
TILIRTGL

SEQ ID NO: 26265 - protein, 8 aa, Dengue virus
ILIRTGLL

SEQ ID NO: 26266 - protein, 8 aa, Dengue virus
LIRTGLLV

SEQ ID NO: 26267 - protein, 8 aa, Dengue virus
IRTGLLVI

SEQ ID NO: 26268 - protein, 8 aa, Dengue virus
RTGLLVIS

SEQ ID NO: 26269 - protein, 8 aa, Dengue virus
TGLLVISG

SEQ ID NO: 26270 - protein, 8 aa, Dengue virus
GLLVISGL

SEQ ID NO: 26271 - protein, 8 aa, Dengue virus
LLVISGLF

SEQ ID NO: 26272 - protein, 8 aa, Dengue virus
LVISGLFP

SEQ ID NO: 26273 - protein, 8 aa, Dengue virus
VISGVFPV

SEQ ID NO: 26274 - protein, 8 aa, Dengue virus
ISGVFPVS

SEQ ID NO: 26275 - protein, 8 aa, Dengue virus
SGVFPVSI

SEQ ID NO: 26276 - protein, 8 aa, Dengue virus
GVFPVSIP

SEQ ID NO: 26277 - protein, 8 aa, Dengue virus
VFPVSIPI

SEQ ID NO: 26278 - protein, 8 aa, Dengue virus
FPVSIPIT

SEQ ID NO: 26279 - protein, 8 aa, Dengue virus
PVSIPITA

SEQ ID NO: 26280 - protein, 8 aa, Dengue virus
VSIPITAA

SEQ ID NO: 26281 - protein, 8 aa, Dengue virus
SIPITAAA

SEQ ID NO: 26282 - protein, 8 aa, Dengue virus
IPITAAAW

SEQ ID NO: 26283 - protein, 8 aa, Dengue virus
PITAAAWY

SEQ ID NO: 26284 - protein, 8 aa, Dengue virus
ITAAAWYL

SEQ ID NO: 26285 - protein, 8 aa, Dengue virus
TAAAWYLW

SEQ ID NO: 26286 - protein, 8 aa, Dengue virus
AAAWYLWE

SEQ ID NO: 26287 - protein, 8 aa, Dengue virus
AAWYLWEV

SEQ ID NO: 26288 - protein, 8 aa, Dengue virus
AWYLWEVK

SEQ ID NO: 26289 - protein, 8 aa, Dengue virus
WYLWEVKK

SEQ ID NO: 26290 - protein, 8 aa, Dengue virus
YLWEVKKQ

SEQ ID NO: 26291 - protein, 8 aa, Dengue virus
LWEVKKQR

SEQ ID NO: 26292 - protein, 8 aa, Dengue virus
WEVKKQRA

SEQ ID NO: 26293 - protein, 8 aa, Dengue virus
EVKKQRAG

SEQ ID NO: 26294 - protein, 8 aa, Dengue virus
VKKQRAGV

SEQ ID NO: 26295 - protein, 8 aa, Dengue virus
KKQRAGVL

SEQ ID NO: 26296 - protein, 8 aa, Dengue virus
KQRAGVLW

SEQ ID NO: 26297 - protein, 8 aa, Dengue virus
QRAGVLWD

SEQ ID NO: 26298 - protein, 8 aa, Dengue virus
RAGVLWDV

SEQ ID NO: 26299 - protein, 8 aa, Dengue virus
AGVLWDVP

SEQ ID NO: 26300 - protein, 8 aa, Dengue virus
GVLWDVPS

SEQ ID NO: 26301 - protein, 8 aa, Dengue virus
VLWDVPSP

SEQ ID NO: 26302 - protein, 8 aa, Dengue virus
LWDVPSPP

SEQ ID NO: 26303 - protein, 8 aa, Dengue virus
WDVPSPPP

SEQ ID NO: 26304 - protein, 8 aa, Dengue virus
DVPSPPPV

SEQ ID NO: 26305 - protein, 8 aa, Dengue virus
VPSPPPVG

SEQ ID NO: 26306 - protein, 8 aa, Dengue virus
GKAELEDG

SEQ ID NO: 26307 - protein, 8 aa, Dengue virus
KAELEDGA

SEQ ID NO: 26308 - protein, 8 aa, Dengue virus
AELEDGAY

SEQ ID NO: 26309 - protein, 8 aa, Dengue virus
ELEDGAYR

SEQ ID NO: 26310 - protein, 8 aa, Dengue virus
LEDGAYRI

SEQ ID NO: 26311 - protein, 8 aa, Dengue virus
EDGAYRIK

SEQ ID NO: 26312 - protein, 8 aa, Dengue virus
DGAYRIKQ

SEQ ID NO: 26313 - protein, 8 aa, Dengue virus
GAYRIKQR

SEQ ID NO: 26314 - protein, 8 aa, Dengue virus
AYRIKQRG

SEQ ID NO: 26315 - protein, 8 aa, Dengue virus
YRIKQRGI

SEQ ID NO: 26316 - protein, 8 aa, Dengue virus
RIKQKGIL

SEQ ID NO: 26317 - protein, 8 aa, Dengue virus
IKQKGILG

SEQ ID NO: 26318 - protein, 8 aa, Dengue virus
KQKGILGY

SEQ ID NO: 26319 - protein, 8 aa, Dengue virus
QKGILGYS

SEQ ID NO: 26320 - protein, 8 aa, Dengue virus
KGILGYSQ

SEQ ID NO: 26321 - protein, 8 aa, Dengue virus
GILGYSQI

SEQ ID NO: 26322 - protein, 8 aa, Dengue virus
ILGYSQIG

SEQ ID NO: 26323 - protein, 8 aa, Dengue virus
LGYSQIGA

SEQ ID NO: 26324 - protein, 8 aa, Dengue virus
GYSQIGAG

SEQ ID NO: 26325 - protein, 8 aa, Dengue virus
YSQIGAGV

SEQ ID NO: 26326 - protein, 8 aa, Dengue virus
SQIGAGVY

SEQ ID NO: 26327 - protein, 8 aa, Dengue virus
QIGAGVYK

SEQ ID NO: 26328 - protein, 8 aa, Dengue virus
IGAGVYKE

SEQ ID NO: 26329 - protein, 8 aa, Dengue virus
GAGVYKEG

SEQ ID NO: 26330 - protein, 8 aa, Dengue virus
AGVYKEGT

SEQ ID NO: 26331 - protein, 8 aa, Dengue virus
GVYKEGTF

SEQ ID NO: 26332 - protein, 8 aa, Dengue virus
VYKEGTFH

SEQ ID NO: 26333 - protein, 8 aa, Dengue virus
YKEGTFHT

SEQ ID NO: 26334 - protein, 8 aa, Dengue virus
KEGTFHTM

SEQ ID NO: 26335 - protein, 8 aa, Dengue virus
EGTFHTMW

SEQ ID NO: 26336 - protein, 8 aa, Dengue virus
GTFHTMWH

SEQ ID NO: 26337 - protein, 8 aa, Dengue virus
TFHTMWHV

SEQ ID NO: 26338 - protein, 8 aa, Dengue virus
FHTMWHVT

SEQ ID NO: 26339 - protein, 8 aa, Dengue virus
HTMWHVTR

SEQ ID NO: 26340 - protein, 8 aa, Dengue virus
TMWHVTRG

SEQ ID NO: 26341 - protein, 8 aa, Dengue virus
MWHVTRGA

SEQ ID NO: 26342 - protein, 8 aa, Dengue virus
WHVTRGAV

SEQ ID NO: 26343 - protein, 8 aa, Dengue virus
HVTRGAVL

SEQ ID NO: 26344 - protein, 8 aa, Dengue virus
VTRGAVLM

SEQ ID NO: 26345 - protein, 8 aa, Dengue virus
TRGAVLMH

SEQ ID NO: 26346 - protein, 8 aa, Dengue virus
RGAVLMHR

SEQ ID NO: 26347 - protein, 8 aa, Dengue virus
GAVLMHRG

SEQ ID NO: 26348 - protein, 8 aa, Dengue virus
AVLMHRGK

SEQ ID NO: 26349 - protein, 8 aa, Dengue virus
VLMHRGKR

SEQ ID NO: 26350 - protein, 8 aa, Dengue virus
LMHRGKRI

SEQ ID NO: 26351 - protein, 8 aa, Dengue virus
MHRGKRIE

SEQ ID NO: 26352 - protein, 8 aa, Dengue virus
HRGKRIEP

SEQ ID NO: 26353 - protein, 8 aa, Dengue virus
RGKRIEPS

SEQ ID NO: 26354 - protein, 8 aa, Dengue virus
GKRIEPSW

SEQ ID NO: 26355 - protein, 8 aa, Dengue virus
KRIEPSWA

SEQ ID NO: 26356 - protein, 8 aa, Dengue virus
RIEPSWAD

SEQ ID NO: 26357 - protein, 8 aa, Dengue virus
IEPSWADV

SEQ ID NO: 26358 - protein, 8 aa, Dengue virus
EPSWADVK

SEQ ID NO: 26359 - protein, 8 aa, Dengue virus
PSWADVKK

SEQ ID NO: 26360 - protein, 8 aa, Dengue virus
SWADVKKD

SEQ ID NO: 26361 - protein, 8 aa, Dengue virus
WADVKKDL

SEQ ID NO: 26362 - protein, 8 aa, Dengue virus
ADVKKDLI

SEQ ID NO: 26363 - protein, 8 aa, Dengue virus
DVKKDLIS

SEQ ID NO: 26364 - protein, 8 aa, Dengue virus
VKKDLISY

SEQ ID NO: 26365 - protein, 8 aa, Dengue virus
KKDLISYG

SEQ ID NO: 26366 - protein, 8 aa, Dengue virus
KDLISYGG

SEQ ID NO: 26367 - protein, 8 aa, Dengue virus
DLISYGGG

SEQ ID NO: 26368 - protein, 8 aa, Dengue virus
LISYGGGW

SEQ ID NO: 26369 - protein, 8 aa, Dengue virus
ISYGGGWK

SEQ ID NO: 26370 - protein, 8 aa, Dengue virus
SYGGGWKL

SEQ ID NO: 26371 - protein, 8 aa, Dengue virus
YGGGWKLE

SEQ ID NO: 26372 - protein, 8 aa, Dengue virus
GGGWKLEG

SEQ ID NO: 26373 - protein, 8 aa, Dengue virus
GGWKLEGE

SEQ ID NO: 26374 - protein, 8 aa, Dengue virus
GWKLEGEW

SEQ ID NO: 26375 - protein, 8 aa, Dengue virus
WKLEGEWK

SEQ ID NO: 26376 - protein, 8 aa, Dengue virus
KLEGEWKE

SEQ ID NO: 26377 - protein, 8 aa, Dengue virus
LEGEWKEG

SEQ ID NO: 26378 - protein, 8 aa, Dengue virus
EGEWKEGE

SEQ ID NO: 26379 - protein, 8 aa, Dengue virus
GEWKEGEE

SEQ ID NO: 26380 - protein, 8 aa, Dengue virus
EWKEGEEV

SEQ ID NO: 26381 - protein, 8 aa, Dengue virus
WKEGEEVQ

SEQ ID NO: 26382 - protein, 8 aa, Dengue virus
KEGEEVQV

SEQ ID NO: 26383 - protein, 8 aa, Dengue virus
EGEEVQVL

SEQ ID NO: 26384 - protein, 8 aa, Dengue virus
GEEVQVLA

SEQ ID NO: 26385 - protein, 8 aa, Dengue virus
EEVQVLAL

SEQ ID NO: 26386 - protein, 8 aa, Dengue virus
EVQVLALE

SEQ ID NO: 26387 - protein, 8 aa, Dengue virus
VQVLALEP

SEQ ID NO: 26388 - protein, 8 aa, Dengue virus
QVLALEPG

SEQ ID NO: 26389 - protein, 8 aa, Dengue virus
VLALEPGK

SEQ ID NO: 26390 - protein, 8 aa, Dengue virus
LALEPGKN

SEQ ID NO: 26391 - protein, 8 aa, Dengue virus
ALEPGKNP

SEQ ID NO: 26392 - protein, 8 aa, Dengue virus
LEPGKNPR

SEQ ID NO: 26393 - protein, 8 aa, Dengue virus
EPGKNPRA

SEQ ID NO: 26394 - protein, 8 aa, Dengue virus
PGKNPRAV

SEQ ID NO: 26395 - protein, 8 aa, Dengue virus
GKNPRAVQ

SEQ ID NO: 26396 - protein, 8 aa, Dengue virus
KNPRAVQT

SEQ ID NO: 26397 - protein, 8 aa, Dengue virus
NPRAVQTK

SEQ ID NO: 26398 - protein, 8 aa, Dengue virus
PRAVQTKP

SEQ ID NO: 26399 - protein, 8 aa, Dengue virus
RAVQTKPG

SEQ ID NO: 26400 - protein, 8 aa, Dengue virus
AVQTKPGL

SEQ ID NO: 26401 - protein, 8 aa, Dengue virus
VQTKPGLF

SEQ ID NO: 26402 - protein, 8 aa, Dengue virus
QTKPGLFK

SEQ ID NO: 26403 - protein, 8 aa, Dengue virus
TKPGLFKT

SEQ ID NO: 26404 - protein, 8 aa, Dengue virus
KPGLFKTN

SEQ ID NO: 26405 - protein, 8 aa, Dengue virus
FKTNTGTI

SEQ ID NO: 26406 - protein, 8 aa, Dengue virus
KTNTGTIG

SEQ ID NO: 26407 - protein, 8 aa, Dengue virus
TNTGTIGA

SEQ ID NO: 26408 - protein, 8 aa, Dengue virus
NTGTIGAV

SEQ ID NO: 26409 - protein, 8 aa, Dengue virus
TGTIGAVS

SEQ ID NO: 26410 - protein, 8 aa, Dengue virus
GTIGAVSL

SEQ ID NO: 26411 - protein, 8 aa, Dengue virus
TIGAVSLD

SEQ ID NO: 26412 - protein, 8 aa, Dengue virus
IGAVSLDF

SEQ ID NO: 26413 - protein, 8 aa, Dengue virus
GAVSLDFS

SEQ ID NO: 26414 - protein, 8 aa, Dengue virus
AVSLDFSP

SEQ ID NO: 26415 - protein, 8 aa, Dengue virus
VSLDFSPG

SEQ ID NO: 26416 - protein, 8 aa, Dengue virus
SLDFSPGT

SEQ ID NO: 26417 - protein, 8 aa, Dengue virus
LDFSPGTS

SEQ ID NO: 26418 - protein, 8 aa, Dengue virus
DFSPGTSG

SEQ ID NO: 26419 - protein, 8 aa, Dengue virus
FSPGTSGS

SEQ ID NO: 26420 - protein, 8 aa, Dengue virus
SPGTSGSP

SEQ ID NO: 26421 - protein, 8 aa, Dengue virus
PGTSGSPI

SEQ ID NO: 26422 - protein, 8 aa, Dengue virus
GTSGSPIV

SEQ ID NO: 26423 - protein, 8 aa, Dengue virus
TSGSPIVD

SEQ ID NO: 26424 - protein, 8 aa, Dengue virus
SGSPIVDR

SEQ ID NO: 26425 - protein, 8 aa, Dengue virus
GSPIVDRK

SEQ ID NO: 26426 - protein, 8 aa, Dengue virus
SPIVDRKG

SEQ ID NO: 26427 - protein, 8 aa, Dengue virus
PIVDRKGK

SEQ ID NO: 26428 - protein, 8 aa, Dengue virus
IVDRKGKV

SEQ ID NO: 26429 - protein, 8 aa, Dengue virus
VDRKGKVV

SEQ ID NO: 26430 - protein, 8 aa, Dengue virus
DRKGKVVG

SEQ ID NO: 26431 - protein, 8 aa, Dengue virus
RKGKVVGL

SEQ ID NO: 26432 - protein, 8 aa, Dengue virus
KGKVVGLY

SEQ ID NO: 26433 - protein, 8 aa, Dengue virus
GKVVGLYG

SEQ ID NO: 26434 - protein, 8 aa, Dengue virus
KVVGLYGN

SEQ ID NO: 26435 - protein, 8 aa, Dengue virus
VVGLYGNG

SEQ ID NO: 26436 - protein, 8 aa, Dengue virus
VGLYGNGV

SEQ ID NO: 26437 - protein, 8 aa, Dengue virus
GLYGNGVV

SEQ ID NO: 26438 - protein, 8 aa, Dengue virus
LYGNGVVT

SEQ ID NO: 26439 - protein, 8 aa, Dengue virus
YGNGVVTR

SEQ ID NO: 26440 - protein, 8 aa, Dengue virus
GNGVVTRS

SEQ ID NO: 26441 - protein, 8 aa, Dengue virus
NGVVTRSG

SEQ ID NO: 26442 - protein, 8 aa, Dengue virus
GVVTRSGA

SEQ ID NO: 26443 - protein, 8 aa, Dengue virus
VVTRSGAY

SEQ ID NO: 26444 - protein, 8 aa, Dengue virus
VTRSGAYV

SEQ ID NO: 26445 - protein, 8 aa, Dengue virus
TRSGAYVS

SEQ ID NO: 26446 - protein, 8 aa, Dengue virus
RSGAYVSA

SEQ ID NO: 26447 - protein, 8 aa, Dengue virus
SGAYVSAI

SEQ ID NO: 26448 - protein, 8 aa, Dengue virus
GAYVSAIA

SEQ ID NO: 26449 - protein, 8 aa, Dengue virus
AYVSAIAQ

SEQ ID NO: 26450 - protein, 8 aa, Dengue virus
YVSAIAQT

SEQ ID NO: 26451 - protein, 8 aa, Dengue virus
VSAIAQTE

SEQ ID NO: 26452 - protein, 8 aa, Dengue virus
SAIAQTEK

SEQ ID NO: 26453 - protein, 8 aa, Dengue virus
AIAQTEKS

SEQ ID NO: 26454 - protein, 8 aa, Dengue virus
IAQTEKSI

SEQ ID NO: 26455 - protein, 8 aa, Dengue virus
AQTEKSIE

SEQ ID NO: 26456 - protein, 8 aa, Dengue virus
IEDNPEIE

SEQ ID NO: 26457 - protein, 8 aa, Dengue virus
EDNPEIED

SEQ ID NO: 26458 - protein, 8 aa, Dengue virus
DNPEIEDD

SEQ ID NO: 26459 - protein, 8 aa, Dengue virus
NPEIEDDI

SEQ ID NO: 26460 - protein, 8 aa, Dengue virus
PEIEDDIF

SEQ ID NO: 26461 - protein, 8 aa, Dengue virus
EIEDDIFR

SEQ ID NO: 26462 - protein, 8 aa, Dengue virus
IEDDIFRK

SEQ ID NO: 26463 - protein, 8 aa, Dengue virus
EDDIFRKK

SEQ ID NO: 26464 - protein, 8 aa, Dengue virus
DDIFRKKR

SEQ ID NO: 26465 - protein, 8 aa, Dengue virus
DIFRKKRL

SEQ ID NO: 26466 - protein, 8 aa, Dengue virus
IFRKKRLT

SEQ ID NO: 26467 - protein, 8 aa, Dengue virus
FRKKRLTI

SEQ ID NO: 26468 - protein, 8 aa, Dengue virus
RKKRLTIM

SEQ ID NO: 26469 - protein, 8 aa, Dengue virus
KKRLTIMD

SEQ ID NO: 26470 - protein, 8 aa, Dengue virus
KRLTIMDL

SEQ ID NO: 26471 - protein, 8 aa, Dengue virus
RLTIMDLH

SEQ ID NO: 26472 - protein, 8 aa, Dengue virus
LTIMDLHP

SEQ ID NO: 26473 - protein, 8 aa, Dengue virus
TIMDLHPG

SEQ ID NO: 26474 - protein, 8 aa, Dengue virus
IMDLHPGA

SEQ ID NO: 26475 - protein, 8 aa, Dengue virus
MDLHPGAG

SEQ ID NO: 26476 - protein, 8 aa, Dengue virus
DLHPGAGK

SEQ ID NO: 26477 - protein, 8 aa, Dengue virus
LHPGAGKT

SEQ ID NO: 26478 - protein, 8 aa, Dengue virus
HPGAGKTK

SEQ ID NO: 26479 - protein, 8 aa, Dengue virus
PGAGKTKR

SEQ ID NO: 26480 - protein, 8 aa, Dengue virus
GAGKTKRY

SEQ ID NO: 26481 - protein, 8 aa, Dengue virus
AGKTKRYL

SEQ ID NO: 26482 - protein, 8 aa, Dengue virus
GKTKRYLP

SEQ ID NO: 26483 - protein, 8 aa, Dengue virus
KTKRYLPA

SEQ ID NO: 26484 - protein, 8 aa, Dengue virus
TKRYLPAI

SEQ ID NO: 26485 - protein, 8 aa, Dengue virus
KRYLPAIV

SEQ ID NO: 26486 - protein, 8 aa, Dengue virus
RYLPAIVR

SEQ ID NO: 26487 - protein, 8 aa, Dengue virus
YLPAIVRE

SEQ ID NO: 26488 - protein, 8 aa, Dengue virus
LPAIVREA

SEQ ID NO: 26489 - protein, 8 aa, Dengue virus
PAIVREAI

SEQ ID NO: 26490 - protein, 8 aa, Dengue virus
AIVREAIK

SEQ ID NO: 26491 - protein, 8 aa, Dengue virus
IVREAIKR

SEQ ID NO: 26492 - protein, 8 aa, Dengue virus
VREAIKRG

SEQ ID NO: 26493 - protein, 8 aa, Dengue virus
REAIKRGL

SEQ ID NO: 26494 - protein, 8 aa, Dengue virus
EAIKRGLR

SEQ ID NO: 26495 - protein, 8 aa, Dengue virus
AIKRGLRT

SEQ ID NO: 26496 - protein, 8 aa, Dengue virus
IKRGLRTL

SEQ ID NO: 26497 - protein, 8 aa, Dengue virus
KRGLRTLI

SEQ ID NO: 26498 - protein, 8 aa, Dengue virus
RGLRTLIL

SEQ ID NO: 26499 - protein, 8 aa, Dengue virus
GLRTLILA

SEQ ID NO: 26500 - protein, 8 aa, Dengue virus
LRTLILAP

SEQ ID NO: 26501 - protein, 8 aa, Dengue virus
RTLILAPT

SEQ ID NO: 26502 - protein, 8 aa, Dengue virus
TLILAPTR

SEQ ID NO: 26503 - protein, 8 aa, Dengue virus
LILAPTRV

SEQ ID NO: 26504 - protein, 8 aa, Dengue virus
ILAPTRVV

SEQ ID NO: 26505 - protein, 8 aa, Dengue virus
LAPTRVVA

SEQ ID NO: 26506 - protein, 8 aa, Dengue virus
APTRVVAA

SEQ ID NO: 26507 - protein, 8 aa, Dengue virus
PTRVVAAE

SEQ ID NO: 26508 - protein, 8 aa, Dengue virus
TRVVAAEM

SEQ ID NO: 26509 - protein, 8 aa, Dengue virus
RVVAAEME

SEQ ID NO: 26510 - protein, 8 aa, Dengue virus
VVAAEMEE

SEQ ID NO: 26511 - protein, 8 aa, Dengue virus
VAAEMEEA

SEQ ID NO: 26512 - protein, 8 aa, Dengue virus
AAEMEEAL

SEQ ID NO: 26513 - protein, 8 aa, Dengue virus
AEMEEALR

SEQ ID NO: 26514 - protein, 8 aa, Dengue virus
EMEEALRG

SEQ ID NO: 26515 - protein, 8 aa, Dengue virus
MEEALRGL

SEQ ID NO: 26516 - protein, 8 aa, Dengue virus
EEALRGLP

SEQ ID NO: 26517 - protein, 8 aa, Dengue virus
EALRGLPI

SEQ ID NO: 26518 - protein, 8 aa, Dengue virus
ALRGLPIR

SEQ ID NO: 26519 - protein, 8 aa, Dengue virus
LRGLPIRY

SEQ ID NO: 26520 - protein, 8 aa, Dengue virus
RGLPIRYQ

SEQ ID NO: 26521 - protein, 8 aa, Dengue virus
GLPIRYQT

SEQ ID NO: 26522 - protein, 8 aa, Dengue virus
LPIRYQTP

SEQ ID NO: 26523 - protein, 8 aa, Dengue virus
PIRYQTPA

SEQ ID NO: 26524 - protein, 8 aa, Dengue virus
IRYQTPAI

SEQ ID NO: 26525 - protein, 8 aa, Dengue virus
RYQTPAIR

SEQ ID NO: 26526 - protein, 8 aa, Dengue virus
YQTPAIRA

SEQ ID NO: 26527 - protein, 8 aa, Dengue virus
QTPAIRAE

SEQ ID NO: 26528 - protein, 8 aa, Dengue virus
TPAIRAEH

SEQ ID NO: 26529 - protein, 8 aa, Dengue virus
PAIRAEHT

SEQ ID NO: 26530 - protein, 8 aa, Dengue virus
AIRAEHTG

SEQ ID NO: 26531 - protein, 8 aa, Dengue virus
IRAEHTGR

SEQ ID NO: 26532 - protein, 8 aa, Dengue virus
RAEHTGRE

SEQ ID NO: 26533 - protein, 8 aa, Dengue virus
AEHTGREI

SEQ ID NO: 26534 - protein, 8 aa, Dengue virus
EHTGREIV

SEQ ID NO: 26535 - protein, 8 aa, Dengue virus
HTGREIVD

SEQ ID NO: 26536 - protein, 8 aa, Dengue virus
TGREIVDL

SEQ ID NO: 26537 - protein, 8 aa, Dengue virus
GREIVDLM

SEQ ID NO: 26538 - protein, 8 aa, Dengue virus
REIVDLMC

SEQ ID NO: 26539 - protein, 8 aa, Dengue virus
EIVDLMCH

SEQ ID NO: 26540 - protein, 8 aa, Dengue virus
IVDLMCHA

SEQ ID NO: 26541 - protein, 8 aa, Dengue virus
VDLMCHAT

SEQ ID NO: 26542 - protein, 8 aa, Dengue virus
DLMCHATF

SEQ ID NO: 26543 - protein, 8 aa, Dengue virus
LMCHATFT

SEQ ID NO: 26544 - protein, 8 aa, Dengue virus
MCHATFTM

SEQ ID NO: 26545 - protein, 8 aa, Dengue virus
CHATFTMR

SEQ ID NO: 26546 - protein, 8 aa, Dengue virus
HATFTMRL

SEQ ID NO: 26547 - protein, 8 aa, Dengue virus
ATFTMRLL

SEQ ID NO: 26548 - protein, 8 aa, Dengue virus
TFTMRLLS

SEQ ID NO: 26549 - protein, 8 aa, Dengue virus
FTMRLLSP

SEQ ID NO: 26550 - protein, 8 aa, Dengue virus
TMRLLSPV

SEQ ID NO: 26551 - protein, 8 aa, Dengue virus
MRLLSPVR

SEQ ID NO: 26552 - protein, 8 aa, Dengue virus
RLLSPVRV

SEQ ID NO: 26553 - protein, 8 aa, Dengue virus
LLSPVRVP

SEQ ID NO: 26554 - protein, 8 aa, Dengue virus
LSPVRVPN

SEQ ID NO: 26555 - protein, 8 aa, Dengue virus
SPVRVPNY

SEQ ID NO: 26556 - protein, 8 aa, Dengue virus
PVRVPNYN

SEQ ID NO: 26557 - protein, 8 aa, Dengue virus
VRVPNYNL

SEQ ID NO: 26558 - protein, 8 aa, Dengue virus
RVPNYNLI

SEQ ID NO: 26559 - protein, 8 aa, Dengue virus
VPNYNLII

SEQ ID NO: 26560 - protein, 8 aa, Dengue virus
PNYNLIIM

SEQ ID NO: 26561 - protein, 8 aa, Dengue virus
NYNLIIMD

SEQ ID NO: 26562 - protein, 8 aa, Dengue virus
YNLIIMDE

SEQ ID NO: 26563 - protein, 8 aa, Dengue virus
NLIIMDEA

SEQ ID NO: 26564 - protein, 8 aa, Dengue virus
LIIMDEAH

SEQ ID NO: 26565 - protein, 8 aa, Dengue virus
IIMDEAHF

SEQ ID NO: 26566 - protein, 8 aa, Dengue virus
IMDEAHFT

SEQ ID NO: 26567 - protein, 8 aa, Dengue virus
MDEAHFTD

SEQ ID NO: 26568 - protein, 8 aa, Dengue virus
DEAHFTDP

SEQ ID NO: 26569 - protein, 8 aa, Dengue virus
EAHFTDPA

SEQ ID NO: 26570 - protein, 8 aa, Dengue virus
AHFTDPAS

SEQ ID NO: 26571 - protein, 8 aa, Dengue virus
HFTDPASI

SEQ ID NO: 26572 - protein, 8 aa, Dengue virus
FTDPASIA

SEQ ID NO: 26573 - protein, 8 aa, Dengue virus
TDPASIAA

SEQ ID NO: 26574 - protein, 8 aa, Dengue virus
DPASIAAR

SEQ ID NO: 26575 - protein, 8 aa, Dengue virus
PASIAARG

SEQ ID NO: 26576 - protein, 8 aa, Dengue virus
ASIAARGY

SEQ ID NO: 26577 - protein, 8 aa, Dengue virus
SIAARGYI

SEQ ID NO: 26578 - protein, 8 aa, Dengue virus
IAARGYIS

SEQ ID NO: 26579 - protein, 8 aa, Dengue virus
AARGYIST

SEQ ID NO: 26580 - protein, 8 aa, Dengue virus
ARGYISTR

SEQ ID NO: 26581 - protein, 8 aa, Dengue virus
RGYISTRV

SEQ ID NO: 26582 - protein, 8 aa, Dengue virus
GYISTRVE

SEQ ID NO: 26583 - protein, 8 aa, Dengue virus
YISTRVEM

SEQ ID NO: 26584 - protein, 8 aa, Dengue virus
ISTRVEMG

SEQ ID NO: 26585 - protein, 8 aa, Dengue virus
STRVEMGE

SEQ ID NO: 26586 - protein, 8 aa, Dengue virus
TRVEMGEA

SEQ ID NO: 26587 - protein, 8 aa, Dengue virus
RVEMGEAA

SEQ ID NO: 26588 - protein, 8 aa, Dengue virus
VEMGEAAG

SEQ ID NO: 26589 - protein, 8 aa, Dengue virus
EMGEAAGI

SEQ ID NO: 26590 - protein, 8 aa, Dengue virus
MGEAAGIF

SEQ ID NO: 26591 - protein, 8 aa, Dengue virus
GEAAGIFM

SEQ ID NO: 26592 - protein, 8 aa, Dengue virus
EAAGIFMT

SEQ ID NO: 26593 - protein, 8 aa, Dengue virus
AAGIFMTA

SEQ ID NO: 26594 - protein, 8 aa, Dengue virus
AGIFMTAT

SEQ ID NO: 26595 - protein, 8 aa, Dengue virus
GIFMTATP

SEQ ID NO: 26596 - protein, 8 aa, Dengue virus
IFMTATPP

SEQ ID NO: 26597 - protein, 8 aa, Dengue virus
FMTATPPG

SEQ ID NO: 26598 - protein, 8 aa, Dengue virus
MTATPPGS

SEQ ID NO: 26599 - protein, 8 aa, Dengue virus
TATPPGSR

SEQ ID NO: 26600 - protein, 8 aa, Dengue virus
ATPPGSRD

SEQ ID NO: 26601 - protein, 8 aa, Dengue virus
TPPGSRDP

SEQ ID NO: 26602 - protein, 8 aa, Dengue virus
PPGSRDPF

SEQ ID NO: 26603 - protein, 8 aa, Dengue virus
PGSRDPFP

SEQ ID NO: 26604 - protein, 8 aa, Dengue virus
GSRDPFPQ

SEQ ID NO: 26605 - protein, 8 aa, Dengue virus
SRDPFPQS

SEQ ID NO: 26606 - protein, 8 aa, Dengue virus
RDPFPQSN

SEQ ID NO: 26607 - protein, 8 aa, Dengue virus
DPFPQSNA

SEQ ID NO: 26608 - protein, 8 aa, Dengue virus
PFPQSNAP

SEQ ID NO: 26609 - protein, 8 aa, Dengue virus
FPQSNAPI

SEQ ID NO: 26610 - protein, 8 aa, Dengue virus
PQSNAPIM

SEQ ID NO: 26611 - protein, 8 aa, Dengue virus
QSNAPIMD

SEQ ID NO: 26612 - protein, 8 aa, Dengue virus
SNAPIMDE

SEQ ID NO: 26613 - protein, 8 aa, Dengue virus
NAPIMDEE

SEQ ID NO: 26614 - protein, 8 aa, Dengue virus
APIMDEER

SEQ ID NO: 26615 - protein, 8 aa, Dengue virus
PIMDEERE

SEQ ID NO: 26616 - protein, 8 aa, Dengue virus
IMDEEREI

SEQ ID NO: 26617 - protein, 8 aa, Dengue virus
MDEEREIP

SEQ ID NO: 26618 - protein, 8 aa, Dengue virus
DEEREIPE

SEQ ID NO: 26619 - protein, 8 aa, Dengue virus
EEREIPER

SEQ ID NO: 26620 - protein, 8 aa, Dengue virus
EREIPERS

SEQ ID NO: 26621 - protein, 8 aa, Dengue virus
REIPERSW

SEQ ID NO: 26622 - protein, 8 aa, Dengue virus
EIPERSWN

SEQ ID NO: 26623 - protein, 8 aa, Dengue virus
IPERSWNS

SEQ ID NO: 26624 - protein, 8 aa, Dengue virus
PERSWNSG

SEQ ID NO: 26625 - protein, 8 aa, Dengue virus
ERSWNSGH

SEQ ID NO: 26626 - protein, 8 aa, Dengue virus
RSWNSGHE

SEQ ID NO: 26627 - protein, 8 aa, Dengue virus
SWNSGHEW

SEQ ID NO: 26628 - protein, 8 aa, Dengue virus
WNSGHEWV

SEQ ID NO: 26629 - protein, 8 aa, Dengue virus
NSGHEWVT

SEQ ID NO: 26630 - protein, 8 aa, Dengue virus
SGHEWVTD

SEQ ID NO: 26631 - protein, 8 aa, Dengue virus
GHEWVTDF

SEQ ID NO: 26632 - protein, 8 aa, Dengue virus
HEWVTDFK

SEQ ID NO: 26633 - protein, 8 aa, Dengue virus
EWVTDFKG

SEQ ID NO: 26634 - protein, 8 aa, Dengue virus
WVTDFKGK

SEQ ID NO: 26635 - protein, 8 aa, Dengue virus
VTDFKGKT

SEQ ID NO: 26636 - protein, 8 aa, Dengue virus
TDFKGKTV

SEQ ID NO: 26637 - protein, 8 aa, Dengue virus
DFKGKTVW

SEQ ID NO: 26638 - protein, 8 aa, Dengue virus
FKGKTVWF

SEQ ID NO: 26639 - protein, 8 aa, Dengue virus
KGKTVWFV

SEQ ID NO: 26640 - protein, 8 aa, Dengue virus
GKTVWFVP

SEQ ID NO: 26641 - protein, 8 aa, Dengue virus
KTVWFVPS

SEQ ID NO: 26642 - protein, 8 aa, Dengue virus
TVWFVPSI

SEQ ID NO: 26643 - protein, 8 aa, Dengue virus
VWFVPSIK

SEQ ID NO: 26644 - protein, 8 aa, Dengue virus
WFVPSIKA

SEQ ID NO: 26645 - protein, 8 aa, Dengue virus
FVPSIKAG

SEQ ID NO: 26646 - protein, 8 aa, Dengue virus
VPSIKAGN

SEQ ID NO: 26647 - protein, 8 aa, Dengue virus
PSIKAGND

SEQ ID NO: 26648 - protein, 8 aa, Dengue virus
SIKAGNDI

SEQ ID NO: 26649 - protein, 8 aa, Dengue virus
IKAGNDIA

SEQ ID NO: 26650 - protein, 8 aa, Dengue virus
KAGNDIAA

SEQ ID NO: 26651 - protein, 8 aa, Dengue virus
AGNDIAAC

SEQ ID NO: 26652 - protein, 8 aa, Dengue virus
GNDIAACL

SEQ ID NO: 26653 - protein, 8 aa, Dengue virus
NDIAACLR

SEQ ID NO: 26654 - protein, 8 aa, Dengue virus
DIAACLRK

SEQ ID NO: 26655 - protein, 8 aa, Dengue virus
IAACLRKN

SEQ ID NO: 26656 - protein, 8 aa, Dengue virus
AACLRKNG

SEQ ID NO: 26657 - protein, 8 aa, Dengue virus
ACLRKNGK

SEQ ID NO: 26658 - protein, 8 aa, Dengue virus
CLRKNGKK

SEQ ID NO: 26659 - protein, 8 aa, Dengue virus
LRKNGKKV

SEQ ID NO: 26660 - protein, 8 aa, Dengue virus
RKNGKKVI

SEQ ID NO: 26661 - protein, 8 aa, Dengue virus
KNGKKVIQ

SEQ ID NO: 26662 - protein, 8 aa, Dengue virus
NGKKVIQL

SEQ ID NO: 26663 - protein, 8 aa, Dengue virus
GKKVIQLS

SEQ ID NO: 26664 - protein, 8 aa, Dengue virus
KKVIQLSR

SEQ ID NO: 26665 - protein, 8 aa, Dengue virus
KVIQLSRK

SEQ ID NO: 26666 - protein, 8 aa, Dengue virus
VIQLSRKT

SEQ ID NO: 26667 - protein, 8 aa, Dengue virus
IQLSRKTF

SEQ ID NO: 26668 - protein, 8 aa, Dengue virus
QLSRKTFD

SEQ ID NO: 26669 - protein, 8 aa, Dengue virus
LSRKTFDS

SEQ ID NO: 26670 - protein, 8 aa, Dengue virus
SRKTFDSE

SEQ ID NO: 26671 - protein, 8 aa, Dengue virus
RKTFDSEY

SEQ ID NO: 26672 - protein, 8 aa, Dengue virus
KTFDSEYV

SEQ ID NO: 26673 - protein, 8 aa, Dengue virus
TFDSEYVK

SEQ ID NO: 26674 - protein, 8 aa, Dengue virus
FDSEYVKT

SEQ ID NO: 26675 - protein, 8 aa, Dengue virus
DSEYVKTR

SEQ ID NO: 26676 - protein, 8 aa, Dengue virus
KTRTNDWD

SEQ ID NO: 26677 - protein, 8 aa, Dengue virus
TRTNDWDF

SEQ ID NO: 26678 - protein, 8 aa, Dengue virus
RTNDWDFV

SEQ ID NO: 26679 - protein, 8 aa, Dengue virus
TNDWDFVV

SEQ ID NO: 26680 - protein, 8 aa, Dengue virus
NDWDFVVT

SEQ ID NO: 26681 - protein, 8 aa, Dengue virus
DWDFVVTT

SEQ ID NO: 26682 - protein, 8 aa, Dengue virus
WDFVVTTD

SEQ ID NO: 26683 - protein, 8 aa, Dengue virus
DFVVTTDI

SEQ ID NO: 26684 - protein, 8 aa, Dengue virus
FVVTTDIS

SEQ ID NO: 26685 - protein, 8 aa, Dengue virus
VVTTDISE

SEQ ID NO: 26686 - protein, 8 aa, Dengue virus
VTTDISEM

SEQ ID NO: 26687 - protein, 8 aa, Dengue virus
TTDISEMG

SEQ ID NO: 26688 - protein, 8 aa, Dengue virus
TDISEMGA

SEQ ID NO: 26689 - protein, 8 aa, Dengue virus
DISEMGAN

SEQ ID NO: 26690 - protein, 8 aa, Dengue virus
ISEMGANF

SEQ ID NO: 26691 - protein, 8 aa, Dengue virus
SEMGANFK

SEQ ID NO: 26692 - protein, 8 aa, Dengue virus
EMGANFKA

SEQ ID NO: 26693 - protein, 8 aa, Dengue virus
MGANFKAE

SEQ ID NO: 26694 - protein, 8 aa, Dengue virus
GANFKAER

SEQ ID NO: 26695 - protein, 8 aa, Dengue virus
ANFKAERV

SEQ ID NO: 26696 - protein, 8 aa, Dengue virus
NFKAERVI

SEQ ID NO: 26697 - protein, 8 aa, Dengue virus
FKAERVID

SEQ ID NO: 26698 - protein, 8 aa, Dengue virus
KAERVIDP

SEQ ID NO: 26699 - protein, 8 aa, Dengue virus
AERVIDPR

SEQ ID NO: 26700 - protein, 8 aa, Dengue virus
ERVIDPRR

SEQ ID NO: 26701 - protein, 8 aa, Dengue virus
RVIDPRRC

SEQ ID NO: 26702 - protein, 8 aa, Dengue virus
VIDPRRCM

SEQ ID NO: 26703 - protein, 8 aa, Dengue virus
IDPRRCMK

SEQ ID NO: 26704 - protein, 8 aa, Dengue virus
DPRRCMKP

SEQ ID NO: 26705 - protein, 8 aa, Dengue virus
PRRCMKPV

SEQ ID NO: 26706 - protein, 8 aa, Dengue virus
RRCMKPVI

SEQ ID NO: 26707 - protein, 8 aa, Dengue virus
RCMKPVIL

SEQ ID NO: 26708 - protein, 8 aa, Dengue virus
CMKPVILT

SEQ ID NO: 26709 - protein, 8 aa, Dengue virus
MKPVILTD

SEQ ID NO: 26710 - protein, 8 aa, Dengue virus
KPVILTDG

SEQ ID NO: 26711 - protein, 8 aa, Dengue virus
PVILTDGE

SEQ ID NO: 26712 - protein, 8 aa, Dengue virus
VILTDGEE

SEQ ID NO: 26713 - protein, 8 aa, Dengue virus
ILTDGEER

SEQ ID NO: 26714 - protein, 8 aa, Dengue virus
LTDGEERV

SEQ ID NO: 26715 - protein, 8 aa, Dengue virus
TDGEERVI

SEQ ID NO: 26716 - protein, 8 aa, Dengue virus
DGEERVIL

SEQ ID NO: 26717 - protein, 8 aa, Dengue virus
GEERVILA

SEQ ID NO: 26718 - protein, 8 aa, Dengue virus
EERVILAG

SEQ ID NO: 26719 - protein, 8 aa, Dengue virus
ERVILAGP

SEQ ID NO: 26720 - protein, 8 aa, Dengue virus
RVILAGPM

SEQ ID NO: 26721 - protein, 8 aa, Dengue virus
VILAGPMP

SEQ ID NO: 26722 - protein, 8 aa, Dengue virus
ILAGPMPV

SEQ ID NO: 26723 - protein, 8 aa, Dengue virus
LAGPMPVT

SEQ ID NO: 26724 - protein, 8 aa, Dengue virus
AGPMPVTH

SEQ ID NO: 26725 - protein, 8 aa, Dengue virus
GPMPVTHS

SEQ ID NO: 26726 - protein, 8 aa, Dengue virus
PMPVTHSS

SEQ ID NO: 26727 - protein, 8 aa, Dengue virus
MPVTHSSA

SEQ ID NO: 26728 - protein, 8 aa, Dengue virus
PVTHSSAA

SEQ ID NO: 26729 - protein, 8 aa, Dengue virus
VTHSSAAQ

SEQ ID NO: 26730 - protein, 8 aa, Dengue virus
THSSAAQR

SEQ ID NO: 26731 - protein, 8 aa, Dengue virus
HSSAAQRR

SEQ ID NO: 26732 - protein, 8 aa, Dengue virus
SSAAQRRG

SEQ ID NO: 26733 - protein, 8 aa, Dengue virus
SAAQRRGR

SEQ ID NO: 26734 - protein, 8 aa, Dengue virus
AAQRRGRI

SEQ ID NO: 26735 - protein, 8 aa, Dengue virus
AQRRGRIG

SEQ ID NO: 26736 - protein, 8 aa, Dengue virus
QRRGRIGR

SEQ ID NO: 26737 - protein, 8 aa, Dengue virus
RRGRIGRN

SEQ ID NO: 26738 - protein, 8 aa, Dengue virus
RGRIGRNP

SEQ ID NO: 26739 - protein, 8 aa, Dengue virus
GRIGRNPK

SEQ ID NO: 26740 - protein, 8 aa, Dengue virus
RIGRNPKN

SEQ ID NO: 26741 - protein, 8 aa, Dengue virus
IGRNPKNE

SEQ ID NO: 26742 - protein, 8 aa, Dengue virus
GRNPKNEN

SEQ ID NO: 26743 - protein, 8 aa, Dengue virus
RNPKNEND

SEQ ID NO: 26744 - protein, 8 aa, Dengue virus
NPKNENDQ

SEQ ID NO: 26745 - protein, 8 aa, Dengue virus
PKNENDQY

SEQ ID NO: 26746 - protein, 8 aa, Dengue virus
KNENDQYI

SEQ ID NO: 26747 - protein, 8 aa, Dengue virus
NENDQYIY

SEQ ID NO: 26748 - protein, 8 aa, Dengue virus
ENDQYIYM

SEQ ID NO: 26749 - protein, 8 aa, Dengue virus
NDQYIYMG

SEQ ID NO: 26750 - protein, 8 aa, Dengue virus
DQYIYMGE

SEQ ID NO: 26751 - protein, 8 aa, Dengue virus
QYIYMGEP

SEQ ID NO: 26752 - protein, 8 aa, Dengue virus
YIYMGEPL

SEQ ID NO: 26753 - protein, 8 aa, Dengue virus
IYMGEPLE

SEQ ID NO: 26754 - protein, 8 aa, Dengue virus
YMGEPLEN

SEQ ID NO: 26755 - protein, 8 aa, Dengue virus
MGEPLEND

SEQ ID NO: 26756 - protein, 8 aa, Dengue virus
GEPLENDE

SEQ ID NO: 26757 - protein, 8 aa, Dengue virus
EPLENDED

SEQ ID NO: 26758 - protein, 8 aa, Dengue virus
PLENDEDC

SEQ ID NO: 26759 - protein, 8 aa, Dengue virus
LENDEDCA

SEQ ID NO: 26760 - protein, 8 aa, Dengue virus
ENDEDCAH

SEQ ID NO: 26761 - protein, 8 aa, Dengue virus
NDEDCAHW

SEQ ID NO: 26762 - protein, 8 aa, Dengue virus
DEDCAHWK

SEQ ID NO: 26763 - protein, 8 aa, Dengue virus
EDCAHWKE

SEQ ID NO: 26764 - protein, 8 aa, Dengue virus
DCAHWKEA

SEQ ID NO: 26765 - protein, 8 aa, Dengue virus
CAHWKEAK

SEQ ID NO: 26766 - protein, 8 aa, Dengue virus
AHWKEAKM

SEQ ID NO: 26767 - protein, 8 aa, Dengue virus
HWKEAKML

SEQ ID NO: 26768 - protein, 8 aa, Dengue virus
WKEAKMLL

SEQ ID NO: 26769 - protein, 8 aa, Dengue virus
KEAKMLLD

SEQ ID NO: 26770 - protein, 8 aa, Dengue virus
EAKMLLDN

SEQ ID NO: 26771 - protein, 8 aa, Dengue virus
AKMLLDNI

SEQ ID NO: 26772 - protein, 8 aa, Dengue virus
KMLLDNIN

SEQ ID NO: 26773 - protein, 8 aa, Dengue virus
MLLDNINT

SEQ ID NO: 26774 - protein, 8 aa, Dengue virus
LLDNINTP

SEQ ID NO: 26775 - protein, 8 aa, Dengue virus
LDNINTPE

SEQ ID NO: 26776 - protein, 8 aa, Dengue virus
DNINTPEG

SEQ ID NO: 26777 - protein, 8 aa, Dengue virus
NINTPEGI

SEQ ID NO: 26778 - protein, 8 aa, Dengue virus
INTPEGII

SEQ ID NO: 26779 - protein, 8 aa, Dengue virus
NTPEGIIP

SEQ ID NO: 26780 - protein, 8 aa, Dengue virus
TPEGIIPS

SEQ ID NO: 26781 - protein, 8 aa, Dengue virus
PEGIIPSM

SEQ ID NO: 26782 - protein, 8 aa, Dengue virus
EGIIPSMF

SEQ ID NO: 26783 - protein, 8 aa, Dengue virus
GIIPSMFE

SEQ ID NO: 26784 - protein, 8 aa, Dengue virus
IIPSMFEP

SEQ ID NO: 26785 - protein, 8 aa, Dengue virus
IPSMFEPE

SEQ ID NO: 26786 - protein, 8 aa, Dengue virus
PSMFEPER

SEQ ID NO: 26787 - protein, 8 aa, Dengue virus
SMFEPERE

SEQ ID NO: 26788 - protein, 8 aa, Dengue virus
MFEPEREK

SEQ ID NO: 26789 - protein, 8 aa, Dengue virus
FEPEREKV

SEQ ID NO: 26790 - protein, 8 aa, Dengue virus
EPEREKVD

SEQ ID NO: 26791 - protein, 8 aa, Dengue virus
PEREKVDA

SEQ ID NO: 26792 - protein, 8 aa, Dengue virus
EREKVDAI

SEQ ID NO: 26793 - protein, 8 aa, Dengue virus
REKVDAID

SEQ ID NO: 26794 - protein, 8 aa, Dengue virus
EKVDAIDG

SEQ ID NO: 26795 - protein, 8 aa, Dengue virus
KVDAIDGE

SEQ ID NO: 26796 - protein, 8 aa, Dengue virus
VDAIDGEY

SEQ ID NO: 26797 - protein, 8 aa, Dengue virus
DAIDGEYR

SEQ ID NO: 26798 - protein, 8 aa, Dengue virus
AIDGEYRL

SEQ ID NO: 26799 - protein, 8 aa, Dengue virus
IDGEYRLR

SEQ ID NO: 26800 - protein, 8 aa, Dengue virus
DGEYRLRG

SEQ ID NO: 26801 - protein, 8 aa, Dengue virus
GEYRLRGE

SEQ ID NO: 26802 - protein, 8 aa, Dengue virus
EYRLRGEA

SEQ ID NO: 26803 - protein, 8 aa, Dengue virus
YRLRGEAR

SEQ ID NO: 26804 - protein, 8 aa, Dengue virus
RLRGEARK

SEQ ID NO: 26805 - protein, 8 aa, Dengue virus
LRGEARKT

SEQ ID NO: 26806 - protein, 8 aa, Dengue virus
RGEARKTF

SEQ ID NO: 26807 - protein, 8 aa, Dengue virus
GEARKTFV

SEQ ID NO: 26808 - protein, 8 aa, Dengue virus
EARKTFVD

SEQ ID NO: 26809 - protein, 8 aa, Dengue virus
ARKTFVDL

SEQ ID NO: 26810 - protein, 8 aa, Dengue virus
RKTFVDLM

SEQ ID NO: 26811 - protein, 8 aa, Dengue virus
KTFVDLMR

SEQ ID NO: 26812 - protein, 8 aa, Dengue virus
TFVDLMRR

SEQ ID NO: 26813 - protein, 8 aa, Dengue virus
FVDLMRRG

SEQ ID NO: 26814 - protein, 8 aa, Dengue virus
VDLMRRGD

SEQ ID NO: 26815 - protein, 8 aa, Dengue virus
DLMRRGDL

SEQ ID NO: 26816 - protein, 8 aa, Dengue virus
LMRRGDLP

SEQ ID NO: 26817 - protein, 8 aa, Dengue virus
MRRGDLPV

SEQ ID NO: 26818 - protein, 8 aa, Dengue virus
RRGDLPVW

SEQ ID NO: 26819 - protein, 8 aa, Dengue virus
RGDLPVWL

SEQ ID NO: 26820 - protein, 8 aa, Dengue virus
GDLPVWLA

SEQ ID NO: 26821 - protein, 8 aa, Dengue virus
DLPVWLAY

SEQ ID NO: 26822 - protein, 8 aa, Dengue virus
LPVWLAYK

SEQ ID NO: 26823 - protein, 8 aa, Dengue virus
PVWLAYKV

SEQ ID NO: 26824 - protein, 8 aa, Dengue virus
VWLAYKVA

SEQ ID NO: 26825 - protein, 8 aa, Dengue virus
WLAYKVAA

SEQ ID NO: 26826 - protein, 8 aa, Dengue virus
LAYKVAAE

SEQ ID NO: 26827 - protein, 8 aa, Dengue virus
AYKVAAEG

SEQ ID NO: 26828 - protein, 8 aa, Dengue virus
YKVAAEGI

SEQ ID NO: 26829 - protein, 8 aa, Dengue virus
KVAAEGIN

SEQ ID NO: 26830 - protein, 8 aa, Dengue virus
VAAEGINY

SEQ ID NO: 26831 - protein, 8 aa, Dengue virus
AAEGINYA

SEQ ID NO: 26832 - protein, 8 aa, Dengue virus
AEGINYAD

SEQ ID NO: 26833 - protein, 8 aa, Dengue virus
EGINYADR

SEQ ID NO: 26834 - protein, 8 aa, Dengue virus
GINYADRR

SEQ ID NO: 26835 - protein, 8 aa, Dengue virus
INYADRRW

SEQ ID NO: 26836 - protein, 8 aa, Dengue virus
NYADRRWC

SEQ ID NO: 26837 - protein, 8 aa, Dengue virus
YADRRWCF

SEQ ID NO: 26838 - protein, 8 aa, Dengue virus
ADRRWCFD

SEQ ID NO: 26839 - protein, 8 aa, Dengue virus
DRRWCFDG

SEQ ID NO: 26840 - protein, 8 aa, Dengue virus
RRWCFDGI

SEQ ID NO: 26841 - protein, 8 aa, Dengue virus
RWCFDGIK

SEQ ID NO: 26842 - protein, 8 aa, Dengue virus
WCFDGIKN

SEQ ID NO: 26843 - protein, 8 aa, Dengue virus
CFDGIKNN

SEQ ID NO: 26844 - protein, 8 aa, Dengue virus
FDGIKNNQ

SEQ ID NO: 26845 - protein, 8 aa, Dengue virus
DGIKNNQI

SEQ ID NO: 26846 - protein, 8 aa, Dengue virus
GIKNNQIL

SEQ ID NO: 26847 - protein, 8 aa, Dengue virus
IKNNQILE

SEQ ID NO: 26848 - protein, 8 aa, Dengue virus
KNNQILEE

SEQ ID NO: 26849 - protein, 8 aa, Dengue virus
NNQILEEN

SEQ ID NO: 26850 - protein, 8 aa, Dengue virus
NQILEENV

SEQ ID NO: 26851 - protein, 8 aa, Dengue virus
QILEENVE

SEQ ID NO: 26852 - protein, 8 aa, Dengue virus
ILEENVEV

SEQ ID NO: 26853 - protein, 8 aa, Dengue virus
LEENVEVE

SEQ ID NO: 26854 - protein, 8 aa, Dengue virus
EENVEVEI

SEQ ID NO: 26855 - protein, 8 aa, Dengue virus
ENVEVEIW

SEQ ID NO: 26856 - protein, 8 aa, Dengue virus
NVEVEIWT

SEQ ID NO: 26857 - protein, 8 aa, Dengue virus
VEVEIWTK

SEQ ID NO: 26858 - protein, 8 aa, Dengue virus
EVEIWTKE

SEQ ID NO: 26859 - protein, 8 aa, Dengue virus
VEIWTKEG

SEQ ID NO: 26860 - protein, 8 aa, Dengue virus
EIWTKEGE

SEQ ID NO: 26861 - protein, 8 aa, Dengue virus
IWTKEGER

SEQ ID NO: 26862 - protein, 8 aa, Dengue virus
WTKEGERK

SEQ ID NO: 26863 - protein, 8 aa, Dengue virus
TKEGERKK

SEQ ID NO: 26864 - protein, 8 aa, Dengue virus
KEGERKKL

SEQ ID NO: 26865 - protein, 8 aa, Dengue virus
EGERKKLK

SEQ ID NO: 26866 - protein, 8 aa, Dengue virus
GERKKLKP

SEQ ID NO: 26867 - protein, 8 aa, Dengue virus
ERKKLKPR

SEQ ID NO: 26868 - protein, 8 aa, Dengue virus
RKKLKPRW

SEQ ID NO: 26869 - protein, 8 aa, Dengue virus
KKLKPRWL

SEQ ID NO: 26870 - protein, 8 aa, Dengue virus
KLKPRWLD

SEQ ID NO: 26871 - protein, 8 aa, Dengue virus
LKPRWLDA

SEQ ID NO: 26872 - protein, 8 aa, Dengue virus
KPRWLDAR

SEQ ID NO: 26873 - protein, 8 aa, Dengue virus
PRWLDARI

SEQ ID NO: 26874 - protein, 8 aa, Dengue virus
RWLDARIY

SEQ ID NO: 26875 - protein, 8 aa, Dengue virus
WLDARIYS

SEQ ID NO: 26876 - protein, 8 aa, Dengue virus
LDARIYSD

SEQ ID NO: 26877 - protein, 8 aa, Dengue virus
DARIYSDP

SEQ ID NO: 26878 - protein, 8 aa, Dengue virus
ARIYSDPL

SEQ ID NO: 26879 - protein, 8 aa, Dengue virus
RIYSDPLA

SEQ ID NO: 26880 - protein, 8 aa, Dengue virus
IYSDPLAL

SEQ ID NO: 26881 - protein, 8 aa, Dengue virus
YSDPLALK

SEQ ID NO: 26882 - protein, 8 aa, Dengue virus
SDPLALKE

SEQ ID NO: 26883 - protein, 8 aa, Dengue virus
DPLALKEF

SEQ ID NO: 26884 - protein, 8 aa, Dengue virus
PLALKEFK

SEQ ID NO: 26885 - protein, 8 aa, Dengue virus
LALKEFKE

SEQ ID NO: 26886 - protein, 8 aa, Dengue virus
ALKEFKEF

SEQ ID NO: 26887 - protein, 8 aa, Dengue virus
LKEFKEFA

SEQ ID NO: 26888 - protein, 8 aa, Dengue virus
KEFKEFAA

SEQ ID NO: 26889 - protein, 8 aa, Dengue virus
EFKEFAAG

SEQ ID NO: 26890 - protein, 8 aa, Dengue virus
FKEFAAGR

SEQ ID NO: 26891 - protein, 8 aa, Dengue virus
KEFAAGRK

SEQ ID NO: 26892 - protein, 8 aa, Dengue virus
EFAAGRKS

SEQ ID NO: 26893 - protein, 8 aa, Dengue virus
FAAGRKSL

SEQ ID NO: 26894 - protein, 8 aa, Dengue virus
AAGRKSLT

SEQ ID NO: 26895 - protein, 8 aa, Dengue virus
AGRKSLTL

SEQ ID NO: 26896 - protein, 8 aa, Dengue virus
GRKSLTLN

SEQ ID NO: 26897 - protein, 8 aa, Dengue virus
RKSLTLNL

SEQ ID NO: 26898 - protein, 8 aa, Dengue virus
KSLTLNLI

SEQ ID NO: 26899 - protein, 8 aa, Dengue virus
SLTLNLIT

SEQ ID NO: 26900 - protein, 8 aa, Dengue virus
LTLNLITE

SEQ ID NO: 26901 - protein, 8 aa, Dengue virus
TLNLITEM

SEQ ID NO: 26902 - protein, 8 aa, Dengue virus
LNLITEMG

SEQ ID NO: 26903 - protein, 8 aa, Dengue virus
NLITEMGR

SEQ ID NO: 26904 - protein, 8 aa, Dengue virus
LITEMGRL

SEQ ID NO: 26905 - protein, 8 aa, Dengue virus
ITEMGRLP

SEQ ID NO: 26906 - protein, 8 aa, Dengue virus
TEMGRLPT

SEQ ID NO: 26907 - protein, 8 aa, Dengue virus
EMGRLPTF

SEQ ID NO: 26908 - protein, 8 aa, Dengue virus
MGRLPTFM

SEQ ID NO: 26909 - protein, 8 aa, Dengue virus
GRLPTFMT

SEQ ID NO: 26910 - protein, 8 aa, Dengue virus
RLPTFMTQ

SEQ ID NO: 26911 - protein, 8 aa, Dengue virus
LPTFMTQK

SEQ ID NO: 26912 - protein, 8 aa, Dengue virus
PTFMTQKA

SEQ ID NO: 26913 - protein, 8 aa, Dengue virus
TFMTQKAR

SEQ ID NO: 26914 - protein, 8 aa, Dengue virus
FMTQKARN

SEQ ID NO: 26915 - protein, 8 aa, Dengue virus
MTQKARNA

SEQ ID NO: 26916 - protein, 8 aa, Dengue virus
TQKARNAL

SEQ ID NO: 26917 - protein, 8 aa, Dengue virus
QKARNALD

SEQ ID NO: 26918 - protein, 8 aa, Dengue virus
KARNALDN

SEQ ID NO: 26919 - protein, 8 aa, Dengue virus
ARNALDNL

SEQ ID NO: 26920 - protein, 8 aa, Dengue virus
RDALDNLA

SEQ ID NO: 26921 - protein, 8 aa, Dengue virus
DALDNLAV

SEQ ID NO: 26922 - protein, 8 aa, Dengue virus
ALDNLAVL

SEQ ID NO: 26923 - protein, 8 aa, Dengue virus
LDNLAVLH

SEQ ID NO: 26924 - protein, 8 aa, Dengue virus
DNLAVLHT

SEQ ID NO: 26925 - protein, 8 aa, Dengue virus
NLAVLHTA

SEQ ID NO: 26926 - protein, 8 aa, Dengue virus
LAVLHTAE

SEQ ID NO: 26927 - protein, 8 aa, Dengue virus
AVLHTAEA

SEQ ID NO: 26928 - protein, 8 aa, Dengue virus
VLHTAEAG

SEQ ID NO: 26929 - protein, 8 aa, Dengue virus
LHTAEAGG

SEQ ID NO: 26930 - protein, 8 aa, Dengue virus
HTAEAGGR

SEQ ID NO: 26931 - protein, 8 aa, Dengue virus
TAEAGGRA

SEQ ID NO: 26932 - protein, 8 aa, Dengue virus
AEAGGRAY

SEQ ID NO: 26933 - protein, 8 aa, Dengue virus
GGRAYNHA

SEQ ID NO: 26934 - protein, 8 aa, Dengue virus
GRAYNHAL

SEQ ID NO: 26935 - protein, 8 aa, Dengue virus
RAYNHALS

SEQ ID NO: 26936 - protein, 8 aa, Dengue virus
AYNHALSE

SEQ ID NO: 26937 - protein, 8 aa, Dengue virus
YNHALSEL

SEQ ID NO: 26938 - protein, 8 aa, Dengue virus
NHALSELP

SEQ ID NO: 26939 - protein, 8 aa, Dengue virus
HALSELPE

SEQ ID NO: 26940 - protein, 8 aa, Dengue virus
ALSELPET

SEQ ID NO: 26941 - protein, 8 aa, Dengue virus
LSELPETL

SEQ ID NO: 26942 - protein, 8 aa, Dengue virus
SELPETLE

SEQ ID NO: 26943 - protein, 8 aa, Dengue virus
ELPETLET

SEQ ID NO: 26944 - protein, 8 aa, Dengue virus
LPETLETL

SEQ ID NO: 26945 - protein, 8 aa, Dengue virus
PETLETLL

SEQ ID NO: 26946 - protein, 8 aa, Dengue virus
ETLETLLL

SEQ ID NO: 26947 - protein, 8 aa, Dengue virus
TLETLLLL

SEQ ID NO: 26948 - protein, 8 aa, Dengue virus
LETLLLLT

SEQ ID NO: 26949 - protein, 8 aa, Dengue virus
ETLLLLTL

SEQ ID NO: 26950 - protein, 8 aa, Dengue virus
TLLLLTLL

SEQ ID NO: 26951 - protein, 8 aa, Dengue virus
LLLLTLLA

SEQ ID NO: 26952 - protein, 8 aa, Dengue virus
LLLTLLAT

SEQ ID NO: 26953 - protein, 8 aa, Dengue virus
LLTLLATV

SEQ ID NO: 26954 - protein, 8 aa, Dengue virus
LTLLATVT

SEQ ID NO: 26955 - protein, 8 aa, Dengue virus
TLLATVTG

SEQ ID NO: 26956 - protein, 8 aa, Dengue virus
LLATVTGG

SEQ ID NO: 26957 - protein, 8 aa, Dengue virus
LATVTGGI

SEQ ID NO: 26958 - protein, 8 aa, Dengue virus
ATVTGGIF

SEQ ID NO: 26959 - protein, 8 aa, Dengue virus
TVTGGIFL

SEQ ID NO: 26960 - protein, 8 aa, Dengue virus
VTGGIFLF

SEQ ID NO: 26961 - protein, 8 aa, Dengue virus
TGGIFLFL

SEQ ID NO: 26962 - protein, 8 aa, Dengue virus
GGIFLFLM

SEQ ID NO: 26963 - protein, 8 aa, Dengue virus
GIFLFLMS

SEQ ID NO: 26964 - protein, 8 aa, Dengue virus
IFLFLMSG

SEQ ID NO: 26965 - protein, 8 aa, Dengue virus
FLFLMSGK

SEQ ID NO: 26966 - protein, 8 aa, Dengue virus
LFLMSGKG

SEQ ID NO: 26967 - protein, 8 aa, Dengue virus
FLMSGKGI

SEQ ID NO: 26968 - protein, 8 aa, Dengue virus
LMSGKGIG

SEQ ID NO: 26969 - protein, 8 aa, Dengue virus
MSGKGIGK

SEQ ID NO: 26970 - protein, 8 aa, Dengue virus
SGKGIGKM

SEQ ID NO: 26971 - protein, 8 aa, Dengue virus
GKGIGKMT

SEQ ID NO: 26972 - protein, 8 aa, Dengue virus
KGIGKMTL

SEQ ID NO: 26973 - protein, 8 aa, Dengue virus
GIGKMTLG

SEQ ID NO: 26974 - protein, 8 aa, Dengue virus
IGKMTLGM

SEQ ID NO: 26975 - protein, 8 aa, Dengue virus
GKMTLGMC

SEQ ID NO: 26976 - protein, 8 aa, Dengue virus
KMTLGMCC

SEQ ID NO: 26977 - protein, 8 aa, Dengue virus
MTLGMCCI

SEQ ID NO: 26978 - protein, 8 aa, Dengue virus
TLGMCCII

SEQ ID NO: 26979 - protein, 8 aa, Dengue virus
LGMCCIIT

SEQ ID NO: 26980 - protein, 8 aa, Dengue virus
GMCCIITA

SEQ ID NO: 26981 - protein, 8 aa, Dengue virus
MCCIITAS

SEQ ID NO: 26982 - protein, 8 aa, Dengue virus
TASILLWY

SEQ ID NO: 26983 - protein, 8 aa, Dengue virus
ASILLWYA

SEQ ID NO: 26984 - protein, 8 aa, Dengue virus
LLWYAQIQ

SEQ ID NO: 26985 - protein, 8 aa, Dengue virus
LWYAQIQP

SEQ ID NO: 26986 - protein, 8 aa, Dengue virus
WYAQIQPH

SEQ ID NO: 26987 - protein, 8 aa, Dengue virus
YAQIQPHW

SEQ ID NO: 26988 - protein, 8 aa, Dengue virus
AQIQPHWI

SEQ ID NO: 26989 - protein, 8 aa, Dengue virus
QIQPHWIA

SEQ ID NO: 26990 - protein, 8 aa, Dengue virus
IQPHWIAA

SEQ ID NO: 26991 - protein, 8 aa, Dengue virus
QPHWIAAS

SEQ ID NO: 26992 - protein, 8 aa, Dengue virus
PHWIAASI

SEQ ID NO: 26993 - protein, 8 aa, Dengue virus
HWIAASII

SEQ ID NO: 26994 - protein, 8 aa, Dengue virus
WIAASIIL

SEQ ID NO: 26995 - protein, 8 aa, Dengue virus
IAASIILE

SEQ ID NO: 26996 - protein, 8 aa, Dengue virus
AASIILEF

SEQ ID NO: 26997 - protein, 8 aa, Dengue virus
ASIILEFF

SEQ ID NO: 26998 - protein, 8 aa, Dengue virus
SIILEFFL

SEQ ID NO: 26999 - protein, 8 aa, Dengue virus
IILEFFLI

SEQ ID NO: 27000 - protein, 8 aa, Dengue virus
ILEFFLIV

SEQ ID NO: 27001 - protein, 8 aa, Dengue virus
LEFFLIVL

SEQ ID NO: 27002 - protein, 8 aa, Dengue virus
EFFLIVLL

SEQ ID NO: 27003 - protein, 8 aa, Dengue virus
FFLIVLLI

SEQ ID NO: 27004 - protein, 8 aa, Dengue virus
FLIVLLIP

SEQ ID NO: 27005 - protein, 8 aa, Dengue virus
LIVLLIPE

SEQ ID NO: 27006 - protein, 8 aa, Dengue virus
IVLLIPEP

SEQ ID NO: 27007 - protein, 8 aa, Dengue virus
VLLIPEPE

SEQ ID NO: 27008 - protein, 8 aa, Dengue virus
LLIPEPEK

SEQ ID NO: 27009 - protein, 8 aa, Dengue virus
LIPEPEKQ

SEQ ID NO: 27010 - protein, 8 aa, Dengue virus
IPEPEKQR

SEQ ID NO: 27011 - protein, 8 aa, Dengue virus
PEPEKQRT

SEQ ID NO: 27012 - protein, 8 aa, Dengue virus
EPEKQRTP

SEQ ID NO: 27013 - protein, 8 aa, Dengue virus
PEKQRTPQ

SEQ ID NO: 27014 - protein, 8 aa, Dengue virus
EKQRTPQD

SEQ ID NO: 27015 - protein, 8 aa, Dengue virus
KQRTPQDN

SEQ ID NO: 27016 - protein, 8 aa, Dengue virus
QRTPQDNQ

SEQ ID NO: 27017 - protein, 8 aa, Dengue virus
RTPQDNQL

SEQ ID NO: 27018 - protein, 8 aa, Dengue virus
TPQDNQLT

SEQ ID NO: 27019 - protein, 8 aa, Dengue virus
PQDNQLTY

SEQ ID NO: 27020 - protein, 8 aa, Dengue virus
QDNQLTYV

SEQ ID NO: 27021 - protein, 8 aa, Dengue virus
DNQLTYVV

SEQ ID NO: 27022 - protein, 8 aa, Dengue virus
NQLTYVVI

SEQ ID NO: 27023 - protein, 8 aa, Dengue virus
QLTYVVIA

SEQ ID NO: 27024 - protein, 8 aa, Dengue virus
LTYVVIAI

SEQ ID NO: 27025 - protein, 8 aa, Dengue virus
TYVVIAIL

SEQ ID NO: 27026 - protein, 8 aa, Dengue virus
YVVIAILT

SEQ ID NO: 27027 - protein, 8 aa, Dengue virus
VVIAILTV

SEQ ID NO: 27028 - protein, 8 aa, Dengue virus
VIAILTVV

SEQ ID NO: 27029 - protein, 8 aa, Dengue virus
IAILTVVA

SEQ ID NO: 27030 - protein, 8 aa, Dengue virus
AILTVVAA

SEQ ID NO: 27031 - protein, 8 aa, Dengue virus
ILTVVAAT

SEQ ID NO: 27032 - protein, 8 aa, Dengue virus
LTVVAATM

SEQ ID NO: 27033 - protein, 8 aa, Dengue virus
TVVAATMA

SEQ ID NO: 27034 - protein, 8 aa, Dengue virus
VVAATMAN

SEQ ID NO: 27035 - protein, 8 aa, Dengue virus
VAATMANE

SEQ ID NO: 27036 - protein, 8 aa, Dengue virus
AATMANEM

SEQ ID NO: 27037 - protein, 8 aa, Dengue virus
ATMANEMG

SEQ ID NO: 27038 - protein, 8 aa, Dengue virus
TMANEMGF

SEQ ID NO: 27039 - protein, 8 aa, Dengue virus
MANEMGFL

SEQ ID NO: 27040 - protein, 8 aa, Dengue virus
ANEMGFLE

SEQ ID NO: 27041 - protein, 8 aa, Dengue virus
NEMGFLEK

SEQ ID NO: 27042 - protein, 8 aa, Dengue virus
EMGFLEKT

SEQ ID NO: 27043 - protein, 8 aa, Dengue virus
MGFLEKTK

SEQ ID NO: 27044 - protein, 8 aa, Dengue virus
GFLEKTKK

SEQ ID NO: 27045 - protein, 8 aa, Dengue virus
FLEKTKKD

SEQ ID NO: 27046 - protein, 8 aa, Dengue virus
LEKTKKDL

SEQ ID NO: 27047 - protein, 8 aa, Dengue virus
EKTKKDLG

SEQ ID NO: 27048 - protein, 8 aa, Dengue virus
KTKKDLGL

SEQ ID NO: 27049 - protein, 8 aa, Dengue virus
TKKDLGLG

SEQ ID NO: 27050 - protein, 8 aa, Dengue virus
ESESNILD

SEQ ID NO: 27051 - protein, 8 aa, Dengue virus
PESNILDI

SEQ ID NO: 27052 - protein, 8 aa, Dengue virus
ESNILDID

SEQ ID NO: 27053 - protein, 8 aa, Dengue virus
SNILDIDL

SEQ ID NO: 27054 - protein, 8 aa, Dengue virus
NILDIDLR

SEQ ID NO: 27055 - protein, 8 aa, Dengue virus
ILDIDLRP

SEQ ID NO: 27056 - protein, 8 aa, Dengue virus
LDIDLRPA

SEQ ID NO: 27057 - protein, 8 aa, Dengue virus
DIDLRPAS

SEQ ID NO: 27058 - protein, 8 aa, Dengue virus
IDLRPASA

SEQ ID NO: 27059 - protein, 8 aa, Dengue virus
DLRPASAW

SEQ ID NO: 27060 - protein, 8 aa, Dengue virus
LRPASAWT

SEQ ID NO: 27061 - protein, 8 aa, Dengue virus
RPASAWTL

SEQ ID NO: 27062 - protein, 8 aa, Dengue virus
PASAWTLY

SEQ ID NO: 27063 - protein, 8 aa, Dengue virus
ASAWTLYA

SEQ ID NO: 27064 - protein, 8 aa, Dengue virus
SAWTLYAV

SEQ ID NO: 27065 - protein, 8 aa, Dengue virus
AWTLYAVA

SEQ ID NO: 27066 - protein, 8 aa, Dengue virus
WTLYAVAT

SEQ ID NO: 27067 - protein, 8 aa, Dengue virus
TLYAVATT

SEQ ID NO: 27068 - protein, 8 aa, Dengue virus
LYAVATTF

SEQ ID NO: 27069 - protein, 8 aa, Dengue virus
YAVATTFV

SEQ ID NO: 27070 - protein, 8 aa, Dengue virus
AVATTFVT

SEQ ID NO: 27071 - protein, 8 aa, Dengue virus
VATTFVTP

SEQ ID NO: 27072 - protein, 8 aa, Dengue virus
ATTFVTPM

SEQ ID NO: 27073 - protein, 8 aa, Dengue virus
TTFVTPML

SEQ ID NO: 27074 - protein, 8 aa, Dengue virus
TFVTPMLR

SEQ ID NO: 27075 - protein, 8 aa, Dengue virus
FVTPMLRH

SEQ ID NO: 27076 - protein, 8 aa, Dengue virus
VTPMLRHS

SEQ ID NO: 27077 - protein, 8 aa, Dengue virus
TPMLRHSI

SEQ ID NO: 27078 - protein, 8 aa, Dengue virus
PMLRHSIE

SEQ ID NO: 27079 - protein, 8 aa, Dengue virus
MLRHSIEN

SEQ ID NO: 27080 - protein, 8 aa, Dengue virus
LRHSIENS

SEQ ID NO: 27081 - protein, 8 aa, Dengue virus
RHSIENSS

SEQ ID NO: 27082 - protein, 8 aa, Dengue virus
HSIENSSV

SEQ ID NO: 27083 - protein, 8 aa, Dengue virus
SIENSSVN

SEQ ID NO: 27084 - protein, 8 aa, Dengue virus
IENSSVNV

SEQ ID NO: 27085 - protein, 8 aa, Dengue virus
ENSSVNVS

SEQ ID NO: 27086 - protein, 8 aa, Dengue virus
NSSVNVSL

SEQ ID NO: 27087 - protein, 8 aa, Dengue virus
SSVNVSLT

SEQ ID NO: 27088 - protein, 8 aa, Dengue virus
SVNVSLTA

SEQ ID NO: 27089 - protein, 8 aa, Dengue virus
VNVSLTAI

SEQ ID NO: 27090 - protein, 8 aa, Dengue virus
NVSLTAIA

SEQ ID NO: 27091 - protein, 8 aa, Dengue virus
VSLTAIAN

SEQ ID NO: 27092 - protein, 8 aa, Dengue virus
SLTAIANQ

SEQ ID NO: 27093 - protein, 8 aa, Dengue virus
LTAIANQA

SEQ ID NO: 27094 - protein, 8 aa, Dengue virus
TAIANQAT

SEQ ID NO: 27095 - protein, 8 aa, Dengue virus
AIANQATV

SEQ ID NO: 27096 - protein, 8 aa, Dengue virus
IANQATVL

SEQ ID NO: 27097 - protein, 8 aa, Dengue virus
ANQATVLM

SEQ ID NO: 27098 - protein, 8 aa, Dengue virus
NQATVLMG

SEQ ID NO: 27099 - protein, 8 aa, Dengue virus
QATVLMGL

SEQ ID NO: 27100 - protein, 8 aa, Dengue virus
ATVLMGLG

SEQ ID NO: 27101 - protein, 8 aa, Dengue virus
TVLMGLGK

SEQ ID NO: 27102 - protein, 8 aa, Dengue virus
VLMGLGKG

SEQ ID NO: 27103 - protein, 8 aa, Dengue virus
LMGLGKGW

SEQ ID NO: 27104 - protein, 8 aa, Dengue virus
MGLGKGWP

SEQ ID NO: 27105 - protein, 8 aa, Dengue virus
GLGKGWPL

SEQ ID NO: 27106 - protein, 8 aa, Dengue virus
LGKGWPLS

SEQ ID NO: 27107 - protein, 8 aa, Dengue virus
GKGWPLSK

SEQ ID NO: 27108 - protein, 8 aa, Dengue virus
KGWPLSKM

SEQ ID NO: 27109 - protein, 8 aa, Dengue virus
GWPLSKMD

SEQ ID NO: 27110 - protein, 8 aa, Dengue virus
WPLSKMDI

SEQ ID NO: 27111 - protein, 8 aa, Dengue virus
PLSKMDIG

SEQ ID NO: 27112 - protein, 8 aa, Dengue virus
LSKMDIGV

SEQ ID NO: 27113 - protein, 8 aa, Dengue virus
SKMDIGVP

SEQ ID NO: 27114 - protein, 8 aa, Dengue virus
KMDIGVPL

SEQ ID NO: 27115 - protein, 8 aa, Dengue virus
MDIGVPLL

SEQ ID NO: 27116 - protein, 8 aa, Dengue virus
DIGVPLLA

SEQ ID NO: 27117 - protein, 8 aa, Dengue virus
IGVPLLAI

SEQ ID NO: 27118 - protein, 8 aa, Dengue virus
GVPLLAIG

SEQ ID NO: 27119 - protein, 8 aa, Dengue virus
VPLLAIGC

SEQ ID NO: 27120 - protein, 8 aa, Dengue virus
PLLAIGCY

SEQ ID NO: 27121 - protein, 8 aa, Dengue virus
LLAIGCYS

SEQ ID NO: 27122 - protein, 8 aa, Dengue virus
LAIGCYSQ

SEQ ID NO: 27123 - protein, 8 aa, Dengue virus
AIGCYSQV

SEQ ID NO: 27124 - protein, 8 aa, Dengue virus
IGCYSQVN

SEQ ID NO: 27125 - protein, 8 aa, Dengue virus
GCYSQVNP

SEQ ID NO: 27126 - protein, 8 aa, Dengue virus
CYSQVNPI

SEQ ID NO: 27127 - protein, 8 aa, Dengue virus
YSQVNPIT

SEQ ID NO: 27128 - protein, 8 aa, Dengue virus
SQVNPITL

SEQ ID NO: 27129 - protein, 8 aa, Dengue virus
QVNPITLT

SEQ ID NO: 27130 - protein, 8 aa, Dengue virus
VNPITLTA

SEQ ID NO: 27131 - protein, 8 aa, Dengue virus
NPITLTAA

SEQ ID NO: 27132 - protein, 8 aa, Dengue virus
PITLTAAL

SEQ ID NO: 27133 - protein, 8 aa, Dengue virus
ITLTAALL

SEQ ID NO: 27134 - protein, 8 aa, Dengue virus
TLTAALLL

SEQ ID NO: 27135 - protein, 8 aa, Dengue virus
LTAALLLL

SEQ ID NO: 27136 - protein, 8 aa, Dengue virus
TAALLLLV

SEQ ID NO: 27137 - protein, 8 aa, Dengue virus
AALLLLVA

SEQ ID NO: 27138 - protein, 8 aa, Dengue virus
ALLLLVAH

SEQ ID NO: 27139 - protein, 8 aa, Dengue virus
LLVAHYAI

SEQ ID NO: 27140 - protein, 8 aa, Dengue virus
LVAHYAII

SEQ ID NO: 27141 - protein, 8 aa, Dengue virus
VAHYAIIG

SEQ ID NO: 27142 - protein, 8 aa, Dengue virus
AHYAIIGP

SEQ ID NO: 27143 - protein, 8 aa, Dengue virus
HYAIIGPG

SEQ ID NO: 27144 - protein, 8 aa, Dengue virus
YAIIGPGL

SEQ ID NO: 27145 - protein, 8 aa, Dengue virus
AIIGPGLQ

SEQ ID NO: 27146 - protein, 8 aa, Dengue virus
IIGPGLQA

SEQ ID NO: 27147 - protein, 8 aa, Dengue virus
IGPGLQAK

SEQ ID NO: 27148 - protein, 8 aa, Dengue virus
GPGLQAKA

SEQ ID NO: 27149 - protein, 8 aa, Dengue virus
PGLQAKAT

SEQ ID NO: 27150 - protein, 8 aa, Dengue virus
GLQAKATR

SEQ ID NO: 27151 - protein, 8 aa, Dengue virus
LQAKATRE

SEQ ID NO: 27152 - protein, 8 aa, Dengue virus
QAKATREA

SEQ ID NO: 27153 - protein, 8 aa, Dengue virus
AKATREAQ

SEQ ID NO: 27154 - protein, 8 aa, Dengue virus
KATREAQK

SEQ ID NO: 27155 - protein, 8 aa, Dengue virus
ATREAQKR

SEQ ID NO: 27156 - protein, 8 aa, Dengue virus
TREAQKRA

SEQ ID NO: 27157 - protein, 8 aa, Dengue virus
REAQKRAA

SEQ ID NO: 27158 - protein, 8 aa, Dengue virus
EAQKRAAA

SEQ ID NO: 27159 - protein, 8 aa, Dengue virus
AQKRAAAG

SEQ ID NO: 27160 - protein, 8 aa, Dengue virus
QKRAAAGI

SEQ ID NO: 27161 - protein, 8 aa, Dengue virus
KRAAAGIM

SEQ ID NO: 27162 - protein, 8 aa, Dengue virus
RAAAGIMK

SEQ ID NO: 27163 - protein, 8 aa, Dengue virus
AAAGIMKN

SEQ ID NO: 27164 - protein, 8 aa, Dengue virus
AAGIMKNP

SEQ ID NO: 27165 - protein, 8 aa, Dengue virus
AGIMKNPT

SEQ ID NO: 27166 - protein, 8 aa, Dengue virus
GIMKNPTV

SEQ ID NO: 27167 - protein, 8 aa, Dengue virus
IMKNPTVD

SEQ ID NO: 27168 - protein, 8 aa, Dengue virus
MKNPTVDG

SEQ ID NO: 27169 - protein, 8 aa, Dengue virus
KNPTVDGI

SEQ ID NO: 27170 - protein, 8 aa, Dengue virus
NPTVDGIT

SEQ ID NO: 27171 - protein, 8 aa, Dengue virus
PTVDGITV

SEQ ID NO: 27172 - protein, 8 aa, Dengue virus
TVDGITVI

SEQ ID NO: 27173 - protein, 8 aa, Dengue virus
VDGITVID

SEQ ID NO: 27174 - protein, 8 aa, Dengue virus
DGITVIDL

SEQ ID NO: 27175 - protein, 8 aa, Dengue virus
GITVIDLE

SEQ ID NO: 27176 - protein, 8 aa, Dengue virus
ITVIDLEP

SEQ ID NO: 27177 - protein, 8 aa, Dengue virus
TVIDLDPI

SEQ ID NO: 27178 - protein, 8 aa, Dengue virus
VIDLDPIP

SEQ ID NO: 27179 - protein, 8 aa, Dengue virus
IDLDPIPY

SEQ ID NO: 27180 - protein, 8 aa, Dengue virus
DLEPIPYD

SEQ ID NO: 27181 - protein, 8 aa, Dengue virus
LEPIPYDP

SEQ ID NO: 27182 - protein, 8 aa, Dengue virus
EPIPYDPK

SEQ ID NO: 27183 - protein, 8 aa, Dengue virus
PIPYDPKF

SEQ ID NO: 27184 - protein, 8 aa, Dengue virus
IPYDPKFE

SEQ ID NO: 27185 - protein, 8 aa, Dengue virus
PYDPKFEK

SEQ ID NO: 27186 - protein, 8 aa, Dengue virus
YDPKFEKQ

SEQ ID NO: 27187 - protein, 8 aa, Dengue virus
DPKFEKQL

SEQ ID NO: 27188 - protein, 8 aa, Dengue virus
PKFEKQLG

SEQ ID NO: 27189 - protein, 8 aa, Dengue virus
KFEKQLGQ

SEQ ID NO: 27190 - protein, 8 aa, Dengue virus
FEKQLGQV

SEQ ID NO: 27191 - protein, 8 aa, Dengue virus
EKQLGQVM

SEQ ID NO: 27192 - protein, 8 aa, Dengue virus
KQLGQVML

SEQ ID NO: 27193 - protein, 8 aa, Dengue virus
QLGQVMLL

SEQ ID NO: 27194 - protein, 8 aa, Dengue virus
LGQVMLLI

SEQ ID NO: 27195 - protein, 8 aa, Dengue virus
GQVMLLIL

SEQ ID NO: 27196 - protein, 8 aa, Dengue virus
QVMLLILC

SEQ ID NO: 27197 - protein, 8 aa, Dengue virus
VMLLILCV

SEQ ID NO: 27198 - protein, 8 aa, Dengue virus
MLLILCVT

SEQ ID NO: 27199 - protein, 8 aa, Dengue virus
LLILCVTQ

SEQ ID NO: 27200 - protein, 8 aa, Dengue virus
LILCVTQV

SEQ ID NO: 27201 - protein, 8 aa, Dengue virus
ILCVTQVL

SEQ ID NO: 27202 - protein, 8 aa, Dengue virus
LCVTQVLM

SEQ ID NO: 27203 - protein, 8 aa, Dengue virus
CVTQVLMM

SEQ ID NO: 27204 - protein, 8 aa, Dengue virus
VTQVLMMR

SEQ ID NO: 27205 - protein, 8 aa, Dengue virus
TQVLMMRT

SEQ ID NO: 27206 - protein, 8 aa, Dengue virus
QVLMMRTT

SEQ ID NO: 27207 - protein, 8 aa, Dengue virus
VLMMRTTW

SEQ ID NO: 27208 - protein, 8 aa, Dengue virus
LMMRTTWA

SEQ ID NO: 27209 - protein, 8 aa, Dengue virus
MMRTTWAL

SEQ ID NO: 27210 - protein, 8 aa, Dengue virus
MRTTWALC

SEQ ID NO: 27211 - protein, 8 aa, Dengue virus
RTTWALCE

SEQ ID NO: 27212 - protein, 8 aa, Dengue virus
TTWALCEA

SEQ ID NO: 27213 - protein, 8 aa, Dengue virus
TWALCEAL

SEQ ID NO: 27214 - protein, 8 aa, Dengue virus
WALCEALT

SEQ ID NO: 27215 - protein, 8 aa, Dengue virus
ALCEALTL

SEQ ID NO: 27216 - protein, 8 aa, Dengue virus
LCEALTLA

SEQ ID NO: 27217 - protein, 8 aa, Dengue virus
CEALTLAT

SEQ ID NO: 27218 - protein, 8 aa, Dengue virus
EALTLATG

SEQ ID NO: 27219 - protein, 8 aa, Dengue virus
ALTLATGP

SEQ ID NO: 27220 - protein, 8 aa, Dengue virus
LTLATGPI

SEQ ID NO: 27221 - protein, 8 aa, Dengue virus
TLATGPIS

SEQ ID NO: 27222 - protein, 8 aa, Dengue virus
LATGPIST

SEQ ID NO: 27223 - protein, 8 aa, Dengue virus
ATGPISTL

SEQ ID NO: 27224 - protein, 8 aa, Dengue virus
TGPISTLW

SEQ ID NO: 27225 - protein, 8 aa, Dengue virus
GPISTLWE

SEQ ID NO: 27226 - protein, 8 aa, Dengue virus
PISTLWEG

SEQ ID NO: 27227 - protein, 8 aa, Dengue virus
ISTLWEGN

SEQ ID NO: 27228 - protein, 8 aa, Dengue virus
STLWEGNP

SEQ ID NO: 27229 - protein, 8 aa, Dengue virus
TLWEGNPG

SEQ ID NO: 27230 - protein, 8 aa, Dengue virus
LWEGNPGR

SEQ ID NO: 27231 - protein, 8 aa, Dengue virus
WEGNPGRF

SEQ ID NO: 27232 - protein, 8 aa, Dengue virus
EGNPGRFW

SEQ ID NO: 27233 - protein, 8 aa, Dengue virus
GNPGRFWN

SEQ ID NO: 27234 - protein, 8 aa, Dengue virus
NPGRFWNT

SEQ ID NO: 27235 - protein, 8 aa, Dengue virus
PGRFWNTT

SEQ ID NO: 27236 - protein, 8 aa, Dengue virus
GRFWNTTI

SEQ ID NO: 27237 - protein, 8 aa, Dengue virus
RFWNTTIA

SEQ ID NO: 27238 - protein, 8 aa, Dengue virus
FWNTTIAV

SEQ ID NO: 27239 - protein, 8 aa, Dengue virus
WNTTIAVS

SEQ ID NO: 27240 - protein, 8 aa, Dengue virus
NTTIAVSM

SEQ ID NO: 27241 - protein, 8 aa, Dengue virus
TTIAVSMA

SEQ ID NO: 27242 - protein, 8 aa, Dengue virus
TIAVSMAN

SEQ ID NO: 27243 - protein, 8 aa, Dengue virus
IAVSMANI

SEQ ID NO: 27244 - protein, 8 aa, Dengue virus
AVSMANIF

SEQ ID NO: 27245 - protein, 8 aa, Dengue virus
VSMANIFR

SEQ ID NO: 27246 - protein, 8 aa, Dengue virus
SMANIFRG

SEQ ID NO: 27247 - protein, 8 aa, Dengue virus
MANIFRGS

SEQ ID NO: 27248 - protein, 8 aa, Dengue virus
ANIFRGSY

SEQ ID NO: 27249 - protein, 8 aa, Dengue virus
NIFRGSYL

SEQ ID NO: 27250 - protein, 8 aa, Dengue virus
IFRGSYLA

SEQ ID NO: 27251 - protein, 8 aa, Dengue virus
FRGSYLAG

SEQ ID NO: 27252 - protein, 8 aa, Dengue virus
RGSYLAGA

SEQ ID NO: 27253 - protein, 8 aa, Dengue virus
GSYLAGAG

SEQ ID NO: 27254 - protein, 8 aa, Dengue virus
SYLAGAGL

SEQ ID NO: 27255 - protein, 8 aa, Dengue virus
YLAGAGLL

SEQ ID NO: 27256 - protein, 8 aa, Dengue virus
LAGAGLLF

SEQ ID NO: 27257 - protein, 8 aa, Dengue virus
AGAGLLFS

SEQ ID NO: 27258 - protein, 8 aa, Dengue virus
GAGLLFSI

SEQ ID NO: 27259 - protein, 8 aa, Dengue virus
AGLLFSIM

SEQ ID NO: 27260 - protein, 8 aa, Dengue virus
GLLFSIMK

SEQ ID NO: 27261 - protein, 8 aa, Dengue virus
LLFSIMKN

SEQ ID NO: 27262 - protein, 8 aa, Dengue virus
LFSIMKNT

SEQ ID NO: 27263 - protein, 8 aa, Dengue virus
FSIMKNTT

SEQ ID NO: 27264 - protein, 8 aa, Dengue virus
SIMKNTTN

SEQ ID NO: 27265 - protein, 8 aa, Dengue virus
RRGTGNIG

SEQ ID NO: 27266 - protein, 8 aa, Dengue virus
RGTGNIGE

SEQ ID NO: 27267 - protein, 8 aa, Dengue virus
GTGNIGET

SEQ ID NO: 27268 - protein, 8 aa, Dengue virus
TGNIGETL

SEQ ID NO: 27269 - protein, 8 aa, Dengue virus
GNIGETLG

SEQ ID NO: 27270 - protein, 8 aa, Dengue virus
NIGETLGE

SEQ ID NO: 27271 - protein, 8 aa, Dengue virus
IGETLGEK

SEQ ID NO: 27272 - protein, 8 aa, Dengue virus
GETLGEKW

SEQ ID NO: 27273 - protein, 8 aa, Dengue virus
ETLGEKWK

SEQ ID NO: 27274 - protein, 8 aa, Dengue virus
TLGEKWKS

SEQ ID NO: 27275 - protein, 8 aa, Dengue virus
LGEKWKSR

SEQ ID NO: 27276 - protein, 8 aa, Dengue virus
GEKWKSRL

SEQ ID NO: 27277 - protein, 8 aa, Dengue virus
EKWKSRLN

SEQ ID NO: 27278 - protein, 8 aa, Dengue virus
KWKSRLNA

SEQ ID NO: 27279 - protein, 8 aa, Dengue virus
WKSRLNAL

SEQ ID NO: 27280 - protein, 8 aa, Dengue virus
KSRLNALG

SEQ ID NO: 27281 - protein, 8 aa, Dengue virus
RLNALGKS

SEQ ID NO: 27282 - protein, 8 aa, Dengue virus
LNALGKSE

SEQ ID NO: 27283 - protein, 8 aa, Dengue virus
NALGKSEF

SEQ ID NO: 27284 - protein, 8 aa, Dengue virus
ALGKSEFQ

SEQ ID NO: 27285 - protein, 8 aa, Dengue virus
LGKSEFQI

SEQ ID NO: 27286 - protein, 8 aa, Dengue virus
GKSEFQIY

SEQ ID NO: 27287 - protein, 8 aa, Dengue virus
KSEFQIYK

SEQ ID NO: 27288 - protein, 8 aa, Dengue virus
SEFQIYKK

SEQ ID NO: 27289 - protein, 8 aa, Dengue virus
EFQIYKKS

SEQ ID NO: 27290 - protein, 8 aa, Dengue virus
FQIYKKSG

SEQ ID NO: 27291 - protein, 8 aa, Dengue virus
QIYKKSGI

SEQ ID NO: 27292 - protein, 8 aa, Dengue virus
IYKKSGIQ

SEQ ID NO: 27293 - protein, 8 aa, Dengue virus
YKKSGIQE

SEQ ID NO: 27294 - protein, 8 aa, Dengue virus
KKSGIQEV

SEQ ID NO: 27295 - protein, 8 aa, Dengue virus
KSGIQEVD

SEQ ID NO: 27296 - protein, 8 aa, Dengue virus
SGIQEVDR

SEQ ID NO: 27297 - protein, 8 aa, Dengue virus
GIQEVDRT

SEQ ID NO: 27298 - protein, 8 aa, Dengue virus
IQEVDRTL

SEQ ID NO: 27299 - protein, 8 aa, Dengue virus
QEVDRTLA

SEQ ID NO: 27300 - protein, 8 aa, Dengue virus
EVDRTLAK

SEQ ID NO: 27301 - protein, 8 aa, Dengue virus
VDRTLAKE

SEQ ID NO: 27302 - protein, 8 aa, Dengue virus
DRTLAKEG

SEQ ID NO: 27303 - protein, 8 aa, Dengue virus
RTLAKEGI

SEQ ID NO: 27304 - protein, 8 aa, Dengue virus
TLAKEGIK

SEQ ID NO: 27305 - protein, 8 aa, Dengue virus
LAKEGIKR

SEQ ID NO: 27306 - protein, 8 aa, Dengue virus
AKEGIKRG

SEQ ID NO: 27307 - protein, 8 aa, Dengue virus
KEGIKRGE

SEQ ID NO: 27308 - protein, 8 aa, Dengue virus
EGIKRGET

SEQ ID NO: 27309 - protein, 8 aa, Dengue virus
GIKRGETD

SEQ ID NO: 27310 - protein, 8 aa, Dengue virus
IKRGETDH

SEQ ID NO: 27311 - protein, 8 aa, Dengue virus
KRGETDHH

SEQ ID NO: 27312 - protein, 8 aa, Dengue virus
RGETDHHA

SEQ ID NO: 27313 - protein, 8 aa, Dengue virus
GETDHHAV

SEQ ID NO: 27314 - protein, 8 aa, Dengue virus
ETDHHAVS

SEQ ID NO: 27315 - protein, 8 aa, Dengue virus
TDHHAVSR

SEQ ID NO: 27316 - protein, 8 aa, Dengue virus
DHHAVSRG

SEQ ID NO: 27317 - protein, 8 aa, Dengue virus
HHAVSRGS

SEQ ID NO: 27318 - protein, 8 aa, Dengue virus
HAVSRGSA

SEQ ID NO: 27319 - protein, 8 aa, Dengue virus
AVSRGSAK

SEQ ID NO: 27320 - protein, 8 aa, Dengue virus
VSRGSAKL

SEQ ID NO: 27321 - protein, 8 aa, Dengue virus
SRGSAKLR

SEQ ID NO: 27322 - protein, 8 aa, Dengue virus
RGSAKLRW

SEQ ID NO: 27323 - protein, 8 aa, Dengue virus
GSAKLRWF

SEQ ID NO: 27324 - protein, 8 aa, Dengue virus
SAKLRWFV

SEQ ID NO: 27325 - protein, 8 aa, Dengue virus
AKLRWFVE

SEQ ID NO: 27326 - protein, 8 aa, Dengue virus
KLRWFVER

SEQ ID NO: 27327 - protein, 8 aa, Dengue virus
LRWFVERN

SEQ ID NO: 27328 - protein, 8 aa, Dengue virus
RWFVERNM

SEQ ID NO: 27329 - protein, 8 aa, Dengue virus
WFVERNMV

SEQ ID NO: 27330 - protein, 8 aa, Dengue virus
FVERNMVT

SEQ ID NO: 27331 - protein, 8 aa, Dengue virus
VERNMVTP

SEQ ID NO: 27332 - protein, 8 aa, Dengue virus
ERNMVTPE

SEQ ID NO: 27333 - protein, 8 aa, Dengue virus
RNMVTPEG

SEQ ID NO: 27334 - protein, 8 aa, Dengue virus
NMVTPEGK

SEQ ID NO: 27335 - protein, 8 aa, Dengue virus
MVTPEGKV

SEQ ID NO: 27336 - protein, 8 aa, Dengue virus
VTPEGKVV

SEQ ID NO: 27337 - protein, 8 aa, Dengue virus
TPEGKVVD

SEQ ID NO: 27338 - protein, 8 aa, Dengue virus
PEGKVVDL

SEQ ID NO: 27339 - protein, 8 aa, Dengue virus
EGKVVDLG

SEQ ID NO: 27340 - protein, 8 aa, Dengue virus
GKVVDLGC

SEQ ID NO: 27341 - protein, 8 aa, Dengue virus
KVVDLGCG

SEQ ID NO: 27342 - protein, 8 aa, Dengue virus
VVDLGCGR

SEQ ID NO: 27343 - protein, 8 aa, Dengue virus
VDLGCGRG

SEQ ID NO: 27344 - protein, 8 aa, Dengue virus
DLGCGRGG

SEQ ID NO: 27345 - protein, 8 aa, Dengue virus
LGCGRGGW

SEQ ID NO: 27346 - protein, 8 aa, Dengue virus
GCGRGGWS

SEQ ID NO: 27347 - protein, 8 aa, Dengue virus
CGRGGWSY

SEQ ID NO: 27348 - protein, 8 aa, Dengue virus
GRGGWSYY

SEQ ID NO: 27349 - protein, 8 aa, Dengue virus
RGGWSYYC

SEQ ID NO: 27350 - protein, 8 aa, Dengue virus
GGWSYYCG

SEQ ID NO: 27351 - protein, 8 aa, Dengue virus
GWSYYCGG

SEQ ID NO: 27352 - protein, 8 aa, Dengue virus
WSYYCGGL

SEQ ID NO: 27353 - protein, 8 aa, Dengue virus
SYYCGGLK

SEQ ID NO: 27354 - protein, 8 aa, Dengue virus
YYCGGLKN

SEQ ID NO: 27355 - protein, 8 aa, Dengue virus
YCGGLKNV

SEQ ID NO: 27356 - protein, 8 aa, Dengue virus
CGGLKNVR

SEQ ID NO: 27357 - protein, 8 aa, Dengue virus
GGLKNVRE

SEQ ID NO: 27358 - protein, 8 aa, Dengue virus
GLKNVREV

SEQ ID NO: 27359 - protein, 8 aa, Dengue virus
LKNVREVK

SEQ ID NO: 27360 - protein, 8 aa, Dengue virus
KNVREVKG

SEQ ID NO: 27361 - protein, 8 aa, Dengue virus
NVREVKGL

SEQ ID NO: 27362 - protein, 8 aa, Dengue virus
VREVKGLT

SEQ ID NO: 27363 - protein, 8 aa, Dengue virus
REVKGLTK

SEQ ID NO: 27364 - protein, 8 aa, Dengue virus
EVKGLTKG

SEQ ID NO: 27365 - protein, 8 aa, Dengue virus
VKGLTKGG

SEQ ID NO: 27366 - protein, 8 aa, Dengue virus
KGLTKGGP

SEQ ID NO: 27367 - protein, 8 aa, Dengue virus
GLTKGGPG

SEQ ID NO: 27368 - protein, 8 aa, Dengue virus
LTKGGPGH

SEQ ID NO: 27369 - protein, 8 aa, Dengue virus
TKGGPGHE

SEQ ID NO: 27370 - protein, 8 aa, Dengue virus
KGGPGHEE

SEQ ID NO: 27371 - protein, 8 aa, Dengue virus
GGPGHEEP

SEQ ID NO: 27372 - protein, 8 aa, Dengue virus
GPGHEEPI

SEQ ID NO: 27373 - protein, 8 aa, Dengue virus
PGHEEPIP

SEQ ID NO: 27374 - protein, 8 aa, Dengue virus
GHEEPIPM

SEQ ID NO: 27375 - protein, 8 aa, Dengue virus
HEEPIPMS

SEQ ID NO: 27376 - protein, 8 aa, Dengue virus
EEPIPMST

SEQ ID NO: 27377 - protein, 8 aa, Dengue virus
EPIPMSTY

SEQ ID NO: 27378 - protein, 8 aa, Dengue virus
PIPMSTYG

SEQ ID NO: 27379 - protein, 8 aa, Dengue virus
IPMSTYGW

SEQ ID NO: 27380 - protein, 8 aa, Dengue virus
PMSTYGWN

SEQ ID NO: 27381 - protein, 8 aa, Dengue virus
MSTYGWNL

SEQ ID NO: 27382 - protein, 8 aa, Dengue virus
STYGWNLV

SEQ ID NO: 27383 - protein, 8 aa, Dengue virus
TYGWNLVR

SEQ ID NO: 27384 - protein, 8 aa, Dengue virus
YGWNLVRL

SEQ ID NO: 27385 - protein, 8 aa, Dengue virus
GWNLVRLQ

SEQ ID NO: 27386 - protein, 8 aa, Dengue virus
WNLVRLQS

SEQ ID NO: 27387 - protein, 8 aa, Dengue virus
NLVRLQSG

SEQ ID NO: 27388 - protein, 8 aa, Dengue virus
LVRLQSGV

SEQ ID NO: 27389 - protein, 8 aa, Dengue virus
VRLQSGVD

SEQ ID NO: 27390 - protein, 8 aa, Dengue virus
RLQSGVDV

SEQ ID NO: 27391 - protein, 8 aa, Dengue virus
LQSGVDVF

SEQ ID NO: 27392 - protein, 8 aa, Dengue virus
QSGVDVFF

SEQ ID NO: 27393 - protein, 8 aa, Dengue virus
SGVDVFFT

SEQ ID NO: 27394 - protein, 8 aa, Dengue virus
GVDVFFTP

SEQ ID NO: 27395 - protein, 8 aa, Dengue virus
VDVFFTPP

SEQ ID NO: 27396 - protein, 8 aa, Dengue virus
DVFFTPPE

SEQ ID NO: 27397 - protein, 8 aa, Dengue virus
VFFTPPEK

SEQ ID NO: 27398 - protein, 8 aa, Dengue virus
FFTPPEKC

SEQ ID NO: 27399 - protein, 8 aa, Dengue virus
FTPPEKCD

SEQ ID NO: 27400 - protein, 8 aa, Dengue virus
TPPEKCDT

SEQ ID NO: 27401 - protein, 8 aa, Dengue virus
PPEKCDTL

SEQ ID NO: 27402 - protein, 8 aa, Dengue virus
PEKCDTLL

SEQ ID NO: 27403 - protein, 8 aa, Dengue virus
EKCDTLLC

SEQ ID NO: 27404 - protein, 8 aa, Dengue virus
KCDTLLCD

SEQ ID NO: 27405 - protein, 8 aa, Dengue virus
CDTLLCDI

SEQ ID NO: 27406 - protein, 8 aa, Dengue virus
DTLLCDIG

SEQ ID NO: 27407 - protein, 8 aa, Dengue virus
TLLCDIGE

SEQ ID NO: 27408 - protein, 8 aa, Dengue virus
LLCDIGES

SEQ ID NO: 27409 - protein, 8 aa, Dengue virus
LCDIGESS

SEQ ID NO: 27410 - protein, 8 aa, Dengue virus
CDIGESSP

SEQ ID NO: 27411 - protein, 8 aa, Dengue virus
DIGESSPN

SEQ ID NO: 27412 - protein, 8 aa, Dengue virus
IGESSPNP

SEQ ID NO: 27413 - protein, 8 aa, Dengue virus
GESSPNPT

SEQ ID NO: 27414 - protein, 8 aa, Dengue virus
ESSPNPTI

SEQ ID NO: 27415 - protein, 8 aa, Dengue virus
SSPNPTIE

SEQ ID NO: 27416 - protein, 8 aa, Dengue virus
SPNPTIEA

SEQ ID NO: 27417 - protein, 8 aa, Dengue virus
PNPTIEAG

SEQ ID NO: 27418 - protein, 8 aa, Dengue virus
NPTIEAGR

SEQ ID NO: 27419 - protein, 8 aa, Dengue virus
PTIEAGRT

SEQ ID NO: 27420 - protein, 8 aa, Dengue virus
TIEAGRTL

SEQ ID NO: 27421 - protein, 8 aa, Dengue virus
IEAGRTLR

SEQ ID NO: 27422 - protein, 8 aa, Dengue virus
EAGRTLRV

SEQ ID NO: 27423 - protein, 8 aa, Dengue virus
AGRTLRVL

SEQ ID NO: 27424 - protein, 8 aa, Dengue virus
GRTLRVLN

SEQ ID NO: 27425 - protein, 8 aa, Dengue virus
RTLRVLNL

SEQ ID NO: 27426 - protein, 8 aa, Dengue virus
TLRVLNLV

SEQ ID NO: 27427 - protein, 8 aa, Dengue virus
LRVLNLVE

SEQ ID NO: 27428 - protein, 8 aa, Dengue virus
RVLNLVEN

SEQ ID NO: 27429 - protein, 8 aa, Dengue virus
VLNLVENW

SEQ ID NO: 27430 - protein, 8 aa, Dengue virus
LNLVENWL

SEQ ID NO: 27431 - protein, 8 aa, Dengue virus
NLVENWLN

SEQ ID NO: 27432 - protein, 8 aa, Dengue virus
LVENWLNN

SEQ ID NO: 27433 - protein, 8 aa, Dengue virus
VENWLNNN

SEQ ID NO: 27434 - protein, 8 aa, Dengue virus
ENWLNNNT

SEQ ID NO: 27435 - protein, 8 aa, Dengue virus
NWLNNNTQ

SEQ ID NO: 27436 - protein, 8 aa, Dengue virus
WLNNNTQF

SEQ ID NO: 27437 - protein, 8 aa, Dengue virus
LNNNTQFC

SEQ ID NO: 27438 - protein, 8 aa, Dengue virus
NNNTQFCI

SEQ ID NO: 27439 - protein, 8 aa, Dengue virus
NNTQFCIK

SEQ ID NO: 27440 - protein, 8 aa, Dengue virus
NTQFCIKV

SEQ ID NO: 27441 - protein, 8 aa, Dengue virus
TQFCIKVL

SEQ ID NO: 27442 - protein, 8 aa, Dengue virus
QFCIKVLN

SEQ ID NO: 27443 - protein, 8 aa, Dengue virus
FCIKVLNP

SEQ ID NO: 27444 - protein, 8 aa, Dengue virus
CIKVLNPY

SEQ ID NO: 27445 - protein, 8 aa, Dengue virus
IKVLNPYM

SEQ ID NO: 27446 - protein, 8 aa, Dengue virus
KVLNPYMP

SEQ ID NO: 27447 - protein, 8 aa, Dengue virus
VLNPYMPS

SEQ ID NO: 27448 - protein, 8 aa, Dengue virus
LNPYMPSV

SEQ ID NO: 27449 - protein, 8 aa, Dengue virus
NPYMPSVI

SEQ ID NO: 27450 - protein, 8 aa, Dengue virus
PYMPSVIE

SEQ ID NO: 27451 - protein, 8 aa, Dengue virus
YMPSVIEK

SEQ ID NO: 27452 - protein, 8 aa, Dengue virus
MPSVIEKM

SEQ ID NO: 27453 - protein, 8 aa, Dengue virus
PSVIEKME

SEQ ID NO: 27454 - protein, 8 aa, Dengue virus
SVIEKMEA

SEQ ID NO: 27455 - protein, 8 aa, Dengue virus
VIEKMEAL

SEQ ID NO: 27456 - protein, 8 aa, Dengue virus
IEKMEALQ

SEQ ID NO: 27457 - protein, 8 aa, Dengue virus
EKMEALQR

SEQ ID NO: 27458 - protein, 8 aa, Dengue virus
LQRKYGGA

SEQ ID NO: 27459 - protein, 8 aa, Dengue virus
QRKYGGAL

SEQ ID NO: 27460 - protein, 8 aa, Dengue virus
RKYGGALV

SEQ ID NO: 27461 - protein, 8 aa, Dengue virus
KYGGALVR

SEQ ID NO: 27462 - protein, 8 aa, Dengue virus
YGGALVRN

SEQ ID NO: 27463 - protein, 8 aa, Dengue virus
GGALVRNP

SEQ ID NO: 27464 - protein, 8 aa, Dengue virus
GALVRNPL

SEQ ID NO: 27465 - protein, 8 aa, Dengue virus
ALVRNPLS

SEQ ID NO: 27466 - protein, 8 aa, Dengue virus
LVRNPLSR

SEQ ID NO: 27467 - protein, 8 aa, Dengue virus
VRNPLSRN

SEQ ID NO: 27468 - protein, 8 aa, Dengue virus
RNPLSRNS

SEQ ID NO: 27469 - protein, 8 aa, Dengue virus
NPLSRNST

SEQ ID NO: 27470 - protein, 8 aa, Dengue virus
PLSRNSTH

SEQ ID NO: 27471 - protein, 8 aa, Dengue virus
LSRNSTHE

SEQ ID NO: 27472 - protein, 8 aa, Dengue virus
SRNSTHEM

SEQ ID NO: 27473 - protein, 8 aa, Dengue virus
RNSTHEMY

SEQ ID NO: 27474 - protein, 8 aa, Dengue virus
NSTHEMYW

SEQ ID NO: 27475 - protein, 8 aa, Dengue virus
STHEMYWV

SEQ ID NO: 27476 - protein, 8 aa, Dengue virus
THEMYWVS

SEQ ID NO: 27477 - protein, 8 aa, Dengue virus
HEMYWVSN

SEQ ID NO: 27478 - protein, 8 aa, Dengue virus
EMYWVSNA

SEQ ID NO: 27479 - protein, 8 aa, Dengue virus
MYWVSNAT

SEQ ID NO: 27480 - protein, 8 aa, Dengue virus
YWVSNATG

SEQ ID NO: 27481 - protein, 8 aa, Dengue virus
WVSNATGN

SEQ ID NO: 27482 - protein, 8 aa, Dengue virus
VSNATGNI

SEQ ID NO: 27483 - protein, 8 aa, Dengue virus
SNATGNIV

SEQ ID NO: 27484 - protein, 8 aa, Dengue virus
NATGNIVS

SEQ ID NO: 27485 - protein, 8 aa, Dengue virus
ATGNIVSS

SEQ ID NO: 27486 - protein, 8 aa, Dengue virus
TGNIVSSV

SEQ ID NO: 27487 - protein, 8 aa, Dengue virus
GNIVSSVN

SEQ ID NO: 27488 - protein, 8 aa, Dengue virus
NIVSSVNM

SEQ ID NO: 27489 - protein, 8 aa, Dengue virus
IVSSVNMI

SEQ ID NO: 27490 - protein, 8 aa, Dengue virus
VSSVNMIS

SEQ ID NO: 27491 - protein, 8 aa, Dengue virus
SSVNMISR

SEQ ID NO: 27492 - protein, 8 aa, Dengue virus
SVNMISRM

SEQ ID NO: 27493 - protein, 8 aa, Dengue virus
VNMISRML

SEQ ID NO: 27494 - protein, 8 aa, Dengue virus
NMISRMLI

SEQ ID NO: 27495 - protein, 8 aa, Dengue virus
MISRMLIN

SEQ ID NO: 27496 - protein, 8 aa, Dengue virus
ISRMLINR

SEQ ID NO: 27497 - protein, 8 aa, Dengue virus
SRMLINRF

SEQ ID NO: 27498 - protein, 8 aa, Dengue virus
RMLINRFT

SEQ ID NO: 27499 - protein, 8 aa, Dengue virus
MLINRFTM

SEQ ID NO: 27500 - protein, 8 aa, Dengue virus
LINRFTMK

SEQ ID NO: 27501 - protein, 8 aa, Dengue virus
INRFTMKH

SEQ ID NO: 27502 - protein, 8 aa, Dengue virus
NRFTMKHK

SEQ ID NO: 27503 - protein, 8 aa, Dengue virus
RFTMKHKK

SEQ ID NO: 27504 - protein, 8 aa, Dengue virus
FTMKHKKA

SEQ ID NO: 27505 - protein, 8 aa, Dengue virus
TMKHKKAT

SEQ ID NO: 27506 - protein, 8 aa, Dengue virus
MKHKKATY

SEQ ID NO: 27507 - protein, 8 aa, Dengue virus
KHKKATYE

SEQ ID NO: 27508 - protein, 8 aa, Dengue virus
HKKATYEP

SEQ ID NO: 27509 - protein, 8 aa, Dengue virus
KKATYEPD

SEQ ID NO: 27510 - protein, 8 aa, Dengue virus
KATYEPDV

SEQ ID NO: 27511 - protein, 8 aa, Dengue virus
ATYEPDVD

SEQ ID NO: 27512 - protein, 8 aa, Dengue virus
TYEPDVDL

SEQ ID NO: 27513 - protein, 8 aa, Dengue virus
YEPDVDLG

SEQ ID NO: 27514 - protein, 8 aa, Dengue virus
EPDVDLGS

SEQ ID NO: 27515 - protein, 8 aa, Dengue virus
PDVDLGSG

SEQ ID NO: 27516 - protein, 8 aa, Dengue virus
DVDLGSGT

SEQ ID NO: 27517 - protein, 8 aa, Dengue virus
VDLGSGTR

SEQ ID NO: 27518 - protein, 8 aa, Dengue virus
DLGSGTRN

SEQ ID NO: 27519 - protein, 8 aa, Dengue virus
LGSGTRNI

SEQ ID NO: 27520 - protein, 8 aa, Dengue virus
GSGTRNIG

SEQ ID NO: 27521 - protein, 8 aa, Dengue virus
SGTRNIGI

SEQ ID NO: 27522 - protein, 8 aa, Dengue virus
GTRNIGIE

SEQ ID NO: 27523 - protein, 8 aa, Dengue virus
TRNIGIES

SEQ ID NO: 27524 - protein, 8 aa, Dengue virus
RNIGIESE

SEQ ID NO: 27525 - protein, 8 aa, Dengue virus
EIPNLDII

SEQ ID NO: 27526 - protein, 8 aa, Dengue virus
IPNLDIIG

SEQ ID NO: 27527 - protein, 8 aa, Dengue virus
PNLDIIGK

SEQ ID NO: 27528 - protein, 8 aa, Dengue virus
NLDIIGKR

SEQ ID NO: 27529 - protein, 8 aa, Dengue virus
LDIIGKRI

SEQ ID NO: 27530 - protein, 8 aa, Dengue virus
DIIGKRIE

SEQ ID NO: 27531 - protein, 8 aa, Dengue virus
IIGKRIEK

SEQ ID NO: 27532 - protein, 8 aa, Dengue virus
IGKRIEKI

SEQ ID NO: 27533 - protein, 8 aa, Dengue virus
GKRIEKIK

SEQ ID NO: 27534 - protein, 8 aa, Dengue virus
KRIEKIKQ

SEQ ID NO: 27535 - protein, 8 aa, Dengue virus
RIEKIKQE

SEQ ID NO: 27536 - protein, 8 aa, Dengue virus
IEKIKQEH

SEQ ID NO: 27537 - protein, 8 aa, Dengue virus
EKIKQEHE

SEQ ID NO: 27538 - protein, 8 aa, Dengue virus
KIKQEHET

SEQ ID NO: 27539 - protein, 8 aa, Dengue virus
IKQEHETS

SEQ ID NO: 27540 - protein, 8 aa, Dengue virus
KQEHETSW

SEQ ID NO: 27541 - protein, 8 aa, Dengue virus
QEHETSWH

SEQ ID NO: 27542 - protein, 8 aa, Dengue virus
EHETSWHY

SEQ ID NO: 27543 - protein, 8 aa, Dengue virus
HETSWHYD

SEQ ID NO: 27544 - protein, 8 aa, Dengue virus
ETSWHYDQ

SEQ ID NO: 27545 - protein, 8 aa, Dengue virus
TSWHYDQD

SEQ ID NO: 27546 - protein, 8 aa, Dengue virus
SWHYDQDH

SEQ ID NO: 27547 - protein, 8 aa, Dengue virus
WHYDQDHP

SEQ ID NO: 27548 - protein, 8 aa, Dengue virus
HYDQDHPY

SEQ ID NO: 27549 - protein, 8 aa, Dengue virus
YDQDHPYK

SEQ ID NO: 27550 - protein, 8 aa, Dengue virus
DQDHPYKT

SEQ ID NO: 27551 - protein, 8 aa, Dengue virus
QDHPYKTW

SEQ ID NO: 27552 - protein, 8 aa, Dengue virus
DHPYKTWA

SEQ ID NO: 27553 - protein, 8 aa, Dengue virus
HPYKTWAY

SEQ ID NO: 27554 - protein, 8 aa, Dengue virus
PYKTWAYH

SEQ ID NO: 27555 - protein, 8 aa, Dengue virus
YKTWAYHG

SEQ ID NO: 27556 - protein, 8 aa, Dengue virus
KTWAYHGS

SEQ ID NO: 27557 - protein, 8 aa, Dengue virus
TWAYHGSY

SEQ ID NO: 27558 - protein, 8 aa, Dengue virus
WAYHGSYE

SEQ ID NO: 27559 - protein, 8 aa, Dengue virus
AYHGSYET

SEQ ID NO: 27560 - protein, 8 aa, Dengue virus
YHGSYETK

SEQ ID NO: 27561 - protein, 8 aa, Dengue virus
HGSYETKQ

SEQ ID NO: 27562 - protein, 8 aa, Dengue virus
GSYETKQT

SEQ ID NO: 27563 - protein, 8 aa, Dengue virus
SYETKQTG

SEQ ID NO: 27564 - protein, 8 aa, Dengue virus
YETKQTGS

SEQ ID NO: 27565 - protein, 8 aa, Dengue virus
ETKQTGSA

SEQ ID NO: 27566 - protein, 8 aa, Dengue virus
TKQTGSAS

SEQ ID NO: 27567 - protein, 8 aa, Dengue virus
KQTGSASS

SEQ ID NO: 27568 - protein, 8 aa, Dengue virus
QTGSASSM

SEQ ID NO: 27569 - protein, 8 aa, Dengue virus
TGSASSMV

SEQ ID NO: 27570 - protein, 8 aa, Dengue virus
GSASSMVN

SEQ ID NO: 27571 - protein, 8 aa, Dengue virus
SASSMVNG

SEQ ID NO: 27572 - protein, 8 aa, Dengue virus
ASSMVNGV

SEQ ID NO: 27573 - protein, 8 aa, Dengue virus
SSMVNGVV

SEQ ID NO: 27574 - protein, 8 aa, Dengue virus
SMVNGVVR

SEQ ID NO: 27575 - protein, 8 aa, Dengue virus
MVNGVVRL

SEQ ID NO: 27576 - protein, 8 aa, Dengue virus
VNGVVRLL

SEQ ID NO: 27577 - protein, 8 aa, Dengue virus
NGVVRLLT

SEQ ID NO: 27578 - protein, 8 aa, Dengue virus
GVVRLLTK

SEQ ID NO: 27579 - protein, 8 aa, Dengue virus
VVRLLTKP

SEQ ID NO: 27580 - protein, 8 aa, Dengue virus
VRLLTKPW

SEQ ID NO: 27581 - protein, 8 aa, Dengue virus
RLLTKPWD

SEQ ID NO: 27582 - protein, 8 aa, Dengue virus
LLTKPWDV

SEQ ID NO: 27583 - protein, 8 aa, Dengue virus
LTKPWDVV

SEQ ID NO: 27584 - protein, 8 aa, Dengue virus
TKPWDVVP

SEQ ID NO: 27585 - protein, 8 aa, Dengue virus
KPWDVVPM

SEQ ID NO: 27586 - protein, 8 aa, Dengue virus
PWDVVPMV

SEQ ID NO: 27587 - protein, 8 aa, Dengue virus
WDVVPMVT

SEQ ID NO: 27588 - protein, 8 aa, Dengue virus
DVVPMVTQ

SEQ ID NO: 27589 - protein, 8 aa, Dengue virus
VVPMVTQM

SEQ ID NO: 27590 - protein, 8 aa, Dengue virus
VPMVTQMA

SEQ ID NO: 27591 - protein, 8 aa, Dengue virus
PMVTQMAM

SEQ ID NO: 27592 - protein, 8 aa, Dengue virus
MVTQMAMT

SEQ ID NO: 27593 - protein, 8 aa, Dengue virus
VTQMAMTD

SEQ ID NO: 27594 - protein, 8 aa, Dengue virus
TQMAMTDT

SEQ ID NO: 27595 - protein, 8 aa, Dengue virus
QMAMTDTT

SEQ ID NO: 27596 - protein, 8 aa, Dengue virus
MAMTDTTP

SEQ ID NO: 27597 - protein, 8 aa, Dengue virus
AMTDTTPF

SEQ ID NO: 27598 - protein, 8 aa, Dengue virus
MTDTTPFG

SEQ ID NO: 27599 - protein, 8 aa, Dengue virus
TDTTPFGQ

SEQ ID NO: 27600 - protein, 8 aa, Dengue virus
DTTPFGQQ

SEQ ID NO: 27601 - protein, 8 aa, Dengue virus
TTPFGQQR

SEQ ID NO: 27602 - protein, 8 aa, Dengue virus
TPFGQQRV

SEQ ID NO: 27603 - protein, 8 aa, Dengue virus
PFGQQRVF

SEQ ID NO: 27604 - protein, 8 aa, Dengue virus
FGQQRVFK

SEQ ID NO: 27605 - protein, 8 aa, Dengue virus
GQQRVFKE

SEQ ID NO: 27606 - protein, 8 aa, Dengue virus
QQRVFKEK

SEQ ID NO: 27607 - protein, 8 aa, Dengue virus
QRVFKEKV

SEQ ID NO: 27608 - protein, 8 aa, Dengue virus
RVFKEKVD

SEQ ID NO: 27609 - protein, 8 aa, Dengue virus
VFKEKVDT

SEQ ID NO: 27610 - protein, 8 aa, Dengue virus
FKEKVDTR

SEQ ID NO: 27611 - protein, 8 aa, Dengue virus
KEKVDTRT

SEQ ID NO: 27612 - protein, 8 aa, Dengue virus
EKVDTRTQ

SEQ ID NO: 27613 - protein, 8 aa, Dengue virus
KVDTRTQE

SEQ ID NO: 27614 - protein, 8 aa, Dengue virus
VDTRTQEP

SEQ ID NO: 27615 - protein, 8 aa, Dengue virus
DTRTQEPK

SEQ ID NO: 27616 - protein, 8 aa, Dengue virus
TRTQEPKE

SEQ ID NO: 27617 - protein, 8 aa, Dengue virus
RTQEPKEG

SEQ ID NO: 27618 - protein, 8 aa, Dengue virus
TQEPKEGT

SEQ ID NO: 27619 - protein, 8 aa, Dengue virus
QEPKEGTK

SEQ ID NO: 27620 - protein, 8 aa, Dengue virus
EPKEGTKK

SEQ ID NO: 27621 - protein, 8 aa, Dengue virus
PKEGTKKL

SEQ ID NO: 27622 - protein, 8 aa, Dengue virus
KEGTKKLM

SEQ ID NO: 27623 - protein, 8 aa, Dengue virus
EGTKKLMK

SEQ ID NO: 27624 - protein, 8 aa, Dengue virus
GTKKLMKI

SEQ ID NO: 27625 - protein, 8 aa, Dengue virus
TKKLMKIT

SEQ ID NO: 27626 - protein, 8 aa, Dengue virus
KKLMKITA

SEQ ID NO: 27627 - protein, 8 aa, Dengue virus
KLMKITAE

SEQ ID NO: 27628 - protein, 8 aa, Dengue virus
LMKITAEW

SEQ ID NO: 27629 - protein, 8 aa, Dengue virus
MKITAEWL

SEQ ID NO: 27630 - protein, 8 aa, Dengue virus
KITAEWLW

SEQ ID NO: 27631 - protein, 8 aa, Dengue virus
ITAEWLWK

SEQ ID NO: 27632 - protein, 8 aa, Dengue virus
TAEWLWKE

SEQ ID NO: 27633 - protein, 8 aa, Dengue virus
AEWLWKEL

SEQ ID NO: 27634 - protein, 8 aa, Dengue virus
EWLWKELG

SEQ ID NO: 27635 - protein, 8 aa, Dengue virus
WLWKELGK

SEQ ID NO: 27636 - protein, 8 aa, Dengue virus
LWKELGKK

SEQ ID NO: 27637 - protein, 8 aa, Dengue virus
WKELGKKK

SEQ ID NO: 27638 - protein, 8 aa, Dengue virus
KELGKKKT

SEQ ID NO: 27639 - protein, 8 aa, Dengue virus
ELGKKKTP

SEQ ID NO: 27640 - protein, 8 aa, Dengue virus
LGKKKTPR

SEQ ID NO: 27641 - protein, 8 aa, Dengue virus
KTPRMCTR

SEQ ID NO: 27642 - protein, 8 aa, Dengue virus
TPRMCTRE

SEQ ID NO: 27643 - protein, 8 aa, Dengue virus
PRMCTREE

SEQ ID NO: 27644 - protein, 8 aa, Dengue virus
RMCTREEF

SEQ ID NO: 27645 - protein, 8 aa, Dengue virus
MCTREEFT

SEQ ID NO: 27646 - protein, 8 aa, Dengue virus
CTREEFTR

SEQ ID NO: 27647 - protein, 8 aa, Dengue virus
TREEFTRK

SEQ ID NO: 27648 - protein, 8 aa, Dengue virus
REEFTRKV

SEQ ID NO: 27649 - protein, 8 aa, Dengue virus
EEFTRKVR

SEQ ID NO: 27650 - protein, 8 aa, Dengue virus
EFTRKVRS

SEQ ID NO: 27651 - protein, 8 aa, Dengue virus
FTRKVRSN

SEQ ID NO: 27652 - protein, 8 aa, Dengue virus
TRKVRSNA

SEQ ID NO: 27653 - protein, 8 aa, Dengue virus
RKVRSNAA

SEQ ID NO: 27654 - protein, 8 aa, Dengue virus
KVRSNAAL

SEQ ID NO: 27655 - protein, 8 aa, Dengue virus
VRSNAALG

SEQ ID NO: 27656 - protein, 8 aa, Dengue virus
RSNAALGA

SEQ ID NO: 27657 - protein, 8 aa, Dengue virus
SNAALGAI

SEQ ID NO: 27658 - protein, 8 aa, Dengue virus
NAALGAIF

SEQ ID NO: 27659 - protein, 8 aa, Dengue virus
AALGAIFT

SEQ ID NO: 27660 - protein, 8 aa, Dengue virus
ALGAIFTD

SEQ ID NO: 27661 - protein, 8 aa, Dengue virus
LGAIFTDE

SEQ ID NO: 27662 - protein, 8 aa, Dengue virus
GAIFTDEN

SEQ ID NO: 27663 - protein, 8 aa, Dengue virus
AIFTDENK

SEQ ID NO: 27664 - protein, 8 aa, Dengue virus
IFTDENKW

SEQ ID NO: 27665 - protein, 8 aa, Dengue virus
FTDENKWK

SEQ ID NO: 27666 - protein, 8 aa, Dengue virus
TDENKWKS

SEQ ID NO: 27667 - protein, 8 aa, Dengue virus
DENKWKSA

SEQ ID NO: 27668 - protein, 8 aa, Dengue virus
ENKWKSAR

SEQ ID NO: 27669 - protein, 8 aa, Dengue virus
NKWKSARE

SEQ ID NO: 27670 - protein, 8 aa, Dengue virus
KWKSAREA

SEQ ID NO: 27671 - protein, 8 aa, Dengue virus
WKSAREAV

SEQ ID NO: 27672 - protein, 8 aa, Dengue virus
KSAREAVE

SEQ ID NO: 27673 - protein, 8 aa, Dengue virus
SAREAVED

SEQ ID NO: 27674 - protein, 8 aa, Dengue virus
AREAVEDS

SEQ ID NO: 27675 - protein, 8 aa, Dengue virus
REAVEDSR

SEQ ID NO: 27676 - protein, 8 aa, Dengue virus
EAVEDSRF

SEQ ID NO: 27677 - protein, 8 aa, Dengue virus
AVEDSRFW

SEQ ID NO: 27678 - protein, 8 aa, Dengue virus
VEDSRFWE

SEQ ID NO: 27679 - protein, 8 aa, Dengue virus
EDSRFWEL

SEQ ID NO: 27680 - protein, 8 aa, Dengue virus
FWELVDKE

SEQ ID NO: 27681 - protein, 8 aa, Dengue virus
WELVDKER

SEQ ID NO: 27682 - protein, 8 aa, Dengue virus
ELVDKERN

SEQ ID NO: 27683 - protein, 8 aa, Dengue virus
LVDKERNL

SEQ ID NO: 27684 - protein, 8 aa, Dengue virus
VDKERNLH

SEQ ID NO: 27685 - protein, 8 aa, Dengue virus
DKERNLHL

SEQ ID NO: 27686 - protein, 8 aa, Dengue virus
KERNLHLE

SEQ ID NO: 27687 - protein, 8 aa, Dengue virus
ERNLHLEG

SEQ ID NO: 27688 - protein, 8 aa, Dengue virus
RNLHLEGK

SEQ ID NO: 27689 - protein, 8 aa, Dengue virus
NLHLEGKC

SEQ ID NO: 27690 - protein, 8 aa, Dengue virus
LHLEGKCE

SEQ ID NO: 27691 - protein, 8 aa, Dengue virus
HLEGKCET

SEQ ID NO: 27692 - protein, 8 aa, Dengue virus
LEGKCETC

SEQ ID NO: 27693 - protein, 8 aa, Dengue virus
EGKCETCV

SEQ ID NO: 27694 - protein, 8 aa, Dengue virus
GKCETCVY

SEQ ID NO: 27695 - protein, 8 aa, Dengue virus
KCETCVYN

SEQ ID NO: 27696 - protein, 8 aa, Dengue virus
CETCVYNM

SEQ ID NO: 27697 - protein, 8 aa, Dengue virus
ETCVYNMM

SEQ ID NO: 27698 - protein, 8 aa, Dengue virus
TCVYNMMG

SEQ ID NO: 27699 - protein, 8 aa, Dengue virus
CVYNMMGK

SEQ ID NO: 27700 - protein, 8 aa, Dengue virus
VYNMMGKR

SEQ ID NO: 27701 - protein, 8 aa, Dengue virus
YNMMGKRE

SEQ ID NO: 27702 - protein, 8 aa, Dengue virus
NMMGKREK

SEQ ID NO: 27703 - protein, 8 aa, Dengue virus
MMGKREKK

SEQ ID NO: 27704 - protein, 8 aa, Dengue virus
MGKREKKL

SEQ ID NO: 27705 - protein, 8 aa, Dengue virus
GKREKKLG

SEQ ID NO: 27706 - protein, 8 aa, Dengue virus
KREKKLGE

SEQ ID NO: 27707 - protein, 8 aa, Dengue virus
REKKLGEF

SEQ ID NO: 27708 - protein, 8 aa, Dengue virus
EKKLGEFG

SEQ ID NO: 27709 - protein, 8 aa, Dengue virus
KKLGEFGK

SEQ ID NO: 27710 - protein, 8 aa, Dengue virus
KLGEFGKA

SEQ ID NO: 27711 - protein, 8 aa, Dengue virus
LGEFGKAK

SEQ ID NO: 27712 - protein, 8 aa, Dengue virus
GEFGKAKG

SEQ ID NO: 27713 - protein, 8 aa, Dengue virus
EFGKAKGS

SEQ ID NO: 27714 - protein, 8 aa, Dengue virus
FGKAKGSR

SEQ ID NO: 27715 - protein, 8 aa, Dengue virus
GKAKGSRA

SEQ ID NO: 27716 - protein, 8 aa, Dengue virus
KAKGSRAI

SEQ ID NO: 27717 - protein, 8 aa, Dengue virus
AKGSRAIW

SEQ ID NO: 27718 - protein, 8 aa, Dengue virus
KGSRAIWY

SEQ ID NO: 27719 - protein, 8 aa, Dengue virus
GSRAIWYM

SEQ ID NO: 27720 - protein, 8 aa, Dengue virus
SRAIWYMW

SEQ ID NO: 27721 - protein, 8 aa, Dengue virus
RAIWYMWL

SEQ ID NO: 27722 - protein, 8 aa, Dengue virus
AIWYMWLG

SEQ ID NO: 27723 - protein, 8 aa, Dengue virus
IWYMWLGA

SEQ ID NO: 27724 - protein, 8 aa, Dengue virus
WYMWLGAR

SEQ ID NO: 27725 - protein, 8 aa, Dengue virus
YMWLGARF

SEQ ID NO: 27726 - protein, 8 aa, Dengue virus
MWLGARFL

SEQ ID NO: 27727 - protein, 8 aa, Dengue virus
WLGARFLE

SEQ ID NO: 27728 - protein, 8 aa, Dengue virus
LGARFLEF

SEQ ID NO: 27729 - protein, 8 aa, Dengue virus
GARFLEFE

SEQ ID NO: 27730 - protein, 8 aa, Dengue virus
ARFLEFEA

SEQ ID NO: 27731 - protein, 8 aa, Dengue virus
RFLEFEAL

SEQ ID NO: 27732 - protein, 8 aa, Dengue virus
FLEFEALG

SEQ ID NO: 27733 - protein, 8 aa, Dengue virus
LEFEALGF

SEQ ID NO: 27734 - protein, 8 aa, Dengue virus
EFEALGFL

SEQ ID NO: 27735 - protein, 8 aa, Dengue virus
FEALGFLN

SEQ ID NO: 27736 - protein, 8 aa, Dengue virus
EALGFLNE

SEQ ID NO: 27737 - protein, 8 aa, Dengue virus
ALGFLNED

SEQ ID NO: 27738 - protein, 8 aa, Dengue virus
LGFLNEDH

SEQ ID NO: 27739 - protein, 8 aa, Dengue virus
GFLNEDHW

SEQ ID NO: 27740 - protein, 8 aa, Dengue virus
FLNEDHWF

SEQ ID NO: 27741 - protein, 8 aa, Dengue virus
LNEDHWFS

SEQ ID NO: 27742 - protein, 8 aa, Dengue virus
NEDHWFSR

SEQ ID NO: 27743 - protein, 8 aa, Dengue virus
EDHWFSRE

SEQ ID NO: 27744 - protein, 8 aa, Dengue virus
DHWFSREN

SEQ ID NO: 27745 - protein, 8 aa, Dengue virus
HWFSRENS

SEQ ID NO: 27746 - protein, 8 aa, Dengue virus
WFSRENSL

SEQ ID NO: 27747 - protein, 8 aa, Dengue virus
FSRENSLS

SEQ ID NO: 27748 - protein, 8 aa, Dengue virus
SRENSLSG

SEQ ID NO: 27749 - protein, 8 aa, Dengue virus
RENSLSGV

SEQ ID NO: 27750 - protein, 8 aa, Dengue virus
ENSLSGVE

SEQ ID NO: 27751 - protein, 8 aa, Dengue virus
NSLSGVEG

SEQ ID NO: 27752 - protein, 8 aa, Dengue virus
SLSGVEGE

SEQ ID NO: 27753 - protein, 8 aa, Dengue virus
LSGVEGEG

SEQ ID NO: 27754 - protein, 8 aa, Dengue virus
SGVEGEGL

SEQ ID NO: 27755 - protein, 8 aa, Dengue virus
GVEGEGLH

SEQ ID NO: 27756 - protein, 8 aa, Dengue virus
VEGEGLHK

SEQ ID NO: 27757 - protein, 8 aa, Dengue virus
EGEGLHKL

SEQ ID NO: 27758 - protein, 8 aa, Dengue virus
GEGLHKLG

SEQ ID NO: 27759 - protein, 8 aa, Dengue virus
EGLHKLGY

SEQ ID NO: 27760 - protein, 8 aa, Dengue virus
GLHKLGYI

SEQ ID NO: 27761 - protein, 8 aa, Dengue virus
LHKLGYIL

SEQ ID NO: 27762 - protein, 8 aa, Dengue virus
HKLGYILR

SEQ ID NO: 27763 - protein, 8 aa, Dengue virus
KLGYILRD

SEQ ID NO: 27764 - protein, 8 aa, Dengue virus
LGYILRDV

SEQ ID NO: 27765 - protein, 8 aa, Dengue virus
GYILRDVS

SEQ ID NO: 27766 - protein, 8 aa, Dengue virus
YILRDVSK

SEQ ID NO: 27767 - protein, 8 aa, Dengue virus
ILRDVSKK

SEQ ID NO: 27768 - protein, 8 aa, Dengue virus
DVSKKEGG

SEQ ID NO: 27769 - protein, 8 aa, Dengue virus
VSKKEGGA

SEQ ID NO: 27770 - protein, 8 aa, Dengue virus
SKKEGGAM

SEQ ID NO: 27771 - protein, 8 aa, Dengue virus
KKEGGAMY

SEQ ID NO: 27772 - protein, 8 aa, Dengue virus
KEGGAMYA

SEQ ID NO: 27773 - protein, 8 aa, Dengue virus
EGGAMYAD

SEQ ID NO: 27774 - protein, 8 aa, Dengue virus
GGAMYADD

SEQ ID NO: 27775 - protein, 8 aa, Dengue virus
GAMYADDT

SEQ ID NO: 27776 - protein, 8 aa, Dengue virus
AMYADDTA

SEQ ID NO: 27777 - protein, 8 aa, Dengue virus
MYADDTAG

SEQ ID NO: 27778 - protein, 8 aa, Dengue virus
YADDTAGW

SEQ ID NO: 27779 - protein, 8 aa, Dengue virus
ADDTAGWD

SEQ ID NO: 27780 - protein, 8 aa, Dengue virus
DDTAGWDT

SEQ ID NO: 27781 - protein, 8 aa, Dengue virus
DTAGWDTR

SEQ ID NO: 27782 - protein, 8 aa, Dengue virus
TAGWDTRI

SEQ ID NO: 27783 - protein, 8 aa, Dengue virus
AGWDTRIT

SEQ ID NO: 27784 - protein, 8 aa, Dengue virus
GWDTRITL

SEQ ID NO: 27785 - protein, 8 aa, Dengue virus
WDTRITLE

SEQ ID NO: 27786 - protein, 8 aa, Dengue virus
DTRITLED

SEQ ID NO: 27787 - protein, 8 aa, Dengue virus
TRITLEDL

SEQ ID NO: 27788 - protein, 8 aa, Dengue virus
RITLEDLK

SEQ ID NO: 27789 - protein, 8 aa, Dengue virus
ITLEDLKN

SEQ ID NO: 27790 - protein, 8 aa, Dengue virus
TLEDLKNE

SEQ ID NO: 27791 - protein, 8 aa, Dengue virus
LEDLKNEE

SEQ ID NO: 27792 - protein, 8 aa, Dengue virus
EDLKNEEM

SEQ ID NO: 27793 - protein, 8 aa, Dengue virus
DLKNEEMV

SEQ ID NO: 27794 - protein, 8 aa, Dengue virus
LKNEEMVT

SEQ ID NO: 27795 - protein, 8 aa, Dengue virus
KNEEMVTN

SEQ ID NO: 27796 - protein, 8 aa, Dengue virus
NEEMVTNH

SEQ ID NO: 27797 - protein, 8 aa, Dengue virus
EEMVTNHM

SEQ ID NO: 27798 - protein, 8 aa, Dengue virus
GEHKKLAE

SEQ ID NO: 27799 - protein, 8 aa, Dengue virus
EHKKLAEA

SEQ ID NO: 27800 - protein, 8 aa, Dengue virus
HKKLAEAI

SEQ ID NO: 27801 - protein, 8 aa, Dengue virus
KKLAEAIF

SEQ ID NO: 27802 - protein, 8 aa, Dengue virus
KLAEAIFK

SEQ ID NO: 27803 - protein, 8 aa, Dengue virus
LAEAIFKL

SEQ ID NO: 27804 - protein, 8 aa, Dengue virus
AEAIFKLT

SEQ ID NO: 27805 - protein, 8 aa, Dengue virus
EAIFKLTY

SEQ ID NO: 27806 - protein, 8 aa, Dengue virus
AIFKLTYQ

SEQ ID NO: 27807 - protein, 8 aa, Dengue virus
IFKLTYQN

SEQ ID NO: 27808 - protein, 8 aa, Dengue virus
FKLTYQNK

SEQ ID NO: 27809 - protein, 8 aa, Dengue virus
KLTYQNKV

SEQ ID NO: 27810 - protein, 8 aa, Dengue virus
LTYQNKVV

SEQ ID NO: 27811 - protein, 8 aa, Dengue virus
TYQNKVVR

SEQ ID NO: 27812 - protein, 8 aa, Dengue virus
YQNKVVRV

SEQ ID NO: 27813 - protein, 8 aa, Dengue virus
QNKVVRVQ

SEQ ID NO: 27814 - protein, 8 aa, Dengue virus
NKVVRVQR

SEQ ID NO: 27815 - protein, 8 aa, Dengue virus
KVVRVQRP

SEQ ID NO: 27816 - protein, 8 aa, Dengue virus
VVRVQRPT

SEQ ID NO: 27817 - protein, 8 aa, Dengue virus
VRVQRPTP

SEQ ID NO: 27818 - protein, 8 aa, Dengue virus
RVQRPTPR

SEQ ID NO: 27819 - protein, 8 aa, Dengue virus
VQRPTPRG

SEQ ID NO: 27820 - protein, 8 aa, Dengue virus
QRPTPRGT

SEQ ID NO: 27821 - protein, 8 aa, Dengue virus
RPTPRGTV

SEQ ID NO: 27822 - protein, 8 aa, Dengue virus
PTPRGTVM

SEQ ID NO: 27823 - protein, 8 aa, Dengue virus
TPRGTVMD

SEQ ID NO: 27824 - protein, 8 aa, Dengue virus
PRGTVMDI

SEQ ID NO: 27825 - protein, 8 aa, Dengue virus
RGTVMDII

SEQ ID NO: 27826 - protein, 8 aa, Dengue virus
GTVMDIIS

SEQ ID NO: 27827 - protein, 8 aa, Dengue virus
TVMDIISR

SEQ ID NO: 27828 - protein, 8 aa, Dengue virus
VMDIISRR

SEQ ID NO: 27829 - protein, 8 aa, Dengue virus
MDIISRRD

SEQ ID NO: 27830 - protein, 8 aa, Dengue virus
DIISRRDQ

SEQ ID NO: 27831 - protein, 8 aa, Dengue virus
IISRRDQR

SEQ ID NO: 27832 - protein, 8 aa, Dengue virus
ISRRDQRG

SEQ ID NO: 27833 - protein, 8 aa, Dengue virus
SRRDQRGS

SEQ ID NO: 27834 - protein, 8 aa, Dengue virus
RRDQRGSG

SEQ ID NO: 27835 - protein, 8 aa, Dengue virus
RDQRGSGQ

SEQ ID NO: 27836 - protein, 8 aa, Dengue virus
DQRGSGQV

SEQ ID NO: 27837 - protein, 8 aa, Dengue virus
QRGSGQVG

SEQ ID NO: 27838 - protein, 8 aa, Dengue virus
RGSGQVGT

SEQ ID NO: 27839 - protein, 8 aa, Dengue virus
GSGQVGTY

SEQ ID NO: 27840 - protein, 8 aa, Dengue virus
SGQVGTYG

SEQ ID NO: 27841 - protein, 8 aa, Dengue virus
GQVGTYGL

SEQ ID NO: 27842 - protein, 8 aa, Dengue virus
QVGTYGLN

SEQ ID NO: 27843 - protein, 8 aa, Dengue virus
VGTYGLNT

SEQ ID NO: 27844 - protein, 8 aa, Dengue virus
GTYGLNTF

SEQ ID NO: 27845 - protein, 8 aa, Dengue virus
TYGLNTFT

SEQ ID NO: 27846 - protein, 8 aa, Dengue virus
YGLNTFTN

SEQ ID NO: 27847 - protein, 8 aa, Dengue virus
GLNTFTNM

SEQ ID NO: 27848 - protein, 8 aa, Dengue virus
LNTFTNME

SEQ ID NO: 27849 - protein, 8 aa, Dengue virus
NTFTNMEA

SEQ ID NO: 27850 - protein, 8 aa, Dengue virus
TFTNMEAQ

SEQ ID NO: 27851 - protein, 8 aa, Dengue virus
FTNMEAQL

SEQ ID NO: 27852 - protein, 8 aa, Dengue virus
TNMEAQLI

SEQ ID NO: 27853 - protein, 8 aa, Dengue virus
NMEAQLIR

SEQ ID NO: 27854 - protein, 8 aa, Dengue virus
MEAQLIRQ

SEQ ID NO: 27855 - protein, 8 aa, Dengue virus
EAQLIRQM

SEQ ID NO: 27856 - protein, 8 aa, Dengue virus
AQLIRQME

SEQ ID NO: 27857 - protein, 8 aa, Dengue virus
QLIRQMEG

SEQ ID NO: 27858 - protein, 8 aa, Dengue virus
LIRQMEGE

SEQ ID NO: 27859 - protein, 8 aa, Dengue virus
IRQMEGEG

SEQ ID NO: 27860 - protein, 8 aa, Dengue virus
RQMEGEGI

SEQ ID NO: 27861 - protein, 8 aa, Dengue virus
QMEGEGIF

SEQ ID NO: 27862 - protein, 8 aa, Dengue virus
MEGEGIFK

SEQ ID NO: 27863 - protein, 8 aa, Dengue virus
RVGRERLS

SEQ ID NO: 27864 - protein, 8 aa, Dengue virus
VGRERLSR

SEQ ID NO: 27865 - protein, 8 aa, Dengue virus
GRERLSRM

SEQ ID NO: 27866 - protein, 8 aa, Dengue virus
RERLSRMA

SEQ ID NO: 27867 - protein, 8 aa, Dengue virus
ERLSRMAI

SEQ ID NO: 27868 - protein, 8 aa, Dengue virus
RLSRMAIS

SEQ ID NO: 27869 - protein, 8 aa, Dengue virus
LSRMAISG

SEQ ID NO: 27870 - protein, 8 aa, Dengue virus
SRMAISGD

SEQ ID NO: 27871 - protein, 8 aa, Dengue virus
RMAISGDD

SEQ ID NO: 27872 - protein, 8 aa, Dengue virus
MAISGDDC

SEQ ID NO: 27873 - protein, 8 aa, Dengue virus
AISGDDCV

SEQ ID NO: 27874 - protein, 8 aa, Dengue virus
ISGDDCVV

SEQ ID NO: 27875 - protein, 8 aa, Dengue virus
SGDDCVVK

SEQ ID NO: 27876 - protein, 8 aa, Dengue virus
GDDCVVKP

SEQ ID NO: 27877 - protein, 8 aa, Dengue virus
DDCVVKPL

SEQ ID NO: 27878 - protein, 8 aa, Dengue virus
DCVVKPLD

SEQ ID NO: 27879 - protein, 8 aa, Dengue virus
CVVKPLDD

SEQ ID NO: 27880 - protein, 8 aa, Dengue virus
VVKPLDDR

SEQ ID NO: 27881 - protein, 8 aa, Dengue virus
VKPLDDRF

SEQ ID NO: 27882 - protein, 8 aa, Dengue virus
KPLDDRFA

SEQ ID NO: 27883 - protein, 8 aa, Dengue virus
DDRFASAL

SEQ ID NO: 27884 - protein, 8 aa, Dengue virus
DRFASALT

SEQ ID NO: 27885 - protein, 8 aa, Dengue virus
RFASALTA

SEQ ID NO: 27886 - protein, 8 aa, Dengue virus
FASALTAL

SEQ ID NO: 27887 - protein, 8 aa, Dengue virus
ASALTALN

SEQ ID NO: 27888 - protein, 8 aa, Dengue virus
SALTALND

SEQ ID NO: 27889 - protein, 8 aa, Dengue virus
ALTALNDM

SEQ ID NO: 27890 - protein, 8 aa, Dengue virus
LTALNDMG

SEQ ID NO: 27891 - protein, 8 aa, Dengue virus
TALNDMGK

SEQ ID NO: 27892 - protein, 8 aa, Dengue virus
ALNDMGKV

SEQ ID NO: 27893 - protein, 8 aa, Dengue virus
LNDMGKVR

SEQ ID NO: 27894 - protein, 8 aa, Dengue virus
NDMGKVRK

SEQ ID NO: 27895 - protein, 8 aa, Dengue virus
DMGKVRKD

SEQ ID NO: 27896 - protein, 8 aa, Dengue virus
MGKVRKDI

SEQ ID NO: 27897 - protein, 8 aa, Dengue virus
GKVRKDIQ

SEQ ID NO: 27898 - protein, 8 aa, Dengue virus
KVRKDIQQ

SEQ ID NO: 27899 - protein, 8 aa, Dengue virus
VRKDIQQW

SEQ ID NO: 27900 - protein, 8 aa, Dengue virus
RKDIQQWE

SEQ ID NO: 27901 - protein, 8 aa, Dengue virus
KDIQQWEP

SEQ ID NO: 27902 - protein, 8 aa, Dengue virus
DIQQWEPS

SEQ ID NO: 27903 - protein, 8 aa, Dengue virus
IQQWEPSR

SEQ ID NO: 27904 - protein, 8 aa, Dengue virus
QQWEPSRG

SEQ ID NO: 27905 - protein, 8 aa, Dengue virus
QWEPSRGW

SEQ ID NO: 27906 - protein, 8 aa, Dengue virus
WEPSRGWN

SEQ ID NO: 27907 - protein, 8 aa, Dengue virus
EPSRGWND

SEQ ID NO: 27908 - protein, 8 aa, Dengue virus
PSRGWNDW

SEQ ID NO: 27909 - protein, 8 aa, Dengue virus
SRGWNDWT

SEQ ID NO: 27910 - protein, 8 aa, Dengue virus
RGWNDWTQ

SEQ ID NO: 27911 - protein, 8 aa, Dengue virus
GWNDWTQV

SEQ ID NO: 27912 - protein, 8 aa, Dengue virus
WNDWTQVP

SEQ ID NO: 27913 - protein, 8 aa, Dengue virus
NDWTQVPF

SEQ ID NO: 27914 - protein, 8 aa, Dengue virus
DWTQVPFC

SEQ ID NO: 27915 - protein, 8 aa, Dengue virus
WTQVPFCS

SEQ ID NO: 27916 - protein, 8 aa, Dengue virus
TQVPFCSH

SEQ ID NO: 27917 - protein, 8 aa, Dengue virus
QVPFCSHH

SEQ ID NO: 27918 - protein, 8 aa, Dengue virus
VPFCSHHF

SEQ ID NO: 27919 - protein, 8 aa, Dengue virus
PFCSHHFH

SEQ ID NO: 27920 - protein, 8 aa, Dengue virus
FCSHHFHE

SEQ ID NO: 27921 - protein, 8 aa, Dengue virus
CSHHFHEL

SEQ ID NO: 27922 - protein, 8 aa, Dengue virus
SHHFHELI

SEQ ID NO: 27923 - protein, 8 aa, Dengue virus
HHFHELIM

SEQ ID NO: 27924 - protein, 8 aa, Dengue virus
HFHELIMK

SEQ ID NO: 27925 - protein, 8 aa, Dengue virus
FHELIMKD

SEQ ID NO: 27926 - protein, 8 aa, Dengue virus
HELIMKDG

SEQ ID NO: 27927 - protein, 8 aa, Dengue virus
ELIMKDGR

SEQ ID NO: 27928 - protein, 8 aa, Dengue virus
MKDGRVLV

SEQ ID NO: 27929 - protein, 8 aa, Dengue virus
KDGRVLVV

SEQ ID NO: 27930 - protein, 8 aa, Dengue virus
DGRVLVVP

SEQ ID NO: 27931 - protein, 8 aa, Dengue virus
GRVLVVPC

SEQ ID NO: 27932 - protein, 8 aa, Dengue virus
RVLVVPCR

SEQ ID NO: 27933 - protein, 8 aa, Dengue virus
LVVPCRNQ

SEQ ID NO: 27934 - protein, 8 aa, Dengue virus
VVPCRNQD

SEQ ID NO: 27935 - protein, 8 aa, Dengue virus
VPCRNQDE

SEQ ID NO: 27936 - protein, 8 aa, Dengue virus
PCRNQDEL

SEQ ID NO: 27937 - protein, 8 aa, Dengue virus
CRNQDELI

SEQ ID NO: 27938 - protein, 8 aa, Dengue virus
RNQDELIG

SEQ ID NO: 27939 - protein, 8 aa, Dengue virus
NQDELIGR

SEQ ID NO: 27940 - protein, 8 aa, Dengue virus
QDELIGRA

SEQ ID NO: 27941 - protein, 8 aa, Dengue virus
DELIGRAR

SEQ ID NO: 27942 - protein, 8 aa, Dengue virus
ELIGRARI

SEQ ID NO: 27943 - protein, 8 aa, Dengue virus
LIGRARIS

SEQ ID NO: 27944 - protein, 8 aa, Dengue virus
IGRARISQ

SEQ ID NO: 27945 - protein, 8 aa, Dengue virus
GRARISQG

SEQ ID NO: 27946 - protein, 8 aa, Dengue virus
RARISQGA

SEQ ID NO: 27947 - protein, 8 aa, Dengue virus
ARISQGAG

SEQ ID NO: 27948 - protein, 8 aa, Dengue virus
RISQGAGW

SEQ ID NO: 27949 - protein, 8 aa, Dengue virus
ISQGAGWS

SEQ ID NO: 27950 - protein, 8 aa, Dengue virus
SQGAGWSL

SEQ ID NO: 27951 - protein, 8 aa, Dengue virus
QGAGWSLK

SEQ ID NO: 27952 - protein, 8 aa, Dengue virus
GAGWSLKE

SEQ ID NO: 27953 - protein, 8 aa, Dengue virus
AGWSLKET

SEQ ID NO: 27954 - protein, 8 aa, Dengue virus
GWSLKETA

SEQ ID NO: 27955 - protein, 8 aa, Dengue virus
WSLKETAC

SEQ ID NO: 27956 - protein, 8 aa, Dengue virus
SLKETACL

SEQ ID NO: 27957 - protein, 8 aa, Dengue virus
LKETACLG

SEQ ID NO: 27958 - protein, 8 aa, Dengue virus
KETACLGK

SEQ ID NO: 27959 - protein, 8 aa, Dengue virus
ETACLGKS

SEQ ID NO: 27960 - protein, 8 aa, Dengue virus
TACLGKSY

SEQ ID NO: 27961 - protein, 8 aa, Dengue virus
ACLGKSYA

SEQ ID NO: 27962 - protein, 8 aa, Dengue virus
CLGKSYAQ

SEQ ID NO: 27963 - protein, 8 aa, Dengue virus
LGKSYAQM

SEQ ID NO: 27964 - protein, 8 aa, Dengue virus
GKSYAQMW

SEQ ID NO: 27965 - protein, 8 aa, Dengue virus
KSYAQMWS

SEQ ID NO: 27966 - protein, 8 aa, Dengue virus
SYAQMWSL

SEQ ID NO: 27967 - protein, 8 aa, Dengue virus
YAQMWSLM

SEQ ID NO: 27968 - protein, 8 aa, Dengue virus
AQMWSLMY

SEQ ID NO: 27969 - protein, 8 aa, Dengue virus
QMWSLMYF

SEQ ID NO: 27970 - protein, 8 aa, Dengue virus
MWSLMYFH

SEQ ID NO: 27971 - protein, 8 aa, Dengue virus
WSLMYFHR

SEQ ID NO: 27972 - protein, 8 aa, Dengue virus
SLMYFHRR

SEQ ID NO: 27973 - protein, 8 aa, Dengue virus
LMYFHRRD

SEQ ID NO: 27974 - protein, 8 aa, Dengue virus
MYFHRRDL

SEQ ID NO: 27975 - protein, 8 aa, Dengue virus
YFHRRDLR

SEQ ID NO: 27976 - protein, 8 aa, Dengue virus
FHRRDLRL

SEQ ID NO: 27977 - protein, 8 aa, Dengue virus
HRRDLRLA

SEQ ID NO: 27978 - protein, 8 aa, Dengue virus
RRDLRLAA

SEQ ID NO: 27979 - protein, 8 aa, Dengue virus
RDLRLAAN

SEQ ID NO: 27980 - protein, 8 aa, Dengue virus
DLRLAANA

SEQ ID NO: 27981 - protein, 8 aa, Dengue virus
LRLAANAI

SEQ ID NO: 27982 - protein, 8 aa, Dengue virus
RLAANAIC

SEQ ID NO: 27983 - protein, 8 aa, Dengue virus
LAANAICS

SEQ ID NO: 27984 - protein, 8 aa, Dengue virus
AANAICSA

SEQ ID NO: 27985 - protein, 8 aa, Dengue virus
ANAICSAV

SEQ ID NO: 27986 - protein, 8 aa, Dengue virus
NAICSAVP

SEQ ID NO: 27987 - protein, 8 aa, Dengue virus
AICSAVPS

SEQ ID NO: 27988 - protein, 8 aa, Dengue virus
ICSAVPSH

SEQ ID NO: 27989 - protein, 8 aa, Dengue virus
CSAVPSHW

SEQ ID NO: 27990 - protein, 8 aa, Dengue virus
SAVPSHWV

SEQ ID NO: 27991 - protein, 8 aa, Dengue virus
AVPSHWVP

SEQ ID NO: 27992 - protein, 8 aa, Dengue virus
VPSHWVPT

SEQ ID NO: 27993 - protein, 8 aa, Dengue virus
PSHWVPTS

SEQ ID NO: 27994 - protein, 8 aa, Dengue virus
SHWVPTSR

SEQ ID NO: 27995 - protein, 8 aa, Dengue virus
HWVPTSRT

SEQ ID NO: 27996 - protein, 8 aa, Dengue virus
WVPTSRTT

SEQ ID NO: 27997 - protein, 8 aa, Dengue virus
VPTSRTTW

SEQ ID NO: 27998 - protein, 8 aa, Dengue virus
PTSRTTWS

SEQ ID NO: 27999 - protein, 8 aa, Dengue virus
TSRTTWSI

SEQ ID NO: 28000 - protein, 8 aa, Dengue virus
SRTTWSIH

SEQ ID NO: 28001 - protein, 8 aa, Dengue virus
RTTWSIHA

SEQ ID NO: 28002 - protein, 8 aa, Dengue virus
TTWSIHAK

SEQ ID NO: 28003 - protein, 8 aa, Dengue virus
TWSIHAKH

SEQ ID NO: 28004 - protein, 8 aa, Dengue virus
WSIHAKHE

SEQ ID NO: 28005 - protein, 8 aa, Dengue virus
SIHAKHEW

SEQ ID NO: 28006 - protein, 8 aa, Dengue virus
IHAKHEWM

SEQ ID NO: 28007 - protein, 8 aa, Dengue virus
HAKHEWMT

SEQ ID NO: 28008 - protein, 8 aa, Dengue virus
AKHEWMTT

SEQ ID NO: 28009 - protein, 8 aa, Dengue virus
KHEWMTTE

SEQ ID NO: 28010 - protein, 8 aa, Dengue virus
HEWMTTED

SEQ ID NO: 28011 - protein, 8 aa, Dengue virus
EWMTTEDM

SEQ ID NO: 28012 - protein, 8 aa, Dengue virus
WMTTEDML

SEQ ID NO: 28013 - protein, 8 aa, Dengue virus
MTTEDMLA

SEQ ID NO: 28014 - protein, 8 aa, Dengue virus
TTEDMLAV

SEQ ID NO: 28015 - protein, 8 aa, Dengue virus
TEDMLAVW

SEQ ID NO: 28016 - protein, 8 aa, Dengue virus
EDMLAVWN

SEQ ID NO: 28017 - protein, 8 aa, Dengue virus
DMLAVWNR

SEQ ID NO: 28018 - protein, 8 aa, Dengue virus
MLAVWNRV

SEQ ID NO: 28019 - protein, 8 aa, Dengue virus
LAVWNRVW

SEQ ID NO: 28020 - protein, 8 aa, Dengue virus
AVWNRVWI

SEQ ID NO: 28021 - protein, 8 aa, Dengue virus
VWNRVWIQ

SEQ ID NO: 28022 - protein, 8 aa, Dengue virus
WNRVWIQE

SEQ ID NO: 28023 - protein, 8 aa, Dengue virus
NRVWIQEN

SEQ ID NO: 28024 - protein, 8 aa, Dengue virus
RVWIQENP

SEQ ID NO: 28025 - protein, 8 aa, Dengue virus
VWIQENPW

SEQ ID NO: 28026 - protein, 8 aa, Dengue virus
WIQENPWM

SEQ ID NO: 28027 - protein, 8 aa, Dengue virus
IQENPWME

SEQ ID NO: 28028 - protein, 8 aa, Dengue virus
QENPWMED

SEQ ID NO: 28029 - protein, 8 aa, Dengue virus
ENPWMEDK

SEQ ID NO: 28030 - protein, 8 aa, Dengue virus
NPWMEDKT

SEQ ID NO: 28031 - protein, 8 aa, Dengue virus
PWMEDKTP

SEQ ID NO: 28032 - protein, 8 aa, Dengue virus
WMEDKTPV

SEQ ID NO: 28033 - protein, 8 aa, Dengue virus
MEDKTPVE

SEQ ID NO: 28034 - protein, 8 aa, Dengue virus
EDKTPVES

SEQ ID NO: 28035 - protein, 8 aa, Dengue virus
DKTPVESW

SEQ ID NO: 28036 - protein, 8 aa, Dengue virus
KTPVESWE

SEQ ID NO: 28037 - protein, 8 aa, Dengue virus
TPVESWEE

SEQ ID NO: 28038 - protein, 8 aa, Dengue virus
PVESWEEV

SEQ ID NO: 28039 - protein, 8 aa, Dengue virus
VESWEEVP

SEQ ID NO: 28040 - protein, 8 aa, Dengue virus
ESWEEVPY

SEQ ID NO: 28041 - protein, 8 aa, Dengue virus
SWEEVPYL

SEQ ID NO: 28042 - protein, 8 aa, Dengue virus
WEEVPYLG

SEQ ID NO: 28043 - protein, 8 aa, Dengue virus
EEVPYLGK

SEQ ID NO: 28044 - protein, 8 aa, Dengue virus
EVPYLGKR

SEQ ID NO: 28045 - protein, 8 aa, Dengue virus
VPYLGKRE

SEQ ID NO: 28046 - protein, 8 aa, Dengue virus
PYLGKRED

SEQ ID NO: 28047 - protein, 8 aa, Dengue virus
YLGKREDQ

SEQ ID NO: 28048 - protein, 8 aa, Dengue virus
LGKREDQW

SEQ ID NO: 28049 - protein, 8 aa, Dengue virus
GKREDQWC

SEQ ID NO: 28050 - protein, 8 aa, Dengue virus
KREDQWCG

SEQ ID NO: 28051 - protein, 8 aa, Dengue virus
REDQWCGS

SEQ ID NO: 28052 - protein, 8 aa, Dengue virus
EDQWCGSL

SEQ ID NO: 28053 - protein, 8 aa, Dengue virus
DQWCGSLI

SEQ ID NO: 28054 - protein, 8 aa, Dengue virus
QWCGSLIG

SEQ ID NO: 28055 - protein, 8 aa, Dengue virus
WCGSLIGL

SEQ ID NO: 28056 - protein, 8 aa, Dengue virus
CGSLIGLT

SEQ ID NO: 28057 - protein, 8 aa, Dengue virus
GSLIGLTS

SEQ ID NO: 28058 - protein, 8 aa, Dengue virus
SLIGLTSR

SEQ ID NO: 28059 - protein, 8 aa, Dengue virus
LIGLTSRA

SEQ ID NO: 28060 - protein, 8 aa, Dengue virus
IGLTSRAT

SEQ ID NO: 28061 - protein, 8 aa, Dengue virus
GLTSRATW

SEQ ID NO: 28062 - protein, 8 aa, Dengue virus
LTSRATWA

SEQ ID NO: 28063 - protein, 8 aa, Dengue virus
TSRATWAK

SEQ ID NO: 28064 - protein, 8 aa, Dengue virus
SRATWAKN

SEQ ID NO: 28065 - protein, 8 aa, Dengue virus
RATWAKNI

SEQ ID NO: 28066 - protein, 8 aa, Dengue virus
ATWAKNIQ

SEQ ID NO: 28067 - protein, 8 aa, Dengue virus
TWAKNIQT

SEQ ID NO: 28068 - protein, 8 aa, Dengue virus
WAKNIQTA

SEQ ID NO: 28069 - protein, 8 aa, Dengue virus
AKNIQTAI

SEQ ID NO: 28070 - protein, 8 aa, Dengue virus
KNIQTAIN

SEQ ID NO: 28071 - protein, 8 aa, Dengue virus
NIQTAINQ

SEQ ID NO: 28072 - protein, 8 aa, Dengue virus
IQTAINQV

SEQ ID NO: 28073 - protein, 8 aa, Dengue virus
QTAINQVR

SEQ ID NO: 28074 - protein, 8 aa, Dengue virus
TAINQVRS

SEQ ID NO: 28075 - protein, 8 aa, Dengue virus
AINQVRSL

SEQ ID NO: 28076 - protein, 8 aa, Dengue virus
INQVRSLI

SEQ ID NO: 28077 - protein, 8 aa, Dengue virus
NQVRSLIG

SEQ ID NO: 28078 - protein, 8 aa, Dengue virus
QVRSLIGN

SEQ ID NO: 28079 - protein, 8 aa, Dengue virus
VRSLIGNE

SEQ ID NO: 28080 - protein, 8 aa, Dengue virus
RSLIGNEE

SEQ ID NO: 28081 - protein, 8 aa, Dengue virus
SLIGNEEY

SEQ ID NO: 28082 - protein, 8 aa, Dengue virus
EEYTDYMP

SEQ ID NO: 28083 - protein, 8 aa, Dengue virus
EYTDYMPS

SEQ ID NO: 28084 - protein, 8 aa, Dengue virus
YTDYMPSM

SEQ ID NO: 28085 - protein, 8 aa, Dengue virus
TDYMPSMK

SEQ ID NO: 28086 - protein, 8 aa, Dengue virus
DYMPSMKR

SEQ ID NO: 28087 - protein, 8 aa, Dengue virus
YMPSMKRF

SEQ ID NO: 28088 - protein, 8 aa, Dengue virus
MPSMKRFR

SEQ ID NO: 28089 - protein, 8 aa, Dengue virus
PSMKRFRR

SEQ ID NO: 28090 - protein, 8 aa, Dengue virus
SMKRFRRE

SEQ ID NO: 28091 - protein, 8 aa, Dengue virus
MKRFRREE

SEQ ID NO: 28092 - protein, 8 aa, Dengue virus
KRFRREEE

SEQ ID NO: 28093 - protein, 8 aa, Dengue virus
RFRREEEE

SEQ ID NO: 28094 - protein, 8 aa, Dengue virus
FRREEEEA

SEQ ID NO: 28095 - protein, 8 aa, Dengue virus
RREEEEAG

SEQ ID NO: 28096 - protein, 8 aa, Dengue virus
REEEEAGV

SEQ ID NO: 28097 - protein, 8 aa, Dengue virus
EEEEAGVL

SEQ ID NO: 28098 - protein, 8 aa, Dengue virus
EEEAGVLW

SEQ ID NO: 28099 - protein, 8 aa, Dengue virus
NNQRKKAK

SEQ ID NO: 28100 - protein, 8 aa, Dengue virus
NQRKKAKN

SEQ ID NO: 28101 - protein, 8 aa, Dengue virus
NTPFNMLK

SEQ ID NO: 28102 - protein, 8 aa, Dengue virus
ERNRVSTI

SEQ ID NO: 28103 - protein, 8 aa, Dengue virus
RNRVSTIQ

SEQ ID NO: 28104 - protein, 8 aa, Dengue virus
NRVSTIQQ

SEQ ID NO: 28105 - protein, 8 aa, Dengue virus
RVSTIQQL

SEQ ID NO: 28106 - protein, 8 aa, Dengue virus
VSTIQQLT

SEQ ID NO: 28107 - protein, 8 aa, Dengue virus
STIQQLTK

SEQ ID NO: 28108 - protein, 8 aa, Dengue virus
TIQQLTKR

SEQ ID NO: 28109 - protein, 8 aa, Dengue virus
IQQLTKRF

SEQ ID NO: 28110 - protein, 8 aa, Dengue virus
GRGPLRLF

SEQ ID NO: 28111 - protein, 8 aa, Dengue virus
RGPLRLFM

SEQ ID NO: 28112 - protein, 8 aa, Dengue virus
PLKLFMAF

SEQ ID NO: 28113 - protein, 8 aa, Dengue virus
LKLFMAFV

SEQ ID NO: 28114 - protein, 8 aa, Dengue virus
KLFMAFVA

SEQ ID NO: 28115 - protein, 8 aa, Dengue virus
LFMAFVAF

SEQ ID NO: 28116 - protein, 8 aa, Dengue virus
FMAFVAFL

SEQ ID NO: 28117 - protein, 8 aa, Dengue virus
MAFVAFLR

SEQ ID NO: 28118 - protein, 8 aa, Dengue virus
AFVAFLRF

SEQ ID NO: 28119 - protein, 8 aa, Dengue virus
FVAFLRFL

SEQ ID NO: 28120 - protein, 8 aa, Dengue virus
FLTIPPTV

SEQ ID NO: 28121 - protein, 8 aa, Dengue virus
LTIPPTVG

SEQ ID NO: 28122 - protein, 8 aa, Dengue virus
TIPPTVGI

SEQ ID NO: 28123 - protein, 8 aa, Dengue virus
IPPTVGIL

SEQ ID NO: 28124 - protein, 8 aa, Dengue virus
PPTVGILK

SEQ ID NO: 28125 - protein, 8 aa, Dengue virus
PTVGILKR

SEQ ID NO: 28126 - protein, 8 aa, Dengue virus
TVGILKRW

SEQ ID NO: 28127 - protein, 8 aa, Dengue virus
VGILKRWG

SEQ ID NO: 28128 - protein, 8 aa, Dengue virus
ILKRWGTV

SEQ ID NO: 28129 - protein, 8 aa, Dengue virus
LKRWGTVK

SEQ ID NO: 28130 - protein, 8 aa, Dengue virus
KRWGTVKK

SEQ ID NO: 28131 - protein, 8 aa, Dengue virus
RWGTVKKS

SEQ ID NO: 28132 - protein, 8 aa, Dengue virus
WGTVKKSK

SEQ ID NO: 28133 - protein, 8 aa, Dengue virus
GTVKKSKA

SEQ ID NO: 28134 - protein, 8 aa, Dengue virus
TVKKSKAI

SEQ ID NO: 28135 - protein, 8 aa, Dengue virus
VKKSKAIN

SEQ ID NO: 28136 - protein, 8 aa, Dengue virus
KKSKAISV

SEQ ID NO: 28137 - protein, 8 aa, Dengue virus
KSKAISVL

SEQ ID NO: 28138 - protein, 8 aa, Dengue virus
SKAISVLR

SEQ ID NO: 28139 - protein, 8 aa, Dengue virus
KAISVLRG

SEQ ID NO: 28140 - protein, 8 aa, Dengue virus
AISVLRGF

SEQ ID NO: 28141 - protein, 8 aa, Dengue virus
ISVLRGFR

SEQ ID NO: 28142 - protein, 8 aa, Dengue virus
SVLRGFRK

SEQ ID NO: 28143 - protein, 8 aa, Dengue virus
VLRGFRRE

SEQ ID NO: 28144 - protein, 8 aa, Dengue virus
REIGRMLN

SEQ ID NO: 28145 - protein, 8 aa, Dengue virus
RMLNILNK

SEQ ID NO: 28146 - protein, 8 aa, Dengue virus
MLNILNKR

SEQ ID NO: 28147 - protein, 8 aa, Dengue virus
LNILNKRR

SEQ ID NO: 28148 - protein, 8 aa, Dengue virus
NILNKRRR

SEQ ID NO: 28149 - protein, 8 aa, Dengue virus
ILNRRRRS

SEQ ID NO: 28150 - protein, 8 aa, Dengue virus
LNRRRRSA

SEQ ID NO: 28151 - protein, 8 aa, Dengue virus
NRRRRSAG

SEQ ID NO: 28152 - protein, 8 aa, Dengue virus
IPTVMAFH

SEQ ID NO: 28153 - protein, 8 aa, Dengue virus
PTVMAFHL

SEQ ID NO: 28154 - protein, 8 aa, Dengue virus
TVMAFHLT

SEQ ID NO: 28155 - protein, 8 aa, Dengue virus
VMAFHLTT

SEQ ID NO: 28156 - protein, 8 aa, Dengue virus
VAFHLTTR

SEQ ID NO: 28157 - protein, 8 aa, Dengue virus
GEPHMIVS

SEQ ID NO: 28158 - protein, 8 aa, Dengue virus
EPHMIVGI

SEQ ID NO: 28159 - protein, 8 aa, Dengue virus
PHMIVGIQ

SEQ ID NO: 28160 - protein, 8 aa, Dengue virus
HMIVGIQE

SEQ ID NO: 28161 - protein, 8 aa, Dengue virus
MIVGIQEK

SEQ ID NO: 28162 - protein, 8 aa, Dengue virus
IVGIQEKG

SEQ ID NO: 28163 - protein, 8 aa, Dengue virus
VGIQEKGK

SEQ ID NO: 28164 - protein, 8 aa, Dengue virus
GIQEKGKS

SEQ ID NO: 28165 - protein, 8 aa, Dengue virus
IQEKGKSL

SEQ ID NO: 28166 - protein, 8 aa, Dengue virus
NEKGKSLL

SEQ ID NO: 28167 - protein, 8 aa, Dengue virus
KSLLFKTK

SEQ ID NO: 28168 - protein, 8 aa, Dengue virus
SLLFKTEN

SEQ ID NO: 28169 - protein, 8 aa, Dengue virus
LLFKTENG

SEQ ID NO: 28170 - protein, 8 aa, Dengue virus
NGVNMCTL

SEQ ID NO: 28171 - protein, 8 aa, Dengue virus
GTNMCTLM

SEQ ID NO: 28172 - protein, 8 aa, Dengue virus
TNMCTLMA

SEQ ID NO: 28173 - protein, 8 aa, Dengue virus
NMCTLMAM

SEQ ID NO: 28174 - protein, 8 aa, Dengue virus
MCTLMAMD

SEQ ID NO: 28175 - protein, 8 aa, Dengue virus
CTLMAMDL

SEQ ID NO: 28176 - protein, 8 aa, Dengue virus
TLMAMDLG

SEQ ID NO: 28177 - protein, 8 aa, Dengue virus
LMAMDLGE

SEQ ID NO: 28178 - protein, 8 aa, Dengue virus
MAMDLGEL

SEQ ID NO: 28179 - protein, 8 aa, Dengue virus
AMDLGELC

SEQ ID NO: 28180 - protein, 8 aa, Dengue virus
MDLGELCE

SEQ ID NO: 28181 - protein, 8 aa, Dengue virus
GELCEDTV

SEQ ID NO: 28182 - protein, 8 aa, Dengue virus
ELCEDTVT

SEQ ID NO: 28183 - protein, 8 aa, Dengue virus
LCEDTVTY

SEQ ID NO: 28184 - protein, 8 aa, Dengue virus
CEDTITYN

SEQ ID NO: 28185 - protein, 8 aa, Dengue virus
EDTITYNC

SEQ ID NO: 28186 - protein, 8 aa, Dengue virus
DTITYNCP

SEQ ID NO: 28187 - protein, 8 aa, Dengue virus
TITYNCPL

SEQ ID NO: 28188 - protein, 8 aa, Dengue virus
ITYNCPLL

SEQ ID NO: 28189 - protein, 8 aa, Dengue virus
TYNCPLLR

SEQ ID NO: 28190 - protein, 8 aa, Dengue virus
YNCPLLRQ

SEQ ID NO: 28191 - protein, 8 aa, Dengue virus
NCPLLRQN

SEQ ID NO: 28192 - protein, 8 aa, Dengue virus
CPFLKQNE

SEQ ID NO: 28193 - protein, 8 aa, Dengue virus
PFLKQNEP

SEQ ID NO: 28194 - protein, 8 aa, Dengue virus
FLKQNEPE

SEQ ID NO: 28195 - protein, 8 aa, Dengue virus
LKQNEPED

SEQ ID NO: 28196 - protein, 8 aa, Dengue virus
KQNEPEDI

SEQ ID NO: 28197 - protein, 8 aa, Dengue virus
CNSTSTWI

SEQ ID NO: 28198 - protein, 8 aa, Dengue virus
NSTSTWIT

SEQ ID NO: 28199 - protein, 8 aa, Dengue virus
STSTWITY

SEQ ID NO: 28200 - protein, 8 aa, Dengue virus
TSTWITYG

SEQ ID NO: 28201 - protein, 8 aa, Dengue virus
STWITYGT

SEQ ID NO: 28202 - protein, 8 aa, Dengue virus
TWITYGTC

SEQ ID NO: 28203 - protein, 8 aa, Dengue virus
WVTYGTCS

SEQ ID NO: 28204 - protein, 8 aa, Dengue virus
ATGEHRRE

SEQ ID NO: 28205 - protein, 8 aa, Dengue virus
MGEHRREK

SEQ ID NO: 28206 - protein, 8 aa, Dengue virus
VALVPHVR

SEQ ID NO: 28207 - protein, 8 aa, Dengue virus
ALVPHVRM

SEQ ID NO: 28208 - protein, 8 aa, Dengue virus
LVPHVRMG

SEQ ID NO: 28209 - protein, 8 aa, Dengue virus
VPHVRMGL

SEQ ID NO: 28210 - protein, 8 aa, Dengue virus
SSEGAWKQ

SEQ ID NO: 28211 - protein, 8 aa, Dengue virus
SEGAWKHA

SEQ ID NO: 28212 - protein, 8 aa, Dengue virus
EGAWKHAQ

SEQ ID NO: 28213 - protein, 8 aa, Dengue virus
GAWKHAQR

SEQ ID NO: 28214 - protein, 8 aa, Dengue virus
AWKHAQRI

SEQ ID NO: 28215 - protein, 8 aa, Dengue virus
WKHAQRIE

SEQ ID NO: 28216 - protein, 8 aa, Dengue virus
KHAQRIET

SEQ ID NO: 28217 - protein, 8 aa, Dengue virus
HAQRIETW

SEQ ID NO: 28218 - protein, 8 aa, Dengue virus
AQRIETWI

SEQ ID NO: 28219 - protein, 8 aa, Dengue virus
QRIETWVL

SEQ ID NO: 28220 - protein, 8 aa, Dengue virus
RIETWVLR

SEQ ID NO: 28221 - protein, 8 aa, Dengue virus
IETWVLRH

SEQ ID NO: 28222 - protein, 8 aa, Dengue virus
ETWVLRHP

SEQ ID NO: 28223 - protein, 8 aa, Dengue virus
TWVLRHPG

SEQ ID NO: 28224 - protein, 8 aa, Dengue virus
WVLRHPGF

SEQ ID NO: 28225 - protein, 8 aa, Dengue virus
VLRHPGFT

SEQ ID NO: 28226 - protein, 8 aa, Dengue virus
LRHPGFTM

SEQ ID NO: 28227 - protein, 8 aa, Dengue virus
RHPGFTMM

SEQ ID NO: 28228 - protein, 8 aa, Dengue virus
HPGFTMMA

SEQ ID NO: 28229 - protein, 8 aa, Dengue virus
PGFTMMAA

SEQ ID NO: 28230 - protein, 8 aa, Dengue virus
MAAVLAYT

SEQ ID NO: 28231 - protein, 8 aa, Dengue virus
AAILAYTV

SEQ ID NO: 28232 - protein, 8 aa, Dengue virus
AILAYTVG

SEQ ID NO: 28233 - protein, 8 aa, Dengue virus
ILAYTVGT

SEQ ID NO: 28234 - protein, 8 aa, Dengue virus
LAYTVGTT

SEQ ID NO: 28235 - protein, 8 aa, Dengue virus
AYTIGTTY

SEQ ID NO: 28236 - protein, 8 aa, Dengue virus
YTIGTTYF

SEQ ID NO: 28237 - protein, 8 aa, Dengue virus
TIGTTYFQ

SEQ ID NO: 28238 - protein, 8 aa, Dengue virus
IGTTYFQR

SEQ ID NO: 28239 - protein, 8 aa, Dengue virus
GTTHFQRV

SEQ ID NO: 28240 - protein, 8 aa, Dengue virus
TTHFQRVL

SEQ ID NO: 28241 - protein, 8 aa, Dengue virus
THFQRVLI

SEQ ID NO: 28242 - protein, 8 aa, Dengue virus
HFQRVLIF

SEQ ID NO: 28243 - protein, 8 aa, Dengue virus
FQRVLIFI

SEQ ID NO: 28244 - protein, 8 aa, Dengue virus
QRVLIFIL

SEQ ID NO: 28245 - protein, 8 aa, Dengue virus
RVLIFILL

SEQ ID NO: 28246 - protein, 8 aa, Dengue virus
VLIFILLT

SEQ ID NO: 28247 - protein, 8 aa, Dengue virus
LIFILLAA

SEQ ID NO: 28248 - protein, 8 aa, Dengue virus
IFILLAAV

SEQ ID NO: 28249 - protein, 8 aa, Dengue virus
FILLAAVA

SEQ ID NO: 28250 - protein, 8 aa, Dengue virus
ILLAAVAP

SEQ ID NO: 28251 - protein, 8 aa, Dengue virus
LLAAVAPS

SEQ ID NO: 28252 - protein, 8 aa, Dengue virus
LAAVAPSM

SEQ ID NO: 28253 - protein, 8 aa, Dengue virus
AAVAPSMT

SEQ ID NO: 28254 - protein, 8 aa, Dengue virus
AVTPSMTM

SEQ ID NO: 28255 - protein, 8 aa, Dengue virus
IAPSMTMR

SEQ ID NO: 28256 - protein, 8 aa, Dengue virus
TPSMTMRC

SEQ ID NO: 28257 - protein, 8 aa, Dengue virus
MTMRCIGM

SEQ ID NO: 28258 - protein, 8 aa, Dengue virus
TMRCIGMS

SEQ ID NO: 28259 - protein, 8 aa, Dengue virus
MRCIGMSN

SEQ ID NO: 28260 - protein, 8 aa, Dengue virus
RCIGMSNR

SEQ ID NO: 28261 - protein, 8 aa, Dengue virus
CIGMSNRD

SEQ ID NO: 28262 - protein, 8 aa, Dengue virus
IGMSNRDF

SEQ ID NO: 28263 - protein, 8 aa, Dengue virus
GMSNRDFV

SEQ ID NO: 28264 - protein, 8 aa, Dengue virus
MSNRDFVE

SEQ ID NO: 28265 - protein, 8 aa, Dengue virus
PTLDFELT

SEQ ID NO: 28266 - protein, 8 aa, Dengue virus
TLDFELTK

SEQ ID NO: 28267 - protein, 8 aa, Dengue virus
LDFELTKT

SEQ ID NO: 28268 - protein, 8 aa, Dengue virus
DFELTKTE

SEQ ID NO: 28269 - protein, 8 aa, Dengue virus
FELTKTEA

SEQ ID NO: 28270 - protein, 8 aa, Dengue virus
ELTKTEAK

SEQ ID NO: 28271 - protein, 8 aa, Dengue virus
LIKTEAKH

SEQ ID NO: 28272 - protein, 8 aa, Dengue virus
KTEAKHPA

SEQ ID NO: 28273 - protein, 8 aa, Dengue virus
TEAKHPAT

SEQ ID NO: 28274 - protein, 8 aa, Dengue virus
EAKHPATL

SEQ ID NO: 28275 - protein, 8 aa, Dengue virus
AKHPATLR

SEQ ID NO: 28276 - protein, 8 aa, Dengue virus
KHPATLRK

SEQ ID NO: 28277 - protein, 8 aa, Dengue virus
HPATLRKY

SEQ ID NO: 28278 - protein, 8 aa, Dengue virus
PATLRKFC

SEQ ID NO: 28279 - protein, 8 aa, Dengue virus
ATLRKFCI

SEQ ID NO: 28280 - protein, 8 aa, Dengue virus
TLRKFCIE

SEQ ID NO: 28281 - protein, 8 aa, Dengue virus
LRKFCIEA

SEQ ID NO: 28282 - protein, 8 aa, Dengue virus
RKFCIEAK

SEQ ID NO: 28283 - protein, 8 aa, Dengue virus
KFCIEAKL

SEQ ID NO: 28284 - protein, 8 aa, Dengue virus
FCIEAKLT

SEQ ID NO: 28285 - protein, 8 aa, Dengue virus
CVEAKLTN

SEQ ID NO: 28286 - protein, 8 aa, Dengue virus
VEAKLTNT

SEQ ID NO: 28287 - protein, 8 aa, Dengue virus
KLTNTTTA

SEQ ID NO: 28288 - protein, 8 aa, Dengue virus
LTNTTTAS

SEQ ID NO: 28289 - protein, 8 aa, Dengue virus
TNTTTASR

SEQ ID NO: 28290 - protein, 8 aa, Dengue virus
NTTTASRC

SEQ ID NO: 28291 - protein, 8 aa, Dengue virus
TTTASRCP

SEQ ID NO: 28292 - protein, 8 aa, Dengue virus
TTASRCPT

SEQ ID NO: 28293 - protein, 8 aa, Dengue virus
TASRCPTQ

SEQ ID NO: 28294 - protein, 8 aa, Dengue virus
ASRCPTQG

SEQ ID NO: 28295 - protein, 8 aa, Dengue virus
CPTQGEPT

SEQ ID NO: 28296 - protein, 8 aa, Dengue virus
PTQGEPTL

SEQ ID NO: 28297 - protein, 8 aa, Dengue virus
TQGEPSLK

SEQ ID NO: 28298 - protein, 8 aa, Dengue virus
QGEPSLKE

SEQ ID NO: 28299 - protein, 8 aa, Dengue virus
GEPSLKEE

SEQ ID NO: 28300 - protein, 8 aa, Dengue virus
EPSLKEEQ

SEQ ID NO: 28301 - protein, 8 aa, Dengue virus
PSLKEEQD

SEQ ID NO: 28302 - protein, 8 aa, Dengue virus
SLKEEQDK

SEQ ID NO: 28303 - protein, 8 aa, Dengue virus
LKEEQDKR

SEQ ID NO: 28304 - protein, 8 aa, Dengue virus
KEEQDKRF

SEQ ID NO: 28305 - protein, 8 aa, Dengue virus
EEQDKRFI

SEQ ID NO: 28306 - protein, 8 aa, Dengue virus
EQDKRFIC

SEQ ID NO: 28307 - protein, 8 aa, Dengue virus
QDKRFICK

SEQ ID NO: 28308 - protein, 8 aa, Dengue virus
DKRFICKH

SEQ ID NO: 28309 - protein, 8 aa, Dengue virus
KRFICKHS

SEQ ID NO: 28310 - protein, 8 aa, Dengue virus
RFICKHSM

SEQ ID NO: 28311 - protein, 8 aa, Dengue virus
FICKHSMV

SEQ ID NO: 28312 - protein, 8 aa, Dengue virus
ICKHSMVD

SEQ ID NO: 28313 - protein, 8 aa, Dengue virus
CRHSMVDR

SEQ ID NO: 28314 - protein, 8 aa, Dengue virus
RHSMVDRG

SEQ ID NO: 28315 - protein, 8 aa, Dengue virus
GGIVTCAK

SEQ ID NO: 28316 - protein, 8 aa, Dengue virus
GIVTCAKF

SEQ ID NO: 28317 - protein, 8 aa, Dengue virus
IVTCAMFR

SEQ ID NO: 28318 - protein, 8 aa, Dengue virus
VTCAMFRC

SEQ ID NO: 28319 - protein, 8 aa, Dengue virus
TCAMFRCK

SEQ ID NO: 28320 - protein, 8 aa, Dengue virus
CAMFRCKK

SEQ ID NO: 28321 - protein, 8 aa, Dengue virus
AMFRCKKN

SEQ ID NO: 28322 - protein, 8 aa, Dengue virus
MFRCKKNM

SEQ ID NO: 28323 - protein, 8 aa, Dengue virus
FRCKKNME

SEQ ID NO: 28324 - protein, 8 aa, Dengue virus
RCKKNMEG

SEQ ID NO: 28325 - protein, 8 aa, Dengue virus
CKKNMKGK

SEQ ID NO: 28326 - protein, 8 aa, Dengue virus
KKNMEGKI

SEQ ID NO: 28327 - protein, 8 aa, Dengue virus
KNMEGKIV

SEQ ID NO: 28328 - protein, 8 aa, Dengue virus
NMEGKVVQ

SEQ ID NO: 28329 - protein, 8 aa, Dengue virus
MEGKVVQP

SEQ ID NO: 28330 - protein, 8 aa, Dengue virus
EGKVVQPE

SEQ ID NO: 28331 - protein, 8 aa, Dengue virus
GKVVQPEN

SEQ ID NO: 28332 - protein, 8 aa, Dengue virus
KVVQPENL

SEQ ID NO: 28333 - protein, 8 aa, Dengue virus
VVQPENLE

SEQ ID NO: 28334 - protein, 8 aa, Dengue virus
VLPENLEY

SEQ ID NO: 28335 - protein, 8 aa, Dengue virus
LPENLEYT

SEQ ID NO: 28336 - protein, 8 aa, Dengue virus
PENLEYTV

SEQ ID NO: 28337 - protein, 8 aa, Dengue virus
ENLEYTVV

SEQ ID NO: 28338 - protein, 8 aa, Dengue virus
NLEYTIVV

SEQ ID NO: 28339 - protein, 8 aa, Dengue virus
LEYTIVVT

SEQ ID NO: 28340 - protein, 8 aa, Dengue virus
EYTIVVTP

SEQ ID NO: 28341 - protein, 8 aa, Dengue virus
YTIVVTPH

SEQ ID NO: 28342 - protein, 8 aa, Dengue virus
TIVVTPHS

SEQ ID NO: 28343 - protein, 8 aa, Dengue virus
IVVTPHSG

SEQ ID NO: 28344 - protein, 8 aa, Dengue virus
VVTPHSGE

SEQ ID NO: 28345 - protein, 8 aa, Dengue virus
VTPHSGEE

SEQ ID NO: 28346 - protein, 8 aa, Dengue virus
TPHSGEEN

SEQ ID NO: 28347 - protein, 8 aa, Dengue virus
PHSGEENA

SEQ ID NO: 28348 - protein, 8 aa, Dengue virus
HSGEENAV

SEQ ID NO: 28349 - protein, 8 aa, Dengue virus
SGEENAVG

SEQ ID NO: 28350 - protein, 8 aa, Dengue virus
GEENAVGN

SEQ ID NO: 28351 - protein, 8 aa, Dengue virus
EENAVGND

SEQ ID NO: 28352 - protein, 8 aa, Dengue virus
ENAVGNDT

SEQ ID NO: 28353 - protein, 8 aa, Dengue virus
NAVGNDTG

SEQ ID NO: 28354 - protein, 8 aa, Dengue virus
AVGDDTGK

SEQ ID NO: 28355 - protein, 8 aa, Dengue virus
NDTGKHGQ

SEQ ID NO: 28356 - protein, 8 aa, Dengue virus
DTGKHGQE

SEQ ID NO: 28357 - protein, 8 aa, Dengue virus
TGKHGQEI

SEQ ID NO: 28358 - protein, 8 aa, Dengue virus
GKHGQEIK

SEQ ID NO: 28359 - protein, 8 aa, Dengue virus
KHGKEIKV

SEQ ID NO: 28360 - protein, 8 aa, Dengue virus
HGKEIKVT

SEQ ID NO: 28361 - protein, 8 aa, Dengue virus
GKEIKVTP

SEQ ID NO: 28362 - protein, 8 aa, Dengue virus
KEIKVTPQ

SEQ ID NO: 28363 - protein, 8 aa, Dengue virus
EIKVTPQS

SEQ ID NO: 28364 - protein, 8 aa, Dengue virus
IKVTPQSS

SEQ ID NO: 28365 - protein, 8 aa, Dengue virus
AEAELTDY

SEQ ID NO: 28366 - protein, 8 aa, Dengue virus
EAELTDYG

SEQ ID NO: 28367 - protein, 8 aa, Dengue virus
AELTDYGT

SEQ ID NO: 28368 - protein, 8 aa, Dengue virus
ELTDYGTI

SEQ ID NO: 28369 - protein, 8 aa, Dengue virus
LTDYGTIT

SEQ ID NO: 28370 - protein, 8 aa, Dengue virus
TDYGTITM

SEQ ID NO: 28371 - protein, 8 aa, Dengue virus
DYGTITME

SEQ ID NO: 28372 - protein, 8 aa, Dengue virus
YGTITMEC

SEQ ID NO: 28373 - protein, 8 aa, Dengue virus
GTITMECS

SEQ ID NO: 28374 - protein, 8 aa, Dengue virus
TITMECSP

SEQ ID NO: 28375 - protein, 8 aa, Dengue virus
ITMECSPR

SEQ ID NO: 28376 - protein, 8 aa, Dengue virus
MECSPRTS

SEQ ID NO: 28377 - protein, 8 aa, Dengue virus
ECSPRTSL

SEQ ID NO: 28378 - protein, 8 aa, Dengue virus
CSPRTSLD

SEQ ID NO: 28379 - protein, 8 aa, Dengue virus
SPRTSLDF

SEQ ID NO: 28380 - protein, 8 aa, Dengue virus
PRTSLDFN

SEQ ID NO: 28381 - protein, 8 aa, Dengue virus
RTSLDFNE

SEQ ID NO: 28382 - protein, 8 aa, Dengue virus
TSLDFNEM

SEQ ID NO: 28383 - protein, 8 aa, Dengue virus
SLDFNEMV

SEQ ID NO: 28384 - protein, 8 aa, Dengue virus
EMVLLQMK

SEQ ID NO: 28385 - protein, 8 aa, Dengue virus
MENKAWLV

SEQ ID NO: 28386 - protein, 8 aa, Dengue virus
ENKAWLVH

SEQ ID NO: 28387 - protein, 8 aa, Dengue virus
NKAWLVHR

SEQ ID NO: 28388 - protein, 8 aa, Dengue virus
PWLPGADK

SEQ ID NO: 28389 - protein, 8 aa, Dengue virus
WLPGADKQ

SEQ ID NO: 28390 - protein, 8 aa, Dengue virus
LPGADKQE

SEQ ID NO: 28391 - protein, 8 aa, Dengue virus
PGADKQES

SEQ ID NO: 28392 - protein, 8 aa, Dengue virus
GADKQESN

SEQ ID NO: 28393 - protein, 8 aa, Dengue virus
ADKQESNW

SEQ ID NO: 28394 - protein, 8 aa, Dengue virus
DKQESNWI

SEQ ID NO: 28395 - protein, 8 aa, Dengue virus
KQESNWIQ

SEQ ID NO: 28396 - protein, 8 aa, Dengue virus
QESNWIQK

SEQ ID NO: 28397 - protein, 8 aa, Dengue virus
ESNWIQKE

SEQ ID NO: 28398 - protein, 8 aa, Dengue virus
SNWIQKEM

SEQ ID NO: 28399 - protein, 8 aa, Dengue virus
NWIQKEML

SEQ ID NO: 28400 - protein, 8 aa, Dengue virus
WIQKEMLV

SEQ ID NO: 28401 - protein, 8 aa, Dengue virus
IQKEMLVT

SEQ ID NO: 28402 - protein, 8 aa, Dengue virus
QKEMLVTF

SEQ ID NO: 28403 - protein, 8 aa, Dengue virus
KEMLVTFK

SEQ ID NO: 28404 - protein, 8 aa, Dengue virus
EMLVTFKN

SEQ ID NO: 28405 - protein, 8 aa, Dengue virus
MLVTFKNP

SEQ ID NO: 28406 - protein, 8 aa, Dengue virus
FKNPHAKR

SEQ ID NO: 28407 - protein, 8 aa, Dengue virus
KNPHAKRQ

SEQ ID NO: 28408 - protein, 8 aa, Dengue virus
NPHAKRQD

SEQ ID NO: 28409 - protein, 8 aa, Dengue virus
PHAKRQDV

SEQ ID NO: 28410 - protein, 8 aa, Dengue virus
HAKRQDVV

SEQ ID NO: 28411 - protein, 8 aa, Dengue virus
AKRQDVVV

SEQ ID NO: 28412 - protein, 8 aa, Dengue virus
KRQDVVVL

SEQ ID NO: 28413 - protein, 8 aa, Dengue virus
RQDVVVLG

SEQ ID NO: 28414 - protein, 8 aa, Dengue virus
ATEIQMSL

SEQ ID NO: 28415 - protein, 8 aa, Dengue virus
TEIQMSLG

SEQ ID NO: 28416 - protein, 8 aa, Dengue virus
EIQMSLGN

SEQ ID NO: 28417 - protein, 8 aa, Dengue virus
IQMSLGNI

SEQ ID NO: 28418 - protein, 8 aa, Dengue virus
QMSLGNIL

SEQ ID NO: 28419 - protein, 8 aa, Dengue virus
MSLGNILF

SEQ ID NO: 28420 - protein, 8 aa, Dengue virus
SLGNILFM

SEQ ID NO: 28421 - protein, 8 aa, Dengue virus
LGNILFMG

SEQ ID NO: 28422 - protein, 8 aa, Dengue virus
GNILFMGH

SEQ ID NO: 28423 - protein, 8 aa, Dengue virus
NILFMGHL

SEQ ID NO: 28424 - protein, 8 aa, Dengue virus
ILFMGHLK

SEQ ID NO: 28425 - protein, 8 aa, Dengue virus
LFMGHLKC

SEQ ID NO: 28426 - protein, 8 aa, Dengue virus
FMGHLKCR

SEQ ID NO: 28427 - protein, 8 aa, Dengue virus
MGHLKCRL

SEQ ID NO: 28428 - protein, 8 aa, Dengue virus
MCTGKFKV

SEQ ID NO: 28429 - protein, 8 aa, Dengue virus
CTGKFKVV

SEQ ID NO: 28430 - protein, 8 aa, Dengue virus
TGKFKVVK

SEQ ID NO: 28431 - protein, 8 aa, Dengue virus
GKFKVVKE

SEQ ID NO: 28432 - protein, 8 aa, Dengue virus
KFKVVKEI

SEQ ID NO: 28433 - protein, 8 aa, Dengue virus
FKVVKEIA

SEQ ID NO: 28434 - protein, 8 aa, Dengue virus
KVVKEIAE

SEQ ID NO: 28435 - protein, 8 aa, Dengue virus
VVKEIAET

SEQ ID NO: 28436 - protein, 8 aa, Dengue virus
TQHGTIVV

SEQ ID NO: 28437 - protein, 8 aa, Dengue virus
QHGTIVVR

SEQ ID NO: 28438 - protein, 8 aa, Dengue virus
HGTIVIRI

SEQ ID NO: 28439 - protein, 8 aa, Dengue virus
GTIVIRIQ

SEQ ID NO: 28440 - protein, 8 aa, Dengue virus
TIVIRIQY

SEQ ID NO: 28441 - protein, 8 aa, Dengue virus
IVIRIQYE

SEQ ID NO: 28442 - protein, 8 aa, Dengue virus
VIRIQYEG

SEQ ID NO: 28443 - protein, 8 aa, Dengue virus
IRIQYEGD

SEQ ID NO: 28444 - protein, 8 aa, Dengue virus
RVQYEGDD

SEQ ID NO: 28445 - protein, 8 aa, Dengue virus
VQYEGDDS

SEQ ID NO: 28446 - protein, 8 aa, Dengue virus
QYEGDDSP

SEQ ID NO: 28447 - protein, 8 aa, Dengue virus
YEGDDSPC

SEQ ID NO: 28448 - protein, 8 aa, Dengue virus
EGDDSPCK

SEQ ID NO: 28449 - protein, 8 aa, Dengue virus
GDDSPCKI

SEQ ID NO: 28450 - protein, 8 aa, Dengue virus
DDSPCKIP

SEQ ID NO: 28451 - protein, 8 aa, Dengue virus
DSPCKIPF

SEQ ID NO: 28452 - protein, 8 aa, Dengue virus
SPCRIPFE

SEQ ID NO: 28453 - protein, 8 aa, Dengue virus
PCRIPFEI

SEQ ID NO: 28454 - protein, 8 aa, Dengue virus
CKIPFEIT

SEQ ID NO: 28455 - protein, 8 aa, Dengue virus
KIPFEITD

SEQ ID NO: 28456 - protein, 8 aa, Dengue virus
IPFEITDL

SEQ ID NO: 28457 - protein, 8 aa, Dengue virus
PFEITDLE

SEQ ID NO: 28458 - protein, 8 aa, Dengue virus
FEITDLEK

SEQ ID NO: 28459 - protein, 8 aa, Dengue virus
EITDLEKR

SEQ ID NO: 28460 - protein, 8 aa, Dengue virus
IMDLEKRY

SEQ ID NO: 28461 - protein, 8 aa, Dengue virus
DLEKRYVL

SEQ ID NO: 28462 - protein, 8 aa, Dengue virus
LEKRYVLG

SEQ ID NO: 28463 - protein, 8 aa, Dengue virus
EKRYVLGR

SEQ ID NO: 28464 - protein, 8 aa, Dengue virus
KRYVLGRL

SEQ ID NO: 28465 - protein, 8 aa, Dengue virus
RYVLGRLI

SEQ ID NO: 28466 - protein, 8 aa, Dengue virus
YVLGRLIT

SEQ ID NO: 28467 - protein, 8 aa, Dengue virus
ILGRLITV

SEQ ID NO: 28468 - protein, 8 aa, Dengue virus
LITVNPII

SEQ ID NO: 28469 - protein, 8 aa, Dengue virus
ITVNPIVI

SEQ ID NO: 28470 - protein, 8 aa, Dengue virus
EKDSPINI

SEQ ID NO: 28471 - protein, 8 aa, Dengue virus
KDSPINIE

SEQ ID NO: 28472 - protein, 8 aa, Dengue virus
DSPINIEA

SEQ ID NO: 28473 - protein, 8 aa, Dengue virus
SPINIEAE

SEQ ID NO: 28474 - protein, 8 aa, Dengue virus
PINIEAEP

SEQ ID NO: 28475 - protein, 8 aa, Dengue virus
INIEAEPP

SEQ ID NO: 28476 - protein, 8 aa, Dengue virus
PFGDSYIV

SEQ ID NO: 28477 - protein, 8 aa, Dengue virus
FGDSYIIV

SEQ ID NO: 28478 - protein, 8 aa, Dengue virus
GDSYIIVG

SEQ ID NO: 28479 - protein, 8 aa, Dengue virus
DSYIIVGV

SEQ ID NO: 28480 - protein, 8 aa, Dengue virus
SYIIVGVE

SEQ ID NO: 28481 - protein, 8 aa, Dengue virus
YIIVGVEP

SEQ ID NO: 28482 - protein, 8 aa, Dengue virus
IIVGVEPG

SEQ ID NO: 28483 - protein, 8 aa, Dengue virus
IVGVEPGQ

SEQ ID NO: 28484 - protein, 8 aa, Dengue virus
VGVEPGQL

SEQ ID NO: 28485 - protein, 8 aa, Dengue virus
EPGQLKLS

SEQ ID NO: 28486 - protein, 8 aa, Dengue virus
PGQLKLSW

SEQ ID NO: 28487 - protein, 8 aa, Dengue virus
GQLKLSWF

SEQ ID NO: 28488 - protein, 8 aa, Dengue virus
QLKLSWFK

SEQ ID NO: 28489 - protein, 8 aa, Dengue virus
LKLSWFKK

SEQ ID NO: 28490 - protein, 8 aa, Dengue virus
KLSWFKKG

SEQ ID NO: 28491 - protein, 8 aa, Dengue virus
LSWFKKGS

SEQ ID NO: 28492 - protein, 8 aa, Dengue virus
SWFKKGSS

SEQ ID NO: 28493 - protein, 8 aa, Dengue virus
GSSIGQMI

SEQ ID NO: 28494 - protein, 8 aa, Dengue virus
SSIGQMIE

SEQ ID NO: 28495 - protein, 8 aa, Dengue virus
SIGQMIET

SEQ ID NO: 28496 - protein, 8 aa, Dengue virus
IGQMIETT

SEQ ID NO: 28497 - protein, 8 aa, Dengue virus
GQMIETTM

SEQ ID NO: 28498 - protein, 8 aa, Dengue virus
QMIETTMR

SEQ ID NO: 28499 - protein, 8 aa, Dengue virus
MIETTMRG

SEQ ID NO: 28500 - protein, 8 aa, Dengue virus
IETTMRGA

SEQ ID NO: 28501 - protein, 8 aa, Dengue virus
TAWDFGSI

SEQ ID NO: 28502 - protein, 8 aa, Dengue virus
AWDFGSIG

SEQ ID NO: 28503 - protein, 8 aa, Dengue virus
WDFGSIGG

SEQ ID NO: 28504 - protein, 8 aa, Dengue virus
DFGSIGGV

SEQ ID NO: 28505 - protein, 8 aa, Dengue virus
FGSIGGVF

SEQ ID NO: 28506 - protein, 8 aa, Dengue virus
GSIGGVFT

SEQ ID NO: 28507 - protein, 8 aa, Dengue virus
SIGGVFTS

SEQ ID NO: 28508 - protein, 8 aa, Dengue virus
IGGVFTSV

SEQ ID NO: 28509 - protein, 8 aa, Dengue virus
GGVFTSVG

SEQ ID NO: 28510 - protein, 8 aa, Dengue virus
GVFTSVGK

SEQ ID NO: 28511 - protein, 8 aa, Dengue virus
VFTSVGKA

SEQ ID NO: 28512 - protein, 8 aa, Dengue virus
FTSVGKAL

SEQ ID NO: 28513 - protein, 8 aa, Dengue virus
TSVGKALH

SEQ ID NO: 28514 - protein, 8 aa, Dengue virus
SVGKALHQ

SEQ ID NO: 28515 - protein, 8 aa, Dengue virus
VGKALHQV

SEQ ID NO: 28516 - protein, 8 aa, Dengue virus
AIYGVAFS

SEQ ID NO: 28517 - protein, 8 aa, Dengue virus
IYGVAFSG

SEQ ID NO: 28518 - protein, 8 aa, Dengue virus
YGVAFSGV

SEQ ID NO: 28519 - protein, 8 aa, Dengue virus
GVAFSGVS

SEQ ID NO: 28520 - protein, 8 aa, Dengue virus
VAFSGVSW

SEQ ID NO: 28521 - protein, 8 aa, Dengue virus
AFSGVSWI

SEQ ID NO: 28522 - protein, 8 aa, Dengue virus
FSGVSWIM

SEQ ID NO: 28523 - protein, 8 aa, Dengue virus
SGVSWIMK

SEQ ID NO: 28524 - protein, 8 aa, Dengue virus
GVSWIMKI

SEQ ID NO: 28525 - protein, 8 aa, Dengue virus
VSWIMKIL

SEQ ID NO: 28526 - protein, 8 aa, Dengue virus
SWIMKILI

SEQ ID NO: 28527 - protein, 8 aa, Dengue virus
WIMKILIG

SEQ ID NO: 28528 - protein, 8 aa, Dengue virus
TMKILIGA

SEQ ID NO: 28529 - protein, 8 aa, Dengue virus
MKILIGVV

SEQ ID NO: 28530 - protein, 8 aa, Dengue virus
KILIGVVI

SEQ ID NO: 28531 - protein, 8 aa, Dengue virus
ILIGVVIT

SEQ ID NO: 28532 - protein, 8 aa, Dengue virus
LIGVVITW

SEQ ID NO: 28533 - protein, 8 aa, Dengue virus
IGVVITWI

SEQ ID NO: 28534 - protein, 8 aa, Dengue virus
GVVITWIG

SEQ ID NO: 28535 - protein, 8 aa, Dengue virus
VVITWIGM

SEQ ID NO: 28536 - protein, 8 aa, Dengue virus
VITWIGMN

SEQ ID NO: 28537 - protein, 8 aa, Dengue virus
RSTSLSVT

SEQ ID NO: 28538 - protein, 8 aa, Dengue virus
STSLSVTL

SEQ ID NO: 28539 - protein, 8 aa, Dengue virus
TSLSVTLV

SEQ ID NO: 28540 - protein, 8 aa, Dengue virus
SLSVTLVL

SEQ ID NO: 28541 - protein, 8 aa, Dengue virus
LSVTLVLV

SEQ ID NO: 28542 - protein, 8 aa, Dengue virus
SVTLVLVG

SEQ ID NO: 28543 - protein, 8 aa, Dengue virus
VSLVLVGI

SEQ ID NO: 28544 - protein, 8 aa, Dengue virus
SLVLVGIV

SEQ ID NO: 28545 - protein, 8 aa, Dengue virus
LVLVGIVT

SEQ ID NO: 28546 - protein, 8 aa, Dengue virus
VLVGIVTL

SEQ ID NO: 28547 - protein, 8 aa, Dengue virus
LVGIVTLY

SEQ ID NO: 28548 - protein, 8 aa, Dengue virus
VGIVTLYL

SEQ ID NO: 28549 - protein, 8 aa, Dengue virus
GIVTLYLG

SEQ ID NO: 28550 - protein, 8 aa, Dengue virus
IVTLYLGV

SEQ ID NO: 28551 - protein, 8 aa, Dengue virus
VTLYLGAM

SEQ ID NO: 28552 - protein, 8 aa, Dengue virus
TLYLGAMV

SEQ ID NO: 28553 - protein, 8 aa, Dengue virus
LYLGAMVQ

SEQ ID NO: 28554 - protein, 8 aa, Dengue virus
YLGAMVQA

SEQ ID NO: 28555 - protein, 8 aa, Dengue virus
LGAMVQAD

SEQ ID NO: 28556 - protein, 8 aa, Dengue virus
GAMVQADS

SEQ ID NO: 28557 - protein, 8 aa, Dengue virus
AMVQADSG

SEQ ID NO: 28558 - protein, 8 aa, Dengue virus
VVQADSGC

SEQ ID NO: 28559 - protein, 8 aa, Dengue virus
VQADTGCV

SEQ ID NO: 28560 - protein, 8 aa, Dengue virus
QADTGCVV

SEQ ID NO: 28561 - protein, 8 aa, Dengue virus
ADTGCVVS

SEQ ID NO: 28562 - protein, 8 aa, Dengue virus
DTGCVVSW

SEQ ID NO: 28563 - protein, 8 aa, Dengue virus
TGCVVSWK

SEQ ID NO: 28564 - protein, 8 aa, Dengue virus
GCVVSWKS

SEQ ID NO: 28565 - protein, 8 aa, Dengue virus
CVVSWKSK

SEQ ID NO: 28566 - protein, 8 aa, Dengue virus
VVSWKSKE

SEQ ID NO: 28567 - protein, 8 aa, Dengue virus
VSWKSKEL

SEQ ID NO: 28568 - protein, 8 aa, Dengue virus
SWKSKELK

SEQ ID NO: 28569 - protein, 8 aa, Dengue virus
WKSKELKC

SEQ ID NO: 28570 - protein, 8 aa, Dengue virus
KSKELKCG

SEQ ID NO: 28571 - protein, 8 aa, Dengue virus
SKELKCGS

SEQ ID NO: 28572 - protein, 8 aa, Dengue virus
KCGSGIFV

SEQ ID NO: 28573 - protein, 8 aa, Dengue virus
CGSGIFVT

SEQ ID NO: 28574 - protein, 8 aa, Dengue virus
GSGIFVTD

SEQ ID NO: 28575 - protein, 8 aa, Dengue virus
SGIFVTDN

SEQ ID NO: 28576 - protein, 8 aa, Dengue virus
GIFVTDNV

SEQ ID NO: 28577 - protein, 8 aa, Dengue virus
IFVTDNVH

SEQ ID NO: 28578 - protein, 8 aa, Dengue virus
FVTDNVHT

SEQ ID NO: 28579 - protein, 8 aa, Dengue virus
VTDNVHTW

SEQ ID NO: 28580 - protein, 8 aa, Dengue virus
EQYKFQPD

SEQ ID NO: 28581 - protein, 8 aa, Dengue virus
QYKFQPDS

SEQ ID NO: 28582 - protein, 8 aa, Dengue virus
YKFQPDSP

SEQ ID NO: 28583 - protein, 8 aa, Dengue virus
KFQPDSPS

SEQ ID NO: 28584 - protein, 8 aa, Dengue virus
FQPDSPSK

SEQ ID NO: 28585 - protein, 8 aa, Dengue virus
QPDSPSKL

SEQ ID NO: 28586 - protein, 8 aa, Dengue virus
PDSPSKLA

SEQ ID NO: 28587 - protein, 8 aa, Dengue virus
DSPSKLAS

SEQ ID NO: 28588 - protein, 8 aa, Dengue virus
ASAIQKAQ

SEQ ID NO: 28589 - protein, 8 aa, Dengue virus
SAIQKAQE

SEQ ID NO: 28590 - protein, 8 aa, Dengue virus
AIQKAQEE

SEQ ID NO: 28591 - protein, 8 aa, Dengue virus
IQKAQEEG

SEQ ID NO: 28592 - protein, 8 aa, Dengue virus
QKAQEEGI

SEQ ID NO: 28593 - protein, 8 aa, Dengue virus
KAQEEGIC

SEQ ID NO: 28594 - protein, 8 aa, Dengue virus
AQEEGICG

SEQ ID NO: 28595 - protein, 8 aa, Dengue virus
QEEGICGI

SEQ ID NO: 28596 - protein, 8 aa, Dengue virus
EEDICGIR

SEQ ID NO: 28597 - protein, 8 aa, Dengue virus
EDICGIRS

SEQ ID NO: 28598 - protein, 8 aa, Dengue virus
DICGIRSV

SEQ ID NO: 28599 - protein, 8 aa, Dengue virus
ENLMWRQI

SEQ ID NO: 28600 - protein, 8 aa, Dengue virus
NLMWRQIT

SEQ ID NO: 28601 - protein, 8 aa, Dengue virus
LMWKQITS

SEQ ID NO: 28602 - protein, 8 aa, Dengue virus
MWKQITSE

SEQ ID NO: 28603 - protein, 8 aa, Dengue virus
WKQITSEL

SEQ ID NO: 28604 - protein, 8 aa, Dengue virus
KQITSELN

SEQ ID NO: 28605 - protein, 8 aa, Dengue virus
QITSELNH

SEQ ID NO: 28606 - protein, 8 aa, Dengue virus
ITSELNHI

SEQ ID NO: 28607 - protein, 8 aa, Dengue virus
TSELNHIL

SEQ ID NO: 28608 - protein, 8 aa, Dengue virus
PELNHILA

SEQ ID NO: 28609 - protein, 8 aa, Dengue virus
ELNHILAE

SEQ ID NO: 28610 - protein, 8 aa, Dengue virus
LNHILAEN

SEQ ID NO: 28611 - protein, 8 aa, Dengue virus
NHILAENE

SEQ ID NO: 28612 - protein, 8 aa, Dengue virus
HILAENEV

SEQ ID NO: 28613 - protein, 8 aa, Dengue virus
ILAENEVK

SEQ ID NO: 28614 - protein, 8 aa, Dengue virus
LAENEVKL

SEQ ID NO: 28615 - protein, 8 aa, Dengue virus
AENEVKLT

SEQ ID NO: 28616 - protein, 8 aa, Dengue virus
ENEAKLTI

SEQ ID NO: 28617 - protein, 8 aa, Dengue virus
NEAKLTIM

SEQ ID NO: 28618 - protein, 8 aa, Dengue virus
EAKLTIMT

SEQ ID NO: 28619 - protein, 8 aa, Dengue virus
AKLTIMTG

SEQ ID NO: 28620 - protein, 8 aa, Dengue virus
KLTIMTGE

SEQ ID NO: 28621 - protein, 8 aa, Dengue virus
LTIMTGDT

SEQ ID NO: 28622 - protein, 8 aa, Dengue virus
TIMTGDIR

SEQ ID NO: 28623 - protein, 8 aa, Dengue virus
IMTGDIRG

SEQ ID NO: 28624 - protein, 8 aa, Dengue virus
MTGDIRGI

SEQ ID NO: 28625 - protein, 8 aa, Dengue virus
TGDIRGIM

SEQ ID NO: 28626 - protein, 8 aa, Dengue virus
GDIRGIMQ

SEQ ID NO: 28627 - protein, 8 aa, Dengue virus
IRGIMQAG

SEQ ID NO: 28628 - protein, 8 aa, Dengue virus
RGIMQAGK

SEQ ID NO: 28629 - protein, 8 aa, Dengue virus
GIMQVGKR

SEQ ID NO: 28630 - protein, 8 aa, Dengue virus
IMQVGKRS

SEQ ID NO: 28631 - protein, 8 aa, Dengue virus
MQVGKRSL

SEQ ID NO: 28632 - protein, 8 aa, Dengue virus
GRRSLKPQ

SEQ ID NO: 28633 - protein, 8 aa, Dengue virus
RRSLKPQP

SEQ ID NO: 28634 - protein, 8 aa, Dengue virus
RSLKPQPT

SEQ ID NO: 28635 - protein, 8 aa, Dengue virus
SLKPQPTE

SEQ ID NO: 28636 - protein, 8 aa, Dengue virus
LKPQPTEL

SEQ ID NO: 28637 - protein, 8 aa, Dengue virus
RPQPTELR

SEQ ID NO: 28638 - protein, 8 aa, Dengue virus
PQPTELRY

SEQ ID NO: 28639 - protein, 8 aa, Dengue virus
QPTELRYS

SEQ ID NO: 28640 - protein, 8 aa, Dengue virus
PTELRYSW

SEQ ID NO: 28641 - protein, 8 aa, Dengue virus
TELRYSWK

SEQ ID NO: 28642 - protein, 8 aa, Dengue virus
ELKYSWKA

SEQ ID NO: 28643 - protein, 8 aa, Dengue virus
LKYSWKAW

SEQ ID NO: 28644 - protein, 8 aa, Dengue virus
KYSWKAWG

SEQ ID NO: 28645 - protein, 8 aa, Dengue virus
YSWKAWGK

SEQ ID NO: 28646 - protein, 8 aa, Dengue virus
SWKAWGKA

SEQ ID NO: 28647 - protein, 8 aa, Dengue virus
WKAWGKAK

SEQ ID NO: 28648 - protein, 8 aa, Dengue virus
KAWGKAKM

SEQ ID NO: 28649 - protein, 8 aa, Dengue virus
AWGKAKML

SEQ ID NO: 28650 - protein, 8 aa, Dengue virus
WGKAKVLS

SEQ ID NO: 28651 - protein, 8 aa, Dengue virus
GKAKVLST

SEQ ID NO: 28652 - protein, 8 aa, Dengue virus
KAKVLSTE

SEQ ID NO: 28653 - protein, 8 aa, Dengue virus
YNQTFLID

SEQ ID NO: 28654 - protein, 8 aa, Dengue virus
NHTFLIDG

SEQ ID NO: 28655 - protein, 8 aa, Dengue virus
HTFLIDGP

SEQ ID NO: 28656 - protein, 8 aa, Dengue virus
LIDGPETT

SEQ ID NO: 28657 - protein, 8 aa, Dengue virus
IDGPETTE

SEQ ID NO: 28658 - protein, 8 aa, Dengue virus
DGPETTEC

SEQ ID NO: 28659 - protein, 8 aa, Dengue virus
GPETTECP

SEQ ID NO: 28660 - protein, 8 aa, Dengue virus
PETTECPN

SEQ ID NO: 28661 - protein, 8 aa, Dengue virus
ETTECPNT

SEQ ID NO: 28662 - protein, 8 aa, Dengue virus
TTECPNTN

SEQ ID NO: 28663 - protein, 8 aa, Dengue virus
TECPNTNR

SEQ ID NO: 28664 - protein, 8 aa, Dengue virus
ECPNSNRA

SEQ ID NO: 28665 - protein, 8 aa, Dengue virus
CPNSNRAW

SEQ ID NO: 28666 - protein, 8 aa, Dengue virus
PNSNRAWN

SEQ ID NO: 28667 - protein, 8 aa, Dengue virus
NSNRAWNS

SEQ ID NO: 28668 - protein, 8 aa, Dengue virus
SNRAWNSL

SEQ ID NO: 28669 - protein, 8 aa, Dengue virus
VEDYGFGI

SEQ ID NO: 28670 - protein, 8 aa, Dengue virus
EDYGFGIF

SEQ ID NO: 28671 - protein, 8 aa, Dengue virus
DYGFGVFS

SEQ ID NO: 28672 - protein, 8 aa, Dengue virus
YGFGVFST

SEQ ID NO: 28673 - protein, 8 aa, Dengue virus
GFGVFSTN

SEQ ID NO: 28674 - protein, 8 aa, Dengue virus
FGVFSTNI

SEQ ID NO: 28675 - protein, 8 aa, Dengue virus
GVFSTNIW

SEQ ID NO: 28676 - protein, 8 aa, Dengue virus
VFSTNIWL

SEQ ID NO: 28677 - protein, 8 aa, Dengue virus
FSTNIWLK

SEQ ID NO: 28678 - protein, 8 aa, Dengue virus
STNIWLKL

SEQ ID NO: 28679 - protein, 8 aa, Dengue virus
TNIWLKLK

SEQ ID NO: 28680 - protein, 8 aa, Dengue virus
NIWLKLKE

SEQ ID NO: 28681 - protein, 8 aa, Dengue virus
IWLKLKEK

SEQ ID NO: 28682 - protein, 8 aa, Dengue virus
WLKLKEKQ

SEQ ID NO: 28683 - protein, 8 aa, Dengue virus
LKLKEKQD

SEQ ID NO: 28684 - protein, 8 aa, Dengue virus
ICDSKLMS

SEQ ID NO: 28685 - protein, 8 aa, Dengue virus
SKLMSAAV

SEQ ID NO: 28686 - protein, 8 aa, Dengue virus
KLMSAAVK

SEQ ID NO: 28687 - protein, 8 aa, Dengue virus
LMSAAVKD

SEQ ID NO: 28688 - protein, 8 aa, Dengue virus
MSAAVKDD

SEQ ID NO: 28689 - protein, 8 aa, Dengue virus
SAAVKDDR

SEQ ID NO: 28690 - protein, 8 aa, Dengue virus
AAVKDDRA

SEQ ID NO: 28691 - protein, 8 aa, Dengue virus
AVKDDRAV

SEQ ID NO: 28692 - protein, 8 aa, Dengue virus
VKDDRAVH

SEQ ID NO: 28693 - protein, 8 aa, Dengue virus
KDDRAVHA

SEQ ID NO: 28694 - protein, 8 aa, Dengue virus
DDRAVHAD

SEQ ID NO: 28695 - protein, 8 aa, Dengue virus
DRAVHADM

SEQ ID NO: 28696 - protein, 8 aa, Dengue virus
MGYWIESR

SEQ ID NO: 28697 - protein, 8 aa, Dengue virus
GYWIESRL

SEQ ID NO: 28698 - protein, 8 aa, Dengue virus
YWIESRLN

SEQ ID NO: 28699 - protein, 8 aa, Dengue virus
WIESRLND

SEQ ID NO: 28700 - protein, 8 aa, Dengue virus
IESRLNDT

SEQ ID NO: 28701 - protein, 8 aa, Dengue virus
ESRLNDTW

SEQ ID NO: 28702 - protein, 8 aa, Dengue virus
SRLNDTWK

SEQ ID NO: 28703 - protein, 8 aa, Dengue virus
ALNDTWKI

SEQ ID NO: 28704 - protein, 8 aa, Dengue virus
LNDTWKIE

SEQ ID NO: 28705 - protein, 8 aa, Dengue virus
NDTWKIEK

SEQ ID NO: 28706 - protein, 8 aa, Dengue virus
DTWKIEKA

SEQ ID NO: 28707 - protein, 8 aa, Dengue virus
TWKIEKAS

SEQ ID NO: 28708 - protein, 8 aa, Dengue virus
WKIEKASF

SEQ ID NO: 28709 - protein, 8 aa, Dengue virus
KIEKASFI

SEQ ID NO: 28710 - protein, 8 aa, Dengue virus
IEKASFIE

SEQ ID NO: 28711 - protein, 8 aa, Dengue virus
EKASFIEI

SEQ ID NO: 28712 - protein, 8 aa, Dengue virus
KASFIEIK

SEQ ID NO: 28713 - protein, 8 aa, Dengue virus
ASFIEVKN

SEQ ID NO: 28714 - protein, 8 aa, Dengue virus
SFIEVKNC

SEQ ID NO: 28715 - protein, 8 aa, Dengue virus
FIEVKNCH

SEQ ID NO: 28716 - protein, 8 aa, Dengue virus
IEVKNCHW

SEQ ID NO: 28717 - protein, 8 aa, Dengue virus
EVKNCHWP

SEQ ID NO: 28718 - protein, 8 aa, Dengue virus
VKNCHWPK

SEQ ID NO: 28719 - protein, 8 aa, Dengue virus
KNCHWPKS

SEQ ID NO: 28720 - protein, 8 aa, Dengue virus
NCHWPKSH

SEQ ID NO: 28721 - protein, 8 aa, Dengue virus
CYWPRSHT

SEQ ID NO: 28722 - protein, 8 aa, Dengue virus
YWPRSHTL

SEQ ID NO: 28723 - protein, 8 aa, Dengue virus
WPRSHTLW

SEQ ID NO: 28724 - protein, 8 aa, Dengue virus
PRSHTLWS

SEQ ID NO: 28725 - protein, 8 aa, Dengue virus
RSHTLWSN

SEQ ID NO: 28726 - protein, 8 aa, Dengue virus
GVLESEMV

SEQ ID NO: 28727 - protein, 8 aa, Dengue virus
VLESEMVI

SEQ ID NO: 28728 - protein, 8 aa, Dengue virus
LESEMVIP

SEQ ID NO: 28729 - protein, 8 aa, Dengue virus
ESEMVIPK

SEQ ID NO: 28730 - protein, 8 aa, Dengue virus
SEMIIPKS

SEQ ID NO: 28731 - protein, 8 aa, Dengue virus
IPKNLAGP

SEQ ID NO: 28732 - protein, 8 aa, Dengue virus
PKNLAGPV

SEQ ID NO: 28733 - protein, 8 aa, Dengue virus
KNLAGPVS

SEQ ID NO: 28734 - protein, 8 aa, Dengue virus
NLAGPVSQ

SEQ ID NO: 28735 - protein, 8 aa, Dengue virus
LAGPVSQH

SEQ ID NO: 28736 - protein, 8 aa, Dengue virus
GPVSQHNN

SEQ ID NO: 28737 - protein, 8 aa, Dengue virus
PVSQHNNR

SEQ ID NO: 28738 - protein, 8 aa, Dengue virus
VSQHNNRP

SEQ ID NO: 28739 - protein, 8 aa, Dengue virus
SQHNNRPG

SEQ ID NO: 28740 - protein, 8 aa, Dengue virus
QHNNRPGY

SEQ ID NO: 28741 - protein, 8 aa, Dengue virus
HNYRPGYY

SEQ ID NO: 28742 - protein, 8 aa, Dengue virus
NYRPGYYT

SEQ ID NO: 28743 - protein, 8 aa, Dengue virus
YRPGYYTQ

SEQ ID NO: 28744 - protein, 8 aa, Dengue virus
RPGYHTQI

SEQ ID NO: 28745 - protein, 8 aa, Dengue virus
PGYHTQIA

SEQ ID NO: 28746 - protein, 8 aa, Dengue virus
GYHTQIAG

SEQ ID NO: 28747 - protein, 8 aa, Dengue virus
YHTQIAGP

SEQ ID NO: 28748 - protein, 8 aa, Dengue virus
HTQIAGPW

SEQ ID NO: 28749 - protein, 8 aa, Dengue virus
TQIAGPWH

SEQ ID NO: 28750 - protein, 8 aa, Dengue virus
QIAGPWHL

SEQ ID NO: 28751 - protein, 8 aa, Dengue virus
IAGPWHLG

SEQ ID NO: 28752 - protein, 8 aa, Dengue virus
AGPWHLGR

SEQ ID NO: 28753 - protein, 8 aa, Dengue virus
GPWHLGRL

SEQ ID NO: 28754 - protein, 8 aa, Dengue virus
PWHLGRLE

SEQ ID NO: 28755 - protein, 8 aa, Dengue virus
WHLGRLEM

SEQ ID NO: 28756 - protein, 8 aa, Dengue virus
HLGRLEMD

SEQ ID NO: 28757 - protein, 8 aa, Dengue virus
LGRLEMDF

SEQ ID NO: 28758 - protein, 8 aa, Dengue virus
GRLEMDFD

SEQ ID NO: 28759 - protein, 8 aa, Dengue virus
KLEMDFDL

SEQ ID NO: 28760 - protein, 8 aa, Dengue virus
LEMDFDLC

SEQ ID NO: 28761 - protein, 8 aa, Dengue virus
EMDFDFCD

SEQ ID NO: 28762 - protein, 8 aa, Dengue virus
MDFDFCDG

SEQ ID NO: 28763 - protein, 8 aa, Dengue virus
DFDFCDGT

SEQ ID NO: 28764 - protein, 8 aa, Dengue virus
FDFCDGTT

SEQ ID NO: 28765 - protein, 8 aa, Dengue virus
DFCDGTTV

SEQ ID NO: 28766 - protein, 8 aa, Dengue virus
FCDGTTVI

SEQ ID NO: 28767 - protein, 8 aa, Dengue virus
CDGTTVIV

SEQ ID NO: 28768 - protein, 8 aa, Dengue virus
DGTTVIVT

SEQ ID NO: 28769 - protein, 8 aa, Dengue virus
GTTVIVTE

SEQ ID NO: 28770 - protein, 8 aa, Dengue virus
TTVIVTED

SEQ ID NO: 28771 - protein, 8 aa, Dengue virus
TVIVTEDC

SEQ ID NO: 28772 - protein, 8 aa, Dengue virus
VIVTEDCG

SEQ ID NO: 28773 - protein, 8 aa, Dengue virus
IVTEDCGN

SEQ ID NO: 28774 - protein, 8 aa, Dengue virus
VTEECGNR

SEQ ID NO: 28775 - protein, 8 aa, Dengue virus
TEECGNRG

SEQ ID NO: 28776 - protein, 8 aa, Dengue virus
EECGNRGP

SEQ ID NO: 28777 - protein, 8 aa, Dengue virus
ECGNRGPS

SEQ ID NO: 28778 - protein, 8 aa, Dengue virus
EIRPLKER

SEQ ID NO: 28779 - protein, 8 aa, Dengue virus
IRPLKERE

SEQ ID NO: 28780 - protein, 8 aa, Dengue virus
RPLKEREE

SEQ ID NO: 28781 - protein, 8 aa, Dengue virus
PLKEREEN

SEQ ID NO: 28782 - protein, 8 aa, Dengue virus
LKEREENL

SEQ ID NO: 28783 - protein, 8 aa, Dengue virus
KEREENLV

SEQ ID NO: 28784 - protein, 8 aa, Dengue virus
EKEENLVS

SEQ ID NO: 28785 - protein, 8 aa, Dengue virus
KEENLVSS

SEQ ID NO: 28786 - protein, 8 aa, Dengue virus
EENLVSSL

SEQ ID NO: 28787 - protein, 8 aa, Dengue virus
ENLVSSLV

SEQ ID NO: 28788 - protein, 8 aa, Dengue virus
NLVSSLVT

SEQ ID NO: 28789 - protein, 8 aa, Dengue virus
LVSSLVTA

SEQ ID NO: 28790 - protein, 8 aa, Dengue virus
VSSLVTAG

SEQ ID NO: 28791 - protein, 8 aa, Dengue virus
SSLVTAGH

SEQ ID NO: 28792 - protein, 8 aa, Dengue virus
SLVTAGQG

SEQ ID NO: 28793 - protein, 8 aa, Dengue virus
LVTAGQGQ

SEQ ID NO: 28794 - protein, 8 aa, Dengue virus
VTAGHGQV

SEQ ID NO: 28795 - protein, 8 aa, Dengue virus
TAGHGQVD

SEQ ID NO: 28796 - protein, 8 aa, Dengue virus
AGHGQVDN

SEQ ID NO: 28797 - protein, 8 aa, Dengue virus
GHGQVDNF

SEQ ID NO: 28798 - protein, 8 aa, Dengue virus
HGQVDNFS

SEQ ID NO: 28799 - protein, 8 aa, Dengue virus
GQVDNFSL

SEQ ID NO: 28800 - protein, 8 aa, Dengue virus
QVDNFSLG

SEQ ID NO: 28801 - protein, 8 aa, Dengue virus
VDNFSLGV

SEQ ID NO: 28802 - protein, 8 aa, Dengue virus
DNFSLGIL

SEQ ID NO: 28803 - protein, 8 aa, Dengue virus
NFSLGILG

SEQ ID NO: 28804 - protein, 8 aa, Dengue virus
FSLGILGM

SEQ ID NO: 28805 - protein, 8 aa, Dengue virus
SLGILGMA

SEQ ID NO: 28806 - protein, 8 aa, Dengue virus
LGILGMAL

SEQ ID NO: 28807 - protein, 8 aa, Dengue virus
GILGMALF

SEQ ID NO: 28808 - protein, 8 aa, Dengue virus
ILGMALFL

SEQ ID NO: 28809 - protein, 8 aa, Dengue virus
LGMALLLE

SEQ ID NO: 28810 - protein, 8 aa, Dengue virus
GMALLLEE

SEQ ID NO: 28811 - protein, 8 aa, Dengue virus
MALLLEEM

SEQ ID NO: 28812 - protein, 8 aa, Dengue virus
ALLLEEML

SEQ ID NO: 28813 - protein, 8 aa, Dengue virus
LLLEEMLR

SEQ ID NO: 28814 - protein, 8 aa, Dengue virus
LLEEMLRT

SEQ ID NO: 28815 - protein, 8 aa, Dengue virus
EEMLRTRI

SEQ ID NO: 28816 - protein, 8 aa, Dengue virus
EMLRTRIG

SEQ ID NO: 28817 - protein, 8 aa, Dengue virus
MLRTRIGT

SEQ ID NO: 28818 - protein, 8 aa, Dengue virus
LRTRIGTK

SEQ ID NO: 28819 - protein, 8 aa, Dengue virus
RTRIGTKH

SEQ ID NO: 28820 - protein, 8 aa, Dengue virus
TRIGTKHA

SEQ ID NO: 28821 - protein, 8 aa, Dengue virus
SFMTLITG

SEQ ID NO: 28822 - protein, 8 aa, Dengue virus
FMTLITGN

SEQ ID NO: 28823 - protein, 8 aa, Dengue virus
MTLITGNM

SEQ ID NO: 28824 - protein, 8 aa, Dengue virus
ITGNMSFK

SEQ ID NO: 28825 - protein, 8 aa, Dengue virus
TGNMSFKD

SEQ ID NO: 28826 - protein, 8 aa, Dengue virus
GNMSFKDL

SEQ ID NO: 28827 - protein, 8 aa, Dengue virus
NMSFKDLG

SEQ ID NO: 28828 - protein, 8 aa, Dengue virus
MSFKDLGR

SEQ ID NO: 28829 - protein, 8 aa, Dengue virus
SFKDLGRV

SEQ ID NO: 28830 - protein, 8 aa, Dengue virus
FKDLGRVV

SEQ ID NO: 28831 - protein, 8 aa, Dengue virus
KDLGRVVV

SEQ ID NO: 28832 - protein, 8 aa, Dengue virus
DLGRVVVM

SEQ ID NO: 28833 - protein, 8 aa, Dengue virus
LGRVVVMV

SEQ ID NO: 28834 - protein, 8 aa, Dengue virus
GRVVVMVG

SEQ ID NO: 28835 - protein, 8 aa, Dengue virus
RVVVMVGA

SEQ ID NO: 28836 - protein, 8 aa, Dengue virus
MADDIGMG

SEQ ID NO: 28837 - protein, 8 aa, Dengue virus
ADDIGMGV

SEQ ID NO: 28838 - protein, 8 aa, Dengue virus
DEMGMGVT

SEQ ID NO: 28839 - protein, 8 aa, Dengue virus
EMGMGVTY

SEQ ID NO: 28840 - protein, 8 aa, Dengue virus
MGMGVTYL

SEQ ID NO: 28841 - protein, 8 aa, Dengue virus
GMGITYLA

SEQ ID NO: 28842 - protein, 8 aa, Dengue virus
MGITYLAL

SEQ ID NO: 28843 - protein, 8 aa, Dengue virus
GITYLALL

SEQ ID NO: 28844 - protein, 8 aa, Dengue virus
ITYLALLA

SEQ ID NO: 28845 - protein, 8 aa, Dengue virus
LALLAAFR

SEQ ID NO: 28846 - protein, 8 aa, Dengue virus
ALLAAFRV

SEQ ID NO: 28847 - protein, 8 aa, Dengue virus
LLAAFRVR

SEQ ID NO: 28848 - protein, 8 aa, Dengue virus
LAAFRVRP

SEQ ID NO: 28849 - protein, 8 aa, Dengue virus
AAFRVRPT

SEQ ID NO: 28850 - protein, 8 aa, Dengue virus
AFRVRPTF

SEQ ID NO: 28851 - protein, 8 aa, Dengue virus
FRVRPTFA

SEQ ID NO: 28852 - protein, 8 aa, Dengue virus
RVRPTFAV

SEQ ID NO: 28853 - protein, 8 aa, Dengue virus
VRPTFAVG

SEQ ID NO: 28854 - protein, 8 aa, Dengue virus
RPTFAVGL

SEQ ID NO: 28855 - protein, 8 aa, Dengue virus
PTFAVGLL

SEQ ID NO: 28856 - protein, 8 aa, Dengue virus
TFAVGLLL

SEQ ID NO: 28857 - protein, 8 aa, Dengue virus
FAVGLLLR

SEQ ID NO: 28858 - protein, 8 aa, Dengue virus
AVGLLLRK

SEQ ID NO: 28859 - protein, 8 aa, Dengue virus
VGLLLRKL

SEQ ID NO: 28860 - protein, 8 aa, Dengue virus
GLFLRKLT

SEQ ID NO: 28861 - protein, 8 aa, Dengue virus
LFLRKLTS

SEQ ID NO: 28862 - protein, 8 aa, Dengue virus
FLRKLTSK

SEQ ID NO: 28863 - protein, 8 aa, Dengue virus
KLTSKELL

SEQ ID NO: 28864 - protein, 8 aa, Dengue virus
LTSKELLM

SEQ ID NO: 28865 - protein, 8 aa, Dengue virus
TSKELMMT

SEQ ID NO: 28866 - protein, 8 aa, Dengue virus
SKELMMTT

SEQ ID NO: 28867 - protein, 8 aa, Dengue virus
KELMMTTI

SEQ ID NO: 28868 - protein, 8 aa, Dengue virus
ELMMTTIG

SEQ ID NO: 28869 - protein, 8 aa, Dengue virus
LMMTTIGI

SEQ ID NO: 28870 - protein, 8 aa, Dengue virus
TIGIVLLS

SEQ ID NO: 28871 - protein, 8 aa, Dengue virus
IGIVLLSQ

SEQ ID NO: 28872 - protein, 8 aa, Dengue virus
GIVLLSQS

SEQ ID NO: 28873 - protein, 8 aa, Dengue virus
PETVLELT

SEQ ID NO: 28874 - protein, 8 aa, Dengue virus
ETVLELTD

SEQ ID NO: 28875 - protein, 8 aa, Dengue virus
TVLELTDA

SEQ ID NO: 28876 - protein, 8 aa, Dengue virus
VLELTDAL

SEQ ID NO: 28877 - protein, 8 aa, Dengue virus
LELTDAIA

SEQ ID NO: 28878 - protein, 8 aa, Dengue virus
ELTDAIAL

SEQ ID NO: 28879 - protein, 8 aa, Dengue virus
LTDAIALG

SEQ ID NO: 28880 - protein, 8 aa, Dengue virus
TDAIALGI

SEQ ID NO: 28881 - protein, 8 aa, Dengue virus
DAIALGIM

SEQ ID NO: 28882 - protein, 8 aa, Dengue virus
ALALGMMA

SEQ ID NO: 28883 - protein, 8 aa, Dengue virus
LALGMMAL

SEQ ID NO: 28884 - protein, 8 aa, Dengue virus
ALGMMALK

SEQ ID NO: 28885 - protein, 8 aa, Dengue virus
VRDMEKYQ

SEQ ID NO: 28886 - protein, 8 aa, Dengue virus
RDMEKYQL

SEQ ID NO: 28887 - protein, 8 aa, Dengue virus
DMEKYQLA

SEQ ID NO: 28888 - protein, 8 aa, Dengue virus
LEKYQLAV

SEQ ID NO: 28889 - protein, 8 aa, Dengue virus
KYQLAVTV

SEQ ID NO: 28890 - protein, 8 aa, Dengue virus
YQLAVTVM

SEQ ID NO: 28891 - protein, 8 aa, Dengue virus
QLAVTVMA

SEQ ID NO: 28892 - protein, 8 aa, Dengue virus
MAILCVPN

SEQ ID NO: 28893 - protein, 8 aa, Dengue virus
AILCVPNA

SEQ ID NO: 28894 - protein, 8 aa, Dengue virus
ILCVPNAV

SEQ ID NO: 28895 - protein, 8 aa, Dengue virus
LCVPNAVI

SEQ ID NO: 28896 - protein, 8 aa, Dengue virus
CIPNVMIL

SEQ ID NO: 28897 - protein, 8 aa, Dengue virus
VPNAVILR

SEQ ID NO: 28898 - protein, 8 aa, Dengue virus
PNAVILRN

SEQ ID NO: 28899 - protein, 8 aa, Dengue virus
NAVILRNA

SEQ ID NO: 28900 - protein, 8 aa, Dengue virus
AVILRNAW

SEQ ID NO: 28901 - protein, 8 aa, Dengue virus
ILRNAWKV

SEQ ID NO: 28902 - protein, 8 aa, Dengue virus
RNAWKVSC

SEQ ID NO: 28903 - protein, 8 aa, Dengue virus
HAWKVGCT

SEQ ID NO: 28904 - protein, 8 aa, Dengue virus
AWKVSCTT

SEQ ID NO: 28905 - protein, 8 aa, Dengue virus
WKVSCTTL

SEQ ID NO: 28906 - protein, 8 aa, Dengue virus
KVSCTTLA

SEQ ID NO: 28907 - protein, 8 aa, Dengue virus
CTILAVVS

SEQ ID NO: 28908 - protein, 8 aa, Dengue virus
TILAVVSV

SEQ ID NO: 28909 - protein, 8 aa, Dengue virus
ILAVVSVS

SEQ ID NO: 28910 - protein, 8 aa, Dengue virus
LAVVSVSP

SEQ ID NO: 28911 - protein, 8 aa, Dengue virus
AVVSVSPL

SEQ ID NO: 28912 - protein, 8 aa, Dengue virus
VSVSPLFL

SEQ ID NO: 28913 - protein, 8 aa, Dengue virus
SVSPLFLT

SEQ ID NO: 28914 - protein, 8 aa, Dengue virus
VSPLFLTS

SEQ ID NO: 28915 - protein, 8 aa, Dengue virus
SPLFLTSS

SEQ ID NO: 28916 - protein, 8 aa, Dengue virus
PLFLTSSQ

SEQ ID NO: 28917 - protein, 8 aa, Dengue virus
LFLTSSQQ

SEQ ID NO: 28918 - protein, 8 aa, Dengue virus
FLTSSQQK

SEQ ID NO: 28919 - protein, 8 aa, Dengue virus
LTSSQQKT

SEQ ID NO: 28920 - protein, 8 aa, Dengue virus
TSSQQKTD

SEQ ID NO: 28921 - protein, 8 aa, Dengue virus
SSQQKTDW

SEQ ID NO: 28922 - protein, 8 aa, Dengue virus
SQQKTDWI

SEQ ID NO: 28923 - protein, 8 aa, Dengue virus
QQKTDWIP

SEQ ID NO: 28924 - protein, 8 aa, Dengue virus
QKTDWIPL

SEQ ID NO: 28925 - protein, 8 aa, Dengue virus
KTDWIPLA

SEQ ID NO: 28926 - protein, 8 aa, Dengue virus
TDWIPLAL

SEQ ID NO: 28927 - protein, 8 aa, Dengue virus
DWIPLVLT

SEQ ID NO: 28928 - protein, 8 aa, Dengue virus
WIPLVLTI

SEQ ID NO: 28929 - protein, 8 aa, Dengue virus
IPLVLTIK

SEQ ID NO: 28930 - protein, 8 aa, Dengue virus
PLVLTIKG

SEQ ID NO: 28931 - protein, 8 aa, Dengue virus
LVLTIKGL

SEQ ID NO: 28932 - protein, 8 aa, Dengue virus
VLTIKGLN

SEQ ID NO: 28933 - protein, 8 aa, Dengue virus
LTVKGLNP

SEQ ID NO: 28934 - protein, 8 aa, Dengue virus
TIKGLSPT

SEQ ID NO: 28935 - protein, 8 aa, Dengue virus
FLTTLSRP

SEQ ID NO: 28936 - protein, 8 aa, Dengue virus
LTTLSRTN

SEQ ID NO: 28937 - protein, 8 aa, Dengue virus
TTLSRTNK

SEQ ID NO: 28938 - protein, 8 aa, Dengue virus
TLSRTNKK

SEQ ID NO: 28939 - protein, 8 aa, Dengue virus
LSRTNKKR

SEQ ID NO: 28940 - protein, 8 aa, Dengue virus
SRTNKKRS

SEQ ID NO: 28941 - protein, 8 aa, Dengue virus
RTNKKRSW

SEQ ID NO: 28942 - protein, 8 aa, Dengue virus
TNKKRSWP

SEQ ID NO: 28943 - protein, 8 aa, Dengue virus
NKKRSWPL

SEQ ID NO: 28944 - protein, 8 aa, Dengue virus
KTRSWPLN

SEQ ID NO: 28945 - protein, 8 aa, Dengue virus
TRSWPLNE

SEQ ID NO: 28946 - protein, 8 aa, Dengue virus
SWPLNEAV

SEQ ID NO: 28947 - protein, 8 aa, Dengue virus
WPLNEAVM

SEQ ID NO: 28948 - protein, 8 aa, Dengue virus
PLNEAVMA

SEQ ID NO: 28949 - protein, 8 aa, Dengue virus
LNEAVMAV

SEQ ID NO: 28950 - protein, 8 aa, Dengue virus
NEAVMAVG

SEQ ID NO: 28951 - protein, 8 aa, Dengue virus
EAVMAVGM

SEQ ID NO: 28952 - protein, 8 aa, Dengue virus
AVMAVGMV

SEQ ID NO: 28953 - protein, 8 aa, Dengue virus
VMAVGMVS

SEQ ID NO: 28954 - protein, 8 aa, Dengue virus
SADLELEK

SEQ ID NO: 28955 - protein, 8 aa, Dengue virus
ADLELEKA

SEQ ID NO: 28956 - protein, 8 aa, Dengue virus
DLELERAT

SEQ ID NO: 28957 - protein, 8 aa, Dengue virus
LELERATD

SEQ ID NO: 28958 - protein, 8 aa, Dengue virus
ELERATDV

SEQ ID NO: 28959 - protein, 8 aa, Dengue virus
VRWEEQAE

SEQ ID NO: 28960 - protein, 8 aa, Dengue virus
RWEEQAEI

SEQ ID NO: 28961 - protein, 8 aa, Dengue virus
WEEQAEIS

SEQ ID NO: 28962 - protein, 8 aa, Dengue virus
EEQAEISG

SEQ ID NO: 28963 - protein, 8 aa, Dengue virus
EQAEISGS

SEQ ID NO: 28964 - protein, 8 aa, Dengue virus
GSSPILSV

SEQ ID NO: 28965 - protein, 8 aa, Dengue virus
SSPILSVT

SEQ ID NO: 28966 - protein, 8 aa, Dengue virus
SPILSVTI

SEQ ID NO: 28967 - protein, 8 aa, Dengue virus
PILSITIA

SEQ ID NO: 28968 - protein, 8 aa, Dengue virus
ILSITIAE

SEQ ID NO: 28969 - protein, 8 aa, Dengue virus
LSITIAED

SEQ ID NO: 28970 - protein, 8 aa, Dengue virus
SITIAEDG

SEQ ID NO: 28971 - protein, 8 aa, Dengue virus
ITIAEDGS

SEQ ID NO: 28972 - protein, 8 aa, Dengue virus
TIAEDGSM

SEQ ID NO: 28973 - protein, 8 aa, Dengue virus
IAEDGSMS

SEQ ID NO: 28974 - protein, 8 aa, Dengue virus
AEDGSMSI

SEQ ID NO: 28975 - protein, 8 aa, Dengue virus
IKNEEEEH

SEQ ID NO: 28976 - protein, 8 aa, Dengue virus
KNEEEEHT

SEQ ID NO: 28977 - protein, 8 aa, Dengue virus
NEEEEHTL

SEQ ID NO: 28978 - protein, 8 aa, Dengue virus
EEEEHTLT

SEQ ID NO: 28979 - protein, 8 aa, Dengue virus
EEEHTLTI

SEQ ID NO: 28980 - protein, 8 aa, Dengue virus
EEHTLTIL

SEQ ID NO: 28981 - protein, 8 aa, Dengue virus
EHTLTILI

SEQ ID NO: 28982 - protein, 8 aa, Dengue virus
HTLTILIR

SEQ ID NO: 28983 - protein, 8 aa, Dengue virus
ILTILIRT

SEQ ID NO: 28984 - protein, 8 aa, Dengue virus
GLLVISGV

SEQ ID NO: 28985 - protein, 8 aa, Dengue virus
LLVISGVF

SEQ ID NO: 28986 - protein, 8 aa, Dengue virus
LVISGVFP

SEQ ID NO: 28987 - protein, 8 aa, Dengue virus
VISGLFPV

SEQ ID NO: 28988 - protein, 8 aa, Dengue virus
ISGLFPVS

SEQ ID NO: 28989 - protein, 8 aa, Dengue virus
SGLFPVSI

SEQ ID NO: 28990 - protein, 8 aa, Dengue virus
GLFPVSIP

SEQ ID NO: 28991 - protein, 8 aa, Dengue virus
LFPVSIPI

SEQ ID NO: 28992 - protein, 8 aa, Dengue virus
FPISIPIT

SEQ ID NO: 28993 - protein, 8 aa, Dengue virus
PISIPITA

SEQ ID NO: 28994 - protein, 8 aa, Dengue virus
ISIPITAA

SEQ ID NO: 28995 - protein, 8 aa, Dengue virus
SMPITAAA

SEQ ID NO: 28996 - protein, 8 aa, Dengue virus
MPITAAAW

SEQ ID NO: 28997 - protein, 8 aa, Dengue virus
AAWYLWET

SEQ ID NO: 28998 - protein, 8 aa, Dengue virus
AWYLWETK

SEQ ID NO: 28999 - protein, 8 aa, Dengue virus
WYLWETKK

SEQ ID NO: 29000 - protein, 8 aa, Dengue virus
YLWETKKQ

SEQ ID NO: 29001 - protein, 8 aa, Dengue virus
LWETKKQR

SEQ ID NO: 29002 - protein, 8 aa, Dengue virus
WETKKQRA

SEQ ID NO: 29003 - protein, 8 aa, Dengue virus
ETKKQRAG

SEQ ID NO: 29004 - protein, 8 aa, Dengue virus
TKKQRAGV

SEQ ID NO: 29005 - protein, 8 aa, Dengue virus
DVPSPPPM

SEQ ID NO: 29006 - protein, 8 aa, Dengue virus
VPSPPPMG

SEQ ID NO: 29007 - protein, 8 aa, Dengue virus
EKAELEDG

SEQ ID NO: 29008 - protein, 8 aa, Dengue virus
RAELEDGA

SEQ ID NO: 29009 - protein, 8 aa, Dengue virus
GAYRIKQK

SEQ ID NO: 29010 - protein, 8 aa, Dengue virus
AYRIKQKG

SEQ ID NO: 29011 - protein, 8 aa, Dengue virus
YRIKQKGI

SEQ ID NO: 29012 - protein, 8 aa, Dengue virus
RIKQRGIL

SEQ ID NO: 29013 - protein, 8 aa, Dengue virus
IKQRGILG

SEQ ID NO: 29014 - protein, 8 aa, Dengue virus
KQRGILGY

SEQ ID NO: 29015 - protein, 8 aa, Dengue virus
QRGILGYS

SEQ ID NO: 29016 - protein, 8 aa, Dengue virus
RGILGYSQ

SEQ ID NO: 29017 - protein, 8 aa, Dengue virus
GIFGYSQI

SEQ ID NO: 29018 - protein, 8 aa, Dengue virus
IFGYSQIG

SEQ ID NO: 29019 - protein, 8 aa, Dengue virus
FGYSQIGA

SEQ ID NO: 29020 - protein, 8 aa, Dengue virus
VTRGAVLV

SEQ ID NO: 29021 - protein, 8 aa, Dengue virus
TRGAVLVH

SEQ ID NO: 29022 - protein, 8 aa, Dengue virus
RGAVLMHK

SEQ ID NO: 29023 - protein, 8 aa, Dengue virus
GAVLMHKG

SEQ ID NO: 29024 - protein, 8 aa, Dengue virus
AVLMHKGK

SEQ ID NO: 29025 - protein, 8 aa, Dengue virus
VLMHKGKR

SEQ ID NO: 29026 - protein, 8 aa, Dengue virus
LMHKGKRI

SEQ ID NO: 29027 - protein, 8 aa, Dengue virus
MHKGKRIE

SEQ ID NO: 29028 - protein, 8 aa, Dengue virus
HKGKRIEP

SEQ ID NO: 29029 - protein, 8 aa, Dengue virus
KGKRIEPS

SEQ ID NO: 29030 - protein, 8 aa, Dengue virus
EPSWADVR

SEQ ID NO: 29031 - protein, 8 aa, Dengue virus
PSWADVRK

SEQ ID NO: 29032 - protein, 8 aa, Dengue virus
SWADVRKD

SEQ ID NO: 29033 - protein, 8 aa, Dengue virus
WADVRKDL

SEQ ID NO: 29034 - protein, 8 aa, Dengue virus
ADVKKDLV

SEQ ID NO: 29035 - protein, 8 aa, Dengue virus
DVRKDLIS

SEQ ID NO: 29036 - protein, 8 aa, Dengue virus
VKKDLVSY

SEQ ID NO: 29037 - protein, 8 aa, Dengue virus
RKDLISYG

SEQ ID NO: 29038 - protein, 8 aa, Dengue virus
KDLVSYGG

SEQ ID NO: 29039 - protein, 8 aa, Dengue virus
DLVSYGGG

SEQ ID NO: 29040 - protein, 8 aa, Dengue virus
LVSYGGGW

SEQ ID NO: 29041 - protein, 8 aa, Dengue virus
VSYGGGWK

SEQ ID NO: 29042 - protein, 8 aa, Dengue virus
AVQTKPGI

SEQ ID NO: 29043 - protein, 8 aa, Dengue virus
VQTKPGIF

SEQ ID NO: 29044 - protein, 8 aa, Dengue virus
QTKPGIFK

SEQ ID NO: 29045 - protein, 8 aa, Dengue virus
TKPGIFKT

SEQ ID NO: 29046 - protein, 8 aa, Dengue virus
KPGIFKTN

SEQ ID NO: 29047 - protein, 8 aa, Dengue virus
FKTNAGTI

SEQ ID NO: 29048 - protein, 8 aa, Dengue virus
KTNAGTIG

SEQ ID NO: 29049 - protein, 8 aa, Dengue virus
TNAGTIGA

SEQ ID NO: 29050 - protein, 8 aa, Dengue virus
NAGTIGAV

SEQ ID NO: 29051 - protein, 8 aa, Dengue virus
AGTIGAVS

SEQ ID NO: 29052 - protein, 8 aa, Dengue virus
GTSGSPII

SEQ ID NO: 29053 - protein, 8 aa, Dengue virus
TSGSPIID

SEQ ID NO: 29054 - protein, 8 aa, Dengue virus
SGSPIIDK

SEQ ID NO: 29055 - protein, 8 aa, Dengue virus
GSPIIDKK

SEQ ID NO: 29056 - protein, 8 aa, Dengue virus
SPIIDKKG

SEQ ID NO: 29057 - protein, 8 aa, Dengue virus
PIIDKKGK

SEQ ID NO: 29058 - protein, 8 aa, Dengue virus
IIDKKGKV

SEQ ID NO: 29059 - protein, 8 aa, Dengue virus
IDKKGKVV

SEQ ID NO: 29060 - protein, 8 aa, Dengue virus
DKKGKVVG

SEQ ID NO: 29061 - protein, 8 aa, Dengue virus
KKGKVVGL

SEQ ID NO: 29062 - protein, 8 aa, Dengue virus
GVVTRSGT

SEQ ID NO: 29063 - protein, 8 aa, Dengue virus
VVTRSGTY

SEQ ID NO: 29064 - protein, 8 aa, Dengue virus
VTRSGTYV

SEQ ID NO: 29065 - protein, 8 aa, Dengue virus
TRSGTYVS

SEQ ID NO: 29066 - protein, 8 aa, Dengue virus
RSGTYVSA

SEQ ID NO: 29067 - protein, 8 aa, Dengue virus
SGTYVSAI

SEQ ID NO: 29068 - protein, 8 aa, Dengue virus
GTYVSAIA

SEQ ID NO: 29069 - protein, 8 aa, Dengue virus
TYVSAIAQ

SEQ ID NO: 29070 - protein, 8 aa, Dengue virus
YVSSIAQT

SEQ ID NO: 29071 - protein, 8 aa, Dengue virus
VSSIAQTE

SEQ ID NO: 29072 - protein, 8 aa, Dengue virus
SSIAQTEK

SEQ ID NO: 29073 - protein, 8 aa, Dengue virus
SIAQTEKS

SEQ ID NO: 29074 - protein, 8 aa, Dengue virus
IAQTEKSV

SEQ ID NO: 29075 - protein, 8 aa, Dengue virus
AQTEKSVE

SEQ ID NO: 29076 - protein, 8 aa, Dengue virus
IEDNPDIE

SEQ ID NO: 29077 - protein, 8 aa, Dengue virus
EDNPDIED

SEQ ID NO: 29078 - protein, 8 aa, Dengue virus
DNPDIEDD

SEQ ID NO: 29079 - protein, 8 aa, Dengue virus
NPDIEDDI

SEQ ID NO: 29080 - protein, 8 aa, Dengue virus
PDIEDDIF

SEQ ID NO: 29081 - protein, 8 aa, Dengue virus
DIEDDIFR

SEQ ID NO: 29082 - protein, 8 aa, Dengue virus
IEDHIFRK

SEQ ID NO: 29083 - protein, 8 aa, Dengue virus
EDDIFRKR

SEQ ID NO: 29084 - protein, 8 aa, Dengue virus
DDIFRKRR

SEQ ID NO: 29085 - protein, 8 aa, Dengue virus
DIFRKRRL

SEQ ID NO: 29086 - protein, 8 aa, Dengue virus
IFRKRRLT

SEQ ID NO: 29087 - protein, 8 aa, Dengue virus
FRKRRLTI

SEQ ID NO: 29088 - protein, 8 aa, Dengue virus
RKRRLTIM

SEQ ID NO: 29089 - protein, 8 aa, Dengue virus
KRRLTIMD

SEQ ID NO: 29090 - protein, 8 aa, Dengue virus
RRLTIMDL

SEQ ID NO: 29091 - protein, 8 aa, Dengue virus
KLTIMDLH

SEQ ID NO: 29092 - protein, 8 aa, Dengue virus
PGAGKTKK

SEQ ID NO: 29093 - protein, 8 aa, Dengue virus
GAGKTKKY

SEQ ID NO: 29094 - protein, 8 aa, Dengue virus
AGKTKKYL

SEQ ID NO: 29095 - protein, 8 aa, Dengue virus
GKTKKYLP

SEQ ID NO: 29096 - protein, 8 aa, Dengue virus
KTKKYLPA

SEQ ID NO: 29097 - protein, 8 aa, Dengue virus
TKKYLPAI

SEQ ID NO: 29098 - protein, 8 aa, Dengue virus
KKYLPAIV

SEQ ID NO: 29099 - protein, 8 aa, Dengue virus
KYLPAIVR

SEQ ID NO: 29100 - protein, 8 aa, Dengue virus
AIVREAIR

SEQ ID NO: 29101 - protein, 8 aa, Dengue virus
IVREAIRR

SEQ ID NO: 29102 - protein, 8 aa, Dengue virus
VREAIRRG

SEQ ID NO: 29103 - protein, 8 aa, Dengue virus
REAIRRGL

SEQ ID NO: 29104 - protein, 8 aa, Dengue virus
EAIRRGLR

SEQ ID NO: 29105 - protein, 8 aa, Dengue virus
AIRRGLRT

SEQ ID NO: 29106 - protein, 8 aa, Dengue virus
IRRGLRTL

SEQ ID NO: 29107 - protein, 8 aa, Dengue virus
RRGLRTLI

SEQ ID NO: 29108 - protein, 8 aa, Dengue virus
LPIRYQTT

SEQ ID NO: 29109 - protein, 8 aa, Dengue virus
PIRYQTTA

SEQ ID NO: 29110 - protein, 8 aa, Dengue virus
IRYQTTAI

SEQ ID NO: 29111 - protein, 8 aa, Dengue virus
RYQTPAIK

SEQ ID NO: 29112 - protein, 8 aa, Dengue virus
YQTPAIKT

SEQ ID NO: 29113 - protein, 8 aa, Dengue virus
QTPAIKTE

SEQ ID NO: 29114 - protein, 8 aa, Dengue virus
TPAIKTEH

SEQ ID NO: 29115 - protein, 8 aa, Dengue virus
PAIKTEHT

SEQ ID NO: 29116 - protein, 8 aa, Dengue virus
AIKTEHTG

SEQ ID NO: 29117 - protein, 8 aa, Dengue virus
IKTEHTGR

SEQ ID NO: 29118 - protein, 8 aa, Dengue virus
KTEHTGRE

SEQ ID NO: 29119 - protein, 8 aa, Dengue virus
TEHTGREI

SEQ ID NO: 29120 - protein, 8 aa, Dengue virus
TMRLLSPI

SEQ ID NO: 29121 - protein, 8 aa, Dengue virus
MRLLSPIR

SEQ ID NO: 29122 - protein, 8 aa, Dengue virus
RLLSPIRV

SEQ ID NO: 29123 - protein, 8 aa, Dengue virus
LLSPIRVP

SEQ ID NO: 29124 - protein, 8 aa, Dengue virus
LSPIRVPN

SEQ ID NO: 29125 - protein, 8 aa, Dengue virus
SPIRVPNY

SEQ ID NO: 29126 - protein, 8 aa, Dengue virus
PIRVPNYN

SEQ ID NO: 29127 - protein, 8 aa, Dengue virus
IRVPNYNL

SEQ ID NO: 29128 - protein, 8 aa, Dengue virus
PQSNAPII

SEQ ID NO: 29129 - protein, 8 aa, Dengue virus
QSNAPIID

SEQ ID NO: 29130 - protein, 8 aa, Dengue virus
SNAPIIDE

SEQ ID NO: 29131 - protein, 8 aa, Dengue virus
NAPIIDEE

SEQ ID NO: 29132 - protein, 8 aa, Dengue virus
APIIDEER

SEQ ID NO: 29133 - protein, 8 aa, Dengue virus
PIIDEERE

SEQ ID NO: 29134 - protein, 8 aa, Dengue virus
IIDEEREI

SEQ ID NO: 29135 - protein, 8 aa, Dengue virus
IDEEREIP

SEQ ID NO: 29136 - protein, 8 aa, Dengue virus
EIPERSWS

SEQ ID NO: 29137 - protein, 8 aa, Dengue virus
IPERSWSS

SEQ ID NO: 29138 - protein, 8 aa, Dengue virus
PERSWSSG

SEQ ID NO: 29139 - protein, 8 aa, Dengue virus
ERSWSSGH

SEQ ID NO: 29140 - protein, 8 aa, Dengue virus
RSWSSGHE

SEQ ID NO: 29141 - protein, 8 aa, Dengue virus
SWSSGHEW

SEQ ID NO: 29142 - protein, 8 aa, Dengue virus
WNSGHEWI

SEQ ID NO: 29143 - protein, 8 aa, Dengue virus
NSGHEWIT

SEQ ID NO: 29144 - protein, 8 aa, Dengue virus
SGHEWITN

SEQ ID NO: 29145 - protein, 8 aa, Dengue virus
GHEWITNF

SEQ ID NO: 29146 - protein, 8 aa, Dengue virus
HEWITNFK

SEQ ID NO: 29147 - protein, 8 aa, Dengue virus
EWITNFKG

SEQ ID NO: 29148 - protein, 8 aa, Dengue virus
WITNFKGK

SEQ ID NO: 29149 - protein, 8 aa, Dengue virus
ITNFKGKT

SEQ ID NO: 29150 - protein, 8 aa, Dengue virus
TNFKGKTV

SEQ ID NO: 29151 - protein, 8 aa, Dengue virus
NFKGKTVW

SEQ ID NO: 29152 - protein, 8 aa, Dengue virus
VWFVPSIR

SEQ ID NO: 29153 - protein, 8 aa, Dengue virus
WFVPSIKT

SEQ ID NO: 29154 - protein, 8 aa, Dengue virus
FVPSIKTG

SEQ ID NO: 29155 - protein, 8 aa, Dengue virus
VPSIKTGN

SEQ ID NO: 29156 - protein, 8 aa, Dengue virus
PSIKTGND

SEQ ID NO: 29157 - protein, 8 aa, Dengue virus
SIKTGNDI

SEQ ID NO: 29158 - protein, 8 aa, Dengue virus
IKTGNDIA

SEQ ID NO: 29159 - protein, 8 aa, Dengue virus
KTGNDIAA

SEQ ID NO: 29160 - protein, 8 aa, Dengue virus
TGNDIAAC

SEQ ID NO: 29161 - protein, 8 aa, Dengue virus
CLRKNGKR

SEQ ID NO: 29162 - protein, 8 aa, Dengue virus
LRKNGKRV

SEQ ID NO: 29163 - protein, 8 aa, Dengue virus
RKNGKRVI

SEQ ID NO: 29164 - protein, 8 aa, Dengue virus
KNGKRVIQ

SEQ ID NO: 29165 - protein, 8 aa, Dengue virus
NGKRVIQL

SEQ ID NO: 29166 - protein, 8 aa, Dengue virus
GKRVIQLS

SEQ ID NO: 29167 - protein, 8 aa, Dengue virus
KRVIQLSR

SEQ ID NO: 29168 - protein, 8 aa, Dengue virus
RVIQLSRK

SEQ ID NO: 29169 - protein, 8 aa, Dengue virus
LSRKTFDT

SEQ ID NO: 29170 - protein, 8 aa, Dengue virus
SRKTFDTE

SEQ ID NO: 29171 - protein, 8 aa, Dengue virus
RKTFDTEY

SEQ ID NO: 29172 - protein, 8 aa, Dengue virus
KTFDSEYI

SEQ ID NO: 29173 - protein, 8 aa, Dengue virus
TFDSEYIK

SEQ ID NO: 29174 - protein, 8 aa, Dengue virus
FDSEYIKT

SEQ ID NO: 29175 - protein, 8 aa, Dengue virus
DSEYIKTR

SEQ ID NO: 29176 - protein, 8 aa, Dengue virus
KTRANDWD

SEQ ID NO: 29177 - protein, 8 aa, Dengue virus
TRANDWDF

SEQ ID NO: 29178 - protein, 8 aa, Dengue virus
RANDWDFV

SEQ ID NO: 29179 - protein, 8 aa, Dengue virus
ANDWDFVV

SEQ ID NO: 29180 - protein, 8 aa, Dengue virus
SEMGANFR

SEQ ID NO: 29181 - protein, 8 aa, Dengue virus
EMGANFRA

SEQ ID NO: 29182 - protein, 8 aa, Dengue virus
MGANFRAE

SEQ ID NO: 29183 - protein, 8 aa, Dengue virus
GANFRAER

SEQ ID NO: 29184 - protein, 8 aa, Dengue virus
ANFRAERV

SEQ ID NO: 29185 - protein, 8 aa, Dengue virus
NFRAERVI

SEQ ID NO: 29186 - protein, 8 aa, Dengue virus
FRAERVID

SEQ ID NO: 29187 - protein, 8 aa, Dengue virus
RAERVIDP

SEQ ID NO: 29188 - protein, 8 aa, Dengue virus
KPVILTEG

SEQ ID NO: 29189 - protein, 8 aa, Dengue virus
PVILTEGE

SEQ ID NO: 29190 - protein, 8 aa, Dengue virus
VILTEGEE

SEQ ID NO: 29191 - protein, 8 aa, Dengue virus
ILTEGEER

SEQ ID NO: 29192 - protein, 8 aa, Dengue virus
LTEGEERV

SEQ ID NO: 29193 - protein, 8 aa, Dengue virus
TDGEERVV

SEQ ID NO: 29194 - protein, 8 aa, Dengue virus
DGEERVVL

SEQ ID NO: 29195 - protein, 8 aa, Dengue virus
GEERVVLA

SEQ ID NO: 29196 - protein, 8 aa, Dengue virus
EERVVLAG

SEQ ID NO: 29197 - protein, 8 aa, Dengue virus
ERVVLAGP

SEQ ID NO: 29198 - protein, 8 aa, Dengue virus
RVVLAGPM

SEQ ID NO: 29199 - protein, 8 aa, Dengue virus
VVLAGPMP

SEQ ID NO: 29200 - protein, 8 aa, Dengue virus
VLAGPMPV

SEQ ID NO: 29201 - protein, 8 aa, Dengue virus
PMPVTHFS

SEQ ID NO: 29202 - protein, 8 aa, Dengue virus
MPVTHFSA

SEQ ID NO: 29203 - protein, 8 aa, Dengue virus
PVTHFSAA

SEQ ID NO: 29204 - protein, 8 aa, Dengue virus
AAQRRGRV

SEQ ID NO: 29205 - protein, 8 aa, Dengue virus
AQRRGRVG

SEQ ID NO: 29206 - protein, 8 aa, Dengue virus
QRRGRVGR

SEQ ID NO: 29207 - protein, 8 aa, Dengue virus
RRGRVGRN

SEQ ID NO: 29208 - protein, 8 aa, Dengue virus
RGRVGRNP

SEQ ID NO: 29209 - protein, 8 aa, Dengue virus
GRVGRNPK

SEQ ID NO: 29210 - protein, 8 aa, Dengue virus
RVGRNPKN

SEQ ID NO: 29211 - protein, 8 aa, Dengue virus
VGRNPKNE

SEQ ID NO: 29212 - protein, 8 aa, Dengue virus
GRNPRNEN

SEQ ID NO: 29213 - protein, 8 aa, Dengue virus
RNPRNEND

SEQ ID NO: 29214 - protein, 8 aa, Dengue virus
NPRNENDQ

SEQ ID NO: 29215 - protein, 8 aa, Dengue virus
PRNENDQY

SEQ ID NO: 29216 - protein, 8 aa, Dengue virus
RNENDQYI

SEQ ID NO: 29217 - protein, 8 aa, Dengue virus
EREKVDAV

SEQ ID NO: 29218 - protein, 8 aa, Dengue virus
REKVDAVD

SEQ ID NO: 29219 - protein, 8 aa, Dengue virus
EKVDAVDG

SEQ ID NO: 29220 - protein, 8 aa, Dengue virus
KVDAVDGE

SEQ ID NO: 29221 - protein, 8 aa, Dengue virus
VDAVDGEY

SEQ ID NO: 29222 - protein, 8 aa, Dengue virus
DAVDGEYR

SEQ ID NO: 29223 - protein, 8 aa, Dengue virus
AVDGEYRL

SEQ ID NO: 29224 - protein, 8 aa, Dengue virus
VDGEYRLR

SEQ ID NO: 29225 - protein, 8 aa, Dengue virus
KTFVDLMK

SEQ ID NO: 29226 - protein, 8 aa, Dengue virus
TFVDLMKR

SEQ ID NO: 29227 - protein, 8 aa, Dengue virus
FVDLMKRG

SEQ ID NO: 29228 - protein, 8 aa, Dengue virus
VDLMKRGD

SEQ ID NO: 29229 - protein, 8 aa, Dengue virus
DLMKRGDL

SEQ ID NO: 29230 - protein, 8 aa, Dengue virus
LMKRGDLP

SEQ ID NO: 29231 - protein, 8 aa, Dengue virus
MKRGDLPV

SEQ ID NO: 29232 - protein, 8 aa, Dengue virus
KRGDLPVW

SEQ ID NO: 29233 - protein, 8 aa, Dengue virus
LPVWLAYR

SEQ ID NO: 29234 - protein, 8 aa, Dengue virus
PVWLAYRV

SEQ ID NO: 29235 - protein, 8 aa, Dengue virus
VWLAYRVA

SEQ ID NO: 29236 - protein, 8 aa, Dengue virus
WLAYRVAA

SEQ ID NO: 29237 - protein, 8 aa, Dengue virus
LAYRVAAE

SEQ ID NO: 29238 - protein, 8 aa, Dengue virus
AYRVAAEG

SEQ ID NO: 29239 - protein, 8 aa, Dengue virus
YRVAAEGI

SEQ ID NO: 29240 - protein, 8 aa, Dengue virus
RVAAEGIN

SEQ ID NO: 29241 - protein, 8 aa, Dengue virus
VASEGINY

SEQ ID NO: 29242 - protein, 8 aa, Dengue virus
ASEGINYA

SEQ ID NO: 29243 - protein, 8 aa, Dengue virus
SEGINYAD

SEQ ID NO: 29244 - protein, 8 aa, Dengue virus
EGINYTDR

SEQ ID NO: 29245 - protein, 8 aa, Dengue virus
GINYADRK

SEQ ID NO: 29246 - protein, 8 aa, Dengue virus
INYADRKW

SEQ ID NO: 29247 - protein, 8 aa, Dengue virus
NYADRKWC

SEQ ID NO: 29248 - protein, 8 aa, Dengue virus
YADRKWCF

SEQ ID NO: 29249 - protein, 8 aa, Dengue virus
ADRKWCFD

SEQ ID NO: 29250 - protein, 8 aa, Dengue virus
DRKWCFDG

SEQ ID NO: 29251 - protein, 8 aa, Dengue virus
RKWCFDGI

SEQ ID NO: 29252 - protein, 8 aa, Dengue virus
KWCFDGIK

SEQ ID NO: 29253 - protein, 8 aa, Dengue virus
WCFDGVKN

SEQ ID NO: 29254 - protein, 8 aa, Dengue virus
CFDGVKNN

SEQ ID NO: 29255 - protein, 8 aa, Dengue virus
FDGVKNNQ

SEQ ID NO: 29256 - protein, 8 aa, Dengue virus
DGVKNNQI

SEQ ID NO: 29257 - protein, 8 aa, Dengue virus
GVKNNQIL

SEQ ID NO: 29258 - protein, 8 aa, Dengue virus
VKNNQILE

SEQ ID NO: 29259 - protein, 8 aa, Dengue virus
RNNQILEE

SEQ ID NO: 29260 - protein, 8 aa, Dengue virus
NQILEENM

SEQ ID NO: 29261 - protein, 8 aa, Dengue virus
QILEENME

SEQ ID NO: 29262 - protein, 8 aa, Dengue virus
ILEENMEV

SEQ ID NO: 29263 - protein, 8 aa, Dengue virus
LEENMEVE

SEQ ID NO: 29264 - protein, 8 aa, Dengue virus
EENMEVEI

SEQ ID NO: 29265 - protein, 8 aa, Dengue virus
ENMEVEIW

SEQ ID NO: 29266 - protein, 8 aa, Dengue virus
NMEVEIWT

SEQ ID NO: 29267 - protein, 8 aa, Dengue virus
MEVEIWTK

SEQ ID NO: 29268 - protein, 8 aa, Dengue virus
EVEVWTKE

SEQ ID NO: 29269 - protein, 8 aa, Dengue virus
VEVWTKEG

SEQ ID NO: 29270 - protein, 8 aa, Dengue virus
EVWTKEGE

SEQ ID NO: 29271 - protein, 8 aa, Dengue virus
VWTKEGER

SEQ ID NO: 29272 - protein, 8 aa, Dengue virus
PRWLDART

SEQ ID NO: 29273 - protein, 8 aa, Dengue virus
RWLDARTY

SEQ ID NO: 29274 - protein, 8 aa, Dengue virus
WLDARTYS

SEQ ID NO: 29275 - protein, 8 aa, Dengue virus
LDARTYSD

SEQ ID NO: 29276 - protein, 8 aa, Dengue virus
DARTYSDP

SEQ ID NO: 29277 - protein, 8 aa, Dengue virus
ARTYSDPL

SEQ ID NO: 29278 - protein, 8 aa, Dengue virus
RTYSDPLA

SEQ ID NO: 29279 - protein, 8 aa, Dengue virus
TYSDPLAL

SEQ ID NO: 29280 - protein, 8 aa, Dengue virus
AAGRKSLA

SEQ ID NO: 29281 - protein, 8 aa, Dengue virus
AGRKSLAL

SEQ ID NO: 29282 - protein, 8 aa, Dengue virus
GRKSLALN

SEQ ID NO: 29283 - protein, 8 aa, Dengue virus
RKSLALNL

SEQ ID NO: 29284 - protein, 8 aa, Dengue virus
KSLALNLI

SEQ ID NO: 29285 - protein, 8 aa, Dengue virus
SLALNLIT

SEQ ID NO: 29286 - protein, 8 aa, Dengue virus
LALNLITE

SEQ ID NO: 29287 - protein, 8 aa, Dengue virus
ALNLITEM

SEQ ID NO: 29288 - protein, 8 aa, Dengue virus
LSLITEMG

SEQ ID NO: 29289 - protein, 8 aa, Dengue virus
SLITEMGR

SEQ ID NO: 29290 - protein, 8 aa, Dengue virus
PTFMTQKT

SEQ ID NO: 29291 - protein, 8 aa, Dengue virus
TFMTQKTR

SEQ ID NO: 29292 - protein, 8 aa, Dengue virus
FMTQKTRD

SEQ ID NO: 29293 - protein, 8 aa, Dengue virus
MTQKTRDA

SEQ ID NO: 29294 - protein, 8 aa, Dengue virus
TQKTRDAL

SEQ ID NO: 29295 - protein, 8 aa, Dengue virus
QKTRDALD

SEQ ID NO: 29296 - protein, 8 aa, Dengue virus
KTRDALDN

SEQ ID NO: 29297 - protein, 8 aa, Dengue virus
TRDALDNL

SEQ ID NO: 29298 - protein, 8 aa, Dengue virus
RNALDNLA

SEQ ID NO: 29299 - protein, 8 aa, Dengue virus
NALDNLAV

SEQ ID NO: 29300 - protein, 8 aa, Dengue virus
DNLAVLHS

SEQ ID NO: 29301 - protein, 8 aa, Dengue virus
NLAVLHSA

SEQ ID NO: 29302 - protein, 8 aa, Dengue virus
LAVLHSAE

SEQ ID NO: 29303 - protein, 8 aa, Dengue virus
AVLHTAEV

SEQ ID NO: 29304 - protein, 8 aa, Dengue virus
VLHTAEVG

SEQ ID NO: 29305 - protein, 8 aa, Dengue virus
LHTAEVGG

SEQ ID NO: 29306 - protein, 8 aa, Dengue virus
HTAEVGGR

SEQ ID NO: 29307 - protein, 8 aa, Dengue virus
TAEVGGRA

SEQ ID NO: 29308 - protein, 8 aa, Dengue virus
AEVGGRAY

SEQ ID NO: 29309 - protein, 8 aa, Dengue virus
GGKAYNHA

SEQ ID NO: 29310 - protein, 8 aa, Dengue virus
GKAYNHAL

SEQ ID NO: 29311 - protein, 8 aa, Dengue virus
KAYNHALS

SEQ ID NO: 29312 - protein, 8 aa, Dengue virus
AYTHALSE

SEQ ID NO: 29313 - protein, 8 aa, Dengue virus
YTHALSEL

SEQ ID NO: 29314 - protein, 8 aa, Dengue virus
THALSELP

SEQ ID NO: 29315 - protein, 8 aa, Dengue virus
LETLLLLG

SEQ ID NO: 29316 - protein, 8 aa, Dengue virus
ETLLLLGL

SEQ ID NO: 29317 - protein, 8 aa, Dengue virus
TLLLLGLL

SEQ ID NO: 29318 - protein, 8 aa, Dengue virus
LLLLGLLA

SEQ ID NO: 29319 - protein, 8 aa, Dengue virus
LLLGLLAT

SEQ ID NO: 29320 - protein, 8 aa, Dengue virus
LLGLLATV

SEQ ID NO: 29321 - protein, 8 aa, Dengue virus
LGLLATVT

SEQ ID NO: 29322 - protein, 8 aa, Dengue virus
GLLATVTG

SEQ ID NO: 29323 - protein, 8 aa, Dengue virus
LLAAVTGG

SEQ ID NO: 29324 - protein, 8 aa, Dengue virus
LAAVTGGI

SEQ ID NO: 29325 - protein, 8 aa, Dengue virus
AAVTGGIF

SEQ ID NO: 29326 - protein, 8 aa, Dengue virus
AVTGGIFL

SEQ ID NO: 29327 - protein, 8 aa, Dengue virus
IFLFLMSA

SEQ ID NO: 29328 - protein, 8 aa, Dengue virus
FLFLMSGR

SEQ ID NO: 29329 - protein, 8 aa, Dengue virus
LFLMSGRG

SEQ ID NO: 29330 - protein, 8 aa, Dengue virus
FLMSGRGI

SEQ ID NO: 29331 - protein, 8 aa, Dengue virus
LMSGRGIG

SEQ ID NO: 29332 - protein, 8 aa, Dengue virus
MSGRGIGK

SEQ ID NO: 29333 - protein, 8 aa, Dengue virus
SGRGIGKM

SEQ ID NO: 29334 - protein, 8 aa, Dengue virus
GRGIGKMT

SEQ ID NO: 29335 - protein, 8 aa, Dengue virus
RGIGKMTL

SEQ ID NO: 29336 - protein, 8 aa, Dengue virus
GVGKMTLG

SEQ ID NO: 29337 - protein, 8 aa, Dengue virus
VGKMTLGM

SEQ ID NO: 29338 - protein, 8 aa, Dengue virus
TLGMCCIV

SEQ ID NO: 29339 - protein, 8 aa, Dengue virus
LGMCCIVT

SEQ ID NO: 29340 - protein, 8 aa, Dengue virus
GMCCIVTA

SEQ ID NO: 29341 - protein, 8 aa, Dengue virus
MCCIVTAS

SEQ ID NO: 29342 - protein, 8 aa, Dengue virus
TASVLLWY

SEQ ID NO: 29343 - protein, 8 aa, Dengue virus
ASVLLWYA

SEQ ID NO: 29344 - protein, 8 aa, Dengue virus
LLWHAQIQ

SEQ ID NO: 29345 - protein, 8 aa, Dengue virus
LWHAQIQP

SEQ ID NO: 29346 - protein, 8 aa, Dengue virus
WHAQIQPH

SEQ ID NO: 29347 - protein, 8 aa, Dengue virus
HAQIQPHW

SEQ ID NO: 29348 - protein, 8 aa, Dengue virus
IILVFFLI

SEQ ID NO: 29349 - protein, 8 aa, Dengue virus
ILVFFLIV

SEQ ID NO: 29350 - protein, 8 aa, Dengue virus
LVFFLIVL

SEQ ID NO: 29351 - protein, 8 aa, Dengue virus
VFFLIVLL

SEQ ID NO: 29352 - protein, 8 aa, Dengue virus
DNQLTYVI

SEQ ID NO: 29353 - protein, 8 aa, Dengue virus
NQLTYVII

SEQ ID NO: 29354 - protein, 8 aa, Dengue virus
QLTYVIIA

SEQ ID NO: 29355 - protein, 8 aa, Dengue virus
LTYVIIAI

SEQ ID NO: 29356 - protein, 8 aa, Dengue virus
TYVIIAIL

SEQ ID NO: 29357 - protein, 8 aa, Dengue virus
YVIIAILT

SEQ ID NO: 29358 - protein, 8 aa, Dengue virus
VIIAILTV

SEQ ID NO: 29359 - protein, 8 aa, Dengue virus
IIAILTVV

SEQ ID NO: 29360 - protein, 8 aa, Dengue virus
IAILTLVA

SEQ ID NO: 29361 - protein, 8 aa, Dengue virus
AILTLVAA

SEQ ID NO: 29362 - protein, 8 aa, Dengue virus
ILTLVAAT

SEQ ID NO: 29363 - protein, 8 aa, Dengue virus
LTLVAATM

SEQ ID NO: 29364 - protein, 8 aa, Dengue virus
TLVAATMA

SEQ ID NO: 29365 - protein, 8 aa, Dengue virus
LVAATMAN

SEQ ID NO: 29366 - protein, 8 aa, Dengue virus
LEKTKKDF

SEQ ID NO: 29367 - protein, 8 aa, Dengue virus
EKTKKDFG

SEQ ID NO: 29368 - protein, 8 aa, Dengue virus
KTKKDFGL

SEQ ID NO: 29369 - protein, 8 aa, Dengue virus
TKKDFGLG

SEQ ID NO: 29370 - protein, 8 aa, Dengue virus
QPESNILD

SEQ ID NO: 29371 - protein, 8 aa, Dengue virus
SESNILDI

SEQ ID NO: 29372 - protein, 8 aa, Dengue virus
EINILDID

SEQ ID NO: 29373 - protein, 8 aa, Dengue virus
INILDIDL

SEQ ID NO: 29374 - protein, 8 aa, Dengue virus
YAVATTFI

SEQ ID NO: 29375 - protein, 8 aa, Dengue virus
AVATTFIT

SEQ ID NO: 29376 - protein, 8 aa, Dengue virus
VATTFITP

SEQ ID NO: 29377 - protein, 8 aa, Dengue virus
ATTFITPM

SEQ ID NO: 29378 - protein, 8 aa, Dengue virus
TTFITPML

SEQ ID NO: 29379 - protein, 8 aa, Dengue virus
TFITPMLR

SEQ ID NO: 29380 - protein, 8 aa, Dengue virus
FITPMLRH

SEQ ID NO: 29381 - protein, 8 aa, Dengue virus
ITPMLRHS

SEQ ID NO: 29382 - protein, 8 aa, Dengue virus
TVLMGLGR

SEQ ID NO: 29383 - protein, 8 aa, Dengue virus
VLMGLGRG

SEQ ID NO: 29384 - protein, 8 aa, Dengue virus
LMGLGRGW

SEQ ID NO: 29385 - protein, 8 aa, Dengue virus
MGLGRGWP

SEQ ID NO: 29386 - protein, 8 aa, Dengue virus
GLGRGWPL

SEQ ID NO: 29387 - protein, 8 aa, Dengue virus
LGRGWPLS

SEQ ID NO: 29388 - protein, 8 aa, Dengue virus
GRGWPLSK

SEQ ID NO: 29389 - protein, 8 aa, Dengue virus
RGWPLSKM

SEQ ID NO: 29390 - protein, 8 aa, Dengue virus
LSKMDIGA

SEQ ID NO: 29391 - protein, 8 aa, Dengue virus
SKMDIGAP

SEQ ID NO: 29392 - protein, 8 aa, Dengue virus
KMDIGAPL

SEQ ID NO: 29393 - protein, 8 aa, Dengue virus
MDIGAPLL

SEQ ID NO: 29394 - protein, 8 aa, Dengue virus
DIGAPLLA

SEQ ID NO: 29395 - protein, 8 aa, Dengue virus
IGAPLLAI

SEQ ID NO: 29396 - protein, 8 aa, Dengue virus
GAPLLAIG

SEQ ID NO: 29397 - protein, 8 aa, Dengue virus
APLLAIGC

SEQ ID NO: 29398 - protein, 8 aa, Dengue virus
NPVTLTAA

SEQ ID NO: 29399 - protein, 8 aa, Dengue virus
PVTLTAAL

SEQ ID NO: 29400 - protein, 8 aa, Dengue virus
ITLTAALF

SEQ ID NO: 29401 - protein, 8 aa, Dengue virus
TLTAALFL

SEQ ID NO: 29402 - protein, 8 aa, Dengue virus
LTAALFLL

SEQ ID NO: 29403 - protein, 8 aa, Dengue virus
TAALFLLV

SEQ ID NO: 29404 - protein, 8 aa, Dengue virus
AALFLLVA

SEQ ID NO: 29405 - protein, 8 aa, Dengue virus
ALFLLVAH

SEQ ID NO: 29406 - protein, 8 aa, Dengue virus
LLIAHYAI

SEQ ID NO: 29407 - protein, 8 aa, Dengue virus
LIAHYAII

SEQ ID NO: 29408 - protein, 8 aa, Dengue virus
IAHYAIIG

SEQ ID NO: 29409 - protein, 8 aa, Dengue virus
TREAQKRT

SEQ ID NO: 29410 - protein, 8 aa, Dengue virus
REAQKRTA

SEQ ID NO: 29411 - protein, 8 aa, Dengue virus
EAQKRTAA

SEQ ID NO: 29412 - protein, 8 aa, Dengue virus
AQKRTAAG

SEQ ID NO: 29413 - protein, 8 aa, Dengue virus
QKRTAAGI

SEQ ID NO: 29414 - protein, 8 aa, Dengue virus
KRTAAGIM

SEQ ID NO: 29415 - protein, 8 aa, Dengue virus
RTAAGIMK

SEQ ID NO: 29416 - protein, 8 aa, Dengue virus
TAAGIMKN

SEQ ID NO: 29417 - protein, 8 aa, Dengue virus
KNPTVDGV

SEQ ID NO: 29418 - protein, 8 aa, Dengue virus
NPTVDGVT

SEQ ID NO: 29419 - protein, 8 aa, Dengue virus
PTVDGVTV

SEQ ID NO: 29420 - protein, 8 aa, Dengue virus
TVDGVTVI

SEQ ID NO: 29421 - protein, 8 aa, Dengue virus
VDGVTVID

SEQ ID NO: 29422 - protein, 8 aa, Dengue virus
DGVTVIDL

SEQ ID NO: 29423 - protein, 8 aa, Dengue virus
GITVIDLD

SEQ ID NO: 29424 - protein, 8 aa, Dengue virus
ITVIDLDP

SEQ ID NO: 29425 - protein, 8 aa, Dengue virus
TVIDLEPI

SEQ ID NO: 29426 - protein, 8 aa, Dengue virus
VIDLEPIP

SEQ ID NO: 29427 - protein, 8 aa, Dengue virus
IDLEPIPY

SEQ ID NO: 29428 - protein, 8 aa, Dengue virus
DLDPIPYD

SEQ ID NO: 29429 - protein, 8 aa, Dengue virus
LDPIPYDP

SEQ ID NO: 29430 - protein, 8 aa, Dengue virus
DPIPYDPK

SEQ ID NO: 29431 - protein, 8 aa, Dengue virus
LGQVMLLV

SEQ ID NO: 29432 - protein, 8 aa, Dengue virus
GQVMLLVL

SEQ ID NO: 29433 - protein, 8 aa, Dengue virus
QVMLLVLC

SEQ ID NO: 29434 - protein, 8 aa, Dengue virus
VMLLVLCV

SEQ ID NO: 29435 - protein, 8 aa, Dengue virus
MLLVLCVT

SEQ ID NO: 29436 - protein, 8 aa, Dengue virus
LLVLCVTQ

SEQ ID NO: 29437 - protein, 8 aa, Dengue virus
LVLCVTQV

SEQ ID NO: 29438 - protein, 8 aa, Dengue virus
VLCVTQVL

SEQ ID NO: 29439 - protein, 8 aa, Dengue virus
LTLATGPV

SEQ ID NO: 29440 - protein, 8 aa, Dengue virus
TLATGPVS

SEQ ID NO: 29441 - protein, 8 aa, Dengue virus
LATGPVST

SEQ ID NO: 29442 - protein, 8 aa, Dengue virus
ATGPVSTL

SEQ ID NO: 29443 - protein, 8 aa, Dengue virus
TGPVSTLW

SEQ ID NO: 29444 - protein, 8 aa, Dengue virus
GPVSTLWE

SEQ ID NO: 29445 - protein, 8 aa, Dengue virus
PVSTLWEG

SEQ ID NO: 29446 - protein, 8 aa, Dengue virus
VSTLWEGN

SEQ ID NO: 29447 - protein, 8 aa, Dengue virus
LWEGNPGK

SEQ ID NO: 29448 - protein, 8 aa, Dengue virus
WEGNPGKF

SEQ ID NO: 29449 - protein, 8 aa, Dengue virus
EGNPGKFW

SEQ ID NO: 29450 - protein, 8 aa, Dengue virus
GNPGKFWN

SEQ ID NO: 29451 - protein, 8 aa, Dengue virus
NPGKFWNT

SEQ ID NO: 29452 - protein, 8 aa, Dengue virus
PGKFWNTT

SEQ ID NO: 29453 - protein, 8 aa, Dengue virus
GKFWNTTI

SEQ ID NO: 29454 - protein, 8 aa, Dengue virus
KFWNTTIA

SEQ ID NO: 29455 - protein, 8 aa, Dengue virus
GLLFSIMR

SEQ ID NO: 29456 - protein, 8 aa, Dengue virus
LLFSIMRN

SEQ ID NO: 29457 - protein, 8 aa, Dengue virus
LFSIMRNT

SEQ ID NO: 29458 - protein, 8 aa, Dengue virus
FSIMKNTA

SEQ ID NO: 29459 - protein, 8 aa, Dengue virus
SIMKNTTS

SEQ ID NO: 29460 - protein, 8 aa, Dengue virus
RRGTGNMG

SEQ ID NO: 29461 - protein, 8 aa, Dengue virus
RGTGNMGE

SEQ ID NO: 29462 - protein, 8 aa, Dengue virus
GTGNMGET

SEQ ID NO: 29463 - protein, 8 aa, Dengue virus
TGNMGETL

SEQ ID NO: 29464 - protein, 8 aa, Dengue virus
GNMGETLG

SEQ ID NO: 29465 - protein, 8 aa, Dengue virus
NMGETLGE

SEQ ID NO: 29466 - protein, 8 aa, Dengue virus
MGETLGEK

SEQ ID NO: 29467 - protein, 8 aa, Dengue virus
TLGEKWKN

SEQ ID NO: 29468 - protein, 8 aa, Dengue virus
LGEKWKNR

SEQ ID NO: 29469 - protein, 8 aa, Dengue virus
GEKWKNRL

SEQ ID NO: 29470 - protein, 8 aa, Dengue virus
EKWKNRLN

SEQ ID NO: 29471 - protein, 8 aa, Dengue virus
KWKNRLNA

SEQ ID NO: 29472 - protein, 8 aa, Dengue virus
WKNRLNAL

SEQ ID NO: 29473 - protein, 8 aa, Dengue virus
KNRLNALG

SEQ ID NO: 29474 - protein, 8 aa, Dengue virus
RLNALGRS

SEQ ID NO: 29475 - protein, 8 aa, Dengue virus
LNALGRSE

SEQ ID NO: 29476 - protein, 8 aa, Dengue virus
NALGRSEF

SEQ ID NO: 29477 - protein, 8 aa, Dengue virus
ALGRSEFQ

SEQ ID NO: 29478 - protein, 8 aa, Dengue virus
LGKSEFQT

SEQ ID NO: 29479 - protein, 8 aa, Dengue virus
GRSEFQIY

SEQ ID NO: 29480 - protein, 8 aa, Dengue virus
KSEFQTYK

SEQ ID NO: 29481 - protein, 8 aa, Dengue virus
SEFQIYKR

SEQ ID NO: 29482 - protein, 8 aa, Dengue virus
EFQIYKRS

SEQ ID NO: 29483 - protein, 8 aa, Dengue virus
FQIYKRSG

SEQ ID NO: 29484 - protein, 8 aa, Dengue virus
QIYKRSGI

SEQ ID NO: 29485 - protein, 8 aa, Dengue virus
IYKRSGIQ

SEQ ID NO: 29486 - protein, 8 aa, Dengue virus
YKRSGIQE

SEQ ID NO: 29487 - protein, 8 aa, Dengue virus
KRSGIQEV

SEQ ID NO: 29488 - protein, 8 aa, Dengue virus
RSGIQEVD

SEQ ID NO: 29489 - protein, 8 aa, Dengue virus
RWFVERNL

SEQ ID NO: 29490 - protein, 8 aa, Dengue virus
WFVERNLV

SEQ ID NO: 29491 - protein, 8 aa, Dengue virus
FVERNLVT

SEQ ID NO: 29492 - protein, 8 aa, Dengue virus
VERNLVTP

SEQ ID NO: 29493 - protein, 8 aa, Dengue virus
ERNLVTPE

SEQ ID NO: 29494 - protein, 8 aa, Dengue virus
RNLVTPEG

SEQ ID NO: 29495 - protein, 8 aa, Dengue virus
NLVTPEGK

SEQ ID NO: 29496 - protein, 8 aa, Dengue virus
LVTPEGKV

SEQ ID NO: 29497 - protein, 8 aa, Dengue virus
VTPEGKVM

SEQ ID NO: 29498 - protein, 8 aa, Dengue virus
TPEGKVMD

SEQ ID NO: 29499 - protein, 8 aa, Dengue virus
PEGKVMDL

SEQ ID NO: 29500 - protein, 8 aa, Dengue virus
EGKVMDLG

SEQ ID NO: 29501 - protein, 8 aa, Dengue virus
GKVMDLGC

SEQ ID NO: 29502 - protein, 8 aa, Dengue virus
KVMDLGCG

SEQ ID NO: 29503 - protein, 8 aa, Dengue virus
VMDLGCGR

SEQ ID NO: 29504 - protein, 8 aa, Dengue virus
MDLGCGRG

SEQ ID NO: 29505 - protein, 8 aa, Dengue virus
YYCGGLKD

SEQ ID NO: 29506 - protein, 8 aa, Dengue virus
YCGGLKDV

SEQ ID NO: 29507 - protein, 8 aa, Dengue virus
CGGLKNVK

SEQ ID NO: 29508 - protein, 8 aa, Dengue virus
GGLKNVKE

SEQ ID NO: 29509 - protein, 8 aa, Dengue virus
GLKNVKEV

SEQ ID NO: 29510 - protein, 8 aa, Dengue virus
LKNVKEVK

SEQ ID NO: 29511 - protein, 8 aa, Dengue virus
KNVKEVKG

SEQ ID NO: 29512 - protein, 8 aa, Dengue virus
NVKEVKGL

SEQ ID NO: 29513 - protein, 8 aa, Dengue virus
VKEVKGLT

SEQ ID NO: 29514 - protein, 8 aa, Dengue virus
KEVKGLTK

SEQ ID NO: 29515 - protein, 8 aa, Dengue virus
PGHEEPVP

SEQ ID NO: 29516 - protein, 8 aa, Dengue virus
GHEEPVPM

SEQ ID NO: 29517 - protein, 8 aa, Dengue virus
HEEPVPMS

SEQ ID NO: 29518 - protein, 8 aa, Dengue virus
EEPVPMST

SEQ ID NO: 29519 - protein, 8 aa, Dengue virus
EPVPMSTY

SEQ ID NO: 29520 - protein, 8 aa, Dengue virus
PVPMSTYG

SEQ ID NO: 29521 - protein, 8 aa, Dengue virus
VPMSTYGW

SEQ ID NO: 29522 - protein, 8 aa, Dengue virus
VRLQSGID

SEQ ID NO: 29523 - protein, 8 aa, Dengue virus
RLQSGIDV

SEQ ID NO: 29524 - protein, 8 aa, Dengue virus
LQSGIDVF

SEQ ID NO: 29525 - protein, 8 aa, Dengue virus
QSGIDVFF

SEQ ID NO: 29526 - protein, 8 aa, Dengue virus
SGVDVFFI

SEQ ID NO: 29527 - protein, 8 aa, Dengue virus
GVDVFFIP

SEQ ID NO: 29528 - protein, 8 aa, Dengue virus
VDVFFIPP

SEQ ID NO: 29529 - protein, 8 aa, Dengue virus
DVFFIPPE

SEQ ID NO: 29530 - protein, 8 aa, Dengue virus
VFFIPPEK

SEQ ID NO: 29531 - protein, 8 aa, Dengue virus
FFIPPEKC

SEQ ID NO: 29532 - protein, 8 aa, Dengue virus
FIPPEKCD

SEQ ID NO: 29533 - protein, 8 aa, Dengue virus
IPPEKCDT

SEQ ID NO: 29534 - protein, 8 aa, Dengue virus
PPERCDTL

SEQ ID NO: 29535 - protein, 8 aa, Dengue virus
PERCDTLL

SEQ ID NO: 29536 - protein, 8 aa, Dengue virus
ERCDTLLC

SEQ ID NO: 29537 - protein, 8 aa, Dengue virus
RCDTLLCD

SEQ ID NO: 29538 - protein, 8 aa, Dengue virus
ESSPNPTV

SEQ ID NO: 29539 - protein, 8 aa, Dengue virus
SSPNPTVE

SEQ ID NO: 29540 - protein, 8 aa, Dengue virus
SPNPTVEA

SEQ ID NO: 29541 - protein, 8 aa, Dengue virus
PNPTVEAG

SEQ ID NO: 29542 - protein, 8 aa, Dengue virus
NPTVEAGR

SEQ ID NO: 29543 - protein, 8 aa, Dengue virus
PTVEAGRT

SEQ ID NO: 29544 - protein, 8 aa, Dengue virus
TVEAGRTL

SEQ ID NO: 29545 - protein, 8 aa, Dengue virus
VEAGRTLR

SEQ ID NO: 29546 - protein, 8 aa, Dengue virus
GRTLRVLS

SEQ ID NO: 29547 - protein, 8 aa, Dengue virus
RTLRVLSL

SEQ ID NO: 29548 - protein, 8 aa, Dengue virus
TLRVLSLV

SEQ ID NO: 29549 - protein, 8 aa, Dengue virus
LRVLSLVE

SEQ ID NO: 29550 - protein, 8 aa, Dengue virus
RVLSLVEN

SEQ ID NO: 29551 - protein, 8 aa, Dengue virus
VLSLVENW

SEQ ID NO: 29552 - protein, 8 aa, Dengue virus
LSLVENWL

SEQ ID NO: 29553 - protein, 8 aa, Dengue virus
SLVENWLN

SEQ ID NO: 29554 - protein, 8 aa, Dengue virus
LVENWLGS

SEQ ID NO: 29555 - protein, 8 aa, Dengue virus
VENWLNND

SEQ ID NO: 29556 - protein, 8 aa, Dengue virus
ENWLNNDT

SEQ ID NO: 29557 - protein, 8 aa, Dengue virus
NWLNNDTQ

SEQ ID NO: 29558 - protein, 8 aa, Dengue virus
WLNNDTQF

SEQ ID NO: 29559 - protein, 8 aa, Dengue virus
LNNDTQFC

SEQ ID NO: 29560 - protein, 8 aa, Dengue virus
NNDTQFCI

SEQ ID NO: 29561 - protein, 8 aa, Dengue virus
NDTQFCIK

SEQ ID NO: 29562 - protein, 8 aa, Dengue virus
NTQFCVKV

SEQ ID NO: 29563 - protein, 8 aa, Dengue virus
TQFCVKVL

SEQ ID NO: 29564 - protein, 8 aa, Dengue virus
QFCVKVLN

SEQ ID NO: 29565 - protein, 8 aa, Dengue virus
FCVKVLNP

SEQ ID NO: 29566 - protein, 8 aa, Dengue virus
CVKVLNPY

SEQ ID NO: 29567 - protein, 8 aa, Dengue virus
VKVLNPYM

SEQ ID NO: 29568 - protein, 8 aa, Dengue virus
YMPSVIER

SEQ ID NO: 29569 - protein, 8 aa, Dengue virus
MPSVIERM

SEQ ID NO: 29570 - protein, 8 aa, Dengue virus
PSVIERME

SEQ ID NO: 29571 - protein, 8 aa, Dengue virus
SVIEKMET

SEQ ID NO: 29572 - protein, 8 aa, Dengue virus
VIEKMETL

SEQ ID NO: 29573 - protein, 8 aa, Dengue virus
IEKMETLQ

SEQ ID NO: 29574 - protein, 8 aa, Dengue virus
EKMETLQR

SEQ ID NO: 29575 - protein, 8 aa, Dengue virus
LQRQYGGA

SEQ ID NO: 29576 - protein, 8 aa, Dengue virus
QRQYGGAL

SEQ ID NO: 29577 - protein, 8 aa, Dengue virus
RQYGGALV

SEQ ID NO: 29578 - protein, 8 aa, Dengue virus
QYGGALVR

SEQ ID NO: 29579 - protein, 8 aa, Dengue virus
FGGALVRN

SEQ ID NO: 29580 - protein, 8 aa, Dengue virus
MYWVSNAS

SEQ ID NO: 29581 - protein, 8 aa, Dengue virus
YWVSNASG

SEQ ID NO: 29582 - protein, 8 aa, Dengue virus
WVSNASGN

SEQ ID NO: 29583 - protein, 8 aa, Dengue virus
VSNASGNI

SEQ ID NO: 29584 - protein, 8 aa, Dengue virus
SNASGNIV

SEQ ID NO: 29585 - protein, 8 aa, Dengue virus
NASGNIVS

SEQ ID NO: 29586 - protein, 8 aa, Dengue virus
ASGNIVSS

SEQ ID NO: 29587 - protein, 8 aa, Dengue virus
SGNIVSSV

SEQ ID NO: 29588 - protein, 8 aa, Dengue virus
LINRFTMR

SEQ ID NO: 29589 - protein, 8 aa, Dengue virus
INRFTMRH

SEQ ID NO: 29590 - protein, 8 aa, Dengue virus
NRFTMRHK

SEQ ID NO: 29591 - protein, 8 aa, Dengue virus
RFTMRHKK

SEQ ID NO: 29592 - protein, 8 aa, Dengue virus
FTMRHKKA

SEQ ID NO: 29593 - protein, 8 aa, Dengue virus
TMRHKKAT

SEQ ID NO: 29594 - protein, 8 aa, Dengue virus
MRHKKATY

SEQ ID NO: 29595 - protein, 8 aa, Dengue virus
RHKKATYE

SEQ ID NO: 29596 - protein, 8 aa, Dengue virus
YKKATYEP

SEQ ID NO: 29597 - protein, 8 aa, Dengue virus
KKTTYEPD

SEQ ID NO: 29598 - protein, 8 aa, Dengue virus
KTTYEPDV

SEQ ID NO: 29599 - protein, 8 aa, Dengue virus
SGTRNIGT

SEQ ID NO: 29600 - protein, 8 aa, Dengue virus
GTRNIGTE

SEQ ID NO: 29601 - protein, 8 aa, Dengue virus
TRNIGIEN

SEQ ID NO: 29602 - protein, 8 aa, Dengue virus
RNIGIENE

SEQ ID NO: 29603 - protein, 8 aa, Dengue virus
ETPNLDII

SEQ ID NO: 29604 - protein, 8 aa, Dengue virus
TPNLDIIG

SEQ ID NO: 29605 - protein, 8 aa, Dengue virus
PNMDIIGK

SEQ ID NO: 29606 - protein, 8 aa, Dengue virus
NMDIIGKR

SEQ ID NO: 29607 - protein, 8 aa, Dengue virus
MDIIGKRI

SEQ ID NO: 29608 - protein, 8 aa, Dengue virus
KRIEKIKE

SEQ ID NO: 29609 - protein, 8 aa, Dengue virus
RIEKIKEE

SEQ ID NO: 29610 - protein, 8 aa, Dengue virus
IEKIKEEH

SEQ ID NO: 29611 - protein, 8 aa, Dengue virus
EKIKEEHE

SEQ ID NO: 29612 - protein, 8 aa, Dengue virus
KIKQEHEI

SEQ ID NO: 29613 - protein, 8 aa, Dengue virus
IKQEHEIS

SEQ ID NO: 29614 - protein, 8 aa, Dengue virus
KQEHEISW

SEQ ID NO: 29615 - protein, 8 aa, Dengue virus
QEHEISWH

SEQ ID NO: 29616 - protein, 8 aa, Dengue virus
EHEISWHY

SEQ ID NO: 29617 - protein, 8 aa, Dengue virus
HEISWHYD

SEQ ID NO: 29618 - protein, 8 aa, Dengue virus
EISWHYDQ

SEQ ID NO: 29619 - protein, 8 aa, Dengue virus
ISWHYDQD

SEQ ID NO: 29620 - protein, 8 aa, Dengue virus
SMVNGVVK

SEQ ID NO: 29621 - protein, 8 aa, Dengue virus
MVNGVVKL

SEQ ID NO: 29622 - protein, 8 aa, Dengue virus
VNGVVKLL

SEQ ID NO: 29623 - protein, 8 aa, Dengue virus
NGVVKLLT

SEQ ID NO: 29624 - protein, 8 aa, Dengue virus
GVVKLLTK

SEQ ID NO: 29625 - protein, 8 aa, Dengue virus
VVKLLTKP

SEQ ID NO: 29626 - protein, 8 aa, Dengue virus
VKLLTKPW

SEQ ID NO: 29627 - protein, 8 aa, Dengue virus
KLLTKPWD

SEQ ID NO: 29628 - protein, 8 aa, Dengue virus
LTKPWDVL

SEQ ID NO: 29629 - protein, 8 aa, Dengue virus
TKPWDVLP

SEQ ID NO: 29630 - protein, 8 aa, Dengue virus
KPWDVLPT

SEQ ID NO: 29631 - protein, 8 aa, Dengue virus
PWDVLPTV

SEQ ID NO: 29632 - protein, 8 aa, Dengue virus
WDVLPTVT

SEQ ID NO: 29633 - protein, 8 aa, Dengue virus
DVLPTVTQ

SEQ ID NO: 29634 - protein, 8 aa, Dengue virus
VLPTVTQM

SEQ ID NO: 29635 - protein, 8 aa, Dengue virus
LPTVTQMA

SEQ ID NO: 29636 - protein, 8 aa, Dengue virus
PTVTQMAM

SEQ ID NO: 29637 - protein, 8 aa, Dengue virus
TVTQMAMT

SEQ ID NO: 29638 - protein, 8 aa, Dengue virus
EGTKKLMR

SEQ ID NO: 29639 - protein, 8 aa, Dengue virus
GTKKLMRI

SEQ ID NO: 29640 - protein, 8 aa, Dengue virus
TKKLMRIT

SEQ ID NO: 29641 - protein, 8 aa, Dengue virus
KKLMRITA

SEQ ID NO: 29642 - protein, 8 aa, Dengue virus
KLMRITAE

SEQ ID NO: 29643 - protein, 8 aa, Dengue virus
LMRITAEW

SEQ ID NO: 29644 - protein, 8 aa, Dengue virus
MRITAEWL

SEQ ID NO: 29645 - protein, 8 aa, Dengue virus
RITAEWLW

SEQ ID NO: 29646 - protein, 8 aa, Dengue virus
ITAEWLWG

SEQ ID NO: 29647 - protein, 8 aa, Dengue virus
TAKWLWKE

SEQ ID NO: 29648 - protein, 8 aa, Dengue virus
AEWLWGEL

SEQ ID NO: 29649 - protein, 8 aa, Dengue virus
EWLWGELG

SEQ ID NO: 29650 - protein, 8 aa, Dengue virus
WLWGELGR

SEQ ID NO: 29651 - protein, 8 aa, Dengue virus
LWKELGKE

SEQ ID NO: 29652 - protein, 8 aa, Dengue virus
WKELGKEK

SEQ ID NO: 29653 - protein, 8 aa, Dengue virus
KELGKEKT

SEQ ID NO: 29654 - protein, 8 aa, Dengue virus
ELGKEKTP

SEQ ID NO: 29655 - protein, 8 aa, Dengue virus
LGKEKTPR

SEQ ID NO: 29656 - protein, 8 aa, Dengue virus
KKPRICTR

SEQ ID NO: 29657 - protein, 8 aa, Dengue virus
KPRICTRA

SEQ ID NO: 29658 - protein, 8 aa, Dengue virus
PRICTRAE

SEQ ID NO: 29659 - protein, 8 aa, Dengue virus
RICTRAEF

SEQ ID NO: 29660 - protein, 8 aa, Dengue virus
ICTRAEFC

SEQ ID NO: 29661 - protein, 8 aa, Dengue virus
CTREEFTK

SEQ ID NO: 29662 - protein, 8 aa, Dengue virus
TREEFTKK

SEQ ID NO: 29663 - protein, 8 aa, Dengue virus
REEFTKKV

SEQ ID NO: 29664 - protein, 8 aa, Dengue virus
EEFTKKVR

SEQ ID NO: 29665 - protein, 8 aa, Dengue virus
EFTKKVRS

SEQ ID NO: 29666 - protein, 8 aa, Dengue virus
FTKKVRSN

SEQ ID NO: 29667 - protein, 8 aa, Dengue virus
TKKVRSNA

SEQ ID NO: 29668 - protein, 8 aa, Dengue virus
KKVRSNAA

SEQ ID NO: 29669 - protein, 8 aa, Dengue virus
SNAALGAV

SEQ ID NO: 29670 - protein, 8 aa, Dengue virus
NAALGAVF

SEQ ID NO: 29671 - protein, 8 aa, Dengue virus
AALGAVFT

SEQ ID NO: 29672 - protein, 8 aa, Dengue virus
ALGAVFTD

SEQ ID NO: 29673 - protein, 8 aa, Dengue virus
LGAVFTDE

SEQ ID NO: 29674 - protein, 8 aa, Dengue virus
GAVFTDEN

SEQ ID NO: 29675 - protein, 8 aa, Dengue virus
AVFTDENK

SEQ ID NO: 29676 - protein, 8 aa, Dengue virus
VFTDENKW

SEQ ID NO: 29677 - protein, 8 aa, Dengue virus
AREAVEDG

SEQ ID NO: 29678 - protein, 8 aa, Dengue virus
REAVEDGR

SEQ ID NO: 29679 - protein, 8 aa, Dengue virus
EAVEDGRF

SEQ ID NO: 29680 - protein, 8 aa, Dengue virus
AVEDGRFW

SEQ ID NO: 29681 - protein, 8 aa, Dengue virus
VEDGRFWE

SEQ ID NO: 29682 - protein, 8 aa, Dengue virus
EDGRFWEL

SEQ ID NO: 29683 - protein, 8 aa, Dengue virus
FWELVDRE

SEQ ID NO: 29684 - protein, 8 aa, Dengue virus
WELVDRER

SEQ ID NO: 29685 - protein, 8 aa, Dengue virus
ELVDRERN

SEQ ID NO: 29686 - protein, 8 aa, Dengue virus
LVDRERNL

SEQ ID NO: 29687 - protein, 8 aa, Dengue virus
VDRERNLH

SEQ ID NO: 29688 - protein, 8 aa, Dengue virus
DRERNLHL

SEQ ID NO: 29689 - protein, 8 aa, Dengue virus
RERNLHLE

SEQ ID NO: 29690 - protein, 8 aa, Dengue virus
ERNLHLDG

SEQ ID NO: 29691 - protein, 8 aa, Dengue virus
RNLHLDGK

SEQ ID NO: 29692 - protein, 8 aa, Dengue virus
NLHLDGKC

SEQ ID NO: 29693 - protein, 8 aa, Dengue virus
LHLDGKCE

SEQ ID NO: 29694 - protein, 8 aa, Dengue virus
HLDGKCET

SEQ ID NO: 29695 - protein, 8 aa, Dengue virus
LDGKCETC

SEQ ID NO: 29696 - protein, 8 aa, Dengue virus
DGKCETCV

SEQ ID NO: 29697 - protein, 8 aa, Dengue virus
EDHWFSRG

SEQ ID NO: 29698 - protein, 8 aa, Dengue virus
DHWFSRGN

SEQ ID NO: 29699 - protein, 8 aa, Dengue virus
HWFSRGNS

SEQ ID NO: 29700 - protein, 8 aa, Dengue virus
WFSRGNSL

SEQ ID NO: 29701 - protein, 8 aa, Dengue virus
FSRGNSLS

SEQ ID NO: 29702 - protein, 8 aa, Dengue virus
SRGNSLSG

SEQ ID NO: 29703 - protein, 8 aa, Dengue virus
RGNSLSGV

SEQ ID NO: 29704 - protein, 8 aa, Dengue virus
GNSLSGVE

SEQ ID NO: 29705 - protein, 8 aa, Dengue virus
GVEGEGLY

SEQ ID NO: 29706 - protein, 8 aa, Dengue virus
VEGEGLHR

SEQ ID NO: 29707 - protein, 8 aa, Dengue virus
EGEGLHRL

SEQ ID NO: 29708 - protein, 8 aa, Dengue virus
GEGLHRLG

SEQ ID NO: 29709 - protein, 8 aa, Dengue virus
EGLHRLGY

SEQ ID NO: 29710 - protein, 8 aa, Dengue virus
GLHRLGYI

SEQ ID NO: 29711 - protein, 8 aa, Dengue virus
LHRLGYIL

SEQ ID NO: 29712 - protein, 8 aa, Dengue virus
HRLGYILR

SEQ ID NO: 29713 - protein, 8 aa, Dengue virus
RLGYILRD

SEQ ID NO: 29714 - protein, 8 aa, Dengue virus
LGYILREV

SEQ ID NO: 29715 - protein, 8 aa, Dengue virus
GYILRDVG

SEQ ID NO: 29716 - protein, 8 aa, Dengue virus
YILRDVGK

SEQ ID NO: 29717 - protein, 8 aa, Dengue virus
ILRDVGKK

SEQ ID NO: 29718 - protein, 8 aa, Dengue virus
DVGKKEGG

SEQ ID NO: 29719 - protein, 8 aa, Dengue virus
VGKKEGGA

SEQ ID NO: 29720 - protein, 8 aa, Dengue virus
GKKEGGAM

SEQ ID NO: 29721 - protein, 8 aa, Dengue virus
RKAGGAMY

SEQ ID NO: 29722 - protein, 8 aa, Dengue virus
KAGGAMYA

SEQ ID NO: 29723 - protein, 8 aa, Dengue virus
AGGAMYAD

SEQ ID NO: 29724 - protein, 8 aa, Dengue virus
GWDTRITI

SEQ ID NO: 29725 - protein, 8 aa, Dengue virus
WDTRITIE

SEQ ID NO: 29726 - protein, 8 aa, Dengue virus
DTRITIED

SEQ ID NO: 29727 - protein, 8 aa, Dengue virus
TRITIEDL

SEQ ID NO: 29728 - protein, 8 aa, Dengue virus
RITIEDLK

SEQ ID NO: 29729 - protein, 8 aa, Dengue virus
ITIEDLKN

SEQ ID NO: 29730 - protein, 8 aa, Dengue virus
TIEDLKNE

SEQ ID NO: 29731 - protein, 8 aa, Dengue virus
IEDLKNEE

SEQ ID NO: 29732 - protein, 8 aa, Dengue virus
DLKNEEMI

SEQ ID NO: 29733 - protein, 8 aa, Dengue virus
LKNEEMIT

SEQ ID NO: 29734 - protein, 8 aa, Dengue virus
KNEEMITN

SEQ ID NO: 29735 - protein, 8 aa, Dengue virus
NEEMITNH

SEQ ID NO: 29736 - protein, 8 aa, Dengue virus
EEMITNHM

SEQ ID NO: 29737 - protein, 8 aa, Dengue virus
GEHKRLAE

SEQ ID NO: 29738 - protein, 8 aa, Dengue virus
EHKRLAEA

SEQ ID NO: 29739 - protein, 8 aa, Dengue virus
HKRLAEAI

SEQ ID NO: 29740 - protein, 8 aa, Dengue virus
KRLAEAIF

SEQ ID NO: 29741 - protein, 8 aa, Dengue virus
RLAEAIFK

SEQ ID NO: 29742 - protein, 8 aa, Dengue virus
LAEAIFRL

SEQ ID NO: 29743 - protein, 8 aa, Dengue virus
AEAIFRLT

SEQ ID NO: 29744 - protein, 8 aa, Dengue virus
EAIFRLTY

SEQ ID NO: 29745 - protein, 8 aa, Dengue virus
AIFRLTYQ

SEQ ID NO: 29746 - protein, 8 aa, Dengue virus
IFRLTYQN

SEQ ID NO: 29747 - protein, 8 aa, Dengue virus
FRLTYQNK

SEQ ID NO: 29748 - protein, 8 aa, Dengue virus
RLTYQNKV

SEQ ID NO: 29749 - protein, 8 aa, Dengue virus
QRPTPKGT

SEQ ID NO: 29750 - protein, 8 aa, Dengue virus
RPTSRGTV

SEQ ID NO: 29751 - protein, 8 aa, Dengue virus
PTSRGTVM

SEQ ID NO: 29752 - protein, 8 aa, Dengue virus
TPIGTVMD

SEQ ID NO: 29753 - protein, 8 aa, Dengue virus
SRGTVMDI

SEQ ID NO: 29754 - protein, 8 aa, Dengue virus
VMDIISRK

SEQ ID NO: 29755 - protein, 8 aa, Dengue virus
MDIISRKD

SEQ ID NO: 29756 - protein, 8 aa, Dengue virus
DIISRKDQ

SEQ ID NO: 29757 - protein, 8 aa, Dengue virus
IISRKDQR

SEQ ID NO: 29758 - protein, 8 aa, Dengue virus
ISRKDQRG

SEQ ID NO: 29759 - protein, 8 aa, Dengue virus
SRKDQRGS

SEQ ID NO: 29760 - protein, 8 aa, Dengue virus
RKDQRGSG

SEQ ID NO: 29761 - protein, 8 aa, Dengue virus
KDQRGSGQ

SEQ ID NO: 29762 - protein, 8 aa, Dengue virus
QRGSGQVV

SEQ ID NO: 29763 - protein, 8 aa, Dengue virus
RGSGQVVT

SEQ ID NO: 29764 - protein, 8 aa, Dengue virus
GSGQVVTY

SEQ ID NO: 29765 - protein, 8 aa, Dengue virus
SGQVVTYG

SEQ ID NO: 29766 - protein, 8 aa, Dengue virus
GQVVTYGL

SEQ ID NO: 29767 - protein, 8 aa, Dengue virus
QVVTYGLN

SEQ ID NO: 29768 - protein, 8 aa, Dengue virus
VVTYGLNT

SEQ ID NO: 29769 - protein, 8 aa, Dengue virus
VTYGLNTF

SEQ ID NO: 29770 - protein, 8 aa, Dengue virus
LNTFTNMG

SEQ ID NO: 29771 - protein, 8 aa, Dengue virus
NTFTNMGA

SEQ ID NO: 29772 - protein, 8 aa, Dengue virus
TFTNMGAQ

SEQ ID NO: 29773 - protein, 8 aa, Dengue virus
FTNMGAQL

SEQ ID NO: 29774 - protein, 8 aa, Dengue virus
TNMGAQLI

SEQ ID NO: 29775 - protein, 8 aa, Dengue virus
NMGAQLIR

SEQ ID NO: 29776 - protein, 8 aa, Dengue virus
MGAQLIRQ

SEQ ID NO: 29777 - protein, 8 aa, Dengue virus
RQMEGEGV

SEQ ID NO: 29778 - protein, 8 aa, Dengue virus
QMEGEGVF

SEQ ID NO: 29779 - protein, 8 aa, Dengue virus
MEGEGVFK

SEQ ID NO: 29780 - protein, 8 aa, Dengue virus
REGRERLA

SEQ ID NO: 29781 - protein, 8 aa, Dengue virus
EGRERLAR

SEQ ID NO: 29782 - protein, 8 aa, Dengue virus
GRERLARM

SEQ ID NO: 29783 - protein, 8 aa, Dengue virus
RERLARMA

SEQ ID NO: 29784 - protein, 8 aa, Dengue virus
ERLARMAI

SEQ ID NO: 29785 - protein, 8 aa, Dengue virus
RLARMAIS

SEQ ID NO: 29786 - protein, 8 aa, Dengue virus
LARMAISG

SEQ ID NO: 29787 - protein, 8 aa, Dengue virus
ARMAISGD

SEQ ID NO: 29788 - protein, 8 aa, Dengue virus
DDCVVKPI

SEQ ID NO: 29789 - protein, 8 aa, Dengue virus
DCVVKPID

SEQ ID NO: 29790 - protein, 8 aa, Dengue virus
CVVKPIDD

SEQ ID NO: 29791 - protein, 8 aa, Dengue virus
VVKPIDDR

SEQ ID NO: 29792 - protein, 8 aa, Dengue virus
VKPIDDRF

SEQ ID NO: 29793 - protein, 8 aa, Dengue virus
KPIDDRFA

SEQ ID NO: 29794 - protein, 8 aa, Dengue virus
DDRFANAL

SEQ ID NO: 29795 - protein, 8 aa, Dengue virus
DRFANALT

SEQ ID NO: 29796 - protein, 8 aa, Dengue virus
RFANALTA

SEQ ID NO: 29797 - protein, 8 aa, Dengue virus
FANALTAL

SEQ ID NO: 29798 - protein, 8 aa, Dengue virus
ANALTALN

SEQ ID NO: 29799 - protein, 8 aa, Dengue virus
NALTALND

SEQ ID NO: 29800 - protein, 8 aa, Dengue virus
ALNDMGKI

SEQ ID NO: 29801 - protein, 8 aa, Dengue virus
LNDMGKIR

SEQ ID NO: 29802 - protein, 8 aa, Dengue virus
NDMGKIRK

SEQ ID NO: 29803 - protein, 8 aa, Dengue virus
DMGKIRKD

SEQ ID NO: 29804 - protein, 8 aa, Dengue virus
MGKIRKDI

SEQ ID NO: 29805 - protein, 8 aa, Dengue virus
GKIRKDIQ

SEQ ID NO: 29806 - protein, 8 aa, Dengue virus
KIRKDIQQ

SEQ ID NO: 29807 - protein, 8 aa, Dengue virus
IRKDIQQW

SEQ ID NO: 29808 - protein, 8 aa, Dengue virus
IQQWEPSK

SEQ ID NO: 29809 - protein, 8 aa, Dengue virus
QQWEPSKG

SEQ ID NO: 29810 - protein, 8 aa, Dengue virus
QWEPSKGW

SEQ ID NO: 29811 - protein, 8 aa, Dengue virus
WEPSKGWN

SEQ ID NO: 29812 - protein, 8 aa, Dengue virus
EPSKGWND

SEQ ID NO: 29813 - protein, 8 aa, Dengue virus
PSKGWNDW

SEQ ID NO: 29814 - protein, 8 aa, Dengue virus
SKGWNDWT

SEQ ID NO: 29815 - protein, 8 aa, Dengue virus
KGWNDWTQ

SEQ ID NO: 29816 - protein, 8 aa, Dengue virus
GWSDWTQV

SEQ ID NO: 29817 - protein, 8 aa, Dengue virus
WSDWTQVP

SEQ ID NO: 29818 - protein, 8 aa, Dengue virus
SDWTQVPF

SEQ ID NO: 29819 - protein, 8 aa, Dengue virus
SHHFHELV

SEQ ID NO: 29820 - protein, 8 aa, Dengue virus
HHFHELVM

SEQ ID NO: 29821 - protein, 8 aa, Dengue virus
HFHELVMK

SEQ ID NO: 29822 - protein, 8 aa, Dengue virus
FHELVMKD

SEQ ID NO: 29823 - protein, 8 aa, Dengue virus
HELVMKDG

SEQ ID NO: 29824 - protein, 8 aa, Dengue virus
ELVMKDGR

SEQ ID NO: 29825 - protein, 8 aa, Dengue virus
MKDGRTLV

SEQ ID NO: 29826 - protein, 8 aa, Dengue virus
KDGRTLVV

SEQ ID NO: 29827 - protein, 8 aa, Dengue virus
DGRTLVVP

SEQ ID NO: 29828 - protein, 8 aa, Dengue virus
GRTLVVPC

SEQ ID NO: 29829 - protein, 8 aa, Dengue virus
RTLVVPCR

SEQ ID NO: 29830 - protein, 8 aa, Dengue virus
LVVPCRSQ

SEQ ID NO: 29831 - protein, 8 aa, Dengue virus
VVPCRSQD

SEQ ID NO: 29832 - protein, 8 aa, Dengue virus
VPCRSQDE

SEQ ID NO: 29833 - protein, 8 aa, Dengue virus
PCRSQDEL

SEQ ID NO: 29834 - protein, 8 aa, Dengue virus
CRSQDELI

SEQ ID NO: 29835 - protein, 8 aa, Dengue virus
RSQDELIG

SEQ ID NO: 29836 - protein, 8 aa, Dengue virus
SQDELIGR

SEQ ID NO: 29837 - protein, 8 aa, Dengue virus
QGAGWSLR

SEQ ID NO: 29838 - protein, 8 aa, Dengue virus
GAGWSLRE

SEQ ID NO: 29839 - protein, 8 aa, Dengue virus
AGWSLRET

SEQ ID NO: 29840 - protein, 8 aa, Dengue virus
GWSLRETA

SEQ ID NO: 29841 - protein, 8 aa, Dengue virus
WSLRETAC

SEQ ID NO: 29842 - protein, 8 aa, Dengue virus
SLRETACL

SEQ ID NO: 29843 - protein, 8 aa, Dengue virus
LRETACLG

SEQ ID NO: 29844 - protein, 8 aa, Dengue virus
RETACLGK

SEQ ID NO: 29845 - protein, 8 aa, Dengue virus
KSYAQMWT

SEQ ID NO: 29846 - protein, 8 aa, Dengue virus
SYAQMWTL

SEQ ID NO: 29847 - protein, 8 aa, Dengue virus
YAQMWTLM

SEQ ID NO: 29848 - protein, 8 aa, Dengue virus
AQMWTLMY

SEQ ID NO: 29849 - protein, 8 aa, Dengue virus
QMWTLMYF

SEQ ID NO: 29850 - protein, 8 aa, Dengue virus
MWTLMYFH

SEQ ID NO: 29851 - protein, 8 aa, Dengue virus
WTLMYFHR

SEQ ID NO: 29852 - protein, 8 aa, Dengue virus
TLMYFHRR

SEQ ID NO: 29853 - protein, 8 aa, Dengue virus
AICSAVPP

SEQ ID NO: 29854 - protein, 8 aa, Dengue virus
ICSAVPPH

SEQ ID NO: 29855 - protein, 8 aa, Dengue virus
CSAVPPHW

SEQ ID NO: 29856 - protein, 8 aa, Dengue virus
SAVPPHWV

SEQ ID NO: 29857 - protein, 8 aa, Dengue virus
AVPPHWVP

SEQ ID NO: 29858 - protein, 8 aa, Dengue virus
VPPHWVPT

SEQ ID NO: 29859 - protein, 8 aa, Dengue virus
PPHWVPTS

SEQ ID NO: 29860 - protein, 8 aa, Dengue virus
PHWVPTSR

SEQ ID NO: 29861 - protein, 8 aa, Dengue virus
TTWSIHAT

SEQ ID NO: 29862 - protein, 8 aa, Dengue virus
TWSIHATH

SEQ ID NO: 29863 - protein, 8 aa, Dengue virus
WSIHATHE

SEQ ID NO: 29864 - protein, 8 aa, Dengue virus
SIHATHEW

SEQ ID NO: 29865 - protein, 8 aa, Dengue virus
IHATHEWM

SEQ ID NO: 29866 - protein, 8 aa, Dengue virus
HATHEWMT

SEQ ID NO: 29867 - protein, 8 aa, Dengue virus
ATHEWMTT

SEQ ID NO: 29868 - protein, 8 aa, Dengue virus
THEWMTTE

SEQ ID NO: 29869 - protein, 8 aa, Dengue virus
MTTEDMLT

SEQ ID NO: 29870 - protein, 8 aa, Dengue virus
TTEDMLTV

SEQ ID NO: 29871 - protein, 8 aa, Dengue virus
TEDMLTVW

SEQ ID NO: 29872 - protein, 8 aa, Dengue virus
EDMLTVWN

SEQ ID NO: 29873 - protein, 8 aa, Dengue virus
DMLTVWNR

SEQ ID NO: 29874 - protein, 8 aa, Dengue virus
MLTVWNRV

SEQ ID NO: 29875 - protein, 8 aa, Dengue virus
LTVWNRVW

SEQ ID NO: 29876 - protein, 8 aa, Dengue virus
TVWNRVWI

SEQ ID NO: 29877 - protein, 8 aa, Dengue virus
VWNRVWIR

SEQ ID NO: 29878 - protein, 8 aa, Dengue virus
WNRVWIRE

SEQ ID NO: 29879 - protein, 8 aa, Dengue virus
NRVWIREN

SEQ ID NO: 29880 - protein, 8 aa, Dengue virus
RVWIRENP

SEQ ID NO: 29881 - protein, 8 aa, Dengue virus
VWIRENPW

SEQ ID NO: 29882 - protein, 8 aa, Dengue virus
WIRENPWM

SEQ ID NO: 29883 - protein, 8 aa, Dengue virus
IRENPWME

SEQ ID NO: 29884 - protein, 8 aa, Dengue virus
RENPWMED

SEQ ID NO: 29885 - protein, 8 aa, Dengue virus
DNPWMEDK

SEQ ID NO: 29886 - protein, 8 aa, Dengue virus
NPWIEDKT

SEQ ID NO: 29887 - protein, 8 aa, Dengue virus
PWIEDKTP

SEQ ID NO: 29888 - protein, 8 aa, Dengue virus
WIEDKTPV

SEQ ID NO: 29889 - protein, 8 aa, Dengue virus
IEDKTPVE

SEQ ID NO: 29890 - protein, 8 aa, Dengue virus
EDKTPVET

SEQ ID NO: 29891 - protein, 8 aa, Dengue virus
DKTPVETW

SEQ ID NO: 29892 - protein, 8 aa, Dengue virus
KTPVETWE

SEQ ID NO: 29893 - protein, 8 aa, Dengue virus
TPVESWED

SEQ ID NO: 29894 - protein, 8 aa, Dengue virus
PVESWEEI

SEQ ID NO: 29895 - protein, 8 aa, Dengue virus
VESWEEIP

SEQ ID NO: 29896 - protein, 8 aa, Dengue virus
ESWEEIPY

SEQ ID NO: 29897 - protein, 8 aa, Dengue virus
SWEEIPYL

SEQ ID NO: 29898 - protein, 8 aa, Dengue virus
WEEIPYLG

SEQ ID NO: 29899 - protein, 8 aa, Dengue virus
EEIPYLGK

SEQ ID NO: 29900 - protein, 8 aa, Dengue virus
EIPYLGKR

SEQ ID NO: 29901 - protein, 8 aa, Dengue virus
IPYLGKRE

SEQ ID NO: 29902 - protein, 8 aa, Dengue virus
TWAKNIQA

SEQ ID NO: 29903 - protein, 8 aa, Dengue virus
WAKNIQAA

SEQ ID NO: 29904 - protein, 8 aa, Dengue virus
AKNIQAAI

SEQ ID NO: 29905 - protein, 8 aa, Dengue virus
KNIQAAIN

SEQ ID NO: 29906 - protein, 8 aa, Dengue virus
NIQAAINQ

SEQ ID NO: 29907 - protein, 8 aa, Dengue virus
IQAAINQV

SEQ ID NO: 29908 - protein, 8 aa, Dengue virus
QAAINQVR

SEQ ID NO: 29909 - protein, 8 aa, Dengue virus
AAINQVRS

SEQ ID NO: 29910 - protein, 8 aa, Dengue virus
AINQVRAL

SEQ ID NO: 29911 - protein, 8 aa, Dengue virus
INQVRALI

SEQ ID NO: 29912 - protein, 8 aa, Dengue virus
NQVRALIG

SEQ ID NO: 29913 - protein, 8 aa, Dengue virus
QVRALIGE

SEQ ID NO: 29914 - protein, 8 aa, Dengue virus
VRALIGEE

SEQ ID NO: 29915 - protein, 8 aa, Dengue virus
RALIGEEE

SEQ ID NO: 29916 - protein, 8 aa, Dengue virus
ALIGEEEY

SEQ ID NO: 29917 - protein, 8 aa, Dengue virus
EGYTDYMP

SEQ ID NO: 29918 - protein, 8 aa, Dengue virus
GYTDYMPS

SEQ ID NO: 29919 - protein, 8 aa, Dengue virus
YIDYMPSM

SEQ ID NO: 29920 - protein, 8 aa, Dengue virus
IDYMPSMK

SEQ ID NO: 29921 - protein, 8 aa, Dengue virus
PSMKRFRK

SEQ ID NO: 29922 - protein, 8 aa, Dengue virus
SMKRFRKE

SEQ ID NO: 29923 - protein, 8 aa, Dengue virus
MKRFRKEE

SEQ ID NO: 29924 - protein, 8 aa, Dengue virus
KRFRKEEE

SEQ ID NO: 29925 - protein, 8 aa, Dengue virus
RFRKEEEE

SEQ ID NO: 29926 - protein, 8 aa, Dengue virus
FRKEEEEA

SEQ ID NO: 29927 - protein, 8 aa, Dengue virus
RKEEEEAG

SEQ ID NO: 29928 - protein, 8 aa, Dengue virus
KEEEEAGV

SEQ ID NO: 29929 - protein, 8 aa, Dengue virus
EEEESGVL

SEQ ID NO: 29930 - protein, 8 aa, Dengue virus
EEESGVLW

SEQ ID NO: 29931 - protein, 8 aa, Dengue virus
NDQRKKAR

SEQ ID NO: 29932 - protein, 8 aa, Dengue virus
NQRKKARN

SEQ ID NO: 29933 - protein, 8 aa, Dengue virus
TTPFNMLK

SEQ ID NO: 29934 - protein, 8 aa, Dengue virus
RLFMALVA

SEQ ID NO: 29935 - protein, 8 aa, Dengue virus
WGTIKKSR

SEQ ID NO: 29936 - protein, 8 aa, Dengue virus
GAIKKSKA

SEQ ID NO: 29937 - protein, 8 aa, Dengue virus
AIKKSKAI

SEQ ID NO: 29938 - protein, 8 aa, Dengue virus
IKKSKAIS

SEQ ID NO: 29939 - protein, 8 aa, Dengue virus
KKSKAINI

SEQ ID NO: 29940 - protein, 8 aa, Dengue virus
KSRAINVL

SEQ ID NO: 29941 - protein, 8 aa, Dengue virus
SRAINVLR

SEQ ID NO: 29942 - protein, 8 aa, Dengue virus
RAINVLRG

SEQ ID NO: 29943 - protein, 8 aa, Dengue virus
NVLRGFRR

SEQ ID NO: 29944 - protein, 8 aa, Dengue virus
ILNKRRRT

SEQ ID NO: 29945 - protein, 8 aa, Dengue virus
LNKRRRTA

SEQ ID NO: 29946 - protein, 8 aa, Dengue virus
NKRRRTAG

SEQ ID NO: 29947 - protein, 8 aa, Dengue virus
IPTVVAFH

SEQ ID NO: 29948 - protein, 8 aa, Dengue virus
PTVVAFHL

SEQ ID NO: 29949 - protein, 8 aa, Dengue virus
TVVAFHLT

SEQ ID NO: 29950 - protein, 8 aa, Dengue virus
VVAFHLTT

SEQ ID NO: 29951 - protein, 8 aa, Dengue virus
IAFHLTTR

SEQ ID NO: 29952 - protein, 8 aa, Dengue virus
EPHMIVSR

SEQ ID NO: 29953 - protein, 8 aa, Dengue virus
PHMIVSRQ

SEQ ID NO: 29954 - protein, 8 aa, Dengue virus
HMIVSRQE

SEQ ID NO: 29955 - protein, 8 aa, Dengue virus
MIVSRQEK

SEQ ID NO: 29956 - protein, 8 aa, Dengue virus
IVSRQEKG

SEQ ID NO: 29957 - protein, 8 aa, Dengue virus
VSRQEKGK

SEQ ID NO: 29958 - protein, 8 aa, Dengue virus
SRQEKGKS

SEQ ID NO: 29959 - protein, 8 aa, Dengue virus
KNEKGKSL

SEQ ID NO: 29960 - protein, 8 aa, Dengue virus
SLLFKTKD

SEQ ID NO: 29961 - protein, 8 aa, Dengue virus
LLFKTKDG

SEQ ID NO: 29962 - protein, 8 aa, Dengue virus
DGTNMCTL

SEQ ID NO: 29963 - protein, 8 aa, Dengue virus
GINMCTLM

SEQ ID NO: 29964 - protein, 8 aa, Dengue virus
INMCTLMA

SEQ ID NO: 29965 - protein, 8 aa, Dengue virus
CEDTVTYK

SEQ ID NO: 29966 - protein, 8 aa, Dengue virus
EDTVTYKC

SEQ ID NO: 29967 - protein, 8 aa, Dengue virus
DTVTYKCP

SEQ ID NO: 29968 - protein, 8 aa, Dengue virus
TITYKCPF

SEQ ID NO: 29969 - protein, 8 aa, Dengue virus
ITYKCPFL

SEQ ID NO: 29970 - protein, 8 aa, Dengue virus
TYKCPFLK

SEQ ID NO: 29971 - protein, 8 aa, Dengue virus
YKCPFLKQ

SEQ ID NO: 29972 - protein, 8 aa, Dengue virus
KCPFLKQN

SEQ ID NO: 29973 - protein, 8 aa, Dengue virus
CPLLKQNE

SEQ ID NO: 29974 - protein, 8 aa, Dengue virus
PLLKQNEP

SEQ ID NO: 29975 - protein, 8 aa, Dengue virus
LLKQNEPE

SEQ ID NO: 29976 - protein, 8 aa, Dengue virus
WVTYGTCA

SEQ ID NO: 29977 - protein, 8 aa, Dengue virus
TMGEHRRE

SEQ ID NO: 29978 - protein, 8 aa, Dengue virus
SEGAWKQA

SEQ ID NO: 29979 - protein, 8 aa, Dengue virus
EGAWKQAQ

SEQ ID NO: 29980 - protein, 8 aa, Dengue virus
GAWKQAQR

SEQ ID NO: 29981 - protein, 8 aa, Dengue virus
AWKQAQRI

SEQ ID NO: 29982 - protein, 8 aa, Dengue virus
WKQAQRIE

SEQ ID NO: 29983 - protein, 8 aa, Dengue virus
KQAQRIET

SEQ ID NO: 29984 - protein, 8 aa, Dengue virus
QAQRIETW

SEQ ID NO: 29985 - protein, 8 aa, Dengue virus
AQRIETWV

SEQ ID NO: 29986 - protein, 8 aa, Dengue virus
ILRHPGFA

SEQ ID NO: 29987 - protein, 8 aa, Dengue virus
LRHPGFTL

SEQ ID NO: 29988 - protein, 8 aa, Dengue virus
RHPGFTLM

SEQ ID NO: 29989 - protein, 8 aa, Dengue virus
HPGFTLMA

SEQ ID NO: 29990 - protein, 8 aa, Dengue virus
PGFTLMAA

SEQ ID NO: 29991 - protein, 8 aa, Dengue virus
AAVLAYTI

SEQ ID NO: 29992 - protein, 8 aa, Dengue virus
AVLAYTIG

SEQ ID NO: 29993 - protein, 8 aa, Dengue virus
VLAYTIGT

SEQ ID NO: 29994 - protein, 8 aa, Dengue virus
AYTVGTTH

SEQ ID NO: 29995 - protein, 8 aa, Dengue virus
YTVGTTHF

SEQ ID NO: 29996 - protein, 8 aa, Dengue virus
TVGTTHFQ

SEQ ID NO: 29997 - protein, 8 aa, Dengue virus
VGTTHFQR

SEQ ID NO: 29998 - protein, 8 aa, Dengue virus
GTTYFQRV

SEQ ID NO: 29999 - protein, 8 aa, Dengue virus
TTYFQRVL

SEQ ID NO: 30000 - protein, 8 aa, Dengue virus
TYFQRVLI

SEQ ID NO: 30001 - protein, 8 aa, Dengue virus
YFQRVLIF

SEQ ID NO: 30002 - protein, 8 aa, Dengue virus
FQRTLIFI

SEQ ID NO: 30003 - protein, 8 aa, Dengue virus
QRTLIFIL

SEQ ID NO: 30004 - protein, 8 aa, Dengue virus
RTLIFILL

SEQ ID NO: 30005 - protein, 8 aa, Dengue virus
ALIFILLA

SEQ ID NO: 30006 - protein, 8 aa, Dengue virus
LIFILLTT

SEQ ID NO: 30007 - protein, 8 aa, Dengue virus
IFILLTAI

SEQ ID NO: 30008 - protein, 8 aa, Dengue virus
FILLTAIA

SEQ ID NO: 30009 - protein, 8 aa, Dengue virus
ILLTAIAP

SEQ ID NO: 30010 - protein, 8 aa, Dengue virus
LLTAIAPS

SEQ ID NO: 30011 - protein, 8 aa, Dengue virus
LTAIAPSM

SEQ ID NO: 30012 - protein, 8 aa, Dengue virus
TAIAPSMT

SEQ ID NO: 30013 - protein, 8 aa, Dengue virus
AIAPSMTM

SEQ ID NO: 30014 - protein, 8 aa, Dengue virus
VTPSMTMR

SEQ ID NO: 30015 - protein, 8 aa, Dengue virus
MAMRCIGI

SEQ ID NO: 30016 - protein, 8 aa, Dengue virus
AMRCIGIS

SEQ ID NO: 30017 - protein, 8 aa, Dengue virus
LTKTEAKH

SEQ ID NO: 30018 - protein, 8 aa, Dengue virus
KTEAKEPA

SEQ ID NO: 30019 - protein, 8 aa, Dengue virus
TEAKEPAT

SEQ ID NO: 30020 - protein, 8 aa, Dengue virus
EAKEPATL

SEQ ID NO: 30021 - protein, 8 aa, Dengue virus
AKEPATLR

SEQ ID NO: 30022 - protein, 8 aa, Dengue virus
KEPATLRK

SEQ ID NO: 30023 - protein, 8 aa, Dengue virus
QPATLRKF

SEQ ID NO: 30024 - protein, 8 aa, Dengue virus
ATLRKYCV

SEQ ID NO: 30025 - protein, 8 aa, Dengue virus
TLRKYCVE

SEQ ID NO: 30026 - protein, 8 aa, Dengue virus
LRKYCVEA

SEQ ID NO: 30027 - protein, 8 aa, Dengue virus
RKYCVEAK

SEQ ID NO: 30028 - protein, 8 aa, Dengue virus
KYCVEAKL

SEQ ID NO: 30029 - protein, 8 aa, Dengue virus
YCVEAKLT

SEQ ID NO: 30030 - protein, 8 aa, Dengue virus
KLTNTTTD

SEQ ID NO: 30031 - protein, 8 aa, Dengue virus
LTNTTTDS

SEQ ID NO: 30032 - protein, 8 aa, Dengue virus
TNTTTDSR

SEQ ID NO: 30033 - protein, 8 aa, Dengue virus
NTTTDSRC

SEQ ID NO: 30034 - protein, 8 aa, Dengue virus
TTTDSRCP

SEQ ID NO: 30035 - protein, 8 aa, Dengue virus
TTDSRCPT

SEQ ID NO: 30036 - protein, 8 aa, Dengue virus
TDSRCPTQ

SEQ ID NO: 30037 - protein, 8 aa, Dengue virus
DSRCPTQG

SEQ ID NO: 30038 - protein, 8 aa, Dengue virus
TQGEPTLN

SEQ ID NO: 30039 - protein, 8 aa, Dengue virus
QGEPTLNE

SEQ ID NO: 30040 - protein, 8 aa, Dengue virus
GEPTLNEE

SEQ ID NO: 30041 - protein, 8 aa, Dengue virus
EPTLNEEQ

SEQ ID NO: 30042 - protein, 8 aa, Dengue virus
PTLNEEQD

SEQ ID NO: 30043 - protein, 8 aa, Dengue virus
TLNEEQDK

SEQ ID NO: 30044 - protein, 8 aa, Dengue virus
LSEEQDKR

SEQ ID NO: 30045 - protein, 8 aa, Dengue virus
SEEQDKRF

SEQ ID NO: 30046 - protein, 8 aa, Dengue virus
EEQDKRFL

SEQ ID NO: 30047 - protein, 8 aa, Dengue virus
EQDKRFLC

SEQ ID NO: 30048 - protein, 8 aa, Dengue virus
QDKRFVCR

SEQ ID NO: 30049 - protein, 8 aa, Dengue virus
DKRFVCRH

SEQ ID NO: 30050 - protein, 8 aa, Dengue virus
KRFVCRHS

SEQ ID NO: 30051 - protein, 8 aa, Dengue virus
RFVCRHSM

SEQ ID NO: 30052 - protein, 8 aa, Dengue virus
FVCRHSMV

SEQ ID NO: 30053 - protein, 8 aa, Dengue virus
VCRHSMVD

SEQ ID NO: 30054 - protein, 8 aa, Dengue virus
IVTCAMFS

SEQ ID NO: 30055 - protein, 8 aa, Dengue virus
VTCAKFTC

SEQ ID NO: 30056 - protein, 8 aa, Dengue virus
TCAMFTCL

SEQ ID NO: 30057 - protein, 8 aa, Dengue virus
CAMFTCLK

SEQ ID NO: 30058 - protein, 8 aa, Dengue virus
AMFTCLKK

SEQ ID NO: 30059 - protein, 8 aa, Dengue virus
MFTCLKKM

SEQ ID NO: 30060 - protein, 8 aa, Dengue virus
FTCKKNMK

SEQ ID NO: 30061 - protein, 8 aa, Dengue virus
TCKKNMKG

SEQ ID NO: 30062 - protein, 8 aa, Dengue virus
CLKKMEGK

SEQ ID NO: 30063 - protein, 8 aa, Dengue virus
KKNMKGKV

SEQ ID NO: 30064 - protein, 8 aa, Dengue virus
KNMKGKVV

SEQ ID NO: 30065 - protein, 8 aa, Dengue virus
NMEGKVVL

SEQ ID NO: 30066 - protein, 8 aa, Dengue virus
MEGKVVLP

SEQ ID NO: 30067 - protein, 8 aa, Dengue virus
EGKVVLPE

SEQ ID NO: 30068 - protein, 8 aa, Dengue virus
GKVVLPEN

SEQ ID NO: 30069 - protein, 8 aa, Dengue virus
KVVLPENL

SEQ ID NO: 30070 - protein, 8 aa, Dengue virus
VVLPENLE

SEQ ID NO: 30071 - protein, 8 aa, Dengue virus
NLEYTVVI

SEQ ID NO: 30072 - protein, 8 aa, Dengue virus
LEYTVVIT

SEQ ID NO: 30073 - protein, 8 aa, Dengue virus
EYTVVITP

SEQ ID NO: 30074 - protein, 8 aa, Dengue virus
YTVVITPH

SEQ ID NO: 30075 - protein, 8 aa, Dengue virus
TVVITPHS

SEQ ID NO: 30076 - protein, 8 aa, Dengue virus
VVITPHSG

SEQ ID NO: 30077 - protein, 8 aa, Dengue virus
GEEHAVGD

SEQ ID NO: 30078 - protein, 8 aa, Dengue virus
EEHAVGDD

SEQ ID NO: 30079 - protein, 8 aa, Dengue virus
EHAVGDDT

SEQ ID NO: 30080 - protein, 8 aa, Dengue virus
HAVGDDTG

SEQ ID NO: 30081 - protein, 8 aa, Dengue virus
NDTGKHGM

SEQ ID NO: 30082 - protein, 8 aa, Dengue virus
DTGKHGME

SEQ ID NO: 30083 - protein, 8 aa, Dengue virus
TGKHGKEV

SEQ ID NO: 30084 - protein, 8 aa, Dengue virus
GKHGKEVK

SEQ ID NO: 30085 - protein, 8 aa, Dengue virus
KHGQEIKV

SEQ ID NO: 30086 - protein, 8 aa, Dengue virus
HGQEIKVT

SEQ ID NO: 30087 - protein, 8 aa, Dengue virus
GQEIKVTP

SEQ ID NO: 30088 - protein, 8 aa, Dengue virus
QEIKVTPQ

SEQ ID NO: 30089 - protein, 8 aa, Dengue virus
EVKITPQS

SEQ ID NO: 30090 - protein, 8 aa, Dengue virus
VKITPQSS

SEQ ID NO: 30091 - protein, 8 aa, Dengue virus
SEAELTDY

SEQ ID NO: 30092 - protein, 8 aa, Dengue virus
GYGTITME

SEQ ID NO: 30093 - protein, 8 aa, Dengue virus
MEEKAWLV

SEQ ID NO: 30094 - protein, 8 aa, Dengue virus
EEKAWLVH

SEQ ID NO: 30095 - protein, 8 aa, Dengue virus
EKAWLVHR

SEQ ID NO: 30096 - protein, 8 aa, Dengue virus
PWLPGADI

SEQ ID NO: 30097 - protein, 8 aa, Dengue virus
WLPGADIQ

SEQ ID NO: 30098 - protein, 8 aa, Dengue virus
LPGADKQG

SEQ ID NO: 30099 - protein, 8 aa, Dengue virus
PGADKQGS

SEQ ID NO: 30100 - protein, 8 aa, Dengue virus
GADKQGSN

SEQ ID NO: 30101 - protein, 8 aa, Dengue virus
ADKQGSNW

SEQ ID NO: 30102 - protein, 8 aa, Dengue virus
DKQGSNWI

SEQ ID NO: 30103 - protein, 8 aa, Dengue virus
KQGSNWIQ

SEQ ID NO: 30104 - protein, 8 aa, Dengue virus
IQMSSGNI

SEQ ID NO: 30105 - protein, 8 aa, Dengue virus
QMSSGNIL

SEQ ID NO: 30106 - protein, 8 aa, Dengue virus
MSSGNILF

SEQ ID NO: 30107 - protein, 8 aa, Dengue virus
HGTIVVRV

SEQ ID NO: 30108 - protein, 8 aa, Dengue virus
GTIVVRVQ

SEQ ID NO: 30109 - protein, 8 aa, Dengue virus
TIVVRVQY

SEQ ID NO: 30110 - protein, 8 aa, Dengue virus
IVVRVQYE

SEQ ID NO: 30111 - protein, 8 aa, Dengue virus
VVRVQYEG

SEQ ID NO: 30112 - protein, 8 aa, Dengue virus
VRVQYEGD

SEQ ID NO: 30113 - protein, 8 aa, Dengue virus
RIQYEGDG

SEQ ID NO: 30114 - protein, 8 aa, Dengue virus
IQYEGDGS

SEQ ID NO: 30115 - protein, 8 aa, Dengue virus
EGDGSPCR

SEQ ID NO: 30116 - protein, 8 aa, Dengue virus
GDGSPCRI

SEQ ID NO: 30117 - protein, 8 aa, Dengue virus
DGSPCRIP

SEQ ID NO: 30118 - protein, 8 aa, Dengue virus
GSPCRIPF

SEQ ID NO: 30119 - protein, 8 aa, Dengue virus
SPCKVPFE

SEQ ID NO: 30120 - protein, 8 aa, Dengue virus
PCKVPFEI

SEQ ID NO: 30121 - protein, 8 aa, Dengue virus
CRIPFEIM

SEQ ID NO: 30122 - protein, 8 aa, Dengue virus
RIPFEIMD

SEQ ID NO: 30123 - protein, 8 aa, Dengue virus
VPFEIMDL

SEQ ID NO: 30124 - protein, 8 aa, Dengue virus
FEIMDLER

SEQ ID NO: 30125 - protein, 8 aa, Dengue virus
EIMDLEKK

SEQ ID NO: 30126 - protein, 8 aa, Dengue virus
ITDLEKRH

SEQ ID NO: 30127 - protein, 8 aa, Dengue virus
DLEKKHVL

SEQ ID NO: 30128 - protein, 8 aa, Dengue virus
LEKKHVLG

SEQ ID NO: 30129 - protein, 8 aa, Dengue virus
EKKHVLGR

SEQ ID NO: 30130 - protein, 8 aa, Dengue virus
KKHVLGRL

SEQ ID NO: 30131 - protein, 8 aa, Dengue virus
KHVLGRLI

SEQ ID NO: 30132 - protein, 8 aa, Dengue virus
YILGRLIT

SEQ ID NO: 30133 - protein, 8 aa, Dengue virus
LITVNPIA

SEQ ID NO: 30134 - protein, 8 aa, Dengue virus
ITVNPIVA

SEQ ID NO: 30135 - protein, 8 aa, Dengue virus
GKDSPVNI

SEQ ID NO: 30136 - protein, 8 aa, Dengue virus
KDNPINIE

SEQ ID NO: 30137 - protein, 8 aa, Dengue virus
DNPINIEA

SEQ ID NO: 30138 - protein, 8 aa, Dengue virus
NPINIEAE

SEQ ID NO: 30139 - protein, 8 aa, Dengue virus
FGDSYIVI

SEQ ID NO: 30140 - protein, 8 aa, Dengue virus
GDSYIVIG

SEQ ID NO: 30141 - protein, 8 aa, Dengue virus
DSYIVIGV

SEQ ID NO: 30142 - protein, 8 aa, Dengue virus
SYIVIGVE

SEQ ID NO: 30143 - protein, 8 aa, Dengue virus
YIVIGVEP

SEQ ID NO: 30144 - protein, 8 aa, Dengue virus
IVIGVEPG

SEQ ID NO: 30145 - protein, 8 aa, Dengue virus
VIGVEPGQ

SEQ ID NO: 30146 - protein, 8 aa, Dengue virus
EPGQLKLD

SEQ ID NO: 30147 - protein, 8 aa, Dengue virus
PGQLKLDW

SEQ ID NO: 30148 - protein, 8 aa, Dengue virus
GQLKLDWF

SEQ ID NO: 30149 - protein, 8 aa, Dengue virus
QLKLDWFK

SEQ ID NO: 30150 - protein, 8 aa, Dengue virus
LKLDWFKK

SEQ ID NO: 30151 - protein, 8 aa, Dengue virus
KLDWFKKG

SEQ ID NO: 30152 - protein, 8 aa, Dengue virus
LDWFKKGS

SEQ ID NO: 30153 - protein, 8 aa, Dengue virus
DWFKKGSS

SEQ ID NO: 30154 - protein, 8 aa, Dengue virus
GQMFATTM

SEQ ID NO: 30155 - protein, 8 aa, Dengue virus
QMFATTMR

SEQ ID NO: 30156 - protein, 8 aa, Dengue virus
DFGSLGGA

SEQ ID NO: 30157 - protein, 8 aa, Dengue virus
FGSLGGAF

SEQ ID NO: 30158 - protein, 8 aa, Dengue virus
GSLGGAFT

SEQ ID NO: 30159 - protein, 8 aa, Dengue virus
SLGGAFTS

SEQ ID NO: 30160 - protein, 8 aa, Dengue virus
LGGVFTSV

SEQ ID NO: 30161 - protein, 8 aa, Dengue virus
GGAFTSIG

SEQ ID NO: 30162 - protein, 8 aa, Dengue virus
GAFTSIGK

SEQ ID NO: 30163 - protein, 8 aa, Dengue virus
AFTSIGKA

SEQ ID NO: 30164 - protein, 8 aa, Dengue virus
SWTMKIFI

SEQ ID NO: 30165 - protein, 8 aa, Dengue virus
WTMKIFIG

SEQ ID NO: 30166 - protein, 8 aa, Dengue virus
IMKILIGV

SEQ ID NO: 30167 - protein, 8 aa, Dengue virus
MKILIGAI

SEQ ID NO: 30168 - protein, 8 aa, Dengue virus
KILIGAII

SEQ ID NO: 30169 - protein, 8 aa, Dengue virus
ILIGAIIT

SEQ ID NO: 30170 - protein, 8 aa, Dengue virus
LIGAIITW

SEQ ID NO: 30171 - protein, 8 aa, Dengue virus
IGAIITWI

SEQ ID NO: 30172 - protein, 8 aa, Dengue virus
GAIITWIG

SEQ ID NO: 30173 - protein, 8 aa, Dengue virus
AIITWIGM

SEQ ID NO: 30174 - protein, 8 aa, Dengue virus
VTLVLVGI

SEQ ID NO: 30175 - protein, 8 aa, Dengue virus
SLVLVGVI

SEQ ID NO: 30176 - protein, 8 aa, Dengue virus
LVLVGVIT

SEQ ID NO: 30177 - protein, 8 aa, Dengue virus
VLVGVITL

SEQ ID NO: 30178 - protein, 8 aa, Dengue virus
LVGVITLY

SEQ ID NO: 30179 - protein, 8 aa, Dengue virus
VGVITLYL

SEQ ID NO: 30180 - protein, 8 aa, Dengue virus
GVITLYLG

SEQ ID NO: 30181 - protein, 8 aa, Dengue virus
VVTLYLGV

SEQ ID NO: 30182 - protein, 8 aa, Dengue virus
VTLYLGAV

SEQ ID NO: 30183 - protein, 8 aa, Dengue virus
TLYLGAVV

SEQ ID NO: 30184 - protein, 8 aa, Dengue virus
LYLGAVVQ

SEQ ID NO: 30185 - protein, 8 aa, Dengue virus
YLGAVVQA

SEQ ID NO: 30186 - protein, 8 aa, Dengue virus
LGAVVQAD

SEQ ID NO: 30187 - protein, 8 aa, Dengue virus
GAVVQADS

SEQ ID NO: 30188 - protein, 8 aa, Dengue virus
AVVQADSG

SEQ ID NO: 30189 - protein, 8 aa, Dengue virus
MVQADTGC

SEQ ID NO: 30190 - protein, 8 aa, Dengue virus
VQADSGCI

SEQ ID NO: 30191 - protein, 8 aa, Dengue virus
QADSGCIV

SEQ ID NO: 30192 - protein, 8 aa, Dengue virus
ADSGCIVS

SEQ ID NO: 30193 - protein, 8 aa, Dengue virus
DSGCIVSW

SEQ ID NO: 30194 - protein, 8 aa, Dengue virus
SGCIVSWK

SEQ ID NO: 30195 - protein, 8 aa, Dengue virus
GCIVSWKN

SEQ ID NO: 30196 - protein, 8 aa, Dengue virus
CIVSWKNK

SEQ ID NO: 30197 - protein, 8 aa, Dengue virus
IVSWKNKE

SEQ ID NO: 30198 - protein, 8 aa, Dengue virus
AIQKAHED

SEQ ID NO: 30199 - protein, 8 aa, Dengue virus
IQKAHEED

SEQ ID NO: 30200 - protein, 8 aa, Dengue virus
QKAHEEDI

SEQ ID NO: 30201 - protein, 8 aa, Dengue virus
KAHEEDIC

SEQ ID NO: 30202 - protein, 8 aa, Dengue virus
AHEEDICG

SEQ ID NO: 30203 - protein, 8 aa, Dengue virus
HEEDICGI

SEQ ID NO: 30204 - protein, 8 aa, Dengue virus
LMWRQITP

SEQ ID NO: 30205 - protein, 8 aa, Dengue virus
MWRQITPE

SEQ ID NO: 30206 - protein, 8 aa, Dengue virus
WRQITPEL

SEQ ID NO: 30207 - protein, 8 aa, Dengue virus
RQITPELN

SEQ ID NO: 30208 - protein, 8 aa, Dengue virus
SELNHILS

SEQ ID NO: 30209 - protein, 8 aa, Dengue virus
HILSENEA

SEQ ID NO: 30210 - protein, 8 aa, Dengue virus
ILSENEAK

SEQ ID NO: 30211 - protein, 8 aa, Dengue virus
LSENEAKL

SEQ ID NO: 30212 - protein, 8 aa, Dengue virus
SENEAKLT

SEQ ID NO: 30213 - protein, 8 aa, Dengue virus
ENEVKMTI

SEQ ID NO: 30214 - protein, 8 aa, Dengue virus
NEVKMTIM

SEQ ID NO: 30215 - protein, 8 aa, Dengue virus
EVKMTIMT

SEQ ID NO: 30216 - protein, 8 aa, Dengue virus
VKMTIMTG

SEQ ID NO: 30217 - protein, 8 aa, Dengue virus
KMTIMTGD

SEQ ID NO: 30218 - protein, 8 aa, Dengue virus
LTIMTGEI

SEQ ID NO: 30219 - protein, 8 aa, Dengue virus
TIMTGDTK

SEQ ID NO: 30220 - protein, 8 aa, Dengue virus
IMTGDTKG

SEQ ID NO: 30221 - protein, 8 aa, Dengue virus
MTGDTKGI

SEQ ID NO: 30222 - protein, 8 aa, Dengue virus
TGDTKGIM

SEQ ID NO: 30223 - protein, 8 aa, Dengue virus
GDTKGIMQ

SEQ ID NO: 30224 - protein, 8 aa, Dengue virus
TKGIMQAG

SEQ ID NO: 30225 - protein, 8 aa, Dengue virus
KGIMQVGK

SEQ ID NO: 30226 - protein, 8 aa, Dengue virus
GIMQAGRR

SEQ ID NO: 30227 - protein, 8 aa, Dengue virus
IMQAGRRS

SEQ ID NO: 30228 - protein, 8 aa, Dengue virus
MQAGRRSL

SEQ ID NO: 30229 - protein, 8 aa, Dengue virus
GKRSLQPQ

SEQ ID NO: 30230 - protein, 8 aa, Dengue virus
KRSLQPQP

SEQ ID NO: 30231 - protein, 8 aa, Dengue virus
RSLQPQPT

SEQ ID NO: 30232 - protein, 8 aa, Dengue virus
SLQPQPTE

SEQ ID NO: 30233 - protein, 8 aa, Dengue virus
LQPQPTEL

SEQ ID NO: 30234 - protein, 8 aa, Dengue virus
KPQPTELR

SEQ ID NO: 30235 - protein, 8 aa, Dengue virus
ELRYSWKT

SEQ ID NO: 30236 - protein, 8 aa, Dengue virus
LRYSWKTW

SEQ ID NO: 30237 - protein, 8 aa, Dengue virus
RYSWKTWG

SEQ ID NO: 30238 - protein, 8 aa, Dengue virus
KTWGKAKV

SEQ ID NO: 30239 - protein, 8 aa, Dengue virus
TWGKAKVL

SEQ ID NO: 30240 - protein, 8 aa, Dengue virus
WGKAKMLP

SEQ ID NO: 30241 - protein, 8 aa, Dengue virus
GKAKMLPT

SEQ ID NO: 30242 - protein, 8 aa, Dengue virus
KAKMLPTE

SEQ ID NO: 30243 - protein, 8 aa, Dengue virus
HNHTFLID

SEQ ID NO: 30244 - protein, 8 aa, Dengue virus
NRTFLIDG

SEQ ID NO: 30245 - protein, 8 aa, Dengue virus
RTFLIDGP

SEQ ID NO: 30246 - protein, 8 aa, Dengue virus
LIDGPETV

SEQ ID NO: 30247 - protein, 8 aa, Dengue virus
IDGPETVE

SEQ ID NO: 30248 - protein, 8 aa, Dengue virus
DGPETVEC

SEQ ID NO: 30249 - protein, 8 aa, Dengue virus
GPETVECP

SEQ ID NO: 30250 - protein, 8 aa, Dengue virus
PETVECPN

SEQ ID NO: 30251 - protein, 8 aa, Dengue virus
ETTECPNS

SEQ ID NO: 30252 - protein, 8 aa, Dengue virus
TTECPNSN

SEQ ID NO: 30253 - protein, 8 aa, Dengue virus
TECPNSNR

SEQ ID NO: 30254 - protein, 8 aa, Dengue virus
DYGFGIFT

SEQ ID NO: 30255 - protein, 8 aa, Dengue virus
YGFGIFTT

SEQ ID NO: 30256 - protein, 8 aa, Dengue virus
GFGIFTTN

SEQ ID NO: 30257 - protein, 8 aa, Dengue virus
FGIFTTNI

SEQ ID NO: 30258 - protein, 8 aa, Dengue virus
GIFTTNIW

SEQ ID NO: 30259 - protein, 8 aa, Dengue virus
IFTTNIWL

SEQ ID NO: 30260 - protein, 8 aa, Dengue virus
FTTNIWLR

SEQ ID NO: 30261 - protein, 8 aa, Dengue virus
TTNIWLRL

SEQ ID NO: 30262 - protein, 8 aa, Dengue virus
TNIWLRLR

SEQ ID NO: 30263 - protein, 8 aa, Dengue virus
NIWLRLRE

SEQ ID NO: 30264 - protein, 8 aa, Dengue virus
IWLKLKER

SEQ ID NO: 30265 - protein, 8 aa, Dengue virus
WLKLKERQ

SEQ ID NO: 30266 - protein, 8 aa, Dengue virus
LKLKERQD

SEQ ID NO: 30267 - protein, 8 aa, Dengue virus
VCDSKLMS

SEQ ID NO: 30268 - protein, 8 aa, Dengue virus
MSAAVKDN

SEQ ID NO: 30269 - protein, 8 aa, Dengue virus
SAAVKDNR

SEQ ID NO: 30270 - protein, 8 aa, Dengue virus
AAVKDNRA

SEQ ID NO: 30271 - protein, 8 aa, Dengue virus
AVKDNRAV

SEQ ID NO: 30272 - protein, 8 aa, Dengue virus
VKDNRAVH

SEQ ID NO: 30273 - protein, 8 aa, Dengue virus
KNNRAVHA

SEQ ID NO: 30274 - protein, 8 aa, Dengue virus
NNRAVHAD

SEQ ID NO: 30275 - protein, 8 aa, Dengue virus
MGYWMESA

SEQ ID NO: 30276 - protein, 8 aa, Dengue virus
GYWMESAL

SEQ ID NO: 30277 - protein, 8 aa, Dengue virus
YWMESALN

SEQ ID NO: 30278 - protein, 8 aa, Dengue virus
WMESALND

SEQ ID NO: 30279 - protein, 8 aa, Dengue virus
MESALNDT

SEQ ID NO: 30280 - protein, 8 aa, Dengue virus
RLNDTWKM

SEQ ID NO: 30281 - protein, 8 aa, Dengue virus
ASFIEIKS

SEQ ID NO: 30282 - protein, 8 aa, Dengue virus
SFIEIKSC

SEQ ID NO: 30283 - protein, 8 aa, Dengue virus
FIEIKSCH

SEQ ID NO: 30284 - protein, 8 aa, Dengue virus
IEIKSCHW

SEQ ID NO: 30285 - protein, 8 aa, Dengue virus
EIKSCHWP

SEQ ID NO: 30286 - protein, 8 aa, Dengue virus
IKSCHWPK

SEQ ID NO: 30287 - protein, 8 aa, Dengue virus
KSCYWPRS

SEQ ID NO: 30288 - protein, 8 aa, Dengue virus
SCYWPRSH

SEQ ID NO: 30289 - protein, 8 aa, Dengue virus
CHWPRSHT

SEQ ID NO: 30290 - protein, 8 aa, Dengue virus
HWPRSHTL

SEQ ID NO: 30291 - protein, 8 aa, Dengue virus
SEMVIPKN

SEQ ID NO: 30292 - protein, 8 aa, Dengue virus
IPKSFAGP

SEQ ID NO: 30293 - protein, 8 aa, Dengue virus
PKSFAGPV

SEQ ID NO: 30294 - protein, 8 aa, Dengue virus
KSFAGPVS

SEQ ID NO: 30295 - protein, 8 aa, Dengue virus
SFAGPVSQ

SEQ ID NO: 30296 - protein, 8 aa, Dengue virus
VSQHNHRP

SEQ ID NO: 30297 - protein, 8 aa, Dengue virus
SQHNHRPG

SEQ ID NO: 30298 - protein, 8 aa, Dengue virus
QHNHRPGY

SEQ ID NO: 30299 - protein, 8 aa, Dengue virus
HNNRPGYH

SEQ ID NO: 30300 - protein, 8 aa, Dengue virus
NNRPGYHT

SEQ ID NO: 30301 - protein, 8 aa, Dengue virus
NRPGYHTQ

SEQ ID NO: 30302 - protein, 8 aa, Dengue virus
RPGYYTQT

SEQ ID NO: 30303 - protein, 8 aa, Dengue virus
PGYYTQTA

SEQ ID NO: 30304 - protein, 8 aa, Dengue virus
GYYTQTAG

SEQ ID NO: 30305 - protein, 8 aa, Dengue virus
YYTQTAGP

SEQ ID NO: 30306 - protein, 8 aa, Dengue virus
YTQTAGPW

SEQ ID NO: 30307 - protein, 8 aa, Dengue virus
TQITGPWH

SEQ ID NO: 30308 - protein, 8 aa, Dengue virus
QITGPWHL

SEQ ID NO: 30309 - protein, 8 aa, Dengue virus
ITGPWHLG

SEQ ID NO: 30310 - protein, 8 aa, Dengue virus
TGPWHLGK

SEQ ID NO: 30311 - protein, 8 aa, Dengue virus
GKLEMDFE

SEQ ID NO: 30312 - protein, 8 aa, Dengue virus
RLEMDFDF

SEQ ID NO: 30313 - protein, 8 aa, Dengue virus
LEMDFEFC

SEQ ID NO: 30314 - protein, 8 aa, Dengue virus
EMDFDLCE

SEQ ID NO: 30315 - protein, 8 aa, Dengue virus
MDFDLCEG

SEQ ID NO: 30316 - protein, 8 aa, Dengue virus
DFDLCEGT

SEQ ID NO: 30317 - protein, 8 aa, Dengue virus
FDLCEGTT

SEQ ID NO: 30318 - protein, 8 aa, Dengue virus
DLCEGTTV

SEQ ID NO: 30319 - protein, 8 aa, Dengue virus
LCEGTTVV

SEQ ID NO: 30320 - protein, 8 aa, Dengue virus
CDGTTVVV

SEQ ID NO: 30321 - protein, 8 aa, Dengue virus
DGTTVVVT

SEQ ID NO: 30322 - protein, 8 aa, Dengue virus
TTVVVTEE

SEQ ID NO: 30323 - protein, 8 aa, Dengue virus
TVVVTEEC

SEQ ID NO: 30324 - protein, 8 aa, Dengue virus
VVVTEECG

SEQ ID NO: 30325 - protein, 8 aa, Dengue virus
VVTEECGN

SEQ ID NO: 30326 - protein, 8 aa, Dengue virus
VTENCGNR

SEQ ID NO: 30327 - protein, 8 aa, Dengue virus
TENCGNRG

SEQ ID NO: 30328 - protein, 8 aa, Dengue virus
ENCGNRGP

SEQ ID NO: 30329 - protein, 8 aa, Dengue virus
EREENLVN

SEQ ID NO: 30330 - protein, 8 aa, Dengue virus
REENLVNS

SEQ ID NO: 30331 - protein, 8 aa, Dengue virus
NSLVTAGQ

SEQ ID NO: 30332 - protein, 8 aa, Dengue virus
VTAGQGQV

SEQ ID NO: 30333 - protein, 8 aa, Dengue virus
TAGQGQVD

SEQ ID NO: 30334 - protein, 8 aa, Dengue virus
AGQGQVDN

SEQ ID NO: 30335 - protein, 8 aa, Dengue virus
GQGQVDNF

SEQ ID NO: 30336 - protein, 8 aa, Dengue virus
QGQVDNFS

SEQ ID NO: 30337 - protein, 8 aa, Dengue virus
IDNFSLGI

SEQ ID NO: 30338 - protein, 8 aa, Dengue virus
GILGMALL

SEQ ID NO: 30339 - protein, 8 aa, Dengue virus
ILGMALLL

SEQ ID NO: 30340 - protein, 8 aa, Dengue virus
MLKTRVGT

SEQ ID NO: 30341 - protein, 8 aa, Dengue virus
LKTRVGTK

SEQ ID NO: 30342 - protein, 8 aa, Dengue virus
KTRVGTKH

SEQ ID NO: 30343 - protein, 8 aa, Dengue virus
TRMGTKHA

SEQ ID NO: 30344 - protein, 8 aa, Dengue virus
SLVTLITG

SEQ ID NO: 30345 - protein, 8 aa, Dengue virus
LVTLITGN

SEQ ID NO: 30346 - protein, 8 aa, Dengue virus
VTLITGNL

SEQ ID NO: 30347 - protein, 8 aa, Dengue virus
FKDLGRVI

SEQ ID NO: 30348 - protein, 8 aa, Dengue virus
KDLGRVII

SEQ ID NO: 30349 - protein, 8 aa, Dengue virus
DLGRVIIM

SEQ ID NO: 30350 - protein, 8 aa, Dengue virus
LGRVIIMV

SEQ ID NO: 30351 - protein, 8 aa, Dengue virus
GRVIIMVG

SEQ ID NO: 30352 - protein, 8 aa, Dengue virus
RVIIMVGA

SEQ ID NO: 30353 - protein, 8 aa, Dengue virus
MTDEMGMG

SEQ ID NO: 30354 - protein, 8 aa, Dengue virus
TDEMGMGV

SEQ ID NO: 30355 - protein, 8 aa, Dengue virus
DDIGMGIT

SEQ ID NO: 30356 - protein, 8 aa, Dengue virus
DIGMGITY

SEQ ID NO: 30357 - protein, 8 aa, Dengue virus
IGMGITYL

SEQ ID NO: 30358 - protein, 8 aa, Dengue virus
GIGVTYLA

SEQ ID NO: 30359 - protein, 8 aa, Dengue virus
IGVTYLAL

SEQ ID NO: 30360 - protein, 8 aa, Dengue virus
YKVRPTFA

SEQ ID NO: 30361 - protein, 8 aa, Dengue virus
RVRPTFAA

SEQ ID NO: 30362 - protein, 8 aa, Dengue virus
PTFAAGLF

SEQ ID NO: 30363 - protein, 8 aa, Dengue virus
TFAAGLFL

SEQ ID NO: 30364 - protein, 8 aa, Dengue virus
FAAGLFLR

SEQ ID NO: 30365 - protein, 8 aa, Dengue virus
AAGLFLRK

SEQ ID NO: 30366 - protein, 8 aa, Dengue virus
AGLFLRKL

SEQ ID NO: 30367 - protein, 8 aa, Dengue virus
TSKELLMA

SEQ ID NO: 30368 - protein, 8 aa, Dengue virus
SKELLMAT

SEQ ID NO: 30369 - protein, 8 aa, Dengue virus
KELLMATI

SEQ ID NO: 30370 - protein, 8 aa, Dengue virus
ELLMATIG

SEQ ID NO: 30371 - protein, 8 aa, Dengue virus
LLMATIGV

SEQ ID NO: 30372 - protein, 8 aa, Dengue virus
TIGITLLS

SEQ ID NO: 30373 - protein, 8 aa, Dengue virus
IGITLLSQ

SEQ ID NO: 30374 - protein, 8 aa, Dengue virus
GITLLSQS

SEQ ID NO: 30375 - protein, 8 aa, Dengue virus
PGTVLELT

SEQ ID NO: 30376 - protein, 8 aa, Dengue virus
GTVLELTD

SEQ ID NO: 30377 - protein, 8 aa, Dengue virus
SILELTDA

SEQ ID NO: 30378 - protein, 8 aa, Dengue virus
VLELTDAI

SEQ ID NO: 30379 - protein, 8 aa, Dengue virus
AIALGIMV

SEQ ID NO: 30380 - protein, 8 aa, Dengue virus
IALGIMVL

SEQ ID NO: 30381 - protein, 8 aa, Dengue virus
ALGIMVLK

SEQ ID NO: 30382 - protein, 8 aa, Dengue virus
VRKMEKYQ

SEQ ID NO: 30383 - protein, 8 aa, Dengue virus
RKMEKYQL

SEQ ID NO: 30384 - protein, 8 aa, Dengue virus
KMEKYQLA

SEQ ID NO: 30385 - protein, 8 aa, Dengue virus
QLAVTIMT

SEQ ID NO: 30386 - protein, 8 aa, Dengue virus
MAMLCIPN

SEQ ID NO: 30387 - protein, 8 aa, Dengue virus
AMLCIPNV

SEQ ID NO: 30388 - protein, 8 aa, Dengue virus
MLCIPNVM

SEQ ID NO: 30389 - protein, 8 aa, Dengue virus
LCIPNVMI

SEQ ID NO: 30390 - protein, 8 aa, Dengue virus
CVPNAVVL

SEQ ID NO: 30391 - protein, 8 aa, Dengue virus
IPNVMILQ

SEQ ID NO: 30392 - protein, 8 aa, Dengue virus
PNVMILQH

SEQ ID NO: 30393 - protein, 8 aa, Dengue virus
NVMILQHA

SEQ ID NO: 30394 - protein, 8 aa, Dengue virus
VMILQHAW

SEQ ID NO: 30395 - protein, 8 aa, Dengue virus
ILQHAWKV

SEQ ID NO: 30396 - protein, 8 aa, Dengue virus
LNAWKVSC

SEQ ID NO: 30397 - protein, 8 aa, Dengue virus
NAWKVGCT

SEQ ID NO: 30398 - protein, 8 aa, Dengue virus
AWKVGCTI

SEQ ID NO: 30399 - protein, 8 aa, Dengue virus
WKVGCTIL

SEQ ID NO: 30400 - protein, 8 aa, Dengue virus
KVGCTILA

SEQ ID NO: 30401 - protein, 8 aa, Dengue virus
CTTLAVVS

SEQ ID NO: 30402 - protein, 8 aa, Dengue virus
TTLAVVSV

SEQ ID NO: 30403 - protein, 8 aa, Dengue virus
TLAVVSVS

SEQ ID NO: 30404 - protein, 8 aa, Dengue virus
LATVSVSP

SEQ ID NO: 30405 - protein, 8 aa, Dengue virus
ATVSVSPL

SEQ ID NO: 30406 - protein, 8 aa, Dengue virus
VSVSPLIL

SEQ ID NO: 30407 - protein, 8 aa, Dengue virus
SVSPLILT

SEQ ID NO: 30408 - protein, 8 aa, Dengue virus
VSPLILTS

SEQ ID NO: 30409 - protein, 8 aa, Dengue virus
SPLILTSS

SEQ ID NO: 30410 - protein, 8 aa, Dengue virus
PLILTSSQ

SEQ ID NO: 30411 - protein, 8 aa, Dengue virus
LILTSSQQ

SEQ ID NO: 30412 - protein, 8 aa, Dengue virus
ILTSSQQK

SEQ ID NO: 30413 - protein, 8 aa, Dengue virus
LTSSRQKT

SEQ ID NO: 30414 - protein, 8 aa, Dengue virus
TSSRQKTD

SEQ ID NO: 30415 - protein, 8 aa, Dengue virus
SSRQKTDW

SEQ ID NO: 30416 - protein, 8 aa, Dengue virus
SRQKTDWI

SEQ ID NO: 30417 - protein, 8 aa, Dengue virus
RQKTDWIP

SEQ ID NO: 30418 - protein, 8 aa, Dengue virus
KTDWIPLV

SEQ ID NO: 30419 - protein, 8 aa, Dengue virus
TDWIPLVL

SEQ ID NO: 30420 - protein, 8 aa, Dengue virus
ALTVKGLN

SEQ ID NO: 30421 - protein, 8 aa, Dengue virus
FLTTLTRT

SEQ ID NO: 30422 - protein, 8 aa, Dengue virus
LTTLSRPN

SEQ ID NO: 30423 - protein, 8 aa, Dengue virus
TTLSRPNK

SEQ ID NO: 30424 - protein, 8 aa, Dengue virus
TLSRPNKT

SEQ ID NO: 30425 - protein, 8 aa, Dengue virus
LSRPNKTR

SEQ ID NO: 30426 - protein, 8 aa, Dengue virus
SRPNKTRS

SEQ ID NO: 30427 - protein, 8 aa, Dengue virus
RPNKTRSW

SEQ ID NO: 30428 - protein, 8 aa, Dengue virus
PNKTRSWP

SEQ ID NO: 30429 - protein, 8 aa, Dengue virus
NKTRSWPL

SEQ ID NO: 30430 - protein, 8 aa, Dengue virus
DLELEKAA

SEQ ID NO: 30431 - protein, 8 aa, Dengue virus
LELEKAAE

SEQ ID NO: 30432 - protein, 8 aa, Dengue virus
ELEKAAEV

SEQ ID NO: 30433 - protein, 8 aa, Dengue virus
VKWDDQAE

SEQ ID NO: 30434 - protein, 8 aa, Dengue virus
KWDDQAEI

SEQ ID NO: 30435 - protein, 8 aa, Dengue virus
WDDQAEIS

SEQ ID NO: 30436 - protein, 8 aa, Dengue virus
DDQAEISG

SEQ ID NO: 30437 - protein, 8 aa, Dengue virus
PILSVTIS

SEQ ID NO: 30438 - protein, 8 aa, Dengue virus
ILSVTISE

SEQ ID NO: 30439 - protein, 8 aa, Dengue virus
LSVTISED

SEQ ID NO: 30440 - protein, 8 aa, Dengue virus
SVTISEDG

SEQ ID NO: 30441 - protein, 8 aa, Dengue virus
VTISEDGS

SEQ ID NO: 30442 - protein, 8 aa, Dengue virus
KNEEEEQI

SEQ ID NO: 30443 - protein, 8 aa, Dengue virus
NEEEEQIL

SEQ ID NO: 30444 - protein, 8 aa, Dengue virus
EEEEQILT

SEQ ID NO: 30445 - protein, 8 aa, Dengue virus
EEEQILTI

SEQ ID NO: 30446 - protein, 8 aa, Dengue virus
EEQILTIL

SEQ ID NO: 30447 - protein, 8 aa, Dengue virus
EQILTILI

SEQ ID NO: 30448 - protein, 8 aa, Dengue virus
QILTILIR

SEQ ID NO: 30449 - protein, 8 aa, Dengue virus
VISGLFPI

SEQ ID NO: 30450 - protein, 8 aa, Dengue virus
ISGLFPIS

SEQ ID NO: 30451 - protein, 8 aa, Dengue virus
SGLFPISI

SEQ ID NO: 30452 - protein, 8 aa, Dengue virus
GLFPISIP

SEQ ID NO: 30453 - protein, 8 aa, Dengue virus
LFPISIPI

SEQ ID NO: 30454 - protein, 8 aa, Dengue virus
FPVSMPIT

SEQ ID NO: 30455 - protein, 8 aa, Dengue virus
PVSMPITA

SEQ ID NO: 30456 - protein, 8 aa, Dengue virus
VSMPITAA

SEQ ID NO: 30457 - protein, 8 aa, Dengue virus
DVPSPPPI

SEQ ID NO: 30458 - protein, 8 aa, Dengue virus
VPSPPPVE

SEQ ID NO: 30459 - protein, 8 aa, Dengue virus
GRAELEDG

SEQ ID NO: 30460 - protein, 8 aa, Dengue virus
RIKQRGIF

SEQ ID NO: 30461 - protein, 8 aa, Dengue virus
IKQRGIFG

SEQ ID NO: 30462 - protein, 8 aa, Dengue virus
KQRGIFGY

SEQ ID NO: 30463 - protein, 8 aa, Dengue virus
QRGIFGYS

SEQ ID NO: 30464 - protein, 8 aa, Dengue virus
RGIFGYSQ

SEQ ID NO: 30465 - protein, 8 aa, Dengue virus
RILGYSQI

SEQ ID NO: 30466 - protein, 8 aa, Dengue virus
VTRGAVLT

SEQ ID NO: 30467 - protein, 8 aa, Dengue virus
TRGAVLTH

SEQ ID NO: 30468 - protein, 8 aa, Dengue virus
RGAVLVHK

SEQ ID NO: 30469 - protein, 8 aa, Dengue virus
GAVLVHKG

SEQ ID NO: 30470 - protein, 8 aa, Dengue virus
AVLVHKGK

SEQ ID NO: 30471 - protein, 8 aa, Dengue virus
VLVHKGKR

SEQ ID NO: 30472 - protein, 8 aa, Dengue virus
LVHKGKRI

SEQ ID NO: 30473 - protein, 8 aa, Dengue virus
VHKGKRIE

SEQ ID NO: 30474 - protein, 8 aa, Dengue virus
ADVRKDLI

SEQ ID NO: 30475 - protein, 8 aa, Dengue virus
DVKKDLVS

SEQ ID NO: 30476 - protein, 8 aa, Dengue virus
VRKDLISY

SEQ ID NO: 30477 - protein, 8 aa, Dengue virus
KKDLVSYG

SEQ ID NO: 30478 - protein, 8 aa, Dengue virus
QTKPGLFR

SEQ ID NO: 30479 - protein, 8 aa, Dengue virus
TKPGLFRT

SEQ ID NO: 30480 - protein, 8 aa, Dengue virus
KPGLFRTN

SEQ ID NO: 30481 - protein, 8 aa, Dengue virus
FRTNTGTI

SEQ ID NO: 30482 - protein, 8 aa, Dengue virus
RTNTGTIG

SEQ ID NO: 30483 - protein, 8 aa, Dengue virus
TSTGTIGA

SEQ ID NO: 30484 - protein, 8 aa, Dengue virus
STGTIGAV

SEQ ID NO: 30485 - protein, 8 aa, Dengue virus
SGSPIVDK

SEQ ID NO: 30486 - protein, 8 aa, Dengue virus
GSPIVDKK

SEQ ID NO: 30487 - protein, 8 aa, Dengue virus
SPIVDKKG

SEQ ID NO: 30488 - protein, 8 aa, Dengue virus
PIVDKKGK

SEQ ID NO: 30489 - protein, 8 aa, Dengue virus
IVDKKGKV

SEQ ID NO: 30490 - protein, 8 aa, Dengue virus
VDKKGKVV

SEQ ID NO: 30491 - protein, 8 aa, Dengue virus
RSGTYVSS

SEQ ID NO: 30492 - protein, 8 aa, Dengue virus
SGTYVSSI

SEQ ID NO: 30493 - protein, 8 aa, Dengue virus
GTYVSSIA

SEQ ID NO: 30494 - protein, 8 aa, Dengue virus
TYVSSIAQ

SEQ ID NO: 30495 - protein, 8 aa, Dengue virus
AIAQTEKN

SEQ ID NO: 30496 - protein, 8 aa, Dengue virus
IAQTEKNI

SEQ ID NO: 30497 - protein, 8 aa, Dengue virus
AQTEKNIE

SEQ ID NO: 30498 - protein, 8 aa, Dengue virus
VEDNPEIE

SEQ ID NO: 30499 - protein, 8 aa, Dengue virus
ENNPEIED

SEQ ID NO: 30500 - protein, 8 aa, Dengue virus
NNPEIEDD

SEQ ID NO: 30501 - protein, 8 aa, Dengue virus
NPEIEDHI

SEQ ID NO: 30502 - protein, 8 aa, Dengue virus
PEIEDHIF

SEQ ID NO: 30503 - protein, 8 aa, Dengue virus
EIEDHIFR

SEQ ID NO: 30504 - protein, 8 aa, Dengue virus
EDHIFRKR

SEQ ID NO: 30505 - protein, 8 aa, Dengue virus
DDIFRKRK

SEQ ID NO: 30506 - protein, 8 aa, Dengue virus
DIFRKRKL

SEQ ID NO: 30507 - protein, 8 aa, Dengue virus
IFRKRKLT

SEQ ID NO: 30508 - protein, 8 aa, Dengue virus
FRKRKLTI

SEQ ID NO: 30509 - protein, 8 aa, Dengue virus
RKRKLTIM

SEQ ID NO: 30510 - protein, 8 aa, Dengue virus
KRKLTIMD

SEQ ID NO: 30511 - protein, 8 aa, Dengue virus
RKLTIMDL

SEQ ID NO: 30512 - protein, 8 aa, Dengue virus
RYQTTAIK

SEQ ID NO: 30513 - protein, 8 aa, Dengue virus
YQTPAIKA

SEQ ID NO: 30514 - protein, 8 aa, Dengue virus
QTPAIKAE

SEQ ID NO: 30515 - protein, 8 aa, Dengue virus
TPAIKAEH

SEQ ID NO: 30516 - protein, 8 aa, Dengue virus
PAIKAEHT

SEQ ID NO: 30517 - protein, 8 aa, Dengue virus
AIKAEHTG

SEQ ID NO: 30518 - protein, 8 aa, Dengue virus
IKAEHTGR

SEQ ID NO: 30519 - protein, 8 aa, Dengue virus
KAEHTGRE

SEQ ID NO: 30520 - protein, 8 aa, Dengue virus
PQSNAPIV

SEQ ID NO: 30521 - protein, 8 aa, Dengue virus
QSNAPIVD

SEQ ID NO: 30522 - protein, 8 aa, Dengue virus
SNAPIVDE

SEQ ID NO: 30523 - protein, 8 aa, Dengue virus
NAPIVDEE

SEQ ID NO: 30524 - protein, 8 aa, Dengue virus
APIVDEER

SEQ ID NO: 30525 - protein, 8 aa, Dengue virus
PIVDEERE

SEQ ID NO: 30526 - protein, 8 aa, Dengue virus
IVDEEREI

SEQ ID NO: 30527 - protein, 8 aa, Dengue virus
VDEEREIP

SEQ ID NO: 30528 - protein, 8 aa, Dengue virus
IPERSWNT

SEQ ID NO: 30529 - protein, 8 aa, Dengue virus
PERSWNTG

SEQ ID NO: 30530 - protein, 8 aa, Dengue virus
ERSWNTGH

SEQ ID NO: 30531 - protein, 8 aa, Dengue virus
RSWNTGHE

SEQ ID NO: 30532 - protein, 8 aa, Dengue virus
SWNTGHEW

SEQ ID NO: 30533 - protein, 8 aa, Dengue virus
WSSGHEWV

SEQ ID NO: 30534 - protein, 8 aa, Dengue virus
SSGHEWVT

SEQ ID NO: 30535 - protein, 8 aa, Dengue virus
TGHEWVTD

SEQ ID NO: 30536 - protein, 8 aa, Dengue virus
YEWVTDFK

SEQ ID NO: 30537 - protein, 8 aa, Dengue virus
EWITNFEG

SEQ ID NO: 30538 - protein, 8 aa, Dengue virus
WITDFKGK

SEQ ID NO: 30539 - protein, 8 aa, Dengue virus
ITNFEGKT

SEQ ID NO: 30540 - protein, 8 aa, Dengue virus
WFVPSIRA

SEQ ID NO: 30541 - protein, 8 aa, Dengue virus
FVPSIRAG

SEQ ID NO: 30542 - protein, 8 aa, Dengue virus
VPSIRAGN

SEQ ID NO: 30543 - protein, 8 aa, Dengue virus
PSIRAGND

SEQ ID NO: 30544 - protein, 8 aa, Dengue virus
SIRAGNDI

SEQ ID NO: 30545 - protein, 8 aa, Dengue virus
IRAGNDIA

SEQ ID NO: 30546 - protein, 8 aa, Dengue virus
RAGNDIAA

SEQ ID NO: 30547 - protein, 8 aa, Dengue virus
KTFDSEYA

SEQ ID NO: 30548 - protein, 8 aa, Dengue virus
TFDSEYAK

SEQ ID NO: 30549 - protein, 8 aa, Dengue virus
FDTEYTKT

SEQ ID NO: 30550 - protein, 8 aa, Dengue virus
DSEYAKTR

SEQ ID NO: 30551 - protein, 8 aa, Dengue virus
KTRSNDWD

SEQ ID NO: 30552 - protein, 8 aa, Dengue virus
TRSNDWDF

SEQ ID NO: 30553 - protein, 8 aa, Dengue virus
RSNDWDFV

SEQ ID NO: 30554 - protein, 8 aa, Dengue virus
SNDWDFVV

SEQ ID NO: 30555 - protein, 8 aa, Dengue virus
ADGEERVI

SEQ ID NO: 30556 - protein, 8 aa, Dengue virus
GRIGRNPR

SEQ ID NO: 30557 - protein, 8 aa, Dengue virus
RIGRNPRN

SEQ ID NO: 30558 - protein, 8 aa, Dengue virus
IGRNPRNE

SEQ ID NO: 30559 - protein, 8 aa, Dengue virus
LPVWLAFK

SEQ ID NO: 30560 - protein, 8 aa, Dengue virus
PVWLAFKV

SEQ ID NO: 30561 - protein, 8 aa, Dengue virus
VWLAFKVA

SEQ ID NO: 30562 - protein, 8 aa, Dengue virus
WLAYKVAS

SEQ ID NO: 30563 - protein, 8 aa, Dengue virus
LAYKVASE

SEQ ID NO: 30564 - protein, 8 aa, Dengue virus
AYKVASEG

SEQ ID NO: 30565 - protein, 8 aa, Dengue virus
YKVASEGI

SEQ ID NO: 30566 - protein, 8 aa, Dengue virus
KVASEGIN

SEQ ID NO: 30567 - protein, 8 aa, Dengue virus
VASEGISY

SEQ ID NO: 30568 - protein, 8 aa, Dengue virus
AAEGINYT

SEQ ID NO: 30569 - protein, 8 aa, Dengue virus
AEGINYTD

SEQ ID NO: 30570 - protein, 8 aa, Dengue virus
EGISYADR

SEQ ID NO: 30571 - protein, 8 aa, Dengue virus
GINYTDRK

SEQ ID NO: 30572 - protein, 8 aa, Dengue virus
INYTDRKW

SEQ ID NO: 30573 - protein, 8 aa, Dengue virus
NYTDRKWC

SEQ ID NO: 30574 - protein, 8 aa, Dengue virus
YTDRKWCF

SEQ ID NO: 30575 - protein, 8 aa, Dengue virus
TDRKWCFD

SEQ ID NO: 30576 - protein, 8 aa, Dengue virus
RRWCFDGV

SEQ ID NO: 30577 - protein, 8 aa, Dengue virus
RWCFDGVK

SEQ ID NO: 30578 - protein, 8 aa, Dengue virus
WCFDGIRN

SEQ ID NO: 30579 - protein, 8 aa, Dengue virus
CFDGIRNN

SEQ ID NO: 30580 - protein, 8 aa, Dengue virus
FDGIRNNQ

SEQ ID NO: 30581 - protein, 8 aa, Dengue virus
DGIRNNQI

SEQ ID NO: 30582 - protein, 8 aa, Dengue virus
GIRNNQIL

SEQ ID NO: 30583 - protein, 8 aa, Dengue virus
IRNNQILE

SEQ ID NO: 30584 - protein, 8 aa, Dengue virus
EENMEVEV

SEQ ID NO: 30585 - protein, 8 aa, Dengue virus
ENMEVEVW

SEQ ID NO: 30586 - protein, 8 aa, Dengue virus
NMEVEVWT

SEQ ID NO: 30587 - protein, 8 aa, Dengue virus
MEVEVWTK

SEQ ID NO: 30588 - protein, 8 aa, Dengue virus
GRKSLTLS

SEQ ID NO: 30589 - protein, 8 aa, Dengue virus
RKSLTLSL

SEQ ID NO: 30590 - protein, 8 aa, Dengue virus
KSLTLSLI

SEQ ID NO: 30591 - protein, 8 aa, Dengue virus
SLTLSLIT

SEQ ID NO: 30592 - protein, 8 aa, Dengue virus
LTLSLITE

SEQ ID NO: 30593 - protein, 8 aa, Dengue virus
TLSLITEM

SEQ ID NO: 30594 - protein, 8 aa, Dengue virus
FMTQKARD

SEQ ID NO: 30595 - protein, 8 aa, Dengue virus
MTQKARDA

SEQ ID NO: 30596 - protein, 8 aa, Dengue virus
TQKARDAL

SEQ ID NO: 30597 - protein, 8 aa, Dengue virus
QKARDALD

SEQ ID NO: 30598 - protein, 8 aa, Dengue virus
KARDALDN

SEQ ID NO: 30599 - protein, 8 aa, Dengue virus
ARDALDNL

SEQ ID NO: 30600 - protein, 8 aa, Dengue virus
AVLHSAEM

SEQ ID NO: 30601 - protein, 8 aa, Dengue virus
VLHSAEMG

SEQ ID NO: 30602 - protein, 8 aa, Dengue virus
LHSAEMGG

SEQ ID NO: 30603 - protein, 8 aa, Dengue virus
HTAEAGGK

SEQ ID NO: 30604 - protein, 8 aa, Dengue virus
TAEAGGKA

SEQ ID NO: 30605 - protein, 8 aa, Dengue virus
AEAGGKAY

SEQ ID NO: 30606 - protein, 8 aa, Dengue virus
GGKAYTHA

SEQ ID NO: 30607 - protein, 8 aa, Dengue virus
GKAYTHAL

SEQ ID NO: 30608 - protein, 8 aa, Dengue virus
KAYTHALS

SEQ ID NO: 30609 - protein, 8 aa, Dengue virus
LLLTLLAA

SEQ ID NO: 30610 - protein, 8 aa, Dengue virus
LLTLLAAV

SEQ ID NO: 30611 - protein, 8 aa, Dengue virus
LTLLAAVT

SEQ ID NO: 30612 - protein, 8 aa, Dengue virus
TLLAAVTG

SEQ ID NO: 30613 - protein, 8 aa, Dengue virus
FLFLMSAR

SEQ ID NO: 30614 - protein, 8 aa, Dengue virus
LFLMSARG

SEQ ID NO: 30615 - protein, 8 aa, Dengue virus
FLMSGKGV

SEQ ID NO: 30616 - protein, 8 aa, Dengue virus
LMSGKGVG

SEQ ID NO: 30617 - protein, 8 aa, Dengue virus
MSGKGVGK

SEQ ID NO: 30618 - protein, 8 aa, Dengue virus
SGKGVGKM

SEQ ID NO: 30619 - protein, 8 aa, Dengue virus
GKGVGKMT

SEQ ID NO: 30620 - protein, 8 aa, Dengue virus
KGVGKMTL

SEQ ID NO: 30621 - protein, 8 aa, Dengue virus
TASGLLWY

SEQ ID NO: 30622 - protein, 8 aa, Dengue virus
ASGLLWYA

SEQ ID NO: 30623 - protein, 8 aa, Dengue virus
VVIAILTL

SEQ ID NO: 30624 - protein, 8 aa, Dengue virus
VIAILTLV

SEQ ID NO: 30625 - protein, 8 aa, Dengue virus
KTKKDLGF

SEQ ID NO: 30626 - protein, 8 aa, Dengue virus
TKKDLGFG

SEQ ID NO: 30627 - protein, 8 aa, Dengue virus
EPESNILD

SEQ ID NO: 30628 - protein, 8 aa, Dengue virus
PEINILDI

SEQ ID NO: 30629 - protein, 8 aa, Dengue virus
VTLTAALL

SEQ ID NO: 30630 - protein, 8 aa, Dengue virus
TLTAALLS

SEQ ID NO: 30631 - protein, 8 aa, Dengue virus
LTAALLSL

SEQ ID NO: 30632 - protein, 8 aa, Dengue virus
TAALLLLI

SEQ ID NO: 30633 - protein, 8 aa, Dengue virus
AALLLLIA

SEQ ID NO: 30634 - protein, 8 aa, Dengue virus
ALLLLIAH

SEQ ID NO: 30635 - protein, 8 aa, Dengue virus
SLVAHYAI

SEQ ID NO: 30636 - protein, 8 aa, Dengue virus
MAHYAIIG

SEQ ID NO: 30637 - protein, 8 aa, Dengue virus
GVTVIDLD

SEQ ID NO: 30638 - protein, 8 aa, Dengue virus
VTVIDLDP

SEQ ID NO: 30639 - protein, 8 aa, Dengue virus
FSIMRNTT

SEQ ID NO: 30640 - protein, 8 aa, Dengue virus
SIMKNTAN

SEQ ID NO: 30641 - protein, 8 aa, Dengue virus
RRGTGNTG

SEQ ID NO: 30642 - protein, 8 aa, Dengue virus
RGTGNTGE

SEQ ID NO: 30643 - protein, 8 aa, Dengue virus
GTGNTGET

SEQ ID NO: 30644 - protein, 8 aa, Dengue virus
TGNTGETL

SEQ ID NO: 30645 - protein, 8 aa, Dengue virus
GNTGETLG

SEQ ID NO: 30646 - protein, 8 aa, Dengue virus
NTGETLGE

SEQ ID NO: 30647 - protein, 8 aa, Dengue virus
TGETLGEK

SEQ ID NO: 30648 - protein, 8 aa, Dengue virus
KWKSRLNT

SEQ ID NO: 30649 - protein, 8 aa, Dengue virus
WKSRLNTL

SEQ ID NO: 30650 - protein, 8 aa, Dengue virus
KSRLNTLG

SEQ ID NO: 30651 - protein, 8 aa, Dengue virus
RLNALGKN

SEQ ID NO: 30652 - protein, 8 aa, Dengue virus
LNALGKNE

SEQ ID NO: 30653 - protein, 8 aa, Dengue virus
NALGKNEF

SEQ ID NO: 30654 - protein, 8 aa, Dengue virus
ALGKNEFQ

SEQ ID NO: 30655 - protein, 8 aa, Dengue virus
LGRSEFQI

SEQ ID NO: 30656 - protein, 8 aa, Dengue virus
GKSEFQTY

SEQ ID NO: 30657 - protein, 8 aa, Dengue virus
RSEFQIYK

SEQ ID NO: 30658 - protein, 8 aa, Dengue virus
SEFQTYKK

SEQ ID NO: 30659 - protein, 8 aa, Dengue virus
EFQTYKKS

SEQ ID NO: 30660 - protein, 8 aa, Dengue virus
FQTYKKSG

SEQ ID NO: 30661 - protein, 8 aa, Dengue virus
QTYKKSGI

SEQ ID NO: 30662 - protein, 8 aa, Dengue virus
TYKKSGIQ

SEQ ID NO: 30663 - protein, 8 aa, Dengue virus
FVERNMVA

SEQ ID NO: 30664 - protein, 8 aa, Dengue virus
VERNMVAP

SEQ ID NO: 30665 - protein, 8 aa, Dengue virus
ERNMVAPE

SEQ ID NO: 30666 - protein, 8 aa, Dengue virus
RNMVAPEG

SEQ ID NO: 30667 - protein, 8 aa, Dengue virus
NMVAPEGK

SEQ ID NO: 30668 - protein, 8 aa, Dengue virus
MVAPEGKV

SEQ ID NO: 30669 - protein, 8 aa, Dengue virus
VAPEGKVV

SEQ ID NO: 30670 - protein, 8 aa, Dengue virus
APEGKVVD

SEQ ID NO: 30671 - protein, 8 aa, Dengue virus
YYCGGLKS

SEQ ID NO: 30672 - protein, 8 aa, Dengue virus
YCGGLKSV

SEQ ID NO: 30673 - protein, 8 aa, Dengue virus
CGGLKDVR

SEQ ID NO: 30674 - protein, 8 aa, Dengue virus
GGLKDVRE

SEQ ID NO: 30675 - protein, 8 aa, Dengue virus
GLKDVREV

SEQ ID NO: 30676 - protein, 8 aa, Dengue virus
LKDVREVK

SEQ ID NO: 30677 - protein, 8 aa, Dengue virus
KDVREVKG

SEQ ID NO: 30678 - protein, 8 aa, Dengue virus
DVREVKGL

SEQ ID NO: 30679 - protein, 8 aa, Dengue virus
SGVDVFFV

SEQ ID NO: 30680 - protein, 8 aa, Dengue virus
GVDVFFVP

SEQ ID NO: 30681 - protein, 8 aa, Dengue virus
VDVFFVPP

SEQ ID NO: 30682 - protein, 8 aa, Dengue virus
DVFFVPPE

SEQ ID NO: 30683 - protein, 8 aa, Dengue virus
VFFVPPEK

SEQ ID NO: 30684 - protein, 8 aa, Dengue virus
FFVPPEKC

SEQ ID NO: 30685 - protein, 8 aa, Dengue virus
FVPPEKCD

SEQ ID NO: 30686 - protein, 8 aa, Dengue virus
VPPEKCDT

SEQ ID NO: 30687 - protein, 8 aa, Dengue virus
NLVENWLG

SEQ ID NO: 30688 - protein, 8 aa, Dengue virus
VENWLGSN

SEQ ID NO: 30689 - protein, 8 aa, Dengue virus
ENWLGSNT

SEQ ID NO: 30690 - protein, 8 aa, Dengue virus
NWLGSNTQ

SEQ ID NO: 30691 - protein, 8 aa, Dengue virus
WLGSNTQF

SEQ ID NO: 30692 - protein, 8 aa, Dengue virus
LGSNTQFC

SEQ ID NO: 30693 - protein, 8 aa, Dengue virus
NNNTQFCV

SEQ ID NO: 30694 - protein, 8 aa, Dengue virus
NNTQFCVK

SEQ ID NO: 30695 - protein, 8 aa, Dengue virus
DTQFCIKV

SEQ ID NO: 30696 - protein, 8 aa, Dengue virus
SVIERMET

SEQ ID NO: 30697 - protein, 8 aa, Dengue virus
VIERMETL

SEQ ID NO: 30698 - protein, 8 aa, Dengue virus
IERMETLQ

SEQ ID NO: 30699 - protein, 8 aa, Dengue virus
ERMETLQR

SEQ ID NO: 30700 - protein, 8 aa, Dengue virus
LQRKFGGA

SEQ ID NO: 30701 - protein, 8 aa, Dengue virus
QRKFGGAL

SEQ ID NO: 30702 - protein, 8 aa, Dengue virus
RKFGGALV

SEQ ID NO: 30703 - protein, 8 aa, Dengue virus
KFGGALVR

SEQ ID NO: 30704 - protein, 8 aa, Dengue virus
INRFTMRY

SEQ ID NO: 30705 - protein, 8 aa, Dengue virus
NRFTMRYK

SEQ ID NO: 30706 - protein, 8 aa, Dengue virus
RFTMRYKK

SEQ ID NO: 30707 - protein, 8 aa, Dengue virus
FTMRYKKA

SEQ ID NO: 30708 - protein, 8 aa, Dengue virus
TMRYKKAT

SEQ ID NO: 30709 - protein, 8 aa, Dengue virus
MRYKKATY

SEQ ID NO: 30710 - protein, 8 aa, Dengue virus
RYKKATYE

SEQ ID NO: 30711 - protein, 8 aa, Dengue virus
HKRATYEP

SEQ ID NO: 30712 - protein, 8 aa, Dengue virus
TRNIGIEC

SEQ ID NO: 30713 - protein, 8 aa, Dengue virus
RNIGIECE

SEQ ID NO: 30714 - protein, 8 aa, Dengue virus
EVPNLDII

SEQ ID NO: 30715 - protein, 8 aa, Dengue virus
VPNLDIIG

SEQ ID NO: 30716 - protein, 8 aa, Dengue virus
KIKEEHET

SEQ ID NO: 30717 - protein, 8 aa, Dengue virus
IKEEHETS

SEQ ID NO: 30718 - protein, 8 aa, Dengue virus
KEEHETSW

SEQ ID NO: 30719 - protein, 8 aa, Dengue virus
EEHETSWH

SEQ ID NO: 30720 - protein, 8 aa, Dengue virus
EHEASWHY

SEQ ID NO: 30721 - protein, 8 aa, Dengue virus
HEASWHYD

SEQ ID NO: 30722 - protein, 8 aa, Dengue virus
EASWHYDQ

SEQ ID NO: 30723 - protein, 8 aa, Dengue virus
ASWHYDQD

SEQ ID NO: 30724 - protein, 8 aa, Dengue virus
LTKPWDVI

SEQ ID NO: 30725 - protein, 8 aa, Dengue virus
TKPWDVIP

SEQ ID NO: 30726 - protein, 8 aa, Dengue virus
KPWDVIPM

SEQ ID NO: 30727 - protein, 8 aa, Dengue virus
PWDVIPMV

SEQ ID NO: 30728 - protein, 8 aa, Dengue virus
WDVIPMVT

SEQ ID NO: 30729 - protein, 8 aa, Dengue virus
DVIPMVTQ

SEQ ID NO: 30730 - protein, 8 aa, Dengue virus
VIPMVTQM

SEQ ID NO: 30731 - protein, 8 aa, Dengue virus
IPMVTQMA

SEQ ID NO: 30732 - protein, 8 aa, Dengue virus
KLMKITAK

SEQ ID NO: 30733 - protein, 8 aa, Dengue virus
LMKITAKW

SEQ ID NO: 30734 - protein, 8 aa, Dengue virus
MKITAKWL

SEQ ID NO: 30735 - protein, 8 aa, Dengue virus
KITAKWLW

SEQ ID NO: 30736 - protein, 8 aa, Dengue virus
ITAKWLWK

SEQ ID NO: 30737 - protein, 8 aa, Dengue virus
TAEWLWGE

SEQ ID NO: 30738 - protein, 8 aa, Dengue virus
AKWLWKEL

SEQ ID NO: 30739 - protein, 8 aa, Dengue virus
KWLWKELG

SEQ ID NO: 30740 - protein, 8 aa, Dengue virus
LWGELGRR

SEQ ID NO: 30741 - protein, 8 aa, Dengue virus
WGELGRRK

SEQ ID NO: 30742 - protein, 8 aa, Dengue virus
GELGRRKK

SEQ ID NO: 30743 - protein, 8 aa, Dengue virus
ELGRRKKP

SEQ ID NO: 30744 - protein, 8 aa, Dengue virus
LGRRKKPR

SEQ ID NO: 30745 - protein, 8 aa, Dengue virus
KTPRICTR

SEQ ID NO: 30746 - protein, 8 aa, Dengue virus
TPRICTRE

SEQ ID NO: 30747 - protein, 8 aa, Dengue virus
PRICTREE

SEQ ID NO: 30748 - protein, 8 aa, Dengue virus
RICTREEF

SEQ ID NO: 30749 - protein, 8 aa, Dengue virus
ICTREEFT

SEQ ID NO: 30750 - protein, 8 aa, Dengue virus
CTRAEFCN

SEQ ID NO: 30751 - protein, 8 aa, Dengue virus
TRAEFCNK

SEQ ID NO: 30752 - protein, 8 aa, Dengue virus
RAEFCNKV

SEQ ID NO: 30753 - protein, 8 aa, Dengue virus
AEFCNKVR

SEQ ID NO: 30754 - protein, 8 aa, Dengue virus
EFCNKVRS

SEQ ID NO: 30755 - protein, 8 aa, Dengue virus
FCNKVRSN

SEQ ID NO: 30756 - protein, 8 aa, Dengue virus
CNKVRSNA

SEQ ID NO: 30757 - protein, 8 aa, Dengue virus
NKVRSNAA

SEQ ID NO: 30758 - protein, 8 aa, Dengue virus
AREAVEDE

SEQ ID NO: 30759 - protein, 8 aa, Dengue virus
REAVEDSG

SEQ ID NO: 30760 - protein, 8 aa, Dengue virus
EAVEDSGF

SEQ ID NO: 30761 - protein, 8 aa, Dengue virus
AVEDSGFW

SEQ ID NO: 30762 - protein, 8 aa, Dengue virus
VEDSGFWE

SEQ ID NO: 30763 - protein, 8 aa, Dengue virus
EDSGFWEL

SEQ ID NO: 30764 - protein, 8 aa, Dengue virus
FWELIDRE

SEQ ID NO: 30765 - protein, 8 aa, Dengue virus
WELIDRER

SEQ ID NO: 30766 - protein, 8 aa, Dengue virus
ELIDRERN

SEQ ID NO: 30767 - protein, 8 aa, Dengue virus
LIDRERNL

SEQ ID NO: 30768 - protein, 8 aa, Dengue virus
IDRERNLH

SEQ ID NO: 30769 - protein, 8 aa, Dengue virus
EKERNLHL

SEQ ID NO: 30770 - protein, 8 aa, Dengue virus
KERNLHLD

SEQ ID NO: 30771 - protein, 8 aa, Dengue virus
VEGEGLYK

SEQ ID NO: 30772 - protein, 8 aa, Dengue virus
GEGLYKLG

SEQ ID NO: 30773 - protein, 8 aa, Dengue virus
RLGYILRE

SEQ ID NO: 30774 - protein, 8 aa, Dengue virus
LGYILRDI

SEQ ID NO: 30775 - protein, 8 aa, Dengue virus
GYILREVG

SEQ ID NO: 30776 - protein, 8 aa, Dengue virus
YILREVGK

SEQ ID NO: 30777 - protein, 8 aa, Dengue virus
ILREVGKK

SEQ ID NO: 30778 - protein, 8 aa, Dengue virus
EVGKKEGG

SEQ ID NO: 30779 - protein, 8 aa, Dengue virus
ISRKAGGA

SEQ ID NO: 30780 - protein, 8 aa, Dengue virus
SRKAGGAM

SEQ ID NO: 30781 - protein, 8 aa, Dengue virus
KKAGGAMY

SEQ ID NO: 30782 - protein, 8 aa, Dengue virus
GWDTRITS

SEQ ID NO: 30783 - protein, 8 aa, Dengue virus
WDTRITSE

SEQ ID NO: 30784 - protein, 8 aa, Dengue virus
DTRITSED

SEQ ID NO: 30785 - protein, 8 aa, Dengue virus
TRITSEDL

SEQ ID NO: 30786 - protein, 8 aa, Dengue virus
RITSEDLK

SEQ ID NO: 30787 - protein, 8 aa, Dengue virus
ITSEDLKN

SEQ ID NO: 30788 - protein, 8 aa, Dengue virus
TSEDLKNE

SEQ ID NO: 30789 - protein, 8 aa, Dengue virus
SEDLKNEE

SEQ ID NO: 30790 - protein, 8 aa, Dengue virus
KNEEMITD

SEQ ID NO: 30791 - protein, 8 aa, Dengue virus
NEEMITDQ

SEQ ID NO: 30792 - protein, 8 aa, Dengue virus
EEMITDQM

SEQ ID NO: 30793 - protein, 8 aa, Dengue virus
GRHKKLAE

SEQ ID NO: 30794 - protein, 8 aa, Dengue virus
RHKKLAEA

SEQ ID NO: 30795 - protein, 8 aa, Dengue virus
KLAEAIFR

SEQ ID NO: 30796 - protein, 8 aa, Dengue virus
RQMEGEGL

SEQ ID NO: 30797 - protein, 8 aa, Dengue virus
QMEGEGLF

SEQ ID NO: 30798 - protein, 8 aa, Dengue virus
MEGEGLFK

SEQ ID NO: 30799 - protein, 8 aa, Dengue virus
RVGRERLT

SEQ ID NO: 30800 - protein, 8 aa, Dengue virus
VGRERLTR

SEQ ID NO: 30801 - protein, 8 aa, Dengue virus
GRERLTRM

SEQ ID NO: 30802 - protein, 8 aa, Dengue virus
RERLTRMA

SEQ ID NO: 30803 - protein, 8 aa, Dengue virus
ERLTRMAI

SEQ ID NO: 30804 - protein, 8 aa, Dengue virus
RLTRMAIS

SEQ ID NO: 30805 - protein, 8 aa, Dengue virus
LTRMAISG

SEQ ID NO: 30806 - protein, 8 aa, Dengue virus
TRMAISGD

SEQ ID NO: 30807 - protein, 8 aa, Dengue virus
DDRFARAL

SEQ ID NO: 30808 - protein, 8 aa, Dengue virus
DRFARALT

SEQ ID NO: 30809 - protein, 8 aa, Dengue virus
RFARALTA

SEQ ID NO: 30810 - protein, 8 aa, Dengue virus
FARALTAL

SEQ ID NO: 30811 - protein, 8 aa, Dengue virus
ARALTALN

SEQ ID NO: 30812 - protein, 8 aa, Dengue virus
RALTALND

SEQ ID NO: 30813 - protein, 8 aa, Dengue virus
WEPSKGWS

SEQ ID NO: 30814 - protein, 8 aa, Dengue virus
EPSKGWSD

SEQ ID NO: 30815 - protein, 8 aa, Dengue virus
PSKGWSDW

SEQ ID NO: 30816 - protein, 8 aa, Dengue virus
SKGWSDWT

SEQ ID NO: 30817 - protein, 8 aa, Dengue virus
KGWSDWTQ

SEQ ID NO: 30818 - protein, 8 aa, Dengue virus
MKDGRILV

SEQ ID NO: 30819 - protein, 8 aa, Dengue virus
KDGRILVV

SEQ ID NO: 30820 - protein, 8 aa, Dengue virus
DGRILVVP

SEQ ID NO: 30821 - protein, 8 aa, Dengue virus
GRILVVPC

SEQ ID NO: 30822 - protein, 8 aa, Dengue virus
RILVVPCR

SEQ ID NO: 30823 - protein, 8 aa, Dengue virus
TTWSIHAS

SEQ ID NO: 30824 - protein, 8 aa, Dengue virus
TWSIHASH

SEQ ID NO: 30825 - protein, 8 aa, Dengue virus
WSIHASHE

SEQ ID NO: 30826 - protein, 8 aa, Dengue virus
SIHASHEW

SEQ ID NO: 30827 - protein, 8 aa, Dengue virus
IHASHEWM

SEQ ID NO: 30828 - protein, 8 aa, Dengue virus
HASHEWMT

SEQ ID NO: 30829 - protein, 8 aa, Dengue virus
ASHEWMTT

SEQ ID NO: 30830 - protein, 8 aa, Dengue virus
SHEWMTTE

SEQ ID NO: 30831 - protein, 8 aa, Dengue virus
DMLTVWNK

SEQ ID NO: 30832 - protein, 8 aa, Dengue virus
MLTVWNKV

SEQ ID NO: 30833 - protein, 8 aa, Dengue virus
LTVWNKVW

SEQ ID NO: 30834 - protein, 8 aa, Dengue virus
TVWNKVWI

SEQ ID NO: 30835 - protein, 8 aa, Dengue virus
VWNRVWIL

SEQ ID NO: 30836 - protein, 8 aa, Dengue virus
WNRVWILE

SEQ ID NO: 30837 - protein, 8 aa, Dengue virus
NRVWILEN

SEQ ID NO: 30838 - protein, 8 aa, Dengue virus
RVWILENP

SEQ ID NO: 30839 - protein, 8 aa, Dengue virus
VWILENPW

SEQ ID NO: 30840 - protein, 8 aa, Dengue virus
WILENPWM

SEQ ID NO: 30841 - protein, 8 aa, Dengue virus
ILENPWME

SEQ ID NO: 30842 - protein, 8 aa, Dengue virus
LENPWMED

SEQ ID NO: 30843 - protein, 8 aa, Dengue virus
ENPWIEDK

SEQ ID NO: 30844 - protein, 8 aa, Dengue virus
TPVETWEE

SEQ ID NO: 30845 - protein, 8 aa, Dengue virus
PVESWEDI

SEQ ID NO: 30846 - protein, 8 aa, Dengue virus
VESWEDIP

SEQ ID NO: 30847 - protein, 8 aa, Dengue virus
ESWEDIPY

SEQ ID NO: 30848 - protein, 8 aa, Dengue virus
SWEDIPYL

SEQ ID NO: 30849 - protein, 8 aa, Dengue virus
WEDIPYLG

SEQ ID NO: 30850 - protein, 8 aa, Dengue virus
EDIPYLGK

SEQ ID NO: 30851 - protein, 8 aa, Dengue virus
DIPYLGKR

SEQ ID NO: 30852 - protein, 8 aa, Dengue virus
TWAKNIQV

SEQ ID NO: 30853 - protein, 8 aa, Dengue virus
WAKNIQVA

SEQ ID NO: 30854 - protein, 8 aa, Dengue virus
AKNIQVAI

SEQ ID NO: 30855 - protein, 8 aa, Dengue virus
KNIQVAIN

SEQ ID NO: 30856 - protein, 8 aa, Dengue virus
NIQVAINQ

SEQ ID NO: 30857 - protein, 8 aa, Dengue virus
IQVAINQV

SEQ ID NO: 30858 - protein, 8 aa, Dengue virus
QVAINQVR

SEQ ID NO: 30859 - protein, 8 aa, Dengue virus
VAINQVRS

SEQ ID NO: 30860 - protein, 8 aa, Dengue virus
INQVRSLM

SEQ ID NO: 30861 - protein, 8 aa, Dengue virus
NQVRSLMG

SEQ ID NO: 30862 - protein, 8 aa, Dengue virus
QVRSLMGN

SEQ ID NO: 30863 - protein, 8 aa, Dengue virus
VRSLMGNE

SEQ ID NO: 30864 - protein, 8 aa, Dengue virus
RSLMGNEG

SEQ ID NO: 30865 - protein, 8 aa, Dengue virus
SLMGNEGY

SEQ ID NO: 30866 - protein, 8 aa, Dengue virus
EEYIDYMP

SEQ ID NO: 30867 - protein, 8 aa, Dengue virus
EYIDYMPS

SEQ ID NO: 30868 - protein, 8 aa, Dengue virus
PSMKRFRS

SEQ ID NO: 30869 - protein, 8 aa, Dengue virus
SMKRFRSE

SEQ ID NO: 30870 - protein, 8 aa, Dengue virus
MKRFRSEE

SEQ ID NO: 30871 - protein, 8 aa, Dengue virus
KRFRSEEE

SEQ ID NO: 30872 - protein, 8 aa, Dengue virus
RFRSEEEE

SEQ ID NO: 30873 - protein, 8 aa, Dengue virus
FRSEEEES

SEQ ID NO: 30874 - protein, 8 aa, Dengue virus
RSEEEESG

SEQ ID NO: 30875 - protein, 8 aa, Dengue virus
SEEEESGV

SEQ ID NO: 30876 - protein, 8 aa, Dengue virus
NQRKKAKT

SEQ ID NO: 30877 - protein, 8 aa, Dengue virus
LNRRRRSV

SEQ ID NO: 30878 - protein, 8 aa, Dengue virus
NRRRRSVG

SEQ ID NO: 30879 - protein, 8 aa, Dengue virus
IPTAIAFH

SEQ ID NO: 30880 - protein, 8 aa, Dengue virus
PTAIAFHL

SEQ ID NO: 30881 - protein, 8 aa, Dengue virus
TAIAFHLT

SEQ ID NO: 30882 - protein, 8 aa, Dengue virus
AIAFHLTT

SEQ ID NO: 30883 - protein, 8 aa, Dengue virus
EPHMIVSI

SEQ ID NO: 30884 - protein, 8 aa, Dengue virus
PHMIVSIQ

SEQ ID NO: 30885 - protein, 8 aa, Dengue virus
HMIVSIQE

SEQ ID NO: 30886 - protein, 8 aa, Dengue virus
MIVSIQEK

SEQ ID NO: 30887 - protein, 8 aa, Dengue virus
IVSIQEKG

SEQ ID NO: 30888 - protein, 8 aa, Dengue virus
VSIQEKGK

SEQ ID NO: 30889 - protein, 8 aa, Dengue virus
SIQEKGKS

SEQ ID NO: 30890 - protein, 8 aa, Dengue virus
SLLFKTEV

SEQ ID NO: 30891 - protein, 8 aa, Dengue virus
LLFKTEVG

SEQ ID NO: 30892 - protein, 8 aa, Dengue virus
NGINMCTL

SEQ ID NO: 30893 - protein, 8 aa, Dengue virus
TVTYKCPF

SEQ ID NO: 30894 - protein, 8 aa, Dengue virus
VTYKCPFL

SEQ ID NO: 30895 - protein, 8 aa, Dengue virus
TYKCPLLK

SEQ ID NO: 30896 - protein, 8 aa, Dengue virus
YKCPLLKQ

SEQ ID NO: 30897 - protein, 8 aa, Dengue virus
KCPLLKQN

SEQ ID NO: 30898 - protein, 8 aa, Dengue virus
WITYGTCT

SEQ ID NO: 30899 - protein, 8 aa, Dengue virus
STGEHRRE

SEQ ID NO: 30900 - protein, 8 aa, Dengue virus
LRHPGFAI

SEQ ID NO: 30901 - protein, 8 aa, Dengue virus
RHPGFAIM

SEQ ID NO: 30902 - protein, 8 aa, Dengue virus
HPGFAIMA

SEQ ID NO: 30903 - protein, 8 aa, Dengue virus
PGFAIMAA

SEQ ID NO: 30904 - protein, 8 aa, Dengue virus
IGTTHFQK

SEQ ID NO: 30905 - protein, 8 aa, Dengue virus
GTTHFQRT

SEQ ID NO: 30906 - protein, 8 aa, Dengue virus
TTHFQRTL

SEQ ID NO: 30907 - protein, 8 aa, Dengue virus
THFQRTLI

SEQ ID NO: 30908 - protein, 8 aa, Dengue virus
HFQRTLIF

SEQ ID NO: 30909 - protein, 8 aa, Dengue virus
FQKALIFI

SEQ ID NO: 30910 - protein, 8 aa, Dengue virus
QKALIFIL

SEQ ID NO: 30911 - protein, 8 aa, Dengue virus
KALIFILL

SEQ ID NO: 30912 - protein, 8 aa, Dengue virus
TLIFILLT

SEQ ID NO: 30913 - protein, 8 aa, Dengue virus
IFILLTTV

SEQ ID NO: 30914 - protein, 8 aa, Dengue virus
FILLTAVT

SEQ ID NO: 30915 - protein, 8 aa, Dengue virus
ILLTAVTP

SEQ ID NO: 30916 - protein, 8 aa, Dengue virus
LLTAVTPS

SEQ ID NO: 30917 - protein, 8 aa, Dengue virus
LTAVTPSM

SEQ ID NO: 30918 - protein, 8 aa, Dengue virus
TAVTPSMT

SEQ ID NO: 30919 - protein, 8 aa, Dengue virus
AIAPSMAM

SEQ ID NO: 30920 - protein, 8 aa, Dengue virus
LIKTEAKE

SEQ ID NO: 30921 - protein, 8 aa, Dengue virus
KTEAKQSA

SEQ ID NO: 30922 - protein, 8 aa, Dengue virus
TEAKQSAT

SEQ ID NO: 30923 - protein, 8 aa, Dengue virus
EAKQSATL

SEQ ID NO: 30924 - protein, 8 aa, Dengue virus
AKQLATLR

SEQ ID NO: 30925 - protein, 8 aa, Dengue virus
KQSATLRK

SEQ ID NO: 30926 - protein, 8 aa, Dengue virus
EPATLRKY

SEQ ID NO: 30927 - protein, 8 aa, Dengue virus
TQGEPSLS

SEQ ID NO: 30928 - protein, 8 aa, Dengue virus
QGEPSLSE

SEQ ID NO: 30929 - protein, 8 aa, Dengue virus
GEPSLSEE

SEQ ID NO: 30930 - protein, 8 aa, Dengue virus
EPSLVEEQ

SEQ ID NO: 30931 - protein, 8 aa, Dengue virus
PSLSEEQD

SEQ ID NO: 30932 - protein, 8 aa, Dengue virus
SLSEEQDK

SEQ ID NO: 30933 - protein, 8 aa, Dengue virus
LVEEQDKR

SEQ ID NO: 30934 - protein, 8 aa, Dengue virus
VEEQDKRF

SEQ ID NO: 30935 - protein, 8 aa, Dengue virus
QDKRFLCK

SEQ ID NO: 30936 - protein, 8 aa, Dengue virus
DKRFLCKH

SEQ ID NO: 30937 - protein, 8 aa, Dengue virus
KRFLCKHS

SEQ ID NO: 30938 - protein, 8 aa, Dengue virus
RFLCKHSM

SEQ ID NO: 30939 - protein, 8 aa, Dengue virus
FLCKHSMV

SEQ ID NO: 30940 - protein, 8 aa, Dengue virus
LCKHSMVD

SEQ ID NO: 30941 - protein, 8 aa, Dengue virus
IVTCAKFT

SEQ ID NO: 30942 - protein, 8 aa, Dengue virus
TCAKFTCK

SEQ ID NO: 30943 - protein, 8 aa, Dengue virus
CAMFSCKK

SEQ ID NO: 30944 - protein, 8 aa, Dengue virus
AKFTCKKN

SEQ ID NO: 30945 - protein, 8 aa, Dengue virus
MFSCKKNM

SEQ ID NO: 30946 - protein, 8 aa, Dengue virus
FTCLKKME

SEQ ID NO: 30947 - protein, 8 aa, Dengue virus
TCLKKMEG

SEQ ID NO: 30948 - protein, 8 aa, Dengue virus
LKKMEGKV

SEQ ID NO: 30949 - protein, 8 aa, Dengue virus
KKMEGKVV

SEQ ID NO: 30950 - protein, 8 aa, Dengue virus
NMKGKVVQ

SEQ ID NO: 30951 - protein, 8 aa, Dengue virus
MKGKVVQP

SEQ ID NO: 30952 - protein, 8 aa, Dengue virus
KGKVVQPE

SEQ ID NO: 30953 - protein, 8 aa, Dengue virus
GEEYAVGN

SEQ ID NO: 30954 - protein, 8 aa, Dengue virus
EEHSVGND

SEQ ID NO: 30955 - protein, 8 aa, Dengue virus
EHSVGNDT

SEQ ID NO: 30956 - protein, 8 aa, Dengue virus
YAVGNDTG

SEQ ID NO: 30957 - protein, 8 aa, Dengue virus
DDTGKHGK

SEQ ID NO: 30958 - protein, 8 aa, Dengue virus
TGKHGMEI

SEQ ID NO: 30959 - protein, 8 aa, Dengue virus
GKHGMEIK

SEQ ID NO: 30960 - protein, 8 aa, Dengue virus
KHGKEVKI

SEQ ID NO: 30961 - protein, 8 aa, Dengue virus
HGKEVKIT

SEQ ID NO: 30962 - protein, 8 aa, Dengue virus
GKEVKITP

SEQ ID NO: 30963 - protein, 8 aa, Dengue virus
KEVKITPQ

SEQ ID NO: 30964 - protein, 8 aa, Dengue virus
IKITPQSP

SEQ ID NO: 30965 - protein, 8 aa, Dengue virus
AEAELTGY

SEQ ID NO: 30966 - protein, 8 aa, Dengue virus
MESKAWLV

SEQ ID NO: 30967 - protein, 8 aa, Dengue virus
ESKAWLVH

SEQ ID NO: 30968 - protein, 8 aa, Dengue virus
SKAWLVHR

SEQ ID NO: 30969 - protein, 8 aa, Dengue virus
LPGADTQE

SEQ ID NO: 30970 - protein, 8 aa, Dengue virus
PGADTQES

SEQ ID NO: 30971 - protein, 8 aa, Dengue virus
GADTQESN

SEQ ID NO: 30972 - protein, 8 aa, Dengue virus
ADTQESNW

SEQ ID NO: 30973 - protein, 8 aa, Dengue virus
DTQESNWI

SEQ ID NO: 30974 - protein, 8 aa, Dengue virus
TQESNWIQ

SEQ ID NO: 30975 - protein, 8 aa, Dengue virus
IRVQYEGE

SEQ ID NO: 30976 - protein, 8 aa, Dengue virus
RVQYEGEG

SEQ ID NO: 30977 - protein, 8 aa, Dengue virus
VQYEGEGA

SEQ ID NO: 30978 - protein, 8 aa, Dengue virus
GDGSPCKV

SEQ ID NO: 30979 - protein, 8 aa, Dengue virus
DGSPCKVP

SEQ ID NO: 30980 - protein, 8 aa, Dengue virus
GSPCKVPF

SEQ ID NO: 30981 - protein, 8 aa, Dengue virus
CKVPFEIM

SEQ ID NO: 30982 - protein, 8 aa, Dengue virus
KVPFEIMD

SEQ ID NO: 30983 - protein, 8 aa, Dengue virus
EIMDLERR

SEQ ID NO: 30984 - protein, 8 aa, Dengue virus
IMDLEKKH

SEQ ID NO: 30985 - protein, 8 aa, Dengue virus
DLERRYVL

SEQ ID NO: 30986 - protein, 8 aa, Dengue virus
LERRYVLG

SEQ ID NO: 30987 - protein, 8 aa, Dengue virus
ERRYVLGR

SEQ ID NO: 30988 - protein, 8 aa, Dengue virus
RRYVLGRL

SEQ ID NO: 30989 - protein, 8 aa, Dengue virus
RYILGRLI

SEQ ID NO: 30990 - protein, 8 aa, Dengue virus
ITVNPIIT

SEQ ID NO: 30991 - protein, 8 aa, Dengue virus
EKDNPINI

SEQ ID NO: 30992 - protein, 8 aa, Dengue virus
LGGAFTSI

SEQ ID NO: 30993 - protein, 8 aa, Dengue virus
TMKIFIGV

SEQ ID NO: 30994 - protein, 8 aa, Dengue virus
MKIFIGVI

SEQ ID NO: 30995 - protein, 8 aa, Dengue virus
TLVLVGIV

SEQ ID NO: 30996 - protein, 8 aa, Dengue virus
LVLVGVVI

SEQ ID NO: 30997 - protein, 8 aa, Dengue virus
VLVGVVIL

SEQ ID NO: 30998 - protein, 8 aa, Dengue virus
LVGVVILY

SEQ ID NO: 30999 - protein, 8 aa, Dengue virus
VITLYLGA

SEQ ID NO: 31000 - protein, 8 aa, Dengue virus
ITLYLGAM

SEQ ID NO: 31001 - protein, 8 aa, Dengue virus
GVMVQADT

SEQ ID NO: 31002 - protein, 8 aa, Dengue virus
VMVQADTG

SEQ ID NO: 31003 - protein, 8 aa, Dengue virus
IQKAYEEG

SEQ ID NO: 31004 - protein, 8 aa, Dengue virus
QKAHEDGI

SEQ ID NO: 31005 - protein, 8 aa, Dengue virus
KAYEEGIC

SEQ ID NO: 31006 - protein, 8 aa, Dengue virus
AYEEGICG

SEQ ID NO: 31007 - protein, 8 aa, Dengue virus
HEDGICGI

SEQ ID NO: 31008 - protein, 8 aa, Dengue virus
LSENEVKM

SEQ ID NO: 31009 - protein, 8 aa, Dengue virus
SENEVKMT

SEQ ID NO: 31010 - protein, 8 aa, Dengue virus
MTIMTGDI

SEQ ID NO: 31011 - protein, 8 aa, Dengue virus
TIMTGEIK

SEQ ID NO: 31012 - protein, 8 aa, Dengue virus
IMTGEIKG

SEQ ID NO: 31013 - protein, 8 aa, Dengue virus
MTGEIKGI

SEQ ID NO: 31014 - protein, 8 aa, Dengue virus
TGEIKGIM

SEQ ID NO: 31015 - protein, 8 aa, Dengue virus
GEIKGIMQ

SEQ ID NO: 31016 - protein, 8 aa, Dengue virus
IKGIMQVG

SEQ ID NO: 31017 - protein, 8 aa, Dengue virus
KGIMQAGR

SEQ ID NO: 31018 - protein, 8 aa, Dengue virus
GIMHAGKR

SEQ ID NO: 31019 - protein, 8 aa, Dengue virus
IMQAGKRY

SEQ ID NO: 31020 - protein, 8 aa, Dengue virus
MQAGKRYL

SEQ ID NO: 31021 - protein, 8 aa, Dengue virus
GKRYLRPQ

SEQ ID NO: 31022 - protein, 8 aa, Dengue virus
KRYLRPQP

SEQ ID NO: 31023 - protein, 8 aa, Dengue virus
RYLRPQPT

SEQ ID NO: 31024 - protein, 8 aa, Dengue virus
YLRPQPTE

SEQ ID NO: 31025 - protein, 8 aa, Dengue virus
QPQPTELK

SEQ ID NO: 31026 - protein, 8 aa, Dengue virus
TWGKAKIL

SEQ ID NO: 31027 - protein, 8 aa, Dengue virus
WGKAKILS

SEQ ID NO: 31028 - protein, 8 aa, Dengue virus
GKAKILST

SEQ ID NO: 31029 - protein, 8 aa, Dengue virus
KAKILSTE

SEQ ID NO: 31030 - protein, 8 aa, Dengue virus
QNQTFLID

SEQ ID NO: 31031 - protein, 8 aa, Dengue virus
ETVECPNT

SEQ ID NO: 31032 - protein, 8 aa, Dengue virus
TVECPNTN

SEQ ID NO: 31033 - protein, 8 aa, Dengue virus
VECPNTNR

SEQ ID NO: 31034 - protein, 8 aa, Dengue virus
TNIWLRLK

SEQ ID NO: 31035 - protein, 8 aa, Dengue virus
NIWLRLKE

SEQ ID NO: 31036 - protein, 8 aa, Dengue virus
IWLRLREK

SEQ ID NO: 31037 - protein, 8 aa, Dengue virus
WLRLREKQ

SEQ ID NO: 31038 - protein, 8 aa, Dengue virus
LRLREKQD

SEQ ID NO: 31039 - protein, 8 aa, Dengue virus
SCDSKLMS

SEQ ID NO: 31040 - protein, 8 aa, Dengue virus
MSAAIKNN

SEQ ID NO: 31041 - protein, 8 aa, Dengue virus
SAAIKNNR

SEQ ID NO: 31042 - protein, 8 aa, Dengue virus
AAIKNNRA

SEQ ID NO: 31043 - protein, 8 aa, Dengue virus
AIKNNRAV

SEQ ID NO: 31044 - protein, 8 aa, Dengue virus
IKNNRAVH

SEQ ID NO: 31045 - protein, 8 aa, Dengue virus
FIEVKSCY

SEQ ID NO: 31046 - protein, 8 aa, Dengue virus
IEVKSCYW

SEQ ID NO: 31047 - protein, 8 aa, Dengue virus
EVKSCYWP

SEQ ID NO: 31048 - protein, 8 aa, Dengue virus
VKSCYWPR

SEQ ID NO: 31049 - protein, 8 aa, Dengue virus
KSCHWPRS

SEQ ID NO: 31050 - protein, 8 aa, Dengue virus
SCHWPRSH

SEQ ID NO: 31051 - protein, 8 aa, Dengue virus
IPKGFAGP

SEQ ID NO: 31052 - protein, 8 aa, Dengue virus
PKGFAGPV

SEQ ID NO: 31053 - protein, 8 aa, Dengue virus
KGFAGPVS

SEQ ID NO: 31054 - protein, 8 aa, Dengue virus
GFAGPVSQ

SEQ ID NO: 31055 - protein, 8 aa, Dengue virus
HNYRLGYH

SEQ ID NO: 31056 - protein, 8 aa, Dengue virus
NNRPGYYT

SEQ ID NO: 31057 - protein, 8 aa, Dengue virus
NRPGYYTQ

SEQ ID NO: 31058 - protein, 8 aa, Dengue virus
PGYHTQIT

SEQ ID NO: 31059 - protein, 8 aa, Dengue virus
GYHTQITG

SEQ ID NO: 31060 - protein, 8 aa, Dengue virus
YHTQITGP

SEQ ID NO: 31061 - protein, 8 aa, Dengue virus
HTQITGPW

SEQ ID NO: 31062 - protein, 8 aa, Dengue virus
GKLEMDFN

SEQ ID NO: 31063 - protein, 8 aa, Dengue virus
KLEMDFEF

SEQ ID NO: 31064 - protein, 8 aa, Dengue virus
LEMDFNFC

SEQ ID NO: 31065 - protein, 8 aa, Dengue virus
EMDFEFCE

SEQ ID NO: 31066 - protein, 8 aa, Dengue virus
MDFEFCEG

SEQ ID NO: 31067 - protein, 8 aa, Dengue virus
DFEFCEGT

SEQ ID NO: 31068 - protein, 8 aa, Dengue virus
FEFCEGTT

SEQ ID NO: 31069 - protein, 8 aa, Dengue virus
EFCEGTTV

SEQ ID NO: 31070 - protein, 8 aa, Dengue virus
FCDGTTVV

SEQ ID NO: 31071 - protein, 8 aa, Dengue virus
TTVVVTEN

SEQ ID NO: 31072 - protein, 8 aa, Dengue virus
TVVVTENC

SEQ ID NO: 31073 - protein, 8 aa, Dengue virus
VVVTENCG

SEQ ID NO: 31074 - protein, 8 aa, Dengue virus
VVTENCGN

SEQ ID NO: 31075 - protein, 8 aa, Dengue virus
GVLGMALL

SEQ ID NO: 31076 - protein, 8 aa, Dengue virus
VLGMALLL

SEQ ID NO: 31077 - protein, 8 aa, Dengue virus
FRDLGRVV

SEQ ID NO: 31078 - protein, 8 aa, Dengue virus
RDLGRVVV

SEQ ID NO: 31079 - protein, 8 aa, Dengue virus
RVVVMVGT

SEQ ID NO: 31080 - protein, 8 aa, Dengue virus
MTDDIGIG

SEQ ID NO: 31081 - protein, 8 aa, Dengue virus
TDDIGMGI

SEQ ID NO: 31082 - protein, 8 aa, Dengue virus
DDIGIGVT

SEQ ID NO: 31083 - protein, 8 aa, Dengue virus
DIGIGVTY

SEQ ID NO: 31084 - protein, 8 aa, Dengue virus
IGIGVTYL

SEQ ID NO: 31085 - protein, 8 aa, Dengue virus
KVRPTFVA

SEQ ID NO: 31086 - protein, 8 aa, Dengue virus
FAAGLLLK

SEQ ID NO: 31087 - protein, 8 aa, Dengue virus
AAGLLLKK

SEQ ID NO: 31088 - protein, 8 aa, Dengue virus
LMMATIGV

SEQ ID NO: 31089 - protein, 8 aa, Dengue virus
TIGVVLLS

SEQ ID NO: 31090 - protein, 8 aa, Dengue virus
IGVVLLSQ

SEQ ID NO: 31091 - protein, 8 aa, Dengue virus
GVVLLSQS

SEQ ID NO: 31092 - protein, 8 aa, Dengue virus
PESILELT

SEQ ID NO: 31093 - protein, 8 aa, Dengue virus
ESILELTD

SEQ ID NO: 31094 - protein, 8 aa, Dengue virus
NILELTDA

SEQ ID NO: 31095 - protein, 8 aa, Dengue virus
ALALGMMI

SEQ ID NO: 31096 - protein, 8 aa, Dengue virus
LALGMMIL

SEQ ID NO: 31097 - protein, 8 aa, Dengue virus
ALGMMILK

SEQ ID NO: 31098 - protein, 8 aa, Dengue virus
VRSMEKYQ

SEQ ID NO: 31099 - protein, 8 aa, Dengue virus
RSMEKYQL

SEQ ID NO: 31100 - protein, 8 aa, Dengue virus
SMEKYQLA

SEQ ID NO: 31101 - protein, 8 aa, Dengue virus
QLAVTIMV

SEQ ID NO: 31102 - protein, 8 aa, Dengue virus
MTILCVPN

SEQ ID NO: 31103 - protein, 8 aa, Dengue virus
TILCVPNA

SEQ ID NO: 31104 - protein, 8 aa, Dengue virus
ISCVPNAM

SEQ ID NO: 31105 - protein, 8 aa, Dengue virus
LCVPNAVV

SEQ ID NO: 31106 - protein, 8 aa, Dengue virus
VPNAVILL

SEQ ID NO: 31107 - protein, 8 aa, Dengue virus
PNAVILLN

SEQ ID NO: 31108 - protein, 8 aa, Dengue virus
NAVILLNA

SEQ ID NO: 31109 - protein, 8 aa, Dengue virus
AVILLNAW

SEQ ID NO: 31110 - protein, 8 aa, Dengue virus
ILLNAWKV

SEQ ID NO: 31111 - protein, 8 aa, Dengue virus
QHAWKVGC

SEQ ID NO: 31112 - protein, 8 aa, Dengue virus
HAWKVSCA

SEQ ID NO: 31113 - protein, 8 aa, Dengue virus
AWKVSCAI

SEQ ID NO: 31114 - protein, 8 aa, Dengue virus
WKVSCAIL

SEQ ID NO: 31115 - protein, 8 aa, Dengue virus
KVSCAILA

SEQ ID NO: 31116 - protein, 8 aa, Dengue virus
CTILATVS

SEQ ID NO: 31117 - protein, 8 aa, Dengue virus
TILATVSV

SEQ ID NO: 31118 - protein, 8 aa, Dengue virus
ILATVSVS

SEQ ID NO: 31119 - protein, 8 aa, Dengue virus
VSVFPLLL

SEQ ID NO: 31120 - protein, 8 aa, Dengue virus
SVFPLLLT

SEQ ID NO: 31121 - protein, 8 aa, Dengue virus
VFPLLLTS

SEQ ID NO: 31122 - protein, 8 aa, Dengue virus
PLLLTSSR

SEQ ID NO: 31123 - protein, 8 aa, Dengue virus
LLLTSSRQ

SEQ ID NO: 31124 - protein, 8 aa, Dengue virus
LLTSSRQK

SEQ ID NO: 31125 - protein, 8 aa, Dengue virus
LTSSRQKA

SEQ ID NO: 31126 - protein, 8 aa, Dengue virus
LTTLTRTS

SEQ ID NO: 31127 - protein, 8 aa, Dengue virus
TTLTRTSK

SEQ ID NO: 31128 - protein, 8 aa, Dengue virus
TLSRPNKI

SEQ ID NO: 31129 - protein, 8 aa, Dengue virus
LSRPNKIR

SEQ ID NO: 31130 - protein, 8 aa, Dengue virus
SRPNKIRS

SEQ ID NO: 31131 - protein, 8 aa, Dengue virus
RPNKIRSW

SEQ ID NO: 31132 - protein, 8 aa, Dengue virus
PNKIRSWP

SEQ ID NO: 31133 - protein, 8 aa, Dengue virus
LELEKAAD

SEQ ID NO: 31134 - protein, 8 aa, Dengue virus
ELEKAADV

SEQ ID NO: 31135 - protein, 8 aa, Dengue virus
VRWEDQAE

SEQ ID NO: 31136 - protein, 8 aa, Dengue virus
RWEDQAEI

SEQ ID NO: 31137 - protein, 8 aa, Dengue virus
SGLFPVSM

SEQ ID NO: 31138 - protein, 8 aa, Dengue virus
GLFPVSMP

SEQ ID NO: 31139 - protein, 8 aa, Dengue virus
LFPVSMPI

SEQ ID NO: 31140 - protein, 8 aa, Dengue virus
VPSPPPIG

SEQ ID NO: 31141 - protein, 8 aa, Dengue virus
RIKQKGIF

SEQ ID NO: 31142 - protein, 8 aa, Dengue virus
IKQKGIFG

SEQ ID NO: 31143 - protein, 8 aa, Dengue virus
KQKGIFGY

SEQ ID NO: 31144 - protein, 8 aa, Dengue virus
QKGIFGYS

SEQ ID NO: 31145 - protein, 8 aa, Dengue virus
KGIFGYSQ

SEQ ID NO: 31146 - protein, 8 aa, Dengue virus
RGAVLTHK

SEQ ID NO: 31147 - protein, 8 aa, Dengue virus
GAVLTHKG

SEQ ID NO: 31148 - protein, 8 aa, Dengue virus
AVLTHKGK

SEQ ID NO: 31149 - protein, 8 aa, Dengue virus
VLTHKGKR

SEQ ID NO: 31150 - protein, 8 aa, Dengue virus
LTHKGKRI

SEQ ID NO: 31151 - protein, 8 aa, Dengue virus
THKGKRIE

SEQ ID NO: 31152 - protein, 8 aa, Dengue virus
QTKPGIFR

SEQ ID NO: 31153 - protein, 8 aa, Dengue virus
TKPGFFKT

SEQ ID NO: 31154 - protein, 8 aa, Dengue virus
KPGLFKTS

SEQ ID NO: 31155 - protein, 8 aa, Dengue virus
FKTSTGTI

SEQ ID NO: 31156 - protein, 8 aa, Dengue virus
KTSTGTIG

SEQ ID NO: 31157 - protein, 8 aa, Dengue virus
AIAQTEKG

SEQ ID NO: 31158 - protein, 8 aa, Dengue virus
IAQTEKGI

SEQ ID NO: 31159 - protein, 8 aa, Dengue virus
AQTEKGIE

SEQ ID NO: 31160 - protein, 8 aa, Dengue virus
IENNPEIE

SEQ ID NO: 31161 - protein, 8 aa, Dengue virus
DNPEIEDH

SEQ ID NO: 31162 - protein, 8 aa, Dengue virus
DHIFRKRR

SEQ ID NO: 31163 - protein, 8 aa, Dengue virus
YQTTAIKT

SEQ ID NO: 31164 - protein, 8 aa, Dengue virus
QTTAIKTE

SEQ ID NO: 31165 - protein, 8 aa, Dengue virus
TTAIKTEH

SEQ ID NO: 31166 - protein, 8 aa, Dengue virus
TAIKTEHT

SEQ ID NO: 31167 - protein, 8 aa, Dengue virus
WNTGHEWV

SEQ ID NO: 31168 - protein, 8 aa, Dengue virus
NTGHEWVT

SEQ ID NO: 31169 - protein, 8 aa, Dengue virus
HEWITNFE

SEQ ID NO: 31170 - protein, 8 aa, Dengue virus
EWITDFKG

SEQ ID NO: 31171 - protein, 8 aa, Dengue virus
WITNFEGK

SEQ ID NO: 31172 - protein, 8 aa, Dengue virus
ITDFKGKT

SEQ ID NO: 31173 - protein, 8 aa, Dengue virus
KTFDTEYT

SEQ ID NO: 31174 - protein, 8 aa, Dengue virus
TFDTEYTK

SEQ ID NO: 31175 - protein, 8 aa, Dengue virus
FDSEYAKT

SEQ ID NO: 31176 - protein, 8 aa, Dengue virus
DTEYTKTR

SEQ ID NO: 31177 - protein, 8 aa, Dengue virus
WLAFKVAA

SEQ ID NO: 31178 - protein, 8 aa, Dengue virus
LAFKVAAE

SEQ ID NO: 31179 - protein, 8 aa, Dengue virus
AFKVAAEG

SEQ ID NO: 31180 - protein, 8 aa, Dengue virus
FKVAAEGI

SEQ ID NO: 31181 - protein, 8 aa, Dengue virus
KVASEGIS

SEQ ID NO: 31182 - protein, 8 aa, Dengue virus
ASEGISYA

SEQ ID NO: 31183 - protein, 8 aa, Dengue virus
SEGISYAD

SEQ ID NO: 31184 - protein, 8 aa, Dengue virus
GISYADRK

SEQ ID NO: 31185 - protein, 8 aa, Dengue virus
ISYADRKW

SEQ ID NO: 31186 - protein, 8 aa, Dengue virus
SYADRKWC

SEQ ID NO: 31187 - protein, 8 aa, Dengue virus
RRWCFDGT

SEQ ID NO: 31188 - protein, 8 aa, Dengue virus
RWCFDGTR

SEQ ID NO: 31189 - protein, 8 aa, Dengue virus
WCFDGTRN

SEQ ID NO: 31190 - protein, 8 aa, Dengue virus
CFDGTRNN

SEQ ID NO: 31191 - protein, 8 aa, Dengue virus
FDGTRNNQ

SEQ ID NO: 31192 - protein, 8 aa, Dengue virus
DGTRNNQI

SEQ ID NO: 31193 - protein, 8 aa, Dengue virus
GTRNNQIL

SEQ ID NO: 31194 - protein, 8 aa, Dengue virus
TRNNQILE

SEQ ID NO: 31195 - protein, 8 aa, Dengue virus
NIEVEIWT

SEQ ID NO: 31196 - protein, 8 aa, Dengue virus
IEVEIWTK

SEQ ID NO: 31197 - protein, 8 aa, Dengue virus
HTAEVGGK

SEQ ID NO: 31198 - protein, 8 aa, Dengue virus
TAEVGGKA

SEQ ID NO: 31199 - protein, 8 aa, Dengue virus
AEVGGKAY

SEQ ID NO: 31200 - protein, 8 aa, Dengue virus
RAHNHALS

SEQ ID NO: 31201 - protein, 8 aa, Dengue virus
FLMSGRGV

SEQ ID NO: 31202 - protein, 8 aa, Dengue virus
LMSGRGVG

SEQ ID NO: 31203 - protein, 8 aa, Dengue virus
MSGRGVGK

SEQ ID NO: 31204 - protein, 8 aa, Dengue virus
SGRGVGKM

SEQ ID NO: 31205 - protein, 8 aa, Dengue virus
GRGVGKMT

SEQ ID NO: 31206 - protein, 8 aa, Dengue virus
RGVGKMTL

SEQ ID NO: 31207 - protein, 8 aa, Dengue virus
TASILLWH

SEQ ID NO: 31208 - protein, 8 aa, Dengue virus
ASILLWHA

SEQ ID NO: 31209 - protein, 8 aa, Dengue virus
QPEINILD

SEQ ID NO: 31210 - protein, 8 aa, Dengue virus
HESNILDI

SEQ ID NO: 31211 - protein, 8 aa, Dengue virus
TAALLSLV

SEQ ID NO: 31212 - protein, 8 aa, Dengue virus
AALLSLVA

SEQ ID NO: 31213 - protein, 8 aa, Dengue virus
ALLSLVAH

SEQ ID NO: 31214 - protein, 8 aa, Dengue virus
LLMAHYAI

SEQ ID NO: 31215 - protein, 8 aa, Dengue virus
SIMRNTTS

SEQ ID NO: 31216 - protein, 8 aa, Dengue virus
RRGTGNVG

SEQ ID NO: 31217 - protein, 8 aa, Dengue virus
RGTGNVGE

SEQ ID NO: 31218 - protein, 8 aa, Dengue virus
GTGNVGET

SEQ ID NO: 31219 - protein, 8 aa, Dengue virus
TGNVGETL

SEQ ID NO: 31220 - protein, 8 aa, Dengue virus
GNVGETLG

SEQ ID NO: 31221 - protein, 8 aa, Dengue virus
NVGETLGE

SEQ ID NO: 31222 - protein, 8 aa, Dengue virus
VGETLGEK

SEQ ID NO: 31223 - protein, 8 aa, Dengue virus
KWKNRLNS

SEQ ID NO: 31224 - protein, 8 aa, Dengue virus
WKNRLNSL

SEQ ID NO: 31225 - protein, 8 aa, Dengue virus
KNRLNSLG

SEQ ID NO: 31226 - protein, 8 aa, Dengue virus
RLNSLGKS

SEQ ID NO: 31227 - protein, 8 aa, Dengue virus
LNSLGKSE

SEQ ID NO: 31228 - protein, 8 aa, Dengue virus
NSLGKSEF

SEQ ID NO: 31229 - protein, 8 aa, Dengue virus
SLGKSEFQ

SEQ ID NO: 31230 - protein, 8 aa, Dengue virus
LGKNEFQI

SEQ ID NO: 31231 - protein, 8 aa, Dengue virus
GKNEFQIY

SEQ ID NO: 31232 - protein, 8 aa, Dengue virus
KNEFQIYK

SEQ ID NO: 31233 - protein, 8 aa, Dengue virus
NEFQIYKK

SEQ ID NO: 31234 - protein, 8 aa, Dengue virus
CGGLKSVR

SEQ ID NO: 31235 - protein, 8 aa, Dengue virus
GGLKSVRE

SEQ ID NO: 31236 - protein, 8 aa, Dengue virus
GLKSVREV

SEQ ID NO: 31237 - protein, 8 aa, Dengue virus
LKSVREVK

SEQ ID NO: 31238 - protein, 8 aa, Dengue virus
KSVREVKG

SEQ ID NO: 31239 - protein, 8 aa, Dengue virus
SGIDVFFT

SEQ ID NO: 31240 - protein, 8 aa, Dengue virus
GIDVFFTP

SEQ ID NO: 31241 - protein, 8 aa, Dengue virus
IDVFFTPP

SEQ ID NO: 31242 - protein, 8 aa, Dengue virus
VFFTPPER

SEQ ID NO: 31243 - protein, 8 aa, Dengue virus
FFTPPERC

SEQ ID NO: 31244 - protein, 8 aa, Dengue virus
FTPPERCD

SEQ ID NO: 31245 - protein, 8 aa, Dengue virus
TPPERCDT

SEQ ID NO: 31246 - protein, 8 aa, Dengue virus
VENWLKNN

SEQ ID NO: 31247 - protein, 8 aa, Dengue virus
ENWLNNNI

SEQ ID NO: 31248 - protein, 8 aa, Dengue virus
NWLKNNTQ

SEQ ID NO: 31249 - protein, 8 aa, Dengue virus
WLNNNTKF

SEQ ID NO: 31250 - protein, 8 aa, Dengue virus
LKNNTQFC

SEQ ID NO: 31251 - protein, 8 aa, Dengue virus
GSNTQFCV

SEQ ID NO: 31252 - protein, 8 aa, Dengue virus
SNTQFCVK

SEQ ID NO: 31253 - protein, 8 aa, Dengue virus
SVIERMEA

SEQ ID NO: 31254 - protein, 8 aa, Dengue virus
VIERMEAL

SEQ ID NO: 31255 - protein, 8 aa, Dengue virus
IERMEALQ

SEQ ID NO: 31256 - protein, 8 aa, Dengue virus
ERMEALQR

SEQ ID NO: 31257 - protein, 8 aa, Dengue virus
MQRKYGGA

SEQ ID NO: 31258 - protein, 8 aa, Dengue virus
TRNIGTES

SEQ ID NO: 31259 - protein, 8 aa, Dengue virus
RNIGTESE

SEQ ID NO: 31260 - protein, 8 aa, Dengue virus
ETPNMDII

SEQ ID NO: 31261 - protein, 8 aa, Dengue virus
TPNMDIIG

SEQ ID NO: 31262 - protein, 8 aa, Dengue virus
KIKQEHEA

SEQ ID NO: 31263 - protein, 8 aa, Dengue virus
IKQEHEAS

SEQ ID NO: 31264 - protein, 8 aa, Dengue virus
KQEHEASW

SEQ ID NO: 31265 - protein, 8 aa, Dengue virus
QEHEASWH

SEQ ID NO: 31266 - protein, 8 aa, Dengue virus
KPWDVLPM

SEQ ID NO: 31267 - protein, 8 aa, Dengue virus
PWDVLPMV

SEQ ID NO: 31268 - protein, 8 aa, Dengue virus
WDVLPMVT

SEQ ID NO: 31269 - protein, 8 aa, Dengue virus
DVLPMVTQ

SEQ ID NO: 31270 - protein, 8 aa, Dengue virus
VLPMVTQM

SEQ ID NO: 31271 - protein, 8 aa, Dengue virus
LPMVTQMA

SEQ ID NO: 31272 - protein, 8 aa, Dengue virus
KLMRITAK

SEQ ID NO: 31273 - protein, 8 aa, Dengue virus
ITAKWLWG

SEQ ID NO: 31274 - protein, 8 aa, Dengue virus
TAKWLWGE

SEQ ID NO: 31275 - protein, 8 aa, Dengue virus
AKWLWGEL

SEQ ID NO: 31276 - protein, 8 aa, Dengue virus
KWLWGELG

SEQ ID NO: 31277 - protein, 8 aa, Dengue virus
KELGKKKI

SEQ ID NO: 31278 - protein, 8 aa, Dengue virus
ELGKKKIP

SEQ ID NO: 31279 - protein, 8 aa, Dengue virus
LGRKKTPR

SEQ ID NO: 31280 - protein, 8 aa, Dengue virus
KTPRVCTR

SEQ ID NO: 31281 - protein, 8 aa, Dengue virus
IPRMCTRE

SEQ ID NO: 31282 - protein, 8 aa, Dengue virus
PRVCTREE

SEQ ID NO: 31283 - protein, 8 aa, Dengue virus
MCTREEFA

SEQ ID NO: 31284 - protein, 8 aa, Dengue virus
CTREEFAR

SEQ ID NO: 31285 - protein, 8 aa, Dengue virus
AREAVEDN

SEQ ID NO: 31286 - protein, 8 aa, Dengue virus
REAVEDNR

SEQ ID NO: 31287 - protein, 8 aa, Dengue virus
EAVEDERF

SEQ ID NO: 31288 - protein, 8 aa, Dengue virus
AVEDNRFW

SEQ ID NO: 31289 - protein, 8 aa, Dengue virus
VEDNRFWE

SEQ ID NO: 31290 - protein, 8 aa, Dengue virus
EDERFWEL

SEQ ID NO: 31291 - protein, 8 aa, Dengue virus
FWELVEKE

SEQ ID NO: 31292 - protein, 8 aa, Dengue virus
WELVEKER

SEQ ID NO: 31293 - protein, 8 aa, Dengue virus
ELVEKERN

SEQ ID NO: 31294 - protein, 8 aa, Dengue virus
LVEKERNL

SEQ ID NO: 31295 - protein, 8 aa, Dengue virus
VEKERNLH

SEQ ID NO: 31296 - protein, 8 aa, Dengue virus
ERERNLHL

SEQ ID NO: 31297 - protein, 8 aa, Dengue virus
RERNLHLD

SEQ ID NO: 31298 - protein, 8 aa, Dengue virus
KLGYILRE

SEQ ID NO: 31299 - protein, 8 aa, Dengue virus
GYILREVS

SEQ ID NO: 31300 - protein, 8 aa, Dengue virus
YILREVSK

SEQ ID NO: 31301 - protein, 8 aa, Dengue virus
ILREVSKK

SEQ ID NO: 31302 - protein, 8 aa, Dengue virus
EVSKKEGG

SEQ ID NO: 31303 - protein, 8 aa, Dengue virus
ISKKAGGA

SEQ ID NO: 31304 - protein, 8 aa, Dengue virus
SKKAGGAM

SEQ ID NO: 31305 - protein, 8 aa, Dengue virus
KNEEMITG

SEQ ID NO: 31306 - protein, 8 aa, Dengue virus
NEEMITGQ

SEQ ID NO: 31307 - protein, 8 aa, Dengue virus
EEMITGQM

SEQ ID NO: 31308 - protein, 8 aa, Dengue virus
REGRERLS

SEQ ID NO: 31309 - protein, 8 aa, Dengue virus
EGRERLSR

SEQ ID NO: 31310 - protein, 8 aa, Dengue virus
DDRFAKAL

SEQ ID NO: 31311 - protein, 8 aa, Dengue virus
DRFAKALT

SEQ ID NO: 31312 - protein, 8 aa, Dengue virus
RFAKALTA

SEQ ID NO: 31313 - protein, 8 aa, Dengue virus
FAKALTAL

SEQ ID NO: 31314 - protein, 8 aa, Dengue virus
AKALTALN

SEQ ID NO: 31315 - protein, 8 aa, Dengue virus
KALTALND

SEQ ID NO: 31316 - protein, 8 aa, Dengue virus
MKDGRKLV

SEQ ID NO: 31317 - protein, 8 aa, Dengue virus
KDGRKLVV

SEQ ID NO: 31318 - protein, 8 aa, Dengue virus
DGRKLVVP

SEQ ID NO: 31319 - protein, 8 aa, Dengue virus
GRKLVVPC

SEQ ID NO: 31320 - protein, 8 aa, Dengue virus
RKLVVPCR

SEQ ID NO: 31321 - protein, 8 aa, Dengue virus
TTWSIHAR

SEQ ID NO: 31322 - protein, 8 aa, Dengue virus
TWSIHARH

SEQ ID NO: 31323 - protein, 8 aa, Dengue virus
WSIHARHE

SEQ ID NO: 31324 - protein, 8 aa, Dengue virus
SIHARHEW

SEQ ID NO: 31325 - protein, 8 aa, Dengue virus
IHARHEWM

SEQ ID NO: 31326 - protein, 8 aa, Dengue virus
HARHEWMT

SEQ ID NO: 31327 - protein, 8 aa, Dengue virus
ARHEWMTT

SEQ ID NO: 31328 - protein, 8 aa, Dengue virus
RHEWMTTE

SEQ ID NO: 31329 - protein, 8 aa, Dengue virus
VWNKVWIR

SEQ ID NO: 31330 - protein, 8 aa, Dengue virus
WNRVWIQD

SEQ ID NO: 31331 - protein, 8 aa, Dengue virus
NRVWIQDN

SEQ ID NO: 31332 - protein, 8 aa, Dengue virus
RVWIQDNP

SEQ ID NO: 31333 - protein, 8 aa, Dengue virus
VWIQDNPW

SEQ ID NO: 31334 - protein, 8 aa, Dengue virus
WIQENPWI

SEQ ID NO: 31335 - protein, 8 aa, Dengue virus
IQENPWIE

SEQ ID NO: 31336 - protein, 8 aa, Dengue virus
QENPWIED

SEQ ID NO: 31337 - protein, 8 aa, Dengue virus
PVETWEEI

SEQ ID NO: 31338 - protein, 8 aa, Dengue virus
RNIQTAIN

SEQ ID NO: 31339 - protein, 8 aa, Dengue virus
TAINQVRA

SEQ ID NO: 31340 - protein, 8 aa, Dengue virus
QVRSLIGS

SEQ ID NO: 31341 - protein, 8 aa, Dengue virus
VRSLIGSE

SEQ ID NO: 31342 - protein, 8 aa, Dengue virus
RSLIGSEE

SEQ ID NO: 31343 - protein, 8 aa, Dengue virus
SLIGSEEY

SEQ ID NO: 31344 - protein, 8 aa, Dengue virus
DQRKKARN

SEQ ID NO: 31345 - protein, 8 aa, Dengue virus
LNRRRRTV

SEQ ID NO: 31346 - protein, 8 aa, Dengue virus
NRRRRTVG

SEQ ID NO: 31347 - protein, 8 aa, Dengue virus
EPHMIVSK

SEQ ID NO: 31348 - protein, 8 aa, Dengue virus
PHMIVSKN

SEQ ID NO: 31349 - protein, 8 aa, Dengue virus
HMIVSKNE

SEQ ID NO: 31350 - protein, 8 aa, Dengue virus
MIVSKNEK

SEQ ID NO: 31351 - protein, 8 aa, Dengue virus
IVSKNEKG

SEQ ID NO: 31352 - protein, 8 aa, Dengue virus
VSKNEKGK

SEQ ID NO: 31353 - protein, 8 aa, Dengue virus
SKNEKGKS

SEQ ID NO: 31354 - protein, 8 aa, Dengue virus
VGVNMCTL

SEQ ID NO: 31355 - protein, 8 aa, Dengue virus
TYKCPFLR

SEQ ID NO: 31356 - protein, 8 aa, Dengue virus
YKCPFLRQ

SEQ ID NO: 31357 - protein, 8 aa, Dengue virus
NCPLLKQN

SEQ ID NO: 31358 - protein, 8 aa, Dengue virus
LRHPGFTT

SEQ ID NO: 31359 - protein, 8 aa, Dengue virus
RHPGFTTM

SEQ ID NO: 31360 - protein, 8 aa, Dengue virus
HPGFTTMA

SEQ ID NO: 31361 - protein, 8 aa, Dengue virus
PGFTTMAA

SEQ ID NO: 31362 - protein, 8 aa, Dengue virus
GTTHFQKA

SEQ ID NO: 31363 - protein, 8 aa, Dengue virus
TTHFQKAL

SEQ ID NO: 31364 - protein, 8 aa, Dengue virus
THFQKALI

SEQ ID NO: 31365 - protein, 8 aa, Dengue virus
HFQKALIF

SEQ ID NO: 31366 - protein, 8 aa, Dengue virus
TAIAPSMA

SEQ ID NO: 31367 - protein, 8 aa, Dengue virus
TQGEPSLV

SEQ ID NO: 31368 - protein, 8 aa, Dengue virus
QGEPSLVE

SEQ ID NO: 31369 - protein, 8 aa, Dengue virus
GEPSLVEE

SEQ ID NO: 31370 - protein, 8 aa, Dengue virus
EPSLSEEQ

SEQ ID NO: 31371 - protein, 8 aa, Dengue virus
PSLVEEQD

SEQ ID NO: 31372 - protein, 8 aa, Dengue virus
SLVEEQDK

SEQ ID NO: 31373 - protein, 8 aa, Dengue virus
KMEGKVVQ

SEQ ID NO: 31374 - protein, 8 aa, Dengue virus
KHGMEIKV

SEQ ID NO: 31375 - protein, 8 aa, Dengue virus
HGMEIKVT

SEQ ID NO: 31376 - protein, 8 aa, Dengue virus
GMEIKVTP

SEQ ID NO: 31377 - protein, 8 aa, Dengue virus
MEIKVTPQ

SEQ ID NO: 31378 - protein, 8 aa, Dengue virus
MGNKAWLV

SEQ ID NO: 31379 - protein, 8 aa, Dengue virus
GNKAWLVH

SEQ ID NO: 31380 - protein, 8 aa, Dengue virus
LPGADIQG

SEQ ID NO: 31381 - protein, 8 aa, Dengue virus
PGADIQGS

SEQ ID NO: 31382 - protein, 8 aa, Dengue virus
GADIQGSN

SEQ ID NO: 31383 - protein, 8 aa, Dengue virus
ADIQGSNW

SEQ ID NO: 31384 - protein, 8 aa, Dengue virus
DIQGSNWI

SEQ ID NO: 31385 - protein, 8 aa, Dengue virus
IQGSNWIQ

SEQ ID NO: 31386 - protein, 8 aa, Dengue virus
GEGAPCKI

SEQ ID NO: 31387 - protein, 8 aa, Dengue virus
EDSPCKIP

SEQ ID NO: 31388 - protein, 8 aa, Dengue virus
IMDLERRY

SEQ ID NO: 31389 - protein, 8 aa, Dengue virus
DLEKRYIL

SEQ ID NO: 31390 - protein, 8 aa, Dengue virus
LEKRYILG

SEQ ID NO: 31391 - protein, 8 aa, Dengue virus
EKRYILGR

SEQ ID NO: 31392 - protein, 8 aa, Dengue virus
KRYILGRL

SEQ ID NO: 31393 - protein, 8 aa, Dengue virus
ITVNPIAT

SEQ ID NO: 31394 - protein, 8 aa, Dengue virus
LGGVFTSM

SEQ ID NO: 31395 - protein, 8 aa, Dengue virus
TLVIVGIV

SEQ ID NO: 31396 - protein, 8 aa, Dengue virus
VVILYLGA

SEQ ID NO: 31397 - protein, 8 aa, Dengue virus
QKAYEEGI

SEQ ID NO: 31398 - protein, 8 aa, Dengue virus
LTENEVKL

SEQ ID NO: 31399 - protein, 8 aa, Dengue virus
TENEVKLT

SEQ ID NO: 31400 - protein, 8 aa, Dengue virus
GDIKGIMH

SEQ ID NO: 31401 - protein, 8 aa, Dengue virus
IKGIMHAG

SEQ ID NO: 31402 - protein, 8 aa, Dengue virus
KGIMHAGK

SEQ ID NO: 31403 - protein, 8 aa, Dengue virus
IMHAGKRS

SEQ ID NO: 31404 - protein, 8 aa, Dengue virus
GRRSLRPQ

SEQ ID NO: 31405 - protein, 8 aa, Dengue virus
RRSLRPQP

SEQ ID NO: 31406 - protein, 8 aa, Dengue virus
SLRPQPTQ

SEQ ID NO: 31407 - protein, 8 aa, Dengue virus
KAKMLSTG

SEQ ID NO: 31408 - protein, 8 aa, Dengue virus
HNRTFLID

SEQ ID NO: 31409 - protein, 8 aa, Dengue virus
KTAECPNT

SEQ ID NO: 31410 - protein, 8 aa, Dengue virus
TAECPNAN

SEQ ID NO: 31411 - protein, 8 aa, Dengue virus
TECPSSNR

SEQ ID NO: 31412 - protein, 8 aa, Dengue virus
IWLRLKEK

SEQ ID NO: 31413 - protein, 8 aa, Dengue virus
WLRLKEKQ

SEQ ID NO: 31414 - protein, 8 aa, Dengue virus
LRLKEKQD

SEQ ID NO: 31415 - protein, 8 aa, Dengue virus
VKSCHWPR

SEQ ID NO: 31416 - protein, 8 aa, Dengue virus
NIAGPVSQ

SEQ ID NO: 31417 - protein, 8 aa, Dengue virus
HNNRPGYY

SEQ ID NO: 31418 - protein, 8 aa, Dengue virus
NYRLGYHT

SEQ ID NO: 31419 - protein, 8 aa, Dengue virus
YRLGYHTQ

SEQ ID NO: 31420 - protein, 8 aa, Dengue virus
KLEMDFNF

SEQ ID NO: 31421 - protein, 8 aa, Dengue virus
EMDFNFCD

SEQ ID NO: 31422 - protein, 8 aa, Dengue virus
MDFNFCDG

SEQ ID NO: 31423 - protein, 8 aa, Dengue virus
DFNFCEGT

SEQ ID NO: 31424 - protein, 8 aa, Dengue virus
FNFCEGTT

SEQ ID NO: 31425 - protein, 8 aa, Dengue virus
NFCEGTTV

SEQ ID NO: 31426 - protein, 8 aa, Dengue virus
FKDLGRVM

SEQ ID NO: 31427 - protein, 8 aa, Dengue virus
MADDIGTG

SEQ ID NO: 31428 - protein, 8 aa, Dengue virus
TDDIGIGV

SEQ ID NO: 31429 - protein, 8 aa, Dengue virus
TIGVALLS

SEQ ID NO: 31430 - protein, 8 aa, Dengue virus
IGVALLSQ

SEQ ID NO: 31431 - protein, 8 aa, Dengue virus
GVALLSQS

SEQ ID NO: 31432 - protein, 8 aa, Dengue virus
PENILELT

SEQ ID NO: 31433 - protein, 8 aa, Dengue virus
ENILELTD

SEQ ID NO: 31434 - protein, 8 aa, Dengue virus
VKNMEKYQ

SEQ ID NO: 31435 - protein, 8 aa, Dengue virus
KNMEKYQL

SEQ ID NO: 31436 - protein, 8 aa, Dengue virus
NLEKYQLA

SEQ ID NO: 31437 - protein, 8 aa, Dengue virus
MVISCVPN

SEQ ID NO: 31438 - protein, 8 aa, Dengue virus
VISCVPNA

SEQ ID NO: 31439 - protein, 8 aa, Dengue virus
VPNAVVLQ

SEQ ID NO: 31440 - protein, 8 aa, Dengue virus
PNAVVLQN

SEQ ID NO: 31441 - protein, 8 aa, Dengue virus
NAVVLQNA

SEQ ID NO: 31442 - protein, 8 aa, Dengue virus
AVVLQNAW

SEQ ID NO: 31443 - protein, 8 aa, Dengue virus
VLQNAWKV

SEQ ID NO: 31444 - protein, 8 aa, Dengue virus
QNAWKVGC

SEQ ID NO: 31445 - protein, 8 aa, Dengue virus
ILAAVSVF

SEQ ID NO: 31446 - protein, 8 aa, Dengue virus
TLTRTSKK

SEQ ID NO: 31447 - protein, 8 aa, Dengue virus
LTRTSKKR

SEQ ID NO: 31448 - protein, 8 aa, Dengue virus
TRTSKKRS

SEQ ID NO: 31449 - protein, 8 aa, Dengue virus
LELERAAE

SEQ ID NO: 31450 - protein, 8 aa, Dengue virus
ELERAAEV

SEQ ID NO: 31451 - protein, 8 aa, Dengue virus
VKWEEQAE

SEQ ID NO: 31452 - protein, 8 aa, Dengue virus
KWEEQAEI

SEQ ID NO: 31453 - protein, 8 aa, Dengue virus
VFPVSIPV

SEQ ID NO: 31454 - protein, 8 aa, Dengue virus
VPSPPPME

SEQ ID NO: 31455 - protein, 8 aa, Dengue virus
KQRGFLGY

SEQ ID NO: 31456 - protein, 8 aa, Dengue virus
QKRILGYS

SEQ ID NO: 31457 - protein, 8 aa, Dengue virus
KRILGYSQ

SEQ ID NO: 31458 - protein, 8 aa, Dengue virus
KPGFFKTN

SEQ ID NO: 31459 - protein, 8 aa, Dengue virus
FRTNAGTI

SEQ ID NO: 31460 - protein, 8 aa, Dengue virus
RTNAGTIG

SEQ ID NO: 31461 - protein, 8 aa, Dengue virus
IAQTETSV

SEQ ID NO: 31462 - protein, 8 aa, Dengue virus
AQTETSVE

SEQ ID NO: 31463 - protein, 8 aa, Dengue virus
HEWITDFK

SEQ ID NO: 31464 - protein, 8 aa, Dengue virus
KTFDTEYI

SEQ ID NO: 31465 - protein, 8 aa, Dengue virus
TFDTEYIK

SEQ ID NO: 31466 - protein, 8 aa, Dengue virus
FDTEYIKT

SEQ ID NO: 31467 - protein, 8 aa, Dengue virus
DTEYIKTR

SEQ ID NO: 31468 - protein, 8 aa, Dengue virus
KWCFDGIR

SEQ ID NO: 31469 - protein, 8 aa, Dengue virus
HSAEMGGR

SEQ ID NO: 31470 - protein, 8 aa, Dengue virus
SAEMGGRA

SEQ ID NO: 31471 - protein, 8 aa, Dengue virus
AEMGGRAY

SEQ ID NO: 31472 - protein, 8 aa, Dengue virus
FLMSARGI

SEQ ID NO: 31473 - protein, 8 aa, Dengue virus
LMSARGIG

SEQ ID NO: 31474 - protein, 8 aa, Dengue virus
MSARGIGK

SEQ ID NO: 31475 - protein, 8 aa, Dengue virus
SARGIGKM

SEQ ID NO: 31476 - protein, 8 aa, Dengue virus
ARGIGKMT

SEQ ID NO: 31477 - protein, 8 aa, Dengue virus
TASSLLWY

SEQ ID NO: 31478 - protein, 8 aa, Dengue virus
ASSLLWYA

SEQ ID NO: 31479 - protein, 8 aa, Dengue virus
QHESNILD

SEQ ID NO: 31480 - protein, 8 aa, Dengue virus
TAALLLLM

SEQ ID NO: 31481 - protein, 8 aa, Dengue virus
AALLMLVA

SEQ ID NO: 31482 - protein, 8 aa, Dengue virus
ALLMLVAH

SEQ ID NO: 31483 - protein, 8 aa, Dengue virus
SIMKNTIN

SEQ ID NO: 31484 - protein, 8 aa, Dengue virus
RRGTGTIG

SEQ ID NO: 31485 - protein, 8 aa, Dengue virus
RGTGTIGE

SEQ ID NO: 31486 - protein, 8 aa, Dengue virus
GTGTIGET

SEQ ID NO: 31487 - protein, 8 aa, Dengue virus
TGTIGETL

SEQ ID NO: 31488 - protein, 8 aa, Dengue virus
GTIGETLG

SEQ ID NO: 31489 - protein, 8 aa, Dengue virus
TIGETLGE

SEQ ID NO: 31490 - protein, 8 aa, Dengue virus
WKSQLNAL

SEQ ID NO: 31491 - protein, 8 aa, Dengue virus
KSQLNALG

SEQ ID NO: 31492 - protein, 8 aa, Dengue virus
RLNTLGKS

SEQ ID NO: 31493 - protein, 8 aa, Dengue virus
NTLGKSEF

SEQ ID NO: 31494 - protein, 8 aa, Dengue virus
TLGKSEFQ

SEQ ID NO: 31495 - protein, 8 aa, Dengue virus
NWLNNNIQ

SEQ ID NO: 31496 - protein, 8 aa, Dengue virus
KNNTQFCI

SEQ ID NO: 31497 - protein, 8 aa, Dengue virus
EKPNLDII

SEQ ID NO: 31498 - protein, 8 aa, Dengue virus
KPNLDIIG

SEQ ID NO: 31499 - protein, 8 aa, Dengue virus
KELGRKKT

SEQ ID NO: 31500 - protein, 8 aa, Dengue virus
ELGRKKTP

SEQ ID NO: 31501 - protein, 8 aa, Dengue virus
LGKKKIPR

SEQ ID NO: 31502 - protein, 8 aa, Dengue virus
TPRVCTRE

SEQ ID NO: 31503 - protein, 8 aa, Dengue virus
VCTREEFT

SEQ ID NO: 31504 - protein, 8 aa, Dengue virus
REAVEDER

SEQ ID NO: 31505 - protein, 8 aa, Dengue virus
EAVEDNRF

SEQ ID NO: 31506 - protein, 8 aa, Dengue virus
AVEDERFW

SEQ ID NO: 31507 - protein, 8 aa, Dengue virus
VEDERFWE

SEQ ID NO: 31508 - protein, 8 aa, Dengue virus
EDNRFWEL

SEQ ID NO: 31509 - protein, 8 aa, Dengue virus
FWELVERE

SEQ ID NO: 31510 - protein, 8 aa, Dengue virus
WELVERER

SEQ ID NO: 31511 - protein, 8 aa, Dengue virus
ELVERERN

SEQ ID NO: 31512 - protein, 8 aa, Dengue virus
LVERERNL

SEQ ID NO: 31513 - protein, 8 aa, Dengue virus
VERERNLH

SEQ ID NO: 31514 - protein, 8 aa, Dengue virus
GYILRDIS

SEQ ID NO: 31515 - protein, 8 aa, Dengue virus
YILRDISR

SEQ ID NO: 31516 - protein, 8 aa, Dengue virus
ILRDISRK

SEQ ID NO: 31517 - protein, 8 aa, Dengue virus
DISRKAGG

SEQ ID NO: 31518 - protein, 8 aa, Dengue virus
SKKEGGTM

SEQ ID NO: 31519 - protein, 8 aa, Dengue virus
MKDGRMLV

SEQ ID NO: 31520 - protein, 8 aa, Dengue virus
KDGRMLVV

SEQ ID NO: 31521 - protein, 8 aa, Dengue virus
DGRMLVVP

SEQ ID NO: 31522 - protein, 8 aa, Dengue virus
GRMLVVPC

SEQ ID NO: 31523 - protein, 8 aa, Dengue virus
RMLVVPCR

SEQ ID NO: 31524 - protein, 8 aa, Dengue virus
WNKVWIRE

SEQ ID NO: 31525 - protein, 8 aa, Dengue virus
NKVWIREN

SEQ ID NO: 31526 - protein, 8 aa, Dengue virus
KVWIRENP

SEQ ID NO: 31527 - protein, 8 aa, Dengue virus
WIQDNPWM

SEQ ID NO: 31528 - protein, 8 aa, Dengue virus
IQDNPWME

SEQ ID NO: 31529 - protein, 8 aa, Dengue virus
QDNPWMED

SEQ ID NO: 31530 - protein, 8 aa, Dengue virus
RSLIGNEG

SEQ ID NO: 31531 - protein, 9 aa, Dengue virus
MNNQRKKAR

SEQ ID NO: 31532 - protein, 9 aa, Dengue virus
NNQRKKARS

SEQ ID NO: 31533 - protein, 9 aa, Dengue virus
STPFNMLKR

SEQ ID NO: 31534 - protein, 9 aa, Dengue virus
TPFNMLKRE

SEQ ID NO: 31535 - protein, 9 aa, Dengue virus
PFNMLKRER

SEQ ID NO: 31536 - protein, 9 aa, Dengue virus
FNMLKRERN

SEQ ID NO: 31537 - protein, 9 aa, Dengue virus
NMLKRERNR

SEQ ID NO: 31538 - protein, 9 aa, Dengue virus
MLKRERNRV

SEQ ID NO: 31539 - protein, 9 aa, Dengue virus
LKRERNRVS

SEQ ID NO: 31540 - protein, 9 aa, Dengue virus
KRERNRVST

SEQ ID NO: 31541 - protein, 9 aa, Dengue virus
RERNRVSTV

SEQ ID NO: 31542 - protein, 9 aa, Dengue virus
ERNRVSTVQ

SEQ ID NO: 31543 - protein, 9 aa, Dengue virus
RNRVSTVQQ

SEQ ID NO: 31544 - protein, 9 aa, Dengue virus
NRVSTVQQL

SEQ ID NO: 31545 - protein, 9 aa, Dengue virus
RVSTVQQLT

SEQ ID NO: 31546 - protein, 9 aa, Dengue virus
VSTVQQLTK

SEQ ID NO: 31547 - protein, 9 aa, Dengue virus
STVQQLTKR

SEQ ID NO: 31548 - protein, 9 aa, Dengue virus
TVQQLTKRF

SEQ ID NO: 31549 - protein, 9 aa, Dengue virus
VQQLTKRFS

SEQ ID NO: 31550 - protein, 9 aa, Dengue virus
QQLTKRFSL

SEQ ID NO: 31551 - protein, 9 aa, Dengue virus
QLTKRFSLG

SEQ ID NO: 31552 - protein, 9 aa, Dengue virus
LTKRFSLGM

SEQ ID NO: 31553 - protein, 9 aa, Dengue virus
TKRFSLGML

SEQ ID NO: 31554 - protein, 9 aa, Dengue virus
KRFSLGMLQ

SEQ ID NO: 31555 - protein, 9 aa, Dengue virus
RFSLGMLQG

SEQ ID NO: 31556 - protein, 9 aa, Dengue virus
FSLGMLQGR

SEQ ID NO: 31557 - protein, 9 aa, Dengue virus
SLGMLQGRG

SEQ ID NO: 31558 - protein, 9 aa, Dengue virus
LGMLQGRGP

SEQ ID NO: 31559 - protein, 9 aa, Dengue virus
GMLQGRGPL

SEQ ID NO: 31560 - protein, 9 aa, Dengue virus
MLQGRGPLK

SEQ ID NO: 31561 - protein, 9 aa, Dengue virus
LQGRGPLKL

SEQ ID NO: 31562 - protein, 9 aa, Dengue virus
QGRGPLKLF

SEQ ID NO: 31563 - protein, 9 aa, Dengue virus
GRGPLKLFM

SEQ ID NO: 31564 - protein, 9 aa, Dengue virus
RGPLKLFMA

SEQ ID NO: 31565 - protein, 9 aa, Dengue virus
GPLKLFMAL

SEQ ID NO: 31566 - protein, 9 aa, Dengue virus
PLKLFMALV

SEQ ID NO: 31567 - protein, 9 aa, Dengue virus
LKLFMALVA

SEQ ID NO: 31568 - protein, 9 aa, Dengue virus
KLFMALVAF

SEQ ID NO: 31569 - protein, 9 aa, Dengue virus
LFMALVAFL

SEQ ID NO: 31570 - protein, 9 aa, Dengue virus
FMALVAFLR

SEQ ID NO: 31571 - protein, 9 aa, Dengue virus
MALVAFLRF

SEQ ID NO: 31572 - protein, 9 aa, Dengue virus
ALVAFLRFL

SEQ ID NO: 31573 - protein, 9 aa, Dengue virus
LVAFLRFLT

SEQ ID NO: 31574 - protein, 9 aa, Dengue virus
VAFLRFLTI

SEQ ID NO: 31575 - protein, 9 aa, Dengue virus
AFLRFLTIP

SEQ ID NO: 31576 - protein, 9 aa, Dengue virus
FLRFLTIPP

SEQ ID NO: 31577 - protein, 9 aa, Dengue virus
LRFLTIPPT

SEQ ID NO: 31578 - protein, 9 aa, Dengue virus
RFLTIPPTA

SEQ ID NO: 31579 - protein, 9 aa, Dengue virus
FLTIPPTAG

SEQ ID NO: 31580 - protein, 9 aa, Dengue virus
LTIPPTAGI

SEQ ID NO: 31581 - protein, 9 aa, Dengue virus
TIPPTAGIL

SEQ ID NO: 31582 - protein, 9 aa, Dengue virus
IPPTAGILK

SEQ ID NO: 31583 - protein, 9 aa, Dengue virus
PPTAGILKR

SEQ ID NO: 31584 - protein, 9 aa, Dengue virus
PTAGILKRW

SEQ ID NO: 31585 - protein, 9 aa, Dengue virus
TAGILKRWG

SEQ ID NO: 31586 - protein, 9 aa, Dengue virus
AGILKRWGT

SEQ ID NO: 31587 - protein, 9 aa, Dengue virus
GILKRWGTI

SEQ ID NO: 31588 - protein, 9 aa, Dengue virus
ILKRWGTIK

SEQ ID NO: 31589 - protein, 9 aa, Dengue virus
LKRWGTIKK

SEQ ID NO: 31590 - protein, 9 aa, Dengue virus
KRWGTIKKS

SEQ ID NO: 31591 - protein, 9 aa, Dengue virus
RWGTIKKSK

SEQ ID NO: 31592 - protein, 9 aa, Dengue virus
WGTIKKSKA

SEQ ID NO: 31593 - protein, 9 aa, Dengue virus
GTIKKSKAI

SEQ ID NO: 31594 - protein, 9 aa, Dengue virus
TIKKSKAIN

SEQ ID NO: 31595 - protein, 9 aa, Dengue virus
IKKSKAINV

SEQ ID NO: 31596 - protein, 9 aa, Dengue virus
KKSKAINVL

SEQ ID NO: 31597 - protein, 9 aa, Dengue virus
KSKAINVLR

SEQ ID NO: 31598 - protein, 9 aa, Dengue virus
SKAINVLRG

SEQ ID NO: 31599 - protein, 9 aa, Dengue virus
KAINVLRGF

SEQ ID NO: 31600 - protein, 9 aa, Dengue virus
AINVLRGFR

SEQ ID NO: 31601 - protein, 9 aa, Dengue virus
INVLRGFRK

SEQ ID NO: 31602 - protein, 9 aa, Dengue virus
NVLRGFRKE

SEQ ID NO: 31603 - protein, 9 aa, Dengue virus
VLRGFRKEI

SEQ ID NO: 31604 - protein, 9 aa, Dengue virus
LRGFRKEIG

SEQ ID NO: 31605 - protein, 9 aa, Dengue virus
RGFRKEIGR

SEQ ID NO: 31606 - protein, 9 aa, Dengue virus
GFRKEIGRM

SEQ ID NO: 31607 - protein, 9 aa, Dengue virus
FRKEIGRML

SEQ ID NO: 31608 - protein, 9 aa, Dengue virus
RKEIGRMLN

SEQ ID NO: 31609 - protein, 9 aa, Dengue virus
KEIGRMLNI

SEQ ID NO: 31610 - protein, 9 aa, Dengue virus
EIGRMLNIL

SEQ ID NO: 31611 - protein, 9 aa, Dengue virus
IGRMLNILN

SEQ ID NO: 31612 - protein, 9 aa, Dengue virus
GRMLNILNR

SEQ ID NO: 31613 - protein, 9 aa, Dengue virus
RMLNILNRR

SEQ ID NO: 31614 - protein, 9 aa, Dengue virus
MLNILNRRR

SEQ ID NO: 31615 - protein, 9 aa, Dengue virus
LNILNRRRR

SEQ ID NO: 31616 - protein, 9 aa, Dengue virus
NILNRRRRT

SEQ ID NO: 31617 - protein, 9 aa, Dengue virus
ILNRRRRTA

SEQ ID NO: 31618 - protein, 9 aa, Dengue virus
LNRRRRTAG

SEQ ID NO: 31619 - protein, 9 aa, Dengue virus
IPTAMAFHL

SEQ ID NO: 31620 - protein, 9 aa, Dengue virus
PTAMAFHLT

SEQ ID NO: 31621 - protein, 9 aa, Dengue virus
TAMAFHLTT

SEQ ID NO: 31622 - protein, 9 aa, Dengue virus
AMAFHLTTR

SEQ ID NO: 31623 - protein, 9 aa, Dengue virus
MAFHLTTRN

SEQ ID NO: 31624 - protein, 9 aa, Dengue virus
AFHLTTRNG

SEQ ID NO: 31625 - protein, 9 aa, Dengue virus
FHLTTRNGE

SEQ ID NO: 31626 - protein, 9 aa, Dengue virus
HLTTRNGEP

SEQ ID NO: 31627 - protein, 9 aa, Dengue virus
LTTRNGEPH

SEQ ID NO: 31628 - protein, 9 aa, Dengue virus
TTRNGEPHM

SEQ ID NO: 31629 - protein, 9 aa, Dengue virus
TRNGEPHMI

SEQ ID NO: 31630 - protein, 9 aa, Dengue virus
RNGEPHMIV

SEQ ID NO: 31631 - protein, 9 aa, Dengue virus
NGEPHMIVG

SEQ ID NO: 31632 - protein, 9 aa, Dengue virus
GEPHMIVGR

SEQ ID NO: 31633 - protein, 9 aa, Dengue virus
EPHMIVGRQ

SEQ ID NO: 31634 - protein, 9 aa, Dengue virus
PHMIVGRQE

SEQ ID NO: 31635 - protein, 9 aa, Dengue virus
HMIVGRQEK

SEQ ID NO: 31636 - protein, 9 aa, Dengue virus
MIVGRQEKG

SEQ ID NO: 31637 - protein, 9 aa, Dengue virus
IVGRQEKGK

SEQ ID NO: 31638 - protein, 9 aa, Dengue virus
VGRQEKGKS

SEQ ID NO: 31639 - protein, 9 aa, Dengue virus
GRQEKGKSL

SEQ ID NO: 31640 - protein, 9 aa, Dengue virus
RQEKGKSLL

SEQ ID NO: 31641 - protein, 9 aa, Dengue virus
QEKGKSLLF

SEQ ID NO: 31642 - protein, 9 aa, Dengue virus
EKGKSLLFK

SEQ ID NO: 31643 - protein, 9 aa, Dengue virus
KGKSLLFKT

SEQ ID NO: 31644 - protein, 9 aa, Dengue virus
GKSLLFKTE

SEQ ID NO: 31645 - protein, 9 aa, Dengue virus
KSLLFKTED

SEQ ID NO: 31646 - protein, 9 aa, Dengue virus
SLLFKTEDG

SEQ ID NO: 31647 - protein, 9 aa, Dengue virus
DGVNMCTLM

SEQ ID NO: 31648 - protein, 9 aa, Dengue virus
GVNMCTLMA

SEQ ID NO: 31649 - protein, 9 aa, Dengue virus
VNMCTLMAI

SEQ ID NO: 31650 - protein, 9 aa, Dengue virus
NMCTLMAID

SEQ ID NO: 31651 - protein, 9 aa, Dengue virus
MCTLMAIDL

SEQ ID NO: 31652 - protein, 9 aa, Dengue virus
CTLMAIDLG

SEQ ID NO: 31653 - protein, 9 aa, Dengue virus
TLMAIDLGE

SEQ ID NO: 31654 - protein, 9 aa, Dengue virus
LMAIDLGEL

SEQ ID NO: 31655 - protein, 9 aa, Dengue virus
MAIDLGELC

SEQ ID NO: 31656 - protein, 9 aa, Dengue virus
AIDLGELCE

SEQ ID NO: 31657 - protein, 9 aa, Dengue virus
IDLGELCED

SEQ ID NO: 31658 - protein, 9 aa, Dengue virus
DLGELCEDT

SEQ ID NO: 31659 - protein, 9 aa, Dengue virus
LGELCEDTI

SEQ ID NO: 31660 - protein, 9 aa, Dengue virus
GELCEDTIT

SEQ ID NO: 31661 - protein, 9 aa, Dengue virus
ELCEDTITY

SEQ ID NO: 31662 - protein, 9 aa, Dengue virus
LCEDTITYK

SEQ ID NO: 31663 - protein, 9 aa, Dengue virus
CEDTITYKC

SEQ ID NO: 31664 - protein, 9 aa, Dengue virus
EDTITYKCP

SEQ ID NO: 31665 - protein, 9 aa, Dengue virus
DTITYKCPL

SEQ ID NO: 31666 - protein, 9 aa, Dengue virus
TITYKCPLL

SEQ ID NO: 31667 - protein, 9 aa, Dengue virus
TYKCPLLRQ

SEQ ID NO: 31668 - protein, 9 aa, Dengue virus
YKCPLLRQN

SEQ ID NO: 31669 - protein, 9 aa, Dengue virus
KCPLLRQNE

SEQ ID NO: 31670 - protein, 9 aa, Dengue virus
CPLLRQNEP

SEQ ID NO: 31671 - protein, 9 aa, Dengue virus
PLLRQNEPE

SEQ ID NO: 31672 - protein, 9 aa, Dengue virus
LLRQNEPED

SEQ ID NO: 31673 - protein, 9 aa, Dengue virus
LRQNEPEDI

SEQ ID NO: 31674 - protein, 9 aa, Dengue virus
RQNEPEDID

SEQ ID NO: 31675 - protein, 9 aa, Dengue virus
QNEPEDIDC

SEQ ID NO: 31676 - protein, 9 aa, Dengue virus
NEPEDIDCW

SEQ ID NO: 31677 - protein, 9 aa, Dengue virus
EPEDIDCWC

SEQ ID NO: 31678 - protein, 9 aa, Dengue virus
PEDIDCWCN

SEQ ID NO: 31679 - protein, 9 aa, Dengue virus
EDIDCWCNS

SEQ ID NO: 31680 - protein, 9 aa, Dengue virus
DIDCWCNST

SEQ ID NO: 31681 - protein, 9 aa, Dengue virus
IDCWCNSTS

SEQ ID NO: 31682 - protein, 9 aa, Dengue virus
DCWCNSTST

SEQ ID NO: 31683 - protein, 9 aa, Dengue virus
CWCNSTSTW

SEQ ID NO: 31684 - protein, 9 aa, Dengue virus
WCNSTSTWV

SEQ ID NO: 31685 - protein, 9 aa, Dengue virus
CNSTSTWVT

SEQ ID NO: 31686 - protein, 9 aa, Dengue virus
NSTSTWVTY

SEQ ID NO: 31687 - protein, 9 aa, Dengue virus
STSTWVTYG

SEQ ID NO: 31688 - protein, 9 aa, Dengue virus
TSTWVTYGT

SEQ ID NO: 31689 - protein, 9 aa, Dengue virus
STWVTYGTC

SEQ ID NO: 31690 - protein, 9 aa, Dengue virus
TWVTYGTCT

SEQ ID NO: 31691 - protein, 9 aa, Dengue virus
TTGEHRREK

SEQ ID NO: 31692 - protein, 9 aa, Dengue virus
TGEHRREKR

SEQ ID NO: 31693 - protein, 9 aa, Dengue virus
GEHRREKRS

SEQ ID NO: 31694 - protein, 9 aa, Dengue virus
EHRREKRSV

SEQ ID NO: 31695 - protein, 9 aa, Dengue virus
HRREKRSVA

SEQ ID NO: 31696 - protein, 9 aa, Dengue virus
RREKRSVAL

SEQ ID NO: 31697 - protein, 9 aa, Dengue virus
REKRSVALV

SEQ ID NO: 31698 - protein, 9 aa, Dengue virus
EKRSVALVP

SEQ ID NO: 31699 - protein, 9 aa, Dengue virus
KRSVALVPH

SEQ ID NO: 31700 - protein, 9 aa, Dengue virus
RSVALVPHV

SEQ ID NO: 31701 - protein, 9 aa, Dengue virus
SVALVPHVG

SEQ ID NO: 31702 - protein, 9 aa, Dengue virus
VALVPHVGM

SEQ ID NO: 31703 - protein, 9 aa, Dengue virus
ALVPHVGMG

SEQ ID NO: 31704 - protein, 9 aa, Dengue virus
LVPHVGMGL

SEQ ID NO: 31705 - protein, 9 aa, Dengue virus
VPHVGMGLE

SEQ ID NO: 31706 - protein, 9 aa, Dengue virus
PHVGMGLET

SEQ ID NO: 31707 - protein, 9 aa, Dengue virus
HVGMGLETR

SEQ ID NO: 31708 - protein, 9 aa, Dengue virus
VGMGLETRT

SEQ ID NO: 31709 - protein, 9 aa, Dengue virus
GMGLETRTE

SEQ ID NO: 31710 - protein, 9 aa, Dengue virus
MGLETRTET

SEQ ID NO: 31711 - protein, 9 aa, Dengue virus
GLETRTETW

SEQ ID NO: 31712 - protein, 9 aa, Dengue virus
LETRTETWM

SEQ ID NO: 31713 - protein, 9 aa, Dengue virus
ETRTETWMS

SEQ ID NO: 31714 - protein, 9 aa, Dengue virus
TRTETWMSS

SEQ ID NO: 31715 - protein, 9 aa, Dengue virus
RTETWMSSE

SEQ ID NO: 31716 - protein, 9 aa, Dengue virus
TETWMSSEG

SEQ ID NO: 31717 - protein, 9 aa, Dengue virus
ETWMSSEGA

SEQ ID NO: 31718 - protein, 9 aa, Dengue virus
TWMSSEGAW

SEQ ID NO: 31719 - protein, 9 aa, Dengue virus
WMSSEGAWK

SEQ ID NO: 31720 - protein, 9 aa, Dengue virus
MSSEGAWKH

SEQ ID NO: 31721 - protein, 9 aa, Dengue virus
SSEGAWKHV

SEQ ID NO: 31722 - protein, 9 aa, Dengue virus
SEGAWKHVQ

SEQ ID NO: 31723 - protein, 9 aa, Dengue virus
EGAWKHVQR

SEQ ID NO: 31724 - protein, 9 aa, Dengue virus
GAWKHVQRI

SEQ ID NO: 31725 - protein, 9 aa, Dengue virus
AWKHVQRIE

SEQ ID NO: 31726 - protein, 9 aa, Dengue virus
WKHVQRIET

SEQ ID NO: 31727 - protein, 9 aa, Dengue virus
KHVQRIETW

SEQ ID NO: 31728 - protein, 9 aa, Dengue virus
HVQRIETWI

SEQ ID NO: 31729 - protein, 9 aa, Dengue virus
VQRIETWIL

SEQ ID NO: 31730 - protein, 9 aa, Dengue virus
QRIETWILR

SEQ ID NO: 31731 - protein, 9 aa, Dengue virus
RIETWILRH

SEQ ID NO: 31732 - protein, 9 aa, Dengue virus
IETWILRHP

SEQ ID NO: 31733 - protein, 9 aa, Dengue virus
ETWILRHPG

SEQ ID NO: 31734 - protein, 9 aa, Dengue virus
TWILRHPGF

SEQ ID NO: 31735 - protein, 9 aa, Dengue virus
WILRHPGFT

SEQ ID NO: 31736 - protein, 9 aa, Dengue virus
LRHPGFTIM

SEQ ID NO: 31737 - protein, 9 aa, Dengue virus
RHPGFTIMA

SEQ ID NO: 31738 - protein, 9 aa, Dengue virus
HPGFTIMAA

SEQ ID NO: 31739 - protein, 9 aa, Dengue virus
MAAILAYTI

SEQ ID NO: 31740 - protein, 9 aa, Dengue virus
AAILAYTIG

SEQ ID NO: 31741 - protein, 9 aa, Dengue virus
AILAYTIGT

SEQ ID NO: 31742 - protein, 9 aa, Dengue virus
ILAYTIGTT

SEQ ID NO: 31743 - protein, 9 aa, Dengue virus
LAYTIGTTH

SEQ ID NO: 31744 - protein, 9 aa, Dengue virus
AYTIGTTHF

SEQ ID NO: 31745 - protein, 9 aa, Dengue virus
YTIGTTHFQ

SEQ ID NO: 31746 - protein, 9 aa, Dengue virus
TIGTTHFQR

SEQ ID NO: 31747 - protein, 9 aa, Dengue virus
GTTHFQRAL

SEQ ID NO: 31748 - protein, 9 aa, Dengue virus
TTHFQRALI

SEQ ID NO: 31749 - protein, 9 aa, Dengue virus
THFQRALIF

SEQ ID NO: 31750 - protein, 9 aa, Dengue virus
HFQRALIFI

SEQ ID NO: 31751 - protein, 9 aa, Dengue virus
FQRALIFIL

SEQ ID NO: 31752 - protein, 9 aa, Dengue virus
QRALIFILL

SEQ ID NO: 31753 - protein, 9 aa, Dengue virus
RALIFILLT

SEQ ID NO: 31754 - protein, 9 aa, Dengue virus
ALIFILLTA

SEQ ID NO: 31755 - protein, 9 aa, Dengue virus
LIFILLTAV

SEQ ID NO: 31756 - protein, 9 aa, Dengue virus
IFILLTAVA

SEQ ID NO: 31757 - protein, 9 aa, Dengue virus
FILLTAVAP

SEQ ID NO: 31758 - protein, 9 aa, Dengue virus
ILLTAVAPS

SEQ ID NO: 31759 - protein, 9 aa, Dengue virus
LLTAVAPSM

SEQ ID NO: 31760 - protein, 9 aa, Dengue virus
LTAVAPSMT

SEQ ID NO: 31761 - protein, 9 aa, Dengue virus
TAVAPSMTM

SEQ ID NO: 31762 - protein, 9 aa, Dengue virus
AVAPSMTMR

SEQ ID NO: 31763 - protein, 9 aa, Dengue virus
VAPSMTMRC

SEQ ID NO: 31764 - protein, 9 aa, Dengue virus
APSMTMRCI

SEQ ID NO: 31765 - protein, 9 aa, Dengue virus
PSMTMRCIG

SEQ ID NO: 31766 - protein, 9 aa, Dengue virus
SMTMRCIGI

SEQ ID NO: 31767 - protein, 9 aa, Dengue virus
MTMRCIGIS

SEQ ID NO: 31768 - protein, 9 aa, Dengue virus
TMRCIGISN

SEQ ID NO: 31769 - protein, 9 aa, Dengue virus
MRCIGISNR

SEQ ID NO: 31770 - protein, 9 aa, Dengue virus
RCIGISNRD

SEQ ID NO: 31771 - protein, 9 aa, Dengue virus
CIGISNRDF

SEQ ID NO: 31772 - protein, 9 aa, Dengue virus
IGISNRDFV

SEQ ID NO: 31773 - protein, 9 aa, Dengue virus
GISNRDFVE

SEQ ID NO: 31774 - protein, 9 aa, Dengue virus
ISNRDFVEG

SEQ ID NO: 31775 - protein, 9 aa, Dengue virus
SNRDFVEGV

SEQ ID NO: 31776 - protein, 9 aa, Dengue virus
NRDFVEGVS

SEQ ID NO: 31777 - protein, 9 aa, Dengue virus
RDFVEGVSG

SEQ ID NO: 31778 - protein, 9 aa, Dengue virus
DFVEGVSGG

SEQ ID NO: 31779 - protein, 9 aa, Dengue virus
FVEGVSGGS

SEQ ID NO: 31780 - protein, 9 aa, Dengue virus
VEGVSGGSW

SEQ ID NO: 31781 - protein, 9 aa, Dengue virus
EGVSGGSWV

SEQ ID NO: 31782 - protein, 9 aa, Dengue virus
GVSGGSWVD

SEQ ID NO: 31783 - protein, 9 aa, Dengue virus
VSGGSWVDI

SEQ ID NO: 31784 - protein, 9 aa, Dengue virus
SGGSWVDIV

SEQ ID NO: 31785 - protein, 9 aa, Dengue virus
GGSWVDIVL

SEQ ID NO: 31786 - protein, 9 aa, Dengue virus
GSWVDIVLE

SEQ ID NO: 31787 - protein, 9 aa, Dengue virus
SWVDIVLEH

SEQ ID NO: 31788 - protein, 9 aa, Dengue virus
WVDIVLEHG

SEQ ID NO: 31789 - protein, 9 aa, Dengue virus
VDIVLEHGS

SEQ ID NO: 31790 - protein, 9 aa, Dengue virus
DIVLEHGSC

SEQ ID NO: 31791 - protein, 9 aa, Dengue virus
IVLEHGSCV

SEQ ID NO: 31792 - protein, 9 aa, Dengue virus
VLEHGSCVT

SEQ ID NO: 31793 - protein, 9 aa, Dengue virus
LEHGSCVTT

SEQ ID NO: 31794 - protein, 9 aa, Dengue virus
EHGSCVTTM

SEQ ID NO: 31795 - protein, 9 aa, Dengue virus
HGSCVTTMA

SEQ ID NO: 31796 - protein, 9 aa, Dengue virus
GSCVTTMAK

SEQ ID NO: 31797 - protein, 9 aa, Dengue virus
SCVTTMAKN

SEQ ID NO: 31798 - protein, 9 aa, Dengue virus
CVTTMAKNK

SEQ ID NO: 31799 - protein, 9 aa, Dengue virus
VTTMAKNKP

SEQ ID NO: 31800 - protein, 9 aa, Dengue virus
TTMAKNKPT

SEQ ID NO: 31801 - protein, 9 aa, Dengue virus
TMAKNKPTL

SEQ ID NO: 31802 - protein, 9 aa, Dengue virus
MAKNKPTLD

SEQ ID NO: 31803 - protein, 9 aa, Dengue virus
AKNKPTLDF

SEQ ID NO: 31804 - protein, 9 aa, Dengue virus
KNKPTLDFE

SEQ ID NO: 31805 - protein, 9 aa, Dengue virus
NKPTLDFEL

SEQ ID NO: 31806 - protein, 9 aa, Dengue virus
KPTLDFELI

SEQ ID NO: 31807 - protein, 9 aa, Dengue virus
PTLDFELIK

SEQ ID NO: 31808 - protein, 9 aa, Dengue virus
TLDFELIKT

SEQ ID NO: 31809 - protein, 9 aa, Dengue virus
LDFELIKTE

SEQ ID NO: 31810 - protein, 9 aa, Dengue virus
DFELIKTEA

SEQ ID NO: 31811 - protein, 9 aa, Dengue virus
FELIKTEAK

SEQ ID NO: 31812 - protein, 9 aa, Dengue virus
ELIKTEAKQ

SEQ ID NO: 31813 - protein, 9 aa, Dengue virus
KTEAKQPAT

SEQ ID NO: 31814 - protein, 9 aa, Dengue virus
TEAKQPATL

SEQ ID NO: 31815 - protein, 9 aa, Dengue virus
EAKQPATLR

SEQ ID NO: 31816 - protein, 9 aa, Dengue virus
AKQPATLRK

SEQ ID NO: 31817 - protein, 9 aa, Dengue virus
KQPATLRKY

SEQ ID NO: 31818 - protein, 9 aa, Dengue virus
QPATLRKYC

SEQ ID NO: 31819 - protein, 9 aa, Dengue virus
PATLRKYCI

SEQ ID NO: 31820 - protein, 9 aa, Dengue virus
ATLRKYCIE

SEQ ID NO: 31821 - protein, 9 aa, Dengue virus
TLRKYCIEA

SEQ ID NO: 31822 - protein, 9 aa, Dengue virus
LRKYCIEAK

SEQ ID NO: 31823 - protein, 9 aa, Dengue virus
RKYCIEAKL

SEQ ID NO: 31824 - protein, 9 aa, Dengue virus
KYCIEAKLT

SEQ ID NO: 31825 - protein, 9 aa, Dengue virus
YCIEAKLTN

SEQ ID NO: 31826 - protein, 9 aa, Dengue virus
CIEAKLTNT

SEQ ID NO: 31827 - protein, 9 aa, Dengue virus
IEAKLTNTT

SEQ ID NO: 31828 - protein, 9 aa, Dengue virus
EAKLTNTTT

SEQ ID NO: 31829 - protein, 9 aa, Dengue virus
AKLTNTTTE

SEQ ID NO: 31830 - protein, 9 aa, Dengue virus
KLTNTTTES

SEQ ID NO: 31831 - protein, 9 aa, Dengue virus
LTNTTTESR

SEQ ID NO: 31832 - protein, 9 aa, Dengue virus
TNTTTESRC

SEQ ID NO: 31833 - protein, 9 aa, Dengue virus
NTTTESRCP

SEQ ID NO: 31834 - protein, 9 aa, Dengue virus
TTTESRCPT

SEQ ID NO: 31835 - protein, 9 aa, Dengue virus
TTESRCPTQ

SEQ ID NO: 31836 - protein, 9 aa, Dengue virus
TESRCPTQG

SEQ ID NO: 31837 - protein, 9 aa, Dengue virus
ESRCPTQGE

SEQ ID NO: 31838 - protein, 9 aa, Dengue virus
SRCPTQGEP

SEQ ID NO: 31839 - protein, 9 aa, Dengue virus
RCPTQGEPS

SEQ ID NO: 31840 - protein, 9 aa, Dengue virus
CPTQGEPSL

SEQ ID NO: 31841 - protein, 9 aa, Dengue virus
PTQGEPSLN

SEQ ID NO: 31842 - protein, 9 aa, Dengue virus
TQGEPSLNE

SEQ ID NO: 31843 - protein, 9 aa, Dengue virus
QGEPSLNEE

SEQ ID NO: 31844 - protein, 9 aa, Dengue virus
GEPSLNEEQ

SEQ ID NO: 31845 - protein, 9 aa, Dengue virus
EPSLNEEQD

SEQ ID NO: 31846 - protein, 9 aa, Dengue virus
PSLNEEQDK

SEQ ID NO: 31847 - protein, 9 aa, Dengue virus
SLNEEQDKR

SEQ ID NO: 31848 - protein, 9 aa, Dengue virus
LNEEQDKRF

SEQ ID NO: 31849 - protein, 9 aa, Dengue virus
EEQDKRFVC

SEQ ID NO: 31850 - protein, 9 aa, Dengue virus
EQDKRFVCK

SEQ ID NO: 31851 - protein, 9 aa, Dengue virus
QDKRFVCKH

SEQ ID NO: 31852 - protein, 9 aa, Dengue virus
DKRFVCKHS

SEQ ID NO: 31853 - protein, 9 aa, Dengue virus
KRFVCKHSM

SEQ ID NO: 31854 - protein, 9 aa, Dengue virus
RFVCKHSMV

SEQ ID NO: 31855 - protein, 9 aa, Dengue virus
FVCKHSMVD

SEQ ID NO: 31856 - protein, 9 aa, Dengue virus
VCKHSMVDR

SEQ ID NO: 31857 - protein, 9 aa, Dengue virus
CKHSMVDRG

SEQ ID NO: 31858 - protein, 9 aa, Dengue virus
KHSMVDRGW

SEQ ID NO: 31859 - protein, 9 aa, Dengue virus
HSMVDRGWG

SEQ ID NO: 31860 - protein, 9 aa, Dengue virus
SMVDRGWGN

SEQ ID NO: 31861 - protein, 9 aa, Dengue virus
MVDRGWGNG

SEQ ID NO: 31862 - protein, 9 aa, Dengue virus
VDRGWGNGC

SEQ ID NO: 31863 - protein, 9 aa, Dengue virus
DRGWGNGCG

SEQ ID NO: 31864 - protein, 9 aa, Dengue virus
RGWGNGCGL

SEQ ID NO: 31865 - protein, 9 aa, Dengue virus
GWGNGCGLF

SEQ ID NO: 31866 - protein, 9 aa, Dengue virus
WGNGCGLFG

SEQ ID NO: 31867 - protein, 9 aa, Dengue virus
GNGCGLFGK

SEQ ID NO: 31868 - protein, 9 aa, Dengue virus
NGCGLFGKG

SEQ ID NO: 31869 - protein, 9 aa, Dengue virus
GCGLFGKGG

SEQ ID NO: 31870 - protein, 9 aa, Dengue virus
CGLFGKGGI

SEQ ID NO: 31871 - protein, 9 aa, Dengue virus
GLFGKGGIV

SEQ ID NO: 31872 - protein, 9 aa, Dengue virus
LFGKGGIVT

SEQ ID NO: 31873 - protein, 9 aa, Dengue virus
FGKGGIVTC

SEQ ID NO: 31874 - protein, 9 aa, Dengue virus
GKGGIVTCA

SEQ ID NO: 31875 - protein, 9 aa, Dengue virus
KGGIVTCAM

SEQ ID NO: 31876 - protein, 9 aa, Dengue virus
GGIVTCAMF

SEQ ID NO: 31877 - protein, 9 aa, Dengue virus
GIVTCAMFT

SEQ ID NO: 31878 - protein, 9 aa, Dengue virus
IVTCAMFTC

SEQ ID NO: 31879 - protein, 9 aa, Dengue virus
VTCAMFTCK

SEQ ID NO: 31880 - protein, 9 aa, Dengue virus
TCAMFTCKK

SEQ ID NO: 31881 - protein, 9 aa, Dengue virus
CAMFTCKKN

SEQ ID NO: 31882 - protein, 9 aa, Dengue virus
AMFTCKKNM

SEQ ID NO: 31883 - protein, 9 aa, Dengue virus
MFTCKKNME

SEQ ID NO: 31884 - protein, 9 aa, Dengue virus
FTCKKNMEG

SEQ ID NO: 31885 - protein, 9 aa, Dengue virus
TCKKNMEGK

SEQ ID NO: 31886 - protein, 9 aa, Dengue virus
CKKNMEGKV

SEQ ID NO: 31887 - protein, 9 aa, Dengue virus
KKNMEGKVV

SEQ ID NO: 31888 - protein, 9 aa, Dengue virus
KNMEGKIVQ

SEQ ID NO: 31889 - protein, 9 aa, Dengue virus
NMEGKIVQP

SEQ ID NO: 31890 - protein, 9 aa, Dengue virus
MEGKIVQPE

SEQ ID NO: 31891 - protein, 9 aa, Dengue virus
EGKIVQPEN

SEQ ID NO: 31892 - protein, 9 aa, Dengue virus
GKIVQPENL

SEQ ID NO: 31893 - protein, 9 aa, Dengue virus
KIVQPENLE

SEQ ID NO: 31894 - protein, 9 aa, Dengue virus
IVQPENLEY

SEQ ID NO: 31895 - protein, 9 aa, Dengue virus
VQPENLEYT

SEQ ID NO: 31896 - protein, 9 aa, Dengue virus
QPENLEYTI

SEQ ID NO: 31897 - protein, 9 aa, Dengue virus
PENLEYTIV

SEQ ID NO: 31898 - protein, 9 aa, Dengue virus
ENLEYTIVI

SEQ ID NO: 31899 - protein, 9 aa, Dengue virus
NLEYTIVIT

SEQ ID NO: 31900 - protein, 9 aa, Dengue virus
LEYTIVITP

SEQ ID NO: 31901 - protein, 9 aa, Dengue virus
EYTIVITPH

SEQ ID NO: 31902 - protein, 9 aa, Dengue virus
YTIVITPHS

SEQ ID NO: 31903 - protein, 9 aa, Dengue virus
TIVITPHSG

SEQ ID NO: 31904 - protein, 9 aa, Dengue virus
IVITPHSGE

SEQ ID NO: 31905 - protein, 9 aa, Dengue virus
VITPHSGEE

SEQ ID NO: 31906 - protein, 9 aa, Dengue virus
ITPHSGEEH

SEQ ID NO: 31907 - protein, 9 aa, Dengue virus
TPHSGEEHA

SEQ ID NO: 31908 - protein, 9 aa, Dengue virus
PHSGEEHAV

SEQ ID NO: 31909 - protein, 9 aa, Dengue virus
HSGEEHAVG

SEQ ID NO: 31910 - protein, 9 aa, Dengue virus
SGEEHAVGN

SEQ ID NO: 31911 - protein, 9 aa, Dengue virus
GEEHAVGND

SEQ ID NO: 31912 - protein, 9 aa, Dengue virus
EEHAVGNDT

SEQ ID NO: 31913 - protein, 9 aa, Dengue virus
EHAVGNDTG

SEQ ID NO: 31914 - protein, 9 aa, Dengue virus
HAVGNDTGK

SEQ ID NO: 31915 - protein, 9 aa, Dengue virus
AVGNDTGKH

SEQ ID NO: 31916 - protein, 9 aa, Dengue virus
VGNDTGKHG

SEQ ID NO: 31917 - protein, 9 aa, Dengue virus
GNDTGKHGK

SEQ ID NO: 31918 - protein, 9 aa, Dengue virus
NDTGKHGKE

SEQ ID NO: 31919 - protein, 9 aa, Dengue virus
DTGKHGKEI

SEQ ID NO: 31920 - protein, 9 aa, Dengue virus
TGKHGKEIK

SEQ ID NO: 31921 - protein, 9 aa, Dengue virus
GKHGKEIKI

SEQ ID NO: 31922 - protein, 9 aa, Dengue virus
KHGKEIKIT

SEQ ID NO: 31923 - protein, 9 aa, Dengue virus
HGKEIKITP

SEQ ID NO: 31924 - protein, 9 aa, Dengue virus
GKEIKITPQ

SEQ ID NO: 31925 - protein, 9 aa, Dengue virus
KEIKITPQS

SEQ ID NO: 31926 - protein, 9 aa, Dengue virus
EIKITPQSS

SEQ ID NO: 31927 - protein, 9 aa, Dengue virus
TEAELTGYG

SEQ ID NO: 31928 - protein, 9 aa, Dengue virus
EAELTGYGT

SEQ ID NO: 31929 - protein, 9 aa, Dengue virus
AELTGYGTV

SEQ ID NO: 31930 - protein, 9 aa, Dengue virus
ELTGYGTVT

SEQ ID NO: 31931 - protein, 9 aa, Dengue virus
LTGYGTVTM

SEQ ID NO: 31932 - protein, 9 aa, Dengue virus
TGYGTVTME

SEQ ID NO: 31933 - protein, 9 aa, Dengue virus
GYGTVTMEC

SEQ ID NO: 31934 - protein, 9 aa, Dengue virus
YGTVTMECS

SEQ ID NO: 31935 - protein, 9 aa, Dengue virus
GTVTMECSP

SEQ ID NO: 31936 - protein, 9 aa, Dengue virus
TVTMECSPR

SEQ ID NO: 31937 - protein, 9 aa, Dengue virus
VTMECSPRT

SEQ ID NO: 31938 - protein, 9 aa, Dengue virus
TMECSPRTG

SEQ ID NO: 31939 - protein, 9 aa, Dengue virus
MECSPRTGL

SEQ ID NO: 31940 - protein, 9 aa, Dengue virus
ECSPRTGLD

SEQ ID NO: 31941 - protein, 9 aa, Dengue virus
CSPRTGLDF

SEQ ID NO: 31942 - protein, 9 aa, Dengue virus
SPRTGLDFN

SEQ ID NO: 31943 - protein, 9 aa, Dengue virus
PRTGLDFNE

SEQ ID NO: 31944 - protein, 9 aa, Dengue virus
RTGLDFNEM

SEQ ID NO: 31945 - protein, 9 aa, Dengue virus
TGLDFNEMV

SEQ ID NO: 31946 - protein, 9 aa, Dengue virus
GLDFNEMVL

SEQ ID NO: 31947 - protein, 9 aa, Dengue virus
LDFNEMVLL

SEQ ID NO: 31948 - protein, 9 aa, Dengue virus
DFNEMVLLQ

SEQ ID NO: 31949 - protein, 9 aa, Dengue virus
FNEMVLLQM

SEQ ID NO: 31950 - protein, 9 aa, Dengue virus
NEMVLLQME

SEQ ID NO: 31951 - protein, 9 aa, Dengue virus
MEDKAWLVH

SEQ ID NO: 31952 - protein, 9 aa, Dengue virus
EDKAWLVHR

SEQ ID NO: 31953 - protein, 9 aa, Dengue virus
DKAWLVHRQ

SEQ ID NO: 31954 - protein, 9 aa, Dengue virus
KAWLVHRQW

SEQ ID NO: 31955 - protein, 9 aa, Dengue virus
AWLVHRQWF

SEQ ID NO: 31956 - protein, 9 aa, Dengue virus
WLVHRQWFL

SEQ ID NO: 31957 - protein, 9 aa, Dengue virus
LVHRQWFLD

SEQ ID NO: 31958 - protein, 9 aa, Dengue virus
VHRQWFLDL

SEQ ID NO: 31959 - protein, 9 aa, Dengue virus
HRQWFLDLP

SEQ ID NO: 31960 - protein, 9 aa, Dengue virus
RQWFLDLPL

SEQ ID NO: 31961 - protein, 9 aa, Dengue virus
QWFLDLPLP

SEQ ID NO: 31962 - protein, 9 aa, Dengue virus
WFLDLPLPW

SEQ ID NO: 31963 - protein, 9 aa, Dengue virus
FLDLPLPWL

SEQ ID NO: 31964 - protein, 9 aa, Dengue virus
LDLPLPWLP

SEQ ID NO: 31965 - protein, 9 aa, Dengue virus
DLPLPWLPG

SEQ ID NO: 31966 - protein, 9 aa, Dengue virus
LPLPWLPGA

SEQ ID NO: 31967 - protein, 9 aa, Dengue virus
PLPWLPGAD

SEQ ID NO: 31968 - protein, 9 aa, Dengue virus
LPWLPGADT

SEQ ID NO: 31969 - protein, 9 aa, Dengue virus
PWLPGADTQ

SEQ ID NO: 31970 - protein, 9 aa, Dengue virus
WLPGADTQG

SEQ ID NO: 31971 - protein, 9 aa, Dengue virus
LPGADTQGS

SEQ ID NO: 31972 - protein, 9 aa, Dengue virus
PGADTQGSN

SEQ ID NO: 31973 - protein, 9 aa, Dengue virus
GADTQGSNW

SEQ ID NO: 31974 - protein, 9 aa, Dengue virus
ADTQGSNWI

SEQ ID NO: 31975 - protein, 9 aa, Dengue virus
DTQGSNWIQ

SEQ ID NO: 31976 - protein, 9 aa, Dengue virus
TQGSNWIQK

SEQ ID NO: 31977 - protein, 9 aa, Dengue virus
QGSNWIQKE

SEQ ID NO: 31978 - protein, 9 aa, Dengue virus
GSNWIQKET

SEQ ID NO: 31979 - protein, 9 aa, Dengue virus
SNWIQKETL

SEQ ID NO: 31980 - protein, 9 aa, Dengue virus
NWIQKETLV

SEQ ID NO: 31981 - protein, 9 aa, Dengue virus
WIQKETLVT

SEQ ID NO: 31982 - protein, 9 aa, Dengue virus
IQKETLVTF

SEQ ID NO: 31983 - protein, 9 aa, Dengue virus
QKETLVTFK

SEQ ID NO: 31984 - protein, 9 aa, Dengue virus
KETLVTFKN

SEQ ID NO: 31985 - protein, 9 aa, Dengue virus
ETLVTFKNP

SEQ ID NO: 31986 - protein, 9 aa, Dengue virus
TLVTFKNPH

SEQ ID NO: 31987 - protein, 9 aa, Dengue virus
LVTFKNPHA

SEQ ID NO: 31988 - protein, 9 aa, Dengue virus
VTFKNPHAK

SEQ ID NO: 31989 - protein, 9 aa, Dengue virus
TFKNPHAKK

SEQ ID NO: 31990 - protein, 9 aa, Dengue virus
FKNPHAKKQ

SEQ ID NO: 31991 - protein, 9 aa, Dengue virus
KNPHAKKQD

SEQ ID NO: 31992 - protein, 9 aa, Dengue virus
NPHAKKQDV

SEQ ID NO: 31993 - protein, 9 aa, Dengue virus
PHAKKQDVV

SEQ ID NO: 31994 - protein, 9 aa, Dengue virus
HAKKQDVVV

SEQ ID NO: 31995 - protein, 9 aa, Dengue virus
AKKQDVVVL

SEQ ID NO: 31996 - protein, 9 aa, Dengue virus
KKQDVVVLG

SEQ ID NO: 31997 - protein, 9 aa, Dengue virus
KQDVVVLGS

SEQ ID NO: 31998 - protein, 9 aa, Dengue virus
QDVVVLGSQ

SEQ ID NO: 31999 - protein, 9 aa, Dengue virus
DVVVLGSQE

SEQ ID NO: 32000 - protein, 9 aa, Dengue virus
VVVLGSQEG

SEQ ID NO: 32001 - protein, 9 aa, Dengue virus
VVLGSQEGA

SEQ ID NO: 32002 - protein, 9 aa, Dengue virus
VLGSQEGAM

SEQ ID NO: 32003 - protein, 9 aa, Dengue virus
LGSQEGAMH

SEQ ID NO: 32004 - protein, 9 aa, Dengue virus
GSQEGAMHT

SEQ ID NO: 32005 - protein, 9 aa, Dengue virus
SQEGAMHTA

SEQ ID NO: 32006 - protein, 9 aa, Dengue virus
QEGAMHTAL

SEQ ID NO: 32007 - protein, 9 aa, Dengue virus
EGAMHTALT

SEQ ID NO: 32008 - protein, 9 aa, Dengue virus
GAMHTALTG

SEQ ID NO: 32009 - protein, 9 aa, Dengue virus
AMHTALTGA

SEQ ID NO: 32010 - protein, 9 aa, Dengue virus
MHTALTGAT

SEQ ID NO: 32011 - protein, 9 aa, Dengue virus
HTALTGATE

SEQ ID NO: 32012 - protein, 9 aa, Dengue virus
TALTGATEI

SEQ ID NO: 32013 - protein, 9 aa, Dengue virus
ALTGATEIQ

SEQ ID NO: 32014 - protein, 9 aa, Dengue virus
LTGATEIQM

SEQ ID NO: 32015 - protein, 9 aa, Dengue virus
TGATEIQMS

SEQ ID NO: 32016 - protein, 9 aa, Dengue virus
GATEIQMSS

SEQ ID NO: 32017 - protein, 9 aa, Dengue virus
ATEIQMSSG

SEQ ID NO: 32018 - protein, 9 aa, Dengue virus
TEIQMSSGN

SEQ ID NO: 32019 - protein, 9 aa, Dengue virus
EIQMSSGNL

SEQ ID NO: 32020 - protein, 9 aa, Dengue virus
IQMSSGNLL

SEQ ID NO: 32021 - protein, 9 aa, Dengue virus
QMSSGNLLF

SEQ ID NO: 32022 - protein, 9 aa, Dengue virus
MSSGNLLFT

SEQ ID NO: 32023 - protein, 9 aa, Dengue virus
SSGNLLFTG

SEQ ID NO: 32024 - protein, 9 aa, Dengue virus
SGNLLFTGH

SEQ ID NO: 32025 - protein, 9 aa, Dengue virus
GNLLFTGHL

SEQ ID NO: 32026 - protein, 9 aa, Dengue virus
NLLFTGHLK

SEQ ID NO: 32027 - protein, 9 aa, Dengue virus
LLFTGHLKC

SEQ ID NO: 32028 - protein, 9 aa, Dengue virus
LFTGHLKCR

SEQ ID NO: 32029 - protein, 9 aa, Dengue virus
FTGHLKCRL

SEQ ID NO: 32030 - protein, 9 aa, Dengue virus
TGHLKCRLR

SEQ ID NO: 32031 - protein, 9 aa, Dengue virus
GHLKCRLRM

SEQ ID NO: 32032 - protein, 9 aa, Dengue virus
HLKCRLRMD

SEQ ID NO: 32033 - protein, 9 aa, Dengue virus
LKCRLRMDK

SEQ ID NO: 32034 - protein, 9 aa, Dengue virus
KCRLRMDKL

SEQ ID NO: 32035 - protein, 9 aa, Dengue virus
CRLRMDKLQ

SEQ ID NO: 32036 - protein, 9 aa, Dengue virus
RLRMDKLQL

SEQ ID NO: 32037 - protein, 9 aa, Dengue virus
LRMDKLQLK

SEQ ID NO: 32038 - protein, 9 aa, Dengue virus
RMDKLQLKG

SEQ ID NO: 32039 - protein, 9 aa, Dengue virus
MDKLQLKGM

SEQ ID NO: 32040 - protein, 9 aa, Dengue virus
DKLQLKGMS

SEQ ID NO: 32041 - protein, 9 aa, Dengue virus
KLQLKGMSY

SEQ ID NO: 32042 - protein, 9 aa, Dengue virus
LQLKGMSYS

SEQ ID NO: 32043 - protein, 9 aa, Dengue virus
QLKGMSYSM

SEQ ID NO: 32044 - protein, 9 aa, Dengue virus
LKGMSYSMC

SEQ ID NO: 32045 - protein, 9 aa, Dengue virus
KGMSYSMCT

SEQ ID NO: 32046 - protein, 9 aa, Dengue virus
GMSYSMCTG

SEQ ID NO: 32047 - protein, 9 aa, Dengue virus
MSYSMCTGK

SEQ ID NO: 32048 - protein, 9 aa, Dengue virus
SYSMCTGKF

SEQ ID NO: 32049 - protein, 9 aa, Dengue virus
YSMCTGKFK

SEQ ID NO: 32050 - protein, 9 aa, Dengue virus
SMCTGKFKI

SEQ ID NO: 32051 - protein, 9 aa, Dengue virus
MCTGKFKIV

SEQ ID NO: 32052 - protein, 9 aa, Dengue virus
CTGKFKIVK

SEQ ID NO: 32053 - protein, 9 aa, Dengue virus
TGKFKIVKE

SEQ ID NO: 32054 - protein, 9 aa, Dengue virus
GKFKIVKEI

SEQ ID NO: 32055 - protein, 9 aa, Dengue virus
KFKIVKEIA

SEQ ID NO: 32056 - protein, 9 aa, Dengue virus
FKIVKEIAE

SEQ ID NO: 32057 - protein, 9 aa, Dengue virus
KIVKEIAET

SEQ ID NO: 32058 - protein, 9 aa, Dengue virus
IVKEIAETQ

SEQ ID NO: 32059 - protein, 9 aa, Dengue virus
VKEIAETQH

SEQ ID NO: 32060 - protein, 9 aa, Dengue virus
KEIAETQHG

SEQ ID NO: 32061 - protein, 9 aa, Dengue virus
EIAETQHGT

SEQ ID NO: 32062 - protein, 9 aa, Dengue virus
IAETQHGTI

SEQ ID NO: 32063 - protein, 9 aa, Dengue virus
AETQHGTIV

SEQ ID NO: 32064 - protein, 9 aa, Dengue virus
ETQHGTIVI

SEQ ID NO: 32065 - protein, 9 aa, Dengue virus
TQHGTIVIR

SEQ ID NO: 32066 - protein, 9 aa, Dengue virus
QHGTIVIRV

SEQ ID NO: 32067 - protein, 9 aa, Dengue virus
HGTIVIRVQ

SEQ ID NO: 32068 - protein, 9 aa, Dengue virus
GTIVIRVQY

SEQ ID NO: 32069 - protein, 9 aa, Dengue virus
TIVIRVQYE

SEQ ID NO: 32070 - protein, 9 aa, Dengue virus
IVIRVQYEG

SEQ ID NO: 32071 - protein, 9 aa, Dengue virus
VIRVQYEGD

SEQ ID NO: 32072 - protein, 9 aa, Dengue virus
IRVQYEGDG

SEQ ID NO: 32073 - protein, 9 aa, Dengue virus
RVQYEGDGS

SEQ ID NO: 32074 - protein, 9 aa, Dengue virus
VQYEGDGSP

SEQ ID NO: 32075 - protein, 9 aa, Dengue virus
QYEGDGSPC

SEQ ID NO: 32076 - protein, 9 aa, Dengue virus
YEGDGSPCK

SEQ ID NO: 32077 - protein, 9 aa, Dengue virus
EGDGSPCKI

SEQ ID NO: 32078 - protein, 9 aa, Dengue virus
GDGSPCKIP

SEQ ID NO: 32079 - protein, 9 aa, Dengue virus
DGSPCKIPF

SEQ ID NO: 32080 - protein, 9 aa, Dengue virus
GSPCKIPFE

SEQ ID NO: 32081 - protein, 9 aa, Dengue virus
SPCKIPFEI

SEQ ID NO: 32082 - protein, 9 aa, Dengue virus
PCKIPFEIM

SEQ ID NO: 32083 - protein, 9 aa, Dengue virus
CKIPFEIMD

SEQ ID NO: 32084 - protein, 9 aa, Dengue virus
KIPFEIMDL

SEQ ID NO: 32085 - protein, 9 aa, Dengue virus
IPFEIMDLE

SEQ ID NO: 32086 - protein, 9 aa, Dengue virus
PFEIMDLEK

SEQ ID NO: 32087 - protein, 9 aa, Dengue virus
FEIMDLEKR

SEQ ID NO: 32088 - protein, 9 aa, Dengue virus
EIMDLEKRH

SEQ ID NO: 32089 - protein, 9 aa, Dengue virus
DLEKRHVLG

SEQ ID NO: 32090 - protein, 9 aa, Dengue virus
LEKRHVLGR

SEQ ID NO: 32091 - protein, 9 aa, Dengue virus
EKRHVLGRL

SEQ ID NO: 32092 - protein, 9 aa, Dengue virus
KRHVLGRLI

SEQ ID NO: 32093 - protein, 9 aa, Dengue virus
RHVLGRLIT

SEQ ID NO: 32094 - protein, 9 aa, Dengue virus
HVLGRLITV

SEQ ID NO: 32095 - protein, 9 aa, Dengue virus
VLGRLITVN

SEQ ID NO: 32096 - protein, 9 aa, Dengue virus
LGRLITVNP

SEQ ID NO: 32097 - protein, 9 aa, Dengue virus
GRLITVNPI

SEQ ID NO: 32098 - protein, 9 aa, Dengue virus
RLITVNPIV

SEQ ID NO: 32099 - protein, 9 aa, Dengue virus
LITVNPIVT

SEQ ID NO: 32100 - protein, 9 aa, Dengue virus
EKDSPVNIE

SEQ ID NO: 32101 - protein, 9 aa, Dengue virus
KDSPVNIEA

SEQ ID NO: 32102 - protein, 9 aa, Dengue virus
DSPVNIEAE

SEQ ID NO: 32103 - protein, 9 aa, Dengue virus
SPVNIEAEP

SEQ ID NO: 32104 - protein, 9 aa, Dengue virus
PVNIEAEPP

SEQ ID NO: 32105 - protein, 9 aa, Dengue virus
VNIEAEPPF

SEQ ID NO: 32106 - protein, 9 aa, Dengue virus
NIEAEPPFG

SEQ ID NO: 32107 - protein, 9 aa, Dengue virus
IEAEPPFGD

SEQ ID NO: 32108 - protein, 9 aa, Dengue virus
EAEPPFGDS

SEQ ID NO: 32109 - protein, 9 aa, Dengue virus
AEPPFGDSY

SEQ ID NO: 32110 - protein, 9 aa, Dengue virus
EPPFGDSYI

SEQ ID NO: 32111 - protein, 9 aa, Dengue virus
PPFGDSYII

SEQ ID NO: 32112 - protein, 9 aa, Dengue virus
PFGDSYIII

SEQ ID NO: 32113 - protein, 9 aa, Dengue virus
FGDSYIIIG

SEQ ID NO: 32114 - protein, 9 aa, Dengue virus
GDSYIIIGV

SEQ ID NO: 32115 - protein, 9 aa, Dengue virus
DSYIIIGVE

SEQ ID NO: 32116 - protein, 9 aa, Dengue virus
SYIIIGVEP

SEQ ID NO: 32117 - protein, 9 aa, Dengue virus
YIIIGVEPG

SEQ ID NO: 32118 - protein, 9 aa, Dengue virus
IIIGVEPGQ

SEQ ID NO: 32119 - protein, 9 aa, Dengue virus
IIGVEPGQL

SEQ ID NO: 32120 - protein, 9 aa, Dengue virus
IGVEPGQLK

SEQ ID NO: 32121 - protein, 9 aa, Dengue virus
GVEPGQLKL

SEQ ID NO: 32122 - protein, 9 aa, Dengue virus
VEPGQLKLN

SEQ ID NO: 32123 - protein, 9 aa, Dengue virus
EPGQLKLNW

SEQ ID NO: 32124 - protein, 9 aa, Dengue virus
PGQLKLNWF

SEQ ID NO: 32125 - protein, 9 aa, Dengue virus
GQLKLNWFK

SEQ ID NO: 32126 - protein, 9 aa, Dengue virus
QLKLNWFKK

SEQ ID NO: 32127 - protein, 9 aa, Dengue virus
LKLNWFKKG

SEQ ID NO: 32128 - protein, 9 aa, Dengue virus
KLNWFKKGS

SEQ ID NO: 32129 - protein, 9 aa, Dengue virus
LNWFKKGSS

SEQ ID NO: 32130 - protein, 9 aa, Dengue virus
NWFKKGSSI

SEQ ID NO: 32131 - protein, 9 aa, Dengue virus
WFKKGSSIG

SEQ ID NO: 32132 - protein, 9 aa, Dengue virus
FKKGSSIGQ

SEQ ID NO: 32133 - protein, 9 aa, Dengue virus
KKGSSIGQM

SEQ ID NO: 32134 - protein, 9 aa, Dengue virus
KGSSIGQMF

SEQ ID NO: 32135 - protein, 9 aa, Dengue virus
GSSIGQMFE

SEQ ID NO: 32136 - protein, 9 aa, Dengue virus
SSIGQMFET

SEQ ID NO: 32137 - protein, 9 aa, Dengue virus
SIGQMFETT

SEQ ID NO: 32138 - protein, 9 aa, Dengue virus
IGQMFETTM

SEQ ID NO: 32139 - protein, 9 aa, Dengue virus
GQMFETTMR

SEQ ID NO: 32140 - protein, 9 aa, Dengue virus
QMFETTMRG

SEQ ID NO: 32141 - protein, 9 aa, Dengue virus
MFETTMRGA

SEQ ID NO: 32142 - protein, 9 aa, Dengue virus
FETTMRGAK

SEQ ID NO: 32143 - protein, 9 aa, Dengue virus
ETTMRGAKR

SEQ ID NO: 32144 - protein, 9 aa, Dengue virus
TTMRGAKRM

SEQ ID NO: 32145 - protein, 9 aa, Dengue virus
TMRGAKRMA

SEQ ID NO: 32146 - protein, 9 aa, Dengue virus
MRGAKRMAI

SEQ ID NO: 32147 - protein, 9 aa, Dengue virus
RGAKRMAIL

SEQ ID NO: 32148 - protein, 9 aa, Dengue virus
GAKRMAILG

SEQ ID NO: 32149 - protein, 9 aa, Dengue virus
AKRMAILGD

SEQ ID NO: 32150 - protein, 9 aa, Dengue virus
KRMAILGDT

SEQ ID NO: 32151 - protein, 9 aa, Dengue virus
RMAILGDTA

SEQ ID NO: 32152 - protein, 9 aa, Dengue virus
MAILGDTAW

SEQ ID NO: 32153 - protein, 9 aa, Dengue virus
AILGDTAWD

SEQ ID NO: 32154 - protein, 9 aa, Dengue virus
ILGDTAWDF

SEQ ID NO: 32155 - protein, 9 aa, Dengue virus
LGDTAWDFG

SEQ ID NO: 32156 - protein, 9 aa, Dengue virus
GDTAWDFGS

SEQ ID NO: 32157 - protein, 9 aa, Dengue virus
DTAWDFGSL

SEQ ID NO: 32158 - protein, 9 aa, Dengue virus
TAWDFGSLG

SEQ ID NO: 32159 - protein, 9 aa, Dengue virus
AWDFGSLGG

SEQ ID NO: 32160 - protein, 9 aa, Dengue virus
WDFGSLGGV

SEQ ID NO: 32161 - protein, 9 aa, Dengue virus
DFGSLGGVF

SEQ ID NO: 32162 - protein, 9 aa, Dengue virus
FGSLGGVFT

SEQ ID NO: 32163 - protein, 9 aa, Dengue virus
GSLGGVFTS

SEQ ID NO: 32164 - protein, 9 aa, Dengue virus
SLGGVFTSI

SEQ ID NO: 32165 - protein, 9 aa, Dengue virus
LGGVFTSIG

SEQ ID NO: 32166 - protein, 9 aa, Dengue virus
GGVFTSIGK

SEQ ID NO: 32167 - protein, 9 aa, Dengue virus
GVFTSIGKA

SEQ ID NO: 32168 - protein, 9 aa, Dengue virus
VFTSIGKAL

SEQ ID NO: 32169 - protein, 9 aa, Dengue virus
FTSIGKALH

SEQ ID NO: 32170 - protein, 9 aa, Dengue virus
TSIGKALHQ

SEQ ID NO: 32171 - protein, 9 aa, Dengue virus
SIGKALHQV

SEQ ID NO: 32172 - protein, 9 aa, Dengue virus
IGKALHQVF

SEQ ID NO: 32173 - protein, 9 aa, Dengue virus
GKALHQVFG

SEQ ID NO: 32174 - protein, 9 aa, Dengue virus
KALHQVFGA

SEQ ID NO: 32175 - protein, 9 aa, Dengue virus
ALHQVFGAI

SEQ ID NO: 32176 - protein, 9 aa, Dengue virus
LHQVFGAIY

SEQ ID NO: 32177 - protein, 9 aa, Dengue virus
HQVFGAIYG

SEQ ID NO: 32178 - protein, 9 aa, Dengue virus
QVFGAIYGA

SEQ ID NO: 32179 - protein, 9 aa, Dengue virus
VFGAIYGAA

SEQ ID NO: 32180 - protein, 9 aa, Dengue virus
FGAIYGAAF

SEQ ID NO: 32181 - protein, 9 aa, Dengue virus
GAIYGAAFS

SEQ ID NO: 32182 - protein, 9 aa, Dengue virus
AIYGAAFSG

SEQ ID NO: 32183 - protein, 9 aa, Dengue virus
IYGAAFSGV

SEQ ID NO: 32184 - protein, 9 aa, Dengue virus
YGAAFSGVS

SEQ ID NO: 32185 - protein, 9 aa, Dengue virus
GAAFSGVSW

SEQ ID NO: 32186 - protein, 9 aa, Dengue virus
AAFSGVSWT

SEQ ID NO: 32187 - protein, 9 aa, Dengue virus
AFSGVSWTM

SEQ ID NO: 32188 - protein, 9 aa, Dengue virus
FSGVSWTMK

SEQ ID NO: 32189 - protein, 9 aa, Dengue virus
SGVSWTMKI

SEQ ID NO: 32190 - protein, 9 aa, Dengue virus
GVSWTMKIL

SEQ ID NO: 32191 - protein, 9 aa, Dengue virus
VSWTMKILI

SEQ ID NO: 32192 - protein, 9 aa, Dengue virus
SWTMKILIG

SEQ ID NO: 32193 - protein, 9 aa, Dengue virus
WTMKILIGV

SEQ ID NO: 32194 - protein, 9 aa, Dengue virus
TMKILIGVI

SEQ ID NO: 32195 - protein, 9 aa, Dengue virus
MKILIGVII

SEQ ID NO: 32196 - protein, 9 aa, Dengue virus
KILIGVIIT

SEQ ID NO: 32197 - protein, 9 aa, Dengue virus
ILIGVIITW

SEQ ID NO: 32198 - protein, 9 aa, Dengue virus
LIGVIITWI

SEQ ID NO: 32199 - protein, 9 aa, Dengue virus
IGVIITWIG

SEQ ID NO: 32200 - protein, 9 aa, Dengue virus
GVIITWIGM

SEQ ID NO: 32201 - protein, 9 aa, Dengue virus
VIITWIGMN

SEQ ID NO: 32202 - protein, 9 aa, Dengue virus
IITWIGMNS

SEQ ID NO: 32203 - protein, 9 aa, Dengue virus
ITWIGMNSR

SEQ ID NO: 32204 - protein, 9 aa, Dengue virus
TWIGMNSRS

SEQ ID NO: 32205 - protein, 9 aa, Dengue virus
WIGMNSRST

SEQ ID NO: 32206 - protein, 9 aa, Dengue virus
IGMNSRSTS

SEQ ID NO: 32207 - protein, 9 aa, Dengue virus
GMNSRSTSL

SEQ ID NO: 32208 - protein, 9 aa, Dengue virus
MNSRSTSLS

SEQ ID NO: 32209 - protein, 9 aa, Dengue virus
NSRSTSLSV

SEQ ID NO: 32210 - protein, 9 aa, Dengue virus
SRSTSLSVS

SEQ ID NO: 32211 - protein, 9 aa, Dengue virus
RSTSLSVSL

SEQ ID NO: 32212 - protein, 9 aa, Dengue virus
STSLSVSLV

SEQ ID NO: 32213 - protein, 9 aa, Dengue virus
TSLSVSLVL

SEQ ID NO: 32214 - protein, 9 aa, Dengue virus
SLSVSLVLV

SEQ ID NO: 32215 - protein, 9 aa, Dengue virus
LSVSLVLVG

SEQ ID NO: 32216 - protein, 9 aa, Dengue virus
SVSLVLVGV

SEQ ID NO: 32217 - protein, 9 aa, Dengue virus
VSLVLVGVV

SEQ ID NO: 32218 - protein, 9 aa, Dengue virus
LVLVGVVTL

SEQ ID NO: 32219 - protein, 9 aa, Dengue virus
VLVGVVTLY

SEQ ID NO: 32220 - protein, 9 aa, Dengue virus
LVGVVTLYL

SEQ ID NO: 32221 - protein, 9 aa, Dengue virus
VGVVTLYLG

SEQ ID NO: 32222 - protein, 9 aa, Dengue virus
GVVTLYLGA

SEQ ID NO: 32223 - protein, 9 aa, Dengue virus
VTLYLGVMV

SEQ ID NO: 32224 - protein, 9 aa, Dengue virus
TLYLGVMVQ

SEQ ID NO: 32225 - protein, 9 aa, Dengue virus
LYLGVMVQA

SEQ ID NO: 32226 - protein, 9 aa, Dengue virus
YLGVMVQAD

SEQ ID NO: 32227 - protein, 9 aa, Dengue virus
LGVMVQADS

SEQ ID NO: 32228 - protein, 9 aa, Dengue virus
GVMVQADSG

SEQ ID NO: 32229 - protein, 9 aa, Dengue virus
VMVQADSGC

SEQ ID NO: 32230 - protein, 9 aa, Dengue virus
MVQADSGCV

SEQ ID NO: 32231 - protein, 9 aa, Dengue virus
VQADSGCVV

SEQ ID NO: 32232 - protein, 9 aa, Dengue virus
QADSGCVVS

SEQ ID NO: 32233 - protein, 9 aa, Dengue virus
ADSGCVVSW

SEQ ID NO: 32234 - protein, 9 aa, Dengue virus
DSGCVVSWK

SEQ ID NO: 32235 - protein, 9 aa, Dengue virus
SGCVVSWKN

SEQ ID NO: 32236 - protein, 9 aa, Dengue virus
GCVVSWKNK

SEQ ID NO: 32237 - protein, 9 aa, Dengue virus
CVVSWKNKE

SEQ ID NO: 32238 - protein, 9 aa, Dengue virus
VVSWKNKEL

SEQ ID NO: 32239 - protein, 9 aa, Dengue virus
VSWKNKELK

SEQ ID NO: 32240 - protein, 9 aa, Dengue virus
SWKNKELKC

SEQ ID NO: 32241 - protein, 9 aa, Dengue virus
WKNKELKCG

SEQ ID NO: 32242 - protein, 9 aa, Dengue virus
KNKELKCGS

SEQ ID NO: 32243 - protein, 9 aa, Dengue virus
NKELKCGSG

SEQ ID NO: 32244 - protein, 9 aa, Dengue virus
KELKCGSGI

SEQ ID NO: 32245 - protein, 9 aa, Dengue virus
ELKCGSGIF

SEQ ID NO: 32246 - protein, 9 aa, Dengue virus
LKCGSGIFI

SEQ ID NO: 32247 - protein, 9 aa, Dengue virus
KCGSGIFIT

SEQ ID NO: 32248 - protein, 9 aa, Dengue virus
CGSGIFITD

SEQ ID NO: 32249 - protein, 9 aa, Dengue virus
GSGIFITDN

SEQ ID NO: 32250 - protein, 9 aa, Dengue virus
SGIFITDNV

SEQ ID NO: 32251 - protein, 9 aa, Dengue virus
GIFITDNVH

SEQ ID NO: 32252 - protein, 9 aa, Dengue virus
IFITDNVHT

SEQ ID NO: 32253 - protein, 9 aa, Dengue virus
FITDNVHTW

SEQ ID NO: 32254 - protein, 9 aa, Dengue virus
ITDNVHTWT

SEQ ID NO: 32255 - protein, 9 aa, Dengue virus
TDNVHTWTE

SEQ ID NO: 32256 - protein, 9 aa, Dengue virus
DNVHTWTEQ

SEQ ID NO: 32257 - protein, 9 aa, Dengue virus
NVHTWTEQY

SEQ ID NO: 32258 - protein, 9 aa, Dengue virus
VHTWTEQYK

SEQ ID NO: 32259 - protein, 9 aa, Dengue virus
HTWTEQYKF

SEQ ID NO: 32260 - protein, 9 aa, Dengue virus
TWTEQYKFQ

SEQ ID NO: 32261 - protein, 9 aa, Dengue virus
WTEQYKFQP

SEQ ID NO: 32262 - protein, 9 aa, Dengue virus
TEQYKFQPE

SEQ ID NO: 32263 - protein, 9 aa, Dengue virus
EQYKFQPES

SEQ ID NO: 32264 - protein, 9 aa, Dengue virus
QYKFQPESP

SEQ ID NO: 32265 - protein, 9 aa, Dengue virus
YKFQPESPS

SEQ ID NO: 32266 - protein, 9 aa, Dengue virus
KFQPESPSK

SEQ ID NO: 32267 - protein, 9 aa, Dengue virus
FQPESPSKL

SEQ ID NO: 32268 - protein, 9 aa, Dengue virus
QPESPSKLA

SEQ ID NO: 32269 - protein, 9 aa, Dengue virus
PESPSKLAS

SEQ ID NO: 32270 - protein, 9 aa, Dengue virus
ESPSKLASA

SEQ ID NO: 32271 - protein, 9 aa, Dengue virus
SPSKLASAI

SEQ ID NO: 32272 - protein, 9 aa, Dengue virus
PSKLASAIQ

SEQ ID NO: 32273 - protein, 9 aa, Dengue virus
SKLASAIQK

SEQ ID NO: 32274 - protein, 9 aa, Dengue virus
KLASAIQKA

SEQ ID NO: 32275 - protein, 9 aa, Dengue virus
LASAIQKAH

SEQ ID NO: 32276 - protein, 9 aa, Dengue virus
ASAIQKAHE

SEQ ID NO: 32277 - protein, 9 aa, Dengue virus
SAIQKAHEE

SEQ ID NO: 32278 - protein, 9 aa, Dengue virus
AIQKAHEEG

SEQ ID NO: 32279 - protein, 9 aa, Dengue virus
IQKAHEEGI

SEQ ID NO: 32280 - protein, 9 aa, Dengue virus
QKAHEEGIC

SEQ ID NO: 32281 - protein, 9 aa, Dengue virus
KAHEEGICG

SEQ ID NO: 32282 - protein, 9 aa, Dengue virus
AHEEGICGI

SEQ ID NO: 32283 - protein, 9 aa, Dengue virus
HEEGICGIR

SEQ ID NO: 32284 - protein, 9 aa, Dengue virus
EEGICGIRS

SEQ ID NO: 32285 - protein, 9 aa, Dengue virus
EGICGIRSV

SEQ ID NO: 32286 - protein, 9 aa, Dengue virus
GICGIRSVT

SEQ ID NO: 32287 - protein, 9 aa, Dengue virus
ICGIRSVTR

SEQ ID NO: 32288 - protein, 9 aa, Dengue virus
CGIRSVTRL

SEQ ID NO: 32289 - protein, 9 aa, Dengue virus
GIRSVTRLE

SEQ ID NO: 32290 - protein, 9 aa, Dengue virus
IRSVTRLEN

SEQ ID NO: 32291 - protein, 9 aa, Dengue virus
RSVTRLENL

SEQ ID NO: 32292 - protein, 9 aa, Dengue virus
SVTRLENLM

SEQ ID NO: 32293 - protein, 9 aa, Dengue virus
VTRLENLMW

SEQ ID NO: 32294 - protein, 9 aa, Dengue virus
TRLENLMWK

SEQ ID NO: 32295 - protein, 9 aa, Dengue virus
RLENLMWKQ

SEQ ID NO: 32296 - protein, 9 aa, Dengue virus
LENLMWKQI

SEQ ID NO: 32297 - protein, 9 aa, Dengue virus
ENLMWKQIT

SEQ ID NO: 32298 - protein, 9 aa, Dengue virus
NLMWKQITP

SEQ ID NO: 32299 - protein, 9 aa, Dengue virus
LMWKQITPE

SEQ ID NO: 32300 - protein, 9 aa, Dengue virus
MWKQITPEL

SEQ ID NO: 32301 - protein, 9 aa, Dengue virus
WKQITPELN

SEQ ID NO: 32302 - protein, 9 aa, Dengue virus
KQITPELNH

SEQ ID NO: 32303 - protein, 9 aa, Dengue virus
QITPELNHI

SEQ ID NO: 32304 - protein, 9 aa, Dengue virus
ITPELNHIL

SEQ ID NO: 32305 - protein, 9 aa, Dengue virus
TPELNHILS

SEQ ID NO: 32306 - protein, 9 aa, Dengue virus
PELNHILSE

SEQ ID NO: 32307 - protein, 9 aa, Dengue virus
ELNHILSEN

SEQ ID NO: 32308 - protein, 9 aa, Dengue virus
LNHILSENE

SEQ ID NO: 32309 - protein, 9 aa, Dengue virus
NHILSENEV

SEQ ID NO: 32310 - protein, 9 aa, Dengue virus
HILSENEVK

SEQ ID NO: 32311 - protein, 9 aa, Dengue virus
ILSENEVKL

SEQ ID NO: 32312 - protein, 9 aa, Dengue virus
LSENEVKLT

SEQ ID NO: 32313 - protein, 9 aa, Dengue virus
SENEVKLTI

SEQ ID NO: 32314 - protein, 9 aa, Dengue virus
ENEVKLTIM

SEQ ID NO: 32315 - protein, 9 aa, Dengue virus
NEVKLTIMT

SEQ ID NO: 32316 - protein, 9 aa, Dengue virus
EVKLTIMTG

SEQ ID NO: 32317 - protein, 9 aa, Dengue virus
VKLTIMTGD

SEQ ID NO: 32318 - protein, 9 aa, Dengue virus
KLTIMTGDI

SEQ ID NO: 32319 - protein, 9 aa, Dengue virus
LTIMTGDIK

SEQ ID NO: 32320 - protein, 9 aa, Dengue virus
TIMTGDIKG

SEQ ID NO: 32321 - protein, 9 aa, Dengue virus
IMTGDIKGI

SEQ ID NO: 32322 - protein, 9 aa, Dengue virus
MTGDIKGIM

SEQ ID NO: 32323 - protein, 9 aa, Dengue virus
TGDIKGIMQ

SEQ ID NO: 32324 - protein, 9 aa, Dengue virus
KGIMQAGKR

SEQ ID NO: 32325 - protein, 9 aa, Dengue virus
GIMQAGKRS

SEQ ID NO: 32326 - protein, 9 aa, Dengue virus
IMQAGKRSL

SEQ ID NO: 32327 - protein, 9 aa, Dengue virus
GKRSLRPQP

SEQ ID NO: 32328 - protein, 9 aa, Dengue virus
KRSLRPQPT

SEQ ID NO: 32329 - protein, 9 aa, Dengue virus
RSLRPQPTE

SEQ ID NO: 32330 - protein, 9 aa, Dengue virus
SLRPQPTEL

SEQ ID NO: 32331 - protein, 9 aa, Dengue virus
LRPQPTELK

SEQ ID NO: 32332 - protein, 9 aa, Dengue virus
RPQPTELKY

SEQ ID NO: 32333 - protein, 9 aa, Dengue virus
PQPTELKYS

SEQ ID NO: 32334 - protein, 9 aa, Dengue virus
QPTELKYSW

SEQ ID NO: 32335 - protein, 9 aa, Dengue virus
PTELKYSWK

SEQ ID NO: 32336 - protein, 9 aa, Dengue virus
TELKYSWKT

SEQ ID NO: 32337 - protein, 9 aa, Dengue virus
ELKYSWKTW

SEQ ID NO: 32338 - protein, 9 aa, Dengue virus
LKYSWKTWG

SEQ ID NO: 32339 - protein, 9 aa, Dengue virus
KYSWKTWGK

SEQ ID NO: 32340 - protein, 9 aa, Dengue virus
YSWKTWGKA

SEQ ID NO: 32341 - protein, 9 aa, Dengue virus
SWKTWGKAK

SEQ ID NO: 32342 - protein, 9 aa, Dengue virus
WKTWGKAKM

SEQ ID NO: 32343 - protein, 9 aa, Dengue virus
KTWGKAKML

SEQ ID NO: 32344 - protein, 9 aa, Dengue virus
WGKAKMLST

SEQ ID NO: 32345 - protein, 9 aa, Dengue virus
GKAKMLSTE

SEQ ID NO: 32346 - protein, 9 aa, Dengue virus
HNQTFLIDG

SEQ ID NO: 32347 - protein, 9 aa, Dengue virus
NQTFLIDGP

SEQ ID NO: 32348 - protein, 9 aa, Dengue virus
QTFLIDGPE

SEQ ID NO: 32349 - protein, 9 aa, Dengue virus
TFLIDGPET

SEQ ID NO: 32350 - protein, 9 aa, Dengue virus
FLIDGPETA

SEQ ID NO: 32351 - protein, 9 aa, Dengue virus
LIDGPETAE

SEQ ID NO: 32352 - protein, 9 aa, Dengue virus
IDGPETAEC

SEQ ID NO: 32353 - protein, 9 aa, Dengue virus
DGPETAECP

SEQ ID NO: 32354 - protein, 9 aa, Dengue virus
GPETAECPN

SEQ ID NO: 32355 - protein, 9 aa, Dengue virus
TAECPNTNR

SEQ ID NO: 32356 - protein, 9 aa, Dengue virus
AECPNTNRA

SEQ ID NO: 32357 - protein, 9 aa, Dengue virus
ECPNTNRAW

SEQ ID NO: 32358 - protein, 9 aa, Dengue virus
CPNTNRAWN

SEQ ID NO: 32359 - protein, 9 aa, Dengue virus
PNTNRAWNS

SEQ ID NO: 32360 - protein, 9 aa, Dengue virus
NTNRAWNSL

SEQ ID NO: 32361 - protein, 9 aa, Dengue virus
TNRAWNSLE

SEQ ID NO: 32362 - protein, 9 aa, Dengue virus
NRAWNSLEV

SEQ ID NO: 32363 - protein, 9 aa, Dengue virus
RAWNSLEVE

SEQ ID NO: 32364 - protein, 9 aa, Dengue virus
AWNSLEVED

SEQ ID NO: 32365 - protein, 9 aa, Dengue virus
WNSLEVEDY

SEQ ID NO: 32366 - protein, 9 aa, Dengue virus
NSLEVEDYG

SEQ ID NO: 32367 - protein, 9 aa, Dengue virus
SLEVEDYGF

SEQ ID NO: 32368 - protein, 9 aa, Dengue virus
LEVEDYGFG

SEQ ID NO: 32369 - protein, 9 aa, Dengue virus
EVEDYGFGV

SEQ ID NO: 32370 - protein, 9 aa, Dengue virus
VEDYGFGVF

SEQ ID NO: 32371 - protein, 9 aa, Dengue virus
EDYGFGVFT

SEQ ID NO: 32372 - protein, 9 aa, Dengue virus
DYGFGVFTT

SEQ ID NO: 32373 - protein, 9 aa, Dengue virus
YGFGVFTTN

SEQ ID NO: 32374 - protein, 9 aa, Dengue virus
GFGVFTTNI

SEQ ID NO: 32375 - protein, 9 aa, Dengue virus
FGVFTTNIW

SEQ ID NO: 32376 - protein, 9 aa, Dengue virus
GVFTTNIWL

SEQ ID NO: 32377 - protein, 9 aa, Dengue virus
VFTTNIWLK

SEQ ID NO: 32378 - protein, 9 aa, Dengue virus
FTTNIWLKL

SEQ ID NO: 32379 - protein, 9 aa, Dengue virus
TTNIWLKLR

SEQ ID NO: 32380 - protein, 9 aa, Dengue virus
TNIWLKLRE

SEQ ID NO: 32381 - protein, 9 aa, Dengue virus
NIWLKLREK

SEQ ID NO: 32382 - protein, 9 aa, Dengue virus
IWLKLREKQ

SEQ ID NO: 32383 - protein, 9 aa, Dengue virus
WLKLREKQD

SEQ ID NO: 32384 - protein, 9 aa, Dengue virus
FCDSKLMSA

SEQ ID NO: 32385 - protein, 9 aa, Dengue virus
CDSKLMSAA

SEQ ID NO: 32386 - protein, 9 aa, Dengue virus
DSKLMSAAI

SEQ ID NO: 32387 - protein, 9 aa, Dengue virus
SKLMSAAIK

SEQ ID NO: 32388 - protein, 9 aa, Dengue virus
KLMSAAIKD

SEQ ID NO: 32389 - protein, 9 aa, Dengue virus
LMSAAIKDN

SEQ ID NO: 32390 - protein, 9 aa, Dengue virus
MSAAIKDNR

SEQ ID NO: 32391 - protein, 9 aa, Dengue virus
SAAIKDNRA

SEQ ID NO: 32392 - protein, 9 aa, Dengue virus
AAIKDNRAV

SEQ ID NO: 32393 - protein, 9 aa, Dengue virus
AIKDNRAVH

SEQ ID NO: 32394 - protein, 9 aa, Dengue virus
IKDNRAVHA

SEQ ID NO: 32395 - protein, 9 aa, Dengue virus
KDNRAVHAD

SEQ ID NO: 32396 - protein, 9 aa, Dengue virus
DNRAVHADM

SEQ ID NO: 32397 - protein, 9 aa, Dengue virus
NRAVHADMG

SEQ ID NO: 32398 - protein, 9 aa, Dengue virus
RAVHADMGY

SEQ ID NO: 32399 - protein, 9 aa, Dengue virus
AVHADMGYW

SEQ ID NO: 32400 - protein, 9 aa, Dengue virus
VHADMGYWI

SEQ ID NO: 32401 - protein, 9 aa, Dengue virus
HADMGYWIE

SEQ ID NO: 32402 - protein, 9 aa, Dengue virus
ADMGYWIES

SEQ ID NO: 32403 - protein, 9 aa, Dengue virus
DMGYWIESA

SEQ ID NO: 32404 - protein, 9 aa, Dengue virus
MGYWIESAL

SEQ ID NO: 32405 - protein, 9 aa, Dengue virus
GYWIESALN

SEQ ID NO: 32406 - protein, 9 aa, Dengue virus
YWIESALND

SEQ ID NO: 32407 - protein, 9 aa, Dengue virus
WIESALNDT

SEQ ID NO: 32408 - protein, 9 aa, Dengue virus
IESALNDTW

SEQ ID NO: 32409 - protein, 9 aa, Dengue virus
ESALNDTWK

SEQ ID NO: 32410 - protein, 9 aa, Dengue virus
SALNDTWKM

SEQ ID NO: 32411 - protein, 9 aa, Dengue virus
ALNDTWKME

SEQ ID NO: 32412 - protein, 9 aa, Dengue virus
LNDTWKMEK

SEQ ID NO: 32413 - protein, 9 aa, Dengue virus
NDTWKMEKA

SEQ ID NO: 32414 - protein, 9 aa, Dengue virus
DTWKMEKAS

SEQ ID NO: 32415 - protein, 9 aa, Dengue virus
TWKMEKASF

SEQ ID NO: 32416 - protein, 9 aa, Dengue virus
WKMEKASFI

SEQ ID NO: 32417 - protein, 9 aa, Dengue virus
KMEKASFIE

SEQ ID NO: 32418 - protein, 9 aa, Dengue virus
MEKASFIEV

SEQ ID NO: 32419 - protein, 9 aa, Dengue virus
EKASFIEVK

SEQ ID NO: 32420 - protein, 9 aa, Dengue virus
KASFIEVKS

SEQ ID NO: 32421 - protein, 9 aa, Dengue virus
ASFIEVKSC

SEQ ID NO: 32422 - protein, 9 aa, Dengue virus
SFIEVKSCH

SEQ ID NO: 32423 - protein, 9 aa, Dengue virus
FIEVKSCHW

SEQ ID NO: 32424 - protein, 9 aa, Dengue virus
IEVKSCHWP

SEQ ID NO: 32425 - protein, 9 aa, Dengue virus
EVKSCHWPK

SEQ ID NO: 32426 - protein, 9 aa, Dengue virus
VKSCHWPKS

SEQ ID NO: 32427 - protein, 9 aa, Dengue virus
KSCHWPKSH

SEQ ID NO: 32428 - protein, 9 aa, Dengue virus
SCHWPKSHT

SEQ ID NO: 32429 - protein, 9 aa, Dengue virus
CHWPKSHTL

SEQ ID NO: 32430 - protein, 9 aa, Dengue virus
HWPKSHTLW

SEQ ID NO: 32431 - protein, 9 aa, Dengue virus
WPKSHTLWS

SEQ ID NO: 32432 - protein, 9 aa, Dengue virus
PKSHTLWSN

SEQ ID NO: 32433 - protein, 9 aa, Dengue virus
KSHTLWSNG

SEQ ID NO: 32434 - protein, 9 aa, Dengue virus
SHTLWSNGV

SEQ ID NO: 32435 - protein, 9 aa, Dengue virus
HTLWSNGVL

SEQ ID NO: 32436 - protein, 9 aa, Dengue virus
TLWSNGVLE

SEQ ID NO: 32437 - protein, 9 aa, Dengue virus
LWSNGVLES

SEQ ID NO: 32438 - protein, 9 aa, Dengue virus
WSNGVLESE

SEQ ID NO: 32439 - protein, 9 aa, Dengue virus
SNGVLESEM

SEQ ID NO: 32440 - protein, 9 aa, Dengue virus
NGVLESEMI

SEQ ID NO: 32441 - protein, 9 aa, Dengue virus
GVLESEMII

SEQ ID NO: 32442 - protein, 9 aa, Dengue virus
VLESEMIIP

SEQ ID NO: 32443 - protein, 9 aa, Dengue virus
LESEMIIPK

SEQ ID NO: 32444 - protein, 9 aa, Dengue virus
ESEMIIPKN

SEQ ID NO: 32445 - protein, 9 aa, Dengue virus
IPKNFAGPV

SEQ ID NO: 32446 - protein, 9 aa, Dengue virus
PKNFAGPVS

SEQ ID NO: 32447 - protein, 9 aa, Dengue virus
KNFAGPVSQ

SEQ ID NO: 32448 - protein, 9 aa, Dengue virus
NFAGPVSQH

SEQ ID NO: 32449 - protein, 9 aa, Dengue virus
FAGPVSQHN

SEQ ID NO: 32450 - protein, 9 aa, Dengue virus
AGPVSQHNY

SEQ ID NO: 32451 - protein, 9 aa, Dengue virus
GPVSQHNYR

SEQ ID NO: 32452 - protein, 9 aa, Dengue virus
PVSQHNYRP

SEQ ID NO: 32453 - protein, 9 aa, Dengue virus
VSQHNYRPG

SEQ ID NO: 32454 - protein, 9 aa, Dengue virus
SQHNYRPGY

SEQ ID NO: 32455 - protein, 9 aa, Dengue virus
QHNYRPGYH

SEQ ID NO: 32456 - protein, 9 aa, Dengue virus
HNYRPGYHT

SEQ ID NO: 32457 - protein, 9 aa, Dengue virus
NYRPGYHTQ

SEQ ID NO: 32458 - protein, 9 aa, Dengue virus
RPGYHTQTA

SEQ ID NO: 32459 - protein, 9 aa, Dengue virus
PGYHTQTAG

SEQ ID NO: 32460 - protein, 9 aa, Dengue virus
GYHTQTAGP

SEQ ID NO: 32461 - protein, 9 aa, Dengue virus
YHTQTAGPW

SEQ ID NO: 32462 - protein, 9 aa, Dengue virus
HTQTAGPWH

SEQ ID NO: 32463 - protein, 9 aa, Dengue virus
TQTAGPWHL

SEQ ID NO: 32464 - protein, 9 aa, Dengue virus
QTAGPWHLG

SEQ ID NO: 32465 - protein, 9 aa, Dengue virus
TAGPWHLGK

SEQ ID NO: 32466 - protein, 9 aa, Dengue virus
AGPWHLGKL

SEQ ID NO: 32467 - protein, 9 aa, Dengue virus
GPWHLGKLE

SEQ ID NO: 32468 - protein, 9 aa, Dengue virus
PWHLGKLEM

SEQ ID NO: 32469 - protein, 9 aa, Dengue virus
WHLGKLEMD

SEQ ID NO: 32470 - protein, 9 aa, Dengue virus
HLGKLEMDF

SEQ ID NO: 32471 - protein, 9 aa, Dengue virus
LGKLEMDFD

SEQ ID NO: 32472 - protein, 9 aa, Dengue virus
GKLEMDFDF

SEQ ID NO: 32473 - protein, 9 aa, Dengue virus
KLEMDFDFC

SEQ ID NO: 32474 - protein, 9 aa, Dengue virus
LEMDFDFCE

SEQ ID NO: 32475 - protein, 9 aa, Dengue virus
EMDFDFCEG

SEQ ID NO: 32476 - protein, 9 aa, Dengue virus
MDFDFCEGT

SEQ ID NO: 32477 - protein, 9 aa, Dengue virus
DFDFCEGTT

SEQ ID NO: 32478 - protein, 9 aa, Dengue virus
FDFCEGTTV

SEQ ID NO: 32479 - protein, 9 aa, Dengue virus
FCEGTTVVV

SEQ ID NO: 32480 - protein, 9 aa, Dengue virus
CEGTTVVVT

SEQ ID NO: 32481 - protein, 9 aa, Dengue virus
EGTTVVVTE

SEQ ID NO: 32482 - protein, 9 aa, Dengue virus
GTTVVVTED

SEQ ID NO: 32483 - protein, 9 aa, Dengue virus
TTVVVTEDC

SEQ ID NO: 32484 - protein, 9 aa, Dengue virus
TVVVTEDCG

SEQ ID NO: 32485 - protein, 9 aa, Dengue virus
VVVTEDCGN

SEQ ID NO: 32486 - protein, 9 aa, Dengue virus
VVTEDCGNR

SEQ ID NO: 32487 - protein, 9 aa, Dengue virus
VTEDCGNRG

SEQ ID NO: 32488 - protein, 9 aa, Dengue virus
TEDCGNRGP

SEQ ID NO: 32489 - protein, 9 aa, Dengue virus
EDCGNRGPS

SEQ ID NO: 32490 - protein, 9 aa, Dengue virus
DCGNRGPSL

SEQ ID NO: 32491 - protein, 9 aa, Dengue virus
CGNRGPSLR

SEQ ID NO: 32492 - protein, 9 aa, Dengue virus
GNRGPSLRT

SEQ ID NO: 32493 - protein, 9 aa, Dengue virus
NRGPSLRTT

SEQ ID NO: 32494 - protein, 9 aa, Dengue virus
RGPSLRTTT

SEQ ID NO: 32495 - protein, 9 aa, Dengue virus
GPSLRTTTA

SEQ ID NO: 32496 - protein, 9 aa, Dengue virus
PSLRTTTAS

SEQ ID NO: 32497 - protein, 9 aa, Dengue virus
SLRTTTASG

SEQ ID NO: 32498 - protein, 9 aa, Dengue virus
LRTTTASGK

SEQ ID NO: 32499 - protein, 9 aa, Dengue virus
RTTTASGKL

SEQ ID NO: 32500 - protein, 9 aa, Dengue virus
TTTASGKLI

SEQ ID NO: 32501 - protein, 9 aa, Dengue virus
TTASGKLIT

SEQ ID NO: 32502 - protein, 9 aa, Dengue virus
TASGKLITE

SEQ ID NO: 32503 - protein, 9 aa, Dengue virus
ASGKLITEW

SEQ ID NO: 32504 - protein, 9 aa, Dengue virus
SGKLITEWC

SEQ ID NO: 32505 - protein, 9 aa, Dengue virus
GKLITEWCC

SEQ ID NO: 32506 - protein, 9 aa, Dengue virus
KLITEWCCR

SEQ ID NO: 32507 - protein, 9 aa, Dengue virus
LITEWCCRS

SEQ ID NO: 32508 - protein, 9 aa, Dengue virus
ITEWCCRSC

SEQ ID NO: 32509 - protein, 9 aa, Dengue virus
TEWCCRSCT

SEQ ID NO: 32510 - protein, 9 aa, Dengue virus
EWCCRSCTL

SEQ ID NO: 32511 - protein, 9 aa, Dengue virus
WCCRSCTLP

SEQ ID NO: 32512 - protein, 9 aa, Dengue virus
CCRSCTLPP

SEQ ID NO: 32513 - protein, 9 aa, Dengue virus
CRSCTLPPL

SEQ ID NO: 32514 - protein, 9 aa, Dengue virus
RSCTLPPLR

SEQ ID NO: 32515 - protein, 9 aa, Dengue virus
SCTLPPLRY

SEQ ID NO: 32516 - protein, 9 aa, Dengue virus
CTLPPLRYR

SEQ ID NO: 32517 - protein, 9 aa, Dengue virus
TLPPLRYRG

SEQ ID NO: 32518 - protein, 9 aa, Dengue virus
LPPLRYRGE

SEQ ID NO: 32519 - protein, 9 aa, Dengue virus
PPLRYRGED

SEQ ID NO: 32520 - protein, 9 aa, Dengue virus
PLRYRGEDG

SEQ ID NO: 32521 - protein, 9 aa, Dengue virus
LRYRGEDGC

SEQ ID NO: 32522 - protein, 9 aa, Dengue virus
RYRGEDGCW

SEQ ID NO: 32523 - protein, 9 aa, Dengue virus
YRGEDGCWY

SEQ ID NO: 32524 - protein, 9 aa, Dengue virus
RGEDGCWYG

SEQ ID NO: 32525 - protein, 9 aa, Dengue virus
GEDGCWYGM

SEQ ID NO: 32526 - protein, 9 aa, Dengue virus
EDGCWYGME

SEQ ID NO: 32527 - protein, 9 aa, Dengue virus
DGCWYGMEI

SEQ ID NO: 32528 - protein, 9 aa, Dengue virus
GCWYGMEIR

SEQ ID NO: 32529 - protein, 9 aa, Dengue virus
CWYGMEIRP

SEQ ID NO: 32530 - protein, 9 aa, Dengue virus
WYGMEIRPL

SEQ ID NO: 32531 - protein, 9 aa, Dengue virus
YGMEIRPLK

SEQ ID NO: 32532 - protein, 9 aa, Dengue virus
GMEIRPLKE

SEQ ID NO: 32533 - protein, 9 aa, Dengue virus
MEIRPLKEK

SEQ ID NO: 32534 - protein, 9 aa, Dengue virus
EIRPLKEKE

SEQ ID NO: 32535 - protein, 9 aa, Dengue virus
IRPLKEKEE

SEQ ID NO: 32536 - protein, 9 aa, Dengue virus
RPLKEKEEN

SEQ ID NO: 32537 - protein, 9 aa, Dengue virus
PLKEKEENL

SEQ ID NO: 32538 - protein, 9 aa, Dengue virus
LKEKEENLV

SEQ ID NO: 32539 - protein, 9 aa, Dengue virus
KEKEENLVN

SEQ ID NO: 32540 - protein, 9 aa, Dengue virus
EKEENLVNS

SEQ ID NO: 32541 - protein, 9 aa, Dengue virus
KEENLVNSL

SEQ ID NO: 32542 - protein, 9 aa, Dengue virus
EENLVNSLV

SEQ ID NO: 32543 - protein, 9 aa, Dengue virus
ENLVNSLVT

SEQ ID NO: 32544 - protein, 9 aa, Dengue virus
NLVNSLVTA

SEQ ID NO: 32545 - protein, 9 aa, Dengue virus
LVNSLVTAG

SEQ ID NO: 32546 - protein, 9 aa, Dengue virus
VNSLVTAGH

SEQ ID NO: 32547 - protein, 9 aa, Dengue virus
NSLVTAGHG

SEQ ID NO: 32548 - protein, 9 aa, Dengue virus
SLVTAGHGQ

SEQ ID NO: 32549 - protein, 9 aa, Dengue virus
LVTAGHGQI

SEQ ID NO: 32550 - protein, 9 aa, Dengue virus
VTAGHGQID

SEQ ID NO: 32551 - protein, 9 aa, Dengue virus
TAGHGQIDN

SEQ ID NO: 32552 - protein, 9 aa, Dengue virus
AGHGQIDNF

SEQ ID NO: 32553 - protein, 9 aa, Dengue virus
GHGQIDNFS

SEQ ID NO: 32554 - protein, 9 aa, Dengue virus
HGQIDNFSL

SEQ ID NO: 32555 - protein, 9 aa, Dengue virus
GQIDNFSLG

SEQ ID NO: 32556 - protein, 9 aa, Dengue virus
QIDNFSLGV

SEQ ID NO: 32557 - protein, 9 aa, Dengue virus
IDNFSLGVL

SEQ ID NO: 32558 - protein, 9 aa, Dengue virus
DNFSLGVLG

SEQ ID NO: 32559 - protein, 9 aa, Dengue virus
NFSLGVLGM

SEQ ID NO: 32560 - protein, 9 aa, Dengue virus
FSLGVLGMA

SEQ ID NO: 32561 - protein, 9 aa, Dengue virus
SLGVLGMAL

SEQ ID NO: 32562 - protein, 9 aa, Dengue virus
LGVLGMALF

SEQ ID NO: 32563 - protein, 9 aa, Dengue virus
GVLGMALFL

SEQ ID NO: 32564 - protein, 9 aa, Dengue virus
VLGMALFLE

SEQ ID NO: 32565 - protein, 9 aa, Dengue virus
LGMALFLEE

SEQ ID NO: 32566 - protein, 9 aa, Dengue virus
GMALFLEEM

SEQ ID NO: 32567 - protein, 9 aa, Dengue virus
MALFLEEML

SEQ ID NO: 32568 - protein, 9 aa, Dengue virus
ALFLEEMLR

SEQ ID NO: 32569 - protein, 9 aa, Dengue virus
LFLEEMLRT

SEQ ID NO: 32570 - protein, 9 aa, Dengue virus
FLEEMLRTR

SEQ ID NO: 32571 - protein, 9 aa, Dengue virus
LEEMLRTRV

SEQ ID NO: 32572 - protein, 9 aa, Dengue virus
EEMLRTRVG

SEQ ID NO: 32573 - protein, 9 aa, Dengue virus
EMLRTRVGT

SEQ ID NO: 32574 - protein, 9 aa, Dengue virus
MLRTRVGTK

SEQ ID NO: 32575 - protein, 9 aa, Dengue virus
LRTRVGTKH

SEQ ID NO: 32576 - protein, 9 aa, Dengue virus
RTRVGTKHA

SEQ ID NO: 32577 - protein, 9 aa, Dengue virus
SFVTLITGN

SEQ ID NO: 32578 - protein, 9 aa, Dengue virus
FVTLITGNM

SEQ ID NO: 32579 - protein, 9 aa, Dengue virus
VTLITGNMS

SEQ ID NO: 32580 - protein, 9 aa, Dengue virus
TLITGNMSF

SEQ ID NO: 32581 - protein, 9 aa, Dengue virus
LITGNMSFR

SEQ ID NO: 32582 - protein, 9 aa, Dengue virus
ITGNMSFRD

SEQ ID NO: 32583 - protein, 9 aa, Dengue virus
TGNMSFRDL

SEQ ID NO: 32584 - protein, 9 aa, Dengue virus
GNMSFRDLG

SEQ ID NO: 32585 - protein, 9 aa, Dengue virus
NMSFRDLGR

SEQ ID NO: 32586 - protein, 9 aa, Dengue virus
MSFRDLGRV

SEQ ID NO: 32587 - protein, 9 aa, Dengue virus
SFRDLGRVM

SEQ ID NO: 32588 - protein, 9 aa, Dengue virus
RDLGRVMVM

SEQ ID NO: 32589 - protein, 9 aa, Dengue virus
DLGRVMVMV

SEQ ID NO: 32590 - protein, 9 aa, Dengue virus
LGRVMVMVG

SEQ ID NO: 32591 - protein, 9 aa, Dengue virus
GRVMVMVGA

SEQ ID NO: 32592 - protein, 9 aa, Dengue virus
TDDIGMGVT

SEQ ID NO: 32593 - protein, 9 aa, Dengue virus
DDIGMGVTY

SEQ ID NO: 32594 - protein, 9 aa, Dengue virus
DIGMGVTYL

SEQ ID NO: 32595 - protein, 9 aa, Dengue virus
IGMGVTYLA

SEQ ID NO: 32596 - protein, 9 aa, Dengue virus
GMGVTYLAL

SEQ ID NO: 32597 - protein, 9 aa, Dengue virus
MGVTYLALL

SEQ ID NO: 32598 - protein, 9 aa, Dengue virus
GVTYLALLA

SEQ ID NO: 32599 - protein, 9 aa, Dengue virus
VTYLALLAA

SEQ ID NO: 32600 - protein, 9 aa, Dengue virus
TYLALLAAF

SEQ ID NO: 32601 - protein, 9 aa, Dengue virus
YLALLAAFK

SEQ ID NO: 32602 - protein, 9 aa, Dengue virus
LALLAAFKV

SEQ ID NO: 32603 - protein, 9 aa, Dengue virus
ALLAAFKVR

SEQ ID NO: 32604 - protein, 9 aa, Dengue virus
LLAAFKVRP

SEQ ID NO: 32605 - protein, 9 aa, Dengue virus
LAAFKVRPT

SEQ ID NO: 32606 - protein, 9 aa, Dengue virus
AAFKVRPTF

SEQ ID NO: 32607 - protein, 9 aa, Dengue virus
AFKVRPTFA

SEQ ID NO: 32608 - protein, 9 aa, Dengue virus
FKVRPTFAA

SEQ ID NO: 32609 - protein, 9 aa, Dengue virus
KVRPTFAAG

SEQ ID NO: 32610 - protein, 9 aa, Dengue virus
VRPTFAAGL

SEQ ID NO: 32611 - protein, 9 aa, Dengue virus
RPTFAAGLL

SEQ ID NO: 32612 - protein, 9 aa, Dengue virus
PTFAAGLLL

SEQ ID NO: 32613 - protein, 9 aa, Dengue virus
TFAAGLLLR

SEQ ID NO: 32614 - protein, 9 aa, Dengue virus
FAAGLLLRK

SEQ ID NO: 32615 - protein, 9 aa, Dengue virus
AAGLLLRKL

SEQ ID NO: 32616 - protein, 9 aa, Dengue virus
AGLLLRKLT

SEQ ID NO: 32617 - protein, 9 aa, Dengue virus
GLLLRKLTS

SEQ ID NO: 32618 - protein, 9 aa, Dengue virus
LLLRKLTSK

SEQ ID NO: 32619 - protein, 9 aa, Dengue virus
LLRKLTSKE

SEQ ID NO: 32620 - protein, 9 aa, Dengue virus
LRKLTSKEL

SEQ ID NO: 32621 - protein, 9 aa, Dengue virus
RKLTSKELM

SEQ ID NO: 32622 - protein, 9 aa, Dengue virus
KLTSKELMM

SEQ ID NO: 32623 - protein, 9 aa, Dengue virus
LTSKELMMA

SEQ ID NO: 32624 - protein, 9 aa, Dengue virus
TSKELMMAT

SEQ ID NO: 32625 - protein, 9 aa, Dengue virus
SKELMMATI

SEQ ID NO: 32626 - protein, 9 aa, Dengue virus
KELMMATIG

SEQ ID NO: 32627 - protein, 9 aa, Dengue virus
ELMMATIGI

SEQ ID NO: 32628 - protein, 9 aa, Dengue virus
TIGIALLSQ

SEQ ID NO: 32629 - protein, 9 aa, Dengue virus
IGIALLSQS

SEQ ID NO: 32630 - protein, 9 aa, Dengue virus
PETILELTD

SEQ ID NO: 32631 - protein, 9 aa, Dengue virus
ETILELTDA

SEQ ID NO: 32632 - protein, 9 aa, Dengue virus
TILELTDAL

SEQ ID NO: 32633 - protein, 9 aa, Dengue virus
ILELTDALA

SEQ ID NO: 32634 - protein, 9 aa, Dengue virus
LELTDALAL

SEQ ID NO: 32635 - protein, 9 aa, Dengue virus
ELTDALALG

SEQ ID NO: 32636 - protein, 9 aa, Dengue virus
LTDALALGM

SEQ ID NO: 32637 - protein, 9 aa, Dengue virus
TDALALGMM

SEQ ID NO: 32638 - protein, 9 aa, Dengue virus
DALALGMMV

SEQ ID NO: 32639 - protein, 9 aa, Dengue virus
ALALGMMVL

SEQ ID NO: 32640 - protein, 9 aa, Dengue virus
LALGMMVLK

SEQ ID NO: 32641 - protein, 9 aa, Dengue virus
VRNMEKYQL

SEQ ID NO: 32642 - protein, 9 aa, Dengue virus
NMEKYQLAV

SEQ ID NO: 32643 - protein, 9 aa, Dengue virus
MEKYQLAVT

SEQ ID NO: 32644 - protein, 9 aa, Dengue virus
EKYQLAVTI

SEQ ID NO: 32645 - protein, 9 aa, Dengue virus
KYQLAVTIM

SEQ ID NO: 32646 - protein, 9 aa, Dengue virus
YQLAVTIMA

SEQ ID NO: 32647 - protein, 9 aa, Dengue virus
ISCVPNAVI

SEQ ID NO: 32648 - protein, 9 aa, Dengue virus
SCVPNAVIL

SEQ ID NO: 32649 - protein, 9 aa, Dengue virus
CVPNAVILQ

SEQ ID NO: 32650 - protein, 9 aa, Dengue virus
VPNAVILQN

SEQ ID NO: 32651 - protein, 9 aa, Dengue virus
PNAVILQNA

SEQ ID NO: 32652 - protein, 9 aa, Dengue virus
NAVILQNAW

SEQ ID NO: 32653 - protein, 9 aa, Dengue virus
AWKVSCTIL

SEQ ID NO: 32654 - protein, 9 aa, Dengue virus
WKVSCTILA

SEQ ID NO: 32655 - protein, 9 aa, Dengue virus
CTILAAVSV

SEQ ID NO: 32656 - protein, 9 aa, Dengue virus
ILAAVSVSP

SEQ ID NO: 32657 - protein, 9 aa, Dengue virus
LAAVSVSPL

SEQ ID NO: 32658 - protein, 9 aa, Dengue virus
VSVSPLLLT

SEQ ID NO: 32659 - protein, 9 aa, Dengue virus
SVSPLLLTS

SEQ ID NO: 32660 - protein, 9 aa, Dengue virus
VSPLLLTSS

SEQ ID NO: 32661 - protein, 9 aa, Dengue virus
SPLLLTSSQ

SEQ ID NO: 32662 - protein, 9 aa, Dengue virus
PLLLTSSQQ

SEQ ID NO: 32663 - protein, 9 aa, Dengue virus
LLLTSSQQK

SEQ ID NO: 32664 - protein, 9 aa, Dengue virus
LTSSQQKAD

SEQ ID NO: 32665 - protein, 9 aa, Dengue virus
TSSQQKADW

SEQ ID NO: 32666 - protein, 9 aa, Dengue virus
SSQQKADWI

SEQ ID NO: 32667 - protein, 9 aa, Dengue virus
SQQKADWIP

SEQ ID NO: 32668 - protein, 9 aa, Dengue virus
QQKADWIPL

SEQ ID NO: 32669 - protein, 9 aa, Dengue virus
QKADWIPLA

SEQ ID NO: 32670 - protein, 9 aa, Dengue virus
KADWIPLAL

SEQ ID NO: 32671 - protein, 9 aa, Dengue virus
ADWIPLALT

SEQ ID NO: 32672 - protein, 9 aa, Dengue virus
DWIPLALTI

SEQ ID NO: 32673 - protein, 9 aa, Dengue virus
WIPLALTIK

SEQ ID NO: 32674 - protein, 9 aa, Dengue virus
IPLALTIKG

SEQ ID NO: 32675 - protein, 9 aa, Dengue virus
PLALTIKGL

SEQ ID NO: 32676 - protein, 9 aa, Dengue virus
LALTIKGLN

SEQ ID NO: 32677 - protein, 9 aa, Dengue virus
ALTIKGLNP

SEQ ID NO: 32678 - protein, 9 aa, Dengue virus
LTIKGLNPT

SEQ ID NO: 32679 - protein, 9 aa, Dengue virus
TIKGLNPTA

SEQ ID NO: 32680 - protein, 9 aa, Dengue virus
IKGLNPTAI

SEQ ID NO: 32681 - protein, 9 aa, Dengue virus
KGLNPTAIF

SEQ ID NO: 32682 - protein, 9 aa, Dengue virus
GLNPTAIFL

SEQ ID NO: 32683 - protein, 9 aa, Dengue virus
LNPTAIFLT

SEQ ID NO: 32684 - protein, 9 aa, Dengue virus
NPTAIFLTT

SEQ ID NO: 32685 - protein, 9 aa, Dengue virus
PTAIFLTTL

SEQ ID NO: 32686 - protein, 9 aa, Dengue virus
TAIFLTTLS

SEQ ID NO: 32687 - protein, 9 aa, Dengue virus
AIFLTTLSR

SEQ ID NO: 32688 - protein, 9 aa, Dengue virus
IFLTTLSRT

SEQ ID NO: 32689 - protein, 9 aa, Dengue virus
FLTTLSRTS

SEQ ID NO: 32690 - protein, 9 aa, Dengue virus
LTTLSRTSK

SEQ ID NO: 32691 - protein, 9 aa, Dengue virus
TTLSRTSKK

SEQ ID NO: 32692 - protein, 9 aa, Dengue virus
TLSRTSKKR

SEQ ID NO: 32693 - protein, 9 aa, Dengue virus
LSRTSKKRS

SEQ ID NO: 32694 - protein, 9 aa, Dengue virus
SRTSKKRSW

SEQ ID NO: 32695 - protein, 9 aa, Dengue virus
RTSKKRSWP

SEQ ID NO: 32696 - protein, 9 aa, Dengue virus
TSKKRSWPL

SEQ ID NO: 32697 - protein, 9 aa, Dengue virus
SKKRSWPLN

SEQ ID NO: 32698 - protein, 9 aa, Dengue virus
KKRSWPLNE

SEQ ID NO: 32699 - protein, 9 aa, Dengue virus
KRSWPLNEA

SEQ ID NO: 32700 - protein, 9 aa, Dengue virus
RSWPLNEAI

SEQ ID NO: 32701 - protein, 9 aa, Dengue virus
SWPLNEAIM

SEQ ID NO: 32702 - protein, 9 aa, Dengue virus
WPLNEAIMA

SEQ ID NO: 32703 - protein, 9 aa, Dengue virus
PLNEAIMAV

SEQ ID NO: 32704 - protein, 9 aa, Dengue virus
LNEAIMAVG

SEQ ID NO: 32705 - protein, 9 aa, Dengue virus
NEAIMAVGM

SEQ ID NO: 32706 - protein, 9 aa, Dengue virus
EAIMAVGMV

SEQ ID NO: 32707 - protein, 9 aa, Dengue virus
AIMAVGMVS

SEQ ID NO: 32708 - protein, 9 aa, Dengue virus
IMAVGMVSI

SEQ ID NO: 32709 - protein, 9 aa, Dengue virus
MAVGMVSIL

SEQ ID NO: 32710 - protein, 9 aa, Dengue virus
AVGMVSILA

SEQ ID NO: 32711 - protein, 9 aa, Dengue virus
VGMVSILAS

SEQ ID NO: 32712 - protein, 9 aa, Dengue virus
GMVSILASS

SEQ ID NO: 32713 - protein, 9 aa, Dengue virus
MVSILASSL

SEQ ID NO: 32714 - protein, 9 aa, Dengue virus
VSILASSLL

SEQ ID NO: 32715 - protein, 9 aa, Dengue virus
SILASSLLK

SEQ ID NO: 32716 - protein, 9 aa, Dengue virus
ILASSLLKN

SEQ ID NO: 32717 - protein, 9 aa, Dengue virus
LASSLLKND

SEQ ID NO: 32718 - protein, 9 aa, Dengue virus
ASSLLKNDI

SEQ ID NO: 32719 - protein, 9 aa, Dengue virus
SSLLKNDIP

SEQ ID NO: 32720 - protein, 9 aa, Dengue virus
SLLKNDIPM

SEQ ID NO: 32721 - protein, 9 aa, Dengue virus
LLKNDIPMT

SEQ ID NO: 32722 - protein, 9 aa, Dengue virus
LKNDIPMTG

SEQ ID NO: 32723 - protein, 9 aa, Dengue virus
KNDIPMTGP

SEQ ID NO: 32724 - protein, 9 aa, Dengue virus
NDIPMTGPL

SEQ ID NO: 32725 - protein, 9 aa, Dengue virus
DIPMTGPLV

SEQ ID NO: 32726 - protein, 9 aa, Dengue virus
IPMTGPLVA

SEQ ID NO: 32727 - protein, 9 aa, Dengue virus
PMTGPLVAG

SEQ ID NO: 32728 - protein, 9 aa, Dengue virus
MTGPLVAGG

SEQ ID NO: 32729 - protein, 9 aa, Dengue virus
TGPLVAGGL

SEQ ID NO: 32730 - protein, 9 aa, Dengue virus
GPLVAGGLL

SEQ ID NO: 32731 - protein, 9 aa, Dengue virus
PLVAGGLLT

SEQ ID NO: 32732 - protein, 9 aa, Dengue virus
LVAGGLLTV

SEQ ID NO: 32733 - protein, 9 aa, Dengue virus
VAGGLLTVC

SEQ ID NO: 32734 - protein, 9 aa, Dengue virus
AGGLLTVCY

SEQ ID NO: 32735 - protein, 9 aa, Dengue virus
GGLLTVCYV

SEQ ID NO: 32736 - protein, 9 aa, Dengue virus
GLLTVCYVL

SEQ ID NO: 32737 - protein, 9 aa, Dengue virus
LLTVCYVLT

SEQ ID NO: 32738 - protein, 9 aa, Dengue virus
LTVCYVLTG

SEQ ID NO: 32739 - protein, 9 aa, Dengue virus
TVCYVLTGR

SEQ ID NO: 32740 - protein, 9 aa, Dengue virus
VCYVLTGRS

SEQ ID NO: 32741 - protein, 9 aa, Dengue virus
CYVLTGRSA

SEQ ID NO: 32742 - protein, 9 aa, Dengue virus
YVLTGRSAD

SEQ ID NO: 32743 - protein, 9 aa, Dengue virus
VLTGRSADL

SEQ ID NO: 32744 - protein, 9 aa, Dengue virus
LTGRSADLE

SEQ ID NO: 32745 - protein, 9 aa, Dengue virus
TGRSADLEL

SEQ ID NO: 32746 - protein, 9 aa, Dengue virus
GRSADLELE

SEQ ID NO: 32747 - protein, 9 aa, Dengue virus
RSADLELER

SEQ ID NO: 32748 - protein, 9 aa, Dengue virus
SADLELERA

SEQ ID NO: 32749 - protein, 9 aa, Dengue virus
ADLELERAA

SEQ ID NO: 32750 - protein, 9 aa, Dengue virus
DLELERAAD

SEQ ID NO: 32751 - protein, 9 aa, Dengue virus
LELERAADV

SEQ ID NO: 32752 - protein, 9 aa, Dengue virus
VKWEDQAEI

SEQ ID NO: 32753 - protein, 9 aa, Dengue virus
KWEDQAEIS

SEQ ID NO: 32754 - protein, 9 aa, Dengue virus
WEDQAEISG

SEQ ID NO: 32755 - protein, 9 aa, Dengue virus
EDQAEISGS

SEQ ID NO: 32756 - protein, 9 aa, Dengue virus
DQAEISGSS

SEQ ID NO: 32757 - protein, 9 aa, Dengue virus
QAEISGSSP

SEQ ID NO: 32758 - protein, 9 aa, Dengue virus
AEISGSSPI

SEQ ID NO: 32759 - protein, 9 aa, Dengue virus
EISGSSPIL

SEQ ID NO: 32760 - protein, 9 aa, Dengue virus
ISGSSPILS

SEQ ID NO: 32761 - protein, 9 aa, Dengue virus
SGSSPILSI

SEQ ID NO: 32762 - protein, 9 aa, Dengue virus
GSSPILSIT

SEQ ID NO: 32763 - protein, 9 aa, Dengue virus
SSPILSITI

SEQ ID NO: 32764 - protein, 9 aa, Dengue virus
SPILSITIS

SEQ ID NO: 32765 - protein, 9 aa, Dengue virus
PILSITISE

SEQ ID NO: 32766 - protein, 9 aa, Dengue virus
ILSITISED

SEQ ID NO: 32767 - protein, 9 aa, Dengue virus
LSITISEDG

SEQ ID NO: 32768 - protein, 9 aa, Dengue virus
SITISEDGS

SEQ ID NO: 32769 - protein, 9 aa, Dengue virus
ITISEDGSM

SEQ ID NO: 32770 - protein, 9 aa, Dengue virus
TISEDGSMS

SEQ ID NO: 32771 - protein, 9 aa, Dengue virus
ISEDGSMSI

SEQ ID NO: 32772 - protein, 9 aa, Dengue virus
SEDGSMSIK

SEQ ID NO: 32773 - protein, 9 aa, Dengue virus
EDGSMSIKN

SEQ ID NO: 32774 - protein, 9 aa, Dengue virus
DGSMSIKNE

SEQ ID NO: 32775 - protein, 9 aa, Dengue virus
GSMSIKNEE

SEQ ID NO: 32776 - protein, 9 aa, Dengue virus
SMSIKNEEE

SEQ ID NO: 32777 - protein, 9 aa, Dengue virus
MSIKNEEEE

SEQ ID NO: 32778 - protein, 9 aa, Dengue virus
SIKNEEEEQ

SEQ ID NO: 32779 - protein, 9 aa, Dengue virus
IKNEEEEQT

SEQ ID NO: 32780 - protein, 9 aa, Dengue virus
KNEEEEQTL

SEQ ID NO: 32781 - protein, 9 aa, Dengue virus
NEEEEQTLT

SEQ ID NO: 32782 - protein, 9 aa, Dengue virus
EEEEQTLTI

SEQ ID NO: 32783 - protein, 9 aa, Dengue virus
EEEQTLTIL

SEQ ID NO: 32784 - protein, 9 aa, Dengue virus
EEQTLTILI

SEQ ID NO: 32785 - protein, 9 aa, Dengue virus
EQTLTILIR

SEQ ID NO: 32786 - protein, 9 aa, Dengue virus
QTLTILIRT

SEQ ID NO: 32787 - protein, 9 aa, Dengue virus
TLTILIRTG

SEQ ID NO: 32788 - protein, 9 aa, Dengue virus
LTILIRTGL

SEQ ID NO: 32789 - protein, 9 aa, Dengue virus
TILIRTGLL

SEQ ID NO: 32790 - protein, 9 aa, Dengue virus
ILIRTGLLV

SEQ ID NO: 32791 - protein, 9 aa, Dengue virus
LIRTGLLVI

SEQ ID NO: 32792 - protein, 9 aa, Dengue virus
IRTGLLVIS

SEQ ID NO: 32793 - protein, 9 aa, Dengue virus
RTGLLVISG

SEQ ID NO: 32794 - protein, 9 aa, Dengue virus
TGLLVISGL

SEQ ID NO: 32795 - protein, 9 aa, Dengue virus
GLLVISGLF

SEQ ID NO: 32796 - protein, 9 aa, Dengue virus
LLVISGLFP

SEQ ID NO: 32797 - protein, 9 aa, Dengue virus
LVISGVFPV

SEQ ID NO: 32798 - protein, 9 aa, Dengue virus
VISGVFPVS

SEQ ID NO: 32799 - protein, 9 aa, Dengue virus
ISGVFPVSI

SEQ ID NO: 32800 - protein, 9 aa, Dengue virus
SGVFPVSIP

SEQ ID NO: 32801 - protein, 9 aa, Dengue virus
GVFPVSIPI

SEQ ID NO: 32802 - protein, 9 aa, Dengue virus
VFPVSIPIT

SEQ ID NO: 32803 - protein, 9 aa, Dengue virus
FPVSIPITA

SEQ ID NO: 32804 - protein, 9 aa, Dengue virus
PVSIPITAA

SEQ ID NO: 32805 - protein, 9 aa, Dengue virus
VSIPITAAA

SEQ ID NO: 32806 - protein, 9 aa, Dengue virus
SIPITAAAW

SEQ ID NO: 32807 - protein, 9 aa, Dengue virus
IPITAAAWY

SEQ ID NO: 32808 - protein, 9 aa, Dengue virus
PITAAAWYL

SEQ ID NO: 32809 - protein, 9 aa, Dengue virus
ITAAAWYLW

SEQ ID NO: 32810 - protein, 9 aa, Dengue virus
TAAAWYLWE

SEQ ID NO: 32811 - protein, 9 aa, Dengue virus
AAAWYLWEV

SEQ ID NO: 32812 - protein, 9 aa, Dengue virus
AAWYLWEVK

SEQ ID NO: 32813 - protein, 9 aa, Dengue virus
AWYLWEVKK

SEQ ID NO: 32814 - protein, 9 aa, Dengue virus
WYLWEVKKQ

SEQ ID NO: 32815 - protein, 9 aa, Dengue virus
YLWEVKKQR

SEQ ID NO: 32816 - protein, 9 aa, Dengue virus
LWEVKKQRA

SEQ ID NO: 32817 - protein, 9 aa, Dengue virus
WEVKKQRAG

SEQ ID NO: 32818 - protein, 9 aa, Dengue virus
EVKKQRAGV

SEQ ID NO: 32819 - protein, 9 aa, Dengue virus
VKKQRAGVL

SEQ ID NO: 32820 - protein, 9 aa, Dengue virus
KKQRAGVLW

SEQ ID NO: 32821 - protein, 9 aa, Dengue virus
KQRAGVLWD

SEQ ID NO: 32822 - protein, 9 aa, Dengue virus
QRAGVLWDV

SEQ ID NO: 32823 - protein, 9 aa, Dengue virus
RAGVLWDVP

SEQ ID NO: 32824 - protein, 9 aa, Dengue virus
AGVLWDVPS

SEQ ID NO: 32825 - protein, 9 aa, Dengue virus
GVLWDVPSP

SEQ ID NO: 32826 - protein, 9 aa, Dengue virus
VLWDVPSPP

SEQ ID NO: 32827 - protein, 9 aa, Dengue virus
LWDVPSPPP

SEQ ID NO: 32828 - protein, 9 aa, Dengue virus
WDVPSPPPV

SEQ ID NO: 32829 - protein, 9 aa, Dengue virus
DVPSPPPVG

SEQ ID NO: 32830 - protein, 9 aa, Dengue virus
GKAELEDGA

SEQ ID NO: 32831 - protein, 9 aa, Dengue virus
KAELEDGAY

SEQ ID NO: 32832 - protein, 9 aa, Dengue virus
AELEDGAYR

SEQ ID NO: 32833 - protein, 9 aa, Dengue virus
ELEDGAYRI

SEQ ID NO: 32834 - protein, 9 aa, Dengue virus
LEDGAYRIK

SEQ ID NO: 32835 - protein, 9 aa, Dengue virus
EDGAYRIKQ

SEQ ID NO: 32836 - protein, 9 aa, Dengue virus
DGAYRIKQR

SEQ ID NO: 32837 - protein, 9 aa, Dengue virus
GAYRIKQRG

SEQ ID NO: 32838 - protein, 9 aa, Dengue virus
AYRIKQRGI

SEQ ID NO: 32839 - protein, 9 aa, Dengue virus
YRIKQKGIL

SEQ ID NO: 32840 - protein, 9 aa, Dengue virus
RIKQKGILG

SEQ ID NO: 32841 - protein, 9 aa, Dengue virus
IKQKGILGY

SEQ ID NO: 32842 - protein, 9 aa, Dengue virus
KQKGILGYS

SEQ ID NO: 32843 - protein, 9 aa, Dengue virus
QKGILGYSQ

SEQ ID NO: 32844 - protein, 9 aa, Dengue virus
KGILGYSQI

SEQ ID NO: 32845 - protein, 9 aa, Dengue virus
GILGYSQIG

SEQ ID NO: 32846 - protein, 9 aa, Dengue virus
ILGYSQIGA

SEQ ID NO: 32847 - protein, 9 aa, Dengue virus
LGYSQIGAG

SEQ ID NO: 32848 - protein, 9 aa, Dengue virus
GYSQIGAGV

SEQ ID NO: 32849 - protein, 9 aa, Dengue virus
YSQIGAGVY

SEQ ID NO: 32850 - protein, 9 aa, Dengue virus
SQIGAGVYK

SEQ ID NO: 32851 - protein, 9 aa, Dengue virus
QIGAGVYKE

SEQ ID NO: 32852 - protein, 9 aa, Dengue virus
IGAGVYKEG

SEQ ID NO: 32853 - protein, 9 aa, Dengue virus
GAGVYKEGT

SEQ ID NO: 32854 - protein, 9 aa, Dengue virus
AGVYKEGTF

SEQ ID NO: 32855 - protein, 9 aa, Dengue virus
GVYKEGTFH

SEQ ID NO: 32856 - protein, 9 aa, Dengue virus
VYKEGTFHT

SEQ ID NO: 32857 - protein, 9 aa, Dengue virus
YKEGTFHTM

SEQ ID NO: 32858 - protein, 9 aa, Dengue virus
KEGTFHTMW

SEQ ID NO: 32859 - protein, 9 aa, Dengue virus
EGTFHTMWH

SEQ ID NO: 32860 - protein, 9 aa, Dengue virus
GTFHTMWHV

SEQ ID NO: 32861 - protein, 9 aa, Dengue virus
TFHTMWHVT

SEQ ID NO: 32862 - protein, 9 aa, Dengue virus
FHTMWHVTR

SEQ ID NO: 32863 - protein, 9 aa, Dengue virus
HTMWHVTRG

SEQ ID NO: 32864 - protein, 9 aa, Dengue virus
TMWHVTRGA

SEQ ID NO: 32865 - protein, 9 aa, Dengue virus
MWHVTRGAV

SEQ ID NO: 32866 - protein, 9 aa, Dengue virus
WHVTRGAVL

SEQ ID NO: 32867 - protein, 9 aa, Dengue virus
HVTRGAVLM

SEQ ID NO: 32868 - protein, 9 aa, Dengue virus
VTRGAVLMH

SEQ ID NO: 32869 - protein, 9 aa, Dengue virus
TRGAVLMHR

SEQ ID NO: 32870 - protein, 9 aa, Dengue virus
RGAVLMHRG

SEQ ID NO: 32871 - protein, 9 aa, Dengue virus
GAVLMHRGK

SEQ ID NO: 32872 - protein, 9 aa, Dengue virus
AVLMHRGKR

SEQ ID NO: 32873 - protein, 9 aa, Dengue virus
VLMHRGKRI

SEQ ID NO: 32874 - protein, 9 aa, Dengue virus
LMHRGKRIE

SEQ ID NO: 32875 - protein, 9 aa, Dengue virus
MHRGKRIEP

SEQ ID NO: 32876 - protein, 9 aa, Dengue virus
HRGKRIEPS

SEQ ID NO: 32877 - protein, 9 aa, Dengue virus
RGKRIEPSW

SEQ ID NO: 32878 - protein, 9 aa, Dengue virus
GKRIEPSWA

SEQ ID NO: 32879 - protein, 9 aa, Dengue virus
KRIEPSWAD

SEQ ID NO: 32880 - protein, 9 aa, Dengue virus
RIEPSWADV

SEQ ID NO: 32881 - protein, 9 aa, Dengue virus
IEPSWADVK

SEQ ID NO: 32882 - protein, 9 aa, Dengue virus
EPSWADVKK

SEQ ID NO: 32883 - protein, 9 aa, Dengue virus
PSWADVKKD

SEQ ID NO: 32884 - protein, 9 aa, Dengue virus
SWADVKKDL

SEQ ID NO: 32885 - protein, 9 aa, Dengue virus
WADVKKDLI

SEQ ID NO: 32886 - protein, 9 aa, Dengue virus
ADVKKDLIS

SEQ ID NO: 32887 - protein, 9 aa, Dengue virus
DVKKDLISY

SEQ ID NO: 32888 - protein, 9 aa, Dengue virus
VKKDLISYG

SEQ ID NO: 32889 - protein, 9 aa, Dengue virus
KKDLISYGG

SEQ ID NO: 32890 - protein, 9 aa, Dengue virus
KDLISYGGG

SEQ ID NO: 32891 - protein, 9 aa, Dengue virus
DLISYGGGW

SEQ ID NO: 32892 - protein, 9 aa, Dengue virus
LISYGGGWK

SEQ ID NO: 32893 - protein, 9 aa, Dengue virus
ISYGGGWKL

SEQ ID NO: 32894 - protein, 9 aa, Dengue virus
SYGGGWKLE

SEQ ID NO: 32895 - protein, 9 aa, Dengue virus
YGGGWKLEG

SEQ ID NO: 32896 - protein, 9 aa, Dengue virus
GGGWKLEGE

SEQ ID NO: 32897 - protein, 9 aa, Dengue virus
GGWKLEGEW

SEQ ID NO: 32898 - protein, 9 aa, Dengue virus
GWKLEGEWK

SEQ ID NO: 32899 - protein, 9 aa, Dengue virus
WKLEGEWKE

SEQ ID NO: 32900 - protein, 9 aa, Dengue virus
KLEGEWKEG

SEQ ID NO: 32901 - protein, 9 aa, Dengue virus
LEGEWKEGE

SEQ ID NO: 32902 - protein, 9 aa, Dengue virus
EGEWKEGEE

SEQ ID NO: 32903 - protein, 9 aa, Dengue virus
GEWKEGEEV

SEQ ID NO: 32904 - protein, 9 aa, Dengue virus
EWKEGEEVQ

SEQ ID NO: 32905 - protein, 9 aa, Dengue virus
WKEGEEVQV

SEQ ID NO: 32906 - protein, 9 aa, Dengue virus
KEGEEVQVL

SEQ ID NO: 32907 - protein, 9 aa, Dengue virus
EGEEVQVLA

SEQ ID NO: 32908 - protein, 9 aa, Dengue virus
GEEVQVLAL

SEQ ID NO: 32909 - protein, 9 aa, Dengue virus
EEVQVLALE

SEQ ID NO: 32910 - protein, 9 aa, Dengue virus
EVQVLALEP

SEQ ID NO: 32911 - protein, 9 aa, Dengue virus
VQVLALEPG

SEQ ID NO: 32912 - protein, 9 aa, Dengue virus
QVLALEPGK

SEQ ID NO: 32913 - protein, 9 aa, Dengue virus
VLALEPGKN

SEQ ID NO: 32914 - protein, 9 aa, Dengue virus
LALEPGKNP

SEQ ID NO: 32915 - protein, 9 aa, Dengue virus
ALEPGKNPR

SEQ ID NO: 32916 - protein, 9 aa, Dengue virus
LEPGKNPRA

SEQ ID NO: 32917 - protein, 9 aa, Dengue virus
EPGKNPRAV

SEQ ID NO: 32918 - protein, 9 aa, Dengue virus
PGKNPRAVQ

SEQ ID NO: 32919 - protein, 9 aa, Dengue virus
GKNPRAVQT

SEQ ID NO: 32920 - protein, 9 aa, Dengue virus
KNPRAVQTK

SEQ ID NO: 32921 - protein, 9 aa, Dengue virus
NPRAVQTKP

SEQ ID NO: 32922 - protein, 9 aa, Dengue virus
PRAVQTKPG

SEQ ID NO: 32923 - protein, 9 aa, Dengue virus
RAVQTKPGL

SEQ ID NO: 32924 - protein, 9 aa, Dengue virus
AVQTKPGLF

SEQ ID NO: 32925 - protein, 9 aa, Dengue virus
VQTKPGLFK

SEQ ID NO: 32926 - protein, 9 aa, Dengue virus
QTKPGLFKT

SEQ ID NO: 32927 - protein, 9 aa, Dengue virus
TKPGLFKTN

SEQ ID NO: 32928 - protein, 9 aa, Dengue virus
FKTNTGTIG

SEQ ID NO: 32929 - protein, 9 aa, Dengue virus
KTNTGTIGA

SEQ ID NO: 32930 - protein, 9 aa, Dengue virus
TNTGTIGAV

SEQ ID NO: 32931 - protein, 9 aa, Dengue virus
NTGTIGAVS

SEQ ID NO: 32932 - protein, 9 aa, Dengue virus
TGTIGAVSL

SEQ ID NO: 32933 - protein, 9 aa, Dengue virus
GTIGAVSLD

SEQ ID NO: 32934 - protein, 9 aa, Dengue virus
TIGAVSLDF

SEQ ID NO: 32935 - protein, 9 aa, Dengue virus
IGAVSLDFS

SEQ ID NO: 32936 - protein, 9 aa, Dengue virus
GAVSLDFSP

SEQ ID NO: 32937 - protein, 9 aa, Dengue virus
AVSLDFSPG

SEQ ID NO: 32938 - protein, 9 aa, Dengue virus
VSLDFSPGT

SEQ ID NO: 32939 - protein, 9 aa, Dengue virus
SLDFSPGTS

SEQ ID NO: 32940 - protein, 9 aa, Dengue virus
LDFSPGTSG

SEQ ID NO: 32941 - protein, 9 aa, Dengue virus
DFSPGTSGS

SEQ ID NO: 32942 - protein, 9 aa, Dengue virus
FSPGTSGSP

SEQ ID NO: 32943 - protein, 9 aa, Dengue virus
SPGTSGSPI

SEQ ID NO: 32944 - protein, 9 aa, Dengue virus
PGTSGSPIV

SEQ ID NO: 32945 - protein, 9 aa, Dengue virus
GTSGSPIVD

SEQ ID NO: 32946 - protein, 9 aa, Dengue virus
TSGSPIVDR

SEQ ID NO: 32947 - protein, 9 aa, Dengue virus
SGSPIVDRK

SEQ ID NO: 32948 - protein, 9 aa, Dengue virus
GSPIVDRKG

SEQ ID NO: 32949 - protein, 9 aa, Dengue virus
SPIVDRKGK

SEQ ID NO: 32950 - protein, 9 aa, Dengue virus
PIVDRKGKV

SEQ ID NO: 32951 - protein, 9 aa, Dengue virus
IVDRKGKVV

SEQ ID NO: 32952 - protein, 9 aa, Dengue virus
VDRKGKVVG

SEQ ID NO: 32953 - protein, 9 aa, Dengue virus
DRKGKVVGL

SEQ ID NO: 32954 - protein, 9 aa, Dengue virus
RKGKVVGLY

SEQ ID NO: 32955 - protein, 9 aa, Dengue virus
KGKVVGLYG

SEQ ID NO: 32956 - protein, 9 aa, Dengue virus
GKVVGLYGN

SEQ ID NO: 32957 - protein, 9 aa, Dengue virus
KVVGLYGNG

SEQ ID NO: 32958 - protein, 9 aa, Dengue virus
VVGLYGNGV

SEQ ID NO: 32959 - protein, 9 aa, Dengue virus
VGLYGNGVV

SEQ ID NO: 32960 - protein, 9 aa, Dengue virus
GLYGNGVVT

SEQ ID NO: 32961 - protein, 9 aa, Dengue virus
LYGNGVVTR

SEQ ID NO: 32962 - protein, 9 aa, Dengue virus
YGNGVVTRS

SEQ ID NO: 32963 - protein, 9 aa, Dengue virus
GNGVVTRSG

SEQ ID NO: 32964 - protein, 9 aa, Dengue virus
NGVVTRSGA

SEQ ID NO: 32965 - protein, 9 aa, Dengue virus
GVVTRSGAY

SEQ ID NO: 32966 - protein, 9 aa, Dengue virus
VVTRSGAYV

SEQ ID NO: 32967 - protein, 9 aa, Dengue virus
VTRSGAYVS

SEQ ID NO: 32968 - protein, 9 aa, Dengue virus
TRSGAYVSA

SEQ ID NO: 32969 - protein, 9 aa, Dengue virus
RSGAYVSAI

SEQ ID NO: 32970 - protein, 9 aa, Dengue virus
SGAYVSAIA

SEQ ID NO: 32971 - protein, 9 aa, Dengue virus
GAYVSAIAQ

SEQ ID NO: 32972 - protein, 9 aa, Dengue virus
AYVSAIAQT

SEQ ID NO: 32973 - protein, 9 aa, Dengue virus
YVSAIAQTE

SEQ ID NO: 32974 - protein, 9 aa, Dengue virus
VSAIAQTEK

SEQ ID NO: 32975 - protein, 9 aa, Dengue virus
SAIAQTEKS

SEQ ID NO: 32976 - protein, 9 aa, Dengue virus
AIAQTEKSI

SEQ ID NO: 32977 - protein, 9 aa, Dengue virus
IAQTEKSIE

SEQ ID NO: 32978 - protein, 9 aa, Dengue virus
IEDNPEIED

SEQ ID NO: 32979 - protein, 9 aa, Dengue virus
EDNPEIEDD

SEQ ID NO: 32980 - protein, 9 aa, Dengue virus
DNPEIEDDI

SEQ ID NO: 32981 - protein, 9 aa, Dengue virus
NPEIEDDIF

SEQ ID NO: 32982 - protein, 9 aa, Dengue virus
PEIEDDIFR

SEQ ID NO: 32983 - protein, 9 aa, Dengue virus
EIEDDIFRK

SEQ ID NO: 32984 - protein, 9 aa, Dengue virus
IEDDIFRKK

SEQ ID NO: 32985 - protein, 9 aa, Dengue virus
EDDIFRKKR

SEQ ID NO: 32986 - protein, 9 aa, Dengue virus
DDIFRKKRL

SEQ ID NO: 32987 - protein, 9 aa, Dengue virus
DIFRKKRLT

SEQ ID NO: 32988 - protein, 9 aa, Dengue virus
IFRKKRLTI

SEQ ID NO: 32989 - protein, 9 aa, Dengue virus
FRKKRLTIM

SEQ ID NO: 32990 - protein, 9 aa, Dengue virus
RKKRLTIMD

SEQ ID NO: 32991 - protein, 9 aa, Dengue virus
KKRLTIMDL

SEQ ID NO: 32992 - protein, 9 aa, Dengue virus
KRLTIMDLH

SEQ ID NO: 32993 - protein, 9 aa, Dengue virus
RLTIMDLHP

SEQ ID NO: 32994 - protein, 9 aa, Dengue virus
LTIMDLHPG

SEQ ID NO: 32995 - protein, 9 aa, Dengue virus
TIMDLHPGA

SEQ ID NO: 32996 - protein, 9 aa, Dengue virus
IMDLHPGAG

SEQ ID NO: 32997 - protein, 9 aa, Dengue virus
MDLHPGAGK

SEQ ID NO: 32998 - protein, 9 aa, Dengue virus
DLHPGAGKT

SEQ ID NO: 32999 - protein, 9 aa, Dengue virus
LHPGAGKTK

SEQ ID NO: 33000 - protein, 9 aa, Dengue virus
HPGAGKTKR

SEQ ID NO: 33001 - protein, 9 aa, Dengue virus
PGAGKTKRY

SEQ ID NO: 33002 - protein, 9 aa, Dengue virus
GAGKTKRYL

SEQ ID NO: 33003 - protein, 9 aa, Dengue virus
AGKTKRYLP

SEQ ID NO: 33004 - protein, 9 aa, Dengue virus
GKTKRYLPA

SEQ ID NO: 33005 - protein, 9 aa, Dengue virus
KTKRYLPAI

SEQ ID NO: 33006 - protein, 9 aa, Dengue virus
TKRYLPAIV

SEQ ID NO: 33007 - protein, 9 aa, Dengue virus
KRYLPAIVR

SEQ ID NO: 33008 - protein, 9 aa, Dengue virus
RYLPAIVRE

SEQ ID NO: 33009 - protein, 9 aa, Dengue virus
YLPAIVREA

SEQ ID NO: 33010 - protein, 9 aa, Dengue virus
LPAIVREAI

SEQ ID NO: 33011 - protein, 9 aa, Dengue virus
PAIVREAIK

SEQ ID NO: 33012 - protein, 9 aa, Dengue virus
AIVREAIKR

SEQ ID NO: 33013 - protein, 9 aa, Dengue virus
IVREAIKRG

SEQ ID NO: 33014 - protein, 9 aa, Dengue virus
VREAIKRGL

SEQ ID NO: 33015 - protein, 9 aa, Dengue virus
REAIKRGLR

SEQ ID NO: 33016 - protein, 9 aa, Dengue virus
EAIKRGLRT

SEQ ID NO: 33017 - protein, 9 aa, Dengue virus
AIKRGLRTL

SEQ ID NO: 33018 - protein, 9 aa, Dengue virus
IKRGLRTLI

SEQ ID NO: 33019 - protein, 9 aa, Dengue virus
KRGLRTLIL

SEQ ID NO: 33020 - protein, 9 aa, Dengue virus
RGLRTLILA

SEQ ID NO: 33021 - protein, 9 aa, Dengue virus
GLRTLILAP

SEQ ID NO: 33022 - protein, 9 aa, Dengue virus
LRTLILAPT

SEQ ID NO: 33023 - protein, 9 aa, Dengue virus
RTLILAPTR

SEQ ID NO: 33024 - protein, 9 aa, Dengue virus
TLILAPTRV

SEQ ID NO: 33025 - protein, 9 aa, Dengue virus
LILAPTRVV

SEQ ID NO: 33026 - protein, 9 aa, Dengue virus
ILAPTRVVA

SEQ ID NO: 33027 - protein, 9 aa, Dengue virus
LAPTRVVAA

SEQ ID NO: 33028 - protein, 9 aa, Dengue virus
APTRVVAAE

SEQ ID NO: 33029 - protein, 9 aa, Dengue virus
PTRVVAAEM

SEQ ID NO: 33030 - protein, 9 aa, Dengue virus
TRVVAAEME

SEQ ID NO: 33031 - protein, 9 aa, Dengue virus
RVVAAEMEE

SEQ ID NO: 33032 - protein, 9 aa, Dengue virus
VVAAEMEEA

SEQ ID NO: 33033 - protein, 9 aa, Dengue virus
VAAEMEEAL

SEQ ID NO: 33034 - protein, 9 aa, Dengue virus
AAEMEEALR

SEQ ID NO: 33035 - protein, 9 aa, Dengue virus
AEMEEALRG

SEQ ID NO: 33036 - protein, 9 aa, Dengue virus
EMEEALRGL

SEQ ID NO: 33037 - protein, 9 aa, Dengue virus
MEEALRGLP

SEQ ID NO: 33038 - protein, 9 aa, Dengue virus
EEALRGLPI

SEQ ID NO: 33039 - protein, 9 aa, Dengue virus
EALRGLPIR

SEQ ID NO: 33040 - protein, 9 aa, Dengue virus
ALRGLPIRY

SEQ ID NO: 33041 - protein, 9 aa, Dengue virus
LRGLPIRYQ

SEQ ID NO: 33042 - protein, 9 aa, Dengue virus
RGLPIRYQT

SEQ ID NO: 33043 - protein, 9 aa, Dengue virus
GLPIRYQTP

SEQ ID NO: 33044 - protein, 9 aa, Dengue virus
LPIRYQTPA

SEQ ID NO: 33045 - protein, 9 aa, Dengue virus
PIRYQTPAI

SEQ ID NO: 33046 - protein, 9 aa, Dengue virus
IRYQTPAIR

SEQ ID NO: 33047 - protein, 9 aa, Dengue virus
RYQTPAIRA

SEQ ID NO: 33048 - protein, 9 aa, Dengue virus
YQTPAIRAE

SEQ ID NO: 33049 - protein, 9 aa, Dengue virus
QTPAIRAEH

SEQ ID NO: 33050 - protein, 9 aa, Dengue virus
TPAIRAEHT

SEQ ID NO: 33051 - protein, 9 aa, Dengue virus
PAIRAEHTG

SEQ ID NO: 33052 - protein, 9 aa, Dengue virus
AIRAEHTGR

SEQ ID NO: 33053 - protein, 9 aa, Dengue virus
IRAEHTGRE

SEQ ID NO: 33054 - protein, 9 aa, Dengue virus
RAEHTGREI

SEQ ID NO: 33055 - protein, 9 aa, Dengue virus
AEHTGREIV

SEQ ID NO: 33056 - protein, 9 aa, Dengue virus
EHTGREIVD

SEQ ID NO: 33057 - protein, 9 aa, Dengue virus
HTGREIVDL

SEQ ID NO: 33058 - protein, 9 aa, Dengue virus
TGREIVDLM

SEQ ID NO: 33059 - protein, 9 aa, Dengue virus
GREIVDLMC

SEQ ID NO: 33060 - protein, 9 aa, Dengue virus
REIVDLMCH

SEQ ID NO: 33061 - protein, 9 aa, Dengue virus
EIVDLMCHA

SEQ ID NO: 33062 - protein, 9 aa, Dengue virus
IVDLMCHAT

SEQ ID NO: 33063 - protein, 9 aa, Dengue virus
VDLMCHATF

SEQ ID NO: 33064 - protein, 9 aa, Dengue virus
DLMCHATFT

SEQ ID NO: 33065 - protein, 9 aa, Dengue virus
LMCHATFTM

SEQ ID NO: 33066 - protein, 9 aa, Dengue virus
MCHATFTMR

SEQ ID NO: 33067 - protein, 9 aa, Dengue virus
CHATFTMRL

SEQ ID NO: 33068 - protein, 9 aa, Dengue virus
HATFTMRLL

SEQ ID NO: 33069 - protein, 9 aa, Dengue virus
ATFTMRLLS

SEQ ID NO: 33070 - protein, 9 aa, Dengue virus
TFTMRLLSP

SEQ ID NO: 33071 - protein, 9 aa, Dengue virus
FTMRLLSPV

SEQ ID NO: 33072 - protein, 9 aa, Dengue virus
TMRLLSPVR

SEQ ID NO: 33073 - protein, 9 aa, Dengue virus
MRLLSPVRV

SEQ ID NO: 33074 - protein, 9 aa, Dengue virus
RLLSPVRVP

SEQ ID NO: 33075 - protein, 9 aa, Dengue virus
LLSPVRVPN

SEQ ID NO: 33076 - protein, 9 aa, Dengue virus
LSPVRVPNY

SEQ ID NO: 33077 - protein, 9 aa, Dengue virus
SPVRVPNYN

SEQ ID NO: 33078 - protein, 9 aa, Dengue virus
PVRVPNYNL

SEQ ID NO: 33079 - protein, 9 aa, Dengue virus
VRVPNYNLI

SEQ ID NO: 33080 - protein, 9 aa, Dengue virus
RVPNYNLII

SEQ ID NO: 33081 - protein, 9 aa, Dengue virus
VPNYNLIIM

SEQ ID NO: 33082 - protein, 9 aa, Dengue virus
PNYNLIIMD

SEQ ID NO: 33083 - protein, 9 aa, Dengue virus
NYNLIIMDE

SEQ ID NO: 33084 - protein, 9 aa, Dengue virus
YNLIIMDEA

SEQ ID NO: 33085 - protein, 9 aa, Dengue virus
NLIIMDEAH

SEQ ID NO: 33086 - protein, 9 aa, Dengue virus
LIIMDEAHF

SEQ ID NO: 33087 - protein, 9 aa, Dengue virus
IIMDEAHFT

SEQ ID NO: 33088 - protein, 9 aa, Dengue virus
IMDEAHFTD

SEQ ID NO: 33089 - protein, 9 aa, Dengue virus
MDEAHFTDP

SEQ ID NO: 33090 - protein, 9 aa, Dengue virus
DEAHFTDPA

SEQ ID NO: 33091 - protein, 9 aa, Dengue virus
EAHFTDPAS

SEQ ID NO: 33092 - protein, 9 aa, Dengue virus
AHFTDPASI

SEQ ID NO: 33093 - protein, 9 aa, Dengue virus
HFTDPASIA

SEQ ID NO: 33094 - protein, 9 aa, Dengue virus
FTDPASIAA

SEQ ID NO: 33095 - protein, 9 aa, Dengue virus
TDPASIAAR

SEQ ID NO: 33096 - protein, 9 aa, Dengue virus
DPASIAARG

SEQ ID NO: 33097 - protein, 9 aa, Dengue virus
PASIAARGY

SEQ ID NO: 33098 - protein, 9 aa, Dengue virus
ASIAARGYI

SEQ ID NO: 33099 - protein, 9 aa, Dengue virus
SIAARGYIS

SEQ ID NO: 33100 - protein, 9 aa, Dengue virus
IAARGYIST

SEQ ID NO: 33101 - protein, 9 aa, Dengue virus
AARGYISTR

SEQ ID NO: 33102 - protein, 9 aa, Dengue virus
ARGYISTRV

SEQ ID NO: 33103 - protein, 9 aa, Dengue virus
RGYISTRVE

SEQ ID NO: 33104 - protein, 9 aa, Dengue virus
GYISTRVEM

SEQ ID NO: 33105 - protein, 9 aa, Dengue virus
YISTRVEMG

SEQ ID NO: 33106 - protein, 9 aa, Dengue virus
ISTRVEMGE

SEQ ID NO: 33107 - protein, 9 aa, Dengue virus
STRVEMGEA

SEQ ID NO: 33108 - protein, 9 aa, Dengue virus
TRVEMGEAA

SEQ ID NO: 33109 - protein, 9 aa, Dengue virus
RVEMGEAAG

SEQ ID NO: 33110 - protein, 9 aa, Dengue virus
VEMGEAAGI

SEQ ID NO: 33111 - protein, 9 aa, Dengue virus
EMGEAAGIF

SEQ ID NO: 33112 - protein, 9 aa, Dengue virus
MGEAAGIFM

SEQ ID NO: 33113 - protein, 9 aa, Dengue virus
GEAAGIFMT

SEQ ID NO: 33114 - protein, 9 aa, Dengue virus
EAAGIFMTA

SEQ ID NO: 33115 - protein, 9 aa, Dengue virus
AAGIFMTAT

SEQ ID NO: 33116 - protein, 9 aa, Dengue virus
AGIFMTATP

SEQ ID NO: 33117 - protein, 9 aa, Dengue virus
GIFMTATPP

SEQ ID NO: 33118 - protein, 9 aa, Dengue virus
IFMTATPPG

SEQ ID NO: 33119 - protein, 9 aa, Dengue virus
FMTATPPGS

SEQ ID NO: 33120 - protein, 9 aa, Dengue virus
MTATPPGSR

SEQ ID NO: 33121 - protein, 9 aa, Dengue virus
TATPPGSRD

SEQ ID NO: 33122 - protein, 9 aa, Dengue virus
ATPPGSRDP

SEQ ID NO: 33123 - protein, 9 aa, Dengue virus
TPPGSRDPF

SEQ ID NO: 33124 - protein, 9 aa, Dengue virus
PPGSRDPFP

SEQ ID NO: 33125 - protein, 9 aa, Dengue virus
PGSRDPFPQ

SEQ ID NO: 33126 - protein, 9 aa, Dengue virus
GSRDPFPQS

SEQ ID NO: 33127 - protein, 9 aa, Dengue virus
SRDPFPQSN

SEQ ID NO: 33128 - protein, 9 aa, Dengue virus
RDPFPQSNA

SEQ ID NO: 33129 - protein, 9 aa, Dengue virus
DPFPQSNAP

SEQ ID NO: 33130 - protein, 9 aa, Dengue virus
PFPQSNAPI

SEQ ID NO: 33131 - protein, 9 aa, Dengue virus
FPQSNAPIM

SEQ ID NO: 33132 - protein, 9 aa, Dengue virus
PQSNAPIMD

SEQ ID NO: 33133 - protein, 9 aa, Dengue virus
QSNAPIMDE

SEQ ID NO: 33134 - protein, 9 aa, Dengue virus
SNAPIMDEE

SEQ ID NO: 33135 - protein, 9 aa, Dengue virus
NAPIMDEER

SEQ ID NO: 33136 - protein, 9 aa, Dengue virus
APIMDEERE

SEQ ID NO: 33137 - protein, 9 aa, Dengue virus
PIMDEEREI

SEQ ID NO: 33138 - protein, 9 aa, Dengue virus
IMDEEREIP

SEQ ID NO: 33139 - protein, 9 aa, Dengue virus
MDEEREIPE

SEQ ID NO: 33140 - protein, 9 aa, Dengue virus
DEEREIPER

SEQ ID NO: 33141 - protein, 9 aa, Dengue virus
EEREIPERS

SEQ ID NO: 33142 - protein, 9 aa, Dengue virus
EREIPERSW

SEQ ID NO: 33143 - protein, 9 aa, Dengue virus
REIPERSWN

SEQ ID NO: 33144 - protein, 9 aa, Dengue virus
EIPERSWNS

SEQ ID NO: 33145 - protein, 9 aa, Dengue virus
IPERSWNSG

SEQ ID NO: 33146 - protein, 9 aa, Dengue virus
PERSWNSGH

SEQ ID NO: 33147 - protein, 9 aa, Dengue virus
ERSWNSGHE

SEQ ID NO: 33148 - protein, 9 aa, Dengue virus
RSWNSGHEW

SEQ ID NO: 33149 - protein, 9 aa, Dengue virus
SWNSGHEWV

SEQ ID NO: 33150 - protein, 9 aa, Dengue virus
WNSGHEWVT

SEQ ID NO: 33151 - protein, 9 aa, Dengue virus
NSGHEWVTD

SEQ ID NO: 33152 - protein, 9 aa, Dengue virus
SGHEWVTDF

SEQ ID NO: 33153 - protein, 9 aa, Dengue virus
GHEWVTDFK

SEQ ID NO: 33154 - protein, 9 aa, Dengue virus
HEWVTDFKG

SEQ ID NO: 33155 - protein, 9 aa, Dengue virus
EWVTDFKGK

SEQ ID NO: 33156 - protein, 9 aa, Dengue virus
WVTDFKGKT

SEQ ID NO: 33157 - protein, 9 aa, Dengue virus
VTDFKGKTV

SEQ ID NO: 33158 - protein, 9 aa, Dengue virus
TDFKGKTVW

SEQ ID NO: 33159 - protein, 9 aa, Dengue virus
DFKGKTVWF

SEQ ID NO: 33160 - protein, 9 aa, Dengue virus
FKGKTVWFV

SEQ ID NO: 33161 - protein, 9 aa, Dengue virus
KGKTVWFVP

SEQ ID NO: 33162 - protein, 9 aa, Dengue virus
GKTVWFVPS

SEQ ID NO: 33163 - protein, 9 aa, Dengue virus
KTVWFVPSI

SEQ ID NO: 33164 - protein, 9 aa, Dengue virus
TVWFVPSIK

SEQ ID NO: 33165 - protein, 9 aa, Dengue virus
VWFVPSIKA

SEQ ID NO: 33166 - protein, 9 aa, Dengue virus
WFVPSIKAG

SEQ ID NO: 33167 - protein, 9 aa, Dengue virus
FVPSIKAGN

SEQ ID NO: 33168 - protein, 9 aa, Dengue virus
VPSIKAGND

SEQ ID NO: 33169 - protein, 9 aa, Dengue virus
PSIKAGNDI

SEQ ID NO: 33170 - protein, 9 aa, Dengue virus
SIKAGNDIA

SEQ ID NO: 33171 - protein, 9 aa, Dengue virus
IKAGNDIAA

SEQ ID NO: 33172 - protein, 9 aa, Dengue virus
KAGNDIAAC

SEQ ID NO: 33173 - protein, 9 aa, Dengue virus
AGNDIAACL

SEQ ID NO: 33174 - protein, 9 aa, Dengue virus
GNDIAACLR

SEQ ID NO: 33175 - protein, 9 aa, Dengue virus
NDIAACLRK

SEQ ID NO: 33176 - protein, 9 aa, Dengue virus
DIAACLRKN

SEQ ID NO: 33177 - protein, 9 aa, Dengue virus
IAACLRKNG

SEQ ID NO: 33178 - protein, 9 aa, Dengue virus
AACLRKNGK

SEQ ID NO: 33179 - protein, 9 aa, Dengue virus
ACLRKNGKK

SEQ ID NO: 33180 - protein, 9 aa, Dengue virus
CLRKNGKKV

SEQ ID NO: 33181 - protein, 9 aa, Dengue virus
LRKNGKKVI

SEQ ID NO: 33182 - protein, 9 aa, Dengue virus
RKNGKKVIQ

SEQ ID NO: 33183 - protein, 9 aa, Dengue virus
KNGKKVIQL

SEQ ID NO: 33184 - protein, 9 aa, Dengue virus
NGKKVIQLS

SEQ ID NO: 33185 - protein, 9 aa, Dengue virus
GKKVIQLSR

SEQ ID NO: 33186 - protein, 9 aa, Dengue virus
KKVIQLSRK

SEQ ID NO: 33187 - protein, 9 aa, Dengue virus
KVIQLSRKT

SEQ ID NO: 33188 - protein, 9 aa, Dengue virus
VIQLSRKTF

SEQ ID NO: 33189 - protein, 9 aa, Dengue virus
IQLSRKTFD

SEQ ID NO: 33190 - protein, 9 aa, Dengue virus
QLSRKTFDS

SEQ ID NO: 33191 - protein, 9 aa, Dengue virus
LSRKTFDSE

SEQ ID NO: 33192 - protein, 9 aa, Dengue virus
SRKTFDSEY

SEQ ID NO: 33193 - protein, 9 aa, Dengue virus
RKTFDSEYV

SEQ ID NO: 33194 - protein, 9 aa, Dengue virus
KTFDSEYVK

SEQ ID NO: 33195 - protein, 9 aa, Dengue virus
TFDSEYVKT

SEQ ID NO: 33196 - protein, 9 aa, Dengue virus
FDSEYVKTR

SEQ ID NO: 33197 - protein, 9 aa, Dengue virus
KTRTNDWDF

SEQ ID NO: 33198 - protein, 9 aa, Dengue virus
TRTNDWDFV

SEQ ID NO: 33199 - protein, 9 aa, Dengue virus
RTNDWDFVV

SEQ ID NO: 33200 - protein, 9 aa, Dengue virus
TNDWDFVVT

SEQ ID NO: 33201 - protein, 9 aa, Dengue virus
NDWDFVVTT

SEQ ID NO: 33202 - protein, 9 aa, Dengue virus
DWDFVVTTD

SEQ ID NO: 33203 - protein, 9 aa, Dengue virus
WDFVVTTDI

SEQ ID NO: 33204 - protein, 9 aa, Dengue virus
DFVVTTDIS

SEQ ID NO: 33205 - protein, 9 aa, Dengue virus
FVVTTDISE

SEQ ID NO: 33206 - protein, 9 aa, Dengue virus
VVTTDISEM

SEQ ID NO: 33207 - protein, 9 aa, Dengue virus
VTTDISEMG

SEQ ID NO: 33208 - protein, 9 aa, Dengue virus
TTDISEMGA

SEQ ID NO: 33209 - protein, 9 aa, Dengue virus
TDISEMGAN

SEQ ID NO: 33210 - protein, 9 aa, Dengue virus
DISEMGANF

SEQ ID NO: 33211 - protein, 9 aa, Dengue virus
ISEMGANFK

SEQ ID NO: 33212 - protein, 9 aa, Dengue virus
SEMGANFKA

SEQ ID NO: 33213 - protein, 9 aa, Dengue virus
EMGANFKAE

SEQ ID NO: 33214 - protein, 9 aa, Dengue virus
MGANFKAER

SEQ ID NO: 33215 - protein, 9 aa, Dengue virus
GANFKAERV

SEQ ID NO: 33216 - protein, 9 aa, Dengue virus
ANFKAERVI

SEQ ID NO: 33217 - protein, 9 aa, Dengue virus
NFKAERVID

SEQ ID NO: 33218 - protein, 9 aa, Dengue virus
FKAERVIDP

SEQ ID NO: 33219 - protein, 9 aa, Dengue virus
KAERVIDPR

SEQ ID NO: 33220 - protein, 9 aa, Dengue virus
AERVIDPRR

SEQ ID NO: 33221 - protein, 9 aa, Dengue virus
ERVIDPRRC

SEQ ID NO: 33222 - protein, 9 aa, Dengue virus
RVIDPRRCM

SEQ ID NO: 33223 - protein, 9 aa, Dengue virus
VIDPRRCMK

SEQ ID NO: 33224 - protein, 9 aa, Dengue virus
IDPRRCMKP

SEQ ID NO: 33225 - protein, 9 aa, Dengue virus
DPRRCMKPV

SEQ ID NO: 33226 - protein, 9 aa, Dengue virus
PRRCMKPVI

SEQ ID NO: 33227 - protein, 9 aa, Dengue virus
RRCMKPVIL

SEQ ID NO: 33228 - protein, 9 aa, Dengue virus
RCMKPVILT

SEQ ID NO: 33229 - protein, 9 aa, Dengue virus
CMKPVILTD

SEQ ID NO: 33230 - protein, 9 aa, Dengue virus
MKPVILTDG

SEQ ID NO: 33231 - protein, 9 aa, Dengue virus
KPVILTDGE

SEQ ID NO: 33232 - protein, 9 aa, Dengue virus
PVILTDGEE

SEQ ID NO: 33233 - protein, 9 aa, Dengue virus
VILTDGEER

SEQ ID NO: 33234 - protein, 9 aa, Dengue virus
ILTDGEERV

SEQ ID NO: 33235 - protein, 9 aa, Dengue virus
LTDGEERVI

SEQ ID NO: 33236 - protein, 9 aa, Dengue virus
TDGEERVIL

SEQ ID NO: 33237 - protein, 9 aa, Dengue virus
DGEERVILA

SEQ ID NO: 33238 - protein, 9 aa, Dengue virus
GEERVILAG

SEQ ID NO: 33239 - protein, 9 aa, Dengue virus
EERVILAGP

SEQ ID NO: 33240 - protein, 9 aa, Dengue virus
ERVILAGPM

SEQ ID NO: 33241 - protein, 9 aa, Dengue virus
RVILAGPMP

SEQ ID NO: 33242 - protein, 9 aa, Dengue virus
VILAGPMPV

SEQ ID NO: 33243 - protein, 9 aa, Dengue virus
ILAGPMPVT

SEQ ID NO: 33244 - protein, 9 aa, Dengue virus
LAGPMPVTH

SEQ ID NO: 33245 - protein, 9 aa, Dengue virus
AGPMPVTHS

SEQ ID NO: 33246 - protein, 9 aa, Dengue virus
GPMPVTHSS

SEQ ID NO: 33247 - protein, 9 aa, Dengue virus
PMPVTHSSA

SEQ ID NO: 33248 - protein, 9 aa, Dengue virus
MPVTHSSAA

SEQ ID NO: 33249 - protein, 9 aa, Dengue virus
PVTHSSAAQ

SEQ ID NO: 33250 - protein, 9 aa, Dengue virus
VTHSSAAQR

SEQ ID NO: 33251 - protein, 9 aa, Dengue virus
THSSAAQRR

SEQ ID NO: 33252 - protein, 9 aa, Dengue virus
HSSAAQRRG

SEQ ID NO: 33253 - protein, 9 aa, Dengue virus
SSAAQRRGR

SEQ ID NO: 33254 - protein, 9 aa, Dengue virus
SAAQRRGRI

SEQ ID NO: 33255 - protein, 9 aa, Dengue virus
AAQRRGRIG

SEQ ID NO: 33256 - protein, 9 aa, Dengue virus
AQRRGRIGR

SEQ ID NO: 33257 - protein, 9 aa, Dengue virus
QRRGRIGRN

SEQ ID NO: 33258 - protein, 9 aa, Dengue virus
RRGRIGRNP

SEQ ID NO: 33259 - protein, 9 aa, Dengue virus
RGRIGRNPK

SEQ ID NO: 33260 - protein, 9 aa, Dengue virus
GRIGRNPKN

SEQ ID NO: 33261 - protein, 9 aa, Dengue virus
RIGRNPKNE

SEQ ID NO: 33262 - protein, 9 aa, Dengue virus
IGRNPKNEN

SEQ ID NO: 33263 - protein, 9 aa, Dengue virus
GRNPKNEND

SEQ ID NO: 33264 - protein, 9 aa, Dengue virus
RNPKNENDQ

SEQ ID NO: 33265 - protein, 9 aa, Dengue virus
NPKNENDQY

SEQ ID NO: 33266 - protein, 9 aa, Dengue virus
PKNENDQYI

SEQ ID NO: 33267 - protein, 9 aa, Dengue virus
KNENDQYIY

SEQ ID NO: 33268 - protein, 9 aa, Dengue virus
NENDQYIYM

SEQ ID NO: 33269 - protein, 9 aa, Dengue virus
ENDQYIYMG

SEQ ID NO: 33270 - protein, 9 aa, Dengue virus
NDQYIYMGE

SEQ ID NO: 33271 - protein, 9 aa, Dengue virus
DQYIYMGEP

SEQ ID NO: 33272 - protein, 9 aa, Dengue virus
QYIYMGEPL

SEQ ID NO: 33273 - protein, 9 aa, Dengue virus
YIYMGEPLE

SEQ ID NO: 33274 - protein, 9 aa, Dengue virus
IYMGEPLEN

SEQ ID NO: 33275 - protein, 9 aa, Dengue virus
YMGEPLEND

SEQ ID NO: 33276 - protein, 9 aa, Dengue virus
MGEPLENDE

SEQ ID NO: 33277 - protein, 9 aa, Dengue virus
GEPLENDED

SEQ ID NO: 33278 - protein, 9 aa, Dengue virus
EPLENDEDC

SEQ ID NO: 33279 - protein, 9 aa, Dengue virus
PLENDEDCA

SEQ ID NO: 33280 - protein, 9 aa, Dengue virus
LENDEDCAH

SEQ ID NO: 33281 - protein, 9 aa, Dengue virus
ENDEDCAHW

SEQ ID NO: 33282 - protein, 9 aa, Dengue virus
NDEDCAHWK

SEQ ID NO: 33283 - protein, 9 aa, Dengue virus
DEDCAHWKE

SEQ ID NO: 33284 - protein, 9 aa, Dengue virus
EDCAHWKEA

SEQ ID NO: 33285 - protein, 9 aa, Dengue virus
DCAHWKEAK

SEQ ID NO: 33286 - protein, 9 aa, Dengue virus
CAHWKEAKM

SEQ ID NO: 33287 - protein, 9 aa, Dengue virus
AHWKEAKML

SEQ ID NO: 33288 - protein, 9 aa, Dengue virus
HWKEAKMLL

SEQ ID NO: 33289 - protein, 9 aa, Dengue virus
WKEAKMLLD

SEQ ID NO: 33290 - protein, 9 aa, Dengue virus
KEAKMLLDN

SEQ ID NO: 33291 - protein, 9 aa, Dengue virus
EAKMLLDNI

SEQ ID NO: 33292 - protein, 9 aa, Dengue virus
AKMLLDNIN

SEQ ID NO: 33293 - protein, 9 aa, Dengue virus
KMLLDNINT

SEQ ID NO: 33294 - protein, 9 aa, Dengue virus
MLLDNINTP

SEQ ID NO: 33295 - protein, 9 aa, Dengue virus
LLDNINTPE

SEQ ID NO: 33296 - protein, 9 aa, Dengue virus
LDNINTPEG

SEQ ID NO: 33297 - protein, 9 aa, Dengue virus
DNINTPEGI

SEQ ID NO: 33298 - protein, 9 aa, Dengue virus
NINTPEGII

SEQ ID NO: 33299 - protein, 9 aa, Dengue virus
INTPEGIIP

SEQ ID NO: 33300 - protein, 9 aa, Dengue virus
NTPEGIIPS

SEQ ID NO: 33301 - protein, 9 aa, Dengue virus
TPEGIIPSM

SEQ ID NO: 33302 - protein, 9 aa, Dengue virus
PEGIIPSMF

SEQ ID NO: 33303 - protein, 9 aa, Dengue virus
EGIIPSMFE

SEQ ID NO: 33304 - protein, 9 aa, Dengue virus
GIIPSMFEP

SEQ ID NO: 33305 - protein, 9 aa, Dengue virus
IIPSMFEPE

SEQ ID NO: 33306 - protein, 9 aa, Dengue virus
IPSMFEPER

SEQ ID NO: 33307 - protein, 9 aa, Dengue virus
PSMFEPERE

SEQ ID NO: 33308 - protein, 9 aa, Dengue virus
SMFEPEREK

SEQ ID NO: 33309 - protein, 9 aa, Dengue virus
MFEPEREKV

SEQ ID NO: 33310 - protein, 9 aa, Dengue virus
FEPEREKVD

SEQ ID NO: 33311 - protein, 9 aa, Dengue virus
EPEREKVDA

SEQ ID NO: 33312 - protein, 9 aa, Dengue virus
PEREKVDAI

SEQ ID NO: 33313 - protein, 9 aa, Dengue virus
EREKVDAID

SEQ ID NO: 33314 - protein, 9 aa, Dengue virus
REKVDAIDG

SEQ ID NO: 33315 - protein, 9 aa, Dengue virus
EKVDAIDGE

SEQ ID NO: 33316 - protein, 9 aa, Dengue virus
KVDAIDGEY

SEQ ID NO: 33317 - protein, 9 aa, Dengue virus
VDAIDGEYR

SEQ ID NO: 33318 - protein, 9 aa, Dengue virus
DAIDGEYRL

SEQ ID NO: 33319 - protein, 9 aa, Dengue virus
AIDGEYRLR

SEQ ID NO: 33320 - protein, 9 aa, Dengue virus
IDGEYRLRG

SEQ ID NO: 33321 - protein, 9 aa, Dengue virus
DGEYRLRGE

SEQ ID NO: 33322 - protein, 9 aa, Dengue virus
GEYRLRGEA

SEQ ID NO: 33323 - protein, 9 aa, Dengue virus
EYRLRGEAR

SEQ ID NO: 33324 - protein, 9 aa, Dengue virus
YRLRGEARK

SEQ ID NO: 33325 - protein, 9 aa, Dengue virus
RLRGEARKT

SEQ ID NO: 33326 - protein, 9 aa, Dengue virus
LRGEARKTF

SEQ ID NO: 33327 - protein, 9 aa, Dengue virus
RGEARKTFV

SEQ ID NO: 33328 - protein, 9 aa, Dengue virus
GEARKTFVD

SEQ ID NO: 33329 - protein, 9 aa, Dengue virus
EARKTFVDL

SEQ ID NO: 33330 - protein, 9 aa, Dengue virus
ARKTFVDLM

SEQ ID NO: 33331 - protein, 9 aa, Dengue virus
RKTFVDLMR

SEQ ID NO: 33332 - protein, 9 aa, Dengue virus
KTFVDLMRR

SEQ ID NO: 33333 - protein, 9 aa, Dengue virus
TFVDLMRRG

SEQ ID NO: 33334 - protein, 9 aa, Dengue virus
FVDLMRRGD

SEQ ID NO: 33335 - protein, 9 aa, Dengue virus
VDLMRRGDL

SEQ ID NO: 33336 - protein, 9 aa, Dengue virus
DLMRRGDLP

SEQ ID NO: 33337 - protein, 9 aa, Dengue virus
LMRRGDLPV

SEQ ID NO: 33338 - protein, 9 aa, Dengue virus
MRRGDLPVW

SEQ ID NO: 33339 - protein, 9 aa, Dengue virus
RRGDLPVWL

SEQ ID NO: 33340 - protein, 9 aa, Dengue virus
RGDLPVWLA

SEQ ID NO: 33341 - protein, 9 aa, Dengue virus
GDLPVWLAY

SEQ ID NO: 33342 - protein, 9 aa, Dengue virus
DLPVWLAYK

SEQ ID NO: 33343 - protein, 9 aa, Dengue virus
LPVWLAYKV

SEQ ID NO: 33344 - protein, 9 aa, Dengue virus
PVWLAYKVA

SEQ ID NO: 33345 - protein, 9 aa, Dengue virus
VWLAYKVAA

SEQ ID NO: 33346 - protein, 9 aa, Dengue virus
WLAYKVAAE

SEQ ID NO: 33347 - protein, 9 aa, Dengue virus
LAYKVAAEG

SEQ ID NO: 33348 - protein, 9 aa, Dengue virus
AYKVAAEGI

SEQ ID NO: 33349 - protein, 9 aa, Dengue virus
YKVAAEGIN

SEQ ID NO: 33350 - protein, 9 aa, Dengue virus
KVAAEGINY

SEQ ID NO: 33351 - protein, 9 aa, Dengue virus
VAAEGINYA

SEQ ID NO: 33352 - protein, 9 aa, Dengue virus
AAEGINYAD

SEQ ID NO: 33353 - protein, 9 aa, Dengue virus
AEGINYADR

SEQ ID NO: 33354 - protein, 9 aa, Dengue virus
EGINYADRR

SEQ ID NO: 33355 - protein, 9 aa, Dengue virus
GINYADRRW

SEQ ID NO: 33356 - protein, 9 aa, Dengue virus
INYADRRWC

SEQ ID NO: 33357 - protein, 9 aa, Dengue virus
NYADRRWCF

SEQ ID NO: 33358 - protein, 9 aa, Dengue virus
YADRRWCFD

SEQ ID NO: 33359 - protein, 9 aa, Dengue virus
ADRRWCFDG

SEQ ID NO: 33360 - protein, 9 aa, Dengue virus
DRRWCFDGI

SEQ ID NO: 33361 - protein, 9 aa, Dengue virus
RRWCFDGIK

SEQ ID NO: 33362 - protein, 9 aa, Dengue virus
RWCFDGIKN

SEQ ID NO: 33363 - protein, 9 aa, Dengue virus
WCFDGIKNN

SEQ ID NO: 33364 - protein, 9 aa, Dengue virus
CFDGIKNNQ

SEQ ID NO: 33365 - protein, 9 aa, Dengue virus
FDGIKNNQI

SEQ ID NO: 33366 - protein, 9 aa, Dengue virus
DGIKNNQIL

SEQ ID NO: 33367 - protein, 9 aa, Dengue virus
GIKNNQILE

SEQ ID NO: 33368 - protein, 9 aa, Dengue virus
IKNNQILEE

SEQ ID NO: 33369 - protein, 9 aa, Dengue virus
KNNQILEEN

SEQ ID NO: 33370 - protein, 9 aa, Dengue virus
NNQILEENV

SEQ ID NO: 33371 - protein, 9 aa, Dengue virus
NQILEENVE

SEQ ID NO: 33372 - protein, 9 aa, Dengue virus
QILEENVEV

SEQ ID NO: 33373 - protein, 9 aa, Dengue virus
ILEENVEVE

SEQ ID NO: 33374 - protein, 9 aa, Dengue virus
LEENVEVEI

SEQ ID NO: 33375 - protein, 9 aa, Dengue virus
EENVEVEIW

SEQ ID NO: 33376 - protein, 9 aa, Dengue virus
ENVEVEIWT

SEQ ID NO: 33377 - protein, 9 aa, Dengue virus
NVEVEIWTK

SEQ ID NO: 33378 - protein, 9 aa, Dengue virus
VEVEIWTKE

SEQ ID NO: 33379 - protein, 9 aa, Dengue virus
EVEIWTKEG

SEQ ID NO: 33380 - protein, 9 aa, Dengue virus
VEIWTKEGE

SEQ ID NO: 33381 - protein, 9 aa, Dengue virus
EIWTKEGER

SEQ ID NO: 33382 - protein, 9 aa, Dengue virus
IWTKEGERK

SEQ ID NO: 33383 - protein, 9 aa, Dengue virus
WTKEGERKK

SEQ ID NO: 33384 - protein, 9 aa, Dengue virus
TKEGERKKL

SEQ ID NO: 33385 - protein, 9 aa, Dengue virus
KEGERKKLK

SEQ ID NO: 33386 - protein, 9 aa, Dengue virus
EGERKKLKP

SEQ ID NO: 33387 - protein, 9 aa, Dengue virus
GERKKLKPR

SEQ ID NO: 33388 - protein, 9 aa, Dengue virus
ERKKLKPRW

SEQ ID NO: 33389 - protein, 9 aa, Dengue virus
RKKLKPRWL

SEQ ID NO: 33390 - protein, 9 aa, Dengue virus
KKLKPRWLD

SEQ ID NO: 33391 - protein, 9 aa, Dengue virus
KLKPRWLDA

SEQ ID NO: 33392 - protein, 9 aa, Dengue virus
LKPRWLDAR

SEQ ID NO: 33393 - protein, 9 aa, Dengue virus
KPRWLDARI

SEQ ID NO: 33394 - protein, 9 aa, Dengue virus
PRWLDARIY

SEQ ID NO: 33395 - protein, 9 aa, Dengue virus
RWLDARIYS

SEQ ID NO: 33396 - protein, 9 aa, Dengue virus
WLDARIYSD

SEQ ID NO: 33397 - protein, 9 aa, Dengue virus
LDARIYSDP

SEQ ID NO: 33398 - protein, 9 aa, Dengue virus
DARIYSDPL

SEQ ID NO: 33399 - protein, 9 aa, Dengue virus
ARIYSDPLA

SEQ ID NO: 33400 - protein, 9 aa, Dengue virus
RIYSDPLAL

SEQ ID NO: 33401 - protein, 9 aa, Dengue virus
IYSDPLALK

SEQ ID NO: 33402 - protein, 9 aa, Dengue virus
YSDPLALKE

SEQ ID NO: 33403 - protein, 9 aa, Dengue virus
SDPLALKEF

SEQ ID NO: 33404 - protein, 9 aa, Dengue virus
DPLALKEFK

SEQ ID NO: 33405 - protein, 9 aa, Dengue virus
PLALKEFKE

SEQ ID NO: 33406 - protein, 9 aa, Dengue virus
LALKEFKEF

SEQ ID NO: 33407 - protein, 9 aa, Dengue virus
ALKEFKEFA

SEQ ID NO: 33408 - protein, 9 aa, Dengue virus
LKEFKEFAA

SEQ ID NO: 33409 - protein, 9 aa, Dengue virus
KEFKEFAAG

SEQ ID NO: 33410 - protein, 9 aa, Dengue virus
EFKEFAAGR

SEQ ID NO: 33411 - protein, 9 aa, Dengue virus
FKEFAAGRK

SEQ ID NO: 33412 - protein, 9 aa, Dengue virus
KEFAAGRKS

SEQ ID NO: 33413 - protein, 9 aa, Dengue virus
EFAAGRKSL

SEQ ID NO: 33414 - protein, 9 aa, Dengue virus
FAAGRKSLT

SEQ ID NO: 33415 - protein, 9 aa, Dengue virus
AAGRKSLTL

SEQ ID NO: 33416 - protein, 9 aa, Dengue virus
AGRKSLTLN

SEQ ID NO: 33417 - protein, 9 aa, Dengue virus
GRKSLTLNL

SEQ ID NO: 33418 - protein, 9 aa, Dengue virus
RKSLTLNLI

SEQ ID NO: 33419 - protein, 9 aa, Dengue virus
KSLTLNLIT

SEQ ID NO: 33420 - protein, 9 aa, Dengue virus
SLTLNLITE

SEQ ID NO: 33421 - protein, 9 aa, Dengue virus
LTLNLITEM

SEQ ID NO: 33422 - protein, 9 aa, Dengue virus
TLNLITEMG

SEQ ID NO: 33423 - protein, 9 aa, Dengue virus
LNLITEMGR

SEQ ID NO: 33424 - protein, 9 aa, Dengue virus
NLITEMGRL

SEQ ID NO: 33425 - protein, 9 aa, Dengue virus
LITEMGRLP

SEQ ID NO: 33426 - protein, 9 aa, Dengue virus
ITEMGRLPT

SEQ ID NO: 33427 - protein, 9 aa, Dengue virus
TEMGRLPTF

SEQ ID NO: 33428 - protein, 9 aa, Dengue virus
EMGRLPTFM

SEQ ID NO: 33429 - protein, 9 aa, Dengue virus
MGRLPTFMT

SEQ ID NO: 33430 - protein, 9 aa, Dengue virus
GRLPTFMTQ

SEQ ID NO: 33431 - protein, 9 aa, Dengue virus
RLPTFMTQK

SEQ ID NO: 33432 - protein, 9 aa, Dengue virus
LPTFMTQKA

SEQ ID NO: 33433 - protein, 9 aa, Dengue virus
PTFMTQKAR

SEQ ID NO: 33434 - protein, 9 aa, Dengue virus
TFMTQKARN

SEQ ID NO: 33435 - protein, 9 aa, Dengue virus
FMTQKARNA

SEQ ID NO: 33436 - protein, 9 aa, Dengue virus
MTQKARNAL

SEQ ID NO: 33437 - protein, 9 aa, Dengue virus
TQKARNALD

SEQ ID NO: 33438 - protein, 9 aa, Dengue virus
QKARNALDN

SEQ ID NO: 33439 - protein, 9 aa, Dengue virus
KARNALDNL

SEQ ID NO: 33440 - protein, 9 aa, Dengue virus
ARNALDNLA

SEQ ID NO: 33441 - protein, 9 aa, Dengue virus
RDALDNLAV

SEQ ID NO: 33442 - protein, 9 aa, Dengue virus
DALDNLAVL

SEQ ID NO: 33443 - protein, 9 aa, Dengue virus
ALDNLAVLH

SEQ ID NO: 33444 - protein, 9 aa, Dengue virus
LDNLAVLHT

SEQ ID NO: 33445 - protein, 9 aa, Dengue virus
DNLAVLHTA

SEQ ID NO: 33446 - protein, 9 aa, Dengue virus
NLAVLHTAE

SEQ ID NO: 33447 - protein, 9 aa, Dengue virus
LAVLHTAEA

SEQ ID NO: 33448 - protein, 9 aa, Dengue virus
AVLHTAEAG

SEQ ID NO: 33449 - protein, 9 aa, Dengue virus
VLHTAEAGG

SEQ ID NO: 33450 - protein, 9 aa, Dengue virus
LHTAEAGGR

SEQ ID NO: 33451 - protein, 9 aa, Dengue virus
HTAEAGGRA

SEQ ID NO: 33452 - protein, 9 aa, Dengue virus
TAEAGGRAY

SEQ ID NO: 33453 - protein, 9 aa, Dengue virus
GGRAYNHAL

SEQ ID NO: 33454 - protein, 9 aa, Dengue virus
GRAYNHALS

SEQ ID NO: 33455 - protein, 9 aa, Dengue virus
RAYNHALSE

SEQ ID NO: 33456 - protein, 9 aa, Dengue virus
AYNHALSEL

SEQ ID NO: 33457 - protein, 9 aa, Dengue virus
YNHALSELP

SEQ ID NO: 33458 - protein, 9 aa, Dengue virus
NHALSELPE

SEQ ID NO: 33459 - protein, 9 aa, Dengue virus
HALSELPET

SEQ ID NO: 33460 - protein, 9 aa, Dengue virus
ALSELPETL

SEQ ID NO: 33461 - protein, 9 aa, Dengue virus
LSELPETLE

SEQ ID NO: 33462 - protein, 9 aa, Dengue virus
SELPETLET

SEQ ID NO: 33463 - protein, 9 aa, Dengue virus
ELPETLETL

SEQ ID NO: 33464 - protein, 9 aa, Dengue virus
LPETLETLL

SEQ ID NO: 33465 - protein, 9 aa, Dengue virus
PETLETLLL

SEQ ID NO: 33466 - protein, 9 aa, Dengue virus
ETLETLLLL

SEQ ID NO: 33467 - protein, 9 aa, Dengue virus
TLETLLLLT

SEQ ID NO: 33468 - protein, 9 aa, Dengue virus
LETLLLLTL

SEQ ID NO: 33469 - protein, 9 aa, Dengue virus
ETLLLLTLL

SEQ ID NO: 33470 - protein, 9 aa, Dengue virus
TLLLLTLLA

SEQ ID NO: 33471 - protein, 9 aa, Dengue virus
LLLLTLLAT

SEQ ID NO: 33472 - protein, 9 aa, Dengue virus
LLLTLLATV

SEQ ID NO: 33473 - protein, 9 aa, Dengue virus
LLTLLATVT

SEQ ID NO: 33474 - protein, 9 aa, Dengue virus
LTLLATVTG

SEQ ID NO: 33475 - protein, 9 aa, Dengue virus
TLLATVTGG

SEQ ID NO: 33476 - protein, 9 aa, Dengue virus
LLATVTGGI

SEQ ID NO: 33477 - protein, 9 aa, Dengue virus
LATVTGGIF

SEQ ID NO: 33478 - protein, 9 aa, Dengue virus
ATVTGGIFL

SEQ ID NO: 33479 - protein, 9 aa, Dengue virus
TVTGGIFLF

SEQ ID NO: 33480 - protein, 9 aa, Dengue virus
VTGGIFLFL

SEQ ID NO: 33481 - protein, 9 aa, Dengue virus
TGGIFLFLM

SEQ ID NO: 33482 - protein, 9 aa, Dengue virus
GGIFLFLMS

SEQ ID NO: 33483 - protein, 9 aa, Dengue virus
GIFLFLMSG

SEQ ID NO: 33484 - protein, 9 aa, Dengue virus
IFLFLMSGK

SEQ ID NO: 33485 - protein, 9 aa, Dengue virus
FLFLMSGKG

SEQ ID NO: 33486 - protein, 9 aa, Dengue virus
LFLMSGKGI

SEQ ID NO: 33487 - protein, 9 aa, Dengue virus
FLMSGKGIG

SEQ ID NO: 33488 - protein, 9 aa, Dengue virus
LMSGKGIGK

SEQ ID NO: 33489 - protein, 9 aa, Dengue virus
MSGKGIGKM

SEQ ID NO: 33490 - protein, 9 aa, Dengue virus
SGKGIGKMT

SEQ ID NO: 33491 - protein, 9 aa, Dengue virus
GKGIGKMTL

SEQ ID NO: 33492 - protein, 9 aa, Dengue virus
KGIGKMTLG

SEQ ID NO: 33493 - protein, 9 aa, Dengue virus
GIGKMTLGM

SEQ ID NO: 33494 - protein, 9 aa, Dengue virus
IGKMTLGMC

SEQ ID NO: 33495 - protein, 9 aa, Dengue virus
GKMTLGMCC

SEQ ID NO: 33496 - protein, 9 aa, Dengue virus
KMTLGMCCI

SEQ ID NO: 33497 - protein, 9 aa, Dengue virus
MTLGMCCII

SEQ ID NO: 33498 - protein, 9 aa, Dengue virus
TLGMCCIIT

SEQ ID NO: 33499 - protein, 9 aa, Dengue virus
LGMCCIITA

SEQ ID NO: 33500 - protein, 9 aa, Dengue virus
GMCCIITAS

SEQ ID NO: 33501 - protein, 9 aa, Dengue virus
TASILLWYA

SEQ ID NO: 33502 - protein, 9 aa, Dengue virus
LLWYAQIQP

SEQ ID NO: 33503 - protein, 9 aa, Dengue virus
LWYAQIQPH

SEQ ID NO: 33504 - protein, 9 aa, Dengue virus
WYAQIQPHW

SEQ ID NO: 33505 - protein, 9 aa, Dengue virus
YAQIQPHWI

SEQ ID NO: 33506 - protein, 9 aa, Dengue virus
AQIQPHWIA

SEQ ID NO: 33507 - protein, 9 aa, Dengue virus
QIQPHWIAA

SEQ ID NO: 33508 - protein, 9 aa, Dengue virus
IQPHWIAAS

SEQ ID NO: 33509 - protein, 9 aa, Dengue virus
QPHWIAASI

SEQ ID NO: 33510 - protein, 9 aa, Dengue virus
PHWIAASII

SEQ ID NO: 33511 - protein, 9 aa, Dengue virus
HWIAASIIL

SEQ ID NO: 33512 - protein, 9 aa, Dengue virus
WIAASIILE

SEQ ID NO: 33513 - protein, 9 aa, Dengue virus
IAASIILEF

SEQ ID NO: 33514 - protein, 9 aa, Dengue virus
AASIILEFF

SEQ ID NO: 33515 - protein, 9 aa, Dengue virus
ASIILEFFL

SEQ ID NO: 33516 - protein, 9 aa, Dengue virus
SIILEFFLI

SEQ ID NO: 33517 - protein, 9 aa, Dengue virus
IILEFFLIV

SEQ ID NO: 33518 - protein, 9 aa, Dengue virus
ILEFFLIVL

SEQ ID NO: 33519 - protein, 9 aa, Dengue virus
LEFFLIVLL

SEQ ID NO: 33520 - protein, 9 aa, Dengue virus
EFFLIVLLI

SEQ ID NO: 33521 - protein, 9 aa, Dengue virus
FFLIVLLIP

SEQ ID NO: 33522 - protein, 9 aa, Dengue virus
FLIVLLIPE

SEQ ID NO: 33523 - protein, 9 aa, Dengue virus
LIVLLIPEP

SEQ ID NO: 33524 - protein, 9 aa, Dengue virus
IVLLIPEPE

SEQ ID NO: 33525 - protein, 9 aa, Dengue virus
VLLIPEPEK

SEQ ID NO: 33526 - protein, 9 aa, Dengue virus
LLIPEPEKQ

SEQ ID NO: 33527 - protein, 9 aa, Dengue virus
LIPEPEKQR

SEQ ID NO: 33528 - protein, 9 aa, Dengue virus
IPEPEKQRT

SEQ ID NO: 33529 - protein, 9 aa, Dengue virus
PEPEKQRTP

SEQ ID NO: 33530 - protein, 9 aa, Dengue virus
EPEKQRTPQ

SEQ ID NO: 33531 - protein, 9 aa, Dengue virus
PEKQRTPQD

SEQ ID NO: 33532 - protein, 9 aa, Dengue virus
EKQRTPQDN

SEQ ID NO: 33533 - protein, 9 aa, Dengue virus
KQRTPQDNQ

SEQ ID NO: 33534 - protein, 9 aa, Dengue virus
QRTPQDNQL

SEQ ID NO: 33535 - protein, 9 aa, Dengue virus
RTPQDNQLT

SEQ ID NO: 33536 - protein, 9 aa, Dengue virus
TPQDNQLTY

SEQ ID NO: 33537 - protein, 9 aa, Dengue virus
PQDNQLTYV

SEQ ID NO: 33538 - protein, 9 aa, Dengue virus
QDNQLTYVV

SEQ ID NO: 33539 - protein, 9 aa, Dengue virus
DNQLTYVVI

SEQ ID NO: 33540 - protein, 9 aa, Dengue virus
NQLTYVVIA

SEQ ID NO: 33541 - protein, 9 aa, Dengue virus
QLTYVVIAI

SEQ ID NO: 33542 - protein, 9 aa, Dengue virus
LTYVVIAIL

SEQ ID NO: 33543 - protein, 9 aa, Dengue virus
TYVVIAILT

SEQ ID NO: 33544 - protein, 9 aa, Dengue virus
YVVIAILTV

SEQ ID NO: 33545 - protein, 9 aa, Dengue virus
VVIAILTVV

SEQ ID NO: 33546 - protein, 9 aa, Dengue virus
VIAILTVVA

SEQ ID NO: 33547 - protein, 9 aa, Dengue virus
IAILTVVAA

SEQ ID NO: 33548 - protein, 9 aa, Dengue virus
AILTVVAAT

SEQ ID NO: 33549 - protein, 9 aa, Dengue virus
ILTVVAATM

SEQ ID NO: 33550 - protein, 9 aa, Dengue virus
LTVVAATMA

SEQ ID NO: 33551 - protein, 9 aa, Dengue virus
TVVAATMAN

SEQ ID NO: 33552 - protein, 9 aa, Dengue virus
VVAATMANE

SEQ ID NO: 33553 - protein, 9 aa, Dengue virus
VAATMANEM

SEQ ID NO: 33554 - protein, 9 aa, Dengue virus
AATMANEMG

SEQ ID NO: 33555 - protein, 9 aa, Dengue virus
ATMANEMGF

SEQ ID NO: 33556 - protein, 9 aa, Dengue virus
TMANEMGFL

SEQ ID NO: 33557 - protein, 9 aa, Dengue virus
MANEMGFLE

SEQ ID NO: 33558 - protein, 9 aa, Dengue virus
ANEMGFLEK

SEQ ID NO: 33559 - protein, 9 aa, Dengue virus
NEMGFLEKT

SEQ ID NO: 33560 - protein, 9 aa, Dengue virus
EMGFLEKTK

SEQ ID NO: 33561 - protein, 9 aa, Dengue virus
MGFLEKTKK

SEQ ID NO: 33562 - protein, 9 aa, Dengue virus
GFLEKTKKD

SEQ ID NO: 33563 - protein, 9 aa, Dengue virus
FLEKTKKDL

SEQ ID NO: 33564 - protein, 9 aa, Dengue virus
LEKTKKDLG

SEQ ID NO: 33565 - protein, 9 aa, Dengue virus
EKTKKDLGL

SEQ ID NO: 33566 - protein, 9 aa, Dengue virus
KTKKDLGLG

SEQ ID NO: 33567 - protein, 9 aa, Dengue virus
ESESNILDI

SEQ ID NO: 33568 - protein, 9 aa, Dengue virus
PESNILDID

SEQ ID NO: 33569 - protein, 9 aa, Dengue virus
ESNILDIDL

SEQ ID NO: 33570 - protein, 9 aa, Dengue virus
SNILDIDLR

SEQ ID NO: 33571 - protein, 9 aa, Dengue virus
NILDIDLRP

SEQ ID NO: 33572 - protein, 9 aa, Dengue virus
ILDIDLRPA

SEQ ID NO: 33573 - protein, 9 aa, Dengue virus
LDIDLRPAS

SEQ ID NO: 33574 - protein, 9 aa, Dengue virus
DIDLRPASA

SEQ ID NO: 33575 - protein, 9 aa, Dengue virus
IDLRPASAW

SEQ ID NO: 33576 - protein, 9 aa, Dengue virus
DLRPASAWT

SEQ ID NO: 33577 - protein, 9 aa, Dengue virus
LRPASAWTL

SEQ ID NO: 33578 - protein, 9 aa, Dengue virus
RPASAWTLY

SEQ ID NO: 33579 - protein, 9 aa, Dengue virus
PASAWTLYA

SEQ ID NO: 33580 - protein, 9 aa, Dengue virus
ASAWTLYAV

SEQ ID NO: 33581 - protein, 9 aa, Dengue virus
SAWTLYAVA

SEQ ID NO: 33582 - protein, 9 aa, Dengue virus
AWTLYAVAT

SEQ ID NO: 33583 - protein, 9 aa, Dengue virus
WTLYAVATT

SEQ ID NO: 33584 - protein, 9 aa, Dengue virus
TLYAVATTF

SEQ ID NO: 33585 - protein, 9 aa, Dengue virus
LYAVATTFV

SEQ ID NO: 33586 - protein, 9 aa, Dengue virus
YAVATTFVT

SEQ ID NO: 33587 - protein, 9 aa, Dengue virus
AVATTFVTP

SEQ ID NO: 33588 - protein, 9 aa, Dengue virus
VATTFVTPM

SEQ ID NO: 33589 - protein, 9 aa, Dengue virus
ATTFVTPML

SEQ ID NO: 33590 - protein, 9 aa, Dengue virus
TTFVTPMLR

SEQ ID NO: 33591 - protein, 9 aa, Dengue virus
TFVTPMLRH

SEQ ID NO: 33592 - protein, 9 aa, Dengue virus
FVTPMLRHS

SEQ ID NO: 33593 - protein, 9 aa, Dengue virus
VTPMLRHSI

SEQ ID NO: 33594 - protein, 9 aa, Dengue virus
TPMLRHSIE

SEQ ID NO: 33595 - protein, 9 aa, Dengue virus
PMLRHSIEN

SEQ ID NO: 33596 - protein, 9 aa, Dengue virus
MLRHSIENS

SEQ ID NO: 33597 - protein, 9 aa, Dengue virus
LRHSIENSS

SEQ ID NO: 33598 - protein, 9 aa, Dengue virus
RHSIENSSV

SEQ ID NO: 33599 - protein, 9 aa, Dengue virus
HSIENSSVN

SEQ ID NO: 33600 - protein, 9 aa, Dengue virus
SIENSSVNV

SEQ ID NO: 33601 - protein, 9 aa, Dengue virus
IENSSVNVS

SEQ ID NO: 33602 - protein, 9 aa, Dengue virus
ENSSVNVSL

SEQ ID NO: 33603 - protein, 9 aa, Dengue virus
NSSVNVSLT

SEQ ID NO: 33604 - protein, 9 aa, Dengue virus
SSVNVSLTA

SEQ ID NO: 33605 - protein, 9 aa, Dengue virus
SVNVSLTAI

SEQ ID NO: 33606 - protein, 9 aa, Dengue virus
VNVSLTAIA

SEQ ID NO: 33607 - protein, 9 aa, Dengue virus
NVSLTAIAN

SEQ ID NO: 33608 - protein, 9 aa, Dengue virus
VSLTAIANQ

SEQ ID NO: 33609 - protein, 9 aa, Dengue virus
SLTAIANQA

SEQ ID NO: 33610 - protein, 9 aa, Dengue virus
LTAIANQAT

SEQ ID NO: 33611 - protein, 9 aa, Dengue virus
TAIANQATV

SEQ ID NO: 33612 - protein, 9 aa, Dengue virus
AIANQATVL

SEQ ID NO: 33613 - protein, 9 aa, Dengue virus
IANQATVLM

SEQ ID NO: 33614 - protein, 9 aa, Dengue virus
ANQATVLMG

SEQ ID NO: 33615 - protein, 9 aa, Dengue virus
NQATVLMGL

SEQ ID NO: 33616 - protein, 9 aa, Dengue virus
QATVLMGLG

SEQ ID NO: 33617 - protein, 9 aa, Dengue virus
ATVLMGLGK

SEQ ID NO: 33618 - protein, 9 aa, Dengue virus
TVLMGLGKG

SEQ ID NO: 33619 - protein, 9 aa, Dengue virus
VLMGLGKGW

SEQ ID NO: 33620 - protein, 9 aa, Dengue virus
LMGLGKGWP

SEQ ID NO: 33621 - protein, 9 aa, Dengue virus
MGLGKGWPL

SEQ ID NO: 33622 - protein, 9 aa, Dengue virus
GLGKGWPLS

SEQ ID NO: 33623 - protein, 9 aa, Dengue virus
LGKGWPLSK

SEQ ID NO: 33624 - protein, 9 aa, Dengue virus
GKGWPLSKM

SEQ ID NO: 33625 - protein, 9 aa, Dengue virus
KGWPLSKMD

SEQ ID NO: 33626 - protein, 9 aa, Dengue virus
GWPLSKMDI

SEQ ID NO: 33627 - protein, 9 aa, Dengue virus
WPLSKMDIG

SEQ ID NO: 33628 - protein, 9 aa, Dengue virus
PLSKMDIGV

SEQ ID NO: 33629 - protein, 9 aa, Dengue virus
LSKMDIGVP

SEQ ID NO: 33630 - protein, 9 aa, Dengue virus
SKMDIGVPL

SEQ ID NO: 33631 - protein, 9 aa, Dengue virus
KMDIGVPLL

SEQ ID NO: 33632 - protein, 9 aa, Dengue virus
MDIGVPLLA

SEQ ID NO: 33633 - protein, 9 aa, Dengue virus
DIGVPLLAI

SEQ ID NO: 33634 - protein, 9 aa, Dengue virus
IGVPLLAIG

SEQ ID NO: 33635 - protein, 9 aa, Dengue virus
GVPLLAIGC

SEQ ID NO: 33636 - protein, 9 aa, Dengue virus
VPLLAIGCY

SEQ ID NO: 33637 - protein, 9 aa, Dengue virus
PLLAIGCYS

SEQ ID NO: 33638 - protein, 9 aa, Dengue virus
LLAIGCYSQ

SEQ ID NO: 33639 - protein, 9 aa, Dengue virus
LAIGCYSQV

SEQ ID NO: 33640 - protein, 9 aa, Dengue virus
AIGCYSQVN

SEQ ID NO: 33641 - protein, 9 aa, Dengue virus
IGCYSQVNP

SEQ ID NO: 33642 - protein, 9 aa, Dengue virus
GCYSQVNPI

SEQ ID NO: 33643 - protein, 9 aa, Dengue virus
CYSQVNPIT

SEQ ID NO: 33644 - protein, 9 aa, Dengue virus
YSQVNPITL

SEQ ID NO: 33645 - protein, 9 aa, Dengue virus
SQVNPITLT

SEQ ID NO: 33646 - protein, 9 aa, Dengue virus
QVNPITLTA

SEQ ID NO: 33647 - protein, 9 aa, Dengue virus
VNPITLTAA

SEQ ID NO: 33648 - protein, 9 aa, Dengue virus
NPITLTAAL

SEQ ID NO: 33649 - protein, 9 aa, Dengue virus
PITLTAALL

SEQ ID NO: 33650 - protein, 9 aa, Dengue virus
ITLTAALLL

SEQ ID NO: 33651 - protein, 9 aa, Dengue virus
TLTAALLLL

SEQ ID NO: 33652 - protein, 9 aa, Dengue virus
TAALLLLVA

SEQ ID NO: 33653 - protein, 9 aa, Dengue virus
AALLLLVAH

SEQ ID NO: 33654 - protein, 9 aa, Dengue virus
LLVAHYAII

SEQ ID NO: 33655 - protein, 9 aa, Dengue virus
LVAHYAIIG

SEQ ID NO: 33656 - protein, 9 aa, Dengue virus
VAHYAIIGP

SEQ ID NO: 33657 - protein, 9 aa, Dengue virus
AHYAIIGPG

SEQ ID NO: 33658 - protein, 9 aa, Dengue virus
HYAIIGPGL

SEQ ID NO: 33659 - protein, 9 aa, Dengue virus
YAIIGPGLQ

SEQ ID NO: 33660 - protein, 9 aa, Dengue virus
AIIGPGLQA

SEQ ID NO: 33661 - protein, 9 aa, Dengue virus
IIGPGLQAK

SEQ ID NO: 33662 - protein, 9 aa, Dengue virus
IGPGLQAKA

SEQ ID NO: 33663 - protein, 9 aa, Dengue virus
GPGLQAKAT

SEQ ID NO: 33664 - protein, 9 aa, Dengue virus
PGLQAKATR

SEQ ID NO: 33665 - protein, 9 aa, Dengue virus
GLQAKATRE

SEQ ID NO: 33666 - protein, 9 aa, Dengue virus
LQAKATREA

SEQ ID NO: 33667 - protein, 9 aa, Dengue virus
QAKATREAQ

SEQ ID NO: 33668 - protein, 9 aa, Dengue virus
AKATREAQK

SEQ ID NO: 33669 - protein, 9 aa, Dengue virus
KATREAQKR

SEQ ID NO: 33670 - protein, 9 aa, Dengue virus
ATREAQKRA

SEQ ID NO: 33671 - protein, 9 aa, Dengue virus
TREAQKRAA

SEQ ID NO: 33672 - protein, 9 aa, Dengue virus
REAQKRAAA

SEQ ID NO: 33673 - protein, 9 aa, Dengue virus
EAQKRAAAG

SEQ ID NO: 33674 - protein, 9 aa, Dengue virus
AQKRAAAGI

SEQ ID NO: 33675 - protein, 9 aa, Dengue virus
QKRAAAGIM

SEQ ID NO: 33676 - protein, 9 aa, Dengue virus
KRAAAGIMK

SEQ ID NO: 33677 - protein, 9 aa, Dengue virus
RAAAGIMKN

SEQ ID NO: 33678 - protein, 9 aa, Dengue virus
AAAGIMKNP

SEQ ID NO: 33679 - protein, 9 aa, Dengue virus
AAGIMKNPT

SEQ ID NO: 33680 - protein, 9 aa, Dengue virus
AGIMKNPTV

SEQ ID NO: 33681 - protein, 9 aa, Dengue virus
GIMKNPTVD

SEQ ID NO: 33682 - protein, 9 aa, Dengue virus
IMKNPTVDG

SEQ ID NO: 33683 - protein, 9 aa, Dengue virus
MKNPTVDGI

SEQ ID NO: 33684 - protein, 9 aa, Dengue virus
KNPTVDGIT

SEQ ID NO: 33685 - protein, 9 aa, Dengue virus
NPTVDGITV

SEQ ID NO: 33686 - protein, 9 aa, Dengue virus
PTVDGITVI

SEQ ID NO: 33687 - protein, 9 aa, Dengue virus
TVDGITVID

SEQ ID NO: 33688 - protein, 9 aa, Dengue virus
VDGITVIDL

SEQ ID NO: 33689 - protein, 9 aa, Dengue virus
DGITVIDLE

SEQ ID NO: 33690 - protein, 9 aa, Dengue virus
GITVIDLEP

SEQ ID NO: 33691 - protein, 9 aa, Dengue virus
ITVIDLEPI

SEQ ID NO: 33692 - protein, 9 aa, Dengue virus
TVIDLDPIP

SEQ ID NO: 33693 - protein, 9 aa, Dengue virus
VIDLDPIPY

SEQ ID NO: 33694 - protein, 9 aa, Dengue virus
IDLEPIPYD

SEQ ID NO: 33695 - protein, 9 aa, Dengue virus
DLDPIPYDP

SEQ ID NO: 33696 - protein, 9 aa, Dengue virus
LDPIPYDPK

SEQ ID NO: 33697 - protein, 9 aa, Dengue virus
DPIPYDPKF

SEQ ID NO: 33698 - protein, 9 aa, Dengue virus
PIPYDPKFE

SEQ ID NO: 33699 - protein, 9 aa, Dengue virus
IPYDPKFEK

SEQ ID NO: 33700 - protein, 9 aa, Dengue virus
PYDPKFEKQ

SEQ ID NO: 33701 - protein, 9 aa, Dengue virus
YDPKFEKQL

SEQ ID NO: 33702 - protein, 9 aa, Dengue virus
DPKFEKQLG

SEQ ID NO: 33703 - protein, 9 aa, Dengue virus
PKFEKQLGQ

SEQ ID NO: 33704 - protein, 9 aa, Dengue virus
KFEKQLGQV

SEQ ID NO: 33705 - protein, 9 aa, Dengue virus
FEKQLGQVM

SEQ ID NO: 33706 - protein, 9 aa, Dengue virus
EKQLGQVML

SEQ ID NO: 33707 - protein, 9 aa, Dengue virus
KQLGQVMLL

SEQ ID NO: 33708 - protein, 9 aa, Dengue virus
QLGQVMLLI

SEQ ID NO: 33709 - protein, 9 aa, Dengue virus
LGQVMLLIL

SEQ ID NO: 33710 - protein, 9 aa, Dengue virus
GQVMLLILC

SEQ ID NO: 33711 - protein, 9 aa, Dengue virus
QVMLLILCV

SEQ ID NO: 33712 - protein, 9 aa, Dengue virus
VMLLILCVT

SEQ ID NO: 33713 - protein, 9 aa, Dengue virus
MLLILCVTQ

SEQ ID NO: 33714 - protein, 9 aa, Dengue virus
LLILCVTQV

SEQ ID NO: 33715 - protein, 9 aa, Dengue virus
LILCVTQVL

SEQ ID NO: 33716 - protein, 9 aa, Dengue virus
ILCVTQVLM

SEQ ID NO: 33717 - protein, 9 aa, Dengue virus
LCVTQVLMM

SEQ ID NO: 33718 - protein, 9 aa, Dengue virus
CVTQVLMMR

SEQ ID NO: 33719 - protein, 9 aa, Dengue virus
VTQVLMMRT

SEQ ID NO: 33720 - protein, 9 aa, Dengue virus
TQVLMMRTT

SEQ ID NO: 33721 - protein, 9 aa, Dengue virus
QVLMMRTTW

SEQ ID NO: 33722 - protein, 9 aa, Dengue virus
VLMMRTTWA

SEQ ID NO: 33723 - protein, 9 aa, Dengue virus
LMMRTTWAL

SEQ ID NO: 33724 - protein, 9 aa, Dengue virus
MMRTTWALC

SEQ ID NO: 33725 - protein, 9 aa, Dengue virus
MRTTWALCE

SEQ ID NO: 33726 - protein, 9 aa, Dengue virus
RTTWALCEA

SEQ ID NO: 33727 - protein, 9 aa, Dengue virus
TTWALCEAL

SEQ ID NO: 33728 - protein, 9 aa, Dengue virus
TWALCEALT

SEQ ID NO: 33729 - protein, 9 aa, Dengue virus
WALCEALTL

SEQ ID NO: 33730 - protein, 9 aa, Dengue virus
ALCEALTLA

SEQ ID NO: 33731 - protein, 9 aa, Dengue virus
LCEALTLAT

SEQ ID NO: 33732 - protein, 9 aa, Dengue virus
CEALTLATG

SEQ ID NO: 33733 - protein, 9 aa, Dengue virus
EALTLATGP

SEQ ID NO: 33734 - protein, 9 aa, Dengue virus
ALTLATGPI

SEQ ID NO: 33735 - protein, 9 aa, Dengue virus
LTLATGPIS

SEQ ID NO: 33736 - protein, 9 aa, Dengue virus
TLATGPIST

SEQ ID NO: 33737 - protein, 9 aa, Dengue virus
LATGPISTL

SEQ ID NO: 33738 - protein, 9 aa, Dengue virus
ATGPISTLW

SEQ ID NO: 33739 - protein, 9 aa, Dengue virus
TGPISTLWE

SEQ ID NO: 33740 - protein, 9 aa, Dengue virus
GPISTLWEG

SEQ ID NO: 33741 - protein, 9 aa, Dengue virus
PISTLWEGN

SEQ ID NO: 33742 - protein, 9 aa, Dengue virus
ISTLWEGNP

SEQ ID NO: 33743 - protein, 9 aa, Dengue virus
STLWEGNPG

SEQ ID NO: 33744 - protein, 9 aa, Dengue virus
TLWEGNPGR

SEQ ID NO: 33745 - protein, 9 aa, Dengue virus
LWEGNPGRF

SEQ ID NO: 33746 - protein, 9 aa, Dengue virus
WEGNPGRFW

SEQ ID NO: 33747 - protein, 9 aa, Dengue virus
EGNPGRFWN

SEQ ID NO: 33748 - protein, 9 aa, Dengue virus
GNPGRFWNT

SEQ ID NO: 33749 - protein, 9 aa, Dengue virus
NPGRFWNTT

SEQ ID NO: 33750 - protein, 9 aa, Dengue virus
PGRFWNTTI

SEQ ID NO: 33751 - protein, 9 aa, Dengue virus
GRFWNTTIA

SEQ ID NO: 33752 - protein, 9 aa, Dengue virus
RFWNTTIAV

SEQ ID NO: 33753 - protein, 9 aa, Dengue virus
FWNTTIAVS

SEQ ID NO: 33754 - protein, 9 aa, Dengue virus
WNTTIAVSM

SEQ ID NO: 33755 - protein, 9 aa, Dengue virus
NTTIAVSMA

SEQ ID NO: 33756 - protein, 9 aa, Dengue virus
TTIAVSMAN

SEQ ID NO: 33757 - protein, 9 aa, Dengue virus
TIAVSMANI

SEQ ID NO: 33758 - protein, 9 aa, Dengue virus
IAVSMANIF

SEQ ID NO: 33759 - protein, 9 aa, Dengue virus
AVSMANIFR

SEQ ID NO: 33760 - protein, 9 aa, Dengue virus
VSMANIFRG

SEQ ID NO: 33761 - protein, 9 aa, Dengue virus
SMANIFRGS

SEQ ID NO: 33762 - protein, 9 aa, Dengue virus
MANIFRGSY

SEQ ID NO: 33763 - protein, 9 aa, Dengue virus
ANIFRGSYL

SEQ ID NO: 33764 - protein, 9 aa, Dengue virus
NIFRGSYLA

SEQ ID NO: 33765 - protein, 9 aa, Dengue virus
IFRGSYLAG

SEQ ID NO: 33766 - protein, 9 aa, Dengue virus
FRGSYLAGA

SEQ ID NO: 33767 - protein, 9 aa, Dengue virus
RGSYLAGAG

SEQ ID NO: 33768 - protein, 9 aa, Dengue virus
GSYLAGAGL

SEQ ID NO: 33769 - protein, 9 aa, Dengue virus
SYLAGAGLL

SEQ ID NO: 33770 - protein, 9 aa, Dengue virus
YLAGAGLLF

SEQ ID NO: 33771 - protein, 9 aa, Dengue virus
LAGAGLLFS

SEQ ID NO: 33772 - protein, 9 aa, Dengue virus
AGAGLLFSI

SEQ ID NO: 33773 - protein, 9 aa, Dengue virus
GAGLLFSIM

SEQ ID NO: 33774 - protein, 9 aa, Dengue virus
AGLLFSIMK

SEQ ID NO: 33775 - protein, 9 aa, Dengue virus
GLLFSIMKN

SEQ ID NO: 33776 - protein, 9 aa, Dengue virus
LLFSIMKNT

SEQ ID NO: 33777 - protein, 9 aa, Dengue virus
LFSIMKNTT

SEQ ID NO: 33778 - protein, 9 aa, Dengue virus
FSIMKNTTN

SEQ ID NO: 33779 - protein, 9 aa, Dengue virus
RRGTGNIGE

SEQ ID NO: 33780 - protein, 9 aa, Dengue virus
RGTGNIGET

SEQ ID NO: 33781 - protein, 9 aa, Dengue virus
GTGNIGETL

SEQ ID NO: 33782 - protein, 9 aa, Dengue virus
TGNIGETLG

SEQ ID NO: 33783 - protein, 9 aa, Dengue virus
GNIGETLGE

SEQ ID NO: 33784 - protein, 9 aa, Dengue virus
NIGETLGEK

SEQ ID NO: 33785 - protein, 9 aa, Dengue virus
IGETLGEKW

SEQ ID NO: 33786 - protein, 9 aa, Dengue virus
GETLGEKWK

SEQ ID NO: 33787 - protein, 9 aa, Dengue virus
ETLGEKWKS

SEQ ID NO: 33788 - protein, 9 aa, Dengue virus
TLGEKWKSR

SEQ ID NO: 33789 - protein, 9 aa, Dengue virus
LGEKWKSRL

SEQ ID NO: 33790 - protein, 9 aa, Dengue virus
GEKWKSRLN

SEQ ID NO: 33791 - protein, 9 aa, Dengue virus
EKWKSRLNA

SEQ ID NO: 33792 - protein, 9 aa, Dengue virus
KWKSRLNAL

SEQ ID NO: 33793 - protein, 9 aa, Dengue virus
WKSRLNALG

SEQ ID NO: 33794 - protein, 9 aa, Dengue virus
RLNALGKSE

SEQ ID NO: 33795 - protein, 9 aa, Dengue virus
LNALGKSEF

SEQ ID NO: 33796 - protein, 9 aa, Dengue virus
NALGKSEFQ

SEQ ID NO: 33797 - protein, 9 aa, Dengue virus
LGKSEFQIY

SEQ ID NO: 33798 - protein, 9 aa, Dengue virus
GKSEFQIYK

SEQ ID NO: 33799 - protein, 9 aa, Dengue virus
KSEFQIYKK

SEQ ID NO: 33800 - protein, 9 aa, Dengue virus
SEFQIYKKS

SEQ ID NO: 33801 - protein, 9 aa, Dengue virus
EFQIYKKSG

SEQ ID NO: 33802 - protein, 9 aa, Dengue virus
FQIYKKSGI

SEQ ID NO: 33803 - protein, 9 aa, Dengue virus
QIYKKSGIQ

SEQ ID NO: 33804 - protein, 9 aa, Dengue virus
IYKKSGIQE

SEQ ID NO: 33805 - protein, 9 aa, Dengue virus
YKKSGIQEV

SEQ ID NO: 33806 - protein, 9 aa, Dengue virus
KKSGIQEVD

SEQ ID NO: 33807 - protein, 9 aa, Dengue virus
KSGIQEVDR

SEQ ID NO: 33808 - protein, 9 aa, Dengue virus
SGIQEVDRT

SEQ ID NO: 33809 - protein, 9 aa, Dengue virus
GIQEVDRTL

SEQ ID NO: 33810 - protein, 9 aa, Dengue virus
IQEVDRTLA

SEQ ID NO: 33811 - protein, 9 aa, Dengue virus
QEVDRTLAK

SEQ ID NO: 33812 - protein, 9 aa, Dengue virus
EVDRTLAKE

SEQ ID NO: 33813 - protein, 9 aa, Dengue virus
VDRTLAKEG

SEQ ID NO: 33814 - protein, 9 aa, Dengue virus
DRTLAKEGI

SEQ ID NO: 33815 - protein, 9 aa, Dengue virus
RTLAKEGIK

SEQ ID NO: 33816 - protein, 9 aa, Dengue virus
TLAKEGIKR

SEQ ID NO: 33817 - protein, 9 aa, Dengue virus
LAKEGIKRG

SEQ ID NO: 33818 - protein, 9 aa, Dengue virus
AKEGIKRGE

SEQ ID NO: 33819 - protein, 9 aa, Dengue virus
KEGIKRGET

SEQ ID NO: 33820 - protein, 9 aa, Dengue virus
EGIKRGETD

SEQ ID NO: 33821 - protein, 9 aa, Dengue virus
GIKRGETDH

SEQ ID NO: 33822 - protein, 9 aa, Dengue virus
IKRGETDHH

SEQ ID NO: 33823 - protein, 9 aa, Dengue virus
KRGETDHHA

SEQ ID NO: 33824 - protein, 9 aa, Dengue virus
RGETDHHAV

SEQ ID NO: 33825 - protein, 9 aa, Dengue virus
GETDHHAVS

SEQ ID NO: 33826 - protein, 9 aa, Dengue virus
ETDHHAVSR

SEQ ID NO: 33827 - protein, 9 aa, Dengue virus
TDHHAVSRG

SEQ ID NO: 33828 - protein, 9 aa, Dengue virus
DHHAVSRGS

SEQ ID NO: 33829 - protein, 9 aa, Dengue virus
HHAVSRGSA

SEQ ID NO: 33830 - protein, 9 aa, Dengue virus
HAVSRGSAK

SEQ ID NO: 33831 - protein, 9 aa, Dengue virus
AVSRGSAKL

SEQ ID NO: 33832 - protein, 9 aa, Dengue virus
VSRGSAKLR

SEQ ID NO: 33833 - protein, 9 aa, Dengue virus
SRGSAKLRW

SEQ ID NO: 33834 - protein, 9 aa, Dengue virus
RGSAKLRWF

SEQ ID NO: 33835 - protein, 9 aa, Dengue virus
GSAKLRWFV

SEQ ID NO: 33836 - protein, 9 aa, Dengue virus
SAKLRWFVE

SEQ ID NO: 33837 - protein, 9 aa, Dengue virus
AKLRWFVER

SEQ ID NO: 33838 - protein, 9 aa, Dengue virus
KLRWFVERN

SEQ ID NO: 33839 - protein, 9 aa, Dengue virus
LRWFVERNM

SEQ ID NO: 33840 - protein, 9 aa, Dengue virus
RWFVERNMV

SEQ ID NO: 33841 - protein, 9 aa, Dengue virus
WFVERNMVT

SEQ ID NO: 33842 - protein, 9 aa, Dengue virus
FVERNMVTP

SEQ ID NO: 33843 - protein, 9 aa, Dengue virus
VERNMVTPE

SEQ ID NO: 33844 - protein, 9 aa, Dengue virus
ERNMVTPEG

SEQ ID NO: 33845 - protein, 9 aa, Dengue virus
RNMVTPEGK

SEQ ID NO: 33846 - protein, 9 aa, Dengue virus
NMVTPEGKV

SEQ ID NO: 33847 - protein, 9 aa, Dengue virus
MVTPEGKVV

SEQ ID NO: 33848 - protein, 9 aa, Dengue virus
VTPEGKVVD

SEQ ID NO: 33849 - protein, 9 aa, Dengue virus
TPEGKVVDL

SEQ ID NO: 33850 - protein, 9 aa, Dengue virus
PEGKVVDLG

SEQ ID NO: 33851 - protein, 9 aa, Dengue virus
EGKVVDLGC

SEQ ID NO: 33852 - protein, 9 aa, Dengue virus
GKVVDLGCG

SEQ ID NO: 33853 - protein, 9 aa, Dengue virus
KVVDLGCGR

SEQ ID NO: 33854 - protein, 9 aa, Dengue virus
VVDLGCGRG

SEQ ID NO: 33855 - protein, 9 aa, Dengue virus
VDLGCGRGG

SEQ ID NO: 33856 - protein, 9 aa, Dengue virus
DLGCGRGGW

SEQ ID NO: 33857 - protein, 9 aa, Dengue virus
LGCGRGGWS

SEQ ID NO: 33858 - protein, 9 aa, Dengue virus
GCGRGGWSY

SEQ ID NO: 33859 - protein, 9 aa, Dengue virus
CGRGGWSYY

SEQ ID NO: 33860 - protein, 9 aa, Dengue virus
GRGGWSYYC

SEQ ID NO: 33861 - protein, 9 aa, Dengue virus
RGGWSYYCG

SEQ ID NO: 33862 - protein, 9 aa, Dengue virus
GGWSYYCGG

SEQ ID NO: 33863 - protein, 9 aa, Dengue virus
GWSYYCGGL

SEQ ID NO: 33864 - protein, 9 aa, Dengue virus
WSYYCGGLK

SEQ ID NO: 33865 - protein, 9 aa, Dengue virus
SYYCGGLKN

SEQ ID NO: 33866 - protein, 9 aa, Dengue virus
YYCGGLKNV

SEQ ID NO: 33867 - protein, 9 aa, Dengue virus
YCGGLKNVR

SEQ ID NO: 33868 - protein, 9 aa, Dengue virus
CGGLKNVRE

SEQ ID NO: 33869 - protein, 9 aa, Dengue virus
GGLKNVREV

SEQ ID NO: 33870 - protein, 9 aa, Dengue virus
GLKNVREVK

SEQ ID NO: 33871 - protein, 9 aa, Dengue virus
LKNVREVKG

SEQ ID NO: 33872 - protein, 9 aa, Dengue virus
KNVREVKGL

SEQ ID NO: 33873 - protein, 9 aa, Dengue virus
NVREVKGLT

SEQ ID NO: 33874 - protein, 9 aa, Dengue virus
VREVKGLTK

SEQ ID NO: 33875 - protein, 9 aa, Dengue virus
REVKGLTKG

SEQ ID NO: 33876 - protein, 9 aa, Dengue virus
EVKGLTKGG

SEQ ID NO: 33877 - protein, 9 aa, Dengue virus
VKGLTKGGP

SEQ ID NO: 33878 - protein, 9 aa, Dengue virus
KGLTKGGPG

SEQ ID NO: 33879 - protein, 9 aa, Dengue virus
GLTKGGPGH

SEQ ID NO: 33880 - protein, 9 aa, Dengue virus
LTKGGPGHE

SEQ ID NO: 33881 - protein, 9 aa, Dengue virus
TKGGPGHEE

SEQ ID NO: 33882 - protein, 9 aa, Dengue virus
KGGPGHEEP

SEQ ID NO: 33883 - protein, 9 aa, Dengue virus
GGPGHEEPI

SEQ ID NO: 33884 - protein, 9 aa, Dengue virus
GPGHEEPIP

SEQ ID NO: 33885 - protein, 9 aa, Dengue virus
PGHEEPIPM

SEQ ID NO: 33886 - protein, 9 aa, Dengue virus
GHEEPIPMS

SEQ ID NO: 33887 - protein, 9 aa, Dengue virus
HEEPIPMST

SEQ ID NO: 33888 - protein, 9 aa, Dengue virus
EEPIPMSTY

SEQ ID NO: 33889 - protein, 9 aa, Dengue virus
EPIPMSTYG

SEQ ID NO: 33890 - protein, 9 aa, Dengue virus
PIPMSTYGW

SEQ ID NO: 33891 - protein, 9 aa, Dengue virus
IPMSTYGWN

SEQ ID NO: 33892 - protein, 9 aa, Dengue virus
PMSTYGWNL

SEQ ID NO: 33893 - protein, 9 aa, Dengue virus
MSTYGWNLV

SEQ ID NO: 33894 - protein, 9 aa, Dengue virus
STYGWNLVR

SEQ ID NO: 33895 - protein, 9 aa, Dengue virus
TYGWNLVRL

SEQ ID NO: 33896 - protein, 9 aa, Dengue virus
YGWNLVRLQ

SEQ ID NO: 33897 - protein, 9 aa, Dengue virus
GWNLVRLQS

SEQ ID NO: 33898 - protein, 9 aa, Dengue virus
WNLVRLQSG

SEQ ID NO: 33899 - protein, 9 aa, Dengue virus
NLVRLQSGV

SEQ ID NO: 33900 - protein, 9 aa, Dengue virus
LVRLQSGVD

SEQ ID NO: 33901 - protein, 9 aa, Dengue virus
VRLQSGVDV

SEQ ID NO: 33902 - protein, 9 aa, Dengue virus
RLQSGVDVF

SEQ ID NO: 33903 - protein, 9 aa, Dengue virus
LQSGVDVFF

SEQ ID NO: 33904 - protein, 9 aa, Dengue virus
QSGVDVFFT

SEQ ID NO: 33905 - protein, 9 aa, Dengue virus
SGVDVFFTP

SEQ ID NO: 33906 - protein, 9 aa, Dengue virus
GVDVFFTPP

SEQ ID NO: 33907 - protein, 9 aa, Dengue virus
VDVFFTPPE

SEQ ID NO: 33908 - protein, 9 aa, Dengue virus
DVFFTPPEK

SEQ ID NO: 33909 - protein, 9 aa, Dengue virus
VFFTPPEKC

SEQ ID NO: 33910 - protein, 9 aa, Dengue virus
FFTPPEKCD

SEQ ID NO: 33911 - protein, 9 aa, Dengue virus
FTPPEKCDT

SEQ ID NO: 33912 - protein, 9 aa, Dengue virus
TPPEKCDTL

SEQ ID NO: 33913 - protein, 9 aa, Dengue virus
PPEKCDTLL

SEQ ID NO: 33914 - protein, 9 aa, Dengue virus
PEKCDTLLC

SEQ ID NO: 33915 - protein, 9 aa, Dengue virus
EKCDTLLCD

SEQ ID NO: 33916 - protein, 9 aa, Dengue virus
KCDTLLCDI

SEQ ID NO: 33917 - protein, 9 aa, Dengue virus
CDTLLCDIG

SEQ ID NO: 33918 - protein, 9 aa, Dengue virus
DTLLCDIGE

SEQ ID NO: 33919 - protein, 9 aa, Dengue virus
TLLCDIGES

SEQ ID NO: 33920 - protein, 9 aa, Dengue virus
LLCDIGESS

SEQ ID NO: 33921 - protein, 9 aa, Dengue virus
LCDIGESSP

SEQ ID NO: 33922 - protein, 9 aa, Dengue virus
CDIGESSPN

SEQ ID NO: 33923 - protein, 9 aa, Dengue virus
DIGESSPNP

SEQ ID NO: 33924 - protein, 9 aa, Dengue virus
IGESSPNPT

SEQ ID NO: 33925 - protein, 9 aa, Dengue virus
GESSPNPTI

SEQ ID NO: 33926 - protein, 9 aa, Dengue virus
ESSPNPTIE

SEQ ID NO: 33927 - protein, 9 aa, Dengue virus
SSPNPTIEA

SEQ ID NO: 33928 - protein, 9 aa, Dengue virus
SPNPTIEAG

SEQ ID NO: 33929 - protein, 9 aa, Dengue virus
PNPTIEAGR

SEQ ID NO: 33930 - protein, 9 aa, Dengue virus
NPTIEAGRT

SEQ ID NO: 33931 - protein, 9 aa, Dengue virus
PTIEAGRTL

SEQ ID NO: 33932 - protein, 9 aa, Dengue virus
TIEAGRTLR

SEQ ID NO: 33933 - protein, 9 aa, Dengue virus
IEAGRTLRV

SEQ ID NO: 33934 - protein, 9 aa, Dengue virus
EAGRTLRVL

SEQ ID NO: 33935 - protein, 9 aa, Dengue virus
AGRTLRVLN

SEQ ID NO: 33936 - protein, 9 aa, Dengue virus
GRTLRVLNL

SEQ ID NO: 33937 - protein, 9 aa, Dengue virus
RTLRVLNLV

SEQ ID NO: 33938 - protein, 9 aa, Dengue virus
TLRVLNLVE

SEQ ID NO: 33939 - protein, 9 aa, Dengue virus
LRVLNLVEN

SEQ ID NO: 33940 - protein, 9 aa, Dengue virus
RVLNLVENW

SEQ ID NO: 33941 - protein, 9 aa, Dengue virus
VLNLVENWL

SEQ ID NO: 33942 - protein, 9 aa, Dengue virus
LNLVENWLN

SEQ ID NO: 33943 - protein, 9 aa, Dengue virus
NLVENWLNN

SEQ ID NO: 33944 - protein, 9 aa, Dengue virus
LVENWLNNN

SEQ ID NO: 33945 - protein, 9 aa, Dengue virus
VENWLNNNT

SEQ ID NO: 33946 - protein, 9 aa, Dengue virus
ENWLNNNTQ

SEQ ID NO: 33947 - protein, 9 aa, Dengue virus
NWLNNNTQF

SEQ ID NO: 33948 - protein, 9 aa, Dengue virus
WLNNNTQFC

SEQ ID NO: 33949 - protein, 9 aa, Dengue virus
LNNNTQFCI

SEQ ID NO: 33950 - protein, 9 aa, Dengue virus
NNNTQFCIK

SEQ ID NO: 33951 - protein, 9 aa, Dengue virus
NNTQFCIKV

SEQ ID NO: 33952 - protein, 9 aa, Dengue virus
NTQFCIKVL

SEQ ID NO: 33953 - protein, 9 aa, Dengue virus
TQFCIKVLN

SEQ ID NO: 33954 - protein, 9 aa, Dengue virus
QFCIKVLNP

SEQ ID NO: 33955 - protein, 9 aa, Dengue virus
FCIKVLNPY

SEQ ID NO: 33956 - protein, 9 aa, Dengue virus
CIKVLNPYM

SEQ ID NO: 33957 - protein, 9 aa, Dengue virus
IKVLNPYMP

SEQ ID NO: 33958 - protein, 9 aa, Dengue virus
KVLNPYMPS

SEQ ID NO: 33959 - protein, 9 aa, Dengue virus
VLNPYMPSV

SEQ ID NO: 33960 - protein, 9 aa, Dengue virus
LNPYMPSVI

SEQ ID NO: 33961 - protein, 9 aa, Dengue virus
NPYMPSVIE

SEQ ID NO: 33962 - protein, 9 aa, Dengue virus
PYMPSVIEK

SEQ ID NO: 33963 - protein, 9 aa, Dengue virus
YMPSVIEKM

SEQ ID NO: 33964 - protein, 9 aa, Dengue virus
MPSVIEKME

SEQ ID NO: 33965 - protein, 9 aa, Dengue virus
PSVIEKMEA

SEQ ID NO: 33966 - protein, 9 aa, Dengue virus
SVIEKMEAL

SEQ ID NO: 33967 - protein, 9 aa, Dengue virus
VIEKMEALQ

SEQ ID NO: 33968 - protein, 9 aa, Dengue virus
IEKMEALQR

SEQ ID NO: 33969 - protein, 9 aa, Dengue virus
LQRKYGGAL

SEQ ID NO: 33970 - protein, 9 aa, Dengue virus
QRKYGGALV

SEQ ID NO: 33971 - protein, 9 aa, Dengue virus
RKYGGALVR

SEQ ID NO: 33972 - protein, 9 aa, Dengue virus
KYGGALVRN

SEQ ID NO: 33973 - protein, 9 aa, Dengue virus
YGGALVRNP

SEQ ID NO: 33974 - protein, 9 aa, Dengue virus
GGALVRNPL

SEQ ID NO: 33975 - protein, 9 aa, Dengue virus
GALVRNPLS

SEQ ID NO: 33976 - protein, 9 aa, Dengue virus
ALVRNPLSR

SEQ ID NO: 33977 - protein, 9 aa, Dengue virus
LVRNPLSRN

SEQ ID NO: 33978 - protein, 9 aa, Dengue virus
VRNPLSRNS

SEQ ID NO: 33979 - protein, 9 aa, Dengue virus
RNPLSRNST

SEQ ID NO: 33980 - protein, 9 aa, Dengue virus
NPLSRNSTH

SEQ ID NO: 33981 - protein, 9 aa, Dengue virus
PLSRNSTHE

SEQ ID NO: 33982 - protein, 9 aa, Dengue virus
LSRNSTHEM

SEQ ID NO: 33983 - protein, 9 aa, Dengue virus
SRNSTHEMY

SEQ ID NO: 33984 - protein, 9 aa, Dengue virus
RNSTHEMYW

SEQ ID NO: 33985 - protein, 9 aa, Dengue virus
NSTHEMYWV

SEQ ID NO: 33986 - protein, 9 aa, Dengue virus
STHEMYWVS

SEQ ID NO: 33987 - protein, 9 aa, Dengue virus
THEMYWVSN

SEQ ID NO: 33988 - protein, 9 aa, Dengue virus
HEMYWVSNA

SEQ ID NO: 33989 - protein, 9 aa, Dengue virus
EMYWVSNAT

SEQ ID NO: 33990 - protein, 9 aa, Dengue virus
MYWVSNATG

SEQ ID NO: 33991 - protein, 9 aa, Dengue virus
YWVSNATGN

SEQ ID NO: 33992 - protein, 9 aa, Dengue virus
WVSNATGNI

SEQ ID NO: 33993 - protein, 9 aa, Dengue virus
VSNATGNIV

SEQ ID NO: 33994 - protein, 9 aa, Dengue virus
SNATGNIVS

SEQ ID NO: 33995 - protein, 9 aa, Dengue virus
NATGNIVSS

SEQ ID NO: 33996 - protein, 9 aa, Dengue virus
ATGNIVSSV

SEQ ID NO: 33997 - protein, 9 aa, Dengue virus
TGNIVSSVN

SEQ ID NO: 33998 - protein, 9 aa, Dengue virus
GNIVSSVNM

SEQ ID NO: 33999 - protein, 9 aa, Dengue virus
NIVSSVNMI

SEQ ID NO: 34000 - protein, 9 aa, Dengue virus
IVSSVNMIS

SEQ ID NO: 34001 - protein, 9 aa, Dengue virus
VSSVNMISR

SEQ ID NO: 34002 - protein, 9 aa, Dengue virus
SSVNMISRM

SEQ ID NO: 34003 - protein, 9 aa, Dengue virus
SVNMISRML

SEQ ID NO: 34004 - protein, 9 aa, Dengue virus
VNMISRMLI

SEQ ID NO: 34005 - protein, 9 aa, Dengue virus
NMISRMLIN

SEQ ID NO: 34006 - protein, 9 aa, Dengue virus
MISRMLINR

SEQ ID NO: 34007 - protein, 9 aa, Dengue virus
ISRMLINRF

SEQ ID NO: 34008 - protein, 9 aa, Dengue virus
SRMLINRFT

SEQ ID NO: 34009 - protein, 9 aa, Dengue virus
RMLINRFTM

SEQ ID NO: 34010 - protein, 9 aa, Dengue virus
MLINRFTMK

SEQ ID NO: 34011 - protein, 9 aa, Dengue virus
LINRFTMKH

SEQ ID NO: 34012 - protein, 9 aa, Dengue virus
INRFTMKHK

SEQ ID NO: 34013 - protein, 9 aa, Dengue virus
NRFTMKHKK

SEQ ID NO: 34014 - protein, 9 aa, Dengue virus
RFTMKHKKA

SEQ ID NO: 34015 - protein, 9 aa, Dengue virus
FTMKHKKAT

SEQ ID NO: 34016 - protein, 9 aa, Dengue virus
TMKHKKATY

SEQ ID NO: 34017 - protein, 9 aa, Dengue virus
MKHKKATYE

SEQ ID NO: 34018 - protein, 9 aa, Dengue virus
KHKKATYEP

SEQ ID NO: 34019 - protein, 9 aa, Dengue virus
HKKATYEPD

SEQ ID NO: 34020 - protein, 9 aa, Dengue virus
KKATYEPDV

SEQ ID NO: 34021 - protein, 9 aa, Dengue virus
KATYEPDVD

SEQ ID NO: 34022 - protein, 9 aa, Dengue virus
ATYEPDVDL

SEQ ID NO: 34023 - protein, 9 aa, Dengue virus
TYEPDVDLG

SEQ ID NO: 34024 - protein, 9 aa, Dengue virus
YEPDVDLGS

SEQ ID NO: 34025 - protein, 9 aa, Dengue virus
EPDVDLGSG

SEQ ID NO: 34026 - protein, 9 aa, Dengue virus
PDVDLGSGT

SEQ ID NO: 34027 - protein, 9 aa, Dengue virus
DVDLGSGTR

SEQ ID NO: 34028 - protein, 9 aa, Dengue virus
VDLGSGTRN

SEQ ID NO: 34029 - protein, 9 aa, Dengue virus
DLGSGTRNI

SEQ ID NO: 34030 - protein, 9 aa, Dengue virus
LGSGTRNIG

SEQ ID NO: 34031 - protein, 9 aa, Dengue virus
GSGTRNIGI

SEQ ID NO: 34032 - protein, 9 aa, Dengue virus
SGTRNIGIE

SEQ ID NO: 34033 - protein, 9 aa, Dengue virus
GTRNIGIES

SEQ ID NO: 34034 - protein, 9 aa, Dengue virus
TRNIGIESE

SEQ ID NO: 34035 - protein, 9 aa, Dengue virus
EIPNLDIIG

SEQ ID NO: 34036 - protein, 9 aa, Dengue virus
IPNLDIIGK

SEQ ID NO: 34037 - protein, 9 aa, Dengue virus
PNLDIIGKR

SEQ ID NO: 34038 - protein, 9 aa, Dengue virus
NLDIIGKRI

SEQ ID NO: 34039 - protein, 9 aa, Dengue virus
LDIIGKRIE

SEQ ID NO: 34040 - protein, 9 aa, Dengue virus
DIIGKRIEK

SEQ ID NO: 34041 - protein, 9 aa, Dengue virus
IIGKRIEKI

SEQ ID NO: 34042 - protein, 9 aa, Dengue virus
IGKRIEKIK

SEQ ID NO: 34043 - protein, 9 aa, Dengue virus
GKRIEKIKQ

SEQ ID NO: 34044 - protein, 9 aa, Dengue virus
KRIEKIKQE

SEQ ID NO: 34045 - protein, 9 aa, Dengue virus
RIEKIKQEH

SEQ ID NO: 34046 - protein, 9 aa, Dengue virus
IEKIKQEHE

SEQ ID NO: 34047 - protein, 9 aa, Dengue virus
EKIKQEHET

SEQ ID NO: 34048 - protein, 9 aa, Dengue virus
KIKQEHETS

SEQ ID NO: 34049 - protein, 9 aa, Dengue virus
IKQEHETSW

SEQ ID NO: 34050 - protein, 9 aa, Dengue virus
KQEHETSWH

SEQ ID NO: 34051 - protein, 9 aa, Dengue virus
QEHETSWHY

SEQ ID NO: 34052 - protein, 9 aa, Dengue virus
EHETSWHYD

SEQ ID NO: 34053 - protein, 9 aa, Dengue virus
HETSWHYDQ

SEQ ID NO: 34054 - protein, 9 aa, Dengue virus
ETSWHYDQD

SEQ ID NO: 34055 - protein, 9 aa, Dengue virus
TSWHYDQDH

SEQ ID NO: 34056 - protein, 9 aa, Dengue virus
SWHYDQDHP

SEQ ID NO: 34057 - protein, 9 aa, Dengue virus
WHYDQDHPY

SEQ ID NO: 34058 - protein, 9 aa, Dengue virus
HYDQDHPYK

SEQ ID NO: 34059 - protein, 9 aa, Dengue virus
YDQDHPYKT

SEQ ID NO: 34060 - protein, 9 aa, Dengue virus
DQDHPYKTW

SEQ ID NO: 34061 - protein, 9 aa, Dengue virus
QDHPYKTWA

SEQ ID NO: 34062 - protein, 9 aa, Dengue virus
DHPYKTWAY

SEQ ID NO: 34063 - protein, 9 aa, Dengue virus
HPYKTWAYH

SEQ ID NO: 34064 - protein, 9 aa, Dengue virus
PYKTWAYHG

SEQ ID NO: 34065 - protein, 9 aa, Dengue virus
YKTWAYHGS

SEQ ID NO: 34066 - protein, 9 aa, Dengue virus
KTWAYHGSY

SEQ ID NO: 34067 - protein, 9 aa, Dengue virus
TWAYHGSYE

SEQ ID NO: 34068 - protein, 9 aa, Dengue virus
WAYHGSYET

SEQ ID NO: 34069 - protein, 9 aa, Dengue virus
AYHGSYETK

SEQ ID NO: 34070 - protein, 9 aa, Dengue virus
YHGSYETKQ

SEQ ID NO: 34071 - protein, 9 aa, Dengue virus
HGSYETKQT

SEQ ID NO: 34072 - protein, 9 aa, Dengue virus
GSYETKQTG

SEQ ID NO: 34073 - protein, 9 aa, Dengue virus
SYETKQTGS

SEQ ID NO: 34074 - protein, 9 aa, Dengue virus
YETKQTGSA

SEQ ID NO: 34075 - protein, 9 aa, Dengue virus
ETKQTGSAS

SEQ ID NO: 34076 - protein, 9 aa, Dengue virus
TKQTGSASS

SEQ ID NO: 34077 - protein, 9 aa, Dengue virus
KQTGSASSM

SEQ ID NO: 34078 - protein, 9 aa, Dengue virus
QTGSASSMV

SEQ ID NO: 34079 - protein, 9 aa, Dengue virus
TGSASSMVN

SEQ ID NO: 34080 - protein, 9 aa, Dengue virus
GSASSMVNG

SEQ ID NO: 34081 - protein, 9 aa, Dengue virus
SASSMVNGV

SEQ ID NO: 34082 - protein, 9 aa, Dengue virus
ASSMVNGVV

SEQ ID NO: 34083 - protein, 9 aa, Dengue virus
SSMVNGVVR

SEQ ID NO: 34084 - protein, 9 aa, Dengue virus
SMVNGVVRL

SEQ ID NO: 34085 - protein, 9 aa, Dengue virus
MVNGVVRLL

SEQ ID NO: 34086 - protein, 9 aa, Dengue virus
VNGVVRLLT

SEQ ID NO: 34087 - protein, 9 aa, Dengue virus
NGVVRLLTK

SEQ ID NO: 34088 - protein, 9 aa, Dengue virus
GVVRLLTKP

SEQ ID NO: 34089 - protein, 9 aa, Dengue virus
VVRLLTKPW

SEQ ID NO: 34090 - protein, 9 aa, Dengue virus
VRLLTKPWD

SEQ ID NO: 34091 - protein, 9 aa, Dengue virus
RLLTKPWDV

SEQ ID NO: 34092 - protein, 9 aa, Dengue virus
LLTKPWDVV

SEQ ID NO: 34093 - protein, 9 aa, Dengue virus
LTKPWDVVP

SEQ ID NO: 34094 - protein, 9 aa, Dengue virus
TKPWDVVPM

SEQ ID NO: 34095 - protein, 9 aa, Dengue virus
KPWDVVPMV

SEQ ID NO: 34096 - protein, 9 aa, Dengue virus
PWDVVPMVT

SEQ ID NO: 34097 - protein, 9 aa, Dengue virus
WDVVPMVTQ

SEQ ID NO: 34098 - protein, 9 aa, Dengue virus
DVVPMVTQM

SEQ ID NO: 34099 - protein, 9 aa, Dengue virus
VVPMVTQMA

SEQ ID NO: 34100 - protein, 9 aa, Dengue virus
VPMVTQMAM

SEQ ID NO: 34101 - protein, 9 aa, Dengue virus
PMVTQMAMT

SEQ ID NO: 34102 - protein, 9 aa, Dengue virus
MVTQMAMTD

SEQ ID NO: 34103 - protein, 9 aa, Dengue virus
VTQMAMTDT

SEQ ID NO: 34104 - protein, 9 aa, Dengue virus
TQMAMTDTT

SEQ ID NO: 34105 - protein, 9 aa, Dengue virus
QMAMTDTTP

SEQ ID NO: 34106 - protein, 9 aa, Dengue virus
MAMTDTTPF

SEQ ID NO: 34107 - protein, 9 aa, Dengue virus
AMTDTTPFG

SEQ ID NO: 34108 - protein, 9 aa, Dengue virus
MTDTTPFGQ

SEQ ID NO: 34109 - protein, 9 aa, Dengue virus
TDTTPFGQQ

SEQ ID NO: 34110 - protein, 9 aa, Dengue virus
DTTPFGQQR

SEQ ID NO: 34111 - protein, 9 aa, Dengue virus
TTPFGQQRV

SEQ ID NO: 34112 - protein, 9 aa, Dengue virus
TPFGQQRVF

SEQ ID NO: 34113 - protein, 9 aa, Dengue virus
PFGQQRVFK

SEQ ID NO: 34114 - protein, 9 aa, Dengue virus
FGQQRVFKE

SEQ ID NO: 34115 - protein, 9 aa, Dengue virus
GQQRVFKEK

SEQ ID NO: 34116 - protein, 9 aa, Dengue virus
QQRVFKEKV

SEQ ID NO: 34117 - protein, 9 aa, Dengue virus
QRVFKEKVD

SEQ ID NO: 34118 - protein, 9 aa, Dengue virus
RVFKEKVDT

SEQ ID NO: 34119 - protein, 9 aa, Dengue virus
VFKEKVDTR

SEQ ID NO: 34120 - protein, 9 aa, Dengue virus
FKEKVDTRT

SEQ ID NO: 34121 - protein, 9 aa, Dengue virus
KEKVDTRTQ

SEQ ID NO: 34122 - protein, 9 aa, Dengue virus
EKVDTRTQE

SEQ ID NO: 34123 - protein, 9 aa, Dengue virus
KVDTRTQEP

SEQ ID NO: 34124 - protein, 9 aa, Dengue virus
VDTRTQEPK

SEQ ID NO: 34125 - protein, 9 aa, Dengue virus
DTRTQEPKE

SEQ ID NO: 34126 - protein, 9 aa, Dengue virus
TRTQEPKEG

SEQ ID NO: 34127 - protein, 9 aa, Dengue virus
RTQEPKEGT

SEQ ID NO: 34128 - protein, 9 aa, Dengue virus
TQEPKEGTK

SEQ ID NO: 34129 - protein, 9 aa, Dengue virus
QEPKEGTKK

SEQ ID NO: 34130 - protein, 9 aa, Dengue virus
EPKEGTKKL

SEQ ID NO: 34131 - protein, 9 aa, Dengue virus
PKEGTKKLM

SEQ ID NO: 34132 - protein, 9 aa, Dengue virus
KEGTKKLMK

SEQ ID NO: 34133 - protein, 9 aa, Dengue virus
EGTKKLMKI

SEQ ID NO: 34134 - protein, 9 aa, Dengue virus
GTKKLMKIT

SEQ ID NO: 34135 - protein, 9 aa, Dengue virus
TKKLMKITA

SEQ ID NO: 34136 - protein, 9 aa, Dengue virus
KKLMKITAE

SEQ ID NO: 34137 - protein, 9 aa, Dengue virus
KLMKITAEW

SEQ ID NO: 34138 - protein, 9 aa, Dengue virus
LMKITAEWL

SEQ ID NO: 34139 - protein, 9 aa, Dengue virus
MKITAEWLW

SEQ ID NO: 34140 - protein, 9 aa, Dengue virus
KITAEWLWK

SEQ ID NO: 34141 - protein, 9 aa, Dengue virus
ITAEWLWKE

SEQ ID NO: 34142 - protein, 9 aa, Dengue virus
TAEWLWKEL

SEQ ID NO: 34143 - protein, 9 aa, Dengue virus
AEWLWKELG

SEQ ID NO: 34144 - protein, 9 aa, Dengue virus
EWLWKELGK

SEQ ID NO: 34145 - protein, 9 aa, Dengue virus
WLWKELGKK

SEQ ID NO: 34146 - protein, 9 aa, Dengue virus
LWKELGKKK

SEQ ID NO: 34147 - protein, 9 aa, Dengue virus
WKELGKKKT

SEQ ID NO: 34148 - protein, 9 aa, Dengue virus
KELGKKKTP

SEQ ID NO: 34149 - protein, 9 aa, Dengue virus
ELGKKKTPR

SEQ ID NO: 34150 - protein, 9 aa, Dengue virus
KTPRMCTRE

SEQ ID NO: 34151 - protein, 9 aa, Dengue virus
TPRMCTREE

SEQ ID NO: 34152 - protein, 9 aa, Dengue virus
PRMCTREEF

SEQ ID NO: 34153 - protein, 9 aa, Dengue virus
RMCTREEFT

SEQ ID NO: 34154 - protein, 9 aa, Dengue virus
CTREEFTRK

SEQ ID NO: 34155 - protein, 9 aa, Dengue virus
TREEFTRKV

SEQ ID NO: 34156 - protein, 9 aa, Dengue virus
REEFTRKVR

SEQ ID NO: 34157 - protein, 9 aa, Dengue virus
EEFTRKVRS

SEQ ID NO: 34158 - protein, 9 aa, Dengue virus
EFTRKVRSN

SEQ ID NO: 34159 - protein, 9 aa, Dengue virus
FTRKVRSNA

SEQ ID NO: 34160 - protein, 9 aa, Dengue virus
TRKVRSNAA

SEQ ID NO: 34161 - protein, 9 aa, Dengue virus
RKVRSNAAL

SEQ ID NO: 34162 - protein, 9 aa, Dengue virus
KVRSNAALG

SEQ ID NO: 34163 - protein, 9 aa, Dengue virus
VRSNAALGA

SEQ ID NO: 34164 - protein, 9 aa, Dengue virus
RSNAALGAI

SEQ ID NO: 34165 - protein, 9 aa, Dengue virus
SNAALGAIF

SEQ ID NO: 34166 - protein, 9 aa, Dengue virus
NAALGAIFT

SEQ ID NO: 34167 - protein, 9 aa, Dengue virus
AALGAIFTD

SEQ ID NO: 34168 - protein, 9 aa, Dengue virus
ALGAIFTDE

SEQ ID NO: 34169 - protein, 9 aa, Dengue virus
LGAIFTDEN

SEQ ID NO: 34170 - protein, 9 aa, Dengue virus
GAIFTDENK

SEQ ID NO: 34171 - protein, 9 aa, Dengue virus
AIFTDENKW

SEQ ID NO: 34172 - protein, 9 aa, Dengue virus
IFTDENKWK

SEQ ID NO: 34173 - protein, 9 aa, Dengue virus
FTDENKWKS

SEQ ID NO: 34174 - protein, 9 aa, Dengue virus
TDENKWKSA

SEQ ID NO: 34175 - protein, 9 aa, Dengue virus
DENKWKSAR

SEQ ID NO: 34176 - protein, 9 aa, Dengue virus
ENKWKSARE

SEQ ID NO: 34177 - protein, 9 aa, Dengue virus
NKWKSAREA

SEQ ID NO: 34178 - protein, 9 aa, Dengue virus
KWKSAREAV

SEQ ID NO: 34179 - protein, 9 aa, Dengue virus
WKSAREAVE

SEQ ID NO: 34180 - protein, 9 aa, Dengue virus
KSAREAVED

SEQ ID NO: 34181 - protein, 9 aa, Dengue virus
SAREAVEDS

SEQ ID NO: 34182 - protein, 9 aa, Dengue virus
AREAVEDSR

SEQ ID NO: 34183 - protein, 9 aa, Dengue virus
REAVEDSRF

SEQ ID NO: 34184 - protein, 9 aa, Dengue virus
EAVEDSRFW

SEQ ID NO: 34185 - protein, 9 aa, Dengue virus
AVEDSRFWE

SEQ ID NO: 34186 - protein, 9 aa, Dengue virus
VEDSRFWEL

SEQ ID NO: 34187 - protein, 9 aa, Dengue virus
FWELVDKER

SEQ ID NO: 34188 - protein, 9 aa, Dengue virus
WELVDKERN

SEQ ID NO: 34189 - protein, 9 aa, Dengue virus
ELVDKERNL

SEQ ID NO: 34190 - protein, 9 aa, Dengue virus
LVDKERNLH

SEQ ID NO: 34191 - protein, 9 aa, Dengue virus
VDKERNLHL

SEQ ID NO: 34192 - protein, 9 aa, Dengue virus
DKERNLHLE

SEQ ID NO: 34193 - protein, 9 aa, Dengue virus
KERNLHLEG

SEQ ID NO: 34194 - protein, 9 aa, Dengue virus
ERNLHLEGK

SEQ ID NO: 34195 - protein, 9 aa, Dengue virus
RNLHLEGKC

SEQ ID NO: 34196 - protein, 9 aa, Dengue virus
NLHLEGKCE

SEQ ID NO: 34197 - protein, 9 aa, Dengue virus
LHLEGKCET

SEQ ID NO: 34198 - protein, 9 aa, Dengue virus
HLEGKCETC

SEQ ID NO: 34199 - protein, 9 aa, Dengue virus
LEGKCETCV

SEQ ID NO: 34200 - protein, 9 aa, Dengue virus
EGKCETCVY

SEQ ID NO: 34201 - protein, 9 aa, Dengue virus
GKCETCVYN

SEQ ID NO: 34202 - protein, 9 aa, Dengue virus
KCETCVYNM

SEQ ID NO: 34203 - protein, 9 aa, Dengue virus
CETCVYNMM

SEQ ID NO: 34204 - protein, 9 aa, Dengue virus
ETCVYNMMG

SEQ ID NO: 34205 - protein, 9 aa, Dengue virus
TCVYNMMGK

SEQ ID NO: 34206 - protein, 9 aa, Dengue virus
CVYNMMGKR

SEQ ID NO: 34207 - protein, 9 aa, Dengue virus
VYNMMGKRE

SEQ ID NO: 34208 - protein, 9 aa, Dengue virus
YNMMGKREK

SEQ ID NO: 34209 - protein, 9 aa, Dengue virus
NMMGKREKK

SEQ ID NO: 34210 - protein, 9 aa, Dengue virus
MMGKREKKL

SEQ ID NO: 34211 - protein, 9 aa, Dengue virus
MGKREKKLG

SEQ ID NO: 34212 - protein, 9 aa, Dengue virus
GKREKKLGE

SEQ ID NO: 34213 - protein, 9 aa, Dengue virus
KREKKLGEF

SEQ ID NO: 34214 - protein, 9 aa, Dengue virus
REKKLGEFG

SEQ ID NO: 34215 - protein, 9 aa, Dengue virus
EKKLGEFGK

SEQ ID NO: 34216 - protein, 9 aa, Dengue virus
KKLGEFGKA

SEQ ID NO: 34217 - protein, 9 aa, Dengue virus
KLGEFGKAK

SEQ ID NO: 34218 - protein, 9 aa, Dengue virus
LGEFGKAKG

SEQ ID NO: 34219 - protein, 9 aa, Dengue virus
GEFGKAKGS

SEQ ID NO: 34220 - protein, 9 aa, Dengue virus
EFGKAKGSR

SEQ ID NO: 34221 - protein, 9 aa, Dengue virus
FGKAKGSRA

SEQ ID NO: 34222 - protein, 9 aa, Dengue virus
GKAKGSRAI

SEQ ID NO: 34223 - protein, 9 aa, Dengue virus
KAKGSRAIW

SEQ ID NO: 34224 - protein, 9 aa, Dengue virus
AKGSRAIWY

SEQ ID NO: 34225 - protein, 9 aa, Dengue virus
KGSRAIWYM

SEQ ID NO: 34226 - protein, 9 aa, Dengue virus
GSRAIWYMW

SEQ ID NO: 34227 - protein, 9 aa, Dengue virus
SRAIWYMWL

SEQ ID NO: 34228 - protein, 9 aa, Dengue virus
RAIWYMWLG

SEQ ID NO: 34229 - protein, 9 aa, Dengue virus
AIWYMWLGA

SEQ ID NO: 34230 - protein, 9 aa, Dengue virus
IWYMWLGAR

SEQ ID NO: 34231 - protein, 9 aa, Dengue virus
WYMWLGARF

SEQ ID NO: 34232 - protein, 9 aa, Dengue virus
YMWLGARFL

SEQ ID NO: 34233 - protein, 9 aa, Dengue virus
MWLGARFLE

SEQ ID NO: 34234 - protein, 9 aa, Dengue virus
WLGARFLEF

SEQ ID NO: 34235 - protein, 9 aa, Dengue virus
LGARFLEFE

SEQ ID NO: 34236 - protein, 9 aa, Dengue virus
GARFLEFEA

SEQ ID NO: 34237 - protein, 9 aa, Dengue virus
ARFLEFEAL

SEQ ID NO: 34238 - protein, 9 aa, Dengue virus
RFLEFEALG

SEQ ID NO: 34239 - protein, 9 aa, Dengue virus
FLEFEALGF

SEQ ID NO: 34240 - protein, 9 aa, Dengue virus
LEFEALGFL

SEQ ID NO: 34241 - protein, 9 aa, Dengue virus
EFEALGFLN

SEQ ID NO: 34242 - protein, 9 aa, Dengue virus
FEALGFLNE

SEQ ID NO: 34243 - protein, 9 aa, Dengue virus
EALGFLNED

SEQ ID NO: 34244 - protein, 9 aa, Dengue virus
ALGFLNEDH

SEQ ID NO: 34245 - protein, 9 aa, Dengue virus
LGFLNEDHW

SEQ ID NO: 34246 - protein, 9 aa, Dengue virus
GFLNEDHWF

SEQ ID NO: 34247 - protein, 9 aa, Dengue virus
FLNEDHWFS

SEQ ID NO: 34248 - protein, 9 aa, Dengue virus
LNEDHWFSR

SEQ ID NO: 34249 - protein, 9 aa, Dengue virus
NEDHWFSRE

SEQ ID NO: 34250 - protein, 9 aa, Dengue virus
EDHWFSREN

SEQ ID NO: 34251 - protein, 9 aa, Dengue virus
DHWFSRENS

SEQ ID NO: 34252 - protein, 9 aa, Dengue virus
HWFSRENSL

SEQ ID NO: 34253 - protein, 9 aa, Dengue virus
WFSRENSLS

SEQ ID NO: 34254 - protein, 9 aa, Dengue virus
FSRENSLSG

SEQ ID NO: 34255 - protein, 9 aa, Dengue virus
SRENSLSGV

SEQ ID NO: 34256 - protein, 9 aa, Dengue virus
RENSLSGVE

SEQ ID NO: 34257 - protein, 9 aa, Dengue virus
ENSLSGVEG

SEQ ID NO: 34258 - protein, 9 aa, Dengue virus
NSLSGVEGE

SEQ ID NO: 34259 - protein, 9 aa, Dengue virus
SLSGVEGEG

SEQ ID NO: 34260 - protein, 9 aa, Dengue virus
LSGVEGEGL

SEQ ID NO: 34261 - protein, 9 aa, Dengue virus
SGVEGEGLH

SEQ ID NO: 34262 - protein, 9 aa, Dengue virus
GVEGEGLHK

SEQ ID NO: 34263 - protein, 9 aa, Dengue virus
VEGEGLHKL

SEQ ID NO: 34264 - protein, 9 aa, Dengue virus
EGEGLHKLG

SEQ ID NO: 34265 - protein, 9 aa, Dengue virus
GEGLHKLGY

SEQ ID NO: 34266 - protein, 9 aa, Dengue virus
EGLHKLGYI

SEQ ID NO: 34267 - protein, 9 aa, Dengue virus
GLHKLGYIL

SEQ ID NO: 34268 - protein, 9 aa, Dengue virus
LHKLGYILR

SEQ ID NO: 34269 - protein, 9 aa, Dengue virus
HKLGYILRD

SEQ ID NO: 34270 - protein, 9 aa, Dengue virus
KLGYILRDV

SEQ ID NO: 34271 - protein, 9 aa, Dengue virus
LGYILRDVS

SEQ ID NO: 34272 - protein, 9 aa, Dengue virus
GYILRDVSK

SEQ ID NO: 34273 - protein, 9 aa, Dengue virus
YILRDVSKK

SEQ ID NO: 34274 - protein, 9 aa, Dengue virus
VSKKEGGAM

SEQ ID NO: 34275 - protein, 9 aa, Dengue virus
SKKEGGAMY

SEQ ID NO: 34276 - protein, 9 aa, Dengue virus
KKEGGAMYA

SEQ ID NO: 34277 - protein, 9 aa, Dengue virus
KEGGAMYAD

SEQ ID NO: 34278 - protein, 9 aa, Dengue virus
EGGAMYADD

SEQ ID NO: 34279 - protein, 9 aa, Dengue virus
GGAMYADDT

SEQ ID NO: 34280 - protein, 9 aa, Dengue virus
GAMYADDTA

SEQ ID NO: 34281 - protein, 9 aa, Dengue virus
AMYADDTAG

SEQ ID NO: 34282 - protein, 9 aa, Dengue virus
MYADDTAGW

SEQ ID NO: 34283 - protein, 9 aa, Dengue virus
YADDTAGWD

SEQ ID NO: 34284 - protein, 9 aa, Dengue virus
ADDTAGWDT

SEQ ID NO: 34285 - protein, 9 aa, Dengue virus
DDTAGWDTR

SEQ ID NO: 34286 - protein, 9 aa, Dengue virus
DTAGWDTRI

SEQ ID NO: 34287 - protein, 9 aa, Dengue virus
TAGWDTRIT

SEQ ID NO: 34288 - protein, 9 aa, Dengue virus
AGWDTRITL

SEQ ID NO: 34289 - protein, 9 aa, Dengue virus
GWDTRITLE

SEQ ID NO: 34290 - protein, 9 aa, Dengue virus
WDTRITLED

SEQ ID NO: 34291 - protein, 9 aa, Dengue virus
DTRITLEDL

SEQ ID NO: 34292 - protein, 9 aa, Dengue virus
TRITLEDLK

SEQ ID NO: 34293 - protein, 9 aa, Dengue virus
RITLEDLKN

SEQ ID NO: 34294 - protein, 9 aa, Dengue virus
ITLEDLKNE

SEQ ID NO: 34295 - protein, 9 aa, Dengue virus
TLEDLKNEE

SEQ ID NO: 34296 - protein, 9 aa, Dengue virus
LEDLKNEEM

SEQ ID NO: 34297 - protein, 9 aa, Dengue virus
EDLKNEEMV

SEQ ID NO: 34298 - protein, 9 aa, Dengue virus
DLKNEEMVT

SEQ ID NO: 34299 - protein, 9 aa, Dengue virus
LKNEEMVTN

SEQ ID NO: 34300 - protein, 9 aa, Dengue virus
KNEEMVTNH

SEQ ID NO: 34301 - protein, 9 aa, Dengue virus
NEEMVTNHM

SEQ ID NO: 34302 - protein, 9 aa, Dengue virus
GEHKKLAEA

SEQ ID NO: 34303 - protein, 9 aa, Dengue virus
EHKKLAEAI

SEQ ID NO: 34304 - protein, 9 aa, Dengue virus
HKKLAEAIF

SEQ ID NO: 34305 - protein, 9 aa, Dengue virus
KKLAEAIFK

SEQ ID NO: 34306 - protein, 9 aa, Dengue virus
KLAEAIFKL

SEQ ID NO: 34307 - protein, 9 aa, Dengue virus
LAEAIFKLT

SEQ ID NO: 34308 - protein, 9 aa, Dengue virus
AEAIFKLTY

SEQ ID NO: 34309 - protein, 9 aa, Dengue virus
EAIFKLTYQ

SEQ ID NO: 34310 - protein, 9 aa, Dengue virus
AIFKLTYQN

SEQ ID NO: 34311 - protein, 9 aa, Dengue virus
IFKLTYQNK

SEQ ID NO: 34312 - protein, 9 aa, Dengue virus
FKLTYQNKV

SEQ ID NO: 34313 - protein, 9 aa, Dengue virus
KLTYQNKVV

SEQ ID NO: 34314 - protein, 9 aa, Dengue virus
LTYQNKVVR

SEQ ID NO: 34315 - protein, 9 aa, Dengue virus
TYQNKVVRV

SEQ ID NO: 34316 - protein, 9 aa, Dengue virus
YQNKVVRVQ

SEQ ID NO: 34317 - protein, 9 aa, Dengue virus
QNKVVRVQR

SEQ ID NO: 34318 - protein, 9 aa, Dengue virus
NKVVRVQRP

SEQ ID NO: 34319 - protein, 9 aa, Dengue virus
KVVRVQRPT

SEQ ID NO: 34320 - protein, 9 aa, Dengue virus
VVRVQRPTP

SEQ ID NO: 34321 - protein, 9 aa, Dengue virus
VRVQRPTPR

SEQ ID NO: 34322 - protein, 9 aa, Dengue virus
RVQRPTPRG

SEQ ID NO: 34323 - protein, 9 aa, Dengue virus
VQRPTPRGT

SEQ ID NO: 34324 - protein, 9 aa, Dengue virus
QRPTPRGTV

SEQ ID NO: 34325 - protein, 9 aa, Dengue virus
RPTPRGTVM

SEQ ID NO: 34326 - protein, 9 aa, Dengue virus
PTPRGTVMD

SEQ ID NO: 34327 - protein, 9 aa, Dengue virus
TPRGTVMDI

SEQ ID NO: 34328 - protein, 9 aa, Dengue virus
PRGTVMDII

SEQ ID NO: 34329 - protein, 9 aa, Dengue virus
RGTVMDIIS

SEQ ID NO: 34330 - protein, 9 aa, Dengue virus
GTVMDIISR

SEQ ID NO: 34331 - protein, 9 aa, Dengue virus
TVMDIISRR

SEQ ID NO: 34332 - protein, 9 aa, Dengue virus
VMDIISRRD

SEQ ID NO: 34333 - protein, 9 aa, Dengue virus
MDIISRRDQ

SEQ ID NO: 34334 - protein, 9 aa, Dengue virus
DIISRRDQR

SEQ ID NO: 34335 - protein, 9 aa, Dengue virus
IISRRDQRG

SEQ ID NO: 34336 - protein, 9 aa, Dengue virus
ISRRDQRGS

SEQ ID NO: 34337 - protein, 9 aa, Dengue virus
SRRDQRGSG

SEQ ID NO: 34338 - protein, 9 aa, Dengue virus
RRDQRGSGQ

SEQ ID NO: 34339 - protein, 9 aa, Dengue virus
RDQRGSGQV

SEQ ID NO: 34340 - protein, 9 aa, Dengue virus
DQRGSGQVG

SEQ ID NO: 34341 - protein, 9 aa, Dengue virus
QRGSGQVGT

SEQ ID NO: 34342 - protein, 9 aa, Dengue virus
RGSGQVGTY

SEQ ID NO: 34343 - protein, 9 aa, Dengue virus
GSGQVGTYG

SEQ ID NO: 34344 - protein, 9 aa, Dengue virus
SGQVGTYGL

SEQ ID NO: 34345 - protein, 9 aa, Dengue virus
GQVGTYGLN

SEQ ID NO: 34346 - protein, 9 aa, Dengue virus
QVGTYGLNT

SEQ ID NO: 34347 - protein, 9 aa, Dengue virus
VGTYGLNTF

SEQ ID NO: 34348 - protein, 9 aa, Dengue virus
GTYGLNTFT

SEQ ID NO: 34349 - protein, 9 aa, Dengue virus
TYGLNTFTN

SEQ ID NO: 34350 - protein, 9 aa, Dengue virus
YGLNTFTNM

SEQ ID NO: 34351 - protein, 9 aa, Dengue virus
GLNTFTNME

SEQ ID NO: 34352 - protein, 9 aa, Dengue virus
LNTFTNMEA

SEQ ID NO: 34353 - protein, 9 aa, Dengue virus
NTFTNMEAQ

SEQ ID NO: 34354 - protein, 9 aa, Dengue virus
TFTNMEAQL

SEQ ID NO: 34355 - protein, 9 aa, Dengue virus
FTNMEAQLI

SEQ ID NO: 34356 - protein, 9 aa, Dengue virus
TNMEAQLIR

SEQ ID NO: 34357 - protein, 9 aa, Dengue virus
NMEAQLIRQ

SEQ ID NO: 34358 - protein, 9 aa, Dengue virus
MEAQLIRQM

SEQ ID NO: 34359 - protein, 9 aa, Dengue virus
EAQLIRQME

SEQ ID NO: 34360 - protein, 9 aa, Dengue virus
AQLIRQMEG

SEQ ID NO: 34361 - protein, 9 aa, Dengue virus
QLIRQMEGE

SEQ ID NO: 34362 - protein, 9 aa, Dengue virus
LIRQMEGEG

SEQ ID NO: 34363 - protein, 9 aa, Dengue virus
IRQMEGEGI

SEQ ID NO: 34364 - protein, 9 aa, Dengue virus
RQMEGEGIF

SEQ ID NO: 34365 - protein, 9 aa, Dengue virus
QMEGEGIFK

SEQ ID NO: 34366 - protein, 9 aa, Dengue virus
RVGRERLSR

SEQ ID NO: 34367 - protein, 9 aa, Dengue virus
VGRERLSRM

SEQ ID NO: 34368 - protein, 9 aa, Dengue virus
GRERLSRMA

SEQ ID NO: 34369 - protein, 9 aa, Dengue virus
RERLSRMAI

SEQ ID NO: 34370 - protein, 9 aa, Dengue virus
ERLSRMAIS

SEQ ID NO: 34371 - protein, 9 aa, Dengue virus
RLSRMAISG

SEQ ID NO: 34372 - protein, 9 aa, Dengue virus
LSRMAISGD

SEQ ID NO: 34373 - protein, 9 aa, Dengue virus
SRMAISGDD

SEQ ID NO: 34374 - protein, 9 aa, Dengue virus
RMAISGDDC

SEQ ID NO: 34375 - protein, 9 aa, Dengue virus
MAISGDDCV

SEQ ID NO: 34376 - protein, 9 aa, Dengue virus
AISGDDCVV

SEQ ID NO: 34377 - protein, 9 aa, Dengue virus
ISGDDCVVK

SEQ ID NO: 34378 - protein, 9 aa, Dengue virus
SGDDCVVKP

SEQ ID NO: 34379 - protein, 9 aa, Dengue virus
GDDCVVKPL

SEQ ID NO: 34380 - protein, 9 aa, Dengue virus
DDCVVKPLD

SEQ ID NO: 34381 - protein, 9 aa, Dengue virus
DCVVKPLDD

SEQ ID NO: 34382 - protein, 9 aa, Dengue virus
CVVKPLDDR

SEQ ID NO: 34383 - protein, 9 aa, Dengue virus
VVKPLDDRF

SEQ ID NO: 34384 - protein, 9 aa, Dengue virus
VKPLDDRFA

SEQ ID NO: 34385 - protein, 9 aa, Dengue virus
DDRFASALT

SEQ ID NO: 34386 - protein, 9 aa, Dengue virus
DRFASALTA

SEQ ID NO: 34387 - protein, 9 aa, Dengue virus
RFASALTAL

SEQ ID NO: 34388 - protein, 9 aa, Dengue virus
FASALTALN

SEQ ID NO: 34389 - protein, 9 aa, Dengue virus
ASALTALND

SEQ ID NO: 34390 - protein, 9 aa, Dengue virus
SALTALNDM

SEQ ID NO: 34391 - protein, 9 aa, Dengue virus
ALTALNDMG

SEQ ID NO: 34392 - protein, 9 aa, Dengue virus
LTALNDMGK

SEQ ID NO: 34393 - protein, 9 aa, Dengue virus
TALNDMGKV

SEQ ID NO: 34394 - protein, 9 aa, Dengue virus
ALNDMGKVR

SEQ ID NO: 34395 - protein, 9 aa, Dengue virus
LNDMGKVRK

SEQ ID NO: 34396 - protein, 9 aa, Dengue virus
NDMGKVRKD

SEQ ID NO: 34397 - protein, 9 aa, Dengue virus
DMGKVRKDI

SEQ ID NO: 34398 - protein, 9 aa, Dengue virus
MGKVRKDIQ

SEQ ID NO: 34399 - protein, 9 aa, Dengue virus
GKVRKDIQQ

SEQ ID NO: 34400 - protein, 9 aa, Dengue virus
KVRKDIQQW

SEQ ID NO: 34401 - protein, 9 aa, Dengue virus
VRKDIQQWE

SEQ ID NO: 34402 - protein, 9 aa, Dengue virus
RKDIQQWEP

SEQ ID NO: 34403 - protein, 9 aa, Dengue virus
KDIQQWEPS

SEQ ID NO: 34404 - protein, 9 aa, Dengue virus
DIQQWEPSR

SEQ ID NO: 34405 - protein, 9 aa, Dengue virus
IQQWEPSRG

SEQ ID NO: 34406 - protein, 9 aa, Dengue virus
QQWEPSRGW

SEQ ID NO: 34407 - protein, 9 aa, Dengue virus
QWEPSRGWN

SEQ ID NO: 34408 - protein, 9 aa, Dengue virus
WEPSRGWND

SEQ ID NO: 34409 - protein, 9 aa, Dengue virus
EPSRGWNDW

SEQ ID NO: 34410 - protein, 9 aa, Dengue virus
PSRGWNDWT

SEQ ID NO: 34411 - protein, 9 aa, Dengue virus
SRGWNDWTQ

SEQ ID NO: 34412 - protein, 9 aa, Dengue virus
RGWNDWTQV

SEQ ID NO: 34413 - protein, 9 aa, Dengue virus
GWNDWTQVP

SEQ ID NO: 34414 - protein, 9 aa, Dengue virus
WNDWTQVPF

SEQ ID NO: 34415 - protein, 9 aa, Dengue virus
NDWTQVPFC

SEQ ID NO: 34416 - protein, 9 aa, Dengue virus
DWTQVPFCS

SEQ ID NO: 34417 - protein, 9 aa, Dengue virus
WTQVPFCSH

SEQ ID NO: 34418 - protein, 9 aa, Dengue virus
TQVPFCSHH

SEQ ID NO: 34419 - protein, 9 aa, Dengue virus
QVPFCSHHF

SEQ ID NO: 34420 - protein, 9 aa, Dengue virus
VPFCSHHFH

SEQ ID NO: 34421 - protein, 9 aa, Dengue virus
PFCSHHFHE

SEQ ID NO: 34422 - protein, 9 aa, Dengue virus
FCSHHFHEL

SEQ ID NO: 34423 - protein, 9 aa, Dengue virus
CSHHFHELI

SEQ ID NO: 34424 - protein, 9 aa, Dengue virus
SHHFHELIM

SEQ ID NO: 34425 - protein, 9 aa, Dengue virus
HHFHELIMK

SEQ ID NO: 34426 - protein, 9 aa, Dengue virus
HFHELIMKD

SEQ ID NO: 34427 - protein, 9 aa, Dengue virus
FHELIMKDG

SEQ ID NO: 34428 - protein, 9 aa, Dengue virus
HELIMKDGR

SEQ ID NO: 34429 - protein, 9 aa, Dengue virus
MKDGRVLVV

SEQ ID NO: 34430 - protein, 9 aa, Dengue virus
KDGRVLVVP

SEQ ID NO: 34431 - protein, 9 aa, Dengue virus
DGRVLVVPC

SEQ ID NO: 34432 - protein, 9 aa, Dengue virus
GRVLVVPCR

SEQ ID NO: 34433 - protein, 9 aa, Dengue virus
LVVPCRNQD

SEQ ID NO: 34434 - protein, 9 aa, Dengue virus
VVPCRNQDE

SEQ ID NO: 34435 - protein, 9 aa, Dengue virus
VPCRNQDEL

SEQ ID NO: 34436 - protein, 9 aa, Dengue virus
PCRNQDELI

SEQ ID NO: 34437 - protein, 9 aa, Dengue virus
CRNQDELIG

SEQ ID NO: 34438 - protein, 9 aa, Dengue virus
RNQDELIGR

SEQ ID NO: 34439 - protein, 9 aa, Dengue virus
NQDELIGRA

SEQ ID NO: 34440 - protein, 9 aa, Dengue virus
QDELIGRAR

SEQ ID NO: 34441 - protein, 9 aa, Dengue virus
DELIGRARI

SEQ ID NO: 34442 - protein, 9 aa, Dengue virus
ELIGRARIS

SEQ ID NO: 34443 - protein, 9 aa, Dengue virus
LIGRARISQ

SEQ ID NO: 34444 - protein, 9 aa, Dengue virus
IGRARISQG

SEQ ID NO: 34445 - protein, 9 aa, Dengue virus
GRARISQGA

SEQ ID NO: 34446 - protein, 9 aa, Dengue virus
RARISQGAG

SEQ ID NO: 34447 - protein, 9 aa, Dengue virus
ARISQGAGW

SEQ ID NO: 34448 - protein, 9 aa, Dengue virus
RISQGAGWS

SEQ ID NO: 34449 - protein, 9 aa, Dengue virus
ISQGAGWSL

SEQ ID NO: 34450 - protein, 9 aa, Dengue virus
SQGAGWSLK

SEQ ID NO: 34451 - protein, 9 aa, Dengue virus
QGAGWSLKE

SEQ ID NO: 34452 - protein, 9 aa, Dengue virus
GAGWSLKET

SEQ ID NO: 34453 - protein, 9 aa, Dengue virus
AGWSLKETA

SEQ ID NO: 34454 - protein, 9 aa, Dengue virus
GWSLKETAC

SEQ ID NO: 34455 - protein, 9 aa, Dengue virus
WSLKETACL

SEQ ID NO: 34456 - protein, 9 aa, Dengue virus
SLKETACLG

SEQ ID NO: 34457 - protein, 9 aa, Dengue virus
LKETACLGK

SEQ ID NO: 34458 - protein, 9 aa, Dengue virus
KETACLGKS

SEQ ID NO: 34459 - protein, 9 aa, Dengue virus
ETACLGKSY

SEQ ID NO: 34460 - protein, 9 aa, Dengue virus
TACLGKSYA

SEQ ID NO: 34461 - protein, 9 aa, Dengue virus
ACLGKSYAQ

SEQ ID NO: 34462 - protein, 9 aa, Dengue virus
CLGKSYAQM

SEQ ID NO: 34463 - protein, 9 aa, Dengue virus
LGKSYAQMW

SEQ ID NO: 34464 - protein, 9 aa, Dengue virus
GKSYAQMWS

SEQ ID NO: 34465 - protein, 9 aa, Dengue virus
KSYAQMWSL

SEQ ID NO: 34466 - protein, 9 aa, Dengue virus
SYAQMWSLM

SEQ ID NO: 34467 - protein, 9 aa, Dengue virus
YAQMWSLMY

SEQ ID NO: 34468 - protein, 9 aa, Dengue virus
AQMWSLMYF

SEQ ID NO: 34469 - protein, 9 aa, Dengue virus
QMWSLMYFH

SEQ ID NO: 34470 - protein, 9 aa, Dengue virus
MWSLMYFHR

SEQ ID NO: 34471 - protein, 9 aa, Dengue virus
WSLMYFHRR

SEQ ID NO: 34472 - protein, 9 aa, Dengue virus
SLMYFHRRD

SEQ ID NO: 34473 - protein, 9 aa, Dengue virus
LMYFHRRDL

SEQ ID NO: 34474 - protein, 9 aa, Dengue virus
MYFHRRDLR

SEQ ID NO: 34475 - protein, 9 aa, Dengue virus
YFHRRDLRL

SEQ ID NO: 34476 - protein, 9 aa, Dengue virus
FHRRDLRLA

SEQ ID NO: 34477 - protein, 9 aa, Dengue virus
HRRDLRLAA

SEQ ID NO: 34478 - protein, 9 aa, Dengue virus
RRDLRLAAN

SEQ ID NO: 34479 - protein, 9 aa, Dengue virus
RDLRLAANA

SEQ ID NO: 34480 - protein, 9 aa, Dengue virus
DLRLAANAI

SEQ ID NO: 34481 - protein, 9 aa, Dengue virus
LRLAANAIC

SEQ ID NO: 34482 - protein, 9 aa, Dengue virus
RLAANAICS

SEQ ID NO: 34483 - protein, 9 aa, Dengue virus
LAANAICSA

SEQ ID NO: 34484 - protein, 9 aa, Dengue virus
AANAICSAV

SEQ ID NO: 34485 - protein, 9 aa, Dengue virus
ANAICSAVP

SEQ ID NO: 34486 - protein, 9 aa, Dengue virus
NAICSAVPS

SEQ ID NO: 34487 - protein, 9 aa, Dengue virus
AICSAVPSH

SEQ ID NO: 34488 - protein, 9 aa, Dengue virus
ICSAVPSHW

SEQ ID NO: 34489 - protein, 9 aa, Dengue virus
CSAVPSHWV

SEQ ID NO: 34490 - protein, 9 aa, Dengue virus
SAVPSHWVP

SEQ ID NO: 34491 - protein, 9 aa, Dengue virus
AVPSHWVPT

SEQ ID NO: 34492 - protein, 9 aa, Dengue virus
VPSHWVPTS

SEQ ID NO: 34493 - protein, 9 aa, Dengue virus
PSHWVPTSR

SEQ ID NO: 34494 - protein, 9 aa, Dengue virus
SHWVPTSRT

SEQ ID NO: 34495 - protein, 9 aa, Dengue virus
HWVPTSRTT

SEQ ID NO: 34496 - protein, 9 aa, Dengue virus
WVPTSRTTW

SEQ ID NO: 34497 - protein, 9 aa, Dengue virus
VPTSRTTWS

SEQ ID NO: 34498 - protein, 9 aa, Dengue virus
PTSRTTWSI

SEQ ID NO: 34499 - protein, 9 aa, Dengue virus
TSRTTWSIH

SEQ ID NO: 34500 - protein, 9 aa, Dengue virus
SRTTWSIHA

SEQ ID NO: 34501 - protein, 9 aa, Dengue virus
RTTWSIHAK

SEQ ID NO: 34502 - protein, 9 aa, Dengue virus
TTWSIHAKH

SEQ ID NO: 34503 - protein, 9 aa, Dengue virus
TWSIHAKHE

SEQ ID NO: 34504 - protein, 9 aa, Dengue virus
WSIHAKHEW

SEQ ID NO: 34505 - protein, 9 aa, Dengue virus
SIHAKHEWM

SEQ ID NO: 34506 - protein, 9 aa, Dengue virus
IHAKHEWMT

SEQ ID NO: 34507 - protein, 9 aa, Dengue virus
HAKHEWMTT

SEQ ID NO: 34508 - protein, 9 aa, Dengue virus
AKHEWMTTE

SEQ ID NO: 34509 - protein, 9 aa, Dengue virus
KHEWMTTED

SEQ ID NO: 34510 - protein, 9 aa, Dengue virus
HEWMTTEDM

SEQ ID NO: 34511 - protein, 9 aa, Dengue virus
EWMTTEDML

SEQ ID NO: 34512 - protein, 9 aa, Dengue virus
WMTTEDMLA

SEQ ID NO: 34513 - protein, 9 aa, Dengue virus
MTTEDMLAV

SEQ ID NO: 34514 - protein, 9 aa, Dengue virus
TTEDMLAVW

SEQ ID NO: 34515 - protein, 9 aa, Dengue virus
TEDMLAVWN

SEQ ID NO: 34516 - protein, 9 aa, Dengue virus
EDMLAVWNR

SEQ ID NO: 34517 - protein, 9 aa, Dengue virus
DMLAVWNRV

SEQ ID NO: 34518 - protein, 9 aa, Dengue virus
MLAVWNRVW

SEQ ID NO: 34519 - protein, 9 aa, Dengue virus
LAVWNRVWI

SEQ ID NO: 34520 - protein, 9 aa, Dengue virus
AVWNRVWIQ

SEQ ID NO: 34521 - protein, 9 aa, Dengue virus
VWNRVWIQE

SEQ ID NO: 34522 - protein, 9 aa, Dengue virus
WNRVWIQEN

SEQ ID NO: 34523 - protein, 9 aa, Dengue virus
NRVWIQENP

SEQ ID NO: 34524 - protein, 9 aa, Dengue virus
RVWIQENPW

SEQ ID NO: 34525 - protein, 9 aa, Dengue virus
VWIQENPWM

SEQ ID NO: 34526 - protein, 9 aa, Dengue virus
WIQENPWME

SEQ ID NO: 34527 - protein, 9 aa, Dengue virus
IQENPWMED

SEQ ID NO: 34528 - protein, 9 aa, Dengue virus
QENPWMEDK

SEQ ID NO: 34529 - protein, 9 aa, Dengue virus
ENPWMEDKT

SEQ ID NO: 34530 - protein, 9 aa, Dengue virus
NPWMEDKTP

SEQ ID NO: 34531 - protein, 9 aa, Dengue virus
PWMEDKTPV

SEQ ID NO: 34532 - protein, 9 aa, Dengue virus
WMEDKTPVE

SEQ ID NO: 34533 - protein, 9 aa, Dengue virus
MEDKTPVES

SEQ ID NO: 34534 - protein, 9 aa, Dengue virus
EDKTPVESW

SEQ ID NO: 34535 - protein, 9 aa, Dengue virus
DKTPVESWE

SEQ ID NO: 34536 - protein, 9 aa, Dengue virus
KTPVESWEE

SEQ ID NO: 34537 - protein, 9 aa, Dengue virus
TPVESWEEV

SEQ ID NO: 34538 - protein, 9 aa, Dengue virus
PVESWEEVP

SEQ ID NO: 34539 - protein, 9 aa, Dengue virus
VESWEEVPY

SEQ ID NO: 34540 - protein, 9 aa, Dengue virus
ESWEEVPYL

SEQ ID NO: 34541 - protein, 9 aa, Dengue virus
SWEEVPYLG

SEQ ID NO: 34542 - protein, 9 aa, Dengue virus
WEEVPYLGK

SEQ ID NO: 34543 - protein, 9 aa, Dengue virus
EEVPYLGKR

SEQ ID NO: 34544 - protein, 9 aa, Dengue virus
EVPYLGKRE

SEQ ID NO: 34545 - protein, 9 aa, Dengue virus
VPYLGKRED

SEQ ID NO: 34546 - protein, 9 aa, Dengue virus
PYLGKREDQ

SEQ ID NO: 34547 - protein, 9 aa, Dengue virus
YLGKREDQW

SEQ ID NO: 34548 - protein, 9 aa, Dengue virus
LGKREDQWC

SEQ ID NO: 34549 - protein, 9 aa, Dengue virus
GKREDQWCG

SEQ ID NO: 34550 - protein, 9 aa, Dengue virus
KREDQWCGS

SEQ ID NO: 34551 - protein, 9 aa, Dengue virus
REDQWCGSL

SEQ ID NO: 34552 - protein, 9 aa, Dengue virus
EDQWCGSLI

SEQ ID NO: 34553 - protein, 9 aa, Dengue virus
DQWCGSLIG

SEQ ID NO: 34554 - protein, 9 aa, Dengue virus
QWCGSLIGL

SEQ ID NO: 34555 - protein, 9 aa, Dengue virus
WCGSLIGLT

SEQ ID NO: 34556 - protein, 9 aa, Dengue virus
CGSLIGLTS

SEQ ID NO: 34557 - protein, 9 aa, Dengue virus
GSLIGLTSR

SEQ ID NO: 34558 - protein, 9 aa, Dengue virus
SLIGLTSRA

SEQ ID NO: 34559 - protein, 9 aa, Dengue virus
LIGLTSRAT

SEQ ID NO: 34560 - protein, 9 aa, Dengue virus
IGLTSRATW

SEQ ID NO: 34561 - protein, 9 aa, Dengue virus
GLTSRATWA

SEQ ID NO: 34562 - protein, 9 aa, Dengue virus
LTSRATWAK

SEQ ID NO: 34563 - protein, 9 aa, Dengue virus
TSRATWAKN

SEQ ID NO: 34564 - protein, 9 aa, Dengue virus
SRATWAKNI

SEQ ID NO: 34565 - protein, 9 aa, Dengue virus
RATWAKNIQ

SEQ ID NO: 34566 - protein, 9 aa, Dengue virus
ATWAKNIQT

SEQ ID NO: 34567 - protein, 9 aa, Dengue virus
TWAKNIQTA

SEQ ID NO: 34568 - protein, 9 aa, Dengue virus
WAKNIQTAI

SEQ ID NO: 34569 - protein, 9 aa, Dengue virus
AKNIQTAIN

SEQ ID NO: 34570 - protein, 9 aa, Dengue virus
KNIQTAINQ

SEQ ID NO: 34571 - protein, 9 aa, Dengue virus
NIQTAINQV

SEQ ID NO: 34572 - protein, 9 aa, Dengue virus
IQTAINQVR

SEQ ID NO: 34573 - protein, 9 aa, Dengue virus
QTAINQVRS

SEQ ID NO: 34574 - protein, 9 aa, Dengue virus
TAINQVRSL

SEQ ID NO: 34575 - protein, 9 aa, Dengue virus
AINQVRSLI

SEQ ID NO: 34576 - protein, 9 aa, Dengue virus
INQVRSLIG

SEQ ID NO: 34577 - protein, 9 aa, Dengue virus
NQVRSLIGN

SEQ ID NO: 34578 - protein, 9 aa, Dengue virus
QVRSLIGNE

SEQ ID NO: 34579 - protein, 9 aa, Dengue virus
VRSLIGNEE

SEQ ID NO: 34580 - protein, 9 aa, Dengue virus
RSLIGNEEY

SEQ ID NO: 34581 - protein, 9 aa, Dengue virus
EEYTDYMPS

SEQ ID NO: 34582 - protein, 9 aa, Dengue virus
EYTDYMPSM

SEQ ID NO: 34583 - protein, 9 aa, Dengue virus
YTDYMPSMK

SEQ ID NO: 34584 - protein, 9 aa, Dengue virus
TDYMPSMKR

SEQ ID NO: 34585 - protein, 9 aa, Dengue virus
DYMPSMKRF

SEQ ID NO: 34586 - protein, 9 aa, Dengue virus
YMPSMKRFR

SEQ ID NO: 34587 - protein, 9 aa, Dengue virus
MPSMKRFRR

SEQ ID NO: 34588 - protein, 9 aa, Dengue virus
PSMKRFRRE

SEQ ID NO: 34589 - protein, 9 aa, Dengue virus
SMKRFRREE

SEQ ID NO: 34590 - protein, 9 aa, Dengue virus
MKRFRREEE

SEQ ID NO: 34591 - protein, 9 aa, Dengue virus
KRFRREEEE

SEQ ID NO: 34592 - protein, 9 aa, Dengue virus
RFRREEEEA

SEQ ID NO: 34593 - protein, 9 aa, Dengue virus
FRREEEEAG

SEQ ID NO: 34594 - protein, 9 aa, Dengue virus
RREEEEAGV

SEQ ID NO: 34595 - protein, 9 aa, Dengue virus
REEEEAGVL

SEQ ID NO: 34596 - protein, 9 aa, Dengue virus
EEEEAGVLW

SEQ ID NO: 34597 - protein, 9 aa, Dengue virus
MNNQRKKAK

SEQ ID NO: 34598 - protein, 9 aa, Dengue virus
NNQRKKAKN

SEQ ID NO: 34599 - protein, 9 aa, Dengue virus
NTPFNMLKR

SEQ ID NO: 34600 - protein, 9 aa, Dengue virus
RERNRVSTI

SEQ ID NO: 34601 - protein, 9 aa, Dengue virus
ERNRVSTIQ

SEQ ID NO: 34602 - protein, 9 aa, Dengue virus
RNRVSTIQQ

SEQ ID NO: 34603 - protein, 9 aa, Dengue virus
NRVSTIQQL

SEQ ID NO: 34604 - protein, 9 aa, Dengue virus
RVSTIQQLT

SEQ ID NO: 34605 - protein, 9 aa, Dengue virus
VSTIQQLTK

SEQ ID NO: 34606 - protein, 9 aa, Dengue virus
STIQQLTKR

SEQ ID NO: 34607 - protein, 9 aa, Dengue virus
TIQQLTKRF

SEQ ID NO: 34608 - protein, 9 aa, Dengue virus
IQQLTKRFS

SEQ ID NO: 34609 - protein, 9 aa, Dengue virus
MLQGRGPLR

SEQ ID NO: 34610 - protein, 9 aa, Dengue virus
QGRGPLRLF

SEQ ID NO: 34611 - protein, 9 aa, Dengue virus
GRGPLRLFM

SEQ ID NO: 34612 - protein, 9 aa, Dengue virus
RGPLRLFMA

SEQ ID NO: 34613 - protein, 9 aa, Dengue virus
GPLKLFMAF

SEQ ID NO: 34614 - protein, 9 aa, Dengue virus
PLKLFMAFV

SEQ ID NO: 34615 - protein, 9 aa, Dengue virus
LKLFMAFVA

SEQ ID NO: 34616 - protein, 9 aa, Dengue virus
KLFMAFVAF

SEQ ID NO: 34617 - protein, 9 aa, Dengue virus
LFMAFVAFL

SEQ ID NO: 34618 - protein, 9 aa, Dengue virus
FMAFVAFLR

SEQ ID NO: 34619 - protein, 9 aa, Dengue virus
MAFVAFLRF

SEQ ID NO: 34620 - protein, 9 aa, Dengue virus
AFVAFLRFL

SEQ ID NO: 34621 - protein, 9 aa, Dengue virus
FVAFLRFLT

SEQ ID NO: 34622 - protein, 9 aa, Dengue virus
RFLTIPPTV

SEQ ID NO: 34623 - protein, 9 aa, Dengue virus
FLTIPPTVG

SEQ ID NO: 34624 - protein, 9 aa, Dengue virus
LTIPPTVGI

SEQ ID NO: 34625 - protein, 9 aa, Dengue virus
TIPPTVGIL

SEQ ID NO: 34626 - protein, 9 aa, Dengue virus
IPPTVGILK

SEQ ID NO: 34627 - protein, 9 aa, Dengue virus
PPTVGILKR

SEQ ID NO: 34628 - protein, 9 aa, Dengue virus
PTVGILKRW

SEQ ID NO: 34629 - protein, 9 aa, Dengue virus
TVGILKRWG

SEQ ID NO: 34630 - protein, 9 aa, Dengue virus
VGILKRWGT

SEQ ID NO: 34631 - protein, 9 aa, Dengue virus
GILKRWGTV

SEQ ID NO: 34632 - protein, 9 aa, Dengue virus
ILKRWGTVK

SEQ ID NO: 34633 - protein, 9 aa, Dengue virus
LKRWGTVKK

SEQ ID NO: 34634 - protein, 9 aa, Dengue virus
KRWGTVKKS

SEQ ID NO: 34635 - protein, 9 aa, Dengue virus
RWGTVKKSK

SEQ ID NO: 34636 - protein, 9 aa, Dengue virus
WGTVKKSKA

SEQ ID NO: 34637 - protein, 9 aa, Dengue virus
GTVKKSKAI

SEQ ID NO: 34638 - protein, 9 aa, Dengue virus
TVKKSKAIN

SEQ ID NO: 34639 - protein, 9 aa, Dengue virus
VKKSKAINV

SEQ ID NO: 34640 - protein, 9 aa, Dengue virus
KKSKAISVL

SEQ ID NO: 34641 - protein, 9 aa, Dengue virus
KSKAISVLR

SEQ ID NO: 34642 - protein, 9 aa, Dengue virus
SKAISVLRG

SEQ ID NO: 34643 - protein, 9 aa, Dengue virus
KAISVLRGF

SEQ ID NO: 34644 - protein, 9 aa, Dengue virus
AISVLRGFR

SEQ ID NO: 34645 - protein, 9 aa, Dengue virus
ISVLRGFRK

SEQ ID NO: 34646 - protein, 9 aa, Dengue virus
SVLRGFRKE

SEQ ID NO: 34647 - protein, 9 aa, Dengue virus
VLRGFRREI

SEQ ID NO: 34648 - protein, 9 aa, Dengue virus
RGFRREIGR

SEQ ID NO: 34649 - protein, 9 aa, Dengue virus
RREIGRMLN

SEQ ID NO: 34650 - protein, 9 aa, Dengue virus
REIGRMLNI

SEQ ID NO: 34651 - protein, 9 aa, Dengue virus
GRMLNILNK

SEQ ID NO: 34652 - protein, 9 aa, Dengue virus
RMLNILNKR

SEQ ID NO: 34653 - protein, 9 aa, Dengue virus
MLNILNKRR

SEQ ID NO: 34654 - protein, 9 aa, Dengue virus
LNILNKRRR

SEQ ID NO: 34655 - protein, 9 aa, Dengue virus
NILNRRRRS

SEQ ID NO: 34656 - protein, 9 aa, Dengue virus
ILNRRRRSA

SEQ ID NO: 34657 - protein, 9 aa, Dengue virus
LNRRRRSAG

SEQ ID NO: 34658 - protein, 9 aa, Dengue virus
IPTVMAFHL

SEQ ID NO: 34659 - protein, 9 aa, Dengue virus
PTVMAFHLT

SEQ ID NO: 34660 - protein, 9 aa, Dengue virus
TVMAFHLTT

SEQ ID NO: 34661 - protein, 9 aa, Dengue virus
VMAFHLTTR

SEQ ID NO: 34662 - protein, 9 aa, Dengue virus
VAFHLTTRN

SEQ ID NO: 34663 - protein, 9 aa, Dengue virus
NGEPHMIVS

SEQ ID NO: 34664 - protein, 9 aa, Dengue virus
GEPHMIVGI

SEQ ID NO: 34665 - protein, 9 aa, Dengue virus
EPHMIVGIQ

SEQ ID NO: 34666 - protein, 9 aa, Dengue virus
PHMIVGIQE

SEQ ID NO: 34667 - protein, 9 aa, Dengue virus
HMIVGIQEK

SEQ ID NO: 34668 - protein, 9 aa, Dengue virus
MIVGIQEKG

SEQ ID NO: 34669 - protein, 9 aa, Dengue virus
IVGIQEKGK

SEQ ID NO: 34670 - protein, 9 aa, Dengue virus
VGIQEKGKS

SEQ ID NO: 34671 - protein, 9 aa, Dengue virus
GIQEKGKSL

SEQ ID NO: 34672 - protein, 9 aa, Dengue virus
IQEKGKSLL

SEQ ID NO: 34673 - protein, 9 aa, Dengue virus
NEKGKSLLF

SEQ ID NO: 34674 - protein, 9 aa, Dengue virus
GKSLLFKTK

SEQ ID NO: 34675 - protein, 9 aa, Dengue virus
KSLLFKTEN

SEQ ID NO: 34676 - protein, 9 aa, Dengue virus
SLLFKTENG

SEQ ID NO: 34677 - protein, 9 aa, Dengue virus
NGVNMCTLM

SEQ ID NO: 34678 - protein, 9 aa, Dengue virus
GTNMCTLMA

SEQ ID NO: 34679 - protein, 9 aa, Dengue virus
VNMCTLMAM

SEQ ID NO: 34680 - protein, 9 aa, Dengue virus
NMCTLMAMD

SEQ ID NO: 34681 - protein, 9 aa, Dengue virus
MCTLMAMDL

SEQ ID NO: 34682 - protein, 9 aa, Dengue virus
CTLMAMDLG

SEQ ID NO: 34683 - protein, 9 aa, Dengue virus
TLMAMDLGE

SEQ ID NO: 34684 - protein, 9 aa, Dengue virus
LMAMDLGEL

SEQ ID NO: 34685 - protein, 9 aa, Dengue virus
MAMDLGELC

SEQ ID NO: 34686 - protein, 9 aa, Dengue virus
AMDLGELCE

SEQ ID NO: 34687 - protein, 9 aa, Dengue virus
MDLGELCED

SEQ ID NO: 34688 - protein, 9 aa, Dengue virus
LGELCEDTV

SEQ ID NO: 34689 - protein, 9 aa, Dengue virus
GELCEDTVT

SEQ ID NO: 34690 - protein, 9 aa, Dengue virus
ELCEDTVTY

SEQ ID NO: 34691 - protein, 9 aa, Dengue virus
LCEDTITYN

SEQ ID NO: 34692 - protein, 9 aa, Dengue virus
CEDTITYNC

SEQ ID NO: 34693 - protein, 9 aa, Dengue virus
EDTITYNCP

SEQ ID NO: 34694 - protein, 9 aa, Dengue virus
DTITYNCPL

SEQ ID NO: 34695 - protein, 9 aa, Dengue virus
TITYNCPLL

SEQ ID NO: 34696 - protein, 9 aa, Dengue virus
TYNCPLLRQ

SEQ ID NO: 34697 - protein, 9 aa, Dengue virus
YNCPLLRQN

SEQ ID NO: 34698 - protein, 9 aa, Dengue virus
NCPLLRQNE

SEQ ID NO: 34699 - protein, 9 aa, Dengue virus
CPFLKQNEP

SEQ ID NO: 34700 - protein, 9 aa, Dengue virus
PFLKQNEPE

SEQ ID NO: 34701 - protein, 9 aa, Dengue virus
FLKQNEPED

SEQ ID NO: 34702 - protein, 9 aa, Dengue virus
LKQNEPEDI

SEQ ID NO: 34703 - protein, 9 aa, Dengue virus
KQNEPEDID

SEQ ID NO: 34704 - protein, 9 aa, Dengue virus
WCNSTSTWI

SEQ ID NO: 34705 - protein, 9 aa, Dengue virus
CNSTSTWIT

SEQ ID NO: 34706 - protein, 9 aa, Dengue virus
NSTSTWITY

SEQ ID NO: 34707 - protein, 9 aa, Dengue virus
STSTWITYG

SEQ ID NO: 34708 - protein, 9 aa, Dengue virus
TSTWITYGT

SEQ ID NO: 34709 - protein, 9 aa, Dengue virus
STWITYGTC

SEQ ID NO: 34710 - protein, 9 aa, Dengue virus
TWVTYGTCS

SEQ ID NO: 34711 - protein, 9 aa, Dengue virus
ATGEHRREK

SEQ ID NO: 34712 - protein, 9 aa, Dengue virus
MGEHRREKR

SEQ ID NO: 34713 - protein, 9 aa, Dengue virus
SVALVPHVR

SEQ ID NO: 34714 - protein, 9 aa, Dengue virus
VALVPHVRM

SEQ ID NO: 34715 - protein, 9 aa, Dengue virus
ALVPHVRMG

SEQ ID NO: 34716 - protein, 9 aa, Dengue virus
LVPHVRMGL

SEQ ID NO: 34717 - protein, 9 aa, Dengue virus
VPHVRMGLE

SEQ ID NO: 34718 - protein, 9 aa, Dengue virus
MSSEGAWKQ

SEQ ID NO: 34719 - protein, 9 aa, Dengue virus
SSEGAWKHA

SEQ ID NO: 34720 - protein, 9 aa, Dengue virus
SEGAWKHAQ

SEQ ID NO: 34721 - protein, 9 aa, Dengue virus
EGAWKHAQR

SEQ ID NO: 34722 - protein, 9 aa, Dengue virus
GAWKHAQRI

SEQ ID NO: 34723 - protein, 9 aa, Dengue virus
AWKHAQRIE

SEQ ID NO: 34724 - protein, 9 aa, Dengue virus
WKHAQRIET

SEQ ID NO: 34725 - protein, 9 aa, Dengue virus
KHAQRIETW

SEQ ID NO: 34726 - protein, 9 aa, Dengue virus
HAQRIETWI

SEQ ID NO: 34727 - protein, 9 aa, Dengue virus
AQRIETWIL

SEQ ID NO: 34728 - protein, 9 aa, Dengue virus
QRIETWVLR

SEQ ID NO: 34729 - protein, 9 aa, Dengue virus
RIETWVLRH

SEQ ID NO: 34730 - protein, 9 aa, Dengue virus
IETWVLRHP

SEQ ID NO: 34731 - protein, 9 aa, Dengue virus
ETWVLRHPG

SEQ ID NO: 34732 - protein, 9 aa, Dengue virus
TWVLRHPGF

SEQ ID NO: 34733 - protein, 9 aa, Dengue virus
WVLRHPGFT

SEQ ID NO: 34734 - protein, 9 aa, Dengue virus
LRHPGFTMM

SEQ ID NO: 34735 - protein, 9 aa, Dengue virus
RHPGFTMMA

SEQ ID NO: 34736 - protein, 9 aa, Dengue virus
HPGFTMMAA

SEQ ID NO: 34737 - protein, 9 aa, Dengue virus
MAAILAYTV

SEQ ID NO: 34738 - protein, 9 aa, Dengue virus
AAILAYTVG

SEQ ID NO: 34739 - protein, 9 aa, Dengue virus
AILAYTVGT

SEQ ID NO: 34740 - protein, 9 aa, Dengue virus
ILAYTVGTT

SEQ ID NO: 34741 - protein, 9 aa, Dengue virus
LAYTIGTTY

SEQ ID NO: 34742 - protein, 9 aa, Dengue virus
AYTIGTTYF

SEQ ID NO: 34743 - protein, 9 aa, Dengue virus
YTIGTTYFQ

SEQ ID NO: 34744 - protein, 9 aa, Dengue virus
TIGTTYFQR

SEQ ID NO: 34745 - protein, 9 aa, Dengue virus
GTTHFQRVL

SEQ ID NO: 34746 - protein, 9 aa, Dengue virus
TTHFQRVLI

SEQ ID NO: 34747 - protein, 9 aa, Dengue virus
THFQRVLIF

SEQ ID NO: 34748 - protein, 9 aa, Dengue virus
HFQRVLIFI

SEQ ID NO: 34749 - protein, 9 aa, Dengue virus
FQRVLIFIL

SEQ ID NO: 34750 - protein, 9 aa, Dengue virus
QRVLIFILL

SEQ ID NO: 34751 - protein, 9 aa, Dengue virus
RVLIFILLT

SEQ ID NO: 34752 - protein, 9 aa, Dengue virus
VLIFILLTA

SEQ ID NO: 34753 - protein, 9 aa, Dengue virus
LIFILLAAV

SEQ ID NO: 34754 - protein, 9 aa, Dengue virus
IFILLAAVA

SEQ ID NO: 34755 - protein, 9 aa, Dengue virus
FILLAAVAP

SEQ ID NO: 34756 - protein, 9 aa, Dengue virus
ILLAAVAPS

SEQ ID NO: 34757 - protein, 9 aa, Dengue virus
LLAAVAPSM

SEQ ID NO: 34758 - protein, 9 aa, Dengue virus
LAAVAPSMT

SEQ ID NO: 34759 - protein, 9 aa, Dengue virus
AAVAPSMTM

SEQ ID NO: 34760 - protein, 9 aa, Dengue virus
AVTPSMTMR

SEQ ID NO: 34761 - protein, 9 aa, Dengue virus
VTPSMTMRC

SEQ ID NO: 34762 - protein, 9 aa, Dengue virus
TPSMTMRCI

SEQ ID NO: 34763 - protein, 9 aa, Dengue virus
SMTMRCIGM

SEQ ID NO: 34764 - protein, 9 aa, Dengue virus
MTMRCIGMS

SEQ ID NO: 34765 - protein, 9 aa, Dengue virus
TMRCIGMSN

SEQ ID NO: 34766 - protein, 9 aa, Dengue virus
MRCIGMSNR

SEQ ID NO: 34767 - protein, 9 aa, Dengue virus
RCIGMSNRD

SEQ ID NO: 34768 - protein, 9 aa, Dengue virus
CIGMSNRDF

SEQ ID NO: 34769 - protein, 9 aa, Dengue virus
IGMSNRDFV

SEQ ID NO: 34770 - protein, 9 aa, Dengue virus
GMSNRDFVE

SEQ ID NO: 34771 - protein, 9 aa, Dengue virus
MSNRDFVEG

SEQ ID NO: 34772 - protein, 9 aa, Dengue virus
KPTLDFELT

SEQ ID NO: 34773 - protein, 9 aa, Dengue virus
PTLDFELTK

SEQ ID NO: 34774 - protein, 9 aa, Dengue virus
TLDFELTKT

SEQ ID NO: 34775 - protein, 9 aa, Dengue virus
LDFELTKTE

SEQ ID NO: 34776 - protein, 9 aa, Dengue virus
DFELTKTEA

SEQ ID NO: 34777 - protein, 9 aa, Dengue virus
FELTKTEAK

SEQ ID NO: 34778 - protein, 9 aa, Dengue virus
ELIKTEAKH

SEQ ID NO: 34779 - protein, 9 aa, Dengue virus
KTEAKHPAT

SEQ ID NO: 34780 - protein, 9 aa, Dengue virus
TEAKHPATL

SEQ ID NO: 34781 - protein, 9 aa, Dengue virus
EAKHPATLR

SEQ ID NO: 34782 - protein, 9 aa, Dengue virus
AKHPATLRK

SEQ ID NO: 34783 - protein, 9 aa, Dengue virus
KHPATLRKY

SEQ ID NO: 34784 - protein, 9 aa, Dengue virus
HPATLRKYC

SEQ ID NO: 34785 - protein, 9 aa, Dengue virus
PATLRKFCI

SEQ ID NO: 34786 - protein, 9 aa, Dengue virus
ATLRKFCIE

SEQ ID NO: 34787 - protein, 9 aa, Dengue virus
TLRKFCIEA

SEQ ID NO: 34788 - protein, 9 aa, Dengue virus
LRKFCIEAK

SEQ ID NO: 34789 - protein, 9 aa, Dengue virus
RKFCIEAKL

SEQ ID NO: 34790 - protein, 9 aa, Dengue virus
KFCIEAKLT

SEQ ID NO: 34791 - protein, 9 aa, Dengue virus
FCIEAKLTN

SEQ ID NO: 34792 - protein, 9 aa, Dengue virus
CVEAKLTNT

SEQ ID NO: 34793 - protein, 9 aa, Dengue virus
VEAKLTNTT

SEQ ID NO: 34794 - protein, 9 aa, Dengue virus
AKLTNTTTA

SEQ ID NO: 34795 - protein, 9 aa, Dengue virus
KLTNTTTAS

SEQ ID NO: 34796 - protein, 9 aa, Dengue virus
LTNTTTASR

SEQ ID NO: 34797 - protein, 9 aa, Dengue virus
TNTTTASRC

SEQ ID NO: 34798 - protein, 9 aa, Dengue virus
NTTTASRCP

SEQ ID NO: 34799 - protein, 9 aa, Dengue virus
TTTASRCPT

SEQ ID NO: 34800 - protein, 9 aa, Dengue virus
TTASRCPTQ

SEQ ID NO: 34801 - protein, 9 aa, Dengue virus
TASRCPTQG

SEQ ID NO: 34802 - protein, 9 aa, Dengue virus
ASRCPTQGE

SEQ ID NO: 34803 - protein, 9 aa, Dengue virus
RCPTQGEPT

SEQ ID NO: 34804 - protein, 9 aa, Dengue virus
CPTQGEPTL

SEQ ID NO: 34805 - protein, 9 aa, Dengue virus
PTQGEPSLK

SEQ ID NO: 34806 - protein, 9 aa, Dengue virus
TQGEPSLKE

SEQ ID NO: 34807 - protein, 9 aa, Dengue virus
QGEPSLKEE

SEQ ID NO: 34808 - protein, 9 aa, Dengue virus
GEPSLKEEQ

SEQ ID NO: 34809 - protein, 9 aa, Dengue virus
EPSLKEEQD

SEQ ID NO: 34810 - protein, 9 aa, Dengue virus
PSLKEEQDK

SEQ ID NO: 34811 - protein, 9 aa, Dengue virus
SLKEEQDKR

SEQ ID NO: 34812 - protein, 9 aa, Dengue virus
LKEEQDKRF

SEQ ID NO: 34813 - protein, 9 aa, Dengue virus
EEQDKRFIC

SEQ ID NO: 34814 - protein, 9 aa, Dengue virus
EQDKRFICK

SEQ ID NO: 34815 - protein, 9 aa, Dengue virus
QDKRFICKH

SEQ ID NO: 34816 - protein, 9 aa, Dengue virus
DKRFICKHS

SEQ ID NO: 34817 - protein, 9 aa, Dengue virus
KRFICKHSM

SEQ ID NO: 34818 - protein, 9 aa, Dengue virus
RFICKHSMV

SEQ ID NO: 34819 - protein, 9 aa, Dengue virus
FICKHSMVD

SEQ ID NO: 34820 - protein, 9 aa, Dengue virus
ICKHSMVDR

SEQ ID NO: 34821 - protein, 9 aa, Dengue virus
CRHSMVDRG

SEQ ID NO: 34822 - protein, 9 aa, Dengue virus
RHSMVDRGW

SEQ ID NO: 34823 - protein, 9 aa, Dengue virus
KGGIVTCAK

SEQ ID NO: 34824 - protein, 9 aa, Dengue virus
GGIVTCAKF

SEQ ID NO: 34825 - protein, 9 aa, Dengue virus
GIVTCAMFR

SEQ ID NO: 34826 - protein, 9 aa, Dengue virus
IVTCAMFRC

SEQ ID NO: 34827 - protein, 9 aa, Dengue virus
VTCAMFTCL

SEQ ID NO: 34828 - protein, 9 aa, Dengue virus
TCAMFRCKK

SEQ ID NO: 34829 - protein, 9 aa, Dengue virus
CAMFRCKKN

SEQ ID NO: 34830 - protein, 9 aa, Dengue virus
AMFRCKKNM

SEQ ID NO: 34831 - protein, 9 aa, Dengue virus
MFRCKKNME

SEQ ID NO: 34832 - protein, 9 aa, Dengue virus
FRCKKNMEG

SEQ ID NO: 34833 - protein, 9 aa, Dengue virus
RCKKNMEGK

SEQ ID NO: 34834 - protein, 9 aa, Dengue virus
CKKNMEGKI

SEQ ID NO: 34835 - protein, 9 aa, Dengue virus
KKNMEGKIV

SEQ ID NO: 34836 - protein, 9 aa, Dengue virus
KNMEGKVVQ

SEQ ID NO: 34837 - protein, 9 aa, Dengue virus
NMEGKVVQP

SEQ ID NO: 34838 - protein, 9 aa, Dengue virus
MEGKVVQPE

SEQ ID NO: 34839 - protein, 9 aa, Dengue virus
EGKVVQPEN

SEQ ID NO: 34840 - protein, 9 aa, Dengue virus
GKVVQPENL

SEQ ID NO: 34841 - protein, 9 aa, Dengue virus
KVVQPENLE

SEQ ID NO: 34842 - protein, 9 aa, Dengue virus
VVQPENLEY

SEQ ID NO: 34843 - protein, 9 aa, Dengue virus
VLPENLEYT

SEQ ID NO: 34844 - protein, 9 aa, Dengue virus
LPENLEYTI

SEQ ID NO: 34845 - protein, 9 aa, Dengue virus
PENLEYTVV

SEQ ID NO: 34846 - protein, 9 aa, Dengue virus
ENLEYTIVV

SEQ ID NO: 34847 - protein, 9 aa, Dengue virus
NLEYTIVVT

SEQ ID NO: 34848 - protein, 9 aa, Dengue virus
LEYTIVVTP

SEQ ID NO: 34849 - protein, 9 aa, Dengue virus
EYTIVVTPH

SEQ ID NO: 34850 - protein, 9 aa, Dengue virus
YTIVVTPHS

SEQ ID NO: 34851 - protein, 9 aa, Dengue virus
TIVVTPHSG

SEQ ID NO: 34852 - protein, 9 aa, Dengue virus
IVVTPHSGE

SEQ ID NO: 34853 - protein, 9 aa, Dengue virus
VVTPHSGEE

SEQ ID NO: 34854 - protein, 9 aa, Dengue virus
VTPHSGEEH

SEQ ID NO: 34855 - protein, 9 aa, Dengue virus
TPHSGEENA

SEQ ID NO: 34856 - protein, 9 aa, Dengue virus
PHSGEENAV

SEQ ID NO: 34857 - protein, 9 aa, Dengue virus
HSGEENAVG

SEQ ID NO: 34858 - protein, 9 aa, Dengue virus
SGEENAVGN

SEQ ID NO: 34859 - protein, 9 aa, Dengue virus
GEENAVGND

SEQ ID NO: 34860 - protein, 9 aa, Dengue virus
EENAVGNDT

SEQ ID NO: 34861 - protein, 9 aa, Dengue virus
ENAVGNDTG

SEQ ID NO: 34862 - protein, 9 aa, Dengue virus
NAVGNDTGK

SEQ ID NO: 34863 - protein, 9 aa, Dengue virus
AVGDDTGKH

SEQ ID NO: 34864 - protein, 9 aa, Dengue virus
GNDTGKHGQ

SEQ ID NO: 34865 - protein, 9 aa, Dengue virus
NDTGKHGQE

SEQ ID NO: 34866 - protein, 9 aa, Dengue virus
DTGKHGQEI

SEQ ID NO: 34867 - protein, 9 aa, Dengue virus
TGKHGQEIK

SEQ ID NO: 34868 - protein, 9 aa, Dengue virus
GKHGKEIKV

SEQ ID NO: 34869 - protein, 9 aa, Dengue virus
KHGKEIKVT

SEQ ID NO: 34870 - protein, 9 aa, Dengue virus
HGKEIKVTP

SEQ ID NO: 34871 - protein, 9 aa, Dengue virus
GKEIKVTPQ

SEQ ID NO: 34872 - protein, 9 aa, Dengue virus
KEIKVTPQS

SEQ ID NO: 34873 - protein, 9 aa, Dengue virus
EIKVTPQSS

SEQ ID NO: 34874 - protein, 9 aa, Dengue virus
AEAELTDYG

SEQ ID NO: 34875 - protein, 9 aa, Dengue virus
EAELTDYGT

SEQ ID NO: 34876 - protein, 9 aa, Dengue virus
AELTDYGTI

SEQ ID NO: 34877 - protein, 9 aa, Dengue virus
ELTDYGTIT

SEQ ID NO: 34878 - protein, 9 aa, Dengue virus
LTDYGTITM

SEQ ID NO: 34879 - protein, 9 aa, Dengue virus
TDYGTITME

SEQ ID NO: 34880 - protein, 9 aa, Dengue virus
DYGTITMEC

SEQ ID NO: 34881 - protein, 9 aa, Dengue virus
YGTITMECS

SEQ ID NO: 34882 - protein, 9 aa, Dengue virus
GTITMECSP

SEQ ID NO: 34883 - protein, 9 aa, Dengue virus
TITMECSPR

SEQ ID NO: 34884 - protein, 9 aa, Dengue virus
ITMECSPRT

SEQ ID NO: 34885 - protein, 9 aa, Dengue virus
TMECSPRTS

SEQ ID NO: 34886 - protein, 9 aa, Dengue virus
MECSPRTSL

SEQ ID NO: 34887 - protein, 9 aa, Dengue virus
ECSPRTSLD

SEQ ID NO: 34888 - protein, 9 aa, Dengue virus
CSPRTSLDF

SEQ ID NO: 34889 - protein, 9 aa, Dengue virus
SPRTSLDFN

SEQ ID NO: 34890 - protein, 9 aa, Dengue virus
PRTSLDFNE

SEQ ID NO: 34891 - protein, 9 aa, Dengue virus
RTSLDFNEM

SEQ ID NO: 34892 - protein, 9 aa, Dengue virus
TSLDFNEMV

SEQ ID NO: 34893 - protein, 9 aa, Dengue virus
SLDFNEMVL

SEQ ID NO: 34894 - protein, 9 aa, Dengue virus
NEMVLLQMK

SEQ ID NO: 34895 - protein, 9 aa, Dengue virus
MENKAWLVH

SEQ ID NO: 34896 - protein, 9 aa, Dengue virus
ENKAWLVHR

SEQ ID NO: 34897 - protein, 9 aa, Dengue virus
NKAWLVHRQ

SEQ ID NO: 34898 - protein, 9 aa, Dengue virus
LPWLPGADK

SEQ ID NO: 34899 - protein, 9 aa, Dengue virus
PWLPGADKQ

SEQ ID NO: 34900 - protein, 9 aa, Dengue virus
WLPGADKQE

SEQ ID NO: 34901 - protein, 9 aa, Dengue virus
LPGADKQES

SEQ ID NO: 34902 - protein, 9 aa, Dengue virus
PGADKQESN

SEQ ID NO: 34903 - protein, 9 aa, Dengue virus
GADKQESNW

SEQ ID NO: 34904 - protein, 9 aa, Dengue virus
ADKQESNWI

SEQ ID NO: 34905 - protein, 9 aa, Dengue virus
DKQESNWIQ

SEQ ID NO: 34906 - protein, 9 aa, Dengue virus
KQESNWIQK

SEQ ID NO: 34907 - protein, 9 aa, Dengue virus
QESNWIQKE

SEQ ID NO: 34908 - protein, 9 aa, Dengue virus
ESNWIQKET

SEQ ID NO: 34909 - protein, 9 aa, Dengue virus
SNWIQKEML

SEQ ID NO: 34910 - protein, 9 aa, Dengue virus
NWIQKEMLV

SEQ ID NO: 34911 - protein, 9 aa, Dengue virus
WIQKEMLVT

SEQ ID NO: 34912 - protein, 9 aa, Dengue virus
IQKEMLVTF

SEQ ID NO: 34913 - protein, 9 aa, Dengue virus
QKEMLVTFK

SEQ ID NO: 34914 - protein, 9 aa, Dengue virus
KEMLVTFKN

SEQ ID NO: 34915 - protein, 9 aa, Dengue virus
EMLVTFKNP

SEQ ID NO: 34916 - protein, 9 aa, Dengue virus
MLVTFKNPH

SEQ ID NO: 34917 - protein, 9 aa, Dengue virus
TFKNPHAKR

SEQ ID NO: 34918 - protein, 9 aa, Dengue virus
FKNPHAKRQ

SEQ ID NO: 34919 - protein, 9 aa, Dengue virus
KNPHAKRQD

SEQ ID NO: 34920 - protein, 9 aa, Dengue virus
NPHAKRQDV

SEQ ID NO: 34921 - protein, 9 aa, Dengue virus
PHAKRQDVV

SEQ ID NO: 34922 - protein, 9 aa, Dengue virus
HAKRQDVVV

SEQ ID NO: 34923 - protein, 9 aa, Dengue virus
AKRQDVVVL

SEQ ID NO: 34924 - protein, 9 aa, Dengue virus
KRQDVVVLG

SEQ ID NO: 34925 - protein, 9 aa, Dengue virus
RQDVVVLGS

SEQ ID NO: 34926 - protein, 9 aa, Dengue virus
GATEIQMSL

SEQ ID NO: 34927 - protein, 9 aa, Dengue virus
ATEIQMSLG

SEQ ID NO: 34928 - protein, 9 aa, Dengue virus
TEIQMSLGN

SEQ ID NO: 34929 - protein, 9 aa, Dengue virus
EIQMSLGNI

SEQ ID NO: 34930 - protein, 9 aa, Dengue virus
IQMSLGNIL

SEQ ID NO: 34931 - protein, 9 aa, Dengue virus
QMSLGNILF

SEQ ID NO: 34932 - protein, 9 aa, Dengue virus
MSLGNILFM

SEQ ID NO: 34933 - protein, 9 aa, Dengue virus
SLGNILFMG

SEQ ID NO: 34934 - protein, 9 aa, Dengue virus
LGNILFMGH

SEQ ID NO: 34935 - protein, 9 aa, Dengue virus
GNILFMGHL

SEQ ID NO: 34936 - protein, 9 aa, Dengue virus
NILFMGHLK

SEQ ID NO: 34937 - protein, 9 aa, Dengue virus
ILFMGHLKC

SEQ ID NO: 34938 - protein, 9 aa, Dengue virus
LFMGHLKCR

SEQ ID NO: 34939 - protein, 9 aa, Dengue virus
FMGHLKCRL

SEQ ID NO: 34940 - protein, 9 aa, Dengue virus
MGHLKCRLR

SEQ ID NO: 34941 - protein, 9 aa, Dengue virus
SMCTGKFKV

SEQ ID NO: 34942 - protein, 9 aa, Dengue virus
MCTGKFKVV

SEQ ID NO: 34943 - protein, 9 aa, Dengue virus
CTGKFKVVK

SEQ ID NO: 34944 - protein, 9 aa, Dengue virus
TGKFKVVKE

SEQ ID NO: 34945 - protein, 9 aa, Dengue virus
GKFKVVKEI

SEQ ID NO: 34946 - protein, 9 aa, Dengue virus
KFKVVKEIA

SEQ ID NO: 34947 - protein, 9 aa, Dengue virus
FKVVKEIAE

SEQ ID NO: 34948 - protein, 9 aa, Dengue virus
KVVKEIAET

SEQ ID NO: 34949 - protein, 9 aa, Dengue virus
VVKEIAETQ

SEQ ID NO: 34950 - protein, 9 aa, Dengue virus
ETQHGTIVV

SEQ ID NO: 34951 - protein, 9 aa, Dengue virus
TQHGTIVVR

SEQ ID NO: 34952 - protein, 9 aa, Dengue virus
QHGTIVIRI

SEQ ID NO: 34953 - protein, 9 aa, Dengue virus
HGTIVIRIQ

SEQ ID NO: 34954 - protein, 9 aa, Dengue virus
GTIVIRIQY

SEQ ID NO: 34955 - protein, 9 aa, Dengue virus
TIVIRIQYE

SEQ ID NO: 34956 - protein, 9 aa, Dengue virus
IVIRIQYEG

SEQ ID NO: 34957 - protein, 9 aa, Dengue virus
VIRIQYEGD

SEQ ID NO: 34958 - protein, 9 aa, Dengue virus
IRVQYEGDD

SEQ ID NO: 34959 - protein, 9 aa, Dengue virus
RVQYEGDDS

SEQ ID NO: 34960 - protein, 9 aa, Dengue virus
VQYEGDDSP

SEQ ID NO: 34961 - protein, 9 aa, Dengue virus
QYEGDDSPC

SEQ ID NO: 34962 - protein, 9 aa, Dengue virus
YEGDDSPCK

SEQ ID NO: 34963 - protein, 9 aa, Dengue virus
EGDDSPCKI

SEQ ID NO: 34964 - protein, 9 aa, Dengue virus
GDDSPCKIP

SEQ ID NO: 34965 - protein, 9 aa, Dengue virus
DDSPCKIPF

SEQ ID NO: 34966 - protein, 9 aa, Dengue virus
DSPCKIPFE

SEQ ID NO: 34967 - protein, 9 aa, Dengue virus
SPCRIPFEI

SEQ ID NO: 34968 - protein, 9 aa, Dengue virus
PCKIPFEIT

SEQ ID NO: 34969 - protein, 9 aa, Dengue virus
CKIPFEITD

SEQ ID NO: 34970 - protein, 9 aa, Dengue virus
KIPFEITDL

SEQ ID NO: 34971 - protein, 9 aa, Dengue virus
IPFEITDLE

SEQ ID NO: 34972 - protein, 9 aa, Dengue virus
PFEITDLEK

SEQ ID NO: 34973 - protein, 9 aa, Dengue virus
FEITDLEKR

SEQ ID NO: 34974 - protein, 9 aa, Dengue virus
EIMDLEKRY

SEQ ID NO: 34975 - protein, 9 aa, Dengue virus
DLEKRYVLG

SEQ ID NO: 34976 - protein, 9 aa, Dengue virus
LEKRYVLGR

SEQ ID NO: 34977 - protein, 9 aa, Dengue virus
EKRYVLGRL

SEQ ID NO: 34978 - protein, 9 aa, Dengue virus
KRYVLGRLI

SEQ ID NO: 34979 - protein, 9 aa, Dengue virus
RYVLGRLIT

SEQ ID NO: 34980 - protein, 9 aa, Dengue virus
YVLGRLITV

SEQ ID NO: 34981 - protein, 9 aa, Dengue virus
ILGRLITVN

SEQ ID NO: 34982 - protein, 9 aa, Dengue virus
RLITVNPII

SEQ ID NO: 34983 - protein, 9 aa, Dengue virus
LITVNPIVI

SEQ ID NO: 34984 - protein, 9 aa, Dengue virus
EKDSPINIE

SEQ ID NO: 34985 - protein, 9 aa, Dengue virus
KDSPINIEA

SEQ ID NO: 34986 - protein, 9 aa, Dengue virus
DSPINIEAE

SEQ ID NO: 34987 - protein, 9 aa, Dengue virus
SPINIEAEP

SEQ ID NO: 34988 - protein, 9 aa, Dengue virus
PINIEAEPP

SEQ ID NO: 34989 - protein, 9 aa, Dengue virus
INIEAEPPF

SEQ ID NO: 34990 - protein, 9 aa, Dengue virus
PPFGDSYIV

SEQ ID NO: 34991 - protein, 9 aa, Dengue virus
PFGDSYIIV

SEQ ID NO: 34992 - protein, 9 aa, Dengue virus
FGDSYIIVG

SEQ ID NO: 34993 - protein, 9 aa, Dengue virus
GDSYIIVGV

SEQ ID NO: 34994 - protein, 9 aa, Dengue virus
DSYIIVGVE

SEQ ID NO: 34995 - protein, 9 aa, Dengue virus
SYIIVGVEP

SEQ ID NO: 34996 - protein, 9 aa, Dengue virus
YIIVGVEPG

SEQ ID NO: 34997 - protein, 9 aa, Dengue virus
IIVGVEPGQ

SEQ ID NO: 34998 - protein, 9 aa, Dengue virus
IVGVEPGQL

SEQ ID NO: 34999 - protein, 9 aa, Dengue virus
VGVEPGQLK

SEQ ID NO: 35000 - protein, 9 aa, Dengue virus
VEPGQLKLS

SEQ ID NO: 35001 - protein, 9 aa, Dengue virus
EPGQLKLSW

SEQ ID NO: 35002 - protein, 9 aa, Dengue virus
PGQLKLSWF

SEQ ID NO: 35003 - protein, 9 aa, Dengue virus
GQLKLSWFK

SEQ ID NO: 35004 - protein, 9 aa, Dengue virus
QLKLSWFKK

SEQ ID NO: 35005 - protein, 9 aa, Dengue virus
LKLSWFKKG

SEQ ID NO: 35006 - protein, 9 aa, Dengue virus
KLSWFKKGS

SEQ ID NO: 35007 - protein, 9 aa, Dengue virus
LSWFKKGSS

SEQ ID NO: 35008 - protein, 9 aa, Dengue virus
SWFKKGSSI

SEQ ID NO: 35009 - protein, 9 aa, Dengue virus
KGSSIGQMI

SEQ ID NO: 35010 - protein, 9 aa, Dengue virus
GSSIGQMIE

SEQ ID NO: 35011 - protein, 9 aa, Dengue virus
SSIGQMIET

SEQ ID NO: 35012 - protein, 9 aa, Dengue virus
SIGQMIETT

SEQ ID NO: 35013 - protein, 9 aa, Dengue virus
IGQMIETTM

SEQ ID NO: 35014 - protein, 9 aa, Dengue virus
GQMIETTMR

SEQ ID NO: 35015 - protein, 9 aa, Dengue virus
QMIETTMRG

SEQ ID NO: 35016 - protein, 9 aa, Dengue virus
MIETTMRGA

SEQ ID NO: 35017 - protein, 9 aa, Dengue virus
IETTMRGAK

SEQ ID NO: 35018 - protein, 9 aa, Dengue virus
DTAWDFGSI

SEQ ID NO: 35019 - protein, 9 aa, Dengue virus
TAWDFGSIG

SEQ ID NO: 35020 - protein, 9 aa, Dengue virus
AWDFGSIGG

SEQ ID NO: 35021 - protein, 9 aa, Dengue virus
WDFGSIGGV

SEQ ID NO: 35022 - protein, 9 aa, Dengue virus
DFGSIGGVF

SEQ ID NO: 35023 - protein, 9 aa, Dengue virus
FGSIGGVFT

SEQ ID NO: 35024 - protein, 9 aa, Dengue virus
GSIGGVFTS

SEQ ID NO: 35025 - protein, 9 aa, Dengue virus
SIGGVFTSV

SEQ ID NO: 35026 - protein, 9 aa, Dengue virus
IGGVFTSVG

SEQ ID NO: 35027 - protein, 9 aa, Dengue virus
GGVFTSVGK

SEQ ID NO: 35028 - protein, 9 aa, Dengue virus
GVFTSVGKA

SEQ ID NO: 35029 - protein, 9 aa, Dengue virus
VFTSVGKAL

SEQ ID NO: 35030 - protein, 9 aa, Dengue virus
FTSVGKALH

SEQ ID NO: 35031 - protein, 9 aa, Dengue virus
TSVGKALHQ

SEQ ID NO: 35032 - protein, 9 aa, Dengue virus
SVGKALHQV

SEQ ID NO: 35033 - protein, 9 aa, Dengue virus
VGKALHQVF

SEQ ID NO: 35034 - protein, 9 aa, Dengue virus
VFGAIYGVA

SEQ ID NO: 35035 - protein, 9 aa, Dengue virus
GAIYGVAFS

SEQ ID NO: 35036 - protein, 9 aa, Dengue virus
AIYGVAFSG

SEQ ID NO: 35037 - protein, 9 aa, Dengue virus
IYGVAFSGV

SEQ ID NO: 35038 - protein, 9 aa, Dengue virus
YGVAFSGVS

SEQ ID NO: 35039 - protein, 9 aa, Dengue virus
GVAFSGVSW

SEQ ID NO: 35040 - protein, 9 aa, Dengue virus
AAFSGVSWI

SEQ ID NO: 35041 - protein, 9 aa, Dengue virus
AFSGVSWIM

SEQ ID NO: 35042 - protein, 9 aa, Dengue virus
FSGVSWIMK

SEQ ID NO: 35043 - protein, 9 aa, Dengue virus
SGVSWIMKI

SEQ ID NO: 35044 - protein, 9 aa, Dengue virus
GVSWIMKIL

SEQ ID NO: 35045 - protein, 9 aa, Dengue virus
VSWIMKILI

SEQ ID NO: 35046 - protein, 9 aa, Dengue virus
SWIMKILIG

SEQ ID NO: 35047 - protein, 9 aa, Dengue virus
WTMKILIGA

SEQ ID NO: 35048 - protein, 9 aa, Dengue virus
TMKILIGVV

SEQ ID NO: 35049 - protein, 9 aa, Dengue virus
MKILIGVVI

SEQ ID NO: 35050 - protein, 9 aa, Dengue virus
KILIGVVIT

SEQ ID NO: 35051 - protein, 9 aa, Dengue virus
ILIGVVITW

SEQ ID NO: 35052 - protein, 9 aa, Dengue virus
LIGVVITWI

SEQ ID NO: 35053 - protein, 9 aa, Dengue virus
IGVVITWIG

SEQ ID NO: 35054 - protein, 9 aa, Dengue virus
GVVITWIGM

SEQ ID NO: 35055 - protein, 9 aa, Dengue virus
VVITWIGMN

SEQ ID NO: 35056 - protein, 9 aa, Dengue virus
VITWIGMNS

SEQ ID NO: 35057 - protein, 9 aa, Dengue virus
SRSTSLSVT

SEQ ID NO: 35058 - protein, 9 aa, Dengue virus
RSTSLSVTL

SEQ ID NO: 35059 - protein, 9 aa, Dengue virus
STSLSVTLV

SEQ ID NO: 35060 - protein, 9 aa, Dengue virus
TSLSVTLVL

SEQ ID NO: 35061 - protein, 9 aa, Dengue virus
SLSVTLVLV

SEQ ID NO: 35062 - protein, 9 aa, Dengue virus
LSVTLVLVG

SEQ ID NO: 35063 - protein, 9 aa, Dengue virus
SVSLVLVGI

SEQ ID NO: 35064 - protein, 9 aa, Dengue virus
VSLVLVGIV

SEQ ID NO: 35065 - protein, 9 aa, Dengue virus
LVLVGIVTL

SEQ ID NO: 35066 - protein, 9 aa, Dengue virus
VLVGIVTLY

SEQ ID NO: 35067 - protein, 9 aa, Dengue virus
LVGIVTLYL

SEQ ID NO: 35068 - protein, 9 aa, Dengue virus
VGIVTLYLG

SEQ ID NO: 35069 - protein, 9 aa, Dengue virus
GIVTLYLGV

SEQ ID NO: 35070 - protein, 9 aa, Dengue virus
VTLYLGAMV

SEQ ID NO: 35071 - protein, 9 aa, Dengue virus
TLYLGAMVQ

SEQ ID NO: 35072 - protein, 9 aa, Dengue virus
LYLGAMVQA

SEQ ID NO: 35073 - protein, 9 aa, Dengue virus
YLGAMVQAD

SEQ ID NO: 35074 - protein, 9 aa, Dengue virus
LGAMVQADS

SEQ ID NO: 35075 - protein, 9 aa, Dengue virus
GAMVQADSG

SEQ ID NO: 35076 - protein, 9 aa, Dengue virus
AMVQADSGC

SEQ ID NO: 35077 - protein, 9 aa, Dengue virus
VVQADSGCV

SEQ ID NO: 35078 - protein, 9 aa, Dengue virus
VQADTGCVV

SEQ ID NO: 35079 - protein, 9 aa, Dengue virus
QADTGCVVS

SEQ ID NO: 35080 - protein, 9 aa, Dengue virus
ADTGCVVSW

SEQ ID NO: 35081 - protein, 9 aa, Dengue virus
DTGCVVSWK

SEQ ID NO: 35082 - protein, 9 aa, Dengue virus
TGCVVSWKN

SEQ ID NO: 35083 - protein, 9 aa, Dengue virus
GCIVSWKNK

SEQ ID NO: 35084 - protein, 9 aa, Dengue virus
CVVSWKSKE

SEQ ID NO: 35085 - protein, 9 aa, Dengue virus
IVSWKNKEL

SEQ ID NO: 35086 - protein, 9 aa, Dengue virus
VSWKSKELK

SEQ ID NO: 35087 - protein, 9 aa, Dengue virus
SWKSKELKC

SEQ ID NO: 35088 - protein, 9 aa, Dengue virus
WKSKELKCG

SEQ ID NO: 35089 - protein, 9 aa, Dengue virus
KSKELKCGS

SEQ ID NO: 35090 - protein, 9 aa, Dengue virus
SKELKCGSG

SEQ ID NO: 35091 - protein, 9 aa, Dengue virus
LKCGSGIFV

SEQ ID NO: 35092 - protein, 9 aa, Dengue virus
KCGSGIFVT

SEQ ID NO: 35093 - protein, 9 aa, Dengue virus
CGSGIFVTD

SEQ ID NO: 35094 - protein, 9 aa, Dengue virus
GSGIFVTDN

SEQ ID NO: 35095 - protein, 9 aa, Dengue virus
SGIFVTDNV

SEQ ID NO: 35096 - protein, 9 aa, Dengue virus
GIFVTDNVH

SEQ ID NO: 35097 - protein, 9 aa, Dengue virus
IFVTDNVHT

SEQ ID NO: 35098 - protein, 9 aa, Dengue virus
FVTDNVHTW

SEQ ID NO: 35099 - protein, 9 aa, Dengue virus
VTDNVHTWT

SEQ ID NO: 35100 - protein, 9 aa, Dengue virus
TEQYKFQPD

SEQ ID NO: 35101 - protein, 9 aa, Dengue virus
EQYKFQPDS

SEQ ID NO: 35102 - protein, 9 aa, Dengue virus
QYKFQPDSP

SEQ ID NO: 35103 - protein, 9 aa, Dengue virus
YKFQPDSPS

SEQ ID NO: 35104 - protein, 9 aa, Dengue virus
KFQPDSPSK

SEQ ID NO: 35105 - protein, 9 aa, Dengue virus
FQPDSPSKL

SEQ ID NO: 35106 - protein, 9 aa, Dengue virus
QPDSPSKLA

SEQ ID NO: 35107 - protein, 9 aa, Dengue virus
PDSPSKLAS

SEQ ID NO: 35108 - protein, 9 aa, Dengue virus
DSPSKLASA

SEQ ID NO: 35109 - protein, 9 aa, Dengue virus
LASAIQKAQ

SEQ ID NO: 35110 - protein, 9 aa, Dengue virus
ASAIQKAQE

SEQ ID NO: 35111 - protein, 9 aa, Dengue virus
SAIQKAQEE

SEQ ID NO: 35112 - protein, 9 aa, Dengue virus
AIQKAQEEG

SEQ ID NO: 35113 - protein, 9 aa, Dengue virus
IQKAQEEGI

SEQ ID NO: 35114 - protein, 9 aa, Dengue virus
QKAQEEGIC

SEQ ID NO: 35115 - protein, 9 aa, Dengue virus
KAQEEGICG

SEQ ID NO: 35116 - protein, 9 aa, Dengue virus
AQEEGICGI

SEQ ID NO: 35117 - protein, 9 aa, Dengue virus
QEEGICGIR

SEQ ID NO: 35118 - protein, 9 aa, Dengue virus
EEDICGIRS

SEQ ID NO: 35119 - protein, 9 aa, Dengue virus
EDICGIRSV

SEQ ID NO: 35120 - protein, 9 aa, Dengue virus
DICGIRSVT

SEQ ID NO: 35121 - protein, 9 aa, Dengue virus
LENLMWRQI

SEQ ID NO: 35122 - protein, 9 aa, Dengue virus
ENLMWRQIT

SEQ ID NO: 35123 - protein, 9 aa, Dengue virus
NLMWKQITS

SEQ ID NO: 35124 - protein, 9 aa, Dengue virus
LMWKQITSE

SEQ ID NO: 35125 - protein, 9 aa, Dengue virus
MWKQITSEL

SEQ ID NO: 35126 - protein, 9 aa, Dengue virus
WKQITSELN

SEQ ID NO: 35127 - protein, 9 aa, Dengue virus
KQITSELNH

SEQ ID NO: 35128 - protein, 9 aa, Dengue virus
QITSELNHI

SEQ ID NO: 35129 - protein, 9 aa, Dengue virus
ITSELNHIL

SEQ ID NO: 35130 - protein, 9 aa, Dengue virus
TPELNHILA

SEQ ID NO: 35131 - protein, 9 aa, Dengue virus
PELNHILAE

SEQ ID NO: 35132 - protein, 9 aa, Dengue virus
ELNHILAEN

SEQ ID NO: 35133 - protein, 9 aa, Dengue virus
LNHILAENE

SEQ ID NO: 35134 - protein, 9 aa, Dengue virus
NHILAENEV

SEQ ID NO: 35135 - protein, 9 aa, Dengue virus
HILAENEVK

SEQ ID NO: 35136 - protein, 9 aa, Dengue virus
ILAENEVKL

SEQ ID NO: 35137 - protein, 9 aa, Dengue virus
LAENEVKLT

SEQ ID NO: 35138 - protein, 9 aa, Dengue virus
AENEVKLTI

SEQ ID NO: 35139 - protein, 9 aa, Dengue virus
ENEAKLTIM

SEQ ID NO: 35140 - protein, 9 aa, Dengue virus
NEAKLTIMT

SEQ ID NO: 35141 - protein, 9 aa, Dengue virus
EAKLTIMTG

SEQ ID NO: 35142 - protein, 9 aa, Dengue virus
VKLTIMTGE

SEQ ID NO: 35143 - protein, 9 aa, Dengue virus
KLTIMTGDT

SEQ ID NO: 35144 - protein, 9 aa, Dengue virus
LTIMTGDIR

SEQ ID NO: 35145 - protein, 9 aa, Dengue virus
TIMTGDIRG

SEQ ID NO: 35146 - protein, 9 aa, Dengue virus
IMTGDIRGI

SEQ ID NO: 35147 - protein, 9 aa, Dengue virus
MTGDIRGIM

SEQ ID NO: 35148 - protein, 9 aa, Dengue virus
TGDIRGIMQ

SEQ ID NO: 35149 - protein, 9 aa, Dengue virus
RGIMQAGKR

SEQ ID NO: 35150 - protein, 9 aa, Dengue virus
GIMQVGKRS

SEQ ID NO: 35151 - protein, 9 aa, Dengue virus
IMQVGKRSL

SEQ ID NO: 35152 - protein, 9 aa, Dengue virus
GRRSLKPQP

SEQ ID NO: 35153 - protein, 9 aa, Dengue virus
RRSLKPQPT

SEQ ID NO: 35154 - protein, 9 aa, Dengue virus
RSLKPQPTE

SEQ ID NO: 35155 - protein, 9 aa, Dengue virus
SLKPQPTEL

SEQ ID NO: 35156 - protein, 9 aa, Dengue virus
LRPQPTELR

SEQ ID NO: 35157 - protein, 9 aa, Dengue virus
RPQPTELRY

SEQ ID NO: 35158 - protein, 9 aa, Dengue virus
PQPTELRYS

SEQ ID NO: 35159 - protein, 9 aa, Dengue virus
QPTELRYSW

SEQ ID NO: 35160 - protein, 9 aa, Dengue virus
PTELRYSWK

SEQ ID NO: 35161 - protein, 9 aa, Dengue virus
TELKYSWKA

SEQ ID NO: 35162 - protein, 9 aa, Dengue virus
ELKYSWKAW

SEQ ID NO: 35163 - protein, 9 aa, Dengue virus
LKYSWKAWG

SEQ ID NO: 35164 - protein, 9 aa, Dengue virus
KYSWKAWGK

SEQ ID NO: 35165 - protein, 9 aa, Dengue virus
YSWKAWGKA

SEQ ID NO: 35166 - protein, 9 aa, Dengue virus
SWKAWGKAK

SEQ ID NO: 35167 - protein, 9 aa, Dengue virus
WKAWGKAKM

SEQ ID NO: 35168 - protein, 9 aa, Dengue virus
KAWGKAKML

SEQ ID NO: 35169 - protein, 9 aa, Dengue virus
WGKAKVLST

SEQ ID NO: 35170 - protein, 9 aa, Dengue virus
GKAKVLSTE

SEQ ID NO: 35171 - protein, 9 aa, Dengue virus
YNQTFLIDG

SEQ ID NO: 35172 - protein, 9 aa, Dengue virus
NHTFLIDGP

SEQ ID NO: 35173 - protein, 9 aa, Dengue virus
HTFLIDGPE

SEQ ID NO: 35174 - protein, 9 aa, Dengue virus
FLIDGPETT

SEQ ID NO: 35175 - protein, 9 aa, Dengue virus
LIDGPETTE

SEQ ID NO: 35176 - protein, 9 aa, Dengue virus
IDGPETTEC

SEQ ID NO: 35177 - protein, 9 aa, Dengue virus
DGPETTECP

SEQ ID NO: 35178 - protein, 9 aa, Dengue virus
GPETTECPN

SEQ ID NO: 35179 - protein, 9 aa, Dengue virus
TTECPNTNR

SEQ ID NO: 35180 - protein, 9 aa, Dengue virus
TECPNTNRA

SEQ ID NO: 35181 - protein, 9 aa, Dengue virus
ECPNSNRAW

SEQ ID NO: 35182 - protein, 9 aa, Dengue virus
CPNSNRAWN

SEQ ID NO: 35183 - protein, 9 aa, Dengue virus
PNSNRAWNS

SEQ ID NO: 35184 - protein, 9 aa, Dengue virus
NSNRAWNSL

SEQ ID NO: 35185 - protein, 9 aa, Dengue virus
SNRAWNSLE

SEQ ID NO: 35186 - protein, 9 aa, Dengue virus
EVEDYGFGI

SEQ ID NO: 35187 - protein, 9 aa, Dengue virus
VEDYGFGIF

SEQ ID NO: 35188 - protein, 9 aa, Dengue virus
EDYGFGVFS

SEQ ID NO: 35189 - protein, 9 aa, Dengue virus
DYGFGVFST

SEQ ID NO: 35190 - protein, 9 aa, Dengue virus
YGFGVFSTN

SEQ ID NO: 35191 - protein, 9 aa, Dengue virus
GFGVFSTNI

SEQ ID NO: 35192 - protein, 9 aa, Dengue virus
FGVFSTNIW

SEQ ID NO: 35193 - protein, 9 aa, Dengue virus
GVFSTNIWL

SEQ ID NO: 35194 - protein, 9 aa, Dengue virus
VFSTNIWLK

SEQ ID NO: 35195 - protein, 9 aa, Dengue virus
FSTNIWLKL

SEQ ID NO: 35196 - protein, 9 aa, Dengue virus
TTNIWLKLK

SEQ ID NO: 35197 - protein, 9 aa, Dengue virus
TNIWLKLKE

SEQ ID NO: 35198 - protein, 9 aa, Dengue virus
NIWLKLKEK

SEQ ID NO: 35199 - protein, 9 aa, Dengue virus
IWLKLKEKQ

SEQ ID NO: 35200 - protein, 9 aa, Dengue virus
WLKLKEKQD

SEQ ID NO: 35201 - protein, 9 aa, Dengue virus
ICDSKLMSA

SEQ ID NO: 35202 - protein, 9 aa, Dengue virus
DSKLMSAAV

SEQ ID NO: 35203 - protein, 9 aa, Dengue virus
SKLMSAAVK

SEQ ID NO: 35204 - protein, 9 aa, Dengue virus
KLMSAAVKD

SEQ ID NO: 35205 - protein, 9 aa, Dengue virus
LMSAAVKDD

SEQ ID NO: 35206 - protein, 9 aa, Dengue virus
MSAAVKDDR

SEQ ID NO: 35207 - protein, 9 aa, Dengue virus
SAAVKDDRA

SEQ ID NO: 35208 - protein, 9 aa, Dengue virus
AAVKDDRAV

SEQ ID NO: 35209 - protein, 9 aa, Dengue virus
AVKDDRAVH

SEQ ID NO: 35210 - protein, 9 aa, Dengue virus
VKDDRAVHA

SEQ ID NO: 35211 - protein, 9 aa, Dengue virus
KDDRAVHAD

SEQ ID NO: 35212 - protein, 9 aa, Dengue virus
DDRAVHADM

SEQ ID NO: 35213 - protein, 9 aa, Dengue virus
DRAVHADMG

SEQ ID NO: 35214 - protein, 9 aa, Dengue virus
DMGYWIESR

SEQ ID NO: 35215 - protein, 9 aa, Dengue virus
MGYWIESRL

SEQ ID NO: 35216 - protein, 9 aa, Dengue virus
GYWIESRLN

SEQ ID NO: 35217 - protein, 9 aa, Dengue virus
YWIESRLND

SEQ ID NO: 35218 - protein, 9 aa, Dengue virus
WIESRLNDT

SEQ ID NO: 35219 - protein, 9 aa, Dengue virus
IESRLNDTW

SEQ ID NO: 35220 - protein, 9 aa, Dengue virus
ESRLNDTWK

SEQ ID NO: 35221 - protein, 9 aa, Dengue virus
SALNDTWKI

SEQ ID NO: 35222 - protein, 9 aa, Dengue virus
ALNDTWKIE

SEQ ID NO: 35223 - protein, 9 aa, Dengue virus
LNDTWKIEK

SEQ ID NO: 35224 - protein, 9 aa, Dengue virus
NDTWKIEKA

SEQ ID NO: 35225 - protein, 9 aa, Dengue virus
DTWKIEKAS

SEQ ID NO: 35226 - protein, 9 aa, Dengue virus
TWKIEKASF

SEQ ID NO: 35227 - protein, 9 aa, Dengue virus
WKIEKASFI

SEQ ID NO: 35228 - protein, 9 aa, Dengue virus
KIEKASFIE

SEQ ID NO: 35229 - protein, 9 aa, Dengue virus
IEKASFIEV

SEQ ID NO: 35230 - protein, 9 aa, Dengue virus
EKASFIEIK

SEQ ID NO: 35231 - protein, 9 aa, Dengue virus
KASFIEVKN

SEQ ID NO: 35232 - protein, 9 aa, Dengue virus
ASFIEVKNC

SEQ ID NO: 35233 - protein, 9 aa, Dengue virus
SFIEVKNCH

SEQ ID NO: 35234 - protein, 9 aa, Dengue virus
FIEVKNCHW

SEQ ID NO: 35235 - protein, 9 aa, Dengue virus
IEVKNCHWP

SEQ ID NO: 35236 - protein, 9 aa, Dengue virus
EVKNCHWPK

SEQ ID NO: 35237 - protein, 9 aa, Dengue virus
VKNCHWPKS

SEQ ID NO: 35238 - protein, 9 aa, Dengue virus
KNCHWPKSH

SEQ ID NO: 35239 - protein, 9 aa, Dengue virus
NCHWPKSHT

SEQ ID NO: 35240 - protein, 9 aa, Dengue virus
CYWPRSHTL

SEQ ID NO: 35241 - protein, 9 aa, Dengue virus
YWPRSHTLW

SEQ ID NO: 35242 - protein, 9 aa, Dengue virus
WPRSHTLWS

SEQ ID NO: 35243 - protein, 9 aa, Dengue virus
PRSHTLWSN

SEQ ID NO: 35244 - protein, 9 aa, Dengue virus
RSHTLWSNG

SEQ ID NO: 35245 - protein, 9 aa, Dengue virus
NGVLESEMV

SEQ ID NO: 35246 - protein, 9 aa, Dengue virus
GVLESEMVI

SEQ ID NO: 35247 - protein, 9 aa, Dengue virus
VLESEMVIP

SEQ ID NO: 35248 - protein, 9 aa, Dengue virus
LESEMVIPK

SEQ ID NO: 35249 - protein, 9 aa, Dengue virus
ESEMIIPKS

SEQ ID NO: 35250 - protein, 9 aa, Dengue virus
IPKNLAGPV

SEQ ID NO: 35251 - protein, 9 aa, Dengue virus
PKNLAGPVS

SEQ ID NO: 35252 - protein, 9 aa, Dengue virus
KNLAGPVSQ

SEQ ID NO: 35253 - protein, 9 aa, Dengue virus
NLAGPVSQH

SEQ ID NO: 35254 - protein, 9 aa, Dengue virus
LAGPVSQHN

SEQ ID NO: 35255 - protein, 9 aa, Dengue virus
AGPVSQHNN

SEQ ID NO: 35256 - protein, 9 aa, Dengue virus
GPVSQHNNR

SEQ ID NO: 35257 - protein, 9 aa, Dengue virus
PVSQHNNRP

SEQ ID NO: 35258 - protein, 9 aa, Dengue virus
VSQHNNRPG

SEQ ID NO: 35259 - protein, 9 aa, Dengue virus
SQHNNRPGY

SEQ ID NO: 35260 - protein, 9 aa, Dengue virus
QHNYRPGYY

SEQ ID NO: 35261 - protein, 9 aa, Dengue virus
HNYRPGYYT

SEQ ID NO: 35262 - protein, 9 aa, Dengue virus
NYRPGYYTQ

SEQ ID NO: 35263 - protein, 9 aa, Dengue virus
RPGYHTQIA

SEQ ID NO: 35264 - protein, 9 aa, Dengue virus
PGYHTQIAG

SEQ ID NO: 35265 - protein, 9 aa, Dengue virus
GYHTQIAGP

SEQ ID NO: 35266 - protein, 9 aa, Dengue virus
YHTQIAGPW

SEQ ID NO: 35267 - protein, 9 aa, Dengue virus
HTQIAGPWH

SEQ ID NO: 35268 - protein, 9 aa, Dengue virus
TQIAGPWHL

SEQ ID NO: 35269 - protein, 9 aa, Dengue virus
QIAGPWHLG

SEQ ID NO: 35270 - protein, 9 aa, Dengue virus
IAGPWHLGK

SEQ ID NO: 35271 - protein, 9 aa, Dengue virus
AGPWHLGRL

SEQ ID NO: 35272 - protein, 9 aa, Dengue virus
GPWHLGRLE

SEQ ID NO: 35273 - protein, 9 aa, Dengue virus
PWHLGRLEM

SEQ ID NO: 35274 - protein, 9 aa, Dengue virus
WHLGRLEMD

SEQ ID NO: 35275 - protein, 9 aa, Dengue virus
HLGRLEMDF

SEQ ID NO: 35276 - protein, 9 aa, Dengue virus
LGRLEMDFD

SEQ ID NO: 35277 - protein, 9 aa, Dengue virus
GKLEMDFDL

SEQ ID NO: 35278 - protein, 9 aa, Dengue virus
KLEMDFDLC

SEQ ID NO: 35279 - protein, 9 aa, Dengue virus
LEMDFDFCD

SEQ ID NO: 35280 - protein, 9 aa, Dengue virus
EMDFDFCDG

SEQ ID NO: 35281 - protein, 9 aa, Dengue virus
MDFDFCDGT

SEQ ID NO: 35282 - protein, 9 aa, Dengue virus
DFDFCDGTT

SEQ ID NO: 35283 - protein, 9 aa, Dengue virus
FDFCDGTTV

SEQ ID NO: 35284 - protein, 9 aa, Dengue virus
FCDGTTVIV

SEQ ID NO: 35285 - protein, 9 aa, Dengue virus
CDGTTVIVT

SEQ ID NO: 35286 - protein, 9 aa, Dengue virus
DGTTVIVTE

SEQ ID NO: 35287 - protein, 9 aa, Dengue virus
GTTVIVTED

SEQ ID NO: 35288 - protein, 9 aa, Dengue virus
TTVIVTEDC

SEQ ID NO: 35289 - protein, 9 aa, Dengue virus
TVIVTEDCG

SEQ ID NO: 35290 - protein, 9 aa, Dengue virus
VIVTEDCGN

SEQ ID NO: 35291 - protein, 9 aa, Dengue virus
IVTEDCGNR

SEQ ID NO: 35292 - protein, 9 aa, Dengue virus
VTEECGNRG

SEQ ID NO: 35293 - protein, 9 aa, Dengue virus
TEECGNRGP

SEQ ID NO: 35294 - protein, 9 aa, Dengue virus
EECGNRGPS

SEQ ID NO: 35295 - protein, 9 aa, Dengue virus
ECGNRGPSL

SEQ ID NO: 35296 - protein, 9 aa, Dengue virus
MEIRPLKER

SEQ ID NO: 35297 - protein, 9 aa, Dengue virus
EIRPLKERE

SEQ ID NO: 35298 - protein, 9 aa, Dengue virus
IRPLKEREE

SEQ ID NO: 35299 - protein, 9 aa, Dengue virus
RPLKEREEN

SEQ ID NO: 35300 - protein, 9 aa, Dengue virus
PLKEREENL

SEQ ID NO: 35301 - protein, 9 aa, Dengue virus
LKEREENLV

SEQ ID NO: 35302 - protein, 9 aa, Dengue virus
KEKEENLVS

SEQ ID NO: 35303 - protein, 9 aa, Dengue virus
EKEENLVSS

SEQ ID NO: 35304 - protein, 9 aa, Dengue virus
KEENLVSSL

SEQ ID NO: 35305 - protein, 9 aa, Dengue virus
EENLVSSLV

SEQ ID NO: 35306 - protein, 9 aa, Dengue virus
ENLVSSLVT

SEQ ID NO: 35307 - protein, 9 aa, Dengue virus
NLVSSLVTA

SEQ ID NO: 35308 - protein, 9 aa, Dengue virus
LVSSLVTAG

SEQ ID NO: 35309 - protein, 9 aa, Dengue virus
VSSLVTAGH

SEQ ID NO: 35310 - protein, 9 aa, Dengue virus
SSLVTAGHG

SEQ ID NO: 35311 - protein, 9 aa, Dengue virus
SLVTAGQGQ

SEQ ID NO: 35312 - protein, 9 aa, Dengue virus
LVTAGHGQV

SEQ ID NO: 35313 - protein, 9 aa, Dengue virus
VTAGHGQVD

SEQ ID NO: 35314 - protein, 9 aa, Dengue virus
TAGHGQVDN

SEQ ID NO: 35315 - protein, 9 aa, Dengue virus
AGHGQVDNF

SEQ ID NO: 35316 - protein, 9 aa, Dengue virus
GHGQVDNFS

SEQ ID NO: 35317 - protein, 9 aa, Dengue virus
HGQVDNFSL

SEQ ID NO: 35318 - protein, 9 aa, Dengue virus
GQVDNFSLG

SEQ ID NO: 35319 - protein, 9 aa, Dengue virus
QVDNFSLGV

SEQ ID NO: 35320 - protein, 9 aa, Dengue virus
VDNFSLGVL

SEQ ID NO: 35321 - protein, 9 aa, Dengue virus
DNFSLGILG

SEQ ID NO: 35322 - protein, 9 aa, Dengue virus
NFSLGILGM

SEQ ID NO: 35323 - protein, 9 aa, Dengue virus
FSLGILGMA

SEQ ID NO: 35324 - protein, 9 aa, Dengue virus
SLGILGMAL

SEQ ID NO: 35325 - protein, 9 aa, Dengue virus
LGILGMALF

SEQ ID NO: 35326 - protein, 9 aa, Dengue virus
GILGMALFL

SEQ ID NO: 35327 - protein, 9 aa, Dengue virus
ILGMALFLE

SEQ ID NO: 35328 - protein, 9 aa, Dengue virus
LGMALLLEE

SEQ ID NO: 35329 - protein, 9 aa, Dengue virus
GMALLLEEM

SEQ ID NO: 35330 - protein, 9 aa, Dengue virus
MALLLEEML

SEQ ID NO: 35331 - protein, 9 aa, Dengue virus
ALLLEEMLR

SEQ ID NO: 35332 - protein, 9 aa, Dengue virus
LLLEEMLRT

SEQ ID NO: 35333 - protein, 9 aa, Dengue virus
LLEEMLRTR

SEQ ID NO: 35334 - protein, 9 aa, Dengue virus
LEEMLRTRI

SEQ ID NO: 35335 - protein, 9 aa, Dengue virus
EEMLRTRIG

SEQ ID NO: 35336 - protein, 9 aa, Dengue virus
EMLRTRIGT

SEQ ID NO: 35337 - protein, 9 aa, Dengue virus
MLRTRIGTK

SEQ ID NO: 35338 - protein, 9 aa, Dengue virus
LRTRIGTKH

SEQ ID NO: 35339 - protein, 9 aa, Dengue virus
RTRIGTKHA

SEQ ID NO: 35340 - protein, 9 aa, Dengue virus
SFMTLITGN

SEQ ID NO: 35341 - protein, 9 aa, Dengue virus
FMTLITGNM

SEQ ID NO: 35342 - protein, 9 aa, Dengue virus
MTLITGNMS

SEQ ID NO: 35343 - protein, 9 aa, Dengue virus
TLITGNLSF

SEQ ID NO: 35344 - protein, 9 aa, Dengue virus
LITGNMSFK

SEQ ID NO: 35345 - protein, 9 aa, Dengue virus
ITGNMSFKD

SEQ ID NO: 35346 - protein, 9 aa, Dengue virus
TGNMSFKDL

SEQ ID NO: 35347 - protein, 9 aa, Dengue virus
GNMSFKDLG

SEQ ID NO: 35348 - protein, 9 aa, Dengue virus
NMSFKDLGR

SEQ ID NO: 35349 - protein, 9 aa, Dengue virus
MSFKDLGRV

SEQ ID NO: 35350 - protein, 9 aa, Dengue virus
SFKDLGRVV

SEQ ID NO: 35351 - protein, 9 aa, Dengue virus
KDLGRVVVM

SEQ ID NO: 35352 - protein, 9 aa, Dengue virus
DLGRVVVMV

SEQ ID NO: 35353 - protein, 9 aa, Dengue virus
LGRVVVMVG

SEQ ID NO: 35354 - protein, 9 aa, Dengue virus
GRVVVMVGA

SEQ ID NO: 35355 - protein, 9 aa, Dengue virus
ADDIGMGVT

SEQ ID NO: 35356 - protein, 9 aa, Dengue virus
DEMGMGVTY

SEQ ID NO: 35357 - protein, 9 aa, Dengue virus
EMGMGVTYL

SEQ ID NO: 35358 - protein, 9 aa, Dengue virus
MGMGVTYLA

SEQ ID NO: 35359 - protein, 9 aa, Dengue virus
GMGITYLAL

SEQ ID NO: 35360 - protein, 9 aa, Dengue virus
MGITYLALL

SEQ ID NO: 35361 - protein, 9 aa, Dengue virus
GITYLALLA

SEQ ID NO: 35362 - protein, 9 aa, Dengue virus
ITYLALLAA

SEQ ID NO: 35363 - protein, 9 aa, Dengue virus
YLALLAAFR

SEQ ID NO: 35364 - protein, 9 aa, Dengue virus
LALLAAFRV

SEQ ID NO: 35365 - protein, 9 aa, Dengue virus
ALLAAFRVR

SEQ ID NO: 35366 - protein, 9 aa, Dengue virus
LLAAFRVRP

SEQ ID NO: 35367 - protein, 9 aa, Dengue virus
LAAFRVRPT

SEQ ID NO: 35368 - protein, 9 aa, Dengue virus
AAFRVRPTF

SEQ ID NO: 35369 - protein, 9 aa, Dengue virus
AFRVRPTFA

SEQ ID NO: 35370 - protein, 9 aa, Dengue virus
FRVRPTFAV

SEQ ID NO: 35371 - protein, 9 aa, Dengue virus
RVRPTFAVG

SEQ ID NO: 35372 - protein, 9 aa, Dengue virus
VRPTFAVGL

SEQ ID NO: 35373 - protein, 9 aa, Dengue virus
RPTFAVGLL

SEQ ID NO: 35374 - protein, 9 aa, Dengue virus
PTFAVGLLL

SEQ ID NO: 35375 - protein, 9 aa, Dengue virus
TFAVGLLLR

SEQ ID NO: 35376 - protein, 9 aa, Dengue virus
FAVGLLLRK

SEQ ID NO: 35377 - protein, 9 aa, Dengue virus
AVGLLLRKL

SEQ ID NO: 35378 - protein, 9 aa, Dengue virus
VGLLLRKLT

SEQ ID NO: 35379 - protein, 9 aa, Dengue virus
GLFLRKLTS

SEQ ID NO: 35380 - protein, 9 aa, Dengue virus
LFLRKLTSK

SEQ ID NO: 35381 - protein, 9 aa, Dengue virus
FLRKLTSKE

SEQ ID NO: 35382 - protein, 9 aa, Dengue virus
RKLTSKELL

SEQ ID NO: 35383 - protein, 9 aa, Dengue virus
KLTSKELLM

SEQ ID NO: 35384 - protein, 9 aa, Dengue virus
LTSKELMMT

SEQ ID NO: 35385 - protein, 9 aa, Dengue virus
TSKELMMTT

SEQ ID NO: 35386 - protein, 9 aa, Dengue virus
SKELMMTTI

SEQ ID NO: 35387 - protein, 9 aa, Dengue virus
KELMMTTIG

SEQ ID NO: 35388 - protein, 9 aa, Dengue virus
ELMMTTIGI

SEQ ID NO: 35389 - protein, 9 aa, Dengue virus
TIGIVLLSQ

SEQ ID NO: 35390 - protein, 9 aa, Dengue virus
IGIVLLSQS

SEQ ID NO: 35391 - protein, 9 aa, Dengue virus
PETVLELTD

SEQ ID NO: 35392 - protein, 9 aa, Dengue virus
ETVLELTDA

SEQ ID NO: 35393 - protein, 9 aa, Dengue virus
TVLELTDAL

SEQ ID NO: 35394 - protein, 9 aa, Dengue virus
VLELTDALA

SEQ ID NO: 35395 - protein, 9 aa, Dengue virus
LELTDAIAL

SEQ ID NO: 35396 - protein, 9 aa, Dengue virus
ELTDAIALG

SEQ ID NO: 35397 - protein, 9 aa, Dengue virus
LTDAIALGI

SEQ ID NO: 35398 - protein, 9 aa, Dengue virus
TDAIALGIM

SEQ ID NO: 35399 - protein, 9 aa, Dengue virus
DALALGMMA

SEQ ID NO: 35400 - protein, 9 aa, Dengue virus
ALALGMMAL

SEQ ID NO: 35401 - protein, 9 aa, Dengue virus
LALGMMALK

SEQ ID NO: 35402 - protein, 9 aa, Dengue virus
VRDMEKYQL

SEQ ID NO: 35403 - protein, 9 aa, Dengue virus
DMEKYQLAV

SEQ ID NO: 35404 - protein, 9 aa, Dengue virus
LEKYQLAVT

SEQ ID NO: 35405 - protein, 9 aa, Dengue virus
EKYQLAVTV

SEQ ID NO: 35406 - protein, 9 aa, Dengue virus
KYQLAVTVM

SEQ ID NO: 35407 - protein, 9 aa, Dengue virus
YQLAVTVMA

SEQ ID NO: 35408 - protein, 9 aa, Dengue virus
ILCVPNAVI

SEQ ID NO: 35409 - protein, 9 aa, Dengue virus
LCVPNAVIL

SEQ ID NO: 35410 - protein, 9 aa, Dengue virus
CVPNAVILR

SEQ ID NO: 35411 - protein, 9 aa, Dengue virus
VPNAVILRN

SEQ ID NO: 35412 - protein, 9 aa, Dengue virus
PNAVILRNA

SEQ ID NO: 35413 - protein, 9 aa, Dengue virus
NAVILRNAW

SEQ ID NO: 35414 - protein, 9 aa, Dengue virus
AWKVSCTTL

SEQ ID NO: 35415 - protein, 9 aa, Dengue virus
WKVSCTTLA

SEQ ID NO: 35416 - protein, 9 aa, Dengue virus
CTILAVVSV

SEQ ID NO: 35417 - protein, 9 aa, Dengue virus
ILAVVSVSP

SEQ ID NO: 35418 - protein, 9 aa, Dengue virus
LAVVSVSPL

SEQ ID NO: 35419 - protein, 9 aa, Dengue virus
VSVSPLFLT

SEQ ID NO: 35420 - protein, 9 aa, Dengue virus
SVSPLFLTS

SEQ ID NO: 35421 - protein, 9 aa, Dengue virus
VSPLFLTSS

SEQ ID NO: 35422 - protein, 9 aa, Dengue virus
SPLFLTSSQ

SEQ ID NO: 35423 - protein, 9 aa, Dengue virus
PLFLTSSQQ

SEQ ID NO: 35424 - protein, 9 aa, Dengue virus
LFLTSSQQK

SEQ ID NO: 35425 - protein, 9 aa, Dengue virus
LTSSQQKTD

SEQ ID NO: 35426 - protein, 9 aa, Dengue virus
TSSQQKTDW

SEQ ID NO: 35427 - protein, 9 aa, Dengue virus
SSQQKTDWI

SEQ ID NO: 35428 - protein, 9 aa, Dengue virus
SQQKTDWIP

SEQ ID NO: 35429 - protein, 9 aa, Dengue virus
QQKTDWIPL

SEQ ID NO: 35430 - protein, 9 aa, Dengue virus
QKTDWIPLA

SEQ ID NO: 35431 - protein, 9 aa, Dengue virus
KTDWIPLAL

SEQ ID NO: 35432 - protein, 9 aa, Dengue virus
TDWIPLALT

SEQ ID NO: 35433 - protein, 9 aa, Dengue virus
DWIPLVLTI

SEQ ID NO: 35434 - protein, 9 aa, Dengue virus
WIPLVLTIK

SEQ ID NO: 35435 - protein, 9 aa, Dengue virus
IPLVLTIKG

SEQ ID NO: 35436 - protein, 9 aa, Dengue virus
PLVLTIKGL

SEQ ID NO: 35437 - protein, 9 aa, Dengue virus
LVLTIKGLN

SEQ ID NO: 35438 - protein, 9 aa, Dengue virus
VLTIKGLNP

SEQ ID NO: 35439 - protein, 9 aa, Dengue virus
LTIKGLSPT

SEQ ID NO: 35440 - protein, 9 aa, Dengue virus
TIKGLSPTA

SEQ ID NO: 35441 - protein, 9 aa, Dengue virus
IFLTTLSRP

SEQ ID NO: 35442 - protein, 9 aa, Dengue virus
FLTTLSRTN

SEQ ID NO: 35443 - protein, 9 aa, Dengue virus
LTTLSRTNK

SEQ ID NO: 35444 - protein, 9 aa, Dengue virus
TTLSRTNKK

SEQ ID NO: 35445 - protein, 9 aa, Dengue virus
TLSRTNKKR

SEQ ID NO: 35446 - protein, 9 aa, Dengue virus
LSRTNKKRS

SEQ ID NO: 35447 - protein, 9 aa, Dengue virus
SRTNKKRSW

SEQ ID NO: 35448 - protein, 9 aa, Dengue virus
RTNKKRSWP

SEQ ID NO: 35449 - protein, 9 aa, Dengue virus
TNKKRSWPL

SEQ ID NO: 35450 - protein, 9 aa, Dengue virus
NKKRSWPLN

SEQ ID NO: 35451 - protein, 9 aa, Dengue virus
KTRSWPLNE

SEQ ID NO: 35452 - protein, 9 aa, Dengue virus
TRSWPLNEA

SEQ ID NO: 35453 - protein, 9 aa, Dengue virus
RSWPLNEAV

SEQ ID NO: 35454 - protein, 9 aa, Dengue virus
SWPLNEAVM

SEQ ID NO: 35455 - protein, 9 aa, Dengue virus
WPLNEAVMA

SEQ ID NO: 35456 - protein, 9 aa, Dengue virus
PLNEAVMAV

SEQ ID NO: 35457 - protein, 9 aa, Dengue virus
LNEAVMAVG

SEQ ID NO: 35458 - protein, 9 aa, Dengue virus
NEAVMAVGM

SEQ ID NO: 35459 - protein, 9 aa, Dengue virus
EAVMAVGMV

SEQ ID NO: 35460 - protein, 9 aa, Dengue virus
AVMAVGMVS

SEQ ID NO: 35461 - protein, 9 aa, Dengue virus
VMAVGMVSI

SEQ ID NO: 35462 - protein, 9 aa, Dengue virus
RSADLELEK

SEQ ID NO: 35463 - protein, 9 aa, Dengue virus
SADLELEKA

SEQ ID NO: 35464 - protein, 9 aa, Dengue virus
ADLELERAT

SEQ ID NO: 35465 - protein, 9 aa, Dengue virus
DLELERATD

SEQ ID NO: 35466 - protein, 9 aa, Dengue virus
LELERATDV

SEQ ID NO: 35467 - protein, 9 aa, Dengue virus
VRWEEQAEI

SEQ ID NO: 35468 - protein, 9 aa, Dengue virus
RWEEQAEIS

SEQ ID NO: 35469 - protein, 9 aa, Dengue virus
WEEQAEISG

SEQ ID NO: 35470 - protein, 9 aa, Dengue virus
EEQAEISGS

SEQ ID NO: 35471 - protein, 9 aa, Dengue virus
EQAEISGSS

SEQ ID NO: 35472 - protein, 9 aa, Dengue virus
SGSSPILSV

SEQ ID NO: 35473 - protein, 9 aa, Dengue virus
GSSPILSVT

SEQ ID NO: 35474 - protein, 9 aa, Dengue virus
SSPILSVTI

SEQ ID NO: 35475 - protein, 9 aa, Dengue virus
SPILSITIA

SEQ ID NO: 35476 - protein, 9 aa, Dengue virus
PILSITIAE

SEQ ID NO: 35477 - protein, 9 aa, Dengue virus
ILSITIAED

SEQ ID NO: 35478 - protein, 9 aa, Dengue virus
LSITIAEDG

SEQ ID NO: 35479 - protein, 9 aa, Dengue virus
SITIAEDGS

SEQ ID NO: 35480 - protein, 9 aa, Dengue virus
ITIAEDGSM

SEQ ID NO: 35481 - protein, 9 aa, Dengue virus
TIAEDGSMS

SEQ ID NO: 35482 - protein, 9 aa, Dengue virus
IAEDGSMSI

SEQ ID NO: 35483 - protein, 9 aa, Dengue virus
AEDGSMSIK

SEQ ID NO: 35484 - protein, 9 aa, Dengue virus
SIKNEEEEH

SEQ ID NO: 35485 - protein, 9 aa, Dengue virus
IKNEEEEHT

SEQ ID NO: 35486 - protein, 9 aa, Dengue virus
KNEEEEHTL

SEQ ID NO: 35487 - protein, 9 aa, Dengue virus
NEEEEHTLT

SEQ ID NO: 35488 - protein, 9 aa, Dengue virus
EEEEHTLTI

SEQ ID NO: 35489 - protein, 9 aa, Dengue virus
EEEHTLTIL

SEQ ID NO: 35490 - protein, 9 aa, Dengue virus
EEHTLTILI

SEQ ID NO: 35491 - protein, 9 aa, Dengue virus
EHTLTILIR

SEQ ID NO: 35492 - protein, 9 aa, Dengue virus
HTLTILIRT

SEQ ID NO: 35493 - protein, 9 aa, Dengue virus
ILTILIRTG

SEQ ID NO: 35494 - protein, 9 aa, Dengue virus
TGLLVISGV

SEQ ID NO: 35495 - protein, 9 aa, Dengue virus
GLLVISGVF

SEQ ID NO: 35496 - protein, 9 aa, Dengue virus
LLVISGVFP

SEQ ID NO: 35497 - protein, 9 aa, Dengue virus
LVISGLFPV

SEQ ID NO: 35498 - protein, 9 aa, Dengue virus
VISGLFPVS

SEQ ID NO: 35499 - protein, 9 aa, Dengue virus
ISGLFPVSI

SEQ ID NO: 35500 - protein, 9 aa, Dengue virus
SGLFPVSIP

SEQ ID NO: 35501 - protein, 9 aa, Dengue virus
GLFPVSIPI

SEQ ID NO: 35502 - protein, 9 aa, Dengue virus
LFPVSIPIT

SEQ ID NO: 35503 - protein, 9 aa, Dengue virus
FPISIPITA

SEQ ID NO: 35504 - protein, 9 aa, Dengue virus
PISIPITAA

SEQ ID NO: 35505 - protein, 9 aa, Dengue virus
ISIPITAAA

SEQ ID NO: 35506 - protein, 9 aa, Dengue virus
SMPITAAAW

SEQ ID NO: 35507 - protein, 9 aa, Dengue virus
MPITAAAWY

SEQ ID NO: 35508 - protein, 9 aa, Dengue virus
AAAWYLWET

SEQ ID NO: 35509 - protein, 9 aa, Dengue virus
AAWYLWETK

SEQ ID NO: 35510 - protein, 9 aa, Dengue virus
AWYLWETKK

SEQ ID NO: 35511 - protein, 9 aa, Dengue virus
WYLWETKKQ

SEQ ID NO: 35512 - protein, 9 aa, Dengue virus
YLWETKKQR

SEQ ID NO: 35513 - protein, 9 aa, Dengue virus
LWETKKQRA

SEQ ID NO: 35514 - protein, 9 aa, Dengue virus
WETKKQRAG

SEQ ID NO: 35515 - protein, 9 aa, Dengue virus
ETKKQRAGV

SEQ ID NO: 35516 - protein, 9 aa, Dengue virus
TKKQRAGVL

SEQ ID NO: 35517 - protein, 9 aa, Dengue virus
WDVPSPPPM

SEQ ID NO: 35518 - protein, 9 aa, Dengue virus
DVPSPPPMG

SEQ ID NO: 35519 - protein, 9 aa, Dengue virus
EKAELEDGA

SEQ ID NO: 35520 - protein, 9 aa, Dengue virus
RAELEDGAY

SEQ ID NO: 35521 - protein, 9 aa, Dengue virus
DGAYRIKQK

SEQ ID NO: 35522 - protein, 9 aa, Dengue virus
GAYRIKQKG

SEQ ID NO: 35523 - protein, 9 aa, Dengue virus
AYRIKQKGI

SEQ ID NO: 35524 - protein, 9 aa, Dengue virus
YRIKQRGIL

SEQ ID NO: 35525 - protein, 9 aa, Dengue virus
RIKQRGILG

SEQ ID NO: 35526 - protein, 9 aa, Dengue virus
IKQRGILGY

SEQ ID NO: 35527 - protein, 9 aa, Dengue virus
KQRGILGYS

SEQ ID NO: 35528 - protein, 9 aa, Dengue virus
QRGILGYSQ

SEQ ID NO: 35529 - protein, 9 aa, Dengue virus
RGILGYSQI

SEQ ID NO: 35530 - protein, 9 aa, Dengue virus
GIFGYSQIG

SEQ ID NO: 35531 - protein, 9 aa, Dengue virus
IFGYSQIGA

SEQ ID NO: 35532 - protein, 9 aa, Dengue virus
FGYSQIGAG

SEQ ID NO: 35533 - protein, 9 aa, Dengue virus
HVTRGAVLV

SEQ ID NO: 35534 - protein, 9 aa, Dengue virus
VTRGAVLVH

SEQ ID NO: 35535 - protein, 9 aa, Dengue virus
TRGAVLMHK

SEQ ID NO: 35536 - protein, 9 aa, Dengue virus
RGAVLMHKG

SEQ ID NO: 35537 - protein, 9 aa, Dengue virus
GAVLMHKGK

SEQ ID NO: 35538 - protein, 9 aa, Dengue virus
AVLMHKGKR

SEQ ID NO: 35539 - protein, 9 aa, Dengue virus
VLMHKGKRI

SEQ ID NO: 35540 - protein, 9 aa, Dengue virus
LMHKGKRIE

SEQ ID NO: 35541 - protein, 9 aa, Dengue virus
MHKGKRIEP

SEQ ID NO: 35542 - protein, 9 aa, Dengue virus
HKGKRIEPS

SEQ ID NO: 35543 - protein, 9 aa, Dengue virus
KGKRIEPSW

SEQ ID NO: 35544 - protein, 9 aa, Dengue virus
IEPSWADVR

SEQ ID NO: 35545 - protein, 9 aa, Dengue virus
EPSWADVRK

SEQ ID NO: 35546 - protein, 9 aa, Dengue virus
PSWADVRKD

SEQ ID NO: 35547 - protein, 9 aa, Dengue virus
SWADVRKDL

SEQ ID NO: 35548 - protein, 9 aa, Dengue virus
WADVRKDLI

SEQ ID NO: 35549 - protein, 9 aa, Dengue virus
ADVRKDLIS

SEQ ID NO: 35550 - protein, 9 aa, Dengue virus
DVKKDLVSY

SEQ ID NO: 35551 - protein, 9 aa, Dengue virus
VRKDLISYG

SEQ ID NO: 35552 - protein, 9 aa, Dengue virus
RKDLISYGG

SEQ ID NO: 35553 - protein, 9 aa, Dengue virus
KDLVSYGGG

SEQ ID NO: 35554 - protein, 9 aa, Dengue virus
DLVSYGGGW

SEQ ID NO: 35555 - protein, 9 aa, Dengue virus
LVSYGGGWK

SEQ ID NO: 35556 - protein, 9 aa, Dengue virus
VSYGGGWKL

SEQ ID NO: 35557 - protein, 9 aa, Dengue virus
RAVQTKPGI

SEQ ID NO: 35558 - protein, 9 aa, Dengue virus
AVQTKPGIF

SEQ ID NO: 35559 - protein, 9 aa, Dengue virus
VQTKPGIFK

SEQ ID NO: 35560 - protein, 9 aa, Dengue virus
QTKPGIFKT

SEQ ID NO: 35561 - protein, 9 aa, Dengue virus
TKPGIFKTN

SEQ ID NO: 35562 - protein, 9 aa, Dengue virus
FKTNAGTIG

SEQ ID NO: 35563 - protein, 9 aa, Dengue virus
KTNAGTIGA

SEQ ID NO: 35564 - protein, 9 aa, Dengue virus
TNAGTIGAV

SEQ ID NO: 35565 - protein, 9 aa, Dengue virus
NAGTIGAVS

SEQ ID NO: 35566 - protein, 9 aa, Dengue virus
AGTIGAVSL

SEQ ID NO: 35567 - protein, 9 aa, Dengue virus
PGTSGSPII

SEQ ID NO: 35568 - protein, 9 aa, Dengue virus
GTSGSPIID

SEQ ID NO: 35569 - protein, 9 aa, Dengue virus
TSGSPIIDK

SEQ ID NO: 35570 - protein, 9 aa, Dengue virus
SGSPIIDKK

SEQ ID NO: 35571 - protein, 9 aa, Dengue virus
GSPIIDKKG

SEQ ID NO: 35572 - protein, 9 aa, Dengue virus
SPIIDKKGK

SEQ ID NO: 35573 - protein, 9 aa, Dengue virus
PIIDKKGKV

SEQ ID NO: 35574 - protein, 9 aa, Dengue virus
IIDKKGKVV

SEQ ID NO: 35575 - protein, 9 aa, Dengue virus
IDKKGKVVG

SEQ ID NO: 35576 - protein, 9 aa, Dengue virus
DKKGKVVGL

SEQ ID NO: 35577 - protein, 9 aa, Dengue virus
KKGKVVGLY

SEQ ID NO: 35578 - protein, 9 aa, Dengue virus
NGVVTRSGT

SEQ ID NO: 35579 - protein, 9 aa, Dengue virus
GVVTRSGTY

SEQ ID NO: 35580 - protein, 9 aa, Dengue virus
VVTRSGTYV

SEQ ID NO: 35581 - protein, 9 aa, Dengue virus
VTRSGTYVS

SEQ ID NO: 35582 - protein, 9 aa, Dengue virus
TRSGTYVSA

SEQ ID NO: 35583 - protein, 9 aa, Dengue virus
RSGTYVSAI

SEQ ID NO: 35584 - protein, 9 aa, Dengue virus
SGTYVSAIA

SEQ ID NO: 35585 - protein, 9 aa, Dengue virus
GTYVSAIAQ

SEQ ID NO: 35586 - protein, 9 aa, Dengue virus
TYVSAIAQT

SEQ ID NO: 35587 - protein, 9 aa, Dengue virus
YVSSIAQTE

SEQ ID NO: 35588 - protein, 9 aa, Dengue virus
VSSIAQTEK

SEQ ID NO: 35589 - protein, 9 aa, Dengue virus
SSIAQTEKS

SEQ ID NO: 35590 - protein, 9 aa, Dengue virus
SIAQTEKSV

SEQ ID NO: 35591 - protein, 9 aa, Dengue virus
IAQTEKSVE

SEQ ID NO: 35592 - protein, 9 aa, Dengue virus
IEDNPDIED

SEQ ID NO: 35593 - protein, 9 aa, Dengue virus
EDNPDIEDD

SEQ ID NO: 35594 - protein, 9 aa, Dengue virus
DNPDIEDDI

SEQ ID NO: 35595 - protein, 9 aa, Dengue virus
NPDIEDDIF

SEQ ID NO: 35596 - protein, 9 aa, Dengue virus
PDIEDDIFR

SEQ ID NO: 35597 - protein, 9 aa, Dengue virus
DIEDDIFRK

SEQ ID NO: 35598 - protein, 9 aa, Dengue virus
IEDDIFRKR

SEQ ID NO: 35599 - protein, 9 aa, Dengue virus
EDDIFRKRR

SEQ ID NO: 35600 - protein, 9 aa, Dengue virus
DDIFRKRRL

SEQ ID NO: 35601 - protein, 9 aa, Dengue virus
DIFRKRRLT

SEQ ID NO: 35602 - protein, 9 aa, Dengue virus
IFRKRRLTI

SEQ ID NO: 35603 - protein, 9 aa, Dengue virus
FRKRRLTIM

SEQ ID NO: 35604 - protein, 9 aa, Dengue virus
RKRRLTIMD

SEQ ID NO: 35605 - protein, 9 aa, Dengue virus
KRRLTIMDL

SEQ ID NO: 35606 - protein, 9 aa, Dengue virus
RRLTIMDLH

SEQ ID NO: 35607 - protein, 9 aa, Dengue virus
KLTIMDLHP

SEQ ID NO: 35608 - protein, 9 aa, Dengue virus
HPGAGKTKK

SEQ ID NO: 35609 - protein, 9 aa, Dengue virus
PGAGKTKKY

SEQ ID NO: 35610 - protein, 9 aa, Dengue virus
GAGKTKKYL

SEQ ID NO: 35611 - protein, 9 aa, Dengue virus
AGKTKKYLP

SEQ ID NO: 35612 - protein, 9 aa, Dengue virus
GKTKKYLPA

SEQ ID NO: 35613 - protein, 9 aa, Dengue virus
KTKKYLPAI

SEQ ID NO: 35614 - protein, 9 aa, Dengue virus
TKKYLPAIV

SEQ ID NO: 35615 - protein, 9 aa, Dengue virus
KKYLPAIVR

SEQ ID NO: 35616 - protein, 9 aa, Dengue virus
KYLPAIVRE

SEQ ID NO: 35617 - protein, 9 aa, Dengue virus
PAIVREAIR

SEQ ID NO: 35618 - protein, 9 aa, Dengue virus
AIVREAIRR

SEQ ID NO: 35619 - protein, 9 aa, Dengue virus
IVREAIRRG

SEQ ID NO: 35620 - protein, 9 aa, Dengue virus
VREAIRRGL

SEQ ID NO: 35621 - protein, 9 aa, Dengue virus
REAIRRGLR

SEQ ID NO: 35622 - protein, 9 aa, Dengue virus
EAIRRGLRT

SEQ ID NO: 35623 - protein, 9 aa, Dengue virus
AIRRGLRTL

SEQ ID NO: 35624 - protein, 9 aa, Dengue virus
IRRGLRTLI

SEQ ID NO: 35625 - protein, 9 aa, Dengue virus
RRGLRTLIL

SEQ ID NO: 35626 - protein, 9 aa, Dengue virus
GLPIRYQTT

SEQ ID NO: 35627 - protein, 9 aa, Dengue virus
LPIRYQTTA

SEQ ID NO: 35628 - protein, 9 aa, Dengue virus
PIRYQTTAI

SEQ ID NO: 35629 - protein, 9 aa, Dengue virus
IRYQTPAIK

SEQ ID NO: 35630 - protein, 9 aa, Dengue virus
RYQTPAIKT

SEQ ID NO: 35631 - protein, 9 aa, Dengue virus
YQTPAIKTE

SEQ ID NO: 35632 - protein, 9 aa, Dengue virus
QTPAIKTEH

SEQ ID NO: 35633 - protein, 9 aa, Dengue virus
TPAIKTEHT

SEQ ID NO: 35634 - protein, 9 aa, Dengue virus
PAIKTEHTG

SEQ ID NO: 35635 - protein, 9 aa, Dengue virus
AIKTEHTGR

SEQ ID NO: 35636 - protein, 9 aa, Dengue virus
IKTEHTGRE

SEQ ID NO: 35637 - protein, 9 aa, Dengue virus
KTEHTGREI

SEQ ID NO: 35638 - protein, 9 aa, Dengue virus
TEHTGREIV

SEQ ID NO: 35639 - protein, 9 aa, Dengue virus
FTMRLLSPI

SEQ ID NO: 35640 - protein, 9 aa, Dengue virus
TMRLLSPIR

SEQ ID NO: 35641 - protein, 9 aa, Dengue virus
MRLLSPIRV

SEQ ID NO: 35642 - protein, 9 aa, Dengue virus
RLLSPIRVP

SEQ ID NO: 35643 - protein, 9 aa, Dengue virus
LLSPIRVPN

SEQ ID NO: 35644 - protein, 9 aa, Dengue virus
LSPIRVPNY

SEQ ID NO: 35645 - protein, 9 aa, Dengue virus
SPIRVPNYN

SEQ ID NO: 35646 - protein, 9 aa, Dengue virus
PIRVPNYNL

SEQ ID NO: 35647 - protein, 9 aa, Dengue virus
IRVPNYNLI

SEQ ID NO: 35648 - protein, 9 aa, Dengue virus
FPQSNAPII

SEQ ID NO: 35649 - protein, 9 aa, Dengue virus
PQSNAPIID

SEQ ID NO: 35650 - protein, 9 aa, Dengue virus
QSNAPIIDE

SEQ ID NO: 35651 - protein, 9 aa, Dengue virus
SNAPIIDEE

SEQ ID NO: 35652 - protein, 9 aa, Dengue virus
NAPIIDEER

SEQ ID NO: 35653 - protein, 9 aa, Dengue virus
APIIDEERE

SEQ ID NO: 35654 - protein, 9 aa, Dengue virus
PIIDEEREI

SEQ ID NO: 35655 - protein, 9 aa, Dengue virus
IIDEEREIP

SEQ ID NO: 35656 - protein, 9 aa, Dengue virus
IDEEREIPE

SEQ ID NO: 35657 - protein, 9 aa, Dengue virus
REIPERSWS

SEQ ID NO: 35658 - protein, 9 aa, Dengue virus
EIPERSWSS

SEQ ID NO: 35659 - protein, 9 aa, Dengue virus
IPERSWSSG

SEQ ID NO: 35660 - protein, 9 aa, Dengue virus
PERSWSSGH

SEQ ID NO: 35661 - protein, 9 aa, Dengue virus
ERSWSSGHE

SEQ ID NO: 35662 - protein, 9 aa, Dengue virus
RSWSSGHEW

SEQ ID NO: 35663 - protein, 9 aa, Dengue virus
SWNSGHEWI

SEQ ID NO: 35664 - protein, 9 aa, Dengue virus
WNSGHEWIT

SEQ ID NO: 35665 - protein, 9 aa, Dengue virus
NSGHEWITN

SEQ ID NO: 35666 - protein, 9 aa, Dengue virus
SGHEWITNF

SEQ ID NO: 35667 - protein, 9 aa, Dengue virus
GHEWITNFK

SEQ ID NO: 35668 - protein, 9 aa, Dengue virus
HEWITNFKG

SEQ ID NO: 35669 - protein, 9 aa, Dengue virus
EWITNFKGK

SEQ ID NO: 35670 - protein, 9 aa, Dengue virus
WITNFKGKT

SEQ ID NO: 35671 - protein, 9 aa, Dengue virus
ITNFKGKTV

SEQ ID NO: 35672 - protein, 9 aa, Dengue virus
TNFKGKTVW

SEQ ID NO: 35673 - protein, 9 aa, Dengue virus
NFKGKTVWF

SEQ ID NO: 35674 - protein, 9 aa, Dengue virus
TVWFVPSIR

SEQ ID NO: 35675 - protein, 9 aa, Dengue virus
VWFVPSIKT

SEQ ID NO: 35676 - protein, 9 aa, Dengue virus
WFVPSIKTG

SEQ ID NO: 35677 - protein, 9 aa, Dengue virus
FVPSIKTGN

SEQ ID NO: 35678 - protein, 9 aa, Dengue virus
VPSIKTGND

SEQ ID NO: 35679 - protein, 9 aa, Dengue virus
PSIKTGNDI

SEQ ID NO: 35680 - protein, 9 aa, Dengue virus
SIKTGNDIA

SEQ ID NO: 35681 - protein, 9 aa, Dengue virus
IKTGNDIAA

SEQ ID NO: 35682 - protein, 9 aa, Dengue virus
KTGNDIAAC

SEQ ID NO: 35683 - protein, 9 aa, Dengue virus
TGNDIAACL

SEQ ID NO: 35684 - protein, 9 aa, Dengue virus
ACLRKNGKR

SEQ ID NO: 35685 - protein, 9 aa, Dengue virus
CLRKNGKRV

SEQ ID NO: 35686 - protein, 9 aa, Dengue virus
LRKNGKRVI

SEQ ID NO: 35687 - protein, 9 aa, Dengue virus
RKNGKRVIQ

SEQ ID NO: 35688 - protein, 9 aa, Dengue virus
KNGKRVIQL

SEQ ID NO: 35689 - protein, 9 aa, Dengue virus
NGKRVIQLS

SEQ ID NO: 35690 - protein, 9 aa, Dengue virus
GKRVIQLSR

SEQ ID NO: 35691 - protein, 9 aa, Dengue virus
KRVIQLSRK

SEQ ID NO: 35692 - protein, 9 aa, Dengue virus
RVIQLSRKT

SEQ ID NO: 35693 - protein, 9 aa, Dengue virus
QLSRKTFDT

SEQ ID NO: 35694 - protein, 9 aa, Dengue virus
LSRKTFDTE

SEQ ID NO: 35695 - protein, 9 aa, Dengue virus
SRKTFDTEY

SEQ ID NO: 35696 - protein, 9 aa, Dengue virus
RKTFDSEYI

SEQ ID NO: 35697 - protein, 9 aa, Dengue virus
KTFDSEYIK

SEQ ID NO: 35698 - protein, 9 aa, Dengue virus
TFDSEYIKT

SEQ ID NO: 35699 - protein, 9 aa, Dengue virus
FDSEYIKTR

SEQ ID NO: 35700 - protein, 9 aa, Dengue virus
KTRANDWDF

SEQ ID NO: 35701 - protein, 9 aa, Dengue virus
TRANDWDFV

SEQ ID NO: 35702 - protein, 9 aa, Dengue virus
RANDWDFVV

SEQ ID NO: 35703 - protein, 9 aa, Dengue virus
ANDWDFVVT

SEQ ID NO: 35704 - protein, 9 aa, Dengue virus
ISEMGANFR

SEQ ID NO: 35705 - protein, 9 aa, Dengue virus
SEMGANFRA

SEQ ID NO: 35706 - protein, 9 aa, Dengue virus
EMGANFRAE

SEQ ID NO: 35707 - protein, 9 aa, Dengue virus
MGANFRAER

SEQ ID NO: 35708 - protein, 9 aa, Dengue virus
GANFRAERV

SEQ ID NO: 35709 - protein, 9 aa, Dengue virus
ANFRAERVI

SEQ ID NO: 35710 - protein, 9 aa, Dengue virus
NFRAERVID

SEQ ID NO: 35711 - protein, 9 aa, Dengue virus
FRAERVIDP

SEQ ID NO: 35712 - protein, 9 aa, Dengue virus
RAERVIDPR

SEQ ID NO: 35713 - protein, 9 aa, Dengue virus
MKPVILTEG

SEQ ID NO: 35714 - protein, 9 aa, Dengue virus
KPVILTEGE

SEQ ID NO: 35715 - protein, 9 aa, Dengue virus
PVILTEGEE

SEQ ID NO: 35716 - protein, 9 aa, Dengue virus
VILTEGEER

SEQ ID NO: 35717 - protein, 9 aa, Dengue virus
ILTEGEERV

SEQ ID NO: 35718 - protein, 9 aa, Dengue virus
LTDGEERVV

SEQ ID NO: 35719 - protein, 9 aa, Dengue virus
TDGEERVVL

SEQ ID NO: 35720 - protein, 9 aa, Dengue virus
DGEERVVLA

SEQ ID NO: 35721 - protein, 9 aa, Dengue virus
GEERVVLAG

SEQ ID NO: 35722 - protein, 9 aa, Dengue virus
EERVVLAGP

SEQ ID NO: 35723 - protein, 9 aa, Dengue virus
ERVVLAGPM

SEQ ID NO: 35724 - protein, 9 aa, Dengue virus
RVVLAGPMP

SEQ ID NO: 35725 - protein, 9 aa, Dengue virus
VVLAGPMPV

SEQ ID NO: 35726 - protein, 9 aa, Dengue virus
VLAGPMPVT

SEQ ID NO: 35727 - protein, 9 aa, Dengue virus
GPMPVTHFS

SEQ ID NO: 35728 - protein, 9 aa, Dengue virus
PMPVTHFSA

SEQ ID NO: 35729 - protein, 9 aa, Dengue virus
MPVTHFSAA

SEQ ID NO: 35730 - protein, 9 aa, Dengue virus
PVTHFSAAQ

SEQ ID NO: 35731 - protein, 9 aa, Dengue virus
SAAQRRGRV

SEQ ID NO: 35732 - protein, 9 aa, Dengue virus
AAQRRGRVG

SEQ ID NO: 35733 - protein, 9 aa, Dengue virus
AQRRGRVGR

SEQ ID NO: 35734 - protein, 9 aa, Dengue virus
QRRGRVGRN

SEQ ID NO: 35735 - protein, 9 aa, Dengue virus
RRGRVGRNP

SEQ ID NO: 35736 - protein, 9 aa, Dengue virus
RGRVGRNPK

SEQ ID NO: 35737 - protein, 9 aa, Dengue virus
GRVGRNPKN

SEQ ID NO: 35738 - protein, 9 aa, Dengue virus
RVGRNPKNE

SEQ ID NO: 35739 - protein, 9 aa, Dengue virus
VGRNPKNEN

SEQ ID NO: 35740 - protein, 9 aa, Dengue virus
GRNPRNEND

SEQ ID NO: 35741 - protein, 9 aa, Dengue virus
RNPRNENDQ

SEQ ID NO: 35742 - protein, 9 aa, Dengue virus
NPRNENDQY

SEQ ID NO: 35743 - protein, 9 aa, Dengue virus
PRNENDQYI

SEQ ID NO: 35744 - protein, 9 aa, Dengue virus
RNENDQYIY

SEQ ID NO: 35745 - protein, 9 aa, Dengue virus
PEREKVDAV

SEQ ID NO: 35746 - protein, 9 aa, Dengue virus
EREKVDAVD

SEQ ID NO: 35747 - protein, 9 aa, Dengue virus
REKVDAVDG

SEQ ID NO: 35748 - protein, 9 aa, Dengue virus
EKVDAVDGE

SEQ ID NO: 35749 - protein, 9 aa, Dengue virus
KVDAVDGEY

SEQ ID NO: 35750 - protein, 9 aa, Dengue virus
VDAVDGEYR

SEQ ID NO: 35751 - protein, 9 aa, Dengue virus
DAVDGEYRL

SEQ ID NO: 35752 - protein, 9 aa, Dengue virus
AVDGEYRLR

SEQ ID NO: 35753 - protein, 9 aa, Dengue virus
VDGEYRLRG

SEQ ID NO: 35754 - protein, 9 aa, Dengue virus
RKTFVDLMK

SEQ ID NO: 35755 - protein, 9 aa, Dengue virus
KTFVDLMKR

SEQ ID NO: 35756 - protein, 9 aa, Dengue virus
TFVDLMKRG

SEQ ID NO: 35757 - protein, 9 aa, Dengue virus
FVDLMKRGD

SEQ ID NO: 35758 - protein, 9 aa, Dengue virus
VDLMKRGDL

SEQ ID NO: 35759 - protein, 9 aa, Dengue virus
DLMKRGDLP

SEQ ID NO: 35760 - protein, 9 aa, Dengue virus
LMKRGDLPV

SEQ ID NO: 35761 - protein, 9 aa, Dengue virus
MKRGDLPVW

SEQ ID NO: 35762 - protein, 9 aa, Dengue virus
KRGDLPVWL

SEQ ID NO: 35763 - protein, 9 aa, Dengue virus
DLPVWLAYR

SEQ ID NO: 35764 - protein, 9 aa, Dengue virus
LPVWLAYRV

SEQ ID NO: 35765 - protein, 9 aa, Dengue virus
PVWLAYRVA

SEQ ID NO: 35766 - protein, 9 aa, Dengue virus
VWLAYRVAA

SEQ ID NO: 35767 - protein, 9 aa, Dengue virus
WLAYRVAAE

SEQ ID NO: 35768 - protein, 9 aa, Dengue virus
LAYRVAAEG

SEQ ID NO: 35769 - protein, 9 aa, Dengue virus
AYRVAAEGI

SEQ ID NO: 35770 - protein, 9 aa, Dengue virus
YRVAAEGIN

SEQ ID NO: 35771 - protein, 9 aa, Dengue virus
RVAAEGINY

SEQ ID NO: 35772 - protein, 9 aa, Dengue virus
VASEGINYA

SEQ ID NO: 35773 - protein, 9 aa, Dengue virus
ASEGINYAD

SEQ ID NO: 35774 - protein, 9 aa, Dengue virus
SEGINYADR

SEQ ID NO: 35775 - protein, 9 aa, Dengue virus
EGINYADRK

SEQ ID NO: 35776 - protein, 9 aa, Dengue virus
GINYADRKW

SEQ ID NO: 35777 - protein, 9 aa, Dengue virus
INYADRKWC

SEQ ID NO: 35778 - protein, 9 aa, Dengue virus
NYADRKWCF

SEQ ID NO: 35779 - protein, 9 aa, Dengue virus
YADRKWCFD

SEQ ID NO: 35780 - protein, 9 aa, Dengue virus
ADRKWCFDG

SEQ ID NO: 35781 - protein, 9 aa, Dengue virus
DRKWCFDGI

SEQ ID NO: 35782 - protein, 9 aa, Dengue virus
RKWCFDGIK

SEQ ID NO: 35783 - protein, 9 aa, Dengue virus
KWCFDGIKN

SEQ ID NO: 35784 - protein, 9 aa, Dengue virus
WCFDGVKNN

SEQ ID NO: 35785 - protein, 9 aa, Dengue virus
CFDGVKNNQ

SEQ ID NO: 35786 - protein, 9 aa, Dengue virus
FDGVKNNQI

SEQ ID NO: 35787 - protein, 9 aa, Dengue virus
DGVKNNQIL

SEQ ID NO: 35788 - protein, 9 aa, Dengue virus
GVKNNQILE

SEQ ID NO: 35789 - protein, 9 aa, Dengue virus
VKNNQILEE

SEQ ID NO: 35790 - protein, 9 aa, Dengue virus
RNNQILEEN

SEQ ID NO: 35791 - protein, 9 aa, Dengue virus
NNQILEENM

SEQ ID NO: 35792 - protein, 9 aa, Dengue virus
NQILEENME

SEQ ID NO: 35793 - protein, 9 aa, Dengue virus
QILEENMEV

SEQ ID NO: 35794 - protein, 9 aa, Dengue virus
ILEENMEVE

SEQ ID NO: 35795 - protein, 9 aa, Dengue virus
LEENMEVEI

SEQ ID NO: 35796 - protein, 9 aa, Dengue virus
EENMEVEIW

SEQ ID NO: 35797 - protein, 9 aa, Dengue virus
ENMEVEIWT

SEQ ID NO: 35798 - protein, 9 aa, Dengue virus
NMEVEIWTK

SEQ ID NO: 35799 - protein, 9 aa, Dengue virus
MEVEIWTKE

SEQ ID NO: 35800 - protein, 9 aa, Dengue virus
EVEVWTKEG

SEQ ID NO: 35801 - protein, 9 aa, Dengue virus
VEVWTKEGE

SEQ ID NO: 35802 - protein, 9 aa, Dengue virus
EVWTKEGER

SEQ ID NO: 35803 - protein, 9 aa, Dengue virus
VWTKEGERK

SEQ ID NO: 35804 - protein, 9 aa, Dengue virus
KPRWLDART

SEQ ID NO: 35805 - protein, 9 aa, Dengue virus
PRWLDARTY

SEQ ID NO: 35806 - protein, 9 aa, Dengue virus
RWLDARTYS

SEQ ID NO: 35807 - protein, 9 aa, Dengue virus
WLDARTYSD

SEQ ID NO: 35808 - protein, 9 aa, Dengue virus
LDARTYSDP

SEQ ID NO: 35809 - protein, 9 aa, Dengue virus
DARTYSDPL

SEQ ID NO: 35810 - protein, 9 aa, Dengue virus
ARTYSDPLA

SEQ ID NO: 35811 - protein, 9 aa, Dengue virus
RTYSDPLAL

SEQ ID NO: 35812 - protein, 9 aa, Dengue virus
TYSDPLALK

SEQ ID NO: 35813 - protein, 9 aa, Dengue virus
FAAGRKSLA

SEQ ID NO: 35814 - protein, 9 aa, Dengue virus
AAGRKSLAL

SEQ ID NO: 35815 - protein, 9 aa, Dengue virus
AGRKSLALN

SEQ ID NO: 35816 - protein, 9 aa, Dengue virus
GRKSLALNL

SEQ ID NO: 35817 - protein, 9 aa, Dengue virus
RKSLALNLI

SEQ ID NO: 35818 - protein, 9 aa, Dengue virus
KSLALNLIT

SEQ ID NO: 35819 - protein, 9 aa, Dengue virus
SLALNLITE

SEQ ID NO: 35820 - protein, 9 aa, Dengue virus
LALNLITEM

SEQ ID NO: 35821 - protein, 9 aa, Dengue virus
ALNLITEMG

SEQ ID NO: 35822 - protein, 9 aa, Dengue virus
LSLITEMGR

SEQ ID NO: 35823 - protein, 9 aa, Dengue virus
SLITEMGRL

SEQ ID NO: 35824 - protein, 9 aa, Dengue virus
LPTFMTQKT

SEQ ID NO: 35825 - protein, 9 aa, Dengue virus
PTFMTQKTR

SEQ ID NO: 35826 - protein, 9 aa, Dengue virus
TFMTQKTRD

SEQ ID NO: 35827 - protein, 9 aa, Dengue virus
FMTQKTRDA

SEQ ID NO: 35828 - protein, 9 aa, Dengue virus
MTQKTRDAL

SEQ ID NO: 35829 - protein, 9 aa, Dengue virus
TQKTRDALD

SEQ ID NO: 35830 - protein, 9 aa, Dengue virus
QKTRDALDN

SEQ ID NO: 35831 - protein, 9 aa, Dengue virus
KTRDALDNL

SEQ ID NO: 35832 - protein, 9 aa, Dengue virus
TRDALDNLA

SEQ ID NO: 35833 - protein, 9 aa, Dengue virus
RNALDNLAV

SEQ ID NO: 35834 - protein, 9 aa, Dengue virus
NALDNLAVL

SEQ ID NO: 35835 - protein, 9 aa, Dengue virus
LDNLAVLHS

SEQ ID NO: 35836 - protein, 9 aa, Dengue virus
DNLAVLHSA

SEQ ID NO: 35837 - protein, 9 aa, Dengue virus
NLAVLHSAE

SEQ ID NO: 35838 - protein, 9 aa, Dengue virus
LAVLHTAEV

SEQ ID NO: 35839 - protein, 9 aa, Dengue virus
AVLHTAEVG

SEQ ID NO: 35840 - protein, 9 aa, Dengue virus
VLHTAEVGG

SEQ ID NO: 35841 - protein, 9 aa, Dengue virus
LHTAEVGGR

SEQ ID NO: 35842 - protein, 9 aa, Dengue virus
HTAEVGGRA

SEQ ID NO: 35843 - protein, 9 aa, Dengue virus
TAEVGGRAY

SEQ ID NO: 35844 - protein, 9 aa, Dengue virus
GGKAYNHAL

SEQ ID NO: 35845 - protein, 9 aa, Dengue virus
GKAYNHALS

SEQ ID NO: 35846 - protein, 9 aa, Dengue virus
KAYNHALSE

SEQ ID NO: 35847 - protein, 9 aa, Dengue virus
AYTHALSEL

SEQ ID NO: 35848 - protein, 9 aa, Dengue virus
YTHALSELP

SEQ ID NO: 35849 - protein, 9 aa, Dengue virus
THALSELPE

SEQ ID NO: 35850 - protein, 9 aa, Dengue virus
TLETLLLLG

SEQ ID NO: 35851 - protein, 9 aa, Dengue virus
LETLLLLGL

SEQ ID NO: 35852 - protein, 9 aa, Dengue virus
ETLLLLGLL

SEQ ID NO: 35853 - protein, 9 aa, Dengue virus
TLLLLGLLA

SEQ ID NO: 35854 - protein, 9 aa, Dengue virus
LLLLGLLAT

SEQ ID NO: 35855 - protein, 9 aa, Dengue virus
LLLGLLATV

SEQ ID NO: 35856 - protein, 9 aa, Dengue virus
LLGLLATVT

SEQ ID NO: 35857 - protein, 9 aa, Dengue virus
LGLLATVTG

SEQ ID NO: 35858 - protein, 9 aa, Dengue virus
GLLATVTGG

SEQ ID NO: 35859 - protein, 9 aa, Dengue virus
LLAAVTGGI

SEQ ID NO: 35860 - protein, 9 aa, Dengue virus
LAAVTGGIF

SEQ ID NO: 35861 - protein, 9 aa, Dengue virus
AAVTGGIFL

SEQ ID NO: 35862 - protein, 9 aa, Dengue virus
AVTGGIFLF

SEQ ID NO: 35863 - protein, 9 aa, Dengue virus
GIFLFLMSA

SEQ ID NO: 35864 - protein, 9 aa, Dengue virus
IFLFLMSGR

SEQ ID NO: 35865 - protein, 9 aa, Dengue virus
FLFLMSGRG

SEQ ID NO: 35866 - protein, 9 aa, Dengue virus
LFLMSGRGI

SEQ ID NO: 35867 - protein, 9 aa, Dengue virus
FLMSGRGIG

SEQ ID NO: 35868 - protein, 9 aa, Dengue virus
LMSGRGIGK

SEQ ID NO: 35869 - protein, 9 aa, Dengue virus
MSGRGIGKM

SEQ ID NO: 35870 - protein, 9 aa, Dengue virus
SGRGIGKMT

SEQ ID NO: 35871 - protein, 9 aa, Dengue virus
GRGIGKMTL

SEQ ID NO: 35872 - protein, 9 aa, Dengue virus
RGIGKMTLG

SEQ ID NO: 35873 - protein, 9 aa, Dengue virus
GVGKMTLGM

SEQ ID NO: 35874 - protein, 9 aa, Dengue virus
VGKMTLGMC

SEQ ID NO: 35875 - protein, 9 aa, Dengue virus
MTLGMCCIV

SEQ ID NO: 35876 - protein, 9 aa, Dengue virus
TLGMCCIVT

SEQ ID NO: 35877 - protein, 9 aa, Dengue virus
LGMCCIVTA

SEQ ID NO: 35878 - protein, 9 aa, Dengue virus
GMCCIVTAS

SEQ ID NO: 35879 - protein, 9 aa, Dengue virus
TASVLLWYA

SEQ ID NO: 35880 - protein, 9 aa, Dengue virus
LLWHAQIQP

SEQ ID NO: 35881 - protein, 9 aa, Dengue virus
LWHAQIQPH

SEQ ID NO: 35882 - protein, 9 aa, Dengue virus
WHAQIQPHW

SEQ ID NO: 35883 - protein, 9 aa, Dengue virus
HAQIQPHWI

SEQ ID NO: 35884 - protein, 9 aa, Dengue virus
SIILVFFLI

SEQ ID NO: 35885 - protein, 9 aa, Dengue virus
IILVFFLIV

SEQ ID NO: 35886 - protein, 9 aa, Dengue virus
ILVFFLIVL

SEQ ID NO: 35887 - protein, 9 aa, Dengue virus
LVFFLIVLL

SEQ ID NO: 35888 - protein, 9 aa, Dengue virus
VFFLIVLLI

SEQ ID NO: 35889 - protein, 9 aa, Dengue virus
QDNQLTYVI

SEQ ID NO: 35890 - protein, 9 aa, Dengue virus
DNQLTYVII

SEQ ID NO: 35891 - protein, 9 aa, Dengue virus
NQLTYVIIA

SEQ ID NO: 35892 - protein, 9 aa, Dengue virus
QLTYVIIAI

SEQ ID NO: 35893 - protein, 9 aa, Dengue virus
LTYVIIAIL

SEQ ID NO: 35894 - protein, 9 aa, Dengue virus
TYVIIAILT

SEQ ID NO: 35895 - protein, 9 aa, Dengue virus
YVIIAILTV

SEQ ID NO: 35896 - protein, 9 aa, Dengue virus
VIIAILTVV

SEQ ID NO: 35897 - protein, 9 aa, Dengue virus
IIAILTVVA

SEQ ID NO: 35898 - protein, 9 aa, Dengue virus
IAILTLVAA

SEQ ID NO: 35899 - protein, 9 aa, Dengue virus
AILTLVAAT

SEQ ID NO: 35900 - protein, 9 aa, Dengue virus
ILTLVAATM

SEQ ID NO: 35901 - protein, 9 aa, Dengue virus
LTLVAATMA

SEQ ID NO: 35902 - protein, 9 aa, Dengue virus
TLVAATMAN

SEQ ID NO: 35903 - protein, 9 aa, Dengue virus
LVAATMANE

SEQ ID NO: 35904 - protein, 9 aa, Dengue virus
FLEKTKKDF

SEQ ID NO: 35905 - protein, 9 aa, Dengue virus
LEKTKKDFG

SEQ ID NO: 35906 - protein, 9 aa, Dengue virus
EKTKKDFGL

SEQ ID NO: 35907 - protein, 9 aa, Dengue virus
KTKKDFGLG

SEQ ID NO: 35908 - protein, 9 aa, Dengue virus
QPESNILDI

SEQ ID NO: 35909 - protein, 9 aa, Dengue virus
SESNILDID

SEQ ID NO: 35910 - protein, 9 aa, Dengue virus
EINILDIDL

SEQ ID NO: 35911 - protein, 9 aa, Dengue virus
INILDIDLR

SEQ ID NO: 35912 - protein, 9 aa, Dengue virus
LYAVATTFI

SEQ ID NO: 35913 - protein, 9 aa, Dengue virus
YAVATTFIT

SEQ ID NO: 35914 - protein, 9 aa, Dengue virus
AVATTFITP

SEQ ID NO: 35915 - protein, 9 aa, Dengue virus
VATTFITPM

SEQ ID NO: 35916 - protein, 9 aa, Dengue virus
ATTFITPML

SEQ ID NO: 35917 - protein, 9 aa, Dengue virus
TTFITPMLR

SEQ ID NO: 35918 - protein, 9 aa, Dengue virus
TFITPMLRH

SEQ ID NO: 35919 - protein, 9 aa, Dengue virus
FITPMLRHS

SEQ ID NO: 35920 - protein, 9 aa, Dengue virus
ITPMLRHSI

SEQ ID NO: 35921 - protein, 9 aa, Dengue virus
ATVLMGLGR

SEQ ID NO: 35922 - protein, 9 aa, Dengue virus
TVLMGLGRG

SEQ ID NO: 35923 - protein, 9 aa, Dengue virus
VLMGLGRGW

SEQ ID NO: 35924 - protein, 9 aa, Dengue virus
LMGLGRGWP

SEQ ID NO: 35925 - protein, 9 aa, Dengue virus
MGLGRGWPL

SEQ ID NO: 35926 - protein, 9 aa, Dengue virus
GLGRGWPLS

SEQ ID NO: 35927 - protein, 9 aa, Dengue virus
LGRGWPLSK

SEQ ID NO: 35928 - protein, 9 aa, Dengue virus
GRGWPLSKM

SEQ ID NO: 35929 - protein, 9 aa, Dengue virus
RGWPLSKMD

SEQ ID NO: 35930 - protein, 9 aa, Dengue virus
PLSKMDIGA

SEQ ID NO: 35931 - protein, 9 aa, Dengue virus
LSKMDIGAP

SEQ ID NO: 35932 - protein, 9 aa, Dengue virus
SKMDIGAPL

SEQ ID NO: 35933 - protein, 9 aa, Dengue virus
KMDIGAPLL

SEQ ID NO: 35934 - protein, 9 aa, Dengue virus
MDIGAPLLA

SEQ ID NO: 35935 - protein, 9 aa, Dengue virus
DIGAPLLAI

SEQ ID NO: 35936 - protein, 9 aa, Dengue virus
IGAPLLAIG

SEQ ID NO: 35937 - protein, 9 aa, Dengue virus
GAPLLAIGC

SEQ ID NO: 35938 - protein, 9 aa, Dengue virus
APLLAIGCY

SEQ ID NO: 35939 - protein, 9 aa, Dengue virus
VNPVTLTAA

SEQ ID NO: 35940 - protein, 9 aa, Dengue virus
NPVTLTAAL

SEQ ID NO: 35941 - protein, 9 aa, Dengue virus
PITLTAALF

SEQ ID NO: 35942 - protein, 9 aa, Dengue virus
ITLTAALFL

SEQ ID NO: 35943 - protein, 9 aa, Dengue virus
TLTAALFLL

SEQ ID NO: 35944 - protein, 9 aa, Dengue virus
TAALFLLVA

SEQ ID NO: 35945 - protein, 9 aa, Dengue virus
AALFLLVAH

SEQ ID NO: 35946 - protein, 9 aa, Dengue virus
LLIAHYAII

SEQ ID NO: 35947 - protein, 9 aa, Dengue virus
LIAHYAIIG

SEQ ID NO: 35948 - protein, 9 aa, Dengue virus
IAHYAIIGP

SEQ ID NO: 35949 - protein, 9 aa, Dengue virus
ATREAQKRT

SEQ ID NO: 35950 - protein, 9 aa, Dengue virus
TREAQKRTA

SEQ ID NO: 35951 - protein, 9 aa, Dengue virus
REAQKRTAA

SEQ ID NO: 35952 - protein, 9 aa, Dengue virus
EAQKRTAAG

SEQ ID NO: 35953 - protein, 9 aa, Dengue virus
AQKRTAAGI

SEQ ID NO: 35954 - protein, 9 aa, Dengue virus
QKRTAAGIM

SEQ ID NO: 35955 - protein, 9 aa, Dengue virus
KRTAAGIMK

SEQ ID NO: 35956 - protein, 9 aa, Dengue virus
RTAAGIMKN

SEQ ID NO: 35957 - protein, 9 aa, Dengue virus
TAAGIMKNP

SEQ ID NO: 35958 - protein, 9 aa, Dengue virus
MKNPTVDGV

SEQ ID NO: 35959 - protein, 9 aa, Dengue virus
KNPTVDGVT

SEQ ID NO: 35960 - protein, 9 aa, Dengue virus
NPTVDGVTV

SEQ ID NO: 35961 - protein, 9 aa, Dengue virus
PTVDGVTVI

SEQ ID NO: 35962 - protein, 9 aa, Dengue virus
TVDGVTVID

SEQ ID NO: 35963 - protein, 9 aa, Dengue virus
VDGVTVIDL

SEQ ID NO: 35964 - protein, 9 aa, Dengue virus
DGITVIDLD

SEQ ID NO: 35965 - protein, 9 aa, Dengue virus
GITVIDLDP

SEQ ID NO: 35966 - protein, 9 aa, Dengue virus
ITVIDLDPI

SEQ ID NO: 35967 - protein, 9 aa, Dengue virus
TVIDLEPIP

SEQ ID NO: 35968 - protein, 9 aa, Dengue virus
VIDLEPIPY

SEQ ID NO: 35969 - protein, 9 aa, Dengue virus
IDLDPIPYD

SEQ ID NO: 35970 - protein, 9 aa, Dengue virus
DLEPIPYDP

SEQ ID NO: 35971 - protein, 9 aa, Dengue virus
LEPIPYDPK

SEQ ID NO: 35972 - protein, 9 aa, Dengue virus
EPIPYDPKF

SEQ ID NO: 35973 - protein, 9 aa, Dengue virus
QLGQVMLLV

SEQ ID NO: 35974 - protein, 9 aa, Dengue virus
LGQVMLLVL

SEQ ID NO: 35975 - protein, 9 aa, Dengue virus
GQVMLLVLC

SEQ ID NO: 35976 - protein, 9 aa, Dengue virus
QVMLLVLCV

SEQ ID NO: 35977 - protein, 9 aa, Dengue virus
VMLLVLCVT

SEQ ID NO: 35978 - protein, 9 aa, Dengue virus
MLLVLCVTQ

SEQ ID NO: 35979 - protein, 9 aa, Dengue virus
LLVLCVTQV

SEQ ID NO: 35980 - protein, 9 aa, Dengue virus
LVLCVTQVL

SEQ ID NO: 35981 - protein, 9 aa, Dengue virus
VLCVTQVLM

SEQ ID NO: 35982 - protein, 9 aa, Dengue virus
ALTLATGPV

SEQ ID NO: 35983 - protein, 9 aa, Dengue virus
LTLATGPVS

SEQ ID NO: 35984 - protein, 9 aa, Dengue virus
TLATGPVST

SEQ ID NO: 35985 - protein, 9 aa, Dengue virus
LATGPVSTL

SEQ ID NO: 35986 - protein, 9 aa, Dengue virus
ATGPVSTLW

SEQ ID NO: 35987 - protein, 9 aa, Dengue virus
TGPVSTLWE

SEQ ID NO: 35988 - protein, 9 aa, Dengue virus
GPVSTLWEG

SEQ ID NO: 35989 - protein, 9 aa, Dengue virus
PVSTLWEGN

SEQ ID NO: 35990 - protein, 9 aa, Dengue virus
VSTLWEGNP

SEQ ID NO: 35991 - protein, 9 aa, Dengue virus
TLWEGNPGK

SEQ ID NO: 35992 - protein, 9 aa, Dengue virus
LWEGNPGKF

SEQ ID NO: 35993 - protein, 9 aa, Dengue virus
WEGNPGKFW

SEQ ID NO: 35994 - protein, 9 aa, Dengue virus
EGNPGKFWN

SEQ ID NO: 35995 - protein, 9 aa, Dengue virus
GNPGKFWNT

SEQ ID NO: 35996 - protein, 9 aa, Dengue virus
NPGKFWNTT

SEQ ID NO: 35997 - protein, 9 aa, Dengue virus
PGKFWNTTI

SEQ ID NO: 35998 - protein, 9 aa, Dengue virus
GKFWNTTIA

SEQ ID NO: 35999 - protein, 9 aa, Dengue virus
KFWNTTIAV

SEQ ID NO: 36000 - protein, 9 aa, Dengue virus
AGLLFSIMR

SEQ ID NO: 36001 - protein, 9 aa, Dengue virus
GLLFSIMRN

SEQ ID NO: 36002 - protein, 9 aa, Dengue virus
LLFSIMRNT

SEQ ID NO: 36003 - protein, 9 aa, Dengue virus
LFSIMKNTA

SEQ ID NO: 36004 - protein, 9 aa, Dengue virus
FSIMKNTTS

SEQ ID NO: 36005 - protein, 9 aa, Dengue virus
RRGTGNMGE

SEQ ID NO: 36006 - protein, 9 aa, Dengue virus
RGTGNMGET

SEQ ID NO: 36007 - protein, 9 aa, Dengue virus
GTGNMGETL

SEQ ID NO: 36008 - protein, 9 aa, Dengue virus
TGNMGETLG

SEQ ID NO: 36009 - protein, 9 aa, Dengue virus
GNMGETLGE

SEQ ID NO: 36010 - protein, 9 aa, Dengue virus
NMGETLGEK

SEQ ID NO: 36011 - protein, 9 aa, Dengue virus
MGETLGEKW

SEQ ID NO: 36012 - protein, 9 aa, Dengue virus
ETLGEKWKN

SEQ ID NO: 36013 - protein, 9 aa, Dengue virus
TLGEKWKNR

SEQ ID NO: 36014 - protein, 9 aa, Dengue virus
LGEKWKNRL

SEQ ID NO: 36015 - protein, 9 aa, Dengue virus
GEKWKNRLN

SEQ ID NO: 36016 - protein, 9 aa, Dengue virus
EKWKNRLNA

SEQ ID NO: 36017 - protein, 9 aa, Dengue virus
KWKNRLNAL

SEQ ID NO: 36018 - protein, 9 aa, Dengue virus
WKNRLNALG

SEQ ID NO: 36019 - protein, 9 aa, Dengue virus
RLNALGRSE

SEQ ID NO: 36020 - protein, 9 aa, Dengue virus
LNALGRSEF

SEQ ID NO: 36021 - protein, 9 aa, Dengue virus
NALGRSEFQ

SEQ ID NO: 36022 - protein, 9 aa, Dengue virus
LGKSEFQTY

SEQ ID NO: 36023 - protein, 9 aa, Dengue virus
GKSEFQTYK

SEQ ID NO: 36024 - protein, 9 aa, Dengue virus
KSEFQIYKR

SEQ ID NO: 36025 - protein, 9 aa, Dengue virus
SEFQIYKRS

SEQ ID NO: 36026 - protein, 9 aa, Dengue virus
EFQIYKRSG

SEQ ID NO: 36027 - protein, 9 aa, Dengue virus
FQIYKRSGI

SEQ ID NO: 36028 - protein, 9 aa, Dengue virus
QIYKRSGIQ

SEQ ID NO: 36029 - protein, 9 aa, Dengue virus
IYKRSGIQE

SEQ ID NO: 36030 - protein, 9 aa, Dengue virus
YKRSGIQEV

SEQ ID NO: 36031 - protein, 9 aa, Dengue virus
KRSGIQEVD

SEQ ID NO: 36032 - protein, 9 aa, Dengue virus
RSGIQEVDR

SEQ ID NO: 36033 - protein, 9 aa, Dengue virus
LRWFVERNL

SEQ ID NO: 36034 - protein, 9 aa, Dengue virus
RWFVERNLV

SEQ ID NO: 36035 - protein, 9 aa, Dengue virus
WFVERNLVT

SEQ ID NO: 36036 - protein, 9 aa, Dengue virus
FVERNLVTP

SEQ ID NO: 36037 - protein, 9 aa, Dengue virus
VERNLVTPE

SEQ ID NO: 36038 - protein, 9 aa, Dengue virus
ERNLVTPEG

SEQ ID NO: 36039 - protein, 9 aa, Dengue virus
RNLVTPEGK

SEQ ID NO: 36040 - protein, 9 aa, Dengue virus
NLVTPEGKV

SEQ ID NO: 36041 - protein, 9 aa, Dengue virus
LVTPEGKVV

SEQ ID NO: 36042 - protein, 9 aa, Dengue virus
VTPEGKVMD

SEQ ID NO: 36043 - protein, 9 aa, Dengue virus
TPEGKVMDL

SEQ ID NO: 36044 - protein, 9 aa, Dengue virus
PEGKVMDLG

SEQ ID NO: 36045 - protein, 9 aa, Dengue virus
EGKVMDLGC

SEQ ID NO: 36046 - protein, 9 aa, Dengue virus
GKVMDLGCG

SEQ ID NO: 36047 - protein, 9 aa, Dengue virus
KVMDLGCGR

SEQ ID NO: 36048 - protein, 9 aa, Dengue virus
VMDLGCGRG

SEQ ID NO: 36049 - protein, 9 aa, Dengue virus
MDLGCGRGG

SEQ ID NO: 36050 - protein, 9 aa, Dengue virus
SYYCGGLKD

SEQ ID NO: 36051 - protein, 9 aa, Dengue virus
YYCGGLKDV

SEQ ID NO: 36052 - protein, 9 aa, Dengue virus
YCGGLKNVK

SEQ ID NO: 36053 - protein, 9 aa, Dengue virus
CGGLKNVKE

SEQ ID NO: 36054 - protein, 9 aa, Dengue virus
GGLKNVKEV

SEQ ID NO: 36055 - protein, 9 aa, Dengue virus
GLKNVKEVK

SEQ ID NO: 36056 - protein, 9 aa, Dengue virus
LKNVKEVKG

SEQ ID NO: 36057 - protein, 9 aa, Dengue virus
KNVKEVKGL

SEQ ID NO: 36058 - protein, 9 aa, Dengue virus
NVKEVKGLT

SEQ ID NO: 36059 - protein, 9 aa, Dengue virus
VKEVKGLTK

SEQ ID NO: 36060 - protein, 9 aa, Dengue virus
KEVKGLTKG

SEQ ID NO: 36061 - protein, 9 aa, Dengue virus
GGPGHEEPV

SEQ ID NO: 36062 - protein, 9 aa, Dengue virus
GPGHEEPVP

SEQ ID NO: 36063 - protein, 9 aa, Dengue virus
PGHEEPVPM

SEQ ID NO: 36064 - protein, 9 aa, Dengue virus
GHEEPVPMS

SEQ ID NO: 36065 - protein, 9 aa, Dengue virus
HEEPVPMST

SEQ ID NO: 36066 - protein, 9 aa, Dengue virus
EEPVPMSTY

SEQ ID NO: 36067 - protein, 9 aa, Dengue virus
EPVPMSTYG

SEQ ID NO: 36068 - protein, 9 aa, Dengue virus
PVPMSTYGW

SEQ ID NO: 36069 - protein, 9 aa, Dengue virus
VPMSTYGWN

SEQ ID NO: 36070 - protein, 9 aa, Dengue virus
LVRLQSGID

SEQ ID NO: 36071 - protein, 9 aa, Dengue virus
VRLQSGIDV

SEQ ID NO: 36072 - protein, 9 aa, Dengue virus
RLQSGIDVF

SEQ ID NO: 36073 - protein, 9 aa, Dengue virus
LQSGIDVFF

SEQ ID NO: 36074 - protein, 9 aa, Dengue virus
QSGVDVFFI

SEQ ID NO: 36075 - protein, 9 aa, Dengue virus
SGVDVFFIP

SEQ ID NO: 36076 - protein, 9 aa, Dengue virus
GVDVFFIPP

SEQ ID NO: 36077 - protein, 9 aa, Dengue virus
VDVFFIPPE

SEQ ID NO: 36078 - protein, 9 aa, Dengue virus
DVFFIPPEK

SEQ ID NO: 36079 - protein, 9 aa, Dengue virus
VFFIPPEKC

SEQ ID NO: 36080 - protein, 9 aa, Dengue virus
FFIPPEKCD

SEQ ID NO: 36081 - protein, 9 aa, Dengue virus
FIPPEKCDT

SEQ ID NO: 36082 - protein, 9 aa, Dengue virus
IPPEKCDTL

SEQ ID NO: 36083 - protein, 9 aa, Dengue virus
PPERCDTLL

SEQ ID NO: 36084 - protein, 9 aa, Dengue virus
PERCDTLLC

SEQ ID NO: 36085 - protein, 9 aa, Dengue virus
ERCDTLLCD

SEQ ID NO: 36086 - protein, 9 aa, Dengue virus
RCDTLLCDI

SEQ ID NO: 36087 - protein, 9 aa, Dengue virus
GESSPNPTV

SEQ ID NO: 36088 - protein, 9 aa, Dengue virus
ESSPNPTVE

SEQ ID NO: 36089 - protein, 9 aa, Dengue virus
SSPNPTVEA

SEQ ID NO: 36090 - protein, 9 aa, Dengue virus
SPNPTVEAG

SEQ ID NO: 36091 - protein, 9 aa, Dengue virus
PNPTVEAGR

SEQ ID NO: 36092 - protein, 9 aa, Dengue virus
NPTVEAGRT

SEQ ID NO: 36093 - protein, 9 aa, Dengue virus
PTVEAGRTL

SEQ ID NO: 36094 - protein, 9 aa, Dengue virus
TVEAGRTLR

SEQ ID NO: 36095 - protein, 9 aa, Dengue virus
VEAGRTLRV

SEQ ID NO: 36096 - protein, 9 aa, Dengue virus
AGRTLRVLS

SEQ ID NO: 36097 - protein, 9 aa, Dengue virus
GRTLRVLSL

SEQ ID NO: 36098 - protein, 9 aa, Dengue virus
RTLRVLSLV

SEQ ID NO: 36099 - protein, 9 aa, Dengue virus
TLRVLSLVE

SEQ ID NO: 36100 - protein, 9 aa, Dengue virus
LRVLSLVEN

SEQ ID NO: 36101 - protein, 9 aa, Dengue virus
RVLSLVENW

SEQ ID NO: 36102 - protein, 9 aa, Dengue virus
VLSLVENWL

SEQ ID NO: 36103 - protein, 9 aa, Dengue virus
LSLVENWLN

SEQ ID NO: 36104 - protein, 9 aa, Dengue virus
SLVENWLNN

SEQ ID NO: 36105 - protein, 9 aa, Dengue virus
LVENWLNND

SEQ ID NO: 36106 - protein, 9 aa, Dengue virus
VENWLNNDT

SEQ ID NO: 36107 - protein, 9 aa, Dengue virus
ENWLNNDTQ

SEQ ID NO: 36108 - protein, 9 aa, Dengue virus
NWLNNDTQF

SEQ ID NO: 36109 - protein, 9 aa, Dengue virus
WLNNDTQFC

SEQ ID NO: 36110 - protein, 9 aa, Dengue virus
LNNDTQFCI

SEQ ID NO: 36111 - protein, 9 aa, Dengue virus
NNDTQFCIK

SEQ ID NO: 36112 - protein, 9 aa, Dengue virus
NDTQFCIKV

SEQ ID NO: 36113 - protein, 9 aa, Dengue virus
NTQFCVKVL

SEQ ID NO: 36114 - protein, 9 aa, Dengue virus
TQFCVKVLN

SEQ ID NO: 36115 - protein, 9 aa, Dengue virus
QFCVKVLNP

SEQ ID NO: 36116 - protein, 9 aa, Dengue virus
FCVKVLNPY

SEQ ID NO: 36117 - protein, 9 aa, Dengue virus
CVKVLNPYM

SEQ ID NO: 36118 - protein, 9 aa, Dengue virus
VKVLNPYMP

SEQ ID NO: 36119 - protein, 9 aa, Dengue virus
PYMPSVIER

SEQ ID NO: 36120 - protein, 9 aa, Dengue virus
YMPSVIERM

SEQ ID NO: 36121 - protein, 9 aa, Dengue virus
MPSVIERME

SEQ ID NO: 36122 - protein, 9 aa, Dengue virus
PSVIEKMET

SEQ ID NO: 36123 - protein, 9 aa, Dengue virus
SVIEKMETL

SEQ ID NO: 36124 - protein, 9 aa, Dengue virus
VIEKMETLQ

SEQ ID NO: 36125 - protein, 9 aa, Dengue virus
IEKMETLQR

SEQ ID NO: 36126 - protein, 9 aa, Dengue virus
LQRQYGGAL

SEQ ID NO: 36127 - protein, 9 aa, Dengue virus
QRQYGGALV

SEQ ID NO: 36128 - protein, 9 aa, Dengue virus
RQYGGALVR

SEQ ID NO: 36129 - protein, 9 aa, Dengue virus
QYGGALVRN

SEQ ID NO: 36130 - protein, 9 aa, Dengue virus
FGGALVRNP

SEQ ID NO: 36131 - protein, 9 aa, Dengue virus
EMYWVSNAS

SEQ ID NO: 36132 - protein, 9 aa, Dengue virus
MYWVSNASG

SEQ ID NO: 36133 - protein, 9 aa, Dengue virus
YWVSNASGN

SEQ ID NO: 36134 - protein, 9 aa, Dengue virus
WVSNASGNI

SEQ ID NO: 36135 - protein, 9 aa, Dengue virus
VSNASGNIV

SEQ ID NO: 36136 - protein, 9 aa, Dengue virus
SNASGNIVS

SEQ ID NO: 36137 - protein, 9 aa, Dengue virus
NASGNIVSS

SEQ ID NO: 36138 - protein, 9 aa, Dengue virus
ASGNIVSSV

SEQ ID NO: 36139 - protein, 9 aa, Dengue virus
SGNIVSSVN

SEQ ID NO: 36140 - protein, 9 aa, Dengue virus
MLINRFTMR

SEQ ID NO: 36141 - protein, 9 aa, Dengue virus
LINRFTMRH

SEQ ID NO: 36142 - protein, 9 aa, Dengue virus
INRFTMRHK

SEQ ID NO: 36143 - protein, 9 aa, Dengue virus
NRFTMRHKK

SEQ ID NO: 36144 - protein, 9 aa, Dengue virus
RFTMRHKKA

SEQ ID NO: 36145 - protein, 9 aa, Dengue virus
FTMRHKKAT

SEQ ID NO: 36146 - protein, 9 aa, Dengue virus
TMRHKKATY

SEQ ID NO: 36147 - protein, 9 aa, Dengue virus
MRHKKATYE

SEQ ID NO: 36148 - protein, 9 aa, Dengue virus
RHKKATYEP

SEQ ID NO: 36149 - protein, 9 aa, Dengue virus
YKKATYEPD

SEQ ID NO: 36150 - protein, 9 aa, Dengue virus
KRATYEPDV

SEQ ID NO: 36151 - protein, 9 aa, Dengue virus
KTTYEPDVD

SEQ ID NO: 36152 - protein, 9 aa, Dengue virus
GSGTRNIGT

SEQ ID NO: 36153 - protein, 9 aa, Dengue virus
SGTRNIGTE

SEQ ID NO: 36154 - protein, 9 aa, Dengue virus
GTRNIGIEN

SEQ ID NO: 36155 - protein, 9 aa, Dengue virus
TRNIGIENE

SEQ ID NO: 36156 - protein, 9 aa, Dengue virus
ETPNLDIIG

SEQ ID NO: 36157 - protein, 9 aa, Dengue virus
TPNLDIIGK

SEQ ID NO: 36158 - protein, 9 aa, Dengue virus
PNMDIIGKR

SEQ ID NO: 36159 - protein, 9 aa, Dengue virus
NMDIIGKRI

SEQ ID NO: 36160 - protein, 9 aa, Dengue virus
MDIIGKRIE

SEQ ID NO: 36161 - protein, 9 aa, Dengue virus
GKRIEKIKE

SEQ ID NO: 36162 - protein, 9 aa, Dengue virus
KRIEKIKEE

SEQ ID NO: 36163 - protein, 9 aa, Dengue virus
RIEKIKEEH

SEQ ID NO: 36164 - protein, 9 aa, Dengue virus
IEKIKEEHE

SEQ ID NO: 36165 - protein, 9 aa, Dengue virus
EKIKQEHEI

SEQ ID NO: 36166 - protein, 9 aa, Dengue virus
KIKQEHEIS

SEQ ID NO: 36167 - protein, 9 aa, Dengue virus
IKQEHEISW

SEQ ID NO: 36168 - protein, 9 aa, Dengue virus
KQEHEISWH

SEQ ID NO: 36169 - protein, 9 aa, Dengue virus
QEHEISWHY

SEQ ID NO: 36170 - protein, 9 aa, Dengue virus
EHEISWHYD

SEQ ID NO: 36171 - protein, 9 aa, Dengue virus
HEISWHYDQ

SEQ ID NO: 36172 - protein, 9 aa, Dengue virus
EISWHYDQD

SEQ ID NO: 36173 - protein, 9 aa, Dengue virus
ISWHYDQDH

SEQ ID NO: 36174 - protein, 9 aa, Dengue virus
HYDQDHPYR

SEQ ID NO: 36175 - protein, 9 aa, Dengue virus
SSMVNGVVK

SEQ ID NO: 36176 - protein, 9 aa, Dengue virus
SMVNGVVKL

SEQ ID NO: 36177 - protein, 9 aa, Dengue virus
MVNGVVKLL

SEQ ID NO: 36178 - protein, 9 aa, Dengue virus
VNGVVKLLT

SEQ ID NO: 36179 - protein, 9 aa, Dengue virus
NGVVKLLTK

SEQ ID NO: 36180 - protein, 9 aa, Dengue virus
GVVKLLTKP

SEQ ID NO: 36181 - protein, 9 aa, Dengue virus
VVKLLTKPW

SEQ ID NO: 36182 - protein, 9 aa, Dengue virus
VKLLTKPWD

SEQ ID NO: 36183 - protein, 9 aa, Dengue virus
KLLTKPWDV

SEQ ID NO: 36184 - protein, 9 aa, Dengue virus
LLTKPWDVL

SEQ ID NO: 36185 - protein, 9 aa, Dengue virus
LTKPWDVLP

SEQ ID NO: 36186 - protein, 9 aa, Dengue virus
TKPWDVLPT

SEQ ID NO: 36187 - protein, 9 aa, Dengue virus
KPWDVLPTV

SEQ ID NO: 36188 - protein, 9 aa, Dengue virus
PWDVLPTVT

SEQ ID NO: 36189 - protein, 9 aa, Dengue virus
WDVLPTVTQ

SEQ ID NO: 36190 - protein, 9 aa, Dengue virus
DVLPTVTQM

SEQ ID NO: 36191 - protein, 9 aa, Dengue virus
VLPTVTQMA

SEQ ID NO: 36192 - protein, 9 aa, Dengue virus
LPTVTQMAM

SEQ ID NO: 36193 - protein, 9 aa, Dengue virus
PTVTQMAMT

SEQ ID NO: 36194 - protein, 9 aa, Dengue virus
TVTQMAMTD

SEQ ID NO: 36195 - protein, 9 aa, Dengue virus
KEGTKKLMR

SEQ ID NO: 36196 - protein, 9 aa, Dengue virus
EGTKKLMRI

SEQ ID NO: 36197 - protein, 9 aa, Dengue virus
GTKKLMRIT

SEQ ID NO: 36198 - protein, 9 aa, Dengue virus
TKKLMRITA

SEQ ID NO: 36199 - protein, 9 aa, Dengue virus
KKLMRITAE

SEQ ID NO: 36200 - protein, 9 aa, Dengue virus
KLMRITAEW

SEQ ID NO: 36201 - protein, 9 aa, Dengue virus
LMRITAEWL

SEQ ID NO: 36202 - protein, 9 aa, Dengue virus
MRITAEWLW

SEQ ID NO: 36203 - protein, 9 aa, Dengue virus
RITAEWLWK

SEQ ID NO: 36204 - protein, 9 aa, Dengue virus
ITAKWLWKE

SEQ ID NO: 36205 - protein, 9 aa, Dengue virus
TAEWLWGEL

SEQ ID NO: 36206 - protein, 9 aa, Dengue virus
AKWLWKELG

SEQ ID NO: 36207 - protein, 9 aa, Dengue virus
KWLWKELGK

SEQ ID NO: 36208 - protein, 9 aa, Dengue virus
WLWKELGKE

SEQ ID NO: 36209 - protein, 9 aa, Dengue virus
LWKELGKEK

SEQ ID NO: 36210 - protein, 9 aa, Dengue virus
WKELGKEKT

SEQ ID NO: 36211 - protein, 9 aa, Dengue virus
KELGKEKTP

SEQ ID NO: 36212 - protein, 9 aa, Dengue virus
ELGKEKTPR

SEQ ID NO: 36213 - protein, 9 aa, Dengue virus
KKPRICTRA

SEQ ID NO: 36214 - protein, 9 aa, Dengue virus
KPRICTRAE

SEQ ID NO: 36215 - protein, 9 aa, Dengue virus
PRICTRAEF

SEQ ID NO: 36216 - protein, 9 aa, Dengue virus
RICTRAEFC

SEQ ID NO: 36217 - protein, 9 aa, Dengue virus
CTREEFTKK

SEQ ID NO: 36218 - protein, 9 aa, Dengue virus
TREEFTKKV

SEQ ID NO: 36219 - protein, 9 aa, Dengue virus
REEFTKKVR

SEQ ID NO: 36220 - protein, 9 aa, Dengue virus
EEFTKKVRS

SEQ ID NO: 36221 - protein, 9 aa, Dengue virus
EFTKKVRSN

SEQ ID NO: 36222 - protein, 9 aa, Dengue virus
FTKKVRSNA

SEQ ID NO: 36223 - protein, 9 aa, Dengue virus
TKKVRSNAA

SEQ ID NO: 36224 - protein, 9 aa, Dengue virus
KKVRSNAAL

SEQ ID NO: 36225 - protein, 9 aa, Dengue virus
RSNAALGAV

SEQ ID NO: 36226 - protein, 9 aa, Dengue virus
SNAALGAVF

SEQ ID NO: 36227 - protein, 9 aa, Dengue virus
NAALGAVFT

SEQ ID NO: 36228 - protein, 9 aa, Dengue virus
AALGAVFTD

SEQ ID NO: 36229 - protein, 9 aa, Dengue virus
ALGAVFTDE

SEQ ID NO: 36230 - protein, 9 aa, Dengue virus
LGAVFTDEN

SEQ ID NO: 36231 - protein, 9 aa, Dengue virus
GAVFTDENK

SEQ ID NO: 36232 - protein, 9 aa, Dengue virus
AVFTDENKW

SEQ ID NO: 36233 - protein, 9 aa, Dengue virus
VFTDENKWK

SEQ ID NO: 36234 - protein, 9 aa, Dengue virus
SAREAVEDG

SEQ ID NO: 36235 - protein, 9 aa, Dengue virus
AREAVEDGR

SEQ ID NO: 36236 - protein, 9 aa, Dengue virus
REAVEDGRF

SEQ ID NO: 36237 - protein, 9 aa, Dengue virus
EAVEDGRFW

SEQ ID NO: 36238 - protein, 9 aa, Dengue virus
AVEDGRFWE

SEQ ID NO: 36239 - protein, 9 aa, Dengue virus
VEDGRFWEL

SEQ ID NO: 36240 - protein, 9 aa, Dengue virus
FWELVDRER

SEQ ID NO: 36241 - protein, 9 aa, Dengue virus
WELVDRERN

SEQ ID NO: 36242 - protein, 9 aa, Dengue virus
ELVDRERNL

SEQ ID NO: 36243 - protein, 9 aa, Dengue virus
LVDRERNLH

SEQ ID NO: 36244 - protein, 9 aa, Dengue virus
VDRERNLHL

SEQ ID NO: 36245 - protein, 9 aa, Dengue virus
DRERNLHLE

SEQ ID NO: 36246 - protein, 9 aa, Dengue virus
RERNLHLEG

SEQ ID NO: 36247 - protein, 9 aa, Dengue virus
ERNLHLDGK

SEQ ID NO: 36248 - protein, 9 aa, Dengue virus
RNLHLDGKC

SEQ ID NO: 36249 - protein, 9 aa, Dengue virus
NLHLDGKCE

SEQ ID NO: 36250 - protein, 9 aa, Dengue virus
LHLDGKCET

SEQ ID NO: 36251 - protein, 9 aa, Dengue virus
HLDGKCETC

SEQ ID NO: 36252 - protein, 9 aa, Dengue virus
LDGKCETCV

SEQ ID NO: 36253 - protein, 9 aa, Dengue virus
DGKCETCVY

SEQ ID NO: 36254 - protein, 9 aa, Dengue virus
IGEFGKAKG

SEQ ID NO: 36255 - protein, 9 aa, Dengue virus
NEDHWFSRG

SEQ ID NO: 36256 - protein, 9 aa, Dengue virus
EDHWFSRGN

SEQ ID NO: 36257 - protein, 9 aa, Dengue virus
DHWFSRGNS

SEQ ID NO: 36258 - protein, 9 aa, Dengue virus
HWFSRGNSL

SEQ ID NO: 36259 - protein, 9 aa, Dengue virus
WFSRGNSLS

SEQ ID NO: 36260 - protein, 9 aa, Dengue virus
FSRGNSLSG

SEQ ID NO: 36261 - protein, 9 aa, Dengue virus
SRGNSLSGV

SEQ ID NO: 36262 - protein, 9 aa, Dengue virus
RGNSLSGVE

SEQ ID NO: 36263 - protein, 9 aa, Dengue virus
GNSLSGVEG

SEQ ID NO: 36264 - protein, 9 aa, Dengue virus
SGVEGEGLY

SEQ ID NO: 36265 - protein, 9 aa, Dengue virus
GVEGEGLHR

SEQ ID NO: 36266 - protein, 9 aa, Dengue virus
VEGEGLHRL

SEQ ID NO: 36267 - protein, 9 aa, Dengue virus
EGEGLHRLG

SEQ ID NO: 36268 - protein, 9 aa, Dengue virus
GEGLHRLGY

SEQ ID NO: 36269 - protein, 9 aa, Dengue virus
EGLHRLGYI

SEQ ID NO: 36270 - protein, 9 aa, Dengue virus
GLHRLGYIL

SEQ ID NO: 36271 - protein, 9 aa, Dengue virus
LHRLGYILR

SEQ ID NO: 36272 - protein, 9 aa, Dengue virus
HRLGYILRD

SEQ ID NO: 36273 - protein, 9 aa, Dengue virus
RLGYILRDV

SEQ ID NO: 36274 - protein, 9 aa, Dengue virus
LGYILRDVG

SEQ ID NO: 36275 - protein, 9 aa, Dengue virus
GYILRDVGK

SEQ ID NO: 36276 - protein, 9 aa, Dengue virus
YILRDVGKK

SEQ ID NO: 36277 - protein, 9 aa, Dengue virus
VGKKEGGAM

SEQ ID NO: 36278 - protein, 9 aa, Dengue virus
GKKEGGAMY

SEQ ID NO: 36279 - protein, 9 aa, Dengue virus
RKAGGAMYA

SEQ ID NO: 36280 - protein, 9 aa, Dengue virus
KAGGAMYAD

SEQ ID NO: 36281 - protein, 9 aa, Dengue virus
AGGAMYADD

SEQ ID NO: 36282 - protein, 9 aa, Dengue virus
AGWDTRITI

SEQ ID NO: 36283 - protein, 9 aa, Dengue virus
GWDTRITIE

SEQ ID NO: 36284 - protein, 9 aa, Dengue virus
WDTRITIED

SEQ ID NO: 36285 - protein, 9 aa, Dengue virus
DTRITIEDL

SEQ ID NO: 36286 - protein, 9 aa, Dengue virus
TRITIEDLK

SEQ ID NO: 36287 - protein, 9 aa, Dengue virus
RITIEDLKN

SEQ ID NO: 36288 - protein, 9 aa, Dengue virus
ITIEDLKNE

SEQ ID NO: 36289 - protein, 9 aa, Dengue virus
TIEDLKNEE

SEQ ID NO: 36290 - protein, 9 aa, Dengue virus
IEDLKNEEM

SEQ ID NO: 36291 - protein, 9 aa, Dengue virus
EDLKNEEMI

SEQ ID NO: 36292 - protein, 9 aa, Dengue virus
DLKNEEMIT

SEQ ID NO: 36293 - protein, 9 aa, Dengue virus
LKNEEMITN

SEQ ID NO: 36294 - protein, 9 aa, Dengue virus
KNEEMITNH

SEQ ID NO: 36295 - protein, 9 aa, Dengue virus
NEEMITNHM

SEQ ID NO: 36296 - protein, 9 aa, Dengue virus
GEHKRLAEA

SEQ ID NO: 36297 - protein, 9 aa, Dengue virus
EHKRLAEAI

SEQ ID NO: 36298 - protein, 9 aa, Dengue virus
HKRLAEAIF

SEQ ID NO: 36299 - protein, 9 aa, Dengue virus
KRLAEAIFK

SEQ ID NO: 36300 - protein, 9 aa, Dengue virus
RLAEAIFKL

SEQ ID NO: 36301 - protein, 9 aa, Dengue virus
LAEAIFRLT

SEQ ID NO: 36302 - protein, 9 aa, Dengue virus
AEAIFRLTY

SEQ ID NO: 36303 - protein, 9 aa, Dengue virus
EAIFRLTYQ

SEQ ID NO: 36304 - protein, 9 aa, Dengue virus
AIFRLTYQN

SEQ ID NO: 36305 - protein, 9 aa, Dengue virus
IFRLTYQNK

SEQ ID NO: 36306 - protein, 9 aa, Dengue virus
FRLTYQNKV

SEQ ID NO: 36307 - protein, 9 aa, Dengue virus
RLTYQNKVV

SEQ ID NO: 36308 - protein, 9 aa, Dengue virus
VQRPTPKGT

SEQ ID NO: 36309 - protein, 9 aa, Dengue virus
QRPTPIGTV

SEQ ID NO: 36310 - protein, 9 aa, Dengue virus
RPTSRGTVM

SEQ ID NO: 36311 - protein, 9 aa, Dengue virus
PTPKGTVMD

SEQ ID NO: 36312 - protein, 9 aa, Dengue virus
TPKGTVMDI

SEQ ID NO: 36313 - protein, 9 aa, Dengue virus
PKGTVMDII

SEQ ID NO: 36314 - protein, 9 aa, Dengue virus
TVMDIISRK

SEQ ID NO: 36315 - protein, 9 aa, Dengue virus
VMDIISRKD

SEQ ID NO: 36316 - protein, 9 aa, Dengue virus
MDIISRKDQ

SEQ ID NO: 36317 - protein, 9 aa, Dengue virus
DIISRKDQR

SEQ ID NO: 36318 - protein, 9 aa, Dengue virus
IISRKDQRG

SEQ ID NO: 36319 - protein, 9 aa, Dengue virus
ISRKDQRGS

SEQ ID NO: 36320 - protein, 9 aa, Dengue virus
SRKDQRGSG

SEQ ID NO: 36321 - protein, 9 aa, Dengue virus
RKDQRGSGQ

SEQ ID NO: 36322 - protein, 9 aa, Dengue virus
KDQRGSGQV

SEQ ID NO: 36323 - protein, 9 aa, Dengue virus
DQRGSGQVV

SEQ ID NO: 36324 - protein, 9 aa, Dengue virus
QRGSGQVVT

SEQ ID NO: 36325 - protein, 9 aa, Dengue virus
RGSGQVVTY

SEQ ID NO: 36326 - protein, 9 aa, Dengue virus
GSGQVVTYG

SEQ ID NO: 36327 - protein, 9 aa, Dengue virus
SGQVVTYGL

SEQ ID NO: 36328 - protein, 9 aa, Dengue virus
GQVVTYGLN

SEQ ID NO: 36329 - protein, 9 aa, Dengue virus
QVVTYGLNT

SEQ ID NO: 36330 - protein, 9 aa, Dengue virus
VVTYGLNTF

SEQ ID NO: 36331 - protein, 9 aa, Dengue virus
VTYGLNTFT

SEQ ID NO: 36332 - protein, 9 aa, Dengue virus
GLNTFTNMG

SEQ ID NO: 36333 - protein, 9 aa, Dengue virus
LNTFTNMGA

SEQ ID NO: 36334 - protein, 9 aa, Dengue virus
NTFTNMGAQ

SEQ ID NO: 36335 - protein, 9 aa, Dengue virus
TFTNMGAQL

SEQ ID NO: 36336 - protein, 9 aa, Dengue virus
FTNMGAQLI

SEQ ID NO: 36337 - protein, 9 aa, Dengue virus
TNMGAQLIR

SEQ ID NO: 36338 - protein, 9 aa, Dengue virus
NMGAQLIRQ

SEQ ID NO: 36339 - protein, 9 aa, Dengue virus
MGAQLIRQM

SEQ ID NO: 36340 - protein, 9 aa, Dengue virus
IRQMEGEGV

SEQ ID NO: 36341 - protein, 9 aa, Dengue virus
RQMEGEGVF

SEQ ID NO: 36342 - protein, 9 aa, Dengue virus
QMEGEGVFK

SEQ ID NO: 36343 - protein, 9 aa, Dengue virus
REGRERLAR

SEQ ID NO: 36344 - protein, 9 aa, Dengue virus
EGRERLARM

SEQ ID NO: 36345 - protein, 9 aa, Dengue virus
GRERLARMA

SEQ ID NO: 36346 - protein, 9 aa, Dengue virus
RERLARMAI

SEQ ID NO: 36347 - protein, 9 aa, Dengue virus
ERLARMAIS

SEQ ID NO: 36348 - protein, 9 aa, Dengue virus
RLARMAISG

SEQ ID NO: 36349 - protein, 9 aa, Dengue virus
LARMAISGD

SEQ ID NO: 36350 - protein, 9 aa, Dengue virus
ARMAISGDD

SEQ ID NO: 36351 - protein, 9 aa, Dengue virus
GDDCVVKPI

SEQ ID NO: 36352 - protein, 9 aa, Dengue virus
DDCVVKPID

SEQ ID NO: 36353 - protein, 9 aa, Dengue virus
DCVVKPIDD

SEQ ID NO: 36354 - protein, 9 aa, Dengue virus
CVVKPIDDR

SEQ ID NO: 36355 - protein, 9 aa, Dengue virus
VVKPIDDRF

SEQ ID NO: 36356 - protein, 9 aa, Dengue virus
VKPIDDRFA

SEQ ID NO: 36357 - protein, 9 aa, Dengue virus
DDRFANALT

SEQ ID NO: 36358 - protein, 9 aa, Dengue virus
DRFANALTA

SEQ ID NO: 36359 - protein, 9 aa, Dengue virus
RFANALTAL

SEQ ID NO: 36360 - protein, 9 aa, Dengue virus
FANALTALN

SEQ ID NO: 36361 - protein, 9 aa, Dengue virus
ANALTALND

SEQ ID NO: 36362 - protein, 9 aa, Dengue virus
NALTALNDM

SEQ ID NO: 36363 - protein, 9 aa, Dengue virus
TALNDMGKI

SEQ ID NO: 36364 - protein, 9 aa, Dengue virus
ALNDMGKIR

SEQ ID NO: 36365 - protein, 9 aa, Dengue virus
LNDMGKIRK

SEQ ID NO: 36366 - protein, 9 aa, Dengue virus
NDMGKIRKD

SEQ ID NO: 36367 - protein, 9 aa, Dengue virus
DMGKIRKDI

SEQ ID NO: 36368 - protein, 9 aa, Dengue virus
MGKIRKDIQ

SEQ ID NO: 36369 - protein, 9 aa, Dengue virus
GKIRKDIQQ

SEQ ID NO: 36370 - protein, 9 aa, Dengue virus
KIRKDIQQW

SEQ ID NO: 36371 - protein, 9 aa, Dengue virus
IRKDIQQWE

SEQ ID NO: 36372 - protein, 9 aa, Dengue virus
DIQQWEPSK

SEQ ID NO: 36373 - protein, 9 aa, Dengue virus
IQQWEPSKG

SEQ ID NO: 36374 - protein, 9 aa, Dengue virus
QQWEPSKGW

SEQ ID NO: 36375 - protein, 9 aa, Dengue virus
QWEPSKGWN

SEQ ID NO: 36376 - protein, 9 aa, Dengue virus
WEPSKGWND

SEQ ID NO: 36377 - protein, 9 aa, Dengue virus
EPSKGWNDW

SEQ ID NO: 36378 - protein, 9 aa, Dengue virus
PSKGWNDWT

SEQ ID NO: 36379 - protein, 9 aa, Dengue virus
SKGWNDWTQ

SEQ ID NO: 36380 - protein, 9 aa, Dengue virus
KGWNDWTQV

SEQ ID NO: 36381 - protein, 9 aa, Dengue virus
GWSDWTQVP

SEQ ID NO: 36382 - protein, 9 aa, Dengue virus
WSDWTQVPF

SEQ ID NO: 36383 - protein, 9 aa, Dengue virus
SDWTQVPFC

SEQ ID NO: 36384 - protein, 9 aa, Dengue virus
CSHHFHELV

SEQ ID NO: 36385 - protein, 9 aa, Dengue virus
SHHFHELVM

SEQ ID NO: 36386 - protein, 9 aa, Dengue virus
HHFHELVMK

SEQ ID NO: 36387 - protein, 9 aa, Dengue virus
HFHELVMKD

SEQ ID NO: 36388 - protein, 9 aa, Dengue virus
FHELVMKDG

SEQ ID NO: 36389 - protein, 9 aa, Dengue virus
HELVMKDGR

SEQ ID NO: 36390 - protein, 9 aa, Dengue virus
MKDGRTLVV

SEQ ID NO: 36391 - protein, 9 aa, Dengue virus
KDGRTLVVP

SEQ ID NO: 36392 - protein, 9 aa, Dengue virus
DGRTLVVPC

SEQ ID NO: 36393 - protein, 9 aa, Dengue virus
GRTLVVPCR

SEQ ID NO: 36394 - protein, 9 aa, Dengue virus
LVVPCRSQD

SEQ ID NO: 36395 - protein, 9 aa, Dengue virus
VVPCRSQDE

SEQ ID NO: 36396 - protein, 9 aa, Dengue virus
VPCRSQDEL

SEQ ID NO: 36397 - protein, 9 aa, Dengue virus
PCRSQDELI

SEQ ID NO: 36398 - protein, 9 aa, Dengue virus
CRSQDELIG

SEQ ID NO: 36399 - protein, 9 aa, Dengue virus
RSQDELIGR

SEQ ID NO: 36400 - protein, 9 aa, Dengue virus
SQDELIGRA

SEQ ID NO: 36401 - protein, 9 aa, Dengue virus
SQGAGWSLR

SEQ ID NO: 36402 - protein, 9 aa, Dengue virus
QGAGWSLRE

SEQ ID NO: 36403 - protein, 9 aa, Dengue virus
GAGWSLRET

SEQ ID NO: 36404 - protein, 9 aa, Dengue virus
AGWSLRETA

SEQ ID NO: 36405 - protein, 9 aa, Dengue virus
GWSLRETAC

SEQ ID NO: 36406 - protein, 9 aa, Dengue virus
WSLRETACL

SEQ ID NO: 36407 - protein, 9 aa, Dengue virus
SLRETACLG

SEQ ID NO: 36408 - protein, 9 aa, Dengue virus
LRETACLGK

SEQ ID NO: 36409 - protein, 9 aa, Dengue virus
RETACLGKS

SEQ ID NO: 36410 - protein, 9 aa, Dengue virus
GKSYAQMWT

SEQ ID NO: 36411 - protein, 9 aa, Dengue virus
KSYAQMWTL

SEQ ID NO: 36412 - protein, 9 aa, Dengue virus
SYAQMWTLM

SEQ ID NO: 36413 - protein, 9 aa, Dengue virus
YAQMWTLMY

SEQ ID NO: 36414 - protein, 9 aa, Dengue virus
AQMWTLMYF

SEQ ID NO: 36415 - protein, 9 aa, Dengue virus
QMWTLMYFH

SEQ ID NO: 36416 - protein, 9 aa, Dengue virus
MWTLMYFHR

SEQ ID NO: 36417 - protein, 9 aa, Dengue virus
WTLMYFHRR

SEQ ID NO: 36418 - protein, 9 aa, Dengue virus
TLMYFHRRD

SEQ ID NO: 36419 - protein, 9 aa, Dengue virus
NAICSAVPP

SEQ ID NO: 36420 - protein, 9 aa, Dengue virus
AICSAVPPH

SEQ ID NO: 36421 - protein, 9 aa, Dengue virus
ICSAVPPHW

SEQ ID NO: 36422 - protein, 9 aa, Dengue virus
CSAVPPHWV

SEQ ID NO: 36423 - protein, 9 aa, Dengue virus
SAVPPHWVP

SEQ ID NO: 36424 - protein, 9 aa, Dengue virus
AVPPHWVPT

SEQ ID NO: 36425 - protein, 9 aa, Dengue virus
VPPHWVPTS

SEQ ID NO: 36426 - protein, 9 aa, Dengue virus
PPHWVPTSR

SEQ ID NO: 36427 - protein, 9 aa, Dengue virus
PHWVPTSRT

SEQ ID NO: 36428 - protein, 9 aa, Dengue virus
RTTWSIHAT

SEQ ID NO: 36429 - protein, 9 aa, Dengue virus
TTWSIHATH

SEQ ID NO: 36430 - protein, 9 aa, Dengue virus
TWSIHATHE

SEQ ID NO: 36431 - protein, 9 aa, Dengue virus
WSIHATHEW

SEQ ID NO: 36432 - protein, 9 aa, Dengue virus
SIHATHEWM

SEQ ID NO: 36433 - protein, 9 aa, Dengue virus
IHATHEWMT

SEQ ID NO: 36434 - protein, 9 aa, Dengue virus
HATHEWMTT

SEQ ID NO: 36435 - protein, 9 aa, Dengue virus
ATHEWMTTE

SEQ ID NO: 36436 - protein, 9 aa, Dengue virus
THEWMTTED

SEQ ID NO: 36437 - protein, 9 aa, Dengue virus
WMTTEDMLT

SEQ ID NO: 36438 - protein, 9 aa, Dengue virus
MTTEDMLTV

SEQ ID NO: 36439 - protein, 9 aa, Dengue virus
TTEDMLTVW

SEQ ID NO: 36440 - protein, 9 aa, Dengue virus
TEDMLTVWN

SEQ ID NO: 36441 - protein, 9 aa, Dengue virus
EDMLTVWNR

SEQ ID NO: 36442 - protein, 9 aa, Dengue virus
DMLTVWNRV

SEQ ID NO: 36443 - protein, 9 aa, Dengue virus
MLTVWNRVW

SEQ ID NO: 36444 - protein, 9 aa, Dengue virus
LTVWNRVWI

SEQ ID NO: 36445 - protein, 9 aa, Dengue virus
TVWNRVWIQ

SEQ ID NO: 36446 - protein, 9 aa, Dengue virus
VWNRVWIRE

SEQ ID NO: 36447 - protein, 9 aa, Dengue virus
WNRVWIREN

SEQ ID NO: 36448 - protein, 9 aa, Dengue virus
NRVWIRENP

SEQ ID NO: 36449 - protein, 9 aa, Dengue virus
RVWIRENPW

SEQ ID NO: 36450 - protein, 9 aa, Dengue virus
VWIRENPWM

SEQ ID NO: 36451 - protein, 9 aa, Dengue virus
WIRENPWME

SEQ ID NO: 36452 - protein, 9 aa, Dengue virus
IRENPWMED

SEQ ID NO: 36453 - protein, 9 aa, Dengue virus
RENPWMEDK

SEQ ID NO: 36454 - protein, 9 aa, Dengue virus
DNPWMEDKT

SEQ ID NO: 36455 - protein, 9 aa, Dengue virus
NPWIEDKTP

SEQ ID NO: 36456 - protein, 9 aa, Dengue virus
PWIEDKTPV

SEQ ID NO: 36457 - protein, 9 aa, Dengue virus
WIEDKTPVE

SEQ ID NO: 36458 - protein, 9 aa, Dengue virus
IEDKTPVES

SEQ ID NO: 36459 - protein, 9 aa, Dengue virus
EDKTPVETW

SEQ ID NO: 36460 - protein, 9 aa, Dengue virus
DKTPVETWE

SEQ ID NO: 36461 - protein, 9 aa, Dengue virus
KTPVESWED

SEQ ID NO: 36462 - protein, 9 aa, Dengue virus
TPVESWEEI

SEQ ID NO: 36463 - protein, 9 aa, Dengue virus
PVESWEEIP

SEQ ID NO: 36464 - protein, 9 aa, Dengue virus
VESWEEIPY

SEQ ID NO: 36465 - protein, 9 aa, Dengue virus
ESWEEIPYL

SEQ ID NO: 36466 - protein, 9 aa, Dengue virus
SWEEIPYLG

SEQ ID NO: 36467 - protein, 9 aa, Dengue virus
WEEIPYLGK

SEQ ID NO: 36468 - protein, 9 aa, Dengue virus
EEIPYLGKR

SEQ ID NO: 36469 - protein, 9 aa, Dengue virus
EIPYLGKRE

SEQ ID NO: 36470 - protein, 9 aa, Dengue virus
IPYLGKRED

SEQ ID NO: 36471 - protein, 9 aa, Dengue virus
ATWAKNIQA

SEQ ID NO: 36472 - protein, 9 aa, Dengue virus
TWAKNIQAA

SEQ ID NO: 36473 - protein, 9 aa, Dengue virus
WAKNIQAAI

SEQ ID NO: 36474 - protein, 9 aa, Dengue virus
AKNIQAAIN

SEQ ID NO: 36475 - protein, 9 aa, Dengue virus
KNIQAAINQ

SEQ ID NO: 36476 - protein, 9 aa, Dengue virus
NIQAAINQV

SEQ ID NO: 36477 - protein, 9 aa, Dengue virus
IQAAINQVR

SEQ ID NO: 36478 - protein, 9 aa, Dengue virus
QAAINQVRS

SEQ ID NO: 36479 - protein, 9 aa, Dengue virus
AAINQVRSL

SEQ ID NO: 36480 - protein, 9 aa, Dengue virus
AINQVRALI

SEQ ID NO: 36481 - protein, 9 aa, Dengue virus
INQVRALIG

SEQ ID NO: 36482 - protein, 9 aa, Dengue virus
NQVRALIGE

SEQ ID NO: 36483 - protein, 9 aa, Dengue virus
QVRALIGEE

SEQ ID NO: 36484 - protein, 9 aa, Dengue virus
VRALIGEEE

SEQ ID NO: 36485 - protein, 9 aa, Dengue virus
RALIGEEEY

SEQ ID NO: 36486 - protein, 9 aa, Dengue virus
EGYTDYMPS

SEQ ID NO: 36487 - protein, 9 aa, Dengue virus
GYTDYMPSM

SEQ ID NO: 36488 - protein, 9 aa, Dengue virus
YIDYMPSMK

SEQ ID NO: 36489 - protein, 9 aa, Dengue virus
IDYMPSMKR

SEQ ID NO: 36490 - protein, 9 aa, Dengue virus
MPSMKRFRK

SEQ ID NO: 36491 - protein, 9 aa, Dengue virus
PSMKRFRKE

SEQ ID NO: 36492 - protein, 9 aa, Dengue virus
SMKRFRKEE

SEQ ID NO: 36493 - protein, 9 aa, Dengue virus
MKRFRKEEE

SEQ ID NO: 36494 - protein, 9 aa, Dengue virus
KRFRKEEEE

SEQ ID NO: 36495 - protein, 9 aa, Dengue virus
RFRKEEEEA

SEQ ID NO: 36496 - protein, 9 aa, Dengue virus
FRKEEEEAG

SEQ ID NO: 36497 - protein, 9 aa, Dengue virus
RKEEEEAGV

SEQ ID NO: 36498 - protein, 9 aa, Dengue virus
KEEEEAGVL

SEQ ID NO: 36499 - protein, 9 aa, Dengue virus
EEEESGVLW

SEQ ID NO: 36500 - protein, 9 aa, Dengue virus
MNNQRKKVS

SEQ ID NO: 36501 - protein, 9 aa, Dengue virus
NNQRKKARN

SEQ ID NO: 36502 - protein, 9 aa, Dengue virus
TTPFNMLKR

SEQ ID NO: 36503 - protein, 9 aa, Dengue virus
LRLFMALVA

SEQ ID NO: 36504 - protein, 9 aa, Dengue virus
RLFMALVAF

SEQ ID NO: 36505 - protein, 9 aa, Dengue virus
TGILKRWGT

SEQ ID NO: 36506 - protein, 9 aa, Dengue virus
RWGAIKKSK

SEQ ID NO: 36507 - protein, 9 aa, Dengue virus
WGTIKKSRA

SEQ ID NO: 36508 - protein, 9 aa, Dengue virus
GAIKKSKAI

SEQ ID NO: 36509 - protein, 9 aa, Dengue virus
TIKKSKAIS

SEQ ID NO: 36510 - protein, 9 aa, Dengue virus
IKKSKAISV

SEQ ID NO: 36511 - protein, 9 aa, Dengue virus
KKSKAINIL

SEQ ID NO: 36512 - protein, 9 aa, Dengue virus
KSRAINVLR

SEQ ID NO: 36513 - protein, 9 aa, Dengue virus
SKAINILRG

SEQ ID NO: 36514 - protein, 9 aa, Dengue virus
KAINILRGF

SEQ ID NO: 36515 - protein, 9 aa, Dengue virus
INVLRGFRR

SEQ ID NO: 36516 - protein, 9 aa, Dengue virus
NVLRGFRRE

SEQ ID NO: 36517 - protein, 9 aa, Dengue virus
NILNKRRRT

SEQ ID NO: 36518 - protein, 9 aa, Dengue virus
ILNKRRRTA

SEQ ID NO: 36519 - protein, 9 aa, Dengue virus
LNKRRRTAG

SEQ ID NO: 36520 - protein, 9 aa, Dengue virus
IPTVVAFHL

SEQ ID NO: 36521 - protein, 9 aa, Dengue virus
PTVVAFHLT

SEQ ID NO: 36522 - protein, 9 aa, Dengue virus
TVVAFHLTT

SEQ ID NO: 36523 - protein, 9 aa, Dengue virus
VVAFHLTTR

SEQ ID NO: 36524 - protein, 9 aa, Dengue virus
IAFHLTTRN

SEQ ID NO: 36525 - protein, 9 aa, Dengue virus
GEPHMIVSR

SEQ ID NO: 36526 - protein, 9 aa, Dengue virus
EPHMIVSRQ

SEQ ID NO: 36527 - protein, 9 aa, Dengue virus
PHMIVSRQE

SEQ ID NO: 36528 - protein, 9 aa, Dengue virus
HMIVSRQEK

SEQ ID NO: 36529 - protein, 9 aa, Dengue virus
MIVSRQEKG

SEQ ID NO: 36530 - protein, 9 aa, Dengue virus
IVSRQEKGK

SEQ ID NO: 36531 - protein, 9 aa, Dengue virus
VSRQEKGKS

SEQ ID NO: 36532 - protein, 9 aa, Dengue virus
SRQEKGKSL

SEQ ID NO: 36533 - protein, 9 aa, Dengue virus
KNEKGKSLL

SEQ ID NO: 36534 - protein, 9 aa, Dengue virus
KSLLFKTKD

SEQ ID NO: 36535 - protein, 9 aa, Dengue virus
SLLFKTKDG

SEQ ID NO: 36536 - protein, 9 aa, Dengue virus
DGTNMCTLM

SEQ ID NO: 36537 - protein, 9 aa, Dengue virus
GINMCTLMA

SEQ ID NO: 36538 - protein, 9 aa, Dengue virus
TNMCTLMAM

SEQ ID NO: 36539 - protein, 9 aa, Dengue virus
LCEDTVTYK

SEQ ID NO: 36540 - protein, 9 aa, Dengue virus
CEDTVTYKC

SEQ ID NO: 36541 - protein, 9 aa, Dengue virus
EDTVTYKCP

SEQ ID NO: 36542 - protein, 9 aa, Dengue virus
DTITYKCPF

SEQ ID NO: 36543 - protein, 9 aa, Dengue virus
TITYKCPFL

SEQ ID NO: 36544 - protein, 9 aa, Dengue virus
TYKCPFLKQ

SEQ ID NO: 36545 - protein, 9 aa, Dengue virus
YKCPFLKQN

SEQ ID NO: 36546 - protein, 9 aa, Dengue virus
KCPFLKQNE

SEQ ID NO: 36547 - protein, 9 aa, Dengue virus
CPLLKQNEP

SEQ ID NO: 36548 - protein, 9 aa, Dengue virus
PLLKQNEPE

SEQ ID NO: 36549 - protein, 9 aa, Dengue virus
LLKQNEPED

SEQ ID NO: 36550 - protein, 9 aa, Dengue virus
TWVTYGTCA

SEQ ID NO: 36551 - protein, 9 aa, Dengue virus
TMGEHRREK

SEQ ID NO: 36552 - protein, 9 aa, Dengue virus
SSEGAWKQA

SEQ ID NO: 36553 - protein, 9 aa, Dengue virus
SEGAWKQAQ

SEQ ID NO: 36554 - protein, 9 aa, Dengue virus
EGAWKQAQR

SEQ ID NO: 36555 - protein, 9 aa, Dengue virus
GAWKQAQRI

SEQ ID NO: 36556 - protein, 9 aa, Dengue virus
AWKQAQRIE

SEQ ID NO: 36557 - protein, 9 aa, Dengue virus
WKQAQRIET

SEQ ID NO: 36558 - protein, 9 aa, Dengue virus
KQAQRIETW

SEQ ID NO: 36559 - protein, 9 aa, Dengue virus
HAQRIETWV

SEQ ID NO: 36560 - protein, 9 aa, Dengue virus
AQRIETWVL

SEQ ID NO: 36561 - protein, 9 aa, Dengue virus
WILRHPGFA

SEQ ID NO: 36562 - protein, 9 aa, Dengue virus
LRHPGFTLM

SEQ ID NO: 36563 - protein, 9 aa, Dengue virus
RHPGFTLMA

SEQ ID NO: 36564 - protein, 9 aa, Dengue virus
HPGFTLMAA

SEQ ID NO: 36565 - protein, 9 aa, Dengue virus
MAAVLAYTI

SEQ ID NO: 36566 - protein, 9 aa, Dengue virus
AAVLAYTIG

SEQ ID NO: 36567 - protein, 9 aa, Dengue virus
AVLAYTIGT

SEQ ID NO: 36568 - protein, 9 aa, Dengue virus
VLAYTIGTT

SEQ ID NO: 36569 - protein, 9 aa, Dengue virus
LAYTVGTTH

SEQ ID NO: 36570 - protein, 9 aa, Dengue virus
AYTVGTTHF

SEQ ID NO: 36571 - protein, 9 aa, Dengue virus
YTVGTTHFQ

SEQ ID NO: 36572 - protein, 9 aa, Dengue virus
TVGTTHFQR

SEQ ID NO: 36573 - protein, 9 aa, Dengue virus
GTTYFQRVL

SEQ ID NO: 36574 - protein, 9 aa, Dengue virus
TTYFQRVLI

SEQ ID NO: 36575 - protein, 9 aa, Dengue virus
TYFQRVLIF

SEQ ID NO: 36576 - protein, 9 aa, Dengue virus
YFQRVLIFI

SEQ ID NO: 36577 - protein, 9 aa, Dengue virus
FQRTLIFIL

SEQ ID NO: 36578 - protein, 9 aa, Dengue virus
QRTLIFILL

SEQ ID NO: 36579 - protein, 9 aa, Dengue virus
RALIFILLA

SEQ ID NO: 36580 - protein, 9 aa, Dengue virus
ALIFILLAA

SEQ ID NO: 36581 - protein, 9 aa, Dengue virus
LIFILLTAI

SEQ ID NO: 36582 - protein, 9 aa, Dengue virus
IFILLTAIA

SEQ ID NO: 36583 - protein, 9 aa, Dengue virus
FILLTAIAP

SEQ ID NO: 36584 - protein, 9 aa, Dengue virus
ILLTAIAPS

SEQ ID NO: 36585 - protein, 9 aa, Dengue virus
LLTAIAPSM

SEQ ID NO: 36586 - protein, 9 aa, Dengue virus
LTAIAPSMT

SEQ ID NO: 36587 - protein, 9 aa, Dengue virus
TAIAPSMTM

SEQ ID NO: 36588 - protein, 9 aa, Dengue virus
AIAPSMTMR

SEQ ID NO: 36589 - protein, 9 aa, Dengue virus
IAPSMTMRC

SEQ ID NO: 36590 - protein, 9 aa, Dengue virus
SMAMRCIGI

SEQ ID NO: 36591 - protein, 9 aa, Dengue virus
MAMRCIGIS

SEQ ID NO: 36592 - protein, 9 aa, Dengue virus
AMRCIGISN

SEQ ID NO: 36593 - protein, 9 aa, Dengue virus
ELIKTEAKE

SEQ ID NO: 36594 - protein, 9 aa, Dengue virus
KTEAKEPAT

SEQ ID NO: 36595 - protein, 9 aa, Dengue virus
TEAKEPATL

SEQ ID NO: 36596 - protein, 9 aa, Dengue virus
EAKEPATLR

SEQ ID NO: 36597 - protein, 9 aa, Dengue virus
AKEPATLRK

SEQ ID NO: 36598 - protein, 9 aa, Dengue virus
KQPATLRKF

SEQ ID NO: 36599 - protein, 9 aa, Dengue virus
QPATLRKFC

SEQ ID NO: 36600 - protein, 9 aa, Dengue virus
PATLRKYCV

SEQ ID NO: 36601 - protein, 9 aa, Dengue virus
ATLRKYCVE

SEQ ID NO: 36602 - protein, 9 aa, Dengue virus
TLRKYCVEA

SEQ ID NO: 36603 - protein, 9 aa, Dengue virus
LRKYCVEAK

SEQ ID NO: 36604 - protein, 9 aa, Dengue virus
RKYCVEAKL

SEQ ID NO: 36605 - protein, 9 aa, Dengue virus
KYCVEAKLT

SEQ ID NO: 36606 - protein, 9 aa, Dengue virus
YCVEAKLTN

SEQ ID NO: 36607 - protein, 9 aa, Dengue virus
IEARLTNTT

SEQ ID NO: 36608 - protein, 9 aa, Dengue virus
AKLTNTTTD

SEQ ID NO: 36609 - protein, 9 aa, Dengue virus
KLTNTTTDS

SEQ ID NO: 36610 - protein, 9 aa, Dengue virus
LTNTTTDSR

SEQ ID NO: 36611 - protein, 9 aa, Dengue virus
TNTTTDSRC

SEQ ID NO: 36612 - protein, 9 aa, Dengue virus
NTTTDSRCP

SEQ ID NO: 36613 - protein, 9 aa, Dengue virus
TTTDSRCPT

SEQ ID NO: 36614 - protein, 9 aa, Dengue virus
TTDSRCPTQ

SEQ ID NO: 36615 - protein, 9 aa, Dengue virus
TDSRCPTQG

SEQ ID NO: 36616 - protein, 9 aa, Dengue virus
DSRCPTQGE

SEQ ID NO: 36617 - protein, 9 aa, Dengue virus
PTQGEPTLN

SEQ ID NO: 36618 - protein, 9 aa, Dengue virus
TQGEPTLNE

SEQ ID NO: 36619 - protein, 9 aa, Dengue virus
QGEPTLNEE

SEQ ID NO: 36620 - protein, 9 aa, Dengue virus
GEPTLNEEQ

SEQ ID NO: 36621 - protein, 9 aa, Dengue virus
EPTLNEEQD

SEQ ID NO: 36622 - protein, 9 aa, Dengue virus
PTLNEEQDK

SEQ ID NO: 36623 - protein, 9 aa, Dengue virus
TLNEEQDKR

SEQ ID NO: 36624 - protein, 9 aa, Dengue virus
LSEEQDKRF

SEQ ID NO: 36625 - protein, 9 aa, Dengue virus
EEQDKRFLC

SEQ ID NO: 36626 - protein, 9 aa, Dengue virus
EQDKRFVCR

SEQ ID NO: 36627 - protein, 9 aa, Dengue virus
QDKRFVCRH

SEQ ID NO: 36628 - protein, 9 aa, Dengue virus
DKRFVCRHS

SEQ ID NO: 36629 - protein, 9 aa, Dengue virus
KRFVCRHSM

SEQ ID NO: 36630 - protein, 9 aa, Dengue virus
RFVCRHSMV

SEQ ID NO: 36631 - protein, 9 aa, Dengue virus
FVCRHSMVD

SEQ ID NO: 36632 - protein, 9 aa, Dengue virus
VCRHSMVDR

SEQ ID NO: 36633 - protein, 9 aa, Dengue virus
GIVTCAKFT

SEQ ID NO: 36634 - protein, 9 aa, Dengue virus
IVTCAMFSC

SEQ ID NO: 36635 - protein, 9 aa, Dengue virus
VTCAMFRCK

SEQ ID NO: 36636 - protein, 9 aa, Dengue virus
TCAMFTCLK

SEQ ID NO: 36637 - protein, 9 aa, Dengue virus
CAMFTCLKK

SEQ ID NO: 36638 - protein, 9 aa, Dengue virus
AMFTCLKKM

SEQ ID NO: 36639 - protein, 9 aa, Dengue virus
MFTCKKNMK

SEQ ID NO: 36640 - protein, 9 aa, Dengue virus
FTCLKKMEG

SEQ ID NO: 36641 - protein, 9 aa, Dengue virus
TCKKNMKGK

SEQ ID NO: 36642 - protein, 9 aa, Dengue virus
CKKNMKGKV

SEQ ID NO: 36643 - protein, 9 aa, Dengue virus
LKKMEGKVV

SEQ ID NO: 36644 - protein, 9 aa, Dengue virus
KNMEGKVVL

SEQ ID NO: 36645 - protein, 9 aa, Dengue virus
NMEGKVVLP

SEQ ID NO: 36646 - protein, 9 aa, Dengue virus
MEGKVVLPE

SEQ ID NO: 36647 - protein, 9 aa, Dengue virus
EGKVVLPEN

SEQ ID NO: 36648 - protein, 9 aa, Dengue virus
GKVVLPENL

SEQ ID NO: 36649 - protein, 9 aa, Dengue virus
KVVLPENLE

SEQ ID NO: 36650 - protein, 9 aa, Dengue virus
VVLPENLEY

SEQ ID NO: 36651 - protein, 9 aa, Dengue virus
QPENLEYTV

SEQ ID NO: 36652 - protein, 9 aa, Dengue virus
ENLEYTVVI

SEQ ID NO: 36653 - protein, 9 aa, Dengue virus
NLEYTVVIT

SEQ ID NO: 36654 - protein, 9 aa, Dengue virus
LEYTVVITP

SEQ ID NO: 36655 - protein, 9 aa, Dengue virus
EYTVVITPH

SEQ ID NO: 36656 - protein, 9 aa, Dengue virus
YTVVITPHS

SEQ ID NO: 36657 - protein, 9 aa, Dengue virus
TVVITPHSG

SEQ ID NO: 36658 - protein, 9 aa, Dengue virus
VVITPHSGE

SEQ ID NO: 36659 - protein, 9 aa, Dengue virus
ITPHSGEEN

SEQ ID NO: 36660 - protein, 9 aa, Dengue virus
SGEEHAVGD

SEQ ID NO: 36661 - protein, 9 aa, Dengue virus
GEEHAVGDD

SEQ ID NO: 36662 - protein, 9 aa, Dengue virus
EEHAVGDDT

SEQ ID NO: 36663 - protein, 9 aa, Dengue virus
EHAVGDDTG

SEQ ID NO: 36664 - protein, 9 aa, Dengue virus
HAVGDDTGK

SEQ ID NO: 36665 - protein, 9 aa, Dengue virus
GNDTGKHGM

SEQ ID NO: 36666 - protein, 9 aa, Dengue virus
NDTGKHGME

SEQ ID NO: 36667 - protein, 9 aa, Dengue virus
DTGKHGKEV

SEQ ID NO: 36668 - protein, 9 aa, Dengue virus
TGKHGKEVK

SEQ ID NO: 36669 - protein, 9 aa, Dengue virus
GKHGQEIKV

SEQ ID NO: 36670 - protein, 9 aa, Dengue virus
KHGQEIKVT

SEQ ID NO: 36671 - protein, 9 aa, Dengue virus
HGQEIKVTP

SEQ ID NO: 36672 - protein, 9 aa, Dengue virus
GQEIKVTPQ

SEQ ID NO: 36673 - protein, 9 aa, Dengue virus
QEIKVTPQS

SEQ ID NO: 36674 - protein, 9 aa, Dengue virus
EVKITPQSS

SEQ ID NO: 36675 - protein, 9 aa, Dengue virus
AEAELTGYG

SEQ ID NO: 36676 - protein, 9 aa, Dengue virus
AELTGYGTI

SEQ ID NO: 36677 - protein, 9 aa, Dengue virus
TGYGTITME

SEQ ID NO: 36678 - protein, 9 aa, Dengue virus
GYGTITMEC

SEQ ID NO: 36679 - protein, 9 aa, Dengue virus
MEEKAWLVH

SEQ ID NO: 36680 - protein, 9 aa, Dengue virus
EEKAWLVHR

SEQ ID NO: 36681 - protein, 9 aa, Dengue virus
EKAWLVHRQ

SEQ ID NO: 36682 - protein, 9 aa, Dengue virus
LPWLPGADI

SEQ ID NO: 36683 - protein, 9 aa, Dengue virus
PWLPGADIQ

SEQ ID NO: 36684 - protein, 9 aa, Dengue virus
WLPGADKQG

SEQ ID NO: 36685 - protein, 9 aa, Dengue virus
LPGADKQGS

SEQ ID NO: 36686 - protein, 9 aa, Dengue virus
PGADKQGSN

SEQ ID NO: 36687 - protein, 9 aa, Dengue virus
GADKQGSNW

SEQ ID NO: 36688 - protein, 9 aa, Dengue virus
ADKQGSNWI

SEQ ID NO: 36689 - protein, 9 aa, Dengue virus
DKQGSNWIQ

SEQ ID NO: 36690 - protein, 9 aa, Dengue virus
KQGSNWIQK

SEQ ID NO: 36691 - protein, 9 aa, Dengue virus
GSNWIQKEM

SEQ ID NO: 36692 - protein, 9 aa, Dengue virus
EIQMSSGNI

SEQ ID NO: 36693 - protein, 9 aa, Dengue virus
IQMSSGNIL

SEQ ID NO: 36694 - protein, 9 aa, Dengue virus
QMSSGNILF

SEQ ID NO: 36695 - protein, 9 aa, Dengue virus
MSSGNILFM

SEQ ID NO: 36696 - protein, 9 aa, Dengue virus
QHGTIVVRV

SEQ ID NO: 36697 - protein, 9 aa, Dengue virus
HGTIVVRVQ

SEQ ID NO: 36698 - protein, 9 aa, Dengue virus
GTIVVRVQY

SEQ ID NO: 36699 - protein, 9 aa, Dengue virus
TIVVRVQYE

SEQ ID NO: 36700 - protein, 9 aa, Dengue virus
IVVRVQYEG

SEQ ID NO: 36701 - protein, 9 aa, Dengue virus
VVRVQYEGD

SEQ ID NO: 36702 - protein, 9 aa, Dengue virus
IRIQYEGDG

SEQ ID NO: 36703 - protein, 9 aa, Dengue virus
RIQYEGDGS

SEQ ID NO: 36704 - protein, 9 aa, Dengue virus
IQYEGDGSP

SEQ ID NO: 36705 - protein, 9 aa, Dengue virus
YEGDGSPCR

SEQ ID NO: 36706 - protein, 9 aa, Dengue virus
EGDGSPCRI

SEQ ID NO: 36707 - protein, 9 aa, Dengue virus
GDGSPCRIP

SEQ ID NO: 36708 - protein, 9 aa, Dengue virus
DGSPCRIPF

SEQ ID NO: 36709 - protein, 9 aa, Dengue virus
GSPCRIPFE

SEQ ID NO: 36710 - protein, 9 aa, Dengue virus
SPCKVPFEI

SEQ ID NO: 36711 - protein, 9 aa, Dengue virus
PCRIPFEIM

SEQ ID NO: 36712 - protein, 9 aa, Dengue virus
CRIPFEIMD

SEQ ID NO: 36713 - protein, 9 aa, Dengue virus
RIPFEIMDL

SEQ ID NO: 36714 - protein, 9 aa, Dengue virus
VPFEIMDLE

SEQ ID NO: 36715 - protein, 9 aa, Dengue virus
PFEIMDLER

SEQ ID NO: 36716 - protein, 9 aa, Dengue virus
FEIMDLEKK

SEQ ID NO: 36717 - protein, 9 aa, Dengue virus
EITDLEKRH

SEQ ID NO: 36718 - protein, 9 aa, Dengue virus
DLEKKHVLG

SEQ ID NO: 36719 - protein, 9 aa, Dengue virus
LEKKHVLGR

SEQ ID NO: 36720 - protein, 9 aa, Dengue virus
EKKHVLGRL

SEQ ID NO: 36721 - protein, 9 aa, Dengue virus
KKHVLGRLI

SEQ ID NO: 36722 - protein, 9 aa, Dengue virus
KHVLGRLIT

SEQ ID NO: 36723 - protein, 9 aa, Dengue virus
YILGRLITV

SEQ ID NO: 36724 - protein, 9 aa, Dengue virus
RLITVNPIA

SEQ ID NO: 36725 - protein, 9 aa, Dengue virus
LITVNPIVA

SEQ ID NO: 36726 - protein, 9 aa, Dengue virus
GKDSPVNIE

SEQ ID NO: 36727 - protein, 9 aa, Dengue virus
KDNPINIEA

SEQ ID NO: 36728 - protein, 9 aa, Dengue virus
DNPINIEAE

SEQ ID NO: 36729 - protein, 9 aa, Dengue virus
NPINIEAEP

SEQ ID NO: 36730 - protein, 9 aa, Dengue virus
PFGDSYIVI

SEQ ID NO: 36731 - protein, 9 aa, Dengue virus
FGDSYIVIG

SEQ ID NO: 36732 - protein, 9 aa, Dengue virus
GDSYIVIGV

SEQ ID NO: 36733 - protein, 9 aa, Dengue virus
DSYIVIGVE

SEQ ID NO: 36734 - protein, 9 aa, Dengue virus
SYIVIGVEP

SEQ ID NO: 36735 - protein, 9 aa, Dengue virus
YIVIGVEPG

SEQ ID NO: 36736 - protein, 9 aa, Dengue virus
IVIGVEPGQ

SEQ ID NO: 36737 - protein, 9 aa, Dengue virus
VIGVEPGQL

SEQ ID NO: 36738 - protein, 9 aa, Dengue virus
VEPGQLKLD

SEQ ID NO: 36739 - protein, 9 aa, Dengue virus
EPGQLKLDW

SEQ ID NO: 36740 - protein, 9 aa, Dengue virus
PGQLKLDWF

SEQ ID NO: 36741 - protein, 9 aa, Dengue virus
GQLKLDWFK

SEQ ID NO: 36742 - protein, 9 aa, Dengue virus
QLKLDWFKK

SEQ ID NO: 36743 - protein, 9 aa, Dengue virus
LKLDWFKKG

SEQ ID NO: 36744 - protein, 9 aa, Dengue virus
KLDWFKKGS

SEQ ID NO: 36745 - protein, 9 aa, Dengue virus
LDWFKKGSS

SEQ ID NO: 36746 - protein, 9 aa, Dengue virus
DWFKKGSSI

SEQ ID NO: 36747 - protein, 9 aa, Dengue virus
IGQMFATTM

SEQ ID NO: 36748 - protein, 9 aa, Dengue virus
GQMFATTMR

SEQ ID NO: 36749 - protein, 9 aa, Dengue virus
QMFATTMRG

SEQ ID NO: 36750 - protein, 9 aa, Dengue virus
WDFGSLGGA

SEQ ID NO: 36751 - protein, 9 aa, Dengue virus
DFGSLGGAF

SEQ ID NO: 36752 - protein, 9 aa, Dengue virus
FGSLGGAFT

SEQ ID NO: 36753 - protein, 9 aa, Dengue virus
GSLGGAFTS

SEQ ID NO: 36754 - protein, 9 aa, Dengue virus
SLGGVFTSV

SEQ ID NO: 36755 - protein, 9 aa, Dengue virus
LGGVFTSVG

SEQ ID NO: 36756 - protein, 9 aa, Dengue virus
GGAFTSIGK

SEQ ID NO: 36757 - protein, 9 aa, Dengue virus
GAFTSIGKA

SEQ ID NO: 36758 - protein, 9 aa, Dengue virus
AFTSIGKAL

SEQ ID NO: 36759 - protein, 9 aa, Dengue virus
VAFSGVSWT

SEQ ID NO: 36760 - protein, 9 aa, Dengue virus
AFNGVSWTM

SEQ ID NO: 36761 - protein, 9 aa, Dengue virus
VSWTMKIFI

SEQ ID NO: 36762 - protein, 9 aa, Dengue virus
SWTMKIFIG

SEQ ID NO: 36763 - protein, 9 aa, Dengue virus
WIMKILIGV

SEQ ID NO: 36764 - protein, 9 aa, Dengue virus
TMKILIGAI

SEQ ID NO: 36765 - protein, 9 aa, Dengue virus
MKILIGAII

SEQ ID NO: 36766 - protein, 9 aa, Dengue virus
KILIGAIIT

SEQ ID NO: 36767 - protein, 9 aa, Dengue virus
ILIGAIITW

SEQ ID NO: 36768 - protein, 9 aa, Dengue virus
LIGAIITWI

SEQ ID NO: 36769 - protein, 9 aa, Dengue virus
IGAIITWIG

SEQ ID NO: 36770 - protein, 9 aa, Dengue virus
GAIITWIGM

SEQ ID NO: 36771 - protein, 9 aa, Dengue virus
AIITWIGMN

SEQ ID NO: 36772 - protein, 9 aa, Dengue virus
SVTLVLVGI

SEQ ID NO: 36773 - protein, 9 aa, Dengue virus
VSLVLVGVI

SEQ ID NO: 36774 - protein, 9 aa, Dengue virus
LVLVGVITL

SEQ ID NO: 36775 - protein, 9 aa, Dengue virus
VLVGVITLY

SEQ ID NO: 36776 - protein, 9 aa, Dengue virus
LVGVITLYL

SEQ ID NO: 36777 - protein, 9 aa, Dengue virus
VGVITLYLG

SEQ ID NO: 36778 - protein, 9 aa, Dengue virus
GVVTLYLGV

SEQ ID NO: 36779 - protein, 9 aa, Dengue virus
VTLYLGAVV

SEQ ID NO: 36780 - protein, 9 aa, Dengue virus
TLYLGAVVQ

SEQ ID NO: 36781 - protein, 9 aa, Dengue virus
LYLGAVVQA

SEQ ID NO: 36782 - protein, 9 aa, Dengue virus
YLGAVVQAD

SEQ ID NO: 36783 - protein, 9 aa, Dengue virus
LGAVVQADS

SEQ ID NO: 36784 - protein, 9 aa, Dengue virus
GAVVQADSG

SEQ ID NO: 36785 - protein, 9 aa, Dengue virus
AVVQADSGC

SEQ ID NO: 36786 - protein, 9 aa, Dengue virus
MVQADTGCV

SEQ ID NO: 36787 - protein, 9 aa, Dengue virus
VQADSGCIV

SEQ ID NO: 36788 - protein, 9 aa, Dengue virus
QADSGCIVS

SEQ ID NO: 36789 - protein, 9 aa, Dengue virus
ADSGCIVSW

SEQ ID NO: 36790 - protein, 9 aa, Dengue virus
DSGCIVSWK

SEQ ID NO: 36791 - protein, 9 aa, Dengue virus
SGCVVSWKS

SEQ ID NO: 36792 - protein, 9 aa, Dengue virus
GCVVSWKSK

SEQ ID NO: 36793 - protein, 9 aa, Dengue virus
CIVSWKNKE

SEQ ID NO: 36794 - protein, 9 aa, Dengue virus
VVSWKSKEL

SEQ ID NO: 36795 - protein, 9 aa, Dengue virus
SAIQKAYEE

SEQ ID NO: 36796 - protein, 9 aa, Dengue virus
AIQKAHEED

SEQ ID NO: 36797 - protein, 9 aa, Dengue virus
IQKAHEEDI

SEQ ID NO: 36798 - protein, 9 aa, Dengue virus
QKAHEEDIC

SEQ ID NO: 36799 - protein, 9 aa, Dengue virus
KAHEEDICG

SEQ ID NO: 36800 - protein, 9 aa, Dengue virus
AHEEDICGI

SEQ ID NO: 36801 - protein, 9 aa, Dengue virus
HEEDICGIR

SEQ ID NO: 36802 - protein, 9 aa, Dengue virus
NLMWRQITP

SEQ ID NO: 36803 - protein, 9 aa, Dengue virus
LMWRQITPE

SEQ ID NO: 36804 - protein, 9 aa, Dengue virus
MWRQITPEL

SEQ ID NO: 36805 - protein, 9 aa, Dengue virus
WRQITPELN

SEQ ID NO: 36806 - protein, 9 aa, Dengue virus
RQITPELNH

SEQ ID NO: 36807 - protein, 9 aa, Dengue virus
TSELNHILS

SEQ ID NO: 36808 - protein, 9 aa, Dengue virus
SELNHILSE

SEQ ID NO: 36809 - protein, 9 aa, Dengue virus
NHILSENEA

SEQ ID NO: 36810 - protein, 9 aa, Dengue virus
HILSENEAK

SEQ ID NO: 36811 - protein, 9 aa, Dengue virus
ILSENEAKL

SEQ ID NO: 36812 - protein, 9 aa, Dengue virus
LSENEAKLT

SEQ ID NO: 36813 - protein, 9 aa, Dengue virus
SENEAKLTI

SEQ ID NO: 36814 - protein, 9 aa, Dengue virus
ENEVKMTIM

SEQ ID NO: 36815 - protein, 9 aa, Dengue virus
NEVKMTIMT

SEQ ID NO: 36816 - protein, 9 aa, Dengue virus
EVKMTIMTG

SEQ ID NO: 36817 - protein, 9 aa, Dengue virus
AKLTIMTGD

SEQ ID NO: 36818 - protein, 9 aa, Dengue virus
KLTIMTGEI

SEQ ID NO: 36819 - protein, 9 aa, Dengue virus
LTIMTGDTK

SEQ ID NO: 36820 - protein, 9 aa, Dengue virus
TIMTGDTKG

SEQ ID NO: 36821 - protein, 9 aa, Dengue virus
IMTGDTKGI

SEQ ID NO: 36822 - protein, 9 aa, Dengue virus
MTGDTKGIM

SEQ ID NO: 36823 - protein, 9 aa, Dengue virus
TGDTKGIMQ

SEQ ID NO: 36824 - protein, 9 aa, Dengue virus
KGIMQVGKR

SEQ ID NO: 36825 - protein, 9 aa, Dengue virus
GIMQAGRRS

SEQ ID NO: 36826 - protein, 9 aa, Dengue virus
IMQAGRRSL

SEQ ID NO: 36827 - protein, 9 aa, Dengue virus
GKRSLQPQP

SEQ ID NO: 36828 - protein, 9 aa, Dengue virus
KRSLQPQPT

SEQ ID NO: 36829 - protein, 9 aa, Dengue virus
RSLQPQPTE

SEQ ID NO: 36830 - protein, 9 aa, Dengue virus
SLQPQPTEL

SEQ ID NO: 36831 - protein, 9 aa, Dengue virus
LKPQPTELR

SEQ ID NO: 36832 - protein, 9 aa, Dengue virus
KPQPTELRY

SEQ ID NO: 36833 - protein, 9 aa, Dengue virus
TELRYSWKT

SEQ ID NO: 36834 - protein, 9 aa, Dengue virus
ELRYSWKTW

SEQ ID NO: 36835 - protein, 9 aa, Dengue virus
LRYSWKTWG

SEQ ID NO: 36836 - protein, 9 aa, Dengue virus
RYSWKTWGK

SEQ ID NO: 36837 - protein, 9 aa, Dengue virus
WKTWGKAKV

SEQ ID NO: 36838 - protein, 9 aa, Dengue virus
KTWGKAKVL

SEQ ID NO: 36839 - protein, 9 aa, Dengue virus
WGKAKMLPT

SEQ ID NO: 36840 - protein, 9 aa, Dengue virus
GKAKMLPTE

SEQ ID NO: 36841 - protein, 9 aa, Dengue virus
HNHTFLIDG

SEQ ID NO: 36842 - protein, 9 aa, Dengue virus
NRTFLIDGP

SEQ ID NO: 36843 - protein, 9 aa, Dengue virus
RTFLIDGPE

SEQ ID NO: 36844 - protein, 9 aa, Dengue virus
FLIDGPETV

SEQ ID NO: 36845 - protein, 9 aa, Dengue virus
LIDGPETVE

SEQ ID NO: 36846 - protein, 9 aa, Dengue virus
IDGPETVEC

SEQ ID NO: 36847 - protein, 9 aa, Dengue virus
DGPETVECP

SEQ ID NO: 36848 - protein, 9 aa, Dengue virus
GPETVECPN

SEQ ID NO: 36849 - protein, 9 aa, Dengue virus
TTECPNSNR

SEQ ID NO: 36850 - protein, 9 aa, Dengue virus
TECPNSNRA

SEQ ID NO: 36851 - protein, 9 aa, Dengue virus
EDYGFGIFT

SEQ ID NO: 36852 - protein, 9 aa, Dengue virus
DYGFGIFTT

SEQ ID NO: 36853 - protein, 9 aa, Dengue virus
YGFGIFTTN

SEQ ID NO: 36854 - protein, 9 aa, Dengue virus
GFGIFTTNI

SEQ ID NO: 36855 - protein, 9 aa, Dengue virus
FGIFTTNIW

SEQ ID NO: 36856 - protein, 9 aa, Dengue virus
GIFTTNIWL

SEQ ID NO: 36857 - protein, 9 aa, Dengue virus
VFTTNIWLR

SEQ ID NO: 36858 - protein, 9 aa, Dengue virus
FTTNIWLRL

SEQ ID NO: 36859 - protein, 9 aa, Dengue virus
STNIWLKLR

SEQ ID NO: 36860 - protein, 9 aa, Dengue virus
TNIWLRLRE

SEQ ID NO: 36861 - protein, 9 aa, Dengue virus
NIWLKLKER

SEQ ID NO: 36862 - protein, 9 aa, Dengue virus
IWLKLKERQ

SEQ ID NO: 36863 - protein, 9 aa, Dengue virus
WLKLKERQD

SEQ ID NO: 36864 - protein, 9 aa, Dengue virus
SCDSKLMSA

SEQ ID NO: 36865 - protein, 9 aa, Dengue virus
KLMSAAIKN

SEQ ID NO: 36866 - protein, 9 aa, Dengue virus
LMSAAVKDN

SEQ ID NO: 36867 - protein, 9 aa, Dengue virus
MSAAVKDNR

SEQ ID NO: 36868 - protein, 9 aa, Dengue virus
SAAVKDNRA

SEQ ID NO: 36869 - protein, 9 aa, Dengue virus
AAVKDNRAV

SEQ ID NO: 36870 - protein, 9 aa, Dengue virus
AVKDNRAVH

SEQ ID NO: 36871 - protein, 9 aa, Dengue virus
VKDNRAVHA

SEQ ID NO: 36872 - protein, 9 aa, Dengue virus
KNNRAVHAD

SEQ ID NO: 36873 - protein, 9 aa, Dengue virus
NNRAVHADM

SEQ ID NO: 36874 - protein, 9 aa, Dengue virus
DMGYWMESA

SEQ ID NO: 36875 - protein, 9 aa, Dengue virus
MGYWMESAL

SEQ ID NO: 36876 - protein, 9 aa, Dengue virus
GYWMESALN

SEQ ID NO: 36877 - protein, 9 aa, Dengue virus
YWMESALND

SEQ ID NO: 36878 - protein, 9 aa, Dengue virus
WMESALNDT

SEQ ID NO: 36879 - protein, 9 aa, Dengue virus
MESALNDTW

SEQ ID NO: 36880 - protein, 9 aa, Dengue virus
SRLNDTWKM

SEQ ID NO: 36881 - protein, 9 aa, Dengue virus
RLNDTWKME

SEQ ID NO: 36882 - protein, 9 aa, Dengue virus
MEKASFIEI

SEQ ID NO: 36883 - protein, 9 aa, Dengue virus
KASFIEIKS

SEQ ID NO: 36884 - protein, 9 aa, Dengue virus
ASFIEIKSC

SEQ ID NO: 36885 - protein, 9 aa, Dengue virus
SFIEIKSCH

SEQ ID NO: 36886 - protein, 9 aa, Dengue virus
FIEIKSCHW

SEQ ID NO: 36887 - protein, 9 aa, Dengue virus
IEIKSCHWP

SEQ ID NO: 36888 - protein, 9 aa, Dengue virus
EIKSCHWPK

SEQ ID NO: 36889 - protein, 9 aa, Dengue virus
IKSCHWPKS

SEQ ID NO: 36890 - protein, 9 aa, Dengue virus
KSCYWPRSH

SEQ ID NO: 36891 - protein, 9 aa, Dengue virus
SCYWPRSHT

SEQ ID NO: 36892 - protein, 9 aa, Dengue virus
CHWPRSHTL

SEQ ID NO: 36893 - protein, 9 aa, Dengue virus
HWPRSHTLW

SEQ ID NO: 36894 - protein, 9 aa, Dengue virus
ESEMVIPKN

SEQ ID NO: 36895 - protein, 9 aa, Dengue virus
IPKSFAGPV

SEQ ID NO: 36896 - protein, 9 aa, Dengue virus
PKSFAGPVS

SEQ ID NO: 36897 - protein, 9 aa, Dengue virus
KSFAGPVSQ

SEQ ID NO: 36898 - protein, 9 aa, Dengue virus
SFAGPVSQH

SEQ ID NO: 36899 - protein, 9 aa, Dengue virus
PVSQHNHRP

SEQ ID NO: 36900 - protein, 9 aa, Dengue virus
VSQHNHRPG

SEQ ID NO: 36901 - protein, 9 aa, Dengue virus
SQHNHRPGY

SEQ ID NO: 36902 - protein, 9 aa, Dengue virus
QHNNRPGYH

SEQ ID NO: 36903 - protein, 9 aa, Dengue virus
HNNRPGYHT

SEQ ID NO: 36904 - protein, 9 aa, Dengue virus
NNRPGYHTQ

SEQ ID NO: 36905 - protein, 9 aa, Dengue virus
RPGYYTQTA

SEQ ID NO: 36906 - protein, 9 aa, Dengue virus
PGYYTQTAG

SEQ ID NO: 36907 - protein, 9 aa, Dengue virus
GYYTQTAGP

SEQ ID NO: 36908 - protein, 9 aa, Dengue virus
YYTQTAGPW

SEQ ID NO: 36909 - protein, 9 aa, Dengue virus
YTQTAGPWH

SEQ ID NO: 36910 - protein, 9 aa, Dengue virus
TQITGPWHL

SEQ ID NO: 36911 - protein, 9 aa, Dengue virus
QITGPWHLG

SEQ ID NO: 36912 - protein, 9 aa, Dengue virus
TAGPWHLGR

SEQ ID NO: 36913 - protein, 9 aa, Dengue virus
TGPWHLGKL

SEQ ID NO: 36914 - protein, 9 aa, Dengue virus
LGKLEMDFE

SEQ ID NO: 36915 - protein, 9 aa, Dengue virus
GRLEMDFDF

SEQ ID NO: 36916 - protein, 9 aa, Dengue virus
RLEMDFDFC

SEQ ID NO: 36917 - protein, 9 aa, Dengue virus
LEMDFDLCE

SEQ ID NO: 36918 - protein, 9 aa, Dengue virus
EMDFDLCEG

SEQ ID NO: 36919 - protein, 9 aa, Dengue virus
MDFDLCEGT

SEQ ID NO: 36920 - protein, 9 aa, Dengue virus
DFDLCEGTT

SEQ ID NO: 36921 - protein, 9 aa, Dengue virus
FDLCEGTTV

SEQ ID NO: 36922 - protein, 9 aa, Dengue virus
LCEGTTVVV

SEQ ID NO: 36923 - protein, 9 aa, Dengue virus
CDGTTVVVT

SEQ ID NO: 36924 - protein, 9 aa, Dengue virus
DGTTVVVTE

SEQ ID NO: 36925 - protein, 9 aa, Dengue virus
GTTVVVTEE

SEQ ID NO: 36926 - protein, 9 aa, Dengue virus
TTVVVTEEC

SEQ ID NO: 36927 - protein, 9 aa, Dengue virus
TVVVTEECG

SEQ ID NO: 36928 - protein, 9 aa, Dengue virus
VVVTEECGN

SEQ ID NO: 36929 - protein, 9 aa, Dengue virus
VVTEECGNR

SEQ ID NO: 36930 - protein, 9 aa, Dengue virus
VTENCGNRG

SEQ ID NO: 36931 - protein, 9 aa, Dengue virus
TENCGNRGP

SEQ ID NO: 36932 - protein, 9 aa, Dengue virus
ENCGNRGPS

SEQ ID NO: 36933 - protein, 9 aa, Dengue virus
KEREENLVN

SEQ ID NO: 36934 - protein, 9 aa, Dengue virus
EREENLVNS

SEQ ID NO: 36935 - protein, 9 aa, Dengue virus
REENLVNSL

SEQ ID NO: 36936 - protein, 9 aa, Dengue virus
VNSLVTAGQ

SEQ ID NO: 36937 - protein, 9 aa, Dengue virus
NSLVTAGQG

SEQ ID NO: 36938 - protein, 9 aa, Dengue virus
LVTAGQGQV

SEQ ID NO: 36939 - protein, 9 aa, Dengue virus
VTAGQGQVD

SEQ ID NO: 36940 - protein, 9 aa, Dengue virus
TAGQGQVDN

SEQ ID NO: 36941 - protein, 9 aa, Dengue virus
AGQGQVDNF

SEQ ID NO: 36942 - protein, 9 aa, Dengue virus
GQGQVDNFS

SEQ ID NO: 36943 - protein, 9 aa, Dengue virus
QGQVDNFSL

SEQ ID NO: 36944 - protein, 9 aa, Dengue virus
QIDNFSLGI

SEQ ID NO: 36945 - protein, 9 aa, Dengue virus
IDNFSLGIL

SEQ ID NO: 36946 - protein, 9 aa, Dengue virus
LGILGMALL

SEQ ID NO: 36947 - protein, 9 aa, Dengue virus
GILGMALLL

SEQ ID NO: 36948 - protein, 9 aa, Dengue virus
ILGMALLLE

SEQ ID NO: 36949 - protein, 9 aa, Dengue virus
EMLKTRVGT

SEQ ID NO: 36950 - protein, 9 aa, Dengue virus
MLKTRVGTK

SEQ ID NO: 36951 - protein, 9 aa, Dengue virus
LKTRVGTKH

SEQ ID NO: 36952 - protein, 9 aa, Dengue virus
KTRVGTKHA

SEQ ID NO: 36953 - protein, 9 aa, Dengue virus
SLVTLITGN

SEQ ID NO: 36954 - protein, 9 aa, Dengue virus
LVTLITGNM

SEQ ID NO: 36955 - protein, 9 aa, Dengue virus
VTLITGNLS

SEQ ID NO: 36956 - protein, 9 aa, Dengue virus
SFKDLGRVI

SEQ ID NO: 36957 - protein, 9 aa, Dengue virus
KDLGRVIIM

SEQ ID NO: 36958 - protein, 9 aa, Dengue virus
DLGRVIIMV

SEQ ID NO: 36959 - protein, 9 aa, Dengue virus
LGRVIIMVG

SEQ ID NO: 36960 - protein, 9 aa, Dengue virus
GRVIIMVGA

SEQ ID NO: 36961 - protein, 9 aa, Dengue virus
TDEMGMGVT

SEQ ID NO: 36962 - protein, 9 aa, Dengue virus
DDIGMGITY

SEQ ID NO: 36963 - protein, 9 aa, Dengue virus
DIGMGITYL

SEQ ID NO: 36964 - protein, 9 aa, Dengue virus
IGMGITYLA

SEQ ID NO: 36965 - protein, 9 aa, Dengue virus
GIGVTYLAL

SEQ ID NO: 36966 - protein, 9 aa, Dengue virus
IGVTYLALL

SEQ ID NO: 36967 - protein, 9 aa, Dengue virus
AFKVRPTFV

SEQ ID NO: 36968 - protein, 9 aa, Dengue virus
FRVRPTFAA

SEQ ID NO: 36969 - protein, 9 aa, Dengue virus
RVRPTFAAG

SEQ ID NO: 36970 - protein, 9 aa, Dengue virus
RPTFAAGLF

SEQ ID NO: 36971 - protein, 9 aa, Dengue virus
PTFAAGLFL

SEQ ID NO: 36972 - protein, 9 aa, Dengue virus
TFAAGLFLR

SEQ ID NO: 36973 - protein, 9 aa, Dengue virus
FAAGLFLRK

SEQ ID NO: 36974 - protein, 9 aa, Dengue virus
AAGLFLRKL

SEQ ID NO: 36975 - protein, 9 aa, Dengue virus
AGLFLRKLT

SEQ ID NO: 36976 - protein, 9 aa, Dengue virus
LLKKLTSKE

SEQ ID NO: 36977 - protein, 9 aa, Dengue virus
LTSKELLMA

SEQ ID NO: 36978 - protein, 9 aa, Dengue virus
TSKELLMAT

SEQ ID NO: 36979 - protein, 9 aa, Dengue virus
SKELLMATI

SEQ ID NO: 36980 - protein, 9 aa, Dengue virus
KELLMATIG

SEQ ID NO: 36981 - protein, 9 aa, Dengue virus
ELLMATIGV

SEQ ID NO: 36982 - protein, 9 aa, Dengue virus
TIGITLLSQ

SEQ ID NO: 36983 - protein, 9 aa, Dengue virus
IGITLLSQS

SEQ ID NO: 36984 - protein, 9 aa, Dengue virus
PGTVLELTD

SEQ ID NO: 36985 - protein, 9 aa, Dengue virus
GTVLELTDA

SEQ ID NO: 36986 - protein, 9 aa, Dengue virus
TVLELTDAI

SEQ ID NO: 36987 - protein, 9 aa, Dengue virus
VLELTDAIA

SEQ ID NO: 36988 - protein, 9 aa, Dengue virus
DAIALGIMV

SEQ ID NO: 36989 - protein, 9 aa, Dengue virus
AIALGIMVL

SEQ ID NO: 36990 - protein, 9 aa, Dengue virus
IALGIMVLK

SEQ ID NO: 36991 - protein, 9 aa, Dengue virus
VRKMEKYQL

SEQ ID NO: 36992 - protein, 9 aa, Dengue virus
KMEKYQLAV

SEQ ID NO: 36993 - protein, 9 aa, Dengue virus
YQLAVTIMT

SEQ ID NO: 36994 - protein, 9 aa, Dengue virus
MLCIPNVMI

SEQ ID NO: 36995 - protein, 9 aa, Dengue virus
LCIPNVMIL

SEQ ID NO: 36996 - protein, 9 aa, Dengue virus
CIPNVMILQ

SEQ ID NO: 36997 - protein, 9 aa, Dengue virus
IPNVMILQH

SEQ ID NO: 36998 - protein, 9 aa, Dengue virus
PNVMILQHA

SEQ ID NO: 36999 - protein, 9 aa, Dengue virus
NVMILQHAW

SEQ ID NO: 37000 - protein, 9 aa, Dengue virus
AWKVGCTIL

SEQ ID NO: 37001 - protein, 9 aa, Dengue virus
WKVGCTILA

SEQ ID NO: 37002 - protein, 9 aa, Dengue virus
CTTLAVVSV

SEQ ID NO: 37003 - protein, 9 aa, Dengue virus
TLAVVSVSP

SEQ ID NO: 37004 - protein, 9 aa, Dengue virus
LATVSVSPL

SEQ ID NO: 37005 - protein, 9 aa, Dengue virus
VSVSPLILT

SEQ ID NO: 37006 - protein, 9 aa, Dengue virus
SVSPLILTS

SEQ ID NO: 37007 - protein, 9 aa, Dengue virus
VSPLILTSS

SEQ ID NO: 37008 - protein, 9 aa, Dengue virus
SPLILTSSQ

SEQ ID NO: 37009 - protein, 9 aa, Dengue virus
PLILTSSQQ

SEQ ID NO: 37010 - protein, 9 aa, Dengue virus
LILTSSQQK

SEQ ID NO: 37011 - protein, 9 aa, Dengue virus
LTSSRQKTD

SEQ ID NO: 37012 - protein, 9 aa, Dengue virus
TSSRQKTDW

SEQ ID NO: 37013 - protein, 9 aa, Dengue virus
SSRQKTDWI

SEQ ID NO: 37014 - protein, 9 aa, Dengue virus
SRQKTDWIP

SEQ ID NO: 37015 - protein, 9 aa, Dengue virus
RQKTDWIPL

SEQ ID NO: 37016 - protein, 9 aa, Dengue virus
QKTDWIPLV

SEQ ID NO: 37017 - protein, 9 aa, Dengue virus
KTDWIPLVL

SEQ ID NO: 37018 - protein, 9 aa, Dengue virus
TDWIPLVLT

SEQ ID NO: 37019 - protein, 9 aa, Dengue virus
LVLIIKGLN

SEQ ID NO: 37020 - protein, 9 aa, Dengue virus
ALTIKGLSP

SEQ ID NO: 37021 - protein, 9 aa, Dengue virus
IFLTTLTRT

SEQ ID NO: 37022 - protein, 9 aa, Dengue virus
FLTTLSRPN

SEQ ID NO: 37023 - protein, 9 aa, Dengue virus
LTTLSRPNK

SEQ ID NO: 37024 - protein, 9 aa, Dengue virus
TTLSRPNKT

SEQ ID NO: 37025 - protein, 9 aa, Dengue virus
TLSRPNKTR

SEQ ID NO: 37026 - protein, 9 aa, Dengue virus
LSRPNKTRS

SEQ ID NO: 37027 - protein, 9 aa, Dengue virus
SRPNKTRSW

SEQ ID NO: 37028 - protein, 9 aa, Dengue virus
RPNKTRSWP

SEQ ID NO: 37029 - protein, 9 aa, Dengue virus
PNKTRSWPL

SEQ ID NO: 37030 - protein, 9 aa, Dengue virus
NKTRSWPLN

SEQ ID NO: 37031 - protein, 9 aa, Dengue virus
ADLELEKAA

SEQ ID NO: 37032 - protein, 9 aa, Dengue virus
DLELEKAAE

SEQ ID NO: 37033 - protein, 9 aa, Dengue virus
LELEKAAEV

SEQ ID NO: 37034 - protein, 9 aa, Dengue virus
VKWDDQAEI

SEQ ID NO: 37035 - protein, 9 aa, Dengue virus
KWDDQAEIS

SEQ ID NO: 37036 - protein, 9 aa, Dengue virus
WDDQAEISG

SEQ ID NO: 37037 - protein, 9 aa, Dengue virus
DDQAEISGS

SEQ ID NO: 37038 - protein, 9 aa, Dengue virus
GSSPILSII

SEQ ID NO: 37039 - protein, 9 aa, Dengue virus
SPILSVTIS

SEQ ID NO: 37040 - protein, 9 aa, Dengue virus
PILSVTISE

SEQ ID NO: 37041 - protein, 9 aa, Dengue virus
ILSVTISED

SEQ ID NO: 37042 - protein, 9 aa, Dengue virus
LSVTISEDG

SEQ ID NO: 37043 - protein, 9 aa, Dengue virus
SVTISEDGS

SEQ ID NO: 37044 - protein, 9 aa, Dengue virus
VTISEDGSM

SEQ ID NO: 37045 - protein, 9 aa, Dengue virus
IKNEEEEQI

SEQ ID NO: 37046 - protein, 9 aa, Dengue virus
KNEEEEQIL

SEQ ID NO: 37047 - protein, 9 aa, Dengue virus
NEEEEQILT

SEQ ID NO: 37048 - protein, 9 aa, Dengue virus
EEEEQILTI

SEQ ID NO: 37049 - protein, 9 aa, Dengue virus
EEEQILTIL

SEQ ID NO: 37050 - protein, 9 aa, Dengue virus
EEQILTILI

SEQ ID NO: 37051 - protein, 9 aa, Dengue virus
EQILTILIR

SEQ ID NO: 37052 - protein, 9 aa, Dengue virus
QILTILIRT

SEQ ID NO: 37053 - protein, 9 aa, Dengue virus
LVISGLFPI

SEQ ID NO: 37054 - protein, 9 aa, Dengue virus
VISGLFPIS

SEQ ID NO: 37055 - protein, 9 aa, Dengue virus
ISGLFPISI

SEQ ID NO: 37056 - protein, 9 aa, Dengue virus
SGLFPISIP

SEQ ID NO: 37057 - protein, 9 aa, Dengue virus
GLFPISIPI

SEQ ID NO: 37058 - protein, 9 aa, Dengue virus
LFPISIPIT

SEQ ID NO: 37059 - protein, 9 aa, Dengue virus
FPVSMPITA

SEQ ID NO: 37060 - protein, 9 aa, Dengue virus
PVSMPITAA

SEQ ID NO: 37061 - protein, 9 aa, Dengue virus
VSMPITAAA

SEQ ID NO: 37062 - protein, 9 aa, Dengue virus
WDVPSPPPI

SEQ ID NO: 37063 - protein, 9 aa, Dengue virus
DVPSPPPVE

SEQ ID NO: 37064 - protein, 9 aa, Dengue virus
GRAELEDGA

SEQ ID NO: 37065 - protein, 9 aa, Dengue virus
YRIKQRGIF

SEQ ID NO: 37066 - protein, 9 aa, Dengue virus
RIKQRGIFG

SEQ ID NO: 37067 - protein, 9 aa, Dengue virus
IKQRGIFGY

SEQ ID NO: 37068 - protein, 9 aa, Dengue virus
KQRGIFGYS

SEQ ID NO: 37069 - protein, 9 aa, Dengue virus
QRGIFGYSQ

SEQ ID NO: 37070 - protein, 9 aa, Dengue virus
RGIFGYSQI

SEQ ID NO: 37071 - protein, 9 aa, Dengue virus
RILGYSQIG

SEQ ID NO: 37072 - protein, 9 aa, Dengue virus
HVTRGAVLT

SEQ ID NO: 37073 - protein, 9 aa, Dengue virus
VTRGAVLTH

SEQ ID NO: 37074 - protein, 9 aa, Dengue virus
TRGAVLVHK

SEQ ID NO: 37075 - protein, 9 aa, Dengue virus
RGAVLVHKG

SEQ ID NO: 37076 - protein, 9 aa, Dengue virus
GAVLVHKGK

SEQ ID NO: 37077 - protein, 9 aa, Dengue virus
AVLVHKGKR

SEQ ID NO: 37078 - protein, 9 aa, Dengue virus
VLVHKGKRI

SEQ ID NO: 37079 - protein, 9 aa, Dengue virus
LVHKGKRIE

SEQ ID NO: 37080 - protein, 9 aa, Dengue virus
VHKGKRIEP

SEQ ID NO: 37081 - protein, 9 aa, Dengue virus
WADVKKDLV

SEQ ID NO: 37082 - protein, 9 aa, Dengue virus
ADVKKDLVS

SEQ ID NO: 37083 - protein, 9 aa, Dengue virus
DVRKDLISY

SEQ ID NO: 37084 - protein, 9 aa, Dengue virus
VKKDLVSYG

SEQ ID NO: 37085 - protein, 9 aa, Dengue virus
KKDLVSYGG

SEQ ID NO: 37086 - protein, 9 aa, Dengue virus
VQTKPGLFR

SEQ ID NO: 37087 - protein, 9 aa, Dengue virus
QTKPGLFRT

SEQ ID NO: 37088 - protein, 9 aa, Dengue virus
TKPGLFRTN

SEQ ID NO: 37089 - protein, 9 aa, Dengue virus
FRTNTGTIG

SEQ ID NO: 37090 - protein, 9 aa, Dengue virus
RTNTGTIGA

SEQ ID NO: 37091 - protein, 9 aa, Dengue virus
TSTGTIGAV

SEQ ID NO: 37092 - protein, 9 aa, Dengue virus
STGTIGAVS

SEQ ID NO: 37093 - protein, 9 aa, Dengue virus
TSGSPIVDK

SEQ ID NO: 37094 - protein, 9 aa, Dengue virus
SGSPIVDKK

SEQ ID NO: 37095 - protein, 9 aa, Dengue virus
GSPIVDKKG

SEQ ID NO: 37096 - protein, 9 aa, Dengue virus
SPIVDKKGK

SEQ ID NO: 37097 - protein, 9 aa, Dengue virus
PIVDKKGKV

SEQ ID NO: 37098 - protein, 9 aa, Dengue virus
IVDKKGKVV

SEQ ID NO: 37099 - protein, 9 aa, Dengue virus
VDKKGKVVG

SEQ ID NO: 37100 - protein, 9 aa, Dengue virus
TRSGTYVSS

SEQ ID NO: 37101 - protein, 9 aa, Dengue virus
RSGTYVSSI

SEQ ID NO: 37102 - protein, 9 aa, Dengue virus
SGTYVSSIA

SEQ ID NO: 37103 - protein, 9 aa, Dengue virus
GTYVSSIAQ

SEQ ID NO: 37104 - protein, 9 aa, Dengue virus
TYVSSIAQT

SEQ ID NO: 37105 - protein, 9 aa, Dengue virus
SAIAQTEKN

SEQ ID NO: 37106 - protein, 9 aa, Dengue virus
AIAQTEKNI

SEQ ID NO: 37107 - protein, 9 aa, Dengue virus
IAQTEKNIE

SEQ ID NO: 37108 - protein, 9 aa, Dengue virus
VEDNPEIED

SEQ ID NO: 37109 - protein, 9 aa, Dengue virus
EDNPEIEDH

SEQ ID NO: 37110 - protein, 9 aa, Dengue virus
NNPEIEDDI

SEQ ID NO: 37111 - protein, 9 aa, Dengue virus
NPEIEDHIF

SEQ ID NO: 37112 - protein, 9 aa, Dengue virus
PEIEDHIFR

SEQ ID NO: 37113 - protein, 9 aa, Dengue virus
EIEDHIFRK

SEQ ID NO: 37114 - protein, 9 aa, Dengue virus
IEDHIFRKR

SEQ ID NO: 37115 - protein, 9 aa, Dengue virus
EDDIFRKRK

SEQ ID NO: 37116 - protein, 9 aa, Dengue virus
DDIFRKRKL

SEQ ID NO: 37117 - protein, 9 aa, Dengue virus
DIFRKRKLT

SEQ ID NO: 37118 - protein, 9 aa, Dengue virus
IFRKRKLTI

SEQ ID NO: 37119 - protein, 9 aa, Dengue virus
FRKRKLTIM

SEQ ID NO: 37120 - protein, 9 aa, Dengue virus
RKRKLTIMD

SEQ ID NO: 37121 - protein, 9 aa, Dengue virus
KRKLTIMDL

SEQ ID NO: 37122 - protein, 9 aa, Dengue virus
RKLTIMDLH

SEQ ID NO: 37123 - protein, 9 aa, Dengue virus
IRYQTTAIK

SEQ ID NO: 37124 - protein, 9 aa, Dengue virus
RYQTPAIKA

SEQ ID NO: 37125 - protein, 9 aa, Dengue virus
YQTPAIKAE

SEQ ID NO: 37126 - protein, 9 aa, Dengue virus
QTPAIKAEH

SEQ ID NO: 37127 - protein, 9 aa, Dengue virus
TPAIKAEHT

SEQ ID NO: 37128 - protein, 9 aa, Dengue virus
PAIKAEHTG

SEQ ID NO: 37129 - protein, 9 aa, Dengue virus
AIKAEHTGR

SEQ ID NO: 37130 - protein, 9 aa, Dengue virus
IKAEHTGRE

SEQ ID NO: 37131 - protein, 9 aa, Dengue virus
KAEHTGREI

SEQ ID NO: 37132 - protein, 9 aa, Dengue virus
FPQSNAPIV

SEQ ID NO: 37133 - protein, 9 aa, Dengue virus
PQSNAPIVD

SEQ ID NO: 37134 - protein, 9 aa, Dengue virus
QSNAPIVDE

SEQ ID NO: 37135 - protein, 9 aa, Dengue virus
SNAPIVDEE

SEQ ID NO: 37136 - protein, 9 aa, Dengue virus
NAPIVDEER

SEQ ID NO: 37137 - protein, 9 aa, Dengue virus
APIVDEERE

SEQ ID NO: 37138 - protein, 9 aa, Dengue virus
PIVDEEREI

SEQ ID NO: 37139 - protein, 9 aa, Dengue virus
IVDEEREIP

SEQ ID NO: 37140 - protein, 9 aa, Dengue virus
VDEEREIPE

SEQ ID NO: 37141 - protein, 9 aa, Dengue virus
EIPERSWNT

SEQ ID NO: 37142 - protein, 9 aa, Dengue virus
IPERSWNTG

SEQ ID NO: 37143 - protein, 9 aa, Dengue virus
PERSWNTGH

SEQ ID NO: 37144 - protein, 9 aa, Dengue virus
ERSWNTGHE

SEQ ID NO: 37145 - protein, 9 aa, Dengue virus
RSWNTGHEW

SEQ ID NO: 37146 - protein, 9 aa, Dengue virus
SWSSGHEWV

SEQ ID NO: 37147 - protein, 9 aa, Dengue virus
WSSGHEWVT

SEQ ID NO: 37148 - protein, 9 aa, Dengue virus
SSGHEWVTD

SEQ ID NO: 37149 - protein, 9 aa, Dengue virus
TGHEWVTDF

SEQ ID NO: 37150 - protein, 9 aa, Dengue virus
GYEWVTDFK

SEQ ID NO: 37151 - protein, 9 aa, Dengue virus
HEWITDFKG

SEQ ID NO: 37152 - protein, 9 aa, Dengue virus
EWITNFEGK

SEQ ID NO: 37153 - protein, 9 aa, Dengue virus
WITDFKGKT

SEQ ID NO: 37154 - protein, 9 aa, Dengue virus
ITNFEGKTV

SEQ ID NO: 37155 - protein, 9 aa, Dengue virus
VWFVPSIRA

SEQ ID NO: 37156 - protein, 9 aa, Dengue virus
WFVPSIRAG

SEQ ID NO: 37157 - protein, 9 aa, Dengue virus
FVPSIRAGN

SEQ ID NO: 37158 - protein, 9 aa, Dengue virus
VPSIRAGND

SEQ ID NO: 37159 - protein, 9 aa, Dengue virus
PSIRAGNDI

SEQ ID NO: 37160 - protein, 9 aa, Dengue virus
SIRAGNDIA

SEQ ID NO: 37161 - protein, 9 aa, Dengue virus
IRAGNDIAA

SEQ ID NO: 37162 - protein, 9 aa, Dengue virus
RAGNDIAAC

SEQ ID NO: 37163 - protein, 9 aa, Dengue virus
RKTFDTEYT

SEQ ID NO: 37164 - protein, 9 aa, Dengue virus
KTFDTEYTK

SEQ ID NO: 37165 - protein, 9 aa, Dengue virus
TFDSEYAKT

SEQ ID NO: 37166 - protein, 9 aa, Dengue virus
FDTEYTKTR

SEQ ID NO: 37167 - protein, 9 aa, Dengue virus
KTRSNDWDF

SEQ ID NO: 37168 - protein, 9 aa, Dengue virus
TRSNDWDFV

SEQ ID NO: 37169 - protein, 9 aa, Dengue virus
RSNDWDFVV

SEQ ID NO: 37170 - protein, 9 aa, Dengue virus
SNDWDFVVT

SEQ ID NO: 37171 - protein, 9 aa, Dengue virus
LTHGEERVI

SEQ ID NO: 37172 - protein, 9 aa, Dengue virus
TEGEERVIL

SEQ ID NO: 37173 - protein, 9 aa, Dengue virus
RGRIGRNPR

SEQ ID NO: 37174 - protein, 9 aa, Dengue virus
GRIGRNPRN

SEQ ID NO: 37175 - protein, 9 aa, Dengue virus
RIGRNPRNE

SEQ ID NO: 37176 - protein, 9 aa, Dengue virus
IGRNPRNEN

SEQ ID NO: 37177 - protein, 9 aa, Dengue virus
DLPVWLAFK

SEQ ID NO: 37178 - protein, 9 aa, Dengue virus
LPVWLAFKV

SEQ ID NO: 37179 - protein, 9 aa, Dengue virus
PVWLAFKVA

SEQ ID NO: 37180 - protein, 9 aa, Dengue virus
VWLAYKVAS

SEQ ID NO: 37181 - protein, 9 aa, Dengue virus
WLAYKVASE

SEQ ID NO: 37182 - protein, 9 aa, Dengue virus
LAYKVASEG

SEQ ID NO: 37183 - protein, 9 aa, Dengue virus
AYKVASEGI

SEQ ID NO: 37184 - protein, 9 aa, Dengue virus
YKVASEGIN

SEQ ID NO: 37185 - protein, 9 aa, Dengue virus
KVASEGINY

SEQ ID NO: 37186 - protein, 9 aa, Dengue virus
VAAEGINYT

SEQ ID NO: 37187 - protein, 9 aa, Dengue virus
AAEGINYTD

SEQ ID NO: 37188 - protein, 9 aa, Dengue virus
AEGINYTDR

SEQ ID NO: 37189 - protein, 9 aa, Dengue virus
EGINYTDRK

SEQ ID NO: 37190 - protein, 9 aa, Dengue virus
GINYTDRKW

SEQ ID NO: 37191 - protein, 9 aa, Dengue virus
INYTDRKWC

SEQ ID NO: 37192 - protein, 9 aa, Dengue virus
NYTDRKWCF

SEQ ID NO: 37193 - protein, 9 aa, Dengue virus
YTDRKWCFD

SEQ ID NO: 37194 - protein, 9 aa, Dengue virus
TDRKWCFDG

SEQ ID NO: 37195 - protein, 9 aa, Dengue virus
DRRWCFDGV

SEQ ID NO: 37196 - protein, 9 aa, Dengue virus
RRWCFDGVK

SEQ ID NO: 37197 - protein, 9 aa, Dengue virus
RWCFDGVKN

SEQ ID NO: 37198 - protein, 9 aa, Dengue virus
WCFDGIRNN

SEQ ID NO: 37199 - protein, 9 aa, Dengue virus
CFDGIRNNQ

SEQ ID NO: 37200 - protein, 9 aa, Dengue virus
FDGIRNNQI

SEQ ID NO: 37201 - protein, 9 aa, Dengue virus
DGIRNNQIL

SEQ ID NO: 37202 - protein, 9 aa, Dengue virus
GIRNNQILE

SEQ ID NO: 37203 - protein, 9 aa, Dengue virus
IRNNQILEE

SEQ ID NO: 37204 - protein, 9 aa, Dengue virus
LEENMEVEV

SEQ ID NO: 37205 - protein, 9 aa, Dengue virus
EENMEVEVW

SEQ ID NO: 37206 - protein, 9 aa, Dengue virus
ENMEVEVWT

SEQ ID NO: 37207 - protein, 9 aa, Dengue virus
NMEVEVWTK

SEQ ID NO: 37208 - protein, 9 aa, Dengue virus
MEVEVWTKE

SEQ ID NO: 37209 - protein, 9 aa, Dengue virus
AGRKSLTLS

SEQ ID NO: 37210 - protein, 9 aa, Dengue virus
GRKSLTLSL

SEQ ID NO: 37211 - protein, 9 aa, Dengue virus
RKSLTLSLI

SEQ ID NO: 37212 - protein, 9 aa, Dengue virus
KSLTLSLIT

SEQ ID NO: 37213 - protein, 9 aa, Dengue virus
SLTLSLITE

SEQ ID NO: 37214 - protein, 9 aa, Dengue virus
LTLSLITEM

SEQ ID NO: 37215 - protein, 9 aa, Dengue virus
TLSLITEMG

SEQ ID NO: 37216 - protein, 9 aa, Dengue virus
TFMTQKARD

SEQ ID NO: 37217 - protein, 9 aa, Dengue virus
FMTQKARDA

SEQ ID NO: 37218 - protein, 9 aa, Dengue virus
MTQKARDAL

SEQ ID NO: 37219 - protein, 9 aa, Dengue virus
TQKARDALD

SEQ ID NO: 37220 - protein, 9 aa, Dengue virus
QKARDALDN

SEQ ID NO: 37221 - protein, 9 aa, Dengue virus
KARDALDNL

SEQ ID NO: 37222 - protein, 9 aa, Dengue virus
ARDALDNLA

SEQ ID NO: 37223 - protein, 9 aa, Dengue virus
LAVLHSAEM

SEQ ID NO: 37224 - protein, 9 aa, Dengue virus
AVLHSAEMG

SEQ ID NO: 37225 - protein, 9 aa, Dengue virus
VLHSAEMGG

SEQ ID NO: 37226 - protein, 9 aa, Dengue virus
LHTAEAGGK

SEQ ID NO: 37227 - protein, 9 aa, Dengue virus
HTAEAGGKA

SEQ ID NO: 37228 - protein, 9 aa, Dengue virus
TAEAGGKAY

SEQ ID NO: 37229 - protein, 9 aa, Dengue virus
GGKAYTHAL

SEQ ID NO: 37230 - protein, 9 aa, Dengue virus
GKAYTHALS

SEQ ID NO: 37231 - protein, 9 aa, Dengue virus
KAYTHALSE

SEQ ID NO: 37232 - protein, 9 aa, Dengue virus
LLLLTLLAA

SEQ ID NO: 37233 - protein, 9 aa, Dengue virus
LLLTLLAAV

SEQ ID NO: 37234 - protein, 9 aa, Dengue virus
LLTLLAAVT

SEQ ID NO: 37235 - protein, 9 aa, Dengue virus
LTLLAAVTG

SEQ ID NO: 37236 - protein, 9 aa, Dengue virus
TLLAAVTGG

SEQ ID NO: 37237 - protein, 9 aa, Dengue virus
IFLFLMSAR

SEQ ID NO: 37238 - protein, 9 aa, Dengue virus
FLFLMSARG

SEQ ID NO: 37239 - protein, 9 aa, Dengue virus
LFLMSGKGV

SEQ ID NO: 37240 - protein, 9 aa, Dengue virus
FLMSGKGVG

SEQ ID NO: 37241 - protein, 9 aa, Dengue virus
LMSGKGVGK

SEQ ID NO: 37242 - protein, 9 aa, Dengue virus
MSGKGVGKM

SEQ ID NO: 37243 - protein, 9 aa, Dengue virus
SGKGVGKMT

SEQ ID NO: 37244 - protein, 9 aa, Dengue virus
GKGVGKMTL

SEQ ID NO: 37245 - protein, 9 aa, Dengue virus
KGVGKMTLG

SEQ ID NO: 37246 - protein, 9 aa, Dengue virus
TASGLLWYA

SEQ ID NO: 37247 - protein, 9 aa, Dengue virus
YVVIAILTL

SEQ ID NO: 37248 - protein, 9 aa, Dengue virus
VVIAILTLV

SEQ ID NO: 37249 - protein, 9 aa, Dengue virus
VIAILTLVA

SEQ ID NO: 37250 - protein, 9 aa, Dengue virus
EKTKKDLGF

SEQ ID NO: 37251 - protein, 9 aa, Dengue virus
KTKKDLGFG

SEQ ID NO: 37252 - protein, 9 aa, Dengue virus
EPESNILDI

SEQ ID NO: 37253 - protein, 9 aa, Dengue virus
PEINILDID

SEQ ID NO: 37254 - protein, 9 aa, Dengue virus
PVTLTAALL

SEQ ID NO: 37255 - protein, 9 aa, Dengue virus
ITLTAALLS

SEQ ID NO: 37256 - protein, 9 aa, Dengue virus
TLTAALLSL

SEQ ID NO: 37257 - protein, 9 aa, Dengue virus
TAALLLLIA

SEQ ID NO: 37258 - protein, 9 aa, Dengue virus
AALLLLIAH

SEQ ID NO: 37259 - protein, 9 aa, Dengue virus
SLVAHYAII

SEQ ID NO: 37260 - protein, 9 aa, Dengue virus
LMAHYAIIG

SEQ ID NO: 37261 - protein, 9 aa, Dengue virus
MAHYAIIGP

SEQ ID NO: 37262 - protein, 9 aa, Dengue virus
DGVTVIDLD

SEQ ID NO: 37263 - protein, 9 aa, Dengue virus
GVTVIDLDP

SEQ ID NO: 37264 - protein, 9 aa, Dengue virus
VTVIDLDPI

SEQ ID NO: 37265 - protein, 9 aa, Dengue virus
LFSIMRNTT

SEQ ID NO: 37266 - protein, 9 aa, Dengue virus
FSIMKNTAN

SEQ ID NO: 37267 - protein, 9 aa, Dengue virus
RRGTGNTGE

SEQ ID NO: 37268 - protein, 9 aa, Dengue virus
RGTGNTGET

SEQ ID NO: 37269 - protein, 9 aa, Dengue virus
GTGNTGETL

SEQ ID NO: 37270 - protein, 9 aa, Dengue virus
TGNTGETLG

SEQ ID NO: 37271 - protein, 9 aa, Dengue virus
GNTGETLGE

SEQ ID NO: 37272 - protein, 9 aa, Dengue virus
NTGETLGEK

SEQ ID NO: 37273 - protein, 9 aa, Dengue virus
TGETLGEKW

SEQ ID NO: 37274 - protein, 9 aa, Dengue virus
EKWKSRLNT

SEQ ID NO: 37275 - protein, 9 aa, Dengue virus
KWKSRLNTL

SEQ ID NO: 37276 - protein, 9 aa, Dengue virus
WKSRLNTLG

SEQ ID NO: 37277 - protein, 9 aa, Dengue virus
RLNALGKNE

SEQ ID NO: 37278 - protein, 9 aa, Dengue virus
LNALGKNEF

SEQ ID NO: 37279 - protein, 9 aa, Dengue virus
NALGKNEFQ

SEQ ID NO: 37280 - protein, 9 aa, Dengue virus
LGRSEFQIY

SEQ ID NO: 37281 - protein, 9 aa, Dengue virus
GRSEFQIYK

SEQ ID NO: 37282 - protein, 9 aa, Dengue virus
RSEFQIYKK

SEQ ID NO: 37283 - protein, 9 aa, Dengue virus
SEFQTYKKS

SEQ ID NO: 37284 - protein, 9 aa, Dengue virus
EFQTYKKSG

SEQ ID NO: 37285 - protein, 9 aa, Dengue virus
FQTYKKSGI

SEQ ID NO: 37286 - protein, 9 aa, Dengue virus
QTYKKSGIQ

SEQ ID NO: 37287 - protein, 9 aa, Dengue virus
TYKKSGIQE

SEQ ID NO: 37288 - protein, 9 aa, Dengue virus
WFVERNMVA

SEQ ID NO: 37289 - protein, 9 aa, Dengue virus
FVERNMVAP

SEQ ID NO: 37290 - protein, 9 aa, Dengue virus
VERNMVAPE

SEQ ID NO: 37291 - protein, 9 aa, Dengue virus
ERNMVAPEG

SEQ ID NO: 37292 - protein, 9 aa, Dengue virus
RNMVAPEGK

SEQ ID NO: 37293 - protein, 9 aa, Dengue virus
NMVAPEGKV

SEQ ID NO: 37294 - protein, 9 aa, Dengue virus
LVTPEGKVM

SEQ ID NO: 37295 - protein, 9 aa, Dengue virus
VAPEGKVVD

SEQ ID NO: 37296 - protein, 9 aa, Dengue virus
APEGKVVDL

SEQ ID NO: 37297 - protein, 9 aa, Dengue virus
SYYCGGLKS

SEQ ID NO: 37298 - protein, 9 aa, Dengue virus
YYCGGLKSV

SEQ ID NO: 37299 - protein, 9 aa, Dengue virus
YCGGLKDVR

SEQ ID NO: 37300 - protein, 9 aa, Dengue virus
CGGLKDVRE

SEQ ID NO: 37301 - protein, 9 aa, Dengue virus
GGLKDVREV

SEQ ID NO: 37302 - protein, 9 aa, Dengue virus
GLKDVREVK

SEQ ID NO: 37303 - protein, 9 aa, Dengue virus
LKDVREVKG

SEQ ID NO: 37304 - protein, 9 aa, Dengue virus
KDVREVKGL

SEQ ID NO: 37305 - protein, 9 aa, Dengue virus
DVREVKGLT

SEQ ID NO: 37306 - protein, 9 aa, Dengue virus
QSGVDVFFV

SEQ ID NO: 37307 - protein, 9 aa, Dengue virus
SGVDVFFVP

SEQ ID NO: 37308 - protein, 9 aa, Dengue virus
GVDVFFVPP

SEQ ID NO: 37309 - protein, 9 aa, Dengue virus
VDVFFVPPE

SEQ ID NO: 37310 - protein, 9 aa, Dengue virus
DVFFVPPEK

SEQ ID NO: 37311 - protein, 9 aa, Dengue virus
VFFVPPEKC

SEQ ID NO: 37312 - protein, 9 aa, Dengue virus
FFVPPEKCD

SEQ ID NO: 37313 - protein, 9 aa, Dengue virus
FVPPEKCDT

SEQ ID NO: 37314 - protein, 9 aa, Dengue virus
VPPEKCDTL

SEQ ID NO: 37315 - protein, 9 aa, Dengue virus
LNLVENWLG

SEQ ID NO: 37316 - protein, 9 aa, Dengue virus
NLVENWLGS

SEQ ID NO: 37317 - protein, 9 aa, Dengue virus
LVENWLGSN

SEQ ID NO: 37318 - protein, 9 aa, Dengue virus
VENWLGSNT

SEQ ID NO: 37319 - protein, 9 aa, Dengue virus
ENWLGSNTQ

SEQ ID NO: 37320 - protein, 9 aa, Dengue virus
NWLGSNTQF

SEQ ID NO: 37321 - protein, 9 aa, Dengue virus
WLGSNTQFC

SEQ ID NO: 37322 - protein, 9 aa, Dengue virus
LNNNTQFCV

SEQ ID NO: 37323 - protein, 9 aa, Dengue virus
NNNTQFCVK

SEQ ID NO: 37324 - protein, 9 aa, Dengue virus
NNTQFCVKV

SEQ ID NO: 37325 - protein, 9 aa, Dengue virus
DTQFCIKVL

SEQ ID NO: 37326 - protein, 9 aa, Dengue virus
PSVIERMET

SEQ ID NO: 37327 - protein, 9 aa, Dengue virus
SVIERMETL

SEQ ID NO: 37328 - protein, 9 aa, Dengue virus
VIERMETLQ

SEQ ID NO: 37329 - protein, 9 aa, Dengue virus
IERMETLQR

SEQ ID NO: 37330 - protein, 9 aa, Dengue virus
LQRKFGGAL

SEQ ID NO: 37331 - protein, 9 aa, Dengue virus
QRKFGGALV

SEQ ID NO: 37332 - protein, 9 aa, Dengue virus
RKFGGALVR

SEQ ID NO: 37333 - protein, 9 aa, Dengue virus
KFGGALVRN

SEQ ID NO: 37334 - protein, 9 aa, Dengue virus
LINRFTMRY

SEQ ID NO: 37335 - protein, 9 aa, Dengue virus
INRFTMRYK

SEQ ID NO: 37336 - protein, 9 aa, Dengue virus
NRFTMRYKK

SEQ ID NO: 37337 - protein, 9 aa, Dengue virus
RFTMRYKKA

SEQ ID NO: 37338 - protein, 9 aa, Dengue virus
FTMRYKKAT

SEQ ID NO: 37339 - protein, 9 aa, Dengue virus
TMRYKKATY

SEQ ID NO: 37340 - protein, 9 aa, Dengue virus
MRYKKATYE

SEQ ID NO: 37341 - protein, 9 aa, Dengue virus
RYKKATYEP

SEQ ID NO: 37342 - protein, 9 aa, Dengue virus
HKKTTYEPD

SEQ ID NO: 37343 - protein, 9 aa, Dengue virus
GTRNIGIEC

SEQ ID NO: 37344 - protein, 9 aa, Dengue virus
TRNIGIECE

SEQ ID NO: 37345 - protein, 9 aa, Dengue virus
EVPNLDIIG

SEQ ID NO: 37346 - protein, 9 aa, Dengue virus
VPNLDIIGK

SEQ ID NO: 37347 - protein, 9 aa, Dengue virus
EKIKEEHET

SEQ ID NO: 37348 - protein, 9 aa, Dengue virus
KIKEEHETS

SEQ ID NO: 37349 - protein, 9 aa, Dengue virus
IKEEHETSW

SEQ ID NO: 37350 - protein, 9 aa, Dengue virus
KEEHETSWH

SEQ ID NO: 37351 - protein, 9 aa, Dengue virus
EEHETSWHY

SEQ ID NO: 37352 - protein, 9 aa, Dengue virus
EHEASWHYD

SEQ ID NO: 37353 - protein, 9 aa, Dengue virus
HEASWHYDQ

SEQ ID NO: 37354 - protein, 9 aa, Dengue virus
EASWHYDQD

SEQ ID NO: 37355 - protein, 9 aa, Dengue virus
ASWHYDQDH

SEQ ID NO: 37356 - protein, 9 aa, Dengue virus
LLTKPWDVI

SEQ ID NO: 37357 - protein, 9 aa, Dengue virus
LTKPWDVIP

SEQ ID NO: 37358 - protein, 9 aa, Dengue virus
TKPWDVIPM

SEQ ID NO: 37359 - protein, 9 aa, Dengue virus
KPWDVIPMV

SEQ ID NO: 37360 - protein, 9 aa, Dengue virus
PWDVIPMVT

SEQ ID NO: 37361 - protein, 9 aa, Dengue virus
WDVIPMVTQ

SEQ ID NO: 37362 - protein, 9 aa, Dengue virus
DVIPMVTQM

SEQ ID NO: 37363 - protein, 9 aa, Dengue virus
VIPMVTQMA

SEQ ID NO: 37364 - protein, 9 aa, Dengue virus
IPMVTQMAM

SEQ ID NO: 37365 - protein, 9 aa, Dengue virus
KKLMKITAK

SEQ ID NO: 37366 - protein, 9 aa, Dengue virus
KLMKITAKW

SEQ ID NO: 37367 - protein, 9 aa, Dengue virus
LMKITAKWL

SEQ ID NO: 37368 - protein, 9 aa, Dengue virus
MKITAKWLW

SEQ ID NO: 37369 - protein, 9 aa, Dengue virus
RITAEWLWG

SEQ ID NO: 37370 - protein, 9 aa, Dengue virus
ITAEWLWGE

SEQ ID NO: 37371 - protein, 9 aa, Dengue virus
TAKWLWKEL

SEQ ID NO: 37372 - protein, 9 aa, Dengue virus
AEWLWGELG

SEQ ID NO: 37373 - protein, 9 aa, Dengue virus
EWLWGELGR

SEQ ID NO: 37374 - protein, 9 aa, Dengue virus
WLWGELGRR

SEQ ID NO: 37375 - protein, 9 aa, Dengue virus
LWGELGRRK

SEQ ID NO: 37376 - protein, 9 aa, Dengue virus
WGELGRRKK

SEQ ID NO: 37377 - protein, 9 aa, Dengue virus
GELGRRKKP

SEQ ID NO: 37378 - protein, 9 aa, Dengue virus
ELGRRKKPR

SEQ ID NO: 37379 - protein, 9 aa, Dengue virus
KTPRICTRE

SEQ ID NO: 37380 - protein, 9 aa, Dengue virus
TPRICTREE

SEQ ID NO: 37381 - protein, 9 aa, Dengue virus
PRICTREEF

SEQ ID NO: 37382 - protein, 9 aa, Dengue virus
RICTREEFT

SEQ ID NO: 37383 - protein, 9 aa, Dengue virus
CTRAEFCNK

SEQ ID NO: 37384 - protein, 9 aa, Dengue virus
TRAEFCNKV

SEQ ID NO: 37385 - protein, 9 aa, Dengue virus
RAEFCNKVR

SEQ ID NO: 37386 - protein, 9 aa, Dengue virus
AEFCNKVRS

SEQ ID NO: 37387 - protein, 9 aa, Dengue virus
EFCNKVRSN

SEQ ID NO: 37388 - protein, 9 aa, Dengue virus
FCNKVRSNA

SEQ ID NO: 37389 - protein, 9 aa, Dengue virus
CNKVRSNAA

SEQ ID NO: 37390 - protein, 9 aa, Dengue virus
NKVRSNAAL

SEQ ID NO: 37391 - protein, 9 aa, Dengue virus
SAREAVEDE

SEQ ID NO: 37392 - protein, 9 aa, Dengue virus
AREAVEDSG

SEQ ID NO: 37393 - protein, 9 aa, Dengue virus
REAVEDSGF

SEQ ID NO: 37394 - protein, 9 aa, Dengue virus
EAVEDSGFW

SEQ ID NO: 37395 - protein, 9 aa, Dengue virus
AVEDSGFWE

SEQ ID NO: 37396 - protein, 9 aa, Dengue virus
VEDSGFWEL

SEQ ID NO: 37397 - protein, 9 aa, Dengue virus
FWELIDRER

SEQ ID NO: 37398 - protein, 9 aa, Dengue virus
WELIDRERN

SEQ ID NO: 37399 - protein, 9 aa, Dengue virus
ELIDRERNL

SEQ ID NO: 37400 - protein, 9 aa, Dengue virus
LIDRERNLH

SEQ ID NO: 37401 - protein, 9 aa, Dengue virus
IDRERNLHL

SEQ ID NO: 37402 - protein, 9 aa, Dengue virus
EKERNLHLD

SEQ ID NO: 37403 - protein, 9 aa, Dengue virus
KERNLHLDG

SEQ ID NO: 37404 - protein, 9 aa, Dengue virus
GVEGEGLYK

SEQ ID NO: 37405 - protein, 9 aa, Dengue virus
VEGEGLYKL

SEQ ID NO: 37406 - protein, 9 aa, Dengue virus
EGEGLYKLG

SEQ ID NO: 37407 - protein, 9 aa, Dengue virus
GEGLYKLGY

SEQ ID NO: 37408 - protein, 9 aa, Dengue virus
HRLGYILRE

SEQ ID NO: 37409 - protein, 9 aa, Dengue virus
RLGYILREV

SEQ ID NO: 37410 - protein, 9 aa, Dengue virus
LGYILREVG

SEQ ID NO: 37411 - protein, 9 aa, Dengue virus
GYILREVGK

SEQ ID NO: 37412 - protein, 9 aa, Dengue virus
YILREVGKK

SEQ ID NO: 37413 - protein, 9 aa, Dengue virus
ISRKAGGAM

SEQ ID NO: 37414 - protein, 9 aa, Dengue virus
SRKAGGAMY

SEQ ID NO: 37415 - protein, 9 aa, Dengue virus
KKAGGAMYA

SEQ ID NO: 37416 - protein, 9 aa, Dengue virus
AGWDTRITS

SEQ ID NO: 37417 - protein, 9 aa, Dengue virus
GWDTRITSE

SEQ ID NO: 37418 - protein, 9 aa, Dengue virus
WDTRITSED

SEQ ID NO: 37419 - protein, 9 aa, Dengue virus
DTRITSEDL

SEQ ID NO: 37420 - protein, 9 aa, Dengue virus
TRITSEDLK

SEQ ID NO: 37421 - protein, 9 aa, Dengue virus
RITSEDLKN

SEQ ID NO: 37422 - protein, 9 aa, Dengue virus
ITSEDLKNE

SEQ ID NO: 37423 - protein, 9 aa, Dengue virus
TSEDLKNEE

SEQ ID NO: 37424 - protein, 9 aa, Dengue virus
SEDLKNEEM

SEQ ID NO: 37425 - protein, 9 aa, Dengue virus
LKNEEMITD

SEQ ID NO: 37426 - protein, 9 aa, Dengue virus
KNEEMITDQ

SEQ ID NO: 37427 - protein, 9 aa, Dengue virus
NEEMITDQM

SEQ ID NO: 37428 - protein, 9 aa, Dengue virus
GRHKKLAEA

SEQ ID NO: 37429 - protein, 9 aa, Dengue virus
RHKKLAEAI

SEQ ID NO: 37430 - protein, 9 aa, Dengue virus
KKLAEAIFR

SEQ ID NO: 37431 - protein, 9 aa, Dengue virus
KLAEAIFRL

SEQ ID NO: 37432 - protein, 9 aa, Dengue virus
IRQMEGEGL

SEQ ID NO: 37433 - protein, 9 aa, Dengue virus
RQMEGEGLF

SEQ ID NO: 37434 - protein, 9 aa, Dengue virus
QMEGEGLFK

SEQ ID NO: 37435 - protein, 9 aa, Dengue virus
RVGRERLTR

SEQ ID NO: 37436 - protein, 9 aa, Dengue virus
VGRERLTRM

SEQ ID NO: 37437 - protein, 9 aa, Dengue virus
GRERLTRMA

SEQ ID NO: 37438 - protein, 9 aa, Dengue virus
RERLTRMAI

SEQ ID NO: 37439 - protein, 9 aa, Dengue virus
ERLTRMAIS

SEQ ID NO: 37440 - protein, 9 aa, Dengue virus
RLTRMAISG

SEQ ID NO: 37441 - protein, 9 aa, Dengue virus
LTRMAISGD

SEQ ID NO: 37442 - protein, 9 aa, Dengue virus
TRMAISGDD

SEQ ID NO: 37443 - protein, 9 aa, Dengue virus
DDRFARALT

SEQ ID NO: 37444 - protein, 9 aa, Dengue virus
DRFARALTA

SEQ ID NO: 37445 - protein, 9 aa, Dengue virus
RFARALTAL

SEQ ID NO: 37446 - protein, 9 aa, Dengue virus
FARALTALN

SEQ ID NO: 37447 - protein, 9 aa, Dengue virus
ARALTALND

SEQ ID NO: 37448 - protein, 9 aa, Dengue virus
RALTALNDM

SEQ ID NO: 37449 - protein, 9 aa, Dengue virus
QWEPSKGWS

SEQ ID NO: 37450 - protein, 9 aa, Dengue virus
WEPSKGWSD

SEQ ID NO: 37451 - protein, 9 aa, Dengue virus
EPSKGWSDW

SEQ ID NO: 37452 - protein, 9 aa, Dengue virus
PSKGWSDWT

SEQ ID NO: 37453 - protein, 9 aa, Dengue virus
SKGWSDWTQ

SEQ ID NO: 37454 - protein, 9 aa, Dengue virus
KGWSDWTQV

SEQ ID NO: 37455 - protein, 9 aa, Dengue virus
MKDGRILVV

SEQ ID NO: 37456 - protein, 9 aa, Dengue virus
KDGRILVVP

SEQ ID NO: 37457 - protein, 9 aa, Dengue virus
DGRILVVPC

SEQ ID NO: 37458 - protein, 9 aa, Dengue virus
GRILVVPCR

SEQ ID NO: 37459 - protein, 9 aa, Dengue virus
RTTWSIHAS

SEQ ID NO: 37460 - protein, 9 aa, Dengue virus
TTWSIHASH

SEQ ID NO: 37461 - protein, 9 aa, Dengue virus
TWSIHASHE

SEQ ID NO: 37462 - protein, 9 aa, Dengue virus
WSIHASHEW

SEQ ID NO: 37463 - protein, 9 aa, Dengue virus
SIHASHEWM

SEQ ID NO: 37464 - protein, 9 aa, Dengue virus
IHASHEWMT

SEQ ID NO: 37465 - protein, 9 aa, Dengue virus
HASHEWMTT

SEQ ID NO: 37466 - protein, 9 aa, Dengue virus
ASHEWMTTE

SEQ ID NO: 37467 - protein, 9 aa, Dengue virus
SHEWMTTED

SEQ ID NO: 37468 - protein, 9 aa, Dengue virus
EDMLTVWNK

SEQ ID NO: 37469 - protein, 9 aa, Dengue virus
DMLTVWNKV

SEQ ID NO: 37470 - protein, 9 aa, Dengue virus
MLTVWNKVW

SEQ ID NO: 37471 - protein, 9 aa, Dengue virus
LTVWNKVWI

SEQ ID NO: 37472 - protein, 9 aa, Dengue virus
TVWNRVWIR

SEQ ID NO: 37473 - protein, 9 aa, Dengue virus
VWNRVWILE

SEQ ID NO: 37474 - protein, 9 aa, Dengue virus
WNRVWILEN

SEQ ID NO: 37475 - protein, 9 aa, Dengue virus
NRVWILENP

SEQ ID NO: 37476 - protein, 9 aa, Dengue virus
RVWILENPW

SEQ ID NO: 37477 - protein, 9 aa, Dengue virus
VWILENPWM

SEQ ID NO: 37478 - protein, 9 aa, Dengue virus
WILENPWME

SEQ ID NO: 37479 - protein, 9 aa, Dengue virus
ILENPWMED

SEQ ID NO: 37480 - protein, 9 aa, Dengue virus
LENPWMEDK

SEQ ID NO: 37481 - protein, 9 aa, Dengue virus
ENPWIEDKT

SEQ ID NO: 37482 - protein, 9 aa, Dengue virus
MEDKTPVET

SEQ ID NO: 37483 - protein, 9 aa, Dengue virus
EKTPVESWE

SEQ ID NO: 37484 - protein, 9 aa, Dengue virus
KTPVETWEE

SEQ ID NO: 37485 - protein, 9 aa, Dengue virus
TPVESWEDI

SEQ ID NO: 37486 - protein, 9 aa, Dengue virus
PVESWEDIP

SEQ ID NO: 37487 - protein, 9 aa, Dengue virus
VESWEDIPY

SEQ ID NO: 37488 - protein, 9 aa, Dengue virus
ESWEDIPYL

SEQ ID NO: 37489 - protein, 9 aa, Dengue virus
SWEDIPYLG

SEQ ID NO: 37490 - protein, 9 aa, Dengue virus
WEDIPYLGK

SEQ ID NO: 37491 - protein, 9 aa, Dengue virus
EDIPYLGKR

SEQ ID NO: 37492 - protein, 9 aa, Dengue virus
DIPYLGKRE

SEQ ID NO: 37493 - protein, 9 aa, Dengue virus
ATWAKNIQV

SEQ ID NO: 37494 - protein, 9 aa, Dengue virus
TWAKNIQVA

SEQ ID NO: 37495 - protein, 9 aa, Dengue virus
WAKNIQVAI

SEQ ID NO: 37496 - protein, 9 aa, Dengue virus
AKNIQVAIN

SEQ ID NO: 37497 - protein, 9 aa, Dengue virus
KNIQVAINQ

SEQ ID NO: 37498 - protein, 9 aa, Dengue virus
NIQVAINQV

SEQ ID NO: 37499 - protein, 9 aa, Dengue virus
IQVAINQVR

SEQ ID NO: 37500 - protein, 9 aa, Dengue virus
QVAINQVRS

SEQ ID NO: 37501 - protein, 9 aa, Dengue virus
VAINQVRSL

SEQ ID NO: 37502 - protein, 9 aa, Dengue virus
AINQVRSLM

SEQ ID NO: 37503 - protein, 9 aa, Dengue virus
INQVRSLMG

SEQ ID NO: 37504 - protein, 9 aa, Dengue virus
NQVRSLMGN

SEQ ID NO: 37505 - protein, 9 aa, Dengue virus
QVRSLMGNE

SEQ ID NO: 37506 - protein, 9 aa, Dengue virus
VRSLMGNEG

SEQ ID NO: 37507 - protein, 9 aa, Dengue virus
RSLMGNEGY

SEQ ID NO: 37508 - protein, 9 aa, Dengue virus
EEYIDYMPS

SEQ ID NO: 37509 - protein, 9 aa, Dengue virus
EYIDYMPSM

SEQ ID NO: 37510 - protein, 9 aa, Dengue virus
MPSMKRFRS

SEQ ID NO: 37511 - protein, 9 aa, Dengue virus
PSMKRFRSE

SEQ ID NO: 37512 - protein, 9 aa, Dengue virus
SMKRFRSEE

SEQ ID NO: 37513 - protein, 9 aa, Dengue virus
MKRFRSEEE

SEQ ID NO: 37514 - protein, 9 aa, Dengue virus
KRFRSEEEE

SEQ ID NO: 37515 - protein, 9 aa, Dengue virus
RFRSEEEES

SEQ ID NO: 37516 - protein, 9 aa, Dengue virus
FRSEEEESG

SEQ ID NO: 37517 - protein, 9 aa, Dengue virus
RSEEEESGV

SEQ ID NO: 37518 - protein, 9 aa, Dengue virus
SEEEESGVL

SEQ ID NO: 37519 - protein, 9 aa, Dengue virus
NNQRKKAKT

SEQ ID NO: 37520 - protein, 9 aa, Dengue virus
AIKKSKAIN

SEQ ID NO: 37521 - protein, 9 aa, Dengue virus
IKKSRAINV

SEQ ID NO: 37522 - protein, 9 aa, Dengue virus
KSKAINILR

SEQ ID NO: 37523 - protein, 9 aa, Dengue virus
ILNRRRRSV

SEQ ID NO: 37524 - protein, 9 aa, Dengue virus
LNRRRRSVG

SEQ ID NO: 37525 - protein, 9 aa, Dengue virus
IPTAIAFHL

SEQ ID NO: 37526 - protein, 9 aa, Dengue virus
PTAIAFHLT

SEQ ID NO: 37527 - protein, 9 aa, Dengue virus
TAIAFHLTT

SEQ ID NO: 37528 - protein, 9 aa, Dengue virus
AIAFHLTTR

SEQ ID NO: 37529 - protein, 9 aa, Dengue virus
GEPHMIVSI

SEQ ID NO: 37530 - protein, 9 aa, Dengue virus
EPHMIVSIQ

SEQ ID NO: 37531 - protein, 9 aa, Dengue virus
PHMIVSIQE

SEQ ID NO: 37532 - protein, 9 aa, Dengue virus
HMIVSIQEK

SEQ ID NO: 37533 - protein, 9 aa, Dengue virus
MIVSIQEKG

SEQ ID NO: 37534 - protein, 9 aa, Dengue virus
IVSIQEKGK

SEQ ID NO: 37535 - protein, 9 aa, Dengue virus
VSIQEKGKS

SEQ ID NO: 37536 - protein, 9 aa, Dengue virus
SIQEKGKSL

SEQ ID NO: 37537 - protein, 9 aa, Dengue virus
KSLLFKTEV

SEQ ID NO: 37538 - protein, 9 aa, Dengue virus
SLLFKTEVG

SEQ ID NO: 37539 - protein, 9 aa, Dengue virus
NGINMCTLM

SEQ ID NO: 37540 - protein, 9 aa, Dengue virus
INMCTLMAM

SEQ ID NO: 37541 - protein, 9 aa, Dengue virus
DTVTYKCPF

SEQ ID NO: 37542 - protein, 9 aa, Dengue virus
TVTYKCPFL

SEQ ID NO: 37543 - protein, 9 aa, Dengue virus
TYKCPLLKQ

SEQ ID NO: 37544 - protein, 9 aa, Dengue virus
YKCPLLKQN

SEQ ID NO: 37545 - protein, 9 aa, Dengue virus
KCPLLKQNE

SEQ ID NO: 37546 - protein, 9 aa, Dengue virus
TWITYGTCT

SEQ ID NO: 37547 - protein, 9 aa, Dengue virus
STGEHRREK

SEQ ID NO: 37548 - protein, 9 aa, Dengue virus
QAQRIETWI

SEQ ID NO: 37549 - protein, 9 aa, Dengue virus
LRHPGFAIM

SEQ ID NO: 37550 - protein, 9 aa, Dengue virus
RHPGFAIMA

SEQ ID NO: 37551 - protein, 9 aa, Dengue virus
HPGFAIMAA

SEQ ID NO: 37552 - protein, 9 aa, Dengue virus
TIGTTHFQK

SEQ ID NO: 37553 - protein, 9 aa, Dengue virus
GTTHFQRTL

SEQ ID NO: 37554 - protein, 9 aa, Dengue virus
TTHFQRTLI

SEQ ID NO: 37555 - protein, 9 aa, Dengue virus
THFQRTLIF

SEQ ID NO: 37556 - protein, 9 aa, Dengue virus
HFQRTLIFI

SEQ ID NO: 37557 - protein, 9 aa, Dengue virus
FQKALIFIL

SEQ ID NO: 37558 - protein, 9 aa, Dengue virus
QKALIFILL

SEQ ID NO: 37559 - protein, 9 aa, Dengue virus
RTLIFILLT

SEQ ID NO: 37560 - protein, 9 aa, Dengue virus
TLIFILLTA

SEQ ID NO: 37561 - protein, 9 aa, Dengue virus
LIFILLTTV

SEQ ID NO: 37562 - protein, 9 aa, Dengue virus
IFILLTAVT

SEQ ID NO: 37563 - protein, 9 aa, Dengue virus
FILLTAVTP

SEQ ID NO: 37564 - protein, 9 aa, Dengue virus
ILLTAVTPS

SEQ ID NO: 37565 - protein, 9 aa, Dengue virus
LLTAVTPSM

SEQ ID NO: 37566 - protein, 9 aa, Dengue virus
LTAVTPSMT

SEQ ID NO: 37567 - protein, 9 aa, Dengue virus
TAVTPSMTM

SEQ ID NO: 37568 - protein, 9 aa, Dengue virus
TVAPSMTMR

SEQ ID NO: 37569 - protein, 9 aa, Dengue virus
ELTKTEAKH

SEQ ID NO: 37570 - protein, 9 aa, Dengue virus
KTEAKQSAT

SEQ ID NO: 37571 - protein, 9 aa, Dengue virus
TEAKQLATL

SEQ ID NO: 37572 - protein, 9 aa, Dengue virus
EAKQSATLR

SEQ ID NO: 37573 - protein, 9 aa, Dengue virus
AKQSATLRK

SEQ ID NO: 37574 - protein, 9 aa, Dengue virus
KEPATLRKY

SEQ ID NO: 37575 - protein, 9 aa, Dengue virus
EPATLRKYC

SEQ ID NO: 37576 - protein, 9 aa, Dengue virus
SATLRKYCI

SEQ ID NO: 37577 - protein, 9 aa, Dengue virus
PTQGEPSLV

SEQ ID NO: 37578 - protein, 9 aa, Dengue virus
TQGEPSLSE

SEQ ID NO: 37579 - protein, 9 aa, Dengue virus
QGEPSLSEE

SEQ ID NO: 37580 - protein, 9 aa, Dengue virus
GEPSLVEEQ

SEQ ID NO: 37581 - protein, 9 aa, Dengue virus
EPSLSEEQD

SEQ ID NO: 37582 - protein, 9 aa, Dengue virus
PSLSEEQDK

SEQ ID NO: 37583 - protein, 9 aa, Dengue virus
SLVEEQDKR

SEQ ID NO: 37584 - protein, 9 aa, Dengue virus
LVEEQDKRF

SEQ ID NO: 37585 - protein, 9 aa, Dengue virus
EQDKRFLCK

SEQ ID NO: 37586 - protein, 9 aa, Dengue virus
QDKRFLCKH

SEQ ID NO: 37587 - protein, 9 aa, Dengue virus
DKRFLCKHS

SEQ ID NO: 37588 - protein, 9 aa, Dengue virus
KRFLCKHSM

SEQ ID NO: 37589 - protein, 9 aa, Dengue virus
RFLCKHSMV

SEQ ID NO: 37590 - protein, 9 aa, Dengue virus
FLCKHSMVD

SEQ ID NO: 37591 - protein, 9 aa, Dengue virus
LCKHSMVDR

SEQ ID NO: 37592 - protein, 9 aa, Dengue virus
GIVTCAMFS

SEQ ID NO: 37593 - protein, 9 aa, Dengue virus
IVTCAKFTC

SEQ ID NO: 37594 - protein, 9 aa, Dengue virus
VTCAMFSCK

SEQ ID NO: 37595 - protein, 9 aa, Dengue virus
TCAMFSCKK

SEQ ID NO: 37596 - protein, 9 aa, Dengue virus
CAMFSCKKN

SEQ ID NO: 37597 - protein, 9 aa, Dengue virus
AKFTCKKNM

SEQ ID NO: 37598 - protein, 9 aa, Dengue virus
MFTCLKKME

SEQ ID NO: 37599 - protein, 9 aa, Dengue virus
FTCKKNMKG

SEQ ID NO: 37600 - protein, 9 aa, Dengue virus
TCLKKMEGK

SEQ ID NO: 37601 - protein, 9 aa, Dengue virus
CLKKMEGKV

SEQ ID NO: 37602 - protein, 9 aa, Dengue virus
KKNMKGKVV

SEQ ID NO: 37603 - protein, 9 aa, Dengue virus
KKMEGKVVQ

SEQ ID NO: 37604 - protein, 9 aa, Dengue virus
KMEGKVVQP

SEQ ID NO: 37605 - protein, 9 aa, Dengue virus
MKGKVVQPE

SEQ ID NO: 37606 - protein, 9 aa, Dengue virus
KGKVVQPEN

SEQ ID NO: 37607 - protein, 9 aa, Dengue virus
VTPHSGEEN

SEQ ID NO: 37608 - protein, 9 aa, Dengue virus
SGEEYAVGN

SEQ ID NO: 37609 - protein, 9 aa, Dengue virus
GEEHSVGND

SEQ ID NO: 37610 - protein, 9 aa, Dengue virus
EEHSVGNDT

SEQ ID NO: 37611 - protein, 9 aa, Dengue virus
EYAVGNDTG

SEQ ID NO: 37612 - protein, 9 aa, Dengue virus
HSVGNDTGK

SEQ ID NO: 37613 - protein, 9 aa, Dengue virus
GDDTGKHGK

SEQ ID NO: 37614 - protein, 9 aa, Dengue virus
DDTGKHGKE

SEQ ID NO: 37615 - protein, 9 aa, Dengue virus
DTGKHGMEI

SEQ ID NO: 37616 - protein, 9 aa, Dengue virus
TGKHGMEIK

SEQ ID NO: 37617 - protein, 9 aa, Dengue virus
GKHGKEVKI

SEQ ID NO: 37618 - protein, 9 aa, Dengue virus
KHGKEVKIT

SEQ ID NO: 37619 - protein, 9 aa, Dengue virus
HGKEVKITP

SEQ ID NO: 37620 - protein, 9 aa, Dengue virus
GKEVKITPQ

SEQ ID NO: 37621 - protein, 9 aa, Dengue virus
KEVKITPQS

SEQ ID NO: 37622 - protein, 9 aa, Dengue virus
EIKITPQSP

SEQ ID NO: 37623 - protein, 9 aa, Dengue virus
SEAELTDYG

SEQ ID NO: 37624 - protein, 9 aa, Dengue virus
MESKAWLVH

SEQ ID NO: 37625 - protein, 9 aa, Dengue virus
ESKAWLVHR

SEQ ID NO: 37626 - protein, 9 aa, Dengue virus
SKAWLVHRQ

SEQ ID NO: 37627 - protein, 9 aa, Dengue virus
WLPGADTQE

SEQ ID NO: 37628 - protein, 9 aa, Dengue virus
LPGADTQES

SEQ ID NO: 37629 - protein, 9 aa, Dengue virus
PGADTQESN

SEQ ID NO: 37630 - protein, 9 aa, Dengue virus
GADTQESNW

SEQ ID NO: 37631 - protein, 9 aa, Dengue virus
ADTQESNWI

SEQ ID NO: 37632 - protein, 9 aa, Dengue virus
DTQESNWIQ

SEQ ID NO: 37633 - protein, 9 aa, Dengue virus
TQESNWIQK

SEQ ID NO: 37634 - protein, 9 aa, Dengue virus
ESNWIQKEM

SEQ ID NO: 37635 - protein, 9 aa, Dengue virus
VIRVQYEGE

SEQ ID NO: 37636 - protein, 9 aa, Dengue virus
VRVQYEGDG

SEQ ID NO: 37637 - protein, 9 aa, Dengue virus
RLQYEGDGS

SEQ ID NO: 37638 - protein, 9 aa, Dengue virus
LQYEGDGSP

SEQ ID NO: 37639 - protein, 9 aa, Dengue virus
EGDGSPCKV

SEQ ID NO: 37640 - protein, 9 aa, Dengue virus
GDGSPCKVP

SEQ ID NO: 37641 - protein, 9 aa, Dengue virus
DGSPCKVPF

SEQ ID NO: 37642 - protein, 9 aa, Dengue virus
GSPCKVPFE

SEQ ID NO: 37643 - protein, 9 aa, Dengue virus
PCKVPFEIM

SEQ ID NO: 37644 - protein, 9 aa, Dengue virus
CKVPFEIMD

SEQ ID NO: 37645 - protein, 9 aa, Dengue virus
KVPFEIMDL

SEQ ID NO: 37646 - protein, 9 aa, Dengue virus
FEIMDLERR

SEQ ID NO: 37647 - protein, 9 aa, Dengue virus
EIMDLEKKH

SEQ ID NO: 37648 - protein, 9 aa, Dengue virus
DLERRYVLG

SEQ ID NO: 37649 - protein, 9 aa, Dengue virus
LERRYVLGR

SEQ ID NO: 37650 - protein, 9 aa, Dengue virus
ERRYVLGRL

SEQ ID NO: 37651 - protein, 9 aa, Dengue virus
RRYVLGRLI

SEQ ID NO: 37652 - protein, 9 aa, Dengue virus
RYILGRLIT

SEQ ID NO: 37653 - protein, 9 aa, Dengue virus
LITVNPIIT

SEQ ID NO: 37654 - protein, 9 aa, Dengue virus
EKDNPINIE

SEQ ID NO: 37655 - protein, 9 aa, Dengue virus
SLGGAFTSI

SEQ ID NO: 37656 - protein, 9 aa, Dengue virus
LGGAFTSIG

SEQ ID NO: 37657 - protein, 9 aa, Dengue virus
WTMKIFIGV

SEQ ID NO: 37658 - protein, 9 aa, Dengue virus
IMKILIGVI

SEQ ID NO: 37659 - protein, 9 aa, Dengue virus
MKIFIGVII

SEQ ID NO: 37660 - protein, 9 aa, Dengue virus
VTLVLVGIV

SEQ ID NO: 37661 - protein, 9 aa, Dengue virus
LVLVGVVIL

SEQ ID NO: 37662 - protein, 9 aa, Dengue virus
VLVGVVILY

SEQ ID NO: 37663 - protein, 9 aa, Dengue virus
LVGVVILYL

SEQ ID NO: 37664 - protein, 9 aa, Dengue virus
GVITLYLGA

SEQ ID NO: 37665 - protein, 9 aa, Dengue virus
ITLYLGAMV

SEQ ID NO: 37666 - protein, 9 aa, Dengue virus
LGVMVQADT

SEQ ID NO: 37667 - protein, 9 aa, Dengue virus
GVMVQADTG

SEQ ID NO: 37668 - protein, 9 aa, Dengue virus
VMVQADTGC

SEQ ID NO: 37669 - protein, 9 aa, Dengue virus
MVQADSGCI

SEQ ID NO: 37670 - protein, 9 aa, Dengue virus
SGCIVSWKN

SEQ ID NO: 37671 - protein, 9 aa, Dengue virus
AIQKAYEEG

SEQ ID NO: 37672 - protein, 9 aa, Dengue virus
IQKAHEDGI

SEQ ID NO: 37673 - protein, 9 aa, Dengue virus
QKAYEEGIC

SEQ ID NO: 37674 - protein, 9 aa, Dengue virus
KAYEEGICG

SEQ ID NO: 37675 - protein, 9 aa, Dengue virus
AYEEGICGI

SEQ ID NO: 37676 - protein, 9 aa, Dengue virus
YEEGICGIR

SEQ ID NO: 37677 - protein, 9 aa, Dengue virus
ILSENEVKM

SEQ ID NO: 37678 - protein, 9 aa, Dengue virus
LSENEVKMT

SEQ ID NO: 37679 - protein, 9 aa, Dengue virus
SENEVKMTI

SEQ ID NO: 37680 - protein, 9 aa, Dengue virus
VKMTIMTGD

SEQ ID NO: 37681 - protein, 9 aa, Dengue virus
KMTIMTGDI

SEQ ID NO: 37682 - protein, 9 aa, Dengue virus
LTIMTGEIK

SEQ ID NO: 37683 - protein, 9 aa, Dengue virus
TIMTGEIKG

SEQ ID NO: 37684 - protein, 9 aa, Dengue virus
IMTGEIKGI

SEQ ID NO: 37685 - protein, 9 aa, Dengue virus
MTGEIKGIM

SEQ ID NO: 37686 - protein, 9 aa, Dengue virus
TGEIKGIMQ

SEQ ID NO: 37687 - protein, 9 aa, Dengue virus
KGIMQAGRR

SEQ ID NO: 37688 - protein, 9 aa, Dengue virus
GIMQAGKRY

SEQ ID NO: 37689 - protein, 9 aa, Dengue virus
IMQAGKRYL

SEQ ID NO: 37690 - protein, 9 aa, Dengue virus
GKRYLRPQP

SEQ ID NO: 37691 - protein, 9 aa, Dengue virus
KRYLRPQPT

SEQ ID NO: 37692 - protein, 9 aa, Dengue virus
RYLRPQPTE

SEQ ID NO: 37693 - protein, 9 aa, Dengue virus
YLRPQPTEL

SEQ ID NO: 37694 - protein, 9 aa, Dengue virus
LQPQPTELK

SEQ ID NO: 37695 - protein, 9 aa, Dengue virus
QPQPTELKY

SEQ ID NO: 37696 - protein, 9 aa, Dengue virus
TQLKYSWKT

SEQ ID NO: 37697 - protein, 9 aa, Dengue virus
KTWGKAKIL

SEQ ID NO: 37698 - protein, 9 aa, Dengue virus
WGKAKILST

SEQ ID NO: 37699 - protein, 9 aa, Dengue virus
GKAKILSTE

SEQ ID NO: 37700 - protein, 9 aa, Dengue virus
QNQTFLIDG

SEQ ID NO: 37701 - protein, 9 aa, Dengue virus
TVECPNTNR

SEQ ID NO: 37702 - protein, 9 aa, Dengue virus
VECPNTNRA

SEQ ID NO: 37703 - protein, 9 aa, Dengue virus
IFTTNIWLK

SEQ ID NO: 37704 - protein, 9 aa, Dengue virus
TTNIWLRLR

SEQ ID NO: 37705 - protein, 9 aa, Dengue virus
TNIWLRLKE

SEQ ID NO: 37706 - protein, 9 aa, Dengue virus
NIWLRLREK

SEQ ID NO: 37707 - protein, 9 aa, Dengue virus
IWLRLREKQ

SEQ ID NO: 37708 - protein, 9 aa, Dengue virus
WLRLREKQD

SEQ ID NO: 37709 - protein, 9 aa, Dengue virus
VCDSKLMSA

SEQ ID NO: 37710 - protein, 9 aa, Dengue virus
LMSAAIKNN

SEQ ID NO: 37711 - protein, 9 aa, Dengue virus
MSAAIKNNR

SEQ ID NO: 37712 - protein, 9 aa, Dengue virus
SAAIKNNRA

SEQ ID NO: 37713 - protein, 9 aa, Dengue virus
AAIKNNRAV

SEQ ID NO: 37714 - protein, 9 aa, Dengue virus
AIKNNRAVH

SEQ ID NO: 37715 - protein, 9 aa, Dengue virus
IKNNRAVHA

SEQ ID NO: 37716 - protein, 9 aa, Dengue virus
SFIEVKSCY

SEQ ID NO: 37717 - protein, 9 aa, Dengue virus
FIEVKSCYW

SEQ ID NO: 37718 - protein, 9 aa, Dengue virus
IEVKSCYWP

SEQ ID NO: 37719 - protein, 9 aa, Dengue virus
EVKSCYWPR

SEQ ID NO: 37720 - protein, 9 aa, Dengue virus
VKSCYWPRS

SEQ ID NO: 37721 - protein, 9 aa, Dengue virus
KSCHWPRSH

SEQ ID NO: 37722 - protein, 9 aa, Dengue virus
SCHWPRSHT

SEQ ID NO: 37723 - protein, 9 aa, Dengue virus
IPKNIAGPV

SEQ ID NO: 37724 - protein, 9 aa, Dengue virus
PKGFAGPVS

SEQ ID NO: 37725 - protein, 9 aa, Dengue virus
KGFAGPVSQ

SEQ ID NO: 37726 - protein, 9 aa, Dengue virus
GFAGPVSQH

SEQ ID NO: 37727 - protein, 9 aa, Dengue virus
QHNNRPGYY

SEQ ID NO: 37728 - protein, 9 aa, Dengue virus
HNYRLGYHT

SEQ ID NO: 37729 - protein, 9 aa, Dengue virus
NYRLGYHTQ

SEQ ID NO: 37730 - protein, 9 aa, Dengue virus
RPGYHTQIT

SEQ ID NO: 37731 - protein, 9 aa, Dengue virus
PGYHTQITG

SEQ ID NO: 37732 - protein, 9 aa, Dengue virus
GYHTQITGP

SEQ ID NO: 37733 - protein, 9 aa, Dengue virus
YHTQITGPW

SEQ ID NO: 37734 - protein, 9 aa, Dengue virus
HTQITGPWH

SEQ ID NO: 37735 - protein, 9 aa, Dengue virus
ITGPWHLGK

SEQ ID NO: 37736 - protein, 9 aa, Dengue virus
LGKLEMDFN

SEQ ID NO: 37737 - protein, 9 aa, Dengue virus
GKLEMDFEF

SEQ ID NO: 37738 - protein, 9 aa, Dengue virus
KLEMDFEFC

SEQ ID NO: 37739 - protein, 9 aa, Dengue virus
LEMDFEFCE

SEQ ID NO: 37740 - protein, 9 aa, Dengue virus
EMDFEFCEG

SEQ ID NO: 37741 - protein, 9 aa, Dengue virus
MDFEFCEGT

SEQ ID NO: 37742 - protein, 9 aa, Dengue virus
DFEFCEGTT

SEQ ID NO: 37743 - protein, 9 aa, Dengue virus
FEFCEGTTV

SEQ ID NO: 37744 - protein, 9 aa, Dengue virus
FCDGTTVVV

SEQ ID NO: 37745 - protein, 9 aa, Dengue virus
GTTVVVTEN

SEQ ID NO: 37746 - protein, 9 aa, Dengue virus
TTVVVTENC

SEQ ID NO: 37747 - protein, 9 aa, Dengue virus
TVVVTENCG

SEQ ID NO: 37748 - protein, 9 aa, Dengue virus
VVVTENCGN

SEQ ID NO: 37749 - protein, 9 aa, Dengue virus
VVTENCGNR

SEQ ID NO: 37750 - protein, 9 aa, Dengue virus
LGVLGMALL

SEQ ID NO: 37751 - protein, 9 aa, Dengue virus
GVLGMALLL

SEQ ID NO: 37752 - protein, 9 aa, Dengue virus
VLGMALLLE

SEQ ID NO: 37753 - protein, 9 aa, Dengue virus
RTRMGTKHA

SEQ ID NO: 37754 - protein, 9 aa, Dengue virus
FVTLITGNL

SEQ ID NO: 37755 - protein, 9 aa, Dengue virus
SFRDLGRVV

SEQ ID NO: 37756 - protein, 9 aa, Dengue virus
RDLGRVVVM

SEQ ID NO: 37757 - protein, 9 aa, Dengue virus
GRVVVMVGT

SEQ ID NO: 37758 - protein, 9 aa, Dengue virus
TDDIGMGIT

SEQ ID NO: 37759 - protein, 9 aa, Dengue virus
DDIGIGVTY

SEQ ID NO: 37760 - protein, 9 aa, Dengue virus
DIGIGVTYL

SEQ ID NO: 37761 - protein, 9 aa, Dengue virus
IGIGVTYLA

SEQ ID NO: 37762 - protein, 9 aa, Dengue virus
AYKVRPTFA

SEQ ID NO: 37763 - protein, 9 aa, Dengue virus
YKVRPTFAA

SEQ ID NO: 37764 - protein, 9 aa, Dengue virus
KVRPTFVAG

SEQ ID NO: 37765 - protein, 9 aa, Dengue virus
TFAAGLLLK

SEQ ID NO: 37766 - protein, 9 aa, Dengue virus
FAAGLLLKK

SEQ ID NO: 37767 - protein, 9 aa, Dengue virus
AAGLLLKKL

SEQ ID NO: 37768 - protein, 9 aa, Dengue virus
ELMMATIGV

SEQ ID NO: 37769 - protein, 9 aa, Dengue virus
TIGVVLLSQ

SEQ ID NO: 37770 - protein, 9 aa, Dengue virus
IGVVLLSQS

SEQ ID NO: 37771 - protein, 9 aa, Dengue virus
PESILELTD

SEQ ID NO: 37772 - protein, 9 aa, Dengue virus
ESILELTDA

SEQ ID NO: 37773 - protein, 9 aa, Dengue virus
SILELTDAL

SEQ ID NO: 37774 - protein, 9 aa, Dengue virus
DALALGMMI

SEQ ID NO: 37775 - protein, 9 aa, Dengue virus
ALALGMMIL

SEQ ID NO: 37776 - protein, 9 aa, Dengue virus
LALGMMILK

SEQ ID NO: 37777 - protein, 9 aa, Dengue virus
VRSMEKYQL

SEQ ID NO: 37778 - protein, 9 aa, Dengue virus
SMEKYQLAV

SEQ ID NO: 37779 - protein, 9 aa, Dengue virus
YQLAVTIMV

SEQ ID NO: 37780 - protein, 9 aa, Dengue virus
ILCVPNAVV

SEQ ID NO: 37781 - protein, 9 aa, Dengue virus
LCVPNAVVL

SEQ ID NO: 37782 - protein, 9 aa, Dengue virus
CVPNAVILL

SEQ ID NO: 37783 - protein, 9 aa, Dengue virus
VPNAVILLN

SEQ ID NO: 37784 - protein, 9 aa, Dengue virus
PNAVILLNA

SEQ ID NO: 37785 - protein, 9 aa, Dengue virus
NAVILLNAW

SEQ ID NO: 37786 - protein, 9 aa, Dengue virus
AWKVSCAIL

SEQ ID NO: 37787 - protein, 9 aa, Dengue virus
WKVSCAILA

SEQ ID NO: 37788 - protein, 9 aa, Dengue virus
CTILATVSV

SEQ ID NO: 37789 - protein, 9 aa, Dengue virus
ILATVSVSP

SEQ ID NO: 37790 - protein, 9 aa, Dengue virus
VSVFPLLLT

SEQ ID NO: 37791 - protein, 9 aa, Dengue virus
SVFPLLLTS

SEQ ID NO: 37792 - protein, 9 aa, Dengue virus
VFPLLLTSS

SEQ ID NO: 37793 - protein, 9 aa, Dengue virus
SPLLLTSSR

SEQ ID NO: 37794 - protein, 9 aa, Dengue virus
PLLLTSSRQ

SEQ ID NO: 37795 - protein, 9 aa, Dengue virus
LLLTSSRQK

SEQ ID NO: 37796 - protein, 9 aa, Dengue virus
LTSSRQKAD

SEQ ID NO: 37797 - protein, 9 aa, Dengue virus
FLTTLTRTS

SEQ ID NO: 37798 - protein, 9 aa, Dengue virus
LTTLTRTSK

SEQ ID NO: 37799 - protein, 9 aa, Dengue virus
TTLSRPNKI

SEQ ID NO: 37800 - protein, 9 aa, Dengue virus
TLSRPNKIR

SEQ ID NO: 37801 - protein, 9 aa, Dengue virus
LSRPNKIRS

SEQ ID NO: 37802 - protein, 9 aa, Dengue virus
SRPNKIRSW

SEQ ID NO: 37803 - protein, 9 aa, Dengue virus
RPNKIRSWP

SEQ ID NO: 37804 - protein, 9 aa, Dengue virus
PNKIRSWPL

SEQ ID NO: 37805 - protein, 9 aa, Dengue virus
DLELEKAAD

SEQ ID NO: 37806 - protein, 9 aa, Dengue virus
LELEKAADV

SEQ ID NO: 37807 - protein, 9 aa, Dengue virus
VRWEDQAEI

SEQ ID NO: 37808 - protein, 9 aa, Dengue virus
RWEDQAEIS

SEQ ID NO: 37809 - protein, 9 aa, Dengue virus
ISGLFPVSM

SEQ ID NO: 37810 - protein, 9 aa, Dengue virus
SGLFPVSMP

SEQ ID NO: 37811 - protein, 9 aa, Dengue virus
GLFPVSMPI

SEQ ID NO: 37812 - protein, 9 aa, Dengue virus
LFPVSMPIT

SEQ ID NO: 37813 - protein, 9 aa, Dengue virus
DVPSPPPIG

SEQ ID NO: 37814 - protein, 9 aa, Dengue virus
YRIKQKGIF

SEQ ID NO: 37815 - protein, 9 aa, Dengue virus
RIKQKGIFG

SEQ ID NO: 37816 - protein, 9 aa, Dengue virus
IKQKGIFGY

SEQ ID NO: 37817 - protein, 9 aa, Dengue virus
KQKGIFGYS

SEQ ID NO: 37818 - protein, 9 aa, Dengue virus
QKGIFGYSQ

SEQ ID NO: 37819 - protein, 9 aa, Dengue virus
KGIFGYSQI

SEQ ID NO: 37820 - protein, 9 aa, Dengue virus
TRGAVLTHK

SEQ ID NO: 37821 - protein, 9 aa, Dengue virus
RGAVLTHKG

SEQ ID NO: 37822 - protein, 9 aa, Dengue virus
GAVLTHKGK

SEQ ID NO: 37823 - protein, 9 aa, Dengue virus
AVLTHKGKR

SEQ ID NO: 37824 - protein, 9 aa, Dengue virus
VLTHKGKRI

SEQ ID NO: 37825 - protein, 9 aa, Dengue virus
LTHKGKRIE

SEQ ID NO: 37826 - protein, 9 aa, Dengue virus
THKGKRIEP

SEQ ID NO: 37827 - protein, 9 aa, Dengue virus
VQTKPGIFR

SEQ ID NO: 37828 - protein, 9 aa, Dengue virus
QTKPGIFRT

SEQ ID NO: 37829 - protein, 9 aa, Dengue virus
TKPGLFKTS

SEQ ID NO: 37830 - protein, 9 aa, Dengue virus
FKTSTGTIG

SEQ ID NO: 37831 - protein, 9 aa, Dengue virus
KTSTGTIGA

SEQ ID NO: 37832 - protein, 9 aa, Dengue virus
SAIAQTEKG

SEQ ID NO: 37833 - protein, 9 aa, Dengue virus
AIAQTEKGI

SEQ ID NO: 37834 - protein, 9 aa, Dengue virus
IAQTEKGIE

SEQ ID NO: 37835 - protein, 9 aa, Dengue virus
IENNPEIED

SEQ ID NO: 37836 - protein, 9 aa, Dengue virus
ENNPEIEDD

SEQ ID NO: 37837 - protein, 9 aa, Dengue virus
DNPEIEDHI

SEQ ID NO: 37838 - protein, 9 aa, Dengue virus
EDHIFRKRR

SEQ ID NO: 37839 - protein, 9 aa, Dengue virus
DHIFRKRRL

SEQ ID NO: 37840 - protein, 9 aa, Dengue virus
RYQTTAIKT

SEQ ID NO: 37841 - protein, 9 aa, Dengue virus
YQTTAIKTE

SEQ ID NO: 37842 - protein, 9 aa, Dengue virus
QTTAIKTEH

SEQ ID NO: 37843 - protein, 9 aa, Dengue virus
TTAIKTEHT

SEQ ID NO: 37844 - protein, 9 aa, Dengue virus
TAIKTEHTG

SEQ ID NO: 37845 - protein, 9 aa, Dengue virus
SWNTGHEWV

SEQ ID NO: 37846 - protein, 9 aa, Dengue virus
WNTGHEWVT

SEQ ID NO: 37847 - protein, 9 aa, Dengue virus
NTGHEWVTD

SEQ ID NO: 37848 - protein, 9 aa, Dengue virus
SGYEWVTDF

SEQ ID NO: 37849 - protein, 9 aa, Dengue virus
GHEWITDFK

SEQ ID NO: 37850 - protein, 9 aa, Dengue virus
YEWVTDFKG

SEQ ID NO: 37851 - protein, 9 aa, Dengue virus
EWITDFKGK

SEQ ID NO: 37852 - protein, 9 aa, Dengue virus
WITNFEGKT

SEQ ID NO: 37853 - protein, 9 aa, Dengue virus
ITDFKGKTV

SEQ ID NO: 37854 - protein, 9 aa, Dengue virus
RKTFDSEYA

SEQ ID NO: 37855 - protein, 9 aa, Dengue virus
KTFDSEYAK

SEQ ID NO: 37856 - protein, 9 aa, Dengue virus
TFDTEYTKT

SEQ ID NO: 37857 - protein, 9 aa, Dengue virus
FDSEYAKTR

SEQ ID NO: 37858 - protein, 9 aa, Dengue virus
VWLAFKVAA

SEQ ID NO: 37859 - protein, 9 aa, Dengue virus
WLAFKVAAE

SEQ ID NO: 37860 - protein, 9 aa, Dengue virus
LAFKVAAEG

SEQ ID NO: 37861 - protein, 9 aa, Dengue virus
AFKVAAEGI

SEQ ID NO: 37862 - protein, 9 aa, Dengue virus
FKVAAEGIN

SEQ ID NO: 37863 - protein, 9 aa, Dengue virus
KVASEGISY

SEQ ID NO: 37864 - protein, 9 aa, Dengue virus
VASEGISYA

SEQ ID NO: 37865 - protein, 9 aa, Dengue virus
ASEGISYAD

SEQ ID NO: 37866 - protein, 9 aa, Dengue virus
SEGISYADR

SEQ ID NO: 37867 - protein, 9 aa, Dengue virus
EGISYADRK

SEQ ID NO: 37868 - protein, 9 aa, Dengue virus
GISYADRKW

SEQ ID NO: 37869 - protein, 9 aa, Dengue virus
ISYADRKWC

SEQ ID NO: 37870 - protein, 9 aa, Dengue virus
SYADRKWCF

SEQ ID NO: 37871 - protein, 9 aa, Dengue virus
DRRWCFDGT

SEQ ID NO: 37872 - protein, 9 aa, Dengue virus
RRWCFDGTR

SEQ ID NO: 37873 - protein, 9 aa, Dengue virus
RWCFDGTRN

SEQ ID NO: 37874 - protein, 9 aa, Dengue virus
WCFDGTRNN

SEQ ID NO: 37875 - protein, 9 aa, Dengue virus
CFDGTRNNQ

SEQ ID NO: 37876 - protein, 9 aa, Dengue virus
FDGTRNNQI

SEQ ID NO: 37877 - protein, 9 aa, Dengue virus
DGTRNNQIL

SEQ ID NO: 37878 - protein, 9 aa, Dengue virus
GTRNNQILE

SEQ ID NO: 37879 - protein, 9 aa, Dengue virus
TRNNQILEE

SEQ ID NO: 37880 - protein, 9 aa, Dengue virus
ENIEVEIWT

SEQ ID NO: 37881 - protein, 9 aa, Dengue virus
NIEVEIWTK

SEQ ID NO: 37882 - protein, 9 aa, Dengue virus
IEVEIWTKE

SEQ ID NO: 37883 - protein, 9 aa, Dengue virus
LHTAEVGGK

SEQ ID NO: 37884 - protein, 9 aa, Dengue virus
HTAEVGGKA

SEQ ID NO: 37885 - protein, 9 aa, Dengue virus
TAEVGGKAY

SEQ ID NO: 37886 - protein, 9 aa, Dengue virus
GRAHNHALS

SEQ ID NO: 37887 - protein, 9 aa, Dengue virus
RAHNHALSE

SEQ ID NO: 37888 - protein, 9 aa, Dengue virus
LFLMSGRGV

SEQ ID NO: 37889 - protein, 9 aa, Dengue virus
FLMSGRGVG

SEQ ID NO: 37890 - protein, 9 aa, Dengue virus
LMSGRGVGK

SEQ ID NO: 37891 - protein, 9 aa, Dengue virus
MSGRGVGKM

SEQ ID NO: 37892 - protein, 9 aa, Dengue virus
SGRGVGKMT

SEQ ID NO: 37893 - protein, 9 aa, Dengue virus
GRGVGKMTL

SEQ ID NO: 37894 - protein, 9 aa, Dengue virus
RGVGKMTLG

SEQ ID NO: 37895 - protein, 9 aa, Dengue virus
TASILLWHA

SEQ ID NO: 37896 - protein, 9 aa, Dengue virus
QPEINILDI

SEQ ID NO: 37897 - protein, 9 aa, Dengue virus
HESNILDID

SEQ ID NO: 37898 - protein, 9 aa, Dengue virus
VTLTAALLL

SEQ ID NO: 37899 - protein, 9 aa, Dengue virus
TAALLSLVA

SEQ ID NO: 37900 - protein, 9 aa, Dengue virus
AALLSLVAH

SEQ ID NO: 37901 - protein, 9 aa, Dengue virus
LLMAHYAII

SEQ ID NO: 37902 - protein, 9 aa, Dengue virus
FSIMRNTTS

SEQ ID NO: 37903 - protein, 9 aa, Dengue virus
RRGTGNVGE

SEQ ID NO: 37904 - protein, 9 aa, Dengue virus
RGTGNVGET

SEQ ID NO: 37905 - protein, 9 aa, Dengue virus
GTGNVGETL

SEQ ID NO: 37906 - protein, 9 aa, Dengue virus
TGNVGETLG

SEQ ID NO: 37907 - protein, 9 aa, Dengue virus
GNVGETLGE

SEQ ID NO: 37908 - protein, 9 aa, Dengue virus
NVGETLGEK

SEQ ID NO: 37909 - protein, 9 aa, Dengue virus
VGETLGEKW

SEQ ID NO: 37910 - protein, 9 aa, Dengue virus
EKWKNRLNS

SEQ ID NO: 37911 - protein, 9 aa, Dengue virus
KWKNRLNSL

SEQ ID NO: 37912 - protein, 9 aa, Dengue virus
WKNRLNSLG

SEQ ID NO: 37913 - protein, 9 aa, Dengue virus
RLNSLGKSE

SEQ ID NO: 37914 - protein, 9 aa, Dengue virus
LNSLGKSEF

SEQ ID NO: 37915 - protein, 9 aa, Dengue virus
NSLGKSEFQ

SEQ ID NO: 37916 - protein, 9 aa, Dengue virus
LGKNEFQIY

SEQ ID NO: 37917 - protein, 9 aa, Dengue virus
GKNEFQIYK

SEQ ID NO: 37918 - protein, 9 aa, Dengue virus
KSEFQTYKK

SEQ ID NO: 37919 - protein, 9 aa, Dengue virus
NEFQIYKKS

SEQ ID NO: 37920 - protein, 9 aa, Dengue virus
MVAPEGKVV

SEQ ID NO: 37921 - protein, 9 aa, Dengue virus
YCGGLKSVR

SEQ ID NO: 37922 - protein, 9 aa, Dengue virus
CGGLKSVRE

SEQ ID NO: 37923 - protein, 9 aa, Dengue virus
GGLKSVREV

SEQ ID NO: 37924 - protein, 9 aa, Dengue virus
GLKSVREVK

SEQ ID NO: 37925 - protein, 9 aa, Dengue virus
LKSVREVKG

SEQ ID NO: 37926 - protein, 9 aa, Dengue virus
KSVREVKGL

SEQ ID NO: 37927 - protein, 9 aa, Dengue virus
QSGIDVFFT

SEQ ID NO: 37928 - protein, 9 aa, Dengue virus
SGIDVFFTP

SEQ ID NO: 37929 - protein, 9 aa, Dengue virus
GIDVFFTPP

SEQ ID NO: 37930 - protein, 9 aa, Dengue virus
IDVFFTPPE

SEQ ID NO: 37931 - protein, 9 aa, Dengue virus
DVFFTPPER

SEQ ID NO: 37932 - protein, 9 aa, Dengue virus
VFFTPPERC

SEQ ID NO: 37933 - protein, 9 aa, Dengue virus
FFTPPERCD

SEQ ID NO: 37934 - protein, 9 aa, Dengue virus
FTPPERCDT

SEQ ID NO: 37935 - protein, 9 aa, Dengue virus
TPPERCDTL

SEQ ID NO: 37936 - protein, 9 aa, Dengue virus
LVESWLNNN

SEQ ID NO: 37937 - protein, 9 aa, Dengue virus
VESWLNNNT

SEQ ID NO: 37938 - protein, 9 aa, Dengue virus
ENWLKNNTQ

SEQ ID NO: 37939 - protein, 9 aa, Dengue virus
NWLNNNTKF

SEQ ID NO: 37940 - protein, 9 aa, Dengue virus
WLKNNTQFC

SEQ ID NO: 37941 - protein, 9 aa, Dengue virus
LGSNTQFCV

SEQ ID NO: 37942 - protein, 9 aa, Dengue virus
GSNTQFCVK

SEQ ID NO: 37943 - protein, 9 aa, Dengue virus
SNTQFCVKV

SEQ ID NO: 37944 - protein, 9 aa, Dengue virus
PSVIERMEA

SEQ ID NO: 37945 - protein, 9 aa, Dengue virus
SVIERMEAL

SEQ ID NO: 37946 - protein, 9 aa, Dengue virus
VIERMEALQ

SEQ ID NO: 37947 - protein, 9 aa, Dengue virus
IERMEALQR

SEQ ID NO: 37948 - protein, 9 aa, Dengue virus
LQRRYGGAL

SEQ ID NO: 37949 - protein, 9 aa, Dengue virus
RHKRATYEP

SEQ ID NO: 37950 - protein, 9 aa, Dengue virus
GTRNIGTES

SEQ ID NO: 37951 - protein, 9 aa, Dengue virus
TRNIGTESE

SEQ ID NO: 37952 - protein, 9 aa, Dengue virus
ETPNMDIIG

SEQ ID NO: 37953 - protein, 9 aa, Dengue virus
TPNMDIIGK

SEQ ID NO: 37954 - protein, 9 aa, Dengue virus
EKIKQEHEA

SEQ ID NO: 37955 - protein, 9 aa, Dengue virus
KIKQEHEAS

SEQ ID NO: 37956 - protein, 9 aa, Dengue virus
IKQEHEASW

SEQ ID NO: 37957 - protein, 9 aa, Dengue virus
KQEHEASWH

SEQ ID NO: 37958 - protein, 9 aa, Dengue virus
QEHEASWHY

SEQ ID NO: 37959 - protein, 9 aa, Dengue virus
TKPWDVLPM

SEQ ID NO: 37960 - protein, 9 aa, Dengue virus
KPWDVLPMV

SEQ ID NO: 37961 - protein, 9 aa, Dengue virus
PWDVLPMVT

SEQ ID NO: 37962 - protein, 9 aa, Dengue virus
WDVLPMVTQ

SEQ ID NO: 37963 - protein, 9 aa, Dengue virus
DVLPMVTQM

SEQ ID NO: 37964 - protein, 9 aa, Dengue virus
VLPMVTQMA

SEQ ID NO: 37965 - protein, 9 aa, Dengue virus
LPMVTQMAM

SEQ ID NO: 37966 - protein, 9 aa, Dengue virus
KKLMRITAK

SEQ ID NO: 37967 - protein, 9 aa, Dengue virus
KLMRITAKW

SEQ ID NO: 37968 - protein, 9 aa, Dengue virus
KITAKWLWK

SEQ ID NO: 37969 - protein, 9 aa, Dengue virus
ITAKWLWGE

SEQ ID NO: 37970 - protein, 9 aa, Dengue virus
TAKWLWGEL

SEQ ID NO: 37971 - protein, 9 aa, Dengue virus
AKWLWGELG

SEQ ID NO: 37972 - protein, 9 aa, Dengue virus
KWLWGELGR

SEQ ID NO: 37973 - protein, 9 aa, Dengue virus
WKELGRKKT

SEQ ID NO: 37974 - protein, 9 aa, Dengue virus
KELGRKKTP

SEQ ID NO: 37975 - protein, 9 aa, Dengue virus
ELGRKKTPR

SEQ ID NO: 37976 - protein, 9 aa, Dengue virus
KTPRVCTRE

SEQ ID NO: 37977 - protein, 9 aa, Dengue virus
IPRMCTREE

SEQ ID NO: 37978 - protein, 9 aa, Dengue virus
PRVCTREEF

SEQ ID NO: 37979 - protein, 9 aa, Dengue virus
RVCTREEFT

SEQ ID NO: 37980 - protein, 9 aa, Dengue virus
CTREEFARK

SEQ ID NO: 37981 - protein, 9 aa, Dengue virus
EEFARKVRS

SEQ ID NO: 37982 - protein, 9 aa, Dengue virus
SAREAVEDN

SEQ ID NO: 37983 - protein, 9 aa, Dengue virus
AREAVEDNR

SEQ ID NO: 37984 - protein, 9 aa, Dengue virus
REAVEDERF

SEQ ID NO: 37985 - protein, 9 aa, Dengue virus
EAVEDNRFW

SEQ ID NO: 37986 - protein, 9 aa, Dengue virus
AVEDNRFWE

SEQ ID NO: 37987 - protein, 9 aa, Dengue virus
VEDERFWEL

SEQ ID NO: 37988 - protein, 9 aa, Dengue virus
FWELVEKER

SEQ ID NO: 37989 - protein, 9 aa, Dengue virus
WELVEKERN

SEQ ID NO: 37990 - protein, 9 aa, Dengue virus
ELVEKERNL

SEQ ID NO: 37991 - protein, 9 aa, Dengue virus
LVEKERNLH

SEQ ID NO: 37992 - protein, 9 aa, Dengue virus
VEKERNLHL

SEQ ID NO: 37993 - protein, 9 aa, Dengue virus
ERERNLHLD

SEQ ID NO: 37994 - protein, 9 aa, Dengue virus
RERNLHLDG

SEQ ID NO: 37995 - protein, 9 aa, Dengue virus
HKLGYILRE

SEQ ID NO: 37996 - protein, 9 aa, Dengue virus
KLGYILREV

SEQ ID NO: 37997 - protein, 9 aa, Dengue virus
LGYILREVS

SEQ ID NO: 37998 - protein, 9 aa, Dengue virus
GYILREVSK

SEQ ID NO: 37999 - protein, 9 aa, Dengue virus
YILREVSKK

SEQ ID NO: 38000 - protein, 9 aa, Dengue virus
ISKKAGGAM

SEQ ID NO: 38001 - protein, 9 aa, Dengue virus
SKKAGGAMY

SEQ ID NO: 38002 - protein, 9 aa, Dengue virus
LKNEEMITG

SEQ ID NO: 38003 - protein, 9 aa, Dengue virus
KNEEMITGQ

SEQ ID NO: 38004 - protein, 9 aa, Dengue virus
NEEMITGQM

SEQ ID NO: 38005 - protein, 9 aa, Dengue virus
REGRERLSR

SEQ ID NO: 38006 - protein, 9 aa, Dengue virus
EGRERLSRM

SEQ ID NO: 38007 - protein, 9 aa, Dengue virus
DDRFAKALT

SEQ ID NO: 38008 - protein, 9 aa, Dengue virus
DRFAKALTA

SEQ ID NO: 38009 - protein, 9 aa, Dengue virus
RFAKALTAL

SEQ ID NO: 38010 - protein, 9 aa, Dengue virus
FAKALTALN

SEQ ID NO: 38011 - protein, 9 aa, Dengue virus
AKALTALND

SEQ ID NO: 38012 - protein, 9 aa, Dengue virus
KALTALNDM

SEQ ID NO: 38013 - protein, 9 aa, Dengue virus
MKDGRKLVV

SEQ ID NO: 38014 - protein, 9 aa, Dengue virus
KDGRKLVVP

SEQ ID NO: 38015 - protein, 9 aa, Dengue virus
DGRKLVVPC

SEQ ID NO: 38016 - protein, 9 aa, Dengue virus
GRKLVVPCR

SEQ ID NO: 38017 - protein, 9 aa, Dengue virus
RTTWSIHAR

SEQ ID NO: 38018 - protein, 9 aa, Dengue virus
TTWSIHARH

SEQ ID NO: 38019 - protein, 9 aa, Dengue virus
TWSIHARHE

SEQ ID NO: 38020 - protein, 9 aa, Dengue virus
WSIHARHEW

SEQ ID NO: 38021 - protein, 9 aa, Dengue virus
SIHARHEWM

SEQ ID NO: 38022 - protein, 9 aa, Dengue virus
IHARHEWMT

SEQ ID NO: 38023 - protein, 9 aa, Dengue virus
HARHEWMTT

SEQ ID NO: 38024 - protein, 9 aa, Dengue virus
ARHEWMTTE

SEQ ID NO: 38025 - protein, 9 aa, Dengue virus
RHEWMTTED

SEQ ID NO: 38026 - protein, 9 aa, Dengue virus
TVWNRVWIL

SEQ ID NO: 38027 - protein, 9 aa, Dengue virus
VWNRVWIQD

SEQ ID NO: 38028 - protein, 9 aa, Dengue virus
WNRVWIQDN

SEQ ID NO: 38029 - protein, 9 aa, Dengue virus
NRVWIQDNP

SEQ ID NO: 38030 - protein, 9 aa, Dengue virus
RVWIQDNPW

SEQ ID NO: 38031 - protein, 9 aa, Dengue virus
VWIQENPWI

SEQ ID NO: 38032 - protein, 9 aa, Dengue virus
WIQENPWIE

SEQ ID NO: 38033 - protein, 9 aa, Dengue virus
IQENPWIED

SEQ ID NO: 38034 - protein, 9 aa, Dengue virus
QENPWIEDK

SEQ ID NO: 38035 - protein, 9 aa, Dengue virus
TPVETWEEI

SEQ ID NO: 38036 - protein, 9 aa, Dengue virus
PVETWEEIP

SEQ ID NO: 38037 - protein, 9 aa, Dengue virus
ARNIQTAIN

SEQ ID NO: 38038 - protein, 9 aa, Dengue virus
RNIQTAINQ

SEQ ID NO: 38039 - protein, 9 aa, Dengue virus
QTAINQVRA

SEQ ID NO: 38040 - protein, 9 aa, Dengue virus
TAINQVRAL

SEQ ID NO: 38041 - protein, 9 aa, Dengue virus
NQVRSLIGS

SEQ ID NO: 38042 - protein, 9 aa, Dengue virus
QVRSLIGSE

SEQ ID NO: 38043 - protein, 9 aa, Dengue virus
VRSLIGSEE

SEQ ID NO: 38044 - protein, 9 aa, Dengue virus
RSLIGSEEY

SEQ ID NO: 38045 - protein, 9 aa, Dengue virus
NDQRKKARN

SEQ ID NO: 38046 - protein, 9 aa, Dengue virus
ILNRRRRTV

SEQ ID NO: 38047 - protein, 9 aa, Dengue virus
LNRRRRTVG

SEQ ID NO: 38048 - protein, 9 aa, Dengue virus
GEPHMIVSK

SEQ ID NO: 38049 - protein, 9 aa, Dengue virus
EPHMIVSKN

SEQ ID NO: 38050 - protein, 9 aa, Dengue virus
PHMIVSKNE

SEQ ID NO: 38051 - protein, 9 aa, Dengue virus
HMIVSKNEK

SEQ ID NO: 38052 - protein, 9 aa, Dengue virus
MIVSKNEKG

SEQ ID NO: 38053 - protein, 9 aa, Dengue virus
IVSKNEKGK

SEQ ID NO: 38054 - protein, 9 aa, Dengue virus
VSKNEKGKS

SEQ ID NO: 38055 - protein, 9 aa, Dengue virus
SKNEKGKSL

SEQ ID NO: 38056 - protein, 9 aa, Dengue virus
VGVNMCTLM

SEQ ID NO: 38057 - protein, 9 aa, Dengue virus
TNMCTLMAL

SEQ ID NO: 38058 - protein, 9 aa, Dengue virus
TYKCPFLRQ

SEQ ID NO: 38059 - protein, 9 aa, Dengue virus
YKCPFLRQN

SEQ ID NO: 38060 - protein, 9 aa, Dengue virus
NCPLLKQNE

SEQ ID NO: 38061 - protein, 9 aa, Dengue virus
LRHPGFTTM

SEQ ID NO: 38062 - protein, 9 aa, Dengue virus
RHPGFTTMA

SEQ ID NO: 38063 - protein, 9 aa, Dengue virus
HPGFTTMAA

SEQ ID NO: 38064 - protein, 9 aa, Dengue virus
GTTHFQKAL

SEQ ID NO: 38065 - protein, 9 aa, Dengue virus
TTHFQKALI

SEQ ID NO: 38066 - protein, 9 aa, Dengue virus
THFQKALIF

SEQ ID NO: 38067 - protein, 9 aa, Dengue virus
HFQKALIFI

SEQ ID NO: 38068 - protein, 9 aa, Dengue virus
KALIFILLT

SEQ ID NO: 38069 - protein, 9 aa, Dengue virus
VLIFILLTT

SEQ ID NO: 38070 - protein, 9 aa, Dengue virus
IFILLTTVA

SEQ ID NO: 38071 - protein, 9 aa, Dengue virus
LTTVAPSMT

SEQ ID NO: 38072 - protein, 9 aa, Dengue virus
TAIAPSMAM

SEQ ID NO: 38073 - protein, 9 aa, Dengue virus
KQSATLRKY

SEQ ID NO: 38074 - protein, 9 aa, Dengue virus
PTQGEPSLS

SEQ ID NO: 38075 - protein, 9 aa, Dengue virus
TQGEPSLVE

SEQ ID NO: 38076 - protein, 9 aa, Dengue virus
QGEPSLVEE

SEQ ID NO: 38077 - protein, 9 aa, Dengue virus
GEPSLSEEQ

SEQ ID NO: 38078 - protein, 9 aa, Dengue virus
EPSLVEEQD

SEQ ID NO: 38079 - protein, 9 aa, Dengue virus
PSLVEEQDK

SEQ ID NO: 38080 - protein, 9 aa, Dengue virus
SLSEEQDKR

SEQ ID NO: 38081 - protein, 9 aa, Dengue virus
CAKFTCKKN

SEQ ID NO: 38082 - protein, 9 aa, Dengue virus
KFTCKKNME

SEQ ID NO: 38083 - protein, 9 aa, Dengue virus
SCKKNMEGK

SEQ ID NO: 38084 - protein, 9 aa, Dengue virus
KNMKGKVVQ

SEQ ID NO: 38085 - protein, 9 aa, Dengue virus
NMKGKVVQP

SEQ ID NO: 38086 - protein, 9 aa, Dengue virus
GKHGMEIKV

SEQ ID NO: 38087 - protein, 9 aa, Dengue virus
KHGMEIKVT

SEQ ID NO: 38088 - protein, 9 aa, Dengue virus
HGMEIKVTP

SEQ ID NO: 38089 - protein, 9 aa, Dengue virus
GMEIKVTPQ

SEQ ID NO: 38090 - protein, 9 aa, Dengue virus
MEIKVTPQS

SEQ ID NO: 38091 - protein, 9 aa, Dengue virus
MGNKAWLVH

SEQ ID NO: 38092 - protein, 9 aa, Dengue virus
GNKAWLVHR

SEQ ID NO: 38093 - protein, 9 aa, Dengue virus
WLPGADIQG

SEQ ID NO: 38094 - protein, 9 aa, Dengue virus
LPGADIQGS

SEQ ID NO: 38095 - protein, 9 aa, Dengue virus
PGADIQGSN

SEQ ID NO: 38096 - protein, 9 aa, Dengue virus
GADIQGSNW

SEQ ID NO: 38097 - protein, 9 aa, Dengue virus
ADIQGSNWI

SEQ ID NO: 38098 - protein, 9 aa, Dengue virus
DIQGSNWIQ

SEQ ID NO: 38099 - protein, 9 aa, Dengue virus
IQGSNWIQK

SEQ ID NO: 38100 - protein, 9 aa, Dengue virus
IRLQYEGDG

SEQ ID NO: 38101 - protein, 9 aa, Dengue virus
EGDGSPCKT

SEQ ID NO: 38102 - protein, 9 aa, Dengue virus
GEGAPCKIP

SEQ ID NO: 38103 - protein, 9 aa, Dengue virus
DGSPCKTPF

SEQ ID NO: 38104 - protein, 9 aa, Dengue virus
EIMDLERRY

SEQ ID NO: 38105 - protein, 9 aa, Dengue virus
DLEKRYILG

SEQ ID NO: 38106 - protein, 9 aa, Dengue virus
LEKRYILGR

SEQ ID NO: 38107 - protein, 9 aa, Dengue virus
EKRYILGRL

SEQ ID NO: 38108 - protein, 9 aa, Dengue virus
KRYILGRLI

SEQ ID NO: 38109 - protein, 9 aa, Dengue virus
LITVNPIAT

SEQ ID NO: 38110 - protein, 9 aa, Dengue virus
SLGGVFTSM

SEQ ID NO: 38111 - protein, 9 aa, Dengue virus
LGGMFTSIG

SEQ ID NO: 38112 - protein, 9 aa, Dengue virus
TMKIFIGVI

SEQ ID NO: 38113 - protein, 9 aa, Dengue virus
VSLILVGIV

SEQ ID NO: 38114 - protein, 9 aa, Dengue virus
GVVILYLGA

SEQ ID NO: 38115 - protein, 9 aa, Dengue virus
IQKAYEEGI

SEQ ID NO: 38116 - protein, 9 aa, Dengue virus
QKAHEDGIC

SEQ ID NO: 38117 - protein, 9 aa, Dengue virus
ILTENEVKL

SEQ ID NO: 38118 - protein, 9 aa, Dengue virus
LTENEVKLT

SEQ ID NO: 38119 - protein, 9 aa, Dengue virus
TENEVKLTI

SEQ ID NO: 38120 - protein, 9 aa, Dengue virus
MTIMTGDIK

SEQ ID NO: 38121 - protein, 9 aa, Dengue virus
TGDIKGIMH

SEQ ID NO: 38122 - protein, 9 aa, Dengue virus
KGIMHAGKR

SEQ ID NO: 38123 - protein, 9 aa, Dengue virus
GIMHAGKRS

SEQ ID NO: 38124 - protein, 9 aa, Dengue virus
IMHAGKRSL

SEQ ID NO: 38125 - protein, 9 aa, Dengue virus
GRRSLRPQP

SEQ ID NO: 38126 - protein, 9 aa, Dengue virus
RRSLRPQPT

SEQ ID NO: 38127 - protein, 9 aa, Dengue virus
RSLRPQPTQ

SEQ ID NO: 38128 - protein, 9 aa, Dengue virus
SLRPQPTQL

SEQ ID NO: 38129 - protein, 9 aa, Dengue virus
GKAKMLSTG

SEQ ID NO: 38130 - protein, 9 aa, Dengue virus
HNRTFLIDG

SEQ ID NO: 38131 - protein, 9 aa, Dengue virus
TAECPNANR

SEQ ID NO: 38132 - protein, 9 aa, Dengue virus
TECPSSNRA

SEQ ID NO: 38133 - protein, 9 aa, Dengue virus
TTNIWLRLK

SEQ ID NO: 38134 - protein, 9 aa, Dengue virus
NIWLRLKEK

SEQ ID NO: 38135 - protein, 9 aa, Dengue virus
IWLRLKEKQ

SEQ ID NO: 38136 - protein, 9 aa, Dengue virus
WLRLKEKQD

SEQ ID NO: 38137 - protein, 9 aa, Dengue virus
EVKSCHWPR

SEQ ID NO: 38138 - protein, 9 aa, Dengue virus
VKSCHWPRS

SEQ ID NO: 38139 - protein, 9 aa, Dengue virus
KNIAGPVSQ

SEQ ID NO: 38140 - protein, 9 aa, Dengue virus
NIAGPVSQH

SEQ ID NO: 38141 - protein, 9 aa, Dengue virus
QHNYRLGYH

SEQ ID NO: 38142 - protein, 9 aa, Dengue virus
HNNRPGYYT

SEQ ID NO: 38143 - protein, 9 aa, Dengue virus
NNRPGYYTQ

SEQ ID NO: 38144 - protein, 9 aa, Dengue virus
GKLEMDFNF

SEQ ID NO: 38145 - protein, 9 aa, Dengue virus
KLEMDFNFC

SEQ ID NO: 38146 - protein, 9 aa, Dengue virus
LEMDFNFCD

SEQ ID NO: 38147 - protein, 9 aa, Dengue virus
EMDFNFCDG

SEQ ID NO: 38148 - protein, 9 aa, Dengue virus
MDFNFCDGT

SEQ ID NO: 38149 - protein, 9 aa, Dengue virus
DFNFCEGTT

SEQ ID NO: 38150 - protein, 9 aa, Dengue virus
FNFCEGTTV

SEQ ID NO: 38151 - protein, 9 aa, Dengue virus
SFKDLGRVM

SEQ ID NO: 38152 - protein, 9 aa, Dengue virus
KDLGRVMVM

SEQ ID NO: 38153 - protein, 9 aa, Dengue virus
TDDIGIGVT

SEQ ID NO: 38154 - protein, 9 aa, Dengue virus
FKVRPTFVA

SEQ ID NO: 38155 - protein, 9 aa, Dengue virus
FVAGLLLRK

SEQ ID NO: 38156 - protein, 9 aa, Dengue virus
TIGVALLSQ

SEQ ID NO: 38157 - protein, 9 aa, Dengue virus
IGVALLSQS

SEQ ID NO: 38158 - protein, 9 aa, Dengue virus
PENILELTD

SEQ ID NO: 38159 - protein, 9 aa, Dengue virus
ENILELTDA

SEQ ID NO: 38160 - protein, 9 aa, Dengue virus
NILELTDAL

SEQ ID NO: 38161 - protein, 9 aa, Dengue virus
VKNMEKYQL

SEQ ID NO: 38162 - protein, 9 aa, Dengue virus
NLEKYQLAV

SEQ ID NO: 38163 - protein, 9 aa, Dengue virus
ISCVPNAMI

SEQ ID NO: 38164 - protein, 9 aa, Dengue virus
CVPNAVVLQ

SEQ ID NO: 38165 - protein, 9 aa, Dengue virus
VPNAVVLQN

SEQ ID NO: 38166 - protein, 9 aa, Dengue virus
PNAVVLQNA

SEQ ID NO: 38167 - protein, 9 aa, Dengue virus
NAVVLQNAW

SEQ ID NO: 38168 - protein, 9 aa, Dengue virus
ILAAVSVFP

SEQ ID NO: 38169 - protein, 9 aa, Dengue virus
FPLLLTSSQ

SEQ ID NO: 38170 - protein, 9 aa, Dengue virus
FLTTLSRPS

SEQ ID NO: 38171 - protein, 9 aa, Dengue virus
TTLTRTSKK

SEQ ID NO: 38172 - protein, 9 aa, Dengue virus
TLTRTSKKR

SEQ ID NO: 38173 - protein, 9 aa, Dengue virus
LTRTSKKRS

SEQ ID NO: 38174 - protein, 9 aa, Dengue virus
TRTSKKRSW

SEQ ID NO: 38175 - protein, 9 aa, Dengue virus
DLELERAAE

SEQ ID NO: 38176 - protein, 9 aa, Dengue virus
LELERAAEV

SEQ ID NO: 38177 - protein, 9 aa, Dengue virus
VKWEEQAEI

SEQ ID NO: 38178 - protein, 9 aa, Dengue virus
KWEEQAEIS

SEQ ID NO: 38179 - protein, 9 aa, Dengue virus
GVFPVSIPV

SEQ ID NO: 38180 - protein, 9 aa, Dengue virus
VFPVSIPVT

SEQ ID NO: 38181 - protein, 9 aa, Dengue virus
DVPSPPPME

SEQ ID NO: 38182 - protein, 9 aa, Dengue virus
IKQKRILGY

SEQ ID NO: 38183 - protein, 9 aa, Dengue virus
KQKRILGYS

SEQ ID NO: 38184 - protein, 9 aa, Dengue virus
QRGFLGYSQ

SEQ ID NO: 38185 - protein, 9 aa, Dengue virus
KRILGYSQI

SEQ ID NO: 38186 - protein, 9 aa, Dengue virus
TKPGFFKTN

SEQ ID NO: 38187 - protein, 9 aa, Dengue virus
FRTNAGTIG

SEQ ID NO: 38188 - protein, 9 aa, Dengue virus
RTNAGTIGA

SEQ ID NO: 38189 - protein, 9 aa, Dengue virus
SIAQTETSV

SEQ ID NO: 38190 - protein, 9 aa, Dengue virus
IAQTETSVE

SEQ ID NO: 38191 - protein, 9 aa, Dengue virus
IEDNPEIEE

SEQ ID NO: 38192 - protein, 9 aa, Dengue virus
GHEWITNFE

SEQ ID NO: 38193 - protein, 9 aa, Dengue virus
HEWITNFEG

SEQ ID NO: 38194 - protein, 9 aa, Dengue virus
RKTFDTEYI

SEQ ID NO: 38195 - protein, 9 aa, Dengue virus
KTFDTEYIK

SEQ ID NO: 38196 - protein, 9 aa, Dengue virus
TFDTEYIKT

SEQ ID NO: 38197 - protein, 9 aa, Dengue virus
FDTEYIKTR

SEQ ID NO: 38198 - protein, 9 aa, Dengue virus
YKVASEGIS

SEQ ID NO: 38199 - protein, 9 aa, Dengue virus
RKWCFDGIR

SEQ ID NO: 38200 - protein, 9 aa, Dengue virus
KWCFDGIRN

SEQ ID NO: 38201 - protein, 9 aa, Dengue virus
LHSAEMGGR

SEQ ID NO: 38202 - protein, 9 aa, Dengue virus
HSAEMGGRA

SEQ ID NO: 38203 - protein, 9 aa, Dengue virus
SAEMGGRAY

SEQ ID NO: 38204 - protein, 9 aa, Dengue virus
LFLMSARGI

SEQ ID NO: 38205 - protein, 9 aa, Dengue virus
FLMSARGIG

SEQ ID NO: 38206 - protein, 9 aa, Dengue virus
LMSARGIGK

SEQ ID NO: 38207 - protein, 9 aa, Dengue virus
MSARGIGKM

SEQ ID NO: 38208 - protein, 9 aa, Dengue virus
SARGIGKMT

SEQ ID NO: 38209 - protein, 9 aa, Dengue virus
ARGIGKMTL

SEQ ID NO: 38210 - protein, 9 aa, Dengue virus
TASSLLWYA

SEQ ID NO: 38211 - protein, 9 aa, Dengue virus
QHESNILDI

SEQ ID NO: 38212 - protein, 9 aa, Dengue virus
TTLTAALFL

SEQ ID NO: 38213 - protein, 9 aa, Dengue virus
TAALLMLVA

SEQ ID NO: 38214 - protein, 9 aa, Dengue virus
AALLLLMAH

SEQ ID NO: 38215 - protein, 9 aa, Dengue virus
SLIAHYAII

SEQ ID NO: 38216 - protein, 9 aa, Dengue virus
FSIMKNTIN

SEQ ID NO: 38217 - protein, 9 aa, Dengue virus
RRGTGTIGE

SEQ ID NO: 38218 - protein, 9 aa, Dengue virus
RGTGTIGET

SEQ ID NO: 38219 - protein, 9 aa, Dengue virus
GTGTIGETL

SEQ ID NO: 38220 - protein, 9 aa, Dengue virus
TGTIGETLG

SEQ ID NO: 38221 - protein, 9 aa, Dengue virus
GTIGETLGE

SEQ ID NO: 38222 - protein, 9 aa, Dengue virus
TIGETLGEK

SEQ ID NO: 38223 - protein, 9 aa, Dengue virus
KWKSQLNAL

SEQ ID NO: 38224 - protein, 9 aa, Dengue virus
WKSQLNALG

SEQ ID NO: 38225 - protein, 9 aa, Dengue virus
RLNTLGKSE

SEQ ID NO: 38226 - protein, 9 aa, Dengue virus
LNTLGKSEF

SEQ ID NO: 38227 - protein, 9 aa, Dengue virus
NTLGKSEFQ

SEQ ID NO: 38228 - protein, 9 aa, Dengue virus
KNEFQIYKK

SEQ ID NO: 38229 - protein, 9 aa, Dengue virus
FIPPERCDT

SEQ ID NO: 38230 - protein, 9 aa, Dengue virus
VENWLNNNI

SEQ ID NO: 38231 - protein, 9 aa, Dengue virus
ENWLNNNIQ

SEQ ID NO: 38232 - protein, 9 aa, Dengue virus
NWLNNNIQF

SEQ ID NO: 38233 - protein, 9 aa, Dengue virus
LNNNTKFCI

SEQ ID NO: 38234 - protein, 9 aa, Dengue virus
NNNTKFCIK

SEQ ID NO: 38235 - protein, 9 aa, Dengue virus
EKPNLDIIG

SEQ ID NO: 38236 - protein, 9 aa, Dengue virus
KPNLDIIGK

SEQ ID NO: 38237 - protein, 9 aa, Dengue virus
RITAKWLWG

SEQ ID NO: 38238 - protein, 9 aa, Dengue virus
WKELGKKKI

SEQ ID NO: 38239 - protein, 9 aa, Dengue virus
KELGKKKIP

SEQ ID NO: 38240 - protein, 9 aa, Dengue virus
ELGKKKIPR

SEQ ID NO: 38241 - protein, 9 aa, Dengue virus
KIPRMCTRE

SEQ ID NO: 38242 - protein, 9 aa, Dengue virus
TPRVCTREE

SEQ ID NO: 38243 - protein, 9 aa, Dengue virus
RMCTREEFA

SEQ ID NO: 38244 - protein, 9 aa, Dengue virus
AREAVEDER

SEQ ID NO: 38245 - protein, 9 aa, Dengue virus
REAVEDNRF

SEQ ID NO: 38246 - protein, 9 aa, Dengue virus
EAVEDERFW

SEQ ID NO: 38247 - protein, 9 aa, Dengue virus
AVEDERFWE

SEQ ID NO: 38248 - protein, 9 aa, Dengue virus
VEDNRFWEL

SEQ ID NO: 38249 - protein, 9 aa, Dengue virus
FWELVERER

SEQ ID NO: 38250 - protein, 9 aa, Dengue virus
WELVERERN

SEQ ID NO: 38251 - protein, 9 aa, Dengue virus
ELVERERNL

SEQ ID NO: 38252 - protein, 9 aa, Dengue virus
LVERERNLH

SEQ ID NO: 38253 - protein, 9 aa, Dengue virus
VERERNLHL

SEQ ID NO: 38254 - protein, 9 aa, Dengue virus
KLGYILRDI

SEQ ID NO: 38255 - protein, 9 aa, Dengue virus
LGYILRDIS

SEQ ID NO: 38256 - protein, 9 aa, Dengue virus
GYILRDISR

SEQ ID NO: 38257 - protein, 9 aa, Dengue virus
YILRDISRK

SEQ ID NO: 38258 - protein, 9 aa, Dengue virus
VSKKEGGTM

SEQ ID NO: 38259 - protein, 9 aa, Dengue virus
SRKAGGAIY

SEQ ID NO: 38260 - protein, 9 aa, Dengue virus
MKDGRMLVV

SEQ ID NO: 38261 - protein, 9 aa, Dengue virus
KDGRMLVVP

SEQ ID NO: 38262 - protein, 9 aa, Dengue virus
DGRMLVVPC

SEQ ID NO: 38263 - protein, 9 aa, Dengue virus
GRMLVVPCR

SEQ ID NO: 38264 - protein, 9 aa, Dengue virus
TVWNKVWIR

SEQ ID NO: 38265 - protein, 9 aa, Dengue virus
VWNKVWIRE

SEQ ID NO: 38266 - protein, 9 aa, Dengue virus
WNKVWIREN

SEQ ID NO: 38267 - protein, 9 aa, Dengue virus
NKVWIRENP

SEQ ID NO: 38268 - protein, 9 aa, Dengue virus
KVWIRENPW

SEQ ID NO: 38269 - protein, 9 aa, Dengue virus
VWIQDNPWM

SEQ ID NO: 38270 - protein, 9 aa, Dengue virus
WIQDNPWME

SEQ ID NO: 38271 - protein, 9 aa, Dengue virus
IQDNPWMED

SEQ ID NO: 38272 - protein, 9 aa, Dengue virus
QDNPWMEDK

SEQ ID NO: 38273 - protein, 9 aa, Dengue virus
VRSLIGNEG

SEQ ID NO: 38274 - protein, 9 aa, Dengue virus
RSLIGNEGY

SEQ ID NO: 38275 - protein, 10 aa, Dengue virus
MNNQRKKARS

SEQ ID NO: 38276 - protein, 10 aa, Dengue virus
STPFNMLKRE

SEQ ID NO: 38277 - protein, 10 aa, Dengue virus
TPFNMLKRER

SEQ ID NO: 38278 - protein, 10 aa, Dengue virus
PFNMLKRERN

SEQ ID NO: 38279 - protein, 10 aa, Dengue virus
FNMLKRERNR

SEQ ID NO: 38280 - protein, 10 aa, Dengue virus
NMLKRERNRV

SEQ ID NO: 38281 - protein, 10 aa, Dengue virus
MLKRERNRVS

SEQ ID NO: 38282 - protein, 10 aa, Dengue virus
LKRERNRVST

SEQ ID NO: 38283 - protein, 10 aa, Dengue virus
KRERNRVSTV

SEQ ID NO: 38284 - protein, 10 aa, Dengue virus
RERNRVSTVQ

SEQ ID NO: 38285 - protein, 10 aa, Dengue virus
ERNRVSTVQQ

SEQ ID NO: 38286 - protein, 10 aa, Dengue virus
RNRVSTVQQL

SEQ ID NO: 38287 - protein, 10 aa, Dengue virus
NRVSTVQQLT

SEQ ID NO: 38288 - protein, 10 aa, Dengue virus
RVSTVQQLTK

SEQ ID NO: 38289 - protein, 10 aa, Dengue virus
VSTVQQLTKR

SEQ ID NO: 38290 - protein, 10 aa, Dengue virus
STVQQLTKRF

SEQ ID NO: 38291 - protein, 10 aa, Dengue virus
TVQQLTKRFS

SEQ ID NO: 38292 - protein, 10 aa, Dengue virus
VQQLTKRFSL

SEQ ID NO: 38293 - protein, 10 aa, Dengue virus
QQLTKRFSLG

SEQ ID NO: 38294 - protein, 10 aa, Dengue virus
QLTKRFSLGM

SEQ ID NO: 38295 - protein, 10 aa, Dengue virus
LTKRFSLGML

SEQ ID NO: 38296 - protein, 10 aa, Dengue virus
TKRFSLGMLQ

SEQ ID NO: 38297 - protein, 10 aa, Dengue virus
KRFSLGMLQG

SEQ ID NO: 38298 - protein, 10 aa, Dengue virus
RFSLGMLQGR

SEQ ID NO: 38299 - protein, 10 aa, Dengue virus
FSLGMLQGRG

SEQ ID NO: 38300 - protein, 10 aa, Dengue virus
SLGMLQGRGP

SEQ ID NO: 38301 - protein, 10 aa, Dengue virus
LGMLQGRGPL

SEQ ID NO: 38302 - protein, 10 aa, Dengue virus
GMLQGRGPLK

SEQ ID NO: 38303 - protein, 10 aa, Dengue virus
MLQGRGPLKL

SEQ ID NO: 38304 - protein, 10 aa, Dengue virus
LQGRGPLKLF

SEQ ID NO: 38305 - protein, 10 aa, Dengue virus
QGRGPLKLFM

SEQ ID NO: 38306 - protein, 10 aa, Dengue virus
GRGPLKLFMA

SEQ ID NO: 38307 - protein, 10 aa, Dengue virus
RGPLKLFMAL

SEQ ID NO: 38308 - protein, 10 aa, Dengue virus
GPLKLFMALV

SEQ ID NO: 38309 - protein, 10 aa, Dengue virus
PLKLFMALVA

SEQ ID NO: 38310 - protein, 10 aa, Dengue virus
LKLFMALVAF

SEQ ID NO: 38311 - protein, 10 aa, Dengue virus
KLFMALVAFL

SEQ ID NO: 38312 - protein, 10 aa, Dengue virus
LFMALVAFLR

SEQ ID NO: 38313 - protein, 10 aa, Dengue virus
FMALVAFLRF

SEQ ID NO: 38314 - protein, 10 aa, Dengue virus
MALVAFLRFL

SEQ ID NO: 38315 - protein, 10 aa, Dengue virus
ALVAFLRFLT

SEQ ID NO: 38316 - protein, 10 aa, Dengue virus
LVAFLRFLTI

SEQ ID NO: 38317 - protein, 10 aa, Dengue virus
VAFLRFLTIP

SEQ ID NO: 38318 - protein, 10 aa, Dengue virus
AFLRFLTIPP

SEQ ID NO: 38319 - protein, 10 aa, Dengue virus
FLRFLTIPPT

SEQ ID NO: 38320 - protein, 10 aa, Dengue virus
LRFLTIPPTA

SEQ ID NO: 38321 - protein, 10 aa, Dengue virus
RFLTIPPTAG

SEQ ID NO: 38322 - protein, 10 aa, Dengue virus
FLTIPPTAGI

SEQ ID NO: 38323 - protein, 10 aa, Dengue virus
LTIPPTAGIL

SEQ ID NO: 38324 - protein, 10 aa, Dengue virus
TIPPTAGILK

SEQ ID NO: 38325 - protein, 10 aa, Dengue virus
IPPTAGILKR

SEQ ID NO: 38326 - protein, 10 aa, Dengue virus
PPTAGILKRW

SEQ ID NO: 38327 - protein, 10 aa, Dengue virus
PTAGILKRWG

SEQ ID NO: 38328 - protein, 10 aa, Dengue virus
TAGILKRWGT

SEQ ID NO: 38329 - protein, 10 aa, Dengue virus
AGILKRWGTI

SEQ ID NO: 38330 - protein, 10 aa, Dengue virus
GILKRWGTIK

SEQ ID NO: 38331 - protein, 10 aa, Dengue virus
ILKRWGTIKK

SEQ ID NO: 38332 - protein, 10 aa, Dengue virus
LKRWGTIKKS

SEQ ID NO: 38333 - protein, 10 aa, Dengue virus
KRWGTIKKSK

SEQ ID NO: 38334 - protein, 10 aa, Dengue virus
RWGTIKKSKA

SEQ ID NO: 38335 - protein, 10 aa, Dengue virus
WGTIKKSKAI

SEQ ID NO: 38336 - protein, 10 aa, Dengue virus
GTIKKSKAIN

SEQ ID NO: 38337 - protein, 10 aa, Dengue virus
TIKKSKAINV

SEQ ID NO: 38338 - protein, 10 aa, Dengue virus
IKKSKAINVL

SEQ ID NO: 38339 - protein, 10 aa, Dengue virus
KKSKAINVLR

SEQ ID NO: 38340 - protein, 10 aa, Dengue virus
KSKAINVLRG

SEQ ID NO: 38341 - protein, 10 aa, Dengue virus
SKAINVLRGF

SEQ ID NO: 38342 - protein, 10 aa, Dengue virus
KAINVLRGFR

SEQ ID NO: 38343 - protein, 10 aa, Dengue virus
AINVLRGFRK

SEQ ID NO: 38344 - protein, 10 aa, Dengue virus
INVLRGFRKE

SEQ ID NO: 38345 - protein, 10 aa, Dengue virus
NVLRGFRKEI

SEQ ID NO: 38346 - protein, 10 aa, Dengue virus
VLRGFRKEIG

SEQ ID NO: 38347 - protein, 10 aa, Dengue virus
LRGFRKEIGR

SEQ ID NO: 38348 - protein, 10 aa, Dengue virus
RGFRKEIGRM

SEQ ID NO: 38349 - protein, 10 aa, Dengue virus
GFRKEIGRML

SEQ ID NO: 38350 - protein, 10 aa, Dengue virus
FRKEIGRMLN

SEQ ID NO: 38351 - protein, 10 aa, Dengue virus
RKEIGRMLNI

SEQ ID NO: 38352 - protein, 10 aa, Dengue virus
KEIGRMLNIL

SEQ ID NO: 38353 - protein, 10 aa, Dengue virus
EIGRMLNILN

SEQ ID NO: 38354 - protein, 10 aa, Dengue virus
IGRMLNILNR

SEQ ID NO: 38355 - protein, 10 aa, Dengue virus
GRMLNILNRR

SEQ ID NO: 38356 - protein, 10 aa, Dengue virus
RMLNILNRRR

SEQ ID NO: 38357 - protein, 10 aa, Dengue virus
MLNILNRRRR

SEQ ID NO: 38358 - protein, 10 aa, Dengue virus
LNILNRRRRT

SEQ ID NO: 38359 - protein, 10 aa, Dengue virus
NILNRRRRTA

SEQ ID NO: 38360 - protein, 10 aa, Dengue virus
ILNRRRRTAG

SEQ ID NO: 38361 - protein, 10 aa, Dengue virus
IPTAMAFHLT

SEQ ID NO: 38362 - protein, 10 aa, Dengue virus
PTAMAFHLTT

SEQ ID NO: 38363 - protein, 10 aa, Dengue virus
TAMAFHLTTR

SEQ ID NO: 38364 - protein, 10 aa, Dengue virus
AMAFHLTTRN

SEQ ID NO: 38365 - protein, 10 aa, Dengue virus
MAFHLTTRNG

SEQ ID NO: 38366 - protein, 10 aa, Dengue virus
AFHLTTRNGE

SEQ ID NO: 38367 - protein, 10 aa, Dengue virus
FHLTTRNGEP

SEQ ID NO: 38368 - protein, 10 aa, Dengue virus
HLTTRNGEPH

SEQ ID NO: 38369 - protein, 10 aa, Dengue virus
LTTRNGEPHM

SEQ ID NO: 38370 - protein, 10 aa, Dengue virus
TTRNGEPHMI

SEQ ID NO: 38371 - protein, 10 aa, Dengue virus
TRNGEPHMIV

SEQ ID NO: 38372 - protein, 10 aa, Dengue virus
RNGEPHMIVG

SEQ ID NO: 38373 - protein, 10 aa, Dengue virus
NGEPHMIVGR

SEQ ID NO: 38374 - protein, 10 aa, Dengue virus
GEPHMIVGRQ

SEQ ID NO: 38375 - protein, 10 aa, Dengue virus
EPHMIVGRQE

SEQ ID NO: 38376 - protein, 10 aa, Dengue virus
PHMIVGRQEK

SEQ ID NO: 38377 - protein, 10 aa, Dengue virus
HMIVGRQEKG

SEQ ID NO: 38378 - protein, 10 aa, Dengue virus
MIVGRQEKGK

SEQ ID NO: 38379 - protein, 10 aa, Dengue virus
IVGRQEKGKS

SEQ ID NO: 38380 - protein, 10 aa, Dengue virus
VGRQEKGKSL

SEQ ID NO: 38381 - protein, 10 aa, Dengue virus
GRQEKGKSLL

SEQ ID NO: 38382 - protein, 10 aa, Dengue virus
RQEKGKSLLF

SEQ ID NO: 38383 - protein, 10 aa, Dengue virus
QEKGKSLLFK

SEQ ID NO: 38384 - protein, 10 aa, Dengue virus
EKGKSLLFKT

SEQ ID NO: 38385 - protein, 10 aa, Dengue virus
KGKSLLFKTE

SEQ ID NO: 38386 - protein, 10 aa, Dengue virus
GKSLLFKTED

SEQ ID NO: 38387 - protein, 10 aa, Dengue virus
KSLLFKTEDG

SEQ ID NO: 38388 - protein, 10 aa, Dengue virus
DGVNMCTLMA

SEQ ID NO: 38389 - protein, 10 aa, Dengue virus
GVNMCTLMAI

SEQ ID NO: 38390 - protein, 10 aa, Dengue virus
VNMCTLMAID

SEQ ID NO: 38391 - protein, 10 aa, Dengue virus
NMCTLMAIDL

SEQ ID NO: 38392 - protein, 10 aa, Dengue virus
MCTLMAIDLG

SEQ ID NO: 38393 - protein, 10 aa, Dengue virus
CTLMAIDLGE

SEQ ID NO: 38394 - protein, 10 aa, Dengue virus
TLMAIDLGEL

SEQ ID NO: 38395 - protein, 10 aa, Dengue virus
LMAIDLGELC

SEQ ID NO: 38396 - protein, 10 aa, Dengue virus
MAIDLGELCE

SEQ ID NO: 38397 - protein, 10 aa, Dengue virus
AIDLGELCED

SEQ ID NO: 38398 - protein, 10 aa, Dengue virus
IDLGELCEDT

SEQ ID NO: 38399 - protein, 10 aa, Dengue virus
DLGELCEDTI

SEQ ID NO: 38400 - protein, 10 aa, Dengue virus
LGELCEDTIT

SEQ ID NO: 38401 - protein, 10 aa, Dengue virus
GELCEDTITY

SEQ ID NO: 38402 - protein, 10 aa, Dengue virus
ELCEDTITYK

SEQ ID NO: 38403 - protein, 10 aa, Dengue virus
LCEDTITYKC

SEQ ID NO: 38404 - protein, 10 aa, Dengue virus
CEDTITYKCP

SEQ ID NO: 38405 - protein, 10 aa, Dengue virus
EDTITYKCPL

SEQ ID NO: 38406 - protein, 10 aa, Dengue virus
DTITYKCPLL

SEQ ID NO: 38407 - protein, 10 aa, Dengue virus
TYKCPLLRQN

SEQ ID NO: 38408 - protein, 10 aa, Dengue virus
YKCPLLRQNE

SEQ ID NO: 38409 - protein, 10 aa, Dengue virus
KCPLLRQNEP

SEQ ID NO: 38410 - protein, 10 aa, Dengue virus
CPLLRQNEPE

SEQ ID NO: 38411 - protein, 10 aa, Dengue virus
PLLRQNEPED

SEQ ID NO: 38412 - protein, 10 aa, Dengue virus
LLRQNEPEDI

SEQ ID NO: 38413 - protein, 10 aa, Dengue virus
LRQNEPEDID

SEQ ID NO: 38414 - protein, 10 aa, Dengue virus
RQNEPEDIDC

SEQ ID NO: 38415 - protein, 10 aa, Dengue virus
QNEPEDIDCW

SEQ ID NO: 38416 - protein, 10 aa, Dengue virus
NEPEDIDCWC

SEQ ID NO: 38417 - protein, 10 aa, Dengue virus
EPEDIDCWCN

SEQ ID NO: 38418 - protein, 10 aa, Dengue virus
PEDIDCWCNS

SEQ ID NO: 38419 - protein, 10 aa, Dengue virus
EDIDCWCNST

SEQ ID NO: 38420 - protein, 10 aa, Dengue virus
DIDCWCNSTS

SEQ ID NO: 38421 - protein, 10 aa, Dengue virus
IDCWCNSTST

SEQ ID NO: 38422 - protein, 10 aa, Dengue virus
DCWCNSTSTW

SEQ ID NO: 38423 - protein, 10 aa, Dengue virus
CWCNSTSTWV

SEQ ID NO: 38424 - protein, 10 aa, Dengue virus
WCNSTSTWVT

SEQ ID NO: 38425 - protein, 10 aa, Dengue virus
CNSTSTWVTY

SEQ ID NO: 38426 - protein, 10 aa, Dengue virus
NSTSTWVTYG

SEQ ID NO: 38427 - protein, 10 aa, Dengue virus
STSTWVTYGT

SEQ ID NO: 38428 - protein, 10 aa, Dengue virus
TSTWVTYGTC

SEQ ID NO: 38429 - protein, 10 aa, Dengue virus
STWVTYGTCT

SEQ ID NO: 38430 - protein, 10 aa, Dengue virus
TTGEHRREKR

SEQ ID NO: 38431 - protein, 10 aa, Dengue virus
TGEHRREKRS

SEQ ID NO: 38432 - protein, 10 aa, Dengue virus
GEHRREKRSV

SEQ ID NO: 38433 - protein, 10 aa, Dengue virus
EHRREKRSVA

SEQ ID NO: 38434 - protein, 10 aa, Dengue virus
HRREKRSVAL

SEQ ID NO: 38435 - protein, 10 aa, Dengue virus
RREKRSVALV

SEQ ID NO: 38436 - protein, 10 aa, Dengue virus
REKRSVALVP

SEQ ID NO: 38437 - protein, 10 aa, Dengue virus
EKRSVALVPH

SEQ ID NO: 38438 - protein, 10 aa, Dengue virus
KRSVALVPHV

SEQ ID NO: 38439 - protein, 10 aa, Dengue virus
RSVALVPHVG

SEQ ID NO: 38440 - protein, 10 aa, Dengue virus
SVALVPHVGM

SEQ ID NO: 38441 - protein, 10 aa, Dengue virus
VALVPHVGMG

SEQ ID NO: 38442 - protein, 10 aa, Dengue virus
ALVPHVGMGL

SEQ ID NO: 38443 - protein, 10 aa, Dengue virus
LVPHVGMGLE

SEQ ID NO: 38444 - protein, 10 aa, Dengue virus
VPHVGMGLET

SEQ ID NO: 38445 - protein, 10 aa, Dengue virus
PHVGMGLETR

SEQ ID NO: 38446 - protein, 10 aa, Dengue virus
HVGMGLETRT

SEQ ID NO: 38447 - protein, 10 aa, Dengue virus
VGMGLETRTE

SEQ ID NO: 38448 - protein, 10 aa, Dengue virus
GMGLETRTET

SEQ ID NO: 38449 - protein, 10 aa, Dengue virus
MGLETRTETW

SEQ ID NO: 38450 - protein, 10 aa, Dengue virus
GLETRTETWM

SEQ ID NO: 38451 - protein, 10 aa, Dengue virus
LETRTETWMS

SEQ ID NO: 38452 - protein, 10 aa, Dengue virus
ETRTETWMSS

SEQ ID NO: 38453 - protein, 10 aa, Dengue virus
TRTETWMSSE

SEQ ID NO: 38454 - protein, 10 aa, Dengue virus
RTETWMSSEG

SEQ ID NO: 38455 - protein, 10 aa, Dengue virus
TETWMSSEGA

SEQ ID NO: 38456 - protein, 10 aa, Dengue virus
ETWMSSEGAW

SEQ ID NO: 38457 - protein, 10 aa, Dengue virus
TWMSSEGAWK

SEQ ID NO: 38458 - protein, 10 aa, Dengue virus
WMSSEGAWKH

SEQ ID NO: 38459 - protein, 10 aa, Dengue virus
MSSEGAWKHV

SEQ ID NO: 38460 - protein, 10 aa, Dengue virus
SSEGAWKHVQ

SEQ ID NO: 38461 - protein, 10 aa, Dengue virus
SEGAWKHVQR

SEQ ID NO: 38462 - protein, 10 aa, Dengue virus
EGAWKHVQRI

SEQ ID NO: 38463 - protein, 10 aa, Dengue virus
GAWKHVQRIE

SEQ ID NO: 38464 - protein, 10 aa, Dengue virus
AWKHVQRIET

SEQ ID NO: 38465 - protein, 10 aa, Dengue virus
WKHVQRIETW

SEQ ID NO: 38466 - protein, 10 aa, Dengue virus
KHVQRIETWI

SEQ ID NO: 38467 - protein, 10 aa, Dengue virus
HVQRIETWIL

SEQ ID NO: 38468 - protein, 10 aa, Dengue virus
VQRIETWILR

SEQ ID NO: 38469 - protein, 10 aa, Dengue virus
QRIETWILRH

SEQ ID NO: 38470 - protein, 10 aa, Dengue virus
RIETWILRHP

SEQ ID NO: 38471 - protein, 10 aa, Dengue virus
IETWILRHPG

SEQ ID NO: 38472 - protein, 10 aa, Dengue virus
ETWILRHPGF

SEQ ID NO: 38473 - protein, 10 aa, Dengue virus
TWILRHPGFT

SEQ ID NO: 38474 - protein, 10 aa, Dengue virus
LRHPGFTIMA

SEQ ID NO: 38475 - protein, 10 aa, Dengue virus
RHPGFTIMAA

SEQ ID NO: 38476 - protein, 10 aa, Dengue virus
MAAILAYTIG

SEQ ID NO: 38477 - protein, 10 aa, Dengue virus
AAILAYTIGT

SEQ ID NO: 38478 - protein, 10 aa, Dengue virus
AILAYTIGTT

SEQ ID NO: 38479 - protein, 10 aa, Dengue virus
ILAYTIGTTH

SEQ ID NO: 38480 - protein, 10 aa, Dengue virus
LAYTIGTTHF

SEQ ID NO: 38481 - protein, 10 aa, Dengue virus
AYTIGTTHFQ

SEQ ID NO: 38482 - protein, 10 aa, Dengue virus
YTIGTTHFQR

SEQ ID NO: 38483 - protein, 10 aa, Dengue virus
GTTHFQRALI

SEQ ID NO: 38484 - protein, 10 aa, Dengue virus
TTHFQRALIF

SEQ ID NO: 38485 - protein, 10 aa, Dengue virus
THFQRALIFI

SEQ ID NO: 38486 - protein, 10 aa, Dengue virus
HFQRALIFIL

SEQ ID NO: 38487 - protein, 10 aa, Dengue virus
FQRALIFILL

SEQ ID NO: 38488 - protein, 10 aa, Dengue virus
QRALIFILLT

SEQ ID NO: 38489 - protein, 10 aa, Dengue virus
LIFILLTAVA

SEQ ID NO: 38490 - protein, 10 aa, Dengue virus
IFILLTAVAP

SEQ ID NO: 38491 - protein, 10 aa, Dengue virus
FILLTAVAPS

SEQ ID NO: 38492 - protein, 10 aa, Dengue virus
ILLTAVAPSM

SEQ ID NO: 38493 - protein, 10 aa, Dengue virus
LLTAVAPSMT

SEQ ID NO: 38494 - protein, 10 aa, Dengue virus
LTAVAPSMTM

SEQ ID NO: 38495 - protein, 10 aa, Dengue virus
TAVAPSMTMR

SEQ ID NO: 38496 - protein, 10 aa, Dengue virus
AVAPSMTMRC

SEQ ID NO: 38497 - protein, 10 aa, Dengue virus
VAPSMTMRCI

SEQ ID NO: 38498 - protein, 10 aa, Dengue virus
APSMTMRCIG

SEQ ID NO: 38499 - protein, 10 aa, Dengue virus
PSMTMRCIGI

SEQ ID NO: 38500 - protein, 10 aa, Dengue virus
SMTMRCIGIS

SEQ ID NO: 38501 - protein, 10 aa, Dengue virus
MTMRCIGISN

SEQ ID NO: 38502 - protein, 10 aa, Dengue virus
TMRCIGISNR

SEQ ID NO: 38503 - protein, 10 aa, Dengue virus
MRCIGISNRD

SEQ ID NO: 38504 - protein, 10 aa, Dengue virus
RCIGISNRDF

SEQ ID NO: 38505 - protein, 10 aa, Dengue virus
CIGISNRDFV

SEQ ID NO: 38506 - protein, 10 aa, Dengue virus
IGISNRDFVE

SEQ ID NO: 38507 - protein, 10 aa, Dengue virus
GISNRDFVEG

SEQ ID NO: 38508 - protein, 10 aa, Dengue virus
ISNRDFVEGV

SEQ ID NO: 38509 - protein, 10 aa, Dengue virus
SNRDFVEGVS

SEQ ID NO: 38510 - protein, 10 aa, Dengue virus
NRDFVEGVSG

SEQ ID NO: 38511 - protein, 10 aa, Dengue virus
RDFVEGVSGG

SEQ ID NO: 38512 - protein, 10 aa, Dengue virus
DFVEGVSGGS

SEQ ID NO: 38513 - protein, 10 aa, Dengue virus
FVEGVSGGSW

SEQ ID NO: 38514 - protein, 10 aa, Dengue virus
VEGVSGGSWV

SEQ ID NO: 38515 - protein, 10 aa, Dengue virus
EGVSGGSWVD

SEQ ID NO: 38516 - protein, 10 aa, Dengue virus
GVSGGSWVDI

SEQ ID NO: 38517 - protein, 10 aa, Dengue virus
VSGGSWVDIV

SEQ ID NO: 38518 - protein, 10 aa, Dengue virus
SGGSWVDIVL

SEQ ID NO: 38519 - protein, 10 aa, Dengue virus
GGSWVDIVLE

SEQ ID NO: 38520 - protein, 10 aa, Dengue virus
GSWVDIVLEH

SEQ ID NO: 38521 - protein, 10 aa, Dengue virus
SWVDIVLEHG

SEQ ID NO: 38522 - protein, 10 aa, Dengue virus
WVDIVLEHGS

SEQ ID NO: 38523 - protein, 10 aa, Dengue virus
VDIVLEHGSC

SEQ ID NO: 38524 - protein, 10 aa, Dengue virus
DIVLEHGSCV

SEQ ID NO: 38525 - protein, 10 aa, Dengue virus
IVLEHGSCVT

SEQ ID NO: 38526 - protein, 10 aa, Dengue virus
VLEHGSCVTT

SEQ ID NO: 38527 - protein, 10 aa, Dengue virus
LEHGSCVTTM

SEQ ID NO: 38528 - protein, 10 aa, Dengue virus
EHGSCVTTMA

SEQ ID NO: 38529 - protein, 10 aa, Dengue virus
HGSCVTTMAK

SEQ ID NO: 38530 - protein, 10 aa, Dengue virus
GSCVTTMAKN

SEQ ID NO: 38531 - protein, 10 aa, Dengue virus
SCVTTMAKNK

SEQ ID NO: 38532 - protein, 10 aa, Dengue virus
CVTTMAKNKP

SEQ ID NO: 38533 - protein, 10 aa, Dengue virus
VTTMAKNKPT

SEQ ID NO: 38534 - protein, 10 aa, Dengue virus
TTMAKNKPTL

SEQ ID NO: 38535 - protein, 10 aa, Dengue virus
TMAKNKPTLD

SEQ ID NO: 38536 - protein, 10 aa, Dengue virus
MAKNKPTLDF

SEQ ID NO: 38537 - protein, 10 aa, Dengue virus
AKNKPTLDFE

SEQ ID NO: 38538 - protein, 10 aa, Dengue virus
KNKPTLDFEL

SEQ ID NO: 38539 - protein, 10 aa, Dengue virus
NKPTLDFELI

SEQ ID NO: 38540 - protein, 10 aa, Dengue virus
KPTLDFELIK

SEQ ID NO: 38541 - protein, 10 aa, Dengue virus
PTLDFELIKT

SEQ ID NO: 38542 - protein, 10 aa, Dengue virus
TLDFELIKTE

SEQ ID NO: 38543 - protein, 10 aa, Dengue virus
LDFELIKTEA

SEQ ID NO: 38544 - protein, 10 aa, Dengue virus
DFELIKTEAK

SEQ ID NO: 38545 - protein, 10 aa, Dengue virus
FELIKTEAKQ

SEQ ID NO: 38546 - protein, 10 aa, Dengue virus
KTEAKQPATL

SEQ ID NO: 38547 - protein, 10 aa, Dengue virus
TEAKQPATLR

SEQ ID NO: 38548 - protein, 10 aa, Dengue virus
EAKQPATLRK

SEQ ID NO: 38549 - protein, 10 aa, Dengue virus
AKQPATLRKY

SEQ ID NO: 38550 - protein, 10 aa, Dengue virus
KQPATLRKYC

SEQ ID NO: 38551 - protein, 10 aa, Dengue virus
PATLRKYCIE

SEQ ID NO: 38552 - protein, 10 aa, Dengue virus
ATLRKYCIEA

SEQ ID NO: 38553 - protein, 10 aa, Dengue virus
TLRKYCIEAK

SEQ ID NO: 38554 - protein, 10 aa, Dengue virus
LRKYCIEAKL

SEQ ID NO: 38555 - protein, 10 aa, Dengue virus
RKYCIEAKLT

SEQ ID NO: 38556 - protein, 10 aa, Dengue virus
KYCIEAKLTN

SEQ ID NO: 38557 - protein, 10 aa, Dengue virus
YCIEAKLTNT

SEQ ID NO: 38558 - protein, 10 aa, Dengue virus
CIEAKLTNTT

SEQ ID NO: 38559 - protein, 10 aa, Dengue virus
IEAKLTNTTT

SEQ ID NO: 38560 - protein, 10 aa, Dengue virus
EAKLTNTTTE

SEQ ID NO: 38561 - protein, 10 aa, Dengue virus
AKLTNTTTES

SEQ ID NO: 38562 - protein, 10 aa, Dengue virus
KLTNTTTESR

SEQ ID NO: 38563 - protein, 10 aa, Dengue virus
LTNTTTESRC

SEQ ID NO: 38564 - protein, 10 aa, Dengue virus
TNTTTESRCP

SEQ ID NO: 38565 - protein, 10 aa, Dengue virus
NTTTESRCPT

SEQ ID NO: 38566 - protein, 10 aa, Dengue virus
TTTESRCPTQ

SEQ ID NO: 38567 - protein, 10 aa, Dengue virus
TTESRCPTQG

SEQ ID NO: 38568 - protein, 10 aa, Dengue virus
TESRCPTQGE

SEQ ID NO: 38569 - protein, 10 aa, Dengue virus
ESRCPTQGEP

SEQ ID NO: 38570 - protein, 10 aa, Dengue virus
SRCPTQGEPS

SEQ ID NO: 38571 - protein, 10 aa, Dengue virus
RCPTQGEPSL

SEQ ID NO: 38572 - protein, 10 aa, Dengue virus
CPTQGEPSLN

SEQ ID NO: 38573 - protein, 10 aa, Dengue virus
PTQGEPSLNE

SEQ ID NO: 38574 - protein, 10 aa, Dengue virus
TQGEPSLNEE

SEQ ID NO: 38575 - protein, 10 aa, Dengue virus
QGEPSLNEEQ

SEQ ID NO: 38576 - protein, 10 aa, Dengue virus
GEPSLNEEQD

SEQ ID NO: 38577 - protein, 10 aa, Dengue virus
EPSLNEEQDK

SEQ ID NO: 38578 - protein, 10 aa, Dengue virus
PSLNEEQDKR

SEQ ID NO: 38579 - protein, 10 aa, Dengue virus
SLNEEQDKRF

SEQ ID NO: 38580 - protein, 10 aa, Dengue virus
EEQDKRFVCK

SEQ ID NO: 38581 - protein, 10 aa, Dengue virus
EQDKRFVCKH

SEQ ID NO: 38582 - protein, 10 aa, Dengue virus
QDKRFVCKHS

SEQ ID NO: 38583 - protein, 10 aa, Dengue virus
DKRFVCKHSM

SEQ ID NO: 38584 - protein, 10 aa, Dengue virus
KRFVCKHSMV

SEQ ID NO: 38585 - protein, 10 aa, Dengue virus
RFVCKHSMVD

SEQ ID NO: 38586 - protein, 10 aa, Dengue virus
FVCKHSMVDR

SEQ ID NO: 38587 - protein, 10 aa, Dengue virus
VCKHSMVDRG

SEQ ID NO: 38588 - protein, 10 aa, Dengue virus
CKHSMVDRGW

SEQ ID NO: 38589 - protein, 10 aa, Dengue virus
KHSMVDRGWG

SEQ ID NO: 38590 - protein, 10 aa, Dengue virus
HSMVDRGWGN

SEQ ID NO: 38591 - protein, 10 aa, Dengue virus
SMVDRGWGNG

SEQ ID NO: 38592 - protein, 10 aa, Dengue virus
MVDRGWGNGC

SEQ ID NO: 38593 - protein, 10 aa, Dengue virus
VDRGWGNGCG

SEQ ID NO: 38594 - protein, 10 aa, Dengue virus
DRGWGNGCGL

SEQ ID NO: 38595 - protein, 10 aa, Dengue virus
RGWGNGCGLF

SEQ ID NO: 38596 - protein, 10 aa, Dengue virus
GWGNGCGLFG

SEQ ID NO: 38597 - protein, 10 aa, Dengue virus
WGNGCGLFGK

SEQ ID NO: 38598 - protein, 10 aa, Dengue virus
GNGCGLFGKG

SEQ ID NO: 38599 - protein, 10 aa, Dengue virus
NGCGLFGKGG

SEQ ID NO: 38600 - protein, 10 aa, Dengue virus
GCGLFGKGGI

SEQ ID NO: 38601 - protein, 10 aa, Dengue virus
CGLFGKGGIV

SEQ ID NO: 38602 - protein, 10 aa, Dengue virus
GLFGKGGIVT

SEQ ID NO: 38603 - protein, 10 aa, Dengue virus
LFGKGGIVTC

SEQ ID NO: 38604 - protein, 10 aa, Dengue virus
FGKGGIVTCA

SEQ ID NO: 38605 - protein, 10 aa, Dengue virus
GKGGIVTCAM

SEQ ID NO: 38606 - protein, 10 aa, Dengue virus
KGGIVTCAMF

SEQ ID NO: 38607 - protein, 10 aa, Dengue virus
GGIVTCAMFT

SEQ ID NO: 38608 - protein, 10 aa, Dengue virus
GIVTCAMFTC

SEQ ID NO: 38609 - protein, 10 aa, Dengue virus
IVTCAMFTCK

SEQ ID NO: 38610 - protein, 10 aa, Dengue virus
VTCAMFTCKK

SEQ ID NO: 38611 - protein, 10 aa, Dengue virus
TCAMFTCKKN

SEQ ID NO: 38612 - protein, 10 aa, Dengue virus
CAMFTCKKNM

SEQ ID NO: 38613 - protein, 10 aa, Dengue virus
AMFTCKKNME

SEQ ID NO: 38614 - protein, 10 aa, Dengue virus
MFTCKKNMEG

SEQ ID NO: 38615 - protein, 10 aa, Dengue virus
FTCKKNMEGK

SEQ ID NO: 38616 - protein, 10 aa, Dengue virus
CKKNMEGKVV

SEQ ID NO: 38617 - protein, 10 aa, Dengue virus
KKNMEGKIVQ

SEQ ID NO: 38618 - protein, 10 aa, Dengue virus
KNMEGKIVQP

SEQ ID NO: 38619 - protein, 10 aa, Dengue virus
NMEGKIVQPE

SEQ ID NO: 38620 - protein, 10 aa, Dengue virus
MEGKIVQPEN

SEQ ID NO: 38621 - protein, 10 aa, Dengue virus
EGKIVQPENL

SEQ ID NO: 38622 - protein, 10 aa, Dengue virus
GKIVQPENLE

SEQ ID NO: 38623 - protein, 10 aa, Dengue virus
KIVQPENLEY

SEQ ID NO: 38624 - protein, 10 aa, Dengue virus
IVQPENLEYT

SEQ ID NO: 38625 - protein, 10 aa, Dengue virus
VQPENLEYTI

SEQ ID NO: 38626 - protein, 10 aa, Dengue virus
QPENLEYTIV

SEQ ID NO: 38627 - protein, 10 aa, Dengue virus
PENLEYTIVI

SEQ ID NO: 38628 - protein, 10 aa, Dengue virus
ENLEYTIVIT

SEQ ID NO: 38629 - protein, 10 aa, Dengue virus
NLEYTIVITP

SEQ ID NO: 38630 - protein, 10 aa, Dengue virus
LEYTIVITPH

SEQ ID NO: 38631 - protein, 10 aa, Dengue virus
EYTIVITPHS

SEQ ID NO: 38632 - protein, 10 aa, Dengue virus
YTIVITPHSG

SEQ ID NO: 38633 - protein, 10 aa, Dengue virus
TIVITPHSGE

SEQ ID NO: 38634 - protein, 10 aa, Dengue virus
IVITPHSGEE

SEQ ID NO: 38635 - protein, 10 aa, Dengue virus
VITPHSGEEH

SEQ ID NO: 38636 - protein, 10 aa, Dengue virus
ITPHSGEEHA

SEQ ID NO: 38637 - protein, 10 aa, Dengue virus
TPHSGEEHAV

SEQ ID NO: 38638 - protein, 10 aa, Dengue virus
PHSGEEHAVG

SEQ ID NO: 38639 - protein, 10 aa, Dengue virus
HSGEEHAVGN

SEQ ID NO: 38640 - protein, 10 aa, Dengue virus
SGEEHAVGND

SEQ ID NO: 38641 - protein, 10 aa, Dengue virus
GEEHAVGNDT

SEQ ID NO: 38642 - protein, 10 aa, Dengue virus
EEHAVGNDTG

SEQ ID NO: 38643 - protein, 10 aa, Dengue virus
EHAVGNDTGK

SEQ ID NO: 38644 - protein, 10 aa, Dengue virus
HAVGNDTGKH

SEQ ID NO: 38645 - protein, 10 aa, Dengue virus
AVGNDTGKHG

SEQ ID NO: 38646 - protein, 10 aa, Dengue virus
VGNDTGKHGK

SEQ ID NO: 38647 - protein, 10 aa, Dengue virus
GNDTGKHGKE

SEQ ID NO: 38648 - protein, 10 aa, Dengue virus
NDTGKHGKEI

SEQ ID NO: 38649 - protein, 10 aa, Dengue virus
DTGKHGKEIK

SEQ ID NO: 38650 - protein, 10 aa, Dengue virus
TGKHGKEIKI

SEQ ID NO: 38651 - protein, 10 aa, Dengue virus
GKHGKEIKIT

SEQ ID NO: 38652 - protein, 10 aa, Dengue virus
KHGKEIKITP

SEQ ID NO: 38653 - protein, 10 aa, Dengue virus
HGKEIKITPQ

SEQ ID NO: 38654 - protein, 10 aa, Dengue virus
GKEIKITPQS

SEQ ID NO: 38655 - protein, 10 aa, Dengue virus
TEAELTGYGT

SEQ ID NO: 38656 - protein, 10 aa, Dengue virus
EAELTGYGTV

SEQ ID NO: 38657 - protein, 10 aa, Dengue virus
AELTGYGTVT

SEQ ID NO: 38658 - protein, 10 aa, Dengue virus
ELTGYGTVTM

SEQ ID NO: 38659 - protein, 10 aa, Dengue virus
LTGYGTVTME

SEQ ID NO: 38660 - protein, 10 aa, Dengue virus
TGYGTVTMEC

SEQ ID NO: 38661 - protein, 10 aa, Dengue virus
GYGTVTMECS

SEQ ID NO: 38662 - protein, 10 aa, Dengue virus
YGTVTMECSP

SEQ ID NO: 38663 - protein, 10 aa, Dengue virus
GTVTMECSPR

SEQ ID NO: 38664 - protein, 10 aa, Dengue virus
TVTMECSPRT

SEQ ID NO: 38665 - protein, 10 aa, Dengue virus
VTMECSPRTG

SEQ ID NO: 38666 - protein, 10 aa, Dengue virus
TMECSPRTGL

SEQ ID NO: 38667 - protein, 10 aa, Dengue virus
MECSPRTGLD

SEQ ID NO: 38668 - protein, 10 aa, Dengue virus
ECSPRTGLDF

SEQ ID NO: 38669 - protein, 10 aa, Dengue virus
CSPRTGLDFN

SEQ ID NO: 38670 - protein, 10 aa, Dengue virus
SPRTGLDFNE

SEQ ID NO: 38671 - protein, 10 aa, Dengue virus
PRTGLDFNEM

SEQ ID NO: 38672 - protein, 10 aa, Dengue virus
RTGLDFNEMV

SEQ ID NO: 38673 - protein, 10 aa, Dengue virus
TGLDFNEMVL

SEQ ID NO: 38674 - protein, 10 aa, Dengue virus
GLDFNEMVLL

SEQ ID NO: 38675 - protein, 10 aa, Dengue virus
LDFNEMVLLQ

SEQ ID NO: 38676 - protein, 10 aa, Dengue virus
DFNEMVLLQM

SEQ ID NO: 38677 - protein, 10 aa, Dengue virus
FNEMVLLQME

SEQ ID NO: 38678 - protein, 10 aa, Dengue virus
MEDKAWLVHR

SEQ ID NO: 38679 - protein, 10 aa, Dengue virus
EDKAWLVHRQ

SEQ ID NO: 38680 - protein, 10 aa, Dengue virus
DKAWLVHRQW

SEQ ID NO: 38681 - protein, 10 aa, Dengue virus
KAWLVHRQWF

SEQ ID NO: 38682 - protein, 10 aa, Dengue virus
AWLVHRQWFL

SEQ ID NO: 38683 - protein, 10 aa, Dengue virus
WLVHRQWFLD

SEQ ID NO: 38684 - protein, 10 aa, Dengue virus
LVHRQWFLDL

SEQ ID NO: 38685 - protein, 10 aa, Dengue virus
VHRQWFLDLP

SEQ ID NO: 38686 - protein, 10 aa, Dengue virus
HRQWFLDLPL

SEQ ID NO: 38687 - protein, 10 aa, Dengue virus
RQWFLDLPLP

SEQ ID NO: 38688 - protein, 10 aa, Dengue virus
QWFLDLPLPW

SEQ ID NO: 38689 - protein, 10 aa, Dengue virus
WFLDLPLPWL

SEQ ID NO: 38690 - protein, 10 aa, Dengue virus
FLDLPLPWLP

SEQ ID NO: 38691 - protein, 10 aa, Dengue virus
LDLPLPWLPG

SEQ ID NO: 38692 - protein, 10 aa, Dengue virus
DLPLPWLPGA

SEQ ID NO: 38693 - protein, 10 aa, Dengue virus
LPLPWLPGAD

SEQ ID NO: 38694 - protein, 10 aa, Dengue virus
PLPWLPGADT

SEQ ID NO: 38695 - protein, 10 aa, Dengue virus
LPWLPGADTQ

SEQ ID NO: 38696 - protein, 10 aa, Dengue virus
PWLPGADTQG

SEQ ID NO: 38697 - protein, 10 aa, Dengue virus
WLPGADTQGS

SEQ ID NO: 38698 - protein, 10 aa, Dengue virus
LPGADTQGSN

SEQ ID NO: 38699 - protein, 10 aa, Dengue virus
PGADTQGSNW

SEQ ID NO: 38700 - protein, 10 aa, Dengue virus
GADTQGSNWI

SEQ ID NO: 38701 - protein, 10 aa, Dengue virus
ADTQGSNWIQ

SEQ ID NO: 38702 - protein, 10 aa, Dengue virus
DTQGSNWIQK

SEQ ID NO: 38703 - protein, 10 aa, Dengue virus
TQGSNWIQKE

SEQ ID NO: 38704 - protein, 10 aa, Dengue virus
QGSNWIQKET

SEQ ID NO: 38705 - protein, 10 aa, Dengue virus
GSNWIQKETL

SEQ ID NO: 38706 - protein, 10 aa, Dengue virus
SNWIQKETLV

SEQ ID NO: 38707 - protein, 10 aa, Dengue virus
NWIQKETLVT

SEQ ID NO: 38708 - protein, 10 aa, Dengue virus
WIQKETLVTF

SEQ ID NO: 38709 - protein, 10 aa, Dengue virus
IQKETLVTFK

SEQ ID NO: 38710 - protein, 10 aa, Dengue virus
QKETLVTFKN

SEQ ID NO: 38711 - protein, 10 aa, Dengue virus
KETLVTFKNP

SEQ ID NO: 38712 - protein, 10 aa, Dengue virus
ETLVTFKNPH

SEQ ID NO: 38713 - protein, 10 aa, Dengue virus
TLVTFKNPHA

SEQ ID NO: 38714 - protein, 10 aa, Dengue virus
LVTFKNPHAK

SEQ ID NO: 38715 - protein, 10 aa, Dengue virus
VTFKNPHAKK

SEQ ID NO: 38716 - protein, 10 aa, Dengue virus
TFKNPHAKKQ

SEQ ID NO: 38717 - protein, 10 aa, Dengue virus
FKNPHAKKQD

SEQ ID NO: 38718 - protein, 10 aa, Dengue virus
KNPHAKKQDV

SEQ ID NO: 38719 - protein, 10 aa, Dengue virus
NPHAKKQDVV

SEQ ID NO: 38720 - protein, 10 aa, Dengue virus
PHAKKQDVVV

SEQ ID NO: 38721 - protein, 10 aa, Dengue virus
HAKKQDVVVL

SEQ ID NO: 38722 - protein, 10 aa, Dengue virus
AKKQDVVVLG

SEQ ID NO: 38723 - protein, 10 aa, Dengue virus
KKQDVVVLGS

SEQ ID NO: 38724 - protein, 10 aa, Dengue virus
KQDVVVLGSQ

SEQ ID NO: 38725 - protein, 10 aa, Dengue virus
QDVVVLGSQE

SEQ ID NO: 38726 - protein, 10 aa, Dengue virus
DVVVLGSQEG

SEQ ID NO: 38727 - protein, 10 aa, Dengue virus
VVVLGSQEGA

SEQ ID NO: 38728 - protein, 10 aa, Dengue virus
VVLGSQEGAM

SEQ ID NO: 38729 - protein, 10 aa, Dengue virus
VLGSQEGAMH

SEQ ID NO: 38730 - protein, 10 aa, Dengue virus
LGSQEGAMHT

SEQ ID NO: 38731 - protein, 10 aa, Dengue virus
GSQEGAMHTA

SEQ ID NO: 38732 - protein, 10 aa, Dengue virus
SQEGAMHTAL

SEQ ID NO: 38733 - protein, 10 aa, Dengue virus
QEGAMHTALT

SEQ ID NO: 38734 - protein, 10 aa, Dengue virus
EGAMHTALTG

SEQ ID NO: 38735 - protein, 10 aa, Dengue virus
GAMHTALTGA

SEQ ID NO: 38736 - protein, 10 aa, Dengue virus
AMHTALTGAT

SEQ ID NO: 38737 - protein, 10 aa, Dengue virus
MHTALTGATE

SEQ ID NO: 38738 - protein, 10 aa, Dengue virus
HTALTGATEI

SEQ ID NO: 38739 - protein, 10 aa, Dengue virus
TALTGATEIQ

SEQ ID NO: 38740 - protein, 10 aa, Dengue virus
ALTGATEIQM

SEQ ID NO: 38741 - protein, 10 aa, Dengue virus
LTGATEIQMS

SEQ ID NO: 38742 - protein, 10 aa, Dengue virus
TGATEIQMSS

SEQ ID NO: 38743 - protein, 10 aa, Dengue virus
GATEIQMSSG

SEQ ID NO: 38744 - protein, 10 aa, Dengue virus
ATEIQMSSGN

SEQ ID NO: 38745 - protein, 10 aa, Dengue virus
TEIQMSSGNL

SEQ ID NO: 38746 - protein, 10 aa, Dengue virus
EIQMSSGNLL

SEQ ID NO: 38747 - protein, 10 aa, Dengue virus
IQMSSGNLLF

SEQ ID NO: 38748 - protein, 10 aa, Dengue virus
QMSSGNLLFT

SEQ ID NO: 38749 - protein, 10 aa, Dengue virus
MSSGNLLFTG

SEQ ID NO: 38750 - protein, 10 aa, Dengue virus
SSGNLLFTGH

SEQ ID NO: 38751 - protein, 10 aa, Dengue virus
SGNLLFTGHL

SEQ ID NO: 38752 - protein, 10 aa, Dengue virus
GNLLFTGHLK

SEQ ID NO: 38753 - protein, 10 aa, Dengue virus
NLLFTGHLKC

SEQ ID NO: 38754 - protein, 10 aa, Dengue virus
LLFTGHLKCR

SEQ ID NO: 38755 - protein, 10 aa, Dengue virus
LFTGHLKCRL

SEQ ID NO: 38756 - protein, 10 aa, Dengue virus
FTGHLKCRLR

SEQ ID NO: 38757 - protein, 10 aa, Dengue virus
TGHLKCRLRM

SEQ ID NO: 38758 - protein, 10 aa, Dengue virus
GHLKCRLRMD

SEQ ID NO: 38759 - protein, 10 aa, Dengue virus
HLKCRLRMDK

SEQ ID NO: 38760 - protein, 10 aa, Dengue virus
LKCRLRMDKL

SEQ ID NO: 38761 - protein, 10 aa, Dengue virus
KCRLRMDKLQ

SEQ ID NO: 38762 - protein, 10 aa, Dengue virus
CRLRMDKLQL

SEQ ID NO: 38763 - protein, 10 aa, Dengue virus
RLRMDKLQLK

SEQ ID NO: 38764 - protein, 10 aa, Dengue virus
LRMDKLQLKG

SEQ ID NO: 38765 - protein, 10 aa, Dengue virus
RMDKLQLKGM

SEQ ID NO: 38766 - protein, 10 aa, Dengue virus
MDKLQLKGMS

SEQ ID NO: 38767 - protein, 10 aa, Dengue virus
DKLQLKGMSY

SEQ ID NO: 38768 - protein, 10 aa, Dengue virus
KLQLKGMSYS

SEQ ID NO: 38769 - protein, 10 aa, Dengue virus
LQLKGMSYSM

SEQ ID NO: 38770 - protein, 10 aa, Dengue virus
QLKGMSYSMC

SEQ ID NO: 38771 - protein, 10 aa, Dengue virus
LKGMSYSMCT

SEQ ID NO: 38772 - protein, 10 aa, Dengue virus
KGMSYSMCTG

SEQ ID NO: 38773 - protein, 10 aa, Dengue virus
GMSYSMCTGK

SEQ ID NO: 38774 - protein, 10 aa, Dengue virus
MSYSMCTGKF

SEQ ID NO: 38775 - protein, 10 aa, Dengue virus
SYSMCTGKFK

SEQ ID NO: 38776 - protein, 10 aa, Dengue virus
YSMCTGKFKI

SEQ ID NO: 38777 - protein, 10 aa, Dengue virus
SMCTGKFKIV

SEQ ID NO: 38778 - protein, 10 aa, Dengue virus
MCTGKFKIVK

SEQ ID NO: 38779 - protein, 10 aa, Dengue virus
CTGKFKIVKE

SEQ ID NO: 38780 - protein, 10 aa, Dengue virus
TGKFKIVKEI

SEQ ID NO: 38781 - protein, 10 aa, Dengue virus
GKFKIVKEIA

SEQ ID NO: 38782 - protein, 10 aa, Dengue virus
KFKIVKEIAE

SEQ ID NO: 38783 - protein, 10 aa, Dengue virus
FKIVKEIAET

SEQ ID NO: 38784 - protein, 10 aa, Dengue virus
KIVKEIAETQ

SEQ ID NO: 38785 - protein, 10 aa, Dengue virus
IVKEIAETQH

SEQ ID NO: 38786 - protein, 10 aa, Dengue virus
VKEIAETQHG

SEQ ID NO: 38787 - protein, 10 aa, Dengue virus
KEIAETQHGT

SEQ ID NO: 38788 - protein, 10 aa, Dengue virus
EIAETQHGTI

SEQ ID NO: 38789 - protein, 10 aa, Dengue virus
IAETQHGTIV

SEQ ID NO: 38790 - protein, 10 aa, Dengue virus
AETQHGTIVI

SEQ ID NO: 38791 - protein, 10 aa, Dengue virus
ETQHGTIVIR

SEQ ID NO: 38792 - protein, 10 aa, Dengue virus
TQHGTIVIRV

SEQ ID NO: 38793 - protein, 10 aa, Dengue virus
QHGTIVIRVQ

SEQ ID NO: 38794 - protein, 10 aa, Dengue virus
HGTIVIRVQY

SEQ ID NO: 38795 - protein, 10 aa, Dengue virus
GTIVIRVQYE

SEQ ID NO: 38796 - protein, 10 aa, Dengue virus
TIVIRVQYEG

SEQ ID NO: 38797 - protein, 10 aa, Dengue virus
IVIRVQYEGD

SEQ ID NO: 38798 - protein, 10 aa, Dengue virus
VIRVQYEGDG

SEQ ID NO: 38799 - protein, 10 aa, Dengue virus
IRVQYEGDGS

SEQ ID NO: 38800 - protein, 10 aa, Dengue virus
RVQYEGDGSP

SEQ ID NO: 38801 - protein, 10 aa, Dengue virus
VQYEGDGSPC

SEQ ID NO: 38802 - protein, 10 aa, Dengue virus
QYEGDGSPCK

SEQ ID NO: 38803 - protein, 10 aa, Dengue virus
YEGDGSPCKI

SEQ ID NO: 38804 - protein, 10 aa, Dengue virus
EGDGSPCKIP

SEQ ID NO: 38805 - protein, 10 aa, Dengue virus
GDGSPCKIPF

SEQ ID NO: 38806 - protein, 10 aa, Dengue virus
DGSPCKIPFE

SEQ ID NO: 38807 - protein, 10 aa, Dengue virus
GSPCKIPFEI

SEQ ID NO: 38808 - protein, 10 aa, Dengue virus
SPCKIPFEIM

SEQ ID NO: 38809 - protein, 10 aa, Dengue virus
PCKIPFEIMD

SEQ ID NO: 38810 - protein, 10 aa, Dengue virus
CKIPFEIMDL

SEQ ID NO: 38811 - protein, 10 aa, Dengue virus
KIPFEIMDLE

SEQ ID NO: 38812 - protein, 10 aa, Dengue virus
IPFEIMDLEK

SEQ ID NO: 38813 - protein, 10 aa, Dengue virus
PFEIMDLEKR

SEQ ID NO: 38814 - protein, 10 aa, Dengue virus
FEIMDLEKRH

SEQ ID NO: 38815 - protein, 10 aa, Dengue virus
DLEKRHVLGR

SEQ ID NO: 38816 - protein, 10 aa, Dengue virus
LEKRHVLGRL

SEQ ID NO: 38817 - protein, 10 aa, Dengue virus
EKRHVLGRLI

SEQ ID NO: 38818 - protein, 10 aa, Dengue virus
KRHVLGRLIT

SEQ ID NO: 38819 - protein, 10 aa, Dengue virus
RHVLGRLITV

SEQ ID NO: 38820 - protein, 10 aa, Dengue virus
HVLGRLITVN

SEQ ID NO: 38821 - protein, 10 aa, Dengue virus
VLGRLITVNP

SEQ ID NO: 38822 - protein, 10 aa, Dengue virus
LGRLITVNPI

SEQ ID NO: 38823 - protein, 10 aa, Dengue virus
GRLITVNPIV

SEQ ID NO: 38824 - protein, 10 aa, Dengue virus
RLITVNPIVT

SEQ ID NO: 38825 - protein, 10 aa, Dengue virus
EKDSPVNIEA

SEQ ID NO: 38826 - protein, 10 aa, Dengue virus
KDSPVNIEAE

SEQ ID NO: 38827 - protein, 10 aa, Dengue virus
DSPVNIEAEP

SEQ ID NO: 38828 - protein, 10 aa, Dengue virus
SPVNIEAEPP

SEQ ID NO: 38829 - protein, 10 aa, Dengue virus
PVNIEAEPPF

SEQ ID NO: 38830 - protein, 10 aa, Dengue virus
VNIEAEPPFG

SEQ ID NO: 38831 - protein, 10 aa, Dengue virus
NIEAEPPFGD

SEQ ID NO: 38832 - protein, 10 aa, Dengue virus
IEAEPPFGDS

SEQ ID NO: 38833 - protein, 10 aa, Dengue virus
EAEPPFGDSY

SEQ ID NO: 38834 - protein, 10 aa, Dengue virus
AEPPFGDSYI

SEQ ID NO: 38835 - protein, 10 aa, Dengue virus
EPPFGDSYII

SEQ ID NO: 38836 - protein, 10 aa, Dengue virus
PPFGDSYIII

SEQ ID NO: 38837 - protein, 10 aa, Dengue virus
PFGDSYIIIG

SEQ ID NO: 38838 - protein, 10 aa, Dengue virus
FGDSYIIIGV

SEQ ID NO: 38839 - protein, 10 aa, Dengue virus
GDSYIIIGVE

SEQ ID NO: 38840 - protein, 10 aa, Dengue virus
DSYIIIGVEP

SEQ ID NO: 38841 - protein, 10 aa, Dengue virus
SYIIIGVEPG

SEQ ID NO: 38842 - protein, 10 aa, Dengue virus
YIIIGVEPGQ

SEQ ID NO: 38843 - protein, 10 aa, Dengue virus
IIIGVEPGQL

SEQ ID NO: 38844 - protein, 10 aa, Dengue virus
IIGVEPGQLK

SEQ ID NO: 38845 - protein, 10 aa, Dengue virus
IGVEPGQLKL

SEQ ID NO: 38846 - protein, 10 aa, Dengue virus
GVEPGQLKLN

SEQ ID NO: 38847 - protein, 10 aa, Dengue virus
VEPGQLKLNW

SEQ ID NO: 38848 - protein, 10 aa, Dengue virus
EPGQLKLNWF

SEQ ID NO: 38849 - protein, 10 aa, Dengue virus
PGQLKLNWFK

SEQ ID NO: 38850 - protein, 10 aa, Dengue virus
GQLKLNWFKK

SEQ ID NO: 38851 - protein, 10 aa, Dengue virus
QLKLNWFKKG

SEQ ID NO: 38852 - protein, 10 aa, Dengue virus
LKLNWFKKGS

SEQ ID NO: 38853 - protein, 10 aa, Dengue virus
KLNWFKKGSS

SEQ ID NO: 38854 - protein, 10 aa, Dengue virus
LNWFKKGSSI

SEQ ID NO: 38855 - protein, 10 aa, Dengue virus
NWFKKGSSIG

SEQ ID NO: 38856 - protein, 10 aa, Dengue virus
WFKKGSSIGQ

SEQ ID NO: 38857 - protein, 10 aa, Dengue virus
FKKGSSIGQM

SEQ ID NO: 38858 - protein, 10 aa, Dengue virus
KKGSSIGQMF

SEQ ID NO: 38859 - protein, 10 aa, Dengue virus
KGSSIGQMFE

SEQ ID NO: 38860 - protein, 10 aa, Dengue virus
GSSIGQMFET

SEQ ID NO: 38861 - protein, 10 aa, Dengue virus
SSIGQMFETT

SEQ ID NO: 38862 - protein, 10 aa, Dengue virus
SIGQMFETTM

SEQ ID NO: 38863 - protein, 10 aa, Dengue virus
IGQMFETTMR

SEQ ID NO: 38864 - protein, 10 aa, Dengue virus
GQMFETTMRG

SEQ ID NO: 38865 - protein, 10 aa, Dengue virus
QMFETTMRGA

SEQ ID NO: 38866 - protein, 10 aa, Dengue virus
MFETTMRGAK

SEQ ID NO: 38867 - protein, 10 aa, Dengue virus
FETTMRGAKR

SEQ ID NO: 38868 - protein, 10 aa, Dengue virus
ETTMRGAKRM

SEQ ID NO: 38869 - protein, 10 aa, Dengue virus
TTMRGAKRMA

SEQ ID NO: 38870 - protein, 10 aa, Dengue virus
TMRGAKRMAI

SEQ ID NO: 38871 - protein, 10 aa, Dengue virus
MRGAKRMAIL

SEQ ID NO: 38872 - protein, 10 aa, Dengue virus
RGAKRMAILG

SEQ ID NO: 38873 - protein, 10 aa, Dengue virus
GAKRMAILGD

SEQ ID NO: 38874 - protein, 10 aa, Dengue virus
AKRMAILGDT

SEQ ID NO: 38875 - protein, 10 aa, Dengue virus
KRMAILGDTA

SEQ ID NO: 38876 - protein, 10 aa, Dengue virus
RMAILGDTAW

SEQ ID NO: 38877 - protein, 10 aa, Dengue virus
MAILGDTAWD

SEQ ID NO: 38878 - protein, 10 aa, Dengue virus
AILGDTAWDF

SEQ ID NO: 38879 - protein, 10 aa, Dengue virus
ILGDTAWDFG

SEQ ID NO: 38880 - protein, 10 aa, Dengue virus
LGDTAWDFGS

SEQ ID NO: 38881 - protein, 10 aa, Dengue virus
GDTAWDFGSL

SEQ ID NO: 38882 - protein, 10 aa, Dengue virus
DTAWDFGSLG

SEQ ID NO: 38883 - protein, 10 aa, Dengue virus
TAWDFGSLGG

SEQ ID NO: 38884 - protein, 10 aa, Dengue virus
AWDFGSLGGV

SEQ ID NO: 38885 - protein, 10 aa, Dengue virus
WDFGSLGGVF

SEQ ID NO: 38886 - protein, 10 aa, Dengue virus
DFGSLGGVFT

SEQ ID NO: 38887 - protein, 10 aa, Dengue virus
FGSLGGVFTS

SEQ ID NO: 38888 - protein, 10 aa, Dengue virus
GSLGGVFTSI

SEQ ID NO: 38889 - protein, 10 aa, Dengue virus
SLGGVFTSIG

SEQ ID NO: 38890 - protein, 10 aa, Dengue virus
LGGVFTSIGK

SEQ ID NO: 38891 - protein, 10 aa, Dengue virus
GGVFTSIGKA

SEQ ID NO: 38892 - protein, 10 aa, Dengue virus
GVFTSIGKAL

SEQ ID NO: 38893 - protein, 10 aa, Dengue virus
VFTSIGKALH

SEQ ID NO: 38894 - protein, 10 aa, Dengue virus
FTSIGKALHQ

SEQ ID NO: 38895 - protein, 10 aa, Dengue virus
TSIGKALHQV

SEQ ID NO: 38896 - protein, 10 aa, Dengue virus
SIGKALHQVF

SEQ ID NO: 38897 - protein, 10 aa, Dengue virus
IGKALHQVFG

SEQ ID NO: 38898 - protein, 10 aa, Dengue virus
GKALHQVFGA

SEQ ID NO: 38899 - protein, 10 aa, Dengue virus
KALHQVFGAI

SEQ ID NO: 38900 - protein, 10 aa, Dengue virus
ALHQVFGAIY

SEQ ID NO: 38901 - protein, 10 aa, Dengue virus
LHQVFGAIYG

SEQ ID NO: 38902 - protein, 10 aa, Dengue virus
HQVFGAIYGA

SEQ ID NO: 38903 - protein, 10 aa, Dengue virus
QVFGAIYGAA

SEQ ID NO: 38904 - protein, 10 aa, Dengue virus
VFGAIYGAAF

SEQ ID NO: 38905 - protein, 10 aa, Dengue virus
FGAIYGAAFS

SEQ ID NO: 38906 - protein, 10 aa, Dengue virus
GAIYGAAFSG

SEQ ID NO: 38907 - protein, 10 aa, Dengue virus
AIYGAAFSGV

SEQ ID NO: 38908 - protein, 10 aa, Dengue virus
IYGAAFSGVS

SEQ ID NO: 38909 - protein, 10 aa, Dengue virus
YGAAFSGVSW

SEQ ID NO: 38910 - protein, 10 aa, Dengue virus
GAAFSGVSWT

SEQ ID NO: 38911 - protein, 10 aa, Dengue virus
AAFSGVSWTM

SEQ ID NO: 38912 - protein, 10 aa, Dengue virus
AFSGVSWTMK

SEQ ID NO: 38913 - protein, 10 aa, Dengue virus
FSGVSWTMKI

SEQ ID NO: 38914 - protein, 10 aa, Dengue virus
SGVSWTMKIL

SEQ ID NO: 38915 - protein, 10 aa, Dengue virus
GVSWTMKILI

SEQ ID NO: 38916 - protein, 10 aa, Dengue virus
VSWTMKILIG

SEQ ID NO: 38917 - protein, 10 aa, Dengue virus
SWTMKILIGV

SEQ ID NO: 38918 - protein, 10 aa, Dengue virus
WTMKILIGVI

SEQ ID NO: 38919 - protein, 10 aa, Dengue virus
TMKILIGVII

SEQ ID NO: 38920 - protein, 10 aa, Dengue virus
MKILIGVIIT

SEQ ID NO: 38921 - protein, 10 aa, Dengue virus
KILIGVIITW

SEQ ID NO: 38922 - protein, 10 aa, Dengue virus
ILIGVIITWI

SEQ ID NO: 38923 - protein, 10 aa, Dengue virus
LIGVIITWIG

SEQ ID NO: 38924 - protein, 10 aa, Dengue virus
IGVIITWIGM

SEQ ID NO: 38925 - protein, 10 aa, Dengue virus
GVIITWIGMN

SEQ ID NO: 38926 - protein, 10 aa, Dengue virus
VIITWIGMNS

SEQ ID NO: 38927 - protein, 10 aa, Dengue virus
IITWIGMNSR

SEQ ID NO: 38928 - protein, 10 aa, Dengue virus
ITWIGMNSRS

SEQ ID NO: 38929 - protein, 10 aa, Dengue virus
TWIGMNSRST

SEQ ID NO: 38930 - protein, 10 aa, Dengue virus
WIGMNSRSTS

SEQ ID NO: 38931 - protein, 10 aa, Dengue virus
IGMNSRSTSL

SEQ ID NO: 38932 - protein, 10 aa, Dengue virus
GMNSRSTSLS

SEQ ID NO: 38933 - protein, 10 aa, Dengue virus
MNSRSTSLSV

SEQ ID NO: 38934 - protein, 10 aa, Dengue virus
NSRSTSLSVS

SEQ ID NO: 38935 - protein, 10 aa, Dengue virus
SRSTSLSVSL

SEQ ID NO: 38936 - protein, 10 aa, Dengue virus
RSTSLSVSLV

SEQ ID NO: 38937 - protein, 10 aa, Dengue virus
STSLSVSLVL

SEQ ID NO: 38938 - protein, 10 aa, Dengue virus
TSLSVSLVLV

SEQ ID NO: 38939 - protein, 10 aa, Dengue virus
SLSVSLVLVG

SEQ ID NO: 38940 - protein, 10 aa, Dengue virus
LSVSLVLVGV

SEQ ID NO: 38941 - protein, 10 aa, Dengue virus
SVSLVLVGVV

SEQ ID NO: 38942 - protein, 10 aa, Dengue virus
LVLVGVVTLY

SEQ ID NO: 38943 - protein, 10 aa, Dengue virus
VLVGVVTLYL

SEQ ID NO: 38944 - protein, 10 aa, Dengue virus
LVGVVTLYLG

SEQ ID NO: 38945 - protein, 10 aa, Dengue virus
VGVVTLYLGA

SEQ ID NO: 38946 - protein, 10 aa, Dengue virus
VTLYLGVMVQ

SEQ ID NO: 38947 - protein, 10 aa, Dengue virus
TLYLGVMVQA

SEQ ID NO: 38948 - protein, 10 aa, Dengue virus
LYLGVMVQAD

SEQ ID NO: 38949 - protein, 10 aa, Dengue virus
YLGVMVQADS

SEQ ID NO: 38950 - protein, 10 aa, Dengue virus
LGVMVQADSG

SEQ ID NO: 38951 - protein, 10 aa, Dengue virus
GVMVQADSGC

SEQ ID NO: 38952 - protein, 10 aa, Dengue virus
VMVQADSGCV

SEQ ID NO: 38953 - protein, 10 aa, Dengue virus
MVQADSGCVV

SEQ ID NO: 38954 - protein, 10 aa, Dengue virus
VQADSGCVVS

SEQ ID NO: 38955 - protein, 10 aa, Dengue virus
QADSGCVVSW

SEQ ID NO: 38956 - protein, 10 aa, Dengue virus
ADSGCVVSWK

SEQ ID NO: 38957 - protein, 10 aa, Dengue virus
DSGCVVSWKN

SEQ ID NO: 38958 - protein, 10 aa, Dengue virus
SGCVVSWKNK

SEQ ID NO: 38959 - protein, 10 aa, Dengue virus
GCVVSWKNKE

SEQ ID NO: 38960 - protein, 10 aa, Dengue virus
CVVSWKNKEL

SEQ ID NO: 38961 - protein, 10 aa, Dengue virus
VVSWKNKELK

SEQ ID NO: 38962 - protein, 10 aa, Dengue virus
VSWKNKELKC

SEQ ID NO: 38963 - protein, 10 aa, Dengue virus
SWKNKELKCG

SEQ ID NO: 38964 - protein, 10 aa, Dengue virus
WKNKELKCGS

SEQ ID NO: 38965 - protein, 10 aa, Dengue virus
KNKELKCGSG

SEQ ID NO: 38966 - protein, 10 aa, Dengue virus
NKELKCGSGI

SEQ ID NO: 38967 - protein, 10 aa, Dengue virus
KELKCGSGIF

SEQ ID NO: 38968 - protein, 10 aa, Dengue virus
ELKCGSGIFI

SEQ ID NO: 38969 - protein, 10 aa, Dengue virus
LKCGSGIFIT

SEQ ID NO: 38970 - protein, 10 aa, Dengue virus
KCGSGIFITD

SEQ ID NO: 38971 - protein, 10 aa, Dengue virus
CGSGIFITDN

SEQ ID NO: 38972 - protein, 10 aa, Dengue virus
GSGIFITDNV

SEQ ID NO: 38973 - protein, 10 aa, Dengue virus
SGIFITDNVH

SEQ ID NO: 38974 - protein, 10 aa, Dengue virus
GIFITDNVHT

SEQ ID NO: 38975 - protein, 10 aa, Dengue virus
IFITDNVHTW

SEQ ID NO: 38976 - protein, 10 aa, Dengue virus
FITDNVHTWT

SEQ ID NO: 38977 - protein, 10 aa, Dengue virus
ITDNVHTWTE

SEQ ID NO: 38978 - protein, 10 aa, Dengue virus
TDNVHTWTEQ

SEQ ID NO: 38979 - protein, 10 aa, Dengue virus
DNVHTWTEQY

SEQ ID NO: 38980 - protein, 10 aa, Dengue virus
NVHTWTEQYK

SEQ ID NO: 38981 - protein, 10 aa, Dengue virus
VHTWTEQYKF

SEQ ID NO: 38982 - protein, 10 aa, Dengue virus
HTWTEQYKFQ

SEQ ID NO: 38983 - protein, 10 aa, Dengue virus
TWTEQYKFQP

SEQ ID NO: 38984 - protein, 10 aa, Dengue virus
WTEQYKFQPE

SEQ ID NO: 38985 - protein, 10 aa, Dengue virus
TEQYKFQPES

SEQ ID NO: 38986 - protein, 10 aa, Dengue virus
EQYKFQPESP

SEQ ID NO: 38987 - protein, 10 aa, Dengue virus
QYKFQPESPS

SEQ ID NO: 38988 - protein, 10 aa, Dengue virus
YKFQPESPSK

SEQ ID NO: 38989 - protein, 10 aa, Dengue virus
KFQPESPSKL

SEQ ID NO: 38990 - protein, 10 aa, Dengue virus
FQPESPSKLA

SEQ ID NO: 38991 - protein, 10 aa, Dengue virus
QPESPSKLAS

SEQ ID NO: 38992 - protein, 10 aa, Dengue virus
PESPSKLASA

SEQ ID NO: 38993 - protein, 10 aa, Dengue virus
ESPSKLASAI

SEQ ID NO: 38994 - protein, 10 aa, Dengue virus
SPSKLASAIQ

SEQ ID NO: 38995 - protein, 10 aa, Dengue virus
PSKLASAIQK

SEQ ID NO: 38996 - protein, 10 aa, Dengue virus
SKLASAIQKA

SEQ ID NO: 38997 - protein, 10 aa, Dengue virus
KLASAIQKAH

SEQ ID NO: 38998 - protein, 10 aa, Dengue virus
LASAIQKAHE

SEQ ID NO: 38999 - protein, 10 aa, Dengue virus
ASAIQKAHEE

SEQ ID NO: 39000 - protein, 10 aa, Dengue virus
SAIQKAHEEG

SEQ ID NO: 39001 - protein, 10 aa, Dengue virus
AIQKAHEEGI

SEQ ID NO: 39002 - protein, 10 aa, Dengue virus
IQKAHEEGIC

SEQ ID NO: 39003 - protein, 10 aa, Dengue virus
QKAHEEGICG

SEQ ID NO: 39004 - protein, 10 aa, Dengue virus
KAHEEGICGI

SEQ ID NO: 39005 - protein, 10 aa, Dengue virus
AHEEGICGIR

SEQ ID NO: 39006 - protein, 10 aa, Dengue virus
HEEGICGIRS

SEQ ID NO: 39007 - protein, 10 aa, Dengue virus
EEGICGIRSV

SEQ ID NO: 39008 - protein, 10 aa, Dengue virus
EGICGIRSVT

SEQ ID NO: 39009 - protein, 10 aa, Dengue virus
GICGIRSVTR

SEQ ID NO: 39010 - protein, 10 aa, Dengue virus
ICGIRSVTRL

SEQ ID NO: 39011 - protein, 10 aa, Dengue virus
CGIRSVTRLE

SEQ ID NO: 39012 - protein, 10 aa, Dengue virus
GIRSVTRLEN

SEQ ID NO: 39013 - protein, 10 aa, Dengue virus
IRSVTRLENL

SEQ ID NO: 39014 - protein, 10 aa, Dengue virus
RSVTRLENLM

SEQ ID NO: 39015 - protein, 10 aa, Dengue virus
SVTRLENLMW

SEQ ID NO: 39016 - protein, 10 aa, Dengue virus
VTRLENLMWK

SEQ ID NO: 39017 - protein, 10 aa, Dengue virus
TRLENLMWKQ

SEQ ID NO: 39018 - protein, 10 aa, Dengue virus
RLENLMWKQI

SEQ ID NO: 39019 - protein, 10 aa, Dengue virus
LENLMWKQIT

SEQ ID NO: 39020 - protein, 10 aa, Dengue virus
ENLMWKQITP

SEQ ID NO: 39021 - protein, 10 aa, Dengue virus
NLMWKQITPE

SEQ ID NO: 39022 - protein, 10 aa, Dengue virus
LMWKQITPEL

SEQ ID NO: 39023 - protein, 10 aa, Dengue virus
MWKQITPELN

SEQ ID NO: 39024 - protein, 10 aa, Dengue virus
WKQITPELNH

SEQ ID NO: 39025 - protein, 10 aa, Dengue virus
KQITPELNHI

SEQ ID NO: 39026 - protein, 10 aa, Dengue virus
QITPELNHIL

SEQ ID NO: 39027 - protein, 10 aa, Dengue virus
ITPELNHILS

SEQ ID NO: 39028 - protein, 10 aa, Dengue virus
TPELNHILSE

SEQ ID NO: 39029 - protein, 10 aa, Dengue virus
PELNHILSEN

SEQ ID NO: 39030 - protein, 10 aa, Dengue virus
ELNHILSENE

SEQ ID NO: 39031 - protein, 10 aa, Dengue virus
LNHILSENEV

SEQ ID NO: 39032 - protein, 10 aa, Dengue virus
NHILSENEVK

SEQ ID NO: 39033 - protein, 10 aa, Dengue virus
HILSENEVKL

SEQ ID NO: 39034 - protein, 10 aa, Dengue virus
ILSENEVKLT

SEQ ID NO: 39035 - protein, 10 aa, Dengue virus
LSENEVKLTI

SEQ ID NO: 39036 - protein, 10 aa, Dengue virus
SENEVKLTIM

SEQ ID NO: 39037 - protein, 10 aa, Dengue virus
ENEVKLTIMT

SEQ ID NO: 39038 - protein, 10 aa, Dengue virus
NEVKLTIMTG

SEQ ID NO: 39039 - protein, 10 aa, Dengue virus
EVKLTIMTGD

SEQ ID NO: 39040 - protein, 10 aa, Dengue virus
VKLTIMTGDI

SEQ ID NO: 39041 - protein, 10 aa, Dengue virus
KLTIMTGDIK

SEQ ID NO: 39042 - protein, 10 aa, Dengue virus
LTIMTGDIKG

SEQ ID NO: 39043 - protein, 10 aa, Dengue virus
TIMTGDIKGI

SEQ ID NO: 39044 - protein, 10 aa, Dengue virus
IMTGDIKGIM

SEQ ID NO: 39045 - protein, 10 aa, Dengue virus
MTGDIKGIMQ

SEQ ID NO: 39046 - protein, 10 aa, Dengue virus
GIMQAGKRSL

SEQ ID NO: 39047 - protein, 10 aa, Dengue virus
GKRSLRPQPT

SEQ ID NO: 39048 - protein, 10 aa, Dengue virus
RSLRPQPTEL

SEQ ID NO: 39049 - protein, 10 aa, Dengue virus
LRPQPTELKY

SEQ ID NO: 39050 - protein, 10 aa, Dengue virus
RPQPTELKYS

SEQ ID NO: 39051 - protein, 10 aa, Dengue virus
PQPTELKYSW

SEQ ID NO: 39052 - protein, 10 aa, Dengue virus
QPTELKYSWK

SEQ ID NO: 39053 - protein, 10 aa, Dengue virus
PTELKYSWKT

SEQ ID NO: 39054 - protein, 10 aa, Dengue virus
TELKYSWKTW

SEQ ID NO: 39055 - protein, 10 aa, Dengue virus
ELKYSWKTWG

SEQ ID NO: 39056 - protein, 10 aa, Dengue virus
LKYSWKTWGK

SEQ ID NO: 39057 - protein, 10 aa, Dengue virus
KYSWKTWGKA

SEQ ID NO: 39058 - protein, 10 aa, Dengue virus
YSWKTWGKAK

SEQ ID NO: 39059 - protein, 10 aa, Dengue virus
SWKTWGKAKM

SEQ ID NO: 39060 - protein, 10 aa, Dengue virus
WKTWGKAKML

SEQ ID NO: 39061 - protein, 10 aa, Dengue virus
WGKAKMLSTE

SEQ ID NO: 39062 - protein, 10 aa, Dengue virus
HNQTFLIDGP

SEQ ID NO: 39063 - protein, 10 aa, Dengue virus
NQTFLIDGPE

SEQ ID NO: 39064 - protein, 10 aa, Dengue virus
QTFLIDGPET

SEQ ID NO: 39065 - protein, 10 aa, Dengue virus
TFLIDGPETA

SEQ ID NO: 39066 - protein, 10 aa, Dengue virus
FLIDGPETAE

SEQ ID NO: 39067 - protein, 10 aa, Dengue virus
LIDGPETAEC

SEQ ID NO: 39068 - protein, 10 aa, Dengue virus
IDGPETAECP

SEQ ID NO: 39069 - protein, 10 aa, Dengue virus
DGPETAECPN

SEQ ID NO: 39070 - protein, 10 aa, Dengue virus
TAECPNTNRA

SEQ ID NO: 39071 - protein, 10 aa, Dengue virus
AECPNTNRAW

SEQ ID NO: 39072 - protein, 10 aa, Dengue virus
ECPNTNRAWN

SEQ ID NO: 39073 - protein, 10 aa, Dengue virus
CPNTNRAWNS

SEQ ID NO: 39074 - protein, 10 aa, Dengue virus
PNTNRAWNSL

SEQ ID NO: 39075 - protein, 10 aa, Dengue virus
NTNRAWNSLE

SEQ ID NO: 39076 - protein, 10 aa, Dengue virus
TNRAWNSLEV

SEQ ID NO: 39077 - protein, 10 aa, Dengue virus
NRAWNSLEVE

SEQ ID NO: 39078 - protein, 10 aa, Dengue virus
RAWNSLEVED

SEQ ID NO: 39079 - protein, 10 aa, Dengue virus
AWNSLEVEDY

SEQ ID NO: 39080 - protein, 10 aa, Dengue virus
WNSLEVEDYG

SEQ ID NO: 39081 - protein, 10 aa, Dengue virus
NSLEVEDYGF

SEQ ID NO: 39082 - protein, 10 aa, Dengue virus
SLEVEDYGFG

SEQ ID NO: 39083 - protein, 10 aa, Dengue virus
LEVEDYGFGV

SEQ ID NO: 39084 - protein, 10 aa, Dengue virus
EVEDYGFGVF

SEQ ID NO: 39085 - protein, 10 aa, Dengue virus
VEDYGFGVFT

SEQ ID NO: 39086 - protein, 10 aa, Dengue virus
EDYGFGVFTT

SEQ ID NO: 39087 - protein, 10 aa, Dengue virus
DYGFGVFTTN

SEQ ID NO: 39088 - protein, 10 aa, Dengue virus
YGFGVFTTNI

SEQ ID NO: 39089 - protein, 10 aa, Dengue virus
GFGVFTTNIW

SEQ ID NO: 39090 - protein, 10 aa, Dengue virus
FGVFTTNIWL

SEQ ID NO: 39091 - protein, 10 aa, Dengue virus
GVFTTNIWLK

SEQ ID NO: 39092 - protein, 10 aa, Dengue virus
VFTTNIWLKL

SEQ ID NO: 39093 - protein, 10 aa, Dengue virus
FTTNIWLKLR

SEQ ID NO: 39094 - protein, 10 aa, Dengue virus
TTNIWLKLRE

SEQ ID NO: 39095 - protein, 10 aa, Dengue virus
TNIWLKLREK

SEQ ID NO: 39096 - protein, 10 aa, Dengue virus
NIWLKLREKQ

SEQ ID NO: 39097 - protein, 10 aa, Dengue virus
IWLKLREKQD

SEQ ID NO: 39098 - protein, 10 aa, Dengue virus
FCDSKLMSAA

SEQ ID NO: 39099 - protein, 10 aa, Dengue virus
CDSKLMSAAI

SEQ ID NO: 39100 - protein, 10 aa, Dengue virus
DSKLMSAAIK

SEQ ID NO: 39101 - protein, 10 aa, Dengue virus
SKLMSAAIKD

SEQ ID NO: 39102 - protein, 10 aa, Dengue virus
KLMSAAIKDN

SEQ ID NO: 39103 - protein, 10 aa, Dengue virus
LMSAAIKDNR

SEQ ID NO: 39104 - protein, 10 aa, Dengue virus
MSAAIKDNRA

SEQ ID NO: 39105 - protein, 10 aa, Dengue virus
SAAIKDNRAV

SEQ ID NO: 39106 - protein, 10 aa, Dengue virus
AAIKDNRAVH

SEQ ID NO: 39107 - protein, 10 aa, Dengue virus
AIKDNRAVHA

SEQ ID NO: 39108 - protein, 10 aa, Dengue virus
IKDNRAVHAD

SEQ ID NO: 39109 - protein, 10 aa, Dengue virus
KDNRAVHADM

SEQ ID NO: 39110 - protein, 10 aa, Dengue virus
DNRAVHADMG

SEQ ID NO: 39111 - protein, 10 aa, Dengue virus
NRAVHADMGY

SEQ ID NO: 39112 - protein, 10 aa, Dengue virus
RAVHADMGYW

SEQ ID NO: 39113 - protein, 10 aa, Dengue virus
AVHADMGYWI

SEQ ID NO: 39114 - protein, 10 aa, Dengue virus
VHADMGYWIE

SEQ ID NO: 39115 - protein, 10 aa, Dengue virus
HADMGYWIES

SEQ ID NO: 39116 - protein, 10 aa, Dengue virus
ADMGYWIESA

SEQ ID NO: 39117 - protein, 10 aa, Dengue virus
DMGYWIESAL

SEQ ID NO: 39118 - protein, 10 aa, Dengue virus
MGYWIESALN

SEQ ID NO: 39119 - protein, 10 aa, Dengue virus
GYWIESALND

SEQ ID NO: 39120 - protein, 10 aa, Dengue virus
YWIESALNDT

SEQ ID NO: 39121 - protein, 10 aa, Dengue virus
WIESALNDTW

SEQ ID NO: 39122 - protein, 10 aa, Dengue virus
IESALNDTWK

SEQ ID NO: 39123 - protein, 10 aa, Dengue virus
ESALNDTWKM

SEQ ID NO: 39124 - protein, 10 aa, Dengue virus
SALNDTWKME

SEQ ID NO: 39125 - protein, 10 aa, Dengue virus
ALNDTWKMEK

SEQ ID NO: 39126 - protein, 10 aa, Dengue virus
LNDTWKMEKA

SEQ ID NO: 39127 - protein, 10 aa, Dengue virus
NDTWKMEKAS

SEQ ID NO: 39128 - protein, 10 aa, Dengue virus
DTWKMEKASF

SEQ ID NO: 39129 - protein, 10 aa, Dengue virus
TWKMEKASFI

SEQ ID NO: 39130 - protein, 10 aa, Dengue virus
WKMEKASFIE

SEQ ID NO: 39131 - protein, 10 aa, Dengue virus
KMEKASFIEV

SEQ ID NO: 39132 - protein, 10 aa, Dengue virus
MEKASFIEVK

SEQ ID NO: 39133 - protein, 10 aa, Dengue virus
EKASFIEVKS

SEQ ID NO: 39134 - protein, 10 aa, Dengue virus
KASFIEVKSC

SEQ ID NO: 39135 - protein, 10 aa, Dengue virus
ASFIEVKSCH

SEQ ID NO: 39136 - protein, 10 aa, Dengue virus
SFIEVKSCHW

SEQ ID NO: 39137 - protein, 10 aa, Dengue virus
FIEVKSCHWP

SEQ ID NO: 39138 - protein, 10 aa, Dengue virus
IEVKSCHWPK

SEQ ID NO: 39139 - protein, 10 aa, Dengue virus
EVKSCHWPKS

SEQ ID NO: 39140 - protein, 10 aa, Dengue virus
VKSCHWPKSH

SEQ ID NO: 39141 - protein, 10 aa, Dengue virus
KSCHWPKSHT

SEQ ID NO: 39142 - protein, 10 aa, Dengue virus
SCHWPKSHTL

SEQ ID NO: 39143 - protein, 10 aa, Dengue virus
CHWPKSHTLW

SEQ ID NO: 39144 - protein, 10 aa, Dengue virus
HWPKSHTLWS

SEQ ID NO: 39145 - protein, 10 aa, Dengue virus
WPKSHTLWSN

SEQ ID NO: 39146 - protein, 10 aa, Dengue virus
PKSHTLWSNG

SEQ ID NO: 39147 - protein, 10 aa, Dengue virus
KSHTLWSNGV

SEQ ID NO: 39148 - protein, 10 aa, Dengue virus
SHTLWSNGVL

SEQ ID NO: 39149 - protein, 10 aa, Dengue virus
HTLWSNGVLE

SEQ ID NO: 39150 - protein, 10 aa, Dengue virus
TLWSNGVLES

SEQ ID NO: 39151 - protein, 10 aa, Dengue virus
LWSNGVLESE

SEQ ID NO: 39152 - protein, 10 aa, Dengue virus
WSNGVLESEM

SEQ ID NO: 39153 - protein, 10 aa, Dengue virus
SNGVLESEMI

SEQ ID NO: 39154 - protein, 10 aa, Dengue virus
NGVLESEMII

SEQ ID NO: 39155 - protein, 10 aa, Dengue virus
GVLESEMIIP

SEQ ID NO: 39156 - protein, 10 aa, Dengue virus
VLESEMIIPK

SEQ ID NO: 39157 - protein, 10 aa, Dengue virus
LESEMIIPKN

SEQ ID NO: 39158 - protein, 10 aa, Dengue virus
IPKNFAGPVS

SEQ ID NO: 39159 - protein, 10 aa, Dengue virus
PKNFAGPVSQ

SEQ ID NO: 39160 - protein, 10 aa, Dengue virus
KNFAGPVSQH

SEQ ID NO: 39161 - protein, 10 aa, Dengue virus
NFAGPVSQHN

SEQ ID NO: 39162 - protein, 10 aa, Dengue virus
FAGPVSQHNY

SEQ ID NO: 39163 - protein, 10 aa, Dengue virus
AGPVSQHNYR

SEQ ID NO: 39164 - protein, 10 aa, Dengue virus
GPVSQHNYRP

SEQ ID NO: 39165 - protein, 10 aa, Dengue virus
PVSQHNYRPG

SEQ ID NO: 39166 - protein, 10 aa, Dengue virus
VSQHNYRPGY

SEQ ID NO: 39167 - protein, 10 aa, Dengue virus
SQHNYRPGYH

SEQ ID NO: 39168 - protein, 10 aa, Dengue virus
QHNYRPGYHT

SEQ ID NO: 39169 - protein, 10 aa, Dengue virus
HNYRPGYHTQ

SEQ ID NO: 39170 - protein, 10 aa, Dengue virus
RPGYHTQTAG

SEQ ID NO: 39171 - protein, 10 aa, Dengue virus
PGYHTQTAGP

SEQ ID NO: 39172 - protein, 10 aa, Dengue virus
GYHTQTAGPW

SEQ ID NO: 39173 - protein, 10 aa, Dengue virus
YHTQTAGPWH

SEQ ID NO: 39174 - protein, 10 aa, Dengue virus
HTQTAGPWHL

SEQ ID NO: 39175 - protein, 10 aa, Dengue virus
TQTAGPWHLG

SEQ ID NO: 39176 - protein, 10 aa, Dengue virus
QTAGPWHLGK

SEQ ID NO: 39177 - protein, 10 aa, Dengue virus
TAGPWHLGKL

SEQ ID NO: 39178 - protein, 10 aa, Dengue virus
AGPWHLGKLE

SEQ ID NO: 39179 - protein, 10 aa, Dengue virus
GPWHLGKLEM

SEQ ID NO: 39180 - protein, 10 aa, Dengue virus
PWHLGKLEMD

SEQ ID NO: 39181 - protein, 10 aa, Dengue virus
WHLGKLEMDF

SEQ ID NO: 39182 - protein, 10 aa, Dengue virus
HLGKLEMDFD

SEQ ID NO: 39183 - protein, 10 aa, Dengue virus
LGKLEMDFDF

SEQ ID NO: 39184 - protein, 10 aa, Dengue virus
GKLEMDFDFC

SEQ ID NO: 39185 - protein, 10 aa, Dengue virus
LEMDFDFCEG

SEQ ID NO: 39186 - protein, 10 aa, Dengue virus
EMDFDFCEGT

SEQ ID NO: 39187 - protein, 10 aa, Dengue virus
MDFDFCEGTT

SEQ ID NO: 39188 - protein, 10 aa, Dengue virus
DFDFCEGTTV

SEQ ID NO: 39189 - protein, 10 aa, Dengue virus
FCEGTTVVVT

SEQ ID NO: 39190 - protein, 10 aa, Dengue virus
CEGTTVVVTE

SEQ ID NO: 39191 - protein, 10 aa, Dengue virus
EGTTVVVTED

SEQ ID NO: 39192 - protein, 10 aa, Dengue virus
GTTVVVTEDC

SEQ ID NO: 39193 - protein, 10 aa, Dengue virus
TTVVVTEDCG

SEQ ID NO: 39194 - protein, 10 aa, Dengue virus
TVVVTEDCGN

SEQ ID NO: 39195 - protein, 10 aa, Dengue virus
VVVTEDCGNR

SEQ ID NO: 39196 - protein, 10 aa, Dengue virus
VVTEDCGNRG

SEQ ID NO: 39197 - protein, 10 aa, Dengue virus
VTEDCGNRGP

SEQ ID NO: 39198 - protein, 10 aa, Dengue virus
TEDCGNRGPS

SEQ ID NO: 39199 - protein, 10 aa, Dengue virus
EDCGNRGPSL

SEQ ID NO: 39200 - protein, 10 aa, Dengue virus
DCGNRGPSLR

SEQ ID NO: 39201 - protein, 10 aa, Dengue virus
CGNRGPSLRT

SEQ ID NO: 39202 - protein, 10 aa, Dengue virus
GNRGPSLRTT

SEQ ID NO: 39203 - protein, 10 aa, Dengue virus
NRGPSLRTTT

SEQ ID NO: 39204 - protein, 10 aa, Dengue virus
RGPSLRTTTA

SEQ ID NO: 39205 - protein, 10 aa, Dengue virus
GPSLRTTTAS

SEQ ID NO: 39206 - protein, 10 aa, Dengue virus
PSLRTTTASG

SEQ ID NO: 39207 - protein, 10 aa, Dengue virus
SLRTTTASGK

SEQ ID NO: 39208 - protein, 10 aa, Dengue virus
LRTTTASGKL

SEQ ID NO: 39209 - protein, 10 aa, Dengue virus
RTTTASGKLI

SEQ ID NO: 39210 - protein, 10 aa, Dengue virus
TTTASGKLIT

SEQ ID NO: 39211 - protein, 10 aa, Dengue virus
TTASGKLITE

SEQ ID NO: 39212 - protein, 10 aa, Dengue virus
TASGKLITEW

SEQ ID NO: 39213 - protein, 10 aa, Dengue virus
ASGKLITEWC

SEQ ID NO: 39214 - protein, 10 aa, Dengue virus
SGKLITEWCC

SEQ ID NO: 39215 - protein, 10 aa, Dengue virus
GKLITEWCCR

SEQ ID NO: 39216 - protein, 10 aa, Dengue virus
KLITEWCCRS

SEQ ID NO: 39217 - protein, 10 aa, Dengue virus
LITEWCCRSC

SEQ ID NO: 39218 - protein, 10 aa, Dengue virus
ITEWCCRSCT

SEQ ID NO: 39219 - protein, 10 aa, Dengue virus
TEWCCRSCTL

SEQ ID NO: 39220 - protein, 10 aa, Dengue virus
EWCCRSCTLP

SEQ ID NO: 39221 - protein, 10 aa, Dengue virus
WCCRSCTLPP

SEQ ID NO: 39222 - protein, 10 aa, Dengue virus
CCRSCTLPPL

SEQ ID NO: 39223 - protein, 10 aa, Dengue virus
CRSCTLPPLR

SEQ ID NO: 39224 - protein, 10 aa, Dengue virus
RSCTLPPLRY

SEQ ID NO: 39225 - protein, 10 aa, Dengue virus
SCTLPPLRYR

SEQ ID NO: 39226 - protein, 10 aa, Dengue virus
CTLPPLRYRG

SEQ ID NO: 39227 - protein, 10 aa, Dengue virus
TLPPLRYRGE

SEQ ID NO: 39228 - protein, 10 aa, Dengue virus
LPPLRYRGED

SEQ ID NO: 39229 - protein, 10 aa, Dengue virus
PPLRYRGEDG

SEQ ID NO: 39230 - protein, 10 aa, Dengue virus
PLRYRGEDGC

SEQ ID NO: 39231 - protein, 10 aa, Dengue virus
LRYRGEDGCW

SEQ ID NO: 39232 - protein, 10 aa, Dengue virus
RYRGEDGCWY

SEQ ID NO: 39233 - protein, 10 aa, Dengue virus
YRGEDGCWYG

SEQ ID NO: 39234 - protein, 10 aa, Dengue virus
RGEDGCWYGM

SEQ ID NO: 39235 - protein, 10 aa, Dengue virus
GEDGCWYGME

SEQ ID NO: 39236 - protein, 10 aa, Dengue virus
EDGCWYGMEI

SEQ ID NO: 39237 - protein, 10 aa, Dengue virus
DGCWYGMEIR

SEQ ID NO: 39238 - protein, 10 aa, Dengue virus
GCWYGMEIRP

SEQ ID NO: 39239 - protein, 10 aa, Dengue virus
CWYGMEIRPL

SEQ ID NO: 39240 - protein, 10 aa, Dengue virus
WYGMEIRPLK

SEQ ID NO: 39241 - protein, 10 aa, Dengue virus
YGMEIRPLKE

SEQ ID NO: 39242 - protein, 10 aa, Dengue virus
GMEIRPLKEK

SEQ ID NO: 39243 - protein, 10 aa, Dengue virus
MEIRPLKEKE

SEQ ID NO: 39244 - protein, 10 aa, Dengue virus
EIRPLKEKEE

SEQ ID NO: 39245 - protein, 10 aa, Dengue virus
IRPLKEKEEN

SEQ ID NO: 39246 - protein, 10 aa, Dengue virus
RPLKEKEENL

SEQ ID NO: 39247 - protein, 10 aa, Dengue virus
PLKEKEENLV

SEQ ID NO: 39248 - protein, 10 aa, Dengue virus
LKEKEENLVN

SEQ ID NO: 39249 - protein, 10 aa, Dengue virus
KEKEENLVNS

SEQ ID NO: 39250 - protein, 10 aa, Dengue virus
EKEENLVNSL

SEQ ID NO: 39251 - protein, 10 aa, Dengue virus
KEENLVNSLV

SEQ ID NO: 39252 - protein, 10 aa, Dengue virus
EENLVNSLVT

SEQ ID NO: 39253 - protein, 10 aa, Dengue virus
ENLVNSLVTA

SEQ ID NO: 39254 - protein, 10 aa, Dengue virus
NLVNSLVTAG

SEQ ID NO: 39255 - protein, 10 aa, Dengue virus
LVNSLVTAGH

SEQ ID NO: 39256 - protein, 10 aa, Dengue virus
VNSLVTAGHG

SEQ ID NO: 39257 - protein, 10 aa, Dengue virus
NSLVTAGHGQ

SEQ ID NO: 39258 - protein, 10 aa, Dengue virus
SLVTAGHGQI

SEQ ID NO: 39259 - protein, 10 aa, Dengue virus
LVTAGHGQID

SEQ ID NO: 39260 - protein, 10 aa, Dengue virus
VTAGHGQIDN

SEQ ID NO: 39261 - protein, 10 aa, Dengue virus
TAGHGQIDNF

SEQ ID NO: 39262 - protein, 10 aa, Dengue virus
AGHGQIDNFS

SEQ ID NO: 39263 - protein, 10 aa, Dengue virus
GHGQIDNFSL

SEQ ID NO: 39264 - protein, 10 aa, Dengue virus
HGQIDNFSLG

SEQ ID NO: 39265 - protein, 10 aa, Dengue virus
GQIDNFSLGV

SEQ ID NO: 39266 - protein, 10 aa, Dengue virus
QIDNFSLGVL

SEQ ID NO: 39267 - protein, 10 aa, Dengue virus
IDNFSLGVLG

SEQ ID NO: 39268 - protein, 10 aa, Dengue virus
DNFSLGVLGM

SEQ ID NO: 39269 - protein, 10 aa, Dengue virus
NFSLGVLGMA

SEQ ID NO: 39270 - protein, 10 aa, Dengue virus
FSLGVLGMAL

SEQ ID NO: 39271 - protein, 10 aa, Dengue virus
SLGVLGMALF

SEQ ID NO: 39272 - protein, 10 aa, Dengue virus
LGVLGMALFL

SEQ ID NO: 39273 - protein, 10 aa, Dengue virus
GVLGMALFLE

SEQ ID NO: 39274 - protein, 10 aa, Dengue virus
VLGMALFLEE

SEQ ID NO: 39275 - protein, 10 aa, Dengue virus
LGMALFLEEM

SEQ ID NO: 39276 - protein, 10 aa, Dengue virus
GMALFLEEML

SEQ ID NO: 39277 - protein, 10 aa, Dengue virus
MALFLEEMLR

SEQ ID NO: 39278 - protein, 10 aa, Dengue virus
ALFLEEMLRT

SEQ ID NO: 39279 - protein, 10 aa, Dengue virus
LFLEEMLRTR

SEQ ID NO: 39280 - protein, 10 aa, Dengue virus
FLEEMLRTRV

SEQ ID NO: 39281 - protein, 10 aa, Dengue virus
LEEMLRTRVG

SEQ ID NO: 39282 - protein, 10 aa, Dengue virus
EEMLRTRVGT

SEQ ID NO: 39283 - protein, 10 aa, Dengue virus
EMLRTRVGTK

SEQ ID NO: 39284 - protein, 10 aa, Dengue virus
MLRTRVGTKH

SEQ ID NO: 39285 - protein, 10 aa, Dengue virus
LRTRVGTKHA

SEQ ID NO: 39286 - protein, 10 aa, Dengue virus
SFVTLITGNM

SEQ ID NO: 39287 - protein, 10 aa, Dengue virus
FVTLITGNMS

SEQ ID NO: 39288 - protein, 10 aa, Dengue virus
VTLITGNMSF

SEQ ID NO: 39289 - protein, 10 aa, Dengue virus
TLITGNMSFR

SEQ ID NO: 39290 - protein, 10 aa, Dengue virus
LITGNMSFRD

SEQ ID NO: 39291 - protein, 10 aa, Dengue virus
ITGNMSFRDL

SEQ ID NO: 39292 - protein, 10 aa, Dengue virus
TGNMSFRDLG

SEQ ID NO: 39293 - protein, 10 aa, Dengue virus
GNMSFRDLGR

SEQ ID NO: 39294 - protein, 10 aa, Dengue virus
NMSFRDLGRV

SEQ ID NO: 39295 - protein, 10 aa, Dengue virus
RDLGRVMVMV

SEQ ID NO: 39296 - protein, 10 aa, Dengue virus
DLGRVMVMVG

SEQ ID NO: 39297 - protein, 10 aa, Dengue virus
LGRVMVMVGA

SEQ ID NO: 39298 - protein, 10 aa, Dengue virus
TDDIGMGVTY

SEQ ID NO: 39299 - protein, 10 aa, Dengue virus
DDIGMGVTYL

SEQ ID NO: 39300 - protein, 10 aa, Dengue virus
DIGMGVTYLA

SEQ ID NO: 39301 - protein, 10 aa, Dengue virus
IGMGVTYLAL

SEQ ID NO: 39302 - protein, 10 aa, Dengue virus
GMGVTYLALL

SEQ ID NO: 39303 - protein, 10 aa, Dengue virus
MGVTYLALLA

SEQ ID NO: 39304 - protein, 10 aa, Dengue virus
GVTYLALLAA

SEQ ID NO: 39305 - protein, 10 aa, Dengue virus
VTYLALLAAF

SEQ ID NO: 39306 - protein, 10 aa, Dengue virus
TYLALLAAFK

SEQ ID NO: 39307 - protein, 10 aa, Dengue virus
YLALLAAFKV

SEQ ID NO: 39308 - protein, 10 aa, Dengue virus
LALLAAFKVR

SEQ ID NO: 39309 - protein, 10 aa, Dengue virus
ALLAAFKVRP

SEQ ID NO: 39310 - protein, 10 aa, Dengue virus
LLAAFKVRPT

SEQ ID NO: 39311 - protein, 10 aa, Dengue virus
LAAFKVRPTF

SEQ ID NO: 39312 - protein, 10 aa, Dengue virus
AAFKVRPTFA

SEQ ID NO: 39313 - protein, 10 aa, Dengue virus
AFKVRPTFAA

SEQ ID NO: 39314 - protein, 10 aa, Dengue virus
FKVRPTFAAG

SEQ ID NO: 39315 - protein, 10 aa, Dengue virus
KVRPTFAAGL

SEQ ID NO: 39316 - protein, 10 aa, Dengue virus
VRPTFAAGLL

SEQ ID NO: 39317 - protein, 10 aa, Dengue virus
RPTFAAGLLL

SEQ ID NO: 39318 - protein, 10 aa, Dengue virus
PTFAAGLLLR

SEQ ID NO: 39319 - protein, 10 aa, Dengue virus
TFAAGLLLRK

SEQ ID NO: 39320 - protein, 10 aa, Dengue virus
FAAGLLLRKL

SEQ ID NO: 39321 - protein, 10 aa, Dengue virus
AAGLLLRKLT

SEQ ID NO: 39322 - protein, 10 aa, Dengue virus
AGLLLRKLTS

SEQ ID NO: 39323 - protein, 10 aa, Dengue virus
GLLLRKLTSK

SEQ ID NO: 39324 - protein, 10 aa, Dengue virus
LLLRKLTSKE

SEQ ID NO: 39325 - protein, 10 aa, Dengue virus
LLRKLTSKEL

SEQ ID NO: 39326 - protein, 10 aa, Dengue virus
LRKLTSKELM

SEQ ID NO: 39327 - protein, 10 aa, Dengue virus
RKLTSKELMM

SEQ ID NO: 39328 - protein, 10 aa, Dengue virus
KLTSKELMMA

SEQ ID NO: 39329 - protein, 10 aa, Dengue virus
LTSKELMMAT

SEQ ID NO: 39330 - protein, 10 aa, Dengue virus
TSKELMMATI

SEQ ID NO: 39331 - protein, 10 aa, Dengue virus
SKELMMATIG

SEQ ID NO: 39332 - protein, 10 aa, Dengue virus
KELMMATIGI

SEQ ID NO: 39333 - protein, 10 aa, Dengue virus
TIGIALLSQS

SEQ ID NO: 39334 - protein, 10 aa, Dengue virus
PETILELTDA

SEQ ID NO: 39335 - protein, 10 aa, Dengue virus
TILELTDALA

SEQ ID NO: 39336 - protein, 10 aa, Dengue virus
ILELTDALAL

SEQ ID NO: 39337 - protein, 10 aa, Dengue virus
LELTDALALG

SEQ ID NO: 39338 - protein, 10 aa, Dengue virus
ELTDALALGM

SEQ ID NO: 39339 - protein, 10 aa, Dengue virus
LTDALALGMM

SEQ ID NO: 39340 - protein, 10 aa, Dengue virus
TDALALGMMV

SEQ ID NO: 39341 - protein, 10 aa, Dengue virus
DALALGMMVL

SEQ ID NO: 39342 - protein, 10 aa, Dengue virus
ALALGMMVLK

SEQ ID NO: 39343 - protein, 10 aa, Dengue virus
NMEKYQLAVT

SEQ ID NO: 39344 - protein, 10 aa, Dengue virus
MEKYQLAVTI

SEQ ID NO: 39345 - protein, 10 aa, Dengue virus
EKYQLAVTIM

SEQ ID NO: 39346 - protein, 10 aa, Dengue virus
KYQLAVTIMA

SEQ ID NO: 39347 - protein, 10 aa, Dengue virus
ISCVPNAVIL

SEQ ID NO: 39348 - protein, 10 aa, Dengue virus
CVPNAVILQN

SEQ ID NO: 39349 - protein, 10 aa, Dengue virus
VPNAVILQNA

SEQ ID NO: 39350 - protein, 10 aa, Dengue virus
PNAVILQNAW

SEQ ID NO: 39351 - protein, 10 aa, Dengue virus
AWKVSCTILA

SEQ ID NO: 39352 - protein, 10 aa, Dengue virus
ILAAVSVSPL

SEQ ID NO: 39353 - protein, 10 aa, Dengue virus
VSVSPLLLTS

SEQ ID NO: 39354 - protein, 10 aa, Dengue virus
SVSPLLLTSS

SEQ ID NO: 39355 - protein, 10 aa, Dengue virus
VSPLLLTSSQ

SEQ ID NO: 39356 - protein, 10 aa, Dengue virus
SPLLLTSSQQ

SEQ ID NO: 39357 - protein, 10 aa, Dengue virus
PLLLTSSQQK

SEQ ID NO: 39358 - protein, 10 aa, Dengue virus
LTSSQQKADW

SEQ ID NO: 39359 - protein, 10 aa, Dengue virus
TSSQQKADWI

SEQ ID NO: 39360 - protein, 10 aa, Dengue virus
SSQQKADWIP

SEQ ID NO: 39361 - protein, 10 aa, Dengue virus
SQQKADWIPL

SEQ ID NO: 39362 - protein, 10 aa, Dengue virus
QQKADWIPLA

SEQ ID NO: 39363 - protein, 10 aa, Dengue virus
QKADWIPLAL

SEQ ID NO: 39364 - protein, 10 aa, Dengue virus
KADWIPLALT

SEQ ID NO: 39365 - protein, 10 aa, Dengue virus
ADWIPLALTI

SEQ ID NO: 39366 - protein, 10 aa, Dengue virus
DWIPLALTIK

SEQ ID NO: 39367 - protein, 10 aa, Dengue virus
WIPLALTIKG

SEQ ID NO: 39368 - protein, 10 aa, Dengue virus
IPLALTIKGL

SEQ ID NO: 39369 - protein, 10 aa, Dengue virus
PLALTIKGLN

SEQ ID NO: 39370 - protein, 10 aa, Dengue virus
LALTIKGLNP

SEQ ID NO: 39371 - protein, 10 aa, Dengue virus
ALTIKGLNPT

SEQ ID NO: 39372 - protein, 10 aa, Dengue virus
LTIKGLNPTA

SEQ ID NO: 39373 - protein, 10 aa, Dengue virus
TIKGLNPTAI

SEQ ID NO: 39374 - protein, 10 aa, Dengue virus
IKGLNPTAIF

SEQ ID NO: 39375 - protein, 10 aa, Dengue virus
KGLNPTAIFL

SEQ ID NO: 39376 - protein, 10 aa, Dengue virus
GLNPTAIFLT

SEQ ID NO: 39377 - protein, 10 aa, Dengue virus
LNPTAIFLTT

SEQ ID NO: 39378 - protein, 10 aa, Dengue virus
NPTAIFLTTL

SEQ ID NO: 39379 - protein, 10 aa, Dengue virus
PTAIFLTTLS

SEQ ID NO: 39380 - protein, 10 aa, Dengue virus
TAIFLTTLSR

SEQ ID NO: 39381 - protein, 10 aa, Dengue virus
AIFLTTLSRT

SEQ ID NO: 39382 - protein, 10 aa, Dengue virus
IFLTTLSRTS

SEQ ID NO: 39383 - protein, 10 aa, Dengue virus
FLTTLSRTSK

SEQ ID NO: 39384 - protein, 10 aa, Dengue virus
LTTLSRTSKK

SEQ ID NO: 39385 - protein, 10 aa, Dengue virus
TTLSRTSKKR

SEQ ID NO: 39386 - protein, 10 aa, Dengue virus
TLSRTSKKRS

SEQ ID NO: 39387 - protein, 10 aa, Dengue virus
LSRTSKKRSW

SEQ ID NO: 39388 - protein, 10 aa, Dengue virus
SRTSKKRSWP

SEQ ID NO: 39389 - protein, 10 aa, Dengue virus
RTSKKRSWPL

SEQ ID NO: 39390 - protein, 10 aa, Dengue virus
TSKKRSWPLN

SEQ ID NO: 39391 - protein, 10 aa, Dengue virus
SKKRSWPLNE

SEQ ID NO: 39392 - protein, 10 aa, Dengue virus
KKRSWPLNEA

SEQ ID NO: 39393 - protein, 10 aa, Dengue virus
KRSWPLNEAI

SEQ ID NO: 39394 - protein, 10 aa, Dengue virus
RSWPLNEAIM

SEQ ID NO: 39395 - protein, 10 aa, Dengue virus
SWPLNEAIMA

SEQ ID NO: 39396 - protein, 10 aa, Dengue virus
WPLNEAIMAV

SEQ ID NO: 39397 - protein, 10 aa, Dengue virus
PLNEAIMAVG

SEQ ID NO: 39398 - protein, 10 aa, Dengue virus
LNEAIMAVGM

SEQ ID NO: 39399 - protein, 10 aa, Dengue virus
NEAIMAVGMV

SEQ ID NO: 39400 - protein, 10 aa, Dengue virus
EAIMAVGMVS

SEQ ID NO: 39401 - protein, 10 aa, Dengue virus
AIMAVGMVSI

SEQ ID NO: 39402 - protein, 10 aa, Dengue virus
IMAVGMVSIL

SEQ ID NO: 39403 - protein, 10 aa, Dengue virus
MAVGMVSILA

SEQ ID NO: 39404 - protein, 10 aa, Dengue virus
AVGMVSILAS

SEQ ID NO: 39405 - protein, 10 aa, Dengue virus
VGMVSILASS

SEQ ID NO: 39406 - protein, 10 aa, Dengue virus
GMVSILASSL

SEQ ID NO: 39407 - protein, 10 aa, Dengue virus
MVSILASSLL

SEQ ID NO: 39408 - protein, 10 aa, Dengue virus
VSILASSLLK

SEQ ID NO: 39409 - protein, 10 aa, Dengue virus
SILASSLLKN

SEQ ID NO: 39410 - protein, 10 aa, Dengue virus
ILASSLLKND

SEQ ID NO: 39411 - protein, 10 aa, Dengue virus
LASSLLKNDI

SEQ ID NO: 39412 - protein, 10 aa, Dengue virus
ASSLLKNDIP

SEQ ID NO: 39413 - protein, 10 aa, Dengue virus
SSLLKNDIPM

SEQ ID NO: 39414 - protein, 10 aa, Dengue virus
SLLKNDIPMT

SEQ ID NO: 39415 - protein, 10 aa, Dengue virus
LLKNDIPMTG

SEQ ID NO: 39416 - protein, 10 aa, Dengue virus
LKNDIPMTGP

SEQ ID NO: 39417 - protein, 10 aa, Dengue virus
KNDIPMTGPL

SEQ ID NO: 39418 - protein, 10 aa, Dengue virus
NDIPMTGPLV

SEQ ID NO: 39419 - protein, 10 aa, Dengue virus
DIPMTGPLVA

SEQ ID NO: 39420 - protein, 10 aa, Dengue virus
IPMTGPLVAG

SEQ ID NO: 39421 - protein, 10 aa, Dengue virus
PMTGPLVAGG

SEQ ID NO: 39422 - protein, 10 aa, Dengue virus
MTGPLVAGGL

SEQ ID NO: 39423 - protein, 10 aa, Dengue virus
TGPLVAGGLL

SEQ ID NO: 39424 - protein, 10 aa, Dengue virus
GPLVAGGLLT

SEQ ID NO: 39425 - protein, 10 aa, Dengue virus
PLVAGGLLTV

SEQ ID NO: 39426 - protein, 10 aa, Dengue virus
LVAGGLLTVC

SEQ ID NO: 39427 - protein, 10 aa, Dengue virus
VAGGLLTVCY

SEQ ID NO: 39428 - protein, 10 aa, Dengue virus
AGGLLTVCYV

SEQ ID NO: 39429 - protein, 10 aa, Dengue virus
GGLLTVCYVL

SEQ ID NO: 39430 - protein, 10 aa, Dengue virus
GLLTVCYVLT

SEQ ID NO: 39431 - protein, 10 aa, Dengue virus
LLTVCYVLTG

SEQ ID NO: 39432 - protein, 10 aa, Dengue virus
LTVCYVLTGR

SEQ ID NO: 39433 - protein, 10 aa, Dengue virus
TVCYVLTGRS

SEQ ID NO: 39434 - protein, 10 aa, Dengue virus
VCYVLTGRSA

SEQ ID NO: 39435 - protein, 10 aa, Dengue virus
CYVLTGRSAD

SEQ ID NO: 39436 - protein, 10 aa, Dengue virus
YVLTGRSADL

SEQ ID NO: 39437 - protein, 10 aa, Dengue virus
VLTGRSADLE

SEQ ID NO: 39438 - protein, 10 aa, Dengue virus
LTGRSADLEL

SEQ ID NO: 39439 - protein, 10 aa, Dengue virus
TGRSADLELE

SEQ ID NO: 39440 - protein, 10 aa, Dengue virus
GRSADLELER

SEQ ID NO: 39441 - protein, 10 aa, Dengue virus
RSADLELERA

SEQ ID NO: 39442 - protein, 10 aa, Dengue virus
SADLELERAA

SEQ ID NO: 39443 - protein, 10 aa, Dengue virus
ADLELERAAD

SEQ ID NO: 39444 - protein, 10 aa, Dengue virus
DLELERAADV

SEQ ID NO: 39445 - protein, 10 aa, Dengue virus
VKWEDQAEIS

SEQ ID NO: 39446 - protein, 10 aa, Dengue virus
KWEDQAEISG

SEQ ID NO: 39447 - protein, 10 aa, Dengue virus
WEDQAEISGS

SEQ ID NO: 39448 - protein, 10 aa, Dengue virus
EDQAEISGSS

SEQ ID NO: 39449 - protein, 10 aa, Dengue virus
DQAEISGSSP

SEQ ID NO: 39450 - protein, 10 aa, Dengue virus
QAEISGSSPI

SEQ ID NO: 39451 - protein, 10 aa, Dengue virus
AEISGSSPIL

SEQ ID NO: 39452 - protein, 10 aa, Dengue virus
EISGSSPILS

SEQ ID NO: 39453 - protein, 10 aa, Dengue virus
ISGSSPILSI

SEQ ID NO: 39454 - protein, 10 aa, Dengue virus
SGSSPILSIT

SEQ ID NO: 39455 - protein, 10 aa, Dengue virus
GSSPILSITI

SEQ ID NO: 39456 - protein, 10 aa, Dengue virus
SSPILSITIS

SEQ ID NO: 39457 - protein, 10 aa, Dengue virus
SPILSITISE

SEQ ID NO: 39458 - protein, 10 aa, Dengue virus
PILSITISED

SEQ ID NO: 39459 - protein, 10 aa, Dengue virus
ILSITISEDG

SEQ ID NO: 39460 - protein, 10 aa, Dengue virus
LSITISEDGS

SEQ ID NO: 39461 - protein, 10 aa, Dengue virus
SITISEDGSM

SEQ ID NO: 39462 - protein, 10 aa, Dengue virus
ITISEDGSMS

SEQ ID NO: 39463 - protein, 10 aa, Dengue virus
TISEDGSMSI

SEQ ID NO: 39464 - protein, 10 aa, Dengue virus
ISEDGSMSIK

SEQ ID NO: 39465 - protein, 10 aa, Dengue virus
SEDGSMSIKN

SEQ ID NO: 39466 - protein, 10 aa, Dengue virus
EDGSMSIKNE

SEQ ID NO: 39467 - protein, 10 aa, Dengue virus
DGSMSIKNEE

SEQ ID NO: 39468 - protein, 10 aa, Dengue virus
GSMSIKNEEE

SEQ ID NO: 39469 - protein, 10 aa, Dengue virus
SMSIKNEEEE

SEQ ID NO: 39470 - protein, 10 aa, Dengue virus
MSIKNEEEEQ

SEQ ID NO: 39471 - protein, 10 aa, Dengue virus
SIKNEEEEQT

SEQ ID NO: 39472 - protein, 10 aa, Dengue virus
IKNEEEEQTL

SEQ ID NO: 39473 - protein, 10 aa, Dengue virus
KNEEEEQTLT

SEQ ID NO: 39474 - protein, 10 aa, Dengue virus
NEEEEQTLTI

SEQ ID NO: 39475 - protein, 10 aa, Dengue virus
EEEEQTLTIL

SEQ ID NO: 39476 - protein, 10 aa, Dengue virus
EEEQTLTILI

SEQ ID NO: 39477 - protein, 10 aa, Dengue virus
EEQTLTILIR

SEQ ID NO: 39478 - protein, 10 aa, Dengue virus
EQTLTILIRT

SEQ ID NO: 39479 - protein, 10 aa, Dengue virus
QTLTILIRTG

SEQ ID NO: 39480 - protein, 10 aa, Dengue virus
TLTILIRTGL

SEQ ID NO: 39481 - protein, 10 aa, Dengue virus
LTILIRTGLL

SEQ ID NO: 39482 - protein, 10 aa, Dengue virus
TILIRTGLLV

SEQ ID NO: 39483 - protein, 10 aa, Dengue virus
ILIRTGLLVI

SEQ ID NO: 39484 - protein, 10 aa, Dengue virus
LIRTGLLVIS

SEQ ID NO: 39485 - protein, 10 aa, Dengue virus
IRTGLLVISG

SEQ ID NO: 39486 - protein, 10 aa, Dengue virus
RTGLLVISGL

SEQ ID NO: 39487 - protein, 10 aa, Dengue virus
TGLLVISGLF

SEQ ID NO: 39488 - protein, 10 aa, Dengue virus
GLLVISGLFP

SEQ ID NO: 39489 - protein, 10 aa, Dengue virus
LLVISGVFPV

SEQ ID NO: 39490 - protein, 10 aa, Dengue virus
LVISGVFPVS

SEQ ID NO: 39491 - protein, 10 aa, Dengue virus
VISGVFPVSI

SEQ ID NO: 39492 - protein, 10 aa, Dengue virus
ISGVFPVSIP

SEQ ID NO: 39493 - protein, 10 aa, Dengue virus
SGVFPVSIPI

SEQ ID NO: 39494 - protein, 10 aa, Dengue virus
GVFPVSIPIT

SEQ ID NO: 39495 - protein, 10 aa, Dengue virus
VFPVSIPITA

SEQ ID NO: 39496 - protein, 10 aa, Dengue virus
FPVSIPITAA

SEQ ID NO: 39497 - protein, 10 aa, Dengue virus
PVSIPITAAA

SEQ ID NO: 39498 - protein, 10 aa, Dengue virus
VSIPITAAAW

SEQ ID NO: 39499 - protein, 10 aa, Dengue virus
SIPITAAAWY

SEQ ID NO: 39500 - protein, 10 aa, Dengue virus
IPITAAAWYL

SEQ ID NO: 39501 - protein, 10 aa, Dengue virus
PITAAAWYLW

SEQ ID NO: 39502 - protein, 10 aa, Dengue virus
ITAAAWYLWE

SEQ ID NO: 39503 - protein, 10 aa, Dengue virus
TAAAWYLWEV

SEQ ID NO: 39504 - protein, 10 aa, Dengue virus
AAAWYLWEVK

SEQ ID NO: 39505 - protein, 10 aa, Dengue virus
AAWYLWEVKK

SEQ ID NO: 39506 - protein, 10 aa, Dengue virus
AWYLWEVKKQ

SEQ ID NO: 39507 - protein, 10 aa, Dengue virus
WYLWEVKKQR

SEQ ID NO: 39508 - protein, 10 aa, Dengue virus
YLWEVKKQRA

SEQ ID NO: 39509 - protein, 10 aa, Dengue virus
LWEVKKQRAG

SEQ ID NO: 39510 - protein, 10 aa, Dengue virus
WEVKKQRAGV

SEQ ID NO: 39511 - protein, 10 aa, Dengue virus
EVKKQRAGVL

SEQ ID NO: 39512 - protein, 10 aa, Dengue virus
VKKQRAGVLW

SEQ ID NO: 39513 - protein, 10 aa, Dengue virus
KKQRAGVLWD

SEQ ID NO: 39514 - protein, 10 aa, Dengue virus
KQRAGVLWDV

SEQ ID NO: 39515 - protein, 10 aa, Dengue virus
QRAGVLWDVP

SEQ ID NO: 39516 - protein, 10 aa, Dengue virus
RAGVLWDVPS

SEQ ID NO: 39517 - protein, 10 aa, Dengue virus
AGVLWDVPSP

SEQ ID NO: 39518 - protein, 10 aa, Dengue virus
GVLWDVPSPP

SEQ ID NO: 39519 - protein, 10 aa, Dengue virus
VLWDVPSPPP

SEQ ID NO: 39520 - protein, 10 aa, Dengue virus
LWDVPSPPPV

SEQ ID NO: 39521 - protein, 10 aa, Dengue virus
WDVPSPPPVG

SEQ ID NO: 39522 - protein, 10 aa, Dengue virus
GKAELEDGAY

SEQ ID NO: 39523 - protein, 10 aa, Dengue virus
KAELEDGAYR

SEQ ID NO: 39524 - protein, 10 aa, Dengue virus
AELEDGAYRI

SEQ ID NO: 39525 - protein, 10 aa, Dengue virus
ELEDGAYRIK

SEQ ID NO: 39526 - protein, 10 aa, Dengue virus
LEDGAYRIKQ

SEQ ID NO: 39527 - protein, 10 aa, Dengue virus
EDGAYRIKQR

SEQ ID NO: 39528 - protein, 10 aa, Dengue virus
DGAYRIKQRG

SEQ ID NO: 39529 - protein, 10 aa, Dengue virus
GAYRIKQRGI

SEQ ID NO: 39530 - protein, 10 aa, Dengue virus
AYRIKQKGIL

SEQ ID NO: 39531 - protein, 10 aa, Dengue virus
YRIKQKGILG

SEQ ID NO: 39532 - protein, 10 aa, Dengue virus
RIKQKGILGY

SEQ ID NO: 39533 - protein, 10 aa, Dengue virus
IKQKGILGYS

SEQ ID NO: 39534 - protein, 10 aa, Dengue virus
KQKGILGYSQ

SEQ ID NO: 39535 - protein, 10 aa, Dengue virus
QKGILGYSQI

SEQ ID NO: 39536 - protein, 10 aa, Dengue virus
KGILGYSQIG

SEQ ID NO: 39537 - protein, 10 aa, Dengue virus
GILGYSQIGA

SEQ ID NO: 39538 - protein, 10 aa, Dengue virus
ILGYSQIGAG

SEQ ID NO: 39539 - protein, 10 aa, Dengue virus
LGYSQIGAGV

SEQ ID NO: 39540 - protein, 10 aa, Dengue virus
GYSQIGAGVY

SEQ ID NO: 39541 - protein, 10 aa, Dengue virus
YSQIGAGVYK

SEQ ID NO: 39542 - protein, 10 aa, Dengue virus
SQIGAGVYKE

SEQ ID NO: 39543 - protein, 10 aa, Dengue virus
QIGAGVYKEG

SEQ ID NO: 39544 - protein, 10 aa, Dengue virus
IGAGVYKEGT

SEQ ID NO: 39545 - protein, 10 aa, Dengue virus
GAGVYKEGTF

SEQ ID NO: 39546 - protein, 10 aa, Dengue virus
AGVYKEGTFH

SEQ ID NO: 39547 - protein, 10 aa, Dengue virus
GVYKEGTFHT

SEQ ID NO: 39548 - protein, 10 aa, Dengue virus
VYKEGTFHTM

SEQ ID NO: 39549 - protein, 10 aa, Dengue virus
YKEGTFHTMW

SEQ ID NO: 39550 - protein, 10 aa, Dengue virus
KEGTFHTMWH

SEQ ID NO: 39551 - protein, 10 aa, Dengue virus
EGTFHTMWHV

SEQ ID NO: 39552 - protein, 10 aa, Dengue virus
GTFHTMWHVT

SEQ ID NO: 39553 - protein, 10 aa, Dengue virus
TFHTMWHVTR

SEQ ID NO: 39554 - protein, 10 aa, Dengue virus
FHTMWHVTRG

SEQ ID NO: 39555 - protein, 10 aa, Dengue virus
HTMWHVTRGA

SEQ ID NO: 39556 - protein, 10 aa, Dengue virus
TMWHVTRGAV

SEQ ID NO: 39557 - protein, 10 aa, Dengue virus
MWHVTRGAVL

SEQ ID NO: 39558 - protein, 10 aa, Dengue virus
WHVTRGAVLM

SEQ ID NO: 39559 - protein, 10 aa, Dengue virus
HVTRGAVLMH

SEQ ID NO: 39560 - protein, 10 aa, Dengue virus
VTRGAVLMHR

SEQ ID NO: 39561 - protein, 10 aa, Dengue virus
TRGAVLMHRG

SEQ ID NO: 39562 - protein, 10 aa, Dengue virus
RGAVLMHRGK

SEQ ID NO: 39563 - protein, 10 aa, Dengue virus
GAVLMHRGKR

SEQ ID NO: 39564 - protein, 10 aa, Dengue virus
AVLMHRGKRI

SEQ ID NO: 39565 - protein, 10 aa, Dengue virus
VLMHRGKRIE

SEQ ID NO: 39566 - protein, 10 aa, Dengue virus
LMHRGKRIEP

SEQ ID NO: 39567 - protein, 10 aa, Dengue virus
MHRGKRIEPS

SEQ ID NO: 39568 - protein, 10 aa, Dengue virus
HRGKRIEPSW

SEQ ID NO: 39569 - protein, 10 aa, Dengue virus
RGKRIEPSWA

SEQ ID NO: 39570 - protein, 10 aa, Dengue virus
GKRIEPSWAD

SEQ ID NO: 39571 - protein, 10 aa, Dengue virus
KRIEPSWADV

SEQ ID NO: 39572 - protein, 10 aa, Dengue virus
RIEPSWADVK

SEQ ID NO: 39573 - protein, 10 aa, Dengue virus
IEPSWADVKK

SEQ ID NO: 39574 - protein, 10 aa, Dengue virus
EPSWADVKKD

SEQ ID NO: 39575 - protein, 10 aa, Dengue virus
PSWADVKKDL

SEQ ID NO: 39576 - protein, 10 aa, Dengue virus
SWADVKKDLI

SEQ ID NO: 39577 - protein, 10 aa, Dengue virus
WADVKKDLIS

SEQ ID NO: 39578 - protein, 10 aa, Dengue virus
ADVKKDLISY

SEQ ID NO: 39579 - protein, 10 aa, Dengue virus
DVKKDLISYG

SEQ ID NO: 39580 - protein, 10 aa, Dengue virus
VKKDLISYGG

SEQ ID NO: 39581 - protein, 10 aa, Dengue virus
KKDLISYGGG

SEQ ID NO: 39582 - protein, 10 aa, Dengue virus
KDLISYGGGW

SEQ ID NO: 39583 - protein, 10 aa, Dengue virus
DLISYGGGWK

SEQ ID NO: 39584 - protein, 10 aa, Dengue virus
LISYGGGWKL

SEQ ID NO: 39585 - protein, 10 aa, Dengue virus
ISYGGGWKLE

SEQ ID NO: 39586 - protein, 10 aa, Dengue virus
SYGGGWKLEG

SEQ ID NO: 39587 - protein, 10 aa, Dengue virus
YGGGWKLEGE

SEQ ID NO: 39588 - protein, 10 aa, Dengue virus
GGGWKLEGEW

SEQ ID NO: 39589 - protein, 10 aa, Dengue virus
GGWKLEGEWK

SEQ ID NO: 39590 - protein, 10 aa, Dengue virus
GWKLEGEWKE

SEQ ID NO: 39591 - protein, 10 aa, Dengue virus
WKLEGEWKEG

SEQ ID NO: 39592 - protein, 10 aa, Dengue virus
KLEGEWKEGE

SEQ ID NO: 39593 - protein, 10 aa, Dengue virus
LEGEWKEGEE

SEQ ID NO: 39594 - protein, 10 aa, Dengue virus
EGEWKEGEEV

SEQ ID NO: 39595 - protein, 10 aa, Dengue virus
GEWKEGEEVQ

SEQ ID NO: 39596 - protein, 10 aa, Dengue virus
EWKEGEEVQV

SEQ ID NO: 39597 - protein, 10 aa, Dengue virus
WKEGEEVQVL

SEQ ID NO: 39598 - protein, 10 aa, Dengue virus
KEGEEVQVLA

SEQ ID NO: 39599 - protein, 10 aa, Dengue virus
EGEEVQVLAL

SEQ ID NO: 39600 - protein, 10 aa, Dengue virus
GEEVQVLALE

SEQ ID NO: 39601 - protein, 10 aa, Dengue virus
EEVQVLALEP

SEQ ID NO: 39602 - protein, 10 aa, Dengue virus
EVQVLALEPG

SEQ ID NO: 39603 - protein, 10 aa, Dengue virus
VQVLALEPGK

SEQ ID NO: 39604 - protein, 10 aa, Dengue virus
QVLALEPGKN

SEQ ID NO: 39605 - protein, 10 aa, Dengue virus
VLALEPGKNP

SEQ ID NO: 39606 - protein, 10 aa, Dengue virus
LALEPGKNPR

SEQ ID NO: 39607 - protein, 10 aa, Dengue virus
ALEPGKNPRA

SEQ ID NO: 39608 - protein, 10 aa, Dengue virus
LEPGKNPRAV

SEQ ID NO: 39609 - protein, 10 aa, Dengue virus
EPGKNPRAVQ

SEQ ID NO: 39610 - protein, 10 aa, Dengue virus
PGKNPRAVQT

SEQ ID NO: 39611 - protein, 10 aa, Dengue virus
GKNPRAVQTK

SEQ ID NO: 39612 - protein, 10 aa, Dengue virus
KNPRAVQTKP

SEQ ID NO: 39613 - protein, 10 aa, Dengue virus
NPRAVQTKPG

SEQ ID NO: 39614 - protein, 10 aa, Dengue virus
PRAVQTKPGL

SEQ ID NO: 39615 - protein, 10 aa, Dengue virus
RAVQTKPGLF

SEQ ID NO: 39616 - protein, 10 aa, Dengue virus
AVQTKPGLFK

SEQ ID NO: 39617 - protein, 10 aa, Dengue virus
VQTKPGLFKT

SEQ ID NO: 39618 - protein, 10 aa, Dengue virus
QTKPGLFKTN

SEQ ID NO: 39619 - protein, 10 aa, Dengue virus
FKTNTGTIGA

SEQ ID NO: 39620 - protein, 10 aa, Dengue virus
KTNTGTIGAV

SEQ ID NO: 39621 - protein, 10 aa, Dengue virus
TNTGTIGAVS

SEQ ID NO: 39622 - protein, 10 aa, Dengue virus
NTGTIGAVSL

SEQ ID NO: 39623 - protein, 10 aa, Dengue virus
TGTIGAVSLD

SEQ ID NO: 39624 - protein, 10 aa, Dengue virus
GTIGAVSLDF

SEQ ID NO: 39625 - protein, 10 aa, Dengue virus
TIGAVSLDFS

SEQ ID NO: 39626 - protein, 10 aa, Dengue virus
IGAVSLDFSP

SEQ ID NO: 39627 - protein, 10 aa, Dengue virus
GAVSLDFSPG

SEQ ID NO: 39628 - protein, 10 aa, Dengue virus
AVSLDFSPGT

SEQ ID NO: 39629 - protein, 10 aa, Dengue virus
VSLDFSPGTS

SEQ ID NO: 39630 - protein, 10 aa, Dengue virus
SLDFSPGTSG

SEQ ID NO: 39631 - protein, 10 aa, Dengue virus
LDFSPGTSGS

SEQ ID NO: 39632 - protein, 10 aa, Dengue virus
DFSPGTSGSP

SEQ ID NO: 39633 - protein, 10 aa, Dengue virus
FSPGTSGSPI

SEQ ID NO: 39634 - protein, 10 aa, Dengue virus
SPGTSGSPIV

SEQ ID NO: 39635 - protein, 10 aa, Dengue virus
PGTSGSPIVD

SEQ ID NO: 39636 - protein, 10 aa, Dengue virus
GTSGSPIVDR

SEQ ID NO: 39637 - protein, 10 aa, Dengue virus
TSGSPIVDRK

SEQ ID NO: 39638 - protein, 10 aa, Dengue virus
SGSPIVDRKG

SEQ ID NO: 39639 - protein, 10 aa, Dengue virus
GSPIVDRKGK

SEQ ID NO: 39640 - protein, 10 aa, Dengue virus
SPIVDRKGKV

SEQ ID NO: 39641 - protein, 10 aa, Dengue virus
PIVDRKGKVV

SEQ ID NO: 39642 - protein, 10 aa, Dengue virus
IVDRKGKVVG

SEQ ID NO: 39643 - protein, 10 aa, Dengue virus
VDRKGKVVGL

SEQ ID NO: 39644 - protein, 10 aa, Dengue virus
DRKGKVVGLY

SEQ ID NO: 39645 - protein, 10 aa, Dengue virus
RKGKVVGLYG

SEQ ID NO: 39646 - protein, 10 aa, Dengue virus
KGKVVGLYGN

SEQ ID NO: 39647 - protein, 10 aa, Dengue virus
GKVVGLYGNG

SEQ ID NO: 39648 - protein, 10 aa, Dengue virus
KVVGLYGNGV

SEQ ID NO: 39649 - protein, 10 aa, Dengue virus
VVGLYGNGVV

SEQ ID NO: 39650 - protein, 10 aa, Dengue virus
VGLYGNGVVT

SEQ ID NO: 39651 - protein, 10 aa, Dengue virus
GLYGNGVVTR

SEQ ID NO: 39652 - protein, 10 aa, Dengue virus
LYGNGVVTRS

SEQ ID NO: 39653 - protein, 10 aa, Dengue virus
YGNGVVTRSG

SEQ ID NO: 39654 - protein, 10 aa, Dengue virus
GNGVVTRSGA

SEQ ID NO: 39655 - protein, 10 aa, Dengue virus
NGVVTRSGAY

SEQ ID NO: 39656 - protein, 10 aa, Dengue virus
GVVTRSGAYV

SEQ ID NO: 39657 - protein, 10 aa, Dengue virus
VVTRSGAYVS

SEQ ID NO: 39658 - protein, 10 aa, Dengue virus
VTRSGAYVSA

SEQ ID NO: 39659 - protein, 10 aa, Dengue virus
TRSGAYVSAI

SEQ ID NO: 39660 - protein, 10 aa, Dengue virus
RSGAYVSAIA

SEQ ID NO: 39661 - protein, 10 aa, Dengue virus
SGAYVSAIAQ

SEQ ID NO: 39662 - protein, 10 aa, Dengue virus
GAYVSAIAQT

SEQ ID NO: 39663 - protein, 10 aa, Dengue virus
AYVSAIAQTE

SEQ ID NO: 39664 - protein, 10 aa, Dengue virus
YVSAIAQTEK

SEQ ID NO: 39665 - protein, 10 aa, Dengue virus
VSAIAQTEKS

SEQ ID NO: 39666 - protein, 10 aa, Dengue virus
SAIAQTEKSI

SEQ ID NO: 39667 - protein, 10 aa, Dengue virus
AIAQTEKSIE

SEQ ID NO: 39668 - protein, 10 aa, Dengue virus
EDNPEIEDDI

SEQ ID NO: 39669 - protein, 10 aa, Dengue virus
DNPEIEDDIF

SEQ ID NO: 39670 - protein, 10 aa, Dengue virus
NPEIEDDIFR

SEQ ID NO: 39671 - protein, 10 aa, Dengue virus
PEIEDDIFRK

SEQ ID NO: 39672 - protein, 10 aa, Dengue virus
EIEDDIFRKK

SEQ ID NO: 39673 - protein, 10 aa, Dengue virus
IEDDIFRKKR

SEQ ID NO: 39674 - protein, 10 aa, Dengue virus
EDDIFRKKRL

SEQ ID NO: 39675 - protein, 10 aa, Dengue virus
DDIFRKKRLT

SEQ ID NO: 39676 - protein, 10 aa, Dengue virus
DIFRKKRLTI

SEQ ID NO: 39677 - protein, 10 aa, Dengue virus
IFRKKRLTIM

SEQ ID NO: 39678 - protein, 10 aa, Dengue virus
FRKKRLTIMD

SEQ ID NO: 39679 - protein, 10 aa, Dengue virus
RKKRLTIMDL

SEQ ID NO: 39680 - protein, 10 aa, Dengue virus
KKRLTIMDLH

SEQ ID NO: 39681 - protein, 10 aa, Dengue virus
KRLTIMDLHP

SEQ ID NO: 39682 - protein, 10 aa, Dengue virus
RLTIMDLHPG

SEQ ID NO: 39683 - protein, 10 aa, Dengue virus
LTIMDLHPGA

SEQ ID NO: 39684 - protein, 10 aa, Dengue virus
TIMDLHPGAG

SEQ ID NO: 39685 - protein, 10 aa, Dengue virus
IMDLHPGAGK

SEQ ID NO: 39686 - protein, 10 aa, Dengue virus
MDLHPGAGKT

SEQ ID NO: 39687 - protein, 10 aa, Dengue virus
DLHPGAGKTK

SEQ ID NO: 39688 - protein, 10 aa, Dengue virus
LHPGAGKTKR

SEQ ID NO: 39689 - protein, 10 aa, Dengue virus
HPGAGKTKRY

SEQ ID NO: 39690 - protein, 10 aa, Dengue virus
PGAGKTKRYL

SEQ ID NO: 39691 - protein, 10 aa, Dengue virus
GAGKTKRYLP

SEQ ID NO: 39692 - protein, 10 aa, Dengue virus
AGKTKRYLPA

SEQ ID NO: 39693 - protein, 10 aa, Dengue virus
GKTKRYLPAI

SEQ ID NO: 39694 - protein, 10 aa, Dengue virus
KTKRYLPAIV

SEQ ID NO: 39695 - protein, 10 aa, Dengue virus
TKRYLPAIVR

SEQ ID NO: 39696 - protein, 10 aa, Dengue virus
KRYLPAIVRE

SEQ ID NO: 39697 - protein, 10 aa, Dengue virus
RYLPAIVREA

SEQ ID NO: 39698 - protein, 10 aa, Dengue virus
YLPAIVREAI

SEQ ID NO: 39699 - protein, 10 aa, Dengue virus
LPAIVREAIK

SEQ ID NO: 39700 - protein, 10 aa, Dengue virus
PAIVREAIKR

SEQ ID NO: 39701 - protein, 10 aa, Dengue virus
AIVREAIKRG

SEQ ID NO: 39702 - protein, 10 aa, Dengue virus
IVREAIKRGL

SEQ ID NO: 39703 - protein, 10 aa, Dengue virus
VREAIKRGLR

SEQ ID NO: 39704 - protein, 10 aa, Dengue virus
REAIKRGLRT

SEQ ID NO: 39705 - protein, 10 aa, Dengue virus
EAIKRGLRTL

SEQ ID NO: 39706 - protein, 10 aa, Dengue virus
AIKRGLRTLI

SEQ ID NO: 39707 - protein, 10 aa, Dengue virus
IKRGLRTLIL

SEQ ID NO: 39708 - protein, 10 aa, Dengue virus
KRGLRTLILA

SEQ ID NO: 39709 - protein, 10 aa, Dengue virus
RGLRTLILAP

SEQ ID NO: 39710 - protein, 10 aa, Dengue virus
GLRTLILAPT

SEQ ID NO: 39711 - protein, 10 aa, Dengue virus
LRTLILAPTR

SEQ ID NO: 39712 - protein, 10 aa, Dengue virus
RTLILAPTRV

SEQ ID NO: 39713 - protein, 10 aa, Dengue virus
TLILAPTRVV

SEQ ID NO: 39714 - protein, 10 aa, Dengue virus
LILAPTRVVA

SEQ ID NO: 39715 - protein, 10 aa, Dengue virus
ILAPTRVVAA

SEQ ID NO: 39716 - protein, 10 aa, Dengue virus
LAPTRVVAAE

SEQ ID NO: 39717 - protein, 10 aa, Dengue virus
APTRVVAAEM

SEQ ID NO: 39718 - protein, 10 aa, Dengue virus
PTRVVAAEME

SEQ ID NO: 39719 - protein, 10 aa, Dengue virus
TRVVAAEMEE

SEQ ID NO: 39720 - protein, 10 aa, Dengue virus
RVVAAEMEEA

SEQ ID NO: 39721 - protein, 10 aa, Dengue virus
VVAAEMEEAL

SEQ ID NO: 39722 - protein, 10 aa, Dengue virus
VAAEMEEALR

SEQ ID NO: 39723 - protein, 10 aa, Dengue virus
AAEMEEALRG

SEQ ID NO: 39724 - protein, 10 aa, Dengue virus
AEMEEALRGL

SEQ ID NO: 39725 - protein, 10 aa, Dengue virus
EMEEALRGLP

SEQ ID NO: 39726 - protein, 10 aa, Dengue virus
MEEALRGLPI

SEQ ID NO: 39727 - protein, 10 aa, Dengue virus
EEALRGLPIR

SEQ ID NO: 39728 - protein, 10 aa, Dengue virus
EALRGLPIRY

SEQ ID NO: 39729 - protein, 10 aa, Dengue virus
ALRGLPIRYQ

SEQ ID NO: 39730 - protein, 10 aa, Dengue virus
LRGLPIRYQT

SEQ ID NO: 39731 - protein, 10 aa, Dengue virus
RGLPIRYQTP

SEQ ID NO: 39732 - protein, 10 aa, Dengue virus
GLPIRYQTPA

SEQ ID NO: 39733 - protein, 10 aa, Dengue virus
LPIRYQTPAI

SEQ ID NO: 39734 - protein, 10 aa, Dengue virus
PIRYQTPAIR

SEQ ID NO: 39735 - protein, 10 aa, Dengue virus
IRYQTPAIRA

SEQ ID NO: 39736 - protein, 10 aa, Dengue virus
RYQTPAIRAE

SEQ ID NO: 39737 - protein, 10 aa, Dengue virus
YQTPAIRAEH

SEQ ID NO: 39738 - protein, 10 aa, Dengue virus
QTPAIRAEHT

SEQ ID NO: 39739 - protein, 10 aa, Dengue virus
TPAIRAEHTG

SEQ ID NO: 39740 - protein, 10 aa, Dengue virus
PAIRAEHTGR

SEQ ID NO: 39741 - protein, 10 aa, Dengue virus
AIRAEHTGRE

SEQ ID NO: 39742 - protein, 10 aa, Dengue virus
IRAEHTGREI

SEQ ID NO: 39743 - protein, 10 aa, Dengue virus
RAEHTGREIV

SEQ ID NO: 39744 - protein, 10 aa, Dengue virus
AEHTGREIVD

SEQ ID NO: 39745 - protein, 10 aa, Dengue virus
EHTGREIVDL

SEQ ID NO: 39746 - protein, 10 aa, Dengue virus
HTGREIVDLM

SEQ ID NO: 39747 - protein, 10 aa, Dengue virus
TGREIVDLMC

SEQ ID NO: 39748 - protein, 10 aa, Dengue virus
GREIVDLMCH

SEQ ID NO: 39749 - protein, 10 aa, Dengue virus
REIVDLMCHA

SEQ ID NO: 39750 - protein, 10 aa, Dengue virus
EIVDLMCHAT

SEQ ID NO: 39751 - protein, 10 aa, Dengue virus
IVDLMCHATF

SEQ ID NO: 39752 - protein, 10 aa, Dengue virus
VDLMCHATFT

SEQ ID NO: 39753 - protein, 10 aa, Dengue virus
DLMCHATFTM

SEQ ID NO: 39754 - protein, 10 aa, Dengue virus
LMCHATFTMR

SEQ ID NO: 39755 - protein, 10 aa, Dengue virus
MCHATFTMRL

SEQ ID NO: 39756 - protein, 10 aa, Dengue virus
CHATFTMRLL

SEQ ID NO: 39757 - protein, 10 aa, Dengue virus
HATFTMRLLS

SEQ ID NO: 39758 - protein, 10 aa, Dengue virus
ATFTMRLLSP

SEQ ID NO: 39759 - protein, 10 aa, Dengue virus
TFTMRLLSPV

SEQ ID NO: 39760 - protein, 10 aa, Dengue virus
FTMRLLSPVR

SEQ ID NO: 39761 - protein, 10 aa, Dengue virus
TMRLLSPVRV

SEQ ID NO: 39762 - protein, 10 aa, Dengue virus
MRLLSPVRVP

SEQ ID NO: 39763 - protein, 10 aa, Dengue virus
RLLSPVRVPN

SEQ ID NO: 39764 - protein, 10 aa, Dengue virus
LLSPVRVPNY

SEQ ID NO: 39765 - protein, 10 aa, Dengue virus
LSPVRVPNYN

SEQ ID NO: 39766 - protein, 10 aa, Dengue virus
SPVRVPNYNL

SEQ ID NO: 39767 - protein, 10 aa, Dengue virus
PVRVPNYNLI

SEQ ID NO: 39768 - protein, 10 aa, Dengue virus
VRVPNYNLII

SEQ ID NO: 39769 - protein, 10 aa, Dengue virus
RVPNYNLIIM

SEQ ID NO: 39770 - protein, 10 aa, Dengue virus
VPNYNLIIMD

SEQ ID NO: 39771 - protein, 10 aa, Dengue virus
PNYNLIIMDE

SEQ ID NO: 39772 - protein, 10 aa, Dengue virus
NYNLIIMDEA

SEQ ID NO: 39773 - protein, 10 aa, Dengue virus
YNLIIMDEAH

SEQ ID NO: 39774 - protein, 10 aa, Dengue virus
NLIIMDEAHF

SEQ ID NO: 39775 - protein, 10 aa, Dengue virus
LIIMDEAHFT

SEQ ID NO: 39776 - protein, 10 aa, Dengue virus
IIMDEAHFTD

SEQ ID NO: 39777 - protein, 10 aa, Dengue virus
IMDEAHFTDP

SEQ ID NO: 39778 - protein, 10 aa, Dengue virus
MDEAHFTDPA

SEQ ID NO: 39779 - protein, 10 aa, Dengue virus
DEAHFTDPAS

SEQ ID NO: 39780 - protein, 10 aa, Dengue virus
EAHFTDPASI

SEQ ID NO: 39781 - protein, 10 aa, Dengue virus
AHFTDPASIA

SEQ ID NO: 39782 - protein, 10 aa, Dengue virus
HFTDPASIAA

SEQ ID NO: 39783 - protein, 10 aa, Dengue virus
FTDPASIAAR

SEQ ID NO: 39784 - protein, 10 aa, Dengue virus
TDPASIAARG

SEQ ID NO: 39785 - protein, 10 aa, Dengue virus
DPASIAARGY

SEQ ID NO: 39786 - protein, 10 aa, Dengue virus
PASIAARGYI

SEQ ID NO: 39787 - protein, 10 aa, Dengue virus
ASIAARGYIS

SEQ ID NO: 39788 - protein, 10 aa, Dengue virus
SIAARGYIST

SEQ ID NO: 39789 - protein, 10 aa, Dengue virus
IAARGYISTR

SEQ ID NO: 39790 - protein, 10 aa, Dengue virus
AARGYISTRV

SEQ ID NO: 39791 - protein, 10 aa, Dengue virus
ARGYISTRVE

SEQ ID NO: 39792 - protein, 10 aa, Dengue virus
RGYISTRVEM

SEQ ID NO: 39793 - protein, 10 aa, Dengue virus
GYISTRVEMG

SEQ ID NO: 39794 - protein, 10 aa, Dengue virus
YISTRVEMGE

SEQ ID NO: 39795 - protein, 10 aa, Dengue virus
ISTRVEMGEA

SEQ ID NO: 39796 - protein, 10 aa, Dengue virus
STRVEMGEAA

SEQ ID NO: 39797 - protein, 10 aa, Dengue virus
TRVEMGEAAG

SEQ ID NO: 39798 - protein, 10 aa, Dengue virus
RVEMGEAAGI

SEQ ID NO: 39799 - protein, 10 aa, Dengue virus
VEMGEAAGIF

SEQ ID NO: 39800 - protein, 10 aa, Dengue virus
EMGEAAGIFM

SEQ ID NO: 39801 - protein, 10 aa, Dengue virus
MGEAAGIFMT

SEQ ID NO: 39802 - protein, 10 aa, Dengue virus
GEAAGIFMTA

SEQ ID NO: 39803 - protein, 10 aa, Dengue virus
EAAGIFMTAT

SEQ ID NO: 39804 - protein, 10 aa, Dengue virus
AAGIFMTATP

SEQ ID NO: 39805 - protein, 10 aa, Dengue virus
AGIFMTATPP

SEQ ID NO: 39806 - protein, 10 aa, Dengue virus
GIFMTATPPG

SEQ ID NO: 39807 - protein, 10 aa, Dengue virus
IFMTATPPGS

SEQ ID NO: 39808 - protein, 10 aa, Dengue virus
FMTATPPGSR

SEQ ID NO: 39809 - protein, 10 aa, Dengue virus
MTATPPGSRD

SEQ ID NO: 39810 - protein, 10 aa, Dengue virus
TATPPGSRDP

SEQ ID NO: 39811 - protein, 10 aa, Dengue virus
ATPPGSRDPF

SEQ ID NO: 39812 - protein, 10 aa, Dengue virus
TPPGSRDPFP

SEQ ID NO: 39813 - protein, 10 aa, Dengue virus
PPGSRDPFPQ

SEQ ID NO: 39814 - protein, 10 aa, Dengue virus
PGSRDPFPQS

SEQ ID NO: 39815 - protein, 10 aa, Dengue virus
GSRDPFPQSN

SEQ ID NO: 39816 - protein, 10 aa, Dengue virus
SRDPFPQSNA

SEQ ID NO: 39817 - protein, 10 aa, Dengue virus
RDPFPQSNAP

SEQ ID NO: 39818 - protein, 10 aa, Dengue virus
DPFPQSNAPI

SEQ ID NO: 39819 - protein, 10 aa, Dengue virus
PFPQSNAPIM

SEQ ID NO: 39820 - protein, 10 aa, Dengue virus
FPQSNAPIMD

SEQ ID NO: 39821 - protein, 10 aa, Dengue virus
PQSNAPIMDE

SEQ ID NO: 39822 - protein, 10 aa, Dengue virus
QSNAPIMDEE

SEQ ID NO: 39823 - protein, 10 aa, Dengue virus
SNAPIMDEER

SEQ ID NO: 39824 - protein, 10 aa, Dengue virus
NAPIMDEERE

SEQ ID NO: 39825 - protein, 10 aa, Dengue virus
APIMDEEREI

SEQ ID NO: 39826 - protein, 10 aa, Dengue virus
PIMDEEREIP

SEQ ID NO: 39827 - protein, 10 aa, Dengue virus
IMDEEREIPE

SEQ ID NO: 39828 - protein, 10 aa, Dengue virus
MDEEREIPER

SEQ ID NO: 39829 - protein, 10 aa, Dengue virus
DEEREIPERS

SEQ ID NO: 39830 - protein, 10 aa, Dengue virus
EEREIPERSW

SEQ ID NO: 39831 - protein, 10 aa, Dengue virus
EREIPERSWN

SEQ ID NO: 39832 - protein, 10 aa, Dengue virus
REIPERSWNS

SEQ ID NO: 39833 - protein, 10 aa, Dengue virus
EIPERSWNSG

SEQ ID NO: 39834 - protein, 10 aa, Dengue virus
IPERSWNSGH

SEQ ID NO: 39835 - protein, 10 aa, Dengue virus
PERSWNSGHE

SEQ ID NO: 39836 - protein, 10 aa, Dengue virus
ERSWNSGHEW

SEQ ID NO: 39837 - protein, 10 aa, Dengue virus
RSWNSGHEWV

SEQ ID NO: 39838 - protein, 10 aa, Dengue virus
SWNSGHEWVT

SEQ ID NO: 39839 - protein, 10 aa, Dengue virus
WNSGHEWVTD

SEQ ID NO: 39840 - protein, 10 aa, Dengue virus
NSGHEWVTDF

SEQ ID NO: 39841 - protein, 10 aa, Dengue virus
GHEWVTDFKG

SEQ ID NO: 39842 - protein, 10 aa, Dengue virus
HEWVTDFKGK

SEQ ID NO: 39843 - protein, 10 aa, Dengue virus
EWVTDFKGKT

SEQ ID NO: 39844 - protein, 10 aa, Dengue virus
WVTDFKGKTV

SEQ ID NO: 39845 - protein, 10 aa, Dengue virus
VTDFKGKTVW

SEQ ID NO: 39846 - protein, 10 aa, Dengue virus
TDFKGKTVWF

SEQ ID NO: 39847 - protein, 10 aa, Dengue virus
DFKGKTVWFV

SEQ ID NO: 39848 - protein, 10 aa, Dengue virus
FKGKTVWFVP

SEQ ID NO: 39849 - protein, 10 aa, Dengue virus
KGKTVWFVPS

SEQ ID NO: 39850 - protein, 10 aa, Dengue virus
GKTVWFVPSI

SEQ ID NO: 39851 - protein, 10 aa, Dengue virus
KTVWFVPSIK

SEQ ID NO: 39852 - protein, 10 aa, Dengue virus
TVWFVPSIKA

SEQ ID NO: 39853 - protein, 10 aa, Dengue virus
VWFVPSIKAG

SEQ ID NO: 39854 - protein, 10 aa, Dengue virus
WFVPSIKAGN

SEQ ID NO: 39855 - protein, 10 aa, Dengue virus
FVPSIKAGND

SEQ ID NO: 39856 - protein, 10 aa, Dengue virus
VPSIKAGNDI

SEQ ID NO: 39857 - protein, 10 aa, Dengue virus
PSIKAGNDIA

SEQ ID NO: 39858 - protein, 10 aa, Dengue virus
SIKAGNDIAA

SEQ ID NO: 39859 - protein, 10 aa, Dengue virus
IKAGNDIAAC

SEQ ID NO: 39860 - protein, 10 aa, Dengue virus
KAGNDIAACL

SEQ ID NO: 39861 - protein, 10 aa, Dengue virus
AGNDIAACLR

SEQ ID NO: 39862 - protein, 10 aa, Dengue virus
GNDIAACLRK

SEQ ID NO: 39863 - protein, 10 aa, Dengue virus
NDIAACLRKN

SEQ ID NO: 39864 - protein, 10 aa, Dengue virus
DIAACLRKNG

SEQ ID NO: 39865 - protein, 10 aa, Dengue virus
IAACLRKNGK

SEQ ID NO: 39866 - protein, 10 aa, Dengue virus
AACLRKNGKK

SEQ ID NO: 39867 - protein, 10 aa, Dengue virus
ACLRKNGKKV

SEQ ID NO: 39868 - protein, 10 aa, Dengue virus
CLRKNGKKVI

SEQ ID NO: 39869 - protein, 10 aa, Dengue virus
LRKNGKKVIQ

SEQ ID NO: 39870 - protein, 10 aa, Dengue virus
RKNGKKVIQL

SEQ ID NO: 39871 - protein, 10 aa, Dengue virus
KNGKKVIQLS

SEQ ID NO: 39872 - protein, 10 aa, Dengue virus
NGKKVIQLSR

SEQ ID NO: 39873 - protein, 10 aa, Dengue virus
GKKVIQLSRK

SEQ ID NO: 39874 - protein, 10 aa, Dengue virus
KKVIQLSRKT

SEQ ID NO: 39875 - protein, 10 aa, Dengue virus
KVIQLSRKTF

SEQ ID NO: 39876 - protein, 10 aa, Dengue virus
VIQLSRKTFD

SEQ ID NO: 39877 - protein, 10 aa, Dengue virus
IQLSRKTFDS

SEQ ID NO: 39878 - protein, 10 aa, Dengue virus
QLSRKTFDSE

SEQ ID NO: 39879 - protein, 10 aa, Dengue virus
LSRKTFDSEY

SEQ ID NO: 39880 - protein, 10 aa, Dengue virus
SRKTFDSEYV

SEQ ID NO: 39881 - protein, 10 aa, Dengue virus
RKTFDSEYVK

SEQ ID NO: 39882 - protein, 10 aa, Dengue virus
KTFDSEYVKT

SEQ ID NO: 39883 - protein, 10 aa, Dengue virus
TFDSEYVKTR

SEQ ID NO: 39884 - protein, 10 aa, Dengue virus
KTRTNDWDFV

SEQ ID NO: 39885 - protein, 10 aa, Dengue virus
TRTNDWDFVV

SEQ ID NO: 39886 - protein, 10 aa, Dengue virus
RTNDWDFVVT

SEQ ID NO: 39887 - protein, 10 aa, Dengue virus
TNDWDFVVTT

SEQ ID NO: 39888 - protein, 10 aa, Dengue virus
NDWDFVVTTD

SEQ ID NO: 39889 - protein, 10 aa, Dengue virus
DWDFVVTTDI

SEQ ID NO: 39890 - protein, 10 aa, Dengue virus
WDFVVTTDIS

SEQ ID NO: 39891 - protein, 10 aa, Dengue virus
DFVVTTDISE

SEQ ID NO: 39892 - protein, 10 aa, Dengue virus
FVVTTDISEM

SEQ ID NO: 39893 - protein, 10 aa, Dengue virus
VVTTDISEMG

SEQ ID NO: 39894 - protein, 10 aa, Dengue virus
VTTDISEMGA

SEQ ID NO: 39895 - protein, 10 aa, Dengue virus
TTDISEMGAN

SEQ ID NO: 39896 - protein, 10 aa, Dengue virus
TDISEMGANF

SEQ ID NO: 39897 - protein, 10 aa, Dengue virus
DISEMGANFK

SEQ ID NO: 39898 - protein, 10 aa, Dengue virus
ISEMGANFKA

SEQ ID NO: 39899 - protein, 10 aa, Dengue virus
SEMGANFKAE

SEQ ID NO: 39900 - protein, 10 aa, Dengue virus
EMGANFKAER

SEQ ID NO: 39901 - protein, 10 aa, Dengue virus
MGANFKAERV

SEQ ID NO: 39902 - protein, 10 aa, Dengue virus
GANFKAERVI

SEQ ID NO: 39903 - protein, 10 aa, Dengue virus
ANFKAERVID

SEQ ID NO: 39904 - protein, 10 aa, Dengue virus
NFKAERVIDP

SEQ ID NO: 39905 - protein, 10 aa, Dengue virus
FKAERVIDPR

SEQ ID NO: 39906 - protein, 10 aa, Dengue virus
KAERVIDPRR

SEQ ID NO: 39907 - protein, 10 aa, Dengue virus
AERVIDPRRC

SEQ ID NO: 39908 - protein, 10 aa, Dengue virus
ERVIDPRRCM

SEQ ID NO: 39909 - protein, 10 aa, Dengue virus
RVIDPRRCMK

SEQ ID NO: 39910 - protein, 10 aa, Dengue virus
VIDPRRCMKP

SEQ ID NO: 39911 - protein, 10 aa, Dengue virus
IDPRRCMKPV

SEQ ID NO: 39912 - protein, 10 aa, Dengue virus
DPRRCMKPVI

SEQ ID NO: 39913 - protein, 10 aa, Dengue virus
PRRCMKPVIL

SEQ ID NO: 39914 - protein, 10 aa, Dengue virus
RRCMKPVILT

SEQ ID NO: 39915 - protein, 10 aa, Dengue virus
RCMKPVILTD

SEQ ID NO: 39916 - protein, 10 aa, Dengue virus
CMKPVILTDG

SEQ ID NO: 39917 - protein, 10 aa, Dengue virus
MKPVILTDGE

SEQ ID NO: 39918 - protein, 10 aa, Dengue virus
KPVILTDGEE

SEQ ID NO: 39919 - protein, 10 aa, Dengue virus
PVILTDGEER

SEQ ID NO: 39920 - protein, 10 aa, Dengue virus
VILTDGEERV

SEQ ID NO: 39921 - protein, 10 aa, Dengue virus
ILTDGEERVI

SEQ ID NO: 39922 - protein, 10 aa, Dengue virus
LTDGEERVIL

SEQ ID NO: 39923 - protein, 10 aa, Dengue virus
TDGEERVILA

SEQ ID NO: 39924 - protein, 10 aa, Dengue virus
DGEERVILAG

SEQ ID NO: 39925 - protein, 10 aa, Dengue virus
GEERVILAGP

SEQ ID NO: 39926 - protein, 10 aa, Dengue virus
EERVILAGPM

SEQ ID NO: 39927 - protein, 10 aa, Dengue virus
ERVILAGPMP

SEQ ID NO: 39928 - protein, 10 aa, Dengue virus
RVILAGPMPV

SEQ ID NO: 39929 - protein, 10 aa, Dengue virus
VILAGPMPVT

SEQ ID NO: 39930 - protein, 10 aa, Dengue virus
ILAGPMPVTH

SEQ ID NO: 39931 - protein, 10 aa, Dengue virus
LAGPMPVTHS

SEQ ID NO: 39932 - protein, 10 aa, Dengue virus
AGPMPVTHSS

SEQ ID NO: 39933 - protein, 10 aa, Dengue virus
GPMPVTHSSA

SEQ ID NO: 39934 - protein, 10 aa, Dengue virus
PMPVTHSSAA

SEQ ID NO: 39935 - protein, 10 aa, Dengue virus
MPVTHSSAAQ

SEQ ID NO: 39936 - protein, 10 aa, Dengue virus
PVTHSSAAQR

SEQ ID NO: 39937 - protein, 10 aa, Dengue virus
VTHSSAAQRR

SEQ ID NO: 39938 - protein, 10 aa, Dengue virus
THSSAAQRRG

SEQ ID NO: 39939 - protein, 10 aa, Dengue virus
HSSAAQRRGR

SEQ ID NO: 39940 - protein, 10 aa, Dengue virus
SSAAQRRGRI

SEQ ID NO: 39941 - protein, 10 aa, Dengue virus
SAAQRRGRIG

SEQ ID NO: 39942 - protein, 10 aa, Dengue virus
AAQRRGRIGR

SEQ ID NO: 39943 - protein, 10 aa, Dengue virus
AQRRGRIGRN

SEQ ID NO: 39944 - protein, 10 aa, Dengue virus
QRRGRIGRNP

SEQ ID NO: 39945 - protein, 10 aa, Dengue virus
RRGRIGRNPK

SEQ ID NO: 39946 - protein, 10 aa, Dengue virus
RGRIGRNPKN

SEQ ID NO: 39947 - protein, 10 aa, Dengue virus
GRIGRNPKNE

SEQ ID NO: 39948 - protein, 10 aa, Dengue virus
RIGRNPKNEN

SEQ ID NO: 39949 - protein, 10 aa, Dengue virus
IGRNPKNEND

SEQ ID NO: 39950 - protein, 10 aa, Dengue virus
GRNPKNENDQ

SEQ ID NO: 39951 - protein, 10 aa, Dengue virus
RNPKNENDQY

SEQ ID NO: 39952 - protein, 10 aa, Dengue virus
NPKNENDQYI

SEQ ID NO: 39953 - protein, 10 aa, Dengue virus
PKNENDQYIY

SEQ ID NO: 39954 - protein, 10 aa, Dengue virus
KNENDQYIYM

SEQ ID NO: 39955 - protein, 10 aa, Dengue virus
NENDQYIYMG

SEQ ID NO: 39956 - protein, 10 aa, Dengue virus
ENDQYIYMGE

SEQ ID NO: 39957 - protein, 10 aa, Dengue virus
NDQYIYMGEP

SEQ ID NO: 39958 - protein, 10 aa, Dengue virus
DQYIYMGEPL

SEQ ID NO: 39959 - protein, 10 aa, Dengue virus
QYIYMGEPLE

SEQ ID NO: 39960 - protein, 10 aa, Dengue virus
YIYMGEPLEN

SEQ ID NO: 39961 - protein, 10 aa, Dengue virus
IYMGEPLEND

SEQ ID NO: 39962 - protein, 10 aa, Dengue virus
YMGEPLENDE

SEQ ID NO: 39963 - protein, 10 aa, Dengue virus
MGEPLENDED

SEQ ID NO: 39964 - protein, 10 aa, Dengue virus
GEPLENDEDC

SEQ ID NO: 39965 - protein, 10 aa, Dengue virus
EPLENDEDCA

SEQ ID NO: 39966 - protein, 10 aa, Dengue virus
PLENDEDCAH

SEQ ID NO: 39967 - protein, 10 aa, Dengue virus
LENDEDCAHW

SEQ ID NO: 39968 - protein, 10 aa, Dengue virus
ENDEDCAHWK

SEQ ID NO: 39969 - protein, 10 aa, Dengue virus
NDEDCAHWKE

SEQ ID NO: 39970 - protein, 10 aa, Dengue virus
DEDCAHWKEA

SEQ ID NO: 39971 - protein, 10 aa, Dengue virus
EDCAHWKEAK

SEQ ID NO: 39972 - protein, 10 aa, Dengue virus
DCAHWKEAKM

SEQ ID NO: 39973 - protein, 10 aa, Dengue virus
CAHWKEAKML

SEQ ID NO: 39974 - protein, 10 aa, Dengue virus
AHWKEAKMLL

SEQ ID NO: 39975 - protein, 10 aa, Dengue virus
HWKEAKMLLD

SEQ ID NO: 39976 - protein, 10 aa, Dengue virus
WKEAKMLLDN

SEQ ID NO: 39977 - protein, 10 aa, Dengue virus
KEAKMLLDNI

SEQ ID NO: 39978 - protein, 10 aa, Dengue virus
EAKMLLDNIN

SEQ ID NO: 39979 - protein, 10 aa, Dengue virus
AKMLLDNINT

SEQ ID NO: 39980 - protein, 10 aa, Dengue virus
KMLLDNINTP

SEQ ID NO: 39981 - protein, 10 aa, Dengue virus
MLLDNINTPE

SEQ ID NO: 39982 - protein, 10 aa, Dengue virus
LLDNINTPEG

SEQ ID NO: 39983 - protein, 10 aa, Dengue virus
LDNINTPEGI

SEQ ID NO: 39984 - protein, 10 aa, Dengue virus
DNINTPEGII

SEQ ID NO: 39985 - protein, 10 aa, Dengue virus
NINTPEGIIP

SEQ ID NO: 39986 - protein, 10 aa, Dengue virus
INTPEGIIPS

SEQ ID NO: 39987 - protein, 10 aa, Dengue virus
NTPEGIIPSM

SEQ ID NO: 39988 - protein, 10 aa, Dengue virus
TPEGIIPSMF

SEQ ID NO: 39989 - protein, 10 aa, Dengue virus
PEGIIPSMFE

SEQ ID NO: 39990 - protein, 10 aa, Dengue virus
EGIIPSMFEP

SEQ ID NO: 39991 - protein, 10 aa, Dengue virus
GIIPSMFEPE

SEQ ID NO: 39992 - protein, 10 aa, Dengue virus
IIPSMFEPER

SEQ ID NO: 39993 - protein, 10 aa, Dengue virus
IPSMFEPERE

SEQ ID NO: 39994 - protein, 10 aa, Dengue virus
PSMFEPEREK

SEQ ID NO: 39995 - protein, 10 aa, Dengue virus
SMFEPEREKV

SEQ ID NO: 39996 - protein, 10 aa, Dengue virus
MFEPEREKVD

SEQ ID NO: 39997 - protein, 10 aa, Dengue virus
FEPEREKVDA

SEQ ID NO: 39998 - protein, 10 aa, Dengue virus
EPEREKVDAI

SEQ ID NO: 39999 - protein, 10 aa, Dengue virus
PEREKVDAID

SEQ ID NO: 40000 - protein, 10 aa, Dengue virus
EREKVDAIDG

SEQ ID NO: 40001 - protein, 10 aa, Dengue virus
REKVDAIDGE

SEQ ID NO: 40002 - protein, 10 aa, Dengue virus
EKVDAIDGEY

SEQ ID NO: 40003 - protein, 10 aa, Dengue virus
KVDAIDGEYR

SEQ ID NO: 40004 - protein, 10 aa, Dengue virus
VDAIDGEYRL

SEQ ID NO: 40005 - protein, 10 aa, Dengue virus
DAIDGEYRLR

SEQ ID NO: 40006 - protein, 10 aa, Dengue virus
AIDGEYRLRG

SEQ ID NO: 40007 - protein, 10 aa, Dengue virus
IDGEYRLRGE

SEQ ID NO: 40008 - protein, 10 aa, Dengue virus
DGEYRLRGEA

SEQ ID NO: 40009 - protein, 10 aa, Dengue virus
GEYRLRGEAR

SEQ ID NO: 40010 - protein, 10 aa, Dengue virus
EYRLRGEARK

SEQ ID NO: 40011 - protein, 10 aa, Dengue virus
YRLRGEARKT

SEQ ID NO: 40012 - protein, 10 aa, Dengue virus
RLRGEARKTF

SEQ ID NO: 40013 - protein, 10 aa, Dengue virus
LRGEARKTFV

SEQ ID NO: 40014 - protein, 10 aa, Dengue virus
RGEARKTFVD

SEQ ID NO: 40015 - protein, 10 aa, Dengue virus
GEARKTFVDL

SEQ ID NO: 40016 - protein, 10 aa, Dengue virus
EARKTFVDLM

SEQ ID NO: 40017 - protein, 10 aa, Dengue virus
ARKTFVDLMR

SEQ ID NO: 40018 - protein, 10 aa, Dengue virus
RKTFVDLMRR

SEQ ID NO: 40019 - protein, 10 aa, Dengue virus
KTFVDLMRRG

SEQ ID NO: 40020 - protein, 10 aa, Dengue virus
TFVDLMRRGD

SEQ ID NO: 40021 - protein, 10 aa, Dengue virus
FVDLMRRGDL

SEQ ID NO: 40022 - protein, 10 aa, Dengue virus
VDLMRRGDLP

SEQ ID NO: 40023 - protein, 10 aa, Dengue virus
DLMRRGDLPV

SEQ ID NO: 40024 - protein, 10 aa, Dengue virus
LMRRGDLPVW

SEQ ID NO: 40025 - protein, 10 aa, Dengue virus
MRRGDLPVWL

SEQ ID NO: 40026 - protein, 10 aa, Dengue virus
RRGDLPVWLA

SEQ ID NO: 40027 - protein, 10 aa, Dengue virus
RGDLPVWLAY

SEQ ID NO: 40028 - protein, 10 aa, Dengue virus
GDLPVWLAYK

SEQ ID NO: 40029 - protein, 10 aa, Dengue virus
DLPVWLAYKV

SEQ ID NO: 40030 - protein, 10 aa, Dengue virus
LPVWLAYKVA

SEQ ID NO: 40031 - protein, 10 aa, Dengue virus
PVWLAYKVAA

SEQ ID NO: 40032 - protein, 10 aa, Dengue virus
VWLAYKVAAE

SEQ ID NO: 40033 - protein, 10 aa, Dengue virus
WLAYKVAAEG

SEQ ID NO: 40034 - protein, 10 aa, Dengue virus
LAYKVAAEGI

SEQ ID NO: 40035 - protein, 10 aa, Dengue virus
AYKVAAEGIN

SEQ ID NO: 40036 - protein, 10 aa, Dengue virus
YKVAAEGINY

SEQ ID NO: 40037 - protein, 10 aa, Dengue virus
KVAAEGINYA

SEQ ID NO: 40038 - protein, 10 aa, Dengue virus
VAAEGINYAD

SEQ ID NO: 40039 - protein, 10 aa, Dengue virus
AAEGINYADR

SEQ ID NO: 40040 - protein, 10 aa, Dengue virus
EGINYADRRW

SEQ ID NO: 40041 - protein, 10 aa, Dengue virus
GINYADRRWC

SEQ ID NO: 40042 - protein, 10 aa, Dengue virus
INYADRRWCF

SEQ ID NO: 40043 - protein, 10 aa, Dengue virus
NYADRRWCFD

SEQ ID NO: 40044 - protein, 10 aa, Dengue virus
YADRRWCFDG

SEQ ID NO: 40045 - protein, 10 aa, Dengue virus
ADRRWCFDGI

SEQ ID NO: 40046 - protein, 10 aa, Dengue virus
DRRWCFDGIK

SEQ ID NO: 40047 - protein, 10 aa, Dengue virus
RRWCFDGIKN

SEQ ID NO: 40048 - protein, 10 aa, Dengue virus
RWCFDGIKNN

SEQ ID NO: 40049 - protein, 10 aa, Dengue virus
WCFDGIKNNQ

SEQ ID NO: 40050 - protein, 10 aa, Dengue virus
CFDGIKNNQI

SEQ ID NO: 40051 - protein, 10 aa, Dengue virus
FDGIKNNQIL

SEQ ID NO: 40052 - protein, 10 aa, Dengue virus
DGIKNNQILE

SEQ ID NO: 40053 - protein, 10 aa, Dengue virus
GIKNNQILEE

SEQ ID NO: 40054 - protein, 10 aa, Dengue virus
IKNNQILEEN

SEQ ID NO: 40055 - protein, 10 aa, Dengue virus
KNNQILEENV

SEQ ID NO: 40056 - protein, 10 aa, Dengue virus
NNQILEENVE

SEQ ID NO: 40057 - protein, 10 aa, Dengue virus
NQILEENVEV

SEQ ID NO: 40058 - protein, 10 aa, Dengue virus
QILEENVEVE

SEQ ID NO: 40059 - protein, 10 aa, Dengue virus
ILEENVEVEI

SEQ ID NO: 40060 - protein, 10 aa, Dengue virus
LEENVEVEIW

SEQ ID NO: 40061 - protein, 10 aa, Dengue virus
EENVEVEIWT

SEQ ID NO: 40062 - protein, 10 aa, Dengue virus
ENVEVEIWTK

SEQ ID NO: 40063 - protein, 10 aa, Dengue virus
NVEVEIWTKE

SEQ ID NO: 40064 - protein, 10 aa, Dengue virus
VEVEIWTKEG

SEQ ID NO: 40065 - protein, 10 aa, Dengue virus
EVEIWTKEGE

SEQ ID NO: 40066 - protein, 10 aa, Dengue virus
VEIWTKEGER

SEQ ID NO: 40067 - protein, 10 aa, Dengue virus
EIWTKEGERK

SEQ ID NO: 40068 - protein, 10 aa, Dengue virus
IWTKEGERKK

SEQ ID NO: 40069 - protein, 10 aa, Dengue virus
WTKEGERKKL

SEQ ID NO: 40070 - protein, 10 aa, Dengue virus
TKEGERKKLK

SEQ ID NO: 40071 - protein, 10 aa, Dengue virus
KEGERKKLKP

SEQ ID NO: 40072 - protein, 10 aa, Dengue virus
EGERKKLKPR

SEQ ID NO: 40073 - protein, 10 aa, Dengue virus
GERKKLKPRW

SEQ ID NO: 40074 - protein, 10 aa, Dengue virus
ERKKLKPRWL

SEQ ID NO: 40075 - protein, 10 aa, Dengue virus
RKKLKPRWLD

SEQ ID NO: 40076 - protein, 10 aa, Dengue virus
KKLKPRWLDA

SEQ ID NO: 40077 - protein, 10 aa, Dengue virus
KLKPRWLDAR

SEQ ID NO: 40078 - protein, 10 aa, Dengue virus
LKPRWLDARI

SEQ ID NO: 40079 - protein, 10 aa, Dengue virus
KPRWLDARIY

SEQ ID NO: 40080 - protein, 10 aa, Dengue virus
PRWLDARIYS

SEQ ID NO: 40081 - protein, 10 aa, Dengue virus
RWLDARIYSD

SEQ ID NO: 40082 - protein, 10 aa, Dengue virus
WLDARIYSDP

SEQ ID NO: 40083 - protein, 10 aa, Dengue virus
LDARIYSDPL

SEQ ID NO: 40084 - protein, 10 aa, Dengue virus
DARIYSDPLA

SEQ ID NO: 40085 - protein, 10 aa, Dengue virus
ARIYSDPLAL

SEQ ID NO: 40086 - protein, 10 aa, Dengue virus
RIYSDPLALK

SEQ ID NO: 40087 - protein, 10 aa, Dengue virus
IYSDPLALKE

SEQ ID NO: 40088 - protein, 10 aa, Dengue virus
YSDPLALKEF

SEQ ID NO: 40089 - protein, 10 aa, Dengue virus
SDPLALKEFK

SEQ ID NO: 40090 - protein, 10 aa, Dengue virus
DPLALKEFKE

SEQ ID NO: 40091 - protein, 10 aa, Dengue virus
PLALKEFKEF

SEQ ID NO: 40092 - protein, 10 aa, Dengue virus
LALKEFKEFA

SEQ ID NO: 40093 - protein, 10 aa, Dengue virus
ALKEFKEFAA

SEQ ID NO: 40094 - protein, 10 aa, Dengue virus
LKEFKEFAAG

SEQ ID NO: 40095 - protein, 10 aa, Dengue virus
KEFKEFAAGR

SEQ ID NO: 40096 - protein, 10 aa, Dengue virus
EFKEFAAGRK

SEQ ID NO: 40097 - protein, 10 aa, Dengue virus
FKEFAAGRKS

SEQ ID NO: 40098 - protein, 10 aa, Dengue virus
KEFAAGRKSL

SEQ ID NO: 40099 - protein, 10 aa, Dengue virus
EFAAGRKSLT

SEQ ID NO: 40100 - protein, 10 aa, Dengue virus
FAAGRKSLTL

SEQ ID NO: 40101 - protein, 10 aa, Dengue virus
AAGRKSLTLN

SEQ ID NO: 40102 - protein, 10 aa, Dengue virus
AGRKSLTLNL

SEQ ID NO: 40103 - protein, 10 aa, Dengue virus
GRKSLTLNLI

SEQ ID NO: 40104 - protein, 10 aa, Dengue virus
RKSLTLNLIT

SEQ ID NO: 40105 - protein, 10 aa, Dengue virus
KSLTLNLITE

SEQ ID NO: 40106 - protein, 10 aa, Dengue virus
SLTLNLITEM

SEQ ID NO: 40107 - protein, 10 aa, Dengue virus
LTLNLITEMG

SEQ ID NO: 40108 - protein, 10 aa, Dengue virus
TLNLITEMGR

SEQ ID NO: 40109 - protein, 10 aa, Dengue virus
LNLITEMGRL

SEQ ID NO: 40110 - protein, 10 aa, Dengue virus
NLITEMGRLP

SEQ ID NO: 40111 - protein, 10 aa, Dengue virus
LITEMGRLPT

SEQ ID NO: 40112 - protein, 10 aa, Dengue virus
ITEMGRLPTF

SEQ ID NO: 40113 - protein, 10 aa, Dengue virus
TEMGRLPTFM

SEQ ID NO: 40114 - protein, 10 aa, Dengue virus
EMGRLPTFMT

SEQ ID NO: 40115 - protein, 10 aa, Dengue virus
MGRLPTFMTQ

SEQ ID NO: 40116 - protein, 10 aa, Dengue virus
GRLPTFMTQK

SEQ ID NO: 40117 - protein, 10 aa, Dengue virus
RLPTFMTQKA

SEQ ID NO: 40118 - protein, 10 aa, Dengue virus
LPTFMTQKAR

SEQ ID NO: 40119 - protein, 10 aa, Dengue virus
PTFMTQKARN

SEQ ID NO: 40120 - protein, 10 aa, Dengue virus
TFMTQKARNA

SEQ ID NO: 40121 - protein, 10 aa, Dengue virus
FMTQKARNAL

SEQ ID NO: 40122 - protein, 10 aa, Dengue virus
MTQKARNALD

SEQ ID NO: 40123 - protein, 10 aa, Dengue virus
TQKARNALDN

SEQ ID NO: 40124 - protein, 10 aa, Dengue virus
QKARNALDNL

SEQ ID NO: 40125 - protein, 10 aa, Dengue virus
KARNALDNLA

SEQ ID NO: 40126 - protein, 10 aa, Dengue virus
ARNALDNLAV

SEQ ID NO: 40127 - protein, 10 aa, Dengue virus
RDALDNLAVL

SEQ ID NO: 40128 - protein, 10 aa, Dengue virus
DALDNLAVLH

SEQ ID NO: 40129 - protein, 10 aa, Dengue virus
ALDNLAVLHT

SEQ ID NO: 40130 - protein, 10 aa, Dengue virus
LDNLAVLHTA

SEQ ID NO: 40131 - protein, 10 aa, Dengue virus
DNLAVLHTAE

SEQ ID NO: 40132 - protein, 10 aa, Dengue virus
NLAVLHTAEA

SEQ ID NO: 40133 - protein, 10 aa, Dengue virus
LAVLHTAEAG

SEQ ID NO: 40134 - protein, 10 aa, Dengue virus
AVLHTAEAGG

SEQ ID NO: 40135 - protein, 10 aa, Dengue virus
VLHTAEAGGR

SEQ ID NO: 40136 - protein, 10 aa, Dengue virus
LHTAEAGGRA

SEQ ID NO: 40137 - protein, 10 aa, Dengue virus
GGRAYNHALS

SEQ ID NO: 40138 - protein, 10 aa, Dengue virus
GRAYNHALSE

SEQ ID NO: 40139 - protein, 10 aa, Dengue virus
RAYNHALSEL

SEQ ID NO: 40140 - protein, 10 aa, Dengue virus
AYNHALSELP

SEQ ID NO: 40141 - protein, 10 aa, Dengue virus
YNHALSELPE

SEQ ID NO: 40142 - protein, 10 aa, Dengue virus
NHALSELPET

SEQ ID NO: 40143 - protein, 10 aa, Dengue virus
HALSELPETL

SEQ ID NO: 40144 - protein, 10 aa, Dengue virus
ALSELPETLE

SEQ ID NO: 40145 - protein, 10 aa, Dengue virus
LSELPETLET

SEQ ID NO: 40146 - protein, 10 aa, Dengue virus
SELPETLETL

SEQ ID NO: 40147 - protein, 10 aa, Dengue virus
ELPETLETLL

SEQ ID NO: 40148 - protein, 10 aa, Dengue virus
LPETLETLLL

SEQ ID NO: 40149 - protein, 10 aa, Dengue virus
PETLETLLLL

SEQ ID NO: 40150 - protein, 10 aa, Dengue virus
ETLETLLLLT

SEQ ID NO: 40151 - protein, 10 aa, Dengue virus
TLETLLLLTL

SEQ ID NO: 40152 - protein, 10 aa, Dengue virus
LETLLLLTLL

SEQ ID NO: 40153 - protein, 10 aa, Dengue virus
ETLLLLTLLA

SEQ ID NO: 40154 - protein, 10 aa, Dengue virus
TLLLLTLLAT

SEQ ID NO: 40155 - protein, 10 aa, Dengue virus
LLLLTLLATV

SEQ ID NO: 40156 - protein, 10 aa, Dengue virus
LLLTLLATVT

SEQ ID NO: 40157 - protein, 10 aa, Dengue virus
LLTLLATVTG

SEQ ID NO: 40158 - protein, 10 aa, Dengue virus
LTLLATVTGG

SEQ ID NO: 40159 - protein, 10 aa, Dengue virus
TLLATVTGGI

SEQ ID NO: 40160 - protein, 10 aa, Dengue virus
LLATVTGGIF

SEQ ID NO: 40161 - protein, 10 aa, Dengue virus
LATVTGGIFL

SEQ ID NO: 40162 - protein, 10 aa, Dengue virus
ATVTGGIFLF

SEQ ID NO: 40163 - protein, 10 aa, Dengue virus
TVTGGIFLFL

SEQ ID NO: 40164 - protein, 10 aa, Dengue virus
VTGGIFLFLM

SEQ ID NO: 40165 - protein, 10 aa, Dengue virus
TGGIFLFLMS

SEQ ID NO: 40166 - protein, 10 aa, Dengue virus
GGIFLFLMSG

SEQ ID NO: 40167 - protein, 10 aa, Dengue virus
GIFLFLMSGK

SEQ ID NO: 40168 - protein, 10 aa, Dengue virus
IFLFLMSGKG

SEQ ID NO: 40169 - protein, 10 aa, Dengue virus
FLFLMSGKGI

SEQ ID NO: 40170 - protein, 10 aa, Dengue virus
LFLMSGKGIG

SEQ ID NO: 40171 - protein, 10 aa, Dengue virus
FLMSGKGIGK

SEQ ID NO: 40172 - protein, 10 aa, Dengue virus
LMSGKGIGKM

SEQ ID NO: 40173 - protein, 10 aa, Dengue virus
MSGKGIGKMT

SEQ ID NO: 40174 - protein, 10 aa, Dengue virus
SGKGIGKMTL

SEQ ID NO: 40175 - protein, 10 aa, Dengue virus
GKGIGKMTLG

SEQ ID NO: 40176 - protein, 10 aa, Dengue virus
KGIGKMTLGM

SEQ ID NO: 40177 - protein, 10 aa, Dengue virus
GIGKMTLGMC

SEQ ID NO: 40178 - protein, 10 aa, Dengue virus
IGKMTLGMCC

SEQ ID NO: 40179 - protein, 10 aa, Dengue virus
GKMTLGMCCI

SEQ ID NO: 40180 - protein, 10 aa, Dengue virus
KMTLGMCCII

SEQ ID NO: 40181 - protein, 10 aa, Dengue virus
MTLGMCCIIT

SEQ ID NO: 40182 - protein, 10 aa, Dengue virus
TLGMCCIITA

SEQ ID NO: 40183 - protein, 10 aa, Dengue virus
LGMCCIITAS

SEQ ID NO: 40184 - protein, 10 aa, Dengue virus
LLWYAQIQPH

SEQ ID NO: 40185 - protein, 10 aa, Dengue virus
LWYAQIQPHW

SEQ ID NO: 40186 - protein, 10 aa, Dengue virus
WYAQIQPHWI

SEQ ID NO: 40187 - protein, 10 aa, Dengue virus
YAQIQPHWIA

SEQ ID NO: 40188 - protein, 10 aa, Dengue virus
AQIQPHWIAA

SEQ ID NO: 40189 - protein, 10 aa, Dengue virus
QIQPHWIAAS

SEQ ID NO: 40190 - protein, 10 aa, Dengue virus
IQPHWIAASI

SEQ ID NO: 40191 - protein, 10 aa, Dengue virus
QPHWIAASII

SEQ ID NO: 40192 - protein, 10 aa, Dengue virus
PHWIAASIIL

SEQ ID NO: 40193 - protein, 10 aa, Dengue virus
HWIAASIILE

SEQ ID NO: 40194 - protein, 10 aa, Dengue virus
WIAASIILEF

SEQ ID NO: 40195 - protein, 10 aa, Dengue virus
IAASIILEFF

SEQ ID NO: 40196 - protein, 10 aa, Dengue virus
AASIILEFFL

SEQ ID NO: 40197 - protein, 10 aa, Dengue virus
ASIILEFFLI

SEQ ID NO: 40198 - protein, 10 aa, Dengue virus
SIILEFFLIV

SEQ ID NO: 40199 - protein, 10 aa, Dengue virus
IILEFFLIVL

SEQ ID NO: 40200 - protein, 10 aa, Dengue virus
ILEFFLIVLL

SEQ ID NO: 40201 - protein, 10 aa, Dengue virus
LEFFLIVLLI

SEQ ID NO: 40202 - protein, 10 aa, Dengue virus
EFFLIVLLIP

SEQ ID NO: 40203 - protein, 10 aa, Dengue virus
FFLIVLLIPE

SEQ ID NO: 40204 - protein, 10 aa, Dengue virus
FLIVLLIPEP

SEQ ID NO: 40205 - protein, 10 aa, Dengue virus
LIVLLIPEPE

SEQ ID NO: 40206 - protein, 10 aa, Dengue virus
IVLLIPEPEK

SEQ ID NO: 40207 - protein, 10 aa, Dengue virus
VLLIPEPEKQ

SEQ ID NO: 40208 - protein, 10 aa, Dengue virus
LLIPEPEKQR

SEQ ID NO: 40209 - protein, 10 aa, Dengue virus
LIPEPEKQRT

SEQ ID NO: 40210 - protein, 10 aa, Dengue virus
IPEPEKQRTP

SEQ ID NO: 40211 - protein, 10 aa, Dengue virus
PEPEKQRTPQ

SEQ ID NO: 40212 - protein, 10 aa, Dengue virus
EPEKQRTPQD

SEQ ID NO: 40213 - protein, 10 aa, Dengue virus
PEKQRTPQDN

SEQ ID NO: 40214 - protein, 10 aa, Dengue virus
EKQRTPQDNQ

SEQ ID NO: 40215 - protein, 10 aa, Dengue virus
KQRTPQDNQL

SEQ ID NO: 40216 - protein, 10 aa, Dengue virus
QRTPQDNQLT

SEQ ID NO: 40217 - protein, 10 aa, Dengue virus
RTPQDNQLTY

SEQ ID NO: 40218 - protein, 10 aa, Dengue virus
TPQDNQLTYV

SEQ ID NO: 40219 - protein, 10 aa, Dengue virus
PQDNQLTYVV

SEQ ID NO: 40220 - protein, 10 aa, Dengue virus
QDNQLTYVVI

SEQ ID NO: 40221 - protein, 10 aa, Dengue virus
DNQLTYVVIA

SEQ ID NO: 40222 - protein, 10 aa, Dengue virus
NQLTYVVIAI

SEQ ID NO: 40223 - protein, 10 aa, Dengue virus
QLTYVVIAIL

SEQ ID NO: 40224 - protein, 10 aa, Dengue virus
LTYVVIAILT

SEQ ID NO: 40225 - protein, 10 aa, Dengue virus
TYVVIAILTV

SEQ ID NO: 40226 - protein, 10 aa, Dengue virus
YVVIAILTVV

SEQ ID NO: 40227 - protein, 10 aa, Dengue virus
VVIAILTVVA

SEQ ID NO: 40228 - protein, 10 aa, Dengue virus
VIAILTVVAA

SEQ ID NO: 40229 - protein, 10 aa, Dengue virus
IAILTVVAAT

SEQ ID NO: 40230 - protein, 10 aa, Dengue virus
AILTVVAATM

SEQ ID NO: 40231 - protein, 10 aa, Dengue virus
ILTVVAATMA

SEQ ID NO: 40232 - protein, 10 aa, Dengue virus
LTVVAATMAN

SEQ ID NO: 40233 - protein, 10 aa, Dengue virus
TVVAATMANE

SEQ ID NO: 40234 - protein, 10 aa, Dengue virus
VVAATMANEM

SEQ ID NO: 40235 - protein, 10 aa, Dengue virus
VAATMANEMG

SEQ ID NO: 40236 - protein, 10 aa, Dengue virus
AATMANEMGF

SEQ ID NO: 40237 - protein, 10 aa, Dengue virus
ATMANEMGFL

SEQ ID NO: 40238 - protein, 10 aa, Dengue virus
TMANEMGFLE

SEQ ID NO: 40239 - protein, 10 aa, Dengue virus
MANEMGFLEK

SEQ ID NO: 40240 - protein, 10 aa, Dengue virus
ANEMGFLEKT

SEQ ID NO: 40241 - protein, 10 aa, Dengue virus
NEMGFLEKTK

SEQ ID NO: 40242 - protein, 10 aa, Dengue virus
EMGFLEKTKK

SEQ ID NO: 40243 - protein, 10 aa, Dengue virus
MGFLEKTKKD

SEQ ID NO: 40244 - protein, 10 aa, Dengue virus
GFLEKTKKDL

SEQ ID NO: 40245 - protein, 10 aa, Dengue virus
FLEKTKKDLG

SEQ ID NO: 40246 - protein, 10 aa, Dengue virus
LEKTKKDLGL

SEQ ID NO: 40247 - protein, 10 aa, Dengue virus
EKTKKDLGLG

SEQ ID NO: 40248 - protein, 10 aa, Dengue virus
ESESNILDID

SEQ ID NO: 40249 - protein, 10 aa, Dengue virus
PESNILDIDL

SEQ ID NO: 40250 - protein, 10 aa, Dengue virus
ESNILDIDLR

SEQ ID NO: 40251 - protein, 10 aa, Dengue virus
SNILDIDLRP

SEQ ID NO: 40252 - protein, 10 aa, Dengue virus
NILDIDLRPA

SEQ ID NO: 40253 - protein, 10 aa, Dengue virus
ILDIDLRPAS

SEQ ID NO: 40254 - protein, 10 aa, Dengue virus
LDIDLRPASA

SEQ ID NO: 40255 - protein, 10 aa, Dengue virus
DIDLRPASAW

SEQ ID NO: 40256 - protein, 10 aa, Dengue virus
IDLRPASAWT

SEQ ID NO: 40257 - protein, 10 aa, Dengue virus
DLRPASAWTL

SEQ ID NO: 40258 - protein, 10 aa, Dengue virus
LRPASAWTLY

SEQ ID NO: 40259 - protein, 10 aa, Dengue virus
RPASAWTLYA

SEQ ID NO: 40260 - protein, 10 aa, Dengue virus
PASAWTLYAV

SEQ ID NO: 40261 - protein, 10 aa, Dengue virus
ASAWTLYAVA

SEQ ID NO: 40262 - protein, 10 aa, Dengue virus
SAWTLYAVAT

SEQ ID NO: 40263 - protein, 10 aa, Dengue virus
AWTLYAVATT

SEQ ID NO: 40264 - protein, 10 aa, Dengue virus
WTLYAVATTF

SEQ ID NO: 40265 - protein, 10 aa, Dengue virus
TLYAVATTFV

SEQ ID NO: 40266 - protein, 10 aa, Dengue virus
LYAVATTFVT

SEQ ID NO: 40267 - protein, 10 aa, Dengue virus
YAVATTFVTP

SEQ ID NO: 40268 - protein, 10 aa, Dengue virus
AVATTFVTPM

SEQ ID NO: 40269 - protein, 10 aa, Dengue virus
VATTFVTPML

SEQ ID NO: 40270 - protein, 10 aa, Dengue virus
ATTFVTPMLR

SEQ ID NO: 40271 - protein, 10 aa, Dengue virus
TTFVTPMLRH

SEQ ID NO: 40272 - protein, 10 aa, Dengue virus
TFVTPMLRHS

SEQ ID NO: 40273 - protein, 10 aa, Dengue virus
FVTPMLRHSI

SEQ ID NO: 40274 - protein, 10 aa, Dengue virus
VTPMLRHSIE

SEQ ID NO: 40275 - protein, 10 aa, Dengue virus
TPMLRHSIEN

SEQ ID NO: 40276 - protein, 10 aa, Dengue virus
PMLRHSIENS

SEQ ID NO: 40277 - protein, 10 aa, Dengue virus
MLRHSIENSS

SEQ ID NO: 40278 - protein, 10 aa, Dengue virus
LRHSIENSSV

SEQ ID NO: 40279 - protein, 10 aa, Dengue virus
RHSIENSSVN

SEQ ID NO: 40280 - protein, 10 aa, Dengue virus
HSIENSSVNV

SEQ ID NO: 40281 - protein, 10 aa, Dengue virus
SIENSSVNVS

SEQ ID NO: 40282 - protein, 10 aa, Dengue virus
IENSSVNVSL

SEQ ID NO: 40283 - protein, 10 aa, Dengue virus
ENSSVNVSLT

SEQ ID NO: 40284 - protein, 10 aa, Dengue virus
NSSVNVSLTA

SEQ ID NO: 40285 - protein, 10 aa, Dengue virus
SSVNVSLTAI

SEQ ID NO: 40286 - protein, 10 aa, Dengue virus
SVNVSLTAIA

SEQ ID NO: 40287 - protein, 10 aa, Dengue virus
VNVSLTAIAN

SEQ ID NO: 40288 - protein, 10 aa, Dengue virus
NVSLTAIANQ

SEQ ID NO: 40289 - protein, 10 aa, Dengue virus
VSLTAIANQA

SEQ ID NO: 40290 - protein, 10 aa, Dengue virus
SLTAIANQAT

SEQ ID NO: 40291 - protein, 10 aa, Dengue virus
LTAIANQATV

SEQ ID NO: 40292 - protein, 10 aa, Dengue virus
TAIANQATVL

SEQ ID NO: 40293 - protein, 10 aa, Dengue virus
AIANQATVLM

SEQ ID NO: 40294 - protein, 10 aa, Dengue virus
IANQATVLMG

SEQ ID NO: 40295 - protein, 10 aa, Dengue virus
ANQATVLMGL

SEQ ID NO: 40296 - protein, 10 aa, Dengue virus
NQATVLMGLG

SEQ ID NO: 40297 - protein, 10 aa, Dengue virus
QATVLMGLGK

SEQ ID NO: 40298 - protein, 10 aa, Dengue virus
ATVLMGLGKG

SEQ ID NO: 40299 - protein, 10 aa, Dengue virus
TVLMGLGKGW

SEQ ID NO: 40300 - protein, 10 aa, Dengue virus
VLMGLGKGWP

SEQ ID NO: 40301 - protein, 10 aa, Dengue virus
LMGLGKGWPL

SEQ ID NO: 40302 - protein, 10 aa, Dengue virus
MGLGKGWPLS

SEQ ID NO: 40303 - protein, 10 aa, Dengue virus
GLGKGWPLSK

SEQ ID NO: 40304 - protein, 10 aa, Dengue virus
LGKGWPLSKM

SEQ ID NO: 40305 - protein, 10 aa, Dengue virus
GKGWPLSKMD

SEQ ID NO: 40306 - protein, 10 aa, Dengue virus
KGWPLSKMDI

SEQ ID NO: 40307 - protein, 10 aa, Dengue virus
GWPLSKMDIG

SEQ ID NO: 40308 - protein, 10 aa, Dengue virus
WPLSKMDIGV

SEQ ID NO: 40309 - protein, 10 aa, Dengue virus
PLSKMDIGVP

SEQ ID NO: 40310 - protein, 10 aa, Dengue virus
LSKMDIGVPL

SEQ ID NO: 40311 - protein, 10 aa, Dengue virus
SKMDIGVPLL

SEQ ID NO: 40312 - protein, 10 aa, Dengue virus
KMDIGVPLLA

SEQ ID NO: 40313 - protein, 10 aa, Dengue virus
MDIGVPLLAI

SEQ ID NO: 40314 - protein, 10 aa, Dengue virus
DIGVPLLAIG

SEQ ID NO: 40315 - protein, 10 aa, Dengue virus
IGVPLLAIGC

SEQ ID NO: 40316 - protein, 10 aa, Dengue virus
GVPLLAIGCY

SEQ ID NO: 40317 - protein, 10 aa, Dengue virus
VPLLAIGCYS

SEQ ID NO: 40318 - protein, 10 aa, Dengue virus
PLLAIGCYSQ

SEQ ID NO: 40319 - protein, 10 aa, Dengue virus
LLAIGCYSQV

SEQ ID NO: 40320 - protein, 10 aa, Dengue virus
LAIGCYSQVN

SEQ ID NO: 40321 - protein, 10 aa, Dengue virus
AIGCYSQVNP

SEQ ID NO: 40322 - protein, 10 aa, Dengue virus
IGCYSQVNPI

SEQ ID NO: 40323 - protein, 10 aa, Dengue virus
GCYSQVNPIT

SEQ ID NO: 40324 - protein, 10 aa, Dengue virus
CYSQVNPITL

SEQ ID NO: 40325 - protein, 10 aa, Dengue virus
YSQVNPITLT

SEQ ID NO: 40326 - protein, 10 aa, Dengue virus
SQVNPITLTA

SEQ ID NO: 40327 - protein, 10 aa, Dengue virus
QVNPITLTAA

SEQ ID NO: 40328 - protein, 10 aa, Dengue virus
VNPITLTAAL

SEQ ID NO: 40329 - protein, 10 aa, Dengue virus
NPITLTAALL

SEQ ID NO: 40330 - protein, 10 aa, Dengue virus
PITLTAALLL

SEQ ID NO: 40331 - protein, 10 aa, Dengue virus
ITLTAALLLL

SEQ ID NO: 40332 - protein, 10 aa, Dengue virus
TAALLLLVAH

SEQ ID NO: 40333 - protein, 10 aa, Dengue virus
LVAHYAIIGP

SEQ ID NO: 40334 - protein, 10 aa, Dengue virus
VAHYAIIGPG

SEQ ID NO: 40335 - protein, 10 aa, Dengue virus
AHYAIIGPGL

SEQ ID NO: 40336 - protein, 10 aa, Dengue virus
HYAIIGPGLQ

SEQ ID NO: 40337 - protein, 10 aa, Dengue virus
YAIIGPGLQA

SEQ ID NO: 40338 - protein, 10 aa, Dengue virus
AIIGPGLQAK

SEQ ID NO: 40339 - protein, 10 aa, Dengue virus
IIGPGLQAKA

SEQ ID NO: 40340 - protein, 10 aa, Dengue virus
IGPGLQAKAT

SEQ ID NO: 40341 - protein, 10 aa, Dengue virus
GPGLQAKATR

SEQ ID NO: 40342 - protein, 10 aa, Dengue virus
PGLQAKATRE

SEQ ID NO: 40343 - protein, 10 aa, Dengue virus
GLQAKATREA

SEQ ID NO: 40344 - protein, 10 aa, Dengue virus
LQAKATREAQ

SEQ ID NO: 40345 - protein, 10 aa, Dengue virus
QAKATREAQK

SEQ ID NO: 40346 - protein, 10 aa, Dengue virus
AKATREAQKR

SEQ ID NO: 40347 - protein, 10 aa, Dengue virus
KATREAQKRA

SEQ ID NO: 40348 - protein, 10 aa, Dengue virus
ATREAQKRAA

SEQ ID NO: 40349 - protein, 10 aa, Dengue virus
TREAQKRAAA

SEQ ID NO: 40350 - protein, 10 aa, Dengue virus
REAQKRAAAG

SEQ ID NO: 40351 - protein, 10 aa, Dengue virus
EAQKRAAAGI

SEQ ID NO: 40352 - protein, 10 aa, Dengue virus
AQKRAAAGIM

SEQ ID NO: 40353 - protein, 10 aa, Dengue virus
QKRAAAGIMK

SEQ ID NO: 40354 - protein, 10 aa, Dengue virus
KRAAAGIMKN

SEQ ID NO: 40355 - protein, 10 aa, Dengue virus
RAAAGIMKNP

SEQ ID NO: 40356 - protein, 10 aa, Dengue virus
AAAGIMKNPT

SEQ ID NO: 40357 - protein, 10 aa, Dengue virus
AAGIMKNPTV

SEQ ID NO: 40358 - protein, 10 aa, Dengue virus
AGIMKNPTVD

SEQ ID NO: 40359 - protein, 10 aa, Dengue virus
GIMKNPTVDG

SEQ ID NO: 40360 - protein, 10 aa, Dengue virus
IMKNPTVDGI

SEQ ID NO: 40361 - protein, 10 aa, Dengue virus
MKNPTVDGIT

SEQ ID NO: 40362 - protein, 10 aa, Dengue virus
KNPTVDGITV

SEQ ID NO: 40363 - protein, 10 aa, Dengue virus
NPTVDGITVI

SEQ ID NO: 40364 - protein, 10 aa, Dengue virus
PTVDGITVID

SEQ ID NO: 40365 - protein, 10 aa, Dengue virus
TVDGITVIDL

SEQ ID NO: 40366 - protein, 10 aa, Dengue virus
VDGITVIDLE

SEQ ID NO: 40367 - protein, 10 aa, Dengue virus
DGITVIDLEP

SEQ ID NO: 40368 - protein, 10 aa, Dengue virus
GITVIDLEPI

SEQ ID NO: 40369 - protein, 10 aa, Dengue virus
ITVIDLEPIP

SEQ ID NO: 40370 - protein, 10 aa, Dengue virus
TVIDLDPIPY

SEQ ID NO: 40371 - protein, 10 aa, Dengue virus
VIDLEPIPYD

SEQ ID NO: 40372 - protein, 10 aa, Dengue virus
IDLEPIPYDP

SEQ ID NO: 40373 - protein, 10 aa, Dengue virus
DLDPIPYDPK

SEQ ID NO: 40374 - protein, 10 aa, Dengue virus
LEPIPYDPKF

SEQ ID NO: 40375 - protein, 10 aa, Dengue virus
DPIPYDPKFE

SEQ ID NO: 40376 - protein, 10 aa, Dengue virus
PIPYDPKFEK

SEQ ID NO: 40377 - protein, 10 aa, Dengue virus
IPYDPKFEKQ

SEQ ID NO: 40378 - protein, 10 aa, Dengue virus
PYDPKFEKQL

SEQ ID NO: 40379 - protein, 10 aa, Dengue virus
YDPKFEKQLG

SEQ ID NO: 40380 - protein, 10 aa, Dengue virus
DPKFEKQLGQ

SEQ ID NO: 40381 - protein, 10 aa, Dengue virus
PKFEKQLGQV

SEQ ID NO: 40382 - protein, 10 aa, Dengue virus
KFEKQLGQVM

SEQ ID NO: 40383 - protein, 10 aa, Dengue virus
FEKQLGQVML

SEQ ID NO: 40384 - protein, 10 aa, Dengue virus
EKQLGQVMLL

SEQ ID NO: 40385 - protein, 10 aa, Dengue virus
KQLGQVMLLI

SEQ ID NO: 40386 - protein, 10 aa, Dengue virus
QLGQVMLLIL

SEQ ID NO: 40387 - protein, 10 aa, Dengue virus
LGQVMLLILC

SEQ ID NO: 40388 - protein, 10 aa, Dengue virus
GQVMLLILCV

SEQ ID NO: 40389 - protein, 10 aa, Dengue virus
QVMLLILCVT

SEQ ID NO: 40390 - protein, 10 aa, Dengue virus
VMLLILCVTQ

SEQ ID NO: 40391 - protein, 10 aa, Dengue virus
MLLILCVTQV

SEQ ID NO: 40392 - protein, 10 aa, Dengue virus
LLILCVTQVL

SEQ ID NO: 40393 - protein, 10 aa, Dengue virus
LILCVTQVLM

SEQ ID NO: 40394 - protein, 10 aa, Dengue virus
ILCVTQVLMM

SEQ ID NO: 40395 - protein, 10 aa, Dengue virus
LCVTQVLMMR

SEQ ID NO: 40396 - protein, 10 aa, Dengue virus
CVTQVLMMRT

SEQ ID NO: 40397 - protein, 10 aa, Dengue virus
VTQVLMMRTT

SEQ ID NO: 40398 - protein, 10 aa, Dengue virus
TQVLMMRTTW

SEQ ID NO: 40399 - protein, 10 aa, Dengue virus
QVLMMRTTWA

SEQ ID NO: 40400 - protein, 10 aa, Dengue virus
VLMMRTTWAL

SEQ ID NO: 40401 - protein, 10 aa, Dengue virus
LMMRTTWALC

SEQ ID NO: 40402 - protein, 10 aa, Dengue virus
MMRTTWALCE

SEQ ID NO: 40403 - protein, 10 aa, Dengue virus
MRTTWALCEA

SEQ ID NO: 40404 - protein, 10 aa, Dengue virus
RTTWALCEAL

SEQ ID NO: 40405 - protein, 10 aa, Dengue virus
TTWALCEALT

SEQ ID NO: 40406 - protein, 10 aa, Dengue virus
TWALCEALTL

SEQ ID NO: 40407 - protein, 10 aa, Dengue virus
WALCEALTLA

SEQ ID NO: 40408 - protein, 10 aa, Dengue virus
ALCEALTLAT

SEQ ID NO: 40409 - protein, 10 aa, Dengue virus
LCEALTLATG

SEQ ID NO: 40410 - protein, 10 aa, Dengue virus
CEALTLATGP

SEQ ID NO: 40411 - protein, 10 aa, Dengue virus
EALTLATGPI

SEQ ID NO: 40412 - protein, 10 aa, Dengue virus
ALTLATGPIS

SEQ ID NO: 40413 - protein, 10 aa, Dengue virus
LTLATGPIST

SEQ ID NO: 40414 - protein, 10 aa, Dengue virus
TLATGPISTL

SEQ ID NO: 40415 - protein, 10 aa, Dengue virus
LATGPISTLW

SEQ ID NO: 40416 - protein, 10 aa, Dengue virus
ATGPISTLWE

SEQ ID NO: 40417 - protein, 10 aa, Dengue virus
TGPISTLWEG

SEQ ID NO: 40418 - protein, 10 aa, Dengue virus
GPISTLWEGN

SEQ ID NO: 40419 - protein, 10 aa, Dengue virus
PISTLWEGNP

SEQ ID NO: 40420 - protein, 10 aa, Dengue virus
ISTLWEGNPG

SEQ ID NO: 40421 - protein, 10 aa, Dengue virus
STLWEGNPGR

SEQ ID NO: 40422 - protein, 10 aa, Dengue virus
TLWEGNPGRF

SEQ ID NO: 40423 - protein, 10 aa, Dengue virus
LWEGNPGRFW

SEQ ID NO: 40424 - protein, 10 aa, Dengue virus
WEGNPGRFWN

SEQ ID NO: 40425 - protein, 10 aa, Dengue virus
EGNPGRFWNT

SEQ ID NO: 40426 - protein, 10 aa, Dengue virus
GNPGRFWNTT

SEQ ID NO: 40427 - protein, 10 aa, Dengue virus
NPGRFWNTTI

SEQ ID NO: 40428 - protein, 10 aa, Dengue virus
PGRFWNTTIA

SEQ ID NO: 40429 - protein, 10 aa, Dengue virus
GRFWNTTIAV

SEQ ID NO: 40430 - protein, 10 aa, Dengue virus
RFWNTTIAVS

SEQ ID NO: 40431 - protein, 10 aa, Dengue virus
FWNTTIAVSM

SEQ ID NO: 40432 - protein, 10 aa, Dengue virus
WNTTIAVSMA

SEQ ID NO: 40433 - protein, 10 aa, Dengue virus
NTTIAVSMAN

SEQ ID NO: 40434 - protein, 10 aa, Dengue virus
TTIAVSMANI

SEQ ID NO: 40435 - protein, 10 aa, Dengue virus
TIAVSMANIF

SEQ ID NO: 40436 - protein, 10 aa, Dengue virus
IAVSMANIFR

SEQ ID NO: 40437 - protein, 10 aa, Dengue virus
AVSMANIFRG

SEQ ID NO: 40438 - protein, 10 aa, Dengue virus
VSMANIFRGS

SEQ ID NO: 40439 - protein, 10 aa, Dengue virus
SMANIFRGSY

SEQ ID NO: 40440 - protein, 10 aa, Dengue virus
MANIFRGSYL

SEQ ID NO: 40441 - protein, 10 aa, Dengue virus
ANIFRGSYLA

SEQ ID NO: 40442 - protein, 10 aa, Dengue virus
NIFRGSYLAG

SEQ ID NO: 40443 - protein, 10 aa, Dengue virus
IFRGSYLAGA

SEQ ID NO: 40444 - protein, 10 aa, Dengue virus
FRGSYLAGAG

SEQ ID NO: 40445 - protein, 10 aa, Dengue virus
RGSYLAGAGL

SEQ ID NO: 40446 - protein, 10 aa, Dengue virus
GSYLAGAGLL

SEQ ID NO: 40447 - protein, 10 aa, Dengue virus
SYLAGAGLLF

SEQ ID NO: 40448 - protein, 10 aa, Dengue virus
YLAGAGLLFS

SEQ ID NO: 40449 - protein, 10 aa, Dengue virus
LAGAGLLFSI

SEQ ID NO: 40450 - protein, 10 aa, Dengue virus
AGAGLLFSIM

SEQ ID NO: 40451 - protein, 10 aa, Dengue virus
GAGLLFSIMK

SEQ ID NO: 40452 - protein, 10 aa, Dengue virus
AGLLFSIMKN

SEQ ID NO: 40453 - protein, 10 aa, Dengue virus
GLLFSIMKNT

SEQ ID NO: 40454 - protein, 10 aa, Dengue virus
LLFSIMKNTT

SEQ ID NO: 40455 - protein, 10 aa, Dengue virus
LFSIMKNTTN

SEQ ID NO: 40456 - protein, 10 aa, Dengue virus
RRGTGNIGET

SEQ ID NO: 40457 - protein, 10 aa, Dengue virus
RGTGNIGETL

SEQ ID NO: 40458 - protein, 10 aa, Dengue virus
GTGNIGETLG

SEQ ID NO: 40459 - protein, 10 aa, Dengue virus
TGNIGETLGE

SEQ ID NO: 40460 - protein, 10 aa, Dengue virus
GNIGETLGEK

SEQ ID NO: 40461 - protein, 10 aa, Dengue virus
NIGETLGEKW

SEQ ID NO: 40462 - protein, 10 aa, Dengue virus
IGETLGEKWK

SEQ ID NO: 40463 - protein, 10 aa, Dengue virus
GETLGEKWKS

SEQ ID NO: 40464 - protein, 10 aa, Dengue virus
ETLGEKWKSR

SEQ ID NO: 40465 - protein, 10 aa, Dengue virus
TLGEKWKSRL

SEQ ID NO: 40466 - protein, 10 aa, Dengue virus
LGEKWKSRLN

SEQ ID NO: 40467 - protein, 10 aa, Dengue virus
GEKWKSRLNA

SEQ ID NO: 40468 - protein, 10 aa, Dengue virus
EKWKSRLNAL

SEQ ID NO: 40469 - protein, 10 aa, Dengue virus
KWKSRLNALG

SEQ ID NO: 40470 - protein, 10 aa, Dengue virus
LNALGKSEFQ

SEQ ID NO: 40471 - protein, 10 aa, Dengue virus
LGKSEFQIYK

SEQ ID NO: 40472 - protein, 10 aa, Dengue virus
GKSEFQIYKK

SEQ ID NO: 40473 - protein, 10 aa, Dengue virus
KSEFQIYKKS

SEQ ID NO: 40474 - protein, 10 aa, Dengue virus
SEFQIYKKSG

SEQ ID NO: 40475 - protein, 10 aa, Dengue virus
EFQIYKKSGI

SEQ ID NO: 40476 - protein, 10 aa, Dengue virus
FQIYKKSGIQ

SEQ ID NO: 40477 - protein, 10 aa, Dengue virus
QIYKKSGIQE

SEQ ID NO: 40478 - protein, 10 aa, Dengue virus
IYKKSGIQEV

SEQ ID NO: 40479 - protein, 10 aa, Dengue virus
YKKSGIQEVD

SEQ ID NO: 40480 - protein, 10 aa, Dengue virus
KKSGIQEVDR

SEQ ID NO: 40481 - protein, 10 aa, Dengue virus
KSGIQEVDRT

SEQ ID NO: 40482 - protein, 10 aa, Dengue virus
SGIQEVDRTL

SEQ ID NO: 40483 - protein, 10 aa, Dengue virus
GIQEVDRTLA

SEQ ID NO: 40484 - protein, 10 aa, Dengue virus
IQEVDRTLAK

SEQ ID NO: 40485 - protein, 10 aa, Dengue virus
QEVDRTLAKE

SEQ ID NO: 40486 - protein, 10 aa, Dengue virus
EVDRTLAKEG

SEQ ID NO: 40487 - protein, 10 aa, Dengue virus
VDRTLAKEGI

SEQ ID NO: 40488 - protein, 10 aa, Dengue virus
DRTLAKEGIK

SEQ ID NO: 40489 - protein, 10 aa, Dengue virus
RTLAKEGIKR

SEQ ID NO: 40490 - protein, 10 aa, Dengue virus
TLAKEGIKRG

SEQ ID NO: 40491 - protein, 10 aa, Dengue virus
LAKEGIKRGE

SEQ ID NO: 40492 - protein, 10 aa, Dengue virus
AKEGIKRGET

SEQ ID NO: 40493 - protein, 10 aa, Dengue virus
KEGIKRGETD

SEQ ID NO: 40494 - protein, 10 aa, Dengue virus
EGIKRGETDH

SEQ ID NO: 40495 - protein, 10 aa, Dengue virus
GIKRGETDHH

SEQ ID NO: 40496 - protein, 10 aa, Dengue virus
IKRGETDHHA

SEQ ID NO: 40497 - protein, 10 aa, Dengue virus
KRGETDHHAV

SEQ ID NO: 40498 - protein, 10 aa, Dengue virus
RGETDHHAVS

SEQ ID NO: 40499 - protein, 10 aa, Dengue virus
GETDHHAVSR

SEQ ID NO: 40500 - protein, 10 aa, Dengue virus
ETDHHAVSRG

SEQ ID NO: 40501 - protein, 10 aa, Dengue virus
TDHHAVSRGS

SEQ ID NO: 40502 - protein, 10 aa, Dengue virus
DHHAVSRGSA

SEQ ID NO: 40503 - protein, 10 aa, Dengue virus
HHAVSRGSAK

SEQ ID NO: 40504 - protein, 10 aa, Dengue virus
HAVSRGSAKL

SEQ ID NO: 40505 - protein, 10 aa, Dengue virus
AVSRGSAKLR

SEQ ID NO: 40506 - protein, 10 aa, Dengue virus
VSRGSAKLRW

SEQ ID NO: 40507 - protein, 10 aa, Dengue virus
SRGSAKLRWF

SEQ ID NO: 40508 - protein, 10 aa, Dengue virus
RGSAKLRWFV

SEQ ID NO: 40509 - protein, 10 aa, Dengue virus
GSAKLRWFVE

SEQ ID NO: 40510 - protein, 10 aa, Dengue virus
SAKLRWFVER

SEQ ID NO: 40511 - protein, 10 aa, Dengue virus
AKLRWFVERN

SEQ ID NO: 40512 - protein, 10 aa, Dengue virus
KLRWFVERNM

SEQ ID NO: 40513 - protein, 10 aa, Dengue virus
LRWFVERNMV

SEQ ID NO: 40514 - protein, 10 aa, Dengue virus
RWFVERNMVT

SEQ ID NO: 40515 - protein, 10 aa, Dengue virus
WFVERNMVTP

SEQ ID NO: 40516 - protein, 10 aa, Dengue virus
FVERNMVTPE

SEQ ID NO: 40517 - protein, 10 aa, Dengue virus
VERNMVTPEG

SEQ ID NO: 40518 - protein, 10 aa, Dengue virus
ERNMVTPEGK

SEQ ID NO: 40519 - protein, 10 aa, Dengue virus
RNMVTPEGKV

SEQ ID NO: 40520 - protein, 10 aa, Dengue virus
NMVTPEGKVV

SEQ ID NO: 40521 - protein, 10 aa, Dengue virus
MVTPEGKVVD

SEQ ID NO: 40522 - protein, 10 aa, Dengue virus
VTPEGKVVDL

SEQ ID NO: 40523 - protein, 10 aa, Dengue virus
TPEGKVVDLG

SEQ ID NO: 40524 - protein, 10 aa, Dengue virus
PEGKVVDLGC

SEQ ID NO: 40525 - protein, 10 aa, Dengue virus
EGKVVDLGCG

SEQ ID NO: 40526 - protein, 10 aa, Dengue virus
GKVVDLGCGR

SEQ ID NO: 40527 - protein, 10 aa, Dengue virus
KVVDLGCGRG

SEQ ID NO: 40528 - protein, 10 aa, Dengue virus
VVDLGCGRGG

SEQ ID NO: 40529 - protein, 10 aa, Dengue virus
VDLGCGRGGW

SEQ ID NO: 40530 - protein, 10 aa, Dengue virus
DLGCGRGGWS

SEQ ID NO: 40531 - protein, 10 aa, Dengue virus
LGCGRGGWSY

SEQ ID NO: 40532 - protein, 10 aa, Dengue virus
GCGRGGWSYY

SEQ ID NO: 40533 - protein, 10 aa, Dengue virus
CGRGGWSYYC

SEQ ID NO: 40534 - protein, 10 aa, Dengue virus
GRGGWSYYCG

SEQ ID NO: 40535 - protein, 10 aa, Dengue virus
RGGWSYYCGG

SEQ ID NO: 40536 - protein, 10 aa, Dengue virus
GGWSYYCGGL

SEQ ID NO: 40537 - protein, 10 aa, Dengue virus
GWSYYCGGLK

SEQ ID NO: 40538 - protein, 10 aa, Dengue virus
WSYYCGGLKN

SEQ ID NO: 40539 - protein, 10 aa, Dengue virus
SYYCGGLKNV

SEQ ID NO: 40540 - protein, 10 aa, Dengue virus
YYCGGLKNVR

SEQ ID NO: 40541 - protein, 10 aa, Dengue virus
YCGGLKNVRE

SEQ ID NO: 40542 - protein, 10 aa, Dengue virus
CGGLKNVREV

SEQ ID NO: 40543 - protein, 10 aa, Dengue virus
GGLKNVREVK

SEQ ID NO: 40544 - protein, 10 aa, Dengue virus
GLKNVREVKG

SEQ ID NO: 40545 - protein, 10 aa, Dengue virus
LKNVREVKGL

SEQ ID NO: 40546 - protein, 10 aa, Dengue virus
KNVREVKGLT

SEQ ID NO: 40547 - protein, 10 aa, Dengue virus
NVREVKGLTK

SEQ ID NO: 40548 - protein, 10 aa, Dengue virus
VREVKGLTKG

SEQ ID NO: 40549 - protein, 10 aa, Dengue virus
REVKGLTKGG

SEQ ID NO: 40550 - protein, 10 aa, Dengue virus
EVKGLTKGGP

SEQ ID NO: 40551 - protein, 10 aa, Dengue virus
VKGLTKGGPG

SEQ ID NO: 40552 - protein, 10 aa, Dengue virus
KGLTKGGPGH

SEQ ID NO: 40553 - protein, 10 aa, Dengue virus
GLTKGGPGHE

SEQ ID NO: 40554 - protein, 10 aa, Dengue virus
LTKGGPGHEE

SEQ ID NO: 40555 - protein, 10 aa, Dengue virus
TKGGPGHEEP

SEQ ID NO: 40556 - protein, 10 aa, Dengue virus
KGGPGHEEPI

SEQ ID NO: 40557 - protein, 10 aa, Dengue virus
GGPGHEEPIP

SEQ ID NO: 40558 - protein, 10 aa, Dengue virus
GPGHEEPIPM

SEQ ID NO: 40559 - protein, 10 aa, Dengue virus
PGHEEPIPMS

SEQ ID NO: 40560 - protein, 10 aa, Dengue virus
GHEEPIPMST

SEQ ID NO: 40561 - protein, 10 aa, Dengue virus
HEEPIPMSTY

SEQ ID NO: 40562 - protein, 10 aa, Dengue virus
EEPIPMSTYG

SEQ ID NO: 40563 - protein, 10 aa, Dengue virus
EPIPMSTYGW

SEQ ID NO: 40564 - protein, 10 aa, Dengue virus
PIPMSTYGWN

SEQ ID NO: 40565 - protein, 10 aa, Dengue virus
IPMSTYGWNL

SEQ ID NO: 40566 - protein, 10 aa, Dengue virus
PMSTYGWNLV

SEQ ID NO: 40567 - protein, 10 aa, Dengue virus
MSTYGWNLVR

SEQ ID NO: 40568 - protein, 10 aa, Dengue virus
STYGWNLVRL

SEQ ID NO: 40569 - protein, 10 aa, Dengue virus
TYGWNLVRLQ

SEQ ID NO: 40570 - protein, 10 aa, Dengue virus
YGWNLVRLQS

SEQ ID NO: 40571 - protein, 10 aa, Dengue virus
GWNLVRLQSG

SEQ ID NO: 40572 - protein, 10 aa, Dengue virus
WNLVRLQSGV

SEQ ID NO: 40573 - protein, 10 aa, Dengue virus
NLVRLQSGVD

SEQ ID NO: 40574 - protein, 10 aa, Dengue virus
LVRLQSGVDV

SEQ ID NO: 40575 - protein, 10 aa, Dengue virus
VRLQSGVDVF

SEQ ID NO: 40576 - protein, 10 aa, Dengue virus
RLQSGVDVFF

SEQ ID NO: 40577 - protein, 10 aa, Dengue virus
LQSGVDVFFT

SEQ ID NO: 40578 - protein, 10 aa, Dengue virus
QSGVDVFFTP

SEQ ID NO: 40579 - protein, 10 aa, Dengue virus
SGVDVFFTPP

SEQ ID NO: 40580 - protein, 10 aa, Dengue virus
GVDVFFTPPE

SEQ ID NO: 40581 - protein, 10 aa, Dengue virus
VDVFFTPPEK

SEQ ID NO: 40582 - protein, 10 aa, Dengue virus
DVFFTPPEKC

SEQ ID NO: 40583 - protein, 10 aa, Dengue virus
VFFTPPEKCD

SEQ ID NO: 40584 - protein, 10 aa, Dengue virus
FFTPPEKCDT

SEQ ID NO: 40585 - protein, 10 aa, Dengue virus
FTPPEKCDTL

SEQ ID NO: 40586 - protein, 10 aa, Dengue virus
TPPEKCDTLL

SEQ ID NO: 40587 - protein, 10 aa, Dengue virus
PPEKCDTLLC

SEQ ID NO: 40588 - protein, 10 aa, Dengue virus
PEKCDTLLCD

SEQ ID NO: 40589 - protein, 10 aa, Dengue virus
EKCDTLLCDI

SEQ ID NO: 40590 - protein, 10 aa, Dengue virus
KCDTLLCDIG

SEQ ID NO: 40591 - protein, 10 aa, Dengue virus
CDTLLCDIGE

SEQ ID NO: 40592 - protein, 10 aa, Dengue virus
DTLLCDIGES

SEQ ID NO: 40593 - protein, 10 aa, Dengue virus
TLLCDIGESS

SEQ ID NO: 40594 - protein, 10 aa, Dengue virus
LLCDIGESSP

SEQ ID NO: 40595 - protein, 10 aa, Dengue virus
LCDIGESSPN

SEQ ID NO: 40596 - protein, 10 aa, Dengue virus
CDIGESSPNP

SEQ ID NO: 40597 - protein, 10 aa, Dengue virus
DIGESSPNPT

SEQ ID NO: 40598 - protein, 10 aa, Dengue virus
IGESSPNPTI

SEQ ID NO: 40599 - protein, 10 aa, Dengue virus
GESSPNPTIE

SEQ ID NO: 40600 - protein, 10 aa, Dengue virus
ESSPNPTIEA

SEQ ID NO: 40601 - protein, 10 aa, Dengue virus
SSPNPTIEAG

SEQ ID NO: 40602 - protein, 10 aa, Dengue virus
SPNPTIEAGR

SEQ ID NO: 40603 - protein, 10 aa, Dengue virus
PNPTIEAGRT

SEQ ID NO: 40604 - protein, 10 aa, Dengue virus
NPTIEAGRTL

SEQ ID NO: 40605 - protein, 10 aa, Dengue virus
PTIEAGRTLR

SEQ ID NO: 40606 - protein, 10 aa, Dengue virus
TIEAGRTLRV

SEQ ID NO: 40607 - protein, 10 aa, Dengue virus
IEAGRTLRVL

SEQ ID NO: 40608 - protein, 10 aa, Dengue virus
EAGRTLRVLN

SEQ ID NO: 40609 - protein, 10 aa, Dengue virus
AGRTLRVLNL

SEQ ID NO: 40610 - protein, 10 aa, Dengue virus
GRTLRVLNLV

SEQ ID NO: 40611 - protein, 10 aa, Dengue virus
RTLRVLNLVE

SEQ ID NO: 40612 - protein, 10 aa, Dengue virus
TLRVLNLVEN

SEQ ID NO: 40613 - protein, 10 aa, Dengue virus
LRVLNLVENW

SEQ ID NO: 40614 - protein, 10 aa, Dengue virus
RVLNLVENWL

SEQ ID NO: 40615 - protein, 10 aa, Dengue virus
VLNLVENWLN

SEQ ID NO: 40616 - protein, 10 aa, Dengue virus
LNLVENWLNN

SEQ ID NO: 40617 - protein, 10 aa, Dengue virus
NLVENWLNNN

SEQ ID NO: 40618 - protein, 10 aa, Dengue virus
LVENWLNNNT

SEQ ID NO: 40619 - protein, 10 aa, Dengue virus
ENWLNNNTQF

SEQ ID NO: 40620 - protein, 10 aa, Dengue virus
NWLNNNTQFC

SEQ ID NO: 40621 - protein, 10 aa, Dengue virus
WLNNNTQFCI

SEQ ID NO: 40622 - protein, 10 aa, Dengue virus
LNNNTQFCIK

SEQ ID NO: 40623 - protein, 10 aa, Dengue virus
NNNTQFCIKV

SEQ ID NO: 40624 - protein, 10 aa, Dengue virus
NNTQFCIKVL

SEQ ID NO: 40625 - protein, 10 aa, Dengue virus
NTQFCIKVLN

SEQ ID NO: 40626 - protein, 10 aa, Dengue virus
TQFCIKVLNP

SEQ ID NO: 40627 - protein, 10 aa, Dengue virus
QFCIKVLNPY

SEQ ID NO: 40628 - protein, 10 aa, Dengue virus
FCIKVLNPYM

SEQ ID NO: 40629 - protein, 10 aa, Dengue virus
CIKVLNPYMP

SEQ ID NO: 40630 - protein, 10 aa, Dengue virus
IKVLNPYMPS

SEQ ID NO: 40631 - protein, 10 aa, Dengue virus
KVLNPYMPSV

SEQ ID NO: 40632 - protein, 10 aa, Dengue virus
VLNPYMPSVI

SEQ ID NO: 40633 - protein, 10 aa, Dengue virus
LNPYMPSVIE

SEQ ID NO: 40634 - protein, 10 aa, Dengue virus
NPYMPSVIEK

SEQ ID NO: 40635 - protein, 10 aa, Dengue virus
PYMPSVIEKM

SEQ ID NO: 40636 - protein, 10 aa, Dengue virus
YMPSVIEKME

SEQ ID NO: 40637 - protein, 10 aa, Dengue virus
MPSVIEKMEA

SEQ ID NO: 40638 - protein, 10 aa, Dengue virus
PSVIEKMEAL

SEQ ID NO: 40639 - protein, 10 aa, Dengue virus
SVIEKMEALQ

SEQ ID NO: 40640 - protein, 10 aa, Dengue virus
VIEKMEALQR

SEQ ID NO: 40641 - protein, 10 aa, Dengue virus
LQRKYGGALV

SEQ ID NO: 40642 - protein, 10 aa, Dengue virus
QRKYGGALVR

SEQ ID NO: 40643 - protein, 10 aa, Dengue virus
RKYGGALVRN

SEQ ID NO: 40644 - protein, 10 aa, Dengue virus
KYGGALVRNP

SEQ ID NO: 40645 - protein, 10 aa, Dengue virus
YGGALVRNPL

SEQ ID NO: 40646 - protein, 10 aa, Dengue virus
GGALVRNPLS

SEQ ID NO: 40647 - protein, 10 aa, Dengue virus
GALVRNPLSR

SEQ ID NO: 40648 - protein, 10 aa, Dengue virus
ALVRNPLSRN

SEQ ID NO: 40649 - protein, 10 aa, Dengue virus
LVRNPLSRNS

SEQ ID NO: 40650 - protein, 10 aa, Dengue virus
VRNPLSRNST

SEQ ID NO: 40651 - protein, 10 aa, Dengue virus
RNPLSRNSTH

SEQ ID NO: 40652 - protein, 10 aa, Dengue virus
NPLSRNSTHE

SEQ ID NO: 40653 - protein, 10 aa, Dengue virus
PLSRNSTHEM

SEQ ID NO: 40654 - protein, 10 aa, Dengue virus
LSRNSTHEMY

SEQ ID NO: 40655 - protein, 10 aa, Dengue virus
SRNSTHEMYW

SEQ ID NO: 40656 - protein, 10 aa, Dengue virus
RNSTHEMYWV

SEQ ID NO: 40657 - protein, 10 aa, Dengue virus
NSTHEMYWVS

SEQ ID NO: 40658 - protein, 10 aa, Dengue virus
STHEMYWVSN

SEQ ID NO: 40659 - protein, 10 aa, Dengue virus
THEMYWVSNA

SEQ ID NO: 40660 - protein, 10 aa, Dengue virus
HEMYWVSNAT

SEQ ID NO: 40661 - protein, 10 aa, Dengue virus
EMYWVSNATG

SEQ ID NO: 40662 - protein, 10 aa, Dengue virus
MYWVSNATGN

SEQ ID NO: 40663 - protein, 10 aa, Dengue virus
YWVSNATGNI

SEQ ID NO: 40664 - protein, 10 aa, Dengue virus
WVSNATGNIV

SEQ ID NO: 40665 - protein, 10 aa, Dengue virus
VSNATGNIVS

SEQ ID NO: 40666 - protein, 10 aa, Dengue virus
SNATGNIVSS

SEQ ID NO: 40667 - protein, 10 aa, Dengue virus
NATGNIVSSV

SEQ ID NO: 40668 - protein, 10 aa, Dengue virus
ATGNIVSSVN

SEQ ID NO: 40669 - protein, 10 aa, Dengue virus
TGNIVSSVNM

SEQ ID NO: 40670 - protein, 10 aa, Dengue virus
GNIVSSVNMI

SEQ ID NO: 40671 - protein, 10 aa, Dengue virus
NIVSSVNMIS

SEQ ID NO: 40672 - protein, 10 aa, Dengue virus
IVSSVNMISR

SEQ ID NO: 40673 - protein, 10 aa, Dengue virus
VSSVNMISRM

SEQ ID NO: 40674 - protein, 10 aa, Dengue virus
SSVNMISRML

SEQ ID NO: 40675 - protein, 10 aa, Dengue virus
SVNMISRMLI

SEQ ID NO: 40676 - protein, 10 aa, Dengue virus
VNMISRMLIN

SEQ ID NO: 40677 - protein, 10 aa, Dengue virus
NMISRMLINR

SEQ ID NO: 40678 - protein, 10 aa, Dengue virus
MISRMLINRF

SEQ ID NO: 40679 - protein, 10 aa, Dengue virus
ISRMLINRFT

SEQ ID NO: 40680 - protein, 10 aa, Dengue virus
SRMLINRFTM

SEQ ID NO: 40681 - protein, 10 aa, Dengue virus
RMLINRFTMK

SEQ ID NO: 40682 - protein, 10 aa, Dengue virus
MLINRFTMKH

SEQ ID NO: 40683 - protein, 10 aa, Dengue virus
LINRFTMKHK

SEQ ID NO: 40684 - protein, 10 aa, Dengue virus
INRFTMKHKK

SEQ ID NO: 40685 - protein, 10 aa, Dengue virus
NRFTMKHKKA

SEQ ID NO: 40686 - protein, 10 aa, Dengue virus
RFTMKHKKAT

SEQ ID NO: 40687 - protein, 10 aa, Dengue virus
FTMKHKKATY

SEQ ID NO: 40688 - protein, 10 aa, Dengue virus
TMKHKKATYE

SEQ ID NO: 40689 - protein, 10 aa, Dengue virus
MKHKKATYEP

SEQ ID NO: 40690 - protein, 10 aa, Dengue virus
KHKKATYEPD

SEQ ID NO: 40691 - protein, 10 aa, Dengue virus
HKKATYEPDV

SEQ ID NO: 40692 - protein, 10 aa, Dengue virus
KKATYEPDVD

SEQ ID NO: 40693 - protein, 10 aa, Dengue virus
KATYEPDVDL

SEQ ID NO: 40694 - protein, 10 aa, Dengue virus
ATYEPDVDLG

SEQ ID NO: 40695 - protein, 10 aa, Dengue virus
TYEPDVDLGS

SEQ ID NO: 40696 - protein, 10 aa, Dengue virus
YEPDVDLGSG

SEQ ID NO: 40697 - protein, 10 aa, Dengue virus
EPDVDLGSGT

SEQ ID NO: 40698 - protein, 10 aa, Dengue virus
PDVDLGSGTR

SEQ ID NO: 40699 - protein, 10 aa, Dengue virus
DVDLGSGTRN

SEQ ID NO: 40700 - protein, 10 aa, Dengue virus
VDLGSGTRNI

SEQ ID NO: 40701 - protein, 10 aa, Dengue virus
DLGSGTRNIG

SEQ ID NO: 40702 - protein, 10 aa, Dengue virus
LGSGTRNIGI

SEQ ID NO: 40703 - protein, 10 aa, Dengue virus
GSGTRNIGIE

SEQ ID NO: 40704 - protein, 10 aa, Dengue virus
SGTRNIGIES

SEQ ID NO: 40705 - protein, 10 aa, Dengue virus
GTRNIGIESE

SEQ ID NO: 40706 - protein, 10 aa, Dengue virus
EIPNLDIIGK

SEQ ID NO: 40707 - protein, 10 aa, Dengue virus
IPNLDIIGKR

SEQ ID NO: 40708 - protein, 10 aa, Dengue virus
PNLDIIGKRI

SEQ ID NO: 40709 - protein, 10 aa, Dengue virus
NLDIIGKRIE

SEQ ID NO: 40710 - protein, 10 aa, Dengue virus
LDIIGKRIEK

SEQ ID NO: 40711 - protein, 10 aa, Dengue virus
DIIGKRIEKI

SEQ ID NO: 40712 - protein, 10 aa, Dengue virus
IIGKRIEKIK

SEQ ID NO: 40713 - protein, 10 aa, Dengue virus
IGKRIEKIKQ

SEQ ID NO: 40714 - protein, 10 aa, Dengue virus
GKRIEKIKQE

SEQ ID NO: 40715 - protein, 10 aa, Dengue virus
KRIEKIKQEH

SEQ ID NO: 40716 - protein, 10 aa, Dengue virus
RIEKIKQEHE

SEQ ID NO: 40717 - protein, 10 aa, Dengue virus
IEKIKQEHET

SEQ ID NO: 40718 - protein, 10 aa, Dengue virus
EKIKQEHETS

SEQ ID NO: 40719 - protein, 10 aa, Dengue virus
KIKQEHETSW

SEQ ID NO: 40720 - protein, 10 aa, Dengue virus
IKQEHETSWH

SEQ ID NO: 40721 - protein, 10 aa, Dengue virus
KQEHETSWHY

SEQ ID NO: 40722 - protein, 10 aa, Dengue virus
QEHETSWHYD

SEQ ID NO: 40723 - protein, 10 aa, Dengue virus
EHETSWHYDQ

SEQ ID NO: 40724 - protein, 10 aa, Dengue virus
HETSWHYDQD

SEQ ID NO: 40725 - protein, 10 aa, Dengue virus
ETSWHYDQDH

SEQ ID NO: 40726 - protein, 10 aa, Dengue virus
TSWHYDQDHP

SEQ ID NO: 40727 - protein, 10 aa, Dengue virus
SWHYDQDHPY

SEQ ID NO: 40728 - protein, 10 aa, Dengue virus
WHYDQDHPYK

SEQ ID NO: 40729 - protein, 10 aa, Dengue virus
HYDQDHPYKT

SEQ ID NO: 40730 - protein, 10 aa, Dengue virus
YDQDHPYKTW

SEQ ID NO: 40731 - protein, 10 aa, Dengue virus
DQDHPYKTWA

SEQ ID NO: 40732 - protein, 10 aa, Dengue virus
QDHPYKTWAY

SEQ ID NO: 40733 - protein, 10 aa, Dengue virus
DHPYKTWAYH

SEQ ID NO: 40734 - protein, 10 aa, Dengue virus
HPYKTWAYHG

SEQ ID NO: 40735 - protein, 10 aa, Dengue virus
PYKTWAYHGS

SEQ ID NO: 40736 - protein, 10 aa, Dengue virus
YKTWAYHGSY

SEQ ID NO: 40737 - protein, 10 aa, Dengue virus
KTWAYHGSYE

SEQ ID NO: 40738 - protein, 10 aa, Dengue virus
TWAYHGSYET

SEQ ID NO: 40739 - protein, 10 aa, Dengue virus
WAYHGSYETK

SEQ ID NO: 40740 - protein, 10 aa, Dengue virus
AYHGSYETKQ

SEQ ID NO: 40741 - protein, 10 aa, Dengue virus
YHGSYETKQT

SEQ ID NO: 40742 - protein, 10 aa, Dengue virus
HGSYETKQTG

SEQ ID NO: 40743 - protein, 10 aa, Dengue virus
GSYETKQTGS

SEQ ID NO: 40744 - protein, 10 aa, Dengue virus
SYETKQTGSA

SEQ ID NO: 40745 - protein, 10 aa, Dengue virus
YETKQTGSAS

SEQ ID NO: 40746 - protein, 10 aa, Dengue virus
ETKQTGSASS

SEQ ID NO: 40747 - protein, 10 aa, Dengue virus
TKQTGSASSM

SEQ ID NO: 40748 - protein, 10 aa, Dengue virus
KQTGSASSMV

SEQ ID NO: 40749 - protein, 10 aa, Dengue virus
QTGSASSMVN

SEQ ID NO: 40750 - protein, 10 aa, Dengue virus
TGSASSMVNG

SEQ ID NO: 40751 - protein, 10 aa, Dengue virus
GSASSMVNGV

SEQ ID NO: 40752 - protein, 10 aa, Dengue virus
SASSMVNGVV

SEQ ID NO: 40753 - protein, 10 aa, Dengue virus
ASSMVNGVVR

SEQ ID NO: 40754 - protein, 10 aa, Dengue virus
SSMVNGVVRL

SEQ ID NO: 40755 - protein, 10 aa, Dengue virus
SMVNGVVRLL

SEQ ID NO: 40756 - protein, 10 aa, Dengue virus
MVNGVVRLLT

SEQ ID NO: 40757 - protein, 10 aa, Dengue virus
VNGVVRLLTK

SEQ ID NO: 40758 - protein, 10 aa, Dengue virus
NGVVRLLTKP

SEQ ID NO: 40759 - protein, 10 aa, Dengue virus
GVVRLLTKPW

SEQ ID NO: 40760 - protein, 10 aa, Dengue virus
VVRLLTKPWD

SEQ ID NO: 40761 - protein, 10 aa, Dengue virus
VRLLTKPWDV

SEQ ID NO: 40762 - protein, 10 aa, Dengue virus
RLLTKPWDVV

SEQ ID NO: 40763 - protein, 10 aa, Dengue virus
LLTKPWDVVP

SEQ ID NO: 40764 - protein, 10 aa, Dengue virus
LTKPWDVVPM

SEQ ID NO: 40765 - protein, 10 aa, Dengue virus
TKPWDVVPMV

SEQ ID NO: 40766 - protein, 10 aa, Dengue virus
KPWDVVPMVT

SEQ ID NO: 40767 - protein, 10 aa, Dengue virus
PWDVVPMVTQ

SEQ ID NO: 40768 - protein, 10 aa, Dengue virus
WDVVPMVTQM

SEQ ID NO: 40769 - protein, 10 aa, Dengue virus
DVVPMVTQMA

SEQ ID NO: 40770 - protein, 10 aa, Dengue virus
VVPMVTQMAM

SEQ ID NO: 40771 - protein, 10 aa, Dengue virus
VPMVTQMAMT

SEQ ID NO: 40772 - protein, 10 aa, Dengue virus
PMVTQMAMTD

SEQ ID NO: 40773 - protein, 10 aa, Dengue virus
MVTQMAMTDT

SEQ ID NO: 40774 - protein, 10 aa, Dengue virus
VTQMAMTDTT

SEQ ID NO: 40775 - protein, 10 aa, Dengue virus
TQMAMTDTTP

SEQ ID NO: 40776 - protein, 10 aa, Dengue virus
QMAMTDTTPF

SEQ ID NO: 40777 - protein, 10 aa, Dengue virus
MAMTDTTPFG

SEQ ID NO: 40778 - protein, 10 aa, Dengue virus
AMTDTTPFGQ

SEQ ID NO: 40779 - protein, 10 aa, Dengue virus
MTDTTPFGQQ

SEQ ID NO: 40780 - protein, 10 aa, Dengue virus
TDTTPFGQQR

SEQ ID NO: 40781 - protein, 10 aa, Dengue virus
DTTPFGQQRV

SEQ ID NO: 40782 - protein, 10 aa, Dengue virus
TTPFGQQRVF

SEQ ID NO: 40783 - protein, 10 aa, Dengue virus
TPFGQQRVFK

SEQ ID NO: 40784 - protein, 10 aa, Dengue virus
PFGQQRVFKE

SEQ ID NO: 40785 - protein, 10 aa, Dengue virus
FGQQRVFKEK

SEQ ID NO: 40786 - protein, 10 aa, Dengue virus
GQQRVFKEKV

SEQ ID NO: 40787 - protein, 10 aa, Dengue virus
QQRVFKEKVD

SEQ ID NO: 40788 - protein, 10 aa, Dengue virus
QRVFKEKVDT

SEQ ID NO: 40789 - protein, 10 aa, Dengue virus
RVFKEKVDTR

SEQ ID NO: 40790 - protein, 10 aa, Dengue virus
VFKEKVDTRT

SEQ ID NO: 40791 - protein, 10 aa, Dengue virus
FKEKVDTRTQ

SEQ ID NO: 40792 - protein, 10 aa, Dengue virus
KEKVDTRTQE

SEQ ID NO: 40793 - protein, 10 aa, Dengue virus
EKVDTRTQEP

SEQ ID NO: 40794 - protein, 10 aa, Dengue virus
KVDTRTQEPK

SEQ ID NO: 40795 - protein, 10 aa, Dengue virus
VDTRTQEPKE

SEQ ID NO: 40796 - protein, 10 aa, Dengue virus
DTRTQEPKEG

SEQ ID NO: 40797 - protein, 10 aa, Dengue virus
TRTQEPKEGT

SEQ ID NO: 40798 - protein, 10 aa, Dengue virus
RTQEPKEGTK

SEQ ID NO: 40799 - protein, 10 aa, Dengue virus
TQEPKEGTKK

SEQ ID NO: 40800 - protein, 10 aa, Dengue virus
QEPKEGTKKL

SEQ ID NO: 40801 - protein, 10 aa, Dengue virus
EPKEGTKKLM

SEQ ID NO: 40802 - protein, 10 aa, Dengue virus
PKEGTKKLMK

SEQ ID NO: 40803 - protein, 10 aa, Dengue virus
KEGTKKLMKI

SEQ ID NO: 40804 - protein, 10 aa, Dengue virus
EGTKKLMKIT

SEQ ID NO: 40805 - protein, 10 aa, Dengue virus
GTKKLMKITA

SEQ ID NO: 40806 - protein, 10 aa, Dengue virus
TKKLMKITAE

SEQ ID NO: 40807 - protein, 10 aa, Dengue virus
KKLMKITAEW

SEQ ID NO: 40808 - protein, 10 aa, Dengue virus
KLMKITAEWL

SEQ ID NO: 40809 - protein, 10 aa, Dengue virus
LMKITAEWLW

SEQ ID NO: 40810 - protein, 10 aa, Dengue virus
MKITAEWLWK

SEQ ID NO: 40811 - protein, 10 aa, Dengue virus
KITAEWLWKE

SEQ ID NO: 40812 - protein, 10 aa, Dengue virus
ITAEWLWKEL

SEQ ID NO: 40813 - protein, 10 aa, Dengue virus
TAEWLWKELG

SEQ ID NO: 40814 - protein, 10 aa, Dengue virus
AEWLWKELGK

SEQ ID NO: 40815 - protein, 10 aa, Dengue virus
WLWKELGKKK

SEQ ID NO: 40816 - protein, 10 aa, Dengue virus
LWKELGKKKT

SEQ ID NO: 40817 - protein, 10 aa, Dengue virus
WKELGKKKTP

SEQ ID NO: 40818 - protein, 10 aa, Dengue virus
KELGKKKTPR

SEQ ID NO: 40819 - protein, 10 aa, Dengue virus
KTPRMCTREE

SEQ ID NO: 40820 - protein, 10 aa, Dengue virus
TPRMCTREEF

SEQ ID NO: 40821 - protein, 10 aa, Dengue virus
PRMCTREEFT

SEQ ID NO: 40822 - protein, 10 aa, Dengue virus
CTREEFTRKV

SEQ ID NO: 40823 - protein, 10 aa, Dengue virus
TREEFTRKVR

SEQ ID NO: 40824 - protein, 10 aa, Dengue virus
REEFTRKVRS

SEQ ID NO: 40825 - protein, 10 aa, Dengue virus
EEFTRKVRSN

SEQ ID NO: 40826 - protein, 10 aa, Dengue virus
EFTRKVRSNA

SEQ ID NO: 40827 - protein, 10 aa, Dengue virus
FTRKVRSNAA

SEQ ID NO: 40828 - protein, 10 aa, Dengue virus
TRKVRSNAAL

SEQ ID NO: 40829 - protein, 10 aa, Dengue virus
RKVRSNAALG

SEQ ID NO: 40830 - protein, 10 aa, Dengue virus
KVRSNAALGA

SEQ ID NO: 40831 - protein, 10 aa, Dengue virus
VRSNAALGAI

SEQ ID NO: 40832 - protein, 10 aa, Dengue virus
RSNAALGAIF

SEQ ID NO: 40833 - protein, 10 aa, Dengue virus
SNAALGAIFT

SEQ ID NO: 40834 - protein, 10 aa, Dengue virus
NAALGAIFTD

SEQ ID NO: 40835 - protein, 10 aa, Dengue virus
AALGAIFTDE

SEQ ID NO: 40836 - protein, 10 aa, Dengue virus
ALGAIFTDEN

SEQ ID NO: 40837 - protein, 10 aa, Dengue virus
LGAIFTDENK

SEQ ID NO: 40838 - protein, 10 aa, Dengue virus
GAIFTDENKW

SEQ ID NO: 40839 - protein, 10 aa, Dengue virus
AIFTDENKWK

SEQ ID NO: 40840 - protein, 10 aa, Dengue virus
IFTDENKWKS

SEQ ID NO: 40841 - protein, 10 aa, Dengue virus
FTDENKWKSA

SEQ ID NO: 40842 - protein, 10 aa, Dengue virus
TDENKWKSAR

SEQ ID NO: 40843 - protein, 10 aa, Dengue virus
DENKWKSARE

SEQ ID NO: 40844 - protein, 10 aa, Dengue virus
ENKWKSAREA

SEQ ID NO: 40845 - protein, 10 aa, Dengue virus
NKWKSAREAV

SEQ ID NO: 40846 - protein, 10 aa, Dengue virus
KWKSAREAVE

SEQ ID NO: 40847 - protein, 10 aa, Dengue virus
WKSAREAVED

SEQ ID NO: 40848 - protein, 10 aa, Dengue virus
KSAREAVEDS

SEQ ID NO: 40849 - protein, 10 aa, Dengue virus
SAREAVEDSR

SEQ ID NO: 40850 - protein, 10 aa, Dengue virus
AREAVEDSRF

SEQ ID NO: 40851 - protein, 10 aa, Dengue virus
REAVEDSRFW

SEQ ID NO: 40852 - protein, 10 aa, Dengue virus
EAVEDSRFWE

SEQ ID NO: 40853 - protein, 10 aa, Dengue virus
AVEDSRFWEL

SEQ ID NO: 40854 - protein, 10 aa, Dengue virus
FWELVDKERN

SEQ ID NO: 40855 - protein, 10 aa, Dengue virus
WELVDKERNL

SEQ ID NO: 40856 - protein, 10 aa, Dengue virus
ELVDKERNLH

SEQ ID NO: 40857 - protein, 10 aa, Dengue virus
LVDKERNLHL

SEQ ID NO: 40858 - protein, 10 aa, Dengue virus
DKERNLHLEG

SEQ ID NO: 40859 - protein, 10 aa, Dengue virus
KERNLHLEGK

SEQ ID NO: 40860 - protein, 10 aa, Dengue virus
ERNLHLEGKC

SEQ ID NO: 40861 - protein, 10 aa, Dengue virus
RNLHLEGKCE

SEQ ID NO: 40862 - protein, 10 aa, Dengue virus
NLHLEGKCET

SEQ ID NO: 40863 - protein, 10 aa, Dengue virus
LHLEGKCETC

SEQ ID NO: 40864 - protein, 10 aa, Dengue virus
HLEGKCETCV

SEQ ID NO: 40865 - protein, 10 aa, Dengue virus
LEGKCETCVY

SEQ ID NO: 40866 - protein, 10 aa, Dengue virus
EGKCETCVYN

SEQ ID NO: 40867 - protein, 10 aa, Dengue virus
GKCETCVYNM

SEQ ID NO: 40868 - protein, 10 aa, Dengue virus
KCETCVYNMM

SEQ ID NO: 40869 - protein, 10 aa, Dengue virus
CETCVYNMMG

SEQ ID NO: 40870 - protein, 10 aa, Dengue virus
ETCVYNMMGK

SEQ ID NO: 40871 - protein, 10 aa, Dengue virus
TCVYNMMGKR

SEQ ID NO: 40872 - protein, 10 aa, Dengue virus
CVYNMMGKRE

SEQ ID NO: 40873 - protein, 10 aa, Dengue virus
VYNMMGKREK

SEQ ID NO: 40874 - protein, 10 aa, Dengue virus
YNMMGKREKK

SEQ ID NO: 40875 - protein, 10 aa, Dengue virus
NMMGKREKKL

SEQ ID NO: 40876 - protein, 10 aa, Dengue virus
MMGKREKKLG

SEQ ID NO: 40877 - protein, 10 aa, Dengue virus
MGKREKKLGE

SEQ ID NO: 40878 - protein, 10 aa, Dengue virus
GKREKKLGEF

SEQ ID NO: 40879 - protein, 10 aa, Dengue virus
KREKKLGEFG

SEQ ID NO: 40880 - protein, 10 aa, Dengue virus
REKKLGEFGK

SEQ ID NO: 40881 - protein, 10 aa, Dengue virus
EKKLGEFGKA

SEQ ID NO: 40882 - protein, 10 aa, Dengue virus
KKLGEFGKAK

SEQ ID NO: 40883 - protein, 10 aa, Dengue virus
KLGEFGKAKG

SEQ ID NO: 40884 - protein, 10 aa, Dengue virus
LGEFGKAKGS

SEQ ID NO: 40885 - protein, 10 aa, Dengue virus
GEFGKAKGSR

SEQ ID NO: 40886 - protein, 10 aa, Dengue virus
EFGKAKGSRA

SEQ ID NO: 40887 - protein, 10 aa, Dengue virus
FGKAKGSRAI

SEQ ID NO: 40888 - protein, 10 aa, Dengue virus
GKAKGSRAIW

SEQ ID NO: 40889 - protein, 10 aa, Dengue virus
KAKGSRAIWY

SEQ ID NO: 40890 - protein, 10 aa, Dengue virus
AKGSRAIWYM

SEQ ID NO: 40891 - protein, 10 aa, Dengue virus
KGSRAIWYMW

SEQ ID NO: 40892 - protein, 10 aa, Dengue virus
GSRAIWYMWL

SEQ ID NO: 40893 - protein, 10 aa, Dengue virus
SRAIWYMWLG

SEQ ID NO: 40894 - protein, 10 aa, Dengue virus
RAIWYMWLGA

SEQ ID NO: 40895 - protein, 10 aa, Dengue virus
AIWYMWLGAR

SEQ ID NO: 40896 - protein, 10 aa, Dengue virus
IWYMWLGARF

SEQ ID NO: 40897 - protein, 10 aa, Dengue virus
WYMWLGARFL

SEQ ID NO: 40898 - protein, 10 aa, Dengue virus
YMWLGARFLE

SEQ ID NO: 40899 - protein, 10 aa, Dengue virus
MWLGARFLEF

SEQ ID NO: 40900 - protein, 10 aa, Dengue virus
WLGARFLEFE

SEQ ID NO: 40901 - protein, 10 aa, Dengue virus
LGARFLEFEA

SEQ ID NO: 40902 - protein, 10 aa, Dengue virus
GARFLEFEAL

SEQ ID NO: 40903 - protein, 10 aa, Dengue virus
ARFLEFEALG

SEQ ID NO: 40904 - protein, 10 aa, Dengue virus
RFLEFEALGF

SEQ ID NO: 40905 - protein, 10 aa, Dengue virus
FLEFEALGFL

SEQ ID NO: 40906 - protein, 10 aa, Dengue virus
LEFEALGFLN

SEQ ID NO: 40907 - protein, 10 aa, Dengue virus
EFEALGFLNE

SEQ ID NO: 40908 - protein, 10 aa, Dengue virus
FEALGFLNED

SEQ ID NO: 40909 - protein, 10 aa, Dengue virus
EALGFLNEDH

SEQ ID NO: 40910 - protein, 10 aa, Dengue virus
ALGFLNEDHW

SEQ ID NO: 40911 - protein, 10 aa, Dengue virus
LGFLNEDHWF

SEQ ID NO: 40912 - protein, 10 aa, Dengue virus
GFLNEDHWFS

SEQ ID NO: 40913 - protein, 10 aa, Dengue virus
FLNEDHWFSR

SEQ ID NO: 40914 - protein, 10 aa, Dengue virus
LNEDHWFSRE

SEQ ID NO: 40915 - protein, 10 aa, Dengue virus
NEDHWFSREN

SEQ ID NO: 40916 - protein, 10 aa, Dengue virus
EDHWFSRENS

SEQ ID NO: 40917 - protein, 10 aa, Dengue virus
DHWFSRENSL

SEQ ID NO: 40918 - protein, 10 aa, Dengue virus
HWFSRENSLS

SEQ ID NO: 40919 - protein, 10 aa, Dengue virus
WFSRENSLSG

SEQ ID NO: 40920 - protein, 10 aa, Dengue virus
FSRENSLSGV

SEQ ID NO: 40921 - protein, 10 aa, Dengue virus
SRENSLSGVE

SEQ ID NO: 40922 - protein, 10 aa, Dengue virus
RENSLSGVEG

SEQ ID NO: 40923 - protein, 10 aa, Dengue virus
ENSLSGVEGE

SEQ ID NO: 40924 - protein, 10 aa, Dengue virus
NSLSGVEGEG

SEQ ID NO: 40925 - protein, 10 aa, Dengue virus
SLSGVEGEGL

SEQ ID NO: 40926 - protein, 10 aa, Dengue virus
LSGVEGEGLH

SEQ ID NO: 40927 - protein, 10 aa, Dengue virus
SGVEGEGLHK

SEQ ID NO: 40928 - protein, 10 aa, Dengue virus
GVEGEGLHKL

SEQ ID NO: 40929 - protein, 10 aa, Dengue virus
VEGEGLHKLG

SEQ ID NO: 40930 - protein, 10 aa, Dengue virus
EGEGLHKLGY

SEQ ID NO: 40931 - protein, 10 aa, Dengue virus
GEGLHKLGYI

SEQ ID NO: 40932 - protein, 10 aa, Dengue virus
EGLHKLGYIL

SEQ ID NO: 40933 - protein, 10 aa, Dengue virus
GLHKLGYILR

SEQ ID NO: 40934 - protein, 10 aa, Dengue virus
LHKLGYILRD

SEQ ID NO: 40935 - protein, 10 aa, Dengue virus
HKLGYILRDV

SEQ ID NO: 40936 - protein, 10 aa, Dengue virus
LGYILRDVSK

SEQ ID NO: 40937 - protein, 10 aa, Dengue virus
GYILRDVSKK

SEQ ID NO: 40938 - protein, 10 aa, Dengue virus
VSKKEGGAMY

SEQ ID NO: 40939 - protein, 10 aa, Dengue virus
SKKEGGAMYA

SEQ ID NO: 40940 - protein, 10 aa, Dengue virus
KKEGGAMYAD

SEQ ID NO: 40941 - protein, 10 aa, Dengue virus
KEGGAMYADD

SEQ ID NO: 40942 - protein, 10 aa, Dengue virus
EGGAMYADDT

SEQ ID NO: 40943 - protein, 10 aa, Dengue virus
GGAMYADDTA

SEQ ID NO: 40944 - protein, 10 aa, Dengue virus
GAMYADDTAG

SEQ ID NO: 40945 - protein, 10 aa, Dengue virus
AMYADDTAGW

SEQ ID NO: 40946 - protein, 10 aa, Dengue virus
MYADDTAGWD

SEQ ID NO: 40947 - protein, 10 aa, Dengue virus
YADDTAGWDT

SEQ ID NO: 40948 - protein, 10 aa, Dengue virus
ADDTAGWDTR

SEQ ID NO: 40949 - protein, 10 aa, Dengue virus
DDTAGWDTRI

SEQ ID NO: 40950 - protein, 10 aa, Dengue virus
DTAGWDTRIT

SEQ ID NO: 40951 - protein, 10 aa, Dengue virus
TAGWDTRITL

SEQ ID NO: 40952 - protein, 10 aa, Dengue virus
AGWDTRITLE

SEQ ID NO: 40953 - protein, 10 aa, Dengue virus
GWDTRITLED

SEQ ID NO: 40954 - protein, 10 aa, Dengue virus
WDTRITLEDL

SEQ ID NO: 40955 - protein, 10 aa, Dengue virus
DTRITLEDLK

SEQ ID NO: 40956 - protein, 10 aa, Dengue virus
TRITLEDLKN

SEQ ID NO: 40957 - protein, 10 aa, Dengue virus
RITLEDLKNE

SEQ ID NO: 40958 - protein, 10 aa, Dengue virus
ITLEDLKNEE

SEQ ID NO: 40959 - protein, 10 aa, Dengue virus
TLEDLKNEEM

SEQ ID NO: 40960 - protein, 10 aa, Dengue virus
LEDLKNEEMV

SEQ ID NO: 40961 - protein, 10 aa, Dengue virus
EDLKNEEMVT

SEQ ID NO: 40962 - protein, 10 aa, Dengue virus
DLKNEEMVTN

SEQ ID NO: 40963 - protein, 10 aa, Dengue virus
LKNEEMVTNH

SEQ ID NO: 40964 - protein, 10 aa, Dengue virus
KNEEMVTNHM

SEQ ID NO: 40965 - protein, 10 aa, Dengue virus
GEHKKLAEAI

SEQ ID NO: 40966 - protein, 10 aa, Dengue virus
EHKKLAEAIF

SEQ ID NO: 40967 - protein, 10 aa, Dengue virus
HKKLAEAIFK

SEQ ID NO: 40968 - protein, 10 aa, Dengue virus
KKLAEAIFKL

SEQ ID NO: 40969 - protein, 10 aa, Dengue virus
KLAEAIFKLT

SEQ ID NO: 40970 - protein, 10 aa, Dengue virus
LAEAIFKLTY

SEQ ID NO: 40971 - protein, 10 aa, Dengue virus
AEAIFKLTYQ

SEQ ID NO: 40972 - protein, 10 aa, Dengue virus
EAIFKLTYQN

SEQ ID NO: 40973 - protein, 10 aa, Dengue virus
AIFKLTYQNK

SEQ ID NO: 40974 - protein, 10 aa, Dengue virus
IFKLTYQNKV

SEQ ID NO: 40975 - protein, 10 aa, Dengue virus
FKLTYQNKVV

SEQ ID NO: 40976 - protein, 10 aa, Dengue virus
KLTYQNKVVR

SEQ ID NO: 40977 - protein, 10 aa, Dengue virus
LTYQNKVVRV

SEQ ID NO: 40978 - protein, 10 aa, Dengue virus
TYQNKVVRVQ

SEQ ID NO: 40979 - protein, 10 aa, Dengue virus
YQNKVVRVQR

SEQ ID NO: 40980 - protein, 10 aa, Dengue virus
QNKVVRVQRP

SEQ ID NO: 40981 - protein, 10 aa, Dengue virus
NKVVRVQRPT

SEQ ID NO: 40982 - protein, 10 aa, Dengue virus
KVVRVQRPTP

SEQ ID NO: 40983 - protein, 10 aa, Dengue virus
VVRVQRPTPR

SEQ ID NO: 40984 - protein, 10 aa, Dengue virus
VRVQRPTPRG

SEQ ID NO: 40985 - protein, 10 aa, Dengue virus
RVQRPTPRGT

SEQ ID NO: 40986 - protein, 10 aa, Dengue virus
VQRPTPRGTV

SEQ ID NO: 40987 - protein, 10 aa, Dengue virus
QRPTPRGTVM

SEQ ID NO: 40988 - protein, 10 aa, Dengue virus
RPTPRGTVMD

SEQ ID NO: 40989 - protein, 10 aa, Dengue virus
PTPRGTVMDI

SEQ ID NO: 40990 - protein, 10 aa, Dengue virus
TPRGTVMDII

SEQ ID NO: 40991 - protein, 10 aa, Dengue virus
PRGTVMDIIS

SEQ ID NO: 40992 - protein, 10 aa, Dengue virus
RGTVMDIISR

SEQ ID NO: 40993 - protein, 10 aa, Dengue virus
GTVMDIISRR

SEQ ID NO: 40994 - protein, 10 aa, Dengue virus
TVMDIISRRD

SEQ ID NO: 40995 - protein, 10 aa, Dengue virus
VMDIISRRDQ

SEQ ID NO: 40996 - protein, 10 aa, Dengue virus
MDIISRRDQR

SEQ ID NO: 40997 - protein, 10 aa, Dengue virus
DIISRRDQRG

SEQ ID NO: 40998 - protein, 10 aa, Dengue virus
IISRRDQRGS

SEQ ID NO: 40999 - protein, 10 aa, Dengue virus
ISRRDQRGSG

SEQ ID NO: 41000 - protein, 10 aa, Dengue virus
SRRDQRGSGQ

SEQ ID NO: 41001 - protein, 10 aa, Dengue virus
RRDQRGSGQV

SEQ ID NO: 41002 - protein, 10 aa, Dengue virus
RDQRGSGQVG

SEQ ID NO: 41003 - protein, 10 aa, Dengue virus
DQRGSGQVGT

SEQ ID NO: 41004 - protein, 10 aa, Dengue virus
QRGSGQVGTY

SEQ ID NO: 41005 - protein, 10 aa, Dengue virus
RGSGQVGTYG

SEQ ID NO: 41006 - protein, 10 aa, Dengue virus
GSGQVGTYGL

SEQ ID NO: 41007 - protein, 10 aa, Dengue virus
SGQVGTYGLN

SEQ ID NO: 41008 - protein, 10 aa, Dengue virus
GQVGTYGLNT

SEQ ID NO: 41009 - protein, 10 aa, Dengue virus
QVGTYGLNTF

SEQ ID NO: 41010 - protein, 10 aa, Dengue virus
VGTYGLNTFT

SEQ ID NO: 41011 - protein, 10 aa, Dengue virus
GTYGLNTFTN

SEQ ID NO: 41012 - protein, 10 aa, Dengue virus
TYGLNTFTNM

SEQ ID NO: 41013 - protein, 10 aa, Dengue virus
YGLNTFTNME

SEQ ID NO: 41014 - protein, 10 aa, Dengue virus
GLNTFTNMEA

SEQ ID NO: 41015 - protein, 10 aa, Dengue virus
LNTFTNMEAQ

SEQ ID NO: 41016 - protein, 10 aa, Dengue virus
NTFTNMEAQL

SEQ ID NO: 41017 - protein, 10 aa, Dengue virus
TFTNMEAQLI

SEQ ID NO: 41018 - protein, 10 aa, Dengue virus
FTNMEAQLIR

SEQ ID NO: 41019 - protein, 10 aa, Dengue virus
TNMEAQLIRQ

SEQ ID NO: 41020 - protein, 10 aa, Dengue virus
NMEAQLIRQM

SEQ ID NO: 41021 - protein, 10 aa, Dengue virus
MEAQLIRQME

SEQ ID NO: 41022 - protein, 10 aa, Dengue virus
EAQLIRQMEG

SEQ ID NO: 41023 - protein, 10 aa, Dengue virus
AQLIRQMEGE

SEQ ID NO: 41024 - protein, 10 aa, Dengue virus
QLIRQMEGEG

SEQ ID NO: 41025 - protein, 10 aa, Dengue virus
LIRQMEGEGI

SEQ ID NO: 41026 - protein, 10 aa, Dengue virus
IRQMEGEGIF

SEQ ID NO: 41027 - protein, 10 aa, Dengue virus
RQMEGEGIFK

SEQ ID NO: 41028 - protein, 10 aa, Dengue virus
RVGRERLSRM

SEQ ID NO: 41029 - protein, 10 aa, Dengue virus
VGRERLSRMA

SEQ ID NO: 41030 - protein, 10 aa, Dengue virus
GRERLSRMAI

SEQ ID NO: 41031 - protein, 10 aa, Dengue virus
RERLSRMAIS

SEQ ID NO: 41032 - protein, 10 aa, Dengue virus
ERLSRMAISG

SEQ ID NO: 41033 - protein, 10 aa, Dengue virus
RLSRMAISGD

SEQ ID NO: 41034 - protein, 10 aa, Dengue virus
LSRMAISGDD

SEQ ID NO: 41035 - protein, 10 aa, Dengue virus
SRMAISGDDC

SEQ ID NO: 41036 - protein, 10 aa, Dengue virus
RMAISGDDCV

SEQ ID NO: 41037 - protein, 10 aa, Dengue virus
MAISGDDCVV

SEQ ID NO: 41038 - protein, 10 aa, Dengue virus
AISGDDCVVK

SEQ ID NO: 41039 - protein, 10 aa, Dengue virus
ISGDDCVVKP

SEQ ID NO: 41040 - protein, 10 aa, Dengue virus
SGDDCVVKPL

SEQ ID NO: 41041 - protein, 10 aa, Dengue virus
GDDCVVKPLD

SEQ ID NO: 41042 - protein, 10 aa, Dengue virus
DDCVVKPLDD

SEQ ID NO: 41043 - protein, 10 aa, Dengue virus
DCVVKPLDDR

SEQ ID NO: 41044 - protein, 10 aa, Dengue virus
CVVKPLDDRF

SEQ ID NO: 41045 - protein, 10 aa, Dengue virus
VVKPLDDRFA

SEQ ID NO: 41046 - protein, 10 aa, Dengue virus
DDRFASALTA

SEQ ID NO: 41047 - protein, 10 aa, Dengue virus
DRFASALTAL

SEQ ID NO: 41048 - protein, 10 aa, Dengue virus
RFASALTALN

SEQ ID NO: 41049 - protein, 10 aa, Dengue virus
FASALTALND

SEQ ID NO: 41050 - protein, 10 aa, Dengue virus
ASALTALNDM

SEQ ID NO: 41051 - protein, 10 aa, Dengue virus
SALTALNDMG

SEQ ID NO: 41052 - protein, 10 aa, Dengue virus
ALTALNDMGK

SEQ ID NO: 41053 - protein, 10 aa, Dengue virus
LTALNDMGKV

SEQ ID NO: 41054 - protein, 10 aa, Dengue virus
TALNDMGKVR

SEQ ID NO: 41055 - protein, 10 aa, Dengue virus
ALNDMGKVRK

SEQ ID NO: 41056 - protein, 10 aa, Dengue virus
LNDMGKVRKD

SEQ ID NO: 41057 - protein, 10 aa, Dengue virus
NDMGKVRKDI

SEQ ID NO: 41058 - protein, 10 aa, Dengue virus
DMGKVRKDIQ

SEQ ID NO: 41059 - protein, 10 aa, Dengue virus
MGKVRKDIQQ

SEQ ID NO: 41060 - protein, 10 aa, Dengue virus
GKVRKDIQQW

SEQ ID NO: 41061 - protein, 10 aa, Dengue virus
KVRKDIQQWE

SEQ ID NO: 41062 - protein, 10 aa, Dengue virus
VRKDIQQWEP

SEQ ID NO: 41063 - protein, 10 aa, Dengue virus
RKDIQQWEPS

SEQ ID NO: 41064 - protein, 10 aa, Dengue virus
KDIQQWEPSR

SEQ ID NO: 41065 - protein, 10 aa, Dengue virus
DIQQWEPSRG

SEQ ID NO: 41066 - protein, 10 aa, Dengue virus
IQQWEPSRGW

SEQ ID NO: 41067 - protein, 10 aa, Dengue virus
QQWEPSRGWN

SEQ ID NO: 41068 - protein, 10 aa, Dengue virus
QWEPSRGWND

SEQ ID NO: 41069 - protein, 10 aa, Dengue virus
WEPSRGWNDW

SEQ ID NO: 41070 - protein, 10 aa, Dengue virus
EPSRGWNDWT

SEQ ID NO: 41071 - protein, 10 aa, Dengue virus
PSRGWNDWTQ

SEQ ID NO: 41072 - protein, 10 aa, Dengue virus
SRGWNDWTQV

SEQ ID NO: 41073 - protein, 10 aa, Dengue virus
RGWNDWTQVP

SEQ ID NO: 41074 - protein, 10 aa, Dengue virus
GWNDWTQVPF

SEQ ID NO: 41075 - protein, 10 aa, Dengue virus
WNDWTQVPFC

SEQ ID NO: 41076 - protein, 10 aa, Dengue virus
NDWTQVPFCS

SEQ ID NO: 41077 - protein, 10 aa, Dengue virus
DWTQVPFCSH

SEQ ID NO: 41078 - protein, 10 aa, Dengue virus
WTQVPFCSHH

SEQ ID NO: 41079 - protein, 10 aa, Dengue virus
TQVPFCSHHF

SEQ ID NO: 41080 - protein, 10 aa, Dengue virus
QVPFCSHHFH

SEQ ID NO: 41081 - protein, 10 aa, Dengue virus
VPFCSHHFHE

SEQ ID NO: 41082 - protein, 10 aa, Dengue virus
PFCSHHFHEL

SEQ ID NO: 41083 - protein, 10 aa, Dengue virus
FCSHHFHELI

SEQ ID NO: 41084 - protein, 10 aa, Dengue virus
CSHHFHELIM

SEQ ID NO: 41085 - protein, 10 aa, Dengue virus
SHHFHELIMK

SEQ ID NO: 41086 - protein, 10 aa, Dengue virus
HHFHELIMKD

SEQ ID NO: 41087 - protein, 10 aa, Dengue virus
HFHELIMKDG

SEQ ID NO: 41088 - protein, 10 aa, Dengue virus
FHELIMKDGR

SEQ ID NO: 41089 - protein, 10 aa, Dengue virus
MKDGRVLVVP

SEQ ID NO: 41090 - protein, 10 aa, Dengue virus
KDGRVLVVPC

SEQ ID NO: 41091 - protein, 10 aa, Dengue virus
DGRVLVVPCR

SEQ ID NO: 41092 - protein, 10 aa, Dengue virus
LVVPCRNQDE

SEQ ID NO: 41093 - protein, 10 aa, Dengue virus
VVPCRNQDEL

SEQ ID NO: 41094 - protein, 10 aa, Dengue virus
VPCRNQDELI

SEQ ID NO: 41095 - protein, 10 aa, Dengue virus
PCRNQDELIG

SEQ ID NO: 41096 - protein, 10 aa, Dengue virus
CRNQDELIGR

SEQ ID NO: 41097 - protein, 10 aa, Dengue virus
RNQDELIGRA

SEQ ID NO: 41098 - protein, 10 aa, Dengue virus
NQDELIGRAR

SEQ ID NO: 41099 - protein, 10 aa, Dengue virus
QDELIGRARI

SEQ ID NO: 41100 - protein, 10 aa, Dengue virus
DELIGRARIS

SEQ ID NO: 41101 - protein, 10 aa, Dengue virus
ELIGRARISQ

SEQ ID NO: 41102 - protein, 10 aa, Dengue virus
LIGRARISQG

SEQ ID NO: 41103 - protein, 10 aa, Dengue virus
IGRARISQGA

SEQ ID NO: 41104 - protein, 10 aa, Dengue virus
GRARISQGAG

SEQ ID NO: 41105 - protein, 10 aa, Dengue virus
RARISQGAGW

SEQ ID NO: 41106 - protein, 10 aa, Dengue virus
ARISQGAGWS

SEQ ID NO: 41107 - protein, 10 aa, Dengue virus
RISQGAGWSL

SEQ ID NO: 41108 - protein, 10 aa, Dengue virus
ISQGAGWSLK

SEQ ID NO: 41109 - protein, 10 aa, Dengue virus
SQGAGWSLKE

SEQ ID NO: 41110 - protein, 10 aa, Dengue virus
QGAGWSLKET

SEQ ID NO: 41111 - protein, 10 aa, Dengue virus
GAGWSLKETA

SEQ ID NO: 41112 - protein, 10 aa, Dengue virus
AGWSLKETAC

SEQ ID NO: 41113 - protein, 10 aa, Dengue virus
GWSLKETACL

SEQ ID NO: 41114 - protein, 10 aa, Dengue virus
WSLKETACLG

SEQ ID NO: 41115 - protein, 10 aa, Dengue virus
SLKETACLGK

SEQ ID NO: 41116 - protein, 10 aa, Dengue virus
LKETACLGKS

SEQ ID NO: 41117 - protein, 10 aa, Dengue virus
KETACLGKSY

SEQ ID NO: 41118 - protein, 10 aa, Dengue virus
ETACLGKSYA

SEQ ID NO: 41119 - protein, 10 aa, Dengue virus
TACLGKSYAQ

SEQ ID NO: 41120 - protein, 10 aa, Dengue virus
ACLGKSYAQM

SEQ ID NO: 41121 - protein, 10 aa, Dengue virus
CLGKSYAQMW

SEQ ID NO: 41122 - protein, 10 aa, Dengue virus
LGKSYAQMWS

SEQ ID NO: 41123 - protein, 10 aa, Dengue virus
GKSYAQMWSL

SEQ ID NO: 41124 - protein, 10 aa, Dengue virus
KSYAQMWSLM

SEQ ID NO: 41125 - protein, 10 aa, Dengue virus
SYAQMWSLMY

SEQ ID NO: 41126 - protein, 10 aa, Dengue virus
YAQMWSLMYF

SEQ ID NO: 41127 - protein, 10 aa, Dengue virus
AQMWSLMYFH

SEQ ID NO: 41128 - protein, 10 aa, Dengue virus
QMWSLMYFHR

SEQ ID NO: 41129 - protein, 10 aa, Dengue virus
MWSLMYFHRR

SEQ ID NO: 41130 - protein, 10 aa, Dengue virus
WSLMYFHRRD

SEQ ID NO: 41131 - protein, 10 aa, Dengue virus
SLMYFHRRDL

SEQ ID NO: 41132 - protein, 10 aa, Dengue virus
LMYFHRRDLR

SEQ ID NO: 41133 - protein, 10 aa, Dengue virus
MYFHRRDLRL

SEQ ID NO: 41134 - protein, 10 aa, Dengue virus
YFHRRDLRLA

SEQ ID NO: 41135 - protein, 10 aa, Dengue virus
FHRRDLRLAA

SEQ ID NO: 41136 - protein, 10 aa, Dengue virus
HRRDLRLAAN

SEQ ID NO: 41137 - protein, 10 aa, Dengue virus
RRDLRLAANA

SEQ ID NO: 41138 - protein, 10 aa, Dengue virus
RDLRLAANAI

SEQ ID NO: 41139 - protein, 10 aa, Dengue virus
DLRLAANAIC

SEQ ID NO: 41140 - protein, 10 aa, Dengue virus
LRLAANAICS

SEQ ID NO: 41141 - protein, 10 aa, Dengue virus
RLAANAICSA

SEQ ID NO: 41142 - protein, 10 aa, Dengue virus
LAANAICSAV

SEQ ID NO: 41143 - protein, 10 aa, Dengue virus
AANAICSAVP

SEQ ID NO: 41144 - protein, 10 aa, Dengue virus
ANAICSAVPS

SEQ ID NO: 41145 - protein, 10 aa, Dengue virus
NAICSAVPSH

SEQ ID NO: 41146 - protein, 10 aa, Dengue virus
AICSAVPSHW

SEQ ID NO: 41147 - protein, 10 aa, Dengue virus
ICSAVPSHWV

SEQ ID NO: 41148 - protein, 10 aa, Dengue virus
CSAVPSHWVP

SEQ ID NO: 41149 - protein, 10 aa, Dengue virus
SAVPSHWVPT

SEQ ID NO: 41150 - protein, 10 aa, Dengue virus
AVPSHWVPTS

SEQ ID NO: 41151 - protein, 10 aa, Dengue virus
VPSHWVPTSR

SEQ ID NO: 41152 - protein, 10 aa, Dengue virus
PSHWVPTSRT

SEQ ID NO: 41153 - protein, 10 aa, Dengue virus
SHWVPTSRTT

SEQ ID NO: 41154 - protein, 10 aa, Dengue virus
HWVPTSRTTW

SEQ ID NO: 41155 - protein, 10 aa, Dengue virus
WVPTSRTTWS

SEQ ID NO: 41156 - protein, 10 aa, Dengue virus
VPTSRTTWSI

SEQ ID NO: 41157 - protein, 10 aa, Dengue virus
PTSRTTWSIH

SEQ ID NO: 41158 - protein, 10 aa, Dengue virus
TSRTTWSIHA

SEQ ID NO: 41159 - protein, 10 aa, Dengue virus
SRTTWSIHAK

SEQ ID NO: 41160 - protein, 10 aa, Dengue virus
RTTWSIHAKH

SEQ ID NO: 41161 - protein, 10 aa, Dengue virus
TTWSIHAKHE

SEQ ID NO: 41162 - protein, 10 aa, Dengue virus
TWSIHAKHEW

SEQ ID NO: 41163 - protein, 10 aa, Dengue virus
WSIHAKHEWM

SEQ ID NO: 41164 - protein, 10 aa, Dengue virus
SIHAKHEWMT

SEQ ID NO: 41165 - protein, 10 aa, Dengue virus
IHAKHEWMTT

SEQ ID NO: 41166 - protein, 10 aa, Dengue virus
HAKHEWMTTE

SEQ ID NO: 41167 - protein, 10 aa, Dengue virus
AKHEWMTTED

SEQ ID NO: 41168 - protein, 10 aa, Dengue virus
KHEWMTTEDM

SEQ ID NO: 41169 - protein, 10 aa, Dengue virus
HEWMTTEDML

SEQ ID NO: 41170 - protein, 10 aa, Dengue virus
EWMTTEDMLA

SEQ ID NO: 41171 - protein, 10 aa, Dengue virus
WMTTEDMLAV

SEQ ID NO: 41172 - protein, 10 aa, Dengue virus
MTTEDMLAVW

SEQ ID NO: 41173 - protein, 10 aa, Dengue virus
TTEDMLAVWN

SEQ ID NO: 41174 - protein, 10 aa, Dengue virus
TEDMLAVWNR

SEQ ID NO: 41175 - protein, 10 aa, Dengue virus
EDMLAVWNRV

SEQ ID NO: 41176 - protein, 10 aa, Dengue virus
DMLAVWNRVW

SEQ ID NO: 41177 - protein, 10 aa, Dengue virus
MLAVWNRVWI

SEQ ID NO: 41178 - protein, 10 aa, Dengue virus
LAVWNRVWIQ

SEQ ID NO: 41179 - protein, 10 aa, Dengue virus
VWNRVWIQEN

SEQ ID NO: 41180 - protein, 10 aa, Dengue virus
WNRVWIQENP

SEQ ID NO: 41181 - protein, 10 aa, Dengue virus
NRVWIQENPW

SEQ ID NO: 41182 - protein, 10 aa, Dengue virus
VWIQENPWME

SEQ ID NO: 41183 - protein, 10 aa, Dengue virus
WIQENPWMED

SEQ ID NO: 41184 - protein, 10 aa, Dengue virus
IQENPWMEDK

SEQ ID NO: 41185 - protein, 10 aa, Dengue virus
QENPWMEDKT

SEQ ID NO: 41186 - protein, 10 aa, Dengue virus
ENPWMEDKTP

SEQ ID NO: 41187 - protein, 10 aa, Dengue virus
NPWMEDKTPV

SEQ ID NO: 41188 - protein, 10 aa, Dengue virus
PWMEDKTPVE

SEQ ID NO: 41189 - protein, 10 aa, Dengue virus
WMEDKTPVES

SEQ ID NO: 41190 - protein, 10 aa, Dengue virus
MEDKTPVESW

SEQ ID NO: 41191 - protein, 10 aa, Dengue virus
EDKTPVESWE

SEQ ID NO: 41192 - protein, 10 aa, Dengue virus
DKTPVESWEE

SEQ ID NO: 41193 - protein, 10 aa, Dengue virus
KTPVESWEEV

SEQ ID NO: 41194 - protein, 10 aa, Dengue virus
TPVESWEEVP

SEQ ID NO: 41195 - protein, 10 aa, Dengue virus
PVESWEEVPY

SEQ ID NO: 41196 - protein, 10 aa, Dengue virus
VESWEEVPYL

SEQ ID NO: 41197 - protein, 10 aa, Dengue virus
ESWEEVPYLG

SEQ ID NO: 41198 - protein, 10 aa, Dengue virus
SWEEVPYLGK

SEQ ID NO: 41199 - protein, 10 aa, Dengue virus
WEEVPYLGKR

SEQ ID NO: 41200 - protein, 10 aa, Dengue virus
EEVPYLGKRE

SEQ ID NO: 41201 - protein, 10 aa, Dengue virus
EVPYLGKRED

SEQ ID NO: 41202 - protein, 10 aa, Dengue virus
VPYLGKREDQ

SEQ ID NO: 41203 - protein, 10 aa, Dengue virus
PYLGKREDQW

SEQ ID NO: 41204 - protein, 10 aa, Dengue virus
YLGKREDQWC

SEQ ID NO: 41205 - protein, 10 aa, Dengue virus
LGKREDQWCG

SEQ ID NO: 41206 - protein, 10 aa, Dengue virus
GKREDQWCGS

SEQ ID NO: 41207 - protein, 10 aa, Dengue virus
KREDQWCGSL

SEQ ID NO: 41208 - protein, 10 aa, Dengue virus
REDQWCGSLI

SEQ ID NO: 41209 - protein, 10 aa, Dengue virus
EDQWCGSLIG

SEQ ID NO: 41210 - protein, 10 aa, Dengue virus
DQWCGSLIGL

SEQ ID NO: 41211 - protein, 10 aa, Dengue virus
QWCGSLIGLT

SEQ ID NO: 41212 - protein, 10 aa, Dengue virus
WCGSLIGLTS

SEQ ID NO: 41213 - protein, 10 aa, Dengue virus
CGSLIGLTSR

SEQ ID NO: 41214 - protein, 10 aa, Dengue virus
GSLIGLTSRA

SEQ ID NO: 41215 - protein, 10 aa, Dengue virus
SLIGLTSRAT

SEQ ID NO: 41216 - protein, 10 aa, Dengue virus
LIGLTSRATW

SEQ ID NO: 41217 - protein, 10 aa, Dengue virus
IGLTSRATWA

SEQ ID NO: 41218 - protein, 10 aa, Dengue virus
GLTSRATWAK

SEQ ID NO: 41219 - protein, 10 aa, Dengue virus
LTSRATWAKN

SEQ ID NO: 41220 - protein, 10 aa, Dengue virus
TSRATWAKNI

SEQ ID NO: 41221 - protein, 10 aa, Dengue virus
SRATWAKNIQ

SEQ ID NO: 41222 - protein, 10 aa, Dengue virus
RATWAKNIQT

SEQ ID NO: 41223 - protein, 10 aa, Dengue virus
ATWAKNIQTA

SEQ ID NO: 41224 - protein, 10 aa, Dengue virus
TWAKNIQTAI

SEQ ID NO: 41225 - protein, 10 aa, Dengue virus
WAKNIQTAIN

SEQ ID NO: 41226 - protein, 10 aa, Dengue virus
AKNIQTAINQ

SEQ ID NO: 41227 - protein, 10 aa, Dengue virus
KNIQTAINQV

SEQ ID NO: 41228 - protein, 10 aa, Dengue virus
NIQTAINQVR

SEQ ID NO: 41229 - protein, 10 aa, Dengue virus
IQTAINQVRS

SEQ ID NO: 41230 - protein, 10 aa, Dengue virus
QTAINQVRSL

SEQ ID NO: 41231 - protein, 10 aa, Dengue virus
TAINQVRSLI

SEQ ID NO: 41232 - protein, 10 aa, Dengue virus
AINQVRSLIG

SEQ ID NO: 41233 - protein, 10 aa, Dengue virus
INQVRSLIGN

SEQ ID NO: 41234 - protein, 10 aa, Dengue virus
NQVRSLIGNE

SEQ ID NO: 41235 - protein, 10 aa, Dengue virus
QVRSLIGNEE

SEQ ID NO: 41236 - protein, 10 aa, Dengue virus
VRSLIGNEEY

SEQ ID NO: 41237 - protein, 10 aa, Dengue virus
EEYTDYMPSM

SEQ ID NO: 41238 - protein, 10 aa, Dengue virus
EYTDYMPSMK

SEQ ID NO: 41239 - protein, 10 aa, Dengue virus
YTDYMPSMKR

SEQ ID NO: 41240 - protein, 10 aa, Dengue virus
TDYMPSMKRF

SEQ ID NO: 41241 - protein, 10 aa, Dengue virus
DYMPSMKRFR

SEQ ID NO: 41242 - protein, 10 aa, Dengue virus
YMPSMKRFRR

SEQ ID NO: 41243 - protein, 10 aa, Dengue virus
MPSMKRFRRE

SEQ ID NO: 41244 - protein, 10 aa, Dengue virus
PSMKRFRREE

SEQ ID NO: 41245 - protein, 10 aa, Dengue virus
SMKRFRREEE

SEQ ID NO: 41246 - protein, 10 aa, Dengue virus
MKRFRREEEE

SEQ ID NO: 41247 - protein, 10 aa, Dengue virus
KRFRREEEEA

SEQ ID NO: 41248 - protein, 10 aa, Dengue virus
RFRREEEEAG

SEQ ID NO: 41249 - protein, 10 aa, Dengue virus
FRREEEEAGV

SEQ ID NO: 41250 - protein, 10 aa, Dengue virus
RREEEEAGVL

SEQ ID NO: 41251 - protein, 10 aa, Dengue virus
REEEEAGVLW

SEQ ID NO: 41252 - protein, 10 aa, Dengue virus
MNNQRKKAKN

SEQ ID NO: 41253 - protein, 10 aa, Dengue virus
NTPFNMLKRE

SEQ ID NO: 41254 - protein, 10 aa, Dengue virus
KRERNRVSTI

SEQ ID NO: 41255 - protein, 10 aa, Dengue virus
RERNRVSTIQ

SEQ ID NO: 41256 - protein, 10 aa, Dengue virus
ERNRVSTIQQ

SEQ ID NO: 41257 - protein, 10 aa, Dengue virus
RNRVSTIQQL

SEQ ID NO: 41258 - protein, 10 aa, Dengue virus
NRVSTIQQLT

SEQ ID NO: 41259 - protein, 10 aa, Dengue virus
RVSTIQQLTK

SEQ ID NO: 41260 - protein, 10 aa, Dengue virus
VSTIQQLTKR

SEQ ID NO: 41261 - protein, 10 aa, Dengue virus
STIQQLTKRF

SEQ ID NO: 41262 - protein, 10 aa, Dengue virus
TIQQLTKRFS

SEQ ID NO: 41263 - protein, 10 aa, Dengue virus
IQQLTKRFSL

SEQ ID NO: 41264 - protein, 10 aa, Dengue virus
GMLQGRGPLR

SEQ ID NO: 41265 - protein, 10 aa, Dengue virus
MLQGRGPLRL

SEQ ID NO: 41266 - protein, 10 aa, Dengue virus
LQGRGPLRLF

SEQ ID NO: 41267 - protein, 10 aa, Dengue virus
QGRGPLRLFM

SEQ ID NO: 41268 - protein, 10 aa, Dengue virus
GRGPLRLFMA

SEQ ID NO: 41269 - protein, 10 aa, Dengue virus
RGPLKLFMAF

SEQ ID NO: 41270 - protein, 10 aa, Dengue virus
GPLKLFMAFV

SEQ ID NO: 41271 - protein, 10 aa, Dengue virus
PLKLFMAFVA

SEQ ID NO: 41272 - protein, 10 aa, Dengue virus
LKLFMAFVAF

SEQ ID NO: 41273 - protein, 10 aa, Dengue virus
KLFMAFVAFL

SEQ ID NO: 41274 - protein, 10 aa, Dengue virus
LFMAFVAFLR

SEQ ID NO: 41275 - protein, 10 aa, Dengue virus
FMAFVAFLRF

SEQ ID NO: 41276 - protein, 10 aa, Dengue virus
MAFVAFLRFL

SEQ ID NO: 41277 - protein, 10 aa, Dengue virus
AFVAFLRFLT

SEQ ID NO: 41278 - protein, 10 aa, Dengue virus
FVAFLRFLTI

SEQ ID NO: 41279 - protein, 10 aa, Dengue virus
LRFLTIPPTV

SEQ ID NO: 41280 - protein, 10 aa, Dengue virus
RFLTIPPTVG

SEQ ID NO: 41281 - protein, 10 aa, Dengue virus
FLTIPPTVGI

SEQ ID NO: 41282 - protein, 10 aa, Dengue virus
LTIPPTVGIL

SEQ ID NO: 41283 - protein, 10 aa, Dengue virus
TIPPTVGILK

SEQ ID NO: 41284 - protein, 10 aa, Dengue virus
IPPTVGILKR

SEQ ID NO: 41285 - protein, 10 aa, Dengue virus
PPTVGILKRW

SEQ ID NO: 41286 - protein, 10 aa, Dengue virus
PTVGILKRWG

SEQ ID NO: 41287 - protein, 10 aa, Dengue virus
TVGILKRWGT

SEQ ID NO: 41288 - protein, 10 aa, Dengue virus
AGILKRWGTV

SEQ ID NO: 41289 - protein, 10 aa, Dengue virus
GILKRWGTVK

SEQ ID NO: 41290 - protein, 10 aa, Dengue virus
ILKRWGTVKK

SEQ ID NO: 41291 - protein, 10 aa, Dengue virus
LKRWGTVKKS

SEQ ID NO: 41292 - protein, 10 aa, Dengue virus
KRWGTVKKSK

SEQ ID NO: 41293 - protein, 10 aa, Dengue virus
RWGTVKKSKA

SEQ ID NO: 41294 - protein, 10 aa, Dengue virus
WGTVKKSKAI

SEQ ID NO: 41295 - protein, 10 aa, Dengue virus
GTVKKSKAIN

SEQ ID NO: 41296 - protein, 10 aa, Dengue virus
TVKKSKAINV

SEQ ID NO: 41297 - protein, 10 aa, Dengue virus
VKKSKAINVL

SEQ ID NO: 41298 - protein, 10 aa, Dengue virus
KKSKAISVLR

SEQ ID NO: 41299 - protein, 10 aa, Dengue virus
KSKAISVLRG

SEQ ID NO: 41300 - protein, 10 aa, Dengue virus
SKAISVLRGF

SEQ ID NO: 41301 - protein, 10 aa, Dengue virus
KAISVLRGFR

SEQ ID NO: 41302 - protein, 10 aa, Dengue virus
AISVLRGFRK

SEQ ID NO: 41303 - protein, 10 aa, Dengue virus
ISVLRGFRKE

SEQ ID NO: 41304 - protein, 10 aa, Dengue virus
SVLRGFRKEI

SEQ ID NO: 41305 - protein, 10 aa, Dengue virus
VLRGFRREIG

SEQ ID NO: 41306 - protein, 10 aa, Dengue virus
LRGFRREIGR

SEQ ID NO: 41307 - protein, 10 aa, Dengue virus
RGFRREIGRM

SEQ ID NO: 41308 - protein, 10 aa, Dengue virus
FRREIGRMLN

SEQ ID NO: 41309 - protein, 10 aa, Dengue virus
RREIGRMLNI

SEQ ID NO: 41310 - protein, 10 aa, Dengue virus
REIGRMLNIL

SEQ ID NO: 41311 - protein, 10 aa, Dengue virus
IGRMLNILNK

SEQ ID NO: 41312 - protein, 10 aa, Dengue virus
GRMLNILNKR

SEQ ID NO: 41313 - protein, 10 aa, Dengue virus
RMLNILNKRR

SEQ ID NO: 41314 - protein, 10 aa, Dengue virus
MLNILNKRRR

SEQ ID NO: 41315 - protein, 10 aa, Dengue virus
LNILNRRRRS

SEQ ID NO: 41316 - protein, 10 aa, Dengue virus
NILNRRRRSA

SEQ ID NO: 41317 - protein, 10 aa, Dengue virus
ILNRRRRSAG

SEQ ID NO: 41318 - protein, 10 aa, Dengue virus
IPTVMAFHLT

SEQ ID NO: 41319 - protein, 10 aa, Dengue virus
PTVMAFHLTT

SEQ ID NO: 41320 - protein, 10 aa, Dengue virus
TVMAFHLTTR

SEQ ID NO: 41321 - protein, 10 aa, Dengue virus
VMAFHLTTRN

SEQ ID NO: 41322 - protein, 10 aa, Dengue virus
VAFHLTTRNG

SEQ ID NO: 41323 - protein, 10 aa, Dengue virus
RNGEPHMIVS

SEQ ID NO: 41324 - protein, 10 aa, Dengue virus
NGEPHMIVGI

SEQ ID NO: 41325 - protein, 10 aa, Dengue virus
GEPHMIVGIQ

SEQ ID NO: 41326 - protein, 10 aa, Dengue virus
EPHMIVGIQE

SEQ ID NO: 41327 - protein, 10 aa, Dengue virus
PHMIVGIQEK

SEQ ID NO: 41328 - protein, 10 aa, Dengue virus
HMIVGIQEKG

SEQ ID NO: 41329 - protein, 10 aa, Dengue virus
MIVGIQEKGK

SEQ ID NO: 41330 - protein, 10 aa, Dengue virus
IVGIQEKGKS

SEQ ID NO: 41331 - protein, 10 aa, Dengue virus
VGIQEKGKSL

SEQ ID NO: 41332 - protein, 10 aa, Dengue virus
GIQEKGKSLL

SEQ ID NO: 41333 - protein, 10 aa, Dengue virus
IQEKGKSLLF

SEQ ID NO: 41334 - protein, 10 aa, Dengue virus
NEKGKSLLFK

SEQ ID NO: 41335 - protein, 10 aa, Dengue virus
KGKSLLFKTK

SEQ ID NO: 41336 - protein, 10 aa, Dengue virus
GKSLLFKTEN

SEQ ID NO: 41337 - protein, 10 aa, Dengue virus
KSLLFKTENG

SEQ ID NO: 41338 - protein, 10 aa, Dengue virus
NGVNMCTLMA

SEQ ID NO: 41339 - protein, 10 aa, Dengue virus
GVNMCTLMAM

SEQ ID NO: 41340 - protein, 10 aa, Dengue virus
VNMCTLMAMD

SEQ ID NO: 41341 - protein, 10 aa, Dengue virus
NMCTLMAMDL

SEQ ID NO: 41342 - protein, 10 aa, Dengue virus
MCTLMAMDLG

SEQ ID NO: 41343 - protein, 10 aa, Dengue virus
CTLMAMDLGE

SEQ ID NO: 41344 - protein, 10 aa, Dengue virus
TLMAMDLGEL

SEQ ID NO: 41345 - protein, 10 aa, Dengue virus
LMAMDLGELC

SEQ ID NO: 41346 - protein, 10 aa, Dengue virus
MAMDLGELCE

SEQ ID NO: 41347 - protein, 10 aa, Dengue virus
AMDLGELCED

SEQ ID NO: 41348 - protein, 10 aa, Dengue virus
MDLGELCEDT

SEQ ID NO: 41349 - protein, 10 aa, Dengue virus
DLGELCEDTV

SEQ ID NO: 41350 - protein, 10 aa, Dengue virus
LGELCEDTVT

SEQ ID NO: 41351 - protein, 10 aa, Dengue virus
GELCEDTVTY

SEQ ID NO: 41352 - protein, 10 aa, Dengue virus
ELCEDTITYN

SEQ ID NO: 41353 - protein, 10 aa, Dengue virus
LCEDTITYNC

SEQ ID NO: 41354 - protein, 10 aa, Dengue virus
CEDTITYNCP

SEQ ID NO: 41355 - protein, 10 aa, Dengue virus
EDTITYNCPL

SEQ ID NO: 41356 - protein, 10 aa, Dengue virus
DTITYNCPLL

SEQ ID NO: 41357 - protein, 10 aa, Dengue virus
TYNCPLLRQN

SEQ ID NO: 41358 - protein, 10 aa, Dengue virus
YNCPLLRQNE

SEQ ID NO: 41359 - protein, 10 aa, Dengue virus
NCPLLRQNEP

SEQ ID NO: 41360 - protein, 10 aa, Dengue virus
CPFLKQNEPE

SEQ ID NO: 41361 - protein, 10 aa, Dengue virus
PFLKQNEPED

SEQ ID NO: 41362 - protein, 10 aa, Dengue virus
FLKQNEPEDI

SEQ ID NO: 41363 - protein, 10 aa, Dengue virus
LKQNEPEDID

SEQ ID NO: 41364 - protein, 10 aa, Dengue virus
KQNEPEDIDC

SEQ ID NO: 41365 - protein, 10 aa, Dengue virus
CWCNSTSTWI

SEQ ID NO: 41366 - protein, 10 aa, Dengue virus
WCNSTSTWIT

SEQ ID NO: 41367 - protein, 10 aa, Dengue virus
CNSTSTWITY

SEQ ID NO: 41368 - protein, 10 aa, Dengue virus
NSTSTWITYG

SEQ ID NO: 41369 - protein, 10 aa, Dengue virus
STSTWITYGT

SEQ ID NO: 41370 - protein, 10 aa, Dengue virus
TSTWITYGTC

SEQ ID NO: 41371 - protein, 10 aa, Dengue virus
STWVTYGTCS

SEQ ID NO: 41372 - protein, 10 aa, Dengue virus
ATGEHRREKR

SEQ ID NO: 41373 - protein, 10 aa, Dengue virus
MGEHRREKRS

SEQ ID NO: 41374 - protein, 10 aa, Dengue virus
RSVALVPHVR

SEQ ID NO: 41375 - protein, 10 aa, Dengue virus
SVALVPHVRM

SEQ ID NO: 41376 - protein, 10 aa, Dengue virus
VALVPHVRMG

SEQ ID NO: 41377 - protein, 10 aa, Dengue virus
ALVPHVRMGL

SEQ ID NO: 41378 - protein, 10 aa, Dengue virus
LVPHVRMGLE

SEQ ID NO: 41379 - protein, 10 aa, Dengue virus
VPHVRMGLET

SEQ ID NO: 41380 - protein, 10 aa, Dengue virus
WMSSEGAWKQ

SEQ ID NO: 41381 - protein, 10 aa, Dengue virus
MSSEGAWKHA

SEQ ID NO: 41382 - protein, 10 aa, Dengue virus
SSEGAWKHAQ

SEQ ID NO: 41383 - protein, 10 aa, Dengue virus
SEGAWKHAQR

SEQ ID NO: 41384 - protein, 10 aa, Dengue virus
EGAWKHAQRI

SEQ ID NO: 41385 - protein, 10 aa, Dengue virus
GAWKHAQRIE

SEQ ID NO: 41386 - protein, 10 aa, Dengue virus
AWKHAQRIET

SEQ ID NO: 41387 - protein, 10 aa, Dengue virus
WKHAQRIETW

SEQ ID NO: 41388 - protein, 10 aa, Dengue virus
KHAQRIETWI

SEQ ID NO: 41389 - protein, 10 aa, Dengue virus
HAQRIETWIL

SEQ ID NO: 41390 - protein, 10 aa, Dengue virus
AQRIETWILR

SEQ ID NO: 41391 - protein, 10 aa, Dengue virus
QRIETWVLRH

SEQ ID NO: 41392 - protein, 10 aa, Dengue virus
RIETWVLRHP

SEQ ID NO: 41393 - protein, 10 aa, Dengue virus
IETWVLRHPG

SEQ ID NO: 41394 - protein, 10 aa, Dengue virus
ETWVLRHPGF

SEQ ID NO: 41395 - protein, 10 aa, Dengue virus
TWVLRHPGFT

SEQ ID NO: 41396 - protein, 10 aa, Dengue virus
LRHPGFTMMA

SEQ ID NO: 41397 - protein, 10 aa, Dengue virus
RHPGFTMMAA

SEQ ID NO: 41398 - protein, 10 aa, Dengue virus
MAAILAYTVG

SEQ ID NO: 41399 - protein, 10 aa, Dengue virus
AAILAYTVGT

SEQ ID NO: 41400 - protein, 10 aa, Dengue virus
AILAYTVGTT

SEQ ID NO: 41401 - protein, 10 aa, Dengue virus
ILAYTIGTTY

SEQ ID NO: 41402 - protein, 10 aa, Dengue virus
LAYTIGTTYF

SEQ ID NO: 41403 - protein, 10 aa, Dengue virus
AYTIGTTYFQ

SEQ ID NO: 41404 - protein, 10 aa, Dengue virus
YTIGTTYFQR

SEQ ID NO: 41405 - protein, 10 aa, Dengue virus
GTTHFQRVLI

SEQ ID NO: 41406 - protein, 10 aa, Dengue virus
TTHFQRVLIF

SEQ ID NO: 41407 - protein, 10 aa, Dengue virus
THFQRVLIFI

SEQ ID NO: 41408 - protein, 10 aa, Dengue virus
HFQRVLIFIL

SEQ ID NO: 41409 - protein, 10 aa, Dengue virus
FQRVLIFILL

SEQ ID NO: 41410 - protein, 10 aa, Dengue virus
QRVLIFILLT

SEQ ID NO: 41411 - protein, 10 aa, Dengue virus
LIFILLAAVA

SEQ ID NO: 41412 - protein, 10 aa, Dengue virus
IFILLAAVAP

SEQ ID NO: 41413 - protein, 10 aa, Dengue virus
FILLAAVAPS

SEQ ID NO: 41414 - protein, 10 aa, Dengue virus
ILLAAVAPSM

SEQ ID NO: 41415 - protein, 10 aa, Dengue virus
LLAAVAPSMT

SEQ ID NO: 41416 - protein, 10 aa, Dengue virus
LAAVAPSMTM

SEQ ID NO: 41417 - protein, 10 aa, Dengue virus
AAVAPSMTMR

SEQ ID NO: 41418 - protein, 10 aa, Dengue virus
AVTPSMTMRC

SEQ ID NO: 41419 - protein, 10 aa, Dengue virus
VTPSMTMRCI

SEQ ID NO: 41420 - protein, 10 aa, Dengue virus
TPSMTMRCIG

SEQ ID NO: 41421 - protein, 10 aa, Dengue virus
PSMTMRCIGM

SEQ ID NO: 41422 - protein, 10 aa, Dengue virus
SMTMRCIGMS

SEQ ID NO: 41423 - protein, 10 aa, Dengue virus
MTMRCIGMSN

SEQ ID NO: 41424 - protein, 10 aa, Dengue virus
TMRCIGMSNR

SEQ ID NO: 41425 - protein, 10 aa, Dengue virus
MRCIGMSNRD

SEQ ID NO: 41426 - protein, 10 aa, Dengue virus
RCIGMSNRDF

SEQ ID NO: 41427 - protein, 10 aa, Dengue virus
CIGMSNRDFV

SEQ ID NO: 41428 - protein, 10 aa, Dengue virus
IGMSNRDFVE

SEQ ID NO: 41429 - protein, 10 aa, Dengue virus
GMSNRDFVEG

SEQ ID NO: 41430 - protein, 10 aa, Dengue virus
MSNRDFVEGV

SEQ ID NO: 41431 - protein, 10 aa, Dengue virus
NKPTLDFELT

SEQ ID NO: 41432 - protein, 10 aa, Dengue virus
KPTLDFELTK

SEQ ID NO: 41433 - protein, 10 aa, Dengue virus
PTLDFELTKT

SEQ ID NO: 41434 - protein, 10 aa, Dengue virus
TLDFELTKTE

SEQ ID NO: 41435 - protein, 10 aa, Dengue virus
LDFELTKTEA

SEQ ID NO: 41436 - protein, 10 aa, Dengue virus
DFELTKTEAK

SEQ ID NO: 41437 - protein, 10 aa, Dengue virus
FELIKTEAKH

SEQ ID NO: 41438 - protein, 10 aa, Dengue virus
KTEAKHPATL

SEQ ID NO: 41439 - protein, 10 aa, Dengue virus
TEAKHPATLR

SEQ ID NO: 41440 - protein, 10 aa, Dengue virus
EAKHPATLRK

SEQ ID NO: 41441 - protein, 10 aa, Dengue virus
AKHPATLRKY

SEQ ID NO: 41442 - protein, 10 aa, Dengue virus
KHPATLRKYC

SEQ ID NO: 41443 - protein, 10 aa, Dengue virus
PATLRKFCIE

SEQ ID NO: 41444 - protein, 10 aa, Dengue virus
ATLRKFCIEA

SEQ ID NO: 41445 - protein, 10 aa, Dengue virus
TLRKFCIEAK

SEQ ID NO: 41446 - protein, 10 aa, Dengue virus
LRKFCIEAKL

SEQ ID NO: 41447 - protein, 10 aa, Dengue virus
RKFCIEAKLT

SEQ ID NO: 41448 - protein, 10 aa, Dengue virus
KFCIEAKLTN

SEQ ID NO: 41449 - protein, 10 aa, Dengue virus
FCIEAKLTNT

SEQ ID NO: 41450 - protein, 10 aa, Dengue virus
CVEAKLTNTT

SEQ ID NO: 41451 - protein, 10 aa, Dengue virus
VEAKLTNTTT

SEQ ID NO: 41452 - protein, 10 aa, Dengue virus
EAKLTNTTTA

SEQ ID NO: 41453 - protein, 10 aa, Dengue virus
AKLTNTTTAS

SEQ ID NO: 41454 - protein, 10 aa, Dengue virus
KLTNTTTASR

SEQ ID NO: 41455 - protein, 10 aa, Dengue virus
LTNTTTASRC

SEQ ID NO: 41456 - protein, 10 aa, Dengue virus
TNTTTASRCP

SEQ ID NO: 41457 - protein, 10 aa, Dengue virus
NTTTASRCPT

SEQ ID NO: 41458 - protein, 10 aa, Dengue virus
TTTASRCPTQ

SEQ ID NO: 41459 - protein, 10 aa, Dengue virus
TTASRCPTQG

SEQ ID NO: 41460 - protein, 10 aa, Dengue virus
TASRCPTQGE

SEQ ID NO: 41461 - protein, 10 aa, Dengue virus
ASRCPTQGEP

SEQ ID NO: 41462 - protein, 10 aa, Dengue virus
SRCPTQGEPT

SEQ ID NO: 41463 - protein, 10 aa, Dengue virus
RCPTQGEPTL

SEQ ID NO: 41464 - protein, 10 aa, Dengue virus
CPTQGEPSLK

SEQ ID NO: 41465 - protein, 10 aa, Dengue virus
PTQGEPSLKE

SEQ ID NO: 41466 - protein, 10 aa, Dengue virus
TQGEPSLKEE

SEQ ID NO: 41467 - protein, 10 aa, Dengue virus
QGEPSLKEEQ

SEQ ID NO: 41468 - protein, 10 aa, Dengue virus
GEPSLKEEQD

SEQ ID NO: 41469 - protein, 10 aa, Dengue virus
EPSLKEEQDK

SEQ ID NO: 41470 - protein, 10 aa, Dengue virus
PSLKEEQDKR

SEQ ID NO: 41471 - protein, 10 aa, Dengue virus
SLKEEQDKRF

SEQ ID NO: 41472 - protein, 10 aa, Dengue virus
EEQDKRFICK

SEQ ID NO: 41473 - protein, 10 aa, Dengue virus
EQDKRFICKH

SEQ ID NO: 41474 - protein, 10 aa, Dengue virus
QDKRFICKHS

SEQ ID NO: 41475 - protein, 10 aa, Dengue virus
DKRFICKHSM

SEQ ID NO: 41476 - protein, 10 aa, Dengue virus
KRFICKHSMV

SEQ ID NO: 41477 - protein, 10 aa, Dengue virus
RFICKHSMVD

SEQ ID NO: 41478 - protein, 10 aa, Dengue virus
FICKHSMVDR

SEQ ID NO: 41479 - protein, 10 aa, Dengue virus
ICKHSMVDRG

SEQ ID NO: 41480 - protein, 10 aa, Dengue virus
CRHSMVDRGW

SEQ ID NO: 41481 - protein, 10 aa, Dengue virus
RHSMVDRGWG

SEQ ID NO: 41482 - protein, 10 aa, Dengue virus
GKGGIVTCAK

SEQ ID NO: 41483 - protein, 10 aa, Dengue virus
KGGIVTCAKF

SEQ ID NO: 41484 - protein, 10 aa, Dengue virus
GGIVTCAMFR

SEQ ID NO: 41485 - protein, 10 aa, Dengue virus
GIVTCAMFRC

SEQ ID NO: 41486 - protein, 10 aa, Dengue virus
IVTCAMFRCK

SEQ ID NO: 41487 - protein, 10 aa, Dengue virus
VTCAMFTCLK

SEQ ID NO: 41488 - protein, 10 aa, Dengue virus
TCAMFRCKKN

SEQ ID NO: 41489 - protein, 10 aa, Dengue virus
CAMFRCKKNM

SEQ ID NO: 41490 - protein, 10 aa, Dengue virus
AMFRCKKNME

SEQ ID NO: 41491 - protein, 10 aa, Dengue virus
MFRCKKNMEG

SEQ ID NO: 41492 - protein, 10 aa, Dengue virus
FRCKKNMEGK

SEQ ID NO: 41493 - protein, 10 aa, Dengue virus
CKKNMEGKIV

SEQ ID NO: 41494 - protein, 10 aa, Dengue virus
KKNMEGKVVQ

SEQ ID NO: 41495 - protein, 10 aa, Dengue virus
KNMEGKVVQP

SEQ ID NO: 41496 - protein, 10 aa, Dengue virus
NMEGKVVQPE

SEQ ID NO: 41497 - protein, 10 aa, Dengue virus
MEGKVVQPEN

SEQ ID NO: 41498 - protein, 10 aa, Dengue virus
EGKVVQPENL

SEQ ID NO: 41499 - protein, 10 aa, Dengue virus
GKVVQPENLE

SEQ ID NO: 41500 - protein, 10 aa, Dengue virus
KVVQPENLEY

SEQ ID NO: 41501 - protein, 10 aa, Dengue virus
VVQPENLEYT

SEQ ID NO: 41502 - protein, 10 aa, Dengue virus
VLPENLEYTI

SEQ ID NO: 41503 - protein, 10 aa, Dengue virus
LPENLEYTIV

SEQ ID NO: 41504 - protein, 10 aa, Dengue virus
PENLEYTIVV

SEQ ID NO: 41505 - protein, 10 aa, Dengue virus
ENLEYTIVVT

SEQ ID NO: 41506 - protein, 10 aa, Dengue virus
NLEYTIVVTP

SEQ ID NO: 41507 - protein, 10 aa, Dengue virus
LEYTIVVTPH

SEQ ID NO: 41508 - protein, 10 aa, Dengue virus
EYTIVVTPHS

SEQ ID NO: 41509 - protein, 10 aa, Dengue virus
YTIVVTPHSG

SEQ ID NO: 41510 - protein, 10 aa, Dengue virus
TIVVTPHSGE

SEQ ID NO: 41511 - protein, 10 aa, Dengue virus
IVVTPHSGEE

SEQ ID NO: 41512 - protein, 10 aa, Dengue virus
VVTPHSGEEH

SEQ ID NO: 41513 - protein, 10 aa, Dengue virus
VTPHSGEEHA

SEQ ID NO: 41514 - protein, 10 aa, Dengue virus
TPHSGEENAV

SEQ ID NO: 41515 - protein, 10 aa, Dengue virus
PHSGEENAVG

SEQ ID NO: 41516 - protein, 10 aa, Dengue virus
HSGEENAVGN

SEQ ID NO: 41517 - protein, 10 aa, Dengue virus
SGEENAVGND

SEQ ID NO: 41518 - protein, 10 aa, Dengue virus
GEENAVGNDT

SEQ ID NO: 41519 - protein, 10 aa, Dengue virus
EENAVGNDTG

SEQ ID NO: 41520 - protein, 10 aa, Dengue virus
ENAVGNDTGK

SEQ ID NO: 41521 - protein, 10 aa, Dengue virus
NAVGNDTGKH

SEQ ID NO: 41522 - protein, 10 aa, Dengue virus
AVGDDTGKHG

SEQ ID NO: 41523 - protein, 10 aa, Dengue virus
VGNDTGKHGQ

SEQ ID NO: 41524 - protein, 10 aa, Dengue virus
GNDTGKHGQE

SEQ ID NO: 41525 - protein, 10 aa, Dengue virus
NDTGKHGQEI

SEQ ID NO: 41526 - protein, 10 aa, Dengue virus
DTGKHGQEIK

SEQ ID NO: 41527 - protein, 10 aa, Dengue virus
TGKHGKEIKV

SEQ ID NO: 41528 - protein, 10 aa, Dengue virus
GKHGKEIKVT

SEQ ID NO: 41529 - protein, 10 aa, Dengue virus
KHGKEIKVTP

SEQ ID NO: 41530 - protein, 10 aa, Dengue virus
HGKEIKVTPQ

SEQ ID NO: 41531 - protein, 10 aa, Dengue virus
GKEIKVTPQS

SEQ ID NO: 41532 - protein, 10 aa, Dengue virus
AEAELTDYGT

SEQ ID NO: 41533 - protein, 10 aa, Dengue virus
EAELTDYGTI

SEQ ID NO: 41534 - protein, 10 aa, Dengue virus
AELTDYGTIT

SEQ ID NO: 41535 - protein, 10 aa, Dengue virus
ELTDYGTITM

SEQ ID NO: 41536 - protein, 10 aa, Dengue virus
LTDYGTITME

SEQ ID NO: 41537 - protein, 10 aa, Dengue virus
TDYGTITMEC

SEQ ID NO: 41538 - protein, 10 aa, Dengue virus
DYGTITMECS

SEQ ID NO: 41539 - protein, 10 aa, Dengue virus
YGTITMECSP

SEQ ID NO: 41540 - protein, 10 aa, Dengue virus
GTITMECSPR

SEQ ID NO: 41541 - protein, 10 aa, Dengue virus
TITMECSPRT

SEQ ID NO: 41542 - protein, 10 aa, Dengue virus
ITMECSPRTG

SEQ ID NO: 41543 - protein, 10 aa, Dengue virus
TMECSPRTSL

SEQ ID NO: 41544 - protein, 10 aa, Dengue virus
MECSPRTSLD

SEQ ID NO: 41545 - protein, 10 aa, Dengue virus
ECSPRTSLDF

SEQ ID NO: 41546 - protein, 10 aa, Dengue virus
CSPRTSLDFN

SEQ ID NO: 41547 - protein, 10 aa, Dengue virus
SPRTSLDFNE

SEQ ID NO: 41548 - protein, 10 aa, Dengue virus
PRTSLDFNEM

SEQ ID NO: 41549 - protein, 10 aa, Dengue virus
RTSLDFNEMV

SEQ ID NO: 41550 - protein, 10 aa, Dengue virus
TSLDFNEMVL

SEQ ID NO: 41551 - protein, 10 aa, Dengue virus
SLDFNEMVLL

SEQ ID NO: 41552 - protein, 10 aa, Dengue virus
FDFNEMVLLQ

SEQ ID NO: 41553 - protein, 10 aa, Dengue virus
FNEMVLLQMK

SEQ ID NO: 41554 - protein, 10 aa, Dengue virus
MENKAWLVHR

SEQ ID NO: 41555 - protein, 10 aa, Dengue virus
ENKAWLVHRQ

SEQ ID NO: 41556 - protein, 10 aa, Dengue virus
NKAWLVHRQW

SEQ ID NO: 41557 - protein, 10 aa, Dengue virus
PLPWLPGADK

SEQ ID NO: 41558 - protein, 10 aa, Dengue virus
LPWLPGADKQ

SEQ ID NO: 41559 - protein, 10 aa, Dengue virus
PWLPGADKQE

SEQ ID NO: 41560 - protein, 10 aa, Dengue virus
WLPGADKQES

SEQ ID NO: 41561 - protein, 10 aa, Dengue virus
LPGADKQESN

SEQ ID NO: 41562 - protein, 10 aa, Dengue virus
PGADKQESNW

SEQ ID NO: 41563 - protein, 10 aa, Dengue virus
GADKQESNWI

SEQ ID NO: 41564 - protein, 10 aa, Dengue virus
ADKQESNWIQ

SEQ ID NO: 41565 - protein, 10 aa, Dengue virus
DKQESNWIQK

SEQ ID NO: 41566 - protein, 10 aa, Dengue virus
KQESNWIQKE

SEQ ID NO: 41567 - protein, 10 aa, Dengue virus
QESNWIQKET

SEQ ID NO: 41568 - protein, 10 aa, Dengue virus
ESNWIQKETL

SEQ ID NO: 41569 - protein, 10 aa, Dengue virus
SNWIQKEMLV

SEQ ID NO: 41570 - protein, 10 aa, Dengue virus
NWIQKEMLVT

SEQ ID NO: 41571 - protein, 10 aa, Dengue virus
WIQKEMLVTF

SEQ ID NO: 41572 - protein, 10 aa, Dengue virus
IQKEMLVTFK

SEQ ID NO: 41573 - protein, 10 aa, Dengue virus
QKEMLVTFKN

SEQ ID NO: 41574 - protein, 10 aa, Dengue virus
KEMLVTFKNP

SEQ ID NO: 41575 - protein, 10 aa, Dengue virus
EMLVTFKNPH

SEQ ID NO: 41576 - protein, 10 aa, Dengue virus
MLVTFKNPHA

SEQ ID NO: 41577 - protein, 10 aa, Dengue virus
VTFKNPHAKR

SEQ ID NO: 41578 - protein, 10 aa, Dengue virus
TFKNPHAKRQ

SEQ ID NO: 41579 - protein, 10 aa, Dengue virus
FKNPHAKRQD

SEQ ID NO: 41580 - protein, 10 aa, Dengue virus
KNPHAKRQDV

SEQ ID NO: 41581 - protein, 10 aa, Dengue virus
NPHAKRQDVV

SEQ ID NO: 41582 - protein, 10 aa, Dengue virus
PHAKRQDVVV

SEQ ID NO: 41583 - protein, 10 aa, Dengue virus
HAKRQDVVVL

SEQ ID NO: 41584 - protein, 10 aa, Dengue virus
AKRQDVVVLG

SEQ ID NO: 41585 - protein, 10 aa, Dengue virus
KRQDVVVLGS

SEQ ID NO: 41586 - protein, 10 aa, Dengue virus
RQDVVVLGSQ

SEQ ID NO: 41587 - protein, 10 aa, Dengue virus
TGATEIQMSL

SEQ ID NO: 41588 - protein, 10 aa, Dengue virus
GATEIQMSLG

SEQ ID NO: 41589 - protein, 10 aa, Dengue virus
ATEIQMSLGN

SEQ ID NO: 41590 - protein, 10 aa, Dengue virus
TEIQMSLGNI

SEQ ID NO: 41591 - protein, 10 aa, Dengue virus
EIQMSLGNIL

SEQ ID NO: 41592 - protein, 10 aa, Dengue virus
IQMSLGNILF

SEQ ID NO: 41593 - protein, 10 aa, Dengue virus
QMSLGNILFM

SEQ ID NO: 41594 - protein, 10 aa, Dengue virus
MSLGNILFMG

SEQ ID NO: 41595 - protein, 10 aa, Dengue virus
SLGNILFMGH

SEQ ID NO: 41596 - protein, 10 aa, Dengue virus
LGNILFMGHL

SEQ ID NO: 41597 - protein, 10 aa, Dengue virus
GNILFMGHLK

SEQ ID NO: 41598 - protein, 10 aa, Dengue virus
NILFMGHLKC

SEQ ID NO: 41599 - protein, 10 aa, Dengue virus
ILFMGHLKCR

SEQ ID NO: 41600 - protein, 10 aa, Dengue virus
LFMGHLKCRL

SEQ ID NO: 41601 - protein, 10 aa, Dengue virus
FMGHLKCRLR

SEQ ID NO: 41602 - protein, 10 aa, Dengue virus
MGHLKCRLRM

SEQ ID NO: 41603 - protein, 10 aa, Dengue virus
YSMCTGKFKV

SEQ ID NO: 41604 - protein, 10 aa, Dengue virus
SMCTGKFKVV

SEQ ID NO: 41605 - protein, 10 aa, Dengue virus
MCTGKFKVVK

SEQ ID NO: 41606 - protein, 10 aa, Dengue virus
CTGKFKVVKE

SEQ ID NO: 41607 - protein, 10 aa, Dengue virus
TGKFKVVKEI

SEQ ID NO: 41608 - protein, 10 aa, Dengue virus
GKFKVVKEIA

SEQ ID NO: 41609 - protein, 10 aa, Dengue virus
KFKVVKEIAE

SEQ ID NO: 41610 - protein, 10 aa, Dengue virus
FKVVKEIAET

SEQ ID NO: 41611 - protein, 10 aa, Dengue virus
KVVKEIAETQ

SEQ ID NO: 41612 - protein, 10 aa, Dengue virus
VVKEIAETQH

SEQ ID NO: 41613 - protein, 10 aa, Dengue virus
AETQHGTIVV

SEQ ID NO: 41614 - protein, 10 aa, Dengue virus
ETQHGTIVVR

SEQ ID NO: 41615 - protein, 10 aa, Dengue virus
TQHGTIVIRI

SEQ ID NO: 41616 - protein, 10 aa, Dengue virus
QHGTIVIRIQ

SEQ ID NO: 41617 - protein, 10 aa, Dengue virus
HGTIVIRIQY

SEQ ID NO: 41618 - protein, 10 aa, Dengue virus
GTIVIRIQYE

SEQ ID NO: 41619 - protein, 10 aa, Dengue virus
TIVIRIQYEG

SEQ ID NO: 41620 - protein, 10 aa, Dengue virus
IVIRIQYEGD

SEQ ID NO: 41621 - protein, 10 aa, Dengue virus
VIRVQYEGDD

SEQ ID NO: 41622 - protein, 10 aa, Dengue virus
IRVQYEGDDS

SEQ ID NO: 41623 - protein, 10 aa, Dengue virus
RVQYEGDDSP

SEQ ID NO: 41624 - protein, 10 aa, Dengue virus
VQYEGDDSPC

SEQ ID NO: 41625 - protein, 10 aa, Dengue virus
QYEGDDSPCK

SEQ ID NO: 41626 - protein, 10 aa, Dengue virus
YEGDDSPCKI

SEQ ID NO: 41627 - protein, 10 aa, Dengue virus
EGDDSPCKIP

SEQ ID NO: 41628 - protein, 10 aa, Dengue virus
GDDSPCKIPF

SEQ ID NO: 41629 - protein, 10 aa, Dengue virus
DDSPCKIPFE

SEQ ID NO: 41630 - protein, 10 aa, Dengue virus
DSPCKIPFEI

SEQ ID NO: 41631 - protein, 10 aa, Dengue virus
SPCKIPFEIT

SEQ ID NO: 41632 - protein, 10 aa, Dengue virus
PCKIPFEITD

SEQ ID NO: 41633 - protein, 10 aa, Dengue virus
CKIPFEITDL

SEQ ID NO: 41634 - protein, 10 aa, Dengue virus
KIPFEITDLE

SEQ ID NO: 41635 - protein, 10 aa, Dengue virus
IPFEITDLEK

SEQ ID NO: 41636 - protein, 10 aa, Dengue virus
PFEITDLEKR

SEQ ID NO: 41637 - protein, 10 aa, Dengue virus
FEIMDLEKRY

SEQ ID NO: 41638 - protein, 10 aa, Dengue virus
DLEKRYVLGR

SEQ ID NO: 41639 - protein, 10 aa, Dengue virus
LEKRYVLGRL

SEQ ID NO: 41640 - protein, 10 aa, Dengue virus
EKRYVLGRLI

SEQ ID NO: 41641 - protein, 10 aa, Dengue virus
KRYVLGRLIT

SEQ ID NO: 41642 - protein, 10 aa, Dengue virus
RYVLGRLITV

SEQ ID NO: 41643 - protein, 10 aa, Dengue virus
YVLGRLITVN

SEQ ID NO: 41644 - protein, 10 aa, Dengue virus
ILGRLITVNP

SEQ ID NO: 41645 - protein, 10 aa, Dengue virus
GRLITVNPII

SEQ ID NO: 41646 - protein, 10 aa, Dengue virus
RLITVNPIVI

SEQ ID NO: 41647 - protein, 10 aa, Dengue virus
EKDSPINIEA

SEQ ID NO: 41648 - protein, 10 aa, Dengue virus
KDSPINIEAE

SEQ ID NO: 41649 - protein, 10 aa, Dengue virus
DSPINIEAEP

SEQ ID NO: 41650 - protein, 10 aa, Dengue virus
SPINIEAEPP

SEQ ID NO: 41651 - protein, 10 aa, Dengue virus
PINIEAEPPF

SEQ ID NO: 41652 - protein, 10 aa, Dengue virus
INIEAEPPFG

SEQ ID NO: 41653 - protein, 10 aa, Dengue virus
EPPFGDSYIV

SEQ ID NO: 41654 - protein, 10 aa, Dengue virus
PPFGDSYIIV

SEQ ID NO: 41655 - protein, 10 aa, Dengue virus
PFGDSYIIVG

SEQ ID NO: 41656 - protein, 10 aa, Dengue virus
FGDSYIIVGV

SEQ ID NO: 41657 - protein, 10 aa, Dengue virus
GDSYIIVGVE

SEQ ID NO: 41658 - protein, 10 aa, Dengue virus
DSYIIVGVEP

SEQ ID NO: 41659 - protein, 10 aa, Dengue virus
SYIIVGVEPG

SEQ ID NO: 41660 - protein, 10 aa, Dengue virus
YIIVGVEPGQ

SEQ ID NO: 41661 - protein, 10 aa, Dengue virus
IIVGVEPGQL

SEQ ID NO: 41662 - protein, 10 aa, Dengue virus
IVGVEPGQLK

SEQ ID NO: 41663 - protein, 10 aa, Dengue virus
VGVEPGQLKL

SEQ ID NO: 41664 - protein, 10 aa, Dengue virus
GVEPGQLKLS

SEQ ID NO: 41665 - protein, 10 aa, Dengue virus
VEPGQLKLSW

SEQ ID NO: 41666 - protein, 10 aa, Dengue virus
EPGQLKLSWF

SEQ ID NO: 41667 - protein, 10 aa, Dengue virus
PGQLKLSWFK

SEQ ID NO: 41668 - protein, 10 aa, Dengue virus
GQLKLSWFKK

SEQ ID NO: 41669 - protein, 10 aa, Dengue virus
QLKLSWFKKG

SEQ ID NO: 41670 - protein, 10 aa, Dengue virus
LKLSWFKKGS

SEQ ID NO: 41671 - protein, 10 aa, Dengue virus
KLSWFKKGSS

SEQ ID NO: 41672 - protein, 10 aa, Dengue virus
LSWFKKGSSI

SEQ ID NO: 41673 - protein, 10 aa, Dengue virus
SWFKKGSSIG

SEQ ID NO: 41674 - protein, 10 aa, Dengue virus
KKGSSIGQMI

SEQ ID NO: 41675 - protein, 10 aa, Dengue virus
KGSSIGQMIE

SEQ ID NO: 41676 - protein, 10 aa, Dengue virus
GSSIGQMIET

SEQ ID NO: 41677 - protein, 10 aa, Dengue virus
SSIGQMIETT

SEQ ID NO: 41678 - protein, 10 aa, Dengue virus
SIGQMIETTM

SEQ ID NO: 41679 - protein, 10 aa, Dengue virus
IGQMIETTMR

SEQ ID NO: 41680 - protein, 10 aa, Dengue virus
GQMIETTMRG

SEQ ID NO: 41681 - protein, 10 aa, Dengue virus
QMIETTMRGA

SEQ ID NO: 41682 - protein, 10 aa, Dengue virus
MIETTMRGAK

SEQ ID NO: 41683 - protein, 10 aa, Dengue virus
IETTMRGAKR

SEQ ID NO: 41684 - protein, 10 aa, Dengue virus
GDTAWDFGSI

SEQ ID NO: 41685 - protein, 10 aa, Dengue virus
DTAWDFGSIG

SEQ ID NO: 41686 - protein, 10 aa, Dengue virus
TAWDFGSIGG

SEQ ID NO: 41687 - protein, 10 aa, Dengue virus
AWDFGSIGGV

SEQ ID NO: 41688 - protein, 10 aa, Dengue virus
WDFGSIGGVF

SEQ ID NO: 41689 - protein, 10 aa, Dengue virus
DFGSIGGVFT

SEQ ID NO: 41690 - protein, 10 aa, Dengue virus
FGSIGGVFTS

SEQ ID NO: 41691 - protein, 10 aa, Dengue virus
GSIGGVFTSV

SEQ ID NO: 41692 - protein, 10 aa, Dengue virus
SIGGVFTSVG

SEQ ID NO: 41693 - protein, 10 aa, Dengue virus
IGGVFTSVGK

SEQ ID NO: 41694 - protein, 10 aa, Dengue virus
GGVFTSVGKA

SEQ ID NO: 41695 - protein, 10 aa, Dengue virus
GVFTSVGKAL

SEQ ID NO: 41696 - protein, 10 aa, Dengue virus
VFTSVGKALH

SEQ ID NO: 41697 - protein, 10 aa, Dengue virus
FTSVGKALHQ

SEQ ID NO: 41698 - protein, 10 aa, Dengue virus
TSVGKALHQV

SEQ ID NO: 41699 - protein, 10 aa, Dengue virus
SVGKALHQVF

SEQ ID NO: 41700 - protein, 10 aa, Dengue virus
VGKALHQVFG

SEQ ID NO: 41701 - protein, 10 aa, Dengue virus
QVFGAIYGVA

SEQ ID NO: 41702 - protein, 10 aa, Dengue virus
VFGAIYGVAF

SEQ ID NO: 41703 - protein, 10 aa, Dengue virus
FGAIYGVAFS

SEQ ID NO: 41704 - protein, 10 aa, Dengue virus
GAIYGVAFSG

SEQ ID NO: 41705 - protein, 10 aa, Dengue virus
AIYGVAFSGV

SEQ ID NO: 41706 - protein, 10 aa, Dengue virus
IYGVAFSGVS

SEQ ID NO: 41707 - protein, 10 aa, Dengue virus
YGVAFSGVSW

SEQ ID NO: 41708 - protein, 10 aa, Dengue virus
GAAFSGVSWI

SEQ ID NO: 41709 - protein, 10 aa, Dengue virus
AAFSGVSWIM

SEQ ID NO: 41710 - protein, 10 aa, Dengue virus
AFSGVSWIMK

SEQ ID NO: 41711 - protein, 10 aa, Dengue virus
FSGVSWIMKI

SEQ ID NO: 41712 - protein, 10 aa, Dengue virus
SGVSWIMKIL

SEQ ID NO: 41713 - protein, 10 aa, Dengue virus
GVSWIMKILI

SEQ ID NO: 41714 - protein, 10 aa, Dengue virus
VSWIMKILIG

SEQ ID NO: 41715 - protein, 10 aa, Dengue virus
SWTMKILIGA

SEQ ID NO: 41716 - protein, 10 aa, Dengue virus
WTMKILIGVV

SEQ ID NO: 41717 - protein, 10 aa, Dengue virus
TMKILIGVVI

SEQ ID NO: 41718 - protein, 10 aa, Dengue virus
MKILIGVVIT

SEQ ID NO: 41719 - protein, 10 aa, Dengue virus
KILIGVVITW

SEQ ID NO: 41720 - protein, 10 aa, Dengue virus
ILIGVVITWI

SEQ ID NO: 41721 - protein, 10 aa, Dengue virus
LIGVVITWIG

SEQ ID NO: 41722 - protein, 10 aa, Dengue virus
IGVVITWIGM

SEQ ID NO: 41723 - protein, 10 aa, Dengue virus
GVVITWIGMN

SEQ ID NO: 41724 - protein, 10 aa, Dengue virus
VVITWIGMNS

SEQ ID NO: 41725 - protein, 10 aa, Dengue virus
VITWIGMNSR

SEQ ID NO: 41726 - protein, 10 aa, Dengue virus
NSRSTSLSVT

SEQ ID NO: 41727 - protein, 10 aa, Dengue virus
SRSTSLSVTL

SEQ ID NO: 41728 - protein, 10 aa, Dengue virus
RSTSLSVTLV

SEQ ID NO: 41729 - protein, 10 aa, Dengue virus
STSLSVTLVL

SEQ ID NO: 41730 - protein, 10 aa, Dengue virus
TSLSVTLVLV

SEQ ID NO: 41731 - protein, 10 aa, Dengue virus
SLSVTLVLVG

SEQ ID NO: 41732 - protein, 10 aa, Dengue virus
LSVSLVLVGI

SEQ ID NO: 41733 - protein, 10 aa, Dengue virus
SVSLVLVGIV

SEQ ID NO: 41734 - protein, 10 aa, Dengue virus
LVLVGIVTLY

SEQ ID NO: 41735 - protein, 10 aa, Dengue virus
VLVGIVTLYL

SEQ ID NO: 41736 - protein, 10 aa, Dengue virus
LVGIVTLYLG

SEQ ID NO: 41737 - protein, 10 aa, Dengue virus
VGIVTLYLGV

SEQ ID NO: 41738 - protein, 10 aa, Dengue virus
VTLYLGAMVQ

SEQ ID NO: 41739 - protein, 10 aa, Dengue virus
TLYLGAMVQA

SEQ ID NO: 41740 - protein, 10 aa, Dengue virus
LYLGAMVQAD

SEQ ID NO: 41741 - protein, 10 aa, Dengue virus
YLGAMVQADS

SEQ ID NO: 41742 - protein, 10 aa, Dengue virus
LGAMVQADSG

SEQ ID NO: 41743 - protein, 10 aa, Dengue virus
GAMVQADSGC

SEQ ID NO: 41744 - protein, 10 aa, Dengue virus
AMVQADSGCV

SEQ ID NO: 41745 - protein, 10 aa, Dengue virus
VVQADSGCVV

SEQ ID NO: 41746 - protein, 10 aa, Dengue virus
VQADTGCVVS

SEQ ID NO: 41747 - protein, 10 aa, Dengue virus
QADTGCVVSW

SEQ ID NO: 41748 - protein, 10 aa, Dengue virus
ADTGCVVSWK

SEQ ID NO: 41749 - protein, 10 aa, Dengue virus
DTGCVVSWKN

SEQ ID NO: 41750 - protein, 10 aa, Dengue virus
TGCVVSWKNK

SEQ ID NO: 41751 - protein, 10 aa, Dengue virus
GCVVSWKSKE

SEQ ID NO: 41752 - protein, 10 aa, Dengue virus
CIVSWKNKEL

SEQ ID NO: 41753 - protein, 10 aa, Dengue virus
IVSWKNKELK

SEQ ID NO: 41754 - protein, 10 aa, Dengue virus
VSWKSKELKC

SEQ ID NO: 41755 - protein, 10 aa, Dengue virus
SWKSKELKCG

SEQ ID NO: 41756 - protein, 10 aa, Dengue virus
WKSKELKCGS

SEQ ID NO: 41757 - protein, 10 aa, Dengue virus
KSKELKCGSG

SEQ ID NO: 41758 - protein, 10 aa, Dengue virus
SKELKCGSGI

SEQ ID NO: 41759 - protein, 10 aa, Dengue virus
ELKCGSGIFV

SEQ ID NO: 41760 - protein, 10 aa, Dengue virus
LKCGSGIFVT

SEQ ID NO: 41761 - protein, 10 aa, Dengue virus
KCGSGIFVTD

SEQ ID NO: 41762 - protein, 10 aa, Dengue virus
CGSGIFVTDN

SEQ ID NO: 41763 - protein, 10 aa, Dengue virus
GSGIFVTDNV

SEQ ID NO: 41764 - protein, 10 aa, Dengue virus
SGIFVTDNVH

SEQ ID NO: 41765 - protein, 10 aa, Dengue virus
GIFVTDNVHT

SEQ ID NO: 41766 - protein, 10 aa, Dengue virus
IFVTDNVHTW

SEQ ID NO: 41767 - protein, 10 aa, Dengue virus
FVTDNVHTWT

SEQ ID NO: 41768 - protein, 10 aa, Dengue virus
VTDNVHTWTE

SEQ ID NO: 41769 - protein, 10 aa, Dengue virus
WTEQYKFQPD

SEQ ID NO: 41770 - protein, 10 aa, Dengue virus
TEQYKFQPDS

SEQ ID NO: 41771 - protein, 10 aa, Dengue virus
EQYKFQPDSP

SEQ ID NO: 41772 - protein, 10 aa, Dengue virus
QYKFQPDSPS

SEQ ID NO: 41773 - protein, 10 aa, Dengue virus
YKFQPDSPSK

SEQ ID NO: 41774 - protein, 10 aa, Dengue virus
KFQPDSPSKL

SEQ ID NO: 41775 - protein, 10 aa, Dengue virus
FQPDSPSKLA

SEQ ID NO: 41776 - protein, 10 aa, Dengue virus
QPDSPSKLAS

SEQ ID NO: 41777 - protein, 10 aa, Dengue virus
PDSPSKLASA

SEQ ID NO: 41778 - protein, 10 aa, Dengue virus
DSPSKLASAI

SEQ ID NO: 41779 - protein, 10 aa, Dengue virus
KLASAIQKAQ

SEQ ID NO: 41780 - protein, 10 aa, Dengue virus
LASAIQKAQE

SEQ ID NO: 41781 - protein, 10 aa, Dengue virus
ASAIQKAQEE

SEQ ID NO: 41782 - protein, 10 aa, Dengue virus
SAIQKAQEEG

SEQ ID NO: 41783 - protein, 10 aa, Dengue virus
AIQKAQEEGI

SEQ ID NO: 41784 - protein, 10 aa, Dengue virus
IQKAQEEGIC

SEQ ID NO: 41785 - protein, 10 aa, Dengue virus
QKAQEEGICG

SEQ ID NO: 41786 - protein, 10 aa, Dengue virus
KAQEEGICGI

SEQ ID NO: 41787 - protein, 10 aa, Dengue virus
AQEEGICGIR

SEQ ID NO: 41788 - protein, 10 aa, Dengue virus
QEEGICGIRS

SEQ ID NO: 41789 - protein, 10 aa, Dengue virus
EEDICGIRSV

SEQ ID NO: 41790 - protein, 10 aa, Dengue virus
EDICGIRSVT

SEQ ID NO: 41791 - protein, 10 aa, Dengue virus
DICGIRSVTR

SEQ ID NO: 41792 - protein, 10 aa, Dengue virus
RLENLMWRQI

SEQ ID NO: 41793 - protein, 10 aa, Dengue virus
LENLMWRQIT

SEQ ID NO: 41794 - protein, 10 aa, Dengue virus
ENLMWKQITS

SEQ ID NO: 41795 - protein, 10 aa, Dengue virus
NLMWKQITSE

SEQ ID NO: 41796 - protein, 10 aa, Dengue virus
LMWKQITSEL

SEQ ID NO: 41797 - protein, 10 aa, Dengue virus
MWKQITSELN

SEQ ID NO: 41798 - protein, 10 aa, Dengue virus
WKQITSELNH

SEQ ID NO: 41799 - protein, 10 aa, Dengue virus
KQITSELNHI

SEQ ID NO: 41800 - protein, 10 aa, Dengue virus
QITSELNHIL

SEQ ID NO: 41801 - protein, 10 aa, Dengue virus
ITPELNHILA

SEQ ID NO: 41802 - protein, 10 aa, Dengue virus
TPELNHILAE

SEQ ID NO: 41803 - protein, 10 aa, Dengue virus
PELNHILAEN

SEQ ID NO: 41804 - protein, 10 aa, Dengue virus
ELNHILAENE

SEQ ID NO: 41805 - protein, 10 aa, Dengue virus
LNHILAENEV

SEQ ID NO: 41806 - protein, 10 aa, Dengue virus
NHILAENEVK

SEQ ID NO: 41807 - protein, 10 aa, Dengue virus
HILAENEVKL

SEQ ID NO: 41808 - protein, 10 aa, Dengue virus
ILAENEVKLT

SEQ ID NO: 41809 - protein, 10 aa, Dengue virus
LAENEVKLTI

SEQ ID NO: 41810 - protein, 10 aa, Dengue virus
AENEVKLTIM

SEQ ID NO: 41811 - protein, 10 aa, Dengue virus
ENEAKLTIMT

SEQ ID NO: 41812 - protein, 10 aa, Dengue virus
NEAKLTIMTG

SEQ ID NO: 41813 - protein, 10 aa, Dengue virus
EVKLTIMTGE

SEQ ID NO: 41814 - protein, 10 aa, Dengue virus
VKLTIMTGDT

SEQ ID NO: 41815 - protein, 10 aa, Dengue virus
KLTIMTGDIR

SEQ ID NO: 41816 - protein, 10 aa, Dengue virus
LTIMTGDIRG

SEQ ID NO: 41817 - protein, 10 aa, Dengue virus
TIMTGDIRGI

SEQ ID NO: 41818 - protein, 10 aa, Dengue virus
IMTGDIRGIM

SEQ ID NO: 41819 - protein, 10 aa, Dengue virus
MTGDIRGIMQ

SEQ ID NO: 41820 - protein, 10 aa, Dengue virus
GIMQVGKRSL

SEQ ID NO: 41821 - protein, 10 aa, Dengue virus
GRRSLKPQPT

SEQ ID NO: 41822 - protein, 10 aa, Dengue virus
RSLKPQPTEL

SEQ ID NO: 41823 - protein, 10 aa, Dengue virus
LRPQPTELRY

SEQ ID NO: 41824 - protein, 10 aa, Dengue virus
RPQPTELRYS

SEQ ID NO: 41825 - protein, 10 aa, Dengue virus
PQPTELRYSW

SEQ ID NO: 41826 - protein, 10 aa, Dengue virus
QPTELRYSWK

SEQ ID NO: 41827 - protein, 10 aa, Dengue virus
PTELKYSWKA

SEQ ID NO: 41828 - protein, 10 aa, Dengue virus
TELKYSWKAW

SEQ ID NO: 41829 - protein, 10 aa, Dengue virus
ELKYSWKAWG

SEQ ID NO: 41830 - protein, 10 aa, Dengue virus
LKYSWKAWGK

SEQ ID NO: 41831 - protein, 10 aa, Dengue virus
KYSWKAWGKA

SEQ ID NO: 41832 - protein, 10 aa, Dengue virus
YSWKAWGKAK

SEQ ID NO: 41833 - protein, 10 aa, Dengue virus
SWKAWGKAKM

SEQ ID NO: 41834 - protein, 10 aa, Dengue virus
WKAWGKAKML

SEQ ID NO: 41835 - protein, 10 aa, Dengue virus
WGKAKVLSTE

SEQ ID NO: 41836 - protein, 10 aa, Dengue virus
YNQTFLIDGP

SEQ ID NO: 41837 - protein, 10 aa, Dengue virus
NHTFLIDGPE

SEQ ID NO: 41838 - protein, 10 aa, Dengue virus
HTFLIDGPET

SEQ ID NO: 41839 - protein, 10 aa, Dengue virus
TFLIDGPETT

SEQ ID NO: 41840 - protein, 10 aa, Dengue virus
FLIDGPETTE

SEQ ID NO: 41841 - protein, 10 aa, Dengue virus
LIDGPETTEC

SEQ ID NO: 41842 - protein, 10 aa, Dengue virus
IDGPETTECP

SEQ ID NO: 41843 - protein, 10 aa, Dengue virus
DGPETTECPN

SEQ ID NO: 41844 - protein, 10 aa, Dengue virus
TTECPNTNRA

SEQ ID NO: 41845 - protein, 10 aa, Dengue virus
TECPNTNRAW

SEQ ID NO: 41846 - protein, 10 aa, Dengue virus
ECPNSNRAWN

SEQ ID NO: 41847 - protein, 10 aa, Dengue virus
CPNSNRAWNS

SEQ ID NO: 41848 - protein, 10 aa, Dengue virus
PNSNRAWNSL

SEQ ID NO: 41849 - protein, 10 aa, Dengue virus
NSNRAWNSLE

SEQ ID NO: 41850 - protein, 10 aa, Dengue virus
SNRAWNSLEV

SEQ ID NO: 41851 - protein, 10 aa, Dengue virus
LEVEDYGFGI

SEQ ID NO: 41852 - protein, 10 aa, Dengue virus
EVEDYGFGIF

SEQ ID NO: 41853 - protein, 10 aa, Dengue virus
VEDYGFGVFS

SEQ ID NO: 41854 - protein, 10 aa, Dengue virus
EDYGFGVFST

SEQ ID NO: 41855 - protein, 10 aa, Dengue virus
DYGFGVFSTN

SEQ ID NO: 41856 - protein, 10 aa, Dengue virus
YGFGVFSTNI

SEQ ID NO: 41857 - protein, 10 aa, Dengue virus
GFGVFSTNIW

SEQ ID NO: 41858 - protein, 10 aa, Dengue virus
FGVFSTNIWL

SEQ ID NO: 41859 - protein, 10 aa, Dengue virus
GVFSTNIWLK

SEQ ID NO: 41860 - protein, 10 aa, Dengue virus
VFSTNIWLKL

SEQ ID NO: 41861 - protein, 10 aa, Dengue virus
FTTNIWLKLK

SEQ ID NO: 41862 - protein, 10 aa, Dengue virus
TTNIWLKLKE

SEQ ID NO: 41863 - protein, 10 aa, Dengue virus
TNIWLKLKEK

SEQ ID NO: 41864 - protein, 10 aa, Dengue virus
NIWLKLKEKQ

SEQ ID NO: 41865 - protein, 10 aa, Dengue virus
IWLKLKEKQD

SEQ ID NO: 41866 - protein, 10 aa, Dengue virus
ICDSKLMSAA

SEQ ID NO: 41867 - protein, 10 aa, Dengue virus
CDSKLMSAAV

SEQ ID NO: 41868 - protein, 10 aa, Dengue virus
DSKLMSAAVK

SEQ ID NO: 41869 - protein, 10 aa, Dengue virus
SKLMSAAVKD

SEQ ID NO: 41870 - protein, 10 aa, Dengue virus
KLMSAAVKDD

SEQ ID NO: 41871 - protein, 10 aa, Dengue virus
LMSAAVKDDR

SEQ ID NO: 41872 - protein, 10 aa, Dengue virus
MSAAVKDDRA

SEQ ID NO: 41873 - protein, 10 aa, Dengue virus
SAAVKDDRAV

SEQ ID NO: 41874 - protein, 10 aa, Dengue virus
AAVKDDRAVH

SEQ ID NO: 41875 - protein, 10 aa, Dengue virus
AVKDDRAVHA

SEQ ID NO: 41876 - protein, 10 aa, Dengue virus
VKDDRAVHAD

SEQ ID NO: 41877 - protein, 10 aa, Dengue virus
KDDRAVHADM

SEQ ID NO: 41878 - protein, 10 aa, Dengue virus
DDRAVHADMG

SEQ ID NO: 41879 - protein, 10 aa, Dengue virus
DRAVHADMGY

SEQ ID NO: 41880 - protein, 10 aa, Dengue virus
ADMGYWIESR

SEQ ID NO: 41881 - protein, 10 aa, Dengue virus
DMGYWIESRL

SEQ ID NO: 41882 - protein, 10 aa, Dengue virus
MGYWIESRLN

SEQ ID NO: 41883 - protein, 10 aa, Dengue virus
GYWIESRLND

SEQ ID NO: 41884 - protein, 10 aa, Dengue virus
YWIESRLNDT

SEQ ID NO: 41885 - protein, 10 aa, Dengue virus
WIESRLNDTW

SEQ ID NO: 41886 - protein, 10 aa, Dengue virus
IESRLNDTWK

SEQ ID NO: 41887 - protein, 10 aa, Dengue virus
ESALNDTWKI

SEQ ID NO: 41888 - protein, 10 aa, Dengue virus
SALNDTWKIE

SEQ ID NO: 41889 - protein, 10 aa, Dengue virus
ALNDTWKIEK

SEQ ID NO: 41890 - protein, 10 aa, Dengue virus
LNDTWKIEKA

SEQ ID NO: 41891 - protein, 10 aa, Dengue virus
NDTWKIEKAS

SEQ ID NO: 41892 - protein, 10 aa, Dengue virus
DTWKIEKASF

SEQ ID NO: 41893 - protein, 10 aa, Dengue virus
TWKIEKASFI

SEQ ID NO: 41894 - protein, 10 aa, Dengue virus
WKIEKASFIE

SEQ ID NO: 41895 - protein, 10 aa, Dengue virus
KIEKASFIEV

SEQ ID NO: 41896 - protein, 10 aa, Dengue virus
IEKASFIEVK

SEQ ID NO: 41897 - protein, 10 aa, Dengue virus
EKASFIEVKN

SEQ ID NO: 41898 - protein, 10 aa, Dengue virus
KASFIEVKNC

SEQ ID NO: 41899 - protein, 10 aa, Dengue virus
ASFIEVKNCH

SEQ ID NO: 41900 - protein, 10 aa, Dengue virus
SFIEVKNCHW

SEQ ID NO: 41901 - protein, 10 aa, Dengue virus
FIEVKNCHWP

SEQ ID NO: 41902 - protein, 10 aa, Dengue virus
IEVKNCHWPK

SEQ ID NO: 41903 - protein, 10 aa, Dengue virus
EVKNCHWPKS

SEQ ID NO: 41904 - protein, 10 aa, Dengue virus
VKNCHWPKSH

SEQ ID NO: 41905 - protein, 10 aa, Dengue virus
KNCHWPKSHT

SEQ ID NO: 41906 - protein, 10 aa, Dengue virus
NCHWPKSHTL

SEQ ID NO: 41907 - protein, 10 aa, Dengue virus
CYWPRSHTLW

SEQ ID NO: 41908 - protein, 10 aa, Dengue virus
YWPRSHTLWS

SEQ ID NO: 41909 - protein, 10 aa, Dengue virus
WPRSHTLWSN

SEQ ID NO: 41910 - protein, 10 aa, Dengue virus
PRSHTLWSNG

SEQ ID NO: 41911 - protein, 10 aa, Dengue virus
RSHTLWSNGV

SEQ ID NO: 41912 - protein, 10 aa, Dengue virus
SNGVLESEMV

SEQ ID NO: 41913 - protein, 10 aa, Dengue virus
NGVLESEMVI

SEQ ID NO: 41914 - protein, 10 aa, Dengue virus
GVLESEMVIP

SEQ ID NO: 41915 - protein, 10 aa, Dengue virus
VLESEMVIPK

SEQ ID NO: 41916 - protein, 10 aa, Dengue virus
LESEMIIPKS

SEQ ID NO: 41917 - protein, 10 aa, Dengue virus
IPKNLAGPVS

SEQ ID NO: 41918 - protein, 10 aa, Dengue virus
PKNLAGPVSQ

SEQ ID NO: 41919 - protein, 10 aa, Dengue virus
KNLAGPVSQH

SEQ ID NO: 41920 - protein, 10 aa, Dengue virus
NLAGPVSQHN

SEQ ID NO: 41921 - protein, 10 aa, Dengue virus
LAGPVSQHNY

SEQ ID NO: 41922 - protein, 10 aa, Dengue virus
AGPVSQHNNR

SEQ ID NO: 41923 - protein, 10 aa, Dengue virus
GPVSQHNNRP

SEQ ID NO: 41924 - protein, 10 aa, Dengue virus
PVSQHNNRPG

SEQ ID NO: 41925 - protein, 10 aa, Dengue virus
VSQHNNRPGY

SEQ ID NO: 41926 - protein, 10 aa, Dengue virus
SQHNYRPGYY

SEQ ID NO: 41927 - protein, 10 aa, Dengue virus
QHNYRPGYYT

SEQ ID NO: 41928 - protein, 10 aa, Dengue virus
HNYRPGYYTQ

SEQ ID NO: 41929 - protein, 10 aa, Dengue virus
RPGYHTQIAG

SEQ ID NO: 41930 - protein, 10 aa, Dengue virus
PGYHTQIAGP

SEQ ID NO: 41931 - protein, 10 aa, Dengue virus
GYHTQIAGPW

SEQ ID NO: 41932 - protein, 10 aa, Dengue virus
YHTQIAGPWH

SEQ ID NO: 41933 - protein, 10 aa, Dengue virus
HTQIAGPWHL

SEQ ID NO: 41934 - protein, 10 aa, Dengue virus
TQIAGPWHLG

SEQ ID NO: 41935 - protein, 10 aa, Dengue virus
QIAGPWHLGK

SEQ ID NO: 41936 - protein, 10 aa, Dengue virus
IAGPWHLGKL

SEQ ID NO: 41937 - protein, 10 aa, Dengue virus
AGPWHLGRLE

SEQ ID NO: 41938 - protein, 10 aa, Dengue virus
GPWHLGRLEM

SEQ ID NO: 41939 - protein, 10 aa, Dengue virus
PWHLGRLEMD

SEQ ID NO: 41940 - protein, 10 aa, Dengue virus
WHLGRLEMDF

SEQ ID NO: 41941 - protein, 10 aa, Dengue virus
HLGRLEMDFD

SEQ ID NO: 41942 - protein, 10 aa, Dengue virus
LGKLEMDFDL

SEQ ID NO: 41943 - protein, 10 aa, Dengue virus
GKLEMDFDLC

SEQ ID NO: 41944 - protein, 10 aa, Dengue virus
LEMDFDFCDG

SEQ ID NO: 41945 - protein, 10 aa, Dengue virus
EMDFDFCDGT

SEQ ID NO: 41946 - protein, 10 aa, Dengue virus
MDFDFCDGTT

SEQ ID NO: 41947 - protein, 10 aa, Dengue virus
DFDFCDGTTV

SEQ ID NO: 41948 - protein, 10 aa, Dengue virus
FCDGTTVIVT

SEQ ID NO: 41949 - protein, 10 aa, Dengue virus
CDGTTVIVTE

SEQ ID NO: 41950 - protein, 10 aa, Dengue virus
DGTTVIVTED

SEQ ID NO: 41951 - protein, 10 aa, Dengue virus
GTTVIVTEDC

SEQ ID NO: 41952 - protein, 10 aa, Dengue virus
TTVIVTEDCG

SEQ ID NO: 41953 - protein, 10 aa, Dengue virus
TVIVTEDCGN

SEQ ID NO: 41954 - protein, 10 aa, Dengue virus
VIVTEDCGNR

SEQ ID NO: 41955 - protein, 10 aa, Dengue virus
IVTEDCGNRG

SEQ ID NO: 41956 - protein, 10 aa, Dengue virus
VTEECGNRGP

SEQ ID NO: 41957 - protein, 10 aa, Dengue virus
TEECGNRGPS

SEQ ID NO: 41958 - protein, 10 aa, Dengue virus
EECGNRGPSL

SEQ ID NO: 41959 - protein, 10 aa, Dengue virus
ECGNRGPSLR

SEQ ID NO: 41960 - protein, 10 aa, Dengue virus
GMEIRPLKER

SEQ ID NO: 41961 - protein, 10 aa, Dengue virus
MEIRPLKERE

SEQ ID NO: 41962 - protein, 10 aa, Dengue virus
EIRPLKEREE

SEQ ID NO: 41963 - protein, 10 aa, Dengue virus
IRPLKEREEN

SEQ ID NO: 41964 - protein, 10 aa, Dengue virus
RPLKEREENL

SEQ ID NO: 41965 - protein, 10 aa, Dengue virus
PLKEREENLV

SEQ ID NO: 41966 - protein, 10 aa, Dengue virus
LKEKEENLVS

SEQ ID NO: 41967 - protein, 10 aa, Dengue virus
KEKEENLVSS

SEQ ID NO: 41968 - protein, 10 aa, Dengue virus
EKEENLVSSL

SEQ ID NO: 41969 - protein, 10 aa, Dengue virus
KEENLVSSLV

SEQ ID NO: 41970 - protein, 10 aa, Dengue virus
EENLVSSLVT

SEQ ID NO: 41971 - protein, 10 aa, Dengue virus
ENLVSSLVTA

SEQ ID NO: 41972 - protein, 10 aa, Dengue virus
NLVSSLVTAG

SEQ ID NO: 41973 - protein, 10 aa, Dengue virus
LVSSLVTAGH

SEQ ID NO: 41974 - protein, 10 aa, Dengue virus
VSSLVTAGHG

SEQ ID NO: 41975 - protein, 10 aa, Dengue virus
SSLVTAGHGQ

SEQ ID NO: 41976 - protein, 10 aa, Dengue virus
SLVTAGHGQV

SEQ ID NO: 41977 - protein, 10 aa, Dengue virus
LVTAGHGQVD

SEQ ID NO: 41978 - protein, 10 aa, Dengue virus
VTAGHGQVDN

SEQ ID NO: 41979 - protein, 10 aa, Dengue virus
TAGHGQVDNF

SEQ ID NO: 41980 - protein, 10 aa, Dengue virus
AGHGQVDNFS

SEQ ID NO: 41981 - protein, 10 aa, Dengue virus
GHGQVDNFSL

SEQ ID NO: 41982 - protein, 10 aa, Dengue virus
HGQVDNFSLG

SEQ ID NO: 41983 - protein, 10 aa, Dengue virus
GQVDNFSLGV

SEQ ID NO: 41984 - protein, 10 aa, Dengue virus
QVDNFSLGVL

SEQ ID NO: 41985 - protein, 10 aa, Dengue virus
VDNFSLGVLG

SEQ ID NO: 41986 - protein, 10 aa, Dengue virus
DNFSLGILGM

SEQ ID NO: 41987 - protein, 10 aa, Dengue virus
NFSLGILGMA

SEQ ID NO: 41988 - protein, 10 aa, Dengue virus
FSLGILGMAL

SEQ ID NO: 41989 - protein, 10 aa, Dengue virus
SLGILGMALF

SEQ ID NO: 41990 - protein, 10 aa, Dengue virus
LGILGMALFL

SEQ ID NO: 41991 - protein, 10 aa, Dengue virus
GILGMALFLE

SEQ ID NO: 41992 - protein, 10 aa, Dengue virus
ILGMALFLEE

SEQ ID NO: 41993 - protein, 10 aa, Dengue virus
LGMALLLEEM

SEQ ID NO: 41994 - protein, 10 aa, Dengue virus
GMALLLEEML

SEQ ID NO: 41995 - protein, 10 aa, Dengue virus
MALLLEEMLR

SEQ ID NO: 41996 - protein, 10 aa, Dengue virus
ALLLEEMLRT

SEQ ID NO: 41997 - protein, 10 aa, Dengue virus
LLLEEMLRTR

SEQ ID NO: 41998 - protein, 10 aa, Dengue virus
FLEEMLRTRI

SEQ ID NO: 41999 - protein, 10 aa, Dengue virus
LEEMLRTRIG

SEQ ID NO: 42000 - protein, 10 aa, Dengue virus
EEMLRTRIGT

SEQ ID NO: 42001 - protein, 10 aa, Dengue virus
EMLRTRIGTK

SEQ ID NO: 42002 - protein, 10 aa, Dengue virus
MLRTRIGTKH

SEQ ID NO: 42003 - protein, 10 aa, Dengue virus
LRTRIGTKHA

SEQ ID NO: 42004 - protein, 10 aa, Dengue virus
SFMTLITGNM

SEQ ID NO: 42005 - protein, 10 aa, Dengue virus
FMTLITGNMS

SEQ ID NO: 42006 - protein, 10 aa, Dengue virus
MTLITGNMSF

SEQ ID NO: 42007 - protein, 10 aa, Dengue virus
TLITGNMSFK

SEQ ID NO: 42008 - protein, 10 aa, Dengue virus
LITGNMSFKD

SEQ ID NO: 42009 - protein, 10 aa, Dengue virus
ITGNMSFKDL

SEQ ID NO: 42010 - protein, 10 aa, Dengue virus
TGNMSFKDLG

SEQ ID NO: 42011 - protein, 10 aa, Dengue virus
GNMSFKDLGR

SEQ ID NO: 42012 - protein, 10 aa, Dengue virus
NMSFKDLGRV

SEQ ID NO: 42013 - protein, 10 aa, Dengue virus
KDLGRVVVMV

SEQ ID NO: 42014 - protein, 10 aa, Dengue virus
DLGRVVVMVG

SEQ ID NO: 42015 - protein, 10 aa, Dengue virus
LGRVVVMVGA

SEQ ID NO: 42016 - protein, 10 aa, Dengue virus
ADDIGMGVTY

SEQ ID NO: 42017 - protein, 10 aa, Dengue virus
DEMGMGVTYL

SEQ ID NO: 42018 - protein, 10 aa, Dengue virus
EMGMGVTYLA

SEQ ID NO: 42019 - protein, 10 aa, Dengue virus
MGMGVTYLAL

SEQ ID NO: 42020 - protein, 10 aa, Dengue virus
GMGITYLALL

SEQ ID NO: 42021 - protein, 10 aa, Dengue virus
MGITYLALLA

SEQ ID NO: 42022 - protein, 10 aa, Dengue virus
GITYLALLAA

SEQ ID NO: 42023 - protein, 10 aa, Dengue virus
ITYLALLAAF

SEQ ID NO: 42024 - protein, 10 aa, Dengue virus
TYLALLAAFR

SEQ ID NO: 42025 - protein, 10 aa, Dengue virus
YLALLAAFRV

SEQ ID NO: 42026 - protein, 10 aa, Dengue virus
LALLAAFRVR

SEQ ID NO: 42027 - protein, 10 aa, Dengue virus
ALLAAFRVRP

SEQ ID NO: 42028 - protein, 10 aa, Dengue virus
LLAAFRVRPT

SEQ ID NO: 42029 - protein, 10 aa, Dengue virus
LAAFRVRPTF

SEQ ID NO: 42030 - protein, 10 aa, Dengue virus
AAFRVRPTFA

SEQ ID NO: 42031 - protein, 10 aa, Dengue virus
AFRVRPTFAV

SEQ ID NO: 42032 - protein, 10 aa, Dengue virus
FRVRPTFAVG

SEQ ID NO: 42033 - protein, 10 aa, Dengue virus
RVRPTFAVGL

SEQ ID NO: 42034 - protein, 10 aa, Dengue virus
VRPTFAVGLL

SEQ ID NO: 42035 - protein, 10 aa, Dengue virus
RPTFAVGLLL

SEQ ID NO: 42036 - protein, 10 aa, Dengue virus
PTFAVGLLLR

SEQ ID NO: 42037 - protein, 10 aa, Dengue virus
TFAVGLLLRK

SEQ ID NO: 42038 - protein, 10 aa, Dengue virus
FAVGLLLRKL

SEQ ID NO: 42039 - protein, 10 aa, Dengue virus
AVGLLLRKLT

SEQ ID NO: 42040 - protein, 10 aa, Dengue virus
VGLLLRKLTS

SEQ ID NO: 42041 - protein, 10 aa, Dengue virus
GLFLRKLTSK

SEQ ID NO: 42042 - protein, 10 aa, Dengue virus
LFLRKLTSKE

SEQ ID NO: 42043 - protein, 10 aa, Dengue virus
FLRKLTSKEL

SEQ ID NO: 42044 - protein, 10 aa, Dengue virus
LRKLTSKELL

SEQ ID NO: 42045 - protein, 10 aa, Dengue virus
RKLTSKELLM

SEQ ID NO: 42046 - protein, 10 aa, Dengue virus
KLTSKELMMT

SEQ ID NO: 42047 - protein, 10 aa, Dengue virus
LTSKELMMTT

SEQ ID NO: 42048 - protein, 10 aa, Dengue virus
TSKELMMTTI

SEQ ID NO: 42049 - protein, 10 aa, Dengue virus
SKELMMTTIG

SEQ ID NO: 42050 - protein, 10 aa, Dengue virus
KELMMTTIGI

SEQ ID NO: 42051 - protein, 10 aa, Dengue virus
TIGIVLLSQS

SEQ ID NO: 42052 - protein, 10 aa, Dengue virus
PETVLELTDA

SEQ ID NO: 42053 - protein, 10 aa, Dengue virus
TVLELTDALA

SEQ ID NO: 42054 - protein, 10 aa, Dengue virus
VLELTDALAL

SEQ ID NO: 42055 - protein, 10 aa, Dengue virus
LELTDAIALG

SEQ ID NO: 42056 - protein, 10 aa, Dengue virus
ELTDAIALGI

SEQ ID NO: 42057 - protein, 10 aa, Dengue virus
LTDAIALGIM

SEQ ID NO: 42058 - protein, 10 aa, Dengue virus
TDALALGMMA

SEQ ID NO: 42059 - protein, 10 aa, Dengue virus
DALALGMMAL

SEQ ID NO: 42060 - protein, 10 aa, Dengue virus
ALALGMMALK

SEQ ID NO: 42061 - protein, 10 aa, Dengue virus
DMEKYQLAVT

SEQ ID NO: 42062 - protein, 10 aa, Dengue virus
MEKYQLAVTV

SEQ ID NO: 42063 - protein, 10 aa, Dengue virus
EKYQLAVTVM

SEQ ID NO: 42064 - protein, 10 aa, Dengue virus
KYQLAVTVMA

SEQ ID NO: 42065 - protein, 10 aa, Dengue virus
ILCVPNAVIL

SEQ ID NO: 42066 - protein, 10 aa, Dengue virus
CVPNAVILRN

SEQ ID NO: 42067 - protein, 10 aa, Dengue virus
VPNAVILRNA

SEQ ID NO: 42068 - protein, 10 aa, Dengue virus
PNAVILRNAW

SEQ ID NO: 42069 - protein, 10 aa, Dengue virus
AWKVSCTTLA

SEQ ID NO: 42070 - protein, 10 aa, Dengue virus
ILAVVSVSPL

SEQ ID NO: 42071 - protein, 10 aa, Dengue virus
VSVSPLFLTS

SEQ ID NO: 42072 - protein, 10 aa, Dengue virus
SVSPLFLTSS

SEQ ID NO: 42073 - protein, 10 aa, Dengue virus
VSPLFLTSSQ

SEQ ID NO: 42074 - protein, 10 aa, Dengue virus
SPLFLTSSQQ

SEQ ID NO: 42075 - protein, 10 aa, Dengue virus
PLFLTSSQQK

SEQ ID NO: 42076 - protein, 10 aa, Dengue virus
LTSSQQKTDW

SEQ ID NO: 42077 - protein, 10 aa, Dengue virus
TSSQQKTDWI

SEQ ID NO: 42078 - protein, 10 aa, Dengue virus
SSQQKTDWIP

SEQ ID NO: 42079 - protein, 10 aa, Dengue virus
SQQKTDWIPL

SEQ ID NO: 42080 - protein, 10 aa, Dengue virus
QQKTDWIPLA

SEQ ID NO: 42081 - protein, 10 aa, Dengue virus
QKTDWIPLAL

SEQ ID NO: 42082 - protein, 10 aa, Dengue virus
KTDWIPLALT

SEQ ID NO: 42083 - protein, 10 aa, Dengue virus
TDWIPLALTI

SEQ ID NO: 42084 - protein, 10 aa, Dengue virus
DWIPLVLTIK

SEQ ID NO: 42085 - protein, 10 aa, Dengue virus
WIPLVLTIKG

SEQ ID NO: 42086 - protein, 10 aa, Dengue virus
IPLVLTIKGL

SEQ ID NO: 42087 - protein, 10 aa, Dengue virus
PLVLTIKGLN

SEQ ID NO: 42088 - protein, 10 aa, Dengue virus
LVLTIKGLNP

SEQ ID NO: 42089 - protein, 10 aa, Dengue virus
VLTIKGLNPT

SEQ ID NO: 42090 - protein, 10 aa, Dengue virus
LTIKGLSPTA

SEQ ID NO: 42091 - protein, 10 aa, Dengue virus
IIKGLNPTAI

SEQ ID NO: 42092 - protein, 10 aa, Dengue virus
AIFLTTLSRP

SEQ ID NO: 42093 - protein, 10 aa, Dengue virus
IFLTTLSRTN

SEQ ID NO: 42094 - protein, 10 aa, Dengue virus
FLTTLSRTNK

SEQ ID NO: 42095 - protein, 10 aa, Dengue virus
LTTLSRTNKK

SEQ ID NO: 42096 - protein, 10 aa, Dengue virus
TTLSRTNKKR

SEQ ID NO: 42097 - protein, 10 aa, Dengue virus
TLSRTNKKRS

SEQ ID NO: 42098 - protein, 10 aa, Dengue virus
LSRTNKKRSW

SEQ ID NO: 42099 - protein, 10 aa, Dengue virus
SRTNKKRSWP

SEQ ID NO: 42100 - protein, 10 aa, Dengue virus
RTNKKRSWPL

SEQ ID NO: 42101 - protein, 10 aa, Dengue virus
TNKKRSWPLN

SEQ ID NO: 42102 - protein, 10 aa, Dengue virus
NKKRSWPLNE

SEQ ID NO: 42103 - protein, 10 aa, Dengue virus
KTRSWPLNEA

SEQ ID NO: 42104 - protein, 10 aa, Dengue virus
KRSWPLNEAV

SEQ ID NO: 42105 - protein, 10 aa, Dengue virus
RSWPLNEAVM

SEQ ID NO: 42106 - protein, 10 aa, Dengue virus
SWPLNEAVMA

SEQ ID NO: 42107 - protein, 10 aa, Dengue virus
WPLNEAVMAV

SEQ ID NO: 42108 - protein, 10 aa, Dengue virus
PLNEAVMAVG

SEQ ID NO: 42109 - protein, 10 aa, Dengue virus
LNEAVMAVGM

SEQ ID NO: 42110 - protein, 10 aa, Dengue virus
NEAVMAVGMV

SEQ ID NO: 42111 - protein, 10 aa, Dengue virus
EAVMAVGMVS

SEQ ID NO: 42112 - protein, 10 aa, Dengue virus
AVMAVGMVSI

SEQ ID NO: 42113 - protein, 10 aa, Dengue virus
VMAVGMVSIL

SEQ ID NO: 42114 - protein, 10 aa, Dengue virus
GRSADLELEK

SEQ ID NO: 42115 - protein, 10 aa, Dengue virus
RSADLELEKA

SEQ ID NO: 42116 - protein, 10 aa, Dengue virus
SADLELERAT

SEQ ID NO: 42117 - protein, 10 aa, Dengue virus
ADLELERATD

SEQ ID NO: 42118 - protein, 10 aa, Dengue virus
DLELERATDV

SEQ ID NO: 42119 - protein, 10 aa, Dengue virus
VRWEEQAEIS

SEQ ID NO: 42120 - protein, 10 aa, Dengue virus
RWEEQAEISG

SEQ ID NO: 42121 - protein, 10 aa, Dengue virus
WEEQAEISGS

SEQ ID NO: 42122 - protein, 10 aa, Dengue virus
EEQAEISGSS

SEQ ID NO: 42123 - protein, 10 aa, Dengue virus
EQAEISGSSP

SEQ ID NO: 42124 - protein, 10 aa, Dengue virus
HAEISGSSPI

SEQ ID NO: 42125 - protein, 10 aa, Dengue virus
ISGSSPILSV

SEQ ID NO: 42126 - protein, 10 aa, Dengue virus
SGSSPILSVT

SEQ ID NO: 42127 - protein, 10 aa, Dengue virus
GSSPILSVTI

SEQ ID NO: 42128 - protein, 10 aa, Dengue virus
SSPILSITIA

SEQ ID NO: 42129 - protein, 10 aa, Dengue virus
SPILSITIAE

SEQ ID NO: 42130 - protein, 10 aa, Dengue virus
PILSITIAED

SEQ ID NO: 42131 - protein, 10 aa, Dengue virus
ILSITIAEDG

SEQ ID NO: 42132 - protein, 10 aa, Dengue virus
LSITIAEDGS

SEQ ID NO: 42133 - protein, 10 aa, Dengue virus
SITIAEDGSM

SEQ ID NO: 42134 - protein, 10 aa, Dengue virus
ITIAEDGSMS

SEQ ID NO: 42135 - protein, 10 aa, Dengue virus
TIAEDGSMSI

SEQ ID NO: 42136 - protein, 10 aa, Dengue virus
IAEDGSMSIK

SEQ ID NO: 42137 - protein, 10 aa, Dengue virus
AEDGSMSIKN

SEQ ID NO: 42138 - protein, 10 aa, Dengue virus
MSIKNEEEEH

SEQ ID NO: 42139 - protein, 10 aa, Dengue virus
SIKNEEEEHT

SEQ ID NO: 42140 - protein, 10 aa, Dengue virus
IKNEEEEHTL

SEQ ID NO: 42141 - protein, 10 aa, Dengue virus
KNEEEEHTLT

SEQ ID NO: 42142 - protein, 10 aa, Dengue virus
NEEEEHTLTI

SEQ ID NO: 42143 - protein, 10 aa, Dengue virus
EEEEHTLTIL

SEQ ID NO: 42144 - protein, 10 aa, Dengue virus
EEEHTLTILI

SEQ ID NO: 42145 - protein, 10 aa, Dengue virus
EEHTLTILIR

SEQ ID NO: 42146 - protein, 10 aa, Dengue virus
EHTLTILIRT

SEQ ID NO: 42147 - protein, 10 aa, Dengue virus
HTLTILIRTG

SEQ ID NO: 42148 - protein, 10 aa, Dengue virus
ILTILIRTGL

SEQ ID NO: 42149 - protein, 10 aa, Dengue virus
RTGLLVISGV

SEQ ID NO: 42150 - protein, 10 aa, Dengue virus
TGLLVISGVF

SEQ ID NO: 42151 - protein, 10 aa, Dengue virus
GLLVISGVFP

SEQ ID NO: 42152 - protein, 10 aa, Dengue virus
LLVISGLFPV

SEQ ID NO: 42153 - protein, 10 aa, Dengue virus
LVISGLFPVS

SEQ ID NO: 42154 - protein, 10 aa, Dengue virus
VISGLFPVSI

SEQ ID NO: 42155 - protein, 10 aa, Dengue virus
ISGLFPVSIP

SEQ ID NO: 42156 - protein, 10 aa, Dengue virus
SGLFPVSIPI

SEQ ID NO: 42157 - protein, 10 aa, Dengue virus
GLFPVSIPIT

SEQ ID NO: 42158 - protein, 10 aa, Dengue virus
LFPVSIPITA

SEQ ID NO: 42159 - protein, 10 aa, Dengue virus
FPISIPITAA

SEQ ID NO: 42160 - protein, 10 aa, Dengue virus
PISIPITAAA

SEQ ID NO: 42161 - protein, 10 aa, Dengue virus
ISIPITAAAW

SEQ ID NO: 42162 - protein, 10 aa, Dengue virus
SMPITAAAWY

SEQ ID NO: 42163 - protein, 10 aa, Dengue virus
MPITAAAWYL

SEQ ID NO: 42164 - protein, 10 aa, Dengue virus
TAAAWYLWET

SEQ ID NO: 42165 - protein, 10 aa, Dengue virus
AAAWYLWETK

SEQ ID NO: 42166 - protein, 10 aa, Dengue virus
AAWYLWETKK

SEQ ID NO: 42167 - protein, 10 aa, Dengue virus
AWYLWETKKQ

SEQ ID NO: 42168 - protein, 10 aa, Dengue virus
WYLWETKKQR

SEQ ID NO: 42169 - protein, 10 aa, Dengue virus
YLWETKKQRA

SEQ ID NO: 42170 - protein, 10 aa, Dengue virus
LWETKKQRAG

SEQ ID NO: 42171 - protein, 10 aa, Dengue virus
WETKKQRAGV

SEQ ID NO: 42172 - protein, 10 aa, Dengue virus
ETKKQRAGVL

SEQ ID NO: 42173 - protein, 10 aa, Dengue virus
TKKQRAGVLW

SEQ ID NO: 42174 - protein, 10 aa, Dengue virus
LWDVPSPPPM

SEQ ID NO: 42175 - protein, 10 aa, Dengue virus
WDVPSPPPMG

SEQ ID NO: 42176 - protein, 10 aa, Dengue virus
EKAELEDGAY

SEQ ID NO: 42177 - protein, 10 aa, Dengue virus
RAELEDGAYR

SEQ ID NO: 42178 - protein, 10 aa, Dengue virus
EDGAYRIKQK

SEQ ID NO: 42179 - protein, 10 aa, Dengue virus
DGAYRIKQKG

SEQ ID NO: 42180 - protein, 10 aa, Dengue virus
GAYRIKQKGI

SEQ ID NO: 42181 - protein, 10 aa, Dengue virus
AYRIKQRGIL

SEQ ID NO: 42182 - protein, 10 aa, Dengue virus
YRIKQRGILG

SEQ ID NO: 42183 - protein, 10 aa, Dengue virus
RIKQRGILGY

SEQ ID NO: 42184 - protein, 10 aa, Dengue virus
IKQRGILGYS

SEQ ID NO: 42185 - protein, 10 aa, Dengue virus
KQRGILGYSQ

SEQ ID NO: 42186 - protein, 10 aa, Dengue virus
QRGILGYSQI

SEQ ID NO: 42187 - protein, 10 aa, Dengue virus
RGILGYSQIG

SEQ ID NO: 42188 - protein, 10 aa, Dengue virus
GIFGYSQIGA

SEQ ID NO: 42189 - protein, 10 aa, Dengue virus
IFGYSQIGAG

SEQ ID NO: 42190 - protein, 10 aa, Dengue virus
FGYSQIGAGV

SEQ ID NO: 42191 - protein, 10 aa, Dengue virus
WHVTRGAVLV

SEQ ID NO: 42192 - protein, 10 aa, Dengue virus
HVTRGAVLVH

SEQ ID NO: 42193 - protein, 10 aa, Dengue virus
VTRGAVLMHK

SEQ ID NO: 42194 - protein, 10 aa, Dengue virus
TRGAVLMHKG

SEQ ID NO: 42195 - protein, 10 aa, Dengue virus
RGAVLMHKGK

SEQ ID NO: 42196 - protein, 10 aa, Dengue virus
GAVLMHKGKR

SEQ ID NO: 42197 - protein, 10 aa, Dengue virus
AVLMHKGKRI

SEQ ID NO: 42198 - protein, 10 aa, Dengue virus
VLMHKGKRIE

SEQ ID NO: 42199 - protein, 10 aa, Dengue virus
LMHKGKRIEP

SEQ ID NO: 42200 - protein, 10 aa, Dengue virus
MHKGKRIEPS

SEQ ID NO: 42201 - protein, 10 aa, Dengue virus
HKGKRIEPSW

SEQ ID NO: 42202 - protein, 10 aa, Dengue virus
KGKRIEPSWA

SEQ ID NO: 42203 - protein, 10 aa, Dengue virus
RIEPSWADVR

SEQ ID NO: 42204 - protein, 10 aa, Dengue virus
IEPSWADVRK

SEQ ID NO: 42205 - protein, 10 aa, Dengue virus
EPSWADVRKD

SEQ ID NO: 42206 - protein, 10 aa, Dengue virus
PSWADVRKDL

SEQ ID NO: 42207 - protein, 10 aa, Dengue virus
SWADVRKDLI

SEQ ID NO: 42208 - protein, 10 aa, Dengue virus
WADVKKDLVS

SEQ ID NO: 42209 - protein, 10 aa, Dengue virus
ADVKKDLVSY

SEQ ID NO: 42210 - protein, 10 aa, Dengue virus
DVRKDLISYG

SEQ ID NO: 42211 - protein, 10 aa, Dengue virus
VKKDLVSYGG

SEQ ID NO: 42212 - protein, 10 aa, Dengue virus
RKDLISYGGG

SEQ ID NO: 42213 - protein, 10 aa, Dengue virus
KDLVSYGGGW

SEQ ID NO: 42214 - protein, 10 aa, Dengue virus
DLVSYGGGWK

SEQ ID NO: 42215 - protein, 10 aa, Dengue virus
LVSYGGGWKL

SEQ ID NO: 42216 - protein, 10 aa, Dengue virus
VSYGGGWKLE

SEQ ID NO: 42217 - protein, 10 aa, Dengue virus
PRAVQTKPGI

SEQ ID NO: 42218 - protein, 10 aa, Dengue virus
RAVQTKPGIF

SEQ ID NO: 42219 - protein, 10 aa, Dengue virus
AVQTKPGIFK

SEQ ID NO: 42220 - protein, 10 aa, Dengue virus
VQTKPGIFKT

SEQ ID NO: 42221 - protein, 10 aa, Dengue virus
QTKPGIFKTN

SEQ ID NO: 42222 - protein, 10 aa, Dengue virus
FKTNAGTIGA

SEQ ID NO: 42223 - protein, 10 aa, Dengue virus
KTNAGTIGAV

SEQ ID NO: 42224 - protein, 10 aa, Dengue virus
TNAGTIGAVS

SEQ ID NO: 42225 - protein, 10 aa, Dengue virus
NAGTIGAVSL

SEQ ID NO: 42226 - protein, 10 aa, Dengue virus
AGTIGAVSLD

SEQ ID NO: 42227 - protein, 10 aa, Dengue virus
SPGTSGSPII

SEQ ID NO: 42228 - protein, 10 aa, Dengue virus
PGTSGSPIID

SEQ ID NO: 42229 - protein, 10 aa, Dengue virus
GTSGSPIIDK

SEQ ID NO: 42230 - protein, 10 aa, Dengue virus
TSGSPIIDKK

SEQ ID NO: 42231 - protein, 10 aa, Dengue virus
SGSPIIDKKG

SEQ ID NO: 42232 - protein, 10 aa, Dengue virus
GSPIIDKKGK

SEQ ID NO: 42233 - protein, 10 aa, Dengue virus
SPIIDKKGKV

SEQ ID NO: 42234 - protein, 10 aa, Dengue virus
PIIDKKGKVV

SEQ ID NO: 42235 - protein, 10 aa, Dengue virus
IIDKKGKVVG

SEQ ID NO: 42236 - protein, 10 aa, Dengue virus
IDKKGKVVGL

SEQ ID NO: 42237 - protein, 10 aa, Dengue virus
DKKGKVVGLY

SEQ ID NO: 42238 - protein, 10 aa, Dengue virus
KKGKVVGLYG

SEQ ID NO: 42239 - protein, 10 aa, Dengue virus
GNGVVTRSGT

SEQ ID NO: 42240 - protein, 10 aa, Dengue virus
NGVVTRSGTY

SEQ ID NO: 42241 - protein, 10 aa, Dengue virus
GVVTRSGTYV

SEQ ID NO: 42242 - protein, 10 aa, Dengue virus
VVTRSGTYVS

SEQ ID NO: 42243 - protein, 10 aa, Dengue virus
VTRSGTYVSA

SEQ ID NO: 42244 - protein, 10 aa, Dengue virus
TRSGTYVSAI

SEQ ID NO: 42245 - protein, 10 aa, Dengue virus
RSGTYVSAIA

SEQ ID NO: 42246 - protein, 10 aa, Dengue virus
SGTYVSAIAQ

SEQ ID NO: 42247 - protein, 10 aa, Dengue virus
GTYVSAIAQT

SEQ ID NO: 42248 - protein, 10 aa, Dengue virus
TYVSAIAQTE

SEQ ID NO: 42249 - protein, 10 aa, Dengue virus
YVSSIAQTEK

SEQ ID NO: 42250 - protein, 10 aa, Dengue virus
VSSIAQTEKS

SEQ ID NO: 42251 - protein, 10 aa, Dengue virus
SSIAQTEKSV

SEQ ID NO: 42252 - protein, 10 aa, Dengue virus
SIAQTEKSVE

SEQ ID NO: 42253 - protein, 10 aa, Dengue virus
EDNPDIEDDI

SEQ ID NO: 42254 - protein, 10 aa, Dengue virus
DNPDIEDDIF

SEQ ID NO: 42255 - protein, 10 aa, Dengue virus
NPDIEDDIFR

SEQ ID NO: 42256 - protein, 10 aa, Dengue virus
PDIEDDIFRK

SEQ ID NO: 42257 - protein, 10 aa, Dengue virus
EIEDDIFRKR

SEQ ID NO: 42258 - protein, 10 aa, Dengue virus
IEDDIFRKRR

SEQ ID NO: 42259 - protein, 10 aa, Dengue virus
EDDIFRKRRL

SEQ ID NO: 42260 - protein, 10 aa, Dengue virus
DDIFRKRRLT

SEQ ID NO: 42261 - protein, 10 aa, Dengue virus
DIFRKRRLTI

SEQ ID NO: 42262 - protein, 10 aa, Dengue virus
IFRKRRLTIM

SEQ ID NO: 42263 - protein, 10 aa, Dengue virus
FRKRRLTIMD

SEQ ID NO: 42264 - protein, 10 aa, Dengue virus
RKRRLTIMDL

SEQ ID NO: 42265 - protein, 10 aa, Dengue virus
KRRLTIMDLH

SEQ ID NO: 42266 - protein, 10 aa, Dengue virus
RRLTIMDLHP

SEQ ID NO: 42267 - protein, 10 aa, Dengue virus
KLTIMDLHPG

SEQ ID NO: 42268 - protein, 10 aa, Dengue virus
LHPGAGKTKK

SEQ ID NO: 42269 - protein, 10 aa, Dengue virus
HPGAGKTKKY

SEQ ID NO: 42270 - protein, 10 aa, Dengue virus
PGAGKTKKYL

SEQ ID NO: 42271 - protein, 10 aa, Dengue virus
GAGKTKKYLP

SEQ ID NO: 42272 - protein, 10 aa, Dengue virus
AGKTKKYLPA

SEQ ID NO: 42273 - protein, 10 aa, Dengue virus
GKTKKYLPAI

SEQ ID NO: 42274 - protein, 10 aa, Dengue virus
KTKKYLPAIV

SEQ ID NO: 42275 - protein, 10 aa, Dengue virus
TKKYLPAIVR

SEQ ID NO: 42276 - protein, 10 aa, Dengue virus
KKYLPAIVRE

SEQ ID NO: 42277 - protein, 10 aa, Dengue virus
KYLPAIVREA

SEQ ID NO: 42278 - protein, 10 aa, Dengue virus
LPAIVREAIR

SEQ ID NO: 42279 - protein, 10 aa, Dengue virus
PAIVREAIRR

SEQ ID NO: 42280 - protein, 10 aa, Dengue virus
AIVREAIRRG

SEQ ID NO: 42281 - protein, 10 aa, Dengue virus
IVREAIRRGL

SEQ ID NO: 42282 - protein, 10 aa, Dengue virus
VREAIRRGLR

SEQ ID NO: 42283 - protein, 10 aa, Dengue virus
REAIRRGLRT

SEQ ID NO: 42284 - protein, 10 aa, Dengue virus
EAIRRGLRTL

SEQ ID NO: 42285 - protein, 10 aa, Dengue virus
AIRRGLRTLI

SEQ ID NO: 42286 - protein, 10 aa, Dengue virus
IRRGLRTLIL

SEQ ID NO: 42287 - protein, 10 aa, Dengue virus
RRGLRTLILA

SEQ ID NO: 42288 - protein, 10 aa, Dengue virus
RGLPIRYQTT

SEQ ID NO: 42289 - protein, 10 aa, Dengue virus
GLPIRYQTTA

SEQ ID NO: 42290 - protein, 10 aa, Dengue virus
LPIRYQTTAI

SEQ ID NO: 42291 - protein, 10 aa, Dengue virus
PIRYQTPAIK

SEQ ID NO: 42292 - protein, 10 aa, Dengue virus
IRYQTPAIKT

SEQ ID NO: 42293 - protein, 10 aa, Dengue virus
RYQTPAIKTE

SEQ ID NO: 42294 - protein, 10 aa, Dengue virus
YQTPAIKTEH

SEQ ID NO: 42295 - protein, 10 aa, Dengue virus
QTPAIKTEHT

SEQ ID NO: 42296 - protein, 10 aa, Dengue virus
TPAIKTEHTG

SEQ ID NO: 42297 - protein, 10 aa, Dengue virus
PAIKTEHTGR

SEQ ID NO: 42298 - protein, 10 aa, Dengue virus
AIKTEHTGRE

SEQ ID NO: 42299 - protein, 10 aa, Dengue virus
IKTEHTGREI

SEQ ID NO: 42300 - protein, 10 aa, Dengue virus
KTEHTGREIV

SEQ ID NO: 42301 - protein, 10 aa, Dengue virus
TEHTGREIVD

SEQ ID NO: 42302 - protein, 10 aa, Dengue virus
TFTMRLLSPI

SEQ ID NO: 42303 - protein, 10 aa, Dengue virus
FTMRLLSPIR

SEQ ID NO: 42304 - protein, 10 aa, Dengue virus
TMRLLSPIRV

SEQ ID NO: 42305 - protein, 10 aa, Dengue virus
MRLLSPIRVP

SEQ ID NO: 42306 - protein, 10 aa, Dengue virus
RLLSPIRVPN

SEQ ID NO: 42307 - protein, 10 aa, Dengue virus
LLSPIRVPNY

SEQ ID NO: 42308 - protein, 10 aa, Dengue virus
LSPIRVPNYN

SEQ ID NO: 42309 - protein, 10 aa, Dengue virus
SPIRVPNYNL

SEQ ID NO: 42310 - protein, 10 aa, Dengue virus
PIRVPNYNLI

SEQ ID NO: 42311 - protein, 10 aa, Dengue virus
IRVPNYNLII

SEQ ID NO: 42312 - protein, 10 aa, Dengue virus
PFPQSNAPII

SEQ ID NO: 42313 - protein, 10 aa, Dengue virus
FPQSNAPIID

SEQ ID NO: 42314 - protein, 10 aa, Dengue virus
PQSNAPIIDE

SEQ ID NO: 42315 - protein, 10 aa, Dengue virus
QSNAPIIDEE

SEQ ID NO: 42316 - protein, 10 aa, Dengue virus
SNAPIIDEER

SEQ ID NO: 42317 - protein, 10 aa, Dengue virus
NAPIIDEERE

SEQ ID NO: 42318 - protein, 10 aa, Dengue virus
APIIDEEREI

SEQ ID NO: 42319 - protein, 10 aa, Dengue virus
PIIDEEREIP

SEQ ID NO: 42320 - protein, 10 aa, Dengue virus
IIDEEREIPE

SEQ ID NO: 42321 - protein, 10 aa, Dengue virus
IDEEREIPER

SEQ ID NO: 42322 - protein, 10 aa, Dengue virus
EREIPERSWS

SEQ ID NO: 42323 - protein, 10 aa, Dengue virus
REIPERSWSS

SEQ ID NO: 42324 - protein, 10 aa, Dengue virus
EIPERSWSSG

SEQ ID NO: 42325 - protein, 10 aa, Dengue virus
IPERSWSSGH

SEQ ID NO: 42326 - protein, 10 aa, Dengue virus
PERSWSSGHE

SEQ ID NO: 42327 - protein, 10 aa, Dengue virus
ERSWSSGHEW

SEQ ID NO: 42328 - protein, 10 aa, Dengue virus
RSWNSGHEWI

SEQ ID NO: 42329 - protein, 10 aa, Dengue virus
SWNSGHEWIT

SEQ ID NO: 42330 - protein, 10 aa, Dengue virus
WNSGHEWITN

SEQ ID NO: 42331 - protein, 10 aa, Dengue virus
SSGHEWVTDF

SEQ ID NO: 42332 - protein, 10 aa, Dengue virus
GHEWITNFKG

SEQ ID NO: 42333 - protein, 10 aa, Dengue virus
HEWITNFKGK

SEQ ID NO: 42334 - protein, 10 aa, Dengue virus
EWITNFKGKT

SEQ ID NO: 42335 - protein, 10 aa, Dengue virus
WITNFKGKTV

SEQ ID NO: 42336 - protein, 10 aa, Dengue virus
ITNFKGKTVW

SEQ ID NO: 42337 - protein, 10 aa, Dengue virus
TNFKGKTVWF

SEQ ID NO: 42338 - protein, 10 aa, Dengue virus
NFKGKTVWFV

SEQ ID NO: 42339 - protein, 10 aa, Dengue virus
KTVWFVPSIR

SEQ ID NO: 42340 - protein, 10 aa, Dengue virus
TVWFVPSIKT

SEQ ID NO: 42341 - protein, 10 aa, Dengue virus
VWFVPSIKTG

SEQ ID NO: 42342 - protein, 10 aa, Dengue virus
WFVPSIKTGN

SEQ ID NO: 42343 - protein, 10 aa, Dengue virus
FVPSIKTGND

SEQ ID NO: 42344 - protein, 10 aa, Dengue virus
VPSIKTGNDI

SEQ ID NO: 42345 - protein, 10 aa, Dengue virus
PSIKTGNDIA

SEQ ID NO: 42346 - protein, 10 aa, Dengue virus
SIKTGNDIAA

SEQ ID NO: 42347 - protein, 10 aa, Dengue virus
IKTGNDIAAC

SEQ ID NO: 42348 - protein, 10 aa, Dengue virus
KTGNDIAACL

SEQ ID NO: 42349 - protein, 10 aa, Dengue virus
TGNDIAACLR

SEQ ID NO: 42350 - protein, 10 aa, Dengue virus
AACLRKNGKR

SEQ ID NO: 42351 - protein, 10 aa, Dengue virus
ACLRKNGKRV

SEQ ID NO: 42352 - protein, 10 aa, Dengue virus
CLRKNGKRVI

SEQ ID NO: 42353 - protein, 10 aa, Dengue virus
LRKNGKRVIQ

SEQ ID NO: 42354 - protein, 10 aa, Dengue virus
RKNGKRVIQL

SEQ ID NO: 42355 - protein, 10 aa, Dengue virus
KNGKRVIQLS

SEQ ID NO: 42356 - protein, 10 aa, Dengue virus
NGKRVIQLSR

SEQ ID NO: 42357 - protein, 10 aa, Dengue virus
GKRVIQLSRK

SEQ ID NO: 42358 - protein, 10 aa, Dengue virus
KRVIQLSRKT

SEQ ID NO: 42359 - protein, 10 aa, Dengue virus
RVIQLSRKTF

SEQ ID NO: 42360 - protein, 10 aa, Dengue virus
IQLSRKTFDT

SEQ ID NO: 42361 - protein, 10 aa, Dengue virus
QLSRKTFDTE

SEQ ID NO: 42362 - protein, 10 aa, Dengue virus
LSRKTFDTEY

SEQ ID NO: 42363 - protein, 10 aa, Dengue virus
SRKTFDSEYI

SEQ ID NO: 42364 - protein, 10 aa, Dengue virus
RKTFDSEYIK

SEQ ID NO: 42365 - protein, 10 aa, Dengue virus
KTFDSEYIKT

SEQ ID NO: 42366 - protein, 10 aa, Dengue virus
TFDSEYIKTR

SEQ ID NO: 42367 - protein, 10 aa, Dengue virus
KTRANDWDFV

SEQ ID NO: 42368 - protein, 10 aa, Dengue virus
TRANDWDFVV

SEQ ID NO: 42369 - protein, 10 aa, Dengue virus
RANDWDFVVT

SEQ ID NO: 42370 - protein, 10 aa, Dengue virus
ANDWDFVVTT

SEQ ID NO: 42371 - protein, 10 aa, Dengue virus
DISEMGANFR

SEQ ID NO: 42372 - protein, 10 aa, Dengue virus
ISEMGANFRA

SEQ ID NO: 42373 - protein, 10 aa, Dengue virus
SEMGANFRAE

SEQ ID NO: 42374 - protein, 10 aa, Dengue virus
EMGANFRAER

SEQ ID NO: 42375 - protein, 10 aa, Dengue virus
MGANFRAERV

SEQ ID NO: 42376 - protein, 10 aa, Dengue virus
GANFRAERVI

SEQ ID NO: 42377 - protein, 10 aa, Dengue virus
ANFRAERVID

SEQ ID NO: 42378 - protein, 10 aa, Dengue virus
NFRAERVIDP

SEQ ID NO: 42379 - protein, 10 aa, Dengue virus
FRAERVIDPR

SEQ ID NO: 42380 - protein, 10 aa, Dengue virus
RAERVIDPRR

SEQ ID NO: 42381 - protein, 10 aa, Dengue virus
CMKPVILTEG

SEQ ID NO: 42382 - protein, 10 aa, Dengue virus
MKPVILTEGE

SEQ ID NO: 42383 - protein, 10 aa, Dengue virus
KPVILTEGEE

SEQ ID NO: 42384 - protein, 10 aa, Dengue virus
PVILTEGEER

SEQ ID NO: 42385 - protein, 10 aa, Dengue virus
VILTEGEERV

SEQ ID NO: 42386 - protein, 10 aa, Dengue virus
ILTDGEERVV

SEQ ID NO: 42387 - protein, 10 aa, Dengue virus
LTDGEERVVL

SEQ ID NO: 42388 - protein, 10 aa, Dengue virus
TDGEERVVLA

SEQ ID NO: 42389 - protein, 10 aa, Dengue virus
DGEERVVLAG

SEQ ID NO: 42390 - protein, 10 aa, Dengue virus
GEERVVLAGP

SEQ ID NO: 42391 - protein, 10 aa, Dengue virus
EERVVLAGPM

SEQ ID NO: 42392 - protein, 10 aa, Dengue virus
ERVVLAGPMP

SEQ ID NO: 42393 - protein, 10 aa, Dengue virus
RVVLAGPMPV

SEQ ID NO: 42394 - protein, 10 aa, Dengue virus
VVLAGPMPVT

SEQ ID NO: 42395 - protein, 10 aa, Dengue virus
VLAGPMPVTH

SEQ ID NO: 42396 - protein, 10 aa, Dengue virus
AGPMPVTHFS

SEQ ID NO: 42397 - protein, 10 aa, Dengue virus
GPMPVTHFSA

SEQ ID NO: 42398 - protein, 10 aa, Dengue virus
PMPVTHFSAA

SEQ ID NO: 42399 - protein, 10 aa, Dengue virus
MPVTHFSAAQ

SEQ ID NO: 42400 - protein, 10 aa, Dengue virus
PVTHFSAAQR

SEQ ID NO: 42401 - protein, 10 aa, Dengue virus
SSAAQRRGRV

SEQ ID NO: 42402 - protein, 10 aa, Dengue virus
SAAQRRGRVG

SEQ ID NO: 42403 - protein, 10 aa, Dengue virus
AAQRRGRVGR

SEQ ID NO: 42404 - protein, 10 aa, Dengue virus
AQRRGRVGRN

SEQ ID NO: 42405 - protein, 10 aa, Dengue virus
QRRGRVGRNP

SEQ ID NO: 42406 - protein, 10 aa, Dengue virus
RRGRVGRNPK

SEQ ID NO: 42407 - protein, 10 aa, Dengue virus
RGRVGRNPKN

SEQ ID NO: 42408 - protein, 10 aa, Dengue virus
GRVGRNPKNE

SEQ ID NO: 42409 - protein, 10 aa, Dengue virus
RVGRNPKNEN

SEQ ID NO: 42410 - protein, 10 aa, Dengue virus
VGRNPKNEND

SEQ ID NO: 42411 - protein, 10 aa, Dengue virus
GRNPRNENDQ

SEQ ID NO: 42412 - protein, 10 aa, Dengue virus
RNPRNENDQY

SEQ ID NO: 42413 - protein, 10 aa, Dengue virus
NPRNENDQYI

SEQ ID NO: 42414 - protein, 10 aa, Dengue virus
PRNENDQYIY

SEQ ID NO: 42415 - protein, 10 aa, Dengue virus
RNENDQYIYM

SEQ ID NO: 42416 - protein, 10 aa, Dengue virus
EPEREKVDAV

SEQ ID NO: 42417 - protein, 10 aa, Dengue virus
PEREKVDAVD

SEQ ID NO: 42418 - protein, 10 aa, Dengue virus
EREKVDAVDG

SEQ ID NO: 42419 - protein, 10 aa, Dengue virus
REKVDAVDGE

SEQ ID NO: 42420 - protein, 10 aa, Dengue virus
EKVDAVDGEY

SEQ ID NO: 42421 - protein, 10 aa, Dengue virus
KVDAVDGEYR

SEQ ID NO: 42422 - protein, 10 aa, Dengue virus
VDAVDGEYRL

SEQ ID NO: 42423 - protein, 10 aa, Dengue virus
DAVDGEYRLR

SEQ ID NO: 42424 - protein, 10 aa, Dengue virus
AVDGEYRLRG

SEQ ID NO: 42425 - protein, 10 aa, Dengue virus
VDGEYRLRGE

SEQ ID NO: 42426 - protein, 10 aa, Dengue virus
ARKTFVDLMK

SEQ ID NO: 42427 - protein, 10 aa, Dengue virus
RKTFVDLMKR

SEQ ID NO: 42428 - protein, 10 aa, Dengue virus
KTFVDLMKRG

SEQ ID NO: 42429 - protein, 10 aa, Dengue virus
TFVDLMKRGD

SEQ ID NO: 42430 - protein, 10 aa, Dengue virus
FVDLMKRGDL

SEQ ID NO: 42431 - protein, 10 aa, Dengue virus
VDLMKRGDLP

SEQ ID NO: 42432 - protein, 10 aa, Dengue virus
DLMKRGDLPV

SEQ ID NO: 42433 - protein, 10 aa, Dengue virus
LMKRGDLPVW

SEQ ID NO: 42434 - protein, 10 aa, Dengue virus
MKRGDLPVWL

SEQ ID NO: 42435 - protein, 10 aa, Dengue virus
KRGDLPVWLA

SEQ ID NO: 42436 - protein, 10 aa, Dengue virus
GDLPVWLAYR

SEQ ID NO: 42437 - protein, 10 aa, Dengue virus
DLPVWLAYRV

SEQ ID NO: 42438 - protein, 10 aa, Dengue virus
LPVWLAYRVA

SEQ ID NO: 42439 - protein, 10 aa, Dengue virus
PVWLAYRVAA

SEQ ID NO: 42440 - protein, 10 aa, Dengue virus
VWLAYRVAAE

SEQ ID NO: 42441 - protein, 10 aa, Dengue virus
WLAYRVAAEG

SEQ ID NO: 42442 - protein, 10 aa, Dengue virus
LAYRVAAEGI

SEQ ID NO: 42443 - protein, 10 aa, Dengue virus
AYRVAAEGIN

SEQ ID NO: 42444 - protein, 10 aa, Dengue virus
YRVAAEGINY

SEQ ID NO: 42445 - protein, 10 aa, Dengue virus
RVAAEGINYA

SEQ ID NO: 42446 - protein, 10 aa, Dengue virus
VASEGINYAD

SEQ ID NO: 42447 - protein, 10 aa, Dengue virus
ASEGINYADR

SEQ ID NO: 42448 - protein, 10 aa, Dengue virus
EGINYADRKW

SEQ ID NO: 42449 - protein, 10 aa, Dengue virus
GINYADRKWC

SEQ ID NO: 42450 - protein, 10 aa, Dengue virus
INYADRKWCF

SEQ ID NO: 42451 - protein, 10 aa, Dengue virus
NYADRKWCFD

SEQ ID NO: 42452 - protein, 10 aa, Dengue virus
YADRKWCFDG

SEQ ID NO: 42453 - protein, 10 aa, Dengue virus
ADRKWCFDGI

SEQ ID NO: 42454 - protein, 10 aa, Dengue virus
DRKWCFDGIK

SEQ ID NO: 42455 - protein, 10 aa, Dengue virus
RKWCFDGIKN

SEQ ID NO: 42456 - protein, 10 aa, Dengue virus
KWCFDGIKNN

SEQ ID NO: 42457 - protein, 10 aa, Dengue virus
WCFDGVKNNQ

SEQ ID NO: 42458 - protein, 10 aa, Dengue virus
CFDGVKNNQI

SEQ ID NO: 42459 - protein, 10 aa, Dengue virus
FDGVKNNQIL

SEQ ID NO: 42460 - protein, 10 aa, Dengue virus
DGVKNNQILE

SEQ ID NO: 42461 - protein, 10 aa, Dengue virus
GVKNNQILEE

SEQ ID NO: 42462 - protein, 10 aa, Dengue virus
VKNNQILEEN

SEQ ID NO: 42463 - protein, 10 aa, Dengue virus
KNNQILEENM

SEQ ID NO: 42464 - protein, 10 aa, Dengue virus
NNQILEENME

SEQ ID NO: 42465 - protein, 10 aa, Dengue virus
NQILEENMEV

SEQ ID NO: 42466 - protein, 10 aa, Dengue virus
QILEENMEVE

SEQ ID NO: 42467 - protein, 10 aa, Dengue virus
ILEENMEVEI

SEQ ID NO: 42468 - protein, 10 aa, Dengue virus
LEENMEVEIW

SEQ ID NO: 42469 - protein, 10 aa, Dengue virus
EENMEVEIWT

SEQ ID NO: 42470 - protein, 10 aa, Dengue virus
ENMEVEIWTK

SEQ ID NO: 42471 - protein, 10 aa, Dengue virus
NMEVEIWTKE

SEQ ID NO: 42472 - protein, 10 aa, Dengue virus
MEVEIWTKEG

SEQ ID NO: 42473 - protein, 10 aa, Dengue virus
EVEVWTKEGE

SEQ ID NO: 42474 - protein, 10 aa, Dengue virus
VEVWTKEGER

SEQ ID NO: 42475 - protein, 10 aa, Dengue virus
EVWTKEGERK

SEQ ID NO: 42476 - protein, 10 aa, Dengue virus
VWTKEGERKK

SEQ ID NO: 42477 - protein, 10 aa, Dengue virus
LKPRWLDART

SEQ ID NO: 42478 - protein, 10 aa, Dengue virus
KPRWLDARTY

SEQ ID NO: 42479 - protein, 10 aa, Dengue virus
PRWLDARTYS

SEQ ID NO: 42480 - protein, 10 aa, Dengue virus
RWLDARTYSD

SEQ ID NO: 42481 - protein, 10 aa, Dengue virus
WLDARTYSDP

SEQ ID NO: 42482 - protein, 10 aa, Dengue virus
LDARTYSDPL

SEQ ID NO: 42483 - protein, 10 aa, Dengue virus
DARTYSDPLA

SEQ ID NO: 42484 - protein, 10 aa, Dengue virus
ARTYSDPLAL

SEQ ID NO: 42485 - protein, 10 aa, Dengue virus
RTYSDPLALK

SEQ ID NO: 42486 - protein, 10 aa, Dengue virus
TYSDPLALKE

SEQ ID NO: 42487 - protein, 10 aa, Dengue virus
EFAAGRKSLA

SEQ ID NO: 42488 - protein, 10 aa, Dengue virus
FAAGRKSLAL

SEQ ID NO: 42489 - protein, 10 aa, Dengue virus
AAGRKSLALN

SEQ ID NO: 42490 - protein, 10 aa, Dengue virus
AGRKSLALNL

SEQ ID NO: 42491 - protein, 10 aa, Dengue virus
GRKSLALNLI

SEQ ID NO: 42492 - protein, 10 aa, Dengue virus
RKSLALNLIT

SEQ ID NO: 42493 - protein, 10 aa, Dengue virus
KSLALNLITE

SEQ ID NO: 42494 - protein, 10 aa, Dengue virus
SLALNLITEM

SEQ ID NO: 42495 - protein, 10 aa, Dengue virus
LALNLITEMG

SEQ ID NO: 42496 - protein, 10 aa, Dengue virus
ALNLITEMGR

SEQ ID NO: 42497 - protein, 10 aa, Dengue virus
LSLITEMGRL

SEQ ID NO: 42498 - protein, 10 aa, Dengue virus
SLITEMGRLP

SEQ ID NO: 42499 - protein, 10 aa, Dengue virus
RLPTFMTQKT

SEQ ID NO: 42500 - protein, 10 aa, Dengue virus
LPTFMTQKTR

SEQ ID NO: 42501 - protein, 10 aa, Dengue virus
PTFMTQKTRD

SEQ ID NO: 42502 - protein, 10 aa, Dengue virus
TFMTQKTRDA

SEQ ID NO: 42503 - protein, 10 aa, Dengue virus
FMTQKTRDAL

SEQ ID NO: 42504 - protein, 10 aa, Dengue virus
MTQKTRDALD

SEQ ID NO: 42505 - protein, 10 aa, Dengue virus
TQKTRDALDN

SEQ ID NO: 42506 - protein, 10 aa, Dengue virus
QKTRDALDNL

SEQ ID NO: 42507 - protein, 10 aa, Dengue virus
KTRDALDNLA

SEQ ID NO: 42508 - protein, 10 aa, Dengue virus
TRDALDNLAV

SEQ ID NO: 42509 - protein, 10 aa, Dengue virus
RNALDNLAVL

SEQ ID NO: 42510 - protein, 10 aa, Dengue virus
NALDNLAVLH

SEQ ID NO: 42511 - protein, 10 aa, Dengue virus
ALDNLAVLHS

SEQ ID NO: 42512 - protein, 10 aa, Dengue virus
LDNLAVLHSA

SEQ ID NO: 42513 - protein, 10 aa, Dengue virus
DNLAVLHSAE

SEQ ID NO: 42514 - protein, 10 aa, Dengue virus
NLAVLHTAEV

SEQ ID NO: 42515 - protein, 10 aa, Dengue virus
LAVLHTAEVG

SEQ ID NO: 42516 - protein, 10 aa, Dengue virus
AVLHTAEVGG

SEQ ID NO: 42517 - protein, 10 aa, Dengue virus
VLHTAEVGGR

SEQ ID NO: 42518 - protein, 10 aa, Dengue virus
LHTAEVGGRA

SEQ ID NO: 42519 - protein, 10 aa, Dengue virus
GGKAYNHALS

SEQ ID NO: 42520 - protein, 10 aa, Dengue virus
GKAYNHALSE

SEQ ID NO: 42521 - protein, 10 aa, Dengue virus
KAYNHALSEL

SEQ ID NO: 42522 - protein, 10 aa, Dengue virus
AYTHALSELP

SEQ ID NO: 42523 - protein, 10 aa, Dengue virus
YTHALSELPE

SEQ ID NO: 42524 - protein, 10 aa, Dengue virus
THALSELPET

SEQ ID NO: 42525 - protein, 10 aa, Dengue virus
ETLETLLLLG

SEQ ID NO: 42526 - protein, 10 aa, Dengue virus
TLETLLLLGL

SEQ ID NO: 42527 - protein, 10 aa, Dengue virus
LETLLLLGLL

SEQ ID NO: 42528 - protein, 10 aa, Dengue virus
ETLLLLGLLA

SEQ ID NO: 42529 - protein, 10 aa, Dengue virus
TLLLLGLLAT

SEQ ID NO: 42530 - protein, 10 aa, Dengue virus
LLLLGLLATV

SEQ ID NO: 42531 - protein, 10 aa, Dengue virus
LLLGLLATVT

SEQ ID NO: 42532 - protein, 10 aa, Dengue virus
LLGLLATVTG

SEQ ID NO: 42533 - protein, 10 aa, Dengue virus
LGLLATVTGG

SEQ ID NO: 42534 - protein, 10 aa, Dengue virus
GLLATVTGGI

SEQ ID NO: 42535 - protein, 10 aa, Dengue virus
LLAAVTGGIF

SEQ ID NO: 42536 - protein, 10 aa, Dengue virus
LAAVTGGIFL

SEQ ID NO: 42537 - protein, 10 aa, Dengue virus
AAVTGGIFLF

SEQ ID NO: 42538 - protein, 10 aa, Dengue virus
AVTGGIFLFL

SEQ ID NO: 42539 - protein, 10 aa, Dengue virus
GGIFLFLMSA

SEQ ID NO: 42540 - protein, 10 aa, Dengue virus
GIFLFLMSGR

SEQ ID NO: 42541 - protein, 10 aa, Dengue virus
IFLFLMSGRG

SEQ ID NO: 42542 - protein, 10 aa, Dengue virus
FLFLMSGRGI

SEQ ID NO: 42543 - protein, 10 aa, Dengue virus
LFLMSGRGIG

SEQ ID NO: 42544 - protein, 10 aa, Dengue virus
FLMSGRGIGK

SEQ ID NO: 42545 - protein, 10 aa, Dengue virus
LMSGRGIGKM

SEQ ID NO: 42546 - protein, 10 aa, Dengue virus
MSGRGIGKMT

SEQ ID NO: 42547 - protein, 10 aa, Dengue virus
SGRGIGKMTL

SEQ ID NO: 42548 - protein, 10 aa, Dengue virus
GRGIGKMTLG

SEQ ID NO: 42549 - protein, 10 aa, Dengue virus
RGIGKMTLGM

SEQ ID NO: 42550 - protein, 10 aa, Dengue virus
GVGKMTLGMC

SEQ ID NO: 42551 - protein, 10 aa, Dengue virus
VGKMTLGMCC

SEQ ID NO: 42552 - protein, 10 aa, Dengue virus
KMTLGMCCIV

SEQ ID NO: 42553 - protein, 10 aa, Dengue virus
MTLGMCCIVT

SEQ ID NO: 42554 - protein, 10 aa, Dengue virus
TLGMCCIVTA

SEQ ID NO: 42555 - protein, 10 aa, Dengue virus
LGMCCIVTAS

SEQ ID NO: 42556 - protein, 10 aa, Dengue virus
LLWHAQIQPH

SEQ ID NO: 42557 - protein, 10 aa, Dengue virus
LWHAQIQPHW

SEQ ID NO: 42558 - protein, 10 aa, Dengue virus
WHAQIQPHWI

SEQ ID NO: 42559 - protein, 10 aa, Dengue virus
HAQIQPHWIA

SEQ ID NO: 42560 - protein, 10 aa, Dengue virus
ASIILVFFLI

SEQ ID NO: 42561 - protein, 10 aa, Dengue virus
SIILVFFLIV

SEQ ID NO: 42562 - protein, 10 aa, Dengue virus
IILVFFLIVL

SEQ ID NO: 42563 - protein, 10 aa, Dengue virus
ILVFFLIVLL

SEQ ID NO: 42564 - protein, 10 aa, Dengue virus
LVFFLIVLLI

SEQ ID NO: 42565 - protein, 10 aa, Dengue virus
VFFLIVLLIP

SEQ ID NO: 42566 - protein, 10 aa, Dengue virus
PQDNQLTYVI

SEQ ID NO: 42567 - protein, 10 aa, Dengue virus
QDNQLTYVII

SEQ ID NO: 42568 - protein, 10 aa, Dengue virus
DNQLTYVIIA

SEQ ID NO: 42569 - protein, 10 aa, Dengue virus
NQLTYVIIAI

SEQ ID NO: 42570 - protein, 10 aa, Dengue virus
QLTYVIIAIL

SEQ ID NO: 42571 - protein, 10 aa, Dengue virus
LTYVIIAILT

SEQ ID NO: 42572 - protein, 10 aa, Dengue virus
TYVIIAILTV

SEQ ID NO: 42573 - protein, 10 aa, Dengue virus
YVIIAILTVV

SEQ ID NO: 42574 - protein, 10 aa, Dengue virus
VIIAILTVVA

SEQ ID NO: 42575 - protein, 10 aa, Dengue virus
IIAILTVVAA

SEQ ID NO: 42576 - protein, 10 aa, Dengue virus
IAILTLVAAT

SEQ ID NO: 42577 - protein, 10 aa, Dengue virus
AILTLVAATM

SEQ ID NO: 42578 - protein, 10 aa, Dengue virus
ILTLVAATMA

SEQ ID NO: 42579 - protein, 10 aa, Dengue virus
LTLVAATMAN

SEQ ID NO: 42580 - protein, 10 aa, Dengue virus
TLVAATMANE

SEQ ID NO: 42581 - protein, 10 aa, Dengue virus
LVAATMANEM

SEQ ID NO: 42582 - protein, 10 aa, Dengue virus
GFLEKTKKDF

SEQ ID NO: 42583 - protein, 10 aa, Dengue virus
FLEKTKKDFG

SEQ ID NO: 42584 - protein, 10 aa, Dengue virus
LEKTKKDFGL

SEQ ID NO: 42585 - protein, 10 aa, Dengue virus
EKTKKDFGLG

SEQ ID NO: 42586 - protein, 10 aa, Dengue virus
QPESNILDID

SEQ ID NO: 42587 - protein, 10 aa, Dengue virus
SESNILDIDL

SEQ ID NO: 42588 - protein, 10 aa, Dengue virus
EINILDIDLR

SEQ ID NO: 42589 - protein, 10 aa, Dengue virus
INILDIDLRP

SEQ ID NO: 42590 - protein, 10 aa, Dengue virus
TLYAVATTFI

SEQ ID NO: 42591 - protein, 10 aa, Dengue virus
LYAVATTFIT

SEQ ID NO: 42592 - protein, 10 aa, Dengue virus
YAVATTFITP

SEQ ID NO: 42593 - protein, 10 aa, Dengue virus
AVATTFITPM

SEQ ID NO: 42594 - protein, 10 aa, Dengue virus
VATTFITPML

SEQ ID NO: 42595 - protein, 10 aa, Dengue virus
ATTFITPMLR

SEQ ID NO: 42596 - protein, 10 aa, Dengue virus
TTFITPMLRH

SEQ ID NO: 42597 - protein, 10 aa, Dengue virus
TFITPMLRHS

SEQ ID NO: 42598 - protein, 10 aa, Dengue virus
FITPMLRHSI

SEQ ID NO: 42599 - protein, 10 aa, Dengue virus
ITPMLRHSIE

SEQ ID NO: 42600 - protein, 10 aa, Dengue virus
QATVLMGLGR

SEQ ID NO: 42601 - protein, 10 aa, Dengue virus
ATVLMGLGRG

SEQ ID NO: 42602 - protein, 10 aa, Dengue virus
TVLMGLGRGW

SEQ ID NO: 42603 - protein, 10 aa, Dengue virus
VLMGLGRGWP

SEQ ID NO: 42604 - protein, 10 aa, Dengue virus
LMGLGRGWPL

SEQ ID NO: 42605 - protein, 10 aa, Dengue virus
MGLGRGWPLS

SEQ ID NO: 42606 - protein, 10 aa, Dengue virus
GLGRGWPLSK

SEQ ID NO: 42607 - protein, 10 aa, Dengue virus
LGRGWPLSKM

SEQ ID NO: 42608 - protein, 10 aa, Dengue virus
GRGWPLSKMD

SEQ ID NO: 42609 - protein, 10 aa, Dengue virus
RGWPLSKMDI

SEQ ID NO: 42610 - protein, 10 aa, Dengue virus
WPLSKMDIGA

SEQ ID NO: 42611 - protein, 10 aa, Dengue virus
PLSKMDIGAP

SEQ ID NO: 42612 - protein, 10 aa, Dengue virus
LSKMDIGAPL

SEQ ID NO: 42613 - protein, 10 aa, Dengue virus
SKMDIGAPLL

SEQ ID NO: 42614 - protein, 10 aa, Dengue virus
KMDIGAPLLA

SEQ ID NO: 42615 - protein, 10 aa, Dengue virus
MDIGAPLLAI

SEQ ID NO: 42616 - protein, 10 aa, Dengue virus
DIGAPLLAIG

SEQ ID NO: 42617 - protein, 10 aa, Dengue virus
IGAPLLAIGC

SEQ ID NO: 42618 - protein, 10 aa, Dengue virus
GAPLLAIGCY

SEQ ID NO: 42619 - protein, 10 aa, Dengue virus
APLLAIGCYS

SEQ ID NO: 42620 - protein, 10 aa, Dengue virus
SQVNPVTLTA

SEQ ID NO: 42621 - protein, 10 aa, Dengue virus
QVNPVTLTAA

SEQ ID NO: 42622 - protein, 10 aa, Dengue virus
VNPVTLTAAL

SEQ ID NO: 42623 - protein, 10 aa, Dengue virus
NPITLTAALF

SEQ ID NO: 42624 - protein, 10 aa, Dengue virus
PITLTAALFL

SEQ ID NO: 42625 - protein, 10 aa, Dengue virus
ITLTAALFLL

SEQ ID NO: 42626 - protein, 10 aa, Dengue virus
TAALFLLVAH

SEQ ID NO: 42627 - protein, 10 aa, Dengue virus
LIAHYAIIGP

SEQ ID NO: 42628 - protein, 10 aa, Dengue virus
IAHYAIIGPG

SEQ ID NO: 42629 - protein, 10 aa, Dengue virus
KATREAQKRT

SEQ ID NO: 42630 - protein, 10 aa, Dengue virus
ATREAQKRTA

SEQ ID NO: 42631 - protein, 10 aa, Dengue virus
TREAQKRTAA

SEQ ID NO: 42632 - protein, 10 aa, Dengue virus
REAQKRTAAG

SEQ ID NO: 42633 - protein, 10 aa, Dengue virus
EAQKRTAAGI

SEQ ID NO: 42634 - protein, 10 aa, Dengue virus
AQKRTAAGIM

SEQ ID NO: 42635 - protein, 10 aa, Dengue virus
QKRTAAGIMK

SEQ ID NO: 42636 - protein, 10 aa, Dengue virus
KRTAAGIMKN

SEQ ID NO: 42637 - protein, 10 aa, Dengue virus
RTAAGIMKNP

SEQ ID NO: 42638 - protein, 10 aa, Dengue virus
TAAGIMKNPT

SEQ ID NO: 42639 - protein, 10 aa, Dengue virus
IMKNPTVDGV

SEQ ID NO: 42640 - protein, 10 aa, Dengue virus
MKNPTVDGVT

SEQ ID NO: 42641 - protein, 10 aa, Dengue virus
KNPTVDGVTV

SEQ ID NO: 42642 - protein, 10 aa, Dengue virus
NPTVDGVTVI

SEQ ID NO: 42643 - protein, 10 aa, Dengue virus
PTVDGVTVID

SEQ ID NO: 42644 - protein, 10 aa, Dengue virus
TVDGVTVIDL

SEQ ID NO: 42645 - protein, 10 aa, Dengue virus
VDGITVIDLD

SEQ ID NO: 42646 - protein, 10 aa, Dengue virus
DGITVIDLDP

SEQ ID NO: 42647 - protein, 10 aa, Dengue virus
GITVIDLDPI

SEQ ID NO: 42648 - protein, 10 aa, Dengue virus
ITVIDLDPIP

SEQ ID NO: 42649 - protein, 10 aa, Dengue virus
TVIDLEPIPY

SEQ ID NO: 42650 - protein, 10 aa, Dengue virus
VIDLDPIPYD

SEQ ID NO: 42651 - protein, 10 aa, Dengue virus
IDLDPIPYDP

SEQ ID NO: 42652 - protein, 10 aa, Dengue virus
DLEPIPYDPK

SEQ ID NO: 42653 - protein, 10 aa, Dengue virus
LDPIPYDPKF

SEQ ID NO: 42654 - protein, 10 aa, Dengue virus
EPIPYDPKFE

SEQ ID NO: 42655 - protein, 10 aa, Dengue virus
KQLGQVMLLV

SEQ ID NO: 42656 - protein, 10 aa, Dengue virus
QLGQVMLLVL

SEQ ID NO: 42657 - protein, 10 aa, Dengue virus
LGQVMLLVLC

SEQ ID NO: 42658 - protein, 10 aa, Dengue virus
GQVMLLVLCV

SEQ ID NO: 42659 - protein, 10 aa, Dengue virus
QVMLLVLCVT

SEQ ID NO: 42660 - protein, 10 aa, Dengue virus
VMLLVLCVTQ

SEQ ID NO: 42661 - protein, 10 aa, Dengue virus
MLLVLCVTQV

SEQ ID NO: 42662 - protein, 10 aa, Dengue virus
LLVLCVTQVL

SEQ ID NO: 42663 - protein, 10 aa, Dengue virus
LVLCVTQVLM

SEQ ID NO: 42664 - protein, 10 aa, Dengue virus
VLCVTQVLMM

SEQ ID NO: 42665 - protein, 10 aa, Dengue virus
EALTLATGPV

SEQ ID NO: 42666 - protein, 10 aa, Dengue virus
ALTLATGPVS

SEQ ID NO: 42667 - protein, 10 aa, Dengue virus
LTLATGPVST

SEQ ID NO: 42668 - protein, 10 aa, Dengue virus
TLATGPVSTL

SEQ ID NO: 42669 - protein, 10 aa, Dengue virus
LATGPVSTLW

SEQ ID NO: 42670 - protein, 10 aa, Dengue virus
ATGPVSTLWE

SEQ ID NO: 42671 - protein, 10 aa, Dengue virus
TGPVSTLWEG

SEQ ID NO: 42672 - protein, 10 aa, Dengue virus
GPVSTLWEGN

SEQ ID NO: 42673 - protein, 10 aa, Dengue virus
PVSTLWEGNP

SEQ ID NO: 42674 - protein, 10 aa, Dengue virus
VSTLWEGNPG

SEQ ID NO: 42675 - protein, 10 aa, Dengue virus
STLWEGNPGK

SEQ ID NO: 42676 - protein, 10 aa, Dengue virus
TLWEGNPGKF

SEQ ID NO: 42677 - protein, 10 aa, Dengue virus
LWEGNPGKFW

SEQ ID NO: 42678 - protein, 10 aa, Dengue virus
WEGNPGKFWN

SEQ ID NO: 42679 - protein, 10 aa, Dengue virus
EGNPGKFWNT

SEQ ID NO: 42680 - protein, 10 aa, Dengue virus
GNPGKFWNTT

SEQ ID NO: 42681 - protein, 10 aa, Dengue virus
NPGKFWNTTI

SEQ ID NO: 42682 - protein, 10 aa, Dengue virus
PGKFWNTTIA

SEQ ID NO: 42683 - protein, 10 aa, Dengue virus
GKFWNTTIAV

SEQ ID NO: 42684 - protein, 10 aa, Dengue virus
KFWNTTIAVS

SEQ ID NO: 42685 - protein, 10 aa, Dengue virus
GAGLLFSIMR

SEQ ID NO: 42686 - protein, 10 aa, Dengue virus
AGLLFSIMRN

SEQ ID NO: 42687 - protein, 10 aa, Dengue virus
GLLFSIMRNT

SEQ ID NO: 42688 - protein, 10 aa, Dengue virus
LLFSIMKNTA

SEQ ID NO: 42689 - protein, 10 aa, Dengue virus
LFSIMKNTTS

SEQ ID NO: 42690 - protein, 10 aa, Dengue virus
RRGTGNMGET

SEQ ID NO: 42691 - protein, 10 aa, Dengue virus
RGTGNMGETL

SEQ ID NO: 42692 - protein, 10 aa, Dengue virus
GTGNMGETLG

SEQ ID NO: 42693 - protein, 10 aa, Dengue virus
TGNMGETLGE

SEQ ID NO: 42694 - protein, 10 aa, Dengue virus
GNMGETLGEK

SEQ ID NO: 42695 - protein, 10 aa, Dengue virus
NMGETLGEKW

SEQ ID NO: 42696 - protein, 10 aa, Dengue virus
MGETLGEKWK

SEQ ID NO: 42697 - protein, 10 aa, Dengue virus
GETLGEKWKN

SEQ ID NO: 42698 - protein, 10 aa, Dengue virus
ETLGEKWKNR

SEQ ID NO: 42699 - protein, 10 aa, Dengue virus
TLGEKWKNRL

SEQ ID NO: 42700 - protein, 10 aa, Dengue virus
LGEKWKNRLN

SEQ ID NO: 42701 - protein, 10 aa, Dengue virus
GEKWKNRLNA

SEQ ID NO: 42702 - protein, 10 aa, Dengue virus
EKWKNRLNAL

SEQ ID NO: 42703 - protein, 10 aa, Dengue virus
KWKNRLNALG

SEQ ID NO: 42704 - protein, 10 aa, Dengue virus
LNALGRSEFQ

SEQ ID NO: 42705 - protein, 10 aa, Dengue virus
LGRSEFQIYK

SEQ ID NO: 42706 - protein, 10 aa, Dengue virus
GKSEFQIYKR

SEQ ID NO: 42707 - protein, 10 aa, Dengue virus
KSEFQIYKRS

SEQ ID NO: 42708 - protein, 10 aa, Dengue virus
SEFQIYKRSG

SEQ ID NO: 42709 - protein, 10 aa, Dengue virus
EFQIYKRSGI

SEQ ID NO: 42710 - protein, 10 aa, Dengue virus
FQIYKRSGIQ

SEQ ID NO: 42711 - protein, 10 aa, Dengue virus
QIYKRSGIQE

SEQ ID NO: 42712 - protein, 10 aa, Dengue virus
IYKRSGIQEV

SEQ ID NO: 42713 - protein, 10 aa, Dengue virus
YKRSGIQEVD

SEQ ID NO: 42714 - protein, 10 aa, Dengue virus
KRSGIQEVDR

SEQ ID NO: 42715 - protein, 10 aa, Dengue virus
RSGIQEVDRT

SEQ ID NO: 42716 - protein, 10 aa, Dengue virus
KLRWFVERNL

SEQ ID NO: 42717 - protein, 10 aa, Dengue virus
LRWFVERNLV

SEQ ID NO: 42718 - protein, 10 aa, Dengue virus
RWFVERNLVT

SEQ ID NO: 42719 - protein, 10 aa, Dengue virus
WFVERNLVTP

SEQ ID NO: 42720 - protein, 10 aa, Dengue virus
FVERNLVTPE

SEQ ID NO: 42721 - protein, 10 aa, Dengue virus
VERNLVTPEG

SEQ ID NO: 42722 - protein, 10 aa, Dengue virus
ERNLVTPEGK

SEQ ID NO: 42723 - protein, 10 aa, Dengue virus
RNLVTPEGKV

SEQ ID NO: 42724 - protein, 10 aa, Dengue virus
NLVTPEGKVV

SEQ ID NO: 42725 - protein, 10 aa, Dengue virus
LVTPEGKVVD

SEQ ID NO: 42726 - protein, 10 aa, Dengue virus
VTPEGKVMDL

SEQ ID NO: 42727 - protein, 10 aa, Dengue virus
TPEGKVMDLG

SEQ ID NO: 42728 - protein, 10 aa, Dengue virus
PEGKVMDLGC

SEQ ID NO: 42729 - protein, 10 aa, Dengue virus
EGKVMDLGCG

SEQ ID NO: 42730 - protein, 10 aa, Dengue virus
GKVMDLGCGR

SEQ ID NO: 42731 - protein, 10 aa, Dengue virus
KVMDLGCGRG

SEQ ID NO: 42732 - protein, 10 aa, Dengue virus
VMDLGCGRGG

SEQ ID NO: 42733 - protein, 10 aa, Dengue virus
MDLGCGRGGW

SEQ ID NO: 42734 - protein, 10 aa, Dengue virus
WSYYCGGLKD

SEQ ID NO: 42735 - protein, 10 aa, Dengue virus
SYYCGGLKDV

SEQ ID NO: 42736 - protein, 10 aa, Dengue virus
YYCGGLKNVK

SEQ ID NO: 42737 - protein, 10 aa, Dengue virus
YCGGLKNVKE

SEQ ID NO: 42738 - protein, 10 aa, Dengue virus
CGGLKNVKEV

SEQ ID NO: 42739 - protein, 10 aa, Dengue virus
GGLKNVKEVK

SEQ ID NO: 42740 - protein, 10 aa, Dengue virus
GLKNVKEVKG

SEQ ID NO: 42741 - protein, 10 aa, Dengue virus
LKNVKEVKGL

SEQ ID NO: 42742 - protein, 10 aa, Dengue virus
KNVKEVKGLT

SEQ ID NO: 42743 - protein, 10 aa, Dengue virus
NVKEVKGLTK

SEQ ID NO: 42744 - protein, 10 aa, Dengue virus
VKEVKGLTKG

SEQ ID NO: 42745 - protein, 10 aa, Dengue virus
KEVKGLTKGG

SEQ ID NO: 42746 - protein, 10 aa, Dengue virus
KGGPGHEEPV

SEQ ID NO: 42747 - protein, 10 aa, Dengue virus
GGPGHEEPVP

SEQ ID NO: 42748 - protein, 10 aa, Dengue virus
GPGHEEPVPM

SEQ ID NO: 42749 - protein, 10 aa, Dengue virus
PGHEEPVPMS

SEQ ID NO: 42750 - protein, 10 aa, Dengue virus
GHEEPVPMST

SEQ ID NO: 42751 - protein, 10 aa, Dengue virus
HEEPVPMSTY

SEQ ID NO: 42752 - protein, 10 aa, Dengue virus
EEPVPMSTYG

SEQ ID NO: 42753 - protein, 10 aa, Dengue virus
EPVPMSTYGW

SEQ ID NO: 42754 - protein, 10 aa, Dengue virus
PVPMSTYGWN

SEQ ID NO: 42755 - protein, 10 aa, Dengue virus
VPMSTYGWNL

SEQ ID NO: 42756 - protein, 10 aa, Dengue virus
NLVRLQSGID

SEQ ID NO: 42757 - protein, 10 aa, Dengue virus
LVRLQSGIDV

SEQ ID NO: 42758 - protein, 10 aa, Dengue virus
VRLQSGIDVF

SEQ ID NO: 42759 - protein, 10 aa, Dengue virus
RLQSGIDVFF

SEQ ID NO: 42760 - protein, 10 aa, Dengue virus
LQSGVDVFFI

SEQ ID NO: 42761 - protein, 10 aa, Dengue virus
QSGVDVFFIP

SEQ ID NO: 42762 - protein, 10 aa, Dengue virus
SGVDVFFIPP

SEQ ID NO: 42763 - protein, 10 aa, Dengue virus
GVDVFFIPPE

SEQ ID NO: 42764 - protein, 10 aa, Dengue virus
VDVFFIPPEK

SEQ ID NO: 42765 - protein, 10 aa, Dengue virus
DVFFIPPEKC

SEQ ID NO: 42766 - protein, 10 aa, Dengue virus
VFFIPPEKCD

SEQ ID NO: 42767 - protein, 10 aa, Dengue virus
FFIPPEKCDT

SEQ ID NO: 42768 - protein, 10 aa, Dengue virus
FIPPEKCDTL

SEQ ID NO: 42769 - protein, 10 aa, Dengue virus
IPPEKCDTLL

SEQ ID NO: 42770 - protein, 10 aa, Dengue virus
PPERCDTLLC

SEQ ID NO: 42771 - protein, 10 aa, Dengue virus
PERCDTLLCD

SEQ ID NO: 42772 - protein, 10 aa, Dengue virus
ERCDTLLCDI

SEQ ID NO: 42773 - protein, 10 aa, Dengue virus
RCDTLLCDIG

SEQ ID NO: 42774 - protein, 10 aa, Dengue virus
IGESSPNPTV

SEQ ID NO: 42775 - protein, 10 aa, Dengue virus
GESSPNPTVE

SEQ ID NO: 42776 - protein, 10 aa, Dengue virus
ESSPNPTVEA

SEQ ID NO: 42777 - protein, 10 aa, Dengue virus
SSPNPTVEAG

SEQ ID NO: 42778 - protein, 10 aa, Dengue virus
SPNPTVEAGR

SEQ ID NO: 42779 - protein, 10 aa, Dengue virus
PNPTVEAGRT

SEQ ID NO: 42780 - protein, 10 aa, Dengue virus
NPTVEAGRTL

SEQ ID NO: 42781 - protein, 10 aa, Dengue virus
PTVEAGRTLR

SEQ ID NO: 42782 - protein, 10 aa, Dengue virus
TVEAGRTLRV

SEQ ID NO: 42783 - protein, 10 aa, Dengue virus
VEAGRTLRVL

SEQ ID NO: 42784 - protein, 10 aa, Dengue virus
EAGRTLRVLS

SEQ ID NO: 42785 - protein, 10 aa, Dengue virus
AGRTLRVLSL

SEQ ID NO: 42786 - protein, 10 aa, Dengue virus
GRTLRVLSLV

SEQ ID NO: 42787 - protein, 10 aa, Dengue virus
RTLRVLSLVE

SEQ ID NO: 42788 - protein, 10 aa, Dengue virus
TLRVLSLVEN

SEQ ID NO: 42789 - protein, 10 aa, Dengue virus
LRVLSLVENW

SEQ ID NO: 42790 - protein, 10 aa, Dengue virus
RVLSLVENWL

SEQ ID NO: 42791 - protein, 10 aa, Dengue virus
VLSLVENWLN

SEQ ID NO: 42792 - protein, 10 aa, Dengue virus
LSLVENWLNN

SEQ ID NO: 42793 - protein, 10 aa, Dengue virus
SLVENWLNND

SEQ ID NO: 42794 - protein, 10 aa, Dengue virus
LVENWLNNDT

SEQ ID NO: 42795 - protein, 10 aa, Dengue virus
ENWLNNDTQF

SEQ ID NO: 42796 - protein, 10 aa, Dengue virus
NWLNNDTQFC

SEQ ID NO: 42797 - protein, 10 aa, Dengue virus
WLNNDTQFCI

SEQ ID NO: 42798 - protein, 10 aa, Dengue virus
LNNDTQFCIK

SEQ ID NO: 42799 - protein, 10 aa, Dengue virus
NNDTQFCIKV

SEQ ID NO: 42800 - protein, 10 aa, Dengue virus
NDTQFCIKVL

SEQ ID NO: 42801 - protein, 10 aa, Dengue virus
NTQFCVKVLN

SEQ ID NO: 42802 - protein, 10 aa, Dengue virus
TQFCVKVLNP

SEQ ID NO: 42803 - protein, 10 aa, Dengue virus
QFCVKVLNPY

SEQ ID NO: 42804 - protein, 10 aa, Dengue virus
FCVKVLNPYM

SEQ ID NO: 42805 - protein, 10 aa, Dengue virus
CVKVLNPYMP

SEQ ID NO: 42806 - protein, 10 aa, Dengue virus
VKVLNPYMPS

SEQ ID NO: 42807 - protein, 10 aa, Dengue virus
NPYMPSVIER

SEQ ID NO: 42808 - protein, 10 aa, Dengue virus
PYMPSVIERM

SEQ ID NO: 42809 - protein, 10 aa, Dengue virus
YMPSVIERME

SEQ ID NO: 42810 - protein, 10 aa, Dengue virus
MPSVIEKMET

SEQ ID NO: 42811 - protein, 10 aa, Dengue virus
PSVIEKMETL

SEQ ID NO: 42812 - protein, 10 aa, Dengue virus
SVIEKMETLQ

SEQ ID NO: 42813 - protein, 10 aa, Dengue virus
VIEKMETLQR

SEQ ID NO: 42814 - protein, 10 aa, Dengue virus
LQRQYGGALV

SEQ ID NO: 42815 - protein, 10 aa, Dengue virus
QRQYGGALVR

SEQ ID NO: 42816 - protein, 10 aa, Dengue virus
RQYGGALVRN

SEQ ID NO: 42817 - protein, 10 aa, Dengue virus
QYGGALVRNP

SEQ ID NO: 42818 - protein, 10 aa, Dengue virus
FGGALVRNPL

SEQ ID NO: 42819 - protein, 10 aa, Dengue virus
HEMYWVSNAS

SEQ ID NO: 42820 - protein, 10 aa, Dengue virus
EMYWVSNASG

SEQ ID NO: 42821 - protein, 10 aa, Dengue virus
MYWVSNASGN

SEQ ID NO: 42822 - protein, 10 aa, Dengue virus
YWVSNASGNI

SEQ ID NO: 42823 - protein, 10 aa, Dengue virus
WVSNASGNIV

SEQ ID NO: 42824 - protein, 10 aa, Dengue virus
VSNASGNIVS

SEQ ID NO: 42825 - protein, 10 aa, Dengue virus
SNASGNIVSS

SEQ ID NO: 42826 - protein, 10 aa, Dengue virus
NASGNIVSSV

SEQ ID NO: 42827 - protein, 10 aa, Dengue virus
ASGNIVSSVN

SEQ ID NO: 42828 - protein, 10 aa, Dengue virus
SGNIVSSVNM

SEQ ID NO: 42829 - protein, 10 aa, Dengue virus
RMLINRFTMR

SEQ ID NO: 42830 - protein, 10 aa, Dengue virus
MLINRFTMRH

SEQ ID NO: 42831 - protein, 10 aa, Dengue virus
LINRFTMRHK

SEQ ID NO: 42832 - protein, 10 aa, Dengue virus
INRFTMRHKK

SEQ ID NO: 42833 - protein, 10 aa, Dengue virus
NRFTMRHKKA

SEQ ID NO: 42834 - protein, 10 aa, Dengue virus
RFTMRHKKAT

SEQ ID NO: 42835 - protein, 10 aa, Dengue virus
FTMRHKKATY

SEQ ID NO: 42836 - protein, 10 aa, Dengue virus
TMRHKKATYE

SEQ ID NO: 42837 - protein, 10 aa, Dengue virus
MRHKKATYEP

SEQ ID NO: 42838 - protein, 10 aa, Dengue virus
RHKKATYEPD

SEQ ID NO: 42839 - protein, 10 aa, Dengue virus
YKKATYEPDV

SEQ ID NO: 42840 - protein, 10 aa, Dengue virus
KRATYEPDVD

SEQ ID NO: 42841 - protein, 10 aa, Dengue virus
KTTYEPDVDL

SEQ ID NO: 42842 - protein, 10 aa, Dengue virus
LGSGTRNIGT

SEQ ID NO: 42843 - protein, 10 aa, Dengue virus
GSGTRNIGTE

SEQ ID NO: 42844 - protein, 10 aa, Dengue virus
SGTRNIGIEN

SEQ ID NO: 42845 - protein, 10 aa, Dengue virus
GTRNIGIENE

SEQ ID NO: 42846 - protein, 10 aa, Dengue virus
ETPNLDIIGK

SEQ ID NO: 42847 - protein, 10 aa, Dengue virus
TPNLDIIGKR

SEQ ID NO: 42848 - protein, 10 aa, Dengue virus
PNMDIIGKRI

SEQ ID NO: 42849 - protein, 10 aa, Dengue virus
NMDIIGKRIE

SEQ ID NO: 42850 - protein, 10 aa, Dengue virus
MDIIGKRIEK

SEQ ID NO: 42851 - protein, 10 aa, Dengue virus
IGKRIEKIKE

SEQ ID NO: 42852 - protein, 10 aa, Dengue virus
GKRIEKIKEE

SEQ ID NO: 42853 - protein, 10 aa, Dengue virus
KRIEKIKEEH

SEQ ID NO: 42854 - protein, 10 aa, Dengue virus
RIEKIKEEHE

SEQ ID NO: 42855 - protein, 10 aa, Dengue virus
IEKIKQEHEI

SEQ ID NO: 42856 - protein, 10 aa, Dengue virus
EKIKQEHEIS

SEQ ID NO: 42857 - protein, 10 aa, Dengue virus
KIKQEHEISW

SEQ ID NO: 42858 - protein, 10 aa, Dengue virus
IKQEHEISWH

SEQ ID NO: 42859 - protein, 10 aa, Dengue virus
KQEHEISWHY

SEQ ID NO: 42860 - protein, 10 aa, Dengue virus
QEHEISWHYD

SEQ ID NO: 42861 - protein, 10 aa, Dengue virus
EHEISWHYDQ

SEQ ID NO: 42862 - protein, 10 aa, Dengue virus
HEISWHYDQD

SEQ ID NO: 42863 - protein, 10 aa, Dengue virus
EISWHYDQDH

SEQ ID NO: 42864 - protein, 10 aa, Dengue virus
ISWHYDQDHP

SEQ ID NO: 42865 - protein, 10 aa, Dengue virus
WHYDQDHPYR

SEQ ID NO: 42866 - protein, 10 aa, Dengue virus
HYDQDHPYRT

SEQ ID NO: 42867 - protein, 10 aa, Dengue virus
ASSMVNGVVK

SEQ ID NO: 42868 - protein, 10 aa, Dengue virus
SSMVNGVVKL

SEQ ID NO: 42869 - protein, 10 aa, Dengue virus
SMVNGVVKLL

SEQ ID NO: 42870 - protein, 10 aa, Dengue virus
MVNGVVKLLT

SEQ ID NO: 42871 - protein, 10 aa, Dengue virus
VNGVVKLLTK

SEQ ID NO: 42872 - protein, 10 aa, Dengue virus
NGVVKLLTKP

SEQ ID NO: 42873 - protein, 10 aa, Dengue virus
GVVKLLTKPW

SEQ ID NO: 42874 - protein, 10 aa, Dengue virus
VVKLLTKPWD

SEQ ID NO: 42875 - protein, 10 aa, Dengue virus
VKLLTKPWDV

SEQ ID NO: 42876 - protein, 10 aa, Dengue virus
RLLTKPWDVL

SEQ ID NO: 42877 - protein, 10 aa, Dengue virus
LLTKPWDVLP

SEQ ID NO: 42878 - protein, 10 aa, Dengue virus
LTKPWDVLPT

SEQ ID NO: 42879 - protein, 10 aa, Dengue virus
TKPWDVLPTV

SEQ ID NO: 42880 - protein, 10 aa, Dengue virus
KPWDVLPTVT

SEQ ID NO: 42881 - protein, 10 aa, Dengue virus
PWDVLPTVTQ

SEQ ID NO: 42882 - protein, 10 aa, Dengue virus
WDVLPTVTQM

SEQ ID NO: 42883 - protein, 10 aa, Dengue virus
DVLPTVTQMA

SEQ ID NO: 42884 - protein, 10 aa, Dengue virus
VLPTVTQMAM

SEQ ID NO: 42885 - protein, 10 aa, Dengue virus
LPTVTQMAMT

SEQ ID NO: 42886 - protein, 10 aa, Dengue virus
PTVTQMAMTD

SEQ ID NO: 42887 - protein, 10 aa, Dengue virus
TVTQMAMTDT

SEQ ID NO: 42888 - protein, 10 aa, Dengue virus
PKEGTKKLMR

SEQ ID NO: 42889 - protein, 10 aa, Dengue virus
KEGTKKLMRI

SEQ ID NO: 42890 - protein, 10 aa, Dengue virus
EGTKKLMRIT

SEQ ID NO: 42891 - protein, 10 aa, Dengue virus
GTKKLMRITA

SEQ ID NO: 42892 - protein, 10 aa, Dengue virus
TKKLMRITAE

SEQ ID NO: 42893 - protein, 10 aa, Dengue virus
KKLMRITAEW

SEQ ID NO: 42894 - protein, 10 aa, Dengue virus
KLMRITAEWL

SEQ ID NO: 42895 - protein, 10 aa, Dengue virus
LMRITAEWLW

SEQ ID NO: 42896 - protein, 10 aa, Dengue virus
MRITAEWLWK

SEQ ID NO: 42897 - protein, 10 aa, Dengue virus
RITAEWLWKE

SEQ ID NO: 42898 - protein, 10 aa, Dengue virus
ITAKWLWKEL

SEQ ID NO: 42899 - protein, 10 aa, Dengue virus
TAEWLWGELG

SEQ ID NO: 42900 - protein, 10 aa, Dengue virus
AEWLWGELGR

SEQ ID NO: 42901 - protein, 10 aa, Dengue virus
WLWKELGKEK

SEQ ID NO: 42902 - protein, 10 aa, Dengue virus
LWKELGKEKT

SEQ ID NO: 42903 - protein, 10 aa, Dengue virus
WKELGKEKTP

SEQ ID NO: 42904 - protein, 10 aa, Dengue virus
KELGKEKTPR

SEQ ID NO: 42905 - protein, 10 aa, Dengue virus
KKPRICTRAE

SEQ ID NO: 42906 - protein, 10 aa, Dengue virus
KPRICTRAEF

SEQ ID NO: 42907 - protein, 10 aa, Dengue virus
PRICTRAEFC

SEQ ID NO: 42908 - protein, 10 aa, Dengue virus
CTREEFTKKV

SEQ ID NO: 42909 - protein, 10 aa, Dengue virus
TREEFTKKVR

SEQ ID NO: 42910 - protein, 10 aa, Dengue virus
REEFTKKVRS

SEQ ID NO: 42911 - protein, 10 aa, Dengue virus
EEFTKKVRSN

SEQ ID NO: 42912 - protein, 10 aa, Dengue virus
EFTKKVRSNA

SEQ ID NO: 42913 - protein, 10 aa, Dengue virus
FTKKVRSNAA

SEQ ID NO: 42914 - protein, 10 aa, Dengue virus
TKKVRSNAAL

SEQ ID NO: 42915 - protein, 10 aa, Dengue virus
KKVRSNAALG

SEQ ID NO: 42916 - protein, 10 aa, Dengue virus
VRSNAALGAV

SEQ ID NO: 42917 - protein, 10 aa, Dengue virus
RSNAALGAVF

SEQ ID NO: 42918 - protein, 10 aa, Dengue virus
SNAALGAVFT

SEQ ID NO: 42919 - protein, 10 aa, Dengue virus
NAALGAVFTD

SEQ ID NO: 42920 - protein, 10 aa, Dengue virus
AALGAVFTDE

SEQ ID NO: 42921 - protein, 10 aa, Dengue virus
ALGAVFTDEN

SEQ ID NO: 42922 - protein, 10 aa, Dengue virus
LGAVFTDENK

SEQ ID NO: 42923 - protein, 10 aa, Dengue virus
GAVFTDENKW

SEQ ID NO: 42924 - protein, 10 aa, Dengue virus
AVFTDENKWK

SEQ ID NO: 42925 - protein, 10 aa, Dengue virus
VFTDENKWKS

SEQ ID NO: 42926 - protein, 10 aa, Dengue virus
KSAREAVEDG

SEQ ID NO: 42927 - protein, 10 aa, Dengue virus
SAREAVEDGR

SEQ ID NO: 42928 - protein, 10 aa, Dengue virus
AREAVEDGRF

SEQ ID NO: 42929 - protein, 10 aa, Dengue virus
REAVEDGRFW

SEQ ID NO: 42930 - protein, 10 aa, Dengue virus
EAVEDGRFWE

SEQ ID NO: 42931 - protein, 10 aa, Dengue virus
AVEDGRFWEL

SEQ ID NO: 42932 - protein, 10 aa, Dengue virus
FWELVDRERN

SEQ ID NO: 42933 - protein, 10 aa, Dengue virus
WELVDRERNL

SEQ ID NO: 42934 - protein, 10 aa, Dengue virus
ELVDRERNLH

SEQ ID NO: 42935 - protein, 10 aa, Dengue virus
LVDRERNLHL

SEQ ID NO: 42936 - protein, 10 aa, Dengue virus
DRERNLHLEG

SEQ ID NO: 42937 - protein, 10 aa, Dengue virus
RERNLHLEGK

SEQ ID NO: 42938 - protein, 10 aa, Dengue virus
ERNLHLDGKC

SEQ ID NO: 42939 - protein, 10 aa, Dengue virus
RNLHLDGKCE

SEQ ID NO: 42940 - protein, 10 aa, Dengue virus
NLHLDGKCET

SEQ ID NO: 42941 - protein, 10 aa, Dengue virus
LHLDGKCETC

SEQ ID NO: 42942 - protein, 10 aa, Dengue virus
HLDGKCETCV

SEQ ID NO: 42943 - protein, 10 aa, Dengue virus
LDGKCETCVY

SEQ ID NO: 42944 - protein, 10 aa, Dengue virus
DGKCETCVYN

SEQ ID NO: 42945 - protein, 10 aa, Dengue virus
KIGEFGKAKG

SEQ ID NO: 42946 - protein, 10 aa, Dengue virus
IGEFGKAKGS

SEQ ID NO: 42947 - protein, 10 aa, Dengue virus
LNEDHWFSRG

SEQ ID NO: 42948 - protein, 10 aa, Dengue virus
NEDHWFSRGN

SEQ ID NO: 42949 - protein, 10 aa, Dengue virus
EDHWFSRGNS

SEQ ID NO: 42950 - protein, 10 aa, Dengue virus
DHWFSRGNSL

SEQ ID NO: 42951 - protein, 10 aa, Dengue virus
HWFSRGNSLS

SEQ ID NO: 42952 - protein, 10 aa, Dengue virus
WFSRGNSLSG

SEQ ID NO: 42953 - protein, 10 aa, Dengue virus
FSRGNSLSGV

SEQ ID NO: 42954 - protein, 10 aa, Dengue virus
SRGNSLSGVE

SEQ ID NO: 42955 - protein, 10 aa, Dengue virus
RGNSLSGVEG

SEQ ID NO: 42956 - protein, 10 aa, Dengue virus
GNSLSGVEGE

SEQ ID NO: 42957 - protein, 10 aa, Dengue virus
LSGVEGEGLY

SEQ ID NO: 42958 - protein, 10 aa, Dengue virus
SGVEGEGLHR

SEQ ID NO: 42959 - protein, 10 aa, Dengue virus
GVEGEGLHRL

SEQ ID NO: 42960 - protein, 10 aa, Dengue virus
VEGEGLHRLG

SEQ ID NO: 42961 - protein, 10 aa, Dengue virus
EGEGLHRLGY

SEQ ID NO: 42962 - protein, 10 aa, Dengue virus
GEGLHRLGYI

SEQ ID NO: 42963 - protein, 10 aa, Dengue virus
EGLHRLGYIL

SEQ ID NO: 42964 - protein, 10 aa, Dengue virus
GLHRLGYILR

SEQ ID NO: 42965 - protein, 10 aa, Dengue virus
LHRLGYILRD

SEQ ID NO: 42966 - protein, 10 aa, Dengue virus
HRLGYILRDV

SEQ ID NO: 42967 - protein, 10 aa, Dengue virus
LGYILRDVGK

SEQ ID NO: 42968 - protein, 10 aa, Dengue virus
GYILRDVGKK

SEQ ID NO: 42969 - protein, 10 aa, Dengue virus
VGKKEGGAMY

SEQ ID NO: 42970 - protein, 10 aa, Dengue virus
GKKEGGAMYA

SEQ ID NO: 42971 - protein, 10 aa, Dengue virus
RKAGGAMYAD

SEQ ID NO: 42972 - protein, 10 aa, Dengue virus
KAGGAMYADD

SEQ ID NO: 42973 - protein, 10 aa, Dengue virus
AGGAMYADDT

SEQ ID NO: 42974 - protein, 10 aa, Dengue virus
TAGWDTRITI

SEQ ID NO: 42975 - protein, 10 aa, Dengue virus
AGWDTRITIE

SEQ ID NO: 42976 - protein, 10 aa, Dengue virus
GWDTRITIED

SEQ ID NO: 42977 - protein, 10 aa, Dengue virus
WDTRITIEDL

SEQ ID NO: 42978 - protein, 10 aa, Dengue virus
DTRITIEDLK

SEQ ID NO: 42979 - protein, 10 aa, Dengue virus
TRITIEDLKN

SEQ ID NO: 42980 - protein, 10 aa, Dengue virus
RITIEDLKNE

SEQ ID NO: 42981 - protein, 10 aa, Dengue virus
ITIEDLKNEE

SEQ ID NO: 42982 - protein, 10 aa, Dengue virus
TIEDLKNEEM

SEQ ID NO: 42983 - protein, 10 aa, Dengue virus
IEDLKNEEMI

SEQ ID NO: 42984 - protein, 10 aa, Dengue virus
EDLKNEEMIT

SEQ ID NO: 42985 - protein, 10 aa, Dengue virus
DLKNEEMITN

SEQ ID NO: 42986 - protein, 10 aa, Dengue virus
LKNEEMITNH

SEQ ID NO: 42987 - protein, 10 aa, Dengue virus
KNEEMITNHM

SEQ ID NO: 42988 - protein, 10 aa, Dengue virus
GEHKRLAEAI

SEQ ID NO: 42989 - protein, 10 aa, Dengue virus
EHKRLAEAIF

SEQ ID NO: 42990 - protein, 10 aa, Dengue virus
HKRLAEAIFK

SEQ ID NO: 42991 - protein, 10 aa, Dengue virus
KRLAEAIFKL

SEQ ID NO: 42992 - protein, 10 aa, Dengue virus
RLAEAIFKLT

SEQ ID NO: 42993 - protein, 10 aa, Dengue virus
LAEAIFRLTY

SEQ ID NO: 42994 - protein, 10 aa, Dengue virus
AEAIFRLTYQ

SEQ ID NO: 42995 - protein, 10 aa, Dengue virus
EAIFRLTYQN

SEQ ID NO: 42996 - protein, 10 aa, Dengue virus
AIFRLTYQNK

SEQ ID NO: 42997 - protein, 10 aa, Dengue virus
IFRLTYQNKV

SEQ ID NO: 42998 - protein, 10 aa, Dengue virus
FRLTYQNKVV

SEQ ID NO: 42999 - protein, 10 aa, Dengue virus
RLTYQNKVVR

SEQ ID NO: 43000 - protein, 10 aa, Dengue virus
VVRVQRPTPI

SEQ ID NO: 43001 - protein, 10 aa, Dengue virus
RVQRPTPKGT

SEQ ID NO: 43002 - protein, 10 aa, Dengue virus
VQRPTSRGTV

SEQ ID NO: 43003 - protein, 10 aa, Dengue virus
QRPTPIGTVM

SEQ ID NO: 43004 - protein, 10 aa, Dengue virus
RPTSRGTVMD

SEQ ID NO: 43005 - protein, 10 aa, Dengue virus
PTPKGTVMDI

SEQ ID NO: 43006 - protein, 10 aa, Dengue virus
TPKGTVMDII

SEQ ID NO: 43007 - protein, 10 aa, Dengue virus
SRGTVMDIIS

SEQ ID NO: 43008 - protein, 10 aa, Dengue virus
GTVMDIISRK

SEQ ID NO: 43009 - protein, 10 aa, Dengue virus
TVMDIISRKD

SEQ ID NO: 43010 - protein, 10 aa, Dengue virus
VMDIISRKDQ

SEQ ID NO: 43011 - protein, 10 aa, Dengue virus
MDIISRKDQR

SEQ ID NO: 43012 - protein, 10 aa, Dengue virus
DIISRKDQRG

SEQ ID NO: 43013 - protein, 10 aa, Dengue virus
IISRKDQRGS

SEQ ID NO: 43014 - protein, 10 aa, Dengue virus
ISRKDQRGSG

SEQ ID NO: 43015 - protein, 10 aa, Dengue virus
SRKDQRGSGQ

SEQ ID NO: 43016 - protein, 10 aa, Dengue virus
RKDQRGSGQV

SEQ ID NO: 43017 - protein, 10 aa, Dengue virus
KDQRGSGQVG

SEQ ID NO: 43018 - protein, 10 aa, Dengue virus
DQRGSGQVVT

SEQ ID NO: 43019 - protein, 10 aa, Dengue virus
QRGSGQVVTY

SEQ ID NO: 43020 - protein, 10 aa, Dengue virus
RGSGQVVTYG

SEQ ID NO: 43021 - protein, 10 aa, Dengue virus
GSGQVVTYGL

SEQ ID NO: 43022 - protein, 10 aa, Dengue virus
SGQVVTYGLN

SEQ ID NO: 43023 - protein, 10 aa, Dengue virus
GQVVTYGLNT

SEQ ID NO: 43024 - protein, 10 aa, Dengue virus
QVVTYGLNTF

SEQ ID NO: 43025 - protein, 10 aa, Dengue virus
VVTYGLNTFT

SEQ ID NO: 43026 - protein, 10 aa, Dengue virus
VTYGLNTFTN

SEQ ID NO: 43027 - protein, 10 aa, Dengue virus
YGLNTFTNMG

SEQ ID NO: 43028 - protein, 10 aa, Dengue virus
GLNTFTNMGA

SEQ ID NO: 43029 - protein, 10 aa, Dengue virus
LNTFTNMGAQ

SEQ ID NO: 43030 - protein, 10 aa, Dengue virus
NTFTNMGAQL

SEQ ID NO: 43031 - protein, 10 aa, Dengue virus
TFTNMGAQLI

SEQ ID NO: 43032 - protein, 10 aa, Dengue virus
FTNMGAQLIR

SEQ ID NO: 43033 - protein, 10 aa, Dengue virus
TNMGAQLIRQ

SEQ ID NO: 43034 - protein, 10 aa, Dengue virus
NMGAQLIRQM

SEQ ID NO: 43035 - protein, 10 aa, Dengue virus
MGAQLIRQME

SEQ ID NO: 43036 - protein, 10 aa, Dengue virus
LIRQMEGEGV

SEQ ID NO: 43037 - protein, 10 aa, Dengue virus
IRQMEGEGVF

SEQ ID NO: 43038 - protein, 10 aa, Dengue virus
RQMEGEGVFK

SEQ ID NO: 43039 - protein, 10 aa, Dengue virus
REGRERLARM

SEQ ID NO: 43040 - protein, 10 aa, Dengue virus
EGRERLARMA

SEQ ID NO: 43041 - protein, 10 aa, Dengue virus
GRERLARMAI

SEQ ID NO: 43042 - protein, 10 aa, Dengue virus
RERLARMAIS

SEQ ID NO: 43043 - protein, 10 aa, Dengue virus
ERLARMAISG

SEQ ID NO: 43044 - protein, 10 aa, Dengue virus
RLARMAISGD

SEQ ID NO: 43045 - protein, 10 aa, Dengue virus
LARMAISGDD

SEQ ID NO: 43046 - protein, 10 aa, Dengue virus
ARMAISGDDC

SEQ ID NO: 43047 - protein, 10 aa, Dengue virus
SGDDCVVKPI

SEQ ID NO: 43048 - protein, 10 aa, Dengue virus
GDDCVVKPID

SEQ ID NO: 43049 - protein, 10 aa, Dengue virus
DDCVVKPIDD

SEQ ID NO: 43050 - protein, 10 aa, Dengue virus
DCVVKPIDDR

SEQ ID NO: 43051 - protein, 10 aa, Dengue virus
CVVKPIDDRF

SEQ ID NO: 43052 - protein, 10 aa, Dengue virus
VVKPIDDRFA

SEQ ID NO: 43053 - protein, 10 aa, Dengue virus
DDRFANALTA

SEQ ID NO: 43054 - protein, 10 aa, Dengue virus
DRFANALTAL

SEQ ID NO: 43055 - protein, 10 aa, Dengue virus
RFANALTALN

SEQ ID NO: 43056 - protein, 10 aa, Dengue virus
FANALTALND

SEQ ID NO: 43057 - protein, 10 aa, Dengue virus
ANALTALNDM

SEQ ID NO: 43058 - protein, 10 aa, Dengue virus
NALTALNDMG

SEQ ID NO: 43059 - protein, 10 aa, Dengue virus
LTALNDMGKI

SEQ ID NO: 43060 - protein, 10 aa, Dengue virus
TALNDMGKIR

SEQ ID NO: 43061 - protein, 10 aa, Dengue virus
ALNDMGKIRK

SEQ ID NO: 43062 - protein, 10 aa, Dengue virus
LNDMGKIRKD

SEQ ID NO: 43063 - protein, 10 aa, Dengue virus
NDMGKIRKDI

SEQ ID NO: 43064 - protein, 10 aa, Dengue virus
DMGKIRKDIQ

SEQ ID NO: 43065 - protein, 10 aa, Dengue virus
MGKIRKDIQQ

SEQ ID NO: 43066 - protein, 10 aa, Dengue virus
GKIRKDIQQW

SEQ ID NO: 43067 - protein, 10 aa, Dengue virus
KIRKDIQQWE

SEQ ID NO: 43068 - protein, 10 aa, Dengue virus
IRKDIQQWEP

SEQ ID NO: 43069 - protein, 10 aa, Dengue virus
KDIQQWEPSK

SEQ ID NO: 43070 - protein, 10 aa, Dengue virus
DIQQWEPSKG

SEQ ID NO: 43071 - protein, 10 aa, Dengue virus
IQQWEPSKGW

SEQ ID NO: 43072 - protein, 10 aa, Dengue virus
QQWEPSKGWN

SEQ ID NO: 43073 - protein, 10 aa, Dengue virus
QWEPSKGWND

SEQ ID NO: 43074 - protein, 10 aa, Dengue virus
WEPSKGWNDW

SEQ ID NO: 43075 - protein, 10 aa, Dengue virus
EPSKGWNDWT

SEQ ID NO: 43076 - protein, 10 aa, Dengue virus
PSKGWNDWTQ

SEQ ID NO: 43077 - protein, 10 aa, Dengue virus
SKGWNDWTQV

SEQ ID NO: 43078 - protein, 10 aa, Dengue virus
KGWNDWTQVP

SEQ ID NO: 43079 - protein, 10 aa, Dengue virus
GWSDWTQVPF

SEQ ID NO: 43080 - protein, 10 aa, Dengue virus
WSDWTQVPFC

SEQ ID NO: 43081 - protein, 10 aa, Dengue virus
SDWTQVPFCS

SEQ ID NO: 43082 - protein, 10 aa, Dengue virus
FCSHHFHELV

SEQ ID NO: 43083 - protein, 10 aa, Dengue virus
CSHHFHELVM

SEQ ID NO: 43084 - protein, 10 aa, Dengue virus
SHHFHELVMK

SEQ ID NO: 43085 - protein, 10 aa, Dengue virus
HHFHELVMKD

SEQ ID NO: 43086 - protein, 10 aa, Dengue virus
HFHELVMKDG

SEQ ID NO: 43087 - protein, 10 aa, Dengue virus
FHELVMKDGR

SEQ ID NO: 43088 - protein, 10 aa, Dengue virus
MKDGRTLVVP

SEQ ID NO: 43089 - protein, 10 aa, Dengue virus
KDGRTLVVPC

SEQ ID NO: 43090 - protein, 10 aa, Dengue virus
DGRTLVVPCR

SEQ ID NO: 43091 - protein, 10 aa, Dengue virus
LVVPCRSQDE

SEQ ID NO: 43092 - protein, 10 aa, Dengue virus
VVPCRSQDEL

SEQ ID NO: 43093 - protein, 10 aa, Dengue virus
VPCRSQDELI

SEQ ID NO: 43094 - protein, 10 aa, Dengue virus
PCRSQDELIG

SEQ ID NO: 43095 - protein, 10 aa, Dengue virus
CRSQDELIGR

SEQ ID NO: 43096 - protein, 10 aa, Dengue virus
RSQDELIGRA

SEQ ID NO: 43097 - protein, 10 aa, Dengue virus
SQDELIGRAR

SEQ ID NO: 43098 - protein, 10 aa, Dengue virus
ISQGAGWSLR

SEQ ID NO: 43099 - protein, 10 aa, Dengue virus
SQGAGWSLRE

SEQ ID NO: 43100 - protein, 10 aa, Dengue virus
QGAGWSLRET

SEQ ID NO: 43101 - protein, 10 aa, Dengue virus
GAGWSLRETA

SEQ ID NO: 43102 - protein, 10 aa, Dengue virus
AGWSLRETAC

SEQ ID NO: 43103 - protein, 10 aa, Dengue virus
GWSLRETACL

SEQ ID NO: 43104 - protein, 10 aa, Dengue virus
WSLRETACLG

SEQ ID NO: 43105 - protein, 10 aa, Dengue virus
SLRETACLGK

SEQ ID NO: 43106 - protein, 10 aa, Dengue virus
LRETACLGKS

SEQ ID NO: 43107 - protein, 10 aa, Dengue virus
RETACLGKSY

SEQ ID NO: 43108 - protein, 10 aa, Dengue virus
LGKSYAQMWT

SEQ ID NO: 43109 - protein, 10 aa, Dengue virus
GKSYAQMWTL

SEQ ID NO: 43110 - protein, 10 aa, Dengue virus
KSYAQMWTLM

SEQ ID NO: 43111 - protein, 10 aa, Dengue virus
SYAQMWTLMY

SEQ ID NO: 43112 - protein, 10 aa, Dengue virus
YAQMWTLMYF

SEQ ID NO: 43113 - protein, 10 aa, Dengue virus
AQMWTLMYFH

SEQ ID NO: 43114 - protein, 10 aa, Dengue virus
QMWTLMYFHR

SEQ ID NO: 43115 - protein, 10 aa, Dengue virus
MWTLMYFHRR

SEQ ID NO: 43116 - protein, 10 aa, Dengue virus
WTLMYFHRRD

SEQ ID NO: 43117 - protein, 10 aa, Dengue virus
TLMYFHRRDL

SEQ ID NO: 43118 - protein, 10 aa, Dengue virus
ANAICSAVPP

SEQ ID NO: 43119 - protein, 10 aa, Dengue virus
NAICSAVPPH

SEQ ID NO: 43120 - protein, 10 aa, Dengue virus
AICSAVPPHW

SEQ ID NO: 43121 - protein, 10 aa, Dengue virus
ICSAVPPHWV

SEQ ID NO: 43122 - protein, 10 aa, Dengue virus
CSAVPPHWVP

SEQ ID NO: 43123 - protein, 10 aa, Dengue virus
SAVPPHWVPT

SEQ ID NO: 43124 - protein, 10 aa, Dengue virus
AVPPHWVPTS

SEQ ID NO: 43125 - protein, 10 aa, Dengue virus
VPPHWVPTSR

SEQ ID NO: 43126 - protein, 10 aa, Dengue virus
PPHWVPTSRT

SEQ ID NO: 43127 - protein, 10 aa, Dengue virus
PHWVPTSRTT

SEQ ID NO: 43128 - protein, 10 aa, Dengue virus
SRTTWSIHAT

SEQ ID NO: 43129 - protein, 10 aa, Dengue virus
RTTWSIHATH

SEQ ID NO: 43130 - protein, 10 aa, Dengue virus
TTWSIHATHE

SEQ ID NO: 43131 - protein, 10 aa, Dengue virus
TWSIHATHEW

SEQ ID NO: 43132 - protein, 10 aa, Dengue virus
WSIHATHEWM

SEQ ID NO: 43133 - protein, 10 aa, Dengue virus
SIHATHEWMT

SEQ ID NO: 43134 - protein, 10 aa, Dengue virus
IHATHEWMTT

SEQ ID NO: 43135 - protein, 10 aa, Dengue virus
HATHEWMTTE

SEQ ID NO: 43136 - protein, 10 aa, Dengue virus
ATHEWMTTED

SEQ ID NO: 43137 - protein, 10 aa, Dengue virus
THEWMTTEDM

SEQ ID NO: 43138 - protein, 10 aa, Dengue virus
EWMTTEDMLT

SEQ ID NO: 43139 - protein, 10 aa, Dengue virus
WMTTEDMLTV

SEQ ID NO: 43140 - protein, 10 aa, Dengue virus
MTTEDMLTVW

SEQ ID NO: 43141 - protein, 10 aa, Dengue virus
TTEDMLTVWN

SEQ ID NO: 43142 - protein, 10 aa, Dengue virus
TEDMLTVWNR

SEQ ID NO: 43143 - protein, 10 aa, Dengue virus
EDMLTVWNRV

SEQ ID NO: 43144 - protein, 10 aa, Dengue virus
DMLTVWNRVW

SEQ ID NO: 43145 - protein, 10 aa, Dengue virus
MLTVWNRVWI

SEQ ID NO: 43146 - protein, 10 aa, Dengue virus
LTVWNRVWIQ

SEQ ID NO: 43147 - protein, 10 aa, Dengue virus
VWNRVWIREN

SEQ ID NO: 43148 - protein, 10 aa, Dengue virus
WNRVWIRENP

SEQ ID NO: 43149 - protein, 10 aa, Dengue virus
NRVWIRENPW

SEQ ID NO: 43150 - protein, 10 aa, Dengue virus
VWIRENPWME

SEQ ID NO: 43151 - protein, 10 aa, Dengue virus
WIRENPWMED

SEQ ID NO: 43152 - protein, 10 aa, Dengue virus
IRENPWMEDK

SEQ ID NO: 43153 - protein, 10 aa, Dengue virus
RENPWMEDKT

SEQ ID NO: 43154 - protein, 10 aa, Dengue virus
ENPWIEDKTP

SEQ ID NO: 43155 - protein, 10 aa, Dengue virus
NPWIEDKTPV

SEQ ID NO: 43156 - protein, 10 aa, Dengue virus
PWIEDKTPVE

SEQ ID NO: 43157 - protein, 10 aa, Dengue virus
WIEDKTPVES

SEQ ID NO: 43158 - protein, 10 aa, Dengue virus
IEDKTPVESW

SEQ ID NO: 43159 - protein, 10 aa, Dengue virus
EDKTPVETWE

SEQ ID NO: 43160 - protein, 10 aa, Dengue virus
DKTPVESWED

SEQ ID NO: 43161 - protein, 10 aa, Dengue virus
KTPVESWEEI

SEQ ID NO: 43162 - protein, 10 aa, Dengue virus
TPVESWEEIP

SEQ ID NO: 43163 - protein, 10 aa, Dengue virus
PVESWEEIPY

SEQ ID NO: 43164 - protein, 10 aa, Dengue virus
VESWEEIPYL

SEQ ID NO: 43165 - protein, 10 aa, Dengue virus
ESWEEIPYLG

SEQ ID NO: 43166 - protein, 10 aa, Dengue virus
SWEEIPYLGK

SEQ ID NO: 43167 - protein, 10 aa, Dengue virus
WEEIPYLGKR

SEQ ID NO: 43168 - protein, 10 aa, Dengue virus
EEIPYLGKRE

SEQ ID NO: 43169 - protein, 10 aa, Dengue virus
EIPYLGKRED

SEQ ID NO: 43170 - protein, 10 aa, Dengue virus
IPYLGKREDQ

SEQ ID NO: 43171 - protein, 10 aa, Dengue virus
RATWAKNIQA

SEQ ID NO: 43172 - protein, 10 aa, Dengue virus
ATWAKNIQAA

SEQ ID NO: 43173 - protein, 10 aa, Dengue virus
TWAKNIQAAI

SEQ ID NO: 43174 - protein, 10 aa, Dengue virus
WAKNIQAAIN

SEQ ID NO: 43175 - protein, 10 aa, Dengue virus
AKNIQAAINQ

SEQ ID NO: 43176 - protein, 10 aa, Dengue virus
KNIQAAINQV

SEQ ID NO: 43177 - protein, 10 aa, Dengue virus
NIQAAINQVR

SEQ ID NO: 43178 - protein, 10 aa, Dengue virus
IQAAINQVRS

SEQ ID NO: 43179 - protein, 10 aa, Dengue virus
QAAINQVRSL

SEQ ID NO: 43180 - protein, 10 aa, Dengue virus
AAINQVRSLI

SEQ ID NO: 43181 - protein, 10 aa, Dengue virus
AINQVRALIG

SEQ ID NO: 43182 - protein, 10 aa, Dengue virus
INQVRALIGE

SEQ ID NO: 43183 - protein, 10 aa, Dengue virus
NQVRALIGEE

SEQ ID NO: 43184 - protein, 10 aa, Dengue virus
QVRALIGEEE

SEQ ID NO: 43185 - protein, 10 aa, Dengue virus
VRALIGEEEY

SEQ ID NO: 43186 - protein, 10 aa, Dengue virus
EGYTDYMPSM

SEQ ID NO: 43187 - protein, 10 aa, Dengue virus
GYTDYMPSMK

SEQ ID NO: 43188 - protein, 10 aa, Dengue virus
YIDYMPSMKR

SEQ ID NO: 43189 - protein, 10 aa, Dengue virus
IDYMPSMKRF

SEQ ID NO: 43190 - protein, 10 aa, Dengue virus
YMPSMKRFRK

SEQ ID NO: 43191 - protein, 10 aa, Dengue virus
MPSMKRFRKE

SEQ ID NO: 43192 - protein, 10 aa, Dengue virus
PSMKRFRKEE

SEQ ID NO: 43193 - protein, 10 aa, Dengue virus
SMKRFRKEEE

SEQ ID NO: 43194 - protein, 10 aa, Dengue virus
MKRFRKEEEE

SEQ ID NO: 43195 - protein, 10 aa, Dengue virus
KRFRKEEEEA

SEQ ID NO: 43196 - protein, 10 aa, Dengue virus
RFRKEEEEAG

SEQ ID NO: 43197 - protein, 10 aa, Dengue virus
FRKEEEEAGV

SEQ ID NO: 43198 - protein, 10 aa, Dengue virus
RKEEEEAGVL

SEQ ID NO: 43199 - protein, 10 aa, Dengue virus
KEEEEAGVLW

SEQ ID NO: 43200 - protein, 10 aa, Dengue virus
MNNQRKKARN

SEQ ID NO: 43201 - protein, 10 aa, Dengue virus
TTPFNMLKRE

SEQ ID NO: 43202 - protein, 10 aa, Dengue virus
RGPLRLFMAL

SEQ ID NO: 43203 - protein, 10 aa, Dengue virus
PLRLFMALVA

SEQ ID NO: 43204 - protein, 10 aa, Dengue virus
LRLFMALVAF

SEQ ID NO: 43205 - protein, 10 aa, Dengue virus
RLFMALVAFL

SEQ ID NO: 43206 - protein, 10 aa, Dengue virus
TTGILKRWGT

SEQ ID NO: 43207 - protein, 10 aa, Dengue virus
VGILKRWGTI

SEQ ID NO: 43208 - protein, 10 aa, Dengue virus
KRWGTIKKSR

SEQ ID NO: 43209 - protein, 10 aa, Dengue virus
RWGTIKKSRA

SEQ ID NO: 43210 - protein, 10 aa, Dengue virus
WGAIKKSKAI

SEQ ID NO: 43211 - protein, 10 aa, Dengue virus
GTIKKSKAIS

SEQ ID NO: 43212 - protein, 10 aa, Dengue virus
TIKKSKAISV

SEQ ID NO: 43213 - protein, 10 aa, Dengue virus
IKKSKAISVL

SEQ ID NO: 43214 - protein, 10 aa, Dengue virus
KKSKAINILR

SEQ ID NO: 43215 - protein, 10 aa, Dengue virus
KSKAINILRG

SEQ ID NO: 43216 - protein, 10 aa, Dengue virus
SRAINVLRGF

SEQ ID NO: 43217 - protein, 10 aa, Dengue virus
RAINVLRGFR

SEQ ID NO: 43218 - protein, 10 aa, Dengue virus
AINVLRGFRR

SEQ ID NO: 43219 - protein, 10 aa, Dengue virus
INVLRGFRRE

SEQ ID NO: 43220 - protein, 10 aa, Dengue virus
NVLRGFRREI

SEQ ID NO: 43221 - protein, 10 aa, Dengue virus
LNILNKRRRT

SEQ ID NO: 43222 - protein, 10 aa, Dengue virus
NILNKRRRTA

SEQ ID NO: 43223 - protein, 10 aa, Dengue virus
ILNKRRRTAG

SEQ ID NO: 43224 - protein, 10 aa, Dengue virus
IPTVVAFHLT

SEQ ID NO: 43225 - protein, 10 aa, Dengue virus
PTVVAFHLTT

SEQ ID NO: 43226 - protein, 10 aa, Dengue virus
TVVAFHLTTR

SEQ ID NO: 43227 - protein, 10 aa, Dengue virus
VVAFHLTTRN

SEQ ID NO: 43228 - protein, 10 aa, Dengue virus
IAFHLTTRNG

SEQ ID NO: 43229 - protein, 10 aa, Dengue virus
NGEPHMIVSR

SEQ ID NO: 43230 - protein, 10 aa, Dengue virus
GEPHMIVSRQ

SEQ ID NO: 43231 - protein, 10 aa, Dengue virus
EPHMIVSRQE

SEQ ID NO: 43232 - protein, 10 aa, Dengue virus
PHMIVSRQEK

SEQ ID NO: 43233 - protein, 10 aa, Dengue virus
HMIVSRQEKG

SEQ ID NO: 43234 - protein, 10 aa, Dengue virus
MIVSRQEKGK

SEQ ID NO: 43235 - protein, 10 aa, Dengue virus
IVSRQEKGKS

SEQ ID NO: 43236 - protein, 10 aa, Dengue virus
VSRQEKGKSL

SEQ ID NO: 43237 - protein, 10 aa, Dengue virus
SRQEKGKSLL

SEQ ID NO: 43238 - protein, 10 aa, Dengue virus
KNEKGKSLLF

SEQ ID NO: 43239 - protein, 10 aa, Dengue virus
GKSLLFKTKD

SEQ ID NO: 43240 - protein, 10 aa, Dengue virus
KSLLFKTKDG

SEQ ID NO: 43241 - protein, 10 aa, Dengue virus
DGTNMCTLMA

SEQ ID NO: 43242 - protein, 10 aa, Dengue virus
GTNMCTLMAM

SEQ ID NO: 43243 - protein, 10 aa, Dengue virus
TNMCTLMAMD

SEQ ID NO: 43244 - protein, 10 aa, Dengue virus
ELCEDTVTYK

SEQ ID NO: 43245 - protein, 10 aa, Dengue virus
LCEDTVTYKC

SEQ ID NO: 43246 - protein, 10 aa, Dengue virus
CEDTVTYKCP

SEQ ID NO: 43247 - protein, 10 aa, Dengue virus
EDTITYKCPF

SEQ ID NO: 43248 - protein, 10 aa, Dengue virus
DTITYKCPFL

SEQ ID NO: 43249 - protein, 10 aa, Dengue virus
TYKCPFLKQN

SEQ ID NO: 43250 - protein, 10 aa, Dengue virus
YKCPFLKQNE

SEQ ID NO: 43251 - protein, 10 aa, Dengue virus
KCPFLKQNEP

SEQ ID NO: 43252 - protein, 10 aa, Dengue virus
CPLLKQNEPE

SEQ ID NO: 43253 - protein, 10 aa, Dengue virus
PLLKQNEPED

SEQ ID NO: 43254 - protein, 10 aa, Dengue virus
LLKQNEPEDI

SEQ ID NO: 43255 - protein, 10 aa, Dengue virus
STWVTYGTCA

SEQ ID NO: 43256 - protein, 10 aa, Dengue virus
TMGEHRREKR

SEQ ID NO: 43257 - protein, 10 aa, Dengue virus
MSSEGAWKQA

SEQ ID NO: 43258 - protein, 10 aa, Dengue virus
SSEGAWKQAQ

SEQ ID NO: 43259 - protein, 10 aa, Dengue virus
SEGAWKQAQR

SEQ ID NO: 43260 - protein, 10 aa, Dengue virus
EGAWKQAQRI

SEQ ID NO: 43261 - protein, 10 aa, Dengue virus
GAWKQAQRIE

SEQ ID NO: 43262 - protein, 10 aa, Dengue virus
AWKQAQRIET

SEQ ID NO: 43263 - protein, 10 aa, Dengue virus
WKQAQRIETW

SEQ ID NO: 43264 - protein, 10 aa, Dengue virus
KHAQRIETWV

SEQ ID NO: 43265 - protein, 10 aa, Dengue virus
HAQRIETWVL

SEQ ID NO: 43266 - protein, 10 aa, Dengue virus
AQRIETWVLR

SEQ ID NO: 43267 - protein, 10 aa, Dengue virus
TWILRHPGFA

SEQ ID NO: 43268 - protein, 10 aa, Dengue virus
LRHPGFTLMA

SEQ ID NO: 43269 - protein, 10 aa, Dengue virus
RHPGFTLMAA

SEQ ID NO: 43270 - protein, 10 aa, Dengue virus
MAAVLAYTIG

SEQ ID NO: 43271 - protein, 10 aa, Dengue virus
AAVLAYTIGT

SEQ ID NO: 43272 - protein, 10 aa, Dengue virus
AVLAYTIGTT

SEQ ID NO: 43273 - protein, 10 aa, Dengue virus
ILAYTVGTTH

SEQ ID NO: 43274 - protein, 10 aa, Dengue virus
LAYTVGTTHF

SEQ ID NO: 43275 - protein, 10 aa, Dengue virus
AYTVGTTHFQ

SEQ ID NO: 43276 - protein, 10 aa, Dengue virus
YTVGTTHFQR

SEQ ID NO: 43277 - protein, 10 aa, Dengue virus
GTTYFQRVLI

SEQ ID NO: 43278 - protein, 10 aa, Dengue virus
TTYFQRVLIF

SEQ ID NO: 43279 - protein, 10 aa, Dengue virus
TYFQRVLIFI

SEQ ID NO: 43280 - protein, 10 aa, Dengue virus
YFQRVLIFIL

SEQ ID NO: 43281 - protein, 10 aa, Dengue virus
FQRTLIFILL

SEQ ID NO: 43282 - protein, 10 aa, Dengue virus
QRALIFILLA

SEQ ID NO: 43283 - protein, 10 aa, Dengue virus
LIFILLTAIA

SEQ ID NO: 43284 - protein, 10 aa, Dengue virus
IFILLTAIAP

SEQ ID NO: 43285 - protein, 10 aa, Dengue virus
FILLTAIAPS

SEQ ID NO: 43286 - protein, 10 aa, Dengue virus
ILLTAIAPSM

SEQ ID NO: 43287 - protein, 10 aa, Dengue virus
LLTAIAPSMT

SEQ ID NO: 43288 - protein, 10 aa, Dengue virus
LTAVTPSMTM

SEQ ID NO: 43289 - protein, 10 aa, Dengue virus
TAVTPSMTMR

SEQ ID NO: 43290 - protein, 10 aa, Dengue virus
AIAPSMTMRC

SEQ ID NO: 43291 - protein, 10 aa, Dengue virus
IAPSMTMRCI

SEQ ID NO: 43292 - protein, 10 aa, Dengue virus
PSMAMRCIGI

SEQ ID NO: 43293 - protein, 10 aa, Dengue virus
SMAMRCIGIS

SEQ ID NO: 43294 - protein, 10 aa, Dengue virus
MAMRCIGISN

SEQ ID NO: 43295 - protein, 10 aa, Dengue virus
AMRCIGISNR

SEQ ID NO: 43296 - protein, 10 aa, Dengue virus
FELTKTEAKH

SEQ ID NO: 43297 - protein, 10 aa, Dengue virus
KTEAKEPATL

SEQ ID NO: 43298 - protein, 10 aa, Dengue virus
TEAKEPATLR

SEQ ID NO: 43299 - protein, 10 aa, Dengue virus
EAKEPATLRK

SEQ ID NO: 43300 - protein, 10 aa, Dengue virus
AKQPATLRKF

SEQ ID NO: 43301 - protein, 10 aa, Dengue virus
KQPATLRKFC

SEQ ID NO: 43302 - protein, 10 aa, Dengue virus
PATLRKYCVE

SEQ ID NO: 43303 - protein, 10 aa, Dengue virus
ATLRKYCVEA

SEQ ID NO: 43304 - protein, 10 aa, Dengue virus
TLRKYCVEAK

SEQ ID NO: 43305 - protein, 10 aa, Dengue virus
LRKYCVEAKL

SEQ ID NO: 43306 - protein, 10 aa, Dengue virus
RKYCVEAKLT

SEQ ID NO: 43307 - protein, 10 aa, Dengue virus
KYCVEAKLTN

SEQ ID NO: 43308 - protein, 10 aa, Dengue virus
YCVEAKLTNT

SEQ ID NO: 43309 - protein, 10 aa, Dengue virus
CIEARLTNTT

SEQ ID NO: 43310 - protein, 10 aa, Dengue virus
IEARLTNTTT

SEQ ID NO: 43311 - protein, 10 aa, Dengue virus
EAKLTNTTTD

SEQ ID NO: 43312 - protein, 10 aa, Dengue virus
AKLTNTTTDS

SEQ ID NO: 43313 - protein, 10 aa, Dengue virus
KLTNTTTDSR

SEQ ID NO: 43314 - protein, 10 aa, Dengue virus
LTNTTTDSRC

SEQ ID NO: 43315 - protein, 10 aa, Dengue virus
TNTTTDSRCP

SEQ ID NO: 43316 - protein, 10 aa, Dengue virus
NTTTDSRCPT

SEQ ID NO: 43317 - protein, 10 aa, Dengue virus
TTTDSRCPTQ

SEQ ID NO: 43318 - protein, 10 aa, Dengue virus
TTDSRCPTQG

SEQ ID NO: 43319 - protein, 10 aa, Dengue virus
TDSRCPTQGE

SEQ ID NO: 43320 - protein, 10 aa, Dengue virus
DSRCPTQGEP

SEQ ID NO: 43321 - protein, 10 aa, Dengue virus
CPTQGEPTLN

SEQ ID NO: 43322 - protein, 10 aa, Dengue virus
PTQGEPTLNE

SEQ ID NO: 43323 - protein, 10 aa, Dengue virus
TQGEPTLNEE

SEQ ID NO: 43324 - protein, 10 aa, Dengue virus
QGEPTLNEEQ

SEQ ID NO: 43325 - protein, 10 aa, Dengue virus
GEPTLNEEQD

SEQ ID NO: 43326 - protein, 10 aa, Dengue virus
EPTLNEEQDK

SEQ ID NO: 43327 - protein, 10 aa, Dengue virus
PTLNEEQDKR

SEQ ID NO: 43328 - protein, 10 aa, Dengue virus
TLNEEQDKRF

SEQ ID NO: 43329 - protein, 10 aa, Dengue virus
EEQDKRFVCR

SEQ ID NO: 43330 - protein, 10 aa, Dengue virus
EQDKRFVCRH

SEQ ID NO: 43331 - protein, 10 aa, Dengue virus
QDKRFVCRHS

SEQ ID NO: 43332 - protein, 10 aa, Dengue virus
DKRFVCRHSM

SEQ ID NO: 43333 - protein, 10 aa, Dengue virus
KRFVCRHSMV

SEQ ID NO: 43334 - protein, 10 aa, Dengue virus
RFVCRHSMVD

SEQ ID NO: 43335 - protein, 10 aa, Dengue virus
FVCRHSMVDR

SEQ ID NO: 43336 - protein, 10 aa, Dengue virus
VCRHSMVDRG

SEQ ID NO: 43337 - protein, 10 aa, Dengue virus
GGIVTCAMFS

SEQ ID NO: 43338 - protein, 10 aa, Dengue virus
GIVTCAMFSC

SEQ ID NO: 43339 - protein, 10 aa, Dengue virus
IVTCAMFTCL

SEQ ID NO: 43340 - protein, 10 aa, Dengue virus
VTCAMFRCKK

SEQ ID NO: 43341 - protein, 10 aa, Dengue virus
TCAMFTCLKK

SEQ ID NO: 43342 - protein, 10 aa, Dengue virus
CAMFTCLKKM

SEQ ID NO: 43343 - protein, 10 aa, Dengue virus
AMFTCLKKME

SEQ ID NO: 43344 - protein, 10 aa, Dengue virus
MFTCKKNMKG

SEQ ID NO: 43345 - protein, 10 aa, Dengue virus
FTCKKNMKGK

SEQ ID NO: 43346 - protein, 10 aa, Dengue virus
CKKNMKGKVV

SEQ ID NO: 43347 - protein, 10 aa, Dengue virus
KKNMEGKVVL

SEQ ID NO: 43348 - protein, 10 aa, Dengue virus
KNMEGKVVLP

SEQ ID NO: 43349 - protein, 10 aa, Dengue virus
NMEGKVVLPE

SEQ ID NO: 43350 - protein, 10 aa, Dengue virus
MEGKVVLPEN

SEQ ID NO: 43351 - protein, 10 aa, Dengue virus
EGKVVLPENL

SEQ ID NO: 43352 - protein, 10 aa, Dengue virus
GKVVLPENLE

SEQ ID NO: 43353 - protein, 10 aa, Dengue virus
KVVLPENLEY

SEQ ID NO: 43354 - protein, 10 aa, Dengue virus
VVLPENLEYT

SEQ ID NO: 43355 - protein, 10 aa, Dengue virus
VQPENLEYTV

SEQ ID NO: 43356 - protein, 10 aa, Dengue virus
QPENLEYTVV

SEQ ID NO: 43357 - protein, 10 aa, Dengue virus
PENLEYTVVI

SEQ ID NO: 43358 - protein, 10 aa, Dengue virus
ENLEYTVVIT

SEQ ID NO: 43359 - protein, 10 aa, Dengue virus
NLEYTVVITP

SEQ ID NO: 43360 - protein, 10 aa, Dengue virus
LEYTVVITPH

SEQ ID NO: 43361 - protein, 10 aa, Dengue virus
EYTVVITPHS

SEQ ID NO: 43362 - protein, 10 aa, Dengue virus
YTVVITPHSG

SEQ ID NO: 43363 - protein, 10 aa, Dengue virus
TVVITPHSGE

SEQ ID NO: 43364 - protein, 10 aa, Dengue virus
VVITPHSGEE

SEQ ID NO: 43365 - protein, 10 aa, Dengue virus
VITPHSGEEN

SEQ ID NO: 43366 - protein, 10 aa, Dengue virus
ITPHSGEENA

SEQ ID NO: 43367 - protein, 10 aa, Dengue virus
HSGEEHAVGD

SEQ ID NO: 43368 - protein, 10 aa, Dengue virus
SGEEHAVGDD

SEQ ID NO: 43369 - protein, 10 aa, Dengue virus
GEEHAVGDDT

SEQ ID NO: 43370 - protein, 10 aa, Dengue virus
EEHAVGDDTG

SEQ ID NO: 43371 - protein, 10 aa, Dengue virus
EHAVGDDTGK

SEQ ID NO: 43372 - protein, 10 aa, Dengue virus
HAVGDDTGKH

SEQ ID NO: 43373 - protein, 10 aa, Dengue virus
VGNDTGKHGM

SEQ ID NO: 43374 - protein, 10 aa, Dengue virus
GNDTGKHGME

SEQ ID NO: 43375 - protein, 10 aa, Dengue virus
NDTGKHGKEV

SEQ ID NO: 43376 - protein, 10 aa, Dengue virus
DTGKHGKEVK

SEQ ID NO: 43377 - protein, 10 aa, Dengue virus
TGKHGQEIKV

SEQ ID NO: 43378 - protein, 10 aa, Dengue virus
GKHGQEIKVT

SEQ ID NO: 43379 - protein, 10 aa, Dengue virus
KHGQEIKVTP

SEQ ID NO: 43380 - protein, 10 aa, Dengue virus
HGQEIKVTPQ

SEQ ID NO: 43381 - protein, 10 aa, Dengue virus
GQEIKVTPQS

SEQ ID NO: 43382 - protein, 10 aa, Dengue virus
AEAELTGYGT

SEQ ID NO: 43383 - protein, 10 aa, Dengue virus
EAELTGYGTI

SEQ ID NO: 43384 - protein, 10 aa, Dengue virus
AELTGYGTIT

SEQ ID NO: 43385 - protein, 10 aa, Dengue virus
LTGYGTITME

SEQ ID NO: 43386 - protein, 10 aa, Dengue virus
TGYGTITMEC

SEQ ID NO: 43387 - protein, 10 aa, Dengue virus
GYGTITMECS

SEQ ID NO: 43388 - protein, 10 aa, Dengue virus
VTMECSPRTS

SEQ ID NO: 43389 - protein, 10 aa, Dengue virus
PRTGFDFNEM

SEQ ID NO: 43390 - protein, 10 aa, Dengue virus
FNEMVLLQMG

SEQ ID NO: 43391 - protein, 10 aa, Dengue virus
MEEKAWLVHR

SEQ ID NO: 43392 - protein, 10 aa, Dengue virus
EEKAWLVHRQ

SEQ ID NO: 43393 - protein, 10 aa, Dengue virus
EKAWLVHRQW

SEQ ID NO: 43394 - protein, 10 aa, Dengue virus
PLPWLPGADI

SEQ ID NO: 43395 - protein, 10 aa, Dengue virus
LPWLPGADIQ

SEQ ID NO: 43396 - protein, 10 aa, Dengue virus
PWLPGADKQG

SEQ ID NO: 43397 - protein, 10 aa, Dengue virus
WLPGADKQGS

SEQ ID NO: 43398 - protein, 10 aa, Dengue virus
LPGADKQGSN

SEQ ID NO: 43399 - protein, 10 aa, Dengue virus
PGADKQGSNW

SEQ ID NO: 43400 - protein, 10 aa, Dengue virus
GADKQGSNWI

SEQ ID NO: 43401 - protein, 10 aa, Dengue virus
ADKQGSNWIQ

SEQ ID NO: 43402 - protein, 10 aa, Dengue virus
DKQGSNWIQK

SEQ ID NO: 43403 - protein, 10 aa, Dengue virus
KQGSNWIQKE

SEQ ID NO: 43404 - protein, 10 aa, Dengue virus
QGSNWIQKEM

SEQ ID NO: 43405 - protein, 10 aa, Dengue virus
GSNWIQKEML

SEQ ID NO: 43406 - protein, 10 aa, Dengue virus
TEIQMSSGNI

SEQ ID NO: 43407 - protein, 10 aa, Dengue virus
EIQMSSGNIL

SEQ ID NO: 43408 - protein, 10 aa, Dengue virus
IQMSSGNILF

SEQ ID NO: 43409 - protein, 10 aa, Dengue virus
QMSSGNILFM

SEQ ID NO: 43410 - protein, 10 aa, Dengue virus
MSSGNILFMG

SEQ ID NO: 43411 - protein, 10 aa, Dengue virus
TQHGTIVVRV

SEQ ID NO: 43412 - protein, 10 aa, Dengue virus
QHGTIVVRVQ

SEQ ID NO: 43413 - protein, 10 aa, Dengue virus
HGTIVVRVQY

SEQ ID NO: 43414 - protein, 10 aa, Dengue virus
GTIVVRVQYE

SEQ ID NO: 43415 - protein, 10 aa, Dengue virus
TIVVRVQYEG

SEQ ID NO: 43416 - protein, 10 aa, Dengue virus
IVVRVQYEGD

SEQ ID NO: 43417 - protein, 10 aa, Dengue virus
VIRIQYEGDG

SEQ ID NO: 43418 - protein, 10 aa, Dengue virus
IRIQYEGDGS

SEQ ID NO: 43419 - protein, 10 aa, Dengue virus
RIQYEGDGSP

SEQ ID NO: 43420 - protein, 10 aa, Dengue virus
IQYEGDGSPC

SEQ ID NO: 43421 - protein, 10 aa, Dengue virus
QYEGDGSPCR

SEQ ID NO: 43422 - protein, 10 aa, Dengue virus
YEGDGSPCRI

SEQ ID NO: 43423 - protein, 10 aa, Dengue virus
EGDGSPCRIP

SEQ ID NO: 43424 - protein, 10 aa, Dengue virus
GDGSPCRIPF

SEQ ID NO: 43425 - protein, 10 aa, Dengue virus
DGSPCRIPFE

SEQ ID NO: 43426 - protein, 10 aa, Dengue virus
GSPCRIPFEI

SEQ ID NO: 43427 - protein, 10 aa, Dengue virus
SPCRIPFEIM

SEQ ID NO: 43428 - protein, 10 aa, Dengue virus
PCRIPFEIMD

SEQ ID NO: 43429 - protein, 10 aa, Dengue virus
CRIPFEIMDL

SEQ ID NO: 43430 - protein, 10 aa, Dengue virus
RIPFEIMDLE

SEQ ID NO: 43431 - protein, 10 aa, Dengue virus
VPFEIMDLEK

SEQ ID NO: 43432 - protein, 10 aa, Dengue virus
PFEIMDLEKK

SEQ ID NO: 43433 - protein, 10 aa, Dengue virus
FEITDLEKRH

SEQ ID NO: 43434 - protein, 10 aa, Dengue virus
DLEKKHVLGR

SEQ ID NO: 43435 - protein, 10 aa, Dengue virus
LEKKHVLGRL

SEQ ID NO: 43436 - protein, 10 aa, Dengue virus
EKKHVLGRLI

SEQ ID NO: 43437 - protein, 10 aa, Dengue virus
KKHVLGRLIT

SEQ ID NO: 43438 - protein, 10 aa, Dengue virus
KHVLGRLITV

SEQ ID NO: 43439 - protein, 10 aa, Dengue virus
YILGRLITVN

SEQ ID NO: 43440 - protein, 10 aa, Dengue virus
GRLITVNPIA

SEQ ID NO: 43441 - protein, 10 aa, Dengue virus
RLITVNPIVA

SEQ ID NO: 43442 - protein, 10 aa, Dengue virus
GKDSPVNIEA

SEQ ID NO: 43443 - protein, 10 aa, Dengue virus
KDNPINIEAE

SEQ ID NO: 43444 - protein, 10 aa, Dengue virus
DNPINIEAEP

SEQ ID NO: 43445 - protein, 10 aa, Dengue virus
NPINIEAEPP

SEQ ID NO: 43446 - protein, 10 aa, Dengue virus
PPFGDSYIVI

SEQ ID NO: 43447 - protein, 10 aa, Dengue virus
PFGDSYIVIG

SEQ ID NO: 43448 - protein, 10 aa, Dengue virus
FGDSYIVIGV

SEQ ID NO: 43449 - protein, 10 aa, Dengue virus
GDSYIVIGVE

SEQ ID NO: 43450 - protein, 10 aa, Dengue virus
DSYIVIGVEP

SEQ ID NO: 43451 - protein, 10 aa, Dengue virus
SYIVIGVEPG

SEQ ID NO: 43452 - protein, 10 aa, Dengue virus
YIVIGVEPGQ

SEQ ID NO: 43453 - protein, 10 aa, Dengue virus
IVIGVEPGQL

SEQ ID NO: 43454 - protein, 10 aa, Dengue virus
VIGVEPGQLK

SEQ ID NO: 43455 - protein, 10 aa, Dengue virus
GVEPGQLKLD

SEQ ID NO: 43456 - protein, 10 aa, Dengue virus
VEPGQLKLDW

SEQ ID NO: 43457 - protein, 10 aa, Dengue virus
EPGQLKLDWF

SEQ ID NO: 43458 - protein, 10 aa, Dengue virus
PGQLKLDWFK

SEQ ID NO: 43459 - protein, 10 aa, Dengue virus
GQLKLDWFKK

SEQ ID NO: 43460 - protein, 10 aa, Dengue virus
QLKLDWFKKG

SEQ ID NO: 43461 - protein, 10 aa, Dengue virus
LKLDWFKKGS

SEQ ID NO: 43462 - protein, 10 aa, Dengue virus
KLDWFKKGSS

SEQ ID NO: 43463 - protein, 10 aa, Dengue virus
LDWFKKGSSI

SEQ ID NO: 43464 - protein, 10 aa, Dengue virus
DWFKKGSSIG

SEQ ID NO: 43465 - protein, 10 aa, Dengue virus
SIGQMFATTM

SEQ ID NO: 43466 - protein, 10 aa, Dengue virus
IGQMFATTMR

SEQ ID NO: 43467 - protein, 10 aa, Dengue virus
GQMFATTMRG

SEQ ID NO: 43468 - protein, 10 aa, Dengue virus
QMFATTMRGA

SEQ ID NO: 43469 - protein, 10 aa, Dengue virus
AWDFGSLGGA

SEQ ID NO: 43470 - protein, 10 aa, Dengue virus
WDFGSLGGAF

SEQ ID NO: 43471 - protein, 10 aa, Dengue virus
DFGSLGGAFT

SEQ ID NO: 43472 - protein, 10 aa, Dengue virus
FGSLGGAFTS

SEQ ID NO: 43473 - protein, 10 aa, Dengue virus
GSLGGVFTSV

SEQ ID NO: 43474 - protein, 10 aa, Dengue virus
SLGGVFTSVG

SEQ ID NO: 43475 - protein, 10 aa, Dengue virus
LGGVFTSVGK

SEQ ID NO: 43476 - protein, 10 aa, Dengue virus
GGAFTSIGKA

SEQ ID NO: 43477 - protein, 10 aa, Dengue virus
GAFTSIGKAL

SEQ ID NO: 43478 - protein, 10 aa, Dengue virus
AFTSIGKALH

SEQ ID NO: 43479 - protein, 10 aa, Dengue virus
GVAFSGVSWT

SEQ ID NO: 43480 - protein, 10 aa, Dengue virus
VAFSGVSWTM

SEQ ID NO: 43481 - protein, 10 aa, Dengue virus
AFNGVSWTMK

SEQ ID NO: 43482 - protein, 10 aa, Dengue virus
SGVSWTMKIF

SEQ ID NO: 43483 - protein, 10 aa, Dengue virus
GVSWTMKIFI

SEQ ID NO: 43484 - protein, 10 aa, Dengue virus
VSWTMKIFIG

SEQ ID NO: 43485 - protein, 10 aa, Dengue virus
SWIMKILIGV

SEQ ID NO: 43486 - protein, 10 aa, Dengue virus
WTMKILIGAI

SEQ ID NO: 43487 - protein, 10 aa, Dengue virus
TMKILIGAII

SEQ ID NO: 43488 - protein, 10 aa, Dengue virus
MKILIGAIIT

SEQ ID NO: 43489 - protein, 10 aa, Dengue virus
KILIGAIITW

SEQ ID NO: 43490 - protein, 10 aa, Dengue virus
ILIGAIITWI

SEQ ID NO: 43491 - protein, 10 aa, Dengue virus
LIGAIITWIG

SEQ ID NO: 43492 - protein, 10 aa, Dengue virus
IGAIITWIGM

SEQ ID NO: 43493 - protein, 10 aa, Dengue virus
GAIITWIGMN

SEQ ID NO: 43494 - protein, 10 aa, Dengue virus
AIITWIGMNS

SEQ ID NO: 43495 - protein, 10 aa, Dengue virus
STSLSVSLIL

SEQ ID NO: 43496 - protein, 10 aa, Dengue virus
LSVTLVLVGI

SEQ ID NO: 43497 - protein, 10 aa, Dengue virus
SVSLVLVGVI

SEQ ID NO: 43498 - protein, 10 aa, Dengue virus
LVLVGVITLY

SEQ ID NO: 43499 - protein, 10 aa, Dengue virus
VLVGVITLYL

SEQ ID NO: 43500 - protein, 10 aa, Dengue virus
LVGVITLYLG

SEQ ID NO: 43501 - protein, 10 aa, Dengue virus
VGVVTLYLGV

SEQ ID NO: 43502 - protein, 10 aa, Dengue virus
VTLYLGAVVQ

SEQ ID NO: 43503 - protein, 10 aa, Dengue virus
TLYLGAVVQA

SEQ ID NO: 43504 - protein, 10 aa, Dengue virus
LYLGAVVQAD

SEQ ID NO: 43505 - protein, 10 aa, Dengue virus
YLGAVVQADS

SEQ ID NO: 43506 - protein, 10 aa, Dengue virus
LGAVVQADSG

SEQ ID NO: 43507 - protein, 10 aa, Dengue virus
GAVVQADSGC

SEQ ID NO: 43508 - protein, 10 aa, Dengue virus
AVVQADSGCV

SEQ ID NO: 43509 - protein, 10 aa, Dengue virus
MVQADTGCVV

SEQ ID NO: 43510 - protein, 10 aa, Dengue virus
VQADSGCIVS

SEQ ID NO: 43511 - protein, 10 aa, Dengue virus
QADSGCIVSW

SEQ ID NO: 43512 - protein, 10 aa, Dengue virus
ADSGCIVSWK

SEQ ID NO: 43513 - protein, 10 aa, Dengue virus
DSGCVVSWKS

SEQ ID NO: 43514 - protein, 10 aa, Dengue virus
SGCVVSWKSK

SEQ ID NO: 43515 - protein, 10 aa, Dengue virus
GCIVSWKNKE

SEQ ID NO: 43516 - protein, 10 aa, Dengue virus
CVVSWKSKEL

SEQ ID NO: 43517 - protein, 10 aa, Dengue virus
VVSWKSKELK

SEQ ID NO: 43518 - protein, 10 aa, Dengue virus
ASAIQKAHED

SEQ ID NO: 43519 - protein, 10 aa, Dengue virus
SAIQKAHEED

SEQ ID NO: 43520 - protein, 10 aa, Dengue virus
AIQKAHEEDI

SEQ ID NO: 43521 - protein, 10 aa, Dengue virus
IQKAHEEDIC

SEQ ID NO: 43522 - protein, 10 aa, Dengue virus
QKAHEEDICG

SEQ ID NO: 43523 - protein, 10 aa, Dengue virus
KAHEEDICGI

SEQ ID NO: 43524 - protein, 10 aa, Dengue virus
AHEEDICGIR

SEQ ID NO: 43525 - protein, 10 aa, Dengue virus
HEEDICGIRS

SEQ ID NO: 43526 - protein, 10 aa, Dengue virus
ENLMWRQITP

SEQ ID NO: 43527 - protein, 10 aa, Dengue virus
NLMWRQITPE

SEQ ID NO: 43528 - protein, 10 aa, Dengue virus
LMWRQITPEL

SEQ ID NO: 43529 - protein, 10 aa, Dengue virus
MWRQITPELN

SEQ ID NO: 43530 - protein, 10 aa, Dengue virus
WRQITPELNH

SEQ ID NO: 43531 - protein, 10 aa, Dengue virus
RQITPELNHI

SEQ ID NO: 43532 - protein, 10 aa, Dengue virus
ITSELNHILS

SEQ ID NO: 43533 - protein, 10 aa, Dengue virus
TSELNHILSE

SEQ ID NO: 43534 - protein, 10 aa, Dengue virus
SELNHILSEN

SEQ ID NO: 43535 - protein, 10 aa, Dengue virus
LNHILSENEA

SEQ ID NO: 43536 - protein, 10 aa, Dengue virus
NHILSENEAK

SEQ ID NO: 43537 - protein, 10 aa, Dengue virus
HILSENEAKL

SEQ ID NO: 43538 - protein, 10 aa, Dengue virus
ILSENEAKLT

SEQ ID NO: 43539 - protein, 10 aa, Dengue virus
LSENEAKLTI

SEQ ID NO: 43540 - protein, 10 aa, Dengue virus
SENEAKLTIM

SEQ ID NO: 43541 - protein, 10 aa, Dengue virus
ENEVKMTIMT

SEQ ID NO: 43542 - protein, 10 aa, Dengue virus
NEVKMTIMTG

SEQ ID NO: 43543 - protein, 10 aa, Dengue virus
EAKLTIMTGD

SEQ ID NO: 43544 - protein, 10 aa, Dengue virus
VKLTIMTGEI

SEQ ID NO: 43545 - protein, 10 aa, Dengue virus
KLTIMTGDTK

SEQ ID NO: 43546 - protein, 10 aa, Dengue virus
LTIMTGDTKG

SEQ ID NO: 43547 - protein, 10 aa, Dengue virus
TIMTGDTKGI

SEQ ID NO: 43548 - protein, 10 aa, Dengue virus
IMTGDTKGIM

SEQ ID NO: 43549 - protein, 10 aa, Dengue virus
MTGDTKGIMQ

SEQ ID NO: 43550 - protein, 10 aa, Dengue virus
GIMQAGRRSL

SEQ ID NO: 43551 - protein, 10 aa, Dengue virus
GKRSLQPQPT

SEQ ID NO: 43552 - protein, 10 aa, Dengue virus
RSLQPQPTEL

SEQ ID NO: 43553 - protein, 10 aa, Dengue virus
LKPQPTELRY

SEQ ID NO: 43554 - protein, 10 aa, Dengue virus
KPQPTELRYS

SEQ ID NO: 43555 - protein, 10 aa, Dengue virus
PTELRYSWKT

SEQ ID NO: 43556 - protein, 10 aa, Dengue virus
TELRYSWKTW

SEQ ID NO: 43557 - protein, 10 aa, Dengue virus
ELRYSWKTWG

SEQ ID NO: 43558 - protein, 10 aa, Dengue virus
LRYSWKTWGK

SEQ ID NO: 43559 - protein, 10 aa, Dengue virus
RYSWKTWGKA

SEQ ID NO: 43560 - protein, 10 aa, Dengue virus
SWKTWGKAKV

SEQ ID NO: 43561 - protein, 10 aa, Dengue virus
WKTWGKAKVL

SEQ ID NO: 43562 - protein, 10 aa, Dengue virus
WGKAKMLPTE

SEQ ID NO: 43563 - protein, 10 aa, Dengue virus
HNHTFLIDGP

SEQ ID NO: 43564 - protein, 10 aa, Dengue virus
NRTFLIDGPE

SEQ ID NO: 43565 - protein, 10 aa, Dengue virus
RTFLIDGPET

SEQ ID NO: 43566 - protein, 10 aa, Dengue virus
TFLIDGPETV

SEQ ID NO: 43567 - protein, 10 aa, Dengue virus
FLIDGPETVE

SEQ ID NO: 43568 - protein, 10 aa, Dengue virus
LIDGPETVEC

SEQ ID NO: 43569 - protein, 10 aa, Dengue virus
IDGPETVECP

SEQ ID NO: 43570 - protein, 10 aa, Dengue virus
DGPETVECPN

SEQ ID NO: 43571 - protein, 10 aa, Dengue virus
TTECPNSNRA

SEQ ID NO: 43572 - protein, 10 aa, Dengue virus
TECPNSNRAW

SEQ ID NO: 43573 - protein, 10 aa, Dengue virus
VEDYGFGIFT

SEQ ID NO: 43574 - protein, 10 aa, Dengue virus
EDYGFGIFTT

SEQ ID NO: 43575 - protein, 10 aa, Dengue virus
DYGFGIFTTN

SEQ ID NO: 43576 - protein, 10 aa, Dengue virus
YGFGIFTTNI

SEQ ID NO: 43577 - protein, 10 aa, Dengue virus
GFGIFTTNIW

SEQ ID NO: 43578 - protein, 10 aa, Dengue virus
FGIFTTNIWL

SEQ ID NO: 43579 - protein, 10 aa, Dengue virus
GVFTTNIWLR

SEQ ID NO: 43580 - protein, 10 aa, Dengue virus
VFTTNIWLRL

SEQ ID NO: 43581 - protein, 10 aa, Dengue virus
FSTNIWLKLR

SEQ ID NO: 43582 - protein, 10 aa, Dengue virus
STNIWLKLRE

SEQ ID NO: 43583 - protein, 10 aa, Dengue virus
TNIWLKLKER

SEQ ID NO: 43584 - protein, 10 aa, Dengue virus
NIWLKLKERQ

SEQ ID NO: 43585 - protein, 10 aa, Dengue virus
IWLKLKERQD

SEQ ID NO: 43586 - protein, 10 aa, Dengue virus
VCDSKLMSAA

SEQ ID NO: 43587 - protein, 10 aa, Dengue virus
SKLMSAAIKN

SEQ ID NO: 43588 - protein, 10 aa, Dengue virus
KLMSAAVKDN

SEQ ID NO: 43589 - protein, 10 aa, Dengue virus
LMSAAVKDNR

SEQ ID NO: 43590 - protein, 10 aa, Dengue virus
MSAAVKDNRA

SEQ ID NO: 43591 - protein, 10 aa, Dengue virus
SAAVKDNRAV

SEQ ID NO: 43592 - protein, 10 aa, Dengue virus
AAVKDNRAVH

SEQ ID NO: 43593 - protein, 10 aa, Dengue virus
AVKDNRAVHA

SEQ ID NO: 43594 - protein, 10 aa, Dengue virus
VKDNRAVHAD

SEQ ID NO: 43595 - protein, 10 aa, Dengue virus
KNNRAVHADM

SEQ ID NO: 43596 - protein, 10 aa, Dengue virus
NNRAVHADMG

SEQ ID NO: 43597 - protein, 10 aa, Dengue virus
ADMGYWMESA

SEQ ID NO: 43598 - protein, 10 aa, Dengue virus
DMGYWMESAL

SEQ ID NO: 43599 - protein, 10 aa, Dengue virus
MGYWMESALN

SEQ ID NO: 43600 - protein, 10 aa, Dengue virus
GYWMESALND

SEQ ID NO: 43601 - protein, 10 aa, Dengue virus
YWMESALNDT

SEQ ID NO: 43602 - protein, 10 aa, Dengue virus
WMESALNDTW

SEQ ID NO: 43603 - protein, 10 aa, Dengue virus
MESALNDTWK

SEQ ID NO: 43604 - protein, 10 aa, Dengue virus
ESRLNDTWKM

SEQ ID NO: 43605 - protein, 10 aa, Dengue virus
SRLNDTWKME

SEQ ID NO: 43606 - protein, 10 aa, Dengue virus
RLNDTWKMEK

SEQ ID NO: 43607 - protein, 10 aa, Dengue virus
KMEKASFIEI

SEQ ID NO: 43608 - protein, 10 aa, Dengue virus
MEKASFIEIK

SEQ ID NO: 43609 - protein, 10 aa, Dengue virus
EKASFIEIKS

SEQ ID NO: 43610 - protein, 10 aa, Dengue virus
KASFIEIKSC

SEQ ID NO: 43611 - protein, 10 aa, Dengue virus
ASFIEIKSCH

SEQ ID NO: 43612 - protein, 10 aa, Dengue virus
SFIEIKSCHW

SEQ ID NO: 43613 - protein, 10 aa, Dengue virus
FIEIKSCHWP

SEQ ID NO: 43614 - protein, 10 aa, Dengue virus
IEIKSCHWPK

SEQ ID NO: 43615 - protein, 10 aa, Dengue virus
EIKSCHWPKS

SEQ ID NO: 43616 - protein, 10 aa, Dengue virus
IKSCHWPKSH

SEQ ID NO: 43617 - protein, 10 aa, Dengue virus
KSCYWPRSHT

SEQ ID NO: 43618 - protein, 10 aa, Dengue virus
SCYWPRSHTL

SEQ ID NO: 43619 - protein, 10 aa, Dengue virus
CHWPRSHTLW

SEQ ID NO: 43620 - protein, 10 aa, Dengue virus
HWPRSHTLWS

SEQ ID NO: 43621 - protein, 10 aa, Dengue virus
LESEMVIPKN

SEQ ID NO: 43622 - protein, 10 aa, Dengue virus
IPKSFAGPVS

SEQ ID NO: 43623 - protein, 10 aa, Dengue virus
PKSFAGPVSQ

SEQ ID NO: 43624 - protein, 10 aa, Dengue virus
KSFAGPVSQH

SEQ ID NO: 43625 - protein, 10 aa, Dengue virus
SFAGPVSQHN

SEQ ID NO: 43626 - protein, 10 aa, Dengue virus
FAGPVSQHNN

SEQ ID NO: 43627 - protein, 10 aa, Dengue virus
GPVSQHNHRP

SEQ ID NO: 43628 - protein, 10 aa, Dengue virus
PVSQHNHRPG

SEQ ID NO: 43629 - protein, 10 aa, Dengue virus
VSQHNHRPGY

SEQ ID NO: 43630 - protein, 10 aa, Dengue virus
SQHNNRPGYH

SEQ ID NO: 43631 - protein, 10 aa, Dengue virus
QHNNRPGYHT

SEQ ID NO: 43632 - protein, 10 aa, Dengue virus
HNNRPGYHTQ

SEQ ID NO: 43633 - protein, 10 aa, Dengue virus
RPGYYTQTAG

SEQ ID NO: 43634 - protein, 10 aa, Dengue virus
PGYYTQTAGP

SEQ ID NO: 43635 - protein, 10 aa, Dengue virus
GYYTQTAGPW

SEQ ID NO: 43636 - protein, 10 aa, Dengue virus
YYTQTAGPWH

SEQ ID NO: 43637 - protein, 10 aa, Dengue virus
YTQTAGPWHL

SEQ ID NO: 43638 - protein, 10 aa, Dengue virus
TQITGPWHLG

SEQ ID NO: 43639 - protein, 10 aa, Dengue virus
QTAGPWHLGR

SEQ ID NO: 43640 - protein, 10 aa, Dengue virus
TAGPWHLGRL

SEQ ID NO: 43641 - protein, 10 aa, Dengue virus
TGPWHLGKLE

SEQ ID NO: 43642 - protein, 10 aa, Dengue virus
HLGKLEMDFE

SEQ ID NO: 43643 - protein, 10 aa, Dengue virus
LGRLEMDFDF

SEQ ID NO: 43644 - protein, 10 aa, Dengue virus
GRLEMDFDFC

SEQ ID NO: 43645 - protein, 10 aa, Dengue virus
LEMDFDLCEG

SEQ ID NO: 43646 - protein, 10 aa, Dengue virus
EMDFDLCEGT

SEQ ID NO: 43647 - protein, 10 aa, Dengue virus
MDFDLCEGTT

SEQ ID NO: 43648 - protein, 10 aa, Dengue virus
DFDLCEGTTV

SEQ ID NO: 43649 - protein, 10 aa, Dengue virus
LCEGTTVVVT

SEQ ID NO: 43650 - protein, 10 aa, Dengue virus
CDGTTVVVTE

SEQ ID NO: 43651 - protein, 10 aa, Dengue virus
DGTTVVVTED

SEQ ID NO: 43652 - protein, 10 aa, Dengue virus
GTTVVVTEEC

SEQ ID NO: 43653 - protein, 10 aa, Dengue virus
TTVVVTEECG

SEQ ID NO: 43654 - protein, 10 aa, Dengue virus
TVVVTEECGN

SEQ ID NO: 43655 - protein, 10 aa, Dengue virus
VVVTEECGNR

SEQ ID NO: 43656 - protein, 10 aa, Dengue virus
VVTEECGNRG

SEQ ID NO: 43657 - protein, 10 aa, Dengue virus
VTENCGNRGP

SEQ ID NO: 43658 - protein, 10 aa, Dengue virus
TENCGNRGPS

SEQ ID NO: 43659 - protein, 10 aa, Dengue virus
ENCGNRGPSL

SEQ ID NO: 43660 - protein, 10 aa, Dengue virus
LKEREENLVN

SEQ ID NO: 43661 - protein, 10 aa, Dengue virus
KEREENLVNS

SEQ ID NO: 43662 - protein, 10 aa, Dengue virus
EREENLVNSL

SEQ ID NO: 43663 - protein, 10 aa, Dengue virus
REENLVNSLV

SEQ ID NO: 43664 - protein, 10 aa, Dengue virus
LVNSLVTAGQ

SEQ ID NO: 43665 - protein, 10 aa, Dengue virus
VNSLVTAGQG

SEQ ID NO: 43666 - protein, 10 aa, Dengue virus
NSLVTAGQGQ

SEQ ID NO: 43667 - protein, 10 aa, Dengue virus
SLVTAGQGQV

SEQ ID NO: 43668 - protein, 10 aa, Dengue virus
LVTAGQGQVD

SEQ ID NO: 43669 - protein, 10 aa, Dengue virus
VTAGQGQVDN

SEQ ID NO: 43670 - protein, 10 aa, Dengue virus
TAGQGQVDNF

SEQ ID NO: 43671 - protein, 10 aa, Dengue virus
AGQGQVDNFS

SEQ ID NO: 43672 - protein, 10 aa, Dengue virus
GQGQVDNFSL

SEQ ID NO: 43673 - protein, 10 aa, Dengue virus
QGQVDNFSLG

SEQ ID NO: 43674 - protein, 10 aa, Dengue virus
GQIDNFSLGI

SEQ ID NO: 43675 - protein, 10 aa, Dengue virus
QIDNFSLGIL

SEQ ID NO: 43676 - protein, 10 aa, Dengue virus
IDNFSLGILG

SEQ ID NO: 43677 - protein, 10 aa, Dengue virus
SLGILGMALL

SEQ ID NO: 43678 - protein, 10 aa, Dengue virus
LGILGMALLL

SEQ ID NO: 43679 - protein, 10 aa, Dengue virus
GILGMALLLE

SEQ ID NO: 43680 - protein, 10 aa, Dengue virus
ILGMALLLEE

SEQ ID NO: 43681 - protein, 10 aa, Dengue virus
MALFLEEMLK

SEQ ID NO: 43682 - protein, 10 aa, Dengue virus
LLEEMLRTRV

SEQ ID NO: 43683 - protein, 10 aa, Dengue virus
EEMLKTRVGT

SEQ ID NO: 43684 - protein, 10 aa, Dengue virus
EMLKTRVGTK

SEQ ID NO: 43685 - protein, 10 aa, Dengue virus
MLKTRVGTKH

SEQ ID NO: 43686 - protein, 10 aa, Dengue virus
LKTRVGTKHA

SEQ ID NO: 43687 - protein, 10 aa, Dengue virus
SLVTLITGNM

SEQ ID NO: 43688 - protein, 10 aa, Dengue virus
LVTLITGNMS

SEQ ID NO: 43689 - protein, 10 aa, Dengue virus
LTLITGNMSF

SEQ ID NO: 43690 - protein, 10 aa, Dengue virus
TLITGNLSFK

SEQ ID NO: 43691 - protein, 10 aa, Dengue virus
KDLGRVIIMV

SEQ ID NO: 43692 - protein, 10 aa, Dengue virus
DLGRVIIMVG

SEQ ID NO: 43693 - protein, 10 aa, Dengue virus
LGRVIIMVGA

SEQ ID NO: 43694 - protein, 10 aa, Dengue virus
TDEMGMGVTY

SEQ ID NO: 43695 - protein, 10 aa, Dengue virus
DDIGMGITYL

SEQ ID NO: 43696 - protein, 10 aa, Dengue virus
DIGMGITYLA

SEQ ID NO: 43697 - protein, 10 aa, Dengue virus
IGMGITYLAL

SEQ ID NO: 43698 - protein, 10 aa, Dengue virus
GIGVTYLALL

SEQ ID NO: 43699 - protein, 10 aa, Dengue virus
IGVTYLALLA

SEQ ID NO: 43700 - protein, 10 aa, Dengue virus
AAFKVRPTFV

SEQ ID NO: 43701 - protein, 10 aa, Dengue virus
AFRVRPTFAA

SEQ ID NO: 43702 - protein, 10 aa, Dengue virus
FRVRPTFAAG

SEQ ID NO: 43703 - protein, 10 aa, Dengue virus
RVRPTFAAGL

SEQ ID NO: 43704 - protein, 10 aa, Dengue virus
VRPTFAAGLF

SEQ ID NO: 43705 - protein, 10 aa, Dengue virus
RPTFAAGLFL

SEQ ID NO: 43706 - protein, 10 aa, Dengue virus
PTFAAGLFLR

SEQ ID NO: 43707 - protein, 10 aa, Dengue virus
TFAAGLFLRK

SEQ ID NO: 43708 - protein, 10 aa, Dengue virus
FAAGLFLRKL

SEQ ID NO: 43709 - protein, 10 aa, Dengue virus
AAGLFLRKLT

SEQ ID NO: 43710 - protein, 10 aa, Dengue virus
AGLFLRKLTS

SEQ ID NO: 43711 - protein, 10 aa, Dengue virus
LLLKKLTSKE

SEQ ID NO: 43712 - protein, 10 aa, Dengue virus
LLKKLTSKEL

SEQ ID NO: 43713 - protein, 10 aa, Dengue virus
KLTSKELLMA

SEQ ID NO: 43714 - protein, 10 aa, Dengue virus
LTSKELLMAT

SEQ ID NO: 43715 - protein, 10 aa, Dengue virus
TSKELLMATI

SEQ ID NO: 43716 - protein, 10 aa, Dengue virus
SKELLMATIG

SEQ ID NO: 43717 - protein, 10 aa, Dengue virus
KELLMATIGV

SEQ ID NO: 43718 - protein, 10 aa, Dengue virus
TIGITLLSQS

SEQ ID NO: 43719 - protein, 10 aa, Dengue virus
PGTVLELTDA

SEQ ID NO: 43720 - protein, 10 aa, Dengue virus
TVLELTDAIA

SEQ ID NO: 43721 - protein, 10 aa, Dengue virus
VLELTDAIAL

SEQ ID NO: 43722 - protein, 10 aa, Dengue virus
TDAIALGIMV

SEQ ID NO: 43723 - protein, 10 aa, Dengue virus
DAIALGIMVL

SEQ ID NO: 43724 - protein, 10 aa, Dengue virus
AIALGIMVLK

SEQ ID NO: 43725 - protein, 10 aa, Dengue virus
KMEKYQLAVT

SEQ ID NO: 43726 - protein, 10 aa, Dengue virus
LEKYQLAVTI

SEQ ID NO: 43727 - protein, 10 aa, Dengue virus
KYQLAVTIMT

SEQ ID NO: 43728 - protein, 10 aa, Dengue virus
MLCIPNVMIL

SEQ ID NO: 43729 - protein, 10 aa, Dengue virus
CIPNVMILQH

SEQ ID NO: 43730 - protein, 10 aa, Dengue virus
IPNVMILQHA

SEQ ID NO: 43731 - protein, 10 aa, Dengue virus
PNVMILQHAW

SEQ ID NO: 43732 - protein, 10 aa, Dengue virus
AWKVGCTILA

SEQ ID NO: 43733 - protein, 10 aa, Dengue virus
TLAVVSVSPL

SEQ ID NO: 43734 - protein, 10 aa, Dengue virus
VSVSPLILTS

SEQ ID NO: 43735 - protein, 10 aa, Dengue virus
SVSPLILTSS

SEQ ID NO: 43736 - protein, 10 aa, Dengue virus
VSPLILTSSQ

SEQ ID NO: 43737 - protein, 10 aa, Dengue virus
SPLILTSSQQ

SEQ ID NO: 43738 - protein, 10 aa, Dengue virus
PLILTSSQQK

SEQ ID NO: 43739 - protein, 10 aa, Dengue virus
LTSSRQKTDW

SEQ ID NO: 43740 - protein, 10 aa, Dengue virus
TSSRQKTDWI

SEQ ID NO: 43741 - protein, 10 aa, Dengue virus
SSRQKTDWIP

SEQ ID NO: 43742 - protein, 10 aa, Dengue virus
SRQKTDWIPL

SEQ ID NO: 43743 - protein, 10 aa, Dengue virus
RQKTDWIPLA

SEQ ID NO: 43744 - protein, 10 aa, Dengue virus
QKTDWIPLVL

SEQ ID NO: 43745 - protein, 10 aa, Dengue virus
KTDWIPLVLT

SEQ ID NO: 43746 - protein, 10 aa, Dengue virus
TDWIPLVLTI

SEQ ID NO: 43747 - protein, 10 aa, Dengue virus
PLALTVKGLN

SEQ ID NO: 43748 - protein, 10 aa, Dengue virus
LVLIIKGLNP

SEQ ID NO: 43749 - protein, 10 aa, Dengue virus
ALTIKGLSPT

SEQ ID NO: 43750 - protein, 10 aa, Dengue virus
AIFLTTLTRT

SEQ ID NO: 43751 - protein, 10 aa, Dengue virus
IFLTTLSRPN

SEQ ID NO: 43752 - protein, 10 aa, Dengue virus
FLTTLSRPNK

SEQ ID NO: 43753 - protein, 10 aa, Dengue virus
LTTLSRPNKT

SEQ ID NO: 43754 - protein, 10 aa, Dengue virus
TTLSRPNKTR

SEQ ID NO: 43755 - protein, 10 aa, Dengue virus
TLSRPNKTRS

SEQ ID NO: 43756 - protein, 10 aa, Dengue virus
LSRPNKTRSW

SEQ ID NO: 43757 - protein, 10 aa, Dengue virus
SRPNKTRSWP

SEQ ID NO: 43758 - protein, 10 aa, Dengue virus
RPNKTRSWPL

SEQ ID NO: 43759 - protein, 10 aa, Dengue virus
PNKTRSWPLN

SEQ ID NO: 43760 - protein, 10 aa, Dengue virus
NKTRSWPLNE

SEQ ID NO: 43761 - protein, 10 aa, Dengue virus
TRSWPLNEAI

SEQ ID NO: 43762 - protein, 10 aa, Dengue virus
SADLELEKAA

SEQ ID NO: 43763 - protein, 10 aa, Dengue virus
ADLELEKAAE

SEQ ID NO: 43764 - protein, 10 aa, Dengue virus
DLELEKAAEV

SEQ ID NO: 43765 - protein, 10 aa, Dengue virus
VKWDDQAEIS

SEQ ID NO: 43766 - protein, 10 aa, Dengue virus
KWDDQAEISG

SEQ ID NO: 43767 - protein, 10 aa, Dengue virus
WDDQAEISGS

SEQ ID NO: 43768 - protein, 10 aa, Dengue virus
DDQAEISGSS

SEQ ID NO: 43769 - protein, 10 aa, Dengue virus
DHAEISGSSP

SEQ ID NO: 43770 - protein, 10 aa, Dengue virus
SGSSPILSII

SEQ ID NO: 43771 - protein, 10 aa, Dengue virus
GSSPILSIII

SEQ ID NO: 43772 - protein, 10 aa, Dengue virus
SSPILSVTIS

SEQ ID NO: 43773 - protein, 10 aa, Dengue virus
SPILSVTISE

SEQ ID NO: 43774 - protein, 10 aa, Dengue virus
PILSVTISED

SEQ ID NO: 43775 - protein, 10 aa, Dengue virus
ILSVTISEDG

SEQ ID NO: 43776 - protein, 10 aa, Dengue virus
LSVTISEDGS

SEQ ID NO: 43777 - protein, 10 aa, Dengue virus
SVTISEDGSM

SEQ ID NO: 43778 - protein, 10 aa, Dengue virus
VTISEDGSMS

SEQ ID NO: 43779 - protein, 10 aa, Dengue virus
SIKNEEEEQI

SEQ ID NO: 43780 - protein, 10 aa, Dengue virus
IKNEEEEQIL

SEQ ID NO: 43781 - protein, 10 aa, Dengue virus
KNEEEEQILT

SEQ ID NO: 43782 - protein, 10 aa, Dengue virus
NEEEEQILTI

SEQ ID NO: 43783 - protein, 10 aa, Dengue virus
EEEEQILTIL

SEQ ID NO: 43784 - protein, 10 aa, Dengue virus
EEEQILTILI

SEQ ID NO: 43785 - protein, 10 aa, Dengue virus
EEQILTILIR

SEQ ID NO: 43786 - protein, 10 aa, Dengue virus
EQILTILIRT

SEQ ID NO: 43787 - protein, 10 aa, Dengue virus
QILTILIRTG

SEQ ID NO: 43788 - protein, 10 aa, Dengue virus
LLVISGLFPI

SEQ ID NO: 43789 - protein, 10 aa, Dengue virus
LVISGLFPIS

SEQ ID NO: 43790 - protein, 10 aa, Dengue virus
VISGLFPISI

SEQ ID NO: 43791 - protein, 10 aa, Dengue virus
ISGLFPISIP

SEQ ID NO: 43792 - protein, 10 aa, Dengue virus
SGLFPISIPI

SEQ ID NO: 43793 - protein, 10 aa, Dengue virus
GLFPISIPIT

SEQ ID NO: 43794 - protein, 10 aa, Dengue virus
LFPISIPITA

SEQ ID NO: 43795 - protein, 10 aa, Dengue virus
FPVSMPITAA

SEQ ID NO: 43796 - protein, 10 aa, Dengue virus
PVSMPITAAA

SEQ ID NO: 43797 - protein, 10 aa, Dengue virus
VSMPITAAAW

SEQ ID NO: 43798 - protein, 10 aa, Dengue virus
LWDVPSPPPI

SEQ ID NO: 43799 - protein, 10 aa, Dengue virus
WDVPSPPPVE

SEQ ID NO: 43800 - protein, 10 aa, Dengue virus
GRAELEDGAY

SEQ ID NO: 43801 - protein, 10 aa, Dengue virus
AYRIKQRGIF

SEQ ID NO: 43802 - protein, 10 aa, Dengue virus
YRIKQRGIFG

SEQ ID NO: 43803 - protein, 10 aa, Dengue virus
RIKQRGIFGY

SEQ ID NO: 43804 - protein, 10 aa, Dengue virus
IKQRGIFGYS

SEQ ID NO: 43805 - protein, 10 aa, Dengue virus
KQRGIFGYSQ

SEQ ID NO: 43806 - protein, 10 aa, Dengue virus
QRGIFGYSQI

SEQ ID NO: 43807 - protein, 10 aa, Dengue virus
RGIFGYSQIG

SEQ ID NO: 43808 - protein, 10 aa, Dengue virus
RILGYSQIGA

SEQ ID NO: 43809 - protein, 10 aa, Dengue virus
WHVTRGAVLT

SEQ ID NO: 43810 - protein, 10 aa, Dengue virus
HVTRGAVLTH

SEQ ID NO: 43811 - protein, 10 aa, Dengue virus
VTRGAVLVHK

SEQ ID NO: 43812 - protein, 10 aa, Dengue virus
TRGAVLVHKG

SEQ ID NO: 43813 - protein, 10 aa, Dengue virus
RGAVLVHKGK

SEQ ID NO: 43814 - protein, 10 aa, Dengue virus
GAVLVHKGKR

SEQ ID NO: 43815 - protein, 10 aa, Dengue virus
AVLVHKGKRI

SEQ ID NO: 43816 - protein, 10 aa, Dengue virus
VLVHKGKRIE

SEQ ID NO: 43817 - protein, 10 aa, Dengue virus
LVHKGKRIEP

SEQ ID NO: 43818 - protein, 10 aa, Dengue virus
VHKGKRIEPS

SEQ ID NO: 43819 - protein, 10 aa, Dengue virus
SWADVKKDLV

SEQ ID NO: 43820 - protein, 10 aa, Dengue virus
WADVRKDLIS

SEQ ID NO: 43821 - protein, 10 aa, Dengue virus
ADVRKDLISY

SEQ ID NO: 43822 - protein, 10 aa, Dengue virus
DVKKDLVSYG

SEQ ID NO: 43823 - protein, 10 aa, Dengue virus
VRKDLISYGG

SEQ ID NO: 43824 - protein, 10 aa, Dengue virus
KKDLVSYGGG

SEQ ID NO: 43825 - protein, 10 aa, Dengue virus
AVQTKPGLFR

SEQ ID NO: 43826 - protein, 10 aa, Dengue virus
VQTKPGLFRT

SEQ ID NO: 43827 - protein, 10 aa, Dengue virus
QTKPGLFRTN

SEQ ID NO: 43828 - protein, 10 aa, Dengue virus
FRTNTGTIGA

SEQ ID NO: 43829 - protein, 10 aa, Dengue virus
RTNTGTIGAV

SEQ ID NO: 43830 - protein, 10 aa, Dengue virus
TSTGTIGAVS

SEQ ID NO: 43831 - protein, 10 aa, Dengue virus
STGTIGAVSL

SEQ ID NO: 43832 - protein, 10 aa, Dengue virus
GTSGSPIVDK

SEQ ID NO: 43833 - protein, 10 aa, Dengue virus
TSGSPIVDKK

SEQ ID NO: 43834 - protein, 10 aa, Dengue virus
SGSPIVDKKG

SEQ ID NO: 43835 - protein, 10 aa, Dengue virus
GSPIVDKKGK

SEQ ID NO: 43836 - protein, 10 aa, Dengue virus
SPIVDKKGKV

SEQ ID NO: 43837 - protein, 10 aa, Dengue virus
PIVDKKGKVV

SEQ ID NO: 43838 - protein, 10 aa, Dengue virus
IVDKKGKVVG

SEQ ID NO: 43839 - protein, 10 aa, Dengue virus
VDKKGKVVGL

SEQ ID NO: 43840 - protein, 10 aa, Dengue virus
VTRSGTYVSS

SEQ ID NO: 43841 - protein, 10 aa, Dengue virus
TRSGTYVSSI

SEQ ID NO: 43842 - protein, 10 aa, Dengue virus
RSGTYVSSIA

SEQ ID NO: 43843 - protein, 10 aa, Dengue virus
SGTYVSSIAQ

SEQ ID NO: 43844 - protein, 10 aa, Dengue virus
GTYVSSIAQT

SEQ ID NO: 43845 - protein, 10 aa, Dengue virus
TYVSSIAQTE

SEQ ID NO: 43846 - protein, 10 aa, Dengue virus
VSAIAQTEKN

SEQ ID NO: 43847 - protein, 10 aa, Dengue virus
SAIAQTEKNI

SEQ ID NO: 43848 - protein, 10 aa, Dengue virus
AIAQTEKNIE

SEQ ID NO: 43849 - protein, 10 aa, Dengue virus
ENNPEIEDDI

SEQ ID NO: 43850 - protein, 10 aa, Dengue virus
DNPEIEDHIF

SEQ ID NO: 43851 - protein, 10 aa, Dengue virus
NPEIEDHIFR

SEQ ID NO: 43852 - protein, 10 aa, Dengue virus
PEIEDHIFRK

SEQ ID NO: 43853 - protein, 10 aa, Dengue virus
DIEDDIFRKR

SEQ ID NO: 43854 - protein, 10 aa, Dengue virus
IEDDIFRKRK

SEQ ID NO: 43855 - protein, 10 aa, Dengue virus
EDDIFRKRKL

SEQ ID NO: 43856 - protein, 10 aa, Dengue virus
DDIFRKRKLT

SEQ ID NO: 43857 - protein, 10 aa, Dengue virus
DIFRKRKLTI

SEQ ID NO: 43858 - protein, 10 aa, Dengue virus
IFRKRKLTIM

SEQ ID NO: 43859 - protein, 10 aa, Dengue virus
FRKRKLTIMD

SEQ ID NO: 43860 - protein, 10 aa, Dengue virus
RKRKLTIMDL

SEQ ID NO: 43861 - protein, 10 aa, Dengue virus
KRKLTIMDLH

SEQ ID NO: 43862 - protein, 10 aa, Dengue virus
RKLTIMDLHP

SEQ ID NO: 43863 - protein, 10 aa, Dengue virus
PIRYQTTAIK

SEQ ID NO: 43864 - protein, 10 aa, Dengue virus
IRYQTPAIKA

SEQ ID NO: 43865 - protein, 10 aa, Dengue virus
RYQTPAIKAE

SEQ ID NO: 43866 - protein, 10 aa, Dengue virus
YQTPAIKAEH

SEQ ID NO: 43867 - protein, 10 aa, Dengue virus
QTPAIKAEHT

SEQ ID NO: 43868 - protein, 10 aa, Dengue virus
TPAIKAEHTG

SEQ ID NO: 43869 - protein, 10 aa, Dengue virus
PAIKAEHTGR

SEQ ID NO: 43870 - protein, 10 aa, Dengue virus
AIKAEHTGRE

SEQ ID NO: 43871 - protein, 10 aa, Dengue virus
IKAEHTGREI

SEQ ID NO: 43872 - protein, 10 aa, Dengue virus
KAEHTGREIV

SEQ ID NO: 43873 - protein, 10 aa, Dengue virus
PFPQSNAPIV

SEQ ID NO: 43874 - protein, 10 aa, Dengue virus
FPQSNAPIVD

SEQ ID NO: 43875 - protein, 10 aa, Dengue virus
PQSNAPIVDE

SEQ ID NO: 43876 - protein, 10 aa, Dengue virus
QSNAPIVDEE

SEQ ID NO: 43877 - protein, 10 aa, Dengue virus
SNAPIVDEER

SEQ ID NO: 43878 - protein, 10 aa, Dengue virus
NAPIVDEERE

SEQ ID NO: 43879 - protein, 10 aa, Dengue virus
APIVDEEREI

SEQ ID NO: 43880 - protein, 10 aa, Dengue virus
PIVDEEREIP

SEQ ID NO: 43881 - protein, 10 aa, Dengue virus
IVDEEREIPE

SEQ ID NO: 43882 - protein, 10 aa, Dengue virus
VDEEREIPER

SEQ ID NO: 43883 - protein, 10 aa, Dengue virus
REIPERSWNT

SEQ ID NO: 43884 - protein, 10 aa, Dengue virus
EIPERSWNTG

SEQ ID NO: 43885 - protein, 10 aa, Dengue virus
IPERSWNTGH

SEQ ID NO: 43886 - protein, 10 aa, Dengue virus
PERSWNTGHE

SEQ ID NO: 43887 - protein, 10 aa, Dengue virus
ERSWNTGHEW

SEQ ID NO: 43888 - protein, 10 aa, Dengue virus
RSWSSGHEWV

SEQ ID NO: 43889 - protein, 10 aa, Dengue virus
SWSSGHEWVT

SEQ ID NO: 43890 - protein, 10 aa, Dengue virus
WSSGHEWVTD

SEQ ID NO: 43891 - protein, 10 aa, Dengue virus
NSGHEWITNF

SEQ ID NO: 43892 - protein, 10 aa, Dengue virus
GHEWITDFKG

SEQ ID NO: 43893 - protein, 10 aa, Dengue virus
YEWVTDFKGK

SEQ ID NO: 43894 - protein, 10 aa, Dengue virus
EWITNFEGKT

SEQ ID NO: 43895 - protein, 10 aa, Dengue virus
WITDFKGKTV

SEQ ID NO: 43896 - protein, 10 aa, Dengue virus
ITDFKGKTVW

SEQ ID NO: 43897 - protein, 10 aa, Dengue virus
TVWFVPSIRA

SEQ ID NO: 43898 - protein, 10 aa, Dengue virus
VWFVPSIRAG

SEQ ID NO: 43899 - protein, 10 aa, Dengue virus
WFVPSIRAGN

SEQ ID NO: 43900 - protein, 10 aa, Dengue virus
FVPSIRAGND

SEQ ID NO: 43901 - protein, 10 aa, Dengue virus
VPSIRAGNDI

SEQ ID NO: 43902 - protein, 10 aa, Dengue virus
PSIRAGNDIA

SEQ ID NO: 43903 - protein, 10 aa, Dengue virus
SIRAGNDIAA

SEQ ID NO: 43904 - protein, 10 aa, Dengue virus
IRAGNDIAAC

SEQ ID NO: 43905 - protein, 10 aa, Dengue virus
RAGNDIAACL

SEQ ID NO: 43906 - protein, 10 aa, Dengue virus
SRKTFDTEYT

SEQ ID NO: 43907 - protein, 10 aa, Dengue virus
RKTFDTEYTK

SEQ ID NO: 43908 - protein, 10 aa, Dengue virus
KTFDSEYAKT

SEQ ID NO: 43909 - protein, 10 aa, Dengue virus
TFDSEYAKTR

SEQ ID NO: 43910 - protein, 10 aa, Dengue virus
KTRSNDWDFV

SEQ ID NO: 43911 - protein, 10 aa, Dengue virus
TRSNDWDFVV

SEQ ID NO: 43912 - protein, 10 aa, Dengue virus
RSNDWDFVVT

SEQ ID NO: 43913 - protein, 10 aa, Dengue virus
SNDWDFVVTT

SEQ ID NO: 43914 - protein, 10 aa, Dengue virus
ILTHGEERVI

SEQ ID NO: 43915 - protein, 10 aa, Dengue virus
LTHGEERVIL

SEQ ID NO: 43916 - protein, 10 aa, Dengue virus
ADGEERVILA

SEQ ID NO: 43917 - protein, 10 aa, Dengue virus
RRGRIGRNPR

SEQ ID NO: 43918 - protein, 10 aa, Dengue virus
RGRIGRNPRN

SEQ ID NO: 43919 - protein, 10 aa, Dengue virus
GRIGRNPRNE

SEQ ID NO: 43920 - protein, 10 aa, Dengue virus
RIGRNPRNEN

SEQ ID NO: 43921 - protein, 10 aa, Dengue virus
IGRNPRNEND

SEQ ID NO: 43922 - protein, 10 aa, Dengue virus
GDLPVWLAFK

SEQ ID NO: 43923 - protein, 10 aa, Dengue virus
DLPVWLAFKV

SEQ ID NO: 43924 - protein, 10 aa, Dengue virus
LPVWLAFKVA

SEQ ID NO: 43925 - protein, 10 aa, Dengue virus
PVWLAYKVAS

SEQ ID NO: 43926 - protein, 10 aa, Dengue virus
VWLAYKVASE

SEQ ID NO: 43927 - protein, 10 aa, Dengue virus
WLAYKVASEG

SEQ ID NO: 43928 - protein, 10 aa, Dengue virus
LAYKVASEGI

SEQ ID NO: 43929 - protein, 10 aa, Dengue virus
AYKVASEGIN

SEQ ID NO: 43930 - protein, 10 aa, Dengue virus
YKVASEGINY

SEQ ID NO: 43931 - protein, 10 aa, Dengue virus
KVASEGINYA

SEQ ID NO: 43932 - protein, 10 aa, Dengue virus
VAAEGINYTD

SEQ ID NO: 43933 - protein, 10 aa, Dengue virus
AAEGINYTDR

SEQ ID NO: 43934 - protein, 10 aa, Dengue virus
EGINYTDRKW

SEQ ID NO: 43935 - protein, 10 aa, Dengue virus
GINYTDRKWC

SEQ ID NO: 43936 - protein, 10 aa, Dengue virus
INYTDRKWCF

SEQ ID NO: 43937 - protein, 10 aa, Dengue virus
NYTDRKWCFD

SEQ ID NO: 43938 - protein, 10 aa, Dengue virus
YTDRKWCFDG

SEQ ID NO: 43939 - protein, 10 aa, Dengue virus
ADRRWCFDGV

SEQ ID NO: 43940 - protein, 10 aa, Dengue virus
DRRWCFDGVK

SEQ ID NO: 43941 - protein, 10 aa, Dengue virus
RRWCFDGVKN

SEQ ID NO: 43942 - protein, 10 aa, Dengue virus
RWCFDGVKNN

SEQ ID NO: 43943 - protein, 10 aa, Dengue virus
WCFDGIRNNQ

SEQ ID NO: 43944 - protein, 10 aa, Dengue virus
CFDGIRNNQI

SEQ ID NO: 43945 - protein, 10 aa, Dengue virus
FDGIRNNQIL

SEQ ID NO: 43946 - protein, 10 aa, Dengue virus
DGIRNNQILE

SEQ ID NO: 43947 - protein, 10 aa, Dengue virus
GIRNNQILEE

SEQ ID NO: 43948 - protein, 10 aa, Dengue virus
IRNNQILEEN

SEQ ID NO: 43949 - protein, 10 aa, Dengue virus
RNNQILEENV

SEQ ID NO: 43950 - protein, 10 aa, Dengue virus
ILEENMEVEV

SEQ ID NO: 43951 - protein, 10 aa, Dengue virus
LEENMEVEVW

SEQ ID NO: 43952 - protein, 10 aa, Dengue virus
EENMEVEVWT

SEQ ID NO: 43953 - protein, 10 aa, Dengue virus
ENMEVEVWTK

SEQ ID NO: 43954 - protein, 10 aa, Dengue virus
NMEVEVWTKE

SEQ ID NO: 43955 - protein, 10 aa, Dengue virus
MEVEVWTKEG

SEQ ID NO: 43956 - protein, 10 aa, Dengue virus
AAGRKSLTLS

SEQ ID NO: 43957 - protein, 10 aa, Dengue virus
AGRKSLTLSL

SEQ ID NO: 43958 - protein, 10 aa, Dengue virus
GRKSLTLSLI

SEQ ID NO: 43959 - protein, 10 aa, Dengue virus
RKSLTLSLIT

SEQ ID NO: 43960 - protein, 10 aa, Dengue virus
KSLTLSLITE

SEQ ID NO: 43961 - protein, 10 aa, Dengue virus
SLTLSLITEM

SEQ ID NO: 43962 - protein, 10 aa, Dengue virus
LTLSLITEMG

SEQ ID NO: 43963 - protein, 10 aa, Dengue virus
TLSLITEMGR

SEQ ID NO: 43964 - protein, 10 aa, Dengue virus
PTFMTQKARD

SEQ ID NO: 43965 - protein, 10 aa, Dengue virus
TFMTQKARDA

SEQ ID NO: 43966 - protein, 10 aa, Dengue virus
FMTQKARDAL

SEQ ID NO: 43967 - protein, 10 aa, Dengue virus
MTQKARDALD

SEQ ID NO: 43968 - protein, 10 aa, Dengue virus
TQKARDALDN

SEQ ID NO: 43969 - protein, 10 aa, Dengue virus
QKARDALDNL

SEQ ID NO: 43970 - protein, 10 aa, Dengue virus
KARDALDNLA

SEQ ID NO: 43971 - protein, 10 aa, Dengue virus
ARDALDNLAV

SEQ ID NO: 43972 - protein, 10 aa, Dengue virus
NLAVLHSAEM

SEQ ID NO: 43973 - protein, 10 aa, Dengue virus
LAVLHSAEMG

SEQ ID NO: 43974 - protein, 10 aa, Dengue virus
AVLHSAEMGG

SEQ ID NO: 43975 - protein, 10 aa, Dengue virus
VLHTAEAGGK

SEQ ID NO: 43976 - protein, 10 aa, Dengue virus
LHTAEAGGKA

SEQ ID NO: 43977 - protein, 10 aa, Dengue virus
GGKAYTHALS

SEQ ID NO: 43978 - protein, 10 aa, Dengue virus
GKAYTHALSE

SEQ ID NO: 43979 - protein, 10 aa, Dengue virus
KAYTHALSEL

SEQ ID NO: 43980 - protein, 10 aa, Dengue virus
TLLLLTLLAA

SEQ ID NO: 43981 - protein, 10 aa, Dengue virus
LLLLTLLAAV

SEQ ID NO: 43982 - protein, 10 aa, Dengue virus
LLLTLLAAVT

SEQ ID NO: 43983 - protein, 10 aa, Dengue virus
LLTLLAAVTG

SEQ ID NO: 43984 - protein, 10 aa, Dengue virus
LTLLAAVTGG

SEQ ID NO: 43985 - protein, 10 aa, Dengue virus
TLLAAVTGGI

SEQ ID NO: 43986 - protein, 10 aa, Dengue virus
GIFLFLMSAR

SEQ ID NO: 43987 - protein, 10 aa, Dengue virus
IFLFLMSARG

SEQ ID NO: 43988 - protein, 10 aa, Dengue virus
FLFLMSGKGV

SEQ ID NO: 43989 - protein, 10 aa, Dengue virus
LFLMSGKGVG

SEQ ID NO: 43990 - protein, 10 aa, Dengue virus
FLMSGKGVGK

SEQ ID NO: 43991 - protein, 10 aa, Dengue virus
LMSGKGVGKM

SEQ ID NO: 43992 - protein, 10 aa, Dengue virus
MSGKGVGKMT

SEQ ID NO: 43993 - protein, 10 aa, Dengue virus
SGKGVGKMTL

SEQ ID NO: 43994 - protein, 10 aa, Dengue virus
GKGVGKMTLG

SEQ ID NO: 43995 - protein, 10 aa, Dengue virus
KGVGKMTLGM

SEQ ID NO: 43996 - protein, 10 aa, Dengue virus
GMGKMTLGMC

SEQ ID NO: 43997 - protein, 10 aa, Dengue virus
TYVVIAILTL

SEQ ID NO: 43998 - protein, 10 aa, Dengue virus
YVVIAILTLV

SEQ ID NO: 43999 - protein, 10 aa, Dengue virus
VVIAILTLVA

SEQ ID NO: 44000 - protein, 10 aa, Dengue virus
VIAILTLVAA

SEQ ID NO: 44001 - protein, 10 aa, Dengue virus
LEKTKKDLGF

SEQ ID NO: 44002 - protein, 10 aa, Dengue virus
EKTKKDLGFG

SEQ ID NO: 44003 - protein, 10 aa, Dengue virus
EPESNILDID

SEQ ID NO: 44004 - protein, 10 aa, Dengue virus
PEINILDIDL

SEQ ID NO: 44005 - protein, 10 aa, Dengue virus
NPVTLTAALL

SEQ ID NO: 44006 - protein, 10 aa, Dengue virus
PITLTAALLS

SEQ ID NO: 44007 - protein, 10 aa, Dengue virus
ITLTAALLSL

SEQ ID NO: 44008 - protein, 10 aa, Dengue virus
TAALLLLIAH

SEQ ID NO: 44009 - protein, 10 aa, Dengue virus
LMAHYAIIGP

SEQ ID NO: 44010 - protein, 10 aa, Dengue virus
MAHYAIIGPG

SEQ ID NO: 44011 - protein, 10 aa, Dengue virus
VDGVTVIDLD

SEQ ID NO: 44012 - protein, 10 aa, Dengue virus
DGVTVIDLDP

SEQ ID NO: 44013 - protein, 10 aa, Dengue virus
GVTVIDLDPI

SEQ ID NO: 44014 - protein, 10 aa, Dengue virus
VTVIDLDPIP

SEQ ID NO: 44015 - protein, 10 aa, Dengue virus
LLFSIMRNTT

SEQ ID NO: 44016 - protein, 10 aa, Dengue virus
LFSIMKNTAN

SEQ ID NO: 44017 - protein, 10 aa, Dengue virus
RRGTGNTGET

SEQ ID NO: 44018 - protein, 10 aa, Dengue virus
RGTGNTGETL

SEQ ID NO: 44019 - protein, 10 aa, Dengue virus
GTGNTGETLG

SEQ ID NO: 44020 - protein, 10 aa, Dengue virus
TGNTGETLGE

SEQ ID NO: 44021 - protein, 10 aa, Dengue virus
GNTGETLGEK

SEQ ID NO: 44022 - protein, 10 aa, Dengue virus
NTGETLGEKW

SEQ ID NO: 44023 - protein, 10 aa, Dengue virus
TGETLGEKWK

SEQ ID NO: 44024 - protein, 10 aa, Dengue virus
GEKWKSRLNT

SEQ ID NO: 44025 - protein, 10 aa, Dengue virus
EKWKSRLNTL

SEQ ID NO: 44026 - protein, 10 aa, Dengue virus
KWKSRLNTLG

SEQ ID NO: 44027 - protein, 10 aa, Dengue virus
LNALGKNEFQ

SEQ ID NO: 44028 - protein, 10 aa, Dengue virus
LGKSEFQTYK

SEQ ID NO: 44029 - protein, 10 aa, Dengue virus
GRSEFQIYKK

SEQ ID NO: 44030 - protein, 10 aa, Dengue virus
RSEFQIYKKS

SEQ ID NO: 44031 - protein, 10 aa, Dengue virus
SEFQTYKKSG

SEQ ID NO: 44032 - protein, 10 aa, Dengue virus
EFQTYKKSGI

SEQ ID NO: 44033 - protein, 10 aa, Dengue virus
FQTYKKSGIQ

SEQ ID NO: 44034 - protein, 10 aa, Dengue virus
QTYKKSGIQE

SEQ ID NO: 44035 - protein, 10 aa, Dengue virus
TYKKSGIQEV

SEQ ID NO: 44036 - protein, 10 aa, Dengue virus
RWFVERNMVA

SEQ ID NO: 44037 - protein, 10 aa, Dengue virus
WFVERNMVAP

SEQ ID NO: 44038 - protein, 10 aa, Dengue virus
FVERNMVAPE

SEQ ID NO: 44039 - protein, 10 aa, Dengue virus
VERNMVAPEG

SEQ ID NO: 44040 - protein, 10 aa, Dengue virus
ERNMVAPEGK

SEQ ID NO: 44041 - protein, 10 aa, Dengue virus
RNMVAPEGKV

SEQ ID NO: 44042 - protein, 10 aa, Dengue virus
NLVTPEGKVM

SEQ ID NO: 44043 - protein, 10 aa, Dengue virus
LVTPEGKVMD

SEQ ID NO: 44044 - protein, 10 aa, Dengue virus
VAPEGKVVDL

SEQ ID NO: 44045 - protein, 10 aa, Dengue virus
APEGKVVDLG

SEQ ID NO: 44046 - protein, 10 aa, Dengue virus
WSYYCGGLKS

SEQ ID NO: 44047 - protein, 10 aa, Dengue virus
SYYCGGLKSV

SEQ ID NO: 44048 - protein, 10 aa, Dengue virus
YYCGGLKDVR

SEQ ID NO: 44049 - protein, 10 aa, Dengue virus
YCGGLKDVRE

SEQ ID NO: 44050 - protein, 10 aa, Dengue virus
CGGLKDVREV

SEQ ID NO: 44051 - protein, 10 aa, Dengue virus
GGLKDVREVK

SEQ ID NO: 44052 - protein, 10 aa, Dengue virus
GLKDVREVKG

SEQ ID NO: 44053 - protein, 10 aa, Dengue virus
LKDVREVKGL

SEQ ID NO: 44054 - protein, 10 aa, Dengue virus
KDVREVKGLT

SEQ ID NO: 44055 - protein, 10 aa, Dengue virus
DVREVKGLTK

SEQ ID NO: 44056 - protein, 10 aa, Dengue virus
LQSGVDVFFV

SEQ ID NO: 44057 - protein, 10 aa, Dengue virus
QSGVDVFFVP

SEQ ID NO: 44058 - protein, 10 aa, Dengue virus
SGVDVFFVPP

SEQ ID NO: 44059 - protein, 10 aa, Dengue virus
GVDVFFVPPE

SEQ ID NO: 44060 - protein, 10 aa, Dengue virus
VDVFFVPPEK

SEQ ID NO: 44061 - protein, 10 aa, Dengue virus
DVFFVPPEKC

SEQ ID NO: 44062 - protein, 10 aa, Dengue virus
VFFVPPEKCD

SEQ ID NO: 44063 - protein, 10 aa, Dengue virus
FFVPPEKCDT

SEQ ID NO: 44064 - protein, 10 aa, Dengue virus
FVPPEKCDTL

SEQ ID NO: 44065 - protein, 10 aa, Dengue virus
VPPEKCDTLL

SEQ ID NO: 44066 - protein, 10 aa, Dengue virus
VLNLVENWLG

SEQ ID NO: 44067 - protein, 10 aa, Dengue virus
LNLVENWLGS

SEQ ID NO: 44068 - protein, 10 aa, Dengue virus
NLVENWLGSN

SEQ ID NO: 44069 - protein, 10 aa, Dengue virus
LVENWLGSNT

SEQ ID NO: 44070 - protein, 10 aa, Dengue virus
ENWLGSNTQF

SEQ ID NO: 44071 - protein, 10 aa, Dengue virus
NWLGSNTQFC

SEQ ID NO: 44072 - protein, 10 aa, Dengue virus
WLNNNTQFCV

SEQ ID NO: 44073 - protein, 10 aa, Dengue virus
LNNNTQFCVK

SEQ ID NO: 44074 - protein, 10 aa, Dengue virus
NNNTQFCVKV

SEQ ID NO: 44075 - protein, 10 aa, Dengue virus
NNTQFCVKVL

SEQ ID NO: 44076 - protein, 10 aa, Dengue virus
DTQFCIKVLN

SEQ ID NO: 44077 - protein, 10 aa, Dengue virus
MPSVIERMET

SEQ ID NO: 44078 - protein, 10 aa, Dengue virus
PSVIERMETL

SEQ ID NO: 44079 - protein, 10 aa, Dengue virus
SVIERMETLQ

SEQ ID NO: 44080 - protein, 10 aa, Dengue virus
VIERMETLQR

SEQ ID NO: 44081 - protein, 10 aa, Dengue virus
LQRKFGGALV

SEQ ID NO: 44082 - protein, 10 aa, Dengue virus
QRKFGGALVR

SEQ ID NO: 44083 - protein, 10 aa, Dengue virus
RKFGGALVRN

SEQ ID NO: 44084 - protein, 10 aa, Dengue virus
KFGGALVRNP

SEQ ID NO: 44085 - protein, 10 aa, Dengue virus
MLINRFTMRY

SEQ ID NO: 44086 - protein, 10 aa, Dengue virus
LINRFTMRYK

SEQ ID NO: 44087 - protein, 10 aa, Dengue virus
INRFTMRYKK

SEQ ID NO: 44088 - protein, 10 aa, Dengue virus
NRFTMRYKKA

SEQ ID NO: 44089 - protein, 10 aa, Dengue virus
RFTMRYKKAT

SEQ ID NO: 44090 - protein, 10 aa, Dengue virus
FTMRYKKATY

SEQ ID NO: 44091 - protein, 10 aa, Dengue virus
TMRYKKATYE

SEQ ID NO: 44092 - protein, 10 aa, Dengue virus
MRYKKATYEP

SEQ ID NO: 44093 - protein, 10 aa, Dengue virus
RYKKATYEPD

SEQ ID NO: 44094 - protein, 10 aa, Dengue virus
HKRATYEPDV

SEQ ID NO: 44095 - protein, 10 aa, Dengue virus
SGTRNIGIEC

SEQ ID NO: 44096 - protein, 10 aa, Dengue virus
GTRNIGIECE

SEQ ID NO: 44097 - protein, 10 aa, Dengue virus
EVPNLDIIGK

SEQ ID NO: 44098 - protein, 10 aa, Dengue virus
VPNLDIIGKR

SEQ ID NO: 44099 - protein, 10 aa, Dengue virus
IEKIKEEHET

SEQ ID NO: 44100 - protein, 10 aa, Dengue virus
EKIKEEHETS

SEQ ID NO: 44101 - protein, 10 aa, Dengue virus
KIKEEHETSW

SEQ ID NO: 44102 - protein, 10 aa, Dengue virus
IKEEHETSWH

SEQ ID NO: 44103 - protein, 10 aa, Dengue virus
KEEHETSWHY

SEQ ID NO: 44104 - protein, 10 aa, Dengue virus
EEHETSWHYD

SEQ ID NO: 44105 - protein, 10 aa, Dengue virus
EHEASWHYDQ

SEQ ID NO: 44106 - protein, 10 aa, Dengue virus
HEASWHYDQD

SEQ ID NO: 44107 - protein, 10 aa, Dengue virus
EASWHYDQDH

SEQ ID NO: 44108 - protein, 10 aa, Dengue virus
ASWHYDQDHP

SEQ ID NO: 44109 - protein, 10 aa, Dengue virus
RLLTKPWDVI

SEQ ID NO: 44110 - protein, 10 aa, Dengue virus
LLTKPWDVIP

SEQ ID NO: 44111 - protein, 10 aa, Dengue virus
LTKPWDVIPM

SEQ ID NO: 44112 - protein, 10 aa, Dengue virus
TKPWDVIPMV

SEQ ID NO: 44113 - protein, 10 aa, Dengue virus
KPWDVIPMVT

SEQ ID NO: 44114 - protein, 10 aa, Dengue virus
PWDVIPMVTQ

SEQ ID NO: 44115 - protein, 10 aa, Dengue virus
WDVIPMVTQM

SEQ ID NO: 44116 - protein, 10 aa, Dengue virus
DVIPMVTQMA

SEQ ID NO: 44117 - protein, 10 aa, Dengue virus
VIPMVTQMAM

SEQ ID NO: 44118 - protein, 10 aa, Dengue virus
IPMVTQMAMT

SEQ ID NO: 44119 - protein, 10 aa, Dengue virus
TKKLMKITAK

SEQ ID NO: 44120 - protein, 10 aa, Dengue virus
KKLMKITAKW

SEQ ID NO: 44121 - protein, 10 aa, Dengue virus
KLMKITAKWL

SEQ ID NO: 44122 - protein, 10 aa, Dengue virus
LMKITAKWLW

SEQ ID NO: 44123 - protein, 10 aa, Dengue virus
MKITAKWLWK

SEQ ID NO: 44124 - protein, 10 aa, Dengue virus
RITAEWLWGE

SEQ ID NO: 44125 - protein, 10 aa, Dengue virus
ITAEWLWGEL

SEQ ID NO: 44126 - protein, 10 aa, Dengue virus
TAKWLWKELG

SEQ ID NO: 44127 - protein, 10 aa, Dengue virus
AKWLWKELGK

SEQ ID NO: 44128 - protein, 10 aa, Dengue virus
WLWGELGRRK

SEQ ID NO: 44129 - protein, 10 aa, Dengue virus
LWGELGRRKK

SEQ ID NO: 44130 - protein, 10 aa, Dengue virus
WGELGRRKKP

SEQ ID NO: 44131 - protein, 10 aa, Dengue virus
GELGRRKKPR

SEQ ID NO: 44132 - protein, 10 aa, Dengue virus
KTPRICTREE

SEQ ID NO: 44133 - protein, 10 aa, Dengue virus
TPRICTREEF

SEQ ID NO: 44134 - protein, 10 aa, Dengue virus
PRICTREEFT

SEQ ID NO: 44135 - protein, 10 aa, Dengue virus
CTRAEFCNKV

SEQ ID NO: 44136 - protein, 10 aa, Dengue virus
TRAEFCNKVR

SEQ ID NO: 44137 - protein, 10 aa, Dengue virus
RAEFCNKVRS

SEQ ID NO: 44138 - protein, 10 aa, Dengue virus
AEFCNKVRSN

SEQ ID NO: 44139 - protein, 10 aa, Dengue virus
EFCNKVRSNA

SEQ ID NO: 44140 - protein, 10 aa, Dengue virus
FCNKVRSNAA

SEQ ID NO: 44141 - protein, 10 aa, Dengue virus
CNKVRSNAAL

SEQ ID NO: 44142 - protein, 10 aa, Dengue virus
NKVRSNAALG

SEQ ID NO: 44143 - protein, 10 aa, Dengue virus
KSAREAVEDE

SEQ ID NO: 44144 - protein, 10 aa, Dengue virus
SAREAVEDSG

SEQ ID NO: 44145 - protein, 10 aa, Dengue virus
AREAVEDSGF

SEQ ID NO: 44146 - protein, 10 aa, Dengue virus
REAVEDSGFW

SEQ ID NO: 44147 - protein, 10 aa, Dengue virus
EAVEDSGFWE

SEQ ID NO: 44148 - protein, 10 aa, Dengue virus
AVEDSGFWEL

SEQ ID NO: 44149 - protein, 10 aa, Dengue virus
FWELIDRERN

SEQ ID NO: 44150 - protein, 10 aa, Dengue virus
WELIDRERNL

SEQ ID NO: 44151 - protein, 10 aa, Dengue virus
ELIDRERNLH

SEQ ID NO: 44152 - protein, 10 aa, Dengue virus
LIDRERNLHL

SEQ ID NO: 44153 - protein, 10 aa, Dengue virus
EKERNLHLDG

SEQ ID NO: 44154 - protein, 10 aa, Dengue virus
KERNLHLDGK

SEQ ID NO: 44155 - protein, 10 aa, Dengue virus
SGVEGEGLYK

SEQ ID NO: 44156 - protein, 10 aa, Dengue virus
GVEGEGLYKL

SEQ ID NO: 44157 - protein, 10 aa, Dengue virus
VEGEGLYKLG

SEQ ID NO: 44158 - protein, 10 aa, Dengue virus
EGEGLYKLGY

SEQ ID NO: 44159 - protein, 10 aa, Dengue virus
GEGLYKLGYI

SEQ ID NO: 44160 - protein, 10 aa, Dengue virus
LHRLGYILRE

SEQ ID NO: 44161 - protein, 10 aa, Dengue virus
HRLGYILREV

SEQ ID NO: 44162 - protein, 10 aa, Dengue virus
LGYILREVGK

SEQ ID NO: 44163 - protein, 10 aa, Dengue virus
GYILREVGKK

SEQ ID NO: 44164 - protein, 10 aa, Dengue virus
ISRKAGGAMY

SEQ ID NO: 44165 - protein, 10 aa, Dengue virus
SRKAGGAMYA

SEQ ID NO: 44166 - protein, 10 aa, Dengue virus
KKAGGAMYAD

SEQ ID NO: 44167 - protein, 10 aa, Dengue virus
TAGWDTRITS

SEQ ID NO: 44168 - protein, 10 aa, Dengue virus
AGWDTRITSE

SEQ ID NO: 44169 - protein, 10 aa, Dengue virus
GWDTRITSED

SEQ ID NO: 44170 - protein, 10 aa, Dengue virus
WDTRITSEDL

SEQ ID NO: 44171 - protein, 10 aa, Dengue virus
DTRITSEDLK

SEQ ID NO: 44172 - protein, 10 aa, Dengue virus
TRITSEDLKN

SEQ ID NO: 44173 - protein, 10 aa, Dengue virus
RITSEDLKNE

SEQ ID NO: 44174 - protein, 10 aa, Dengue virus
ITSEDLKNEE

SEQ ID NO: 44175 - protein, 10 aa, Dengue virus
TSEDLKNEEM

SEQ ID NO: 44176 - protein, 10 aa, Dengue virus
SEDLKNEEMI

SEQ ID NO: 44177 - protein, 10 aa, Dengue virus
DLKNEEMITD

SEQ ID NO: 44178 - protein, 10 aa, Dengue virus
LKNEEMITDQ

SEQ ID NO: 44179 - protein, 10 aa, Dengue virus
KNEEMITDQM

SEQ ID NO: 44180 - protein, 10 aa, Dengue virus
GRHKKLAEAI

SEQ ID NO: 44181 - protein, 10 aa, Dengue virus
RHKKLAEAIF

SEQ ID NO: 44182 - protein, 10 aa, Dengue virus
HKKLAEAIFR

SEQ ID NO: 44183 - protein, 10 aa, Dengue virus
KKLAEAIFRL

SEQ ID NO: 44184 - protein, 10 aa, Dengue virus
KLAEAIFRLT

SEQ ID NO: 44185 - protein, 10 aa, Dengue virus
RDQRGSGQVV

SEQ ID NO: 44186 - protein, 10 aa, Dengue virus
LIRQMEGEGL

SEQ ID NO: 44187 - protein, 10 aa, Dengue virus
IRQMEGEGLF

SEQ ID NO: 44188 - protein, 10 aa, Dengue virus
RQMEGEGLFK

SEQ ID NO: 44189 - protein, 10 aa, Dengue virus
RVGRERLTRM

SEQ ID NO: 44190 - protein, 10 aa, Dengue virus
VGRERLTRMA

SEQ ID NO: 44191 - protein, 10 aa, Dengue virus
GRERLTRMAI

SEQ ID NO: 44192 - protein, 10 aa, Dengue virus
RERLTRMAIS

SEQ ID NO: 44193 - protein, 10 aa, Dengue virus
ERLTRMAISG

SEQ ID NO: 44194 - protein, 10 aa, Dengue virus
RLTRMAISGD

SEQ ID NO: 44195 - protein, 10 aa, Dengue virus
LTRMAISGDD

SEQ ID NO: 44196 - protein, 10 aa, Dengue virus
TRMAISGDDC

SEQ ID NO: 44197 - protein, 10 aa, Dengue virus
DDRFARALTA

SEQ ID NO: 44198 - protein, 10 aa, Dengue virus
DRFARALTAL

SEQ ID NO: 44199 - protein, 10 aa, Dengue virus
RFARALTALN

SEQ ID NO: 44200 - protein, 10 aa, Dengue virus
FARALTALND

SEQ ID NO: 44201 - protein, 10 aa, Dengue virus
ARALTALNDM

SEQ ID NO: 44202 - protein, 10 aa, Dengue virus
RALTALNDMG

SEQ ID NO: 44203 - protein, 10 aa, Dengue virus
QQWEPSKGWS

SEQ ID NO: 44204 - protein, 10 aa, Dengue virus
QWEPSKGWSD

SEQ ID NO: 44205 - protein, 10 aa, Dengue virus
WEPSKGWSDW

SEQ ID NO: 44206 - protein, 10 aa, Dengue virus
EPSKGWSDWT

SEQ ID NO: 44207 - protein, 10 aa, Dengue virus
PSKGWSDWTQ

SEQ ID NO: 44208 - protein, 10 aa, Dengue virus
SKGWSDWTQV

SEQ ID NO: 44209 - protein, 10 aa, Dengue virus
KGWSDWTQVP

SEQ ID NO: 44210 - protein, 10 aa, Dengue virus
MKDGRILVVP

SEQ ID NO: 44211 - protein, 10 aa, Dengue virus
KDGRILVVPC

SEQ ID NO: 44212 - protein, 10 aa, Dengue virus
DGRILVVPCR

SEQ ID NO: 44213 - protein, 10 aa, Dengue virus
SRTTWSIHAS

SEQ ID NO: 44214 - protein, 10 aa, Dengue virus
RTTWSIHASH

SEQ ID NO: 44215 - protein, 10 aa, Dengue virus
TTWSIHASHE

SEQ ID NO: 44216 - protein, 10 aa, Dengue virus
TWSIHASHEW

SEQ ID NO: 44217 - protein, 10 aa, Dengue virus
WSIHASHEWM

SEQ ID NO: 44218 - protein, 10 aa, Dengue virus
SIHASHEWMT

SEQ ID NO: 44219 - protein, 10 aa, Dengue virus
IHASHEWMTT

SEQ ID NO: 44220 - protein, 10 aa, Dengue virus
HASHEWMTTE

SEQ ID NO: 44221 - protein, 10 aa, Dengue virus
ASHEWMTTED

SEQ ID NO: 44222 - protein, 10 aa, Dengue virus
SHEWMTTEDM

SEQ ID NO: 44223 - protein, 10 aa, Dengue virus
TEDMLTVWNK

SEQ ID NO: 44224 - protein, 10 aa, Dengue virus
EDMLTVWNKV

SEQ ID NO: 44225 - protein, 10 aa, Dengue virus
DMLTVWNKVW

SEQ ID NO: 44226 - protein, 10 aa, Dengue virus
MLTVWNKVWI

SEQ ID NO: 44227 - protein, 10 aa, Dengue virus
LTVWNRVWIR

SEQ ID NO: 44228 - protein, 10 aa, Dengue virus
VWNRVWILEN

SEQ ID NO: 44229 - protein, 10 aa, Dengue virus
WNRVWILENP

SEQ ID NO: 44230 - protein, 10 aa, Dengue virus
NRVWILENPW

SEQ ID NO: 44231 - protein, 10 aa, Dengue virus
VWILENPWME

SEQ ID NO: 44232 - protein, 10 aa, Dengue virus
WILENPWMED

SEQ ID NO: 44233 - protein, 10 aa, Dengue virus
ILENPWMEDK

SEQ ID NO: 44234 - protein, 10 aa, Dengue virus
LENPWMEDKT

SEQ ID NO: 44235 - protein, 10 aa, Dengue virus
DNPWMEDKTP

SEQ ID NO: 44236 - protein, 10 aa, Dengue virus
WMEDKTPVET

SEQ ID NO: 44237 - protein, 10 aa, Dengue virus
MEDKTPVETW

SEQ ID NO: 44238 - protein, 10 aa, Dengue virus
EEKTPVESWE

SEQ ID NO: 44239 - protein, 10 aa, Dengue virus
DKTPVETWEE

SEQ ID NO: 44240 - protein, 10 aa, Dengue virus
KTPVESWEDI

SEQ ID NO: 44241 - protein, 10 aa, Dengue virus
TPVESWEDIP

SEQ ID NO: 44242 - protein, 10 aa, Dengue virus
PVESWEDIPY

SEQ ID NO: 44243 - protein, 10 aa, Dengue virus
VESWEDIPYL

SEQ ID NO: 44244 - protein, 10 aa, Dengue virus
ESWEDIPYLG

SEQ ID NO: 44245 - protein, 10 aa, Dengue virus
SWEDIPYLGK

SEQ ID NO: 44246 - protein, 10 aa, Dengue virus
WEDIPYLGKR

SEQ ID NO: 44247 - protein, 10 aa, Dengue virus
EDIPYLGKRE

SEQ ID NO: 44248 - protein, 10 aa, Dengue virus
DIPYLGKRED

SEQ ID NO: 44249 - protein, 10 aa, Dengue virus
RATWAKNIQV

SEQ ID NO: 44250 - protein, 10 aa, Dengue virus
ATWAKNIQVA

SEQ ID NO: 44251 - protein, 10 aa, Dengue virus
TWAKNIQVAI

SEQ ID NO: 44252 - protein, 10 aa, Dengue virus
WAKNIQVAIN

SEQ ID NO: 44253 - protein, 10 aa, Dengue virus
AKNIQVAINQ

SEQ ID NO: 44254 - protein, 10 aa, Dengue virus
KNIQVAINQV

SEQ ID NO: 44255 - protein, 10 aa, Dengue virus
NIQVAINQVR

SEQ ID NO: 44256 - protein, 10 aa, Dengue virus
IQVAINQVRS

SEQ ID NO: 44257 - protein, 10 aa, Dengue virus
QVAINQVRSL

SEQ ID NO: 44258 - protein, 10 aa, Dengue virus
VAINQVRSLI

SEQ ID NO: 44259 - protein, 10 aa, Dengue virus
AINQVRSLMG

SEQ ID NO: 44260 - protein, 10 aa, Dengue virus
INQVRSLMGN

SEQ ID NO: 44261 - protein, 10 aa, Dengue virus
NQVRSLMGNE

SEQ ID NO: 44262 - protein, 10 aa, Dengue virus
QVRSLMGNEG

SEQ ID NO: 44263 - protein, 10 aa, Dengue virus
VRSLMGNEGY

SEQ ID NO: 44264 - protein, 10 aa, Dengue virus
EEYIDYMPSM

SEQ ID NO: 44265 - protein, 10 aa, Dengue virus
EYIDYMPSMK

SEQ ID NO: 44266 - protein, 10 aa, Dengue virus
YMPSMKRFRS

SEQ ID NO: 44267 - protein, 10 aa, Dengue virus
MPSMKRFRSE

SEQ ID NO: 44268 - protein, 10 aa, Dengue virus
PSMKRFRSEE

SEQ ID NO: 44269 - protein, 10 aa, Dengue virus
SMKRFRSEEE

SEQ ID NO: 44270 - protein, 10 aa, Dengue virus
MKRFRSEEEE

SEQ ID NO: 44271 - protein, 10 aa, Dengue virus
KRFRSEEEES

SEQ ID NO: 44272 - protein, 10 aa, Dengue virus
RFRSEEEESG

SEQ ID NO: 44273 - protein, 10 aa, Dengue virus
FRSEEEESGV

SEQ ID NO: 44274 - protein, 10 aa, Dengue virus
RSEEEESGVL

SEQ ID NO: 44275 - protein, 10 aa, Dengue virus
SEEEESGVLW

SEQ ID NO: 44276 - protein, 10 aa, Dengue virus
MNNQRKKAKT

SEQ ID NO: 44277 - protein, 10 aa, Dengue virus
TGILKRWGTI

SEQ ID NO: 44278 - protein, 10 aa, Dengue virus
GAIKKSKAIN

SEQ ID NO: 44279 - protein, 10 aa, Dengue virus
TIKKSRAINV

SEQ ID NO: 44280 - protein, 10 aa, Dengue virus
IKKSRAINVL

SEQ ID NO: 44281 - protein, 10 aa, Dengue virus
KKSRAINVLR

SEQ ID NO: 44282 - protein, 10 aa, Dengue virus
KSRAINVLRG

SEQ ID NO: 44283 - protein, 10 aa, Dengue virus
NILNRRRRSV

SEQ ID NO: 44284 - protein, 10 aa, Dengue virus
ILNRRRRSVG

SEQ ID NO: 44285 - protein, 10 aa, Dengue virus
IPTAIAFHLT

SEQ ID NO: 44286 - protein, 10 aa, Dengue virus
PTAIAFHLTT

SEQ ID NO: 44287 - protein, 10 aa, Dengue virus
TAIAFHLTTR

SEQ ID NO: 44288 - protein, 10 aa, Dengue virus
AIAFHLTTRN

SEQ ID NO: 44289 - protein, 10 aa, Dengue virus
NGEPHMIVSI

SEQ ID NO: 44290 - protein, 10 aa, Dengue virus
GEPHMIVSIQ

SEQ ID NO: 44291 - protein, 10 aa, Dengue virus
EPHMIVSIQE

SEQ ID NO: 44292 - protein, 10 aa, Dengue virus
PHMIVSIQEK

SEQ ID NO: 44293 - protein, 10 aa, Dengue virus
HMIVSIQEKG

SEQ ID NO: 44294 - protein, 10 aa, Dengue virus
MIVSIQEKGK

SEQ ID NO: 44295 - protein, 10 aa, Dengue virus
IVSIQEKGKS

SEQ ID NO: 44296 - protein, 10 aa, Dengue virus
VSIQEKGKSL

SEQ ID NO: 44297 - protein, 10 aa, Dengue virus
SIQEKGKSLL

SEQ ID NO: 44298 - protein, 10 aa, Dengue virus
GKSLLFKTEV

SEQ ID NO: 44299 - protein, 10 aa, Dengue virus
KSLLFKTEVG

SEQ ID NO: 44300 - protein, 10 aa, Dengue virus
NGINMCTLMA

SEQ ID NO: 44301 - protein, 10 aa, Dengue virus
GINMCTLMAM

SEQ ID NO: 44302 - protein, 10 aa, Dengue virus
INMCTLMAMD

SEQ ID NO: 44303 - protein, 10 aa, Dengue virus
EDTVTYKCPF

SEQ ID NO: 44304 - protein, 10 aa, Dengue virus
DTVTYKCPFL

SEQ ID NO: 44305 - protein, 10 aa, Dengue virus
TYKCPLLKQN

SEQ ID NO: 44306 - protein, 10 aa, Dengue virus
YKCPLLKQNE

SEQ ID NO: 44307 - protein, 10 aa, Dengue virus
KCPLLKQNEP

SEQ ID NO: 44308 - protein, 10 aa, Dengue virus
STWITYGTCT

SEQ ID NO: 44309 - protein, 10 aa, Dengue virus
STGEHRREKR

SEQ ID NO: 44310 - protein, 10 aa, Dengue virus
KQAQRIETWI

SEQ ID NO: 44311 - protein, 10 aa, Dengue virus
QAQRIETWIL

SEQ ID NO: 44312 - protein, 10 aa, Dengue virus
LRHPGFAIMA

SEQ ID NO: 44313 - protein, 10 aa, Dengue virus
RHPGFAIMAA

SEQ ID NO: 44314 - protein, 10 aa, Dengue virus
VLAYTIGTTH

SEQ ID NO: 44315 - protein, 10 aa, Dengue virus
YTIGTTHFQK

SEQ ID NO: 44316 - protein, 10 aa, Dengue virus
GTTHFQRTLI

SEQ ID NO: 44317 - protein, 10 aa, Dengue virus
TTHFQRTLIF

SEQ ID NO: 44318 - protein, 10 aa, Dengue virus
THFQRTLIFI

SEQ ID NO: 44319 - protein, 10 aa, Dengue virus
HFQRTLIFIL

SEQ ID NO: 44320 - protein, 10 aa, Dengue virus
FQKALIFILL

SEQ ID NO: 44321 - protein, 10 aa, Dengue virus
QRTLIFILLT

SEQ ID NO: 44322 - protein, 10 aa, Dengue virus
LIFILLTAVT

SEQ ID NO: 44323 - protein, 10 aa, Dengue virus
IFILLTAVTP

SEQ ID NO: 44324 - protein, 10 aa, Dengue virus
FILLTAVTPS

SEQ ID NO: 44325 - protein, 10 aa, Dengue virus
ILLTAVTPSM

SEQ ID NO: 44326 - protein, 10 aa, Dengue virus
LLTAVTPSMT

SEQ ID NO: 44327 - protein, 10 aa, Dengue virus
LTAIAPSMTM

SEQ ID NO: 44328 - protein, 10 aa, Dengue virus
TAIAPSMTMR

SEQ ID NO: 44329 - protein, 10 aa, Dengue virus
AIAPSMAMRC

SEQ ID NO: 44330 - protein, 10 aa, Dengue virus
FELIKTEAKE

SEQ ID NO: 44331 - protein, 10 aa, Dengue virus
KTEAKQSATL

SEQ ID NO: 44332 - protein, 10 aa, Dengue virus
TEAKQLATLR

SEQ ID NO: 44333 - protein, 10 aa, Dengue virus
EAKQSATLRK

SEQ ID NO: 44334 - protein, 10 aa, Dengue virus
AKEPATLRKY

SEQ ID NO: 44335 - protein, 10 aa, Dengue virus
KEPATLRKYC

SEQ ID NO: 44336 - protein, 10 aa, Dengue virus
SATLRKYCIE

SEQ ID NO: 44337 - protein, 10 aa, Dengue virus
TLRKYCIEAR

SEQ ID NO: 44338 - protein, 10 aa, Dengue virus
CPTQGEPSLV

SEQ ID NO: 44339 - protein, 10 aa, Dengue virus
PTQGEPSLSE

SEQ ID NO: 44340 - protein, 10 aa, Dengue virus
TQGEPSLSEE

SEQ ID NO: 44341 - protein, 10 aa, Dengue virus
QGEPSLVEEQ

SEQ ID NO: 44342 - protein, 10 aa, Dengue virus
GEPSLVEEQD

SEQ ID NO: 44343 - protein, 10 aa, Dengue virus
EPSLSEEQDK

SEQ ID NO: 44344 - protein, 10 aa, Dengue virus
PSLSEEQDKR

SEQ ID NO: 44345 - protein, 10 aa, Dengue virus
SLVEEQDKRF

SEQ ID NO: 44346 - protein, 10 aa, Dengue virus
EEQDKRFLCK

SEQ ID NO: 44347 - protein, 10 aa, Dengue virus
EQDKRFLCKH

SEQ ID NO: 44348 - protein, 10 aa, Dengue virus
QDKRFLCKHS

SEQ ID NO: 44349 - protein, 10 aa, Dengue virus
DKRFLCKHSM

SEQ ID NO: 44350 - protein, 10 aa, Dengue virus
KRFLCKHSMV

SEQ ID NO: 44351 - protein, 10 aa, Dengue virus
RFLCKHSMVD

SEQ ID NO: 44352 - protein, 10 aa, Dengue virus
FLCKHSMVDR

SEQ ID NO: 44353 - protein, 10 aa, Dengue virus
LCKHSMVDRG

SEQ ID NO: 44354 - protein, 10 aa, Dengue virus
GGIVTCAKFT

SEQ ID NO: 44355 - protein, 10 aa, Dengue virus
GIVTCAKFTC

SEQ ID NO: 44356 - protein, 10 aa, Dengue virus
IVTCAMFSCK

SEQ ID NO: 44357 - protein, 10 aa, Dengue virus
VTCAKFTCKK

SEQ ID NO: 44358 - protein, 10 aa, Dengue virus
TCAMFSCKKN

SEQ ID NO: 44359 - protein, 10 aa, Dengue virus
CAMFSCKKNM

SEQ ID NO: 44360 - protein, 10 aa, Dengue virus
AMFTCKKNMK

SEQ ID NO: 44361 - protein, 10 aa, Dengue virus
MFTCLKKMEG

SEQ ID NO: 44362 - protein, 10 aa, Dengue virus
FTCLKKMEGK

SEQ ID NO: 44363 - protein, 10 aa, Dengue virus
CLKKMEGKVV

SEQ ID NO: 44364 - protein, 10 aa, Dengue virus
KKNMKGKVVQ

SEQ ID NO: 44365 - protein, 10 aa, Dengue virus
KKMEGKVVQP

SEQ ID NO: 44366 - protein, 10 aa, Dengue virus
KMEGKVVQPE

SEQ ID NO: 44367 - protein, 10 aa, Dengue virus
MKGKVVQPEN

SEQ ID NO: 44368 - protein, 10 aa, Dengue virus
KGKVVQPENL

SEQ ID NO: 44369 - protein, 10 aa, Dengue virus
VVTPHSGEEN

SEQ ID NO: 44370 - protein, 10 aa, Dengue virus
VTPHSGEENA

SEQ ID NO: 44371 - protein, 10 aa, Dengue virus
HSGEEHSVGN

SEQ ID NO: 44372 - protein, 10 aa, Dengue virus
SGEEYAVGND

SEQ ID NO: 44373 - protein, 10 aa, Dengue virus
GEEYAVGNDT

SEQ ID NO: 44374 - protein, 10 aa, Dengue virus
EEHSVGNDTG

SEQ ID NO: 44375 - protein, 10 aa, Dengue virus
EYAVGNDTGK

SEQ ID NO: 44376 - protein, 10 aa, Dengue virus
YAVGNDTGKH

SEQ ID NO: 44377 - protein, 10 aa, Dengue virus
VGDDTGKHGK

SEQ ID NO: 44378 - protein, 10 aa, Dengue virus
GDDTGKHGKE

SEQ ID NO: 44379 - protein, 10 aa, Dengue virus
NDTGKHGMEI

SEQ ID NO: 44380 - protein, 10 aa, Dengue virus
DTGKHGMEIK

SEQ ID NO: 44381 - protein, 10 aa, Dengue virus
TGKHGKEVKI

SEQ ID NO: 44382 - protein, 10 aa, Dengue virus
GKHGKEVKIT

SEQ ID NO: 44383 - protein, 10 aa, Dengue virus
KHGKEVKITP

SEQ ID NO: 44384 - protein, 10 aa, Dengue virus
HGKEVKITPQ

SEQ ID NO: 44385 - protein, 10 aa, Dengue virus
GKEVKITPQS

SEQ ID NO: 44386 - protein, 10 aa, Dengue virus
SEAELTDYGT

SEQ ID NO: 44387 - protein, 10 aa, Dengue virus
MESKAWLVHR

SEQ ID NO: 44388 - protein, 10 aa, Dengue virus
ESKAWLVHRQ

SEQ ID NO: 44389 - protein, 10 aa, Dengue virus
SKAWLVHRQW

SEQ ID NO: 44390 - protein, 10 aa, Dengue virus
PWLPGADTQE

SEQ ID NO: 44391 - protein, 10 aa, Dengue virus
WLPGADTQES

SEQ ID NO: 44392 - protein, 10 aa, Dengue virus
LPGADTQESN

SEQ ID NO: 44393 - protein, 10 aa, Dengue virus
PGADTQESNW

SEQ ID NO: 44394 - protein, 10 aa, Dengue virus
GADTQESNWI

SEQ ID NO: 44395 - protein, 10 aa, Dengue virus
ADTQESNWIQ

SEQ ID NO: 44396 - protein, 10 aa, Dengue virus
DTQESNWIQK

SEQ ID NO: 44397 - protein, 10 aa, Dengue virus
TQESNWIQKE

SEQ ID NO: 44398 - protein, 10 aa, Dengue virus
QGLNWIQKET

SEQ ID NO: 44399 - protein, 10 aa, Dengue virus
ESNWIQKEML

SEQ ID NO: 44400 - protein, 10 aa, Dengue virus
IVIRVQYEGE

SEQ ID NO: 44401 - protein, 10 aa, Dengue virus
VVRVQYEGDG

SEQ ID NO: 44402 - protein, 10 aa, Dengue virus
VRVQYEGDGS

SEQ ID NO: 44403 - protein, 10 aa, Dengue virus
RVQYEGEDSP

SEQ ID NO: 44404 - protein, 10 aa, Dengue virus
LQYEGDGSPC

SEQ ID NO: 44405 - protein, 10 aa, Dengue virus
YEGDGSPCKV

SEQ ID NO: 44406 - protein, 10 aa, Dengue virus
EGDGSPCKVP

SEQ ID NO: 44407 - protein, 10 aa, Dengue virus
GDGSPCKVPF

SEQ ID NO: 44408 - protein, 10 aa, Dengue virus
DGSPCKVPFE

SEQ ID NO: 44409 - protein, 10 aa, Dengue virus
GSPCKVPFEI

SEQ ID NO: 44410 - protein, 10 aa, Dengue virus
SPCKVPFEIM

SEQ ID NO: 44411 - protein, 10 aa, Dengue virus
PCKVPFEIMD

SEQ ID NO: 44412 - protein, 10 aa, Dengue virus
CKVPFEIMDL

SEQ ID NO: 44413 - protein, 10 aa, Dengue virus
KVPFEIMDLE

SEQ ID NO: 44414 - protein, 10 aa, Dengue virus
IPFEIMDLER

SEQ ID NO: 44415 - protein, 10 aa, Dengue virus
PFEIMDLERR

SEQ ID NO: 44416 - protein, 10 aa, Dengue virus
FEIMDLEKKH

SEQ ID NO: 44417 - protein, 10 aa, Dengue virus
DLERRYVLGR

SEQ ID NO: 44418 - protein, 10 aa, Dengue virus
LERRYVLGRL

SEQ ID NO: 44419 - protein, 10 aa, Dengue virus
ERRYVLGRLI

SEQ ID NO: 44420 - protein, 10 aa, Dengue virus
RRYVLGRLIT

SEQ ID NO: 44421 - protein, 10 aa, Dengue virus
RYILGRLITV

SEQ ID NO: 44422 - protein, 10 aa, Dengue virus
RLITVNPIIT

SEQ ID NO: 44423 - protein, 10 aa, Dengue virus
EKDNPINIEA

SEQ ID NO: 44424 - protein, 10 aa, Dengue virus
GSLGGAFTSI

SEQ ID NO: 44425 - protein, 10 aa, Dengue virus
SLGGAFTSIG

SEQ ID NO: 44426 - protein, 10 aa, Dengue virus
LGGAFTSIGK

SEQ ID NO: 44427 - protein, 10 aa, Dengue virus
AAFNGVSWTM

SEQ ID NO: 44428 - protein, 10 aa, Dengue virus
SWTMKIFIGV

SEQ ID NO: 44429 - protein, 10 aa, Dengue virus
WIMKILIGVI

SEQ ID NO: 44430 - protein, 10 aa, Dengue virus
IMKILIGVII

SEQ ID NO: 44431 - protein, 10 aa, Dengue virus
MKIFIGVIIT

SEQ ID NO: 44432 - protein, 10 aa, Dengue virus
LSVTLVIVGI

SEQ ID NO: 44433 - protein, 10 aa, Dengue virus
SVTLVLVGIV

SEQ ID NO: 44434 - protein, 10 aa, Dengue virus
LVLVGVVILY

SEQ ID NO: 44435 - protein, 10 aa, Dengue virus
VLVGVVILYL

SEQ ID NO: 44436 - protein, 10 aa, Dengue virus
LVGVVILYLG

SEQ ID NO: 44437 - protein, 10 aa, Dengue virus
VGVITLYLGA

SEQ ID NO: 44438 - protein, 10 aa, Dengue virus
ITLYLGAMVQ

SEQ ID NO: 44439 - protein, 10 aa, Dengue virus
YLGVMVQADT

SEQ ID NO: 44440 - protein, 10 aa, Dengue virus
LGVMVQADTG

SEQ ID NO: 44441 - protein, 10 aa, Dengue virus
GVMVQADTGC

SEQ ID NO: 44442 - protein, 10 aa, Dengue virus
VMVQADTGCV

SEQ ID NO: 44443 - protein, 10 aa, Dengue virus
MVQADSGCIV

SEQ ID NO: 44444 - protein, 10 aa, Dengue virus
DSGCIVSWKN

SEQ ID NO: 44445 - protein, 10 aa, Dengue virus
SGCIVSWKNK

SEQ ID NO: 44446 - protein, 10 aa, Dengue virus
SAIQKAHEDG

SEQ ID NO: 44447 - protein, 10 aa, Dengue virus
AIQKAHEDGI

SEQ ID NO: 44448 - protein, 10 aa, Dengue virus
IQKAHEDGIC

SEQ ID NO: 44449 - protein, 10 aa, Dengue virus
QKAYEEGICG

SEQ ID NO: 44450 - protein, 10 aa, Dengue virus
KAYEEGICGI

SEQ ID NO: 44451 - protein, 10 aa, Dengue virus
AHEDGICGIR

SEQ ID NO: 44452 - protein, 10 aa, Dengue virus
HEDGICGIRS

SEQ ID NO: 44453 - protein, 10 aa, Dengue virus
ITPELNHILT

SEQ ID NO: 44454 - protein, 10 aa, Dengue virus
HILSENEVKM

SEQ ID NO: 44455 - protein, 10 aa, Dengue virus
ILSENEVKMT

SEQ ID NO: 44456 - protein, 10 aa, Dengue virus
LSENEVKMTI

SEQ ID NO: 44457 - protein, 10 aa, Dengue virus
SENEVKMTIM

SEQ ID NO: 44458 - protein, 10 aa, Dengue virus
EVKMTIMTGD

SEQ ID NO: 44459 - protein, 10 aa, Dengue virus
AKLTIMTGDI

SEQ ID NO: 44460 - protein, 10 aa, Dengue virus
KLTIMTGEIK

SEQ ID NO: 44461 - protein, 10 aa, Dengue virus
LTIMTGEIKG

SEQ ID NO: 44462 - protein, 10 aa, Dengue virus
TIMTGEIKGI

SEQ ID NO: 44463 - protein, 10 aa, Dengue virus
IMTGEIKGIM

SEQ ID NO: 44464 - protein, 10 aa, Dengue virus
MTGEIKGIMQ

SEQ ID NO: 44465 - protein, 10 aa, Dengue virus
GIMQAGKRYL

SEQ ID NO: 44466 - protein, 10 aa, Dengue virus
GKRYLRPQPT

SEQ ID NO: 44467 - protein, 10 aa, Dengue virus
RYLRPQPTEL

SEQ ID NO: 44468 - protein, 10 aa, Dengue virus
LQPQPTELKY

SEQ ID NO: 44469 - protein, 10 aa, Dengue virus
QPQPTELKYS

SEQ ID NO: 44470 - protein, 10 aa, Dengue virus
PTQLKYSWKT

SEQ ID NO: 44471 - protein, 10 aa, Dengue virus
TQLKYSWKTW

SEQ ID NO: 44472 - protein, 10 aa, Dengue virus
WKTWGKAKIL

SEQ ID NO: 44473 - protein, 10 aa, Dengue virus
WGKAKILSTE

SEQ ID NO: 44474 - protein, 10 aa, Dengue virus
QNQTFLIDGP

SEQ ID NO: 44475 - protein, 10 aa, Dengue virus
TVECPNTNRA

SEQ ID NO: 44476 - protein, 10 aa, Dengue virus
VECPNTNRAW

SEQ ID NO: 44477 - protein, 10 aa, Dengue virus
GIFTTNIWLK

SEQ ID NO: 44478 - protein, 10 aa, Dengue virus
IFTTNIWLKL

SEQ ID NO: 44479 - protein, 10 aa, Dengue virus
FTTNIWLRLR

SEQ ID NO: 44480 - protein, 10 aa, Dengue virus
TTNIWLRLRE

SEQ ID NO: 44481 - protein, 10 aa, Dengue virus
TNIWLRLREK

SEQ ID NO: 44482 - protein, 10 aa, Dengue virus
NIWLRLREKQ

SEQ ID NO: 44483 - protein, 10 aa, Dengue virus
IWLRLREKQD

SEQ ID NO: 44484 - protein, 10 aa, Dengue virus
SCDSKLMSAA

SEQ ID NO: 44485 - protein, 10 aa, Dengue virus
KLMSAAIKNN

SEQ ID NO: 44486 - protein, 10 aa, Dengue virus
LMSAAIKNNR

SEQ ID NO: 44487 - protein, 10 aa, Dengue virus
MSAAIKNNRA

SEQ ID NO: 44488 - protein, 10 aa, Dengue virus
SAAIKNNRAV

SEQ ID NO: 44489 - protein, 10 aa, Dengue virus
AAIKNNRAVH

SEQ ID NO: 44490 - protein, 10 aa, Dengue virus
AIKNNRAVHA

SEQ ID NO: 44491 - protein, 10 aa, Dengue virus
IKNNRAVHAD

SEQ ID NO: 44492 - protein, 10 aa, Dengue virus
ALNDTWKMER

SEQ ID NO: 44493 - protein, 10 aa, Dengue virus
ASFIEVKSCY

SEQ ID NO: 44494 - protein, 10 aa, Dengue virus
SFIEVKSCYW

SEQ ID NO: 44495 - protein, 10 aa, Dengue virus
FIEVKSCYWP

SEQ ID NO: 44496 - protein, 10 aa, Dengue virus
IEVKSCYWPR

SEQ ID NO: 44497 - protein, 10 aa, Dengue virus
EVKSCYWPRS

SEQ ID NO: 44498 - protein, 10 aa, Dengue virus
VKSCYWPRSH

SEQ ID NO: 44499 - protein, 10 aa, Dengue virus
KSCHWPRSHT

SEQ ID NO: 44500 - protein, 10 aa, Dengue virus
SCHWPRSHTL

SEQ ID NO: 44501 - protein, 10 aa, Dengue virus
IPKNIAGPVS

SEQ ID NO: 44502 - protein, 10 aa, Dengue virus
PKNIAGPVSQ

SEQ ID NO: 44503 - protein, 10 aa, Dengue virus
KNIAGPVSQH

SEQ ID NO: 44504 - protein, 10 aa, Dengue virus
NIAGPVSQHN

SEQ ID NO: 44505 - protein, 10 aa, Dengue virus
FAGPVSQHNH

SEQ ID NO: 44506 - protein, 10 aa, Dengue virus
SQHNYRLGYH

SEQ ID NO: 44507 - protein, 10 aa, Dengue virus
QHNYRLGYHT

SEQ ID NO: 44508 - protein, 10 aa, Dengue virus
HNYRLGYHTQ

SEQ ID NO: 44509 - protein, 10 aa, Dengue virus
RPGYHTQITG

SEQ ID NO: 44510 - protein, 10 aa, Dengue virus
PGYHTQITGP

SEQ ID NO: 44511 - protein, 10 aa, Dengue virus
GYHTQITGPW

SEQ ID NO: 44512 - protein, 10 aa, Dengue virus
YHTQITGPWH

SEQ ID NO: 44513 - protein, 10 aa, Dengue virus
HTQITGPWHL

SEQ ID NO: 44514 - protein, 10 aa, Dengue virus
QITGPWHLGK

SEQ ID NO: 44515 - protein, 10 aa, Dengue virus
ITGPWHLGKL

SEQ ID NO: 44516 - protein, 10 aa, Dengue virus
HLGKLEMDFN

SEQ ID NO: 44517 - protein, 10 aa, Dengue virus
LGKLEMDFEF

SEQ ID NO: 44518 - protein, 10 aa, Dengue virus
GKLEMDFEFC

SEQ ID NO: 44519 - protein, 10 aa, Dengue virus
LEMDFEFCEG

SEQ ID NO: 44520 - protein, 10 aa, Dengue virus
EMDFEFCEGT

SEQ ID NO: 44521 - protein, 10 aa, Dengue virus
MDFEFCEGTT

SEQ ID NO: 44522 - protein, 10 aa, Dengue virus
DFEFCEGTTV

SEQ ID NO: 44523 - protein, 10 aa, Dengue virus
FCDGTTVVVT

SEQ ID NO: 44524 - protein, 10 aa, Dengue virus
EGTTVVVTEE

SEQ ID NO: 44525 - protein, 10 aa, Dengue virus
GTTVVVTENC

SEQ ID NO: 44526 - protein, 10 aa, Dengue virus
TTVVVTENCG

SEQ ID NO: 44527 - protein, 10 aa, Dengue virus
TVVVTENCGN

SEQ ID NO: 44528 - protein, 10 aa, Dengue virus
VVVTENCGNR

SEQ ID NO: 44529 - protein, 10 aa, Dengue virus
VVTENCGNRG

SEQ ID NO: 44530 - protein, 10 aa, Dengue virus
SLGVLGMALL

SEQ ID NO: 44531 - protein, 10 aa, Dengue virus
LGVLGMALLL

SEQ ID NO: 44532 - protein, 10 aa, Dengue virus
GVLGMALLLE

SEQ ID NO: 44533 - protein, 10 aa, Dengue virus
VLGMALLLEE

SEQ ID NO: 44534 - protein, 10 aa, Dengue virus
FLEEMLKTRV

SEQ ID NO: 44535 - protein, 10 aa, Dengue virus
LRTRVGTKHV

SEQ ID NO: 44536 - protein, 10 aa, Dengue virus
SFLTLITGNM

SEQ ID NO: 44537 - protein, 10 aa, Dengue virus
FLTLITGNMS

SEQ ID NO: 44538 - protein, 10 aa, Dengue virus
VTLITGNLSF

SEQ ID NO: 44539 - protein, 10 aa, Dengue virus
RDLGRVVVMV

SEQ ID NO: 44540 - protein, 10 aa, Dengue virus
LGRVVVMVGT

SEQ ID NO: 44541 - protein, 10 aa, Dengue virus
TDDIGMGITY

SEQ ID NO: 44542 - protein, 10 aa, Dengue virus
DDIGIGVTYL

SEQ ID NO: 44543 - protein, 10 aa, Dengue virus
DIGIGVTYLA

SEQ ID NO: 44544 - protein, 10 aa, Dengue virus
IGIGVTYLAL

SEQ ID NO: 44545 - protein, 10 aa, Dengue virus
AAYKVRPTFA

SEQ ID NO: 44546 - protein, 10 aa, Dengue virus
AYKVRPTFAA

SEQ ID NO: 44547 - protein, 10 aa, Dengue virus
FKVRPTFVAG

SEQ ID NO: 44548 - protein, 10 aa, Dengue virus
KVRPTFVAGL

SEQ ID NO: 44549 - protein, 10 aa, Dengue virus
VRPTFVAGLL

SEQ ID NO: 44550 - protein, 10 aa, Dengue virus
PTFAAGLLLK

SEQ ID NO: 44551 - protein, 10 aa, Dengue virus
TFAAGLLLKK

SEQ ID NO: 44552 - protein, 10 aa, Dengue virus
FAAGLLLKKL

SEQ ID NO: 44553 - protein, 10 aa, Dengue virus
AAGLLLKKLT

SEQ ID NO: 44554 - protein, 10 aa, Dengue virus
KELMMATIGV

SEQ ID NO: 44555 - protein, 10 aa, Dengue virus
TIGVVLLSQS

SEQ ID NO: 44556 - protein, 10 aa, Dengue virus
PESILELTDA

SEQ ID NO: 44557 - protein, 10 aa, Dengue virus
SILELTDALA

SEQ ID NO: 44558 - protein, 10 aa, Dengue virus
TDALALGMMI

SEQ ID NO: 44559 - protein, 10 aa, Dengue virus
DALALGMMIL

SEQ ID NO: 44560 - protein, 10 aa, Dengue virus
ALALGMMILK

SEQ ID NO: 44561 - protein, 10 aa, Dengue virus
SMEKYQLAVT

SEQ ID NO: 44562 - protein, 10 aa, Dengue virus
KYQLAVTIMV

SEQ ID NO: 44563 - protein, 10 aa, Dengue virus
ILCVPNAVVL

SEQ ID NO: 44564 - protein, 10 aa, Dengue virus
CVPNAVILLN

SEQ ID NO: 44565 - protein, 10 aa, Dengue virus
VPNAVILLNA

SEQ ID NO: 44566 - protein, 10 aa, Dengue virus
PNAVILLNAW

SEQ ID NO: 44567 - protein, 10 aa, Dengue virus
AWKVSCAILA

SEQ ID NO: 44568 - protein, 10 aa, Dengue virus
ILATVSVSPL

SEQ ID NO: 44569 - protein, 10 aa, Dengue virus
VSVFPLLLTS

SEQ ID NO: 44570 - protein, 10 aa, Dengue virus
SVFPLLLTSS

SEQ ID NO: 44571 - protein, 10 aa, Dengue virus
VSPLLLTSSR

SEQ ID NO: 44572 - protein, 10 aa, Dengue virus
SPLLLTSSRQ

SEQ ID NO: 44573 - protein, 10 aa, Dengue virus
PLLLTSSRQK

SEQ ID NO: 44574 - protein, 10 aa, Dengue virus
LTSSRQKADW

SEQ ID NO: 44575 - protein, 10 aa, Dengue virus
QQKTDWIPLV

SEQ ID NO: 44576 - protein, 10 aa, Dengue virus
IFLTTLTRTS

SEQ ID NO: 44577 - protein, 10 aa, Dengue virus
FLTTLTRTSK

SEQ ID NO: 44578 - protein, 10 aa, Dengue virus
LTTLSRPNKI

SEQ ID NO: 44579 - protein, 10 aa, Dengue virus
TTLSRPNKIR

SEQ ID NO: 44580 - protein, 10 aa, Dengue virus
TLSRPNKIRS

SEQ ID NO: 44581 - protein, 10 aa, Dengue virus
LSRPNKIRSW

SEQ ID NO: 44582 - protein, 10 aa, Dengue virus
SRPNKIRSWP

SEQ ID NO: 44583 - protein, 10 aa, Dengue virus
RPNKIRSWPL

SEQ ID NO: 44584 - protein, 10 aa, Dengue virus
PNKIRSWPLN

SEQ ID NO: 44585 - protein, 10 aa, Dengue virus
ADLELEKAAD

SEQ ID NO: 44586 - protein, 10 aa, Dengue virus
DLELEKAADV

SEQ ID NO: 44587 - protein, 10 aa, Dengue virus
VRWEDQAEIS

SEQ ID NO: 44588 - protein, 10 aa, Dengue virus
RWEDQAEISG

SEQ ID NO: 44589 - protein, 10 aa, Dengue virus
VISGLFPVSM

SEQ ID NO: 44590 - protein, 10 aa, Dengue virus
ISGLFPVSMP

SEQ ID NO: 44591 - protein, 10 aa, Dengue virus
SGLFPVSMPI

SEQ ID NO: 44592 - protein, 10 aa, Dengue virus
GLFPVSMPIT

SEQ ID NO: 44593 - protein, 10 aa, Dengue virus
LFPVSMPITA

SEQ ID NO: 44594 - protein, 10 aa, Dengue virus
WDVPSPPPIG

SEQ ID NO: 44595 - protein, 10 aa, Dengue virus
AYRIKQKGIF

SEQ ID NO: 44596 - protein, 10 aa, Dengue virus
YRIKQKGIFG

SEQ ID NO: 44597 - protein, 10 aa, Dengue virus
RIKQKGIFGY

SEQ ID NO: 44598 - protein, 10 aa, Dengue virus
IKQKGIFGYS

SEQ ID NO: 44599 - protein, 10 aa, Dengue virus
KQKGIFGYSQ

SEQ ID NO: 44600 - protein, 10 aa, Dengue virus
QKGIFGYSQI

SEQ ID NO: 44601 - protein, 10 aa, Dengue virus
KGIFGYSQIG

SEQ ID NO: 44602 - protein, 10 aa, Dengue virus
VTRGAVLTHK

SEQ ID NO: 44603 - protein, 10 aa, Dengue virus
TRGAVLTHKG

SEQ ID NO: 44604 - protein, 10 aa, Dengue virus
RGAVLTHKGK

SEQ ID NO: 44605 - protein, 10 aa, Dengue virus
GAVLTHKGKR

SEQ ID NO: 44606 - protein, 10 aa, Dengue virus
AVLTHKGKRI

SEQ ID NO: 44607 - protein, 10 aa, Dengue virus
VLTHKGKRIE

SEQ ID NO: 44608 - protein, 10 aa, Dengue virus
LTHKGKRIEP

SEQ ID NO: 44609 - protein, 10 aa, Dengue virus
THKGKRIEPS

SEQ ID NO: 44610 - protein, 10 aa, Dengue virus
AVQTKPGIFR

SEQ ID NO: 44611 - protein, 10 aa, Dengue virus
VQTKPGIFRT

SEQ ID NO: 44612 - protein, 10 aa, Dengue virus
QTKPGLFKTS

SEQ ID NO: 44613 - protein, 10 aa, Dengue virus
FKTSTGTIGA

SEQ ID NO: 44614 - protein, 10 aa, Dengue virus
KTSTGTIGAV

SEQ ID NO: 44615 - protein, 10 aa, Dengue virus
VSAIAQTEKG

SEQ ID NO: 44616 - protein, 10 aa, Dengue virus
SAIAQTEKGI

SEQ ID NO: 44617 - protein, 10 aa, Dengue virus
AIAQTEKGIE

SEQ ID NO: 44618 - protein, 10 aa, Dengue virus
EDNPEIEDHI

SEQ ID NO: 44619 - protein, 10 aa, Dengue virus
NNPEIEDDIF

SEQ ID NO: 44620 - protein, 10 aa, Dengue virus
EIEDHIFRKR

SEQ ID NO: 44621 - protein, 10 aa, Dengue virus
IEDHIFRKRR

SEQ ID NO: 44622 - protein, 10 aa, Dengue virus
EDHIFRKRRL

SEQ ID NO: 44623 - protein, 10 aa, Dengue virus
DHIFRKRRLT

SEQ ID NO: 44624 - protein, 10 aa, Dengue virus
IRYQTTAIKT

SEQ ID NO: 44625 - protein, 10 aa, Dengue virus
RYQTTAIKTE

SEQ ID NO: 44626 - protein, 10 aa, Dengue virus
YQTTAIKTEH

SEQ ID NO: 44627 - protein, 10 aa, Dengue virus
QTTAIKTEHT

SEQ ID NO: 44628 - protein, 10 aa, Dengue virus
TTAIKTEHTG

SEQ ID NO: 44629 - protein, 10 aa, Dengue virus
TAIKTEHTGR

SEQ ID NO: 44630 - protein, 10 aa, Dengue virus
RSWNTGHEWV

SEQ ID NO: 44631 - protein, 10 aa, Dengue virus
SWNTGHEWVT

SEQ ID NO: 44632 - protein, 10 aa, Dengue virus
WNTGHEWVTD

SEQ ID NO: 44633 - protein, 10 aa, Dengue virus
NTGHEWVTDF

SEQ ID NO: 44634 - protein, 10 aa, Dengue virus
GHEWITNFEG

SEQ ID NO: 44635 - protein, 10 aa, Dengue virus
HEWITNFEGK

SEQ ID NO: 44636 - protein, 10 aa, Dengue virus
EWITDFKGKT

SEQ ID NO: 44637 - protein, 10 aa, Dengue virus
WITNFEGKTV

SEQ ID NO: 44638 - protein, 10 aa, Dengue virus
ITNFEGKTVW

SEQ ID NO: 44639 - protein, 10 aa, Dengue virus
SRKTFDSEYA

SEQ ID NO: 44640 - protein, 10 aa, Dengue virus
RKTFDSEYAK

SEQ ID NO: 44641 - protein, 10 aa, Dengue virus
KTFDTEYTKT

SEQ ID NO: 44642 - protein, 10 aa, Dengue virus
TFDTEYTKTR

SEQ ID NO: 44643 - protein, 10 aa, Dengue virus
PVWLAFKVAA

SEQ ID NO: 44644 - protein, 10 aa, Dengue virus
VWLAFKVAAE

SEQ ID NO: 44645 - protein, 10 aa, Dengue virus
WLAFKVAAEG

SEQ ID NO: 44646 - protein, 10 aa, Dengue virus
LAFKVAAEGI

SEQ ID NO: 44647 - protein, 10 aa, Dengue virus
AFKVAAEGIN

SEQ ID NO: 44648 - protein, 10 aa, Dengue virus
FKVAAEGINY

SEQ ID NO: 44649 - protein, 10 aa, Dengue virus
KVAAEGINYT

SEQ ID NO: 44650 - protein, 10 aa, Dengue virus
VASEGISYAD

SEQ ID NO: 44651 - protein, 10 aa, Dengue virus
ASEGISYADR

SEQ ID NO: 44652 - protein, 10 aa, Dengue virus
EGISYADRKW

SEQ ID NO: 44653 - protein, 10 aa, Dengue virus
GISYADRKWC

SEQ ID NO: 44654 - protein, 10 aa, Dengue virus
ISYADRKWCF

SEQ ID NO: 44655 - protein, 10 aa, Dengue virus
SYADRKWCFD

SEQ ID NO: 44656 - protein, 10 aa, Dengue virus
ADRRWCFDGT

SEQ ID NO: 44657 - protein, 10 aa, Dengue virus
DRRWCFDGTR

SEQ ID NO: 44658 - protein, 10 aa, Dengue virus
RRWCFDGTRN

SEQ ID NO: 44659 - protein, 10 aa, Dengue virus
RWCFDGTRNN

SEQ ID NO: 44660 - protein, 10 aa, Dengue virus
WCFDGTRNNQ

SEQ ID NO: 44661 - protein, 10 aa, Dengue virus
CFDGTRNNQI

SEQ ID NO: 44662 - protein, 10 aa, Dengue virus
FDGTRNNQIL

SEQ ID NO: 44663 - protein, 10 aa, Dengue virus
DGTRNNQILE

SEQ ID NO: 44664 - protein, 10 aa, Dengue virus
GTRNNQILEE

SEQ ID NO: 44665 - protein, 10 aa, Dengue virus
TRNNQILEEN

SEQ ID NO: 44666 - protein, 10 aa, Dengue virus
RNNQILEENM

SEQ ID NO: 44667 - protein, 10 aa, Dengue virus
EENIEVEIWT

SEQ ID NO: 44668 - protein, 10 aa, Dengue virus
ENIEVEIWTK

SEQ ID NO: 44669 - protein, 10 aa, Dengue virus
NIEVEIWTKE

SEQ ID NO: 44670 - protein, 10 aa, Dengue virus
IEVEIWTKEG

SEQ ID NO: 44671 - protein, 10 aa, Dengue virus
VLHTAEVGGK

SEQ ID NO: 44672 - protein, 10 aa, Dengue virus
LHTAEVGGKA

SEQ ID NO: 44673 - protein, 10 aa, Dengue virus
GGRAHNHALS

SEQ ID NO: 44674 - protein, 10 aa, Dengue virus
GRAYNHALNE

SEQ ID NO: 44675 - protein, 10 aa, Dengue virus
RAYNHALNEL

SEQ ID NO: 44676 - protein, 10 aa, Dengue virus
FLFLMSGRGV

SEQ ID NO: 44677 - protein, 10 aa, Dengue virus
LFLMSGRGVG

SEQ ID NO: 44678 - protein, 10 aa, Dengue virus
FLMSGRGVGK

SEQ ID NO: 44679 - protein, 10 aa, Dengue virus
LMSGRGVGKM

SEQ ID NO: 44680 - protein, 10 aa, Dengue virus
MSGRGVGKMT

SEQ ID NO: 44681 - protein, 10 aa, Dengue virus
SGRGVGKMTL

SEQ ID NO: 44682 - protein, 10 aa, Dengue virus
GRGVGKMTLG

SEQ ID NO: 44683 - protein, 10 aa, Dengue virus
RGVGKMTLGM

SEQ ID NO: 44684 - protein, 10 aa, Dengue virus
QPEINILDID

SEQ ID NO: 44685 - protein, 10 aa, Dengue virus
HESNILDIDL

SEQ ID NO: 44686 - protein, 10 aa, Dengue virus
PVTLTAALLL

SEQ ID NO: 44687 - protein, 10 aa, Dengue virus
VTLTAALLLL

SEQ ID NO: 44688 - protein, 10 aa, Dengue virus
TAALLSLVAH

SEQ ID NO: 44689 - protein, 10 aa, Dengue virus
VAHYAIIGPA

SEQ ID NO: 44690 - protein, 10 aa, Dengue virus
LFSIMRNTTS

SEQ ID NO: 44691 - protein, 10 aa, Dengue virus
RRGTGNVGET

SEQ ID NO: 44692 - protein, 10 aa, Dengue virus
RGTGNVGETL

SEQ ID NO: 44693 - protein, 10 aa, Dengue virus
GTGNVGETLG

SEQ ID NO: 44694 - protein, 10 aa, Dengue virus
TGNVGETLGE

SEQ ID NO: 44695 - protein, 10 aa, Dengue virus
GNVGETLGEK

SEQ ID NO: 44696 - protein, 10 aa, Dengue virus
NVGETLGEKW

SEQ ID NO: 44697 - protein, 10 aa, Dengue virus
VGETLGEKWK

SEQ ID NO: 44698 - protein, 10 aa, Dengue virus
GEKWKNRLNS

SEQ ID NO: 44699 - protein, 10 aa, Dengue virus
EKWKNRLNSL

SEQ ID NO: 44700 - protein, 10 aa, Dengue virus
KWKNRLNSLG

SEQ ID NO: 44701 - protein, 10 aa, Dengue virus
LNSLGKSEFQ

SEQ ID NO: 44702 - protein, 10 aa, Dengue virus
LGKNEFQIYK

SEQ ID NO: 44703 - protein, 10 aa, Dengue virus
GKSEFQTYKK

SEQ ID NO: 44704 - protein, 10 aa, Dengue virus
KSEFQTYKKS

SEQ ID NO: 44705 - protein, 10 aa, Dengue virus
NEFQIYKKSG

SEQ ID NO: 44706 - protein, 10 aa, Dengue virus
NMVAPEGKVV

SEQ ID NO: 44707 - protein, 10 aa, Dengue virus
MVAPEGKVVD

SEQ ID NO: 44708 - protein, 10 aa, Dengue virus
YYCGGLKSVR

SEQ ID NO: 44709 - protein, 10 aa, Dengue virus
YCGGLKSVRE

SEQ ID NO: 44710 - protein, 10 aa, Dengue virus
CGGLKSVREV

SEQ ID NO: 44711 - protein, 10 aa, Dengue virus
GGLKSVREVK

SEQ ID NO: 44712 - protein, 10 aa, Dengue virus
GLKSVREVKG

SEQ ID NO: 44713 - protein, 10 aa, Dengue virus
LKSVREVKGL

SEQ ID NO: 44714 - protein, 10 aa, Dengue virus
KSVREVKGLT

SEQ ID NO: 44715 - protein, 10 aa, Dengue virus
LQSGIDVFFT

SEQ ID NO: 44716 - protein, 10 aa, Dengue virus
QSGIDVFFTP

SEQ ID NO: 44717 - protein, 10 aa, Dengue virus
SGIDVFFTPP

SEQ ID NO: 44718 - protein, 10 aa, Dengue virus
GIDVFFTPPE

SEQ ID NO: 44719 - protein, 10 aa, Dengue virus
VDVFFTPPER

SEQ ID NO: 44720 - protein, 10 aa, Dengue virus
DVFFTPPERC

SEQ ID NO: 44721 - protein, 10 aa, Dengue virus
VFFTPPERCD

SEQ ID NO: 44722 - protein, 10 aa, Dengue virus
FFTPPERCDT

SEQ ID NO: 44723 - protein, 10 aa, Dengue virus
FTPPERCDTL

SEQ ID NO: 44724 - protein, 10 aa, Dengue virus
TPPERCDTLL

SEQ ID NO: 44725 - protein, 10 aa, Dengue virus
NLVESWLNNN

SEQ ID NO: 44726 - protein, 10 aa, Dengue virus
LVENWLNNNI

SEQ ID NO: 44727 - protein, 10 aa, Dengue virus
ENWLNNNIQF

SEQ ID NO: 44728 - protein, 10 aa, Dengue virus
NWLKNNTQFC

SEQ ID NO: 44729 - protein, 10 aa, Dengue virus
WLGSNTQFCV

SEQ ID NO: 44730 - protein, 10 aa, Dengue virus
LGSNTQFCVK

SEQ ID NO: 44731 - protein, 10 aa, Dengue virus
GSNTQFCVKV

SEQ ID NO: 44732 - protein, 10 aa, Dengue virus
SNTQFCVKVL

SEQ ID NO: 44733 - protein, 10 aa, Dengue virus
MPSVIERMEA

SEQ ID NO: 44734 - protein, 10 aa, Dengue virus
PSVIERMEAL

SEQ ID NO: 44735 - protein, 10 aa, Dengue virus
SVIERMEALQ

SEQ ID NO: 44736 - protein, 10 aa, Dengue virus
VIERMEALQR

SEQ ID NO: 44737 - protein, 10 aa, Dengue virus
LQRKHGGALV

SEQ ID NO: 44738 - protein, 10 aa, Dengue virus
QRRYGGALVR

SEQ ID NO: 44739 - protein, 10 aa, Dengue virus
MRHKRATYEP

SEQ ID NO: 44740 - protein, 10 aa, Dengue virus
RHKRATYEPD

SEQ ID NO: 44741 - protein, 10 aa, Dengue virus
SGTRNIGTES

SEQ ID NO: 44742 - protein, 10 aa, Dengue virus
GTRNIGTESE

SEQ ID NO: 44743 - protein, 10 aa, Dengue virus
ETPNMDIIGK

SEQ ID NO: 44744 - protein, 10 aa, Dengue virus
TPNMDIIGKR

SEQ ID NO: 44745 - protein, 10 aa, Dengue virus
IEKIKQEHEA

SEQ ID NO: 44746 - protein, 10 aa, Dengue virus
EKIKQEHEAS

SEQ ID NO: 44747 - protein, 10 aa, Dengue virus
KIKQEHEASW

SEQ ID NO: 44748 - protein, 10 aa, Dengue virus
IKQEHEASWH

SEQ ID NO: 44749 - protein, 10 aa, Dengue virus
KQEHEASWHY

SEQ ID NO: 44750 - protein, 10 aa, Dengue virus
QEHEASWHYD

SEQ ID NO: 44751 - protein, 10 aa, Dengue virus
KLLTKPWDVV

SEQ ID NO: 44752 - protein, 10 aa, Dengue virus
LTKPWDVLPM

SEQ ID NO: 44753 - protein, 10 aa, Dengue virus
TKPWDVLPMV

SEQ ID NO: 44754 - protein, 10 aa, Dengue virus
KPWDVLPMVT

SEQ ID NO: 44755 - protein, 10 aa, Dengue virus
PWDVLPMVTQ

SEQ ID NO: 44756 - protein, 10 aa, Dengue virus
WDVLPMVTQM

SEQ ID NO: 44757 - protein, 10 aa, Dengue virus
DVLPMVTQMA

SEQ ID NO: 44758 - protein, 10 aa, Dengue virus
VLPMVTQMAM

SEQ ID NO: 44759 - protein, 10 aa, Dengue virus
LPMVTQMAMT

SEQ ID NO: 44760 - protein, 10 aa, Dengue virus
TKKLMRITAK

SEQ ID NO: 44761 - protein, 10 aa, Dengue virus
KKLMRITAKW

SEQ ID NO: 44762 - protein, 10 aa, Dengue virus
KLMRITAKWL

SEQ ID NO: 44763 - protein, 10 aa, Dengue virus
MRITAEWLWG

SEQ ID NO: 44764 - protein, 10 aa, Dengue virus
KITAKWLWKE

SEQ ID NO: 44765 - protein, 10 aa, Dengue virus
ITAKWLWGEL

SEQ ID NO: 44766 - protein, 10 aa, Dengue virus
TAKWLWGELG

SEQ ID NO: 44767 - protein, 10 aa, Dengue virus
AKWLWGELGR

SEQ ID NO: 44768 - protein, 10 aa, Dengue virus
LWKELGKKKI

SEQ ID NO: 44769 - protein, 10 aa, Dengue virus
WKELGRKKTP

SEQ ID NO: 44770 - protein, 10 aa, Dengue virus
KELGKKKIPR

SEQ ID NO: 44771 - protein, 10 aa, Dengue virus
KIPRMCTREE

SEQ ID NO: 44772 - protein, 10 aa, Dengue virus
IPRMCTREEF

SEQ ID NO: 44773 - protein, 10 aa, Dengue virus
PRVCTREEFT

SEQ ID NO: 44774 - protein, 10 aa, Dengue virus
CTREEFARKV

SEQ ID NO: 44775 - protein, 10 aa, Dengue virus
REEFARKVRS

SEQ ID NO: 44776 - protein, 10 aa, Dengue virus
EEFARKVRSN

SEQ ID NO: 44777 - protein, 10 aa, Dengue virus
KSAREAVEDN

SEQ ID NO: 44778 - protein, 10 aa, Dengue virus
SAREAVEDER

SEQ ID NO: 44779 - protein, 10 aa, Dengue virus
AREAVEDNRF

SEQ ID NO: 44780 - protein, 10 aa, Dengue virus
REAVEDNRFW

SEQ ID NO: 44781 - protein, 10 aa, Dengue virus
EAVEDERFWE

SEQ ID NO: 44782 - protein, 10 aa, Dengue virus
AVEDNRFWEL

SEQ ID NO: 44783 - protein, 10 aa, Dengue virus
FWELVEKERN

SEQ ID NO: 44784 - protein, 10 aa, Dengue virus
WELVEKERNL

SEQ ID NO: 44785 - protein, 10 aa, Dengue virus
ELVEKERNLH

SEQ ID NO: 44786 - protein, 10 aa, Dengue virus
LVEKERNLHL

SEQ ID NO: 44787 - protein, 10 aa, Dengue virus
ERERNLHLDG

SEQ ID NO: 44788 - protein, 10 aa, Dengue virus
RERNLHLDGK

SEQ ID NO: 44789 - protein, 10 aa, Dengue virus
LHKLGYILRE

SEQ ID NO: 44790 - protein, 10 aa, Dengue virus
HKLGYILREV

SEQ ID NO: 44791 - protein, 10 aa, Dengue virus
LGYILREVSK

SEQ ID NO: 44792 - protein, 10 aa, Dengue virus
GYILREVSKK

SEQ ID NO: 44793 - protein, 10 aa, Dengue virus
ISKKAGGAMY

SEQ ID NO: 44794 - protein, 10 aa, Dengue virus
SKKAGGAMYA

SEQ ID NO: 44795 - protein, 10 aa, Dengue virus
DLKNEEMITG

SEQ ID NO: 44796 - protein, 10 aa, Dengue virus
LKNEEMITGQ

SEQ ID NO: 44797 - protein, 10 aa, Dengue virus
KNEEMITGQM

SEQ ID NO: 44798 - protein, 10 aa, Dengue virus
REGRERLSRM

SEQ ID NO: 44799 - protein, 10 aa, Dengue virus
EGRERLSRMA

SEQ ID NO: 44800 - protein, 10 aa, Dengue virus
DDRFAKALTA

SEQ ID NO: 44801 - protein, 10 aa, Dengue virus
DRFAKALTAL

SEQ ID NO: 44802 - protein, 10 aa, Dengue virus
RFAKALTALN

SEQ ID NO: 44803 - protein, 10 aa, Dengue virus
FAKALTALND

SEQ ID NO: 44804 - protein, 10 aa, Dengue virus
AKALTALNDM

SEQ ID NO: 44805 - protein, 10 aa, Dengue virus
KALTALNDMG

SEQ ID NO: 44806 - protein, 10 aa, Dengue virus
MKDGRKLVVP

SEQ ID NO: 44807 - protein, 10 aa, Dengue virus
KDGRKLVVPC

SEQ ID NO: 44808 - protein, 10 aa, Dengue virus
DGRKLVVPCR

SEQ ID NO: 44809 - protein, 10 aa, Dengue virus
SRTTWSIHAR

SEQ ID NO: 44810 - protein, 10 aa, Dengue virus
RTTWSIHARH

SEQ ID NO: 44811 - protein, 10 aa, Dengue virus
TTWSIHARHE

SEQ ID NO: 44812 - protein, 10 aa, Dengue virus
TWSIHARHEW

SEQ ID NO: 44813 - protein, 10 aa, Dengue virus
WSIHARHEWM

SEQ ID NO: 44814 - protein, 10 aa, Dengue virus
SIHARHEWMT

SEQ ID NO: 44815 - protein, 10 aa, Dengue virus
IHARHEWMTT

SEQ ID NO: 44816 - protein, 10 aa, Dengue virus
HARHEWMTTE

SEQ ID NO: 44817 - protein, 10 aa, Dengue virus
ARHEWMTTED

SEQ ID NO: 44818 - protein, 10 aa, Dengue virus
RHEWMTTEDM

SEQ ID NO: 44819 - protein, 10 aa, Dengue virus
LTVWNRVWIL

SEQ ID NO: 44820 - protein, 10 aa, Dengue virus
VWNRVWIQDN

SEQ ID NO: 44821 - protein, 10 aa, Dengue virus
WNRVWIQDNP

SEQ ID NO: 44822 - protein, 10 aa, Dengue virus
NRVWIQDNPW

SEQ ID NO: 44823 - protein, 10 aa, Dengue virus
VWIQENPWIE

SEQ ID NO: 44824 - protein, 10 aa, Dengue virus
WIQENPWIED

SEQ ID NO: 44825 - protein, 10 aa, Dengue virus
IQENPWIEDK

SEQ ID NO: 44826 - protein, 10 aa, Dengue virus
QENPWIEDKT

SEQ ID NO: 44827 - protein, 10 aa, Dengue virus
ENPWMEDKTL

SEQ ID NO: 44828 - protein, 10 aa, Dengue virus
DKTFVESWED

SEQ ID NO: 44829 - protein, 10 aa, Dengue virus
KTPVETWEEI

SEQ ID NO: 44830 - protein, 10 aa, Dengue virus
TPVETWEEIP

SEQ ID NO: 44831 - protein, 10 aa, Dengue virus
PVETWEEIPY

SEQ ID NO: 44832 - protein, 10 aa, Dengue virus
WARNIQTAIN

SEQ ID NO: 44833 - protein, 10 aa, Dengue virus
ARNIQTAINQ

SEQ ID NO: 44834 - protein, 10 aa, Dengue virus
RNIQTAINQV

SEQ ID NO: 44835 - protein, 10 aa, Dengue virus
IQTAINQVRA

SEQ ID NO: 44836 - protein, 10 aa, Dengue virus
QTAINQVRAL

SEQ ID NO: 44837 - protein, 10 aa, Dengue virus
TAINQVRALI

SEQ ID NO: 44838 - protein, 10 aa, Dengue virus
INQVRSLIGS

SEQ ID NO: 44839 - protein, 10 aa, Dengue virus
NQVRSLIGSE

SEQ ID NO: 44840 - protein, 10 aa, Dengue virus
QVRSLIGSEE

SEQ ID NO: 44841 - protein, 10 aa, Dengue virus
VRSLIGSEEY

SEQ ID NO: 44842 - protein, 10 aa, Dengue virus
MNDQRKKARN

SEQ ID NO: 44843 - protein, 10 aa, Dengue virus
AIKKSKAINV

SEQ ID NO: 44844 - protein, 10 aa, Dengue virus
NILNRRRRTV

SEQ ID NO: 44845 - protein, 10 aa, Dengue virus
ILNRRRRTVG

SEQ ID NO: 44846 - protein, 10 aa, Dengue virus
NGEPHMIVSK

SEQ ID NO: 44847 - protein, 10 aa, Dengue virus
GEPHMIVSKN

SEQ ID NO: 44848 - protein, 10 aa, Dengue virus
EPHMIVSKNE

SEQ ID NO: 44849 - protein, 10 aa, Dengue virus
PHMIVSKNEK

SEQ ID NO: 44850 - protein, 10 aa, Dengue virus
HMIVSKNEKG

SEQ ID NO: 44851 - protein, 10 aa, Dengue virus
MIVSKNEKGK

SEQ ID NO: 44852 - protein, 10 aa, Dengue virus
IVSKNEKGKS

SEQ ID NO: 44853 - protein, 10 aa, Dengue virus
VSKNEKGKSL

SEQ ID NO: 44854 - protein, 10 aa, Dengue virus
SKNEKGKSLL

SEQ ID NO: 44855 - protein, 10 aa, Dengue virus
VGVNMCTLMA

SEQ ID NO: 44856 - protein, 10 aa, Dengue virus
GINMCTLMAI

SEQ ID NO: 44857 - protein, 10 aa, Dengue virus
TNMCTLMALD

SEQ ID NO: 44858 - protein, 10 aa, Dengue virus
TYKCPFLRQN

SEQ ID NO: 44859 - protein, 10 aa, Dengue virus
YKCPFLRQNE

SEQ ID NO: 44860 - protein, 10 aa, Dengue virus
NCPLLKQNEP

SEQ ID NO: 44861 - protein, 10 aa, Dengue virus
LRHPGFTTMA

SEQ ID NO: 44862 - protein, 10 aa, Dengue virus
RHPGFTTMAA

SEQ ID NO: 44863 - protein, 10 aa, Dengue virus
GTTHFQKALI

SEQ ID NO: 44864 - protein, 10 aa, Dengue virus
TTHFQKALIF

SEQ ID NO: 44865 - protein, 10 aa, Dengue virus
THFQKALIFI

SEQ ID NO: 44866 - protein, 10 aa, Dengue virus
HFQKALIFIL

SEQ ID NO: 44867 - protein, 10 aa, Dengue virus
QKALIFILLT

SEQ ID NO: 44868 - protein, 10 aa, Dengue virus
LIFILLTTVA

SEQ ID NO: 44869 - protein, 10 aa, Dengue virus
IFILLTTVAP

SEQ ID NO: 44870 - protein, 10 aa, Dengue virus
LLTTVAPSMT

SEQ ID NO: 44871 - protein, 10 aa, Dengue virus
LTAIAPSMAM

SEQ ID NO: 44872 - protein, 10 aa, Dengue virus
TTVAPSMTMR

SEQ ID NO: 44873 - protein, 10 aa, Dengue virus
AKQSATLRKY

SEQ ID NO: 44874 - protein, 10 aa, Dengue virus
KQSATLRKYC

SEQ ID NO: 44875 - protein, 10 aa, Dengue virus
CPTQGEPSLS

SEQ ID NO: 44876 - protein, 10 aa, Dengue virus
PTQGEPSLVE

SEQ ID NO: 44877 - protein, 10 aa, Dengue virus
TQGEPSLVEE

SEQ ID NO: 44878 - protein, 10 aa, Dengue virus
QGEPSLSEEQ

SEQ ID NO: 44879 - protein, 10 aa, Dengue virus
GEPSLSEEQD

SEQ ID NO: 44880 - protein, 10 aa, Dengue virus
EPSLVEEQDK

SEQ ID NO: 44881 - protein, 10 aa, Dengue virus
PSLVEEQDKR

SEQ ID NO: 44882 - protein, 10 aa, Dengue virus
SLSEEQDKRF

SEQ ID NO: 44883 - protein, 10 aa, Dengue virus
IVTCAKFTCK

SEQ ID NO: 44884 - protein, 10 aa, Dengue virus
TCAKFTCKKN

SEQ ID NO: 44885 - protein, 10 aa, Dengue virus
CAKFTCKKNM

SEQ ID NO: 44886 - protein, 10 aa, Dengue virus
AKFTCKKNME

SEQ ID NO: 44887 - protein, 10 aa, Dengue virus
MFSCKKNMEG

SEQ ID NO: 44888 - protein, 10 aa, Dengue virus
FSCKKNMEGK

SEQ ID NO: 44889 - protein, 10 aa, Dengue virus
LKKMEGKVVQ

SEQ ID NO: 44890 - protein, 10 aa, Dengue virus
KNMKGKVVQP

SEQ ID NO: 44891 - protein, 10 aa, Dengue virus
NMKGKVVQPE

SEQ ID NO: 44892 - protein, 10 aa, Dengue virus
NDTGKHGEEI

SEQ ID NO: 44893 - protein, 10 aa, Dengue virus
TGKHGMEIKV

SEQ ID NO: 44894 - protein, 10 aa, Dengue virus
GKHGMEIKVT

SEQ ID NO: 44895 - protein, 10 aa, Dengue virus
KHGMEIKVTP

SEQ ID NO: 44896 - protein, 10 aa, Dengue virus
HGMEIKVTPQ

SEQ ID NO: 44897 - protein, 10 aa, Dengue virus
GMEIKVTPQS

SEQ ID NO: 44898 - protein, 10 aa, Dengue virus
TDAELTGYGT

SEQ ID NO: 44899 - protein, 10 aa, Dengue virus
MKNKAWLVHR

SEQ ID NO: 44900 - protein, 10 aa, Dengue virus
GNKAWLVHRQ

SEQ ID NO: 44901 - protein, 10 aa, Dengue virus
PWLPGADIQG

SEQ ID NO: 44902 - protein, 10 aa, Dengue virus
WLPGADIQGS

SEQ ID NO: 44903 - protein, 10 aa, Dengue virus
LPGADIQGSN

SEQ ID NO: 44904 - protein, 10 aa, Dengue virus
PGADIQGSNW

SEQ ID NO: 44905 - protein, 10 aa, Dengue virus
GADIQGSNWI

SEQ ID NO: 44906 - protein, 10 aa, Dengue virus
ADIQGSNWIQ

SEQ ID NO: 44907 - protein, 10 aa, Dengue virus
DIQGSNWIQK

SEQ ID NO: 44908 - protein, 10 aa, Dengue virus
IQGSNWIQKE

SEQ ID NO: 44909 - protein, 10 aa, Dengue virus
VIRVQYEGED

SEQ ID NO: 44910 - protein, 10 aa, Dengue virus
IRVQYEGEGA

SEQ ID NO: 44911 - protein, 10 aa, Dengue virus
YEGEGAPCKI

SEQ ID NO: 44912 - protein, 10 aa, Dengue virus
EGEDSPCKIP

SEQ ID NO: 44913 - protein, 10 aa, Dengue virus
GDGSPCKTPF

SEQ ID NO: 44914 - protein, 10 aa, Dengue virus
EGAPCKIPFE

SEQ ID NO: 44915 - protein, 10 aa, Dengue virus
FEIMDLERRY

SEQ ID NO: 44916 - protein, 10 aa, Dengue virus
DLEKRYILGR

SEQ ID NO: 44917 - protein, 10 aa, Dengue virus
LEKRYILGRL

SEQ ID NO: 44918 - protein, 10 aa, Dengue virus
EKRYILGRLI

SEQ ID NO: 44919 - protein, 10 aa, Dengue virus
KRYILGRLIT

SEQ ID NO: 44920 - protein, 10 aa, Dengue virus
RLITVNPIAT

SEQ ID NO: 44921 - protein, 10 aa, Dengue virus
GSLGGVFTSM

SEQ ID NO: 44922 - protein, 10 aa, Dengue virus
SLGGMFTSIG

SEQ ID NO: 44923 - protein, 10 aa, Dengue virus
LGGVFTSMGK

SEQ ID NO: 44924 - protein, 10 aa, Dengue virus
WTMKIFIGVI

SEQ ID NO: 44925 - protein, 10 aa, Dengue virus
TMKIFIGVII

SEQ ID NO: 44926 - protein, 10 aa, Dengue virus
SVSLILVGIV

SEQ ID NO: 44927 - protein, 10 aa, Dengue virus
VGVVILYLGA

SEQ ID NO: 44928 - protein, 10 aa, Dengue virus
AMVQADSGCI

SEQ ID NO: 44929 - protein, 10 aa, Dengue virus
AIQKAYEEGI

SEQ ID NO: 44930 - protein, 10 aa, Dengue virus
IQKAYEEGIC

SEQ ID NO: 44931 - protein, 10 aa, Dengue virus
QKAHEDGICG

SEQ ID NO: 44932 - protein, 10 aa, Dengue virus
HILTENEVKL

SEQ ID NO: 44933 - protein, 10 aa, Dengue virus
ILTENEVKLT

SEQ ID NO: 44934 - protein, 10 aa, Dengue virus
LTENEVKLTI

SEQ ID NO: 44935 - protein, 10 aa, Dengue virus
TENEVKLTIM

SEQ ID NO: 44936 - protein, 10 aa, Dengue virus
VKMTIMTGDI

SEQ ID NO: 44937 - protein, 10 aa, Dengue virus
KMTIMTGDIK

SEQ ID NO: 44938 - protein, 10 aa, Dengue virus
MTIMTGDIKG

SEQ ID NO: 44939 - protein, 10 aa, Dengue virus
TIMTGGIKGI

SEQ ID NO: 44940 - protein, 10 aa, Dengue virus
MTGDIKGIMH

SEQ ID NO: 44941 - protein, 10 aa, Dengue virus
GIMHAGKRSL

SEQ ID NO: 44942 - protein, 10 aa, Dengue virus
GRRSLRPQPT

SEQ ID NO: 44943 - protein, 10 aa, Dengue virus
RSLRPQPTQL

SEQ ID NO: 44944 - protein, 10 aa, Dengue virus
WGKAKMLSTG

SEQ ID NO: 44945 - protein, 10 aa, Dengue virus
HNRTFLIDGP

SEQ ID NO: 44946 - protein, 10 aa, Dengue virus
TTECPSSNRA

SEQ ID NO: 44947 - protein, 10 aa, Dengue virus
AECPNANRAW

SEQ ID NO: 44948 - protein, 10 aa, Dengue virus
FTTNIWLRLK

SEQ ID NO: 44949 - protein, 10 aa, Dengue virus
TTNIWLRLKE

SEQ ID NO: 44950 - protein, 10 aa, Dengue virus
TNIWLRLKEK

SEQ ID NO: 44951 - protein, 10 aa, Dengue virus
NIWLRLKEKQ

SEQ ID NO: 44952 - protein, 10 aa, Dengue virus
IWLRLKEKQD

SEQ ID NO: 44953 - protein, 10 aa, Dengue virus
LCDSKLMSAA

SEQ ID NO: 44954 - protein, 10 aa, Dengue virus
IEVKSCHWPR

SEQ ID NO: 44955 - protein, 10 aa, Dengue virus
EVKSCHWPRS

SEQ ID NO: 44956 - protein, 10 aa, Dengue virus
VKSCHWPRSH

SEQ ID NO: 44957 - protein, 10 aa, Dengue virus
PKGFAGPVSQ

SEQ ID NO: 44958 - protein, 10 aa, Dengue virus
KGFAGPVSQH

SEQ ID NO: 44959 - protein, 10 aa, Dengue virus
GFAGPVSQHN

SEQ ID NO: 44960 - protein, 10 aa, Dengue virus
IAGPVSQHNN

SEQ ID NO: 44961 - protein, 10 aa, Dengue virus
SQHNNRPGYY

SEQ ID NO: 44962 - protein, 10 aa, Dengue virus
QHNNRPGYYT

SEQ ID NO: 44963 - protein, 10 aa, Dengue virus
HNNRPGYYTQ

SEQ ID NO: 44964 - protein, 10 aa, Dengue virus
LGKLEMDFNF

SEQ ID NO: 44965 - protein, 10 aa, Dengue virus
GKLEMDFNFC

SEQ ID NO: 44966 - protein, 10 aa, Dengue virus
LEMDFNFCDG

SEQ ID NO: 44967 - protein, 10 aa, Dengue virus
EMDFNFCDGT

SEQ ID NO: 44968 - protein, 10 aa, Dengue virus
MDFNFCDGTT

SEQ ID NO: 44969 - protein, 10 aa, Dengue virus
DFNFCEGTTV

SEQ ID NO: 44970 - protein, 10 aa, Dengue virus
EGTTVVVTEN

SEQ ID NO: 44971 - protein, 10 aa, Dengue virus
RDLGRVIIMV

SEQ ID NO: 44972 - protein, 10 aa, Dengue virus
TDDIGIGVTY

SEQ ID NO: 44973 - protein, 10 aa, Dengue virus
AFKVRPTFVA

SEQ ID NO: 44974 - protein, 10 aa, Dengue virus
YKVRPTFAAG

SEQ ID NO: 44975 - protein, 10 aa, Dengue virus
TFVAGLLLRK

SEQ ID NO: 44976 - protein, 10 aa, Dengue virus
FVAGLLLRKL

SEQ ID NO: 44977 - protein, 10 aa, Dengue virus
TIGVALLSQS

SEQ ID NO: 44978 - protein, 10 aa, Dengue virus
PENILELTDA

SEQ ID NO: 44979 - protein, 10 aa, Dengue virus
NILELTDALA

SEQ ID NO: 44980 - protein, 10 aa, Dengue virus
NLEKYQLAVT

SEQ ID NO: 44981 - protein, 10 aa, Dengue virus
TLCVPNAVIL

SEQ ID NO: 44982 - protein, 10 aa, Dengue virus
CVPNAVVLQN

SEQ ID NO: 44983 - protein, 10 aa, Dengue virus
VPNAVVLQNA

SEQ ID NO: 44984 - protein, 10 aa, Dengue virus
PNAVVLQNAW

SEQ ID NO: 44985 - protein, 10 aa, Dengue virus
ILAAVSASPL

SEQ ID NO: 44986 - protein, 10 aa, Dengue virus
VFPLLLTSSQ

SEQ ID NO: 44987 - protein, 10 aa, Dengue virus
FPLLLTSSQQ

SEQ ID NO: 44988 - protein, 10 aa, Dengue virus
RQKADWIPLA

SEQ ID NO: 44989 - protein, 10 aa, Dengue virus
IFLTTLARTS

SEQ ID NO: 44990 - protein, 10 aa, Dengue virus
FLTTLSRPSK

SEQ ID NO: 44991 - protein, 10 aa, Dengue virus
LTTLTRTSKK

SEQ ID NO: 44992 - protein, 10 aa, Dengue virus
TTLTRTSKKR

SEQ ID NO: 44993 - protein, 10 aa, Dengue virus
TLTRTSKKRS

SEQ ID NO: 44994 - protein, 10 aa, Dengue virus
LTRTSKKRSW

SEQ ID NO: 44995 - protein, 10 aa, Dengue virus
TRTSKKRSWP

SEQ ID NO: 44996 - protein, 10 aa, Dengue virus
ADLELERAAE

SEQ ID NO: 44997 - protein, 10 aa, Dengue virus
DLELERAAEV

SEQ ID NO: 44998 - protein, 10 aa, Dengue virus
VKWEEQAEIS

SEQ ID NO: 44999 - protein, 10 aa, Dengue virus
KWEEQAEISG

SEQ ID NO: 45000 - protein, 10 aa, Dengue virus
SGVFPVSIPV

SEQ ID NO: 45001 - protein, 10 aa, Dengue virus
GVFPVSIPVT

SEQ ID NO: 45002 - protein, 10 aa, Dengue virus
VFPVSIPVTA

SEQ ID NO: 45003 - protein, 10 aa, Dengue virus
WDVPSPPPME

SEQ ID NO: 45004 - protein, 10 aa, Dengue virus
RIKQKRILGY

SEQ ID NO: 45005 - protein, 10 aa, Dengue virus
IKQRGFLGYS

SEQ ID NO: 45006 - protein, 10 aa, Dengue virus
KQRGFLGYSQ

SEQ ID NO: 45007 - protein, 10 aa, Dengue virus
QRGFLGYSQI

SEQ ID NO: 45008 - protein, 10 aa, Dengue virus
RGFLGYSQIG

SEQ ID NO: 45009 - protein, 10 aa, Dengue virus
QTKPGFFKTN

SEQ ID NO: 45010 - protein, 10 aa, Dengue virus
FRTNAGTIGA

SEQ ID NO: 45011 - protein, 10 aa, Dengue virus
RTNAGTIGAV

SEQ ID NO: 45012 - protein, 10 aa, Dengue virus
SSIAQTETSV

SEQ ID NO: 45013 - protein, 10 aa, Dengue virus
SIAQTETSVE

SEQ ID NO: 45014 - protein, 10 aa, Dengue virus
NSGHEWITDF

SEQ ID NO: 45015 - protein, 10 aa, Dengue virus
GYEWVTDFKG

SEQ ID NO: 45016 - protein, 10 aa, Dengue virus
HEWITDFKGK

SEQ ID NO: 45017 - protein, 10 aa, Dengue virus
SRKTFDTEYI

SEQ ID NO: 45018 - protein, 10 aa, Dengue virus
RKTFDTEYIK

SEQ ID NO: 45019 - protein, 10 aa, Dengue virus
KTFDTEYIKT

SEQ ID NO: 45020 - protein, 10 aa, Dengue virus
TFDTEYIKTR

SEQ ID NO: 45021 - protein, 10 aa, Dengue virus
AYKVASEGIS

SEQ ID NO: 45022 - protein, 10 aa, Dengue virus
YKVASEGISY

SEQ ID NO: 45023 - protein, 10 aa, Dengue virus
KVASEGISYA

SEQ ID NO: 45024 - protein, 10 aa, Dengue virus
TDRKWCFDGI

SEQ ID NO: 45025 - protein, 10 aa, Dengue virus
DRKWCFDGIR

SEQ ID NO: 45026 - protein, 10 aa, Dengue virus
RKWCFDGIRN

SEQ ID NO: 45027 - protein, 10 aa, Dengue virus
KWCFDGIRNN

SEQ ID NO: 45028 - protein, 10 aa, Dengue virus
VLHSAEMGGR

SEQ ID NO: 45029 - protein, 10 aa, Dengue virus
LHSAEMGGRA

SEQ ID NO: 45030 - protein, 10 aa, Dengue virus
FLFLMSARGI

SEQ ID NO: 45031 - protein, 10 aa, Dengue virus
LFLMSARGIG

SEQ ID NO: 45032 - protein, 10 aa, Dengue virus
FLMSARGIGK

SEQ ID NO: 45033 - protein, 10 aa, Dengue virus
LMSARGIGKM

SEQ ID NO: 45034 - protein, 10 aa, Dengue virus
MSARGIGKMT

SEQ ID NO: 45035 - protein, 10 aa, Dengue virus
SARGIGKMTL

SEQ ID NO: 45036 - protein, 10 aa, Dengue virus
ARGIGKMTLG

SEQ ID NO: 45037 - protein, 10 aa, Dengue virus
QHESNILDID

SEQ ID NO: 45038 - protein, 10 aa, Dengue virus
PITLTAALLM

SEQ ID NO: 45039 - protein, 10 aa, Dengue virus
TTLTAALFLL

SEQ ID NO: 45040 - protein, 10 aa, Dengue virus
TAALLLLMAH

SEQ ID NO: 45041 - protein, 10 aa, Dengue virus
LFSIMKNTIN

SEQ ID NO: 45042 - protein, 10 aa, Dengue virus
RRGTGTIGET

SEQ ID NO: 45043 - protein, 10 aa, Dengue virus
RGTGTIGETL

SEQ ID NO: 45044 - protein, 10 aa, Dengue virus
GTGTIGETLG

SEQ ID NO: 45045 - protein, 10 aa, Dengue virus
TGTIGETLGE

SEQ ID NO: 45046 - protein, 10 aa, Dengue virus
GTIGETLGEK

SEQ ID NO: 45047 - protein, 10 aa, Dengue virus
TIGETLGEKW

SEQ ID NO: 45048 - protein, 10 aa, Dengue virus
EKWKSQLNAL

SEQ ID NO: 45049 - protein, 10 aa, Dengue virus
KWKSQLNALG

SEQ ID NO: 45050 - protein, 10 aa, Dengue virus
LNTLGKSEFQ

SEQ ID NO: 45051 - protein, 10 aa, Dengue virus
GKNEFQIYKK

SEQ ID NO: 45052 - protein, 10 aa, Dengue virus
KNEFQIYKKS

SEQ ID NO: 45053 - protein, 10 aa, Dengue virus
IDVFFTPPEK

SEQ ID NO: 45054 - protein, 10 aa, Dengue virus
FFIPPERCDT

SEQ ID NO: 45055 - protein, 10 aa, Dengue virus
FIPPERCDTL

SEQ ID NO: 45056 - protein, 10 aa, Dengue virus
NLVENWLKNN

SEQ ID NO: 45057 - protein, 10 aa, Dengue virus
LVENWLKNNT

SEQ ID NO: 45058 - protein, 10 aa, Dengue virus
ESWLNNNTQF

SEQ ID NO: 45059 - protein, 10 aa, Dengue virus
NWLNNNIQFC

SEQ ID NO: 45060 - protein, 10 aa, Dengue virus
WLKNNTQFCI

SEQ ID NO: 45061 - protein, 10 aa, Dengue virus
LNNNTKFCIK

SEQ ID NO: 45062 - protein, 10 aa, Dengue virus
NNNTKFCIKV

SEQ ID NO: 45063 - protein, 10 aa, Dengue virus
EKPNLDIIGK

SEQ ID NO: 45064 - protein, 10 aa, Dengue virus
KPNLDIIGKR

SEQ ID NO: 45065 - protein, 10 aa, Dengue virus
MRITAKWLWG

SEQ ID NO: 45066 - protein, 10 aa, Dengue virus
RITAKWLWGE

SEQ ID NO: 45067 - protein, 10 aa, Dengue virus
LWKELGRKKT

SEQ ID NO: 45068 - protein, 10 aa, Dengue virus
WKELGKKKIP

SEQ ID NO: 45069 - protein, 10 aa, Dengue virus
KELGRKKTPR

SEQ ID NO: 45070 - protein, 10 aa, Dengue virus
KTPRVCTREE

SEQ ID NO: 45071 - protein, 10 aa, Dengue virus
TPRVCTREEF

SEQ ID NO: 45072 - protein, 10 aa, Dengue virus
PRMCTREEFA

SEQ ID NO: 45073 - protein, 10 aa, Dengue virus
SAREAVEDNR

SEQ ID NO: 45074 - protein, 10 aa, Dengue virus
AREAVEDERF

SEQ ID NO: 45075 - protein, 10 aa, Dengue virus
REAVEDERFW

SEQ ID NO: 45076 - protein, 10 aa, Dengue virus
EAVEDNRFWE

SEQ ID NO: 45077 - protein, 10 aa, Dengue virus
AVEDERFWEL

SEQ ID NO: 45078 - protein, 10 aa, Dengue virus
FWELVERERN

SEQ ID NO: 45079 - protein, 10 aa, Dengue virus
WELVERERNL

SEQ ID NO: 45080 - protein, 10 aa, Dengue virus
ELVERERNLH

SEQ ID NO: 45081 - protein, 10 aa, Dengue virus
LVERERNLHL

SEQ ID NO: 45082 - protein, 10 aa, Dengue virus
HKLGYILRDI

SEQ ID NO: 45083 - protein, 10 aa, Dengue virus
LGYILRDISR

SEQ ID NO: 45084 - protein, 10 aa, Dengue virus
GYILRDISRK

SEQ ID NO: 45085 - protein, 10 aa, Dengue virus
VSKKEGGTMY

SEQ ID NO: 45086 - protein, 10 aa, Dengue virus
SKKEGGTMYA

SEQ ID NO: 45087 - protein, 10 aa, Dengue virus
VGRERLSRMV

SEQ ID NO: 45088 - protein, 10 aa, Dengue virus
MKDGRMLVVP

SEQ ID NO: 45089 - protein, 10 aa, Dengue virus
KDGRMLVVPC

SEQ ID NO: 45090 - protein, 10 aa, Dengue virus
DGRMLVVPCR

SEQ ID NO: 45091 - protein, 10 aa, Dengue virus
LTVWNKVWIR

SEQ ID NO: 45092 - protein, 10 aa, Dengue virus
VWNKVWIREN

SEQ ID NO: 45093 - protein, 10 aa, Dengue virus
WNKVWIRENP

SEQ ID NO: 45094 - protein, 10 aa, Dengue virus
NKVWIRENPW

SEQ ID NO: 45095 - protein, 10 aa, Dengue virus
VWIQDNPWME

SEQ ID NO: 45096 - protein, 10 aa, Dengue virus
WIQDNPWMED

SEQ ID NO: 45097 - protein, 10 aa, Dengue virus
IQDNPWMEDK

SEQ ID NO: 45098 - protein, 10 aa, Dengue virus
QDNPWMEDKT

SEQ ID NO: 45099 - protein, 10 aa, Dengue virus
TAINQVRSLM

SEQ ID NO: 45100 - protein, 10 aa, Dengue virus
QVRSLIGNEG

SEQ ID NO: 45101 - protein, 10 aa, Dengue virus
VRSLIGNEGY

SEQ ID NO: 45102 - protein, 11 aa, Dengue virus
STPFNMLKRER

SEQ ID NO: 45103 - protein, 11 aa, Dengue virus
TPFNMLKRERN

SEQ ID NO: 45104 - protein, 11 aa, Dengue virus
PFNMLKRERNR

SEQ ID NO: 45105 - protein, 11 aa, Dengue virus
FNMLKRERNRV

SEQ ID NO: 45106 - protein, 11 aa, Dengue virus
NMLKRERNRVS

SEQ ID NO: 45107 - protein, 11 aa, Dengue virus
MLKRERNRVST

SEQ ID NO: 45108 - protein, 11 aa, Dengue virus
LKRERNRVSTV

SEQ ID NO: 45109 - protein, 11 aa, Dengue virus
KRERNRVSTVQ

SEQ ID NO: 45110 - protein, 11 aa, Dengue virus
RERNRVSTVQQ

SEQ ID NO: 45111 - protein, 11 aa, Dengue virus
ERNRVSTVQQL

SEQ ID NO: 45112 - protein, 11 aa, Dengue virus
RNRVSTVQQLT

SEQ ID NO: 45113 - protein, 11 aa, Dengue virus
NRVSTVQQLTK

SEQ ID NO: 45114 - protein, 11 aa, Dengue virus
RVSTVQQLTKR

SEQ ID NO: 45115 - protein, 11 aa, Dengue virus
VSTVQQLTKRF

SEQ ID NO: 45116 - protein, 11 aa, Dengue virus
STVQQLTKRFS

SEQ ID NO: 45117 - protein, 11 aa, Dengue virus
TVQQLTKRFSL

SEQ ID NO: 45118 - protein, 11 aa, Dengue virus
VQQLTKRFSLG

SEQ ID NO: 45119 - protein, 11 aa, Dengue virus
QQLTKRFSLGM

SEQ ID NO: 45120 - protein, 11 aa, Dengue virus
QLTKRFSLGML

SEQ ID NO: 45121 - protein, 11 aa, Dengue virus
LTKRFSLGMLQ

SEQ ID NO: 45122 - protein, 11 aa, Dengue virus
TKRFSLGMLQG

SEQ ID NO: 45123 - protein, 11 aa, Dengue virus
KRFSLGMLQGR

SEQ ID NO: 45124 - protein, 11 aa, Dengue virus
RFSLGMLQGRG

SEQ ID NO: 45125 - protein, 11 aa, Dengue virus
FSLGMLQGRGP

SEQ ID NO: 45126 - protein, 11 aa, Dengue virus
SLGMLQGRGPL

SEQ ID NO: 45127 - protein, 11 aa, Dengue virus
LGMLQGRGPLK

SEQ ID NO: 45128 - protein, 11 aa, Dengue virus
GMLQGRGPLKL

SEQ ID NO: 45129 - protein, 11 aa, Dengue virus
MLQGRGPLKLF

SEQ ID NO: 45130 - protein, 11 aa, Dengue virus
LQGRGPLKLFM

SEQ ID NO: 45131 - protein, 11 aa, Dengue virus
QGRGPLKLFMA

SEQ ID NO: 45132 - protein, 11 aa, Dengue virus
GRGPLKLFMAL

SEQ ID NO: 45133 - protein, 11 aa, Dengue virus
RGPLKLFMALV

SEQ ID NO: 45134 - protein, 11 aa, Dengue virus
GPLKLFMALVA

SEQ ID NO: 45135 - protein, 11 aa, Dengue virus
PLKLFMALVAF

SEQ ID NO: 45136 - protein, 11 aa, Dengue virus
LKLFMALVAFL

SEQ ID NO: 45137 - protein, 11 aa, Dengue virus
KLFMALVAFLR

SEQ ID NO: 45138 - protein, 11 aa, Dengue virus
LFMALVAFLRF

SEQ ID NO: 45139 - protein, 11 aa, Dengue virus
FMALVAFLRFL

SEQ ID NO: 45140 - protein, 11 aa, Dengue virus
MALVAFLRFLT

SEQ ID NO: 45141 - protein, 11 aa, Dengue virus
ALVAFLRFLTI

SEQ ID NO: 45142 - protein, 11 aa, Dengue virus
LVAFLRFLTIP

SEQ ID NO: 45143 - protein, 11 aa, Dengue virus
VAFLRFLTIPP

SEQ ID NO: 45144 - protein, 11 aa, Dengue virus
AFLRFLTIPPT

SEQ ID NO: 45145 - protein, 11 aa, Dengue virus
FLRFLTIPPTA

SEQ ID NO: 45146 - protein, 11 aa, Dengue virus
LRFLTIPPTAG

SEQ ID NO: 45147 - protein, 11 aa, Dengue virus
RFLTIPPTAGI

SEQ ID NO: 45148 - protein, 11 aa, Dengue virus
FLTIPPTAGIL

SEQ ID NO: 45149 - protein, 11 aa, Dengue virus
LTIPPTAGILK

SEQ ID NO: 45150 - protein, 11 aa, Dengue virus
TIPPTAGILKR

SEQ ID NO: 45151 - protein, 11 aa, Dengue virus
IPPTAGILKRW

SEQ ID NO: 45152 - protein, 11 aa, Dengue virus
PPTAGILKRWG

SEQ ID NO: 45153 - protein, 11 aa, Dengue virus
PTAGILKRWGT

SEQ ID NO: 45154 - protein, 11 aa, Dengue virus
TAGILKRWGTI

SEQ ID NO: 45155 - protein, 11 aa, Dengue virus
AGILKRWGTIK

SEQ ID NO: 45156 - protein, 11 aa, Dengue virus
GILKRWGTIKK

SEQ ID NO: 45157 - protein, 11 aa, Dengue virus
ILKRWGTIKKS

SEQ ID NO: 45158 - protein, 11 aa, Dengue virus
LKRWGTIKKSK

SEQ ID NO: 45159 - protein, 11 aa, Dengue virus
KRWGTIKKSKA

SEQ ID NO: 45160 - protein, 11 aa, Dengue virus
RWGTIKKSKAI

SEQ ID NO: 45161 - protein, 11 aa, Dengue virus
WGTIKKSKAIN

SEQ ID NO: 45162 - protein, 11 aa, Dengue virus
GTIKKSKAINV

SEQ ID NO: 45163 - protein, 11 aa, Dengue virus
TIKKSKAINVL

SEQ ID NO: 45164 - protein, 11 aa, Dengue virus
IKKSKAINVLR

SEQ ID NO: 45165 - protein, 11 aa, Dengue virus
KKSKAINVLRG

SEQ ID NO: 45166 - protein, 11 aa, Dengue virus
KSKAINVLRGF

SEQ ID NO: 45167 - protein, 11 aa, Dengue virus
SKAINVLRGFR

SEQ ID NO: 45168 - protein, 11 aa, Dengue virus
KAINVLRGFRK

SEQ ID NO: 45169 - protein, 11 aa, Dengue virus
AINVLRGFRKE

SEQ ID NO: 45170 - protein, 11 aa, Dengue virus
INVLRGFRKEI

SEQ ID NO: 45171 - protein, 11 aa, Dengue virus
NVLRGFRKEIG

SEQ ID NO: 45172 - protein, 11 aa, Dengue virus
VLRGFRKEIGR

SEQ ID NO: 45173 - protein, 11 aa, Dengue virus
LRGFRKEIGRM

SEQ ID NO: 45174 - protein, 11 aa, Dengue virus
RGFRKEIGRML

SEQ ID NO: 45175 - protein, 11 aa, Dengue virus
GFRKEIGRMLN

SEQ ID NO: 45176 - protein, 11 aa, Dengue virus
FRKEIGRMLNI

SEQ ID NO: 45177 - protein, 11 aa, Dengue virus
RKEIGRMLNIL

SEQ ID NO: 45178 - protein, 11 aa, Dengue virus
KEIGRMLNILN

SEQ ID NO: 45179 - protein, 11 aa, Dengue virus
EIGRMLNILNR

SEQ ID NO: 45180 - protein, 11 aa, Dengue virus
IGRMLNILNRR

SEQ ID NO: 45181 - protein, 11 aa, Dengue virus
GRMLNILNRRR

SEQ ID NO: 45182 - protein, 11 aa, Dengue virus
RMLNILNRRRR

SEQ ID NO: 45183 - protein, 11 aa, Dengue virus
MLNILNRRRRT

SEQ ID NO: 45184 - protein, 11 aa, Dengue virus
LNILNRRRRTA

SEQ ID NO: 45185 - protein, 11 aa, Dengue virus
NILNRRRRTAG

SEQ ID NO: 45186 - protein, 11 aa, Dengue virus
IPTAMAFHLTT

SEQ ID NO: 45187 - protein, 11 aa, Dengue virus
PTAMAFHLTTR

SEQ ID NO: 45188 - protein, 11 aa, Dengue virus
TAMAFHLTTRN

SEQ ID NO: 45189 - protein, 11 aa, Dengue virus
AMAFHLTTRNG

SEQ ID NO: 45190 - protein, 11 aa, Dengue virus
MAFHLTTRNGE

SEQ ID NO: 45191 - protein, 11 aa, Dengue virus
AFHLTTRNGEP

SEQ ID NO: 45192 - protein, 11 aa, Dengue virus
FHLTTRNGEPH

SEQ ID NO: 45193 - protein, 11 aa, Dengue virus
HLTTRNGEPHM

SEQ ID NO: 45194 - protein, 11 aa, Dengue virus
LTTRNGEPHMI

SEQ ID NO: 45195 - protein, 11 aa, Dengue virus
TTRNGEPHMIV

SEQ ID NO: 45196 - protein, 11 aa, Dengue virus
TRNGEPHMIVG

SEQ ID NO: 45197 - protein, 11 aa, Dengue virus
RNGEPHMIVGR

SEQ ID NO: 45198 - protein, 11 aa, Dengue virus
GEPHMIVGRQE

SEQ ID NO: 45199 - protein, 11 aa, Dengue virus
EPHMIVGRQEK

SEQ ID NO: 45200 - protein, 11 aa, Dengue virus
PHMIVGRQEKG

SEQ ID NO: 45201 - protein, 11 aa, Dengue virus
HMIVGRQEKGK

SEQ ID NO: 45202 - protein, 11 aa, Dengue virus
MIVGRQEKGKS

SEQ ID NO: 45203 - protein, 11 aa, Dengue virus
IVGRQEKGKSL

SEQ ID NO: 45204 - protein, 11 aa, Dengue virus
VGRQEKGKSLL

SEQ ID NO: 45205 - protein, 11 aa, Dengue virus
GRQEKGKSLLF

SEQ ID NO: 45206 - protein, 11 aa, Dengue virus
RQEKGKSLLFK

SEQ ID NO: 45207 - protein, 11 aa, Dengue virus
QEKGKSLLFKT

SEQ ID NO: 45208 - protein, 11 aa, Dengue virus
EKGKSLLFKTE

SEQ ID NO: 45209 - protein, 11 aa, Dengue virus
KGKSLLFKTED

SEQ ID NO: 45210 - protein, 11 aa, Dengue virus
GKSLLFKTEDG

SEQ ID NO: 45211 - protein, 11 aa, Dengue virus
GVNMCTLMAID

SEQ ID NO: 45212 - protein, 11 aa, Dengue virus
VNMCTLMAIDL

SEQ ID NO: 45213 - protein, 11 aa, Dengue virus
NMCTLMAIDLG

SEQ ID NO: 45214 - protein, 11 aa, Dengue virus
MCTLMAIDLGE

SEQ ID NO: 45215 - protein, 11 aa, Dengue virus
CTLMAIDLGEL

SEQ ID NO: 45216 - protein, 11 aa, Dengue virus
TLMAIDLGELC

SEQ ID NO: 45217 - protein, 11 aa, Dengue virus
LMAIDLGELCE

SEQ ID NO: 45218 - protein, 11 aa, Dengue virus
MAIDLGELCED

SEQ ID NO: 45219 - protein, 11 aa, Dengue virus
AIDLGELCEDT

SEQ ID NO: 45220 - protein, 11 aa, Dengue virus
IDLGELCEDTI

SEQ ID NO: 45221 - protein, 11 aa, Dengue virus
DLGELCEDTIT

SEQ ID NO: 45222 - protein, 11 aa, Dengue virus
LGELCEDTITY

SEQ ID NO: 45223 - protein, 11 aa, Dengue virus
GELCEDTITYK

SEQ ID NO: 45224 - protein, 11 aa, Dengue virus
ELCEDTITYKC

SEQ ID NO: 45225 - protein, 11 aa, Dengue virus
LCEDTITYKCP

SEQ ID NO: 45226 - protein, 11 aa, Dengue virus
CEDTITYKCPL

SEQ ID NO: 45227 - protein, 11 aa, Dengue virus
EDTITYKCPLL

SEQ ID NO: 45228 - protein, 11 aa, Dengue virus
TYKCPLLRQNE

SEQ ID NO: 45229 - protein, 11 aa, Dengue virus
YKCPLLRQNEP

SEQ ID NO: 45230 - protein, 11 aa, Dengue virus
KCPLLRQNEPE

SEQ ID NO: 45231 - protein, 11 aa, Dengue virus
CPLLRQNEPED

SEQ ID NO: 45232 - protein, 11 aa, Dengue virus
PLLRQNEPEDI

SEQ ID NO: 45233 - protein, 11 aa, Dengue virus
LLRQNEPEDID

SEQ ID NO: 45234 - protein, 11 aa, Dengue virus
LRQNEPEDIDC

SEQ ID NO: 45235 - protein, 11 aa, Dengue virus
RQNEPEDIDCW

SEQ ID NO: 45236 - protein, 11 aa, Dengue virus
QNEPEDIDCWC

SEQ ID NO: 45237 - protein, 11 aa, Dengue virus
NEPEDIDCWCN

SEQ ID NO: 45238 - protein, 11 aa, Dengue virus
EPEDIDCWCNS

SEQ ID NO: 45239 - protein, 11 aa, Dengue virus
PEDIDCWCNST

SEQ ID NO: 45240 - protein, 11 aa, Dengue virus
EDIDCWCNSTS

SEQ ID NO: 45241 - protein, 11 aa, Dengue virus
DIDCWCNSTST

SEQ ID NO: 45242 - protein, 11 aa, Dengue virus
IDCWCNSTSTW

SEQ ID NO: 45243 - protein, 11 aa, Dengue virus
DCWCNSTSTWV

SEQ ID NO: 45244 - protein, 11 aa, Dengue virus
CWCNSTSTWVT

SEQ ID NO: 45245 - protein, 11 aa, Dengue virus
WCNSTSTWVTY

SEQ ID NO: 45246 - protein, 11 aa, Dengue virus
CNSTSTWVTYG

SEQ ID NO: 45247 - protein, 11 aa, Dengue virus
NSTSTWVTYGT

SEQ ID NO: 45248 - protein, 11 aa, Dengue virus
STSTWVTYGTC

SEQ ID NO: 45249 - protein, 11 aa, Dengue virus
TSTWVTYGTCT

SEQ ID NO: 45250 - protein, 11 aa, Dengue virus
TTGEHRREKRS

SEQ ID NO: 45251 - protein, 11 aa, Dengue virus
TGEHRREKRSV

SEQ ID NO: 45252 - protein, 11 aa, Dengue virus
GEHRREKRSVA

SEQ ID NO: 45253 - protein, 11 aa, Dengue virus
EHRREKRSVAL

SEQ ID NO: 45254 - protein, 11 aa, Dengue virus
HRREKRSVALV

SEQ ID NO: 45255 - protein, 11 aa, Dengue virus
RREKRSVALVP

SEQ ID NO: 45256 - protein, 11 aa, Dengue virus
REKRSVALVPH

SEQ ID NO: 45257 - protein, 11 aa, Dengue virus
EKRSVALVPHV

SEQ ID NO: 45258 - protein, 11 aa, Dengue virus
KRSVALVPHVG

SEQ ID NO: 45259 - protein, 11 aa, Dengue virus
RSVALVPHVGM

SEQ ID NO: 45260 - protein, 11 aa, Dengue virus
SVALVPHVGMG

SEQ ID NO: 45261 - protein, 11 aa, Dengue virus
VALVPHVGMGL

SEQ ID NO: 45262 - protein, 11 aa, Dengue virus
ALVPHVGMGLE

SEQ ID NO: 45263 - protein, 11 aa, Dengue virus
LVPHVGMGLET

SEQ ID NO: 45264 - protein, 11 aa, Dengue virus
VPHVGMGLETR

SEQ ID NO: 45265 - protein, 11 aa, Dengue virus
PHVGMGLETRT

SEQ ID NO: 45266 - protein, 11 aa, Dengue virus
HVGMGLETRTE

SEQ ID NO: 45267 - protein, 11 aa, Dengue virus
VGMGLETRTET

SEQ ID NO: 45268 - protein, 11 aa, Dengue virus
GMGLETRTETW

SEQ ID NO: 45269 - protein, 11 aa, Dengue virus
MGLETRTETWM

SEQ ID NO: 45270 - protein, 11 aa, Dengue virus
GLETRTETWMS

SEQ ID NO: 45271 - protein, 11 aa, Dengue virus
LETRTETWMSS

SEQ ID NO: 45272 - protein, 11 aa, Dengue virus
ETRTETWMSSE

SEQ ID NO: 45273 - protein, 11 aa, Dengue virus
TRTETWMSSEG

SEQ ID NO: 45274 - protein, 11 aa, Dengue virus
RTETWMSSEGA

SEQ ID NO: 45275 - protein, 11 aa, Dengue virus
TETWMSSEGAW

SEQ ID NO: 45276 - protein, 11 aa, Dengue virus
ETWMSSEGAWK

SEQ ID NO: 45277 - protein, 11 aa, Dengue virus
TWMSSEGAWKH

SEQ ID NO: 45278 - protein, 11 aa, Dengue virus
WMSSEGAWKHV

SEQ ID NO: 45279 - protein, 11 aa, Dengue virus
MSSEGAWKHVQ

SEQ ID NO: 45280 - protein, 11 aa, Dengue virus
SSEGAWKHVQR

SEQ ID NO: 45281 - protein, 11 aa, Dengue virus
SEGAWKHVQRI

SEQ ID NO: 45282 - protein, 11 aa, Dengue virus
EGAWKHVQRIE

SEQ ID NO: 45283 - protein, 11 aa, Dengue virus
GAWKHVQRIET

SEQ ID NO: 45284 - protein, 11 aa, Dengue virus
AWKHVQRIETW

SEQ ID NO: 45285 - protein, 11 aa, Dengue virus
WKHVQRIETWI

SEQ ID NO: 45286 - protein, 11 aa, Dengue virus
KHVQRIETWIL

SEQ ID NO: 45287 - protein, 11 aa, Dengue virus
HVQRIETWILR

SEQ ID NO: 45288 - protein, 11 aa, Dengue virus
VQRIETWILRH

SEQ ID NO: 45289 - protein, 11 aa, Dengue virus
QRIETWILRHP

SEQ ID NO: 45290 - protein, 11 aa, Dengue virus
RIETWILRHPG

SEQ ID NO: 45291 - protein, 11 aa, Dengue virus
IETWILRHPGF

SEQ ID NO: 45292 - protein, 11 aa, Dengue virus
ETWILRHPGFT

SEQ ID NO: 45293 - protein, 11 aa, Dengue virus
LRHPGFTIMAA

SEQ ID NO: 45294 - protein, 11 aa, Dengue virus
MAAILAYTIGT

SEQ ID NO: 45295 - protein, 11 aa, Dengue virus
AAILAYTIGTT

SEQ ID NO: 45296 - protein, 11 aa, Dengue virus
AILAYTIGTTH

SEQ ID NO: 45297 - protein, 11 aa, Dengue virus
ILAYTIGTTHF

SEQ ID NO: 45298 - protein, 11 aa, Dengue virus
LAYTIGTTHFQ

SEQ ID NO: 45299 - protein, 11 aa, Dengue virus
AYTIGTTHFQR

SEQ ID NO: 45300 - protein, 11 aa, Dengue virus
GTTHFQRALIF

SEQ ID NO: 45301 - protein, 11 aa, Dengue virus
TTHFQRALIFI

SEQ ID NO: 45302 - protein, 11 aa, Dengue virus
THFQRALIFIL

SEQ ID NO: 45303 - protein, 11 aa, Dengue virus
HFQRALIFILL

SEQ ID NO: 45304 - protein, 11 aa, Dengue virus
FQRALIFILLT

SEQ ID NO: 45305 - protein, 11 aa, Dengue virus
LIFILLTAVAP

SEQ ID NO: 45306 - protein, 11 aa, Dengue virus
IFILLTAVAPS

SEQ ID NO: 45307 - protein, 11 aa, Dengue virus
FILLTAVAPSM

SEQ ID NO: 45308 - protein, 11 aa, Dengue virus
LLTAVAPSMTM

SEQ ID NO: 45309 - protein, 11 aa, Dengue virus
LTAVAPSMTMR

SEQ ID NO: 45310 - protein, 11 aa, Dengue virus
TAVAPSMTMRC

SEQ ID NO: 45311 - protein, 11 aa, Dengue virus
AVAPSMTMRCI

SEQ ID NO: 45312 - protein, 11 aa, Dengue virus
VAPSMTMRCIG

SEQ ID NO: 45313 - protein, 11 aa, Dengue virus
APSMTMRCIGI

SEQ ID NO: 45314 - protein, 11 aa, Dengue virus
PSMTMRCIGIS

SEQ ID NO: 45315 - protein, 11 aa, Dengue virus
SMTMRCIGISN

SEQ ID NO: 45316 - protein, 11 aa, Dengue virus
MTMRCIGISNR

SEQ ID NO: 45317 - protein, 11 aa, Dengue virus
TMRCIGISNRD

SEQ ID NO: 45318 - protein, 11 aa, Dengue virus
MRCIGISNRDF

SEQ ID NO: 45319 - protein, 11 aa, Dengue virus
RCIGISNRDFV

SEQ ID NO: 45320 - protein, 11 aa, Dengue virus
CIGISNRDFVE

SEQ ID NO: 45321 - protein, 11 aa, Dengue virus
IGISNRDFVEG

SEQ ID NO: 45322 - protein, 11 aa, Dengue virus
GISNRDFVEGV

SEQ ID NO: 45323 - protein, 11 aa, Dengue virus
ISNRDFVEGVS

SEQ ID NO: 45324 - protein, 11 aa, Dengue virus
SNRDFVEGVSG

SEQ ID NO: 45325 - protein, 11 aa, Dengue virus
NRDFVEGVSGG

SEQ ID NO: 45326 - protein, 11 aa, Dengue virus
RDFVEGVSGGS

SEQ ID NO: 45327 - protein, 11 aa, Dengue virus
DFVEGVSGGSW

SEQ ID NO: 45328 - protein, 11 aa, Dengue virus
FVEGVSGGSWV

SEQ ID NO: 45329 - protein, 11 aa, Dengue virus
VEGVSGGSWVD

SEQ ID NO: 45330 - protein, 11 aa, Dengue virus
EGVSGGSWVDI

SEQ ID NO: 45331 - protein, 11 aa, Dengue virus
GVSGGSWVDIV

SEQ ID NO: 45332 - protein, 11 aa, Dengue virus
VSGGSWVDIVL

SEQ ID NO: 45333 - protein, 11 aa, Dengue virus
SGGSWVDIVLE

SEQ ID NO: 45334 - protein, 11 aa, Dengue virus
GGSWVDIVLEH

SEQ ID NO: 45335 - protein, 11 aa, Dengue virus
GSWVDIVLEHG

SEQ ID NO: 45336 - protein, 11 aa, Dengue virus
SWVDIVLEHGS

SEQ ID NO: 45337 - protein, 11 aa, Dengue virus
WVDIVLEHGSC

SEQ ID NO: 45338 - protein, 11 aa, Dengue virus
VDIVLEHGSCV

SEQ ID NO: 45339 - protein, 11 aa, Dengue virus
DIVLEHGSCVT

SEQ ID NO: 45340 - protein, 11 aa, Dengue virus
IVLEHGSCVTT

SEQ ID NO: 45341 - protein, 11 aa, Dengue virus
VLEHGSCVTTM

SEQ ID NO: 45342 - protein, 11 aa, Dengue virus
LEHGSCVTTMA

SEQ ID NO: 45343 - protein, 11 aa, Dengue virus
EHGSCVTTMAK

SEQ ID NO: 45344 - protein, 11 aa, Dengue virus
HGSCVTTMAKN

SEQ ID NO: 45345 - protein, 11 aa, Dengue virus
GSCVTTMAKNK

SEQ ID NO: 45346 - protein, 11 aa, Dengue virus
SCVTTMAKNKP

SEQ ID NO: 45347 - protein, 11 aa, Dengue virus
CVTTMAKNKPT

SEQ ID NO: 45348 - protein, 11 aa, Dengue virus
VTTMAKNKPTL

SEQ ID NO: 45349 - protein, 11 aa, Dengue virus
TTMAKNKPTLD

SEQ ID NO: 45350 - protein, 11 aa, Dengue virus
TMAKNKPTLDF

SEQ ID NO: 45351 - protein, 11 aa, Dengue virus
MAKNKPTLDFE

SEQ ID NO: 45352 - protein, 11 aa, Dengue virus
AKNKPTLDFEL

SEQ ID NO: 45353 - protein, 11 aa, Dengue virus
KNKPTLDFELI

SEQ ID NO: 45354 - protein, 11 aa, Dengue virus
NKPTLDFELIK

SEQ ID NO: 45355 - protein, 11 aa, Dengue virus
KPTLDFELIKT

SEQ ID NO: 45356 - protein, 11 aa, Dengue virus
PTLDFELIKTE

SEQ ID NO: 45357 - protein, 11 aa, Dengue virus
TLDFELIKTEA

SEQ ID NO: 45358 - protein, 11 aa, Dengue virus
LDFELIKTEAK

SEQ ID NO: 45359 - protein, 11 aa, Dengue virus
DFELIKTEAKQ

SEQ ID NO: 45360 - protein, 11 aa, Dengue virus
KTEAKQPATLR

SEQ ID NO: 45361 - protein, 11 aa, Dengue virus
TEAKQPATLRK

SEQ ID NO: 45362 - protein, 11 aa, Dengue virus
EAKQPATLRKY

SEQ ID NO: 45363 - protein, 11 aa, Dengue virus
AKQPATLRKYC

SEQ ID NO: 45364 - protein, 11 aa, Dengue virus
PATLRKYCIEA

SEQ ID NO: 45365 - protein, 11 aa, Dengue virus
ATLRKYCIEAK

SEQ ID NO: 45366 - protein, 11 aa, Dengue virus
TLRKYCIEAKL

SEQ ID NO: 45367 - protein, 11 aa, Dengue virus
LRKYCIEAKLT

SEQ ID NO: 45368 - protein, 11 aa, Dengue virus
RKYCIEAKLTN

SEQ ID NO: 45369 - protein, 11 aa, Dengue virus
KYCIEAKLTNT

SEQ ID NO: 45370 - protein, 11 aa, Dengue virus
YCIEAKLTNTT

SEQ ID NO: 45371 - protein, 11 aa, Dengue virus
CIEAKLTNTTT

SEQ ID NO: 45372 - protein, 11 aa, Dengue virus
IEAKLTNTTTE

SEQ ID NO: 45373 - protein, 11 aa, Dengue virus
EAKLTNTTTES

SEQ ID NO: 45374 - protein, 11 aa, Dengue virus
AKLTNTTTESR

SEQ ID NO: 45375 - protein, 11 aa, Dengue virus
KLTNTTTESRC

SEQ ID NO: 45376 - protein, 11 aa, Dengue virus
LTNTTTESRCP

SEQ ID NO: 45377 - protein, 11 aa, Dengue virus
TNTTTESRCPT

SEQ ID NO: 45378 - protein, 11 aa, Dengue virus
NTTTESRCPTQ

SEQ ID NO: 45379 - protein, 11 aa, Dengue virus
TTTESRCPTQG

SEQ ID NO: 45380 - protein, 11 aa, Dengue virus
TTESRCPTQGE

SEQ ID NO: 45381 - protein, 11 aa, Dengue virus
TESRCPTQGEP

SEQ ID NO: 45382 - protein, 11 aa, Dengue virus
ESRCPTQGEPS

SEQ ID NO: 45383 - protein, 11 aa, Dengue virus
SRCPTQGEPSL

SEQ ID NO: 45384 - protein, 11 aa, Dengue virus
RCPTQGEPSLN

SEQ ID NO: 45385 - protein, 11 aa, Dengue virus
CPTQGEPSLNE

SEQ ID NO: 45386 - protein, 11 aa, Dengue virus
PTQGEPSLNEE

SEQ ID NO: 45387 - protein, 11 aa, Dengue virus
TQGEPSLNEEQ

SEQ ID NO: 45388 - protein, 11 aa, Dengue virus
QGEPSLNEEQD

SEQ ID NO: 45389 - protein, 11 aa, Dengue virus
GEPSLNEEQDK

SEQ ID NO: 45390 - protein, 11 aa, Dengue virus
EPSLNEEQDKR

SEQ ID NO: 45391 - protein, 11 aa, Dengue virus
PSLNEEQDKRF

SEQ ID NO: 45392 - protein, 11 aa, Dengue virus
EEQDKRFVCKH

SEQ ID NO: 45393 - protein, 11 aa, Dengue virus
EQDKRFVCKHS

SEQ ID NO: 45394 - protein, 11 aa, Dengue virus
QDKRFVCKHSM

SEQ ID NO: 45395 - protein, 11 aa, Dengue virus
DKRFVCKHSMV

SEQ ID NO: 45396 - protein, 11 aa, Dengue virus
KRFVCKHSMVD

SEQ ID NO: 45397 - protein, 11 aa, Dengue virus
RFVCKHSMVDR

SEQ ID NO: 45398 - protein, 11 aa, Dengue virus
FVCKHSMVDRG

SEQ ID NO: 45399 - protein, 11 aa, Dengue virus
VCKHSMVDRGW

SEQ ID NO: 45400 - protein, 11 aa, Dengue virus
CKHSMVDRGWG

SEQ ID NO: 45401 - protein, 11 aa, Dengue virus
KHSMVDRGWGN

SEQ ID NO: 45402 - protein, 11 aa, Dengue virus
HSMVDRGWGNG

SEQ ID NO: 45403 - protein, 11 aa, Dengue virus
SMVDRGWGNGC

SEQ ID NO: 45404 - protein, 11 aa, Dengue virus
MVDRGWGNGCG

SEQ ID NO: 45405 - protein, 11 aa, Dengue virus
VDRGWGNGCGL

SEQ ID NO: 45406 - protein, 11 aa, Dengue virus
DRGWGNGCGLF

SEQ ID NO: 45407 - protein, 11 aa, Dengue virus
RGWGNGCGLFG

SEQ ID NO: 45408 - protein, 11 aa, Dengue virus
GWGNGCGLFGK

SEQ ID NO: 45409 - protein, 11 aa, Dengue virus
WGNGCGLFGKG

SEQ ID NO: 45410 - protein, 11 aa, Dengue virus
GNGCGLFGKGG

SEQ ID NO: 45411 - protein, 11 aa, Dengue virus
NGCGLFGKGGI

SEQ ID NO: 45412 - protein, 11 aa, Dengue virus
GCGLFGKGGIV

SEQ ID NO: 45413 - protein, 11 aa, Dengue virus
CGLFGKGGIVT

SEQ ID NO: 45414 - protein, 11 aa, Dengue virus
GLFGKGGIVTC

SEQ ID NO: 45415 - protein, 11 aa, Dengue virus
LFGKGGIVTCA

SEQ ID NO: 45416 - protein, 11 aa, Dengue virus
FGKGGIVTCAM

SEQ ID NO: 45417 - protein, 11 aa, Dengue virus
GKGGIVTCAMF

SEQ ID NO: 45418 - protein, 11 aa, Dengue virus
KGGIVTCAMFT

SEQ ID NO: 45419 - protein, 11 aa, Dengue virus
GGIVTCAMFTC

SEQ ID NO: 45420 - protein, 11 aa, Dengue virus
GIVTCAMFTCK

SEQ ID NO: 45421 - protein, 11 aa, Dengue virus
IVTCAMFTCKK

SEQ ID NO: 45422 - protein, 11 aa, Dengue virus
VTCAMFTCKKN

SEQ ID NO: 45423 - protein, 11 aa, Dengue virus
TCAMFTCKKNM

SEQ ID NO: 45424 - protein, 11 aa, Dengue virus
AMFTCKKNMEG

SEQ ID NO: 45425 - protein, 11 aa, Dengue virus
CKKNMEGKIVQ

SEQ ID NO: 45426 - protein, 11 aa, Dengue virus
KKNMEGKIVQP

SEQ ID NO: 45427 - protein, 11 aa, Dengue virus
KNMEGKIVQPE

SEQ ID NO: 45428 - protein, 11 aa, Dengue virus
NMEGKIVQPEN

SEQ ID NO: 45429 - protein, 11 aa, Dengue virus
MEGKIVQPENL

SEQ ID NO: 45430 - protein, 11 aa, Dengue virus
EGKIVQPENLE

SEQ ID NO: 45431 - protein, 11 aa, Dengue virus
GKIVQPENLEY

SEQ ID NO: 45432 - protein, 11 aa, Dengue virus
KIVQPENLEYT

SEQ ID NO: 45433 - protein, 11 aa, Dengue virus
IVQPENLEYTI

SEQ ID NO: 45434 - protein, 11 aa, Dengue virus
VQPENLEYTIV

SEQ ID NO: 45435 - protein, 11 aa, Dengue virus
QPENLEYTIVI

SEQ ID NO: 45436 - protein, 11 aa, Dengue virus
PENLEYTIVIT

SEQ ID NO: 45437 - protein, 11 aa, Dengue virus
ENLEYTIVITP

SEQ ID NO: 45438 - protein, 11 aa, Dengue virus
NLEYTIVITPH

SEQ ID NO: 45439 - protein, 11 aa, Dengue virus
LEYTIVITPHS

SEQ ID NO: 45440 - protein, 11 aa, Dengue virus
EYTIVITPHSG

SEQ ID NO: 45441 - protein, 11 aa, Dengue virus
YTIVITPHSGE

SEQ ID NO: 45442 - protein, 11 aa, Dengue virus
TIVITPHSGEE

SEQ ID NO: 45443 - protein, 11 aa, Dengue virus
IVITPHSGEEH

SEQ ID NO: 45444 - protein, 11 aa, Dengue virus
VITPHSGEEHA

SEQ ID NO: 45445 - protein, 11 aa, Dengue virus
ITPHSGEEHAV

SEQ ID NO: 45446 - protein, 11 aa, Dengue virus
TPHSGEEHAVG

SEQ ID NO: 45447 - protein, 11 aa, Dengue virus
PHSGEEHAVGN

SEQ ID NO: 45448 - protein, 11 aa, Dengue virus
HSGEEHAVGND

SEQ ID NO: 45449 - protein, 11 aa, Dengue virus
SGEEHAVGNDT

SEQ ID NO: 45450 - protein, 11 aa, Dengue virus
GEEHAVGNDTG

SEQ ID NO: 45451 - protein, 11 aa, Dengue virus
EEHAVGNDTGK

SEQ ID NO: 45452 - protein, 11 aa, Dengue virus
EHAVGNDTGKH

SEQ ID NO: 45453 - protein, 11 aa, Dengue virus
HAVGNDTGKHG

SEQ ID NO: 45454 - protein, 11 aa, Dengue virus
AVGNDTGKHGK

SEQ ID NO: 45455 - protein, 11 aa, Dengue virus
VGNDTGKHGKE

SEQ ID NO: 45456 - protein, 11 aa, Dengue virus
GNDTGKHGKEI

SEQ ID NO: 45457 - protein, 11 aa, Dengue virus
NDTGKHGKEIK

SEQ ID NO: 45458 - protein, 11 aa, Dengue virus
DTGKHGKEIKI

SEQ ID NO: 45459 - protein, 11 aa, Dengue virus
TGKHGKEIKIT

SEQ ID NO: 45460 - protein, 11 aa, Dengue virus
GKHGKEIKITP

SEQ ID NO: 45461 - protein, 11 aa, Dengue virus
KHGKEIKITPQ

SEQ ID NO: 45462 - protein, 11 aa, Dengue virus
HGKEIKITPQS

SEQ ID NO: 45463 - protein, 11 aa, Dengue virus
EAELTGYGTVT

SEQ ID NO: 45464 - protein, 11 aa, Dengue virus
AELTGYGTVTM

SEQ ID NO: 45465 - protein, 11 aa, Dengue virus
ELTGYGTVTME

SEQ ID NO: 45466 - protein, 11 aa, Dengue virus
LTGYGTVTMEC

SEQ ID NO: 45467 - protein, 11 aa, Dengue virus
TGYGTVTMECS

SEQ ID NO: 45468 - protein, 11 aa, Dengue virus
GYGTVTMECSP

SEQ ID NO: 45469 - protein, 11 aa, Dengue virus
YGTVTMECSPR

SEQ ID NO: 45470 - protein, 11 aa, Dengue virus
GTVTMECSPRT

SEQ ID NO: 45471 - protein, 11 aa, Dengue virus
TVTMECSPRTG

SEQ ID NO: 45472 - protein, 11 aa, Dengue virus
VTMECSPRTGL

SEQ ID NO: 45473 - protein, 11 aa, Dengue virus
TMECSPRTGLD

SEQ ID NO: 45474 - protein, 11 aa, Dengue virus
MECSPRTGLDF

SEQ ID NO: 45475 - protein, 11 aa, Dengue virus
ECSPRTGLDFN

SEQ ID NO: 45476 - protein, 11 aa, Dengue virus
CSPRTGLDFNE

SEQ ID NO: 45477 - protein, 11 aa, Dengue virus
SPRTGLDFNEM

SEQ ID NO: 45478 - protein, 11 aa, Dengue virus
PRTGLDFNEMV

SEQ ID NO: 45479 - protein, 11 aa, Dengue virus
RTGLDFNEMVL

SEQ ID NO: 45480 - protein, 11 aa, Dengue virus
TGLDFNEMVLL

SEQ ID NO: 45481 - protein, 11 aa, Dengue virus
GLDFNEMVLLQ

SEQ ID NO: 45482 - protein, 11 aa, Dengue virus
LDFNEMVLLQM

SEQ ID NO: 45483 - protein, 11 aa, Dengue virus
DFNEMVLLQME

SEQ ID NO: 45484 - protein, 11 aa, Dengue virus
MEDKAWLVHRQ

SEQ ID NO: 45485 - protein, 11 aa, Dengue virus
EDKAWLVHRQW

SEQ ID NO: 45486 - protein, 11 aa, Dengue virus
DKAWLVHRQWF

SEQ ID NO: 45487 - protein, 11 aa, Dengue virus
KAWLVHRQWFL

SEQ ID NO: 45488 - protein, 11 aa, Dengue virus
AWLVHRQWFLD

SEQ ID NO: 45489 - protein, 11 aa, Dengue virus
WLVHRQWFLDL

SEQ ID NO: 45490 - protein, 11 aa, Dengue virus
LVHRQWFLDLP

SEQ ID NO: 45491 - protein, 11 aa, Dengue virus
VHRQWFLDLPL

SEQ ID NO: 45492 - protein, 11 aa, Dengue virus
HRQWFLDLPLP

SEQ ID NO: 45493 - protein, 11 aa, Dengue virus
RQWFLDLPLPW

SEQ ID NO: 45494 - protein, 11 aa, Dengue virus
QWFLDLPLPWL

SEQ ID NO: 45495 - protein, 11 aa, Dengue virus
WFLDLPLPWLP

SEQ ID NO: 45496 - protein, 11 aa, Dengue virus
FLDLPLPWLPG

SEQ ID NO: 45497 - protein, 11 aa, Dengue virus
LDLPLPWLPGA

SEQ ID NO: 45498 - protein, 11 aa, Dengue virus
DLPLPWLPGAD

SEQ ID NO: 45499 - protein, 11 aa, Dengue virus
LPLPWLPGADT

SEQ ID NO: 45500 - protein, 11 aa, Dengue virus
PLPWLPGADTQ

SEQ ID NO: 45501 - protein, 11 aa, Dengue virus
LPWLPGADTQG

SEQ ID NO: 45502 - protein, 11 aa, Dengue virus
PWLPGADTQGS

SEQ ID NO: 45503 - protein, 11 aa, Dengue virus
WLPGADTQGSN

SEQ ID NO: 45504 - protein, 11 aa, Dengue virus
LPGADTQGSNW

SEQ ID NO: 45505 - protein, 11 aa, Dengue virus
PGADTQGSNWI

SEQ ID NO: 45506 - protein, 11 aa, Dengue virus
GADTQGSNWIQ

SEQ ID NO: 45507 - protein, 11 aa, Dengue virus
ADTQGSNWIQK

SEQ ID NO: 45508 - protein, 11 aa, Dengue virus
DTQGSNWIQKE

SEQ ID NO: 45509 - protein, 11 aa, Dengue virus
QGSNWIQKETL

SEQ ID NO: 45510 - protein, 11 aa, Dengue virus
GSNWIQKETLV

SEQ ID NO: 45511 - protein, 11 aa, Dengue virus
SNWIQKETLVT

SEQ ID NO: 45512 - protein, 11 aa, Dengue virus
NWIQKETLVTF

SEQ ID NO: 45513 - protein, 11 aa, Dengue virus
WIQKETLVTFK

SEQ ID NO: 45514 - protein, 11 aa, Dengue virus
IQKETLVTFKN

SEQ ID NO: 45515 - protein, 11 aa, Dengue virus
QKETLVTFKNP

SEQ ID NO: 45516 - protein, 11 aa, Dengue virus
KETLVTFKNPH

SEQ ID NO: 45517 - protein, 11 aa, Dengue virus
ETLVTFKNPHA

SEQ ID NO: 45518 - protein, 11 aa, Dengue virus
TLVTFKNPHAK

SEQ ID NO: 45519 - protein, 11 aa, Dengue virus
LVTFKNPHAKK

SEQ ID NO: 45520 - protein, 11 aa, Dengue virus
VTFKNPHAKKQ

SEQ ID NO: 45521 - protein, 11 aa, Dengue virus
TFKNPHAKKQD

SEQ ID NO: 45522 - protein, 11 aa, Dengue virus
FKNPHAKKQDV

SEQ ID NO: 45523 - protein, 11 aa, Dengue virus
KNPHAKKQDVV

SEQ ID NO: 45524 - protein, 11 aa, Dengue virus
NPHAKKQDVVV

SEQ ID NO: 45525 - protein, 11 aa, Dengue virus
PHAKKQDVVVL

SEQ ID NO: 45526 - protein, 11 aa, Dengue virus
HAKKQDVVVLG

SEQ ID NO: 45527 - protein, 11 aa, Dengue virus
AKKQDVVVLGS

SEQ ID NO: 45528 - protein, 11 aa, Dengue virus
KKQDVVVLGSQ

SEQ ID NO: 45529 - protein, 11 aa, Dengue virus
KQDVVVLGSQE

SEQ ID NO: 45530 - protein, 11 aa, Dengue virus
QDVVVLGSQEG

SEQ ID NO: 45531 - protein, 11 aa, Dengue virus
DVVVLGSQEGA

SEQ ID NO: 45532 - protein, 11 aa, Dengue virus
VVVLGSQEGAM

SEQ ID NO: 45533 - protein, 11 aa, Dengue virus
VVLGSQEGAMH

SEQ ID NO: 45534 - protein, 11 aa, Dengue virus
VLGSQEGAMHT

SEQ ID NO: 45535 - protein, 11 aa, Dengue virus
LGSQEGAMHTA

SEQ ID NO: 45536 - protein, 11 aa, Dengue virus
GSQEGAMHTAL

SEQ ID NO: 45537 - protein, 11 aa, Dengue virus
SQEGAMHTALT

SEQ ID NO: 45538 - protein, 11 aa, Dengue virus
QEGAMHTALTG

SEQ ID NO: 45539 - protein, 11 aa, Dengue virus
EGAMHTALTGA

SEQ ID NO: 45540 - protein, 11 aa, Dengue virus
GAMHTALTGAT

SEQ ID NO: 45541 - protein, 11 aa, Dengue virus
AMHTALTGATE

SEQ ID NO: 45542 - protein, 11 aa, Dengue virus
MHTALTGATEI

SEQ ID NO: 45543 - protein, 11 aa, Dengue virus
HTALTGATEIQ

SEQ ID NO: 45544 - protein, 11 aa, Dengue virus
TALTGATEIQM

SEQ ID NO: 45545 - protein, 11 aa, Dengue virus
ALTGATEIQMS

SEQ ID NO: 45546 - protein, 11 aa, Dengue virus
LTGATEIQMSS

SEQ ID NO: 45547 - protein, 11 aa, Dengue virus
TGATEIQMSSG

SEQ ID NO: 45548 - protein, 11 aa, Dengue virus
GATEIQMSSGN

SEQ ID NO: 45549 - protein, 11 aa, Dengue virus
ATEIQMSSGNL

SEQ ID NO: 45550 - protein, 11 aa, Dengue virus
TEIQMSSGNLL

SEQ ID NO: 45551 - protein, 11 aa, Dengue virus
EIQMSSGNLLF

SEQ ID NO: 45552 - protein, 11 aa, Dengue virus
IQMSSGNLLFT

SEQ ID NO: 45553 - protein, 11 aa, Dengue virus
QMSSGNLLFTG

SEQ ID NO: 45554 - protein, 11 aa, Dengue virus
MSSGNLLFTGH

SEQ ID NO: 45555 - protein, 11 aa, Dengue virus
SSGNLLFTGHL

SEQ ID NO: 45556 - protein, 11 aa, Dengue virus
SGNLLFTGHLK

SEQ ID NO: 45557 - protein, 11 aa, Dengue virus
GNLLFTGHLKC

SEQ ID NO: 45558 - protein, 11 aa, Dengue virus
NLLFTGHLKCR

SEQ ID NO: 45559 - protein, 11 aa, Dengue virus
LLFTGHLKCRL

SEQ ID NO: 45560 - protein, 11 aa, Dengue virus
LFTGHLKCRLR

SEQ ID NO: 45561 - protein, 11 aa, Dengue virus
FTGHLKCRLRM

SEQ ID NO: 45562 - protein, 11 aa, Dengue virus
TGHLKCRLRMD

SEQ ID NO: 45563 - protein, 11 aa, Dengue virus
GHLKCRLRMDK

SEQ ID NO: 45564 - protein, 11 aa, Dengue virus
HLKCRLRMDKL

SEQ ID NO: 45565 - protein, 11 aa, Dengue virus
LKCRLRMDKLQ

SEQ ID NO: 45566 - protein, 11 aa, Dengue virus
KCRLRMDKLQL

SEQ ID NO: 45567 - protein, 11 aa, Dengue virus
CRLRMDKLQLK

SEQ ID NO: 45568 - protein, 11 aa, Dengue virus
RLRMDKLQLKG

SEQ ID NO: 45569 - protein, 11 aa, Dengue virus
LRMDKLQLKGM

SEQ ID NO: 45570 - protein, 11 aa, Dengue virus
RMDKLQLKGMS

SEQ ID NO: 45571 - protein, 11 aa, Dengue virus
MDKLQLKGMSY

SEQ ID NO: 45572 - protein, 11 aa, Dengue virus
DKLQLKGMSYS

SEQ ID NO: 45573 - protein, 11 aa, Dengue virus
KLQLKGMSYSM

SEQ ID NO: 45574 - protein, 11 aa, Dengue virus
LQLKGMSYSMC

SEQ ID NO: 45575 - protein, 11 aa, Dengue virus
QLKGMSYSMCT

SEQ ID NO: 45576 - protein, 11 aa, Dengue virus
LKGMSYSMCTG

SEQ ID NO: 45577 - protein, 11 aa, Dengue virus
KGMSYSMCTGK

SEQ ID NO: 45578 - protein, 11 aa, Dengue virus
GMSYSMCTGKF

SEQ ID NO: 45579 - protein, 11 aa, Dengue virus
MSYSMCTGKFK

SEQ ID NO: 45580 - protein, 11 aa, Dengue virus
SYSMCTGKFKI

SEQ ID NO: 45581 - protein, 11 aa, Dengue virus
YSMCTGKFKIV

SEQ ID NO: 45582 - protein, 11 aa, Dengue virus
SMCTGKFKIVK

SEQ ID NO: 45583 - protein, 11 aa, Dengue virus
MCTGKFKIVKE

SEQ ID NO: 45584 - protein, 11 aa, Dengue virus
CTGKFKIVKEI

SEQ ID NO: 45585 - protein, 11 aa, Dengue virus
TGKFKIVKEIA

SEQ ID NO: 45586 - protein, 11 aa, Dengue virus
GKFKIVKEIAE

SEQ ID NO: 45587 - protein, 11 aa, Dengue virus
KFKIVKEIAET

SEQ ID NO: 45588 - protein, 11 aa, Dengue virus
FKIVKEIAETQ

SEQ ID NO: 45589 - protein, 11 aa, Dengue virus
KIVKEIAETQH

SEQ ID NO: 45590 - protein, 11 aa, Dengue virus
IVKEIAETQHG

SEQ ID NO: 45591 - protein, 11 aa, Dengue virus
VKEIAETQHGT

SEQ ID NO: 45592 - protein, 11 aa, Dengue virus
KEIAETQHGTI

SEQ ID NO: 45593 - protein, 11 aa, Dengue virus
EIAETQHGTIV

SEQ ID NO: 45594 - protein, 11 aa, Dengue virus
IAETQHGTIVI

SEQ ID NO: 45595 - protein, 11 aa, Dengue virus
AETQHGTIVIR

SEQ ID NO: 45596 - protein, 11 aa, Dengue virus
ETQHGTIVIRV

SEQ ID NO: 45597 - protein, 11 aa, Dengue virus
TQHGTIVIRVQ

SEQ ID NO: 45598 - protein, 11 aa, Dengue virus
QHGTIVIRVQY

SEQ ID NO: 45599 - protein, 11 aa, Dengue virus
HGTIVIRVQYE

SEQ ID NO: 45600 - protein, 11 aa, Dengue virus
GTIVIRVQYEG

SEQ ID NO: 45601 - protein, 11 aa, Dengue virus
TIVIRVQYEGD

SEQ ID NO: 45602 - protein, 11 aa, Dengue virus
VIRVQYEGDGS

SEQ ID NO: 45603 - protein, 11 aa, Dengue virus
IRVQYEGDGSP

SEQ ID NO: 45604 - protein, 11 aa, Dengue virus
RVQYEGDGSPC

SEQ ID NO: 45605 - protein, 11 aa, Dengue virus
VQYEGDGSPCK

SEQ ID NO: 45606 - protein, 11 aa, Dengue virus
QYEGDGSPCKI

SEQ ID NO: 45607 - protein, 11 aa, Dengue virus
YEGDGSPCKIP

SEQ ID NO: 45608 - protein, 11 aa, Dengue virus
EGDGSPCKIPF

SEQ ID NO: 45609 - protein, 11 aa, Dengue virus
GDGSPCKIPFE

SEQ ID NO: 45610 - protein, 11 aa, Dengue virus
DGSPCKIPFEI

SEQ ID NO: 45611 - protein, 11 aa, Dengue virus
SPCKIPFEIMD

SEQ ID NO: 45612 - protein, 11 aa, Dengue virus
PCKIPFEIMDL

SEQ ID NO: 45613 - protein, 11 aa, Dengue virus
CKIPFEIMDLE

SEQ ID NO: 45614 - protein, 11 aa, Dengue virus
KIPFEIMDLEK

SEQ ID NO: 45615 - protein, 11 aa, Dengue virus
IPFEIMDLEKR

SEQ ID NO: 45616 - protein, 11 aa, Dengue virus
PFEIMDLEKRH

SEQ ID NO: 45617 - protein, 11 aa, Dengue virus
DLEKRHVLGRL

SEQ ID NO: 45618 - protein, 11 aa, Dengue virus
LEKRHVLGRLI

SEQ ID NO: 45619 - protein, 11 aa, Dengue virus
EKRHVLGRLIT

SEQ ID NO: 45620 - protein, 11 aa, Dengue virus
KRHVLGRLITV

SEQ ID NO: 45621 - protein, 11 aa, Dengue virus
RHVLGRLITVN

SEQ ID NO: 45622 - protein, 11 aa, Dengue virus
HVLGRLITVNP

SEQ ID NO: 45623 - protein, 11 aa, Dengue virus
VLGRLITVNPI

SEQ ID NO: 45624 - protein, 11 aa, Dengue virus
LGRLITVNPIV

SEQ ID NO: 45625 - protein, 11 aa, Dengue virus
GRLITVNPIVT

SEQ ID NO: 45626 - protein, 11 aa, Dengue virus
EKDSPVNIEAE

SEQ ID NO: 45627 - protein, 11 aa, Dengue virus
KDSPVNIEAEP

SEQ ID NO: 45628 - protein, 11 aa, Dengue virus
DSPVNIEAEPP

SEQ ID NO: 45629 - protein, 11 aa, Dengue virus
SPVNIEAEPPF

SEQ ID NO: 45630 - protein, 11 aa, Dengue virus
PVNIEAEPPFG

SEQ ID NO: 45631 - protein, 11 aa, Dengue virus
VNIEAEPPFGD

SEQ ID NO: 45632 - protein, 11 aa, Dengue virus
NIEAEPPFGDS

SEQ ID NO: 45633 - protein, 11 aa, Dengue virus
IEAEPPFGDSY

SEQ ID NO: 45634 - protein, 11 aa, Dengue virus
EAEPPFGDSYI

SEQ ID NO: 45635 - protein, 11 aa, Dengue virus
AEPPFGDSYII

SEQ ID NO: 45636 - protein, 11 aa, Dengue virus
EPPFGDSYIII

SEQ ID NO: 45637 - protein, 11 aa, Dengue virus
PPFGDSYIIIG

SEQ ID NO: 45638 - protein, 11 aa, Dengue virus
PFGDSYIIIGV

SEQ ID NO: 45639 - protein, 11 aa, Dengue virus
FGDSYIIIGVE

SEQ ID NO: 45640 - protein, 11 aa, Dengue virus
GDSYIIIGVEP

SEQ ID NO: 45641 - protein, 11 aa, Dengue virus
DSYIIIGVEPG

SEQ ID NO: 45642 - protein, 11 aa, Dengue virus
SYIIIGVEPGQ

SEQ ID NO: 45643 - protein, 11 aa, Dengue virus
YIIIGVEPGQL

SEQ ID NO: 45644 - protein, 11 aa, Dengue virus
IIIGVEPGQLK

SEQ ID NO: 45645 - protein, 11 aa, Dengue virus
IIGVEPGQLKL

SEQ ID NO: 45646 - protein, 11 aa, Dengue virus
IGVEPGQLKLN

SEQ ID NO: 45647 - protein, 11 aa, Dengue virus
GVEPGQLKLNW

SEQ ID NO: 45648 - protein, 11 aa, Dengue virus
VEPGQLKLNWF

SEQ ID NO: 45649 - protein, 11 aa, Dengue virus
EPGQLKLNWFK

SEQ ID NO: 45650 - protein, 11 aa, Dengue virus
PGQLKLNWFKK

SEQ ID NO: 45651 - protein, 11 aa, Dengue virus
GQLKLNWFKKG

SEQ ID NO: 45652 - protein, 11 aa, Dengue virus
QLKLNWFKKGS

SEQ ID NO: 45653 - protein, 11 aa, Dengue virus
LKLNWFKKGSS

SEQ ID NO: 45654 - protein, 11 aa, Dengue virus
KLNWFKKGSSI

SEQ ID NO: 45655 - protein, 11 aa, Dengue virus
LNWFKKGSSIG

SEQ ID NO: 45656 - protein, 11 aa, Dengue virus
NWFKKGSSIGQ

SEQ ID NO: 45657 - protein, 11 aa, Dengue virus
WFKKGSSIGQM

SEQ ID NO: 45658 - protein, 11 aa, Dengue virus
FKKGSSIGQMF

SEQ ID NO: 45659 - protein, 11 aa, Dengue virus
KKGSSIGQMFE

SEQ ID NO: 45660 - protein, 11 aa, Dengue virus
KGSSIGQMFET

SEQ ID NO: 45661 - protein, 11 aa, Dengue virus
GSSIGQMFETT

SEQ ID NO: 45662 - protein, 11 aa, Dengue virus
SSIGQMFETTM

SEQ ID NO: 45663 - protein, 11 aa, Dengue virus
SIGQMFETTMR

SEQ ID NO: 45664 - protein, 11 aa, Dengue virus
IGQMFETTMRG

SEQ ID NO: 45665 - protein, 11 aa, Dengue virus
GQMFETTMRGA

SEQ ID NO: 45666 - protein, 11 aa, Dengue virus
QMFETTMRGAK

SEQ ID NO: 45667 - protein, 11 aa, Dengue virus
MFETTMRGAKR

SEQ ID NO: 45668 - protein, 11 aa, Dengue virus
FETTMRGAKRM

SEQ ID NO: 45669 - protein, 11 aa, Dengue virus
ETTMRGAKRMA

SEQ ID NO: 45670 - protein, 11 aa, Dengue virus
TTMRGAKRMAI

SEQ ID NO: 45671 - protein, 11 aa, Dengue virus
TMRGAKRMAIL

SEQ ID NO: 45672 - protein, 11 aa, Dengue virus
MRGAKRMAILG

SEQ ID NO: 45673 - protein, 11 aa, Dengue virus
RGAKRMAILGD

SEQ ID NO: 45674 - protein, 11 aa, Dengue virus
GAKRMAILGDT

SEQ ID NO: 45675 - protein, 11 aa, Dengue virus
AKRMAILGDTA

SEQ ID NO: 45676 - protein, 11 aa, Dengue virus
KRMAILGDTAW

SEQ ID NO: 45677 - protein, 11 aa, Dengue virus
RMAILGDTAWD

SEQ ID NO: 45678 - protein, 11 aa, Dengue virus
MAILGDTAWDF

SEQ ID NO: 45679 - protein, 11 aa, Dengue virus
AILGDTAWDFG

SEQ ID NO: 45680 - protein, 11 aa, Dengue virus
ILGDTAWDFGS

SEQ ID NO: 45681 - protein, 11 aa, Dengue virus
LGDTAWDFGSL

SEQ ID NO: 45682 - protein, 11 aa, Dengue virus
GDTAWDFGSLG

SEQ ID NO: 45683 - protein, 11 aa, Dengue virus
DTAWDFGSLGG

SEQ ID NO: 45684 - protein, 11 aa, Dengue virus
TAWDFGSLGGV

SEQ ID NO: 45685 - protein, 11 aa, Dengue virus
AWDFGSLGGVF

SEQ ID NO: 45686 - protein, 11 aa, Dengue virus
WDFGSLGGVFT

SEQ ID NO: 45687 - protein, 11 aa, Dengue virus
DFGSLGGVFTS

SEQ ID NO: 45688 - protein, 11 aa, Dengue virus
FGSLGGVFTSI

SEQ ID NO: 45689 - protein, 11 aa, Dengue virus
GSLGGVFTSIG

SEQ ID NO: 45690 - protein, 11 aa, Dengue virus
SLGGVFTSIGK

SEQ ID NO: 45691 - protein, 11 aa, Dengue virus
LGGVFTSIGKA

SEQ ID NO: 45692 - protein, 11 aa, Dengue virus
GGVFTSIGKAL

SEQ ID NO: 45693 - protein, 11 aa, Dengue virus
GVFTSIGKALH

SEQ ID NO: 45694 - protein, 11 aa, Dengue virus
VFTSIGKALHQ

SEQ ID NO: 45695 - protein, 11 aa, Dengue virus
FTSIGKALHQV

SEQ ID NO: 45696 - protein, 11 aa, Dengue virus
TSIGKALHQVF

SEQ ID NO: 45697 - protein, 11 aa, Dengue virus
SIGKALHQVFG

SEQ ID NO: 45698 - protein, 11 aa, Dengue virus
IGKALHQVFGA

SEQ ID NO: 45699 - protein, 11 aa, Dengue virus
GKALHQVFGAI

SEQ ID NO: 45700 - protein, 11 aa, Dengue virus
KALHQVFGAIY

SEQ ID NO: 45701 - protein, 11 aa, Dengue virus
ALHQVFGAIYG

SEQ ID NO: 45702 - protein, 11 aa, Dengue virus
LHQVFGAIYGA

SEQ ID NO: 45703 - protein, 11 aa, Dengue virus
HQVFGAIYGAA

SEQ ID NO: 45704 - protein, 11 aa, Dengue virus
QVFGAIYGAAF

SEQ ID NO: 45705 - protein, 11 aa, Dengue virus
VFGAIYGAAFS

SEQ ID NO: 45706 - protein, 11 aa, Dengue virus
FGAIYGAAFSG

SEQ ID NO: 45707 - protein, 11 aa, Dengue virus
GAIYGAAFSGV

SEQ ID NO: 45708 - protein, 11 aa, Dengue virus
AIYGAAFSGVS

SEQ ID NO: 45709 - protein, 11 aa, Dengue virus
IYGAAFSGVSW

SEQ ID NO: 45710 - protein, 11 aa, Dengue virus
YGAAFSGVSWT

SEQ ID NO: 45711 - protein, 11 aa, Dengue virus
GAAFSGVSWTM

SEQ ID NO: 45712 - protein, 11 aa, Dengue virus
AAFSGVSWTMK

SEQ ID NO: 45713 - protein, 11 aa, Dengue virus
AFSGVSWTMKI

SEQ ID NO: 45714 - protein, 11 aa, Dengue virus
FSGVSWTMKIL

SEQ ID NO: 45715 - protein, 11 aa, Dengue virus
SGVSWTMKILI

SEQ ID NO: 45716 - protein, 11 aa, Dengue virus
GVSWTMKILIG

SEQ ID NO: 45717 - protein, 11 aa, Dengue virus
VSWTMKILIGV

SEQ ID NO: 45718 - protein, 11 aa, Dengue virus
SWTMKILIGVI

SEQ ID NO: 45719 - protein, 11 aa, Dengue virus
WTMKILIGVII

SEQ ID NO: 45720 - protein, 11 aa, Dengue virus
TMKILIGVIIT

SEQ ID NO: 45721 - protein, 11 aa, Dengue virus
MKILIGVIITW

SEQ ID NO: 45722 - protein, 11 aa, Dengue virus
KILIGVIITWI

SEQ ID NO: 45723 - protein, 11 aa, Dengue virus
ILIGVIITWIG

SEQ ID NO: 45724 - protein, 11 aa, Dengue virus
LIGVIITWIGM

SEQ ID NO: 45725 - protein, 11 aa, Dengue virus
IGVIITWIGMN

SEQ ID NO: 45726 - protein, 11 aa, Dengue virus
GVIITWIGMNS

SEQ ID NO: 45727 - protein, 11 aa, Dengue virus
VIITWIGMNSR

SEQ ID NO: 45728 - protein, 11 aa, Dengue virus
IITWIGMNSRS

SEQ ID NO: 45729 - protein, 11 aa, Dengue virus
ITWIGMNSRST

SEQ ID NO: 45730 - protein, 11 aa, Dengue virus
TWIGMNSRSTS

SEQ ID NO: 45731 - protein, 11 aa, Dengue virus
WIGMNSRSTSL

SEQ ID NO: 45732 - protein, 11 aa, Dengue virus
IGMNSRSTSLS

SEQ ID NO: 45733 - protein, 11 aa, Dengue virus
GMNSRSTSLSV

SEQ ID NO: 45734 - protein, 11 aa, Dengue virus
MNSRSTSLSVS

SEQ ID NO: 45735 - protein, 11 aa, Dengue virus
NSRSTSLSVSL

SEQ ID NO: 45736 - protein, 11 aa, Dengue virus
SRSTSLSVSLV

SEQ ID NO: 45737 - protein, 11 aa, Dengue virus
RSTSLSVSLVL

SEQ ID NO: 45738 - protein, 11 aa, Dengue virus
STSLSVSLVLV

SEQ ID NO: 45739 - protein, 11 aa, Dengue virus
TSLSVSLVLVG

SEQ ID NO: 45740 - protein, 11 aa, Dengue virus
SLSVSLVLVGV

SEQ ID NO: 45741 - protein, 11 aa, Dengue virus
LSVSLVLVGVV

SEQ ID NO: 45742 - protein, 11 aa, Dengue virus
LVLVGVVTLYL

SEQ ID NO: 45743 - protein, 11 aa, Dengue virus
VLVGVVTLYLG

SEQ ID NO: 45744 - protein, 11 aa, Dengue virus
LVGVVTLYLGA

SEQ ID NO: 45745 - protein, 11 aa, Dengue virus
VTLYLGVMVQA

SEQ ID NO: 45746 - protein, 11 aa, Dengue virus
TLYLGVMVQAD

SEQ ID NO: 45747 - protein, 11 aa, Dengue virus
LYLGVMVQADS

SEQ ID NO: 45748 - protein, 11 aa, Dengue virus
YLGVMVQADSG

SEQ ID NO: 45749 - protein, 11 aa, Dengue virus
LGVMVQADSGC

SEQ ID NO: 45750 - protein, 11 aa, Dengue virus
GVMVQADSGCV

SEQ ID NO: 45751 - protein, 11 aa, Dengue virus
VMVQADSGCVV

SEQ ID NO: 45752 - protein, 11 aa, Dengue virus
MVQADSGCVVS

SEQ ID NO: 45753 - protein, 11 aa, Dengue virus
VQADSGCVVSW

SEQ ID NO: 45754 - protein, 11 aa, Dengue virus
QADSGCVVSWK

SEQ ID NO: 45755 - protein, 11 aa, Dengue virus
ADSGCVVSWKN

SEQ ID NO: 45756 - protein, 11 aa, Dengue virus
DSGCVVSWKNK

SEQ ID NO: 45757 - protein, 11 aa, Dengue virus
SGCVVSWKNKE

SEQ ID NO: 45758 - protein, 11 aa, Dengue virus
GCVVSWKNKEL

SEQ ID NO: 45759 - protein, 11 aa, Dengue virus
CVVSWKNKELK

SEQ ID NO: 45760 - protein, 11 aa, Dengue virus
VVSWKNKELKC

SEQ ID NO: 45761 - protein, 11 aa, Dengue virus
VSWKNKELKCG

SEQ ID NO: 45762 - protein, 11 aa, Dengue virus
SWKNKELKCGS

SEQ ID NO: 45763 - protein, 11 aa, Dengue virus
WKNKELKCGSG

SEQ ID NO: 45764 - protein, 11 aa, Dengue virus
KNKELKCGSGI

SEQ ID NO: 45765 - protein, 11 aa, Dengue virus
NKELKCGSGIF

SEQ ID NO: 45766 - protein, 11 aa, Dengue virus
KELKCGSGIFI

SEQ ID NO: 45767 - protein, 11 aa, Dengue virus
ELKCGSGIFIT

SEQ ID NO: 45768 - protein, 11 aa, Dengue virus
LKCGSGIFITD

SEQ ID NO: 45769 - protein, 11 aa, Dengue virus
KCGSGIFITDN

SEQ ID NO: 45770 - protein, 11 aa, Dengue virus
CGSGIFITDNV

SEQ ID NO: 45771 - protein, 11 aa, Dengue virus
GSGIFITDNVH

SEQ ID NO: 45772 - protein, 11 aa, Dengue virus
SGIFITDNVHT

SEQ ID NO: 45773 - protein, 11 aa, Dengue virus
GIFITDNVHTW

SEQ ID NO: 45774 - protein, 11 aa, Dengue virus
IFITDNVHTWT

SEQ ID NO: 45775 - protein, 11 aa, Dengue virus
FITDNVHTWTE

SEQ ID NO: 45776 - protein, 11 aa, Dengue virus
ITDNVHTWTEQ

SEQ ID NO: 45777 - protein, 11 aa, Dengue virus
TDNVHTWTEQY

SEQ ID NO: 45778 - protein, 11 aa, Dengue virus
DNVHTWTEQYK

SEQ ID NO: 45779 - protein, 11 aa, Dengue virus
NVHTWTEQYKF

SEQ ID NO: 45780 - protein, 11 aa, Dengue virus
VHTWTEQYKFQ

SEQ ID NO: 45781 - protein, 11 aa, Dengue virus
HTWTEQYKFQP

SEQ ID NO: 45782 - protein, 11 aa, Dengue virus
TWTEQYKFQPE

SEQ ID NO: 45783 - protein, 11 aa, Dengue virus
WTEQYKFQPES

SEQ ID NO: 45784 - protein, 11 aa, Dengue virus
TEQYKFQPESP

SEQ ID NO: 45785 - protein, 11 aa, Dengue virus
EQYKFQPESPS

SEQ ID NO: 45786 - protein, 11 aa, Dengue virus
QYKFQPESPSK

SEQ ID NO: 45787 - protein, 11 aa, Dengue virus
YKFQPESPSKL

SEQ ID NO: 45788 - protein, 11 aa, Dengue virus
KFQPESPSKLA

SEQ ID NO: 45789 - protein, 11 aa, Dengue virus
FQPESPSKLAS

SEQ ID NO: 45790 - protein, 11 aa, Dengue virus
QPESPSKLASA

SEQ ID NO: 45791 - protein, 11 aa, Dengue virus
PESPSKLASAI

SEQ ID NO: 45792 - protein, 11 aa, Dengue virus
ESPSKLASAIQ

SEQ ID NO: 45793 - protein, 11 aa, Dengue virus
SPSKLASAIQK

SEQ ID NO: 45794 - protein, 11 aa, Dengue virus
PSKLASAIQKA

SEQ ID NO: 45795 - protein, 11 aa, Dengue virus
SKLASAIQKAH

SEQ ID NO: 45796 - protein, 11 aa, Dengue virus
KLASAIQKAHE

SEQ ID NO: 45797 - protein, 11 aa, Dengue virus
LASAIQKAHEE

SEQ ID NO: 45798 - protein, 11 aa, Dengue virus
ASAIQKAHEEG

SEQ ID NO: 45799 - protein, 11 aa, Dengue virus
SAIQKAHEEGI

SEQ ID NO: 45800 - protein, 11 aa, Dengue virus
AIQKAHEEGIC

SEQ ID NO: 45801 - protein, 11 aa, Dengue virus
IQKAHEEGICG

SEQ ID NO: 45802 - protein, 11 aa, Dengue virus
QKAHEEGICGI

SEQ ID NO: 45803 - protein, 11 aa, Dengue virus
KAHEEGICGIR

SEQ ID NO: 45804 - protein, 11 aa, Dengue virus
AHEEGICGIRS

SEQ ID NO: 45805 - protein, 11 aa, Dengue virus
HEEGICGIRSV

SEQ ID NO: 45806 - protein, 11 aa, Dengue virus
EEGICGIRSVT

SEQ ID NO: 45807 - protein, 11 aa, Dengue virus
EGICGIRSVTR

SEQ ID NO: 45808 - protein, 11 aa, Dengue virus
GICGIRSVTRL

SEQ ID NO: 45809 - protein, 11 aa, Dengue virus
ICGIRSVTRLE

SEQ ID NO: 45810 - protein, 11 aa, Dengue virus
CGIRSVTRLEN

SEQ ID NO: 45811 - protein, 11 aa, Dengue virus
GIRSVTRLENL

SEQ ID NO: 45812 - protein, 11 aa, Dengue virus
IRSVTRLENLM

SEQ ID NO: 45813 - protein, 11 aa, Dengue virus
RSVTRLENLMW

SEQ ID NO: 45814 - protein, 11 aa, Dengue virus
SVTRLENLMWK

SEQ ID NO: 45815 - protein, 11 aa, Dengue virus
VTRLENLMWKQ

SEQ ID NO: 45816 - protein, 11 aa, Dengue virus
TRLENLMWKQI

SEQ ID NO: 45817 - protein, 11 aa, Dengue virus
RLENLMWKQIT

SEQ ID NO: 45818 - protein, 11 aa, Dengue virus
LENLMWKQITP

SEQ ID NO: 45819 - protein, 11 aa, Dengue virus
ENLMWKQITPE

SEQ ID NO: 45820 - protein, 11 aa, Dengue virus
NLMWKQITPEL

SEQ ID NO: 45821 - protein, 11 aa, Dengue virus
LMWKQITPELN

SEQ ID NO: 45822 - protein, 11 aa, Dengue virus
MWKQITPELNH

SEQ ID NO: 45823 - protein, 11 aa, Dengue virus
WKQITPELNHI

SEQ ID NO: 45824 - protein, 11 aa, Dengue virus
KQITPELNHIL

SEQ ID NO: 45825 - protein, 11 aa, Dengue virus
QITPELNHILS

SEQ ID NO: 45826 - protein, 11 aa, Dengue virus
ITPELNHILSE

SEQ ID NO: 45827 - protein, 11 aa, Dengue virus
TPELNHILSEN

SEQ ID NO: 45828 - protein, 11 aa, Dengue virus
PELNHILSENE

SEQ ID NO: 45829 - protein, 11 aa, Dengue virus
ELNHILSENEV

SEQ ID NO: 45830 - protein, 11 aa, Dengue virus
LNHILSENEVK

SEQ ID NO: 45831 - protein, 11 aa, Dengue virus
NHILSENEVKL

SEQ ID NO: 45832 - protein, 11 aa, Dengue virus
HILSENEVKLT

SEQ ID NO: 45833 - protein, 11 aa, Dengue virus
ILSENEVKLTI

SEQ ID NO: 45834 - protein, 11 aa, Dengue virus
SENEVKLTIMT

SEQ ID NO: 45835 - protein, 11 aa, Dengue virus
ENEVKLTIMTG

SEQ ID NO: 45836 - protein, 11 aa, Dengue virus
NEVKLTIMTGD

SEQ ID NO: 45837 - protein, 11 aa, Dengue virus
EVKLTIMTGDI

SEQ ID NO: 45838 - protein, 11 aa, Dengue virus
KLTIMTGDIKG

SEQ ID NO: 45839 - protein, 11 aa, Dengue virus
TIMTGDIKGIM

SEQ ID NO: 45840 - protein, 11 aa, Dengue virus
IMTGDIKGIMQ

SEQ ID NO: 45841 - protein, 11 aa, Dengue virus
LRPQPTELKYS

SEQ ID NO: 45842 - protein, 11 aa, Dengue virus
RPQPTELKYSW

SEQ ID NO: 45843 - protein, 11 aa, Dengue virus
PQPTELKYSWK

SEQ ID NO: 45844 - protein, 11 aa, Dengue virus
QPTELKYSWKT

SEQ ID NO: 45845 - protein, 11 aa, Dengue virus
PTELKYSWKTW

SEQ ID NO: 45846 - protein, 11 aa, Dengue virus
TELKYSWKTWG

SEQ ID NO: 45847 - protein, 11 aa, Dengue virus
ELKYSWKTWGK

SEQ ID NO: 45848 - protein, 11 aa, Dengue virus
LKYSWKTWGKA

SEQ ID NO: 45849 - protein, 11 aa, Dengue virus
KYSWKTWGKAK

SEQ ID NO: 45850 - protein, 11 aa, Dengue virus
YSWKTWGKAKM

SEQ ID NO: 45851 - protein, 11 aa, Dengue virus
SWKTWGKAKML

SEQ ID NO: 45852 - protein, 11 aa, Dengue virus
HNQTFLIDGPE

SEQ ID NO: 45853 - protein, 11 aa, Dengue virus
NQTFLIDGPET

SEQ ID NO: 45854 - protein, 11 aa, Dengue virus
QTFLIDGPETA

SEQ ID NO: 45855 - protein, 11 aa, Dengue virus
TFLIDGPETAE

SEQ ID NO: 45856 - protein, 11 aa, Dengue virus
FLIDGPETAEC

SEQ ID NO: 45857 - protein, 11 aa, Dengue virus
LIDGPETAECP

SEQ ID NO: 45858 - protein, 11 aa, Dengue virus
IDGPETAECPN

SEQ ID NO: 45859 - protein, 11 aa, Dengue virus
TAECPNTNRAW

SEQ ID NO: 45860 - protein, 11 aa, Dengue virus
AECPNTNRAWN

SEQ ID NO: 45861 - protein, 11 aa, Dengue virus
ECPNTNRAWNS

SEQ ID NO: 45862 - protein, 11 aa, Dengue virus
CPNTNRAWNSL

SEQ ID NO: 45863 - protein, 11 aa, Dengue virus
PNTNRAWNSLE

SEQ ID NO: 45864 - protein, 11 aa, Dengue virus
NTNRAWNSLEV

SEQ ID NO: 45865 - protein, 11 aa, Dengue virus
TNRAWNSLEVE

SEQ ID NO: 45866 - protein, 11 aa, Dengue virus
NRAWNSLEVED

SEQ ID NO: 45867 - protein, 11 aa, Dengue virus
RAWNSLEVEDY

SEQ ID NO: 45868 - protein, 11 aa, Dengue virus
AWNSLEVEDYG

SEQ ID NO: 45869 - protein, 11 aa, Dengue virus
WNSLEVEDYGF

SEQ ID NO: 45870 - protein, 11 aa, Dengue virus
NSLEVEDYGFG

SEQ ID NO: 45871 - protein, 11 aa, Dengue virus
SLEVEDYGFGV

SEQ ID NO: 45872 - protein, 11 aa, Dengue virus
LEVEDYGFGVF

SEQ ID NO: 45873 - protein, 11 aa, Dengue virus
EVEDYGFGVFT

SEQ ID NO: 45874 - protein, 11 aa, Dengue virus
VEDYGFGVFTT

SEQ ID NO: 45875 - protein, 11 aa, Dengue virus
EDYGFGVFTTN

SEQ ID NO: 45876 - protein, 11 aa, Dengue virus
DYGFGVFTTNI

SEQ ID NO: 45877 - protein, 11 aa, Dengue virus
YGFGVFTTNIW

SEQ ID NO: 45878 - protein, 11 aa, Dengue virus
GFGVFTTNIWL

SEQ ID NO: 45879 - protein, 11 aa, Dengue virus
FGVFTTNIWLK

SEQ ID NO: 45880 - protein, 11 aa, Dengue virus
GVFTTNIWLKL

SEQ ID NO: 45881 - protein, 11 aa, Dengue virus
FTTNIWLKLRE

SEQ ID NO: 45882 - protein, 11 aa, Dengue virus
TNIWLKLREKQ

SEQ ID NO: 45883 - protein, 11 aa, Dengue virus
NIWLKLREKQD

SEQ ID NO: 45884 - protein, 11 aa, Dengue virus
CDSKLMSAAIK

SEQ ID NO: 45885 - protein, 11 aa, Dengue virus
DSKLMSAAIKD

SEQ ID NO: 45886 - protein, 11 aa, Dengue virus
SKLMSAAIKDN

SEQ ID NO: 45887 - protein, 11 aa, Dengue virus
KLMSAAIKDNR

SEQ ID NO: 45888 - protein, 11 aa, Dengue virus
LMSAAIKDNRA

SEQ ID NO: 45889 - protein, 11 aa, Dengue virus
MSAAIKDNRAV

SEQ ID NO: 45890 - protein, 11 aa, Dengue virus
SAAIKDNRAVH

SEQ ID NO: 45891 - protein, 11 aa, Dengue virus
AAIKDNRAVHA

SEQ ID NO: 45892 - protein, 11 aa, Dengue virus
AIKDNRAVHAD

SEQ ID NO: 45893 - protein, 11 aa, Dengue virus
IKDNRAVHADM

SEQ ID NO: 45894 - protein, 11 aa, Dengue virus
KDNRAVHADMG

SEQ ID NO: 45895 - protein, 11 aa, Dengue virus
DNRAVHADMGY

SEQ ID NO: 45896 - protein, 11 aa, Dengue virus
NRAVHADMGYW

SEQ ID NO: 45897 - protein, 11 aa, Dengue virus
RAVHADMGYWI

SEQ ID NO: 45898 - protein, 11 aa, Dengue virus
AVHADMGYWIE

SEQ ID NO: 45899 - protein, 11 aa, Dengue virus
VHADMGYWIES

SEQ ID NO: 45900 - protein, 11 aa, Dengue virus
HADMGYWIESA

SEQ ID NO: 45901 - protein, 11 aa, Dengue virus
ADMGYWIESAL

SEQ ID NO: 45902 - protein, 11 aa, Dengue virus
DMGYWIESALN

SEQ ID NO: 45903 - protein, 11 aa, Dengue virus
MGYWIESALND

SEQ ID NO: 45904 - protein, 11 aa, Dengue virus
GYWIESALNDT

SEQ ID NO: 45905 - protein, 11 aa, Dengue virus
YWIESALNDTW

SEQ ID NO: 45906 - protein, 11 aa, Dengue virus
WIESALNDTWK

SEQ ID NO: 45907 - protein, 11 aa, Dengue virus
IESALNDTWKM

SEQ ID NO: 45908 - protein, 11 aa, Dengue virus
ESALNDTWKME

SEQ ID NO: 45909 - protein, 11 aa, Dengue virus
SALNDTWKMEK

SEQ ID NO: 45910 - protein, 11 aa, Dengue virus
ALNDTWKMEKA

SEQ ID NO: 45911 - protein, 11 aa, Dengue virus
LNDTWKMEKAS

SEQ ID NO: 45912 - protein, 11 aa, Dengue virus
NDTWKMEKASF

SEQ ID NO: 45913 - protein, 11 aa, Dengue virus
DTWKMEKASFI

SEQ ID NO: 45914 - protein, 11 aa, Dengue virus
TWKMEKASFIE

SEQ ID NO: 45915 - protein, 11 aa, Dengue virus
WKMEKASFIEV

SEQ ID NO: 45916 - protein, 11 aa, Dengue virus
KMEKASFIEVK

SEQ ID NO: 45917 - protein, 11 aa, Dengue virus
MEKASFIEVKS

SEQ ID NO: 45918 - protein, 11 aa, Dengue virus
EKASFIEVKSC

SEQ ID NO: 45919 - protein, 11 aa, Dengue virus
KASFIEVKSCH

SEQ ID NO: 45920 - protein, 11 aa, Dengue virus
ASFIEVKSCHW

SEQ ID NO: 45921 - protein, 11 aa, Dengue virus
SFIEVKSCHWP

SEQ ID NO: 45922 - protein, 11 aa, Dengue virus
FIEVKSCHWPK

SEQ ID NO: 45923 - protein, 11 aa, Dengue virus
IEVKSCHWPKS

SEQ ID NO: 45924 - protein, 11 aa, Dengue virus
EVKSCHWPKSH

SEQ ID NO: 45925 - protein, 11 aa, Dengue virus
VKSCHWPKSHT

SEQ ID NO: 45926 - protein, 11 aa, Dengue virus
KSCHWPKSHTL

SEQ ID NO: 45927 - protein, 11 aa, Dengue virus
SCHWPKSHTLW

SEQ ID NO: 45928 - protein, 11 aa, Dengue virus
CHWPKSHTLWS

SEQ ID NO: 45929 - protein, 11 aa, Dengue virus
HWPKSHTLWSN

SEQ ID NO: 45930 - protein, 11 aa, Dengue virus
WPKSHTLWSNG

SEQ ID NO: 45931 - protein, 11 aa, Dengue virus
PKSHTLWSNGV

SEQ ID NO: 45932 - protein, 11 aa, Dengue virus
KSHTLWSNGVL

SEQ ID NO: 45933 - protein, 11 aa, Dengue virus
SHTLWSNGVLE

SEQ ID NO: 45934 - protein, 11 aa, Dengue virus
HTLWSNGVLES

SEQ ID NO: 45935 - protein, 11 aa, Dengue virus
TLWSNGVLESE

SEQ ID NO: 45936 - protein, 11 aa, Dengue virus
LWSNGVLESEM

SEQ ID NO: 45937 - protein, 11 aa, Dengue virus
WSNGVLESEMI

SEQ ID NO: 45938 - protein, 11 aa, Dengue virus
SNGVLESEMII

SEQ ID NO: 45939 - protein, 11 aa, Dengue virus
NGVLESEMIIP

SEQ ID NO: 45940 - protein, 11 aa, Dengue virus
GVLESEMIIPK

SEQ ID NO: 45941 - protein, 11 aa, Dengue virus
VLESEMIIPKN

SEQ ID NO: 45942 - protein, 11 aa, Dengue virus
IPKNFAGPVSQ

SEQ ID NO: 45943 - protein, 11 aa, Dengue virus
PKNFAGPVSQH

SEQ ID NO: 45944 - protein, 11 aa, Dengue virus
KNFAGPVSQHN

SEQ ID NO: 45945 - protein, 11 aa, Dengue virus
FAGPVSQHNYR

SEQ ID NO: 45946 - protein, 11 aa, Dengue virus
AGPVSQHNYRP

SEQ ID NO: 45947 - protein, 11 aa, Dengue virus
GPVSQHNYRPG

SEQ ID NO: 45948 - protein, 11 aa, Dengue virus
PVSQHNYRPGY

SEQ ID NO: 45949 - protein, 11 aa, Dengue virus
VSQHNYRPGYH

SEQ ID NO: 45950 - protein, 11 aa, Dengue virus
SQHNYRPGYHT

SEQ ID NO: 45951 - protein, 11 aa, Dengue virus
QHNYRPGYHTQ

SEQ ID NO: 45952 - protein, 11 aa, Dengue virus
RPGYHTQTAGP

SEQ ID NO: 45953 - protein, 11 aa, Dengue virus
PGYHTQTAGPW

SEQ ID NO: 45954 - protein, 11 aa, Dengue virus
GYHTQTAGPWH

SEQ ID NO: 45955 - protein, 11 aa, Dengue virus
YHTQTAGPWHL

SEQ ID NO: 45956 - protein, 11 aa, Dengue virus
HTQTAGPWHLG

SEQ ID NO: 45957 - protein, 11 aa, Dengue virus
TQTAGPWHLGK

SEQ ID NO: 45958 - protein, 11 aa, Dengue virus
QTAGPWHLGKL

SEQ ID NO: 45959 - protein, 11 aa, Dengue virus
TAGPWHLGKLE

SEQ ID NO: 45960 - protein, 11 aa, Dengue virus
AGPWHLGKLEM

SEQ ID NO: 45961 - protein, 11 aa, Dengue virus
GPWHLGKLEMD

SEQ ID NO: 45962 - protein, 11 aa, Dengue virus
PWHLGKLEMDF

SEQ ID NO: 45963 - protein, 11 aa, Dengue virus
WHLGKLEMDFD

SEQ ID NO: 45964 - protein, 11 aa, Dengue virus
HLGKLEMDFDF

SEQ ID NO: 45965 - protein, 11 aa, Dengue virus
LGKLEMDFDFC

SEQ ID NO: 45966 - protein, 11 aa, Dengue virus
LEMDFDFCEGT

SEQ ID NO: 45967 - protein, 11 aa, Dengue virus
EMDFDFCEGTT

SEQ ID NO: 45968 - protein, 11 aa, Dengue virus
MDFDFCEGTTV

SEQ ID NO: 45969 - protein, 11 aa, Dengue virus
FCEGTTVVVTE

SEQ ID NO: 45970 - protein, 11 aa, Dengue virus
CEGTTVVVTED

SEQ ID NO: 45971 - protein, 11 aa, Dengue virus
EGTTVVVTEDC

SEQ ID NO: 45972 - protein, 11 aa, Dengue virus
GTTVVVTEDCG

SEQ ID NO: 45973 - protein, 11 aa, Dengue virus
TTVVVTEDCGN

SEQ ID NO: 45974 - protein, 11 aa, Dengue virus
TVVVTEDCGNR

SEQ ID NO: 45975 - protein, 11 aa, Dengue virus
VVVTEDCGNRG

SEQ ID NO: 45976 - protein, 11 aa, Dengue virus
VVTEDCGNRGP

SEQ ID NO: 45977 - protein, 11 aa, Dengue virus
VTEDCGNRGPS

SEQ ID NO: 45978 - protein, 11 aa, Dengue virus
TEDCGNRGPSL

SEQ ID NO: 45979 - protein, 11 aa, Dengue virus
EDCGNRGPSLR

SEQ ID NO: 45980 - protein, 11 aa, Dengue virus
DCGNRGPSLRT

SEQ ID NO: 45981 - protein, 11 aa, Dengue virus
CGNRGPSLRTT

SEQ ID NO: 45982 - protein, 11 aa, Dengue virus
GNRGPSLRTTT

SEQ ID NO: 45983 - protein, 11 aa, Dengue virus
NRGPSLRTTTA

SEQ ID NO: 45984 - protein, 11 aa, Dengue virus
RGPSLRTTTAS

SEQ ID NO: 45985 - protein, 11 aa, Dengue virus
GPSLRTTTASG

SEQ ID NO: 45986 - protein, 11 aa, Dengue virus
PSLRTTTASGK

SEQ ID NO: 45987 - protein, 11 aa, Dengue virus
SLRTTTASGKL

SEQ ID NO: 45988 - protein, 11 aa, Dengue virus
LRTTTASGKLI

SEQ ID NO: 45989 - protein, 11 aa, Dengue virus
RTTTASGKLIT

SEQ ID NO: 45990 - protein, 11 aa, Dengue virus
TTTASGKLITE

SEQ ID NO: 45991 - protein, 11 aa, Dengue virus
TTASGKLITEW

SEQ ID NO: 45992 - protein, 11 aa, Dengue virus
TASGKLITEWC

SEQ ID NO: 45993 - protein, 11 aa, Dengue virus
ASGKLITEWCC

SEQ ID NO: 45994 - protein, 11 aa, Dengue virus
SGKLITEWCCR

SEQ ID NO: 45995 - protein, 11 aa, Dengue virus
GKLITEWCCRS

SEQ ID NO: 45996 - protein, 11 aa, Dengue virus
KLITEWCCRSC

SEQ ID NO: 45997 - protein, 11 aa, Dengue virus
LITEWCCRSCT

SEQ ID NO: 45998 - protein, 11 aa, Dengue virus
ITEWCCRSCTL

SEQ ID NO: 45999 - protein, 11 aa, Dengue virus
TEWCCRSCTLP

SEQ ID NO: 46000 - protein, 11 aa, Dengue virus
EWCCRSCTLPP

SEQ ID NO: 46001 - protein, 11 aa, Dengue virus
WCCRSCTLPPL

SEQ ID NO: 46002 - protein, 11 aa, Dengue virus
CCRSCTLPPLR

SEQ ID NO: 46003 - protein, 11 aa, Dengue virus
CRSCTLPPLRY

SEQ ID NO: 46004 - protein, 11 aa, Dengue virus
RSCTLPPLRYR

SEQ ID NO: 46005 - protein, 11 aa, Dengue virus
SCTLPPLRYRG

SEQ ID NO: 46006 - protein, 11 aa, Dengue virus
CTLPPLRYRGE

SEQ ID NO: 46007 - protein, 11 aa, Dengue virus
TLPPLRYRGED

SEQ ID NO: 46008 - protein, 11 aa, Dengue virus
LPPLRYRGEDG

SEQ ID NO: 46009 - protein, 11 aa, Dengue virus
PPLRYRGEDGC

SEQ ID NO: 46010 - protein, 11 aa, Dengue virus
PLRYRGEDGCW

SEQ ID NO: 46011 - protein, 11 aa, Dengue virus
LRYRGEDGCWY

SEQ ID NO: 46012 - protein, 11 aa, Dengue virus
RYRGEDGCWYG

SEQ ID NO: 46013 - protein, 11 aa, Dengue virus
YRGEDGCWYGM

SEQ ID NO: 46014 - protein, 11 aa, Dengue virus
RGEDGCWYGME

SEQ ID NO: 46015 - protein, 11 aa, Dengue virus
GEDGCWYGMEI

SEQ ID NO: 46016 - protein, 11 aa, Dengue virus
EDGCWYGMEIR

SEQ ID NO: 46017 - protein, 11 aa, Dengue virus
DGCWYGMEIRP

SEQ ID NO: 46018 - protein, 11 aa, Dengue virus
GCWYGMEIRPL

SEQ ID NO: 46019 - protein, 11 aa, Dengue virus
CWYGMEIRPLK

SEQ ID NO: 46020 - protein, 11 aa, Dengue virus
WYGMEIRPLKE

SEQ ID NO: 46021 - protein, 11 aa, Dengue virus
YGMEIRPLKEK

SEQ ID NO: 46022 - protein, 11 aa, Dengue virus
GMEIRPLKEKE

SEQ ID NO: 46023 - protein, 11 aa, Dengue virus
MEIRPLKEKEE

SEQ ID NO: 46024 - protein, 11 aa, Dengue virus
EIRPLKEKEEN

SEQ ID NO: 46025 - protein, 11 aa, Dengue virus
IRPLKEKEENL

SEQ ID NO: 46026 - protein, 11 aa, Dengue virus
RPLKEKEENLV

SEQ ID NO: 46027 - protein, 11 aa, Dengue virus
PLKEKEENLVN

SEQ ID NO: 46028 - protein, 11 aa, Dengue virus
LKEKEENLVNS

SEQ ID NO: 46029 - protein, 11 aa, Dengue virus
KEKEENLVNSL

SEQ ID NO: 46030 - protein, 11 aa, Dengue virus
EKEENLVNSLV

SEQ ID NO: 46031 - protein, 11 aa, Dengue virus
KEENLVNSLVT

SEQ ID NO: 46032 - protein, 11 aa, Dengue virus
EENLVNSLVTA

SEQ ID NO: 46033 - protein, 11 aa, Dengue virus
ENLVNSLVTAG

SEQ ID NO: 46034 - protein, 11 aa, Dengue virus
NLVNSLVTAGH

SEQ ID NO: 46035 - protein, 11 aa, Dengue virus
LVNSLVTAGHG

SEQ ID NO: 46036 - protein, 11 aa, Dengue virus
VNSLVTAGHGQ

SEQ ID NO: 46037 - protein, 11 aa, Dengue virus
NSLVTAGHGQI

SEQ ID NO: 46038 - protein, 11 aa, Dengue virus
SLVTAGHGQID

SEQ ID NO: 46039 - protein, 11 aa, Dengue virus
LVTAGHGQIDN

SEQ ID NO: 46040 - protein, 11 aa, Dengue virus
VTAGHGQIDNF

SEQ ID NO: 46041 - protein, 11 aa, Dengue virus
TAGHGQIDNFS

SEQ ID NO: 46042 - protein, 11 aa, Dengue virus
AGHGQIDNFSL

SEQ ID NO: 46043 - protein, 11 aa, Dengue virus
GHGQIDNFSLG

SEQ ID NO: 46044 - protein, 11 aa, Dengue virus
HGQIDNFSLGV

SEQ ID NO: 46045 - protein, 11 aa, Dengue virus
GQIDNFSLGVL

SEQ ID NO: 46046 - protein, 11 aa, Dengue virus
QIDNFSLGVLG

SEQ ID NO: 46047 - protein, 11 aa, Dengue virus
IDNFSLGVLGM

SEQ ID NO: 46048 - protein, 11 aa, Dengue virus
DNFSLGVLGMA

SEQ ID NO: 46049 - protein, 11 aa, Dengue virus
NFSLGVLGMAL

SEQ ID NO: 46050 - protein, 11 aa, Dengue virus
FSLGVLGMALF

SEQ ID NO: 46051 - protein, 11 aa, Dengue virus
SLGVLGMALFL

SEQ ID NO: 46052 - protein, 11 aa, Dengue virus
LGVLGMALFLE

SEQ ID NO: 46053 - protein, 11 aa, Dengue virus
GVLGMALFLEE

SEQ ID NO: 46054 - protein, 11 aa, Dengue virus
VLGMALFLEEM

SEQ ID NO: 46055 - protein, 11 aa, Dengue virus
LGMALFLEEML

SEQ ID NO: 46056 - protein, 11 aa, Dengue virus
GMALFLEEMLR

SEQ ID NO: 46057 - protein, 11 aa, Dengue virus
MALFLEEMLRT

SEQ ID NO: 46058 - protein, 11 aa, Dengue virus
ALFLEEMLRTR

SEQ ID NO: 46059 - protein, 11 aa, Dengue virus
LFLEEMLRTRV

SEQ ID NO: 46060 - protein, 11 aa, Dengue virus
FLEEMLRTRVG

SEQ ID NO: 46061 - protein, 11 aa, Dengue virus
LEEMLRTRVGT

SEQ ID NO: 46062 - protein, 11 aa, Dengue virus
EEMLRTRVGTK

SEQ ID NO: 46063 - protein, 11 aa, Dengue virus
EMLRTRVGTKH

SEQ ID NO: 46064 - protein, 11 aa, Dengue virus
MLRTRVGTKHA

SEQ ID NO: 46065 - protein, 11 aa, Dengue virus
SFVTLITGNMS

SEQ ID NO: 46066 - protein, 11 aa, Dengue virus
FVTLITGNMSF

SEQ ID NO: 46067 - protein, 11 aa, Dengue virus
TLITGNMSFRD

SEQ ID NO: 46068 - protein, 11 aa, Dengue virus
LITGNMSFRDL

SEQ ID NO: 46069 - protein, 11 aa, Dengue virus
ITGNMSFRDLG

SEQ ID NO: 46070 - protein, 11 aa, Dengue virus
TGNMSFRDLGR

SEQ ID NO: 46071 - protein, 11 aa, Dengue virus
GNMSFRDLGRV

SEQ ID NO: 46072 - protein, 11 aa, Dengue virus
RDLGRVMVMVG

SEQ ID NO: 46073 - protein, 11 aa, Dengue virus
DLGRVMVMVGA

SEQ ID NO: 46074 - protein, 11 aa, Dengue virus
TDDIGMGVTYL

SEQ ID NO: 46075 - protein, 11 aa, Dengue virus
DDIGMGVTYLA

SEQ ID NO: 46076 - protein, 11 aa, Dengue virus
DIGMGVTYLAL

SEQ ID NO: 46077 - protein, 11 aa, Dengue virus
IGMGVTYLALL

SEQ ID NO: 46078 - protein, 11 aa, Dengue virus
GMGVTYLALLA

SEQ ID NO: 46079 - protein, 11 aa, Dengue virus
MGVTYLALLAA

SEQ ID NO: 46080 - protein, 11 aa, Dengue virus
GVTYLALLAAF

SEQ ID NO: 46081 - protein, 11 aa, Dengue virus
VTYLALLAAFK

SEQ ID NO: 46082 - protein, 11 aa, Dengue virus
TYLALLAAFKV

SEQ ID NO: 46083 - protein, 11 aa, Dengue virus
YLALLAAFKVR

SEQ ID NO: 46084 - protein, 11 aa, Dengue virus
LALLAAFKVRP

SEQ ID NO: 46085 - protein, 11 aa, Dengue virus
ALLAAFKVRPT

SEQ ID NO: 46086 - protein, 11 aa, Dengue virus
LLAAFKVRPTF

SEQ ID NO: 46087 - protein, 11 aa, Dengue virus
LAAFKVRPTFA

SEQ ID NO: 46088 - protein, 11 aa, Dengue virus
AAFKVRPTFAA

SEQ ID NO: 46089 - protein, 11 aa, Dengue virus
AFKVRPTFAAG

SEQ ID NO: 46090 - protein, 11 aa, Dengue virus
FKVRPTFAAGL

SEQ ID NO: 46091 - protein, 11 aa, Dengue virus
KVRPTFAAGLL

SEQ ID NO: 46092 - protein, 11 aa, Dengue virus
VRPTFAAGLLL

SEQ ID NO: 46093 - protein, 11 aa, Dengue virus
RPTFAAGLLLR

SEQ ID NO: 46094 - protein, 11 aa, Dengue virus
PTFAAGLLLRK

SEQ ID NO: 46095 - protein, 11 aa, Dengue virus
TFAAGLLLRKL

SEQ ID NO: 46096 - protein, 11 aa, Dengue virus
FAAGLLLRKLT

SEQ ID NO: 46097 - protein, 11 aa, Dengue virus
AAGLLLRKLTS

SEQ ID NO: 46098 - protein, 11 aa, Dengue virus
AGLLLRKLTSK

SEQ ID NO: 46099 - protein, 11 aa, Dengue virus
GLLLRKLTSKE

SEQ ID NO: 46100 - protein, 11 aa, Dengue virus
LLLRKLTSKEL

SEQ ID NO: 46101 - protein, 11 aa, Dengue virus
LLRKLTSKELM

SEQ ID NO: 46102 - protein, 11 aa, Dengue virus
LRKLTSKELMM

SEQ ID NO: 46103 - protein, 11 aa, Dengue virus
RKLTSKELMMA

SEQ ID NO: 46104 - protein, 11 aa, Dengue virus
KLTSKELMMAT

SEQ ID NO: 46105 - protein, 11 aa, Dengue virus
LTSKELMMATI

SEQ ID NO: 46106 - protein, 11 aa, Dengue virus
TSKELMMATIG

SEQ ID NO: 46107 - protein, 11 aa, Dengue virus
SKELMMATIGI

SEQ ID NO: 46108 - protein, 11 aa, Dengue virus
TILELTDALAL

SEQ ID NO: 46109 - protein, 11 aa, Dengue virus
ILELTDALALG

SEQ ID NO: 46110 - protein, 11 aa, Dengue virus
LELTDALALGM

SEQ ID NO: 46111 - protein, 11 aa, Dengue virus
ELTDALALGMM

SEQ ID NO: 46112 - protein, 11 aa, Dengue virus
LTDALALGMMV

SEQ ID NO: 46113 - protein, 11 aa, Dengue virus
TDALALGMMVL

SEQ ID NO: 46114 - protein, 11 aa, Dengue virus
DALALGMMVLK

SEQ ID NO: 46115 - protein, 11 aa, Dengue virus
MEKYQLAVTIM

SEQ ID NO: 46116 - protein, 11 aa, Dengue virus
EKYQLAVTIMA

SEQ ID NO: 46117 - protein, 11 aa, Dengue virus
CVPNAVILQNA

SEQ ID NO: 46118 - protein, 11 aa, Dengue virus
VPNAVILQNAW

SEQ ID NO: 46119 - protein, 11 aa, Dengue virus
VSVSPLLLTSS

SEQ ID NO: 46120 - protein, 11 aa, Dengue virus
SVSPLLLTSSQ

SEQ ID NO: 46121 - protein, 11 aa, Dengue virus
VSPLLLTSSQQ

SEQ ID NO: 46122 - protein, 11 aa, Dengue virus
SPLLLTSSQQK

SEQ ID NO: 46123 - protein, 11 aa, Dengue virus
LTSSQQKADWI

SEQ ID NO: 46124 - protein, 11 aa, Dengue virus
TSSQQKADWIP

SEQ ID NO: 46125 - protein, 11 aa, Dengue virus
SSQQKADWIPL

SEQ ID NO: 46126 - protein, 11 aa, Dengue virus
SQQKADWIPLA

SEQ ID NO: 46127 - protein, 11 aa, Dengue virus
QQKADWIPLAL

SEQ ID NO: 46128 - protein, 11 aa, Dengue virus
QKADWIPLALT

SEQ ID NO: 46129 - protein, 11 aa, Dengue virus
KADWIPLALTI

SEQ ID NO: 46130 - protein, 11 aa, Dengue virus
ADWIPLALTIK

SEQ ID NO: 46131 - protein, 11 aa, Dengue virus
DWIPLALTIKG

SEQ ID NO: 46132 - protein, 11 aa, Dengue virus
WIPLALTIKGL

SEQ ID NO: 46133 - protein, 11 aa, Dengue virus
IPLALTIKGLN

SEQ ID NO: 46134 - protein, 11 aa, Dengue virus
PLALTIKGLNP

SEQ ID NO: 46135 - protein, 11 aa, Dengue virus
LALTIKGLNPT

SEQ ID NO: 46136 - protein, 11 aa, Dengue virus
ALTIKGLNPTA

SEQ ID NO: 46137 - protein, 11 aa, Dengue virus
LTIKGLNPTAI

SEQ ID NO: 46138 - protein, 11 aa, Dengue virus
TIKGLNPTAIF

SEQ ID NO: 46139 - protein, 11 aa, Dengue virus
IKGLNPTAIFL

SEQ ID NO: 46140 - protein, 11 aa, Dengue virus
KGLNPTAIFLT

SEQ ID NO: 46141 - protein, 11 aa, Dengue virus
GLNPTAIFLTT

SEQ ID NO: 46142 - protein, 11 aa, Dengue virus
LNPTAIFLTTL

SEQ ID NO: 46143 - protein, 11 aa, Dengue virus
NPTAIFLTTLS

SEQ ID NO: 46144 - protein, 11 aa, Dengue virus
PTAIFLTTLSR

SEQ ID NO: 46145 - protein, 11 aa, Dengue virus
TAIFLTTLSRT

SEQ ID NO: 46146 - protein, 11 aa, Dengue virus
AIFLTTLSRTS

SEQ ID NO: 46147 - protein, 11 aa, Dengue virus
IFLTTLSRTSK

SEQ ID NO: 46148 - protein, 11 aa, Dengue virus
LTTLSRTSKKR

SEQ ID NO: 46149 - protein, 11 aa, Dengue virus
TTLSRTSKKRS

SEQ ID NO: 46150 - protein, 11 aa, Dengue virus
TLSRTSKKRSW

SEQ ID NO: 46151 - protein, 11 aa, Dengue virus
LSRTSKKRSWP

SEQ ID NO: 46152 - protein, 11 aa, Dengue virus
RTSKKRSWPLN

SEQ ID NO: 46153 - protein, 11 aa, Dengue virus
TSKKRSWPLNE

SEQ ID NO: 46154 - protein, 11 aa, Dengue virus
SKKRSWPLNEA

SEQ ID NO: 46155 - protein, 11 aa, Dengue virus
KKRSWPLNEAI

SEQ ID NO: 46156 - protein, 11 aa, Dengue virus
KRSWPLNEAIM

SEQ ID NO: 46157 - protein, 11 aa, Dengue virus
RSWPLNEAIMA

SEQ ID NO: 46158 - protein, 11 aa, Dengue virus
SWPLNEAIMAV

SEQ ID NO: 46159 - protein, 11 aa, Dengue virus
WPLNEAIMAVG

SEQ ID NO: 46160 - protein, 11 aa, Dengue virus
PLNEAIMAVGM

SEQ ID NO: 46161 - protein, 11 aa, Dengue virus
LNEAIMAVGMV

SEQ ID NO: 46162 - protein, 11 aa, Dengue virus
NEAIMAVGMVS

SEQ ID NO: 46163 - protein, 11 aa, Dengue virus
EAIMAVGMVSI

SEQ ID NO: 46164 - protein, 11 aa, Dengue virus
AIMAVGMVSIL

SEQ ID NO: 46165 - protein, 11 aa, Dengue virus
IMAVGMVSILA

SEQ ID NO: 46166 - protein, 11 aa, Dengue virus
MAVGMVSILAS

SEQ ID NO: 46167 - protein, 11 aa, Dengue virus
AVGMVSILASS

SEQ ID NO: 46168 - protein, 11 aa, Dengue virus
VGMVSILASSL

SEQ ID NO: 46169 - protein, 11 aa, Dengue virus
GMVSILASSLL

SEQ ID NO: 46170 - protein, 11 aa, Dengue virus
MVSILASSLLK

SEQ ID NO: 46171 - protein, 11 aa, Dengue virus
VSILASSLLKN

SEQ ID NO: 46172 - protein, 11 aa, Dengue virus
SILASSLLKND

SEQ ID NO: 46173 - protein, 11 aa, Dengue virus
ILASSLLKNDI

SEQ ID NO: 46174 - protein, 11 aa, Dengue virus
LASSLLKNDIP

SEQ ID NO: 46175 - protein, 11 aa, Dengue virus
ASSLLKNDIPM

SEQ ID NO: 46176 - protein, 11 aa, Dengue virus
SSLLKNDIPMT

SEQ ID NO: 46177 - protein, 11 aa, Dengue virus
SLLKNDIPMTG

SEQ ID NO: 46178 - protein, 11 aa, Dengue virus
LLKNDIPMTGP

SEQ ID NO: 46179 - protein, 11 aa, Dengue virus
LKNDIPMTGPL

SEQ ID NO: 46180 - protein, 11 aa, Dengue virus
KNDIPMTGPLV

SEQ ID NO: 46181 - protein, 11 aa, Dengue virus
NDIPMTGPLVA

SEQ ID NO: 46182 - protein, 11 aa, Dengue virus
DIPMTGPLVAG

SEQ ID NO: 46183 - protein, 11 aa, Dengue virus
IPMTGPLVAGG

SEQ ID NO: 46184 - protein, 11 aa, Dengue virus
PMTGPLVAGGL

SEQ ID NO: 46185 - protein, 11 aa, Dengue virus
MTGPLVAGGLL

SEQ ID NO: 46186 - protein, 11 aa, Dengue virus
TGPLVAGGLLT

SEQ ID NO: 46187 - protein, 11 aa, Dengue virus
GPLVAGGLLTV

SEQ ID NO: 46188 - protein, 11 aa, Dengue virus
PLVAGGLLTVC

SEQ ID NO: 46189 - protein, 11 aa, Dengue virus
LVAGGLLTVCY

SEQ ID NO: 46190 - protein, 11 aa, Dengue virus
VAGGLLTVCYV

SEQ ID NO: 46191 - protein, 11 aa, Dengue virus
AGGLLTVCYVL

SEQ ID NO: 46192 - protein, 11 aa, Dengue virus
GGLLTVCYVLT

SEQ ID NO: 46193 - protein, 11 aa, Dengue virus
GLLTVCYVLTG

SEQ ID NO: 46194 - protein, 11 aa, Dengue virus
LLTVCYVLTGR

SEQ ID NO: 46195 - protein, 11 aa, Dengue virus
LTVCYVLTGRS

SEQ ID NO: 46196 - protein, 11 aa, Dengue virus
TVCYVLTGRSA

SEQ ID NO: 46197 - protein, 11 aa, Dengue virus
VCYVLTGRSAD

SEQ ID NO: 46198 - protein, 11 aa, Dengue virus
CYVLTGRSADL

SEQ ID NO: 46199 - protein, 11 aa, Dengue virus
YVLTGRSADLE

SEQ ID NO: 46200 - protein, 11 aa, Dengue virus
VLTGRSADLEL

SEQ ID NO: 46201 - protein, 11 aa, Dengue virus
LTGRSADLELE

SEQ ID NO: 46202 - protein, 11 aa, Dengue virus
TGRSADLELER

SEQ ID NO: 46203 - protein, 11 aa, Dengue virus
GRSADLELERA

SEQ ID NO: 46204 - protein, 11 aa, Dengue virus
RSADLELERAA

SEQ ID NO: 46205 - protein, 11 aa, Dengue virus
SADLELERAAD

SEQ ID NO: 46206 - protein, 11 aa, Dengue virus
ADLELERAADV

SEQ ID NO: 46207 - protein, 11 aa, Dengue virus
VKWEDQAEISG

SEQ ID NO: 46208 - protein, 11 aa, Dengue virus
KWEDQAEISGS

SEQ ID NO: 46209 - protein, 11 aa, Dengue virus
WEDQAEISGSS

SEQ ID NO: 46210 - protein, 11 aa, Dengue virus
EDQAEISGSSP

SEQ ID NO: 46211 - protein, 11 aa, Dengue virus
DQAEISGSSPI

SEQ ID NO: 46212 - protein, 11 aa, Dengue virus
QAEISGSSPIL

SEQ ID NO: 46213 - protein, 11 aa, Dengue virus
AEISGSSPILS

SEQ ID NO: 46214 - protein, 11 aa, Dengue virus
EISGSSPILSI

SEQ ID NO: 46215 - protein, 11 aa, Dengue virus
ISGSSPILSIT

SEQ ID NO: 46216 - protein, 11 aa, Dengue virus
SGSSPILSITI

SEQ ID NO: 46217 - protein, 11 aa, Dengue virus
GSSPILSITIS

SEQ ID NO: 46218 - protein, 11 aa, Dengue virus
SSPILSITISE

SEQ ID NO: 46219 - protein, 11 aa, Dengue virus
SPILSITISED

SEQ ID NO: 46220 - protein, 11 aa, Dengue virus
PILSITISEDG

SEQ ID NO: 46221 - protein, 11 aa, Dengue virus
ILSITISEDGS

SEQ ID NO: 46222 - protein, 11 aa, Dengue virus
LSITISEDGSM

SEQ ID NO: 46223 - protein, 11 aa, Dengue virus
SITISEDGSMS

SEQ ID NO: 46224 - protein, 11 aa, Dengue virus
ITISEDGSMSI

SEQ ID NO: 46225 - protein, 11 aa, Dengue virus
TISEDGSMSIK

SEQ ID NO: 46226 - protein, 11 aa, Dengue virus
ISEDGSMSIKN

SEQ ID NO: 46227 - protein, 11 aa, Dengue virus
SEDGSMSIKNE

SEQ ID NO: 46228 - protein, 11 aa, Dengue virus
EDGSMSIKNEE

SEQ ID NO: 46229 - protein, 11 aa, Dengue virus
DGSMSIKNEEE

SEQ ID NO: 46230 - protein, 11 aa, Dengue virus
GSMSIKNEEEE

SEQ ID NO: 46231 - protein, 11 aa, Dengue virus
SMSIKNEEEEQ

SEQ ID NO: 46232 - protein, 11 aa, Dengue virus
MSIKNEEEEQT

SEQ ID NO: 46233 - protein, 11 aa, Dengue virus
SIKNEEEEQTL

SEQ ID NO: 46234 - protein, 11 aa, Dengue virus
IKNEEEEQTLT

SEQ ID NO: 46235 - protein, 11 aa, Dengue virus
KNEEEEQTLTI

SEQ ID NO: 46236 - protein, 11 aa, Dengue virus
NEEEEQTLTIL

SEQ ID NO: 46237 - protein, 11 aa, Dengue virus
EEEEQTLTILI

SEQ ID NO: 46238 - protein, 11 aa, Dengue virus
EEEQTLTILIR

SEQ ID NO: 46239 - protein, 11 aa, Dengue virus
EEQTLTILIRT

SEQ ID NO: 46240 - protein, 11 aa, Dengue virus
EQTLTILIRTG

SEQ ID NO: 46241 - protein, 11 aa, Dengue virus
QTLTILIRTGL

SEQ ID NO: 46242 - protein, 11 aa, Dengue virus
TLTILIRTGLL

SEQ ID NO: 46243 - protein, 11 aa, Dengue virus
LTILIRTGLLV

SEQ ID NO: 46244 - protein, 11 aa, Dengue virus
TILIRTGLLVI

SEQ ID NO: 46245 - protein, 11 aa, Dengue virus
ILIRTGLLVIS

SEQ ID NO: 46246 - protein, 11 aa, Dengue virus
LIRTGLLVISG

SEQ ID NO: 46247 - protein, 11 aa, Dengue virus
IRTGLLVISGL

SEQ ID NO: 46248 - protein, 11 aa, Dengue virus
RTGLLVISGLF

SEQ ID NO: 46249 - protein, 11 aa, Dengue virus
TGLLVISGLFP

SEQ ID NO: 46250 - protein, 11 aa, Dengue virus
GLLVISGVFPV

SEQ ID NO: 46251 - protein, 11 aa, Dengue virus
LLVISGVFPVS

SEQ ID NO: 46252 - protein, 11 aa, Dengue virus
LVISGVFPVSI

SEQ ID NO: 46253 - protein, 11 aa, Dengue virus
VISGVFPVSIP

SEQ ID NO: 46254 - protein, 11 aa, Dengue virus
SGVFPVSIPIT

SEQ ID NO: 46255 - protein, 11 aa, Dengue virus
GVFPVSIPITA

SEQ ID NO: 46256 - protein, 11 aa, Dengue virus
VFPVSIPITAA

SEQ ID NO: 46257 - protein, 11 aa, Dengue virus
FPVSIPITAAA

SEQ ID NO: 46258 - protein, 11 aa, Dengue virus
PVSIPITAAAW

SEQ ID NO: 46259 - protein, 11 aa, Dengue virus
VSIPITAAAWY

SEQ ID NO: 46260 - protein, 11 aa, Dengue virus
SIPITAAAWYL

SEQ ID NO: 46261 - protein, 11 aa, Dengue virus
IPITAAAWYLW

SEQ ID NO: 46262 - protein, 11 aa, Dengue virus
PITAAAWYLWE

SEQ ID NO: 46263 - protein, 11 aa, Dengue virus
ITAAAWYLWEV

SEQ ID NO: 46264 - protein, 11 aa, Dengue virus
TAAAWYLWEVK

SEQ ID NO: 46265 - protein, 11 aa, Dengue virus
AAAWYLWEVKK

SEQ ID NO: 46266 - protein, 11 aa, Dengue virus
AAWYLWEVKKQ

SEQ ID NO: 46267 - protein, 11 aa, Dengue virus
AWYLWEVKKQR

SEQ ID NO: 46268 - protein, 11 aa, Dengue virus
WYLWEVKKQRA

SEQ ID NO: 46269 - protein, 11 aa, Dengue virus
YLWEVKKQRAG

SEQ ID NO: 46270 - protein, 11 aa, Dengue virus
LWEVKKQRAGV

SEQ ID NO: 46271 - protein, 11 aa, Dengue virus
WEVKKQRAGVL

SEQ ID NO: 46272 - protein, 11 aa, Dengue virus
EVKKQRAGVLW

SEQ ID NO: 46273 - protein, 11 aa, Dengue virus
VKKQRAGVLWD

SEQ ID NO: 46274 - protein, 11 aa, Dengue virus
KKQRAGVLWDV

SEQ ID NO: 46275 - protein, 11 aa, Dengue virus
KQRAGVLWDVP

SEQ ID NO: 46276 - protein, 11 aa, Dengue virus
QRAGVLWDVPS

SEQ ID NO: 46277 - protein, 11 aa, Dengue virus
RAGVLWDVPSP

SEQ ID NO: 46278 - protein, 11 aa, Dengue virus
AGVLWDVPSPP

SEQ ID NO: 46279 - protein, 11 aa, Dengue virus
GVLWDVPSPPP

SEQ ID NO: 46280 - protein, 11 aa, Dengue virus
VLWDVPSPPPV

SEQ ID NO: 46281 - protein, 11 aa, Dengue virus
LWDVPSPPPVG

SEQ ID NO: 46282 - protein, 11 aa, Dengue virus
GKAELEDGAYR

SEQ ID NO: 46283 - protein, 11 aa, Dengue virus
KAELEDGAYRI

SEQ ID NO: 46284 - protein, 11 aa, Dengue virus
AELEDGAYRIK

SEQ ID NO: 46285 - protein, 11 aa, Dengue virus
ELEDGAYRIKQ

SEQ ID NO: 46286 - protein, 11 aa, Dengue virus
LEDGAYRIKQR

SEQ ID NO: 46287 - protein, 11 aa, Dengue virus
EDGAYRIKQRG

SEQ ID NO: 46288 - protein, 11 aa, Dengue virus
DGAYRIKQRGI

SEQ ID NO: 46289 - protein, 11 aa, Dengue virus
GAYRIKQKGIL

SEQ ID NO: 46290 - protein, 11 aa, Dengue virus
AYRIKQKGILG

SEQ ID NO: 46291 - protein, 11 aa, Dengue virus
YRIKQKGILGY

SEQ ID NO: 46292 - protein, 11 aa, Dengue virus
RIKQKGILGYS

SEQ ID NO: 46293 - protein, 11 aa, Dengue virus
IKQKGILGYSQ

SEQ ID NO: 46294 - protein, 11 aa, Dengue virus
KQKGILGYSQI

SEQ ID NO: 46295 - protein, 11 aa, Dengue virus
QKGILGYSQIG

SEQ ID NO: 46296 - protein, 11 aa, Dengue virus
KGILGYSQIGA

SEQ ID NO: 46297 - protein, 11 aa, Dengue virus
GILGYSQIGAG

SEQ ID NO: 46298 - protein, 11 aa, Dengue virus
ILGYSQIGAGV

SEQ ID NO: 46299 - protein, 11 aa, Dengue virus
LGYSQIGAGVY

SEQ ID NO: 46300 - protein, 11 aa, Dengue virus
GYSQIGAGVYK

SEQ ID NO: 46301 - protein, 11 aa, Dengue virus
YSQIGAGVYKE

SEQ ID NO: 46302 - protein, 11 aa, Dengue virus
SQIGAGVYKEG

SEQ ID NO: 46303 - protein, 11 aa, Dengue virus
QIGAGVYKEGT

SEQ ID NO: 46304 - protein, 11 aa, Dengue virus
IGAGVYKEGTF

SEQ ID NO: 46305 - protein, 11 aa, Dengue virus
GAGVYKEGTFH

SEQ ID NO: 46306 - protein, 11 aa, Dengue virus
AGVYKEGTFHT

SEQ ID NO: 46307 - protein, 11 aa, Dengue virus
GVYKEGTFHTM

SEQ ID NO: 46308 - protein, 11 aa, Dengue virus
VYKEGTFHTMW

SEQ ID NO: 46309 - protein, 11 aa, Dengue virus
YKEGTFHTMWH

SEQ ID NO: 46310 - protein, 11 aa, Dengue virus
KEGTFHTMWHV

SEQ ID NO: 46311 - protein, 11 aa, Dengue virus
EGTFHTMWHVT

SEQ ID NO: 46312 - protein, 11 aa, Dengue virus
GTFHTMWHVTR

SEQ ID NO: 46313 - protein, 11 aa, Dengue virus
TFHTMWHVTRG

SEQ ID NO: 46314 - protein, 11 aa, Dengue virus
FHTMWHVTRGA

SEQ ID NO: 46315 - protein, 11 aa, Dengue virus
HTMWHVTRGAV

SEQ ID NO: 46316 - protein, 11 aa, Dengue virus
TMWHVTRGAVL

SEQ ID NO: 46317 - protein, 11 aa, Dengue virus
MWHVTRGAVLM

SEQ ID NO: 46318 - protein, 11 aa, Dengue virus
WHVTRGAVLMH

SEQ ID NO: 46319 - protein, 11 aa, Dengue virus
HVTRGAVLMHR

SEQ ID NO: 46320 - protein, 11 aa, Dengue virus
VTRGAVLMHRG

SEQ ID NO: 46321 - protein, 11 aa, Dengue virus
TRGAVLMHRGK

SEQ ID NO: 46322 - protein, 11 aa, Dengue virus
RGAVLMHRGKR

SEQ ID NO: 46323 - protein, 11 aa, Dengue virus
GAVLMHRGKRI

SEQ ID NO: 46324 - protein, 11 aa, Dengue virus
AVLMHRGKRIE

SEQ ID NO: 46325 - protein, 11 aa, Dengue virus
VLMHRGKRIEP

SEQ ID NO: 46326 - protein, 11 aa, Dengue virus
LMHRGKRIEPS

SEQ ID NO: 46327 - protein, 11 aa, Dengue virus
MHRGKRIEPSW

SEQ ID NO: 46328 - protein, 11 aa, Dengue virus
HRGKRIEPSWA

SEQ ID NO: 46329 - protein, 11 aa, Dengue virus
RGKRIEPSWAD

SEQ ID NO: 46330 - protein, 11 aa, Dengue virus
GKRIEPSWADV

SEQ ID NO: 46331 - protein, 11 aa, Dengue virus
KRIEPSWADVK

SEQ ID NO: 46332 - protein, 11 aa, Dengue virus
RIEPSWADVKK

SEQ ID NO: 46333 - protein, 11 aa, Dengue virus
IEPSWADVKKD

SEQ ID NO: 46334 - protein, 11 aa, Dengue virus
EPSWADVKKDL

SEQ ID NO: 46335 - protein, 11 aa, Dengue virus
PSWADVKKDLI

SEQ ID NO: 46336 - protein, 11 aa, Dengue virus
SWADVKKDLIS

SEQ ID NO: 46337 - protein, 11 aa, Dengue virus
WADVKKDLISY

SEQ ID NO: 46338 - protein, 11 aa, Dengue virus
ADVKKDLISYG

SEQ ID NO: 46339 - protein, 11 aa, Dengue virus
DVKKDLISYGG

SEQ ID NO: 46340 - protein, 11 aa, Dengue virus
VKKDLISYGGG

SEQ ID NO: 46341 - protein, 11 aa, Dengue virus
KKDLISYGGGW

SEQ ID NO: 46342 - protein, 11 aa, Dengue virus
KDLISYGGGWK

SEQ ID NO: 46343 - protein, 11 aa, Dengue virus
DLISYGGGWKL

SEQ ID NO: 46344 - protein, 11 aa, Dengue virus
LISYGGGWKLE

SEQ ID NO: 46345 - protein, 11 aa, Dengue virus
ISYGGGWKLEG

SEQ ID NO: 46346 - protein, 11 aa, Dengue virus
SYGGGWKLEGE

SEQ ID NO: 46347 - protein, 11 aa, Dengue virus
YGGGWKLEGEW

SEQ ID NO: 46348 - protein, 11 aa, Dengue virus
GGGWKLEGEWK

SEQ ID NO: 46349 - protein, 11 aa, Dengue virus
GGWKLEGEWKE

SEQ ID NO: 46350 - protein, 11 aa, Dengue virus
GWKLEGEWKEG

SEQ ID NO: 46351 - protein, 11 aa, Dengue virus
WKLEGEWKEGE

SEQ ID NO: 46352 - protein, 11 aa, Dengue virus
KLEGEWKEGEE

SEQ ID NO: 46353 - protein, 11 aa, Dengue virus
LEGEWKEGEEV

SEQ ID NO: 46354 - protein, 11 aa, Dengue virus
EGEWKEGEEVQ

SEQ ID NO: 46355 - protein, 11 aa, Dengue virus
GEWKEGEEVQV

SEQ ID NO: 46356 - protein, 11 aa, Dengue virus
EWKEGEEVQVL

SEQ ID NO: 46357 - protein, 11 aa, Dengue virus
WKEGEEVQVLA

SEQ ID NO: 46358 - protein, 11 aa, Dengue virus
KEGEEVQVLAL

SEQ ID NO: 46359 - protein, 11 aa, Dengue virus
EGEEVQVLALE

SEQ ID NO: 46360 - protein, 11 aa, Dengue virus
GEEVQVLALEP

SEQ ID NO: 46361 - protein, 11 aa, Dengue virus
EEVQVLALEPG

SEQ ID NO: 46362 - protein, 11 aa, Dengue virus
EVQVLALEPGK

SEQ ID NO: 46363 - protein, 11 aa, Dengue virus
VQVLALEPGKN

SEQ ID NO: 46364 - protein, 11 aa, Dengue virus
QVLALEPGKNP

SEQ ID NO: 46365 - protein, 11 aa, Dengue virus
VLALEPGKNPR

SEQ ID NO: 46366 - protein, 11 aa, Dengue virus
LALEPGKNPRA

SEQ ID NO: 46367 - protein, 11 aa, Dengue virus
ALEPGKNPRAV

SEQ ID NO: 46368 - protein, 11 aa, Dengue virus
LEPGKNPRAVQ

SEQ ID NO: 46369 - protein, 11 aa, Dengue virus
EPGKNPRAVQT

SEQ ID NO: 46370 - protein, 11 aa, Dengue virus
PGKNPRAVQTK

SEQ ID NO: 46371 - protein, 11 aa, Dengue virus
GKNPRAVQTKP

SEQ ID NO: 46372 - protein, 11 aa, Dengue virus
KNPRAVQTKPG

SEQ ID NO: 46373 - protein, 11 aa, Dengue virus
NPRAVQTKPGL

SEQ ID NO: 46374 - protein, 11 aa, Dengue virus
PRAVQTKPGLF

SEQ ID NO: 46375 - protein, 11 aa, Dengue virus
RAVQTKPGLFK

SEQ ID NO: 46376 - protein, 11 aa, Dengue virus
AVQTKPGLFKT

SEQ ID NO: 46377 - protein, 11 aa, Dengue virus
VQTKPGLFKTN

SEQ ID NO: 46378 - protein, 11 aa, Dengue virus
FKTNTGTIGAV

SEQ ID NO: 46379 - protein, 11 aa, Dengue virus
KTNTGTIGAVS

SEQ ID NO: 46380 - protein, 11 aa, Dengue virus
TNTGTIGAVSL

SEQ ID NO: 46381 - protein, 11 aa, Dengue virus
NTGTIGAVSLD

SEQ ID NO: 46382 - protein, 11 aa, Dengue virus
TGTIGAVSLDF

SEQ ID NO: 46383 - protein, 11 aa, Dengue virus
GTIGAVSLDFS

SEQ ID NO: 46384 - protein, 11 aa, Dengue virus
TIGAVSLDFSP

SEQ ID NO: 46385 - protein, 11 aa, Dengue virus
IGAVSLDFSPG

SEQ ID NO: 46386 - protein, 11 aa, Dengue virus
GAVSLDFSPGT

SEQ ID NO: 46387 - protein, 11 aa, Dengue virus
AVSLDFSPGTS

SEQ ID NO: 46388 - protein, 11 aa, Dengue virus
VSLDFSPGTSG

SEQ ID NO: 46389 - protein, 11 aa, Dengue virus
SLDFSPGTSGS

SEQ ID NO: 46390 - protein, 11 aa, Dengue virus
LDFSPGTSGSP

SEQ ID NO: 46391 - protein, 11 aa, Dengue virus
DFSPGTSGSPI

SEQ ID NO: 46392 - protein, 11 aa, Dengue virus
FSPGTSGSPIV

SEQ ID NO: 46393 - protein, 11 aa, Dengue virus
SPGTSGSPIVD

SEQ ID NO: 46394 - protein, 11 aa, Dengue virus
PGTSGSPIVDR

SEQ ID NO: 46395 - protein, 11 aa, Dengue virus
GTSGSPIVDRK

SEQ ID NO: 46396 - protein, 11 aa, Dengue virus
TSGSPIVDRKG

SEQ ID NO: 46397 - protein, 11 aa, Dengue virus
SGSPIVDRKGK

SEQ ID NO: 46398 - protein, 11 aa, Dengue virus
GSPIVDRKGKV

SEQ ID NO: 46399 - protein, 11 aa, Dengue virus
SPIVDRKGKVV

SEQ ID NO: 46400 - protein, 11 aa, Dengue virus
PIVDRKGKVVG

SEQ ID NO: 46401 - protein, 11 aa, Dengue virus
IVDRKGKVVGL

SEQ ID NO: 46402 - protein, 11 aa, Dengue virus
VDRKGKVVGLY

SEQ ID NO: 46403 - protein, 11 aa, Dengue virus
DRKGKVVGLYG

SEQ ID NO: 46404 - protein, 11 aa, Dengue virus
RKGKVVGLYGN

SEQ ID NO: 46405 - protein, 11 aa, Dengue virus
KGKVVGLYGNG

SEQ ID NO: 46406 - protein, 11 aa, Dengue virus
GKVVGLYGNGV

SEQ ID NO: 46407 - protein, 11 aa, Dengue virus
KVVGLYGNGVV

SEQ ID NO: 46408 - protein, 11 aa, Dengue virus
VVGLYGNGVVT

SEQ ID NO: 46409 - protein, 11 aa, Dengue virus
VGLYGNGVVTR

SEQ ID NO: 46410 - protein, 11 aa, Dengue virus
GLYGNGVVTRS

SEQ ID NO: 46411 - protein, 11 aa, Dengue virus
LYGNGVVTRSG

SEQ ID NO: 46412 - protein, 11 aa, Dengue virus
YGNGVVTRSGA

SEQ ID NO: 46413 - protein, 11 aa, Dengue virus
GNGVVTRSGAY

SEQ ID NO: 46414 - protein, 11 aa, Dengue virus
NGVVTRSGAYV

SEQ ID NO: 46415 - protein, 11 aa, Dengue virus
GVVTRSGAYVS

SEQ ID NO: 46416 - protein, 11 aa, Dengue virus
VVTRSGAYVSA

SEQ ID NO: 46417 - protein, 11 aa, Dengue virus
VTRSGAYVSAI

SEQ ID NO: 46418 - protein, 11 aa, Dengue virus
TRSGAYVSAIA

SEQ ID NO: 46419 - protein, 11 aa, Dengue virus
RSGAYVSAIAQ

SEQ ID NO: 46420 - protein, 11 aa, Dengue virus
SGAYVSAIAQT

SEQ ID NO: 46421 - protein, 11 aa, Dengue virus
GAYVSAIAQTE

SEQ ID NO: 46422 - protein, 11 aa, Dengue virus
AYVSAIAQTEK

SEQ ID NO: 46423 - protein, 11 aa, Dengue virus
YVSAIAQTEKS

SEQ ID NO: 46424 - protein, 11 aa, Dengue virus
VSAIAQTEKSI

SEQ ID NO: 46425 - protein, 11 aa, Dengue virus
SAIAQTEKSIE

SEQ ID NO: 46426 - protein, 11 aa, Dengue virus
EDNPEIEDDIF

SEQ ID NO: 46427 - protein, 11 aa, Dengue virus
DNPEIEDDIFR

SEQ ID NO: 46428 - protein, 11 aa, Dengue virus
NPEIEDDIFRK

SEQ ID NO: 46429 - protein, 11 aa, Dengue virus
PEIEDDIFRKK

SEQ ID NO: 46430 - protein, 11 aa, Dengue virus
EIEDDIFRKKR

SEQ ID NO: 46431 - protein, 11 aa, Dengue virus
IEDDIFRKKRL

SEQ ID NO: 46432 - protein, 11 aa, Dengue virus
EDDIFRKKRLT

SEQ ID NO: 46433 - protein, 11 aa, Dengue virus
DDIFRKKRLTI

SEQ ID NO: 46434 - protein, 11 aa, Dengue virus
DIFRKKRLTIM

SEQ ID NO: 46435 - protein, 11 aa, Dengue virus
IFRKKRLTIMD

SEQ ID NO: 46436 - protein, 11 aa, Dengue virus
FRKKRLTIMDL

SEQ ID NO: 46437 - protein, 11 aa, Dengue virus
RKKRLTIMDLH

SEQ ID NO: 46438 - protein, 11 aa, Dengue virus
KKRLTIMDLHP

SEQ ID NO: 46439 - protein, 11 aa, Dengue virus
KRLTIMDLHPG

SEQ ID NO: 46440 - protein, 11 aa, Dengue virus
RLTIMDLHPGA

SEQ ID NO: 46441 - protein, 11 aa, Dengue virus
LTIMDLHPGAG

SEQ ID NO: 46442 - protein, 11 aa, Dengue virus
TIMDLHPGAGK

SEQ ID NO: 46443 - protein, 11 aa, Dengue virus
IMDLHPGAGKT

SEQ ID NO: 46444 - protein, 11 aa, Dengue virus
MDLHPGAGKTK

SEQ ID NO: 46445 - protein, 11 aa, Dengue virus
DLHPGAGKTKR

SEQ ID NO: 46446 - protein, 11 aa, Dengue virus
LHPGAGKTKRY

SEQ ID NO: 46447 - protein, 11 aa, Dengue virus
HPGAGKTKRYL

SEQ ID NO: 46448 - protein, 11 aa, Dengue virus
PGAGKTKRYLP

SEQ ID NO: 46449 - protein, 11 aa, Dengue virus
GAGKTKRYLPA

SEQ ID NO: 46450 - protein, 11 aa, Dengue virus
AGKTKRYLPAI

SEQ ID NO: 46451 - protein, 11 aa, Dengue virus
GKTKRYLPAIV

SEQ ID NO: 46452 - protein, 11 aa, Dengue virus
KTKRYLPAIVR

SEQ ID NO: 46453 - protein, 11 aa, Dengue virus
TKRYLPAIVRE

SEQ ID NO: 46454 - protein, 11 aa, Dengue virus
KRYLPAIVREA

SEQ ID NO: 46455 - protein, 11 aa, Dengue virus
RYLPAIVREAI

SEQ ID NO: 46456 - protein, 11 aa, Dengue virus
YLPAIVREAIK

SEQ ID NO: 46457 - protein, 11 aa, Dengue virus
LPAIVREAIKR

SEQ ID NO: 46458 - protein, 11 aa, Dengue virus
PAIVREAIKRG

SEQ ID NO: 46459 - protein, 11 aa, Dengue virus
AIVREAIKRGL

SEQ ID NO: 46460 - protein, 11 aa, Dengue virus
IVREAIKRGLR

SEQ ID NO: 46461 - protein, 11 aa, Dengue virus
VREAIKRGLRT

SEQ ID NO: 46462 - protein, 11 aa, Dengue virus
REAIKRGLRTL

SEQ ID NO: 46463 - protein, 11 aa, Dengue virus
EAIKRGLRTLI

SEQ ID NO: 46464 - protein, 11 aa, Dengue virus
AIKRGLRTLIL

SEQ ID NO: 46465 - protein, 11 aa, Dengue virus
IKRGLRTLILA

SEQ ID NO: 46466 - protein, 11 aa, Dengue virus
KRGLRTLILAP

SEQ ID NO: 46467 - protein, 11 aa, Dengue virus
RGLRTLILAPT

SEQ ID NO: 46468 - protein, 11 aa, Dengue virus
GLRTLILAPTR

SEQ ID NO: 46469 - protein, 11 aa, Dengue virus
LRTLILAPTRV

SEQ ID NO: 46470 - protein, 11 aa, Dengue virus
RTLILAPTRVV

SEQ ID NO: 46471 - protein, 11 aa, Dengue virus
TLILAPTRVVA

SEQ ID NO: 46472 - protein, 11 aa, Dengue virus
LILAPTRVVAA

SEQ ID NO: 46473 - protein, 11 aa, Dengue virus
ILAPTRVVAAE

SEQ ID NO: 46474 - protein, 11 aa, Dengue virus
LAPTRVVAAEM

SEQ ID NO: 46475 - protein, 11 aa, Dengue virus
APTRVVAAEME

SEQ ID NO: 46476 - protein, 11 aa, Dengue virus
PTRVVAAEMEE

SEQ ID NO: 46477 - protein, 11 aa, Dengue virus
TRVVAAEMEEA

SEQ ID NO: 46478 - protein, 11 aa, Dengue virus
RVVAAEMEEAL

SEQ ID NO: 46479 - protein, 11 aa, Dengue virus
VVAAEMEEALR

SEQ ID NO: 46480 - protein, 11 aa, Dengue virus
VAAEMEEALRG

SEQ ID NO: 46481 - protein, 11 aa, Dengue virus
AAEMEEALRGL

SEQ ID NO: 46482 - protein, 11 aa, Dengue virus
AEMEEALRGLP

SEQ ID NO: 46483 - protein, 11 aa, Dengue virus
EMEEALRGLPI

SEQ ID NO: 46484 - protein, 11 aa, Dengue virus
MEEALRGLPIR

SEQ ID NO: 46485 - protein, 11 aa, Dengue virus
EEALRGLPIRY

SEQ ID NO: 46486 - protein, 11 aa, Dengue virus
EALRGLPIRYQ

SEQ ID NO: 46487 - protein, 11 aa, Dengue virus
ALRGLPIRYQT

SEQ ID NO: 46488 - protein, 11 aa, Dengue virus
LRGLPIRYQTP

SEQ ID NO: 46489 - protein, 11 aa, Dengue virus
RGLPIRYQTPA

SEQ ID NO: 46490 - protein, 11 aa, Dengue virus
GLPIRYQTPAI

SEQ ID NO: 46491 - protein, 11 aa, Dengue virus
LPIRYQTPAIR

SEQ ID NO: 46492 - protein, 11 aa, Dengue virus
PIRYQTPAIRA

SEQ ID NO: 46493 - protein, 11 aa, Dengue virus
IRYQTPAIRAE

SEQ ID NO: 46494 - protein, 11 aa, Dengue virus
RYQTPAIRAEH

SEQ ID NO: 46495 - protein, 11 aa, Dengue virus
YQTPAIRAEHT

SEQ ID NO: 46496 - protein, 11 aa, Dengue virus
QTPAIRAEHTG

SEQ ID NO: 46497 - protein, 11 aa, Dengue virus
TPAIRAEHTGR

SEQ ID NO: 46498 - protein, 11 aa, Dengue virus
PAIRAEHTGRE

SEQ ID NO: 46499 - protein, 11 aa, Dengue virus
AIRAEHTGREI

SEQ ID NO: 46500 - protein, 11 aa, Dengue virus
IRAEHTGREIV

SEQ ID NO: 46501 - protein, 11 aa, Dengue virus
RAEHTGREIVD

SEQ ID NO: 46502 - protein, 11 aa, Dengue virus
AEHTGREIVDL

SEQ ID NO: 46503 - protein, 11 aa, Dengue virus
EHTGREIVDLM

SEQ ID NO: 46504 - protein, 11 aa, Dengue virus
HTGREIVDLMC

SEQ ID NO: 46505 - protein, 11 aa, Dengue virus
TGREIVDLMCH

SEQ ID NO: 46506 - protein, 11 aa, Dengue virus
GREIVDLMCHA

SEQ ID NO: 46507 - protein, 11 aa, Dengue virus
REIVDLMCHAT

SEQ ID NO: 46508 - protein, 11 aa, Dengue virus
EIVDLMCHATF

SEQ ID NO: 46509 - protein, 11 aa, Dengue virus
IVDLMCHATFT

SEQ ID NO: 46510 - protein, 11 aa, Dengue virus
VDLMCHATFTM

SEQ ID NO: 46511 - protein, 11 aa, Dengue virus
DLMCHATFTMR

SEQ ID NO: 46512 - protein, 11 aa, Dengue virus
LMCHATFTMRL

SEQ ID NO: 46513 - protein, 11 aa, Dengue virus
MCHATFTMRLL

SEQ ID NO: 46514 - protein, 11 aa, Dengue virus
CHATFTMRLLS

SEQ ID NO: 46515 - protein, 11 aa, Dengue virus
HATFTMRLLSP

SEQ ID NO: 46516 - protein, 11 aa, Dengue virus
ATFTMRLLSPV

SEQ ID NO: 46517 - protein, 11 aa, Dengue virus
TFTMRLLSPVR

SEQ ID NO: 46518 - protein, 11 aa, Dengue virus
FTMRLLSPVRV

SEQ ID NO: 46519 - protein, 11 aa, Dengue virus
TMRLLSPVRVP

SEQ ID NO: 46520 - protein, 11 aa, Dengue virus
MRLLSPVRVPN

SEQ ID NO: 46521 - protein, 11 aa, Dengue virus
RLLSPVRVPNY

SEQ ID NO: 46522 - protein, 11 aa, Dengue virus
LLSPVRVPNYN

SEQ ID NO: 46523 - protein, 11 aa, Dengue virus
LSPVRVPNYNL

SEQ ID NO: 46524 - protein, 11 aa, Dengue virus
SPVRVPNYNLI

SEQ ID NO: 46525 - protein, 11 aa, Dengue virus
PVRVPNYNLII

SEQ ID NO: 46526 - protein, 11 aa, Dengue virus
VRVPNYNLIIM

SEQ ID NO: 46527 - protein, 11 aa, Dengue virus
RVPNYNLIIMD

SEQ ID NO: 46528 - protein, 11 aa, Dengue virus
VPNYNLIIMDE

SEQ ID NO: 46529 - protein, 11 aa, Dengue virus
PNYNLIIMDEA

SEQ ID NO: 46530 - protein, 11 aa, Dengue virus
NYNLIIMDEAH

SEQ ID NO: 46531 - protein, 11 aa, Dengue virus
YNLIIMDEAHF

SEQ ID NO: 46532 - protein, 11 aa, Dengue virus
NLIIMDEAHFT

SEQ ID NO: 46533 - protein, 11 aa, Dengue virus
LIIMDEAHFTD

SEQ ID NO: 46534 - protein, 11 aa, Dengue virus
IIMDEAHFTDP

SEQ ID NO: 46535 - protein, 11 aa, Dengue virus
IMDEAHFTDPA

SEQ ID NO: 46536 - protein, 11 aa, Dengue virus
MDEAHFTDPAS

SEQ ID NO: 46537 - protein, 11 aa, Dengue virus
DEAHFTDPASI

SEQ ID NO: 46538 - protein, 11 aa, Dengue virus
EAHFTDPASIA

SEQ ID NO: 46539 - protein, 11 aa, Dengue virus
AHFTDPASIAA

SEQ ID NO: 46540 - protein, 11 aa, Dengue virus
HFTDPASIAAR

SEQ ID NO: 46541 - protein, 11 aa, Dengue virus
FTDPASIAARG

SEQ ID NO: 46542 - protein, 11 aa, Dengue virus
TDPASIAARGY

SEQ ID NO: 46543 - protein, 11 aa, Dengue virus
DPASIAARGYI

SEQ ID NO: 46544 - protein, 11 aa, Dengue virus
PASIAARGYIS

SEQ ID NO: 46545 - protein, 11 aa, Dengue virus
ASIAARGYIST

SEQ ID NO: 46546 - protein, 11 aa, Dengue virus
SIAARGYISTR

SEQ ID NO: 46547 - protein, 11 aa, Dengue virus
IAARGYISTRV

SEQ ID NO: 46548 - protein, 11 aa, Dengue virus
AARGYISTRVE

SEQ ID NO: 46549 - protein, 11 aa, Dengue virus
ARGYISTRVEM

SEQ ID NO: 46550 - protein, 11 aa, Dengue virus
RGYISTRVEMG

SEQ ID NO: 46551 - protein, 11 aa, Dengue virus
GYISTRVEMGE

SEQ ID NO: 46552 - protein, 11 aa, Dengue virus
YISTRVEMGEA

SEQ ID NO: 46553 - protein, 11 aa, Dengue virus
ISTRVEMGEAA

SEQ ID NO: 46554 - protein, 11 aa, Dengue virus
STRVEMGEAAG

SEQ ID NO: 46555 - protein, 11 aa, Dengue virus
TRVEMGEAAGI

SEQ ID NO: 46556 - protein, 11 aa, Dengue virus
RVEMGEAAGIF

SEQ ID NO: 46557 - protein, 11 aa, Dengue virus
VEMGEAAGIFM

SEQ ID NO: 46558 - protein, 11 aa, Dengue virus
EMGEAAGIFMT

SEQ ID NO: 46559 - protein, 11 aa, Dengue virus
MGEAAGIFMTA

SEQ ID NO: 46560 - protein, 11 aa, Dengue virus
GEAAGIFMTAT

SEQ ID NO: 46561 - protein, 11 aa, Dengue virus
EAAGIFMTATP

SEQ ID NO: 46562 - protein, 11 aa, Dengue virus
AAGIFMTATPP

SEQ ID NO: 46563 - protein, 11 aa, Dengue virus
AGIFMTATPPG

SEQ ID NO: 46564 - protein, 11 aa, Dengue virus
GIFMTATPPGS

SEQ ID NO: 46565 - protein, 11 aa, Dengue virus
IFMTATPPGSR

SEQ ID NO: 46566 - protein, 11 aa, Dengue virus
FMTATPPGSRD

SEQ ID NO: 46567 - protein, 11 aa, Dengue virus
MTATPPGSRDP

SEQ ID NO: 46568 - protein, 11 aa, Dengue virus
TATPPGSRDPF

SEQ ID NO: 46569 - protein, 11 aa, Dengue virus
ATPPGSRDPFP

SEQ ID NO: 46570 - protein, 11 aa, Dengue virus
TPPGSRDPFPQ

SEQ ID NO: 46571 - protein, 11 aa, Dengue virus
PPGSRDPFPQS

SEQ ID NO: 46572 - protein, 11 aa, Dengue virus
PGSRDPFPQSN

SEQ ID NO: 46573 - protein, 11 aa, Dengue virus
GSRDPFPQSNA

SEQ ID NO: 46574 - protein, 11 aa, Dengue virus
SRDPFPQSNAP

SEQ ID NO: 46575 - protein, 11 aa, Dengue virus
RDPFPQSNAPI

SEQ ID NO: 46576 - protein, 11 aa, Dengue virus
DPFPQSNAPIM

SEQ ID NO: 46577 - protein, 11 aa, Dengue virus
PFPQSNAPIMD

SEQ ID NO: 46578 - protein, 11 aa, Dengue virus
FPQSNAPIMDE

SEQ ID NO: 46579 - protein, 11 aa, Dengue virus
PQSNAPIMDEE

SEQ ID NO: 46580 - protein, 11 aa, Dengue virus
QSNAPIMDEER

SEQ ID NO: 46581 - protein, 11 aa, Dengue virus
SNAPIMDEERE

SEQ ID NO: 46582 - protein, 11 aa, Dengue virus
NAPIMDEEREI

SEQ ID NO: 46583 - protein, 11 aa, Dengue virus
APIMDEEREIP

SEQ ID NO: 46584 - protein, 11 aa, Dengue virus
PIMDEEREIPE

SEQ ID NO: 46585 - protein, 11 aa, Dengue virus
IMDEEREIPER

SEQ ID NO: 46586 - protein, 11 aa, Dengue virus
MDEEREIPERS

SEQ ID NO: 46587 - protein, 11 aa, Dengue virus
DEEREIPERSW

SEQ ID NO: 46588 - protein, 11 aa, Dengue virus
EEREIPERSWN

SEQ ID NO: 46589 - protein, 11 aa, Dengue virus
EREIPERSWNS

SEQ ID NO: 46590 - protein, 11 aa, Dengue virus
REIPERSWNSG

SEQ ID NO: 46591 - protein, 11 aa, Dengue virus
EIPERSWNSGH

SEQ ID NO: 46592 - protein, 11 aa, Dengue virus
IPERSWNSGHE

SEQ ID NO: 46593 - protein, 11 aa, Dengue virus
PERSWNSGHEW

SEQ ID NO: 46594 - protein, 11 aa, Dengue virus
ERSWNSGHEWV

SEQ ID NO: 46595 - protein, 11 aa, Dengue virus
RSWNSGHEWVT

SEQ ID NO: 46596 - protein, 11 aa, Dengue virus
SWNSGHEWVTD

SEQ ID NO: 46597 - protein, 11 aa, Dengue virus
WNSGHEWVTDF

SEQ ID NO: 46598 - protein, 11 aa, Dengue virus
GHEWVTDFKGK

SEQ ID NO: 46599 - protein, 11 aa, Dengue virus
HEWVTDFKGKT

SEQ ID NO: 46600 - protein, 11 aa, Dengue virus
EWVTDFKGKTV

SEQ ID NO: 46601 - protein, 11 aa, Dengue virus
WVTDFKGKTVW

SEQ ID NO: 46602 - protein, 11 aa, Dengue virus
VTDFKGKTVWF

SEQ ID NO: 46603 - protein, 11 aa, Dengue virus
TDFKGKTVWFV

SEQ ID NO: 46604 - protein, 11 aa, Dengue virus
DFKGKTVWFVP

SEQ ID NO: 46605 - protein, 11 aa, Dengue virus
FKGKTVWFVPS

SEQ ID NO: 46606 - protein, 11 aa, Dengue virus
KGKTVWFVPSI

SEQ ID NO: 46607 - protein, 11 aa, Dengue virus
GKTVWFVPSIK

SEQ ID NO: 46608 - protein, 11 aa, Dengue virus
KTVWFVPSIKA

SEQ ID NO: 46609 - protein, 11 aa, Dengue virus
TVWFVPSIKAG

SEQ ID NO: 46610 - protein, 11 aa, Dengue virus
VWFVPSIKAGN

SEQ ID NO: 46611 - protein, 11 aa, Dengue virus
WFVPSIKAGND

SEQ ID NO: 46612 - protein, 11 aa, Dengue virus
FVPSIKAGNDI

SEQ ID NO: 46613 - protein, 11 aa, Dengue virus
VPSIKAGNDIA

SEQ ID NO: 46614 - protein, 11 aa, Dengue virus
PSIKAGNDIAA

SEQ ID NO: 46615 - protein, 11 aa, Dengue virus
SIKAGNDIAAC

SEQ ID NO: 46616 - protein, 11 aa, Dengue virus
IKAGNDIAACL

SEQ ID NO: 46617 - protein, 11 aa, Dengue virus
KAGNDIAACLR

SEQ ID NO: 46618 - protein, 11 aa, Dengue virus
AGNDIAACLRK

SEQ ID NO: 46619 - protein, 11 aa, Dengue virus
GNDIAACLRKN

SEQ ID NO: 46620 - protein, 11 aa, Dengue virus
NDIAACLRKNG

SEQ ID NO: 46621 - protein, 11 aa, Dengue virus
DIAACLRKNGK

SEQ ID NO: 46622 - protein, 11 aa, Dengue virus
IAACLRKNGKK

SEQ ID NO: 46623 - protein, 11 aa, Dengue virus
AACLRKNGKKV

SEQ ID NO: 46624 - protein, 11 aa, Dengue virus
ACLRKNGKKVI

SEQ ID NO: 46625 - protein, 11 aa, Dengue virus
CLRKNGKKVIQ

SEQ ID NO: 46626 - protein, 11 aa, Dengue virus
LRKNGKKVIQL

SEQ ID NO: 46627 - protein, 11 aa, Dengue virus
RKNGKKVIQLS

SEQ ID NO: 46628 - protein, 11 aa, Dengue virus
KNGKKVIQLSR

SEQ ID NO: 46629 - protein, 11 aa, Dengue virus
NGKKVIQLSRK

SEQ ID NO: 46630 - protein, 11 aa, Dengue virus
GKKVIQLSRKT

SEQ ID NO: 46631 - protein, 11 aa, Dengue virus
KKVIQLSRKTF

SEQ ID NO: 46632 - protein, 11 aa, Dengue virus
KVIQLSRKTFD

SEQ ID NO: 46633 - protein, 11 aa, Dengue virus
VIQLSRKTFDS

SEQ ID NO: 46634 - protein, 11 aa, Dengue virus
IQLSRKTFDSE

SEQ ID NO: 46635 - protein, 11 aa, Dengue virus
QLSRKTFDSEY

SEQ ID NO: 46636 - protein, 11 aa, Dengue virus
LSRKTFDSEYV

SEQ ID NO: 46637 - protein, 11 aa, Dengue virus
SRKTFDSEYVK

SEQ ID NO: 46638 - protein, 11 aa, Dengue virus
RKTFDSEYVKT

SEQ ID NO: 46639 - protein, 11 aa, Dengue virus
KTFDSEYVKTR

SEQ ID NO: 46640 - protein, 11 aa, Dengue virus
KTRTNDWDFVV

SEQ ID NO: 46641 - protein, 11 aa, Dengue virus
TRTNDWDFVVT

SEQ ID NO: 46642 - protein, 11 aa, Dengue virus
RTNDWDFVVTT

SEQ ID NO: 46643 - protein, 11 aa, Dengue virus
TNDWDFVVTTD

SEQ ID NO: 46644 - protein, 11 aa, Dengue virus
NDWDFVVTTDI

SEQ ID NO: 46645 - protein, 11 aa, Dengue virus
DWDFVVTTDIS

SEQ ID NO: 46646 - protein, 11 aa, Dengue virus
WDFVVTTDISE

SEQ ID NO: 46647 - protein, 11 aa, Dengue virus
DFVVTTDISEM

SEQ ID NO: 46648 - protein, 11 aa, Dengue virus
FVVTTDISEMG

SEQ ID NO: 46649 - protein, 11 aa, Dengue virus
VVTTDISEMGA

SEQ ID NO: 46650 - protein, 11 aa, Dengue virus
VTTDISEMGAN

SEQ ID NO: 46651 - protein, 11 aa, Dengue virus
TTDISEMGANF

SEQ ID NO: 46652 - protein, 11 aa, Dengue virus
TDISEMGANFK

SEQ ID NO: 46653 - protein, 11 aa, Dengue virus
DISEMGANFKA

SEQ ID NO: 46654 - protein, 11 aa, Dengue virus
ISEMGANFKAE

SEQ ID NO: 46655 - protein, 11 aa, Dengue virus
SEMGANFKAER

SEQ ID NO: 46656 - protein, 11 aa, Dengue virus
EMGANFKAERV

SEQ ID NO: 46657 - protein, 11 aa, Dengue virus
MGANFKAERVI

SEQ ID NO: 46658 - protein, 11 aa, Dengue virus
GANFKAERVID

SEQ ID NO: 46659 - protein, 11 aa, Dengue virus
ANFKAERVIDP

SEQ ID NO: 46660 - protein, 11 aa, Dengue virus
NFKAERVIDPR

SEQ ID NO: 46661 - protein, 11 aa, Dengue virus
FKAERVIDPRR

SEQ ID NO: 46662 - protein, 11 aa, Dengue virus
KAERVIDPRRC

SEQ ID NO: 46663 - protein, 11 aa, Dengue virus
AERVIDPRRCM

SEQ ID NO: 46664 - protein, 11 aa, Dengue virus
ERVIDPRRCMK

SEQ ID NO: 46665 - protein, 11 aa, Dengue virus
RVIDPRRCMKP

SEQ ID NO: 46666 - protein, 11 aa, Dengue virus
VIDPRRCMKPV

SEQ ID NO: 46667 - protein, 11 aa, Dengue virus
IDPRRCMKPVI

SEQ ID NO: 46668 - protein, 11 aa, Dengue virus
DPRRCMKPVIL

SEQ ID NO: 46669 - protein, 11 aa, Dengue virus
PRRCMKPVILT

SEQ ID NO: 46670 - protein, 11 aa, Dengue virus
RRCMKPVILTD

SEQ ID NO: 46671 - protein, 11 aa, Dengue virus
RCMKPVILTDG

SEQ ID NO: 46672 - protein, 11 aa, Dengue virus
CMKPVILTDGE

SEQ ID NO: 46673 - protein, 11 aa, Dengue virus
MKPVILTDGEE

SEQ ID NO: 46674 - protein, 11 aa, Dengue virus
KPVILTDGEER

SEQ ID NO: 46675 - protein, 11 aa, Dengue virus
PVILTDGEERV

SEQ ID NO: 46676 - protein, 11 aa, Dengue virus
VILTDGEERVI

SEQ ID NO: 46677 - protein, 11 aa, Dengue virus
ILTDGEERVIL

SEQ ID NO: 46678 - protein, 11 aa, Dengue virus
LTDGEERVILA

SEQ ID NO: 46679 - protein, 11 aa, Dengue virus
TDGEERVILAG

SEQ ID NO: 46680 - protein, 11 aa, Dengue virus
DGEERVILAGP

SEQ ID NO: 46681 - protein, 11 aa, Dengue virus
GEERVILAGPM

SEQ ID NO: 46682 - protein, 11 aa, Dengue virus
EERVILAGPMP

SEQ ID NO: 46683 - protein, 11 aa, Dengue virus
ERVILAGPMPV

SEQ ID NO: 46684 - protein, 11 aa, Dengue virus
RVILAGPMPVT

SEQ ID NO: 46685 - protein, 11 aa, Dengue virus
VILAGPMPVTH

SEQ ID NO: 46686 - protein, 11 aa, Dengue virus
ILAGPMPVTHS

SEQ ID NO: 46687 - protein, 11 aa, Dengue virus
LAGPMPVTHSS

SEQ ID NO: 46688 - protein, 11 aa, Dengue virus
AGPMPVTHSSA

SEQ ID NO: 46689 - protein, 11 aa, Dengue virus
GPMPVTHSSAA

SEQ ID NO: 46690 - protein, 11 aa, Dengue virus
PMPVTHSSAAQ

SEQ ID NO: 46691 - protein, 11 aa, Dengue virus
MPVTHSSAAQR

SEQ ID NO: 46692 - protein, 11 aa, Dengue virus
PVTHSSAAQRR

SEQ ID NO: 46693 - protein, 11 aa, Dengue virus
VTHSSAAQRRG

SEQ ID NO: 46694 - protein, 11 aa, Dengue virus
THSSAAQRRGR

SEQ ID NO: 46695 - protein, 11 aa, Dengue virus
HSSAAQRRGRI

SEQ ID NO: 46696 - protein, 11 aa, Dengue virus
SSAAQRRGRIG

SEQ ID NO: 46697 - protein, 11 aa, Dengue virus
SAAQRRGRIGR

SEQ ID NO: 46698 - protein, 11 aa, Dengue virus
AAQRRGRIGRN

SEQ ID NO: 46699 - protein, 11 aa, Dengue virus
AQRRGRIGRNP

SEQ ID NO: 46700 - protein, 11 aa, Dengue virus
QRRGRIGRNPK

SEQ ID NO: 46701 - protein, 11 aa, Dengue virus
RRGRIGRNPKN

SEQ ID NO: 46702 - protein, 11 aa, Dengue virus
RGRIGRNPKNE

SEQ ID NO: 46703 - protein, 11 aa, Dengue virus
GRIGRNPKNEN

SEQ ID NO: 46704 - protein, 11 aa, Dengue virus
RIGRNPKNEND

SEQ ID NO: 46705 - protein, 11 aa, Dengue virus
IGRNPKNENDQ

SEQ ID NO: 46706 - protein, 11 aa, Dengue virus
GRNPKNENDQY

SEQ ID NO: 46707 - protein, 11 aa, Dengue virus
RNPKNENDQYI

SEQ ID NO: 46708 - protein, 11 aa, Dengue virus
NPKNENDQYIY

SEQ ID NO: 46709 - protein, 11 aa, Dengue virus
PKNENDQYIYM

SEQ ID NO: 46710 - protein, 11 aa, Dengue virus
KNENDQYIYMG

SEQ ID NO: 46711 - protein, 11 aa, Dengue virus
NENDQYIYMGE

SEQ ID NO: 46712 - protein, 11 aa, Dengue virus
ENDQYIYMGEP

SEQ ID NO: 46713 - protein, 11 aa, Dengue virus
NDQYIYMGEPL

SEQ ID NO: 46714 - protein, 11 aa, Dengue virus
DQYIYMGEPLE

SEQ ID NO: 46715 - protein, 11 aa, Dengue virus
QYIYMGEPLEN

SEQ ID NO: 46716 - protein, 11 aa, Dengue virus
YIYMGEPLEND

SEQ ID NO: 46717 - protein, 11 aa, Dengue virus
IYMGEPLENDE

SEQ ID NO: 46718 - protein, 11 aa, Dengue virus
YMGEPLENDED

SEQ ID NO: 46719 - protein, 11 aa, Dengue virus
MGEPLENDEDC

SEQ ID NO: 46720 - protein, 11 aa, Dengue virus
GEPLENDEDCA

SEQ ID NO: 46721 - protein, 11 aa, Dengue virus
EPLENDEDCAH

SEQ ID NO: 46722 - protein, 11 aa, Dengue virus
PLENDEDCAHW

SEQ ID NO: 46723 - protein, 11 aa, Dengue virus
LENDEDCAHWK

SEQ ID NO: 46724 - protein, 11 aa, Dengue virus
ENDEDCAHWKE

SEQ ID NO: 46725 - protein, 11 aa, Dengue virus
NDEDCAHWKEA

SEQ ID NO: 46726 - protein, 11 aa, Dengue virus
DEDCAHWKEAK

SEQ ID NO: 46727 - protein, 11 aa, Dengue virus
EDCAHWKEAKM

SEQ ID NO: 46728 - protein, 11 aa, Dengue virus
DCAHWKEAKML

SEQ ID NO: 46729 - protein, 11 aa, Dengue virus
CAHWKEAKMLL

SEQ ID NO: 46730 - protein, 11 aa, Dengue virus
AHWKEAKMLLD

SEQ ID NO: 46731 - protein, 11 aa, Dengue virus
HWKEAKMLLDN

SEQ ID NO: 46732 - protein, 11 aa, Dengue virus
WKEAKMLLDNI

SEQ ID NO: 46733 - protein, 11 aa, Dengue virus
KEAKMLLDNIN

SEQ ID NO: 46734 - protein, 11 aa, Dengue virus
EAKMLLDNINT

SEQ ID NO: 46735 - protein, 11 aa, Dengue virus
AKMLLDNINTP

SEQ ID NO: 46736 - protein, 11 aa, Dengue virus
KMLLDNINTPE

SEQ ID NO: 46737 - protein, 11 aa, Dengue virus
MLLDNINTPEG

SEQ ID NO: 46738 - protein, 11 aa, Dengue virus
LLDNINTPEGI

SEQ ID NO: 46739 - protein, 11 aa, Dengue virus
LDNINTPEGII

SEQ ID NO: 46740 - protein, 11 aa, Dengue virus
DNINTPEGIIP

SEQ ID NO: 46741 - protein, 11 aa, Dengue virus
NINTPEGIIPS

SEQ ID NO: 46742 - protein, 11 aa, Dengue virus
INTPEGIIPSM

SEQ ID NO: 46743 - protein, 11 aa, Dengue virus
NTPEGIIPSMF

SEQ ID NO: 46744 - protein, 11 aa, Dengue virus
TPEGIIPSMFE

SEQ ID NO: 46745 - protein, 11 aa, Dengue virus
PEGIIPSMFEP

SEQ ID NO: 46746 - protein, 11 aa, Dengue virus
EGIIPSMFEPE

SEQ ID NO: 46747 - protein, 11 aa, Dengue virus
GIIPSMFEPER

SEQ ID NO: 46748 - protein, 11 aa, Dengue virus
IIPSMFEPERE

SEQ ID NO: 46749 - protein, 11 aa, Dengue virus
IPSMFEPEREK

SEQ ID NO: 46750 - protein, 11 aa, Dengue virus
PSMFEPEREKV

SEQ ID NO: 46751 - protein, 11 aa, Dengue virus
SMFEPEREKVD

SEQ ID NO: 46752 - protein, 11 aa, Dengue virus
MFEPEREKVDA

SEQ ID NO: 46753 - protein, 11 aa, Dengue virus
FEPEREKVDAI

SEQ ID NO: 46754 - protein, 11 aa, Dengue virus
EPEREKVDAID

SEQ ID NO: 46755 - protein, 11 aa, Dengue virus
PEREKVDAIDG

SEQ ID NO: 46756 - protein, 11 aa, Dengue virus
EREKVDAIDGE

SEQ ID NO: 46757 - protein, 11 aa, Dengue virus
REKVDAIDGEY

SEQ ID NO: 46758 - protein, 11 aa, Dengue virus
EKVDAIDGEYR

SEQ ID NO: 46759 - protein, 11 aa, Dengue virus
KVDAIDGEYRL

SEQ ID NO: 46760 - protein, 11 aa, Dengue virus
VDAIDGEYRLR

SEQ ID NO: 46761 - protein, 11 aa, Dengue virus
DAIDGEYRLRG

SEQ ID NO: 46762 - protein, 11 aa, Dengue virus
AIDGEYRLRGE

SEQ ID NO: 46763 - protein, 11 aa, Dengue virus
IDGEYRLRGEA

SEQ ID NO: 46764 - protein, 11 aa, Dengue virus
DGEYRLRGEAR

SEQ ID NO: 46765 - protein, 11 aa, Dengue virus
GEYRLRGEARK

SEQ ID NO: 46766 - protein, 11 aa, Dengue virus
EYRLRGEARKT

SEQ ID NO: 46767 - protein, 11 aa, Dengue virus
YRLRGEARKTF

SEQ ID NO: 46768 - protein, 11 aa, Dengue virus
RLRGEARKTFV

SEQ ID NO: 46769 - protein, 11 aa, Dengue virus
LRGEARKTFVD

SEQ ID NO: 46770 - protein, 11 aa, Dengue virus
RGEARKTFVDL

SEQ ID NO: 46771 - protein, 11 aa, Dengue virus
GEARKTFVDLM

SEQ ID NO: 46772 - protein, 11 aa, Dengue virus
EARKTFVDLMR

SEQ ID NO: 46773 - protein, 11 aa, Dengue virus
ARKTFVDLMRR

SEQ ID NO: 46774 - protein, 11 aa, Dengue virus
RKTFVDLMRRG

SEQ ID NO: 46775 - protein, 11 aa, Dengue virus
KTFVDLMRRGD

SEQ ID NO: 46776 - protein, 11 aa, Dengue virus
TFVDLMRRGDL

SEQ ID NO: 46777 - protein, 11 aa, Dengue virus
FVDLMRRGDLP

SEQ ID NO: 46778 - protein, 11 aa, Dengue virus
VDLMRRGDLPV

SEQ ID NO: 46779 - protein, 11 aa, Dengue virus
DLMRRGDLPVW

SEQ ID NO: 46780 - protein, 11 aa, Dengue virus
LMRRGDLPVWL

SEQ ID NO: 46781 - protein, 11 aa, Dengue virus
MRRGDLPVWLA

SEQ ID NO: 46782 - protein, 11 aa, Dengue virus
RRGDLPVWLAY

SEQ ID NO: 46783 - protein, 11 aa, Dengue virus
RGDLPVWLAYK

SEQ ID NO: 46784 - protein, 11 aa, Dengue virus
GDLPVWLAYKV

SEQ ID NO: 46785 - protein, 11 aa, Dengue virus
DLPVWLAYKVA

SEQ ID NO: 46786 - protein, 11 aa, Dengue virus
LPVWLAYKVAA

SEQ ID NO: 46787 - protein, 11 aa, Dengue virus
PVWLAYKVAAE

SEQ ID NO: 46788 - protein, 11 aa, Dengue virus
VWLAYKVAAEG

SEQ ID NO: 46789 - protein, 11 aa, Dengue virus
WLAYKVAAEGI

SEQ ID NO: 46790 - protein, 11 aa, Dengue virus
LAYKVAAEGIN

SEQ ID NO: 46791 - protein, 11 aa, Dengue virus
AYKVAAEGINY

SEQ ID NO: 46792 - protein, 11 aa, Dengue virus
KVAAEGINYAD

SEQ ID NO: 46793 - protein, 11 aa, Dengue virus
VAAEGINYADR

SEQ ID NO: 46794 - protein, 11 aa, Dengue virus
EGINYADRRWC

SEQ ID NO: 46795 - protein, 11 aa, Dengue virus
GINYADRRWCF

SEQ ID NO: 46796 - protein, 11 aa, Dengue virus
INYADRRWCFD

SEQ ID NO: 46797 - protein, 11 aa, Dengue virus
NYADRRWCFDG

SEQ ID NO: 46798 - protein, 11 aa, Dengue virus
YADRRWCFDGI

SEQ ID NO: 46799 - protein, 11 aa, Dengue virus
DRRWCFDGIKN

SEQ ID NO: 46800 - protein, 11 aa, Dengue virus
RRWCFDGIKNN

SEQ ID NO: 46801 - protein, 11 aa, Dengue virus
RWCFDGIKNNQ

SEQ ID NO: 46802 - protein, 11 aa, Dengue virus
WCFDGIKNNQI

SEQ ID NO: 46803 - protein, 11 aa, Dengue virus
CFDGIKNNQIL

SEQ ID NO: 46804 - protein, 11 aa, Dengue virus
FDGIKNNQILE

SEQ ID NO: 46805 - protein, 11 aa, Dengue virus
DGIKNNQILEE

SEQ ID NO: 46806 - protein, 11 aa, Dengue virus
GIKNNQILEEN

SEQ ID NO: 46807 - protein, 11 aa, Dengue virus
KNNQILEENVE

SEQ ID NO: 46808 - protein, 11 aa, Dengue virus
NNQILEENVEV

SEQ ID NO: 46809 - protein, 11 aa, Dengue virus
NQILEENVEVE

SEQ ID NO: 46810 - protein, 11 aa, Dengue virus
QILEENVEVEI

SEQ ID NO: 46811 - protein, 11 aa, Dengue virus
ILEENVEVEIW

SEQ ID NO: 46812 - protein, 11 aa, Dengue virus
LEENVEVEIWT

SEQ ID NO: 46813 - protein, 11 aa, Dengue virus
EENVEVEIWTK

SEQ ID NO: 46814 - protein, 11 aa, Dengue virus
ENVEVEIWTKE

SEQ ID NO: 46815 - protein, 11 aa, Dengue virus
NVEVEIWTKEG

SEQ ID NO: 46816 - protein, 11 aa, Dengue virus
VEVEIWTKEGE

SEQ ID NO: 46817 - protein, 11 aa, Dengue virus
EVEIWTKEGER

SEQ ID NO: 46818 - protein, 11 aa, Dengue virus
VEIWTKEGERK

SEQ ID NO: 46819 - protein, 11 aa, Dengue virus
EIWTKEGERKK

SEQ ID NO: 46820 - protein, 11 aa, Dengue virus
IWTKEGERKKL

SEQ ID NO: 46821 - protein, 11 aa, Dengue virus
WTKEGERKKLK

SEQ ID NO: 46822 - protein, 11 aa, Dengue virus
TKEGERKKLKP

SEQ ID NO: 46823 - protein, 11 aa, Dengue virus
KEGERKKLKPR

SEQ ID NO: 46824 - protein, 11 aa, Dengue virus
EGERKKLKPRW

SEQ ID NO: 46825 - protein, 11 aa, Dengue virus
GERKKLKPRWL

SEQ ID NO: 46826 - protein, 11 aa, Dengue virus
ERKKLKPRWLD

SEQ ID NO: 46827 - protein, 11 aa, Dengue virus
RKKLKPRWLDA

SEQ ID NO: 46828 - protein, 11 aa, Dengue virus
KKLKPRWLDAR

SEQ ID NO: 46829 - protein, 11 aa, Dengue virus
KLKPRWLDARI

SEQ ID NO: 46830 - protein, 11 aa, Dengue virus
LKPRWLDARIY

SEQ ID NO: 46831 - protein, 11 aa, Dengue virus
KPRWLDARIYS

SEQ ID NO: 46832 - protein, 11 aa, Dengue virus
PRWLDARIYSD

SEQ ID NO: 46833 - protein, 11 aa, Dengue virus
RWLDARIYSDP

SEQ ID NO: 46834 - protein, 11 aa, Dengue virus
WLDARIYSDPL

SEQ ID NO: 46835 - protein, 11 aa, Dengue virus
LDARIYSDPLA

SEQ ID NO: 46836 - protein, 11 aa, Dengue virus
DARIYSDPLAL

SEQ ID NO: 46837 - protein, 11 aa, Dengue virus
ARIYSDPLALK

SEQ ID NO: 46838 - protein, 11 aa, Dengue virus
RIYSDPLALKE

SEQ ID NO: 46839 - protein, 11 aa, Dengue virus
IYSDPLALKEF

SEQ ID NO: 46840 - protein, 11 aa, Dengue virus
YSDPLALKEFK

SEQ ID NO: 46841 - protein, 11 aa, Dengue virus
SDPLALKEFKE

SEQ ID NO: 46842 - protein, 11 aa, Dengue virus
DPLALKEFKEF

SEQ ID NO: 46843 - protein, 11 aa, Dengue virus
PLALKEFKEFA

SEQ ID NO: 46844 - protein, 11 aa, Dengue virus
LALKEFKEFAA

SEQ ID NO: 46845 - protein, 11 aa, Dengue virus
ALKEFKEFAAG

SEQ ID NO: 46846 - protein, 11 aa, Dengue virus
LKEFKEFAAGR

SEQ ID NO: 46847 - protein, 11 aa, Dengue virus
KEFKEFAAGRK

SEQ ID NO: 46848 - protein, 11 aa, Dengue virus
EFKEFAAGRKS

SEQ ID NO: 46849 - protein, 11 aa, Dengue virus
FKEFAAGRKSL

SEQ ID NO: 46850 - protein, 11 aa, Dengue virus
KEFAAGRKSLT

SEQ ID NO: 46851 - protein, 11 aa, Dengue virus
EFAAGRKSLTL

SEQ ID NO: 46852 - protein, 11 aa, Dengue virus
FAAGRKSLTLN

SEQ ID NO: 46853 - protein, 11 aa, Dengue virus
AAGRKSLTLNL

SEQ ID NO: 46854 - protein, 11 aa, Dengue virus
AGRKSLTLNLI

SEQ ID NO: 46855 - protein, 11 aa, Dengue virus
GRKSLTLNLIT

SEQ ID NO: 46856 - protein, 11 aa, Dengue virus
RKSLTLNLITE

SEQ ID NO: 46857 - protein, 11 aa, Dengue virus
KSLTLNLITEM

SEQ ID NO: 46858 - protein, 11 aa, Dengue virus
SLTLNLITEMG

SEQ ID NO: 46859 - protein, 11 aa, Dengue virus
LTLNLITEMGR

SEQ ID NO: 46860 - protein, 11 aa, Dengue virus
TLNLITEMGRL

SEQ ID NO: 46861 - protein, 11 aa, Dengue virus
LNLITEMGRLP

SEQ ID NO: 46862 - protein, 11 aa, Dengue virus
NLITEMGRLPT

SEQ ID NO: 46863 - protein, 11 aa, Dengue virus
LITEMGRLPTF

SEQ ID NO: 46864 - protein, 11 aa, Dengue virus
ITEMGRLPTFM

SEQ ID NO: 46865 - protein, 11 aa, Dengue virus
TEMGRLPTFMT

SEQ ID NO: 46866 - protein, 11 aa, Dengue virus
EMGRLPTFMTQ

SEQ ID NO: 46867 - protein, 11 aa, Dengue virus
MGRLPTFMTQK

SEQ ID NO: 46868 - protein, 11 aa, Dengue virus
GRLPTFMTQKA

SEQ ID NO: 46869 - protein, 11 aa, Dengue virus
RLPTFMTQKAR

SEQ ID NO: 46870 - protein, 11 aa, Dengue virus
LPTFMTQKARN

SEQ ID NO: 46871 - protein, 11 aa, Dengue virus
PTFMTQKARNA

SEQ ID NO: 46872 - protein, 11 aa, Dengue virus
TFMTQKARNAL

SEQ ID NO: 46873 - protein, 11 aa, Dengue virus
FMTQKARNALD

SEQ ID NO: 46874 - protein, 11 aa, Dengue virus
MTQKARNALDN

SEQ ID NO: 46875 - protein, 11 aa, Dengue virus
TQKARNALDNL

SEQ ID NO: 46876 - protein, 11 aa, Dengue virus
QKARNALDNLA

SEQ ID NO: 46877 - protein, 11 aa, Dengue virus
KARNALDNLAV

SEQ ID NO: 46878 - protein, 11 aa, Dengue virus
ARNALDNLAVL

SEQ ID NO: 46879 - protein, 11 aa, Dengue virus
RDALDNLAVLH

SEQ ID NO: 46880 - protein, 11 aa, Dengue virus
DALDNLAVLHT

SEQ ID NO: 46881 - protein, 11 aa, Dengue virus
ALDNLAVLHTA

SEQ ID NO: 46882 - protein, 11 aa, Dengue virus
LDNLAVLHTAE

SEQ ID NO: 46883 - protein, 11 aa, Dengue virus
DNLAVLHTAEA

SEQ ID NO: 46884 - protein, 11 aa, Dengue virus
NLAVLHTAEAG

SEQ ID NO: 46885 - protein, 11 aa, Dengue virus
LAVLHTAEAGG

SEQ ID NO: 46886 - protein, 11 aa, Dengue virus
AVLHTAEAGGR

SEQ ID NO: 46887 - protein, 11 aa, Dengue virus
VLHTAEAGGRA

SEQ ID NO: 46888 - protein, 11 aa, Dengue virus
GGRAYNHALSE

SEQ ID NO: 46889 - protein, 11 aa, Dengue virus
GRAYNHALSEL

SEQ ID NO: 46890 - protein, 11 aa, Dengue virus
RAYNHALSELP

SEQ ID NO: 46891 - protein, 11 aa, Dengue virus
AYNHALSELPE

SEQ ID NO: 46892 - protein, 11 aa, Dengue virus
YNHALSELPET

SEQ ID NO: 46893 - protein, 11 aa, Dengue virus
NHALSELPETL

SEQ ID NO: 46894 - protein, 11 aa, Dengue virus
HALSELPETLE

SEQ ID NO: 46895 - protein, 11 aa, Dengue virus
ALSELPETLET

SEQ ID NO: 46896 - protein, 11 aa, Dengue virus
LSELPETLETL

SEQ ID NO: 46897 - protein, 11 aa, Dengue virus
SELPETLETLL

SEQ ID NO: 46898 - protein, 11 aa, Dengue virus
ELPETLETLLL

SEQ ID NO: 46899 - protein, 11 aa, Dengue virus
LPETLETLLLL

SEQ ID NO: 46900 - protein, 11 aa, Dengue virus
PETLETLLLLT

SEQ ID NO: 46901 - protein, 11 aa, Dengue virus
ETLETLLLLTL

SEQ ID NO: 46902 - protein, 11 aa, Dengue virus
TLETLLLLTLL

SEQ ID NO: 46903 - protein, 11 aa, Dengue virus
LETLLLLTLLA

SEQ ID NO: 46904 - protein, 11 aa, Dengue virus
ETLLLLTLLAT

SEQ ID NO: 46905 - protein, 11 aa, Dengue virus
TLLLLTLLATV

SEQ ID NO: 46906 - protein, 11 aa, Dengue virus
LLLLTLLATVT

SEQ ID NO: 46907 - protein, 11 aa, Dengue virus
LLLTLLATVTG

SEQ ID NO: 46908 - protein, 11 aa, Dengue virus
LLTLLATVTGG

SEQ ID NO: 46909 - protein, 11 aa, Dengue virus
LTLLATVTGGI

SEQ ID NO: 46910 - protein, 11 aa, Dengue virus
TLLATVTGGIF

SEQ ID NO: 46911 - protein, 11 aa, Dengue virus
LLATVTGGIFL

SEQ ID NO: 46912 - protein, 11 aa, Dengue virus
LATVTGGIFLF

SEQ ID NO: 46913 - protein, 11 aa, Dengue virus
ATVTGGIFLFL

SEQ ID NO: 46914 - protein, 11 aa, Dengue virus
TVTGGIFLFLM

SEQ ID NO: 46915 - protein, 11 aa, Dengue virus
VTGGIFLFLMS

SEQ ID NO: 46916 - protein, 11 aa, Dengue virus
TGGIFLFLMSG

SEQ ID NO: 46917 - protein, 11 aa, Dengue virus
GGIFLFLMSGK

SEQ ID NO: 46918 - protein, 11 aa, Dengue virus
GIFLFLMSGKG

SEQ ID NO: 46919 - protein, 11 aa, Dengue virus
FLFLMSGKGIG

SEQ ID NO: 46920 - protein, 11 aa, Dengue virus
LFLMSGKGIGK

SEQ ID NO: 46921 - protein, 11 aa, Dengue virus
FLMSGKGIGKM

SEQ ID NO: 46922 - protein, 11 aa, Dengue virus
LMSGKGIGKMT

SEQ ID NO: 46923 - protein, 11 aa, Dengue virus
MSGKGIGKMTL

SEQ ID NO: 46924 - protein, 11 aa, Dengue virus
SGKGIGKMTLG

SEQ ID NO: 46925 - protein, 11 aa, Dengue virus
GKGIGKMTLGM

SEQ ID NO: 46926 - protein, 11 aa, Dengue virus
KGIGKMTLGMC

SEQ ID NO: 46927 - protein, 11 aa, Dengue virus
GIGKMTLGMCC

SEQ ID NO: 46928 - protein, 11 aa, Dengue virus
IGKMTLGMCCI

SEQ ID NO: 46929 - protein, 11 aa, Dengue virus
GKMTLGMCCII

SEQ ID NO: 46930 - protein, 11 aa, Dengue virus
KMTLGMCCIIT

SEQ ID NO: 46931 - protein, 11 aa, Dengue virus
MTLGMCCIITA

SEQ ID NO: 46932 - protein, 11 aa, Dengue virus
TLGMCCIITAS

SEQ ID NO: 46933 - protein, 11 aa, Dengue virus
LLWYAQIQPHW

SEQ ID NO: 46934 - protein, 11 aa, Dengue virus
LWYAQIQPHWI

SEQ ID NO: 46935 - protein, 11 aa, Dengue virus
WYAQIQPHWIA

SEQ ID NO: 46936 - protein, 11 aa, Dengue virus
YAQIQPHWIAA

SEQ ID NO: 46937 - protein, 11 aa, Dengue virus
AQIQPHWIAAS

SEQ ID NO: 46938 - protein, 11 aa, Dengue virus
QIQPHWIAASI

SEQ ID NO: 46939 - protein, 11 aa, Dengue virus
IQPHWIAASII

SEQ ID NO: 46940 - protein, 11 aa, Dengue virus
QPHWIAASIIL

SEQ ID NO: 46941 - protein, 11 aa, Dengue virus
PHWIAASIILE

SEQ ID NO: 46942 - protein, 11 aa, Dengue virus
HWIAASIILEF

SEQ ID NO: 46943 - protein, 11 aa, Dengue virus
WIAASIILEFF

SEQ ID NO: 46944 - protein, 11 aa, Dengue virus
IAASIILEFFL

SEQ ID NO: 46945 - protein, 11 aa, Dengue virus
AASIILEFFLI

SEQ ID NO: 46946 - protein, 11 aa, Dengue virus
ASIILEFFLIV

SEQ ID NO: 46947 - protein, 11 aa, Dengue virus
SIILEFFLIVL

SEQ ID NO: 46948 - protein, 11 aa, Dengue virus
IILEFFLIVLL

SEQ ID NO: 46949 - protein, 11 aa, Dengue virus
ILEFFLIVLLI

SEQ ID NO: 46950 - protein, 11 aa, Dengue virus
LEFFLIVLLIP

SEQ ID NO: 46951 - protein, 11 aa, Dengue virus
EFFLIVLLIPE

SEQ ID NO: 46952 - protein, 11 aa, Dengue virus
FFLIVLLIPEP

SEQ ID NO: 46953 - protein, 11 aa, Dengue virus
FLIVLLIPEPE

SEQ ID NO: 46954 - protein, 11 aa, Dengue virus
LIVLLIPEPEK

SEQ ID NO: 46955 - protein, 11 aa, Dengue virus
IVLLIPEPEKQ

SEQ ID NO: 46956 - protein, 11 aa, Dengue virus
VLLIPEPEKQR

SEQ ID NO: 46957 - protein, 11 aa, Dengue virus
LLIPEPEKQRT

SEQ ID NO: 46958 - protein, 11 aa, Dengue virus
LIPEPEKQRTP

SEQ ID NO: 46959 - protein, 11 aa, Dengue virus
IPEPEKQRTPQ

SEQ ID NO: 46960 - protein, 11 aa, Dengue virus
PEPEKQRTPQD

SEQ ID NO: 46961 - protein, 11 aa, Dengue virus
EPEKQRTPQDN

SEQ ID NO: 46962 - protein, 11 aa, Dengue virus
PEKQRTPQDNQ

SEQ ID NO: 46963 - protein, 11 aa, Dengue virus
EKQRTPQDNQL

SEQ ID NO: 46964 - protein, 11 aa, Dengue virus
KQRTPQDNQLT

SEQ ID NO: 46965 - protein, 11 aa, Dengue virus
QRTPQDNQLTY

SEQ ID NO: 46966 - protein, 11 aa, Dengue virus
RTPQDNQLTYV

SEQ ID NO: 46967 - protein, 11 aa, Dengue virus
TPQDNQLTYVV

SEQ ID NO: 46968 - protein, 11 aa, Dengue virus
PQDNQLTYVVI

SEQ ID NO: 46969 - protein, 11 aa, Dengue virus
QDNQLTYVVIA

SEQ ID NO: 46970 - protein, 11 aa, Dengue virus
DNQLTYVVIAI

SEQ ID NO: 46971 - protein, 11 aa, Dengue virus
NQLTYVVIAIL

SEQ ID NO: 46972 - protein, 11 aa, Dengue virus
QLTYVVIAILT

SEQ ID NO: 46973 - protein, 11 aa, Dengue virus
LTYVVIAILTV

SEQ ID NO: 46974 - protein, 11 aa, Dengue virus
TYVVIAILTVV

SEQ ID NO: 46975 - protein, 11 aa, Dengue virus
YVVIAILTVVA

SEQ ID NO: 46976 - protein, 11 aa, Dengue virus
VVIAILTVVAA

SEQ ID NO: 46977 - protein, 11 aa, Dengue virus
VIAILTVVAAT

SEQ ID NO: 46978 - protein, 11 aa, Dengue virus
IAILTVVAATM

SEQ ID NO: 46979 - protein, 11 aa, Dengue virus
AILTVVAATMA

SEQ ID NO: 46980 - protein, 11 aa, Dengue virus
ILTVVAATMAN

SEQ ID NO: 46981 - protein, 11 aa, Dengue virus
LTVVAATMANE

SEQ ID NO: 46982 - protein, 11 aa, Dengue virus
TVVAATMANEM

SEQ ID NO: 46983 - protein, 11 aa, Dengue virus
VVAATMANEMG

SEQ ID NO: 46984 - protein, 11 aa, Dengue virus
VAATMANEMGF

SEQ ID NO: 46985 - protein, 11 aa, Dengue virus
AATMANEMGFL

SEQ ID NO: 46986 - protein, 11 aa, Dengue virus
ATMANEMGFLE

SEQ ID NO: 46987 - protein, 11 aa, Dengue virus
TMANEMGFLEK

SEQ ID NO: 46988 - protein, 11 aa, Dengue virus
MANEMGFLEKT

SEQ ID NO: 46989 - protein, 11 aa, Dengue virus
ANEMGFLEKTK

SEQ ID NO: 46990 - protein, 11 aa, Dengue virus
NEMGFLEKTKK

SEQ ID NO: 46991 - protein, 11 aa, Dengue virus
EMGFLEKTKKD

SEQ ID NO: 46992 - protein, 11 aa, Dengue virus
MGFLEKTKKDL

SEQ ID NO: 46993 - protein, 11 aa, Dengue virus
GFLEKTKKDLG

SEQ ID NO: 46994 - protein, 11 aa, Dengue virus
FLEKTKKDLGL

SEQ ID NO: 46995 - protein, 11 aa, Dengue virus
LEKTKKDLGLG

SEQ ID NO: 46996 - protein, 11 aa, Dengue virus
ESESNILDIDL

SEQ ID NO: 46997 - protein, 11 aa, Dengue virus
PESNILDIDLR

SEQ ID NO: 46998 - protein, 11 aa, Dengue virus
ESNILDIDLRP

SEQ ID NO: 46999 - protein, 11 aa, Dengue virus
SNILDIDLRPA

SEQ ID NO: 47000 - protein, 11 aa, Dengue virus
NILDIDLRPAS

SEQ ID NO: 47001 - protein, 11 aa, Dengue virus
ILDIDLRPASA

SEQ ID NO: 47002 - protein, 11 aa, Dengue virus
LDIDLRPASAW

SEQ ID NO: 47003 - protein, 11 aa, Dengue virus
DIDLRPASAWT

SEQ ID NO: 47004 - protein, 11 aa, Dengue virus
IDLRPASAWTL

SEQ ID NO: 47005 - protein, 11 aa, Dengue virus
DLRPASAWTLY

SEQ ID NO: 47006 - protein, 11 aa, Dengue virus
LRPASAWTLYA

SEQ ID NO: 47007 - protein, 11 aa, Dengue virus
RPASAWTLYAV

SEQ ID NO: 47008 - protein, 11 aa, Dengue virus
PASAWTLYAVA

SEQ ID NO: 47009 - protein, 11 aa, Dengue virus
ASAWTLYAVAT

SEQ ID NO: 47010 - protein, 11 aa, Dengue virus
SAWTLYAVATT

SEQ ID NO: 47011 - protein, 11 aa, Dengue virus
AWTLYAVATTF

SEQ ID NO: 47012 - protein, 11 aa, Dengue virus
WTLYAVATTFV

SEQ ID NO: 47013 - protein, 11 aa, Dengue virus
TLYAVATTFVT

SEQ ID NO: 47014 - protein, 11 aa, Dengue virus
LYAVATTFVTP

SEQ ID NO: 47015 - protein, 11 aa, Dengue virus
YAVATTFVTPM

SEQ ID NO: 47016 - protein, 11 aa, Dengue virus
AVATTFVTPML

SEQ ID NO: 47017 - protein, 11 aa, Dengue virus
VATTFVTPMLR

SEQ ID NO: 47018 - protein, 11 aa, Dengue virus
ATTFVTPMLRH

SEQ ID NO: 47019 - protein, 11 aa, Dengue virus
TTFVTPMLRHS

SEQ ID NO: 47020 - protein, 11 aa, Dengue virus
TFVTPMLRHSI

SEQ ID NO: 47021 - protein, 11 aa, Dengue virus
FVTPMLRHSIE

SEQ ID NO: 47022 - protein, 11 aa, Dengue virus
VTPMLRHSIEN

SEQ ID NO: 47023 - protein, 11 aa, Dengue virus
TPMLRHSIENS

SEQ ID NO: 47024 - protein, 11 aa, Dengue virus
PMLRHSIENSS

SEQ ID NO: 47025 - protein, 11 aa, Dengue virus
MLRHSIENSSV

SEQ ID NO: 47026 - protein, 11 aa, Dengue virus
LRHSIENSSVN

SEQ ID NO: 47027 - protein, 11 aa, Dengue virus
RHSIENSSVNV

SEQ ID NO: 47028 - protein, 11 aa, Dengue virus
HSIENSSVNVS

SEQ ID NO: 47029 - protein, 11 aa, Dengue virus
SIENSSVNVSL

SEQ ID NO: 47030 - protein, 11 aa, Dengue virus
IENSSVNVSLT

SEQ ID NO: 47031 - protein, 11 aa, Dengue virus
ENSSVNVSLTA

SEQ ID NO: 47032 - protein, 11 aa, Dengue virus
NSSVNVSLTAI

SEQ ID NO: 47033 - protein, 11 aa, Dengue virus
SSVNVSLTAIA

SEQ ID NO: 47034 - protein, 11 aa, Dengue virus
SVNVSLTAIAN

SEQ ID NO: 47035 - protein, 11 aa, Dengue virus
VNVSLTAIANQ

SEQ ID NO: 47036 - protein, 11 aa, Dengue virus
NVSLTAIANQA

SEQ ID NO: 47037 - protein, 11 aa, Dengue virus
VSLTAIANQAT

SEQ ID NO: 47038 - protein, 11 aa, Dengue virus
SLTAIANQATV

SEQ ID NO: 47039 - protein, 11 aa, Dengue virus
LTAIANQATVL

SEQ ID NO: 47040 - protein, 11 aa, Dengue virus
TAIANQATVLM

SEQ ID NO: 47041 - protein, 11 aa, Dengue virus
AIANQATVLMG

SEQ ID NO: 47042 - protein, 11 aa, Dengue virus
IANQATVLMGL

SEQ ID NO: 47043 - protein, 11 aa, Dengue virus
ANQATVLMGLG

SEQ ID NO: 47044 - protein, 11 aa, Dengue virus
NQATVLMGLGK

SEQ ID NO: 47045 - protein, 11 aa, Dengue virus
QATVLMGLGKG

SEQ ID NO: 47046 - protein, 11 aa, Dengue virus
ATVLMGLGKGW

SEQ ID NO: 47047 - protein, 11 aa, Dengue virus
TVLMGLGKGWP

SEQ ID NO: 47048 - protein, 11 aa, Dengue virus
VLMGLGKGWPL

SEQ ID NO: 47049 - protein, 11 aa, Dengue virus
LMGLGKGWPLS

SEQ ID NO: 47050 - protein, 11 aa, Dengue virus
MGLGKGWPLSK

SEQ ID NO: 47051 - protein, 11 aa, Dengue virus
GLGKGWPLSKM

SEQ ID NO: 47052 - protein, 11 aa, Dengue virus
LGKGWPLSKMD

SEQ ID NO: 47053 - protein, 11 aa, Dengue virus
GKGWPLSKMDI

SEQ ID NO: 47054 - protein, 11 aa, Dengue virus
KGWPLSKMDIG

SEQ ID NO: 47055 - protein, 11 aa, Dengue virus
GWPLSKMDIGV

SEQ ID NO: 47056 - protein, 11 aa, Dengue virus
WPLSKMDIGVP

SEQ ID NO: 47057 - protein, 11 aa, Dengue virus
PLSKMDIGVPL

SEQ ID NO: 47058 - protein, 11 aa, Dengue virus
LSKMDIGVPLL

SEQ ID NO: 47059 - protein, 11 aa, Dengue virus
SKMDIGVPLLA

SEQ ID NO: 47060 - protein, 11 aa, Dengue virus
KMDIGVPLLAI

SEQ ID NO: 47061 - protein, 11 aa, Dengue virus
MDIGVPLLAIG

SEQ ID NO: 47062 - protein, 11 aa, Dengue virus
DIGVPLLAIGC

SEQ ID NO: 47063 - protein, 11 aa, Dengue virus
IGVPLLAIGCY

SEQ ID NO: 47064 - protein, 11 aa, Dengue virus
GVPLLAIGCYS

SEQ ID NO: 47065 - protein, 11 aa, Dengue virus
VPLLAIGCYSQ

SEQ ID NO: 47066 - protein, 11 aa, Dengue virus
PLLAIGCYSQV

SEQ ID NO: 47067 - protein, 11 aa, Dengue virus
LLAIGCYSQVN

SEQ ID NO: 47068 - protein, 11 aa, Dengue virus
LAIGCYSQVNP

SEQ ID NO: 47069 - protein, 11 aa, Dengue virus
AIGCYSQVNPI

SEQ ID NO: 47070 - protein, 11 aa, Dengue virus
IGCYSQVNPIT

SEQ ID NO: 47071 - protein, 11 aa, Dengue virus
GCYSQVNPITL

SEQ ID NO: 47072 - protein, 11 aa, Dengue virus
CYSQVNPITLT

SEQ ID NO: 47073 - protein, 11 aa, Dengue virus
YSQVNPITLTA

SEQ ID NO: 47074 - protein, 11 aa, Dengue virus
SQVNPITLTAA

SEQ ID NO: 47075 - protein, 11 aa, Dengue virus
QVNPITLTAAL

SEQ ID NO: 47076 - protein, 11 aa, Dengue virus
VNPITLTAALL

SEQ ID NO: 47077 - protein, 11 aa, Dengue virus
NPITLTAALLL

SEQ ID NO: 47078 - protein, 11 aa, Dengue virus
PITLTAALLLL

SEQ ID NO: 47079 - protein, 11 aa, Dengue virus
LVAHYAIIGPG

SEQ ID NO: 47080 - protein, 11 aa, Dengue virus
VAHYAIIGPGL

SEQ ID NO: 47081 - protein, 11 aa, Dengue virus
AHYAIIGPGLQ

SEQ ID NO: 47082 - protein, 11 aa, Dengue virus
HYAIIGPGLQA

SEQ ID NO: 47083 - protein, 11 aa, Dengue virus
YAIIGPGLQAK

SEQ ID NO: 47084 - protein, 11 aa, Dengue virus
AIIGPGLQAKA

SEQ ID NO: 47085 - protein, 11 aa, Dengue virus
IIGPGLQAKAT

SEQ ID NO: 47086 - protein, 11 aa, Dengue virus
IGPGLQAKATR

SEQ ID NO: 47087 - protein, 11 aa, Dengue virus
GPGLQAKATRE

SEQ ID NO: 47088 - protein, 11 aa, Dengue virus
PGLQAKATREA

SEQ ID NO: 47089 - protein, 11 aa, Dengue virus
GLQAKATREAQ

SEQ ID NO: 47090 - protein, 11 aa, Dengue virus
LQAKATREAQK

SEQ ID NO: 47091 - protein, 11 aa, Dengue virus
QAKATREAQKR

SEQ ID NO: 47092 - protein, 11 aa, Dengue virus
AKATREAQKRA

SEQ ID NO: 47093 - protein, 11 aa, Dengue virus
KATREAQKRAA

SEQ ID NO: 47094 - protein, 11 aa, Dengue virus
ATREAQKRAAA

SEQ ID NO: 47095 - protein, 11 aa, Dengue virus
TREAQKRAAAG

SEQ ID NO: 47096 - protein, 11 aa, Dengue virus
REAQKRAAAGI

SEQ ID NO: 47097 - protein, 11 aa, Dengue virus
EAQKRAAAGIM

SEQ ID NO: 47098 - protein, 11 aa, Dengue virus
AQKRAAAGIMK

SEQ ID NO: 47099 - protein, 11 aa, Dengue virus
QKRAAAGIMKN

SEQ ID NO: 47100 - protein, 11 aa, Dengue virus
KRAAAGIMKNP

SEQ ID NO: 47101 - protein, 11 aa, Dengue virus
RAAAGIMKNPT

SEQ ID NO: 47102 - protein, 11 aa, Dengue virus
AAAGIMKNPTV

SEQ ID NO: 47103 - protein, 11 aa, Dengue virus
AAGIMKNPTVD

SEQ ID NO: 47104 - protein, 11 aa, Dengue virus
AGIMKNPTVDG

SEQ ID NO: 47105 - protein, 11 aa, Dengue virus
GIMKNPTVDGI

SEQ ID NO: 47106 - protein, 11 aa, Dengue virus
IMKNPTVDGIT

SEQ ID NO: 47107 - protein, 11 aa, Dengue virus
MKNPTVDGITV

SEQ ID NO: 47108 - protein, 11 aa, Dengue virus
KNPTVDGITVI

SEQ ID NO: 47109 - protein, 11 aa, Dengue virus
NPTVDGITVID

SEQ ID NO: 47110 - protein, 11 aa, Dengue virus
PTVDGITVIDL

SEQ ID NO: 47111 - protein, 11 aa, Dengue virus
TVDGITVIDLE

SEQ ID NO: 47112 - protein, 11 aa, Dengue virus
VDGITVIDLEP

SEQ ID NO: 47113 - protein, 11 aa, Dengue virus
DGITVIDLEPI

SEQ ID NO: 47114 - protein, 11 aa, Dengue virus
GITVIDLEPIP

SEQ ID NO: 47115 - protein, 11 aa, Dengue virus
ITVIDLEPIPY

SEQ ID NO: 47116 - protein, 11 aa, Dengue virus
TVIDLDPIPYD

SEQ ID NO: 47117 - protein, 11 aa, Dengue virus
VIDLDPIPYDP

SEQ ID NO: 47118 - protein, 11 aa, Dengue virus
IDLDPIPYDPK

SEQ ID NO: 47119 - protein, 11 aa, Dengue virus
DLDPIPYDPKF

SEQ ID NO: 47120 - protein, 11 aa, Dengue virus
LEPIPYDPKFE

SEQ ID NO: 47121 - protein, 11 aa, Dengue virus
DPIPYDPKFEK

SEQ ID NO: 47122 - protein, 11 aa, Dengue virus
PIPYDPKFEKQ

SEQ ID NO: 47123 - protein, 11 aa, Dengue virus
IPYDPKFEKQL

SEQ ID NO: 47124 - protein, 11 aa, Dengue virus
PYDPKFEKQLG

SEQ ID NO: 47125 - protein, 11 aa, Dengue virus
YDPKFEKQLGQ

SEQ ID NO: 47126 - protein, 11 aa, Dengue virus
DPKFEKQLGQV

SEQ ID NO: 47127 - protein, 11 aa, Dengue virus
PKFEKQLGQVM

SEQ ID NO: 47128 - protein, 11 aa, Dengue virus
KFEKQLGQVML

SEQ ID NO: 47129 - protein, 11 aa, Dengue virus
FEKQLGQVMLL

SEQ ID NO: 47130 - protein, 11 aa, Dengue virus
EKQLGQVMLLI

SEQ ID NO: 47131 - protein, 11 aa, Dengue virus
KQLGQVMLLIL

SEQ ID NO: 47132 - protein, 11 aa, Dengue virus
QLGQVMLLILC

SEQ ID NO: 47133 - protein, 11 aa, Dengue virus
LGQVMLLILCV

SEQ ID NO: 47134 - protein, 11 aa, Dengue virus
GQVMLLILCVT

SEQ ID NO: 47135 - protein, 11 aa, Dengue virus
QVMLLILCVTQ

SEQ ID NO: 47136 - protein, 11 aa, Dengue virus
VMLLILCVTQV

SEQ ID NO: 47137 - protein, 11 aa, Dengue virus
MLLILCVTQVL

SEQ ID NO: 47138 - protein, 11 aa, Dengue virus
LLILCVTQVLM

SEQ ID NO: 47139 - protein, 11 aa, Dengue virus
LILCVTQVLMM

SEQ ID NO: 47140 - protein, 11 aa, Dengue virus
ILCVTQVLMMR

SEQ ID NO: 47141 - protein, 11 aa, Dengue virus
LCVTQVLMMRT

SEQ ID NO: 47142 - protein, 11 aa, Dengue virus
CVTQVLMMRTT

SEQ ID NO: 47143 - protein, 11 aa, Dengue virus
VTQVLMMRTTW

SEQ ID NO: 47144 - protein, 11 aa, Dengue virus
TQVLMMRTTWA

SEQ ID NO: 47145 - protein, 11 aa, Dengue virus
QVLMMRTTWAL

SEQ ID NO: 47146 - protein, 11 aa, Dengue virus
VLMMRTTWALC

SEQ ID NO: 47147 - protein, 11 aa, Dengue virus
LMMRTTWALCE

SEQ ID NO: 47148 - protein, 11 aa, Dengue virus
MMRTTWALCEA

SEQ ID NO: 47149 - protein, 11 aa, Dengue virus
MRTTWALCEAL

SEQ ID NO: 47150 - protein, 11 aa, Dengue virus
RTTWALCEALT

SEQ ID NO: 47151 - protein, 11 aa, Dengue virus
TTWALCEALTL

SEQ ID NO: 47152 - protein, 11 aa, Dengue virus
TWALCEALTLA

SEQ ID NO: 47153 - protein, 11 aa, Dengue virus
WALCEALTLAT

SEQ ID NO: 47154 - protein, 11 aa, Dengue virus
ALCEALTLATG

SEQ ID NO: 47155 - protein, 11 aa, Dengue virus
LCEALTLATGP

SEQ ID NO: 47156 - protein, 11 aa, Dengue virus
CEALTLATGPI

SEQ ID NO: 47157 - protein, 11 aa, Dengue virus
EALTLATGPIS

SEQ ID NO: 47158 - protein, 11 aa, Dengue virus
ALTLATGPIST

SEQ ID NO: 47159 - protein, 11 aa, Dengue virus
LTLATGPISTL

SEQ ID NO: 47160 - protein, 11 aa, Dengue virus
TLATGPISTLW

SEQ ID NO: 47161 - protein, 11 aa, Dengue virus
LATGPISTLWE

SEQ ID NO: 47162 - protein, 11 aa, Dengue virus
ATGPISTLWEG

SEQ ID NO: 47163 - protein, 11 aa, Dengue virus
TGPISTLWEGN

SEQ ID NO: 47164 - protein, 11 aa, Dengue virus
GPISTLWEGNP

SEQ ID NO: 47165 - protein, 11 aa, Dengue virus
PISTLWEGNPG

SEQ ID NO: 47166 - protein, 11 aa, Dengue virus
ISTLWEGNPGR

SEQ ID NO: 47167 - protein, 11 aa, Dengue virus
STLWEGNPGRF

SEQ ID NO: 47168 - protein, 11 aa, Dengue virus
TLWEGNPGRFW

SEQ ID NO: 47169 - protein, 11 aa, Dengue virus
LWEGNPGRFWN

SEQ ID NO: 47170 - protein, 11 aa, Dengue virus
WEGNPGRFWNT

SEQ ID NO: 47171 - protein, 11 aa, Dengue virus
EGNPGRFWNTT

SEQ ID NO: 47172 - protein, 11 aa, Dengue virus
GNPGRFWNTTI

SEQ ID NO: 47173 - protein, 11 aa, Dengue virus
NPGRFWNTTIA

SEQ ID NO: 47174 - protein, 11 aa, Dengue virus
PGRFWNTTIAV

SEQ ID NO: 47175 - protein, 11 aa, Dengue virus
GRFWNTTIAVS

SEQ ID NO: 47176 - protein, 11 aa, Dengue virus
RFWNTTIAVSM

SEQ ID NO: 47177 - protein, 11 aa, Dengue virus
FWNTTIAVSMA

SEQ ID NO: 47178 - protein, 11 aa, Dengue virus
WNTTIAVSMAN

SEQ ID NO: 47179 - protein, 11 aa, Dengue virus
NTTIAVSMANI

SEQ ID NO: 47180 - protein, 11 aa, Dengue virus
TTIAVSMANIF

SEQ ID NO: 47181 - protein, 11 aa, Dengue virus
TIAVSMANIFR

SEQ ID NO: 47182 - protein, 11 aa, Dengue virus
IAVSMANIFRG

SEQ ID NO: 47183 - protein, 11 aa, Dengue virus
AVSMANIFRGS

SEQ ID NO: 47184 - protein, 11 aa, Dengue virus
VSMANIFRGSY

SEQ ID NO: 47185 - protein, 11 aa, Dengue virus
SMANIFRGSYL

SEQ ID NO: 47186 - protein, 11 aa, Dengue virus
MANIFRGSYLA

SEQ ID NO: 47187 - protein, 11 aa, Dengue virus
ANIFRGSYLAG

SEQ ID NO: 47188 - protein, 11 aa, Dengue virus
NIFRGSYLAGA

SEQ ID NO: 47189 - protein, 11 aa, Dengue virus
IFRGSYLAGAG

SEQ ID NO: 47190 - protein, 11 aa, Dengue virus
FRGSYLAGAGL

SEQ ID NO: 47191 - protein, 11 aa, Dengue virus
RGSYLAGAGLL

SEQ ID NO: 47192 - protein, 11 aa, Dengue virus
GSYLAGAGLLF

SEQ ID NO: 47193 - protein, 11 aa, Dengue virus
SYLAGAGLLFS

SEQ ID NO: 47194 - protein, 11 aa, Dengue virus
YLAGAGLLFSI

SEQ ID NO: 47195 - protein, 11 aa, Dengue virus
LAGAGLLFSIM

SEQ ID NO: 47196 - protein, 11 aa, Dengue virus
AGAGLLFSIMK

SEQ ID NO: 47197 - protein, 11 aa, Dengue virus
GAGLLFSIMKN

SEQ ID NO: 47198 - protein, 11 aa, Dengue virus
AGLLFSIMKNT

SEQ ID NO: 47199 - protein, 11 aa, Dengue virus
GLLFSIMKNTT

SEQ ID NO: 47200 - protein, 11 aa, Dengue virus
LLFSIMKNTTN

SEQ ID NO: 47201 - protein, 11 aa, Dengue virus
RRGTGNIGETL

SEQ ID NO: 47202 - protein, 11 aa, Dengue virus
RGTGNIGETLG

SEQ ID NO: 47203 - protein, 11 aa, Dengue virus
GTGNIGETLGE

SEQ ID NO: 47204 - protein, 11 aa, Dengue virus
TGNIGETLGEK

SEQ ID NO: 47205 - protein, 11 aa, Dengue virus
GNIGETLGEKW

SEQ ID NO: 47206 - protein, 11 aa, Dengue virus
NIGETLGEKWK

SEQ ID NO: 47207 - protein, 11 aa, Dengue virus
GETLGEKWKSR

SEQ ID NO: 47208 - protein, 11 aa, Dengue virus
ETLGEKWKSRL

SEQ ID NO: 47209 - protein, 11 aa, Dengue virus
TLGEKWKSRLN

SEQ ID NO: 47210 - protein, 11 aa, Dengue virus
LGEKWKSRLNA

SEQ ID NO: 47211 - protein, 11 aa, Dengue virus
GEKWKSRLNAL

SEQ ID NO: 47212 - protein, 11 aa, Dengue virus
EKWKSRLNALG

SEQ ID NO: 47213 - protein, 11 aa, Dengue virus
LGKSEFQIYKK

SEQ ID NO: 47214 - protein, 11 aa, Dengue virus
GKSEFQIYKKS

SEQ ID NO: 47215 - protein, 11 aa, Dengue virus
KSEFQIYKKSG

SEQ ID NO: 47216 - protein, 11 aa, Dengue virus
SEFQIYKKSGI

SEQ ID NO: 47217 - protein, 11 aa, Dengue virus
EFQIYKKSGIQ

SEQ ID NO: 47218 - protein, 11 aa, Dengue virus
FQIYKKSGIQE

SEQ ID NO: 47219 - protein, 11 aa, Dengue virus
QIYKKSGIQEV

SEQ ID NO: 47220 - protein, 11 aa, Dengue virus
IYKKSGIQEVD

SEQ ID NO: 47221 - protein, 11 aa, Dengue virus
YKKSGIQEVDR

SEQ ID NO: 47222 - protein, 11 aa, Dengue virus
KKSGIQEVDRT

SEQ ID NO: 47223 - protein, 11 aa, Dengue virus
KSGIQEVDRTL

SEQ ID NO: 47224 - protein, 11 aa, Dengue virus
SGIQEVDRTLA

SEQ ID NO: 47225 - protein, 11 aa, Dengue virus
GIQEVDRTLAK

SEQ ID NO: 47226 - protein, 11 aa, Dengue virus
IQEVDRTLAKE

SEQ ID NO: 47227 - protein, 11 aa, Dengue virus
QEVDRTLAKEG

SEQ ID NO: 47228 - protein, 11 aa, Dengue virus
EVDRTLAKEGI

SEQ ID NO: 47229 - protein, 11 aa, Dengue virus
VDRTLAKEGIK

SEQ ID NO: 47230 - protein, 11 aa, Dengue virus
DRTLAKEGIKR

SEQ ID NO: 47231 - protein, 11 aa, Dengue virus
RTLAKEGIKRG

SEQ ID NO: 47232 - protein, 11 aa, Dengue virus
TLAKEGIKRGE

SEQ ID NO: 47233 - protein, 11 aa, Dengue virus
LAKEGIKRGET

SEQ ID NO: 47234 - protein, 11 aa, Dengue virus
AKEGIKRGETD

SEQ ID NO: 47235 - protein, 11 aa, Dengue virus
KEGIKRGETDH

SEQ ID NO: 47236 - protein, 11 aa, Dengue virus
EGIKRGETDHH

SEQ ID NO: 47237 - protein, 11 aa, Dengue virus
GIKRGETDHHA

SEQ ID NO: 47238 - protein, 11 aa, Dengue virus
IKRGETDHHAV

SEQ ID NO: 47239 - protein, 11 aa, Dengue virus
KRGETDHHAVS

SEQ ID NO: 47240 - protein, 11 aa, Dengue virus
RGETDHHAVSR

SEQ ID NO: 47241 - protein, 11 aa, Dengue virus
GETDHHAVSRG

SEQ ID NO: 47242 - protein, 11 aa, Dengue virus
ETDHHAVSRGS

SEQ ID NO: 47243 - protein, 11 aa, Dengue virus
TDHHAVSRGSA

SEQ ID NO: 47244 - protein, 11 aa, Dengue virus
DHHAVSRGSAK

SEQ ID NO: 47245 - protein, 11 aa, Dengue virus
HHAVSRGSAKL

SEQ ID NO: 47246 - protein, 11 aa, Dengue virus
HAVSRGSAKLR

SEQ ID NO: 47247 - protein, 11 aa, Dengue virus
AVSRGSAKLRW

SEQ ID NO: 47248 - protein, 11 aa, Dengue virus
VSRGSAKLRWF

SEQ ID NO: 47249 - protein, 11 aa, Dengue virus
SRGSAKLRWFV

SEQ ID NO: 47250 - protein, 11 aa, Dengue virus
RGSAKLRWFVE

SEQ ID NO: 47251 - protein, 11 aa, Dengue virus
GSAKLRWFVER

SEQ ID NO: 47252 - protein, 11 aa, Dengue virus
SAKLRWFVERN

SEQ ID NO: 47253 - protein, 11 aa, Dengue virus
AKLRWFVERNM

SEQ ID NO: 47254 - protein, 11 aa, Dengue virus
KLRWFVERNMV

SEQ ID NO: 47255 - protein, 11 aa, Dengue virus
LRWFVERNMVT

SEQ ID NO: 47256 - protein, 11 aa, Dengue virus
RWFVERNMVTP

SEQ ID NO: 47257 - protein, 11 aa, Dengue virus
WFVERNMVTPE

SEQ ID NO: 47258 - protein, 11 aa, Dengue virus
FVERNMVTPEG

SEQ ID NO: 47259 - protein, 11 aa, Dengue virus
VERNMVTPEGK

SEQ ID NO: 47260 - protein, 11 aa, Dengue virus
ERNMVTPEGKV

SEQ ID NO: 47261 - protein, 11 aa, Dengue virus
RNMVTPEGKVV

SEQ ID NO: 47262 - protein, 11 aa, Dengue virus
NMVTPEGKVVD

SEQ ID NO: 47263 - protein, 11 aa, Dengue virus
MVTPEGKVVDL

SEQ ID NO: 47264 - protein, 11 aa, Dengue virus
VTPEGKVVDLG

SEQ ID NO: 47265 - protein, 11 aa, Dengue virus
TPEGKVVDLGC

SEQ ID NO: 47266 - protein, 11 aa, Dengue virus
PEGKVVDLGCG

SEQ ID NO: 47267 - protein, 11 aa, Dengue virus
EGKVVDLGCGR

SEQ ID NO: 47268 - protein, 11 aa, Dengue virus
GKVVDLGCGRG

SEQ ID NO: 47269 - protein, 11 aa, Dengue virus
KVVDLGCGRGG

SEQ ID NO: 47270 - protein, 11 aa, Dengue virus
VVDLGCGRGGW

SEQ ID NO: 47271 - protein, 11 aa, Dengue virus
VDLGCGRGGWS

SEQ ID NO: 47272 - protein, 11 aa, Dengue virus
DLGCGRGGWSY

SEQ ID NO: 47273 - protein, 11 aa, Dengue virus
LGCGRGGWSYY

SEQ ID NO: 47274 - protein, 11 aa, Dengue virus
GCGRGGWSYYC

SEQ ID NO: 47275 - protein, 11 aa, Dengue virus
CGRGGWSYYCG

SEQ ID NO: 47276 - protein, 11 aa, Dengue virus
GRGGWSYYCGG

SEQ ID NO: 47277 - protein, 11 aa, Dengue virus
RGGWSYYCGGL

SEQ ID NO: 47278 - protein, 11 aa, Dengue virus
GGWSYYCGGLK

SEQ ID NO: 47279 - protein, 11 aa, Dengue virus
GWSYYCGGLKN

SEQ ID NO: 47280 - protein, 11 aa, Dengue virus
WSYYCGGLKNV

SEQ ID NO: 47281 - protein, 11 aa, Dengue virus
SYYCGGLKNVR

SEQ ID NO: 47282 - protein, 11 aa, Dengue virus
YYCGGLKNVRE

SEQ ID NO: 47283 - protein, 11 aa, Dengue virus
YCGGLKNVREV

SEQ ID NO: 47284 - protein, 11 aa, Dengue virus
CGGLKNVREVK

SEQ ID NO: 47285 - protein, 11 aa, Dengue virus
GGLKNVREVKG

SEQ ID NO: 47286 - protein, 11 aa, Dengue virus
GLKNVREVKGL

SEQ ID NO: 47287 - protein, 11 aa, Dengue virus
LKNVREVKGLT

SEQ ID NO: 47288 - protein, 11 aa, Dengue virus
KNVREVKGLTK

SEQ ID NO: 47289 - protein, 11 aa, Dengue virus
NVREVKGLTKG

SEQ ID NO: 47290 - protein, 11 aa, Dengue virus
VREVKGLTKGG

SEQ ID NO: 47291 - protein, 11 aa, Dengue virus
REVKGLTKGGP

SEQ ID NO: 47292 - protein, 11 aa, Dengue virus
EVKGLTKGGPG

SEQ ID NO: 47293 - protein, 11 aa, Dengue virus
VKGLTKGGPGH

SEQ ID NO: 47294 - protein, 11 aa, Dengue virus
KGLTKGGPGHE

SEQ ID NO: 47295 - protein, 11 aa, Dengue virus
GLTKGGPGHEE

SEQ ID NO: 47296 - protein, 11 aa, Dengue virus
LTKGGPGHEEP

SEQ ID NO: 47297 - protein, 11 aa, Dengue virus
TKGGPGHEEPI

SEQ ID NO: 47298 - protein, 11 aa, Dengue virus
KGGPGHEEPIP

SEQ ID NO: 47299 - protein, 11 aa, Dengue virus
GGPGHEEPIPM

SEQ ID NO: 47300 - protein, 11 aa, Dengue virus
GPGHEEPIPMS

SEQ ID NO: 47301 - protein, 11 aa, Dengue virus
PGHEEPIPMST

SEQ ID NO: 47302 - protein, 11 aa, Dengue virus
GHEEPIPMSTY

SEQ ID NO: 47303 - protein, 11 aa, Dengue virus
HEEPIPMSTYG

SEQ ID NO: 47304 - protein, 11 aa, Dengue virus
EEPIPMSTYGW

SEQ ID NO: 47305 - protein, 11 aa, Dengue virus
EPIPMSTYGWN

SEQ ID NO: 47306 - protein, 11 aa, Dengue virus
PIPMSTYGWNL

SEQ ID NO: 47307 - protein, 11 aa, Dengue virus
IPMSTYGWNLV

SEQ ID NO: 47308 - protein, 11 aa, Dengue virus
PMSTYGWNLVR

SEQ ID NO: 47309 - protein, 11 aa, Dengue virus
MSTYGWNLVRL

SEQ ID NO: 47310 - protein, 11 aa, Dengue virus
STYGWNLVRLQ

SEQ ID NO: 47311 - protein, 11 aa, Dengue virus
TYGWNLVRLQS

SEQ ID NO: 47312 - protein, 11 aa, Dengue virus
YGWNLVRLQSG

SEQ ID NO: 47313 - protein, 11 aa, Dengue virus
GWNLVRLQSGV

SEQ ID NO: 47314 - protein, 11 aa, Dengue virus
WNLVRLQSGVD

SEQ ID NO: 47315 - protein, 11 aa, Dengue virus
NLVRLQSGVDV

SEQ ID NO: 47316 - protein, 11 aa, Dengue virus
LVRLQSGVDVF

SEQ ID NO: 47317 - protein, 11 aa, Dengue virus
VRLQSGVDVFF

SEQ ID NO: 47318 - protein, 11 aa, Dengue virus
RLQSGVDVFFT

SEQ ID NO: 47319 - protein, 11 aa, Dengue virus
LQSGVDVFFTP

SEQ ID NO: 47320 - protein, 11 aa, Dengue virus
QSGVDVFFTPP

SEQ ID NO: 47321 - protein, 11 aa, Dengue virus
SGVDVFFTPPE

SEQ ID NO: 47322 - protein, 11 aa, Dengue virus
GVDVFFTPPEK

SEQ ID NO: 47323 - protein, 11 aa, Dengue virus
VDVFFTPPEKC

SEQ ID NO: 47324 - protein, 11 aa, Dengue virus
DVFFTPPEKCD

SEQ ID NO: 47325 - protein, 11 aa, Dengue virus
VFFTPPEKCDT

SEQ ID NO: 47326 - protein, 11 aa, Dengue virus
FFTPPEKCDTL

SEQ ID NO: 47327 - protein, 11 aa, Dengue virus
FTPPEKCDTLL

SEQ ID NO: 47328 - protein, 11 aa, Dengue virus
TPPEKCDTLLC

SEQ ID NO: 47329 - protein, 11 aa, Dengue virus
PPEKCDTLLCD

SEQ ID NO: 47330 - protein, 11 aa, Dengue virus
PEKCDTLLCDI

SEQ ID NO: 47331 - protein, 11 aa, Dengue virus
EKCDTLLCDIG

SEQ ID NO: 47332 - protein, 11 aa, Dengue virus
KCDTLLCDIGE

SEQ ID NO: 47333 - protein, 11 aa, Dengue virus
CDTLLCDIGES

SEQ ID NO: 47334 - protein, 11 aa, Dengue virus
DTLLCDIGESS

SEQ ID NO: 47335 - protein, 11 aa, Dengue virus
TLLCDIGESSP

SEQ ID NO: 47336 - protein, 11 aa, Dengue virus
LLCDIGESSPN

SEQ ID NO: 47337 - protein, 11 aa, Dengue virus
LCDIGESSPNP

SEQ ID NO: 47338 - protein, 11 aa, Dengue virus
CDIGESSPNPT

SEQ ID NO: 47339 - protein, 11 aa, Dengue virus
DIGESSPNPTI

SEQ ID NO: 47340 - protein, 11 aa, Dengue virus
IGESSPNPTIE

SEQ ID NO: 47341 - protein, 11 aa, Dengue virus
GESSPNPTIEA

SEQ ID NO: 47342 - protein, 11 aa, Dengue virus
ESSPNPTIEAG

SEQ ID NO: 47343 - protein, 11 aa, Dengue virus
SSPNPTIEAGR

SEQ ID NO: 47344 - protein, 11 aa, Dengue virus
SPNPTIEAGRT

SEQ ID NO: 47345 - protein, 11 aa, Dengue virus
PNPTIEAGRTL

SEQ ID NO: 47346 - protein, 11 aa, Dengue virus
NPTIEAGRTLR

SEQ ID NO: 47347 - protein, 11 aa, Dengue virus
PTIEAGRTLRV

SEQ ID NO: 47348 - protein, 11 aa, Dengue virus
TIEAGRTLRVL

SEQ ID NO: 47349 - protein, 11 aa, Dengue virus
IEAGRTLRVLN

SEQ ID NO: 47350 - protein, 11 aa, Dengue virus
EAGRTLRVLNL

SEQ ID NO: 47351 - protein, 11 aa, Dengue virus
AGRTLRVLNLV

SEQ ID NO: 47352 - protein, 11 aa, Dengue virus
GRTLRVLNLVE

SEQ ID NO: 47353 - protein, 11 aa, Dengue virus
RTLRVLNLVEN

SEQ ID NO: 47354 - protein, 11 aa, Dengue virus
TLRVLNLVENW

SEQ ID NO: 47355 - protein, 11 aa, Dengue virus
LRVLNLVENWL

SEQ ID NO: 47356 - protein, 11 aa, Dengue virus
RVLNLVENWLN

SEQ ID NO: 47357 - protein, 11 aa, Dengue virus
VLNLVENWLNN

SEQ ID NO: 47358 - protein, 11 aa, Dengue virus
LNLVENWLNNN

SEQ ID NO: 47359 - protein, 11 aa, Dengue virus
ENWLNNNTQFC

SEQ ID NO: 47360 - protein, 11 aa, Dengue virus
WLNNNTQFCIK

SEQ ID NO: 47361 - protein, 11 aa, Dengue virus
LNNNTQFCIKV

SEQ ID NO: 47362 - protein, 11 aa, Dengue virus
NNNTQFCIKVL

SEQ ID NO: 47363 - protein, 11 aa, Dengue virus
NNTQFCIKVLN

SEQ ID NO: 47364 - protein, 11 aa, Dengue virus
NTQFCIKVLNP

SEQ ID NO: 47365 - protein, 11 aa, Dengue virus
TQFCIKVLNPY

SEQ ID NO: 47366 - protein, 11 aa, Dengue virus
QFCIKVLNPYM

SEQ ID NO: 47367 - protein, 11 aa, Dengue virus
FCIKVLNPYMP

SEQ ID NO: 47368 - protein, 11 aa, Dengue virus
CIKVLNPYMPS

SEQ ID NO: 47369 - protein, 11 aa, Dengue virus
IKVLNPYMPSV

SEQ ID NO: 47370 - protein, 11 aa, Dengue virus
KVLNPYMPSVI

SEQ ID NO: 47371 - protein, 11 aa, Dengue virus
VLNPYMPSVIE

SEQ ID NO: 47372 - protein, 11 aa, Dengue virus
LNPYMPSVIEK

SEQ ID NO: 47373 - protein, 11 aa, Dengue virus
NPYMPSVIEKM

SEQ ID NO: 47374 - protein, 11 aa, Dengue virus
PYMPSVIEKME

SEQ ID NO: 47375 - protein, 11 aa, Dengue virus
YMPSVIEKMEA

SEQ ID NO: 47376 - protein, 11 aa, Dengue virus
MPSVIEKMEAL

SEQ ID NO: 47377 - protein, 11 aa, Dengue virus
PSVIEKMEALQ

SEQ ID NO: 47378 - protein, 11 aa, Dengue virus
SVIEKMEALQR

SEQ ID NO: 47379 - protein, 11 aa, Dengue virus
LQRKYGGALVR

SEQ ID NO: 47380 - protein, 11 aa, Dengue virus
QRKYGGALVRN

SEQ ID NO: 47381 - protein, 11 aa, Dengue virus
RKYGGALVRNP

SEQ ID NO: 47382 - protein, 11 aa, Dengue virus
KYGGALVRNPL

SEQ ID NO: 47383 - protein, 11 aa, Dengue virus
YGGALVRNPLS

SEQ ID NO: 47384 - protein, 11 aa, Dengue virus
GGALVRNPLSR

SEQ ID NO: 47385 - protein, 11 aa, Dengue virus
GALVRNPLSRN

SEQ ID NO: 47386 - protein, 11 aa, Dengue virus
ALVRNPLSRNS

SEQ ID NO: 47387 - protein, 11 aa, Dengue virus
LVRNPLSRNST

SEQ ID NO: 47388 - protein, 11 aa, Dengue virus
VRNPLSRNSTH

SEQ ID NO: 47389 - protein, 11 aa, Dengue virus
RNPLSRNSTHE

SEQ ID NO: 47390 - protein, 11 aa, Dengue virus
NPLSRNSTHEM

SEQ ID NO: 47391 - protein, 11 aa, Dengue virus
PLSRNSTHEMY

SEQ ID NO: 47392 - protein, 11 aa, Dengue virus
LSRNSTHEMYW

SEQ ID NO: 47393 - protein, 11 aa, Dengue virus
SRNSTHEMYWV

SEQ ID NO: 47394 - protein, 11 aa, Dengue virus
RNSTHEMYWVS

SEQ ID NO: 47395 - protein, 11 aa, Dengue virus
NSTHEMYWVSN

SEQ ID NO: 47396 - protein, 11 aa, Dengue virus
STHEMYWVSNA

SEQ ID NO: 47397 - protein, 11 aa, Dengue virus
THEMYWVSNAT

SEQ ID NO: 47398 - protein, 11 aa, Dengue virus
HEMYWVSNATG

SEQ ID NO: 47399 - protein, 11 aa, Dengue virus
EMYWVSNATGN

SEQ ID NO: 47400 - protein, 11 aa, Dengue virus
MYWVSNATGNI

SEQ ID NO: 47401 - protein, 11 aa, Dengue virus
YWVSNATGNIV

SEQ ID NO: 47402 - protein, 11 aa, Dengue virus
WVSNATGNIVS

SEQ ID NO: 47403 - protein, 11 aa, Dengue virus
VSNATGNIVSS

SEQ ID NO: 47404 - protein, 11 aa, Dengue virus
SNATGNIVSSV

SEQ ID NO: 47405 - protein, 11 aa, Dengue virus
NATGNIVSSVN

SEQ ID NO: 47406 - protein, 11 aa, Dengue virus
ATGNIVSSVNM

SEQ ID NO: 47407 - protein, 11 aa, Dengue virus
TGNIVSSVNMI

SEQ ID NO: 47408 - protein, 11 aa, Dengue virus
GNIVSSVNMIS

SEQ ID NO: 47409 - protein, 11 aa, Dengue virus
NIVSSVNMISR

SEQ ID NO: 47410 - protein, 11 aa, Dengue virus
IVSSVNMISRM

SEQ ID NO: 47411 - protein, 11 aa, Dengue virus
VSSVNMISRML

SEQ ID NO: 47412 - protein, 11 aa, Dengue virus
SSVNMISRMLI

SEQ ID NO: 47413 - protein, 11 aa, Dengue virus
SVNMISRMLIN

SEQ ID NO: 47414 - protein, 11 aa, Dengue virus
VNMISRMLINR

SEQ ID NO: 47415 - protein, 11 aa, Dengue virus
NMISRMLINRF

SEQ ID NO: 47416 - protein, 11 aa, Dengue virus
MISRMLINRFT

SEQ ID NO: 47417 - protein, 11 aa, Dengue virus
ISRMLINRFTM

SEQ ID NO: 47418 - protein, 11 aa, Dengue virus
SRMLINRFTMK

SEQ ID NO: 47419 - protein, 11 aa, Dengue virus
RMLINRFTMKH

SEQ ID NO: 47420 - protein, 11 aa, Dengue virus
MLINRFTMKHK

SEQ ID NO: 47421 - protein, 11 aa, Dengue virus
LINRFTMKHKK

SEQ ID NO: 47422 - protein, 11 aa, Dengue virus
INRFTMKHKKA

SEQ ID NO: 47423 - protein, 11 aa, Dengue virus
NRFTMKHKKAT

SEQ ID NO: 47424 - protein, 11 aa, Dengue virus
RFTMKHKKATY

SEQ ID NO: 47425 - protein, 11 aa, Dengue virus
FTMKHKKATYE

SEQ ID NO: 47426 - protein, 11 aa, Dengue virus
TMKHKKATYEP

SEQ ID NO: 47427 - protein, 11 aa, Dengue virus
MKHKKATYEPD

SEQ ID NO: 47428 - protein, 11 aa, Dengue virus
KHKKATYEPDV

SEQ ID NO: 47429 - protein, 11 aa, Dengue virus
HKKATYEPDVD

SEQ ID NO: 47430 - protein, 11 aa, Dengue virus
KKATYEPDVDL

SEQ ID NO: 47431 - protein, 11 aa, Dengue virus
KATYEPDVDLG

SEQ ID NO: 47432 - protein, 11 aa, Dengue virus
ATYEPDVDLGS

SEQ ID NO: 47433 - protein, 11 aa, Dengue virus
TYEPDVDLGSG

SEQ ID NO: 47434 - protein, 11 aa, Dengue virus
YEPDVDLGSGT

SEQ ID NO: 47435 - protein, 11 aa, Dengue virus
EPDVDLGSGTR

SEQ ID NO: 47436 - protein, 11 aa, Dengue virus
PDVDLGSGTRN

SEQ ID NO: 47437 - protein, 11 aa, Dengue virus
DVDLGSGTRNI

SEQ ID NO: 47438 - protein, 11 aa, Dengue virus
VDLGSGTRNIG

SEQ ID NO: 47439 - protein, 11 aa, Dengue virus
DLGSGTRNIGI

SEQ ID NO: 47440 - protein, 11 aa, Dengue virus
LGSGTRNIGIE

SEQ ID NO: 47441 - protein, 11 aa, Dengue virus
GSGTRNIGIES

SEQ ID NO: 47442 - protein, 11 aa, Dengue virus
SGTRNIGIESE

SEQ ID NO: 47443 - protein, 11 aa, Dengue virus
EIPNLDIIGKR

SEQ ID NO: 47444 - protein, 11 aa, Dengue virus
IPNLDIIGKRI

SEQ ID NO: 47445 - protein, 11 aa, Dengue virus
PNLDIIGKRIE

SEQ ID NO: 47446 - protein, 11 aa, Dengue virus
NLDIIGKRIEK

SEQ ID NO: 47447 - protein, 11 aa, Dengue virus
LDIIGKRIEKI

SEQ ID NO: 47448 - protein, 11 aa, Dengue virus
DIIGKRIEKIK

SEQ ID NO: 47449 - protein, 11 aa, Dengue virus
IIGKRIEKIKQ

SEQ ID NO: 47450 - protein, 11 aa, Dengue virus
IGKRIEKIKQE

SEQ ID NO: 47451 - protein, 11 aa, Dengue virus
GKRIEKIKQEH

SEQ ID NO: 47452 - protein, 11 aa, Dengue virus
KRIEKIKQEHE

SEQ ID NO: 47453 - protein, 11 aa, Dengue virus
RIEKIKQEHET

SEQ ID NO: 47454 - protein, 11 aa, Dengue virus
IEKIKQEHETS

SEQ ID NO: 47455 - protein, 11 aa, Dengue virus
EKIKQEHETSW

SEQ ID NO: 47456 - protein, 11 aa, Dengue virus
KIKQEHETSWH

SEQ ID NO: 47457 - protein, 11 aa, Dengue virus
IKQEHETSWHY

SEQ ID NO: 47458 - protein, 11 aa, Dengue virus
KQEHETSWHYD

SEQ ID NO: 47459 - protein, 11 aa, Dengue virus
QEHETSWHYDQ

SEQ ID NO: 47460 - protein, 11 aa, Dengue virus
EHETSWHYDQD

SEQ ID NO: 47461 - protein, 11 aa, Dengue virus
HETSWHYDQDH

SEQ ID NO: 47462 - protein, 11 aa, Dengue virus
ETSWHYDQDHP

SEQ ID NO: 47463 - protein, 11 aa, Dengue virus
TSWHYDQDHPY

SEQ ID NO: 47464 - protein, 11 aa, Dengue virus
SWHYDQDHPYK

SEQ ID NO: 47465 - protein, 11 aa, Dengue virus
WHYDQDHPYKT

SEQ ID NO: 47466 - protein, 11 aa, Dengue virus
HYDQDHPYKTW

SEQ ID NO: 47467 - protein, 11 aa, Dengue virus
YDQDHPYKTWA

SEQ ID NO: 47468 - protein, 11 aa, Dengue virus
DQDHPYKTWAY

SEQ ID NO: 47469 - protein, 11 aa, Dengue virus
QDHPYKTWAYH

SEQ ID NO: 47470 - protein, 11 aa, Dengue virus
DHPYKTWAYHG

SEQ ID NO: 47471 - protein, 11 aa, Dengue virus
HPYKTWAYHGS

SEQ ID NO: 47472 - protein, 11 aa, Dengue virus
PYKTWAYHGSY

SEQ ID NO: 47473 - protein, 11 aa, Dengue virus
YKTWAYHGSYE

SEQ ID NO: 47474 - protein, 11 aa, Dengue virus
KTWAYHGSYET

SEQ ID NO: 47475 - protein, 11 aa, Dengue virus
TWAYHGSYETK

SEQ ID NO: 47476 - protein, 11 aa, Dengue virus
WAYHGSYETKQ

SEQ ID NO: 47477 - protein, 11 aa, Dengue virus
AYHGSYETKQT

SEQ ID NO: 47478 - protein, 11 aa, Dengue virus
YHGSYETKQTG

SEQ ID NO: 47479 - protein, 11 aa, Dengue virus
HGSYETKQTGS

SEQ ID NO: 47480 - protein, 11 aa, Dengue virus
GSYETKQTGSA

SEQ ID NO: 47481 - protein, 11 aa, Dengue virus
SYETKQTGSAS

SEQ ID NO: 47482 - protein, 11 aa, Dengue virus
YETKQTGSASS

SEQ ID NO: 47483 - protein, 11 aa, Dengue virus
ETKQTGSASSM

SEQ ID NO: 47484 - protein, 11 aa, Dengue virus
TKQTGSASSMV

SEQ ID NO: 47485 - protein, 11 aa, Dengue virus
KQTGSASSMVN

SEQ ID NO: 47486 - protein, 11 aa, Dengue virus
QTGSASSMVNG

SEQ ID NO: 47487 - protein, 11 aa, Dengue virus
TGSASSMVNGV

SEQ ID NO: 47488 - protein, 11 aa, Dengue virus
GSASSMVNGVV

SEQ ID NO: 47489 - protein, 11 aa, Dengue virus
SASSMVNGVVR

SEQ ID NO: 47490 - protein, 11 aa, Dengue virus
ASSMVNGVVRL

SEQ ID NO: 47491 - protein, 11 aa, Dengue virus
SSMVNGVVRLL

SEQ ID NO: 47492 - protein, 11 aa, Dengue virus
SMVNGVVRLLT

SEQ ID NO: 47493 - protein, 11 aa, Dengue virus
MVNGVVRLLTK

SEQ ID NO: 47494 - protein, 11 aa, Dengue virus
VNGVVRLLTKP

SEQ ID NO: 47495 - protein, 11 aa, Dengue virus
NGVVRLLTKPW

SEQ ID NO: 47496 - protein, 11 aa, Dengue virus
GVVRLLTKPWD

SEQ ID NO: 47497 - protein, 11 aa, Dengue virus
VVRLLTKPWDV

SEQ ID NO: 47498 - protein, 11 aa, Dengue virus
VRLLTKPWDVV

SEQ ID NO: 47499 - protein, 11 aa, Dengue virus
RLLTKPWDVVP

SEQ ID NO: 47500 - protein, 11 aa, Dengue virus
LLTKPWDVVPM

SEQ ID NO: 47501 - protein, 11 aa, Dengue virus
LTKPWDVVPMV

SEQ ID NO: 47502 - protein, 11 aa, Dengue virus
TKPWDVVPMVT

SEQ ID NO: 47503 - protein, 11 aa, Dengue virus
KPWDVVPMVTQ

SEQ ID NO: 47504 - protein, 11 aa, Dengue virus
PWDVVPMVTQM

SEQ ID NO: 47505 - protein, 11 aa, Dengue virus
WDVVPMVTQMA

SEQ ID NO: 47506 - protein, 11 aa, Dengue virus
DVVPMVTQMAM

SEQ ID NO: 47507 - protein, 11 aa, Dengue virus
VVPMVTQMAMT

SEQ ID NO: 47508 - protein, 11 aa, Dengue virus
VPMVTQMAMTD

SEQ ID NO: 47509 - protein, 11 aa, Dengue virus
PMVTQMAMTDT

SEQ ID NO: 47510 - protein, 11 aa, Dengue virus
MVTQMAMTDTT

SEQ ID NO: 47511 - protein, 11 aa, Dengue virus
VTQMAMTDTTP

SEQ ID NO: 47512 - protein, 11 aa, Dengue virus
TQMAMTDTTPF

SEQ ID NO: 47513 - protein, 11 aa, Dengue virus
QMAMTDTTPFG

SEQ ID NO: 47514 - protein, 11 aa, Dengue virus
MAMTDTTPFGQ

SEQ ID NO: 47515 - protein, 11 aa, Dengue virus
AMTDTTPFGQQ

SEQ ID NO: 47516 - protein, 11 aa, Dengue virus
MTDTTPFGQQR

SEQ ID NO: 47517 - protein, 11 aa, Dengue virus
TDTTPFGQQRV

SEQ ID NO: 47518 - protein, 11 aa, Dengue virus
DTTPFGQQRVF

SEQ ID NO: 47519 - protein, 11 aa, Dengue virus
TTPFGQQRVFK

SEQ ID NO: 47520 - protein, 11 aa, Dengue virus
TPFGQQRVFKE

SEQ ID NO: 47521 - protein, 11 aa, Dengue virus
PFGQQRVFKEK

SEQ ID NO: 47522 - protein, 11 aa, Dengue virus
FGQQRVFKEKV

SEQ ID NO: 47523 - protein, 11 aa, Dengue virus
GQQRVFKEKVD

SEQ ID NO: 47524 - protein, 11 aa, Dengue virus
QQRVFKEKVDT

SEQ ID NO: 47525 - protein, 11 aa, Dengue virus
QRVFKEKVDTR

SEQ ID NO: 47526 - protein, 11 aa, Dengue virus
RVFKEKVDTRT

SEQ ID NO: 47527 - protein, 11 aa, Dengue virus
VFKEKVDTRTQ

SEQ ID NO: 47528 - protein, 11 aa, Dengue virus
FKEKVDTRTQE

SEQ ID NO: 47529 - protein, 11 aa, Dengue virus
KEKVDTRTQEP

SEQ ID NO: 47530 - protein, 11 aa, Dengue virus
EKVDTRTQEPK

SEQ ID NO: 47531 - protein, 11 aa, Dengue virus
KVDTRTQEPKE

SEQ ID NO: 47532 - protein, 11 aa, Dengue virus
VDTRTQEPKEG

SEQ ID NO: 47533 - protein, 11 aa, Dengue virus
DTRTQEPKEGT

SEQ ID NO: 47534 - protein, 11 aa, Dengue virus
TRTQEPKEGTK

SEQ ID NO: 47535 - protein, 11 aa, Dengue virus
RTQEPKEGTKK

SEQ ID NO: 47536 - protein, 11 aa, Dengue virus
TQEPKEGTKKL

SEQ ID NO: 47537 - protein, 11 aa, Dengue virus
QEPKEGTKKLM

SEQ ID NO: 47538 - protein, 11 aa, Dengue virus
EPKEGTKKLMK

SEQ ID NO: 47539 - protein, 11 aa, Dengue virus
PKEGTKKLMKI

SEQ ID NO: 47540 - protein, 11 aa, Dengue virus
KEGTKKLMKIT

SEQ ID NO: 47541 - protein, 11 aa, Dengue virus
EGTKKLMKITA

SEQ ID NO: 47542 - protein, 11 aa, Dengue virus
GTKKLMKITAE

SEQ ID NO: 47543 - protein, 11 aa, Dengue virus
TKKLMKITAEW

SEQ ID NO: 47544 - protein, 11 aa, Dengue virus
KKLMKITAEWL

SEQ ID NO: 47545 - protein, 11 aa, Dengue virus
KLMKITAEWLW

SEQ ID NO: 47546 - protein, 11 aa, Dengue virus
LMKITAEWLWK

SEQ ID NO: 47547 - protein, 11 aa, Dengue virus
MKITAEWLWKE

SEQ ID NO: 47548 - protein, 11 aa, Dengue virus
KITAEWLWKEL

SEQ ID NO: 47549 - protein, 11 aa, Dengue virus
ITAEWLWKELG

SEQ ID NO: 47550 - protein, 11 aa, Dengue virus
TAEWLWKELGK

SEQ ID NO: 47551 - protein, 11 aa, Dengue virus
WLWKELGKKKT

SEQ ID NO: 47552 - protein, 11 aa, Dengue virus
LWKELGKKKTP

SEQ ID NO: 47553 - protein, 11 aa, Dengue virus
WKELGKKKTPR

SEQ ID NO: 47554 - protein, 11 aa, Dengue virus
KTPRMCTREEF

SEQ ID NO: 47555 - protein, 11 aa, Dengue virus
CTREEFTRKVR

SEQ ID NO: 47556 - protein, 11 aa, Dengue virus
TREEFTRKVRS

SEQ ID NO: 47557 - protein, 11 aa, Dengue virus
REEFTRKVRSN

SEQ ID NO: 47558 - protein, 11 aa, Dengue virus
EEFTRKVRSNA

SEQ ID NO: 47559 - protein, 11 aa, Dengue virus
EFTRKVRSNAA

SEQ ID NO: 47560 - protein, 11 aa, Dengue virus
FTRKVRSNAAL

SEQ ID NO: 47561 - protein, 11 aa, Dengue virus
TRKVRSNAALG

SEQ ID NO: 47562 - protein, 11 aa, Dengue virus
RKVRSNAALGA

SEQ ID NO: 47563 - protein, 11 aa, Dengue virus
KVRSNAALGAI

SEQ ID NO: 47564 - protein, 11 aa, Dengue virus
VRSNAALGAIF

SEQ ID NO: 47565 - protein, 11 aa, Dengue virus
RSNAALGAIFT

SEQ ID NO: 47566 - protein, 11 aa, Dengue virus
SNAALGAIFTD

SEQ ID NO: 47567 - protein, 11 aa, Dengue virus
NAALGAIFTDE

SEQ ID NO: 47568 - protein, 11 aa, Dengue virus
AALGAIFTDEN

SEQ ID NO: 47569 - protein, 11 aa, Dengue virus
ALGAIFTDENK

SEQ ID NO: 47570 - protein, 11 aa, Dengue virus
LGAIFTDENKW

SEQ ID NO: 47571 - protein, 11 aa, Dengue virus
GAIFTDENKWK

SEQ ID NO: 47572 - protein, 11 aa, Dengue virus
AIFTDENKWKS

SEQ ID NO: 47573 - protein, 11 aa, Dengue virus
IFTDENKWKSA

SEQ ID NO: 47574 - protein, 11 aa, Dengue virus
FTDENKWKSAR

SEQ ID NO: 47575 - protein, 11 aa, Dengue virus
TDENKWKSARE

SEQ ID NO: 47576 - protein, 11 aa, Dengue virus
DENKWKSAREA

SEQ ID NO: 47577 - protein, 11 aa, Dengue virus
ENKWKSAREAV

SEQ ID NO: 47578 - protein, 11 aa, Dengue virus
NKWKSAREAVE

SEQ ID NO: 47579 - protein, 11 aa, Dengue virus
KWKSAREAVED

SEQ ID NO: 47580 - protein, 11 aa, Dengue virus
WKSAREAVEDS

SEQ ID NO: 47581 - protein, 11 aa, Dengue virus
KSAREAVEDSR

SEQ ID NO: 47582 - protein, 11 aa, Dengue virus
SAREAVEDSRF

SEQ ID NO: 47583 - protein, 11 aa, Dengue virus
AREAVEDSRFW

SEQ ID NO: 47584 - protein, 11 aa, Dengue virus
REAVEDSRFWE

SEQ ID NO: 47585 - protein, 11 aa, Dengue virus
EAVEDSRFWEL

SEQ ID NO: 47586 - protein, 11 aa, Dengue virus
FWELVDKERNL

SEQ ID NO: 47587 - protein, 11 aa, Dengue virus
WELVDKERNLH

SEQ ID NO: 47588 - protein, 11 aa, Dengue virus
ELVDKERNLHL

SEQ ID NO: 47589 - protein, 11 aa, Dengue virus
DKERNLHLEGK

SEQ ID NO: 47590 - protein, 11 aa, Dengue virus
KERNLHLEGKC

SEQ ID NO: 47591 - protein, 11 aa, Dengue virus
ERNLHLEGKCE

SEQ ID NO: 47592 - protein, 11 aa, Dengue virus
RNLHLEGKCET

SEQ ID NO: 47593 - protein, 11 aa, Dengue virus
NLHLEGKCETC

SEQ ID NO: 47594 - protein, 11 aa, Dengue virus
LHLEGKCETCV

SEQ ID NO: 47595 - protein, 11 aa, Dengue virus
HLEGKCETCVY

SEQ ID NO: 47596 - protein, 11 aa, Dengue virus
LEGKCETCVYN

SEQ ID NO: 47597 - protein, 11 aa, Dengue virus
EGKCETCVYNM

SEQ ID NO: 47598 - protein, 11 aa, Dengue virus
GKCETCVYNMM

SEQ ID NO: 47599 - protein, 11 aa, Dengue virus
KCETCVYNMMG

SEQ ID NO: 47600 - protein, 11 aa, Dengue virus
CETCVYNMMGK

SEQ ID NO: 47601 - protein, 11 aa, Dengue virus
ETCVYNMMGKR

SEQ ID NO: 47602 - protein, 11 aa, Dengue virus
TCVYNMMGKRE

SEQ ID NO: 47603 - protein, 11 aa, Dengue virus
CVYNMMGKREK

SEQ ID NO: 47604 - protein, 11 aa, Dengue virus
VYNMMGKREKK

SEQ ID NO: 47605 - protein, 11 aa, Dengue virus
YNMMGKREKKL

SEQ ID NO: 47606 - protein, 11 aa, Dengue virus
NMMGKREKKLG

SEQ ID NO: 47607 - protein, 11 aa, Dengue virus
MMGKREKKLGE

SEQ ID NO: 47608 - protein, 11 aa, Dengue virus
MGKREKKLGEF

SEQ ID NO: 47609 - protein, 11 aa, Dengue virus
GKREKKLGEFG

SEQ ID NO: 47610 - protein, 11 aa, Dengue virus
KREKKLGEFGK

SEQ ID NO: 47611 - protein, 11 aa, Dengue virus
REKKLGEFGKA

SEQ ID NO: 47612 - protein, 11 aa, Dengue virus
EKKLGEFGKAK

SEQ ID NO: 47613 - protein, 11 aa, Dengue virus
KKLGEFGKAKG

SEQ ID NO: 47614 - protein, 11 aa, Dengue virus
KLGEFGKAKGS

SEQ ID NO: 47615 - protein, 11 aa, Dengue virus
LGEFGKAKGSR

SEQ ID NO: 47616 - protein, 11 aa, Dengue virus
GEFGKAKGSRA

SEQ ID NO: 47617 - protein, 11 aa, Dengue virus
EFGKAKGSRAI

SEQ ID NO: 47618 - protein, 11 aa, Dengue virus
FGKAKGSRAIW

SEQ ID NO: 47619 - protein, 11 aa, Dengue virus
GKAKGSRAIWY

SEQ ID NO: 47620 - protein, 11 aa, Dengue virus
KAKGSRAIWYM

SEQ ID NO: 47621 - protein, 11 aa, Dengue virus
AKGSRAIWYMW

SEQ ID NO: 47622 - protein, 11 aa, Dengue virus
KGSRAIWYMWL

SEQ ID NO: 47623 - protein, 11 aa, Dengue virus
GSRAIWYMWLG

SEQ ID NO: 47624 - protein, 11 aa, Dengue virus
SRAIWYMWLGA

SEQ ID NO: 47625 - protein, 11 aa, Dengue virus
RAIWYMWLGAR

SEQ ID NO: 47626 - protein, 11 aa, Dengue virus
AIWYMWLGARF

SEQ ID NO: 47627 - protein, 11 aa, Dengue virus
IWYMWLGARFL

SEQ ID NO: 47628 - protein, 11 aa, Dengue virus
WYMWLGARFLE

SEQ ID NO: 47629 - protein, 11 aa, Dengue virus
YMWLGARFLEF

SEQ ID NO: 47630 - protein, 11 aa, Dengue virus
MWLGARFLEFE

SEQ ID NO: 47631 - protein, 11 aa, Dengue virus
WLGARFLEFEA

SEQ ID NO: 47632 - protein, 11 aa, Dengue virus
LGARFLEFEAL

SEQ ID NO: 47633 - protein, 11 aa, Dengue virus
GARFLEFEALG

SEQ ID NO: 47634 - protein, 11 aa, Dengue virus
ARFLEFEALGF

SEQ ID NO: 47635 - protein, 11 aa, Dengue virus
RFLEFEALGFL

SEQ ID NO: 47636 - protein, 11 aa, Dengue virus
FLEFEALGFLN

SEQ ID NO: 47637 - protein, 11 aa, Dengue virus
LEFEALGFLNE

SEQ ID NO: 47638 - protein, 11 aa, Dengue virus
EFEALGFLNED

SEQ ID NO: 47639 - protein, 11 aa, Dengue virus
FEALGFLNEDH

SEQ ID NO: 47640 - protein, 11 aa, Dengue virus
EALGFLNEDHW

SEQ ID NO: 47641 - protein, 11 aa, Dengue virus
ALGFLNEDHWF

SEQ ID NO: 47642 - protein, 11 aa, Dengue virus
LGFLNEDHWFS

SEQ ID NO: 47643 - protein, 11 aa, Dengue virus
GFLNEDHWFSR

SEQ ID NO: 47644 - protein, 11 aa, Dengue virus
FLNEDHWFSRE

SEQ ID NO: 47645 - protein, 11 aa, Dengue virus
LNEDHWFSREN

SEQ ID NO: 47646 - protein, 11 aa, Dengue virus
NEDHWFSRENS

SEQ ID NO: 47647 - protein, 11 aa, Dengue virus
EDHWFSRENSL

SEQ ID NO: 47648 - protein, 11 aa, Dengue virus
DHWFSRENSLS

SEQ ID NO: 47649 - protein, 11 aa, Dengue virus
HWFSRENSLSG

SEQ ID NO: 47650 - protein, 11 aa, Dengue virus
WFSRENSLSGV

SEQ ID NO: 47651 - protein, 11 aa, Dengue virus
FSRENSLSGVE

SEQ ID NO: 47652 - protein, 11 aa, Dengue virus
SRENSLSGVEG

SEQ ID NO: 47653 - protein, 11 aa, Dengue virus
RENSLSGVEGE

SEQ ID NO: 47654 - protein, 11 aa, Dengue virus
ENSLSGVEGEG

SEQ ID NO: 47655 - protein, 11 aa, Dengue virus
NSLSGVEGEGL

SEQ ID NO: 47656 - protein, 11 aa, Dengue virus
SLSGVEGEGLH

SEQ ID NO: 47657 - protein, 11 aa, Dengue virus
LSGVEGEGLHK

SEQ ID NO: 47658 - protein, 11 aa, Dengue virus
SGVEGEGLHKL

SEQ ID NO: 47659 - protein, 11 aa, Dengue virus
GVEGEGLHKLG

SEQ ID NO: 47660 - protein, 11 aa, Dengue virus
VEGEGLHKLGY

SEQ ID NO: 47661 - protein, 11 aa, Dengue virus
EGEGLHKLGYI

SEQ ID NO: 47662 - protein, 11 aa, Dengue virus
GEGLHKLGYIL

SEQ ID NO: 47663 - protein, 11 aa, Dengue virus
EGLHKLGYILR

SEQ ID NO: 47664 - protein, 11 aa, Dengue virus
GLHKLGYILRD

SEQ ID NO: 47665 - protein, 11 aa, Dengue virus
LHKLGYILRDV

SEQ ID NO: 47666 - protein, 11 aa, Dengue virus
LGYILRDVSKK

SEQ ID NO: 47667 - protein, 11 aa, Dengue virus
VSKKEGGAMYA

SEQ ID NO: 47668 - protein, 11 aa, Dengue virus
SKKEGGAMYAD

SEQ ID NO: 47669 - protein, 11 aa, Dengue virus
KKEGGAMYADD

SEQ ID NO: 47670 - protein, 11 aa, Dengue virus
KEGGAMYADDT

SEQ ID NO: 47671 - protein, 11 aa, Dengue virus
EGGAMYADDTA

SEQ ID NO: 47672 - protein, 11 aa, Dengue virus
GGAMYADDTAG

SEQ ID NO: 47673 - protein, 11 aa, Dengue virus
GAMYADDTAGW

SEQ ID NO: 47674 - protein, 11 aa, Dengue virus
AMYADDTAGWD

SEQ ID NO: 47675 - protein, 11 aa, Dengue virus
MYADDTAGWDT

SEQ ID NO: 47676 - protein, 11 aa, Dengue virus
YADDTAGWDTR

SEQ ID NO: 47677 - protein, 11 aa, Dengue virus
ADDTAGWDTRI

SEQ ID NO: 47678 - protein, 11 aa, Dengue virus
DDTAGWDTRIT

SEQ ID NO: 47679 - protein, 11 aa, Dengue virus
DTAGWDTRITL

SEQ ID NO: 47680 - protein, 11 aa, Dengue virus
TAGWDTRITLE

SEQ ID NO: 47681 - protein, 11 aa, Dengue virus
AGWDTRITLED

SEQ ID NO: 47682 - protein, 11 aa, Dengue virus
GWDTRITLEDL

SEQ ID NO: 47683 - protein, 11 aa, Dengue virus
WDTRITLEDLK

SEQ ID NO: 47684 - protein, 11 aa, Dengue virus
DTRITLEDLKN

SEQ ID NO: 47685 - protein, 11 aa, Dengue virus
TRITLEDLKNE

SEQ ID NO: 47686 - protein, 11 aa, Dengue virus
RITLEDLKNEE

SEQ ID NO: 47687 - protein, 11 aa, Dengue virus
ITLEDLKNEEM

SEQ ID NO: 47688 - protein, 11 aa, Dengue virus
TLEDLKNEEMV

SEQ ID NO: 47689 - protein, 11 aa, Dengue virus
LEDLKNEEMVT

SEQ ID NO: 47690 - protein, 11 aa, Dengue virus
EDLKNEEMVTN

SEQ ID NO: 47691 - protein, 11 aa, Dengue virus
DLKNEEMVTNH

SEQ ID NO: 47692 - protein, 11 aa, Dengue virus
LKNEEMVTNHM

SEQ ID NO: 47693 - protein, 11 aa, Dengue virus
GEHKKLAEAIF

SEQ ID NO: 47694 - protein, 11 aa, Dengue virus
EHKKLAEAIFK

SEQ ID NO: 47695 - protein, 11 aa, Dengue virus
HKKLAEAIFKL

SEQ ID NO: 47696 - protein, 11 aa, Dengue virus
KKLAEAIFKLT

SEQ ID NO: 47697 - protein, 11 aa, Dengue virus
KLAEAIFKLTY

SEQ ID NO: 47698 - protein, 11 aa, Dengue virus
LAEAIFKLTYQ

SEQ ID NO: 47699 - protein, 11 aa, Dengue virus
AEAIFKLTYQN

SEQ ID NO: 47700 - protein, 11 aa, Dengue virus
EAIFKLTYQNK

SEQ ID NO: 47701 - protein, 11 aa, Dengue virus
AIFKLTYQNKV

SEQ ID NO: 47702 - protein, 11 aa, Dengue virus
IFKLTYQNKVV

SEQ ID NO: 47703 - protein, 11 aa, Dengue virus
FKLTYQNKVVR

SEQ ID NO: 47704 - protein, 11 aa, Dengue virus
KLTYQNKVVRV

SEQ ID NO: 47705 - protein, 11 aa, Dengue virus
LTYQNKVVRVQ

SEQ ID NO: 47706 - protein, 11 aa, Dengue virus
TYQNKVVRVQR

SEQ ID NO: 47707 - protein, 11 aa, Dengue virus
YQNKVVRVQRP

SEQ ID NO: 47708 - protein, 11 aa, Dengue virus
QNKVVRVQRPT

SEQ ID NO: 47709 - protein, 11 aa, Dengue virus
NKVVRVQRPTP

SEQ ID NO: 47710 - protein, 11 aa, Dengue virus
KVVRVQRPTPR

SEQ ID NO: 47711 - protein, 11 aa, Dengue virus
VVRVQRPTPRG

SEQ ID NO: 47712 - protein, 11 aa, Dengue virus
VRVQRPTPRGT

SEQ ID NO: 47713 - protein, 11 aa, Dengue virus
RVQRPTPRGTV

SEQ ID NO: 47714 - protein, 11 aa, Dengue virus
VQRPTPRGTVM

SEQ ID NO: 47715 - protein, 11 aa, Dengue virus
QRPTPRGTVMD

SEQ ID NO: 47716 - protein, 11 aa, Dengue virus
RPTPRGTVMDI

SEQ ID NO: 47717 - protein, 11 aa, Dengue virus
PTPRGTVMDII

SEQ ID NO: 47718 - protein, 11 aa, Dengue virus
TPRGTVMDIIS

SEQ ID NO: 47719 - protein, 11 aa, Dengue virus
PRGTVMDIISR

SEQ ID NO: 47720 - protein, 11 aa, Dengue virus
RGTVMDIISRR

SEQ ID NO: 47721 - protein, 11 aa, Dengue virus
GTVMDIISRRD

SEQ ID NO: 47722 - protein, 11 aa, Dengue virus
TVMDIISRRDQ

SEQ ID NO: 47723 - protein, 11 aa, Dengue virus
VMDIISRRDQR

SEQ ID NO: 47724 - protein, 11 aa, Dengue virus
MDIISRRDQRG

SEQ ID NO: 47725 - protein, 11 aa, Dengue virus
DIISRRDQRGS

SEQ ID NO: 47726 - protein, 11 aa, Dengue virus
IISRRDQRGSG

SEQ ID NO: 47727 - protein, 11 aa, Dengue virus
ISRRDQRGSGQ

SEQ ID NO: 47728 - protein, 11 aa, Dengue virus
SRRDQRGSGQV

SEQ ID NO: 47729 - protein, 11 aa, Dengue virus
RRDQRGSGQVG

SEQ ID NO: 47730 - protein, 11 aa, Dengue virus
RDQRGSGQVGT

SEQ ID NO: 47731 - protein, 11 aa, Dengue virus
DQRGSGQVGTY

SEQ ID NO: 47732 - protein, 11 aa, Dengue virus
QRGSGQVGTYG

SEQ ID NO: 47733 - protein, 11 aa, Dengue virus
RGSGQVGTYGL

SEQ ID NO: 47734 - protein, 11 aa, Dengue virus
GSGQVGTYGLN

SEQ ID NO: 47735 - protein, 11 aa, Dengue virus
SGQVGTYGLNT

SEQ ID NO: 47736 - protein, 11 aa, Dengue virus
GQVGTYGLNTF

SEQ ID NO: 47737 - protein, 11 aa, Dengue virus
QVGTYGLNTFT

SEQ ID NO: 47738 - protein, 11 aa, Dengue virus
VGTYGLNTFTN

SEQ ID NO: 47739 - protein, 11 aa, Dengue virus
GTYGLNTFTNM

SEQ ID NO: 47740 - protein, 11 aa, Dengue virus
TYGLNTFTNME

SEQ ID NO: 47741 - protein, 11 aa, Dengue virus
YGLNTFTNMEA

SEQ ID NO: 47742 - protein, 11 aa, Dengue virus
GLNTFTNMEAQ

SEQ ID NO: 47743 - protein, 11 aa, Dengue virus
LNTFTNMEAQL

SEQ ID NO: 47744 - protein, 11 aa, Dengue virus
NTFTNMEAQLI

SEQ ID NO: 47745 - protein, 11 aa, Dengue virus
TFTNMEAQLIR

SEQ ID NO: 47746 - protein, 11 aa, Dengue virus
FTNMEAQLIRQ

SEQ ID NO: 47747 - protein, 11 aa, Dengue virus
TNMEAQLIRQM

SEQ ID NO: 47748 - protein, 11 aa, Dengue virus
NMEAQLIRQME

SEQ ID NO: 47749 - protein, 11 aa, Dengue virus
MEAQLIRQMEG

SEQ ID NO: 47750 - protein, 11 aa, Dengue virus
EAQLIRQMEGE

SEQ ID NO: 47751 - protein, 11 aa, Dengue virus
AQLIRQMEGEG

SEQ ID NO: 47752 - protein, 11 aa, Dengue virus
QLIRQMEGEGI

SEQ ID NO: 47753 - protein, 11 aa, Dengue virus
LIRQMEGEGIF

SEQ ID NO: 47754 - protein, 11 aa, Dengue virus
IRQMEGEGIFK

SEQ ID NO: 47755 - protein, 11 aa, Dengue virus
GRERLSRMAIS

SEQ ID NO: 47756 - protein, 11 aa, Dengue virus
RERLSRMAISG

SEQ ID NO: 47757 - protein, 11 aa, Dengue virus
ERLSRMAISGD

SEQ ID NO: 47758 - protein, 11 aa, Dengue virus
RLSRMAISGDD

SEQ ID NO: 47759 - protein, 11 aa, Dengue virus
LSRMAISGDDC

SEQ ID NO: 47760 - protein, 11 aa, Dengue virus
SRMAISGDDCV

SEQ ID NO: 47761 - protein, 11 aa, Dengue virus
RMAISGDDCVV

SEQ ID NO: 47762 - protein, 11 aa, Dengue virus
MAISGDDCVVK

SEQ ID NO: 47763 - protein, 11 aa, Dengue virus
AISGDDCVVKP

SEQ ID NO: 47764 - protein, 11 aa, Dengue virus
ISGDDCVVKPL

SEQ ID NO: 47765 - protein, 11 aa, Dengue virus
SGDDCVVKPLD

SEQ ID NO: 47766 - protein, 11 aa, Dengue virus
GDDCVVKPLDD

SEQ ID NO: 47767 - protein, 11 aa, Dengue virus
DDCVVKPLDDR

SEQ ID NO: 47768 - protein, 11 aa, Dengue virus
DCVVKPLDDRF

SEQ ID NO: 47769 - protein, 11 aa, Dengue virus
CVVKPLDDRFA

SEQ ID NO: 47770 - protein, 11 aa, Dengue virus
DDRFASALTAL

SEQ ID NO: 47771 - protein, 11 aa, Dengue virus
DRFASALTALN

SEQ ID NO: 47772 - protein, 11 aa, Dengue virus
RFASALTALND

SEQ ID NO: 47773 - protein, 11 aa, Dengue virus
FASALTALNDM

SEQ ID NO: 47774 - protein, 11 aa, Dengue virus
ASALTALNDMG

SEQ ID NO: 47775 - protein, 11 aa, Dengue virus
SALTALNDMGK

SEQ ID NO: 47776 - protein, 11 aa, Dengue virus
ALTALNDMGKV

SEQ ID NO: 47777 - protein, 11 aa, Dengue virus
LTALNDMGKVR

SEQ ID NO: 47778 - protein, 11 aa, Dengue virus
TALNDMGKVRK

SEQ ID NO: 47779 - protein, 11 aa, Dengue virus
ALNDMGKVRKD

SEQ ID NO: 47780 - protein, 11 aa, Dengue virus
LNDMGKVRKDI

SEQ ID NO: 47781 - protein, 11 aa, Dengue virus
NDMGKVRKDIQ

SEQ ID NO: 47782 - protein, 11 aa, Dengue virus
DMGKVRKDIQQ

SEQ ID NO: 47783 - protein, 11 aa, Dengue virus
MGKVRKDIQQW

SEQ ID NO: 47784 - protein, 11 aa, Dengue virus
GKVRKDIQQWE

SEQ ID NO: 47785 - protein, 11 aa, Dengue virus
KVRKDIQQWEP

SEQ ID NO: 47786 - protein, 11 aa, Dengue virus
VRKDIQQWEPS

SEQ ID NO: 47787 - protein, 11 aa, Dengue virus
RKDIQQWEPSR

SEQ ID NO: 47788 - protein, 11 aa, Dengue virus
KDIQQWEPSRG

SEQ ID NO: 47789 - protein, 11 aa, Dengue virus
DIQQWEPSRGW

SEQ ID NO: 47790 - protein, 11 aa, Dengue virus
IQQWEPSRGWN

SEQ ID NO: 47791 - protein, 11 aa, Dengue virus
QQWEPSRGWND

SEQ ID NO: 47792 - protein, 11 aa, Dengue virus
QWEPSRGWNDW

SEQ ID NO: 47793 - protein, 11 aa, Dengue virus
WEPSRGWNDWT

SEQ ID NO: 47794 - protein, 11 aa, Dengue virus
EPSRGWNDWTQ

SEQ ID NO: 47795 - protein, 11 aa, Dengue virus
PSRGWNDWTQV

SEQ ID NO: 47796 - protein, 11 aa, Dengue virus
SRGWNDWTQVP

SEQ ID NO: 47797 - protein, 11 aa, Dengue virus
RGWNDWTQVPF

SEQ ID NO: 47798 - protein, 11 aa, Dengue virus
GWNDWTQVPFC

SEQ ID NO: 47799 - protein, 11 aa, Dengue virus
WNDWTQVPFCS

SEQ ID NO: 47800 - protein, 11 aa, Dengue virus
NDWTQVPFCSH

SEQ ID NO: 47801 - protein, 11 aa, Dengue virus
DWTQVPFCSHH

SEQ ID NO: 47802 - protein, 11 aa, Dengue virus
WTQVPFCSHHF

SEQ ID NO: 47803 - protein, 11 aa, Dengue virus
TQVPFCSHHFH

SEQ ID NO: 47804 - protein, 11 aa, Dengue virus
QVPFCSHHFHE

SEQ ID NO: 47805 - protein, 11 aa, Dengue virus
VPFCSHHFHEL

SEQ ID NO: 47806 - protein, 11 aa, Dengue virus
PFCSHHFHELI

SEQ ID NO: 47807 - protein, 11 aa, Dengue virus
FCSHHFHELIM

SEQ ID NO: 47808 - protein, 11 aa, Dengue virus
CSHHFHELIMK

SEQ ID NO: 47809 - protein, 11 aa, Dengue virus
SHHFHELIMKD

SEQ ID NO: 47810 - protein, 11 aa, Dengue virus
HHFHELIMKDG

SEQ ID NO: 47811 - protein, 11 aa, Dengue virus
HFHELIMKDGR

SEQ ID NO: 47812 - protein, 11 aa, Dengue virus
MKDGRVLVVPC

SEQ ID NO: 47813 - protein, 11 aa, Dengue virus
KDGRVLVVPCR

SEQ ID NO: 47814 - protein, 11 aa, Dengue virus
LVVPCRNQDEL

SEQ ID NO: 47815 - protein, 11 aa, Dengue virus
VVPCRNQDELI

SEQ ID NO: 47816 - protein, 11 aa, Dengue virus
VPCRNQDELIG

SEQ ID NO: 47817 - protein, 11 aa, Dengue virus
PCRNQDELIGR

SEQ ID NO: 47818 - protein, 11 aa, Dengue virus
CRNQDELIGRA

SEQ ID NO: 47819 - protein, 11 aa, Dengue virus
RNQDELIGRAR

SEQ ID NO: 47820 - protein, 11 aa, Dengue virus
NQDELIGRARI

SEQ ID NO: 47821 - protein, 11 aa, Dengue virus
QDELIGRARIS

SEQ ID NO: 47822 - protein, 11 aa, Dengue virus
DELIGRARISQ

SEQ ID NO: 47823 - protein, 11 aa, Dengue virus
ELIGRARISQG

SEQ ID NO: 47824 - protein, 11 aa, Dengue virus
LIGRARISQGA

SEQ ID NO: 47825 - protein, 11 aa, Dengue virus
IGRARISQGAG

SEQ ID NO: 47826 - protein, 11 aa, Dengue virus
GRARISQGAGW

SEQ ID NO: 47827 - protein, 11 aa, Dengue virus
RARISQGAGWS

SEQ ID NO: 47828 - protein, 11 aa, Dengue virus
ARISQGAGWSL

SEQ ID NO: 47829 - protein, 11 aa, Dengue virus
RISQGAGWSLK

SEQ ID NO: 47830 - protein, 11 aa, Dengue virus
ISQGAGWSLKE

SEQ ID NO: 47831 - protein, 11 aa, Dengue virus
SQGAGWSLKET

SEQ ID NO: 47832 - protein, 11 aa, Dengue virus
QGAGWSLKETA

SEQ ID NO: 47833 - protein, 11 aa, Dengue virus
GAGWSLKETAC

SEQ ID NO: 47834 - protein, 11 aa, Dengue virus
AGWSLKETACL

SEQ ID NO: 47835 - protein, 11 aa, Dengue virus
GWSLKETACLG

SEQ ID NO: 47836 - protein, 11 aa, Dengue virus
WSLKETACLGK

SEQ ID NO: 47837 - protein, 11 aa, Dengue virus
SLKETACLGKS

SEQ ID NO: 47838 - protein, 11 aa, Dengue virus
LKETACLGKSY

SEQ ID NO: 47839 - protein, 11 aa, Dengue virus
KETACLGKSYA

SEQ ID NO: 47840 - protein, 11 aa, Dengue virus
ETACLGKSYAQ

SEQ ID NO: 47841 - protein, 11 aa, Dengue virus
TACLGKSYAQM

SEQ ID NO: 47842 - protein, 11 aa, Dengue virus
ACLGKSYAQMW

SEQ ID NO: 47843 - protein, 11 aa, Dengue virus
CLGKSYAQMWS

SEQ ID NO: 47844 - protein, 11 aa, Dengue virus
LGKSYAQMWSL

SEQ ID NO: 47845 - protein, 11 aa, Dengue virus
GKSYAQMWSLM

SEQ ID NO: 47846 - protein, 11 aa, Dengue virus
KSYAQMWSLMY

SEQ ID NO: 47847 - protein, 11 aa, Dengue virus
SYAQMWSLMYF

SEQ ID NO: 47848 - protein, 11 aa, Dengue virus
YAQMWSLMYFH

SEQ ID NO: 47849 - protein, 11 aa, Dengue virus
AQMWSLMYFHR

SEQ ID NO: 47850 - protein, 11 aa, Dengue virus
QMWSLMYFHRR

SEQ ID NO: 47851 - protein, 11 aa, Dengue virus
MWSLMYFHRRD

SEQ ID NO: 47852 - protein, 11 aa, Dengue virus
WSLMYFHRRDL

SEQ ID NO: 47853 - protein, 11 aa, Dengue virus
SLMYFHRRDLR

SEQ ID NO: 47854 - protein, 11 aa, Dengue virus
LMYFHRRDLRL

SEQ ID NO: 47855 - protein, 11 aa, Dengue virus
MYFHRRDLRLA

SEQ ID NO: 47856 - protein, 11 aa, Dengue virus
YFHRRDLRLAA

SEQ ID NO: 47857 - protein, 11 aa, Dengue virus
FHRRDLRLAAN

SEQ ID NO: 47858 - protein, 11 aa, Dengue virus
HRRDLRLAANA

SEQ ID NO: 47859 - protein, 11 aa, Dengue virus
RRDLRLAANAI

SEQ ID NO: 47860 - protein, 11 aa, Dengue virus
RDLRLAANAIC

SEQ ID NO: 47861 - protein, 11 aa, Dengue virus
DLRLAANAICS

SEQ ID NO: 47862 - protein, 11 aa, Dengue virus
LRLAANAICSA

SEQ ID NO: 47863 - protein, 11 aa, Dengue virus
RLAANAICSAV

SEQ ID NO: 47864 - protein, 11 aa, Dengue virus
LAANAICSAVP

SEQ ID NO: 47865 - protein, 11 aa, Dengue virus
AANAICSAVPS

SEQ ID NO: 47866 - protein, 11 aa, Dengue virus
ANAICSAVPSH

SEQ ID NO: 47867 - protein, 11 aa, Dengue virus
NAICSAVPSHW

SEQ ID NO: 47868 - protein, 11 aa, Dengue virus
AICSAVPSHWV

SEQ ID NO: 47869 - protein, 11 aa, Dengue virus
ICSAVPSHWVP

SEQ ID NO: 47870 - protein, 11 aa, Dengue virus
CSAVPSHWVPT

SEQ ID NO: 47871 - protein, 11 aa, Dengue virus
SAVPSHWVPTS

SEQ ID NO: 47872 - protein, 11 aa, Dengue virus
AVPSHWVPTSR

SEQ ID NO: 47873 - protein, 11 aa, Dengue virus
VPSHWVPTSRT

SEQ ID NO: 47874 - protein, 11 aa, Dengue virus
PSHWVPTSRTT

SEQ ID NO: 47875 - protein, 11 aa, Dengue virus
SHWVPTSRTTW

SEQ ID NO: 47876 - protein, 11 aa, Dengue virus
HWVPTSRTTWS

SEQ ID NO: 47877 - protein, 11 aa, Dengue virus
WVPTSRTTWSI

SEQ ID NO: 47878 - protein, 11 aa, Dengue virus
VPTSRTTWSIH

SEQ ID NO: 47879 - protein, 11 aa, Dengue virus
PTSRTTWSIHA

SEQ ID NO: 47880 - protein, 11 aa, Dengue virus
TSRTTWSIHAK

SEQ ID NO: 47881 - protein, 11 aa, Dengue virus
SRTTWSIHAKH

SEQ ID NO: 47882 - protein, 11 aa, Dengue virus
RTTWSIHAKHE

SEQ ID NO: 47883 - protein, 11 aa, Dengue virus
TTWSIHAKHEW

SEQ ID NO: 47884 - protein, 11 aa, Dengue virus
TWSIHAKHEWM

SEQ ID NO: 47885 - protein, 11 aa, Dengue virus
WSIHAKHEWMT

SEQ ID NO: 47886 - protein, 11 aa, Dengue virus
SIHAKHEWMTT

SEQ ID NO: 47887 - protein, 11 aa, Dengue virus
IHAKHEWMTTE

SEQ ID NO: 47888 - protein, 11 aa, Dengue virus
HAKHEWMTTED

SEQ ID NO: 47889 - protein, 11 aa, Dengue virus
AKHEWMTTEDM

SEQ ID NO: 47890 - protein, 11 aa, Dengue virus
KHEWMTTEDML

SEQ ID NO: 47891 - protein, 11 aa, Dengue virus
HEWMTTEDMLA

SEQ ID NO: 47892 - protein, 11 aa, Dengue virus
EWMTTEDMLAV

SEQ ID NO: 47893 - protein, 11 aa, Dengue virus
WMTTEDMLAVW

SEQ ID NO: 47894 - protein, 11 aa, Dengue virus
MTTEDMLAVWN

SEQ ID NO: 47895 - protein, 11 aa, Dengue virus
TTEDMLAVWNR

SEQ ID NO: 47896 - protein, 11 aa, Dengue virus
TEDMLAVWNRV

SEQ ID NO: 47897 - protein, 11 aa, Dengue virus
EDMLAVWNRVW

SEQ ID NO: 47898 - protein, 11 aa, Dengue virus
DMLAVWNRVWI

SEQ ID NO: 47899 - protein, 11 aa, Dengue virus
MLAVWNRVWIQ

SEQ ID NO: 47900 - protein, 11 aa, Dengue virus
VWNRVWIQENP

SEQ ID NO: 47901 - protein, 11 aa, Dengue virus
WNRVWIQENPW

SEQ ID NO: 47902 - protein, 11 aa, Dengue virus
VWIQENPWMED

SEQ ID NO: 47903 - protein, 11 aa, Dengue virus
WIQENPWMEDK

SEQ ID NO: 47904 - protein, 11 aa, Dengue virus
IQENPWMEDKT

SEQ ID NO: 47905 - protein, 11 aa, Dengue virus
ENPWMEDKTPV

SEQ ID NO: 47906 - protein, 11 aa, Dengue virus
NPWMEDKTPVE

SEQ ID NO: 47907 - protein, 11 aa, Dengue virus
PWMEDKTPVES

SEQ ID NO: 47908 - protein, 11 aa, Dengue virus
WMEDKTPVESW

SEQ ID NO: 47909 - protein, 11 aa, Dengue virus
MEDKTPVESWE

SEQ ID NO: 47910 - protein, 11 aa, Dengue virus
EDKTPVESWEE

SEQ ID NO: 47911 - protein, 11 aa, Dengue virus
DKTPVESWEEV

SEQ ID NO: 47912 - protein, 11 aa, Dengue virus
KTPVESWEEVP

SEQ ID NO: 47913 - protein, 11 aa, Dengue virus
TPVESWEEVPY

SEQ ID NO: 47914 - protein, 11 aa, Dengue virus
PVESWEEVPYL

SEQ ID NO: 47915 - protein, 11 aa, Dengue virus
VESWEEVPYLG

SEQ ID NO: 47916 - protein, 11 aa, Dengue virus
ESWEEVPYLGK

SEQ ID NO: 47917 - protein, 11 aa, Dengue virus
SWEEVPYLGKR

SEQ ID NO: 47918 - protein, 11 aa, Dengue virus
WEEVPYLGKRE

SEQ ID NO: 47919 - protein, 11 aa, Dengue virus
EEVPYLGKRED

SEQ ID NO: 47920 - protein, 11 aa, Dengue virus
EVPYLGKREDQ

SEQ ID NO: 47921 - protein, 11 aa, Dengue virus
VPYLGKREDQW

SEQ ID NO: 47922 - protein, 11 aa, Dengue virus
PYLGKREDQWC

SEQ ID NO: 47923 - protein, 11 aa, Dengue virus
YLGKREDQWCG

SEQ ID NO: 47924 - protein, 11 aa, Dengue virus
LGKREDQWCGS

SEQ ID NO: 47925 - protein, 11 aa, Dengue virus
GKREDQWCGSL

SEQ ID NO: 47926 - protein, 11 aa, Dengue virus
KREDQWCGSLI

SEQ ID NO: 47927 - protein, 11 aa, Dengue virus
REDQWCGSLIG

SEQ ID NO: 47928 - protein, 11 aa, Dengue virus
EDQWCGSLIGL

SEQ ID NO: 47929 - protein, 11 aa, Dengue virus
DQWCGSLIGLT

SEQ ID NO: 47930 - protein, 11 aa, Dengue virus
QWCGSLIGLTS

SEQ ID NO: 47931 - protein, 11 aa, Dengue virus
WCGSLIGLTSR

SEQ ID NO: 47932 - protein, 11 aa, Dengue virus
CGSLIGLTSRA

SEQ ID NO: 47933 - protein, 11 aa, Dengue virus
GSLIGLTSRAT

SEQ ID NO: 47934 - protein, 11 aa, Dengue virus
SLIGLTSRATW

SEQ ID NO: 47935 - protein, 11 aa, Dengue virus
LIGLTSRATWA

SEQ ID NO: 47936 - protein, 11 aa, Dengue virus
IGLTSRATWAK

SEQ ID NO: 47937 - protein, 11 aa, Dengue virus
GLTSRATWAKN

SEQ ID NO: 47938 - protein, 11 aa, Dengue virus
LTSRATWAKNI

SEQ ID NO: 47939 - protein, 11 aa, Dengue virus
TSRATWAKNIQ

SEQ ID NO: 47940 - protein, 11 aa, Dengue virus
SRATWAKNIQT

SEQ ID NO: 47941 - protein, 11 aa, Dengue virus
RATWAKNIQTA

SEQ ID NO: 47942 - protein, 11 aa, Dengue virus
ATWAKNIQTAI

SEQ ID NO: 47943 - protein, 11 aa, Dengue virus
TWAKNIQTAIN

SEQ ID NO: 47944 - protein, 11 aa, Dengue virus
WAKNIQTAINQ

SEQ ID NO: 47945 - protein, 11 aa, Dengue virus
AKNIQTAINQV

SEQ ID NO: 47946 - protein, 11 aa, Dengue virus
KNIQTAINQVR

SEQ ID NO: 47947 - protein, 11 aa, Dengue virus
NIQTAINQVRS

SEQ ID NO: 47948 - protein, 11 aa, Dengue virus
IQTAINQVRSL

SEQ ID NO: 47949 - protein, 11 aa, Dengue virus
QTAINQVRSLI

SEQ ID NO: 47950 - protein, 11 aa, Dengue virus
TAINQVRSLIG

SEQ ID NO: 47951 - protein, 11 aa, Dengue virus
AINQVRSLIGN

SEQ ID NO: 47952 - protein, 11 aa, Dengue virus
INQVRSLIGNE

SEQ ID NO: 47953 - protein, 11 aa, Dengue virus
NQVRSLIGNEE

SEQ ID NO: 47954 - protein, 11 aa, Dengue virus
QVRSLIGNEEY

SEQ ID NO: 47955 - protein, 11 aa, Dengue virus
EEYTDYMPSMK

SEQ ID NO: 47956 - protein, 11 aa, Dengue virus
EYTDYMPSMKR

SEQ ID NO: 47957 - protein, 11 aa, Dengue virus
YTDYMPSMKRF

SEQ ID NO: 47958 - protein, 11 aa, Dengue virus
TDYMPSMKRFR

SEQ ID NO: 47959 - protein, 11 aa, Dengue virus
DYMPSMKRFRR

SEQ ID NO: 47960 - protein, 11 aa, Dengue virus
YMPSMKRFRRE

SEQ ID NO: 47961 - protein, 11 aa, Dengue virus
MPSMKRFRREE

SEQ ID NO: 47962 - protein, 11 aa, Dengue virus
PSMKRFRREEE

SEQ ID NO: 47963 - protein, 11 aa, Dengue virus
SMKRFRREEEE

SEQ ID NO: 47964 - protein, 11 aa, Dengue virus
MKRFRREEEEA

SEQ ID NO: 47965 - protein, 11 aa, Dengue virus
KRFRREEEEAG

SEQ ID NO: 47966 - protein, 11 aa, Dengue virus
RFRREEEEAGV

SEQ ID NO: 47967 - protein, 11 aa, Dengue virus
FRREEEEAGVL

SEQ ID NO: 47968 - protein, 11 aa, Dengue virus
RREEEEAGVLW

SEQ ID NO: 47969 - protein, 11 aa, Dengue virus
NTPFNMLKRER

SEQ ID NO: 47970 - protein, 11 aa, Dengue virus
LKRERNRVSTI

SEQ ID NO: 47971 - protein, 11 aa, Dengue virus
KRERNRVSTIQ

SEQ ID NO: 47972 - protein, 11 aa, Dengue virus
RERNRVSTIQQ

SEQ ID NO: 47973 - protein, 11 aa, Dengue virus
ERNRVSTIQQL

SEQ ID NO: 47974 - protein, 11 aa, Dengue virus
RNRVSTIQQLT

SEQ ID NO: 47975 - protein, 11 aa, Dengue virus
NRVSTIQQLTK

SEQ ID NO: 47976 - protein, 11 aa, Dengue virus
RVSTIQQLTKR

SEQ ID NO: 47977 - protein, 11 aa, Dengue virus
VSTIQQLTKRF

SEQ ID NO: 47978 - protein, 11 aa, Dengue virus
STIQQLTKRFS

SEQ ID NO: 47979 - protein, 11 aa, Dengue virus
TIQQLTKRFSL

SEQ ID NO: 47980 - protein, 11 aa, Dengue virus
IQQLTKRFSLG

SEQ ID NO: 47981 - protein, 11 aa, Dengue virus
LGMLQGRGPLR

SEQ ID NO: 47982 - protein, 11 aa, Dengue virus
GMLQGRGPLRL

SEQ ID NO: 47983 - protein, 11 aa, Dengue virus
MLQGRGPLRLF

SEQ ID NO: 47984 - protein, 11 aa, Dengue virus
LQGRGPLRLFM

SEQ ID NO: 47985 - protein, 11 aa, Dengue virus
QGRGPLRLFMA

SEQ ID NO: 47986 - protein, 11 aa, Dengue virus
GRGPLKLFMAF

SEQ ID NO: 47987 - protein, 11 aa, Dengue virus
RGPLKLFMAFV

SEQ ID NO: 47988 - protein, 11 aa, Dengue virus
GPLKLFMAFVA

SEQ ID NO: 47989 - protein, 11 aa, Dengue virus
PLKLFMAFVAF

SEQ ID NO: 47990 - protein, 11 aa, Dengue virus
LKLFMAFVAFL

SEQ ID NO: 47991 - protein, 11 aa, Dengue virus
KLFMAFVAFLR

SEQ ID NO: 47992 - protein, 11 aa, Dengue virus
LFMAFVAFLRF

SEQ ID NO: 47993 - protein, 11 aa, Dengue virus
FMAFVAFLRFL

SEQ ID NO: 47994 - protein, 11 aa, Dengue virus
MAFVAFLRFLT

SEQ ID NO: 47995 - protein, 11 aa, Dengue virus
AFVAFLRFLTI

SEQ ID NO: 47996 - protein, 11 aa, Dengue virus
FVAFLRFLTIP

SEQ ID NO: 47997 - protein, 11 aa, Dengue virus
FLRFLTIPPTV

SEQ ID NO: 47998 - protein, 11 aa, Dengue virus
LRFLTIPPTVG

SEQ ID NO: 47999 - protein, 11 aa, Dengue virus
RFLTIPPTVGI

SEQ ID NO: 48000 - protein, 11 aa, Dengue virus
FLTIPPTVGIL

SEQ ID NO: 48001 - protein, 11 aa, Dengue virus
LTIPPTVGILK

SEQ ID NO: 48002 - protein, 11 aa, Dengue virus
TIPPTVGILKR

SEQ ID NO: 48003 - protein, 11 aa, Dengue virus
IPPTVGILKRW

SEQ ID NO: 48004 - protein, 11 aa, Dengue virus
PPTVGILKRWG

SEQ ID NO: 48005 - protein, 11 aa, Dengue virus
PTVGILKRWGT

SEQ ID NO: 48006 - protein, 11 aa, Dengue virus
TAGILKRWGTV

SEQ ID NO: 48007 - protein, 11 aa, Dengue virus
AGILKRWGTVK

SEQ ID NO: 48008 - protein, 11 aa, Dengue virus
GILKRWGTVKK

SEQ ID NO: 48009 - protein, 11 aa, Dengue virus
ILKRWGTVKKS

SEQ ID NO: 48010 - protein, 11 aa, Dengue virus
LKRWGTVKKSK

SEQ ID NO: 48011 - protein, 11 aa, Dengue virus
KRWGTVKKSKA

SEQ ID NO: 48012 - protein, 11 aa, Dengue virus
RWGTVKKSKAI

SEQ ID NO: 48013 - protein, 11 aa, Dengue virus
WGTVKKSKAIN

SEQ ID NO: 48014 - protein, 11 aa, Dengue virus
GTVKKSKAINV

SEQ ID NO: 48015 - protein, 11 aa, Dengue virus
TVKKSKAINVL

SEQ ID NO: 48016 - protein, 11 aa, Dengue virus
VKKSKAINVLR

SEQ ID NO: 48017 - protein, 11 aa, Dengue virus
KKSKAISVLRG

SEQ ID NO: 48018 - protein, 11 aa, Dengue virus
KSKAISVLRGF

SEQ ID NO: 48019 - protein, 11 aa, Dengue virus
SKAISVLRGFR

SEQ ID NO: 48020 - protein, 11 aa, Dengue virus
KAISVLRGFRK

SEQ ID NO: 48021 - protein, 11 aa, Dengue virus
AISVLRGFRKE

SEQ ID NO: 48022 - protein, 11 aa, Dengue virus
ISVLRGFRKEI

SEQ ID NO: 48023 - protein, 11 aa, Dengue virus
SVLRGFRKEIG

SEQ ID NO: 48024 - protein, 11 aa, Dengue virus
VLRGFRREIGR

SEQ ID NO: 48025 - protein, 11 aa, Dengue virus
LRGFRREIGRM

SEQ ID NO: 48026 - protein, 11 aa, Dengue virus
RGFRREIGRML

SEQ ID NO: 48027 - protein, 11 aa, Dengue virus
GFRREIGRMLN

SEQ ID NO: 48028 - protein, 11 aa, Dengue virus
FRREIGRMLNI

SEQ ID NO: 48029 - protein, 11 aa, Dengue virus
RREIGRMLNIL

SEQ ID NO: 48030 - protein, 11 aa, Dengue virus
REIGRMLNILN

SEQ ID NO: 48031 - protein, 11 aa, Dengue virus
EIGRMLNILNK

SEQ ID NO: 48032 - protein, 11 aa, Dengue virus
IGRMLNILNKR

SEQ ID NO: 48033 - protein, 11 aa, Dengue virus
GRMLNILNKRR

SEQ ID NO: 48034 - protein, 11 aa, Dengue virus
RMLNILNKRRR

SEQ ID NO: 48035 - protein, 11 aa, Dengue virus
MLNILNRRRRS

SEQ ID NO: 48036 - protein, 11 aa, Dengue virus
LNILNRRRRSA

SEQ ID NO: 48037 - protein, 11 aa, Dengue virus
NILNRRRRSAG

SEQ ID NO: 48038 - protein, 11 aa, Dengue virus
IPTVMAFHLTT

SEQ ID NO: 48039 - protein, 11 aa, Dengue virus
PTVMAFHLTTR

SEQ ID NO: 48040 - protein, 11 aa, Dengue virus
TVMAFHLTTRN

SEQ ID NO: 48041 - protein, 11 aa, Dengue virus
VMAFHLTTRNG

SEQ ID NO: 48042 - protein, 11 aa, Dengue virus
VAFHLTTRNGE

SEQ ID NO: 48043 - protein, 11 aa, Dengue virus
TRNGEPHMIVS

SEQ ID NO: 48044 - protein, 11 aa, Dengue virus
RNGEPHMIVGI

SEQ ID NO: 48045 - protein, 11 aa, Dengue virus
GEPHMIVGIQE

SEQ ID NO: 48046 - protein, 11 aa, Dengue virus
EPHMIVGIQEK

SEQ ID NO: 48047 - protein, 11 aa, Dengue virus
PHMIVGIQEKG

SEQ ID NO: 48048 - protein, 11 aa, Dengue virus
HMIVGIQEKGK

SEQ ID NO: 48049 - protein, 11 aa, Dengue virus
MIVGIQEKGKS

SEQ ID NO: 48050 - protein, 11 aa, Dengue virus
IVGIQEKGKSL

SEQ ID NO: 48051 - protein, 11 aa, Dengue virus
VGIQEKGKSLL

SEQ ID NO: 48052 - protein, 11 aa, Dengue virus
GIQEKGKSLLF

SEQ ID NO: 48053 - protein, 11 aa, Dengue virus
IQEKGKSLLFK

SEQ ID NO: 48054 - protein, 11 aa, Dengue virus
NEKGKSLLFKT

SEQ ID NO: 48055 - protein, 11 aa, Dengue virus
EKGKSLLFKTK

SEQ ID NO: 48056 - protein, 11 aa, Dengue virus
KGKSLLFKTEN

SEQ ID NO: 48057 - protein, 11 aa, Dengue virus
GKSLLFKTENG

SEQ ID NO: 48058 - protein, 11 aa, Dengue virus
GVNMCTLMAMD

SEQ ID NO: 48059 - protein, 11 aa, Dengue virus
VNMCTLMAMDL

SEQ ID NO: 48060 - protein, 11 aa, Dengue virus
NMCTLMAMDLG

SEQ ID NO: 48061 - protein, 11 aa, Dengue virus
MCTLMAMDLGE

SEQ ID NO: 48062 - protein, 11 aa, Dengue virus
CTLMAMDLGEL

SEQ ID NO: 48063 - protein, 11 aa, Dengue virus
TLMAMDLGELC

SEQ ID NO: 48064 - protein, 11 aa, Dengue virus
LMAMDLGELCE

SEQ ID NO: 48065 - protein, 11 aa, Dengue virus
MAMDLGELCED

SEQ ID NO: 48066 - protein, 11 aa, Dengue virus
AMDLGELCEDT

SEQ ID NO: 48067 - protein, 11 aa, Dengue virus
MDLGELCEDTI

SEQ ID NO: 48068 - protein, 11 aa, Dengue virus
DLGELCEDTVT

SEQ ID NO: 48069 - protein, 11 aa, Dengue virus
LGELCEDTVTY

SEQ ID NO: 48070 - protein, 11 aa, Dengue virus
GELCEDTITYN

SEQ ID NO: 48071 - protein, 11 aa, Dengue virus
ELCEDTITYNC

SEQ ID NO: 48072 - protein, 11 aa, Dengue virus
LCEDTITYNCP

SEQ ID NO: 48073 - protein, 11 aa, Dengue virus
CEDTITYNCPL

SEQ ID NO: 48074 - protein, 11 aa, Dengue virus
EDTITYNCPLL

SEQ ID NO: 48075 - protein, 11 aa, Dengue virus
TYNCPLLRQNE

SEQ ID NO: 48076 - protein, 11 aa, Dengue virus
YNCPLLRQNEP

SEQ ID NO: 48077 - protein, 11 aa, Dengue virus
NCPLLRQNEPE

SEQ ID NO: 48078 - protein, 11 aa, Dengue virus
CPFLKQNEPED

SEQ ID NO: 48079 - protein, 11 aa, Dengue virus
PFLKQNEPEDI

SEQ ID NO: 48080 - protein, 11 aa, Dengue virus
FLKQNEPEDID

SEQ ID NO: 48081 - protein, 11 aa, Dengue virus
LKQNEPEDIDC

SEQ ID NO: 48082 - protein, 11 aa, Dengue virus
KQNEPEDIDCW

SEQ ID NO: 48083 - protein, 11 aa, Dengue virus
DCWCNSTSTWI

SEQ ID NO: 48084 - protein, 11 aa, Dengue virus
CWCNSTSTWIT

SEQ ID NO: 48085 - protein, 11 aa, Dengue virus
WCNSTSTWITY

SEQ ID NO: 48086 - protein, 11 aa, Dengue virus
CNSTSTWITYG

SEQ ID NO: 48087 - protein, 11 aa, Dengue virus
NSTSTWITYGT

SEQ ID NO: 48088 - protein, 11 aa, Dengue virus
STSTWITYGTC

SEQ ID NO: 48089 - protein, 11 aa, Dengue virus
TSTWVTYGTCS

SEQ ID NO: 48090 - protein, 11 aa, Dengue virus
ATGEHRREKRS

SEQ ID NO: 48091 - protein, 11 aa, Dengue virus
MGEHRREKRSV

SEQ ID NO: 48092 - protein, 11 aa, Dengue virus
KRSVALVPHVR

SEQ ID NO: 48093 - protein, 11 aa, Dengue virus
RSVALVPHVRM

SEQ ID NO: 48094 - protein, 11 aa, Dengue virus
SVALVPHVRMG

SEQ ID NO: 48095 - protein, 11 aa, Dengue virus
VALVPHVRMGL

SEQ ID NO: 48096 - protein, 11 aa, Dengue virus
ALVPHVRMGLE

SEQ ID NO: 48097 - protein, 11 aa, Dengue virus
LVPHVRMGLET

SEQ ID NO: 48098 - protein, 11 aa, Dengue virus
VPHVRMGLETR

SEQ ID NO: 48099 - protein, 11 aa, Dengue virus
TWMSSEGAWKQ

SEQ ID NO: 48100 - protein, 11 aa, Dengue virus
WMSSEGAWKHA

SEQ ID NO: 48101 - protein, 11 aa, Dengue virus
MSSEGAWKHAQ

SEQ ID NO: 48102 - protein, 11 aa, Dengue virus
SSEGAWKHAQR

SEQ ID NO: 48103 - protein, 11 aa, Dengue virus
SEGAWKHAQRI

SEQ ID NO: 48104 - protein, 11 aa, Dengue virus
EGAWKHAQRIE

SEQ ID NO: 48105 - protein, 11 aa, Dengue virus
GAWKHAQRIET

SEQ ID NO: 48106 - protein, 11 aa, Dengue virus
AWKHAQRIETW

SEQ ID NO: 48107 - protein, 11 aa, Dengue virus
WKHAQRIETWI

SEQ ID NO: 48108 - protein, 11 aa, Dengue virus
KHAQRIETWIL

SEQ ID NO: 48109 - protein, 11 aa, Dengue virus
HAQRIETWILR

SEQ ID NO: 48110 - protein, 11 aa, Dengue virus
AQRIETWILRH

SEQ ID NO: 48111 - protein, 11 aa, Dengue virus
QRIETWVLRHP

SEQ ID NO: 48112 - protein, 11 aa, Dengue virus
RIETWVLRHPG

SEQ ID NO: 48113 - protein, 11 aa, Dengue virus
IETWVLRHPGF

SEQ ID NO: 48114 - protein, 11 aa, Dengue virus
ETWVLRHPGFT

SEQ ID NO: 48115 - protein, 11 aa, Dengue virus
LRHPGFTMMAA

SEQ ID NO: 48116 - protein, 11 aa, Dengue virus
MAAILAYTVGT

SEQ ID NO: 48117 - protein, 11 aa, Dengue virus
AAILAYTVGTT

SEQ ID NO: 48118 - protein, 11 aa, Dengue virus
AILAYTIGTTY

SEQ ID NO: 48119 - protein, 11 aa, Dengue virus
ILAYTIGTTYF

SEQ ID NO: 48120 - protein, 11 aa, Dengue virus
LAYTIGTTYFQ

SEQ ID NO: 48121 - protein, 11 aa, Dengue virus
AYTIGTTYFQR

SEQ ID NO: 48122 - protein, 11 aa, Dengue virus
GTTHFQRVLIF

SEQ ID NO: 48123 - protein, 11 aa, Dengue virus
TTHFQRVLIFI

SEQ ID NO: 48124 - protein, 11 aa, Dengue virus
THFQRVLIFIL

SEQ ID NO: 48125 - protein, 11 aa, Dengue virus
HFQRVLIFILL

SEQ ID NO: 48126 - protein, 11 aa, Dengue virus
FQRVLIFILLT

SEQ ID NO: 48127 - protein, 11 aa, Dengue virus
LIFILLAAVAP

SEQ ID NO: 48128 - protein, 11 aa, Dengue virus
IFILLAAVAPS

SEQ ID NO: 48129 - protein, 11 aa, Dengue virus
FILLAAVAPSM

SEQ ID NO: 48130 - protein, 11 aa, Dengue virus
LLAAVAPSMTM

SEQ ID NO: 48131 - protein, 11 aa, Dengue virus
LAAVAPSMTMR

SEQ ID NO: 48132 - protein, 11 aa, Dengue virus
AAVAPSMTMRC

SEQ ID NO: 48133 - protein, 11 aa, Dengue virus
AVTPSMTMRCI

SEQ ID NO: 48134 - protein, 11 aa, Dengue virus
VTPSMTMRCIG

SEQ ID NO: 48135 - protein, 11 aa, Dengue virus
TPSMTMRCIGM

SEQ ID NO: 48136 - protein, 11 aa, Dengue virus
PSMTMRCIGMS

SEQ ID NO: 48137 - protein, 11 aa, Dengue virus
SMTMRCIGMSN

SEQ ID NO: 48138 - protein, 11 aa, Dengue virus
MTMRCIGMSNR

SEQ ID NO: 48139 - protein, 11 aa, Dengue virus
TMRCIGMSNRD

SEQ ID NO: 48140 - protein, 11 aa, Dengue virus
MRCIGMSNRDF

SEQ ID NO: 48141 - protein, 11 aa, Dengue virus
RCIGMSNRDFV

SEQ ID NO: 48142 - protein, 11 aa, Dengue virus
CIGMSNRDFVE

SEQ ID NO: 48143 - protein, 11 aa, Dengue virus
IGMSNRDFVEG

SEQ ID NO: 48144 - protein, 11 aa, Dengue virus
GMSNRDFVEGV

SEQ ID NO: 48145 - protein, 11 aa, Dengue virus
MSNRDFVEGVS

SEQ ID NO: 48146 - protein, 11 aa, Dengue virus
KNKPTLDFELT

SEQ ID NO: 48147 - protein, 11 aa, Dengue virus
NKPTLDFELTK

SEQ ID NO: 48148 - protein, 11 aa, Dengue virus
KPTLDFELTKT

SEQ ID NO: 48149 - protein, 11 aa, Dengue virus
PTLDFELTKTE

SEQ ID NO: 48150 - protein, 11 aa, Dengue virus
TLDFELTKTEA

SEQ ID NO: 48151 - protein, 11 aa, Dengue virus
LDFELTKTEAK

SEQ ID NO: 48152 - protein, 11 aa, Dengue virus
DFELIKTEAKH

SEQ ID NO: 48153 - protein, 11 aa, Dengue virus
KTEAKHPATLR

SEQ ID NO: 48154 - protein, 11 aa, Dengue virus
TEAKHPATLRK

SEQ ID NO: 48155 - protein, 11 aa, Dengue virus
EAKHPATLRKY

SEQ ID NO: 48156 - protein, 11 aa, Dengue virus
AKHPATLRKYC

SEQ ID NO: 48157 - protein, 11 aa, Dengue virus
PATLRKFCIEA

SEQ ID NO: 48158 - protein, 11 aa, Dengue virus
ATLRKFCIEAK

SEQ ID NO: 48159 - protein, 11 aa, Dengue virus
TLRKFCIEAKL

SEQ ID NO: 48160 - protein, 11 aa, Dengue virus
LRKFCIEAKLT

SEQ ID NO: 48161 - protein, 11 aa, Dengue virus
RKFCIEAKLTN

SEQ ID NO: 48162 - protein, 11 aa, Dengue virus
KFCIEAKLTNT

SEQ ID NO: 48163 - protein, 11 aa, Dengue virus
FCIEAKLTNTT

SEQ ID NO: 48164 - protein, 11 aa, Dengue virus
CVEAKLTNTTT

SEQ ID NO: 48165 - protein, 11 aa, Dengue virus
IEAKLTNTTTA

SEQ ID NO: 48166 - protein, 11 aa, Dengue virus
EAKLTNTTTAS

SEQ ID NO: 48167 - protein, 11 aa, Dengue virus
AKLTNTTTASR

SEQ ID NO: 48168 - protein, 11 aa, Dengue virus
KLTNTTTASRC

SEQ ID NO: 48169 - protein, 11 aa, Dengue virus
LTNTTTASRCP

SEQ ID NO: 48170 - protein, 11 aa, Dengue virus
TNTTTASRCPT

SEQ ID NO: 48171 - protein, 11 aa, Dengue virus
NTTTASRCPTQ

SEQ ID NO: 48172 - protein, 11 aa, Dengue virus
TTTASRCPTQG

SEQ ID NO: 48173 - protein, 11 aa, Dengue virus
TTASRCPTQGE

SEQ ID NO: 48174 - protein, 11 aa, Dengue virus
TASRCPTQGEP

SEQ ID NO: 48175 - protein, 11 aa, Dengue virus
ASRCPTQGEPS

SEQ ID NO: 48176 - protein, 11 aa, Dengue virus
SRCPTQGEPTL

SEQ ID NO: 48177 - protein, 11 aa, Dengue virus
RCPTQGEPSLK

SEQ ID NO: 48178 - protein, 11 aa, Dengue virus
CPTQGEPSLKE

SEQ ID NO: 48179 - protein, 11 aa, Dengue virus
PTQGEPSLKEE

SEQ ID NO: 48180 - protein, 11 aa, Dengue virus
TQGEPSLKEEQ

SEQ ID NO: 48181 - protein, 11 aa, Dengue virus
QGEPSLKEEQD

SEQ ID NO: 48182 - protein, 11 aa, Dengue virus
GEPSLKEEQDK

SEQ ID NO: 48183 - protein, 11 aa, Dengue virus
EPSLKEEQDKR

SEQ ID NO: 48184 - protein, 11 aa, Dengue virus
PSLKEEQDKRF

SEQ ID NO: 48185 - protein, 11 aa, Dengue virus
EEQDKRFICKH

SEQ ID NO: 48186 - protein, 11 aa, Dengue virus
EQDKRFICKHS

SEQ ID NO: 48187 - protein, 11 aa, Dengue virus
QDKRFICKHSM

SEQ ID NO: 48188 - protein, 11 aa, Dengue virus
DKRFICKHSMV

SEQ ID NO: 48189 - protein, 11 aa, Dengue virus
KRFICKHSMVD

SEQ ID NO: 48190 - protein, 11 aa, Dengue virus
RFICKHSMVDR

SEQ ID NO: 48191 - protein, 11 aa, Dengue virus
FICKHSMVDRG

SEQ ID NO: 48192 - protein, 11 aa, Dengue virus
ICKHSMVDRGW

SEQ ID NO: 48193 - protein, 11 aa, Dengue virus
CRHSMVDRGWG

SEQ ID NO: 48194 - protein, 11 aa, Dengue virus
RHSMVDRGWGN

SEQ ID NO: 48195 - protein, 11 aa, Dengue virus
FGKGGIVTCAK

SEQ ID NO: 48196 - protein, 11 aa, Dengue virus
GKGGIVTCAKF

SEQ ID NO: 48197 - protein, 11 aa, Dengue virus
KGGIVTCAMFR

SEQ ID NO: 48198 - protein, 11 aa, Dengue virus
GGIVTCAMFRC

SEQ ID NO: 48199 - protein, 11 aa, Dengue virus
GIVTCAMFRCK

SEQ ID NO: 48200 - protein, 11 aa, Dengue virus
IVTCAMFRCKK

SEQ ID NO: 48201 - protein, 11 aa, Dengue virus
VTCAMFRCKKN

SEQ ID NO: 48202 - protein, 11 aa, Dengue virus
TCAMFRCKKNM

SEQ ID NO: 48203 - protein, 11 aa, Dengue virus
AMFRCKKNMEG

SEQ ID NO: 48204 - protein, 11 aa, Dengue virus
CKKNMEGKVVQ

SEQ ID NO: 48205 - protein, 11 aa, Dengue virus
KKNMEGKVVQP

SEQ ID NO: 48206 - protein, 11 aa, Dengue virus
KNMEGKVVQPE

SEQ ID NO: 48207 - protein, 11 aa, Dengue virus
NMEGKVVQPEN

SEQ ID NO: 48208 - protein, 11 aa, Dengue virus
MEGKVVQPENL

SEQ ID NO: 48209 - protein, 11 aa, Dengue virus
EGKVVQPENLE

SEQ ID NO: 48210 - protein, 11 aa, Dengue virus
GKVVQPENLEY

SEQ ID NO: 48211 - protein, 11 aa, Dengue virus
KVVQPENLEYT

SEQ ID NO: 48212 - protein, 11 aa, Dengue virus
VVQPENLEYTI

SEQ ID NO: 48213 - protein, 11 aa, Dengue virus
VLPENLEYTIV

SEQ ID NO: 48214 - protein, 11 aa, Dengue virus
QPENLEYTIVV

SEQ ID NO: 48215 - protein, 11 aa, Dengue virus
PENLEYTIVVT

SEQ ID NO: 48216 - protein, 11 aa, Dengue virus
ENLEYTIVVTP

SEQ ID NO: 48217 - protein, 11 aa, Dengue virus
NLEYTIVVTPH

SEQ ID NO: 48218 - protein, 11 aa, Dengue virus
LEYTIVVTPHS

SEQ ID NO: 48219 - protein, 11 aa, Dengue virus
EYTIVVTPHSG

SEQ ID NO: 48220 - protein, 11 aa, Dengue virus
YTIVVTPHSGE

SEQ ID NO: 48221 - protein, 11 aa, Dengue virus
TIVVTPHSGEE

SEQ ID NO: 48222 - protein, 11 aa, Dengue virus
IVVTPHSGEEH

SEQ ID NO: 48223 - protein, 11 aa, Dengue virus
VVTPHSGEEHA

SEQ ID NO: 48224 - protein, 11 aa, Dengue virus
VTPHSGEEHAV

SEQ ID NO: 48225 - protein, 11 aa, Dengue virus
TPHSGEENAVG

SEQ ID NO: 48226 - protein, 11 aa, Dengue virus
PHSGEENAVGN

SEQ ID NO: 48227 - protein, 11 aa, Dengue virus
HSGEENAVGND

SEQ ID NO: 48228 - protein, 11 aa, Dengue virus
SGEENAVGNDT

SEQ ID NO: 48229 - protein, 11 aa, Dengue virus
GEENAVGNDTG

SEQ ID NO: 48230 - protein, 11 aa, Dengue virus
EENAVGNDTGK

SEQ ID NO: 48231 - protein, 11 aa, Dengue virus
ENAVGNDTGKH

SEQ ID NO: 48232 - protein, 11 aa, Dengue virus
NAVGNDTGKHG

SEQ ID NO: 48233 - protein, 11 aa, Dengue virus
AVGNDTGKHGQ

SEQ ID NO: 48234 - protein, 11 aa, Dengue virus
VGNDTGKHGQE

SEQ ID NO: 48235 - protein, 11 aa, Dengue virus
GNDTGKHGQEI

SEQ ID NO: 48236 - protein, 11 aa, Dengue virus
NDTGKHGQEIK

SEQ ID NO: 48237 - protein, 11 aa, Dengue virus
DTGKHGKEIKV

SEQ ID NO: 48238 - protein, 11 aa, Dengue virus
TGKHGKEIKVT

SEQ ID NO: 48239 - protein, 11 aa, Dengue virus
GKHGKEIKVTP

SEQ ID NO: 48240 - protein, 11 aa, Dengue virus
KHGKEIKVTPQ

SEQ ID NO: 48241 - protein, 11 aa, Dengue virus
HGKEIKVTPQS

SEQ ID NO: 48242 - protein, 11 aa, Dengue virus
EAELTDYGTIT

SEQ ID NO: 48243 - protein, 11 aa, Dengue virus
AELTDYGTITM

SEQ ID NO: 48244 - protein, 11 aa, Dengue virus
ELTDYGTITME

SEQ ID NO: 48245 - protein, 11 aa, Dengue virus
LTDYGTITMEC

SEQ ID NO: 48246 - protein, 11 aa, Dengue virus
TDYGTITMECS

SEQ ID NO: 48247 - protein, 11 aa, Dengue virus
DYGTITMECSP

SEQ ID NO: 48248 - protein, 11 aa, Dengue virus
YGTITMECSPR

SEQ ID NO: 48249 - protein, 11 aa, Dengue virus
GTITMECSPRT

SEQ ID NO: 48250 - protein, 11 aa, Dengue virus
TITMECSPRTG

SEQ ID NO: 48251 - protein, 11 aa, Dengue virus
ITMECSPRTGL

SEQ ID NO: 48252 - protein, 11 aa, Dengue virus
TMECSPRTSLD

SEQ ID NO: 48253 - protein, 11 aa, Dengue virus
MECSPRTSLDF

SEQ ID NO: 48254 - protein, 11 aa, Dengue virus
ECSPRTSLDFN

SEQ ID NO: 48255 - protein, 11 aa, Dengue virus
CSPRTSLDFNE

SEQ ID NO: 48256 - protein, 11 aa, Dengue virus
SPRTSLDFNEM

SEQ ID NO: 48257 - protein, 11 aa, Dengue virus
PRTSLDFNEMV

SEQ ID NO: 48258 - protein, 11 aa, Dengue virus
RTSLDFNEMVL

SEQ ID NO: 48259 - protein, 11 aa, Dengue virus
TSLDFNEMVLL

SEQ ID NO: 48260 - protein, 11 aa, Dengue virus
SLDFNEMVLLQ

SEQ ID NO: 48261 - protein, 11 aa, Dengue virus
FDFNEMVLLQM

SEQ ID NO: 48262 - protein, 11 aa, Dengue virus
DFNEMVLLQMK

SEQ ID NO: 48263 - protein, 11 aa, Dengue virus
MENKAWLVHRQ

SEQ ID NO: 48264 - protein, 11 aa, Dengue virus
ENKAWLVHRQW

SEQ ID NO: 48265 - protein, 11 aa, Dengue virus
NKAWLVHRQWF

SEQ ID NO: 48266 - protein, 11 aa, Dengue virus
LPLPWLPGADK

SEQ ID NO: 48267 - protein, 11 aa, Dengue virus
PLPWLPGADKQ

SEQ ID NO: 48268 - protein, 11 aa, Dengue virus
LPWLPGADKQE

SEQ ID NO: 48269 - protein, 11 aa, Dengue virus
PWLPGADKQES

SEQ ID NO: 48270 - protein, 11 aa, Dengue virus
WLPGADKQESN

SEQ ID NO: 48271 - protein, 11 aa, Dengue virus
LPGADKQESNW

SEQ ID NO: 48272 - protein, 11 aa, Dengue virus
PGADKQESNWI

SEQ ID NO: 48273 - protein, 11 aa, Dengue virus
GADKQESNWIQ

SEQ ID NO: 48274 - protein, 11 aa, Dengue virus
ADKQESNWIQK

SEQ ID NO: 48275 - protein, 11 aa, Dengue virus
DKQESNWIQKE

SEQ ID NO: 48276 - protein, 11 aa, Dengue virus
QESNWIQKETL

SEQ ID NO: 48277 - protein, 11 aa, Dengue virus
ESNWIQKETLV

SEQ ID NO: 48278 - protein, 11 aa, Dengue virus
SNWIQKEMLVT

SEQ ID NO: 48279 - protein, 11 aa, Dengue virus
NWIQKEMLVTF

SEQ ID NO: 48280 - protein, 11 aa, Dengue virus
WIQKEMLVTFK

SEQ ID NO: 48281 - protein, 11 aa, Dengue virus
IQKEMLVTFKN

SEQ ID NO: 48282 - protein, 11 aa, Dengue virus
QKEMLVTFKNP

SEQ ID NO: 48283 - protein, 11 aa, Dengue virus
KEMLVTFKNPH

SEQ ID NO: 48284 - protein, 11 aa, Dengue virus
EMLVTFKNPHA

SEQ ID NO: 48285 - protein, 11 aa, Dengue virus
MLVTFKNPHAK

SEQ ID NO: 48286 - protein, 11 aa, Dengue virus
LVTFKNPHAKR

SEQ ID NO: 48287 - protein, 11 aa, Dengue virus
VTFKNPHAKRQ

SEQ ID NO: 48288 - protein, 11 aa, Dengue virus
TFKNPHAKRQD

SEQ ID NO: 48289 - protein, 11 aa, Dengue virus
FKNPHAKRQDV

SEQ ID NO: 48290 - protein, 11 aa, Dengue virus
KNPHAKRQDVV

SEQ ID NO: 48291 - protein, 11 aa, Dengue virus
NPHAKRQDVVV

SEQ ID NO: 48292 - protein, 11 aa, Dengue virus
PHAKRQDVVVL

SEQ ID NO: 48293 - protein, 11 aa, Dengue virus
HAKRQDVVVLG

SEQ ID NO: 48294 - protein, 11 aa, Dengue virus
AKRQDVVVLGS

SEQ ID NO: 48295 - protein, 11 aa, Dengue virus
KRQDVVVLGSQ

SEQ ID NO: 48296 - protein, 11 aa, Dengue virus
RQDVVVLGSQE

SEQ ID NO: 48297 - protein, 11 aa, Dengue virus
LTGATEIQMSL

SEQ ID NO: 48298 - protein, 11 aa, Dengue virus
TGATEIQMSLG

SEQ ID NO: 48299 - protein, 11 aa, Dengue virus
GATEIQMSLGN

SEQ ID NO: 48300 - protein, 11 aa, Dengue virus
ATEIQMSLGNI

SEQ ID NO: 48301 - protein, 11 aa, Dengue virus
TEIQMSLGNIL

SEQ ID NO: 48302 - protein, 11 aa, Dengue virus
EIQMSLGNILF

SEQ ID NO: 48303 - protein, 11 aa, Dengue virus
IQMSLGNILFM

SEQ ID NO: 48304 - protein, 11 aa, Dengue virus
QMSLGNILFMG

SEQ ID NO: 48305 - protein, 11 aa, Dengue virus
MSLGNILFMGH

SEQ ID NO: 48306 - protein, 11 aa, Dengue virus
SLGNILFMGHL

SEQ ID NO: 48307 - protein, 11 aa, Dengue virus
LGNILFMGHLK

SEQ ID NO: 48308 - protein, 11 aa, Dengue virus
GNILFMGHLKC

SEQ ID NO: 48309 - protein, 11 aa, Dengue virus
NILFMGHLKCR

SEQ ID NO: 48310 - protein, 11 aa, Dengue virus
ILFMGHLKCRL

SEQ ID NO: 48311 - protein, 11 aa, Dengue virus
LFMGHLKCRLR

SEQ ID NO: 48312 - protein, 11 aa, Dengue virus
FMGHLKCRLRM

SEQ ID NO: 48313 - protein, 11 aa, Dengue virus
MGHLKCRLRMD

SEQ ID NO: 48314 - protein, 11 aa, Dengue virus
SYSMCTGKFKV

SEQ ID NO: 48315 - protein, 11 aa, Dengue virus
YSMCTGKFKVV

SEQ ID NO: 48316 - protein, 11 aa, Dengue virus
SMCTGKFKVVK

SEQ ID NO: 48317 - protein, 11 aa, Dengue virus
MCTGKFKVVKE

SEQ ID NO: 48318 - protein, 11 aa, Dengue virus
CTGKFKVVKEI

SEQ ID NO: 48319 - protein, 11 aa, Dengue virus
TGKFKVVKEIA

SEQ ID NO: 48320 - protein, 11 aa, Dengue virus
GKFKVVKEIAE

SEQ ID NO: 48321 - protein, 11 aa, Dengue virus
KFKVVKEIAET

SEQ ID NO: 48322 - protein, 11 aa, Dengue virus
FKVVKEIAETQ

SEQ ID NO: 48323 - protein, 11 aa, Dengue virus
KVVKEIAETQH

SEQ ID NO: 48324 - protein, 11 aa, Dengue virus
VVKEIAETQHG

SEQ ID NO: 48325 - protein, 11 aa, Dengue virus
IAETQHGTIVV

SEQ ID NO: 48326 - protein, 11 aa, Dengue virus
AETQHGTIVVR

SEQ ID NO: 48327 - protein, 11 aa, Dengue virus
ETQHGTIVIRI

SEQ ID NO: 48328 - protein, 11 aa, Dengue virus
TQHGTIVIRIQ

SEQ ID NO: 48329 - protein, 11 aa, Dengue virus
QHGTIVIRIQY

SEQ ID NO: 48330 - protein, 11 aa, Dengue virus
HGTIVIRIQYE

SEQ ID NO: 48331 - protein, 11 aa, Dengue virus
GTIVIRIQYEG

SEQ ID NO: 48332 - protein, 11 aa, Dengue virus
TIVIRIQYEGD

SEQ ID NO: 48333 - protein, 11 aa, Dengue virus
VIRVQYEGDDS

SEQ ID NO: 48334 - protein, 11 aa, Dengue virus
IRVQYEGDDSP

SEQ ID NO: 48335 - protein, 11 aa, Dengue virus
RVQYEGDDSPC

SEQ ID NO: 48336 - protein, 11 aa, Dengue virus
VQYEGDDSPCK

SEQ ID NO: 48337 - protein, 11 aa, Dengue virus
QYEGDDSPCKI

SEQ ID NO: 48338 - protein, 11 aa, Dengue virus
YEGDDSPCKIP

SEQ ID NO: 48339 - protein, 11 aa, Dengue virus
EGDDSPCKIPF

SEQ ID NO: 48340 - protein, 11 aa, Dengue virus
GDDSPCKIPFE

SEQ ID NO: 48341 - protein, 11 aa, Dengue virus
DDSPCKIPFEI

SEQ ID NO: 48342 - protein, 11 aa, Dengue virus
SPCKIPFEITD

SEQ ID NO: 48343 - protein, 11 aa, Dengue virus
PCKIPFEITDL

SEQ ID NO: 48344 - protein, 11 aa, Dengue virus
CKIPFEITDLE

SEQ ID NO: 48345 - protein, 11 aa, Dengue virus
KIPFEITDLEK

SEQ ID NO: 48346 - protein, 11 aa, Dengue virus
IPFEITDLEKR

SEQ ID NO: 48347 - protein, 11 aa, Dengue virus
PFEIMDLEKRY

SEQ ID NO: 48348 - protein, 11 aa, Dengue virus
DLEKRYVLGRL

SEQ ID NO: 48349 - protein, 11 aa, Dengue virus
LEKRYVLGRLI

SEQ ID NO: 48350 - protein, 11 aa, Dengue virus
EKRYVLGRLIT

SEQ ID NO: 48351 - protein, 11 aa, Dengue virus
KRYVLGRLITV

SEQ ID NO: 48352 - protein, 11 aa, Dengue virus
RYVLGRLITVN

SEQ ID NO: 48353 - protein, 11 aa, Dengue virus
YVLGRLITVNP

SEQ ID NO: 48354 - protein, 11 aa, Dengue virus
ILGRLITVNPI

SEQ ID NO: 48355 - protein, 11 aa, Dengue virus
LGRLITVNPII

SEQ ID NO: 48356 - protein, 11 aa, Dengue virus
GRLITVNPIVI

SEQ ID NO: 48357 - protein, 11 aa, Dengue virus
EKDSPINIEAE

SEQ ID NO: 48358 - protein, 11 aa, Dengue virus
KDSPINIEAEP

SEQ ID NO: 48359 - protein, 11 aa, Dengue virus
DSPINIEAEPP

SEQ ID NO: 48360 - protein, 11 aa, Dengue virus
SPINIEAEPPF

SEQ ID NO: 48361 - protein, 11 aa, Dengue virus
PINIEAEPPFG

SEQ ID NO: 48362 - protein, 11 aa, Dengue virus
INIEAEPPFGD

SEQ ID NO: 48363 - protein, 11 aa, Dengue virus
AEPPFGDSYIV

SEQ ID NO: 48364 - protein, 11 aa, Dengue virus
EPPFGDSYIIV

SEQ ID NO: 48365 - protein, 11 aa, Dengue virus
PPFGDSYIIVG

SEQ ID NO: 48366 - protein, 11 aa, Dengue virus
PFGDSYIIVGV

SEQ ID NO: 48367 - protein, 11 aa, Dengue virus
FGDSYIIVGVE

SEQ ID NO: 48368 - protein, 11 aa, Dengue virus
GDSYIIVGVEP

SEQ ID NO: 48369 - protein, 11 aa, Dengue virus
DSYIIVGVEPG

SEQ ID NO: 48370 - protein, 11 aa, Dengue virus
SYIIVGVEPGQ

SEQ ID NO: 48371 - protein, 11 aa, Dengue virus
YIIVGVEPGQL

SEQ ID NO: 48372 - protein, 11 aa, Dengue virus
IIVGVEPGQLK

SEQ ID NO: 48373 - protein, 11 aa, Dengue virus
IVGVEPGQLKL

SEQ ID NO: 48374 - protein, 11 aa, Dengue virus
IGVEPGQLKLS

SEQ ID NO: 48375 - protein, 11 aa, Dengue virus
GVEPGQLKLSW

SEQ ID NO: 48376 - protein, 11 aa, Dengue virus
VEPGQLKLSWF

SEQ ID NO: 48377 - protein, 11 aa, Dengue virus
EPGQLKLSWFK

SEQ ID NO: 48378 - protein, 11 aa, Dengue virus
PGQLKLSWFKK

SEQ ID NO: 48379 - protein, 11 aa, Dengue virus
GQLKLSWFKKG

SEQ ID NO: 48380 - protein, 11 aa, Dengue virus
QLKLSWFKKGS

SEQ ID NO: 48381 - protein, 11 aa, Dengue virus
LKLSWFKKGSS

SEQ ID NO: 48382 - protein, 11 aa, Dengue virus
KLSWFKKGSSI

SEQ ID NO: 48383 - protein, 11 aa, Dengue virus
LSWFKKGSSIG

SEQ ID NO: 48384 - protein, 11 aa, Dengue virus
SWFKKGSSIGQ

SEQ ID NO: 48385 - protein, 11 aa, Dengue virus
FKKGSSIGQMI

SEQ ID NO: 48386 - protein, 11 aa, Dengue virus
KKGSSIGQMIE

SEQ ID NO: 48387 - protein, 11 aa, Dengue virus
KGSSIGQMIET

SEQ ID NO: 48388 - protein, 11 aa, Dengue virus
GSSIGQMIETT

SEQ ID NO: 48389 - protein, 11 aa, Dengue virus
SSIGQMIETTM

SEQ ID NO: 48390 - protein, 11 aa, Dengue virus
SIGQMIETTMR

SEQ ID NO: 48391 - protein, 11 aa, Dengue virus
IGQMIETTMRG

SEQ ID NO: 48392 - protein, 11 aa, Dengue virus
GQMIETTMRGA

SEQ ID NO: 48393 - protein, 11 aa, Dengue virus
QMIETTMRGAK

SEQ ID NO: 48394 - protein, 11 aa, Dengue virus
MIETTMRGAKR

SEQ ID NO: 48395 - protein, 11 aa, Dengue virus
IETTMRGAKRM

SEQ ID NO: 48396 - protein, 11 aa, Dengue virus
LGDTAWDFGSI

SEQ ID NO: 48397 - protein, 11 aa, Dengue virus
GDTAWDFGSIG

SEQ ID NO: 48398 - protein, 11 aa, Dengue virus
DTAWDFGSIGG

SEQ ID NO: 48399 - protein, 11 aa, Dengue virus
TAWDFGSIGGV

SEQ ID NO: 48400 - protein, 11 aa, Dengue virus
AWDFGSIGGVF

SEQ ID NO: 48401 - protein, 11 aa, Dengue virus
WDFGSIGGVFT

SEQ ID NO: 48402 - protein, 11 aa, Dengue virus
DFGSIGGVFTS

SEQ ID NO: 48403 - protein, 11 aa, Dengue virus
FGSIGGVFTSV

SEQ ID NO: 48404 - protein, 11 aa, Dengue virus
GSIGGVFTSVG

SEQ ID NO: 48405 - protein, 11 aa, Dengue virus
SIGGVFTSVGK

SEQ ID NO: 48406 - protein, 11 aa, Dengue virus
IGGVFTSVGKA

SEQ ID NO: 48407 - protein, 11 aa, Dengue virus
GGVFTSVGKAL

SEQ ID NO: 48408 - protein, 11 aa, Dengue virus
GVFTSVGKALH

SEQ ID NO: 48409 - protein, 11 aa, Dengue virus
VFTSVGKALHQ

SEQ ID NO: 48410 - protein, 11 aa, Dengue virus
FTSVGKALHQV

SEQ ID NO: 48411 - protein, 11 aa, Dengue virus
TSVGKALHQVF

SEQ ID NO: 48412 - protein, 11 aa, Dengue virus
SVGKALHQVFG

SEQ ID NO: 48413 - protein, 11 aa, Dengue virus
VGKALHQVFGA

SEQ ID NO: 48414 - protein, 11 aa, Dengue virus
HQVFGAIYGVA

SEQ ID NO: 48415 - protein, 11 aa, Dengue virus
QVFGAIYGVAF

SEQ ID NO: 48416 - protein, 11 aa, Dengue virus
VFGAIYGVAFS

SEQ ID NO: 48417 - protein, 11 aa, Dengue virus
FGAIYGVAFSG

SEQ ID NO: 48418 - protein, 11 aa, Dengue virus
GAIYGVAFSGV

SEQ ID NO: 48419 - protein, 11 aa, Dengue virus
AIYGVAFSGVS

SEQ ID NO: 48420 - protein, 11 aa, Dengue virus
IYGVAFSGVSW

SEQ ID NO: 48421 - protein, 11 aa, Dengue virus
YGAAFSGVSWI

SEQ ID NO: 48422 - protein, 11 aa, Dengue virus
GAAFSGVSWIM

SEQ ID NO: 48423 - protein, 11 aa, Dengue virus
AAFSGVSWIMK

SEQ ID NO: 48424 - protein, 11 aa, Dengue virus
AFSGVSWIMKI

SEQ ID NO: 48425 - protein, 11 aa, Dengue virus
FSGVSWIMKIL

SEQ ID NO: 48426 - protein, 11 aa, Dengue virus
SGVSWIMKILI

SEQ ID NO: 48427 - protein, 11 aa, Dengue virus
GVSWIMKILIG

SEQ ID NO: 48428 - protein, 11 aa, Dengue virus
VSWTMKILIGA

SEQ ID NO: 48429 - protein, 11 aa, Dengue virus
SWTMKILIGVV

SEQ ID NO: 48430 - protein, 11 aa, Dengue virus
WTMKILIGVVI

SEQ ID NO: 48431 - protein, 11 aa, Dengue virus
TMKILIGVVIT

SEQ ID NO: 48432 - protein, 11 aa, Dengue virus
MKILIGVVITW

SEQ ID NO: 48433 - protein, 11 aa, Dengue virus
KILIGVVITWI

SEQ ID NO: 48434 - protein, 11 aa, Dengue virus
ILIGVVITWIG

SEQ ID NO: 48435 - protein, 11 aa, Dengue virus
LIGVVITWIGM

SEQ ID NO: 48436 - protein, 11 aa, Dengue virus
IGVVITWIGMN

SEQ ID NO: 48437 - protein, 11 aa, Dengue virus
GVVITWIGMNS

SEQ ID NO: 48438 - protein, 11 aa, Dengue virus
VVITWIGMNSR

SEQ ID NO: 48439 - protein, 11 aa, Dengue virus
VITWIGMNSRS

SEQ ID NO: 48440 - protein, 11 aa, Dengue virus
MNSRSTSLSVT

SEQ ID NO: 48441 - protein, 11 aa, Dengue virus
NSRSTSLSVTL

SEQ ID NO: 48442 - protein, 11 aa, Dengue virus
SRSTSLSVTLV

SEQ ID NO: 48443 - protein, 11 aa, Dengue virus
RSTSLSVTLVL

SEQ ID NO: 48444 - protein, 11 aa, Dengue virus
STSLSVTLVLV

SEQ ID NO: 48445 - protein, 11 aa, Dengue virus
TSLSVTLVLVG

SEQ ID NO: 48446 - protein, 11 aa, Dengue virus
SLSVSLVLVGI

SEQ ID NO: 48447 - protein, 11 aa, Dengue virus
LSVSLVLVGIV

SEQ ID NO: 48448 - protein, 11 aa, Dengue virus
LVLVGIVTLYL

SEQ ID NO: 48449 - protein, 11 aa, Dengue virus
VLVGIVTLYLG

SEQ ID NO: 48450 - protein, 11 aa, Dengue virus
LVGIVTLYLGV

SEQ ID NO: 48451 - protein, 11 aa, Dengue virus
VTLYLGAMVQA

SEQ ID NO: 48452 - protein, 11 aa, Dengue virus
TLYLGAMVQAD

SEQ ID NO: 48453 - protein, 11 aa, Dengue virus
LYLGAMVQADS

SEQ ID NO: 48454 - protein, 11 aa, Dengue virus
YLGAMVQADSG

SEQ ID NO: 48455 - protein, 11 aa, Dengue virus
LGAMVQADSGC

SEQ ID NO: 48456 - protein, 11 aa, Dengue virus
GAMVQADSGCV

SEQ ID NO: 48457 - protein, 11 aa, Dengue virus
AMVQADSGCVV

SEQ ID NO: 48458 - protein, 11 aa, Dengue virus
VVQADSGCVVS

SEQ ID NO: 48459 - protein, 11 aa, Dengue virus
VQADTGCVVSW

SEQ ID NO: 48460 - protein, 11 aa, Dengue virus
QADTGCVVSWK

SEQ ID NO: 48461 - protein, 11 aa, Dengue virus
ADTGCVVSWKN

SEQ ID NO: 48462 - protein, 11 aa, Dengue virus
DTGCVVSWKNK

SEQ ID NO: 48463 - protein, 11 aa, Dengue virus
TGCVVSWKNKE

SEQ ID NO: 48464 - protein, 11 aa, Dengue virus
GCIVSWKNKEL

SEQ ID NO: 48465 - protein, 11 aa, Dengue virus
CIVSWKNKELK

SEQ ID NO: 48466 - protein, 11 aa, Dengue virus
VVSWKSKELKC

SEQ ID NO: 48467 - protein, 11 aa, Dengue virus
VSWKSKELKCG

SEQ ID NO: 48468 - protein, 11 aa, Dengue virus
SWKSKELKCGS

SEQ ID NO: 48469 - protein, 11 aa, Dengue virus
WKSKELKCGSG

SEQ ID NO: 48470 - protein, 11 aa, Dengue virus
KSKELKCGSGI

SEQ ID NO: 48471 - protein, 11 aa, Dengue virus
SKELKCGSGIF

SEQ ID NO: 48472 - protein, 11 aa, Dengue virus
KELKCGSGIFV

SEQ ID NO: 48473 - protein, 11 aa, Dengue virus
ELKCGSGIFVT

SEQ ID NO: 48474 - protein, 11 aa, Dengue virus
LKCGSGIFVTD

SEQ ID NO: 48475 - protein, 11 aa, Dengue virus
KCGSGIFVTDN

SEQ ID NO: 48476 - protein, 11 aa, Dengue virus
CGSGIFVTDNV

SEQ ID NO: 48477 - protein, 11 aa, Dengue virus
GSGIFVTDNVH

SEQ ID NO: 48478 - protein, 11 aa, Dengue virus
SGIFVTDNVHT

SEQ ID NO: 48479 - protein, 11 aa, Dengue virus
GIFVTDNVHTW

SEQ ID NO: 48480 - protein, 11 aa, Dengue virus
IFVTDNVHTWT

SEQ ID NO: 48481 - protein, 11 aa, Dengue virus
FVTDNVHTWTE

SEQ ID NO: 48482 - protein, 11 aa, Dengue virus
VTDNVHTWTEQ

SEQ ID NO: 48483 - protein, 11 aa, Dengue virus
TWTEQYKFQPD

SEQ ID NO: 48484 - protein, 11 aa, Dengue virus
WTEQYKFQPDS

SEQ ID NO: 48485 - protein, 11 aa, Dengue virus
TEQYKFQPDSP

SEQ ID NO: 48486 - protein, 11 aa, Dengue virus
EQYKFQPDSPS

SEQ ID NO: 48487 - protein, 11 aa, Dengue virus
QYKFQPDSPSK

SEQ ID NO: 48488 - protein, 11 aa, Dengue virus
YKFQPDSPSKL

SEQ ID NO: 48489 - protein, 11 aa, Dengue virus
KFQPDSPSKLA

SEQ ID NO: 48490 - protein, 11 aa, Dengue virus
FQPDSPSKLAS

SEQ ID NO: 48491 - protein, 11 aa, Dengue virus
QPDSPSKLASA

SEQ ID NO: 48492 - protein, 11 aa, Dengue virus
PDSPSKLASAI

SEQ ID NO: 48493 - protein, 11 aa, Dengue virus
DSPSKLASAIQ

SEQ ID NO: 48494 - protein, 11 aa, Dengue virus
SKLASAIQKAQ

SEQ ID NO: 48495 - protein, 11 aa, Dengue virus
KLASAIQKAQE

SEQ ID NO: 48496 - protein, 11 aa, Dengue virus
LASAIQKAQEE

SEQ ID NO: 48497 - protein, 11 aa, Dengue virus
ASAIQKAQEEG

SEQ ID NO: 48498 - protein, 11 aa, Dengue virus
SAIQKAQEEGI

SEQ ID NO: 48499 - protein, 11 aa, Dengue virus
AIQKAQEEGIC

SEQ ID NO: 48500 - protein, 11 aa, Dengue virus
IQKAQEEGICG

SEQ ID NO: 48501 - protein, 11 aa, Dengue virus
QKAQEEGICGI

SEQ ID NO: 48502 - protein, 11 aa, Dengue virus
KAQEEGICGIR

SEQ ID NO: 48503 - protein, 11 aa, Dengue virus
AQEEGICGIRS

SEQ ID NO: 48504 - protein, 11 aa, Dengue virus
QEEGICGIRSV

SEQ ID NO: 48505 - protein, 11 aa, Dengue virus
EEDICGIRSVT

SEQ ID NO: 48506 - protein, 11 aa, Dengue virus
EDICGIRSVTR

SEQ ID NO: 48507 - protein, 11 aa, Dengue virus
DICGIRSVTRL

SEQ ID NO: 48508 - protein, 11 aa, Dengue virus
SVTRLENLMWR

SEQ ID NO: 48509 - protein, 11 aa, Dengue virus
TRLENLMWRQI

SEQ ID NO: 48510 - protein, 11 aa, Dengue virus
RLENLMWRQIT

SEQ ID NO: 48511 - protein, 11 aa, Dengue virus
LENLMWKQITS

SEQ ID NO: 48512 - protein, 11 aa, Dengue virus
ENLMWKQITSE

SEQ ID NO: 48513 - protein, 11 aa, Dengue virus
NLMWKQITSEL

SEQ ID NO: 48514 - protein, 11 aa, Dengue virus
LMWKQITSELN

SEQ ID NO: 48515 - protein, 11 aa, Dengue virus
MWKQITSELNH

SEQ ID NO: 48516 - protein, 11 aa, Dengue virus
WKQITSELNHI

SEQ ID NO: 48517 - protein, 11 aa, Dengue virus
KQITSELNHIL

SEQ ID NO: 48518 - protein, 11 aa, Dengue virus
QITPELNHILA

SEQ ID NO: 48519 - protein, 11 aa, Dengue virus
ITPELNHILAE

SEQ ID NO: 48520 - protein, 11 aa, Dengue virus
TPELNHILAEN

SEQ ID NO: 48521 - protein, 11 aa, Dengue virus
PELNHILAENE

SEQ ID NO: 48522 - protein, 11 aa, Dengue virus
ELNHILAENEV

SEQ ID NO: 48523 - protein, 11 aa, Dengue virus
LNHILAENEVK

SEQ ID NO: 48524 - protein, 11 aa, Dengue virus
NHILAENEVKL

SEQ ID NO: 48525 - protein, 11 aa, Dengue virus
HILAENEVKLT

SEQ ID NO: 48526 - protein, 11 aa, Dengue virus
ILAENEVKLTI

SEQ ID NO: 48527 - protein, 11 aa, Dengue virus
AENEVKLTIMT

SEQ ID NO: 48528 - protein, 11 aa, Dengue virus
ENEAKLTIMTG

SEQ ID NO: 48529 - protein, 11 aa, Dengue virus
NEVKLTIMTGE

SEQ ID NO: 48530 - protein, 11 aa, Dengue virus
EVKLTIMTGDT

SEQ ID NO: 48531 - protein, 11 aa, Dengue virus
KLTIMTGDIRG

SEQ ID NO: 48532 - protein, 11 aa, Dengue virus
TIMTGDIRGIM

SEQ ID NO: 48533 - protein, 11 aa, Dengue virus
IMTGDIRGIMQ

SEQ ID NO: 48534 - protein, 11 aa, Dengue virus
LRPQPTELRYS

SEQ ID NO: 48535 - protein, 11 aa, Dengue virus
RPQPTELRYSW

SEQ ID NO: 48536 - protein, 11 aa, Dengue virus
PQPTELRYSWK

SEQ ID NO: 48537 - protein, 11 aa, Dengue virus
QPTELKYSWKA

SEQ ID NO: 48538 - protein, 11 aa, Dengue virus
PTELKYSWKAW

SEQ ID NO: 48539 - protein, 11 aa, Dengue virus
TELKYSWKAWG

SEQ ID NO: 48540 - protein, 11 aa, Dengue virus
ELKYSWKAWGK

SEQ ID NO: 48541 - protein, 11 aa, Dengue virus
LKYSWKAWGKA

SEQ ID NO: 48542 - protein, 11 aa, Dengue virus
KYSWKAWGKAK

SEQ ID NO: 48543 - protein, 11 aa, Dengue virus
YSWKAWGKAKM

SEQ ID NO: 48544 - protein, 11 aa, Dengue virus
SWKAWGKAKML

SEQ ID NO: 48545 - protein, 11 aa, Dengue virus
YNQTFLIDGPE

SEQ ID NO: 48546 - protein, 11 aa, Dengue virus
NHTFLIDGPET

SEQ ID NO: 48547 - protein, 11 aa, Dengue virus
HTFLIDGPETA

SEQ ID NO: 48548 - protein, 11 aa, Dengue virus
TFLIDGPETTE

SEQ ID NO: 48549 - protein, 11 aa, Dengue virus
FLIDGPETTEC

SEQ ID NO: 48550 - protein, 11 aa, Dengue virus
LIDGPETTECP

SEQ ID NO: 48551 - protein, 11 aa, Dengue virus
IDGPETTECPN

SEQ ID NO: 48552 - protein, 11 aa, Dengue virus
TTECPNTNRAW

SEQ ID NO: 48553 - protein, 11 aa, Dengue virus
TECPNTNRAWN

SEQ ID NO: 48554 - protein, 11 aa, Dengue virus
ECPNSNRAWNS

SEQ ID NO: 48555 - protein, 11 aa, Dengue virus
CPNSNRAWNSL

SEQ ID NO: 48556 - protein, 11 aa, Dengue virus
PNSNRAWNSLE

SEQ ID NO: 48557 - protein, 11 aa, Dengue virus
NSNRAWNSLEV

SEQ ID NO: 48558 - protein, 11 aa, Dengue virus
SNRAWNSLEVE

SEQ ID NO: 48559 - protein, 11 aa, Dengue virus
SLEVEDYGFGI

SEQ ID NO: 48560 - protein, 11 aa, Dengue virus
LEVEDYGFGIF

SEQ ID NO: 48561 - protein, 11 aa, Dengue virus
EVEDYGFGVFS

SEQ ID NO: 48562 - protein, 11 aa, Dengue virus
VEDYGFGVFST

SEQ ID NO: 48563 - protein, 11 aa, Dengue virus
EDYGFGVFSTN

SEQ ID NO: 48564 - protein, 11 aa, Dengue virus
DYGFGVFSTNI

SEQ ID NO: 48565 - protein, 11 aa, Dengue virus
YGFGVFSTNIW

SEQ ID NO: 48566 - protein, 11 aa, Dengue virus
GFGVFSTNIWL

SEQ ID NO: 48567 - protein, 11 aa, Dengue virus
FGVFSTNIWLK

SEQ ID NO: 48568 - protein, 11 aa, Dengue virus
GVFSTNIWLKL

SEQ ID NO: 48569 - protein, 11 aa, Dengue virus
FTTNIWLKLKE

SEQ ID NO: 48570 - protein, 11 aa, Dengue virus
TNIWLKLKEKQ

SEQ ID NO: 48571 - protein, 11 aa, Dengue virus
NIWLKLKEKQD

SEQ ID NO: 48572 - protein, 11 aa, Dengue virus
CDSKLMSAAVK

SEQ ID NO: 48573 - protein, 11 aa, Dengue virus
DSKLMSAAVKD

SEQ ID NO: 48574 - protein, 11 aa, Dengue virus
SKLMSAAVKDD

SEQ ID NO: 48575 - protein, 11 aa, Dengue virus
KLMSAAVKDDR

SEQ ID NO: 48576 - protein, 11 aa, Dengue virus
LMSAAVKDDRA

SEQ ID NO: 48577 - protein, 11 aa, Dengue virus
MSAAVKDDRAV

SEQ ID NO: 48578 - protein, 11 aa, Dengue virus
SAAVKDDRAVH

SEQ ID NO: 48579 - protein, 11 aa, Dengue virus
AAVKDDRAVHA

SEQ ID NO: 48580 - protein, 11 aa, Dengue virus
AVKDDRAVHAD

SEQ ID NO: 48581 - protein, 11 aa, Dengue virus
VKDDRAVHADM

SEQ ID NO: 48582 - protein, 11 aa, Dengue virus
KDDRAVHADMG

SEQ ID NO: 48583 - protein, 11 aa, Dengue virus
DDRAVHADMGY

SEQ ID NO: 48584 - protein, 11 aa, Dengue virus
DRAVHADMGYW

SEQ ID NO: 48585 - protein, 11 aa, Dengue virus
HADMGYWIESR

SEQ ID NO: 48586 - protein, 11 aa, Dengue virus
ADMGYWIESRL

SEQ ID NO: 48587 - protein, 11 aa, Dengue virus
DMGYWIESRLN

SEQ ID NO: 48588 - protein, 11 aa, Dengue virus
MGYWIESRLND

SEQ ID NO: 48589 - protein, 11 aa, Dengue virus
GYWIESRLNDT

SEQ ID NO: 48590 - protein, 11 aa, Dengue virus
YWIESRLNDTW

SEQ ID NO: 48591 - protein, 11 aa, Dengue virus
WIESRLNDTWK

SEQ ID NO: 48592 - protein, 11 aa, Dengue virus
IESALNDTWKI

SEQ ID NO: 48593 - protein, 11 aa, Dengue virus
ESALNDTWKIE

SEQ ID NO: 48594 - protein, 11 aa, Dengue virus
SALNDTWKIEK

SEQ ID NO: 48595 - protein, 11 aa, Dengue virus
ALNDTWKIEKA

SEQ ID NO: 48596 - protein, 11 aa, Dengue virus
LNDTWKIEKAS

SEQ ID NO: 48597 - protein, 11 aa, Dengue virus
NDTWKIEKASF

SEQ ID NO: 48598 - protein, 11 aa, Dengue virus
DTWKIEKASFI

SEQ ID NO: 48599 - protein, 11 aa, Dengue virus
TWKIEKASFIE

SEQ ID NO: 48600 - protein, 11 aa, Dengue virus
WKIEKASFIEV

SEQ ID NO: 48601 - protein, 11 aa, Dengue virus
KIEKASFIEVK

SEQ ID NO: 48602 - protein, 11 aa, Dengue virus
IEKASFIEVKN

SEQ ID NO: 48603 - protein, 11 aa, Dengue virus
EKASFIEVKNC

SEQ ID NO: 48604 - protein, 11 aa, Dengue virus
KASFIEVKNCH

SEQ ID NO: 48605 - protein, 11 aa, Dengue virus
ASFIEVKNCHW

SEQ ID NO: 48606 - protein, 11 aa, Dengue virus
SFIEVKNCHWP

SEQ ID NO: 48607 - protein, 11 aa, Dengue virus
FIEVKNCHWPK

SEQ ID NO: 48608 - protein, 11 aa, Dengue virus
IEVKNCHWPKS

SEQ ID NO: 48609 - protein, 11 aa, Dengue virus
EVKNCHWPKSH

SEQ ID NO: 48610 - protein, 11 aa, Dengue virus
VKNCHWPKSHT

SEQ ID NO: 48611 - protein, 11 aa, Dengue virus
KNCHWPKSHTL

SEQ ID NO: 48612 - protein, 11 aa, Dengue virus
NCHWPKSHTLW

SEQ ID NO: 48613 - protein, 11 aa, Dengue virus
CYWPRSHTLWS

SEQ ID NO: 48614 - protein, 11 aa, Dengue virus
YWPRSHTLWSN

SEQ ID NO: 48615 - protein, 11 aa, Dengue virus
WPRSHTLWSNG

SEQ ID NO: 48616 - protein, 11 aa, Dengue virus
PRSHTLWSNGV

SEQ ID NO: 48617 - protein, 11 aa, Dengue virus
RSHTLWSNGVL

SEQ ID NO: 48618 - protein, 11 aa, Dengue virus
WSNGVLESEMV

SEQ ID NO: 48619 - protein, 11 aa, Dengue virus
SNGVLESEMVI

SEQ ID NO: 48620 - protein, 11 aa, Dengue virus
NGVLESEMVIP

SEQ ID NO: 48621 - protein, 11 aa, Dengue virus
GVLESEMVIPK

SEQ ID NO: 48622 - protein, 11 aa, Dengue virus
VLESEMIIPKS

SEQ ID NO: 48623 - protein, 11 aa, Dengue virus
IPKNLAGPVSQ

SEQ ID NO: 48624 - protein, 11 aa, Dengue virus
PKNLAGPVSQH

SEQ ID NO: 48625 - protein, 11 aa, Dengue virus
KNLAGPVSQHN

SEQ ID NO: 48626 - protein, 11 aa, Dengue virus
LAGPVSQHNYR

SEQ ID NO: 48627 - protein, 11 aa, Dengue virus
AGPVSQHNNRP

SEQ ID NO: 48628 - protein, 11 aa, Dengue virus
GPVSQHNNRPG

SEQ ID NO: 48629 - protein, 11 aa, Dengue virus
PVSQHNNRPGY

SEQ ID NO: 48630 - protein, 11 aa, Dengue virus
VSQHNYRPGYY

SEQ ID NO: 48631 - protein, 11 aa, Dengue virus
SQHNYRPGYYT

SEQ ID NO: 48632 - protein, 11 aa, Dengue virus
QHNYRPGYYTQ

SEQ ID NO: 48633 - protein, 11 aa, Dengue virus
RPGYHTQIAGP

SEQ ID NO: 48634 - protein, 11 aa, Dengue virus
PGYHTQIAGPW

SEQ ID NO: 48635 - protein, 11 aa, Dengue virus
GYHTQIAGPWH

SEQ ID NO: 48636 - protein, 11 aa, Dengue virus
YHTQIAGPWHL

SEQ ID NO: 48637 - protein, 11 aa, Dengue virus
HTQIAGPWHLG

SEQ ID NO: 48638 - protein, 11 aa, Dengue virus
TQIAGPWHLGK

SEQ ID NO: 48639 - protein, 11 aa, Dengue virus
QIAGPWHLGKL

SEQ ID NO: 48640 - protein, 11 aa, Dengue virus
IAGPWHLGKLE

SEQ ID NO: 48641 - protein, 11 aa, Dengue virus
AGPWHLGRLEM

SEQ ID NO: 48642 - protein, 11 aa, Dengue virus
GPWHLGRLEMD

SEQ ID NO: 48643 - protein, 11 aa, Dengue virus
PWHLGRLEMDF

SEQ ID NO: 48644 - protein, 11 aa, Dengue virus
WHLGRLEMDFD

SEQ ID NO: 48645 - protein, 11 aa, Dengue virus
HLGKLEMDFDL

SEQ ID NO: 48646 - protein, 11 aa, Dengue virus
LGKLEMDFDLC

SEQ ID NO: 48647 - protein, 11 aa, Dengue virus
LEMDFDFCDGT

SEQ ID NO: 48648 - protein, 11 aa, Dengue virus
EMDFDFCDGTT

SEQ ID NO: 48649 - protein, 11 aa, Dengue virus
MDFDFCDGTTV

SEQ ID NO: 48650 - protein, 11 aa, Dengue virus
FCDGTTVIVTE

SEQ ID NO: 48651 - protein, 11 aa, Dengue virus
CDGTTVIVTED

SEQ ID NO: 48652 - protein, 11 aa, Dengue virus
DGTTVIVTEDC

SEQ ID NO: 48653 - protein, 11 aa, Dengue virus
GTTVIVTEDCG

SEQ ID NO: 48654 - protein, 11 aa, Dengue virus
TTVIVTEDCGN

SEQ ID NO: 48655 - protein, 11 aa, Dengue virus
TVIVTEDCGNR

SEQ ID NO: 48656 - protein, 11 aa, Dengue virus
VIVTEDCGNRG

SEQ ID NO: 48657 - protein, 11 aa, Dengue virus
IVTEDCGNRGP

SEQ ID NO: 48658 - protein, 11 aa, Dengue virus
VTEECGNRGPS

SEQ ID NO: 48659 - protein, 11 aa, Dengue virus
TEECGNRGPSL

SEQ ID NO: 48660 - protein, 11 aa, Dengue virus
EECGNRGPSLR

SEQ ID NO: 48661 - protein, 11 aa, Dengue virus
ECGNRGPSLRT

SEQ ID NO: 48662 - protein, 11 aa, Dengue virus
YGMEIRPLKER

SEQ ID NO: 48663 - protein, 11 aa, Dengue virus
GMEIRPLKERE

SEQ ID NO: 48664 - protein, 11 aa, Dengue virus
MEIRPLKEREE

SEQ ID NO: 48665 - protein, 11 aa, Dengue virus
EIRPLKEREEN

SEQ ID NO: 48666 - protein, 11 aa, Dengue virus
IRPLKEREENL

SEQ ID NO: 48667 - protein, 11 aa, Dengue virus
RPLKEREENLV

SEQ ID NO: 48668 - protein, 11 aa, Dengue virus
PLKEKEENLVS

SEQ ID NO: 48669 - protein, 11 aa, Dengue virus
LKEKEENLVSS

SEQ ID NO: 48670 - protein, 11 aa, Dengue virus
KEKEENLVSSL

SEQ ID NO: 48671 - protein, 11 aa, Dengue virus
EKEENLVSSLV

SEQ ID NO: 48672 - protein, 11 aa, Dengue virus
KEENLVSSLVT

SEQ ID NO: 48673 - protein, 11 aa, Dengue virus
EENLVSSLVTA

SEQ ID NO: 48674 - protein, 11 aa, Dengue virus
ENLVSSLVTAG

SEQ ID NO: 48675 - protein, 11 aa, Dengue virus
NLVSSLVTAGH

SEQ ID NO: 48676 - protein, 11 aa, Dengue virus
LVSSLVTAGHG

SEQ ID NO: 48677 - protein, 11 aa, Dengue virus
VSSLVTAGHGQ

SEQ ID NO: 48678 - protein, 11 aa, Dengue virus
NSLVTAGHGQV

SEQ ID NO: 48679 - protein, 11 aa, Dengue virus
SLVTAGHGQVD

SEQ ID NO: 48680 - protein, 11 aa, Dengue virus
LVTAGHGQVDN

SEQ ID NO: 48681 - protein, 11 aa, Dengue virus
VTAGHGQVDNF

SEQ ID NO: 48682 - protein, 11 aa, Dengue virus
TAGHGQVDNFS

SEQ ID NO: 48683 - protein, 11 aa, Dengue virus
AGHGQVDNFSL

SEQ ID NO: 48684 - protein, 11 aa, Dengue virus
GHGQVDNFSLG

SEQ ID NO: 48685 - protein, 11 aa, Dengue virus
HGQVDNFSLGV

SEQ ID NO: 48686 - protein, 11 aa, Dengue virus
GQVDNFSLGVL

SEQ ID NO: 48687 - protein, 11 aa, Dengue virus
QVDNFSLGVLG

SEQ ID NO: 48688 - protein, 11 aa, Dengue virus
VDNFSLGVLGM

SEQ ID NO: 48689 - protein, 11 aa, Dengue virus
DNFSLGILGMA

SEQ ID NO: 48690 - protein, 11 aa, Dengue virus
NFSLGILGMAL

SEQ ID NO: 48691 - protein, 11 aa, Dengue virus
FSLGILGMALF

SEQ ID NO: 48692 - protein, 11 aa, Dengue virus
SLGILGMALFL

SEQ ID NO: 48693 - protein, 11 aa, Dengue virus
LGILGMALFLE

SEQ ID NO: 48694 - protein, 11 aa, Dengue virus
GILGMALFLEE

SEQ ID NO: 48695 - protein, 11 aa, Dengue virus
ILGMALFLEEM

SEQ ID NO: 48696 - protein, 11 aa, Dengue virus
LGMALLLEEML

SEQ ID NO: 48697 - protein, 11 aa, Dengue virus
GMALLLEEMLR

SEQ ID NO: 48698 - protein, 11 aa, Dengue virus
MALLLEEMLRT

SEQ ID NO: 48699 - protein, 11 aa, Dengue virus
ALLLEEMLRTR

SEQ ID NO: 48700 - protein, 11 aa, Dengue virus
LFLEEMLRTRI

SEQ ID NO: 48701 - protein, 11 aa, Dengue virus
FLEEMLRTRIG

SEQ ID NO: 48702 - protein, 11 aa, Dengue virus
LEEMLRTRIGT

SEQ ID NO: 48703 - protein, 11 aa, Dengue virus
EEMLRTRIGTK

SEQ ID NO: 48704 - protein, 11 aa, Dengue virus
EMLRTRIGTKH

SEQ ID NO: 48705 - protein, 11 aa, Dengue virus
MLRTRIGTKHA

SEQ ID NO: 48706 - protein, 11 aa, Dengue virus
SFMTLITGNMS

SEQ ID NO: 48707 - protein, 11 aa, Dengue virus
FMTLITGNMSF

SEQ ID NO: 48708 - protein, 11 aa, Dengue virus
TLITGNMSFKD

SEQ ID NO: 48709 - protein, 11 aa, Dengue virus
LITGNMSFKDL

SEQ ID NO: 48710 - protein, 11 aa, Dengue virus
ITGNMSFKDLG

SEQ ID NO: 48711 - protein, 11 aa, Dengue virus
TGNMSFKDLGR

SEQ ID NO: 48712 - protein, 11 aa, Dengue virus
GNMSFKDLGRV

SEQ ID NO: 48713 - protein, 11 aa, Dengue virus
KDLGRVVVMVG

SEQ ID NO: 48714 - protein, 11 aa, Dengue virus
DLGRVVVMVGA

SEQ ID NO: 48715 - protein, 11 aa, Dengue virus
ADDIGMGVTYL

SEQ ID NO: 48716 - protein, 11 aa, Dengue virus
DEMGMGVTYLA

SEQ ID NO: 48717 - protein, 11 aa, Dengue virus
EMGMGVTYLAL

SEQ ID NO: 48718 - protein, 11 aa, Dengue virus
MGMGVTYLALL

SEQ ID NO: 48719 - protein, 11 aa, Dengue virus
GMGITYLALLA

SEQ ID NO: 48720 - protein, 11 aa, Dengue virus
MGITYLALLAA

SEQ ID NO: 48721 - protein, 11 aa, Dengue virus
GITYLALLAAF

SEQ ID NO: 48722 - protein, 11 aa, Dengue virus
VTYLALLAAFR

SEQ ID NO: 48723 - protein, 11 aa, Dengue virus
TYLALLAAFRV

SEQ ID NO: 48724 - protein, 11 aa, Dengue virus
YLALLAAFRVR

SEQ ID NO: 48725 - protein, 11 aa, Dengue virus
LALLAAFRVRP

SEQ ID NO: 48726 - protein, 11 aa, Dengue virus
ALLAAFRVRPT

SEQ ID NO: 48727 - protein, 11 aa, Dengue virus
LLAAFRVRPTF

SEQ ID NO: 48728 - protein, 11 aa, Dengue virus
LAAFRVRPTFA

SEQ ID NO: 48729 - protein, 11 aa, Dengue virus
AAFRVRPTFAV

SEQ ID NO: 48730 - protein, 11 aa, Dengue virus
AFRVRPTFAVG

SEQ ID NO: 48731 - protein, 11 aa, Dengue virus
FRVRPTFAVGL

SEQ ID NO: 48732 - protein, 11 aa, Dengue virus
RVRPTFAVGLL

SEQ ID NO: 48733 - protein, 11 aa, Dengue virus
VRPTFAVGLLL

SEQ ID NO: 48734 - protein, 11 aa, Dengue virus
RPTFAVGLLLR

SEQ ID NO: 48735 - protein, 11 aa, Dengue virus
PTFAVGLLLRK

SEQ ID NO: 48736 - protein, 11 aa, Dengue virus
TFAVGLLLRKL

SEQ ID NO: 48737 - protein, 11 aa, Dengue virus
FAVGLLLRKLT

SEQ ID NO: 48738 - protein, 11 aa, Dengue virus
AVGLLLRKLTS

SEQ ID NO: 48739 - protein, 11 aa, Dengue virus
VGLLLRKLTSK

SEQ ID NO: 48740 - protein, 11 aa, Dengue virus
GLFLRKLTSKE

SEQ ID NO: 48741 - protein, 11 aa, Dengue virus
LFLRKLTSKEL

SEQ ID NO: 48742 - protein, 11 aa, Dengue virus
LLRKLTSKELL

SEQ ID NO: 48743 - protein, 11 aa, Dengue virus
LRKLTSKELLM

SEQ ID NO: 48744 - protein, 11 aa, Dengue virus
RKLTSKELMMT

SEQ ID NO: 48745 - protein, 11 aa, Dengue virus
KLTSKELMMTT

SEQ ID NO: 48746 - protein, 11 aa, Dengue virus
LTSKELMMTTI

SEQ ID NO: 48747 - protein, 11 aa, Dengue virus
TSKELMMTTIG

SEQ ID NO: 48748 - protein, 11 aa, Dengue virus
SKELMMTTIGI

SEQ ID NO: 48749 - protein, 11 aa, Dengue virus
TVLELTDALAL

SEQ ID NO: 48750 - protein, 11 aa, Dengue virus
VLELTDALALG

SEQ ID NO: 48751 - protein, 11 aa, Dengue virus
LELTDAIALGI

SEQ ID NO: 48752 - protein, 11 aa, Dengue virus
ELTDAIALGIM

SEQ ID NO: 48753 - protein, 11 aa, Dengue virus
LTDALALGMMA

SEQ ID NO: 48754 - protein, 11 aa, Dengue virus
TDALALGMMAL

SEQ ID NO: 48755 - protein, 11 aa, Dengue virus
DALALGMMALK

SEQ ID NO: 48756 - protein, 11 aa, Dengue virus
MEKYQLAVTVM

SEQ ID NO: 48757 - protein, 11 aa, Dengue virus
EKYQLAVTVMA

SEQ ID NO: 48758 - protein, 11 aa, Dengue virus
CVPNAVILRNA

SEQ ID NO: 48759 - protein, 11 aa, Dengue virus
VPNAVILRNAW

SEQ ID NO: 48760 - protein, 11 aa, Dengue virus
VSVSPLFLTSS

SEQ ID NO: 48761 - protein, 11 aa, Dengue virus
SVSPLFLTSSQ

SEQ ID NO: 48762 - protein, 11 aa, Dengue virus
VSPLFLTSSQQ

SEQ ID NO: 48763 - protein, 11 aa, Dengue virus
SPLFLTSSQQK

SEQ ID NO: 48764 - protein, 11 aa, Dengue virus
LTSSQQKTDWI

SEQ ID NO: 48765 - protein, 11 aa, Dengue virus
TSSQQKTDWIP

SEQ ID NO: 48766 - protein, 11 aa, Dengue virus
SSQQKTDWIPL

SEQ ID NO: 48767 - protein, 11 aa, Dengue virus
SQQKTDWIPLA

SEQ ID NO: 48768 - protein, 11 aa, Dengue virus
QQKTDWIPLAL

SEQ ID NO: 48769 - protein, 11 aa, Dengue virus
QKTDWIPLALT

SEQ ID NO: 48770 - protein, 11 aa, Dengue virus
KTDWIPLALTI

SEQ ID NO: 48771 - protein, 11 aa, Dengue virus
TDWIPLALTIK

SEQ ID NO: 48772 - protein, 11 aa, Dengue virus
DWIPLVLTIKG

SEQ ID NO: 48773 - protein, 11 aa, Dengue virus
WIPLVLTIKGL

SEQ ID NO: 48774 - protein, 11 aa, Dengue virus
IPLVLTIKGLN

SEQ ID NO: 48775 - protein, 11 aa, Dengue virus
PLVLTIKGLNP

SEQ ID NO: 48776 - protein, 11 aa, Dengue virus
LVLTIKGLNPT

SEQ ID NO: 48777 - protein, 11 aa, Dengue virus
VLTIKGLNPTA

SEQ ID NO: 48778 - protein, 11 aa, Dengue virus
LIIKGLNPTAI

SEQ ID NO: 48779 - protein, 11 aa, Dengue virus
IIKGLNPTAIF

SEQ ID NO: 48780 - protein, 11 aa, Dengue virus
TAIFLTTLSRP

SEQ ID NO: 48781 - protein, 11 aa, Dengue virus
AIFLTTLSRTN

SEQ ID NO: 48782 - protein, 11 aa, Dengue virus
IFLTTLSRTNK

SEQ ID NO: 48783 - protein, 11 aa, Dengue virus
LTTLSRTNKKR

SEQ ID NO: 48784 - protein, 11 aa, Dengue virus
TTLSRTNKKRS

SEQ ID NO: 48785 - protein, 11 aa, Dengue virus
TLSRTNKKRSW

SEQ ID NO: 48786 - protein, 11 aa, Dengue virus
LSRTNKKRSWP

SEQ ID NO: 48787 - protein, 11 aa, Dengue virus
RTNKKRSWPLN

SEQ ID NO: 48788 - protein, 11 aa, Dengue virus
TNKKRSWPLNE

SEQ ID NO: 48789 - protein, 11 aa, Dengue virus
NKKRSWPLNEA

SEQ ID NO: 48790 - protein, 11 aa, Dengue virus
KKRSWPLNEAV

SEQ ID NO: 48791 - protein, 11 aa, Dengue virus
KRSWPLNEAVM

SEQ ID NO: 48792 - protein, 11 aa, Dengue virus
RSWPLNEAVMA

SEQ ID NO: 48793 - protein, 11 aa, Dengue virus
SWPLNEAVMAV

SEQ ID NO: 48794 - protein, 11 aa, Dengue virus
WPLNEAVMAVG

SEQ ID NO: 48795 - protein, 11 aa, Dengue virus
PLNEAVMAVGM

SEQ ID NO: 48796 - protein, 11 aa, Dengue virus
LNEAVMAVGMV

SEQ ID NO: 48797 - protein, 11 aa, Dengue virus
NEAVMAVGMVS

SEQ ID NO: 48798 - protein, 11 aa, Dengue virus
EAVMAVGMVSI

SEQ ID NO: 48799 - protein, 11 aa, Dengue virus
AVMAVGMVSIL

SEQ ID NO: 48800 - protein, 11 aa, Dengue virus
VMAVGMVSILA

SEQ ID NO: 48801 - protein, 11 aa, Dengue virus
TGRSADLELEK

SEQ ID NO: 48802 - protein, 11 aa, Dengue virus
GRSADLELEKA

SEQ ID NO: 48803 - protein, 11 aa, Dengue virus
RSADLELERAT

SEQ ID NO: 48804 - protein, 11 aa, Dengue virus
SADLELERATD

SEQ ID NO: 48805 - protein, 11 aa, Dengue virus
ADLELERATDV

SEQ ID NO: 48806 - protein, 11 aa, Dengue virus
VRWEEQAEISG

SEQ ID NO: 48807 - protein, 11 aa, Dengue virus
RWEEQAEISGS

SEQ ID NO: 48808 - protein, 11 aa, Dengue virus
WEEQAEISGSS

SEQ ID NO: 48809 - protein, 11 aa, Dengue virus
EEQAEISGSSP

SEQ ID NO: 48810 - protein, 11 aa, Dengue virus
EQAEISGSSPI

SEQ ID NO: 48811 - protein, 11 aa, Dengue virus
HAEISGSSPIL

SEQ ID NO: 48812 - protein, 11 aa, Dengue virus
EISGSSPILSV

SEQ ID NO: 48813 - protein, 11 aa, Dengue virus
ISGSSPILSVT

SEQ ID NO: 48814 - protein, 11 aa, Dengue virus
SGSSPILSVTI

SEQ ID NO: 48815 - protein, 11 aa, Dengue virus
GSSPILSITIA

SEQ ID NO: 48816 - protein, 11 aa, Dengue virus
SSPILSITIAE

SEQ ID NO: 48817 - protein, 11 aa, Dengue virus
SPILSITIAED

SEQ ID NO: 48818 - protein, 11 aa, Dengue virus
PILSITIAEDG

SEQ ID NO: 48819 - protein, 11 aa, Dengue virus
ILSITIAEDGS

SEQ ID NO: 48820 - protein, 11 aa, Dengue virus
LSITIAEDGSM

SEQ ID NO: 48821 - protein, 11 aa, Dengue virus
SITIAEDGSMS

SEQ ID NO: 48822 - protein, 11 aa, Dengue virus
ITIAEDGSMSI

SEQ ID NO: 48823 - protein, 11 aa, Dengue virus
TIAEDGSMSIK

SEQ ID NO: 48824 - protein, 11 aa, Dengue virus
IAEDGSMSIKN

SEQ ID NO: 48825 - protein, 11 aa, Dengue virus
AEDGSMSIKNE

SEQ ID NO: 48826 - protein, 11 aa, Dengue virus
SMSIKNEEEEH

SEQ ID NO: 48827 - protein, 11 aa, Dengue virus
MSIKNEEEEHT

SEQ ID NO: 48828 - protein, 11 aa, Dengue virus
SIKNEEEEHTL

SEQ ID NO: 48829 - protein, 11 aa, Dengue virus
IKNEEEEHTLT

SEQ ID NO: 48830 - protein, 11 aa, Dengue virus
KNEEEEHTLTI

SEQ ID NO: 48831 - protein, 11 aa, Dengue virus
NEEEEHTLTIL

SEQ ID NO: 48832 - protein, 11 aa, Dengue virus
EEEEHTLTILI

SEQ ID NO: 48833 - protein, 11 aa, Dengue virus
EEEHTLTILIR

SEQ ID NO: 48834 - protein, 11 aa, Dengue virus
EEHTLTILIRT

SEQ ID NO: 48835 - protein, 11 aa, Dengue virus
EHTLTILIRTG

SEQ ID NO: 48836 - protein, 11 aa, Dengue virus
HTLTILIRTGL

SEQ ID NO: 48837 - protein, 11 aa, Dengue virus
ILTILIRTGLL

SEQ ID NO: 48838 - protein, 11 aa, Dengue virus
IRTGLLVISGV

SEQ ID NO: 48839 - protein, 11 aa, Dengue virus
RTGLLVISGVF

SEQ ID NO: 48840 - protein, 11 aa, Dengue virus
TGLLVISGVFP

SEQ ID NO: 48841 - protein, 11 aa, Dengue virus
GLLVISGLFPV

SEQ ID NO: 48842 - protein, 11 aa, Dengue virus
LLVISGLFPVS

SEQ ID NO: 48843 - protein, 11 aa, Dengue virus
LVISGLFPVSI

SEQ ID NO: 48844 - protein, 11 aa, Dengue virus
VISGLFPVSIP

SEQ ID NO: 48845 - protein, 11 aa, Dengue virus
SGLFPVSIPIT

SEQ ID NO: 48846 - protein, 11 aa, Dengue virus
GLFPVSIPITA

SEQ ID NO: 48847 - protein, 11 aa, Dengue virus
LFPVSIPITAA

SEQ ID NO: 48848 - protein, 11 aa, Dengue virus
FPISIPITAAA

SEQ ID NO: 48849 - protein, 11 aa, Dengue virus
PISIPITAAAW

SEQ ID NO: 48850 - protein, 11 aa, Dengue virus
ISIPITAAAWY

SEQ ID NO: 48851 - protein, 11 aa, Dengue virus
SMPITAAAWYL

SEQ ID NO: 48852 - protein, 11 aa, Dengue virus
MPITAAAWYLW

SEQ ID NO: 48853 - protein, 11 aa, Dengue virus
ITAAAWYLWET

SEQ ID NO: 48854 - protein, 11 aa, Dengue virus
TAAAWYLWETK

SEQ ID NO: 48855 - protein, 11 aa, Dengue virus
AAAWYLWETKK

SEQ ID NO: 48856 - protein, 11 aa, Dengue virus
AAWYLWETKKQ

SEQ ID NO: 48857 - protein, 11 aa, Dengue virus
AWYLWETKKQR

SEQ ID NO: 48858 - protein, 11 aa, Dengue virus
WYLWETKKQRA

SEQ ID NO: 48859 - protein, 11 aa, Dengue virus
YLWETKKQRAG

SEQ ID NO: 48860 - protein, 11 aa, Dengue virus
LWETKKQRAGV

SEQ ID NO: 48861 - protein, 11 aa, Dengue virus
WETKKQRAGVL

SEQ ID NO: 48862 - protein, 11 aa, Dengue virus
ETKKQRAGVLW

SEQ ID NO: 48863 - protein, 11 aa, Dengue virus
TKKQRAGVLWD

SEQ ID NO: 48864 - protein, 11 aa, Dengue virus
VLWDVPSPPPM

SEQ ID NO: 48865 - protein, 11 aa, Dengue virus
LWDVPSPPPMG

SEQ ID NO: 48866 - protein, 11 aa, Dengue virus
EKAELEDGAYR

SEQ ID NO: 48867 - protein, 11 aa, Dengue virus
RAELEDGAYRI

SEQ ID NO: 48868 - protein, 11 aa, Dengue virus
LEDGAYRIKQK

SEQ ID NO: 48869 - protein, 11 aa, Dengue virus
EDGAYRIKQKG

SEQ ID NO: 48870 - protein, 11 aa, Dengue virus
DGAYRIKQKGI

SEQ ID NO: 48871 - protein, 11 aa, Dengue virus
GAYRIKQRGIL

SEQ ID NO: 48872 - protein, 11 aa, Dengue virus
AYRIKQRGILG

SEQ ID NO: 48873 - protein, 11 aa, Dengue virus
YRIKQRGILGY

SEQ ID NO: 48874 - protein, 11 aa, Dengue virus
RIKQRGILGYS

SEQ ID NO: 48875 - protein, 11 aa, Dengue virus
IKQRGILGYSQ

SEQ ID NO: 48876 - protein, 11 aa, Dengue virus
KQRGILGYSQI

SEQ ID NO: 48877 - protein, 11 aa, Dengue virus
QRGILGYSQIG

SEQ ID NO: 48878 - protein, 11 aa, Dengue virus
RGILGYSQIGA

SEQ ID NO: 48879 - protein, 11 aa, Dengue virus
GIFGYSQIGAG

SEQ ID NO: 48880 - protein, 11 aa, Dengue virus
IFGYSQIGAGV

SEQ ID NO: 48881 - protein, 11 aa, Dengue virus
FGYSQIGAGVY

SEQ ID NO: 48882 - protein, 11 aa, Dengue virus
MWHVTRGAVLV

SEQ ID NO: 48883 - protein, 11 aa, Dengue virus
WHVTRGAVLVH

SEQ ID NO: 48884 - protein, 11 aa, Dengue virus
HVTRGAVLMHK

SEQ ID NO: 48885 - protein, 11 aa, Dengue virus
VTRGAVLMHKG

SEQ ID NO: 48886 - protein, 11 aa, Dengue virus
TRGAVLMHKGK

SEQ ID NO: 48887 - protein, 11 aa, Dengue virus
RGAVLMHKGKR

SEQ ID NO: 48888 - protein, 11 aa, Dengue virus
GAVLMHKGKRI

SEQ ID NO: 48889 - protein, 11 aa, Dengue virus
AVLMHKGKRIE

SEQ ID NO: 48890 - protein, 11 aa, Dengue virus
VLMHKGKRIEP

SEQ ID NO: 48891 - protein, 11 aa, Dengue virus
LMHKGKRIEPS

SEQ ID NO: 48892 - protein, 11 aa, Dengue virus
MHKGKRIEPSW

SEQ ID NO: 48893 - protein, 11 aa, Dengue virus
HKGKRIEPSWA

SEQ ID NO: 48894 - protein, 11 aa, Dengue virus
KGKRIEPSWAD

SEQ ID NO: 48895 - protein, 11 aa, Dengue virus
KRIEPSWADVR

SEQ ID NO: 48896 - protein, 11 aa, Dengue virus
RIEPSWADVRK

SEQ ID NO: 48897 - protein, 11 aa, Dengue virus
IEPSWADVRKD

SEQ ID NO: 48898 - protein, 11 aa, Dengue virus
EPSWADVRKDL

SEQ ID NO: 48899 - protein, 11 aa, Dengue virus
PSWADVKKDLV

SEQ ID NO: 48900 - protein, 11 aa, Dengue virus
SWADVRKDLIS

SEQ ID NO: 48901 - protein, 11 aa, Dengue virus
WADVRKDLISY

SEQ ID NO: 48902 - protein, 11 aa, Dengue virus
ADVKKDLVSYG

SEQ ID NO: 48903 - protein, 11 aa, Dengue virus
DVRKDLISYGG

SEQ ID NO: 48904 - protein, 11 aa, Dengue virus
VKKDLVSYGGG

SEQ ID NO: 48905 - protein, 11 aa, Dengue virus
RKDLISYGGGW

SEQ ID NO: 48906 - protein, 11 aa, Dengue virus
KDLVSYGGGWK

SEQ ID NO: 48907 - protein, 11 aa, Dengue virus
DLVSYGGGWKL

SEQ ID NO: 48908 - protein, 11 aa, Dengue virus
LVSYGGGWKLE

SEQ ID NO: 48909 - protein, 11 aa, Dengue virus
VSYGGGWKLEG

SEQ ID NO: 48910 - protein, 11 aa, Dengue virus
NPRAVQTKPGI

SEQ ID NO: 48911 - protein, 11 aa, Dengue virus
PRAVQTKPGIF

SEQ ID NO: 48912 - protein, 11 aa, Dengue virus
RAVQTKPGIFK

SEQ ID NO: 48913 - protein, 11 aa, Dengue virus
AVQTKPGIFKT

SEQ ID NO: 48914 - protein, 11 aa, Dengue virus
VQTKPGIFKTN

SEQ ID NO: 48915 - protein, 11 aa, Dengue virus
FKTNAGTIGAV

SEQ ID NO: 48916 - protein, 11 aa, Dengue virus
KTNAGTIGAVS

SEQ ID NO: 48917 - protein, 11 aa, Dengue virus
TNAGTIGAVSL

SEQ ID NO: 48918 - protein, 11 aa, Dengue virus
NAGTIGAVSLD

SEQ ID NO: 48919 - protein, 11 aa, Dengue virus
AGTIGAVSLDF

SEQ ID NO: 48920 - protein, 11 aa, Dengue virus
FSPGTSGSPII

SEQ ID NO: 48921 - protein, 11 aa, Dengue virus
SPGTSGSPIID

SEQ ID NO: 48922 - protein, 11 aa, Dengue virus
PGTSGSPIIDK

SEQ ID NO: 48923 - protein, 11 aa, Dengue virus
GTSGSPIIDKK

SEQ ID NO: 48924 - protein, 11 aa, Dengue virus
TSGSPIIDKKG

SEQ ID NO: 48925 - protein, 11 aa, Dengue virus
SGSPIIDKKGK

SEQ ID NO: 48926 - protein, 11 aa, Dengue virus
GSPIIDKKGKV

SEQ ID NO: 48927 - protein, 11 aa, Dengue virus
SPIIDKKGKVV

SEQ ID NO: 48928 - protein, 11 aa, Dengue virus
PIIDKKGKVVG

SEQ ID NO: 48929 - protein, 11 aa, Dengue virus
IIDKKGKVVGL

SEQ ID NO: 48930 - protein, 11 aa, Dengue virus
IDKKGKVVGLY

SEQ ID NO: 48931 - protein, 11 aa, Dengue virus
DKKGKVVGLYG

SEQ ID NO: 48932 - protein, 11 aa, Dengue virus
KKGKVVGLYGN

SEQ ID NO: 48933 - protein, 11 aa, Dengue virus
YGNGVVTRSGT

SEQ ID NO: 48934 - protein, 11 aa, Dengue virus
GNGVVTRSGTY

SEQ ID NO: 48935 - protein, 11 aa, Dengue virus
NGVVTRSGTYV

SEQ ID NO: 48936 - protein, 11 aa, Dengue virus
GVVTRSGTYVS

SEQ ID NO: 48937 - protein, 11 aa, Dengue virus
VVTRSGTYVSA

SEQ ID NO: 48938 - protein, 11 aa, Dengue virus
VTRSGTYVSAI

SEQ ID NO: 48939 - protein, 11 aa, Dengue virus
TRSGTYVSAIA

SEQ ID NO: 48940 - protein, 11 aa, Dengue virus
RSGTYVSAIAQ

SEQ ID NO: 48941 - protein, 11 aa, Dengue virus
SGTYVSAIAQT

SEQ ID NO: 48942 - protein, 11 aa, Dengue virus
GTYVSAIAQTE

SEQ ID NO: 48943 - protein, 11 aa, Dengue virus
TYVSAIAQTEK

SEQ ID NO: 48944 - protein, 11 aa, Dengue virus
YVSSIAQTEKS

SEQ ID NO: 48945 - protein, 11 aa, Dengue virus
VSSIAQTEKSV

SEQ ID NO: 48946 - protein, 11 aa, Dengue virus
SSIAQTEKSVE

SEQ ID NO: 48947 - protein, 11 aa, Dengue virus
EDNPDIEDDIF

SEQ ID NO: 48948 - protein, 11 aa, Dengue virus
DNPDIEDDIFR

SEQ ID NO: 48949 - protein, 11 aa, Dengue virus
NPDIEDDIFRK

SEQ ID NO: 48950 - protein, 11 aa, Dengue virus
PEIEDDIFRKR

SEQ ID NO: 48951 - protein, 11 aa, Dengue virus
EIEDDIFRKRR

SEQ ID NO: 48952 - protein, 11 aa, Dengue virus
IEDDIFRKRRL

SEQ ID NO: 48953 - protein, 11 aa, Dengue virus
EDDIFRKRRLT

SEQ ID NO: 48954 - protein, 11 aa, Dengue virus
DDIFRKRRLTI

SEQ ID NO: 48955 - protein, 11 aa, Dengue virus
DIFRKRRLTIM

SEQ ID NO: 48956 - protein, 11 aa, Dengue virus
IFRKRRLTIMD

SEQ ID NO: 48957 - protein, 11 aa, Dengue virus
FRKRRLTIMDL

SEQ ID NO: 48958 - protein, 11 aa, Dengue virus
RKRRLTIMDLH

SEQ ID NO: 48959 - protein, 11 aa, Dengue virus
KRRLTIMDLHP

SEQ ID NO: 48960 - protein, 11 aa, Dengue virus
RRLTIMDLHPG

SEQ ID NO: 48961 - protein, 11 aa, Dengue virus
KLTIMDLHPGA

SEQ ID NO: 48962 - protein, 11 aa, Dengue virus
DLHPGAGKTKK

SEQ ID NO: 48963 - protein, 11 aa, Dengue virus
LHPGAGKTKKY

SEQ ID NO: 48964 - protein, 11 aa, Dengue virus
HPGAGKTKKYL

SEQ ID NO: 48965 - protein, 11 aa, Dengue virus
PGAGKTKKYLP

SEQ ID NO: 48966 - protein, 11 aa, Dengue virus
GAGKTKKYLPA

SEQ ID NO: 48967 - protein, 11 aa, Dengue virus
AGKTKKYLPAI

SEQ ID NO: 48968 - protein, 11 aa, Dengue virus
GKTKKYLPAIV

SEQ ID NO: 48969 - protein, 11 aa, Dengue virus
KTKKYLPAIVR

SEQ ID NO: 48970 - protein, 11 aa, Dengue virus
TKKYLPAIVRE

SEQ ID NO: 48971 - protein, 11 aa, Dengue virus
KKYLPAIVREA

SEQ ID NO: 48972 - protein, 11 aa, Dengue virus
KYLPAIVREAI

SEQ ID NO: 48973 - protein, 11 aa, Dengue virus
YLPAIVREAIR

SEQ ID NO: 48974 - protein, 11 aa, Dengue virus
LPAIVREAIRR

SEQ ID NO: 48975 - protein, 11 aa, Dengue virus
PAIVREAIRRG

SEQ ID NO: 48976 - protein, 11 aa, Dengue virus
AIVREAIRRGL

SEQ ID NO: 48977 - protein, 11 aa, Dengue virus
IVREAIRRGLR

SEQ ID NO: 48978 - protein, 11 aa, Dengue virus
VREAIRRGLRT

SEQ ID NO: 48979 - protein, 11 aa, Dengue virus
REAIRRGLRTL

SEQ ID NO: 48980 - protein, 11 aa, Dengue virus
EAIRRGLRTLI

SEQ ID NO: 48981 - protein, 11 aa, Dengue virus
AIRRGLRTLIL

SEQ ID NO: 48982 - protein, 11 aa, Dengue virus
IRRGLRTLILA

SEQ ID NO: 48983 - protein, 11 aa, Dengue virus
RRGLRTLILAP

SEQ ID NO: 48984 - protein, 11 aa, Dengue virus
LRGLPIRYQTT

SEQ ID NO: 48985 - protein, 11 aa, Dengue virus
RGLPIRYQTTA

SEQ ID NO: 48986 - protein, 11 aa, Dengue virus
GLPIRYQTTAI

SEQ ID NO: 48987 - protein, 11 aa, Dengue virus
LPIRYQTPAIK

SEQ ID NO: 48988 - protein, 11 aa, Dengue virus
PIRYQTPAIKT

SEQ ID NO: 48989 - protein, 11 aa, Dengue virus
IRYQTPAIKTE

SEQ ID NO: 48990 - protein, 11 aa, Dengue virus
RYQTPAIKTEH

SEQ ID NO: 48991 - protein, 11 aa, Dengue virus
YQTPAIKTEHT

SEQ ID NO: 48992 - protein, 11 aa, Dengue virus
QTPAIKTEHTG

SEQ ID NO: 48993 - protein, 11 aa, Dengue virus
TPAIKTEHTGR

SEQ ID NO: 48994 - protein, 11 aa, Dengue virus
PAIKTEHTGRE

SEQ ID NO: 48995 - protein, 11 aa, Dengue virus
AIKTEHTGREI

SEQ ID NO: 48996 - protein, 11 aa, Dengue virus
IKTEHTGREIV

SEQ ID NO: 48997 - protein, 11 aa, Dengue virus
KTEHTGREIVD

SEQ ID NO: 48998 - protein, 11 aa, Dengue virus
TEHTGREIVDL

SEQ ID NO: 48999 - protein, 11 aa, Dengue virus
ATFTMRLLSPI

SEQ ID NO: 49000 - protein, 11 aa, Dengue virus
TFTMRLLSPIR

SEQ ID NO: 49001 - protein, 11 aa, Dengue virus
FTMRLLSPIRV

SEQ ID NO: 49002 - protein, 11 aa, Dengue virus
TMRLLSPIRVP

SEQ ID NO: 49003 - protein, 11 aa, Dengue virus
MRLLSPIRVPN

SEQ ID NO: 49004 - protein, 11 aa, Dengue virus
RLLSPIRVPNY

SEQ ID NO: 49005 - protein, 11 aa, Dengue virus
LLSPIRVPNYN

SEQ ID NO: 49006 - protein, 11 aa, Dengue virus
LSPIRVPNYNL

SEQ ID NO: 49007 - protein, 11 aa, Dengue virus
SPIRVPNYNLI

SEQ ID NO: 49008 - protein, 11 aa, Dengue virus
PIRVPNYNLII

SEQ ID NO: 49009 - protein, 11 aa, Dengue virus
IRVPNYNLIIM

SEQ ID NO: 49010 - protein, 11 aa, Dengue virus
DPFPQSNAPII

SEQ ID NO: 49011 - protein, 11 aa, Dengue virus
PFPQSNAPIID

SEQ ID NO: 49012 - protein, 11 aa, Dengue virus
FPQSNAPIIDE

SEQ ID NO: 49013 - protein, 11 aa, Dengue virus
PQSNAPIIDEE

SEQ ID NO: 49014 - protein, 11 aa, Dengue virus
QSNAPIIDEER

SEQ ID NO: 49015 - protein, 11 aa, Dengue virus
SNAPIIDEERE

SEQ ID NO: 49016 - protein, 11 aa, Dengue virus
NAPIIDEEREI

SEQ ID NO: 49017 - protein, 11 aa, Dengue virus
APIIDEEREIP

SEQ ID NO: 49018 - protein, 11 aa, Dengue virus
PIIDEEREIPE

SEQ ID NO: 49019 - protein, 11 aa, Dengue virus
IIDEEREIPER

SEQ ID NO: 49020 - protein, 11 aa, Dengue virus
IDEEREIPERS

SEQ ID NO: 49021 - protein, 11 aa, Dengue virus
EEREIPERSWS

SEQ ID NO: 49022 - protein, 11 aa, Dengue virus
EREIPERSWSS

SEQ ID NO: 49023 - protein, 11 aa, Dengue virus
REIPERSWSSG

SEQ ID NO: 49024 - protein, 11 aa, Dengue virus
EIPERSWSSGH

SEQ ID NO: 49025 - protein, 11 aa, Dengue virus
IPERSWSSGHE

SEQ ID NO: 49026 - protein, 11 aa, Dengue virus
PERSWSSGHEW

SEQ ID NO: 49027 - protein, 11 aa, Dengue virus
ERSWNSGHEWI

SEQ ID NO: 49028 - protein, 11 aa, Dengue virus
RSWNSGHEWIT

SEQ ID NO: 49029 - protein, 11 aa, Dengue virus
SWNSGHEWITN

SEQ ID NO: 49030 - protein, 11 aa, Dengue virus
WSSGHEWVTDF

SEQ ID NO: 49031 - protein, 11 aa, Dengue virus
GHEWITNFKGK

SEQ ID NO: 49032 - protein, 11 aa, Dengue virus
HEWITNFKGKT

SEQ ID NO: 49033 - protein, 11 aa, Dengue virus
EWITNFKGKTV

SEQ ID NO: 49034 - protein, 11 aa, Dengue virus
WITNFKGKTVW

SEQ ID NO: 49035 - protein, 11 aa, Dengue virus
ITNFKGKTVWF

SEQ ID NO: 49036 - protein, 11 aa, Dengue virus
TNFKGKTVWFV

SEQ ID NO: 49037 - protein, 11 aa, Dengue virus
NFKGKTVWFVP

SEQ ID NO: 49038 - protein, 11 aa, Dengue virus
GKTVWFVPSIR

SEQ ID NO: 49039 - protein, 11 aa, Dengue virus
KTVWFVPSIKT

SEQ ID NO: 49040 - protein, 11 aa, Dengue virus
TVWFVPSIKTG

SEQ ID NO: 49041 - protein, 11 aa, Dengue virus
VWFVPSIKTGN

SEQ ID NO: 49042 - protein, 11 aa, Dengue virus
WFVPSIKTGND

SEQ ID NO: 49043 - protein, 11 aa, Dengue virus
FVPSIKTGNDI

SEQ ID NO: 49044 - protein, 11 aa, Dengue virus
VPSIKTGNDIA

SEQ ID NO: 49045 - protein, 11 aa, Dengue virus
PSIKTGNDIAA

SEQ ID NO: 49046 - protein, 11 aa, Dengue virus
SIKTGNDIAAC

SEQ ID NO: 49047 - protein, 11 aa, Dengue virus
IKTGNDIAACL

SEQ ID NO: 49048 - protein, 11 aa, Dengue virus
KTGNDIAACLR

SEQ ID NO: 49049 - protein, 11 aa, Dengue virus
TGNDIAACLRK

SEQ ID NO: 49050 - protein, 11 aa, Dengue virus
IAACLRKNGKR

SEQ ID NO: 49051 - protein, 11 aa, Dengue virus
AACLRKNGKRV

SEQ ID NO: 49052 - protein, 11 aa, Dengue virus
ACLRKNGKRVI

SEQ ID NO: 49053 - protein, 11 aa, Dengue virus
CLRKNGKRVIQ

SEQ ID NO: 49054 - protein, 11 aa, Dengue virus
LRKNGKRVIQL

SEQ ID NO: 49055 - protein, 11 aa, Dengue virus
RKNGKRVIQLS

SEQ ID NO: 49056 - protein, 11 aa, Dengue virus
KNGKRVIQLSR

SEQ ID NO: 49057 - protein, 11 aa, Dengue virus
NGKRVIQLSRK

SEQ ID NO: 49058 - protein, 11 aa, Dengue virus
GKRVIQLSRKT

SEQ ID NO: 49059 - protein, 11 aa, Dengue virus
KRVIQLSRKTF

SEQ ID NO: 49060 - protein, 11 aa, Dengue virus
RVIQLSRKTFD

SEQ ID NO: 49061 - protein, 11 aa, Dengue virus
VIQLSRKTFDT

SEQ ID NO: 49062 - protein, 11 aa, Dengue virus
IQLSRKTFDTE

SEQ ID NO: 49063 - protein, 11 aa, Dengue virus
QLSRKTFDTEY

SEQ ID NO: 49064 - protein, 11 aa, Dengue virus
LSRKTFDSEYI

SEQ ID NO: 49065 - protein, 11 aa, Dengue virus
SRKTFDSEYIK

SEQ ID NO: 49066 - protein, 11 aa, Dengue virus
RKTFDSEYIKT

SEQ ID NO: 49067 - protein, 11 aa, Dengue virus
KTFDSEYIKTR

SEQ ID NO: 49068 - protein, 11 aa, Dengue virus
KTRANDWDFVV

SEQ ID NO: 49069 - protein, 11 aa, Dengue virus
TRANDWDFVVT

SEQ ID NO: 49070 - protein, 11 aa, Dengue virus
RANDWDFVVTT

SEQ ID NO: 49071 - protein, 11 aa, Dengue virus
ANDWDFVVTTD

SEQ ID NO: 49072 - protein, 11 aa, Dengue virus
TDISEMGANFR

SEQ ID NO: 49073 - protein, 11 aa, Dengue virus
DISEMGANFRA

SEQ ID NO: 49074 - protein, 11 aa, Dengue virus
ISEMGANFRAE

SEQ ID NO: 49075 - protein, 11 aa, Dengue virus
SEMGANFRAER

SEQ ID NO: 49076 - protein, 11 aa, Dengue virus
EMGANFRAERV

SEQ ID NO: 49077 - protein, 11 aa, Dengue virus
MGANFRAERVI

SEQ ID NO: 49078 - protein, 11 aa, Dengue virus
GANFRAERVID

SEQ ID NO: 49079 - protein, 11 aa, Dengue virus
ANFRAERVIDP

SEQ ID NO: 49080 - protein, 11 aa, Dengue virus
NFRAERVIDPR

SEQ ID NO: 49081 - protein, 11 aa, Dengue virus
FRAERVIDPRR

SEQ ID NO: 49082 - protein, 11 aa, Dengue virus
RAERVIDPRRC

SEQ ID NO: 49083 - protein, 11 aa, Dengue virus
RCMKPVILTEG

SEQ ID NO: 49084 - protein, 11 aa, Dengue virus
CMKPVILTEGE

SEQ ID NO: 49085 - protein, 11 aa, Dengue virus
MKPVILTEGEE

SEQ ID NO: 49086 - protein, 11 aa, Dengue virus
KPVILTEGEER

SEQ ID NO: 49087 - protein, 11 aa, Dengue virus
PVILTEGEERV

SEQ ID NO: 49088 - protein, 11 aa, Dengue virus
VILTDGEERVV

SEQ ID NO: 49089 - protein, 11 aa, Dengue virus
ILTDGEERVVL

SEQ ID NO: 49090 - protein, 11 aa, Dengue virus
LTDGEERVVLA

SEQ ID NO: 49091 - protein, 11 aa, Dengue virus
TDGEERVVLAG

SEQ ID NO: 49092 - protein, 11 aa, Dengue virus
DGEERVVLAGP

SEQ ID NO: 49093 - protein, 11 aa, Dengue virus
GEERVVLAGPM

SEQ ID NO: 49094 - protein, 11 aa, Dengue virus
EERVVLAGPMP

SEQ ID NO: 49095 - protein, 11 aa, Dengue virus
ERVVLAGPMPV

SEQ ID NO: 49096 - protein, 11 aa, Dengue virus
RVVLAGPMPVT

SEQ ID NO: 49097 - protein, 11 aa, Dengue virus
VVLAGPMPVTH

SEQ ID NO: 49098 - protein, 11 aa, Dengue virus
VLAGPMPVTHS

SEQ ID NO: 49099 - protein, 11 aa, Dengue virus
LAGPMPVTHFS

SEQ ID NO: 49100 - protein, 11 aa, Dengue virus
AGPMPVTHFSA

SEQ ID NO: 49101 - protein, 11 aa, Dengue virus
GPMPVTHFSAA

SEQ ID NO: 49102 - protein, 11 aa, Dengue virus
PMPVTHFSAAQ

SEQ ID NO: 49103 - protein, 11 aa, Dengue virus
MPVTHFSAAQR

SEQ ID NO: 49104 - protein, 11 aa, Dengue virus
PVTHFSAAQRR

SEQ ID NO: 49105 - protein, 11 aa, Dengue virus
HSSAAQRRGRV

SEQ ID NO: 49106 - protein, 11 aa, Dengue virus
SSAAQRRGRVG

SEQ ID NO: 49107 - protein, 11 aa, Dengue virus
SAAQRRGRVGR

SEQ ID NO: 49108 - protein, 11 aa, Dengue virus
AAQRRGRVGRN

SEQ ID NO: 49109 - protein, 11 aa, Dengue virus
AQRRGRVGRNP

SEQ ID NO: 49110 - protein, 11 aa, Dengue virus
QRRGRVGRNPK

SEQ ID NO: 49111 - protein, 11 aa, Dengue virus
RRGRVGRNPKN

SEQ ID NO: 49112 - protein, 11 aa, Dengue virus
RGRVGRNPKNE

SEQ ID NO: 49113 - protein, 11 aa, Dengue virus
GRVGRNPKNEN

SEQ ID NO: 49114 - protein, 11 aa, Dengue virus
RVGRNPKNEND

SEQ ID NO: 49115 - protein, 11 aa, Dengue virus
VGRNPKNENDQ

SEQ ID NO: 49116 - protein, 11 aa, Dengue virus
GRNPRNENDQY

SEQ ID NO: 49117 - protein, 11 aa, Dengue virus
RNPRNENDQYI

SEQ ID NO: 49118 - protein, 11 aa, Dengue virus
NPRNENDQYIY

SEQ ID NO: 49119 - protein, 11 aa, Dengue virus
PRNENDQYIYM

SEQ ID NO: 49120 - protein, 11 aa, Dengue virus
RNENDQYIYMG

SEQ ID NO: 49121 - protein, 11 aa, Dengue virus
FEPEREKVDAV

SEQ ID NO: 49122 - protein, 11 aa, Dengue virus
EPEREKVDAVD

SEQ ID NO: 49123 - protein, 11 aa, Dengue virus
PEREKVDAVDG

SEQ ID NO: 49124 - protein, 11 aa, Dengue virus
EREKVDAVDGE

SEQ ID NO: 49125 - protein, 11 aa, Dengue virus
REKVDAVDGEY

SEQ ID NO: 49126 - protein, 11 aa, Dengue virus
EKVDAVDGEYR

SEQ ID NO: 49127 - protein, 11 aa, Dengue virus
KVDAVDGEYRL

SEQ ID NO: 49128 - protein, 11 aa, Dengue virus
VDAVDGEYRLR

SEQ ID NO: 49129 - protein, 11 aa, Dengue virus
DAVDGEYRLRG

SEQ ID NO: 49130 - protein, 11 aa, Dengue virus
AVDGEYRLRGE

SEQ ID NO: 49131 - protein, 11 aa, Dengue virus
VDGEYRLRGEA

SEQ ID NO: 49132 - protein, 11 aa, Dengue virus
EARKTFVDLMK

SEQ ID NO: 49133 - protein, 11 aa, Dengue virus
ARKTFVDLMKR

SEQ ID NO: 49134 - protein, 11 aa, Dengue virus
RKTFVDLMKRG

SEQ ID NO: 49135 - protein, 11 aa, Dengue virus
KTFVDLMKRGD

SEQ ID NO: 49136 - protein, 11 aa, Dengue virus
TFVDLMKRGDL

SEQ ID NO: 49137 - protein, 11 aa, Dengue virus
FVDLMKRGDLP

SEQ ID NO: 49138 - protein, 11 aa, Dengue virus
VDLMKRGDLPV

SEQ ID NO: 49139 - protein, 11 aa, Dengue virus
DLMKRGDLPVW

SEQ ID NO: 49140 - protein, 11 aa, Dengue virus
LMKRGDLPVWL

SEQ ID NO: 49141 - protein, 11 aa, Dengue virus
MKRGDLPVWLA

SEQ ID NO: 49142 - protein, 11 aa, Dengue virus
KRGDLPVWLAY

SEQ ID NO: 49143 - protein, 11 aa, Dengue virus
RGDLPVWLAYR

SEQ ID NO: 49144 - protein, 11 aa, Dengue virus
GDLPVWLAYRV

SEQ ID NO: 49145 - protein, 11 aa, Dengue virus
DLPVWLAYRVA

SEQ ID NO: 49146 - protein, 11 aa, Dengue virus
LPVWLAYRVAA

SEQ ID NO: 49147 - protein, 11 aa, Dengue virus
PVWLAYRVAAE

SEQ ID NO: 49148 - protein, 11 aa, Dengue virus
VWLAYRVAAEG

SEQ ID NO: 49149 - protein, 11 aa, Dengue virus
WLAYRVAAEGI

SEQ ID NO: 49150 - protein, 11 aa, Dengue virus
LAYRVAAEGIN

SEQ ID NO: 49151 - protein, 11 aa, Dengue virus
AYRVAAEGINY

SEQ ID NO: 49152 - protein, 11 aa, Dengue virus
RVAAEGINYAD

SEQ ID NO: 49153 - protein, 11 aa, Dengue virus
VASEGINYADR

SEQ ID NO: 49154 - protein, 11 aa, Dengue virus
EGINYADRKWC

SEQ ID NO: 49155 - protein, 11 aa, Dengue virus
GINYADRKWCF

SEQ ID NO: 49156 - protein, 11 aa, Dengue virus
INYADRKWCFD

SEQ ID NO: 49157 - protein, 11 aa, Dengue virus
NYADRKWCFDG

SEQ ID NO: 49158 - protein, 11 aa, Dengue virus
YADRKWCFDGI

SEQ ID NO: 49159 - protein, 11 aa, Dengue virus
DRKWCFDGIKN

SEQ ID NO: 49160 - protein, 11 aa, Dengue virus
RKWCFDGIKNN

SEQ ID NO: 49161 - protein, 11 aa, Dengue virus
KWCFDGIKNNQ

SEQ ID NO: 49162 - protein, 11 aa, Dengue virus
WCFDGVKNNQI

SEQ ID NO: 49163 - protein, 11 aa, Dengue virus
CFDGVKNNQIL

SEQ ID NO: 49164 - protein, 11 aa, Dengue virus
FDGVKNNQILE

SEQ ID NO: 49165 - protein, 11 aa, Dengue virus
DGVKNNQILEE

SEQ ID NO: 49166 - protein, 11 aa, Dengue virus
GVKNNQILEEN

SEQ ID NO: 49167 - protein, 11 aa, Dengue virus
KNNQILEENME

SEQ ID NO: 49168 - protein, 11 aa, Dengue virus
NNQILEENMEV

SEQ ID NO: 49169 - protein, 11 aa, Dengue virus
NQILEENMEVE

SEQ ID NO: 49170 - protein, 11 aa, Dengue virus
QILEENMEVEI

SEQ ID NO: 49171 - protein, 11 aa, Dengue virus
ILEENMEVEIW

SEQ ID NO: 49172 - protein, 11 aa, Dengue virus
LEENMEVEIWT

SEQ ID NO: 49173 - protein, 11 aa, Dengue virus
EENMEVEIWTK

SEQ ID NO: 49174 - protein, 11 aa, Dengue virus
ENMEVEIWTKE

SEQ ID NO: 49175 - protein, 11 aa, Dengue virus
NMEVEIWTKEG

SEQ ID NO: 49176 - protein, 11 aa, Dengue virus
MEVEIWTKEGE

SEQ ID NO: 49177 - protein, 11 aa, Dengue virus
EVEVWTKEGER

SEQ ID NO: 49178 - protein, 11 aa, Dengue virus
VEVWTKEGERK

SEQ ID NO: 49179 - protein, 11 aa, Dengue virus
EVWTKEGERKK

SEQ ID NO: 49180 - protein, 11 aa, Dengue virus
VWTKEGERKKL

SEQ ID NO: 49181 - protein, 11 aa, Dengue virus
KLKPRWLDART

SEQ ID NO: 49182 - protein, 11 aa, Dengue virus
LKPRWLDARTY

SEQ ID NO: 49183 - protein, 11 aa, Dengue virus
KPRWLDARTYS

SEQ ID NO: 49184 - protein, 11 aa, Dengue virus
PRWLDARTYSD

SEQ ID NO: 49185 - protein, 11 aa, Dengue virus
RWLDARTYSDP

SEQ ID NO: 49186 - protein, 11 aa, Dengue virus
WLDARTYSDPL

SEQ ID NO: 49187 - protein, 11 aa, Dengue virus
LDARTYSDPLA

SEQ ID NO: 49188 - protein, 11 aa, Dengue virus
DARTYSDPLAL

SEQ ID NO: 49189 - protein, 11 aa, Dengue virus
ARTYSDPLALK

SEQ ID NO: 49190 - protein, 11 aa, Dengue virus
RTYSDPLALKE

SEQ ID NO: 49191 - protein, 11 aa, Dengue virus
TYSDPLALKEF

SEQ ID NO: 49192 - protein, 11 aa, Dengue virus
KEFAAGRKSLA

SEQ ID NO: 49193 - protein, 11 aa, Dengue virus
EFAAGRKSLAL

SEQ ID NO: 49194 - protein, 11 aa, Dengue virus
FAAGRKSLALN

SEQ ID NO: 49195 - protein, 11 aa, Dengue virus
AAGRKSLALNL

SEQ ID NO: 49196 - protein, 11 aa, Dengue virus
AGRKSLALNLI

SEQ ID NO: 49197 - protein, 11 aa, Dengue virus
GRKSLALNLIT

SEQ ID NO: 49198 - protein, 11 aa, Dengue virus
RKSLALNLITE

SEQ ID NO: 49199 - protein, 11 aa, Dengue virus
KSLALNLITEM

SEQ ID NO: 49200 - protein, 11 aa, Dengue virus
SLALNLITEMG

SEQ ID NO: 49201 - protein, 11 aa, Dengue virus
LALNLITEMGR

SEQ ID NO: 49202 - protein, 11 aa, Dengue virus
ALNLITEMGRL

SEQ ID NO: 49203 - protein, 11 aa, Dengue virus
LSLITEMGRLP

SEQ ID NO: 49204 - protein, 11 aa, Dengue virus
SLITEMGRLPT

SEQ ID NO: 49205 - protein, 11 aa, Dengue virus
GRLPTFMTQKT

SEQ ID NO: 49206 - protein, 11 aa, Dengue virus
RLPTFMTQKTR

SEQ ID NO: 49207 - protein, 11 aa, Dengue virus
LPTFMTQKTRD

SEQ ID NO: 49208 - protein, 11 aa, Dengue virus
PTFMTQKTRDA

SEQ ID NO: 49209 - protein, 11 aa, Dengue virus
TFMTQKTRDAL

SEQ ID NO: 49210 - protein, 11 aa, Dengue virus
FMTQKTRDALD

SEQ ID NO: 49211 - protein, 11 aa, Dengue virus
MTQKTRDALDN

SEQ ID NO: 49212 - protein, 11 aa, Dengue virus
TQKTRDALDNL

SEQ ID NO: 49213 - protein, 11 aa, Dengue virus
QKTRDALDNLA

SEQ ID NO: 49214 - protein, 11 aa, Dengue virus
KTRDALDNLAV

SEQ ID NO: 49215 - protein, 11 aa, Dengue virus
TRDALDNLAVL

SEQ ID NO: 49216 - protein, 11 aa, Dengue virus
RNALDNLAVLH

SEQ ID NO: 49217 - protein, 11 aa, Dengue virus
NALDNLAVLHT

SEQ ID NO: 49218 - protein, 11 aa, Dengue virus
ALDNLAVLHSA

SEQ ID NO: 49219 - protein, 11 aa, Dengue virus
LDNLAVLHSAE

SEQ ID NO: 49220 - protein, 11 aa, Dengue virus
DNLAVLHTAEV

SEQ ID NO: 49221 - protein, 11 aa, Dengue virus
NLAVLHTAEVG

SEQ ID NO: 49222 - protein, 11 aa, Dengue virus
LAVLHTAEVGG

SEQ ID NO: 49223 - protein, 11 aa, Dengue virus
AVLHTAEVGGR

SEQ ID NO: 49224 - protein, 11 aa, Dengue virus
VLHTAEVGGRA

SEQ ID NO: 49225 - protein, 11 aa, Dengue virus
GGKAYNHALSE

SEQ ID NO: 49226 - protein, 11 aa, Dengue virus
GKAYNHALSEL

SEQ ID NO: 49227 - protein, 11 aa, Dengue virus
KAYNHALSELP

SEQ ID NO: 49228 - protein, 11 aa, Dengue virus
AYTHALSELPE

SEQ ID NO: 49229 - protein, 11 aa, Dengue virus
YTHALSELPET

SEQ ID NO: 49230 - protein, 11 aa, Dengue virus
THALSELPETL

SEQ ID NO: 49231 - protein, 11 aa, Dengue virus
PETLETLLLLG

SEQ ID NO: 49232 - protein, 11 aa, Dengue virus
ETLETLLLLGL

SEQ ID NO: 49233 - protein, 11 aa, Dengue virus
TLETLLLLGLL

SEQ ID NO: 49234 - protein, 11 aa, Dengue virus
LETLLLLGLLA

SEQ ID NO: 49235 - protein, 11 aa, Dengue virus
ETLLLLGLLAT

SEQ ID NO: 49236 - protein, 11 aa, Dengue virus
TLLLLGLLATV

SEQ ID NO: 49237 - protein, 11 aa, Dengue virus
LLLLGLLATVT

SEQ ID NO: 49238 - protein, 11 aa, Dengue virus
LLLGLLATVTG

SEQ ID NO: 49239 - protein, 11 aa, Dengue virus
LLGLLATVTGG

SEQ ID NO: 49240 - protein, 11 aa, Dengue virus
LGLLATVTGGI

SEQ ID NO: 49241 - protein, 11 aa, Dengue virus
GLLATVTGGIF

SEQ ID NO: 49242 - protein, 11 aa, Dengue virus
LLAAVTGGIFL

SEQ ID NO: 49243 - protein, 11 aa, Dengue virus
LAAVTGGIFLF

SEQ ID NO: 49244 - protein, 11 aa, Dengue virus
AAVTGGIFLFL

SEQ ID NO: 49245 - protein, 11 aa, Dengue virus
AVTGGIFLFLM

SEQ ID NO: 49246 - protein, 11 aa, Dengue virus
TGGIFLFLMSA

SEQ ID NO: 49247 - protein, 11 aa, Dengue virus
GGIFLFLMSGR

SEQ ID NO: 49248 - protein, 11 aa, Dengue virus
GIFLFLMSGRG

SEQ ID NO: 49249 - protein, 11 aa, Dengue virus
FLFLMSGRGIG

SEQ ID NO: 49250 - protein, 11 aa, Dengue virus
LFLMSGRGIGK

SEQ ID NO: 49251 - protein, 11 aa, Dengue virus
FLMSGRGIGKM

SEQ ID NO: 49252 - protein, 11 aa, Dengue virus
LMSGRGIGKMT

SEQ ID NO: 49253 - protein, 11 aa, Dengue virus
MSGRGIGKMTL

SEQ ID NO: 49254 - protein, 11 aa, Dengue virus
SGRGIGKMTLG

SEQ ID NO: 49255 - protein, 11 aa, Dengue virus
GRGIGKMTLGM

SEQ ID NO: 49256 - protein, 11 aa, Dengue virus
RGIGKMTLGMC

SEQ ID NO: 49257 - protein, 11 aa, Dengue virus
GVGKMTLGMCC

SEQ ID NO: 49258 - protein, 11 aa, Dengue virus
VGKMTLGMCCI

SEQ ID NO: 49259 - protein, 11 aa, Dengue virus
GKMTLGMCCIV

SEQ ID NO: 49260 - protein, 11 aa, Dengue virus
KMTLGMCCIVT

SEQ ID NO: 49261 - protein, 11 aa, Dengue virus
MTLGMCCIVTA

SEQ ID NO: 49262 - protein, 11 aa, Dengue virus
TLGMCCIVTAS

SEQ ID NO: 49263 - protein, 11 aa, Dengue virus
LLWHAQIQPHW

SEQ ID NO: 49264 - protein, 11 aa, Dengue virus
LWHAQIQPHWI

SEQ ID NO: 49265 - protein, 11 aa, Dengue virus
WHAQIQPHWIA

SEQ ID NO: 49266 - protein, 11 aa, Dengue virus
HAQIQPHWIAA

SEQ ID NO: 49267 - protein, 11 aa, Dengue virus
AASIILVFFLI

SEQ ID NO: 49268 - protein, 11 aa, Dengue virus
ASIILVFFLIV

SEQ ID NO: 49269 - protein, 11 aa, Dengue virus
SIILVFFLIVL

SEQ ID NO: 49270 - protein, 11 aa, Dengue virus
IILVFFLIVLL

SEQ ID NO: 49271 - protein, 11 aa, Dengue virus
ILVFFLIVLLI

SEQ ID NO: 49272 - protein, 11 aa, Dengue virus
LVFFLIVLLIP

SEQ ID NO: 49273 - protein, 11 aa, Dengue virus
VFFLIVLLIPE

SEQ ID NO: 49274 - protein, 11 aa, Dengue virus
TPQDNQLTYVI

SEQ ID NO: 49275 - protein, 11 aa, Dengue virus
PQDNQLTYVII

SEQ ID NO: 49276 - protein, 11 aa, Dengue virus
QDNQLTYVIIA

SEQ ID NO: 49277 - protein, 11 aa, Dengue virus
DNQLTYVIIAI

SEQ ID NO: 49278 - protein, 11 aa, Dengue virus
NQLTYVIIAIL

SEQ ID NO: 49279 - protein, 11 aa, Dengue virus
QLTYVIIAILT

SEQ ID NO: 49280 - protein, 11 aa, Dengue virus
LTYVIIAILTV

SEQ ID NO: 49281 - protein, 11 aa, Dengue virus
TYVIIAILTVV

SEQ ID NO: 49282 - protein, 11 aa, Dengue virus
YVIIAILTVVA

SEQ ID NO: 49283 - protein, 11 aa, Dengue virus
VIIAILTVVAA

SEQ ID NO: 49284 - protein, 11 aa, Dengue virus
IIAILTVVAAT

SEQ ID NO: 49285 - protein, 11 aa, Dengue virus
IAILTLVAATM

SEQ ID NO: 49286 - protein, 11 aa, Dengue virus
AILTLVAATMA

SEQ ID NO: 49287 - protein, 11 aa, Dengue virus
ILTLVAATMAN

SEQ ID NO: 49288 - protein, 11 aa, Dengue virus
LTLVAATMANE

SEQ ID NO: 49289 - protein, 11 aa, Dengue virus
TLVAATMANEM

SEQ ID NO: 49290 - protein, 11 aa, Dengue virus
LVAATMANEMG

SEQ ID NO: 49291 - protein, 11 aa, Dengue virus
MGFLEKTKKDF

SEQ ID NO: 49292 - protein, 11 aa, Dengue virus
GFLEKTKKDFG

SEQ ID NO: 49293 - protein, 11 aa, Dengue virus
FLEKTKKDFGL

SEQ ID NO: 49294 - protein, 11 aa, Dengue virus
LEKTKKDFGLG

SEQ ID NO: 49295 - protein, 11 aa, Dengue virus
QPESNILDIDL

SEQ ID NO: 49296 - protein, 11 aa, Dengue virus
SESNILDIDLR

SEQ ID NO: 49297 - protein, 11 aa, Dengue virus
EINILDIDLRP

SEQ ID NO: 49298 - protein, 11 aa, Dengue virus
INILDIDLRPA

SEQ ID NO: 49299 - protein, 11 aa, Dengue virus
WTLYAVATTFI

SEQ ID NO: 49300 - protein, 11 aa, Dengue virus
TLYAVATTFIT

SEQ ID NO: 49301 - protein, 11 aa, Dengue virus
LYAVATTFITP

SEQ ID NO: 49302 - protein, 11 aa, Dengue virus
YAVATTFITPM

SEQ ID NO: 49303 - protein, 11 aa, Dengue virus
AVATTFITPML

SEQ ID NO: 49304 - protein, 11 aa, Dengue virus
VATTFITPMLR

SEQ ID NO: 49305 - protein, 11 aa, Dengue virus
ATTFITPMLRH

SEQ ID NO: 49306 - protein, 11 aa, Dengue virus
TTFITPMLRHS

SEQ ID NO: 49307 - protein, 11 aa, Dengue virus
TFITPMLRHSI

SEQ ID NO: 49308 - protein, 11 aa, Dengue virus
FITPMLRHSIE

SEQ ID NO: 49309 - protein, 11 aa, Dengue virus
ITPMLRHSIEN

SEQ ID NO: 49310 - protein, 11 aa, Dengue virus
NQATVLMGLGR

SEQ ID NO: 49311 - protein, 11 aa, Dengue virus
QATVLMGLGRG

SEQ ID NO: 49312 - protein, 11 aa, Dengue virus
ATVLMGLGRGW

SEQ ID NO: 49313 - protein, 11 aa, Dengue virus
TVLMGLGRGWP

SEQ ID NO: 49314 - protein, 11 aa, Dengue virus
VLMGLGRGWPL

SEQ ID NO: 49315 - protein, 11 aa, Dengue virus
LMGLGRGWPLS

SEQ ID NO: 49316 - protein, 11 aa, Dengue virus
MGLGRGWPLSK

SEQ ID NO: 49317 - protein, 11 aa, Dengue virus
GLGRGWPLSKM

SEQ ID NO: 49318 - protein, 11 aa, Dengue virus
LGRGWPLSKMD

SEQ ID NO: 49319 - protein, 11 aa, Dengue virus
GRGWPLSKMDI

SEQ ID NO: 49320 - protein, 11 aa, Dengue virus
RGWPLSKMDIG

SEQ ID NO: 49321 - protein, 11 aa, Dengue virus
GWPLSKMDIGA

SEQ ID NO: 49322 - protein, 11 aa, Dengue virus
WPLSKMDIGAP

SEQ ID NO: 49323 - protein, 11 aa, Dengue virus
PLSKMDIGAPL

SEQ ID NO: 49324 - protein, 11 aa, Dengue virus
LSKMDIGAPLL

SEQ ID NO: 49325 - protein, 11 aa, Dengue virus
SKMDIGAPLLA

SEQ ID NO: 49326 - protein, 11 aa, Dengue virus
KMDIGAPLLAI

SEQ ID NO: 49327 - protein, 11 aa, Dengue virus
MDIGAPLLAIG

SEQ ID NO: 49328 - protein, 11 aa, Dengue virus
DIGAPLLAIGC

SEQ ID NO: 49329 - protein, 11 aa, Dengue virus
IGAPLLAIGCY

SEQ ID NO: 49330 - protein, 11 aa, Dengue virus
GAPLLAIGCYS

SEQ ID NO: 49331 - protein, 11 aa, Dengue virus
APLLAIGCYSQ

SEQ ID NO: 49332 - protein, 11 aa, Dengue virus
AIGCYSQVNPV

SEQ ID NO: 49333 - protein, 11 aa, Dengue virus
YSQVNPVTLTA

SEQ ID NO: 49334 - protein, 11 aa, Dengue virus
SQVNPVTLTAA

SEQ ID NO: 49335 - protein, 11 aa, Dengue virus
QVNPVTLTAAL

SEQ ID NO: 49336 - protein, 11 aa, Dengue virus
VNPITLTAALF

SEQ ID NO: 49337 - protein, 11 aa, Dengue virus
NPITLTAALFL

SEQ ID NO: 49338 - protein, 11 aa, Dengue virus
PITLTAALFLL

SEQ ID NO: 49339 - protein, 11 aa, Dengue virus
LIAHYAIIGPG

SEQ ID NO: 49340 - protein, 11 aa, Dengue virus
IAHYAIIGPGL

SEQ ID NO: 49341 - protein, 11 aa, Dengue virus
AKATREAQKRT

SEQ ID NO: 49342 - protein, 11 aa, Dengue virus
KATREAQKRTA

SEQ ID NO: 49343 - protein, 11 aa, Dengue virus
ATREAQKRTAA

SEQ ID NO: 49344 - protein, 11 aa, Dengue virus
TREAQKRTAAG

SEQ ID NO: 49345 - protein, 11 aa, Dengue virus
REAQKRTAAGI

SEQ ID NO: 49346 - protein, 11 aa, Dengue virus
EAQKRTAAGIM

SEQ ID NO: 49347 - protein, 11 aa, Dengue virus
AQKRTAAGIMK

SEQ ID NO: 49348 - protein, 11 aa, Dengue virus
QKRTAAGIMKN

SEQ ID NO: 49349 - protein, 11 aa, Dengue virus
KRTAAGIMKNP

SEQ ID NO: 49350 - protein, 11 aa, Dengue virus
RTAAGIMKNPT

SEQ ID NO: 49351 - protein, 11 aa, Dengue virus
TAAGIMKNPTV

SEQ ID NO: 49352 - protein, 11 aa, Dengue virus
GIMKNPTVDGV

SEQ ID NO: 49353 - protein, 11 aa, Dengue virus
IMKNPTVDGVT

SEQ ID NO: 49354 - protein, 11 aa, Dengue virus
MKNPTVDGVTV

SEQ ID NO: 49355 - protein, 11 aa, Dengue virus
KNPTVDGVTVI

SEQ ID NO: 49356 - protein, 11 aa, Dengue virus
NPTVDGVTVID

SEQ ID NO: 49357 - protein, 11 aa, Dengue virus
PTVDGVTVIDL

SEQ ID NO: 49358 - protein, 11 aa, Dengue virus
TVDGITVIDLD

SEQ ID NO: 49359 - protein, 11 aa, Dengue virus
VDGITVIDLDP

SEQ ID NO: 49360 - protein, 11 aa, Dengue virus
DGITVIDLDPI

SEQ ID NO: 49361 - protein, 11 aa, Dengue virus
GITVIDLDPIP

SEQ ID NO: 49362 - protein, 11 aa, Dengue virus
ITVIDLDPIPY

SEQ ID NO: 49363 - protein, 11 aa, Dengue virus
TVIDLEPIPYD

SEQ ID NO: 49364 - protein, 11 aa, Dengue virus
VIDLEPIPYDP

SEQ ID NO: 49365 - protein, 11 aa, Dengue virus
IDLEPIPYDPK

SEQ ID NO: 49366 - protein, 11 aa, Dengue virus
DLEPIPYDPKF

SEQ ID NO: 49367 - protein, 11 aa, Dengue virus
LDPIPYDPKFE

SEQ ID NO: 49368 - protein, 11 aa, Dengue virus
EPIPYDPKFEK

SEQ ID NO: 49369 - protein, 11 aa, Dengue virus
EKQLGQVMLLV

SEQ ID NO: 49370 - protein, 11 aa, Dengue virus
KQLGQVMLLVL

SEQ ID NO: 49371 - protein, 11 aa, Dengue virus
QLGQVMLLVLC

SEQ ID NO: 49372 - protein, 11 aa, Dengue virus
LGQVMLLVLCV

SEQ ID NO: 49373 - protein, 11 aa, Dengue virus
GQVMLLVLCVT

SEQ ID NO: 49374 - protein, 11 aa, Dengue virus
QVMLLVLCVTQ

SEQ ID NO: 49375 - protein, 11 aa, Dengue virus
VMLLVLCVTQV

SEQ ID NO: 49376 - protein, 11 aa, Dengue virus
MLLVLCVTQVL

SEQ ID NO: 49377 - protein, 11 aa, Dengue virus
LLVLCVTQVLM

SEQ ID NO: 49378 - protein, 11 aa, Dengue virus
LVLCVTQVLMM

SEQ ID NO: 49379 - protein, 11 aa, Dengue virus
VLCVTQVLMMR

SEQ ID NO: 49380 - protein, 11 aa, Dengue virus
CEALTLATGPV

SEQ ID NO: 49381 - protein, 11 aa, Dengue virus
EALTLATGPVS

SEQ ID NO: 49382 - protein, 11 aa, Dengue virus
ALTLATGPVST

SEQ ID NO: 49383 - protein, 11 aa, Dengue virus
LTLATGPVSTL

SEQ ID NO: 49384 - protein, 11 aa, Dengue virus
TLATGPVSTLW

SEQ ID NO: 49385 - protein, 11 aa, Dengue virus
LATGPVSTLWE

SEQ ID NO: 49386 - protein, 11 aa, Dengue virus
ATGPVSTLWEG

SEQ ID NO: 49387 - protein, 11 aa, Dengue virus
TGPVSTLWEGN

SEQ ID NO: 49388 - protein, 11 aa, Dengue virus
GPVSTLWEGNP

SEQ ID NO: 49389 - protein, 11 aa, Dengue virus
PVSTLWEGNPG

SEQ ID NO: 49390 - protein, 11 aa, Dengue virus
VSTLWEGNPGR

SEQ ID NO: 49391 - protein, 11 aa, Dengue virus
STLWEGNPGKF

SEQ ID NO: 49392 - protein, 11 aa, Dengue virus
TLWEGNPGKFW

SEQ ID NO: 49393 - protein, 11 aa, Dengue virus
LWEGNPGKFWN

SEQ ID NO: 49394 - protein, 11 aa, Dengue virus
WEGNPGKFWNT

SEQ ID NO: 49395 - protein, 11 aa, Dengue virus
EGNPGKFWNTT

SEQ ID NO: 49396 - protein, 11 aa, Dengue virus
GNPGKFWNTTI

SEQ ID NO: 49397 - protein, 11 aa, Dengue virus
NPGKFWNTTIA

SEQ ID NO: 49398 - protein, 11 aa, Dengue virus
PGKFWNTTIAV

SEQ ID NO: 49399 - protein, 11 aa, Dengue virus
GKFWNTTIAVS

SEQ ID NO: 49400 - protein, 11 aa, Dengue virus
KFWNTTIAVSM

SEQ ID NO: 49401 - protein, 11 aa, Dengue virus
AGAGLLFSIMR

SEQ ID NO: 49402 - protein, 11 aa, Dengue virus
GAGLLFSIMRN

SEQ ID NO: 49403 - protein, 11 aa, Dengue virus
AGLLFSIMRNT

SEQ ID NO: 49404 - protein, 11 aa, Dengue virus
GLLFSIMKNTA

SEQ ID NO: 49405 - protein, 11 aa, Dengue virus
LLFSIMKNTTS

SEQ ID NO: 49406 - protein, 11 aa, Dengue virus
RRGTGNMGETL

SEQ ID NO: 49407 - protein, 11 aa, Dengue virus
RGTGNMGETLG

SEQ ID NO: 49408 - protein, 11 aa, Dengue virus
GTGNMGETLGE

SEQ ID NO: 49409 - protein, 11 aa, Dengue virus
TGNMGETLGEK

SEQ ID NO: 49410 - protein, 11 aa, Dengue virus
GNMGETLGEKW

SEQ ID NO: 49411 - protein, 11 aa, Dengue virus
NMGETLGEKWK

SEQ ID NO: 49412 - protein, 11 aa, Dengue virus
GETLGEKWKNR

SEQ ID NO: 49413 - protein, 11 aa, Dengue virus
ETLGEKWKNRL

SEQ ID NO: 49414 - protein, 11 aa, Dengue virus
TLGEKWKNRLN

SEQ ID NO: 49415 - protein, 11 aa, Dengue virus
LGEKWKNRLNA

SEQ ID NO: 49416 - protein, 11 aa, Dengue virus
GEKWKNRLNAL

SEQ ID NO: 49417 - protein, 11 aa, Dengue virus
EKWKNRLNALG

SEQ ID NO: 49418 - protein, 11 aa, Dengue virus
LGKSEFQIYKR

SEQ ID NO: 49419 - protein, 11 aa, Dengue virus
GKSEFQIYKRS

SEQ ID NO: 49420 - protein, 11 aa, Dengue virus
KSEFQIYKRSG

SEQ ID NO: 49421 - protein, 11 aa, Dengue virus
SEFQIYKRSGI

SEQ ID NO: 49422 - protein, 11 aa, Dengue virus
EFQIYKRSGIQ

SEQ ID NO: 49423 - protein, 11 aa, Dengue virus
FQIYKRSGIQE

SEQ ID NO: 49424 - protein, 11 aa, Dengue virus
QIYKRSGIQEV

SEQ ID NO: 49425 - protein, 11 aa, Dengue virus
IYKRSGIQEVD

SEQ ID NO: 49426 - protein, 11 aa, Dengue virus
YKRSGIQEVDR

SEQ ID NO: 49427 - protein, 11 aa, Dengue virus
KRSGIQEVDRT

SEQ ID NO: 49428 - protein, 11 aa, Dengue virus
RSGIQEVDRTL

SEQ ID NO: 49429 - protein, 11 aa, Dengue virus
AKLRWFVERNL

SEQ ID NO: 49430 - protein, 11 aa, Dengue virus
KLRWFVERNLV

SEQ ID NO: 49431 - protein, 11 aa, Dengue virus
LRWFVERNLVT

SEQ ID NO: 49432 - protein, 11 aa, Dengue virus
RWFVERNLVTP

SEQ ID NO: 49433 - protein, 11 aa, Dengue virus
WFVERNLVTPE

SEQ ID NO: 49434 - protein, 11 aa, Dengue virus
FVERNLVTPEG

SEQ ID NO: 49435 - protein, 11 aa, Dengue virus
VERNLVTPEGK

SEQ ID NO: 49436 - protein, 11 aa, Dengue virus
ERNLVTPEGKV

SEQ ID NO: 49437 - protein, 11 aa, Dengue virus
RNLVTPEGKVV

SEQ ID NO: 49438 - protein, 11 aa, Dengue virus
NLVTPEGKVVD

SEQ ID NO: 49439 - protein, 11 aa, Dengue virus
LVTPEGKVVDL

SEQ ID NO: 49440 - protein, 11 aa, Dengue virus
VTPEGKVMDLG

SEQ ID NO: 49441 - protein, 11 aa, Dengue virus
TPEGKVMDLGC

SEQ ID NO: 49442 - protein, 11 aa, Dengue virus
PEGKVMDLGCG

SEQ ID NO: 49443 - protein, 11 aa, Dengue virus
EGKVMDLGCGR

SEQ ID NO: 49444 - protein, 11 aa, Dengue virus
GKVMDLGCGRG

SEQ ID NO: 49445 - protein, 11 aa, Dengue virus
KVMDLGCGRGG

SEQ ID NO: 49446 - protein, 11 aa, Dengue virus
VMDLGCGRGGW

SEQ ID NO: 49447 - protein, 11 aa, Dengue virus
MDLGCGRGGWS

SEQ ID NO: 49448 - protein, 11 aa, Dengue virus
GWSYYCGGLKD

SEQ ID NO: 49449 - protein, 11 aa, Dengue virus
WSYYCGGLKDV

SEQ ID NO: 49450 - protein, 11 aa, Dengue virus
SYYCGGLKNVK

SEQ ID NO: 49451 - protein, 11 aa, Dengue virus
YYCGGLKNVKE

SEQ ID NO: 49452 - protein, 11 aa, Dengue virus
YCGGLKNVKEV

SEQ ID NO: 49453 - protein, 11 aa, Dengue virus
CGGLKNVKEVK

SEQ ID NO: 49454 - protein, 11 aa, Dengue virus
GGLKNVKEVKG

SEQ ID NO: 49455 - protein, 11 aa, Dengue virus
GLKNVKEVKGL

SEQ ID NO: 49456 - protein, 11 aa, Dengue virus
LKNVKEVKGLT

SEQ ID NO: 49457 - protein, 11 aa, Dengue virus
KNVKEVKGLTK

SEQ ID NO: 49458 - protein, 11 aa, Dengue virus
NVKEVKGLTKG

SEQ ID NO: 49459 - protein, 11 aa, Dengue virus
VKEVKGLTKGG

SEQ ID NO: 49460 - protein, 11 aa, Dengue virus
KEVKGLTKGGP

SEQ ID NO: 49461 - protein, 11 aa, Dengue virus
TKGGPGHEEPV

SEQ ID NO: 49462 - protein, 11 aa, Dengue virus
KGGPGHEEPVP

SEQ ID NO: 49463 - protein, 11 aa, Dengue virus
GGPGHEEPVPM

SEQ ID NO: 49464 - protein, 11 aa, Dengue virus
GPGHEEPVPMS

SEQ ID NO: 49465 - protein, 11 aa, Dengue virus
PGHEEPVPMST

SEQ ID NO: 49466 - protein, 11 aa, Dengue virus
GHEEPVPMSTY

SEQ ID NO: 49467 - protein, 11 aa, Dengue virus
HEEPVPMSTYG

SEQ ID NO: 49468 - protein, 11 aa, Dengue virus
EEPVPMSTYGW

SEQ ID NO: 49469 - protein, 11 aa, Dengue virus
EPVPMSTYGWN

SEQ ID NO: 49470 - protein, 11 aa, Dengue virus
PVPMSTYGWNL

SEQ ID NO: 49471 - protein, 11 aa, Dengue virus
VPMSTYGWNLV

SEQ ID NO: 49472 - protein, 11 aa, Dengue virus
WNLVRLQSGID

SEQ ID NO: 49473 - protein, 11 aa, Dengue virus
NLVRLQSGIDV

SEQ ID NO: 49474 - protein, 11 aa, Dengue virus
LVRLQSGIDVF

SEQ ID NO: 49475 - protein, 11 aa, Dengue virus
VRLQSGIDVFF

SEQ ID NO: 49476 - protein, 11 aa, Dengue virus
RLQSGVDVFFI

SEQ ID NO: 49477 - protein, 11 aa, Dengue virus
LQSGVDVFFIP

SEQ ID NO: 49478 - protein, 11 aa, Dengue virus
QSGVDVFFIPP

SEQ ID NO: 49479 - protein, 11 aa, Dengue virus
SGVDVFFIPPE

SEQ ID NO: 49480 - protein, 11 aa, Dengue virus
GVDVFFIPPEK

SEQ ID NO: 49481 - protein, 11 aa, Dengue virus
VDVFFIPPEKC

SEQ ID NO: 49482 - protein, 11 aa, Dengue virus
DVFFIPPEKCD

SEQ ID NO: 49483 - protein, 11 aa, Dengue virus
VFFIPPEKCDT

SEQ ID NO: 49484 - protein, 11 aa, Dengue virus
FFIPPEKCDTL

SEQ ID NO: 49485 - protein, 11 aa, Dengue virus
FIPPEKCDTLL

SEQ ID NO: 49486 - protein, 11 aa, Dengue virus
IPPEKCDTLLC

SEQ ID NO: 49487 - protein, 11 aa, Dengue virus
PPERCDTLLCD

SEQ ID NO: 49488 - protein, 11 aa, Dengue virus
PERCDTLLCDI

SEQ ID NO: 49489 - protein, 11 aa, Dengue virus
ERCDTLLCDIG

SEQ ID NO: 49490 - protein, 11 aa, Dengue virus
RCDTLLCDIGE

SEQ ID NO: 49491 - protein, 11 aa, Dengue virus
DIGESSPNPTV

SEQ ID NO: 49492 - protein, 11 aa, Dengue virus
IGESSPNPTVE

SEQ ID NO: 49493 - protein, 11 aa, Dengue virus
GESSPNPTVEA

SEQ ID NO: 49494 - protein, 11 aa, Dengue virus
ESSPNPTVEAG

SEQ ID NO: 49495 - protein, 11 aa, Dengue virus
SSPNPTVEAGR

SEQ ID NO: 49496 - protein, 11 aa, Dengue virus
SPNPTVEAGRT

SEQ ID NO: 49497 - protein, 11 aa, Dengue virus
PNPTVEAGRTL

SEQ ID NO: 49498 - protein, 11 aa, Dengue virus
NPTVEAGRTLR

SEQ ID NO: 49499 - protein, 11 aa, Dengue virus
PTVEAGRTLRV

SEQ ID NO: 49500 - protein, 11 aa, Dengue virus
TVEAGRTLRVL

SEQ ID NO: 49501 - protein, 11 aa, Dengue virus
VEAGRTLRVLN

SEQ ID NO: 49502 - protein, 11 aa, Dengue virus
EAGRTLRVLSL

SEQ ID NO: 49503 - protein, 11 aa, Dengue virus
AGRTLRVLSLV

SEQ ID NO: 49504 - protein, 11 aa, Dengue virus
GRTLRVLSLVE

SEQ ID NO: 49505 - protein, 11 aa, Dengue virus
RTLRVLSLVEN

SEQ ID NO: 49506 - protein, 11 aa, Dengue virus
TLRVLSLVENW

SEQ ID NO: 49507 - protein, 11 aa, Dengue virus
LRVLSLVENWL

SEQ ID NO: 49508 - protein, 11 aa, Dengue virus
RVLSLVENWLN

SEQ ID NO: 49509 - protein, 11 aa, Dengue virus
VLSLVENWLNN

SEQ ID NO: 49510 - protein, 11 aa, Dengue virus
LSLVENWLNND

SEQ ID NO: 49511 - protein, 11 aa, Dengue virus
ENWLNNDTQFC

SEQ ID NO: 49512 - protein, 11 aa, Dengue virus
WLNNDTQFCIK

SEQ ID NO: 49513 - protein, 11 aa, Dengue virus
LNNDTQFCIKV

SEQ ID NO: 49514 - protein, 11 aa, Dengue virus
NNDTQFCIKVL

SEQ ID NO: 49515 - protein, 11 aa, Dengue virus
NDTQFCIKVLN

SEQ ID NO: 49516 - protein, 11 aa, Dengue virus
NTQFCVKVLNP

SEQ ID NO: 49517 - protein, 11 aa, Dengue virus
TQFCVKVLNPY

SEQ ID NO: 49518 - protein, 11 aa, Dengue virus
QFCVKVLNPYM

SEQ ID NO: 49519 - protein, 11 aa, Dengue virus
FCVKVLNPYMP

SEQ ID NO: 49520 - protein, 11 aa, Dengue virus
CVKVLNPYMPS

SEQ ID NO: 49521 - protein, 11 aa, Dengue virus
VKVLNPYMPSV

SEQ ID NO: 49522 - protein, 11 aa, Dengue virus
LNPYMPSVIER

SEQ ID NO: 49523 - protein, 11 aa, Dengue virus
NPYMPSVIERM

SEQ ID NO: 49524 - protein, 11 aa, Dengue virus
PYMPSVIERME

SEQ ID NO: 49525 - protein, 11 aa, Dengue virus
YMPSVIEKMET

SEQ ID NO: 49526 - protein, 11 aa, Dengue virus
MPSVIEKMETL

SEQ ID NO: 49527 - protein, 11 aa, Dengue virus
PSVIEKMETLQ

SEQ ID NO: 49528 - protein, 11 aa, Dengue virus
SVIEKMETLQR

SEQ ID NO: 49529 - protein, 11 aa, Dengue virus
LQRQYGGALVR

SEQ ID NO: 49530 - protein, 11 aa, Dengue virus
QRQYGGALVRN

SEQ ID NO: 49531 - protein, 11 aa, Dengue virus
RQYGGALVRNP

SEQ ID NO: 49532 - protein, 11 aa, Dengue virus
QYGGALVRNPL

SEQ ID NO: 49533 - protein, 11 aa, Dengue virus
FGGALVRNPLS

SEQ ID NO: 49534 - protein, 11 aa, Dengue virus
THEMYWVSNAS

SEQ ID NO: 49535 - protein, 11 aa, Dengue virus
HEMYWVSNASG

SEQ ID NO: 49536 - protein, 11 aa, Dengue virus
EMYWVSNASGN

SEQ ID NO: 49537 - protein, 11 aa, Dengue virus
MYWVSNASGNI

SEQ ID NO: 49538 - protein, 11 aa, Dengue virus
YWVSNASGNIV

SEQ ID NO: 49539 - protein, 11 aa, Dengue virus
WVSNASGNIVS

SEQ ID NO: 49540 - protein, 11 aa, Dengue virus
VSNASGNIVSS

SEQ ID NO: 49541 - protein, 11 aa, Dengue virus
SNASGNIVSSV

SEQ ID NO: 49542 - protein, 11 aa, Dengue virus
NASGNIVSSVN

SEQ ID NO: 49543 - protein, 11 aa, Dengue virus
ASGNIVSSVNM

SEQ ID NO: 49544 - protein, 11 aa, Dengue virus
SGNIVSSVNMI

SEQ ID NO: 49545 - protein, 11 aa, Dengue virus
SRMLINRFTMR

SEQ ID NO: 49546 - protein, 11 aa, Dengue virus
RMLINRFTMRH

SEQ ID NO: 49547 - protein, 11 aa, Dengue virus
MLINRFTMRHK

SEQ ID NO: 49548 - protein, 11 aa, Dengue virus
LINRFTMRHKK

SEQ ID NO: 49549 - protein, 11 aa, Dengue virus
INRFTMRHKKA

SEQ ID NO: 49550 - protein, 11 aa, Dengue virus
NRFTMRHKKAT

SEQ ID NO: 49551 - protein, 11 aa, Dengue virus
RFTMRHKKATY

SEQ ID NO: 49552 - protein, 11 aa, Dengue virus
FTMRHKKATYE

SEQ ID NO: 49553 - protein, 11 aa, Dengue virus
TMRHKKATYEP

SEQ ID NO: 49554 - protein, 11 aa, Dengue virus
MRHKKATYEPD

SEQ ID NO: 49555 - protein, 11 aa, Dengue virus
RHKKATYEPDV

SEQ ID NO: 49556 - protein, 11 aa, Dengue virus
YKKATYEPDVD

SEQ ID NO: 49557 - protein, 11 aa, Dengue virus
KRATYEPDVDL

SEQ ID NO: 49558 - protein, 11 aa, Dengue virus
KTTYEPDVDLG

SEQ ID NO: 49559 - protein, 11 aa, Dengue virus
DLGSGTRNIGT

SEQ ID NO: 49560 - protein, 11 aa, Dengue virus
LGSGTRNIGTE

SEQ ID NO: 49561 - protein, 11 aa, Dengue virus
GSGTRNIGIEN

SEQ ID NO: 49562 - protein, 11 aa, Dengue virus
SGTRNIGIENE

SEQ ID NO: 49563 - protein, 11 aa, Dengue virus
ETPNLDIIGKR

SEQ ID NO: 49564 - protein, 11 aa, Dengue virus
TPNLDIIGKRI

SEQ ID NO: 49565 - protein, 11 aa, Dengue virus
PNMDIIGKRIE

SEQ ID NO: 49566 - protein, 11 aa, Dengue virus
NMDIIGKRIEK

SEQ ID NO: 49567 - protein, 11 aa, Dengue virus
MDIIGKRIEKI

SEQ ID NO: 49568 - protein, 11 aa, Dengue virus
IIGKRIEKIKE

SEQ ID NO: 49569 - protein, 11 aa, Dengue virus
IGKRIEKIKEE

SEQ ID NO: 49570 - protein, 11 aa, Dengue virus
GKRIEKIKEEH

SEQ ID NO: 49571 - protein, 11 aa, Dengue virus
KRIEKIKEEHE

SEQ ID NO: 49572 - protein, 11 aa, Dengue virus
RIEKIKQEHEI

SEQ ID NO: 49573 - protein, 11 aa, Dengue virus
IEKIKQEHEIS

SEQ ID NO: 49574 - protein, 11 aa, Dengue virus
EKIKQEHEISW

SEQ ID NO: 49575 - protein, 11 aa, Dengue virus
KIKQEHEISWH

SEQ ID NO: 49576 - protein, 11 aa, Dengue virus
IKQEHEISWHY

SEQ ID NO: 49577 - protein, 11 aa, Dengue virus
KQEHEISWHYD

SEQ ID NO: 49578 - protein, 11 aa, Dengue virus
QEHEISWHYDQ

SEQ ID NO: 49579 - protein, 11 aa, Dengue virus
EHEISWHYDQD

SEQ ID NO: 49580 - protein, 11 aa, Dengue virus
HEISWHYDQDH

SEQ ID NO: 49581 - protein, 11 aa, Dengue virus
EISWHYDQDHP

SEQ ID NO: 49582 - protein, 11 aa, Dengue virus
ISWHYDQDHPY

SEQ ID NO: 49583 - protein, 11 aa, Dengue virus
SWHYDQDHPYR

SEQ ID NO: 49584 - protein, 11 aa, Dengue virus
WHYDQDHPYRT

SEQ ID NO: 49585 - protein, 11 aa, Dengue virus
HYDQDHPYRTW

SEQ ID NO: 49586 - protein, 11 aa, Dengue virus
SASSMVNGVVK

SEQ ID NO: 49587 - protein, 11 aa, Dengue virus
ASSMVNGVVKL

SEQ ID NO: 49588 - protein, 11 aa, Dengue virus
SSMVNGVVKLL

SEQ ID NO: 49589 - protein, 11 aa, Dengue virus
SMVNGVVKLLT

SEQ ID NO: 49590 - protein, 11 aa, Dengue virus
MVNGVVKLLTK

SEQ ID NO: 49591 - protein, 11 aa, Dengue virus
VNGVVKLLTKP

SEQ ID NO: 49592 - protein, 11 aa, Dengue virus
NGVVKLLTKPW

SEQ ID NO: 49593 - protein, 11 aa, Dengue virus
GVVKLLTKPWD

SEQ ID NO: 49594 - protein, 11 aa, Dengue virus
VVKLLTKPWDV

SEQ ID NO: 49595 - protein, 11 aa, Dengue virus
VRLLTKPWDVL

SEQ ID NO: 49596 - protein, 11 aa, Dengue virus
RLLTKPWDVLP

SEQ ID NO: 49597 - protein, 11 aa, Dengue virus
LLTKPWDVLPT

SEQ ID NO: 49598 - protein, 11 aa, Dengue virus
LTKPWDVLPTV

SEQ ID NO: 49599 - protein, 11 aa, Dengue virus
TKPWDVLPTVT

SEQ ID NO: 49600 - protein, 11 aa, Dengue virus
KPWDVLPTVTQ

SEQ ID NO: 49601 - protein, 11 aa, Dengue virus
PWDVLPTVTQM

SEQ ID NO: 49602 - protein, 11 aa, Dengue virus
WDVLPTVTQMA

SEQ ID NO: 49603 - protein, 11 aa, Dengue virus
DVLPTVTQMAM

SEQ ID NO: 49604 - protein, 11 aa, Dengue virus
VLPTVTQMAMT

SEQ ID NO: 49605 - protein, 11 aa, Dengue virus
LPTVTQMAMTD

SEQ ID NO: 49606 - protein, 11 aa, Dengue virus
PTVTQMAMTDT

SEQ ID NO: 49607 - protein, 11 aa, Dengue virus
TVTQMAMTDTT

SEQ ID NO: 49608 - protein, 11 aa, Dengue virus
EPKEGTKKLMR

SEQ ID NO: 49609 - protein, 11 aa, Dengue virus
PKEGTKKLMRI

SEQ ID NO: 49610 - protein, 11 aa, Dengue virus
KEGTKKLMRIT

SEQ ID NO: 49611 - protein, 11 aa, Dengue virus
EGTKKLMRITA

SEQ ID NO: 49612 - protein, 11 aa, Dengue virus
GTKKLMRITAE

SEQ ID NO: 49613 - protein, 11 aa, Dengue virus
TKKLMRITAEW

SEQ ID NO: 49614 - protein, 11 aa, Dengue virus
KKLMRITAEWL

SEQ ID NO: 49615 - protein, 11 aa, Dengue virus
KLMRITAEWLW

SEQ ID NO: 49616 - protein, 11 aa, Dengue virus
LMRITAEWLWK

SEQ ID NO: 49617 - protein, 11 aa, Dengue virus
MRITAEWLWKE

SEQ ID NO: 49618 - protein, 11 aa, Dengue virus
RITAEWLWKEL

SEQ ID NO: 49619 - protein, 11 aa, Dengue virus
ITAEWLWGELG

SEQ ID NO: 49620 - protein, 11 aa, Dengue virus
TAKWLWKELGK

SEQ ID NO: 49621 - protein, 11 aa, Dengue virus
WLWKELGKEKT

SEQ ID NO: 49622 - protein, 11 aa, Dengue virus
LWKELGKEKTP

SEQ ID NO: 49623 - protein, 11 aa, Dengue virus
WKELGKEKTPR

SEQ ID NO: 49624 - protein, 11 aa, Dengue virus
KKPRICTRAEF

SEQ ID NO: 49625 - protein, 11 aa, Dengue virus
CTREEFTKKVR

SEQ ID NO: 49626 - protein, 11 aa, Dengue virus
TREEFTKKVRS

SEQ ID NO: 49627 - protein, 11 aa, Dengue virus
REEFTKKVRSN

SEQ ID NO: 49628 - protein, 11 aa, Dengue virus
EEFTKKVRSNA

SEQ ID NO: 49629 - protein, 11 aa, Dengue virus
EFTKKVRSNAA

SEQ ID NO: 49630 - protein, 11 aa, Dengue virus
FTKKVRSNAAL

SEQ ID NO: 49631 - protein, 11 aa, Dengue virus
TKKVRSNAALG

SEQ ID NO: 49632 - protein, 11 aa, Dengue virus
KKVRSNAALGA

SEQ ID NO: 49633 - protein, 11 aa, Dengue virus
KVRSNAALGAV

SEQ ID NO: 49634 - protein, 11 aa, Dengue virus
VRSNAALGAVF

SEQ ID NO: 49635 - protein, 11 aa, Dengue virus
RSNAALGAVFT

SEQ ID NO: 49636 - protein, 11 aa, Dengue virus
SNAALGAVFTD

SEQ ID NO: 49637 - protein, 11 aa, Dengue virus
NAALGAVFTDE

SEQ ID NO: 49638 - protein, 11 aa, Dengue virus
AALGAVFTDEN

SEQ ID NO: 49639 - protein, 11 aa, Dengue virus
ALGAVFTDENK

SEQ ID NO: 49640 - protein, 11 aa, Dengue virus
LGAVFTDENKW

SEQ ID NO: 49641 - protein, 11 aa, Dengue virus
GAVFTDENKWK

SEQ ID NO: 49642 - protein, 11 aa, Dengue virus
AVFTDENKWKS

SEQ ID NO: 49643 - protein, 11 aa, Dengue virus
VFTDENKWKSA

SEQ ID NO: 49644 - protein, 11 aa, Dengue virus
WKSAREAVEDG

SEQ ID NO: 49645 - protein, 11 aa, Dengue virus
KSAREAVEDGR

SEQ ID NO: 49646 - protein, 11 aa, Dengue virus
SAREAVEDGRF

SEQ ID NO: 49647 - protein, 11 aa, Dengue virus
AREAVEDGRFW

SEQ ID NO: 49648 - protein, 11 aa, Dengue virus
REAVEDGRFWE

SEQ ID NO: 49649 - protein, 11 aa, Dengue virus
EAVEDGRFWEL

SEQ ID NO: 49650 - protein, 11 aa, Dengue virus
FWELVDRERNL

SEQ ID NO: 49651 - protein, 11 aa, Dengue virus
WELVDRERNLH

SEQ ID NO: 49652 - protein, 11 aa, Dengue virus
ELVDRERNLHL

SEQ ID NO: 49653 - protein, 11 aa, Dengue virus
DRERNLHLEGK

SEQ ID NO: 49654 - protein, 11 aa, Dengue virus
RERNLHLEGKC

SEQ ID NO: 49655 - protein, 11 aa, Dengue virus
ERNLHLDGKCE

SEQ ID NO: 49656 - protein, 11 aa, Dengue virus
RNLHLDGKCET

SEQ ID NO: 49657 - protein, 11 aa, Dengue virus
NLHLDGKCETC

SEQ ID NO: 49658 - protein, 11 aa, Dengue virus
LHLDGKCETCV

SEQ ID NO: 49659 - protein, 11 aa, Dengue virus
HLDGKCETCVY

SEQ ID NO: 49660 - protein, 11 aa, Dengue virus
LDGKCETCVYN

SEQ ID NO: 49661 - protein, 11 aa, Dengue virus
DGKCETCVYNM

SEQ ID NO: 49662 - protein, 11 aa, Dengue virus
KKIGEFGKAKG

SEQ ID NO: 49663 - protein, 11 aa, Dengue virus
KIGEFGKAKGS

SEQ ID NO: 49664 - protein, 11 aa, Dengue virus
IGEFGKAKGSR

SEQ ID NO: 49665 - protein, 11 aa, Dengue virus
FLNEDHWFSRG

SEQ ID NO: 49666 - protein, 11 aa, Dengue virus
LNEDHWFSRGN

SEQ ID NO: 49667 - protein, 11 aa, Dengue virus
NEDHWFSRGNS

SEQ ID NO: 49668 - protein, 11 aa, Dengue virus
EDHWFSRGNSL

SEQ ID NO: 49669 - protein, 11 aa, Dengue virus
DHWFSRGNSLS

SEQ ID NO: 49670 - protein, 11 aa, Dengue virus
HWFSRGNSLSG

SEQ ID NO: 49671 - protein, 11 aa, Dengue virus
WFSRGNSLSGV

SEQ ID NO: 49672 - protein, 11 aa, Dengue virus
FSRGNSLSGVE

SEQ ID NO: 49673 - protein, 11 aa, Dengue virus
SRGNSLSGVEG

SEQ ID NO: 49674 - protein, 11 aa, Dengue virus
RGNSLSGVEGE

SEQ ID NO: 49675 - protein, 11 aa, Dengue virus
GNSLSGVEGEG

SEQ ID NO: 49676 - protein, 11 aa, Dengue virus
SLSGVEGEGLY

SEQ ID NO: 49677 - protein, 11 aa, Dengue virus
LSGVEGEGLHR

SEQ ID NO: 49678 - protein, 11 aa, Dengue virus
SGVEGEGLHRL

SEQ ID NO: 49679 - protein, 11 aa, Dengue virus
GVEGEGLHRLG

SEQ ID NO: 49680 - protein, 11 aa, Dengue virus
VEGEGLHRLGY

SEQ ID NO: 49681 - protein, 11 aa, Dengue virus
EGEGLHRLGYI

SEQ ID NO: 49682 - protein, 11 aa, Dengue virus
GEGLHRLGYIL

SEQ ID NO: 49683 - protein, 11 aa, Dengue virus
EGLHRLGYILR

SEQ ID NO: 49684 - protein, 11 aa, Dengue virus
GLHRLGYILRD

SEQ ID NO: 49685 - protein, 11 aa, Dengue virus
LHRLGYILRDV

SEQ ID NO: 49686 - protein, 11 aa, Dengue virus
LGYILRDVGKK

SEQ ID NO: 49687 - protein, 11 aa, Dengue virus
VGKKEGGAMYA

SEQ ID NO: 49688 - protein, 11 aa, Dengue virus
GKKEGGAMYAD

SEQ ID NO: 49689 - protein, 11 aa, Dengue virus
RKAGGAMYADD

SEQ ID NO: 49690 - protein, 11 aa, Dengue virus
KAGGAMYADDT

SEQ ID NO: 49691 - protein, 11 aa, Dengue virus
AGGAMYADDTA

SEQ ID NO: 49692 - protein, 11 aa, Dengue virus
DTAGWDTRITI

SEQ ID NO: 49693 - protein, 11 aa, Dengue virus
TAGWDTRITIE

SEQ ID NO: 49694 - protein, 11 aa, Dengue virus
AGWDTRITIED

SEQ ID NO: 49695 - protein, 11 aa, Dengue virus
GWDTRITIEDL

SEQ ID NO: 49696 - protein, 11 aa, Dengue virus
WDTRITIEDLK

SEQ ID NO: 49697 - protein, 11 aa, Dengue virus
DTRITIEDLKN

SEQ ID NO: 49698 - protein, 11 aa, Dengue virus
TRITIEDLKNE

SEQ ID NO: 49699 - protein, 11 aa, Dengue virus
RITIEDLKNEE

SEQ ID NO: 49700 - protein, 11 aa, Dengue virus
ITIEDLKNEEM

SEQ ID NO: 49701 - protein, 11 aa, Dengue virus
TIEDLKNEEMI

SEQ ID NO: 49702 - protein, 11 aa, Dengue virus
IEDLKNEEMIT

SEQ ID NO: 49703 - protein, 11 aa, Dengue virus
EDLKNEEMITN

SEQ ID NO: 49704 - protein, 11 aa, Dengue virus
DLKNEEMITNH

SEQ ID NO: 49705 - protein, 11 aa, Dengue virus
LKNEEMITNHM

SEQ ID NO: 49706 - protein, 11 aa, Dengue virus
GEHKRLAEAIF

SEQ ID NO: 49707 - protein, 11 aa, Dengue virus
EHKRLAEAIFK

SEQ ID NO: 49708 - protein, 11 aa, Dengue virus
HKRLAEAIFKL

SEQ ID NO: 49709 - protein, 11 aa, Dengue virus
KRLAEAIFKLT

SEQ ID NO: 49710 - protein, 11 aa, Dengue virus
RLAEAIFKLTY

SEQ ID NO: 49711 - protein, 11 aa, Dengue virus
LAEAIFRLTYQ

SEQ ID NO: 49712 - protein, 11 aa, Dengue virus
AEAIFRLTYQN

SEQ ID NO: 49713 - protein, 11 aa, Dengue virus
EAIFRLTYQNK

SEQ ID NO: 49714 - protein, 11 aa, Dengue virus
AIFRLTYQNKV

SEQ ID NO: 49715 - protein, 11 aa, Dengue virus
IFRLTYQNKVV

SEQ ID NO: 49716 - protein, 11 aa, Dengue virus
FRLTYQNKVVR

SEQ ID NO: 49717 - protein, 11 aa, Dengue virus
RLTYQNKVVRV

SEQ ID NO: 49718 - protein, 11 aa, Dengue virus
KVVRVQRPTPI

SEQ ID NO: 49719 - protein, 11 aa, Dengue virus
VVRVQRPTPKG

SEQ ID NO: 49720 - protein, 11 aa, Dengue virus
VRVQRPTSRGT

SEQ ID NO: 49721 - protein, 11 aa, Dengue virus
RVQRPTSRGTV

SEQ ID NO: 49722 - protein, 11 aa, Dengue virus
VQRPTSRGTVM

SEQ ID NO: 49723 - protein, 11 aa, Dengue virus
QRPTSRGTVMD

SEQ ID NO: 49724 - protein, 11 aa, Dengue virus
RPTSRGTVMDI

SEQ ID NO: 49725 - protein, 11 aa, Dengue virus
PTSRGTVMDII

SEQ ID NO: 49726 - protein, 11 aa, Dengue virus
TPIGTVMDIIS

SEQ ID NO: 49727 - protein, 11 aa, Dengue virus
PKGTVMDIISR

SEQ ID NO: 49728 - protein, 11 aa, Dengue virus
RGTVMDIISRK

SEQ ID NO: 49729 - protein, 11 aa, Dengue virus
GTVMDIISRKD

SEQ ID NO: 49730 - protein, 11 aa, Dengue virus
TVMDIISRKDQ

SEQ ID NO: 49731 - protein, 11 aa, Dengue virus
VMDIISRKDQR

SEQ ID NO: 49732 - protein, 11 aa, Dengue virus
MDIISRKDQRG

SEQ ID NO: 49733 - protein, 11 aa, Dengue virus
DIISRKDQRGS

SEQ ID NO: 49734 - protein, 11 aa, Dengue virus
IISRKDQRGSG

SEQ ID NO: 49735 - protein, 11 aa, Dengue virus
ISRKDQRGSGQ

SEQ ID NO: 49736 - protein, 11 aa, Dengue virus
SRKDQRGSGQV

SEQ ID NO: 49737 - protein, 11 aa, Dengue virus
RKDQRGSGQVG

SEQ ID NO: 49738 - protein, 11 aa, Dengue virus
KDQRGSGQVGT

SEQ ID NO: 49739 - protein, 11 aa, Dengue virus
DQRGSGQVVTY

SEQ ID NO: 49740 - protein, 11 aa, Dengue virus
QRGSGQVVTYG

SEQ ID NO: 49741 - protein, 11 aa, Dengue virus
RGSGQVVTYGL

SEQ ID NO: 49742 - protein, 11 aa, Dengue virus
GSGQVVTYGLN

SEQ ID NO: 49743 - protein, 11 aa, Dengue virus
SGQVVTYGLNT

SEQ ID NO: 49744 - protein, 11 aa, Dengue virus
GQVVTYGLNTF

SEQ ID NO: 49745 - protein, 11 aa, Dengue virus
QVVTYGLNTFT

SEQ ID NO: 49746 - protein, 11 aa, Dengue virus
VVTYGLNTFTN

SEQ ID NO: 49747 - protein, 11 aa, Dengue virus
VTYGLNTFTNM

SEQ ID NO: 49748 - protein, 11 aa, Dengue virus
TYGLNTFTNMG

SEQ ID NO: 49749 - protein, 11 aa, Dengue virus
YGLNTFTNMGA

SEQ ID NO: 49750 - protein, 11 aa, Dengue virus
GLNTFTNMGAQ

SEQ ID NO: 49751 - protein, 11 aa, Dengue virus
LNTFTNMGAQL

SEQ ID NO: 49752 - protein, 11 aa, Dengue virus
NTFTNMGAQLI

SEQ ID NO: 49753 - protein, 11 aa, Dengue virus
TFTNMGAQLIR

SEQ ID NO: 49754 - protein, 11 aa, Dengue virus
FTNMGAQLIRQ

SEQ ID NO: 49755 - protein, 11 aa, Dengue virus
TNMGAQLIRQM

SEQ ID NO: 49756 - protein, 11 aa, Dengue virus
NMGAQLIRQME

SEQ ID NO: 49757 - protein, 11 aa, Dengue virus
MGAQLIRQMEG

SEQ ID NO: 49758 - protein, 11 aa, Dengue virus
QLIRQMEGEGV

SEQ ID NO: 49759 - protein, 11 aa, Dengue virus
LIRQMEGEGVF

SEQ ID NO: 49760 - protein, 11 aa, Dengue virus
IRQMEGEGVFK

SEQ ID NO: 49761 - protein, 11 aa, Dengue virus
GRERLARMAIS

SEQ ID NO: 49762 - protein, 11 aa, Dengue virus
RERLARMAISG

SEQ ID NO: 49763 - protein, 11 aa, Dengue virus
ERLARMAISGD

SEQ ID NO: 49764 - protein, 11 aa, Dengue virus
RLARMAISGDD

SEQ ID NO: 49765 - protein, 11 aa, Dengue virus
LARMAISGDDC

SEQ ID NO: 49766 - protein, 11 aa, Dengue virus
ARMAISGDDCV

SEQ ID NO: 49767 - protein, 11 aa, Dengue virus
ISGDDCVVKPI

SEQ ID NO: 49768 - protein, 11 aa, Dengue virus
SGDDCVVKPID

SEQ ID NO: 49769 - protein, 11 aa, Dengue virus
GDDCVVKPIDD

SEQ ID NO: 49770 - protein, 11 aa, Dengue virus
DDCVVKPIDDR

SEQ ID NO: 49771 - protein, 11 aa, Dengue virus
DCVVKPIDDRF

SEQ ID NO: 49772 - protein, 11 aa, Dengue virus
CVVKPIDDRFA

SEQ ID NO: 49773 - protein, 11 aa, Dengue virus
DDRFANALTAL

SEQ ID NO: 49774 - protein, 11 aa, Dengue virus
DRFANALTALN

SEQ ID NO: 49775 - protein, 11 aa, Dengue virus
RFANALTALND

SEQ ID NO: 49776 - protein, 11 aa, Dengue virus
FANALTALNDM

SEQ ID NO: 49777 - protein, 11 aa, Dengue virus
ANALTALNDMG

SEQ ID NO: 49778 - protein, 11 aa, Dengue virus
NALTALNDMGK

SEQ ID NO: 49779 - protein, 11 aa, Dengue virus
ALTALNDMGKI

SEQ ID NO: 49780 - protein, 11 aa, Dengue virus
LTALNDMGKIR

SEQ ID NO: 49781 - protein, 11 aa, Dengue virus
TALNDMGKIRK

SEQ ID NO: 49782 - protein, 11 aa, Dengue virus
ALNDMGKIRKD

SEQ ID NO: 49783 - protein, 11 aa, Dengue virus
LNDMGKIRKDI

SEQ ID NO: 49784 - protein, 11 aa, Dengue virus
NDMGKIRKDIQ

SEQ ID NO: 49785 - protein, 11 aa, Dengue virus
DMGKIRKDIQQ

SEQ ID NO: 49786 - protein, 11 aa, Dengue virus
MGKIRKDIQQW

SEQ ID NO: 49787 - protein, 11 aa, Dengue virus
GKIRKDIQQWE

SEQ ID NO: 49788 - protein, 11 aa, Dengue virus
KIRKDIQQWEP

SEQ ID NO: 49789 - protein, 11 aa, Dengue virus
IRKDIQQWEPS

SEQ ID NO: 49790 - protein, 11 aa, Dengue virus
RKDIQQWEPSK

SEQ ID NO: 49791 - protein, 11 aa, Dengue virus
KDIQQWEPSKG

SEQ ID NO: 49792 - protein, 11 aa, Dengue virus
DIQQWEPSKGW

SEQ ID NO: 49793 - protein, 11 aa, Dengue virus
IQQWEPSKGWN

SEQ ID NO: 49794 - protein, 11 aa, Dengue virus
QQWEPSKGWND

SEQ ID NO: 49795 - protein, 11 aa, Dengue virus
QWEPSKGWNDW

SEQ ID NO: 49796 - protein, 11 aa, Dengue virus
WEPSKGWNDWT

SEQ ID NO: 49797 - protein, 11 aa, Dengue virus
EPSKGWNDWTQ

SEQ ID NO: 49798 - protein, 11 aa, Dengue virus
PSKGWNDWTQV

SEQ ID NO: 49799 - protein, 11 aa, Dengue virus
SKGWNDWTQVP

SEQ ID NO: 49800 - protein, 11 aa, Dengue virus
KGWNDWTQVPF

SEQ ID NO: 49801 - protein, 11 aa, Dengue virus
GWSDWTQVPFC

SEQ ID NO: 49802 - protein, 11 aa, Dengue virus
WSDWTQVPFCS

SEQ ID NO: 49803 - protein, 11 aa, Dengue virus
SDWTQVPFCSH

SEQ ID NO: 49804 - protein, 11 aa, Dengue virus
PFCSHHFHELV

SEQ ID NO: 49805 - protein, 11 aa, Dengue virus
FCSHHFHELVM

SEQ ID NO: 49806 - protein, 11 aa, Dengue virus
CSHHFHELVMK

SEQ ID NO: 49807 - protein, 11 aa, Dengue virus
SHHFHELVMKD

SEQ ID NO: 49808 - protein, 11 aa, Dengue virus
HHFHELVMKDG

SEQ ID NO: 49809 - protein, 11 aa, Dengue virus
HFHELVMKDGR

SEQ ID NO: 49810 - protein, 11 aa, Dengue virus
MKDGRTLVVPC

SEQ ID NO: 49811 - protein, 11 aa, Dengue virus
KDGRTLVVPCR

SEQ ID NO: 49812 - protein, 11 aa, Dengue virus
LVVPCRSQDEL

SEQ ID NO: 49813 - protein, 11 aa, Dengue virus
VVPCRSQDELI

SEQ ID NO: 49814 - protein, 11 aa, Dengue virus
VPCRSQDELIG

SEQ ID NO: 49815 - protein, 11 aa, Dengue virus
PCRSQDELIGR

SEQ ID NO: 49816 - protein, 11 aa, Dengue virus
CRSQDELIGRA

SEQ ID NO: 49817 - protein, 11 aa, Dengue virus
RSQDELIGRAR

SEQ ID NO: 49818 - protein, 11 aa, Dengue virus
SQDELIGRARI

SEQ ID NO: 49819 - protein, 11 aa, Dengue virus
RISQGAGWSLR

SEQ ID NO: 49820 - protein, 11 aa, Dengue virus
ISQGAGWSLRE

SEQ ID NO: 49821 - protein, 11 aa, Dengue virus
SQGAGWSLRET

SEQ ID NO: 49822 - protein, 11 aa, Dengue virus
QGAGWSLRETA

SEQ ID NO: 49823 - protein, 11 aa, Dengue virus
GAGWSLRETAC

SEQ ID NO: 49824 - protein, 11 aa, Dengue virus
AGWSLRETACL

SEQ ID NO: 49825 - protein, 11 aa, Dengue virus
GWSLRETACLG

SEQ ID NO: 49826 - protein, 11 aa, Dengue virus
WSLRETACLGK

SEQ ID NO: 49827 - protein, 11 aa, Dengue virus
SLRETACLGKS

SEQ ID NO: 49828 - protein, 11 aa, Dengue virus
LRETACLGKSY

SEQ ID NO: 49829 - protein, 11 aa, Dengue virus
RETACLGKSYA

SEQ ID NO: 49830 - protein, 11 aa, Dengue virus
CLGKSYAQMWT

SEQ ID NO: 49831 - protein, 11 aa, Dengue virus
LGKSYAQMWTL

SEQ ID NO: 49832 - protein, 11 aa, Dengue virus
GKSYAQMWTLM

SEQ ID NO: 49833 - protein, 11 aa, Dengue virus
KSYAQMWTLMY

SEQ ID NO: 49834 - protein, 11 aa, Dengue virus
SYAQMWTLMYF

SEQ ID NO: 49835 - protein, 11 aa, Dengue virus
YAQMWTLMYFH

SEQ ID NO: 49836 - protein, 11 aa, Dengue virus
AQMWTLMYFHR

SEQ ID NO: 49837 - protein, 11 aa, Dengue virus
QMWTLMYFHRR

SEQ ID NO: 49838 - protein, 11 aa, Dengue virus
MWTLMYFHRRD

SEQ ID NO: 49839 - protein, 11 aa, Dengue virus
WTLMYFHRRDL

SEQ ID NO: 49840 - protein, 11 aa, Dengue virus
TLMYFHRRDLR

SEQ ID NO: 49841 - protein, 11 aa, Dengue virus
AANAICSAVPP

SEQ ID NO: 49842 - protein, 11 aa, Dengue virus
ANAICSAVPPH

SEQ ID NO: 49843 - protein, 11 aa, Dengue virus
NAICSAVPPHW

SEQ ID NO: 49844 - protein, 11 aa, Dengue virus
AICSAVPPHWV

SEQ ID NO: 49845 - protein, 11 aa, Dengue virus
ICSAVPPHWVP

SEQ ID NO: 49846 - protein, 11 aa, Dengue virus
CSAVPPHWVPT

SEQ ID NO: 49847 - protein, 11 aa, Dengue virus
SAVPPHWVPTS

SEQ ID NO: 49848 - protein, 11 aa, Dengue virus
AVPPHWVPTSR

SEQ ID NO: 49849 - protein, 11 aa, Dengue virus
VPPHWVPTSRT

SEQ ID NO: 49850 - protein, 11 aa, Dengue virus
PPHWVPTSRTT

SEQ ID NO: 49851 - protein, 11 aa, Dengue virus
PHWVPTSRTTW

SEQ ID NO: 49852 - protein, 11 aa, Dengue virus
TSRTTWSIHAT

SEQ ID NO: 49853 - protein, 11 aa, Dengue virus
SRTTWSIHATH

SEQ ID NO: 49854 - protein, 11 aa, Dengue virus
RTTWSIHATHE

SEQ ID NO: 49855 - protein, 11 aa, Dengue virus
TTWSIHATHEW

SEQ ID NO: 49856 - protein, 11 aa, Dengue virus
TWSIHATHEWM

SEQ ID NO: 49857 - protein, 11 aa, Dengue virus
WSIHATHEWMT

SEQ ID NO: 49858 - protein, 11 aa, Dengue virus
SIHATHEWMTT

SEQ ID NO: 49859 - protein, 11 aa, Dengue virus
IHATHEWMTTE

SEQ ID NO: 49860 - protein, 11 aa, Dengue virus
HATHEWMTTED

SEQ ID NO: 49861 - protein, 11 aa, Dengue virus
ATHEWMTTEDM

SEQ ID NO: 49862 - protein, 11 aa, Dengue virus
THEWMTTEDML

SEQ ID NO: 49863 - protein, 11 aa, Dengue virus
HEWMTTEDMLT

SEQ ID NO: 49864 - protein, 11 aa, Dengue virus
EWMTTEDMLTV

SEQ ID NO: 49865 - protein, 11 aa, Dengue virus
WMTTEDMLTVW

SEQ ID NO: 49866 - protein, 11 aa, Dengue virus
MTTEDMLTVWN

SEQ ID NO: 49867 - protein, 11 aa, Dengue virus
TTEDMLTVWNR

SEQ ID NO: 49868 - protein, 11 aa, Dengue virus
TEDMLTVWNRV

SEQ ID NO: 49869 - protein, 11 aa, Dengue virus
EDMLTVWNRVW

SEQ ID NO: 49870 - protein, 11 aa, Dengue virus
DMLTVWNRVWI

SEQ ID NO: 49871 - protein, 11 aa, Dengue virus
MLTVWNRVWIQ

SEQ ID NO: 49872 - protein, 11 aa, Dengue virus
VWNRVWIRENP

SEQ ID NO: 49873 - protein, 11 aa, Dengue virus
WNRVWIRENPW

SEQ ID NO: 49874 - protein, 11 aa, Dengue virus
VWIRENPWMED

SEQ ID NO: 49875 - protein, 11 aa, Dengue virus
WIRENPWMEDK

SEQ ID NO: 49876 - protein, 11 aa, Dengue virus
IRENPWMEDKT

SEQ ID NO: 49877 - protein, 11 aa, Dengue virus
ENPWIEDKTPV

SEQ ID NO: 49878 - protein, 11 aa, Dengue virus
NPWIEDKTPVE

SEQ ID NO: 49879 - protein, 11 aa, Dengue virus
PWIEDKTPVES

SEQ ID NO: 49880 - protein, 11 aa, Dengue virus
WIEDKTPVESW

SEQ ID NO: 49881 - protein, 11 aa, Dengue virus
IEDKTPVESWE

SEQ ID NO: 49882 - protein, 11 aa, Dengue virus
EDKTPVESWED

SEQ ID NO: 49883 - protein, 11 aa, Dengue virus
DKTPVESWEEI

SEQ ID NO: 49884 - protein, 11 aa, Dengue virus
KTPVESWEEIP

SEQ ID NO: 49885 - protein, 11 aa, Dengue virus
TPVESWEEIPY

SEQ ID NO: 49886 - protein, 11 aa, Dengue virus
PVESWEEIPYL

SEQ ID NO: 49887 - protein, 11 aa, Dengue virus
VESWEEIPYLG

SEQ ID NO: 49888 - protein, 11 aa, Dengue virus
ESWEEIPYLGK

SEQ ID NO: 49889 - protein, 11 aa, Dengue virus
SWEEIPYLGKR

SEQ ID NO: 49890 - protein, 11 aa, Dengue virus
WEEIPYLGKRE

SEQ ID NO: 49891 - protein, 11 aa, Dengue virus
EEIPYLGKRED

SEQ ID NO: 49892 - protein, 11 aa, Dengue virus
EIPYLGKREDQ

SEQ ID NO: 49893 - protein, 11 aa, Dengue virus
IPYLGKREDQW

SEQ ID NO: 49894 - protein, 11 aa, Dengue virus
SRATWAKNIQA

SEQ ID NO: 49895 - protein, 11 aa, Dengue virus
RATWAKNIQAA

SEQ ID NO: 49896 - protein, 11 aa, Dengue virus
ATWAKNIQAAI

SEQ ID NO: 49897 - protein, 11 aa, Dengue virus
TWAKNIQAAIN

SEQ ID NO: 49898 - protein, 11 aa, Dengue virus
WAKNIQAAINQ

SEQ ID NO: 49899 - protein, 11 aa, Dengue virus
AKNIQAAINQV

SEQ ID NO: 49900 - protein, 11 aa, Dengue virus
KNIQAAINQVR

SEQ ID NO: 49901 - protein, 11 aa, Dengue virus
NIQAAINQVRS

SEQ ID NO: 49902 - protein, 11 aa, Dengue virus
IQAAINQVRSL

SEQ ID NO: 49903 - protein, 11 aa, Dengue virus
QAAINQVRSLI

SEQ ID NO: 49904 - protein, 11 aa, Dengue virus
AAINQVRSLIG

SEQ ID NO: 49905 - protein, 11 aa, Dengue virus
AINQVRALIGE

SEQ ID NO: 49906 - protein, 11 aa, Dengue virus
INQVRALIGEE

SEQ ID NO: 49907 - protein, 11 aa, Dengue virus
NQVRALIGEEE

SEQ ID NO: 49908 - protein, 11 aa, Dengue virus
QVRALIGEEEY

SEQ ID NO: 49909 - protein, 11 aa, Dengue virus
EGYTDYMPSMK

SEQ ID NO: 49910 - protein, 11 aa, Dengue virus
GYTDYMPSMKR

SEQ ID NO: 49911 - protein, 11 aa, Dengue virus
YIDYMPSMKRF

SEQ ID NO: 49912 - protein, 11 aa, Dengue virus
IDYMPSMKRFR

SEQ ID NO: 49913 - protein, 11 aa, Dengue virus
DYMPSMKRFRK

SEQ ID NO: 49914 - protein, 11 aa, Dengue virus
YMPSMKRFRKE

SEQ ID NO: 49915 - protein, 11 aa, Dengue virus
MPSMKRFRKEE

SEQ ID NO: 49916 - protein, 11 aa, Dengue virus
PSMKRFRKEEE

SEQ ID NO: 49917 - protein, 11 aa, Dengue virus
SMKRFRKEEEE

SEQ ID NO: 49918 - protein, 11 aa, Dengue virus
MKRFRKEEEEA

SEQ ID NO: 49919 - protein, 11 aa, Dengue virus
KRFRKEEEEAG

SEQ ID NO: 49920 - protein, 11 aa, Dengue virus
RFRKEEEEAGV

SEQ ID NO: 49921 - protein, 11 aa, Dengue virus
FRKEEEEAGVL

SEQ ID NO: 49922 - protein, 11 aa, Dengue virus
RKEEEEAGVLW

SEQ ID NO: 49923 - protein, 11 aa, Dengue virus
TTPFNMLKRER

SEQ ID NO: 49924 - protein, 11 aa, Dengue virus
GRGPLRLFMAL

SEQ ID NO: 49925 - protein, 11 aa, Dengue virus
RGPLRLFMALV

SEQ ID NO: 49926 - protein, 11 aa, Dengue virus
GPLRLFMALVA

SEQ ID NO: 49927 - protein, 11 aa, Dengue virus
PLRLFMALVAF

SEQ ID NO: 49928 - protein, 11 aa, Dengue virus
LRLFMALVAFL

SEQ ID NO: 49929 - protein, 11 aa, Dengue virus
RLFMALVAFLR

SEQ ID NO: 49930 - protein, 11 aa, Dengue virus
PTTGILKRWGT

SEQ ID NO: 49931 - protein, 11 aa, Dengue virus
TVGILKRWGTI

SEQ ID NO: 49932 - protein, 11 aa, Dengue virus
VGILKRWGTIK

SEQ ID NO: 49933 - protein, 11 aa, Dengue virus
LKRWGTIKKSR

SEQ ID NO: 49934 - protein, 11 aa, Dengue virus
KRWGTIKKSRA

SEQ ID NO: 49935 - protein, 11 aa, Dengue virus
RWGTIKKSRAI

SEQ ID NO: 49936 - protein, 11 aa, Dengue virus
WGTIKKSKAIS

SEQ ID NO: 49937 - protein, 11 aa, Dengue virus
GTIKKSKAISV

SEQ ID NO: 49938 - protein, 11 aa, Dengue virus
TIKKSKAISVL

SEQ ID NO: 49939 - protein, 11 aa, Dengue virus
IKKSKAISVLR

SEQ ID NO: 49940 - protein, 11 aa, Dengue virus
KKSRAINVLRG

SEQ ID NO: 49941 - protein, 11 aa, Dengue virus
KSRAINVLRGF

SEQ ID NO: 49942 - protein, 11 aa, Dengue virus
SKAINILRGFR

SEQ ID NO: 49943 - protein, 11 aa, Dengue virus
KAINVLRGFRR

SEQ ID NO: 49944 - protein, 11 aa, Dengue virus
AINVLRGFRRE

SEQ ID NO: 49945 - protein, 11 aa, Dengue virus
INVLRGFRREI

SEQ ID NO: 49946 - protein, 11 aa, Dengue virus
NVLRGFRREIG

SEQ ID NO: 49947 - protein, 11 aa, Dengue virus
MLNILNKRRRT

SEQ ID NO: 49948 - protein, 11 aa, Dengue virus
LNILNKRRRTA

SEQ ID NO: 49949 - protein, 11 aa, Dengue virus
NILNKRRRTAG

SEQ ID NO: 49950 - protein, 11 aa, Dengue virus
IPTVVAFHLTT

SEQ ID NO: 49951 - protein, 11 aa, Dengue virus
PTVVAFHLTTR

SEQ ID NO: 49952 - protein, 11 aa, Dengue virus
TVVAFHLTTRN

SEQ ID NO: 49953 - protein, 11 aa, Dengue virus
VVAFHLTTRNG

SEQ ID NO: 49954 - protein, 11 aa, Dengue virus
IAFHLTTRNGE

SEQ ID NO: 49955 - protein, 11 aa, Dengue virus
RNGEPHMIVSR

SEQ ID NO: 49956 - protein, 11 aa, Dengue virus
GEPHMIVSRQE

SEQ ID NO: 49957 - protein, 11 aa, Dengue virus
EPHMIVSRQEK

SEQ ID NO: 49958 - protein, 11 aa, Dengue virus
PHMIVSRQEKG

SEQ ID NO: 49959 - protein, 11 aa, Dengue virus
HMIVSRQEKGK

SEQ ID NO: 49960 - protein, 11 aa, Dengue virus
MIVSRQEKGKS

SEQ ID NO: 49961 - protein, 11 aa, Dengue virus
IVSRQEKGKSL

SEQ ID NO: 49962 - protein, 11 aa, Dengue virus
VSRQEKGKSLL

SEQ ID NO: 49963 - protein, 11 aa, Dengue virus
SRQEKGKSLLF

SEQ ID NO: 49964 - protein, 11 aa, Dengue virus
KNEKGKSLLFK

SEQ ID NO: 49965 - protein, 11 aa, Dengue virus
KGKSLLFKTKD

SEQ ID NO: 49966 - protein, 11 aa, Dengue virus
GKSLLFKTKDG

SEQ ID NO: 49967 - protein, 11 aa, Dengue virus
GTNMCTLMAMD

SEQ ID NO: 49968 - protein, 11 aa, Dengue virus
TNMCTLMAMDL

SEQ ID NO: 49969 - protein, 11 aa, Dengue virus
MDLGELCEDTV

SEQ ID NO: 49970 - protein, 11 aa, Dengue virus
GELCEDTVTYK

SEQ ID NO: 49971 - protein, 11 aa, Dengue virus
ELCEDTVTYKC

SEQ ID NO: 49972 - protein, 11 aa, Dengue virus
LCEDTVTYKCP

SEQ ID NO: 49973 - protein, 11 aa, Dengue virus
CEDTITYKCPF

SEQ ID NO: 49974 - protein, 11 aa, Dengue virus
EDTITYKCPFL

SEQ ID NO: 49975 - protein, 11 aa, Dengue virus
TYKCPFLKQNE

SEQ ID NO: 49976 - protein, 11 aa, Dengue virus
YKCPFLKQNEP

SEQ ID NO: 49977 - protein, 11 aa, Dengue virus
KCPFLKQNEPE

SEQ ID NO: 49978 - protein, 11 aa, Dengue virus
CPLLKQNEPED

SEQ ID NO: 49979 - protein, 11 aa, Dengue virus
PLLKQNEPEDI

SEQ ID NO: 49980 - protein, 11 aa, Dengue virus
LLKQNEPEDID

SEQ ID NO: 49981 - protein, 11 aa, Dengue virus
TSTWVTYGTCA

SEQ ID NO: 49982 - protein, 11 aa, Dengue virus
TMGEHRREKRS

SEQ ID NO: 49983 - protein, 11 aa, Dengue virus
WMSSEGAWKQA

SEQ ID NO: 49984 - protein, 11 aa, Dengue virus
MSSEGAWKQAQ

SEQ ID NO: 49985 - protein, 11 aa, Dengue virus
SSEGAWKQAQR

SEQ ID NO: 49986 - protein, 11 aa, Dengue virus
SEGAWKQAQRI

SEQ ID NO: 49987 - protein, 11 aa, Dengue virus
EGAWKQAQRIE

SEQ ID NO: 49988 - protein, 11 aa, Dengue virus
GAWKQAQRIET

SEQ ID NO: 49989 - protein, 11 aa, Dengue virus
AWKQAQRIETW

SEQ ID NO: 49990 - protein, 11 aa, Dengue virus
WKHAQRIETWV

SEQ ID NO: 49991 - protein, 11 aa, Dengue virus
KHAQRIETWVL

SEQ ID NO: 49992 - protein, 11 aa, Dengue virus
HAQRIETWVLR

SEQ ID NO: 49993 - protein, 11 aa, Dengue virus
AQRIETWVLRH

SEQ ID NO: 49994 - protein, 11 aa, Dengue virus
ETWILRHPGFA

SEQ ID NO: 49995 - protein, 11 aa, Dengue virus
LRHPGFTLMAA

SEQ ID NO: 49996 - protein, 11 aa, Dengue virus
MAAVLAYTIGT

SEQ ID NO: 49997 - protein, 11 aa, Dengue virus
AAVLAYTIGTT

SEQ ID NO: 49998 - protein, 11 aa, Dengue virus
AILAYTVGTTH

SEQ ID NO: 49999 - protein, 11 aa, Dengue virus
ILAYTVGTTHF

SEQ ID NO: 50000 - protein, 11 aa, Dengue virus
LAYTVGTTHFQ

SEQ ID NO: 50001 - protein, 11 aa, Dengue virus
AYTVGTTHFQR

SEQ ID NO: 50002 - protein, 11 aa, Dengue virus
GTTYFQRVLIF

SEQ ID NO: 50003 - protein, 11 aa, Dengue virus
TTYFQRVLIFI

SEQ ID NO: 50004 - protein, 11 aa, Dengue virus
TYFQRVLIFIL

SEQ ID NO: 50005 - protein, 11 aa, Dengue virus
YFQRVLIFILL

SEQ ID NO: 50006 - protein, 11 aa, Dengue virus
FQRALIFILLA

SEQ ID NO: 50007 - protein, 11 aa, Dengue virus
LIFILLTAIAP

SEQ ID NO: 50008 - protein, 11 aa, Dengue virus
IFILLTAIAPS

SEQ ID NO: 50009 - protein, 11 aa, Dengue virus
FILLTAIAPSM

SEQ ID NO: 50010 - protein, 11 aa, Dengue virus
LLTAIAPSMTM

SEQ ID NO: 50011 - protein, 11 aa, Dengue virus
LTAVTPSMTMR

SEQ ID NO: 50012 - protein, 11 aa, Dengue virus
TAIAPSMTMRC

SEQ ID NO: 50013 - protein, 11 aa, Dengue virus
AIAPSMTMRCI

SEQ ID NO: 50014 - protein, 11 aa, Dengue virus
IAPSMTMRCIG

SEQ ID NO: 50015 - protein, 11 aa, Dengue virus
APSMTMRCIGV

SEQ ID NO: 50016 - protein, 11 aa, Dengue virus
PSMAMRCIGIS

SEQ ID NO: 50017 - protein, 11 aa, Dengue virus
SMAMRCIGISN

SEQ ID NO: 50018 - protein, 11 aa, Dengue virus
MAMRCIGISNR

SEQ ID NO: 50019 - protein, 11 aa, Dengue virus
AMRCIGISNRD

SEQ ID NO: 50020 - protein, 11 aa, Dengue virus
DFELIKTEAKE

SEQ ID NO: 50021 - protein, 11 aa, Dengue virus
KTEAKEPATLR

SEQ ID NO: 50022 - protein, 11 aa, Dengue virus
TEAKEPATLRK

SEQ ID NO: 50023 - protein, 11 aa, Dengue virus
EAKQPATLRKF

SEQ ID NO: 50024 - protein, 11 aa, Dengue virus
AKQPATLRKFC

SEQ ID NO: 50025 - protein, 11 aa, Dengue virus
PATLRKYCVEA

SEQ ID NO: 50026 - protein, 11 aa, Dengue virus
ATLRKYCVEAK

SEQ ID NO: 50027 - protein, 11 aa, Dengue virus
TLRKYCVEAKL

SEQ ID NO: 50028 - protein, 11 aa, Dengue virus
LRKYCVEAKLT

SEQ ID NO: 50029 - protein, 11 aa, Dengue virus
RKYCVEAKLTN

SEQ ID NO: 50030 - protein, 11 aa, Dengue virus
KYCVEAKLTNT

SEQ ID NO: 50031 - protein, 11 aa, Dengue virus
YCVEAKLTNTT

SEQ ID NO: 50032 - protein, 11 aa, Dengue virus
CIEARLTNTTT

SEQ ID NO: 50033 - protein, 11 aa, Dengue virus
IEAKLTNTTTD

SEQ ID NO: 50034 - protein, 11 aa, Dengue virus
EAKLTNTTTDS

SEQ ID NO: 50035 - protein, 11 aa, Dengue virus
AKLTNTTTDSR

SEQ ID NO: 50036 - protein, 11 aa, Dengue virus
KLTNTTTDSRC

SEQ ID NO: 50037 - protein, 11 aa, Dengue virus
LTNTTTDSRCP

SEQ ID NO: 50038 - protein, 11 aa, Dengue virus
TNTTTDSRCPT

SEQ ID NO: 50039 - protein, 11 aa, Dengue virus
NTTTDSRCPTQ

SEQ ID NO: 50040 - protein, 11 aa, Dengue virus
TTTDSRCPTQG

SEQ ID NO: 50041 - protein, 11 aa, Dengue virus
TTDSRCPTQGE

SEQ ID NO: 50042 - protein, 11 aa, Dengue virus
TDSRCPTQGEP

SEQ ID NO: 50043 - protein, 11 aa, Dengue virus
DSRCPTQGEPT

SEQ ID NO: 50044 - protein, 11 aa, Dengue virus
RCPTQGEPTLN

SEQ ID NO: 50045 - protein, 11 aa, Dengue virus
CPTQGEPTLNE

SEQ ID NO: 50046 - protein, 11 aa, Dengue virus
PTQGEPTLNEE

SEQ ID NO: 50047 - protein, 11 aa, Dengue virus
TQGEPTLNEEQ

SEQ ID NO: 50048 - protein, 11 aa, Dengue virus
QGEPTLNEEQD

SEQ ID NO: 50049 - protein, 11 aa, Dengue virus
GEPTLNEEQDK

SEQ ID NO: 50050 - protein, 11 aa, Dengue virus
EPTLNEEQDKR

SEQ ID NO: 50051 - protein, 11 aa, Dengue virus
PTLNEEQDKRF

SEQ ID NO: 50052 - protein, 11 aa, Dengue virus
EEQDKRFVCRH

SEQ ID NO: 50053 - protein, 11 aa, Dengue virus
EQDKRFVCRHS

SEQ ID NO: 50054 - protein, 11 aa, Dengue virus
QDKRFVCRHSM

SEQ ID NO: 50055 - protein, 11 aa, Dengue virus
DKRFVCRHSMV

SEQ ID NO: 50056 - protein, 11 aa, Dengue virus
KRFVCRHSMVD

SEQ ID NO: 50057 - protein, 11 aa, Dengue virus
RFVCRHSMVDR

SEQ ID NO: 50058 - protein, 11 aa, Dengue virus
FVCRHSMVDRG

SEQ ID NO: 50059 - protein, 11 aa, Dengue virus
VCRHSMVDRGW

SEQ ID NO: 50060 - protein, 11 aa, Dengue virus
KGGIVTCAMFS

SEQ ID NO: 50061 - protein, 11 aa, Dengue virus
GGIVTCAKFTC

SEQ ID NO: 50062 - protein, 11 aa, Dengue virus
GIVTCAMFTCL

SEQ ID NO: 50063 - protein, 11 aa, Dengue virus
IVTCAMFTCLK

SEQ ID NO: 50064 - protein, 11 aa, Dengue virus
VTCAMFTCLKK

SEQ ID NO: 50065 - protein, 11 aa, Dengue virus
TCAMFTCLKKM

SEQ ID NO: 50066 - protein, 11 aa, Dengue virus
AMFTCLKKMEG

SEQ ID NO: 50067 - protein, 11 aa, Dengue virus
CKKNMEGKVVL

SEQ ID NO: 50068 - protein, 11 aa, Dengue virus
KKNMEGKVVLP

SEQ ID NO: 50069 - protein, 11 aa, Dengue virus
KNMEGKVVLPE

SEQ ID NO: 50070 - protein, 11 aa, Dengue virus
NMEGKVVLPEN

SEQ ID NO: 50071 - protein, 11 aa, Dengue virus
MEGKVVLPENL

SEQ ID NO: 50072 - protein, 11 aa, Dengue virus
EGKVVLPENLE

SEQ ID NO: 50073 - protein, 11 aa, Dengue virus
GKVVLPENLEY

SEQ ID NO: 50074 - protein, 11 aa, Dengue virus
KVVLPENLEYT

SEQ ID NO: 50075 - protein, 11 aa, Dengue virus
VVLPENLEYTI

SEQ ID NO: 50076 - protein, 11 aa, Dengue virus
VQPENLEYTVV

SEQ ID NO: 50077 - protein, 11 aa, Dengue virus
LPENLEYTIVI

SEQ ID NO: 50078 - protein, 11 aa, Dengue virus
PENLEYTVVIT

SEQ ID NO: 50079 - protein, 11 aa, Dengue virus
ENLEYTVVITP

SEQ ID NO: 50080 - protein, 11 aa, Dengue virus
NLEYTVVITPH

SEQ ID NO: 50081 - protein, 11 aa, Dengue virus
LEYTVVITPHS

SEQ ID NO: 50082 - protein, 11 aa, Dengue virus
EYTVVITPHSG

SEQ ID NO: 50083 - protein, 11 aa, Dengue virus
YTVVITPHSGE

SEQ ID NO: 50084 - protein, 11 aa, Dengue virus
TVVITPHSGEE

SEQ ID NO: 50085 - protein, 11 aa, Dengue virus
IVITPHSGEEN

SEQ ID NO: 50086 - protein, 11 aa, Dengue virus
VITPHSGEENA

SEQ ID NO: 50087 - protein, 11 aa, Dengue virus
ITPHSGEENAV

SEQ ID NO: 50088 - protein, 11 aa, Dengue virus
PHSGEEHAVGD

SEQ ID NO: 50089 - protein, 11 aa, Dengue virus
HSGEEHAVGDD

SEQ ID NO: 50090 - protein, 11 aa, Dengue virus
SGEEHAVGDDT

SEQ ID NO: 50091 - protein, 11 aa, Dengue virus
GEEHAVGDDTG

SEQ ID NO: 50092 - protein, 11 aa, Dengue virus
EEHAVGDDTGK

SEQ ID NO: 50093 - protein, 11 aa, Dengue virus
EHAVGDDTGKH

SEQ ID NO: 50094 - protein, 11 aa, Dengue virus
HAVGDDTGKHG

SEQ ID NO: 50095 - protein, 11 aa, Dengue virus
AVGNDTGKHGM

SEQ ID NO: 50096 - protein, 11 aa, Dengue virus
VGNDTGKHGME

SEQ ID NO: 50097 - protein, 11 aa, Dengue virus
GNDTGKHGKEV

SEQ ID NO: 50098 - protein, 11 aa, Dengue virus
NDTGKHGKEVK

SEQ ID NO: 50099 - protein, 11 aa, Dengue virus
DTGKHGQEIKV

SEQ ID NO: 50100 - protein, 11 aa, Dengue virus
TGKHGQEIKVT

SEQ ID NO: 50101 - protein, 11 aa, Dengue virus
GKHGQEIKVTP

SEQ ID NO: 50102 - protein, 11 aa, Dengue virus
KHGQEIKVTPQ

SEQ ID NO: 50103 - protein, 11 aa, Dengue virus
HGQEIKVTPQS

SEQ ID NO: 50104 - protein, 11 aa, Dengue virus
EAELTGYGTIT

SEQ ID NO: 50105 - protein, 11 aa, Dengue virus
AELTGYGTITM

SEQ ID NO: 50106 - protein, 11 aa, Dengue virus
ELTGYGTITME

SEQ ID NO: 50107 - protein, 11 aa, Dengue virus
LTGYGTITMEC

SEQ ID NO: 50108 - protein, 11 aa, Dengue virus
TGYGTITMECS

SEQ ID NO: 50109 - protein, 11 aa, Dengue virus
GYGTITMECSP

SEQ ID NO: 50110 - protein, 11 aa, Dengue virus
TVTMECSPRTS

SEQ ID NO: 50111 - protein, 11 aa, Dengue virus
VTMECSPRTSL

SEQ ID NO: 50112 - protein, 11 aa, Dengue virus
ECSPRTGFDFN

SEQ ID NO: 50113 - protein, 11 aa, Dengue virus
SPRTGFDFNEM

SEQ ID NO: 50114 - protein, 11 aa, Dengue virus
PRTGFDFNEMV

SEQ ID NO: 50115 - protein, 11 aa, Dengue virus
GFDFNEMVLLQ

SEQ ID NO: 50116 - protein, 11 aa, Dengue virus
DFNEMVLLQMG

SEQ ID NO: 50117 - protein, 11 aa, Dengue virus
MEEKAWLVHRQ

SEQ ID NO: 50118 - protein, 11 aa, Dengue virus
EEKAWLVHRQW

SEQ ID NO: 50119 - protein, 11 aa, Dengue virus
EKAWLVHRQWF

SEQ ID NO: 50120 - protein, 11 aa, Dengue virus
LPLPWLPGADI

SEQ ID NO: 50121 - protein, 11 aa, Dengue virus
PLPWLPGADIQ

SEQ ID NO: 50122 - protein, 11 aa, Dengue virus
LPWLPGADKQG

SEQ ID NO: 50123 - protein, 11 aa, Dengue virus
PWLPGADKQGS

SEQ ID NO: 50124 - protein, 11 aa, Dengue virus
WLPGADKQGSN

SEQ ID NO: 50125 - protein, 11 aa, Dengue virus
LPGADKQGSNW

SEQ ID NO: 50126 - protein, 11 aa, Dengue virus
PGADKQGSNWI

SEQ ID NO: 50127 - protein, 11 aa, Dengue virus
GADKQGSNWIQ

SEQ ID NO: 50128 - protein, 11 aa, Dengue virus
ADKQGSNWIQK

SEQ ID NO: 50129 - protein, 11 aa, Dengue virus
DKQGSNWIQKE

SEQ ID NO: 50130 - protein, 11 aa, Dengue virus
QGSNWIQKEML

SEQ ID NO: 50131 - protein, 11 aa, Dengue virus
GSNWIQKEMLV

SEQ ID NO: 50132 - protein, 11 aa, Dengue virus
ATEIQMSSGNI

SEQ ID NO: 50133 - protein, 11 aa, Dengue virus
TEIQMSSGNIL

SEQ ID NO: 50134 - protein, 11 aa, Dengue virus
EIQMSSGNILF

SEQ ID NO: 50135 - protein, 11 aa, Dengue virus
IQMSSGNILFM

SEQ ID NO: 50136 - protein, 11 aa, Dengue virus
QMSSGNILFMG

SEQ ID NO: 50137 - protein, 11 aa, Dengue virus
MSSGNILFMGH

SEQ ID NO: 50138 - protein, 11 aa, Dengue virus
ETQHGTIVVRV

SEQ ID NO: 50139 - protein, 11 aa, Dengue virus
TQHGTIVVRVQ

SEQ ID NO: 50140 - protein, 11 aa, Dengue virus
QHGTIVVRVQY

SEQ ID NO: 50141 - protein, 11 aa, Dengue virus
HGTIVVRVQYE

SEQ ID NO: 50142 - protein, 11 aa, Dengue virus
GTIVVRVQYEG

SEQ ID NO: 50143 - protein, 11 aa, Dengue virus
TIVVRVQYEGD

SEQ ID NO: 50144 - protein, 11 aa, Dengue virus
VIRIQYEGDGS

SEQ ID NO: 50145 - protein, 11 aa, Dengue virus
IRIQYEGDGSP

SEQ ID NO: 50146 - protein, 11 aa, Dengue virus
RIQYEGDGSPC

SEQ ID NO: 50147 - protein, 11 aa, Dengue virus
VQYEGDGSPCR

SEQ ID NO: 50148 - protein, 11 aa, Dengue virus
QYEGDGSPCRI

SEQ ID NO: 50149 - protein, 11 aa, Dengue virus
YEGDGSPCRIP

SEQ ID NO: 50150 - protein, 11 aa, Dengue virus
EGDGSPCRIPF

SEQ ID NO: 50151 - protein, 11 aa, Dengue virus
GDGSPCRIPFE

SEQ ID NO: 50152 - protein, 11 aa, Dengue virus
DGSPCRIPFEI

SEQ ID NO: 50153 - protein, 11 aa, Dengue virus
SPCRIPFEIMD

SEQ ID NO: 50154 - protein, 11 aa, Dengue virus
PCRIPFEIMDL

SEQ ID NO: 50155 - protein, 11 aa, Dengue virus
CRIPFEIMDLE

SEQ ID NO: 50156 - protein, 11 aa, Dengue virus
RIPFEIMDLEK

SEQ ID NO: 50157 - protein, 11 aa, Dengue virus
IPFEIMDLEKK

SEQ ID NO: 50158 - protein, 11 aa, Dengue virus
PFEITDLEKRH

SEQ ID NO: 50159 - protein, 11 aa, Dengue virus
DLEKKHVLGRL

SEQ ID NO: 50160 - protein, 11 aa, Dengue virus
LEKKHVLGRLI

SEQ ID NO: 50161 - protein, 11 aa, Dengue virus
EKKHVLGRLIT

SEQ ID NO: 50162 - protein, 11 aa, Dengue virus
KKHVLGRLITV

SEQ ID NO: 50163 - protein, 11 aa, Dengue virus
KHVLGRLITVN

SEQ ID NO: 50164 - protein, 11 aa, Dengue virus
YILGRLITVNP

SEQ ID NO: 50165 - protein, 11 aa, Dengue virus
LGRLITVNPIA

SEQ ID NO: 50166 - protein, 11 aa, Dengue virus
GRLITVNPIVA

SEQ ID NO: 50167 - protein, 11 aa, Dengue virus
GKDSPVNIEAE

SEQ ID NO: 50168 - protein, 11 aa, Dengue virus
KDNPINIEAEP

SEQ ID NO: 50169 - protein, 11 aa, Dengue virus
DNPINIEAEPP

SEQ ID NO: 50170 - protein, 11 aa, Dengue virus
NPINIEAEPPF

SEQ ID NO: 50171 - protein, 11 aa, Dengue virus
EPPFGDSYIVI

SEQ ID NO: 50172 - protein, 11 aa, Dengue virus
PPFGDSYIVIG

SEQ ID NO: 50173 - protein, 11 aa, Dengue virus
PFGDSYIVIGV

SEQ ID NO: 50174 - protein, 11 aa, Dengue virus
FGDSYIVIGVE

SEQ ID NO: 50175 - protein, 11 aa, Dengue virus
GDSYIVIGVEP

SEQ ID NO: 50176 - protein, 11 aa, Dengue virus
DSYIVIGVEPG

SEQ ID NO: 50177 - protein, 11 aa, Dengue virus
SYIVIGVEPGQ

SEQ ID NO: 50178 - protein, 11 aa, Dengue virus
YIVIGVEPGQL

SEQ ID NO: 50179 - protein, 11 aa, Dengue virus
IVIGVEPGQLK

SEQ ID NO: 50180 - protein, 11 aa, Dengue virus
VIGVEPGQLKL

SEQ ID NO: 50181 - protein, 11 aa, Dengue virus
VGVEPGQLKLN

SEQ ID NO: 50182 - protein, 11 aa, Dengue virus
GVEPGQLKLDW

SEQ ID NO: 50183 - protein, 11 aa, Dengue virus
VEPGQLKLDWF

SEQ ID NO: 50184 - protein, 11 aa, Dengue virus
EPGQLKLDWFK

SEQ ID NO: 50185 - protein, 11 aa, Dengue virus
PGQLKLDWFKK

SEQ ID NO: 50186 - protein, 11 aa, Dengue virus
GQLKLDWFKKG

SEQ ID NO: 50187 - protein, 11 aa, Dengue virus
QLKLDWFKKGS

SEQ ID NO: 50188 - protein, 11 aa, Dengue virus
LKLDWFKKGSS

SEQ ID NO: 50189 - protein, 11 aa, Dengue virus
KLDWFKKGSSI

SEQ ID NO: 50190 - protein, 11 aa, Dengue virus
LDWFKKGSSIG

SEQ ID NO: 50191 - protein, 11 aa, Dengue virus
DWFKKGSSIGQ

SEQ ID NO: 50192 - protein, 11 aa, Dengue virus
RKGSSIGQMFE

SEQ ID NO: 50193 - protein, 11 aa, Dengue virus
SSIGQMFATTM

SEQ ID NO: 50194 - protein, 11 aa, Dengue virus
SIGQMFATTMR

SEQ ID NO: 50195 - protein, 11 aa, Dengue virus
IGQMFATTMRG

SEQ ID NO: 50196 - protein, 11 aa, Dengue virus
GQMFATTMRGA

SEQ ID NO: 50197 - protein, 11 aa, Dengue virus
QMFATTMRGAK

SEQ ID NO: 50198 - protein, 11 aa, Dengue virus
TAWDFGSLGGA

SEQ ID NO: 50199 - protein, 11 aa, Dengue virus
AWDFGSLGGAF

SEQ ID NO: 50200 - protein, 11 aa, Dengue virus
WDFGSLGGAFT

SEQ ID NO: 50201 - protein, 11 aa, Dengue virus
DFGSLGGAFTS

SEQ ID NO: 50202 - protein, 11 aa, Dengue virus
FGSLGGVFTSV

SEQ ID NO: 50203 - protein, 11 aa, Dengue virus
GSLGGVFTSVG

SEQ ID NO: 50204 - protein, 11 aa, Dengue virus
SLGGVFTSVGK

SEQ ID NO: 50205 - protein, 11 aa, Dengue virus
LGGVFTSVGKA

SEQ ID NO: 50206 - protein, 11 aa, Dengue virus
GGAFTSIGKAL

SEQ ID NO: 50207 - protein, 11 aa, Dengue virus
GAFTSIGKALH

SEQ ID NO: 50208 - protein, 11 aa, Dengue virus
AFTSIGKALHQ

SEQ ID NO: 50209 - protein, 11 aa, Dengue virus
VFGAIYGAAFN

SEQ ID NO: 50210 - protein, 11 aa, Dengue virus
YGVAFSGVSWT

SEQ ID NO: 50211 - protein, 11 aa, Dengue virus
GVAFSGVSWTM

SEQ ID NO: 50212 - protein, 11 aa, Dengue virus
VAFSGVSWTMK

SEQ ID NO: 50213 - protein, 11 aa, Dengue virus
AFNGVSWTMKI

SEQ ID NO: 50214 - protein, 11 aa, Dengue virus
FSGVSWTMKIF

SEQ ID NO: 50215 - protein, 11 aa, Dengue virus
SGVSWTMKIFI

SEQ ID NO: 50216 - protein, 11 aa, Dengue virus
GVSWTMKIFIG

SEQ ID NO: 50217 - protein, 11 aa, Dengue virus
VSWIMKILIGV

SEQ ID NO: 50218 - protein, 11 aa, Dengue virus
SWTMKILIGAI

SEQ ID NO: 50219 - protein, 11 aa, Dengue virus
WTMKILIGAII

SEQ ID NO: 50220 - protein, 11 aa, Dengue virus
TMKILIGAIIT

SEQ ID NO: 50221 - protein, 11 aa, Dengue virus
MKILIGAIITW

SEQ ID NO: 50222 - protein, 11 aa, Dengue virus
KILIGAIITWI

SEQ ID NO: 50223 - protein, 11 aa, Dengue virus
ILIGAIITWIG

SEQ ID NO: 50224 - protein, 11 aa, Dengue virus
LIGAIITWIGM

SEQ ID NO: 50225 - protein, 11 aa, Dengue virus
IGAIITWIGMN

SEQ ID NO: 50226 - protein, 11 aa, Dengue virus
GAIITWIGMNS

SEQ ID NO: 50227 - protein, 11 aa, Dengue virus
AIITWIGMNSR

SEQ ID NO: 50228 - protein, 11 aa, Dengue virus
RSTSLSVSLIL

SEQ ID NO: 50229 - protein, 11 aa, Dengue virus
STSLSVTLVIV

SEQ ID NO: 50230 - protein, 11 aa, Dengue virus
SLSVTLVLVGI

SEQ ID NO: 50231 - protein, 11 aa, Dengue virus
LSVSLVLVGVI

SEQ ID NO: 50232 - protein, 11 aa, Dengue virus
LVLVGVITLYL

SEQ ID NO: 50233 - protein, 11 aa, Dengue virus
VLVGVITLYLG

SEQ ID NO: 50234 - protein, 11 aa, Dengue virus
LVGVVTLYLGV

SEQ ID NO: 50235 - protein, 11 aa, Dengue virus
VTLYLGAVVQA

SEQ ID NO: 50236 - protein, 11 aa, Dengue virus
TLYLGAVVQAD

SEQ ID NO: 50237 - protein, 11 aa, Dengue virus
LYLGAVVQADS

SEQ ID NO: 50238 - protein, 11 aa, Dengue virus
YLGAVVQADSG

SEQ ID NO: 50239 - protein, 11 aa, Dengue virus
LGAVVQADSGC

SEQ ID NO: 50240 - protein, 11 aa, Dengue virus
GAVVQADSGCV

SEQ ID NO: 50241 - protein, 11 aa, Dengue virus
AVVQADSGCVV

SEQ ID NO: 50242 - protein, 11 aa, Dengue virus
MVQADTGCVVS

SEQ ID NO: 50243 - protein, 11 aa, Dengue virus
VQADSGCIVSW

SEQ ID NO: 50244 - protein, 11 aa, Dengue virus
QADSGCIVSWK

SEQ ID NO: 50245 - protein, 11 aa, Dengue virus
ADSGCVVSWKS

SEQ ID NO: 50246 - protein, 11 aa, Dengue virus
DSGCVVSWKSK

SEQ ID NO: 50247 - protein, 11 aa, Dengue virus
SGCVVSWKSKE

SEQ ID NO: 50248 - protein, 11 aa, Dengue virus
GCVVSWKSKEL

SEQ ID NO: 50249 - protein, 11 aa, Dengue virus
CVVSWKSKELK

SEQ ID NO: 50250 - protein, 11 aa, Dengue virus
IVSWKNKELKC

SEQ ID NO: 50251 - protein, 11 aa, Dengue virus
LASAIQKAYEE

SEQ ID NO: 50252 - protein, 11 aa, Dengue virus
ASAIQKAHEED

SEQ ID NO: 50253 - protein, 11 aa, Dengue virus
SAIQKAHEEDI

SEQ ID NO: 50254 - protein, 11 aa, Dengue virus
AIQKAHEEDIC

SEQ ID NO: 50255 - protein, 11 aa, Dengue virus
IQKAHEEDICG

SEQ ID NO: 50256 - protein, 11 aa, Dengue virus
QKAHEEDICGI

SEQ ID NO: 50257 - protein, 11 aa, Dengue virus
KAHEEDICGIR

SEQ ID NO: 50258 - protein, 11 aa, Dengue virus
AHEEDICGIRS

SEQ ID NO: 50259 - protein, 11 aa, Dengue virus
HEEDICGIRSV

SEQ ID NO: 50260 - protein, 11 aa, Dengue virus
LENLMWRQITP

SEQ ID NO: 50261 - protein, 11 aa, Dengue virus
ENLMWRQITPE

SEQ ID NO: 50262 - protein, 11 aa, Dengue virus
NLMWRQITPEL

SEQ ID NO: 50263 - protein, 11 aa, Dengue virus
LMWRQITPELN

SEQ ID NO: 50264 - protein, 11 aa, Dengue virus
MWRQITPELNH

SEQ ID NO: 50265 - protein, 11 aa, Dengue virus
WRQITPELNHI

SEQ ID NO: 50266 - protein, 11 aa, Dengue virus
RQITPELNHIL

SEQ ID NO: 50267 - protein, 11 aa, Dengue virus
QITSELNHILS

SEQ ID NO: 50268 - protein, 11 aa, Dengue virus
ITSELNHILSE

SEQ ID NO: 50269 - protein, 11 aa, Dengue virus
TSELNHILSEN

SEQ ID NO: 50270 - protein, 11 aa, Dengue virus
SELNHILSENE

SEQ ID NO: 50271 - protein, 11 aa, Dengue virus
ELNHILSENEA

SEQ ID NO: 50272 - protein, 11 aa, Dengue virus
LNHILSENEAK

SEQ ID NO: 50273 - protein, 11 aa, Dengue virus
NHILSENEAKL

SEQ ID NO: 50274 - protein, 11 aa, Dengue virus
HILSENEAKLT

SEQ ID NO: 50275 - protein, 11 aa, Dengue virus
ILSENEAKLTI

SEQ ID NO: 50276 - protein, 11 aa, Dengue virus
SENEAKLTIMT

SEQ ID NO: 50277 - protein, 11 aa, Dengue virus
ENEVKMTIMTG

SEQ ID NO: 50278 - protein, 11 aa, Dengue virus
NEAKLTIMTGD

SEQ ID NO: 50279 - protein, 11 aa, Dengue virus
EVKLTIMTGEI

SEQ ID NO: 50280 - protein, 11 aa, Dengue virus
KLTIMTGDTKG

SEQ ID NO: 50281 - protein, 11 aa, Dengue virus
TIMTGDTKGIM

SEQ ID NO: 50282 - protein, 11 aa, Dengue virus
IMTGDTKGIMQ

SEQ ID NO: 50283 - protein, 11 aa, Dengue virus
LKPQPTELRYS

SEQ ID NO: 50284 - protein, 11 aa, Dengue virus
KPQPTELRYSW

SEQ ID NO: 50285 - protein, 11 aa, Dengue virus
QPTELRYSWKT

SEQ ID NO: 50286 - protein, 11 aa, Dengue virus
PTELRYSWKTW

SEQ ID NO: 50287 - protein, 11 aa, Dengue virus
TELRYSWKTWG

SEQ ID NO: 50288 - protein, 11 aa, Dengue virus
ELRYSWKTWGK

SEQ ID NO: 50289 - protein, 11 aa, Dengue virus
LRYSWKTWGKA

SEQ ID NO: 50290 - protein, 11 aa, Dengue virus
RYSWKTWGKAK

SEQ ID NO: 50291 - protein, 11 aa, Dengue virus
YSWKTWGKAKV

SEQ ID NO: 50292 - protein, 11 aa, Dengue virus
SWKTWGKAKVL

SEQ ID NO: 50293 - protein, 11 aa, Dengue virus
HNHTFLIDGPE

SEQ ID NO: 50294 - protein, 11 aa, Dengue virus
NRTFLIDGPET

SEQ ID NO: 50295 - protein, 11 aa, Dengue virus
QTFLIDGPETT

SEQ ID NO: 50296 - protein, 11 aa, Dengue virus
TFLIDGPETVE

SEQ ID NO: 50297 - protein, 11 aa, Dengue virus
FLIDGPETVEC

SEQ ID NO: 50298 - protein, 11 aa, Dengue virus
LIDGPETVECP

SEQ ID NO: 50299 - protein, 11 aa, Dengue virus
IDGPETVECPN

SEQ ID NO: 50300 - protein, 11 aa, Dengue virus
TTECPNSNRAW

SEQ ID NO: 50301 - protein, 11 aa, Dengue virus
TECPNSNRAWN

SEQ ID NO: 50302 - protein, 11 aa, Dengue virus
EVEDYGFGIFT

SEQ ID NO: 50303 - protein, 11 aa, Dengue virus
VEDYGFGIFTT

SEQ ID NO: 50304 - protein, 11 aa, Dengue virus
EDYGFGIFTTN

SEQ ID NO: 50305 - protein, 11 aa, Dengue virus
DYGFGIFTTNI

SEQ ID NO: 50306 - protein, 11 aa, Dengue virus
YGFGIFTTNIW

SEQ ID NO: 50307 - protein, 11 aa, Dengue virus
GFGIFTTNIWL

SEQ ID NO: 50308 - protein, 11 aa, Dengue virus
FGVFTTNIWLR

SEQ ID NO: 50309 - protein, 11 aa, Dengue virus
GVFTTNIWLRL

SEQ ID NO: 50310 - protein, 11 aa, Dengue virus
FSTNIWLKLRE

SEQ ID NO: 50311 - protein, 11 aa, Dengue virus
TNIWLKLKERQ

SEQ ID NO: 50312 - protein, 11 aa, Dengue virus
NIWLKLKERQD

SEQ ID NO: 50313 - protein, 11 aa, Dengue virus
DSKLMSAAIKN

SEQ ID NO: 50314 - protein, 11 aa, Dengue virus
SKLMSAAVKDN

SEQ ID NO: 50315 - protein, 11 aa, Dengue virus
KLMSAAVKDNR

SEQ ID NO: 50316 - protein, 11 aa, Dengue virus
LMSAAVKDNRA

SEQ ID NO: 50317 - protein, 11 aa, Dengue virus
MSAAVKDNRAV

SEQ ID NO: 50318 - protein, 11 aa, Dengue virus
SAAVKDNRAVH

SEQ ID NO: 50319 - protein, 11 aa, Dengue virus
AAVKDNRAVHA

SEQ ID NO: 50320 - protein, 11 aa, Dengue virus
AVKDNRAVHAD

SEQ ID NO: 50321 - protein, 11 aa, Dengue virus
VKDNRAVHADM

SEQ ID NO: 50322 - protein, 11 aa, Dengue virus
KNNRAVHADMG

SEQ ID NO: 50323 - protein, 11 aa, Dengue virus
NNRAVHADMGY

SEQ ID NO: 50324 - protein, 11 aa, Dengue virus
HADMGYWMESA

SEQ ID NO: 50325 - protein, 11 aa, Dengue virus
ADMGYWMESAL

SEQ ID NO: 50326 - protein, 11 aa, Dengue virus
DMGYWMESALN

SEQ ID NO: 50327 - protein, 11 aa, Dengue virus
MGYWMESALND

SEQ ID NO: 50328 - protein, 11 aa, Dengue virus
GYWMESALNDT

SEQ ID NO: 50329 - protein, 11 aa, Dengue virus
YWMESALNDTW

SEQ ID NO: 50330 - protein, 11 aa, Dengue virus
WMESALNDTWK

SEQ ID NO: 50331 - protein, 11 aa, Dengue virus
IESRLNDTWKM

SEQ ID NO: 50332 - protein, 11 aa, Dengue virus
ESRLNDTWKME

SEQ ID NO: 50333 - protein, 11 aa, Dengue virus
SRLNDTWKMEK

SEQ ID NO: 50334 - protein, 11 aa, Dengue virus
RLNDTWKMEKA

SEQ ID NO: 50335 - protein, 11 aa, Dengue virus
WKMEKASFIEI

SEQ ID NO: 50336 - protein, 11 aa, Dengue virus
KMEKASFIEIK

SEQ ID NO: 50337 - protein, 11 aa, Dengue virus
IEKASFIEVKS

SEQ ID NO: 50338 - protein, 11 aa, Dengue virus
EKASFIEIKSC

SEQ ID NO: 50339 - protein, 11 aa, Dengue virus
KASFIEIKSCH

SEQ ID NO: 50340 - protein, 11 aa, Dengue virus
ASFIEIKSCHW

SEQ ID NO: 50341 - protein, 11 aa, Dengue virus
SFIEIKSCHWP

SEQ ID NO: 50342 - protein, 11 aa, Dengue virus
FIEIKSCHWPK

SEQ ID NO: 50343 - protein, 11 aa, Dengue virus
IEIKSCHWPKS

SEQ ID NO: 50344 - protein, 11 aa, Dengue virus
EIKSCHWPKSH

SEQ ID NO: 50345 - protein, 11 aa, Dengue virus
IKSCHWPKSHT

SEQ ID NO: 50346 - protein, 11 aa, Dengue virus
KSCYWPRSHTL

SEQ ID NO: 50347 - protein, 11 aa, Dengue virus
SCYWPRSHTLW

SEQ ID NO: 50348 - protein, 11 aa, Dengue virus
CHWPRSHTLWS

SEQ ID NO: 50349 - protein, 11 aa, Dengue virus
HWPRSHTLWSN

SEQ ID NO: 50350 - protein, 11 aa, Dengue virus
VLESEMVIPKN

SEQ ID NO: 50351 - protein, 11 aa, Dengue virus
IPKSFAGPVSQ

SEQ ID NO: 50352 - protein, 11 aa, Dengue virus
PKSFAGPVSQH

SEQ ID NO: 50353 - protein, 11 aa, Dengue virus
KSFAGPVSQHN

SEQ ID NO: 50354 - protein, 11 aa, Dengue virus
FAGPVSQHNNR

SEQ ID NO: 50355 - protein, 11 aa, Dengue virus
AGPVSQHNHRP

SEQ ID NO: 50356 - protein, 11 aa, Dengue virus
GPVSQHNHRPG

SEQ ID NO: 50357 - protein, 11 aa, Dengue virus
PVSQHNHRPGY

SEQ ID NO: 50358 - protein, 11 aa, Dengue virus
VSQHNNRPGYH

SEQ ID NO: 50359 - protein, 11 aa, Dengue virus
SQHNNRPGYHT

SEQ ID NO: 50360 - protein, 11 aa, Dengue virus
QHNNRPGYHTQ

SEQ ID NO: 50361 - protein, 11 aa, Dengue virus
RPGYYTQTAGP

SEQ ID NO: 50362 - protein, 11 aa, Dengue virus
PGYYTQTAGPW

SEQ ID NO: 50363 - protein, 11 aa, Dengue virus
GYYTQTAGPWH

SEQ ID NO: 50364 - protein, 11 aa, Dengue virus
YYTQTAGPWHL

SEQ ID NO: 50365 - protein, 11 aa, Dengue virus
YTQTAGPWHLG

SEQ ID NO: 50366 - protein, 11 aa, Dengue virus
TQTAGPWHLGR

SEQ ID NO: 50367 - protein, 11 aa, Dengue virus
QTAGPWHLGRL

SEQ ID NO: 50368 - protein, 11 aa, Dengue virus
TAGPWHLGRLE

SEQ ID NO: 50369 - protein, 11 aa, Dengue virus
TGPWHLGKLEM

SEQ ID NO: 50370 - protein, 11 aa, Dengue virus
WHLGKLEMDFE

SEQ ID NO: 50371 - protein, 11 aa, Dengue virus
HLGRLEMDFDF

SEQ ID NO: 50372 - protein, 11 aa, Dengue virus
LGRLEMDFDFC

SEQ ID NO: 50373 - protein, 11 aa, Dengue virus
LEMDFDLCEGT

SEQ ID NO: 50374 - protein, 11 aa, Dengue virus
EMDFDLCEGTT

SEQ ID NO: 50375 - protein, 11 aa, Dengue virus
MDFDLCEGTTV

SEQ ID NO: 50376 - protein, 11 aa, Dengue virus
LCEGTTVVVTE

SEQ ID NO: 50377 - protein, 11 aa, Dengue virus
CDGTTVVVTED

SEQ ID NO: 50378 - protein, 11 aa, Dengue virus
DGTTVVVTEDC

SEQ ID NO: 50379 - protein, 11 aa, Dengue virus
GTTVVVTEECG

SEQ ID NO: 50380 - protein, 11 aa, Dengue virus
TTVVVTEECGN

SEQ ID NO: 50381 - protein, 11 aa, Dengue virus
TVVVTEECGNR

SEQ ID NO: 50382 - protein, 11 aa, Dengue virus
VVVTEECGNRG

SEQ ID NO: 50383 - protein, 11 aa, Dengue virus
VVTEECGNRGP

SEQ ID NO: 50384 - protein, 11 aa, Dengue virus
VTENCGNRGPS

SEQ ID NO: 50385 - protein, 11 aa, Dengue virus
TENCGNRGPSL

SEQ ID NO: 50386 - protein, 11 aa, Dengue virus
ENCGNRGPSLR

SEQ ID NO: 50387 - protein, 11 aa, Dengue virus
PLKEREENLVN

SEQ ID NO: 50388 - protein, 11 aa, Dengue virus
LKEREENLVNS

SEQ ID NO: 50389 - protein, 11 aa, Dengue virus
KEREENLVNSL

SEQ ID NO: 50390 - protein, 11 aa, Dengue virus
EREENLVNSLV

SEQ ID NO: 50391 - protein, 11 aa, Dengue virus
REENLVNSLVT

SEQ ID NO: 50392 - protein, 11 aa, Dengue virus
NLVNSLVTAGQ

SEQ ID NO: 50393 - protein, 11 aa, Dengue virus
LVNSLVTAGQG

SEQ ID NO: 50394 - protein, 11 aa, Dengue virus
VNSLVTAGQGQ

SEQ ID NO: 50395 - protein, 11 aa, Dengue virus
SSLVTAGHGQI

SEQ ID NO: 50396 - protein, 11 aa, Dengue virus
SLVTAGQGQVD

SEQ ID NO: 50397 - protein, 11 aa, Dengue virus
LVTAGQGQVDN

SEQ ID NO: 50398 - protein, 11 aa, Dengue virus
VTAGQGQVDNF

SEQ ID NO: 50399 - protein, 11 aa, Dengue virus
TAGQGQVDNFS

SEQ ID NO: 50400 - protein, 11 aa, Dengue virus
AGQGQVDNFSL

SEQ ID NO: 50401 - protein, 11 aa, Dengue virus
GQGQVDNFSLG

SEQ ID NO: 50402 - protein, 11 aa, Dengue virus
HGQIDNFSLGI

SEQ ID NO: 50403 - protein, 11 aa, Dengue virus
GQIDNFSLGIL

SEQ ID NO: 50404 - protein, 11 aa, Dengue virus
QIDNFSLGILG

SEQ ID NO: 50405 - protein, 11 aa, Dengue virus
IDNFSLGILGM

SEQ ID NO: 50406 - protein, 11 aa, Dengue virus
FSLGILGMALL

SEQ ID NO: 50407 - protein, 11 aa, Dengue virus
SLGILGMALLL

SEQ ID NO: 50408 - protein, 11 aa, Dengue virus
LGILGMALLLE

SEQ ID NO: 50409 - protein, 11 aa, Dengue virus
GILGMALLLEE

SEQ ID NO: 50410 - protein, 11 aa, Dengue virus
ILGMALLLEEM

SEQ ID NO: 50411 - protein, 11 aa, Dengue virus
GMALFLEEMLK

SEQ ID NO: 50412 - protein, 11 aa, Dengue virus
MALFLEEMLKT

SEQ ID NO: 50413 - protein, 11 aa, Dengue virus
LLLEEMLRTRV

SEQ ID NO: 50414 - protein, 11 aa, Dengue virus
LLEEMLRTRVG

SEQ ID NO: 50415 - protein, 11 aa, Dengue virus
LEEMLKTRVGT

SEQ ID NO: 50416 - protein, 11 aa, Dengue virus
EEMLKTRVGTK

SEQ ID NO: 50417 - protein, 11 aa, Dengue virus
EMLKTRVGTKH

SEQ ID NO: 50418 - protein, 11 aa, Dengue virus
MLKTRVGTKHA

SEQ ID NO: 50419 - protein, 11 aa, Dengue virus
SLVTLITGNMS

SEQ ID NO: 50420 - protein, 11 aa, Dengue virus
LVTLITGNMSF

SEQ ID NO: 50421 - protein, 11 aa, Dengue virus
TLITGNLSFKD

SEQ ID NO: 50422 - protein, 11 aa, Dengue virus
KDLGRVIIMVG

SEQ ID NO: 50423 - protein, 11 aa, Dengue virus
DLGRVIIMVGA

SEQ ID NO: 50424 - protein, 11 aa, Dengue virus
TDEMGMGVTYL

SEQ ID NO: 50425 - protein, 11 aa, Dengue virus
DDIGMGITYLA

SEQ ID NO: 50426 - protein, 11 aa, Dengue virus
DIGMGITYLAL

SEQ ID NO: 50427 - protein, 11 aa, Dengue virus
IGMGITYLALL

SEQ ID NO: 50428 - protein, 11 aa, Dengue virus
GIGVTYLALLA

SEQ ID NO: 50429 - protein, 11 aa, Dengue virus
IGVTYLALLAA

SEQ ID NO: 50430 - protein, 11 aa, Dengue virus
ITYLALLAAFK

SEQ ID NO: 50431 - protein, 11 aa, Dengue virus
LAAFKVRPTFV

SEQ ID NO: 50432 - protein, 11 aa, Dengue virus
AAFRVRPTFAA

SEQ ID NO: 50433 - protein, 11 aa, Dengue virus
AFRVRPTFAAG

SEQ ID NO: 50434 - protein, 11 aa, Dengue virus
FRVRPTFAAGL

SEQ ID NO: 50435 - protein, 11 aa, Dengue virus
KVRPTFAAGLF

SEQ ID NO: 50436 - protein, 11 aa, Dengue virus
VRPTFAAGLFL

SEQ ID NO: 50437 - protein, 11 aa, Dengue virus
RPTFAAGLFLR

SEQ ID NO: 50438 - protein, 11 aa, Dengue virus
PTFAAGLFLRK

SEQ ID NO: 50439 - protein, 11 aa, Dengue virus
TFAAGLFLRKL

SEQ ID NO: 50440 - protein, 11 aa, Dengue virus
FAAGLFLRKLT

SEQ ID NO: 50441 - protein, 11 aa, Dengue virus
AAGLFLRKLTS

SEQ ID NO: 50442 - protein, 11 aa, Dengue virus
AGLFLRKLTSK

SEQ ID NO: 50443 - protein, 11 aa, Dengue virus
GLLLKKLTSKE

SEQ ID NO: 50444 - protein, 11 aa, Dengue virus
LLLKKLTSKEL

SEQ ID NO: 50445 - protein, 11 aa, Dengue virus
FLRKLTSKELM

SEQ ID NO: 50446 - protein, 11 aa, Dengue virus
RKLTSKELLMA

SEQ ID NO: 50447 - protein, 11 aa, Dengue virus
KLTSKELLMAT

SEQ ID NO: 50448 - protein, 11 aa, Dengue virus
LTSKELLMATI

SEQ ID NO: 50449 - protein, 11 aa, Dengue virus
TSKELLMATIG

SEQ ID NO: 50450 - protein, 11 aa, Dengue virus
SKELLMATIGV

SEQ ID NO: 50451 - protein, 11 aa, Dengue virus
TVLELTDAIAL

SEQ ID NO: 50452 - protein, 11 aa, Dengue virus
VLELTDAIALG

SEQ ID NO: 50453 - protein, 11 aa, Dengue virus
LTDAIALGIMV

SEQ ID NO: 50454 - protein, 11 aa, Dengue virus
TDAIALGIMVL

SEQ ID NO: 50455 - protein, 11 aa, Dengue virus
DAIALGIMVLK

SEQ ID NO: 50456 - protein, 11 aa, Dengue virus
LEKYQLAVTIM

SEQ ID NO: 50457 - protein, 11 aa, Dengue virus
EKYQLAVTIMT

SEQ ID NO: 50458 - protein, 11 aa, Dengue virus
CIPNVMILQHA

SEQ ID NO: 50459 - protein, 11 aa, Dengue virus
IPNVMILQHAW

SEQ ID NO: 50460 - protein, 11 aa, Dengue virus
VSVSPLILTSS

SEQ ID NO: 50461 - protein, 11 aa, Dengue virus
SVSPLILTSSQ

SEQ ID NO: 50462 - protein, 11 aa, Dengue virus
VSPLILTSSQQ

SEQ ID NO: 50463 - protein, 11 aa, Dengue virus
SPLILTSSQQK

SEQ ID NO: 50464 - protein, 11 aa, Dengue virus
LTSSRQKTDWI

SEQ ID NO: 50465 - protein, 11 aa, Dengue virus
TSSRQKTDWIP

SEQ ID NO: 50466 - protein, 11 aa, Dengue virus
SSRQKTDWIPL

SEQ ID NO: 50467 - protein, 11 aa, Dengue virus
SRQKTDWIPLA

SEQ ID NO: 50468 - protein, 11 aa, Dengue virus
RQKTDWIPLAL

SEQ ID NO: 50469 - protein, 11 aa, Dengue virus
QKTDWIPLVLT

SEQ ID NO: 50470 - protein, 11 aa, Dengue virus
KTDWIPLVLTI

SEQ ID NO: 50471 - protein, 11 aa, Dengue virus
TDWIPLVLTIK

SEQ ID NO: 50472 - protein, 11 aa, Dengue virus
IPLALTIKGLS

SEQ ID NO: 50473 - protein, 11 aa, Dengue virus
PLALTVKGLNP

SEQ ID NO: 50474 - protein, 11 aa, Dengue virus
LALTVKGLNPT

SEQ ID NO: 50475 - protein, 11 aa, Dengue virus
ALTVKGLNPTA

SEQ ID NO: 50476 - protein, 11 aa, Dengue virus
TAIFLTTLTRT

SEQ ID NO: 50477 - protein, 11 aa, Dengue virus
AIFLTTLSRPN

SEQ ID NO: 50478 - protein, 11 aa, Dengue virus
IFLTTLSRPNK

SEQ ID NO: 50479 - protein, 11 aa, Dengue virus
LTTLSRPNKTR

SEQ ID NO: 50480 - protein, 11 aa, Dengue virus
TTLSRPNKTRS

SEQ ID NO: 50481 - protein, 11 aa, Dengue virus
TLSRPNKTRSW

SEQ ID NO: 50482 - protein, 11 aa, Dengue virus
LSRPNKTRSWP

SEQ ID NO: 50483 - protein, 11 aa, Dengue virus
RPNKTRSWPLN

SEQ ID NO: 50484 - protein, 11 aa, Dengue virus
PNKTRSWPLNE

SEQ ID NO: 50485 - protein, 11 aa, Dengue virus
NKTRSWPLNEA

SEQ ID NO: 50486 - protein, 11 aa, Dengue virus
KTRSWPLNEAI

SEQ ID NO: 50487 - protein, 11 aa, Dengue virus
TRSWPLNEAIM

SEQ ID NO: 50488 - protein, 11 aa, Dengue virus
RSADLELEKAA

SEQ ID NO: 50489 - protein, 11 aa, Dengue virus
SADLELEKAAE

SEQ ID NO: 50490 - protein, 11 aa, Dengue virus
ADLELEKAAEV

SEQ ID NO: 50491 - protein, 11 aa, Dengue virus
VKWDDQAEISG

SEQ ID NO: 50492 - protein, 11 aa, Dengue virus
KWDDQAEISGS

SEQ ID NO: 50493 - protein, 11 aa, Dengue virus
WDDQAEISGSS

SEQ ID NO: 50494 - protein, 11 aa, Dengue virus
DDQAEISGSSP

SEQ ID NO: 50495 - protein, 11 aa, Dengue virus
DHAEISGSSPI

SEQ ID NO: 50496 - protein, 11 aa, Dengue virus
ISGSSPILSII

SEQ ID NO: 50497 - protein, 11 aa, Dengue virus
SGSSPILSIII

SEQ ID NO: 50498 - protein, 11 aa, Dengue virus
GSSPILSVTIS

SEQ ID NO: 50499 - protein, 11 aa, Dengue virus
SSPILSVTISE

SEQ ID NO: 50500 - protein, 11 aa, Dengue virus
SPILSVTISED

SEQ ID NO: 50501 - protein, 11 aa, Dengue virus
PILSVTISEDG

SEQ ID NO: 50502 - protein, 11 aa, Dengue virus
ILSVTISEDGS

SEQ ID NO: 50503 - protein, 11 aa, Dengue virus
LSVTISEDGSM

SEQ ID NO: 50504 - protein, 11 aa, Dengue virus
SVTISEDGSMS

SEQ ID NO: 50505 - protein, 11 aa, Dengue virus
VTISEDGSMSI

SEQ ID NO: 50506 - protein, 11 aa, Dengue virus
MSIKNEEEEQI

SEQ ID NO: 50507 - protein, 11 aa, Dengue virus
SIKNEEEEQIL

SEQ ID NO: 50508 - protein, 11 aa, Dengue virus
IKNEEEEQILT

SEQ ID NO: 50509 - protein, 11 aa, Dengue virus
KNEEEEQILTI

SEQ ID NO: 50510 - protein, 11 aa, Dengue virus
NEEEEQILTIL

SEQ ID NO: 50511 - protein, 11 aa, Dengue virus
EEEEQILTILI

SEQ ID NO: 50512 - protein, 11 aa, Dengue virus
EEEQILTILIR

SEQ ID NO: 50513 - protein, 11 aa, Dengue virus
EEQILTILIRT

SEQ ID NO: 50514 - protein, 11 aa, Dengue virus
EQILTILIRTG

SEQ ID NO: 50515 - protein, 11 aa, Dengue virus
QILTILIRTGL

SEQ ID NO: 50516 - protein, 11 aa, Dengue virus
GLLVISGLFPI

SEQ ID NO: 50517 - protein, 11 aa, Dengue virus
LLVISGLFPIS

SEQ ID NO: 50518 - protein, 11 aa, Dengue virus
LVISGLFPISI

SEQ ID NO: 50519 - protein, 11 aa, Dengue virus
VISGLFPISIP

SEQ ID NO: 50520 - protein, 11 aa, Dengue virus
SGLFPISIPIT

SEQ ID NO: 50521 - protein, 11 aa, Dengue virus
GLFPISIPITA

SEQ ID NO: 50522 - protein, 11 aa, Dengue virus
LFPISIPITAA

SEQ ID NO: 50523 - protein, 11 aa, Dengue virus
FPVSMPITAAA

SEQ ID NO: 50524 - protein, 11 aa, Dengue virus
PVSMPITAAAW

SEQ ID NO: 50525 - protein, 11 aa, Dengue virus
VSMPITAAAWY

SEQ ID NO: 50526 - protein, 11 aa, Dengue virus
VLWDVPSPPPI

SEQ ID NO: 50527 - protein, 11 aa, Dengue virus
LWDVPSPPPVE

SEQ ID NO: 50528 - protein, 11 aa, Dengue virus
GRAELEDGAYR

SEQ ID NO: 50529 - protein, 11 aa, Dengue virus
DGAYRIKQRGF

SEQ ID NO: 50530 - protein, 11 aa, Dengue virus
GAYRIKQRGIF

SEQ ID NO: 50531 - protein, 11 aa, Dengue virus
AYRIKQRGIFG

SEQ ID NO: 50532 - protein, 11 aa, Dengue virus
YRIKQRGIFGY

SEQ ID NO: 50533 - protein, 11 aa, Dengue virus
RIKQRGIFGYS

SEQ ID NO: 50534 - protein, 11 aa, Dengue virus
IKQRGIFGYSQ

SEQ ID NO: 50535 - protein, 11 aa, Dengue virus
KQRGIFGYSQI

SEQ ID NO: 50536 - protein, 11 aa, Dengue virus
QRGIFGYSQIG

SEQ ID NO: 50537 - protein, 11 aa, Dengue virus
RGIFGYSQIGA

SEQ ID NO: 50538 - protein, 11 aa, Dengue virus
RILGYSQIGAG

SEQ ID NO: 50539 - protein, 11 aa, Dengue virus
MWHVTRGAVLT

SEQ ID NO: 50540 - protein, 11 aa, Dengue virus
WHVTRGAVLTH

SEQ ID NO: 50541 - protein, 11 aa, Dengue virus
HVTRGAVLVHK

SEQ ID NO: 50542 - protein, 11 aa, Dengue virus
VTRGAVLVHKG

SEQ ID NO: 50543 - protein, 11 aa, Dengue virus
TRGAVLVHKGK

SEQ ID NO: 50544 - protein, 11 aa, Dengue virus
RGAVLVHKGKR

SEQ ID NO: 50545 - protein, 11 aa, Dengue virus
GAVLVHKGKRI

SEQ ID NO: 50546 - protein, 11 aa, Dengue virus
AVLVHKGKRIE

SEQ ID NO: 50547 - protein, 11 aa, Dengue virus
VLVHKGKRIEP

SEQ ID NO: 50548 - protein, 11 aa, Dengue virus
LVHKGKRIEPS

SEQ ID NO: 50549 - protein, 11 aa, Dengue virus
VHKGKRIEPSW

SEQ ID NO: 50550 - protein, 11 aa, Dengue virus
PSWADVRKDLI

SEQ ID NO: 50551 - protein, 11 aa, Dengue virus
SWADVKKDLVS

SEQ ID NO: 50552 - protein, 11 aa, Dengue virus
WADVKKDLVSY

SEQ ID NO: 50553 - protein, 11 aa, Dengue virus
ADVRKDLISYG

SEQ ID NO: 50554 - protein, 11 aa, Dengue virus
DVKKDLVSYGG

SEQ ID NO: 50555 - protein, 11 aa, Dengue virus
VRKDLISYGGG

SEQ ID NO: 50556 - protein, 11 aa, Dengue virus
KKDLVSYGGGW

SEQ ID NO: 50557 - protein, 11 aa, Dengue virus
RAVQTKPGLFR

SEQ ID NO: 50558 - protein, 11 aa, Dengue virus
AVQTKPGLFRT

SEQ ID NO: 50559 - protein, 11 aa, Dengue virus
VQTKPGLFRTN

SEQ ID NO: 50560 - protein, 11 aa, Dengue virus
FRTNTGTIGAV

SEQ ID NO: 50561 - protein, 11 aa, Dengue virus
RTNTGTIGAVS

SEQ ID NO: 50562 - protein, 11 aa, Dengue virus
TSTGTIGAVSL

SEQ ID NO: 50563 - protein, 11 aa, Dengue virus
STGTIGAVSLD

SEQ ID NO: 50564 - protein, 11 aa, Dengue virus
PGTSGSPIVDK

SEQ ID NO: 50565 - protein, 11 aa, Dengue virus
GTSGSPIVDKK

SEQ ID NO: 50566 - protein, 11 aa, Dengue virus
TSGSPIVDKKG

SEQ ID NO: 50567 - protein, 11 aa, Dengue virus
SGSPIVDKKGK

SEQ ID NO: 50568 - protein, 11 aa, Dengue virus
GSPIVDKKGKV

SEQ ID NO: 50569 - protein, 11 aa, Dengue virus
SPIVDKKGKVV

SEQ ID NO: 50570 - protein, 11 aa, Dengue virus
PIVDKKGKVVG

SEQ ID NO: 50571 - protein, 11 aa, Dengue virus
IVDKKGKVVGL

SEQ ID NO: 50572 - protein, 11 aa, Dengue virus
VDKKGKVVGLY

SEQ ID NO: 50573 - protein, 11 aa, Dengue virus
VVTRSGTYVSS

SEQ ID NO: 50574 - protein, 11 aa, Dengue virus
VTRSGTYVSSI

SEQ ID NO: 50575 - protein, 11 aa, Dengue virus
TRSGTYVSSIA

SEQ ID NO: 50576 - protein, 11 aa, Dengue virus
RSGTYVSSIAQ

SEQ ID NO: 50577 - protein, 11 aa, Dengue virus
SGTYVSSIAQT

SEQ ID NO: 50578 - protein, 11 aa, Dengue virus
GTYVSSIAQTE

SEQ ID NO: 50579 - protein, 11 aa, Dengue virus
TYVSSIAQTEK

SEQ ID NO: 50580 - protein, 11 aa, Dengue virus
YVSAIAQTEKN

SEQ ID NO: 50581 - protein, 11 aa, Dengue virus
VSAIAQTEKNI

SEQ ID NO: 50582 - protein, 11 aa, Dengue virus
SAIAQTEKNIE

SEQ ID NO: 50583 - protein, 11 aa, Dengue virus
EDNPEIEDHIF

SEQ ID NO: 50584 - protein, 11 aa, Dengue virus
DNPEIEDHIFR

SEQ ID NO: 50585 - protein, 11 aa, Dengue virus
NPEIEDHIFRK

SEQ ID NO: 50586 - protein, 11 aa, Dengue virus
PDIEDDIFRKR

SEQ ID NO: 50587 - protein, 11 aa, Dengue virus
DIEDDIFRKRR

SEQ ID NO: 50588 - protein, 11 aa, Dengue virus
IEDDIFRKRKL

SEQ ID NO: 50589 - protein, 11 aa, Dengue virus
EDDIFRKRKLT

SEQ ID NO: 50590 - protein, 11 aa, Dengue virus
DDIFRKRKLTI

SEQ ID NO: 50591 - protein, 11 aa, Dengue virus
DIFRKRKLTIM

SEQ ID NO: 50592 - protein, 11 aa, Dengue virus
IFRKRKLTIMD

SEQ ID NO: 50593 - protein, 11 aa, Dengue virus
FRKRKLTIMDL

SEQ ID NO: 50594 - protein, 11 aa, Dengue virus
RKRKLTIMDLH

SEQ ID NO: 50595 - protein, 11 aa, Dengue virus
KRKLTIMDLHP

SEQ ID NO: 50596 - protein, 11 aa, Dengue virus
RKLTIMDLHPG

SEQ ID NO: 50597 - protein, 11 aa, Dengue virus
LPIRYQTTAIK

SEQ ID NO: 50598 - protein, 11 aa, Dengue virus
PIRYQTPAIKA

SEQ ID NO: 50599 - protein, 11 aa, Dengue virus
IRYQTPAIKAE

SEQ ID NO: 50600 - protein, 11 aa, Dengue virus
RYQTPAIKAEH

SEQ ID NO: 50601 - protein, 11 aa, Dengue virus
YQTPAIKAEHT

SEQ ID NO: 50602 - protein, 11 aa, Dengue virus
QTPAIKAEHTG

SEQ ID NO: 50603 - protein, 11 aa, Dengue virus
TPAIKAEHTGR

SEQ ID NO: 50604 - protein, 11 aa, Dengue virus
PAIKAEHTGRE

SEQ ID NO: 50605 - protein, 11 aa, Dengue virus
AIKAEHTGREI

SEQ ID NO: 50606 - protein, 11 aa, Dengue virus
IKAEHTGREIV

SEQ ID NO: 50607 - protein, 11 aa, Dengue virus
KAEHTGREIVD

SEQ ID NO: 50608 - protein, 11 aa, Dengue virus
DPFPQSNAPIV

SEQ ID NO: 50609 - protein, 11 aa, Dengue virus
PFPQSNAPIVD

SEQ ID NO: 50610 - protein, 11 aa, Dengue virus
FPQSNAPIVDE

SEQ ID NO: 50611 - protein, 11 aa, Dengue virus
PQSNAPIVDEE

SEQ ID NO: 50612 - protein, 11 aa, Dengue virus
QSNAPIVDEER

SEQ ID NO: 50613 - protein, 11 aa, Dengue virus
SNAPIVDEERE

SEQ ID NO: 50614 - protein, 11 aa, Dengue virus
NAPIVDEEREI

SEQ ID NO: 50615 - protein, 11 aa, Dengue virus
APIVDEEREIP

SEQ ID NO: 50616 - protein, 11 aa, Dengue virus
PIVDEEREIPE

SEQ ID NO: 50617 - protein, 11 aa, Dengue virus
IVDEEREIPER

SEQ ID NO: 50618 - protein, 11 aa, Dengue virus
VDEEREIPERS

SEQ ID NO: 50619 - protein, 11 aa, Dengue virus
EREIPERSWNT

SEQ ID NO: 50620 - protein, 11 aa, Dengue virus
REIPERSWNTG

SEQ ID NO: 50621 - protein, 11 aa, Dengue virus
EIPERSWNTGH

SEQ ID NO: 50622 - protein, 11 aa, Dengue virus
IPERSWNTGHE

SEQ ID NO: 50623 - protein, 11 aa, Dengue virus
PERSWNTGHEW

SEQ ID NO: 50624 - protein, 11 aa, Dengue virus
ERSWSSGHEWV

SEQ ID NO: 50625 - protein, 11 aa, Dengue virus
RSWSSGHEWVT

SEQ ID NO: 50626 - protein, 11 aa, Dengue virus
SWSSGHEWVTD

SEQ ID NO: 50627 - protein, 11 aa, Dengue virus
WNSGHEWITNF

SEQ ID NO: 50628 - protein, 11 aa, Dengue virus
GYEWVTDFKGK

SEQ ID NO: 50629 - protein, 11 aa, Dengue virus
YEWVTDFKGKT

SEQ ID NO: 50630 - protein, 11 aa, Dengue virus
EWITNFEGKTV

SEQ ID NO: 50631 - protein, 11 aa, Dengue virus
WITDFKGKTVW

SEQ ID NO: 50632 - protein, 11 aa, Dengue virus
ITNFEGKTVWF

SEQ ID NO: 50633 - protein, 11 aa, Dengue virus
KTVWFVPSIRA

SEQ ID NO: 50634 - protein, 11 aa, Dengue virus
TVWFVPSIRAG

SEQ ID NO: 50635 - protein, 11 aa, Dengue virus
VWFVPSIRAGN

SEQ ID NO: 50636 - protein, 11 aa, Dengue virus
WFVPSIRAGND

SEQ ID NO: 50637 - protein, 11 aa, Dengue virus
FVPSIRAGNDI

SEQ ID NO: 50638 - protein, 11 aa, Dengue virus
VPSIRAGNDIA

SEQ ID NO: 50639 - protein, 11 aa, Dengue virus
PSIRAGNDIAA

SEQ ID NO: 50640 - protein, 11 aa, Dengue virus
SIRAGNDIAAC

SEQ ID NO: 50641 - protein, 11 aa, Dengue virus
IRAGNDIAACL

SEQ ID NO: 50642 - protein, 11 aa, Dengue virus
RAGNDIAACLR

SEQ ID NO: 50643 - protein, 11 aa, Dengue virus
LSRKTFDTEYT

SEQ ID NO: 50644 - protein, 11 aa, Dengue virus
SRKTFDSEYAK

SEQ ID NO: 50645 - protein, 11 aa, Dengue virus
RKTFDTEYTKT

SEQ ID NO: 50646 - protein, 11 aa, Dengue virus
KTFDTEYTKTR

SEQ ID NO: 50647 - protein, 11 aa, Dengue virus
KTRSNDWDFVV

SEQ ID NO: 50648 - protein, 11 aa, Dengue virus
TRSNDWDFVVT

SEQ ID NO: 50649 - protein, 11 aa, Dengue virus
RSNDWDFVVTT

SEQ ID NO: 50650 - protein, 11 aa, Dengue virus
SNDWDFVVTTD

SEQ ID NO: 50651 - protein, 11 aa, Dengue virus
VILTEGEERVI

SEQ ID NO: 50652 - protein, 11 aa, Dengue virus
ILTEGEERVIL

SEQ ID NO: 50653 - protein, 11 aa, Dengue virus
LADGEERVILA

SEQ ID NO: 50654 - protein, 11 aa, Dengue virus
TEGEERVILAG

SEQ ID NO: 50655 - protein, 11 aa, Dengue virus
QRRGRIGRNPR

SEQ ID NO: 50656 - protein, 11 aa, Dengue virus
RRGRIGRNPRN

SEQ ID NO: 50657 - protein, 11 aa, Dengue virus
RGRIGRNPRNE

SEQ ID NO: 50658 - protein, 11 aa, Dengue virus
GRIGRNPRNEN

SEQ ID NO: 50659 - protein, 11 aa, Dengue virus
RIGRNPRNEND

SEQ ID NO: 50660 - protein, 11 aa, Dengue virus
IGRNPRNENDQ

SEQ ID NO: 50661 - protein, 11 aa, Dengue virus
RGDLPVWLAFK

SEQ ID NO: 50662 - protein, 11 aa, Dengue virus
GDLPVWLAFKV

SEQ ID NO: 50663 - protein, 11 aa, Dengue virus
DLPVWLAFKVA

SEQ ID NO: 50664 - protein, 11 aa, Dengue virus
LPVWLAYKVAS

SEQ ID NO: 50665 - protein, 11 aa, Dengue virus
PVWLAYKVASE

SEQ ID NO: 50666 - protein, 11 aa, Dengue virus
VWLAYKVASEG

SEQ ID NO: 50667 - protein, 11 aa, Dengue virus
WLAYKVASEGI

SEQ ID NO: 50668 - protein, 11 aa, Dengue virus
LAYKVASEGIN

SEQ ID NO: 50669 - protein, 11 aa, Dengue virus
AYKVASEGINY

SEQ ID NO: 50670 - protein, 11 aa, Dengue virus
KVASEGINYAD

SEQ ID NO: 50671 - protein, 11 aa, Dengue virus
VAAEGINYTDR

SEQ ID NO: 50672 - protein, 11 aa, Dengue virus
EGINYTDRKWC

SEQ ID NO: 50673 - protein, 11 aa, Dengue virus
GINYTDRKWCF

SEQ ID NO: 50674 - protein, 11 aa, Dengue virus
INYTDRKWCFD

SEQ ID NO: 50675 - protein, 11 aa, Dengue virus
NYTDRKWCFDG

SEQ ID NO: 50676 - protein, 11 aa, Dengue virus
YADRRWCFDGV

SEQ ID NO: 50677 - protein, 11 aa, Dengue virus
DRRWCFDGVKN

SEQ ID NO: 50678 - protein, 11 aa, Dengue virus
RRWCFDGVKNN

SEQ ID NO: 50679 - protein, 11 aa, Dengue virus
RWCFDGVKNNQ

SEQ ID NO: 50680 - protein, 11 aa, Dengue virus
WCFDGIRNNQI

SEQ ID NO: 50681 - protein, 11 aa, Dengue virus
CFDGIRNNQIL

SEQ ID NO: 50682 - protein, 11 aa, Dengue virus
FDGIRNNQILE

SEQ ID NO: 50683 - protein, 11 aa, Dengue virus
DGIRNNQILEE

SEQ ID NO: 50684 - protein, 11 aa, Dengue virus
GIRNNQILEEN

SEQ ID NO: 50685 - protein, 11 aa, Dengue virus
RNNQILEENVE

SEQ ID NO: 50686 - protein, 11 aa, Dengue virus
QILEENMEVEV

SEQ ID NO: 50687 - protein, 11 aa, Dengue virus
ILEENMEVEVW

SEQ ID NO: 50688 - protein, 11 aa, Dengue virus
LEENMEVEVWT

SEQ ID NO: 50689 - protein, 11 aa, Dengue virus
EENMEVEVWTK

SEQ ID NO: 50690 - protein, 11 aa, Dengue virus
ENMEVEVWTKE

SEQ ID NO: 50691 - protein, 11 aa, Dengue virus
NMEVEVWTKEG

SEQ ID NO: 50692 - protein, 11 aa, Dengue virus
MEVEVWTKEGE

SEQ ID NO: 50693 - protein, 11 aa, Dengue virus
FAAGRKSLTLS

SEQ ID NO: 50694 - protein, 11 aa, Dengue virus
AAGRKSLTLSL

SEQ ID NO: 50695 - protein, 11 aa, Dengue virus
AGRKSLTLSLI

SEQ ID NO: 50696 - protein, 11 aa, Dengue virus
GRKSLTLSLIT

SEQ ID NO: 50697 - protein, 11 aa, Dengue virus
RKSLTLSLITE

SEQ ID NO: 50698 - protein, 11 aa, Dengue virus
KSLTLSLITEM

SEQ ID NO: 50699 - protein, 11 aa, Dengue virus
SLTLSLITEMG

SEQ ID NO: 50700 - protein, 11 aa, Dengue virus
LTLSLITEMGR

SEQ ID NO: 50701 - protein, 11 aa, Dengue virus
TLSLITEMGRL

SEQ ID NO: 50702 - protein, 11 aa, Dengue virus
KLPTFMTQKAR

SEQ ID NO: 50703 - protein, 11 aa, Dengue virus
LPTFMTQKARD

SEQ ID NO: 50704 - protein, 11 aa, Dengue virus
PTFMTQKARDA

SEQ ID NO: 50705 - protein, 11 aa, Dengue virus
TFMTQKARDAL

SEQ ID NO: 50706 - protein, 11 aa, Dengue virus
FMTQKARDALD

SEQ ID NO: 50707 - protein, 11 aa, Dengue virus
MTQKARDALDN

SEQ ID NO: 50708 - protein, 11 aa, Dengue virus
TQKARDALDNL

SEQ ID NO: 50709 - protein, 11 aa, Dengue virus
QKARDALDNLA

SEQ ID NO: 50710 - protein, 11 aa, Dengue virus
KARDALDNLAV

SEQ ID NO: 50711 - protein, 11 aa, Dengue virus
ARDALDNLAVL

SEQ ID NO: 50712 - protein, 11 aa, Dengue virus
DALDNLAVLHS

SEQ ID NO: 50713 - protein, 11 aa, Dengue virus
DNLAVLHSAEM

SEQ ID NO: 50714 - protein, 11 aa, Dengue virus
NLAVLHSAEMG

SEQ ID NO: 50715 - protein, 11 aa, Dengue virus
LAVLHSAEMGG

SEQ ID NO: 50716 - protein, 11 aa, Dengue virus
AVLHTAEAGGK

SEQ ID NO: 50717 - protein, 11 aa, Dengue virus
VLHTAEAGGKA

SEQ ID NO: 50718 - protein, 11 aa, Dengue virus
GGKAYTHALSE

SEQ ID NO: 50719 - protein, 11 aa, Dengue virus
GKAYTHALSEL

SEQ ID NO: 50720 - protein, 11 aa, Dengue virus
KAYTHALSELP

SEQ ID NO: 50721 - protein, 11 aa, Dengue virus
ETLLLLTLLAA

SEQ ID NO: 50722 - protein, 11 aa, Dengue virus
TLLLLTLLAAV

SEQ ID NO: 50723 - protein, 11 aa, Dengue virus
LLLLTLLAAVT

SEQ ID NO: 50724 - protein, 11 aa, Dengue virus
LLLTLLAAVTG

SEQ ID NO: 50725 - protein, 11 aa, Dengue virus
LLTLLAAVTGG

SEQ ID NO: 50726 - protein, 11 aa, Dengue virus
LTLLAAVTGGI

SEQ ID NO: 50727 - protein, 11 aa, Dengue virus
TLLAAVTGGIF

SEQ ID NO: 50728 - protein, 11 aa, Dengue virus
GGIFLFLMSAR

SEQ ID NO: 50729 - protein, 11 aa, Dengue virus
GIFLFLMSARG

SEQ ID NO: 50730 - protein, 11 aa, Dengue virus
FLFLMSGKGVG

SEQ ID NO: 50731 - protein, 11 aa, Dengue virus
LFLMSGKGVGK

SEQ ID NO: 50732 - protein, 11 aa, Dengue virus
FLMSGKGVGKM

SEQ ID NO: 50733 - protein, 11 aa, Dengue virus
LMSGKGVGKMT

SEQ ID NO: 50734 - protein, 11 aa, Dengue virus
MSGKGVGKMTL

SEQ ID NO: 50735 - protein, 11 aa, Dengue virus
SGKGVGKMTLG

SEQ ID NO: 50736 - protein, 11 aa, Dengue virus
GKGVGKMTLGM

SEQ ID NO: 50737 - protein, 11 aa, Dengue virus
KGVGKMTLGMC

SEQ ID NO: 50738 - protein, 11 aa, Dengue virus
GMGKMTLGMCC

SEQ ID NO: 50739 - protein, 11 aa, Dengue virus
LTYVVIAILTL

SEQ ID NO: 50740 - protein, 11 aa, Dengue virus
TYVVIAILTLV

SEQ ID NO: 50741 - protein, 11 aa, Dengue virus
YVVIAILTLVA

SEQ ID NO: 50742 - protein, 11 aa, Dengue virus
VVIAILTLVAA

SEQ ID NO: 50743 - protein, 11 aa, Dengue virus
VIAILTLVAAT

SEQ ID NO: 50744 - protein, 11 aa, Dengue virus
FLEKTKKDLGF

SEQ ID NO: 50745 - protein, 11 aa, Dengue virus
LEKTKKDLGFG

SEQ ID NO: 50746 - protein, 11 aa, Dengue virus
EPESNILDIDL

SEQ ID NO: 50747 - protein, 11 aa, Dengue virus
PEINILDIDLR

SEQ ID NO: 50748 - protein, 11 aa, Dengue virus
VNPVTLTAALL

SEQ ID NO: 50749 - protein, 11 aa, Dengue virus
NPITLTAALLS

SEQ ID NO: 50750 - protein, 11 aa, Dengue virus
PITLTAALLSL

SEQ ID NO: 50751 - protein, 11 aa, Dengue virus
LVAHYAIIGPA

SEQ ID NO: 50752 - protein, 11 aa, Dengue virus
MAHYAIIGPGL

SEQ ID NO: 50753 - protein, 11 aa, Dengue virus
TVDGVTVIDLD

SEQ ID NO: 50754 - protein, 11 aa, Dengue virus
VDGVTVIDLDP

SEQ ID NO: 50755 - protein, 11 aa, Dengue virus
DGVTVIDLDPI

SEQ ID NO: 50756 - protein, 11 aa, Dengue virus
GVTVIDLDPIP

SEQ ID NO: 50757 - protein, 11 aa, Dengue virus
VTVIDLDPIPY

SEQ ID NO: 50758 - protein, 11 aa, Dengue virus
ISTLWEGNPGK

SEQ ID NO: 50759 - protein, 11 aa, Dengue virus
GLLFSIMRNTT

SEQ ID NO: 50760 - protein, 11 aa, Dengue virus
LLFSIMKNTAN

SEQ ID NO: 50761 - protein, 11 aa, Dengue virus
RRGTGNTGETL

SEQ ID NO: 50762 - protein, 11 aa, Dengue virus
RGTGNTGETLG

SEQ ID NO: 50763 - protein, 11 aa, Dengue virus
GTGNTGETLGE

SEQ ID NO: 50764 - protein, 11 aa, Dengue virus
TGNTGETLGEK

SEQ ID NO: 50765 - protein, 11 aa, Dengue virus
GNTGETLGEKW

SEQ ID NO: 50766 - protein, 11 aa, Dengue virus
NTGETLGEKWK

SEQ ID NO: 50767 - protein, 11 aa, Dengue virus
LGEKWKSRLNT

SEQ ID NO: 50768 - protein, 11 aa, Dengue virus
GEKWKSRLNTL

SEQ ID NO: 50769 - protein, 11 aa, Dengue virus
EKWKSRLNTLG

SEQ ID NO: 50770 - protein, 11 aa, Dengue virus
LGRSEFQIYKK

SEQ ID NO: 50771 - protein, 11 aa, Dengue virus
GKSEFQTYKKS

SEQ ID NO: 50772 - protein, 11 aa, Dengue virus
RSEFQIYKKSG

SEQ ID NO: 50773 - protein, 11 aa, Dengue virus
SEFQTYKKSGI

SEQ ID NO: 50774 - protein, 11 aa, Dengue virus
EFQTYKKSGIQ

SEQ ID NO: 50775 - protein, 11 aa, Dengue virus
FQTYKKSGIQE

SEQ ID NO: 50776 - protein, 11 aa, Dengue virus
QTYKKSGIQEV

SEQ ID NO: 50777 - protein, 11 aa, Dengue virus
TYKKSGIQEVD

SEQ ID NO: 50778 - protein, 11 aa, Dengue virus
LRWFVERNMVA

SEQ ID NO: 50779 - protein, 11 aa, Dengue virus
RWFVERNMVAP

SEQ ID NO: 50780 - protein, 11 aa, Dengue virus
WFVERNMVAPE

SEQ ID NO: 50781 - protein, 11 aa, Dengue virus
FVERNMVAPEG

SEQ ID NO: 50782 - protein, 11 aa, Dengue virus
VERNMVAPEGK

SEQ ID NO: 50783 - protein, 11 aa, Dengue virus
ERNMVAPEGKV

SEQ ID NO: 50784 - protein, 11 aa, Dengue virus
RNLVTPEGKVM

SEQ ID NO: 50785 - protein, 11 aa, Dengue virus
NLVTPEGKVMD

SEQ ID NO: 50786 - protein, 11 aa, Dengue virus
LVTPEGKVMDL

SEQ ID NO: 50787 - protein, 11 aa, Dengue virus
VAPEGKVVDLG

SEQ ID NO: 50788 - protein, 11 aa, Dengue virus
APEGKVVDLGC

SEQ ID NO: 50789 - protein, 11 aa, Dengue virus
GWSYYCGGLKS

SEQ ID NO: 50790 - protein, 11 aa, Dengue virus
WSYYCGGLKSV

SEQ ID NO: 50791 - protein, 11 aa, Dengue virus
SYYCGGLKDVR

SEQ ID NO: 50792 - protein, 11 aa, Dengue virus
YYCGGLKDVRE

SEQ ID NO: 50793 - protein, 11 aa, Dengue virus
YCGGLKDVREV

SEQ ID NO: 50794 - protein, 11 aa, Dengue virus
CGGLKDVREVK

SEQ ID NO: 50795 - protein, 11 aa, Dengue virus
GGLKDVREVKG

SEQ ID NO: 50796 - protein, 11 aa, Dengue virus
GLKDVREVKGL

SEQ ID NO: 50797 - protein, 11 aa, Dengue virus
LKDVREVKGLT

SEQ ID NO: 50798 - protein, 11 aa, Dengue virus
KDVREVKGLTK

SEQ ID NO: 50799 - protein, 11 aa, Dengue virus
DVREVKGLTKG

SEQ ID NO: 50800 - protein, 11 aa, Dengue virus
RLQSGVDVFFV

SEQ ID NO: 50801 - protein, 11 aa, Dengue virus
LQSGVDVFFVP

SEQ ID NO: 50802 - protein, 11 aa, Dengue virus
QSGVDVFFVPP

SEQ ID NO: 50803 - protein, 11 aa, Dengue virus
SGVDVFFVPPE

SEQ ID NO: 50804 - protein, 11 aa, Dengue virus
GVDVFFVPPEK

SEQ ID NO: 50805 - protein, 11 aa, Dengue virus
VDVFFVPPEKC

SEQ ID NO: 50806 - protein, 11 aa, Dengue virus
DVFFVPPEKCD

SEQ ID NO: 50807 - protein, 11 aa, Dengue virus
VFFVPPEKCDT

SEQ ID NO: 50808 - protein, 11 aa, Dengue virus
FFVPPEKCDTL

SEQ ID NO: 50809 - protein, 11 aa, Dengue virus
FVPPEKCDTLL

SEQ ID NO: 50810 - protein, 11 aa, Dengue virus
VPPEKCDTLLC

SEQ ID NO: 50811 - protein, 11 aa, Dengue virus
IEAGRTLRVLS

SEQ ID NO: 50812 - protein, 11 aa, Dengue virus
RVLNLVENWLG

SEQ ID NO: 50813 - protein, 11 aa, Dengue virus
VLNLVENWLGS

SEQ ID NO: 50814 - protein, 11 aa, Dengue virus
LNLVENWLGSN

SEQ ID NO: 50815 - protein, 11 aa, Dengue virus
ENWLGSNTQFC

SEQ ID NO: 50816 - protein, 11 aa, Dengue virus
WLNNNTQFCVK

SEQ ID NO: 50817 - protein, 11 aa, Dengue virus
LNNNTQFCVKV

SEQ ID NO: 50818 - protein, 11 aa, Dengue virus
NNNTQFCVKVL

SEQ ID NO: 50819 - protein, 11 aa, Dengue virus
NNTQFCVKVLN

SEQ ID NO: 50820 - protein, 11 aa, Dengue virus
DTQFCIKVLNP

SEQ ID NO: 50821 - protein, 11 aa, Dengue virus
YMPSVIERMET

SEQ ID NO: 50822 - protein, 11 aa, Dengue virus
MPSVIERMETL

SEQ ID NO: 50823 - protein, 11 aa, Dengue virus
PSVIERMETLQ

SEQ ID NO: 50824 - protein, 11 aa, Dengue virus
SVIERMETLQR

SEQ ID NO: 50825 - protein, 11 aa, Dengue virus
LQRKFGGALVR

SEQ ID NO: 50826 - protein, 11 aa, Dengue virus
QRKFGGALVRN

SEQ ID NO: 50827 - protein, 11 aa, Dengue virus
RKFGGALVRNP

SEQ ID NO: 50828 - protein, 11 aa, Dengue virus
KFGGALVRNPL

SEQ ID NO: 50829 - protein, 11 aa, Dengue virus
RMLINRFTMRY

SEQ ID NO: 50830 - protein, 11 aa, Dengue virus
MLINRFTMRYK

SEQ ID NO: 50831 - protein, 11 aa, Dengue virus
LINRFTMRYKK

SEQ ID NO: 50832 - protein, 11 aa, Dengue virus
INRFTMRYKKA

SEQ ID NO: 50833 - protein, 11 aa, Dengue virus
NRFTMRYKKAT

SEQ ID NO: 50834 - protein, 11 aa, Dengue virus
RFTMRYKKATY

SEQ ID NO: 50835 - protein, 11 aa, Dengue virus
FTMRYKKATYE

SEQ ID NO: 50836 - protein, 11 aa, Dengue virus
TMRYKKATYEP

SEQ ID NO: 50837 - protein, 11 aa, Dengue virus
MRYKKATYEPD

SEQ ID NO: 50838 - protein, 11 aa, Dengue virus
RYKKATYEPDV

SEQ ID NO: 50839 - protein, 11 aa, Dengue virus
HKKTTYEPDVD

SEQ ID NO: 50840 - protein, 11 aa, Dengue virus
GSGTRNIGIEC

SEQ ID NO: 50841 - protein, 11 aa, Dengue virus
SGTRNIGIECE

SEQ ID NO: 50842 - protein, 11 aa, Dengue virus
EVPNLDIIGKR

SEQ ID NO: 50843 - protein, 11 aa, Dengue virus
VPNLDIIGKRI

SEQ ID NO: 50844 - protein, 11 aa, Dengue virus
RIEKIKEEHET

SEQ ID NO: 50845 - protein, 11 aa, Dengue virus
IEKIKEEHETS

SEQ ID NO: 50846 - protein, 11 aa, Dengue virus
EKIKEEHETSW

SEQ ID NO: 50847 - protein, 11 aa, Dengue virus
KIKEEHETSWH

SEQ ID NO: 50848 - protein, 11 aa, Dengue virus
IKEEHETSWHY

SEQ ID NO: 50849 - protein, 11 aa, Dengue virus
KEEHETSWHYD

SEQ ID NO: 50850 - protein, 11 aa, Dengue virus
EEHETSWHYDQ

SEQ ID NO: 50851 - protein, 11 aa, Dengue virus
EHEASWHYDQD

SEQ ID NO: 50852 - protein, 11 aa, Dengue virus
HEASWHYDQDH

SEQ ID NO: 50853 - protein, 11 aa, Dengue virus
EASWHYDQDHP

SEQ ID NO: 50854 - protein, 11 aa, Dengue virus
ASWHYDQDHPY

SEQ ID NO: 50855 - protein, 11 aa, Dengue virus
VRLLTKPWDVI

SEQ ID NO: 50856 - protein, 11 aa, Dengue virus
RLLTKPWDVIP

SEQ ID NO: 50857 - protein, 11 aa, Dengue virus
LLTKPWDVIPM

SEQ ID NO: 50858 - protein, 11 aa, Dengue virus
LTKPWDVIPMV

SEQ ID NO: 50859 - protein, 11 aa, Dengue virus
TKPWDVIPMVT

SEQ ID NO: 50860 - protein, 11 aa, Dengue virus
KPWDVIPMVTQ

SEQ ID NO: 50861 - protein, 11 aa, Dengue virus
PWDVIPMVTQM

SEQ ID NO: 50862 - protein, 11 aa, Dengue virus
WDVIPMVTQMA

SEQ ID NO: 50863 - protein, 11 aa, Dengue virus
DVIPMVTQMAM

SEQ ID NO: 50864 - protein, 11 aa, Dengue virus
VIPMVTQMAMT

SEQ ID NO: 50865 - protein, 11 aa, Dengue virus
IPMVTQMAMTD

SEQ ID NO: 50866 - protein, 11 aa, Dengue virus
GTKKLMKITAK

SEQ ID NO: 50867 - protein, 11 aa, Dengue virus
TKKLMKITAKW

SEQ ID NO: 50868 - protein, 11 aa, Dengue virus
KKLMKITAKWL

SEQ ID NO: 50869 - protein, 11 aa, Dengue virus
KLMKITAKWLW

SEQ ID NO: 50870 - protein, 11 aa, Dengue virus
LMKITAKWLWK

SEQ ID NO: 50871 - protein, 11 aa, Dengue virus
MRITAEWLWGE

SEQ ID NO: 50872 - protein, 11 aa, Dengue virus
RITAEWLWGEL

SEQ ID NO: 50873 - protein, 11 aa, Dengue virus
ITAKWLWKELG

SEQ ID NO: 50874 - protein, 11 aa, Dengue virus
TAEWLWGELGR

SEQ ID NO: 50875 - protein, 11 aa, Dengue virus
WLWGELGRRKK

SEQ ID NO: 50876 - protein, 11 aa, Dengue virus
LWGELGRRKKP

SEQ ID NO: 50877 - protein, 11 aa, Dengue virus
WGELGRRKKPR

SEQ ID NO: 50878 - protein, 11 aa, Dengue virus
KTPRICTREEF

SEQ ID NO: 50879 - protein, 11 aa, Dengue virus
CTRAEFCNKVR

SEQ ID NO: 50880 - protein, 11 aa, Dengue virus
TRAEFCNKVRS

SEQ ID NO: 50881 - protein, 11 aa, Dengue virus
RAEFCNKVRSN

SEQ ID NO: 50882 - protein, 11 aa, Dengue virus
AEFCNKVRSNA

SEQ ID NO: 50883 - protein, 11 aa, Dengue virus
EFCNKVRSNAA

SEQ ID NO: 50884 - protein, 11 aa, Dengue virus
FCNKVRSNAAL

SEQ ID NO: 50885 - protein, 11 aa, Dengue virus
CNKVRSNAALG

SEQ ID NO: 50886 - protein, 11 aa, Dengue virus
NKVRSNAALGA

SEQ ID NO: 50887 - protein, 11 aa, Dengue virus
WKSAREAVEDN

SEQ ID NO: 50888 - protein, 11 aa, Dengue virus
KSAREAVEDSG

SEQ ID NO: 50889 - protein, 11 aa, Dengue virus
SAREAVEDSGF

SEQ ID NO: 50890 - protein, 11 aa, Dengue virus
AREAVEDSGFW

SEQ ID NO: 50891 - protein, 11 aa, Dengue virus
REAVEDSGFWE

SEQ ID NO: 50892 - protein, 11 aa, Dengue virus
EAVEDSGFWEL

SEQ ID NO: 50893 - protein, 11 aa, Dengue virus
FWELIDRERNL

SEQ ID NO: 50894 - protein, 11 aa, Dengue virus
WELIDRERNLH

SEQ ID NO: 50895 - protein, 11 aa, Dengue virus
ELIDRERNLHL

SEQ ID NO: 50896 - protein, 11 aa, Dengue virus
EKERNLHLDGK

SEQ ID NO: 50897 - protein, 11 aa, Dengue virus
KERNLHLDGKC

SEQ ID NO: 50898 - protein, 11 aa, Dengue virus
LSGVEGEGLYK

SEQ ID NO: 50899 - protein, 11 aa, Dengue virus
SGVEGEGLYKL

SEQ ID NO: 50900 - protein, 11 aa, Dengue virus
GVEGEGLYKLG

SEQ ID NO: 50901 - protein, 11 aa, Dengue virus
VEGEGLYKLGY

SEQ ID NO: 50902 - protein, 11 aa, Dengue virus
EGEGLYKLGYI

SEQ ID NO: 50903 - protein, 11 aa, Dengue virus
GEGLYKLGYIL

SEQ ID NO: 50904 - protein, 11 aa, Dengue virus
EGLYKLGYILR

SEQ ID NO: 50905 - protein, 11 aa, Dengue virus
GLHRLGYILRE

SEQ ID NO: 50906 - protein, 11 aa, Dengue virus
LHRLGYILREV

SEQ ID NO: 50907 - protein, 11 aa, Dengue virus
LGYILREVGKK

SEQ ID NO: 50908 - protein, 11 aa, Dengue virus
ISRKAGGAMYA

SEQ ID NO: 50909 - protein, 11 aa, Dengue virus
SRKAGGAMYAD

SEQ ID NO: 50910 - protein, 11 aa, Dengue virus
KKAGGAMYADD

SEQ ID NO: 50911 - protein, 11 aa, Dengue virus
DTAGWDTRITS

SEQ ID NO: 50912 - protein, 11 aa, Dengue virus
TAGWDTRITSE

SEQ ID NO: 50913 - protein, 11 aa, Dengue virus
AGWDTRITSED

SEQ ID NO: 50914 - protein, 11 aa, Dengue virus
GWDTRITSEDL

SEQ ID NO: 50915 - protein, 11 aa, Dengue virus
WDTRITSEDLK

SEQ ID NO: 50916 - protein, 11 aa, Dengue virus
DTRITSEDLKN

SEQ ID NO: 50917 - protein, 11 aa, Dengue virus
TRITSEDLKNE

SEQ ID NO: 50918 - protein, 11 aa, Dengue virus
RITSEDLKNEE

SEQ ID NO: 50919 - protein, 11 aa, Dengue virus
ITSEDLKNEEM

SEQ ID NO: 50920 - protein, 11 aa, Dengue virus
TSEDLKNEEMI

SEQ ID NO: 50921 - protein, 11 aa, Dengue virus
SEDLKNEEMIT

SEQ ID NO: 50922 - protein, 11 aa, Dengue virus
EDLKNEEMITD

SEQ ID NO: 50923 - protein, 11 aa, Dengue virus
DLKNEEMITDQ

SEQ ID NO: 50924 - protein, 11 aa, Dengue virus
LKNEEMITDQM

SEQ ID NO: 50925 - protein, 11 aa, Dengue virus
GRHKKLAEAIF

SEQ ID NO: 50926 - protein, 11 aa, Dengue virus
RHKKLAEAIFK

SEQ ID NO: 50927 - protein, 11 aa, Dengue virus
HKKLAEAIFRL

SEQ ID NO: 50928 - protein, 11 aa, Dengue virus
KKLAEAIFRLT

SEQ ID NO: 50929 - protein, 11 aa, Dengue virus
KLAEAIFRLTY

SEQ ID NO: 50930 - protein, 11 aa, Dengue virus
RRDQRGSGQVV

SEQ ID NO: 50931 - protein, 11 aa, Dengue virus
RDQRGSGQVVT

SEQ ID NO: 50932 - protein, 11 aa, Dengue virus
QLIRQMEGEGL

SEQ ID NO: 50933 - protein, 11 aa, Dengue virus
LIRQMEGEGLF

SEQ ID NO: 50934 - protein, 11 aa, Dengue virus
IRQMEGEGLFK

SEQ ID NO: 50935 - protein, 11 aa, Dengue virus
GRERLTRMAIS

SEQ ID NO: 50936 - protein, 11 aa, Dengue virus
RERLTRMAISG

SEQ ID NO: 50937 - protein, 11 aa, Dengue virus
ERLTRMAISGD

SEQ ID NO: 50938 - protein, 11 aa, Dengue virus
RLTRMAISGDD

SEQ ID NO: 50939 - protein, 11 aa, Dengue virus
LTRMAISGDDC

SEQ ID NO: 50940 - protein, 11 aa, Dengue virus
TRMAISGDDCV

SEQ ID NO: 50941 - protein, 11 aa, Dengue virus
DDRFARALTAL

SEQ ID NO: 50942 - protein, 11 aa, Dengue virus
DRFARALTALN

SEQ ID NO: 50943 - protein, 11 aa, Dengue virus
RFARALTALND

SEQ ID NO: 50944 - protein, 11 aa, Dengue virus
FARALTALNDM

SEQ ID NO: 50945 - protein, 11 aa, Dengue virus
ARALTALNDMG

SEQ ID NO: 50946 - protein, 11 aa, Dengue virus
RALTALNDMGK

SEQ ID NO: 50947 - protein, 11 aa, Dengue virus
IQQWEPSKGWS

SEQ ID NO: 50948 - protein, 11 aa, Dengue virus
QQWEPSKGWSD

SEQ ID NO: 50949 - protein, 11 aa, Dengue virus
QWEPSKGWSDW

SEQ ID NO: 50950 - protein, 11 aa, Dengue virus
WEPSKGWSDWT

SEQ ID NO: 50951 - protein, 11 aa, Dengue virus
EPSKGWSDWTQ

SEQ ID NO: 50952 - protein, 11 aa, Dengue virus
PSKGWSDWTQV

SEQ ID NO: 50953 - protein, 11 aa, Dengue virus
SKGWSDWTQVP

SEQ ID NO: 50954 - protein, 11 aa, Dengue virus
KGWSDWTQVPF

SEQ ID NO: 50955 - protein, 11 aa, Dengue virus
MKDGRILVVPC

SEQ ID NO: 50956 - protein, 11 aa, Dengue virus
KDGRILVVPCR

SEQ ID NO: 50957 - protein, 11 aa, Dengue virus
TSRTTWSIHAS

SEQ ID NO: 50958 - protein, 11 aa, Dengue virus
SRTTWSIHASH

SEQ ID NO: 50959 - protein, 11 aa, Dengue virus
RTTWSIHASHE

SEQ ID NO: 50960 - protein, 11 aa, Dengue virus
TTWSIHASHEW

SEQ ID NO: 50961 - protein, 11 aa, Dengue virus
TWSIHASHEWM

SEQ ID NO: 50962 - protein, 11 aa, Dengue virus
WSIHASHEWMT

SEQ ID NO: 50963 - protein, 11 aa, Dengue virus
SIHASHEWMTT

SEQ ID NO: 50964 - protein, 11 aa, Dengue virus
IHASHEWMTTE

SEQ ID NO: 50965 - protein, 11 aa, Dengue virus
HASHEWMTTED

SEQ ID NO: 50966 - protein, 11 aa, Dengue virus
ASHEWMTTEDM

SEQ ID NO: 50967 - protein, 11 aa, Dengue virus
SHEWMTTEDML

SEQ ID NO: 50968 - protein, 11 aa, Dengue virus
TTEDMLTVWNK

SEQ ID NO: 50969 - protein, 11 aa, Dengue virus
TEDMLTVWNKV

SEQ ID NO: 50970 - protein, 11 aa, Dengue virus
EDMLTVWNKVW

SEQ ID NO: 50971 - protein, 11 aa, Dengue virus
DMLTVWNKVWI

SEQ ID NO: 50972 - protein, 11 aa, Dengue virus
MLTVWNRVWIR

SEQ ID NO: 50973 - protein, 11 aa, Dengue virus
VWNRVWILENP

SEQ ID NO: 50974 - protein, 11 aa, Dengue virus
WNRVWILENPW

SEQ ID NO: 50975 - protein, 11 aa, Dengue virus
VWILENPWMED

SEQ ID NO: 50976 - protein, 11 aa, Dengue virus
WILENPWMEDK

SEQ ID NO: 50977 - protein, 11 aa, Dengue virus
ILENPWMEDKT

SEQ ID NO: 50978 - protein, 11 aa, Dengue virus
DNPWMEDKTPV

SEQ ID NO: 50979 - protein, 11 aa, Dengue virus
PWMEDKTPVET

SEQ ID NO: 50980 - protein, 11 aa, Dengue virus
WMEDKTPVETW

SEQ ID NO: 50981 - protein, 11 aa, Dengue virus
MEDKTPVETWE

SEQ ID NO: 50982 - protein, 11 aa, Dengue virus
EDKTPVETWEE

SEQ ID NO: 50983 - protein, 11 aa, Dengue virus
DKTPVESWEDI

SEQ ID NO: 50984 - protein, 11 aa, Dengue virus
KTPVESWEDIP

SEQ ID NO: 50985 - protein, 11 aa, Dengue virus
TPVESWEDIPY

SEQ ID NO: 50986 - protein, 11 aa, Dengue virus
PVESWEDIPYL

SEQ ID NO: 50987 - protein, 11 aa, Dengue virus
VESWEDIPYLG

SEQ ID NO: 50988 - protein, 11 aa, Dengue virus
ESWEDIPYLGK

SEQ ID NO: 50989 - protein, 11 aa, Dengue virus
SWEDIPYLGKR

SEQ ID NO: 50990 - protein, 11 aa, Dengue virus
WEDIPYLGKRE

SEQ ID NO: 50991 - protein, 11 aa, Dengue virus
EDIPYLGKRED

SEQ ID NO: 50992 - protein, 11 aa, Dengue virus
DIPYLGKREDQ

SEQ ID NO: 50993 - protein, 11 aa, Dengue virus
SRATWAKNIQV

SEQ ID NO: 50994 - protein, 11 aa, Dengue virus
RATWAKNIQVA

SEQ ID NO: 50995 - protein, 11 aa, Dengue virus
ATWAKNIQVAI

SEQ ID NO: 50996 - protein, 11 aa, Dengue virus
TWAKNIQVAIN

SEQ ID NO: 50997 - protein, 11 aa, Dengue virus
WAKNIQVAINQ

SEQ ID NO: 50998 - protein, 11 aa, Dengue virus
AKNIQVAINQV

SEQ ID NO: 50999 - protein, 11 aa, Dengue virus
KNIQVAINQVR

SEQ ID NO: 51000 - protein, 11 aa, Dengue virus
NIQVAINQVRS

SEQ ID NO: 51001 - protein, 11 aa, Dengue virus
IQVAINQVRSL

SEQ ID NO: 51002 - protein, 11 aa, Dengue virus
QVAINQVRSLI

SEQ ID NO: 51003 - protein, 11 aa, Dengue virus
VAINQVRSLIG

SEQ ID NO: 51004 - protein, 11 aa, Dengue virus
AINQVRSLMGN

SEQ ID NO: 51005 - protein, 11 aa, Dengue virus
INQVRSLMGNE

SEQ ID NO: 51006 - protein, 11 aa, Dengue virus
NQVRSLMGNEG

SEQ ID NO: 51007 - protein, 11 aa, Dengue virus
QVRSLMGNEGY

SEQ ID NO: 51008 - protein, 11 aa, Dengue virus
EEYIDYMPSMK

SEQ ID NO: 51009 - protein, 11 aa, Dengue virus
EYIDYMPSMKR

SEQ ID NO: 51010 - protein, 11 aa, Dengue virus
DYMPSMKRFRS

SEQ ID NO: 51011 - protein, 11 aa, Dengue virus
YMPSMKRFRSE

SEQ ID NO: 51012 - protein, 11 aa, Dengue virus
MPSMKRFRSEE

SEQ ID NO: 51013 - protein, 11 aa, Dengue virus
PSMKRFRSEEE

SEQ ID NO: 51014 - protein, 11 aa, Dengue virus
SMKRFRSEEEE

SEQ ID NO: 51015 - protein, 11 aa, Dengue virus
MKRFRSEEEES

SEQ ID NO: 51016 - protein, 11 aa, Dengue virus
KRFRSEEEESG

SEQ ID NO: 51017 - protein, 11 aa, Dengue virus
RFRSEEEESGV

SEQ ID NO: 51018 - protein, 11 aa, Dengue virus
FRSEEEESGVL

SEQ ID NO: 51019 - protein, 11 aa, Dengue virus
RSEEEESGVLW

SEQ ID NO: 51020 - protein, 11 aa, Dengue virus
TTGILKRWGTI

SEQ ID NO: 51021 - protein, 11 aa, Dengue virus
TGILKRWGTIK

SEQ ID NO: 51022 - protein, 11 aa, Dengue virus
WGTIKKSRAIN

SEQ ID NO: 51023 - protein, 11 aa, Dengue virus
GAIKKSKAINV

SEQ ID NO: 51024 - protein, 11 aa, Dengue virus
TIKKSRAINVL

SEQ ID NO: 51025 - protein, 11 aa, Dengue virus
IKKSKAINILR

SEQ ID NO: 51026 - protein, 11 aa, Dengue virus
KKSKAINILRG

SEQ ID NO: 51027 - protein, 11 aa, Dengue virus
KSKAINILRGF

SEQ ID NO: 51028 - protein, 11 aa, Dengue virus
RAINVLRGFRK

SEQ ID NO: 51029 - protein, 11 aa, Dengue virus
LNILNRRRRSV

SEQ ID NO: 51030 - protein, 11 aa, Dengue virus
NILNRRRRSVG

SEQ ID NO: 51031 - protein, 11 aa, Dengue virus
IPTAIAFHLTT

SEQ ID NO: 51032 - protein, 11 aa, Dengue virus
PTAIAFHLTTR

SEQ ID NO: 51033 - protein, 11 aa, Dengue virus
TAIAFHLTTRN

SEQ ID NO: 51034 - protein, 11 aa, Dengue virus
AIAFHLTTRNG

SEQ ID NO: 51035 - protein, 11 aa, Dengue virus
RNGEPHMIVSI

SEQ ID NO: 51036 - protein, 11 aa, Dengue virus
GEPHMIVSIQE

SEQ ID NO: 51037 - protein, 11 aa, Dengue virus
EPHMIVSIQEK

SEQ ID NO: 51038 - protein, 11 aa, Dengue virus
PHMIVSIQEKG

SEQ ID NO: 51039 - protein, 11 aa, Dengue virus
HMIVSIQEKGK

SEQ ID NO: 51040 - protein, 11 aa, Dengue virus
MIVSIQEKGKS

SEQ ID NO: 51041 - protein, 11 aa, Dengue virus
IVSIQEKGKSL

SEQ ID NO: 51042 - protein, 11 aa, Dengue virus
VSIQEKGKSLL

SEQ ID NO: 51043 - protein, 11 aa, Dengue virus
SIQEKGKSLLF

SEQ ID NO: 51044 - protein, 11 aa, Dengue virus
KGKSLLFKTEV

SEQ ID NO: 51045 - protein, 11 aa, Dengue virus
GKSLLFKTEVG

SEQ ID NO: 51046 - protein, 11 aa, Dengue virus
GINMCTLMAMD

SEQ ID NO: 51047 - protein, 11 aa, Dengue virus
INMCTLMAMDL

SEQ ID NO: 51048 - protein, 11 aa, Dengue virus
CEDTVTYKCPF

SEQ ID NO: 51049 - protein, 11 aa, Dengue virus
EDTVTYKCPFL

SEQ ID NO: 51050 - protein, 11 aa, Dengue virus
TYKCPLLKQNE

SEQ ID NO: 51051 - protein, 11 aa, Dengue virus
YKCPLLKQNEP

SEQ ID NO: 51052 - protein, 11 aa, Dengue virus
KCPLLKQNEPE

SEQ ID NO: 51053 - protein, 11 aa, Dengue virus
TSTWITYGTCT

SEQ ID NO: 51054 - protein, 11 aa, Dengue virus
STGEHRREKRS

SEQ ID NO: 51055 - protein, 11 aa, Dengue virus
WKQAQRIETWI

SEQ ID NO: 51056 - protein, 11 aa, Dengue virus
KQAQRIETWIL

SEQ ID NO: 51057 - protein, 11 aa, Dengue virus
QAQRIETWILR

SEQ ID NO: 51058 - protein, 11 aa, Dengue virus
LRHPGFAIMAA

SEQ ID NO: 51059 - protein, 11 aa, Dengue virus
AVLAYTIGTTH

SEQ ID NO: 51060 - protein, 11 aa, Dengue virus
VLAYTIGTTHF

SEQ ID NO: 51061 - protein, 11 aa, Dengue virus
AYTIGTTHFQK

SEQ ID NO: 51062 - protein, 11 aa, Dengue virus
GTTHFQRTLIF

SEQ ID NO: 51063 - protein, 11 aa, Dengue virus
TTHFQRTLIFI

SEQ ID NO: 51064 - protein, 11 aa, Dengue virus
THFQRTLIFIL

SEQ ID NO: 51065 - protein, 11 aa, Dengue virus
HFQRTLIFILL

SEQ ID NO: 51066 - protein, 11 aa, Dengue virus
FQRTLIFILLT

SEQ ID NO: 51067 - protein, 11 aa, Dengue virus
LIFILLTAVTP

SEQ ID NO: 51068 - protein, 11 aa, Dengue virus
IFILLTAVTPS

SEQ ID NO: 51069 - protein, 11 aa, Dengue virus
FILLTAVTPSM

SEQ ID NO: 51070 - protein, 11 aa, Dengue virus
LLTAVTPSMTM

SEQ ID NO: 51071 - protein, 11 aa, Dengue virus
LTAIAPSMTMR

SEQ ID NO: 51072 - protein, 11 aa, Dengue virus
TAVTPSMTMRC

SEQ ID NO: 51073 - protein, 11 aa, Dengue virus
TVAPSMTMRCI

SEQ ID NO: 51074 - protein, 11 aa, Dengue virus
APSMAMRCIGI

SEQ ID NO: 51075 - protein, 11 aa, Dengue virus
DFELTKTEAKH

SEQ ID NO: 51076 - protein, 11 aa, Dengue virus
KTEAKQLATLR

SEQ ID NO: 51077 - protein, 11 aa, Dengue virus
TEAKQSATLRK

SEQ ID NO: 51078 - protein, 11 aa, Dengue virus
EAKEPATLRKY

SEQ ID NO: 51079 - protein, 11 aa, Dengue virus
AKEPATLRKYC

SEQ ID NO: 51080 - protein, 11 aa, Dengue virus
SATLRKYCIEA

SEQ ID NO: 51081 - protein, 11 aa, Dengue virus
ATLRKYCIEAR

SEQ ID NO: 51082 - protein, 11 aa, Dengue virus
TLRKYCIEARL

SEQ ID NO: 51083 - protein, 11 aa, Dengue virus
YCIEARLTNTT

SEQ ID NO: 51084 - protein, 11 aa, Dengue virus
VEAKLTNTTTE

SEQ ID NO: 51085 - protein, 11 aa, Dengue virus
DSRCPTQGEPS

SEQ ID NO: 51086 - protein, 11 aa, Dengue virus
RCPTQGEPSLS

SEQ ID NO: 51087 - protein, 11 aa, Dengue virus
CPTQGEPSLVE

SEQ ID NO: 51088 - protein, 11 aa, Dengue virus
PTQGEPSLVEE

SEQ ID NO: 51089 - protein, 11 aa, Dengue virus
TQGEPSLVEEQ

SEQ ID NO: 51090 - protein, 11 aa, Dengue virus
QGEPSLVEEQD

SEQ ID NO: 51091 - protein, 11 aa, Dengue virus
GEPSLSEEQDK

SEQ ID NO: 51092 - protein, 11 aa, Dengue virus
EPSLSEEQDKR

SEQ ID NO: 51093 - protein, 11 aa, Dengue virus
PSLVEEQDKRF

SEQ ID NO: 51094 - protein, 11 aa, Dengue virus
EEQDKRFLCKH

SEQ ID NO: 51095 - protein, 11 aa, Dengue virus
EQDKRFLCKHS

SEQ ID NO: 51096 - protein, 11 aa, Dengue virus
QDKRFLCKHSM

SEQ ID NO: 51097 - protein, 11 aa, Dengue virus
DKRFLCKHSMV

SEQ ID NO: 51098 - protein, 11 aa, Dengue virus
KRFLCKHSMVD

SEQ ID NO: 51099 - protein, 11 aa, Dengue virus
RFLCKHSMVDR

SEQ ID NO: 51100 - protein, 11 aa, Dengue virus
FLCKHSMVDRG

SEQ ID NO: 51101 - protein, 11 aa, Dengue virus
LCKHSMVDRGW

SEQ ID NO: 51102 - protein, 11 aa, Dengue virus
KGGIVTCAKFT

SEQ ID NO: 51103 - protein, 11 aa, Dengue virus
GGIVTCAMFSC

SEQ ID NO: 51104 - protein, 11 aa, Dengue virus
GIVTCAMFSCK

SEQ ID NO: 51105 - protein, 11 aa, Dengue virus
IVTCAKFTCKK

SEQ ID NO: 51106 - protein, 11 aa, Dengue virus
VTCAMFSCKKN

SEQ ID NO: 51107 - protein, 11 aa, Dengue virus
TCAKFTCKKNM

SEQ ID NO: 51108 - protein, 11 aa, Dengue virus
AMFTCKKNMKG

SEQ ID NO: 51109 - protein, 11 aa, Dengue virus
CKKNMKGKVVQ

SEQ ID NO: 51110 - protein, 11 aa, Dengue virus
KKNMKGKVVQP

SEQ ID NO: 51111 - protein, 11 aa, Dengue virus
KNMKGKVVQPE

SEQ ID NO: 51112 - protein, 11 aa, Dengue virus
NMKGKVVQPEN

SEQ ID NO: 51113 - protein, 11 aa, Dengue virus
MKGKVVQPENL

SEQ ID NO: 51114 - protein, 11 aa, Dengue virus
KGKVVQPENLE

SEQ ID NO: 51115 - protein, 11 aa, Dengue virus
IVQPENLEYTV

SEQ ID NO: 51116 - protein, 11 aa, Dengue virus
QPENLEYTVVI

SEQ ID NO: 51117 - protein, 11 aa, Dengue virus
VVITPHSGEEH

SEQ ID NO: 51118 - protein, 11 aa, Dengue virus
VVTPHSGEENA

SEQ ID NO: 51119 - protein, 11 aa, Dengue virus
VTPHSGEENAV

SEQ ID NO: 51120 - protein, 11 aa, Dengue virus
PHSGEEYAVGN

SEQ ID NO: 51121 - protein, 11 aa, Dengue virus
HSGEEYAVGND

SEQ ID NO: 51122 - protein, 11 aa, Dengue virus
SGEEHSVGNDT

SEQ ID NO: 51123 - protein, 11 aa, Dengue virus
GEEYAVGNDTG

SEQ ID NO: 51124 - protein, 11 aa, Dengue virus
EEHSVGNDTGK

SEQ ID NO: 51125 - protein, 11 aa, Dengue virus
EYAVGNDTGKH

SEQ ID NO: 51126 - protein, 11 aa, Dengue virus
YAVGNDTGKHG

SEQ ID NO: 51127 - protein, 11 aa, Dengue virus
AVGDDTGKHGK

SEQ ID NO: 51128 - protein, 11 aa, Dengue virus
VGDDTGKHGKE

SEQ ID NO: 51129 - protein, 11 aa, Dengue virus
GNDTGKHGMEI

SEQ ID NO: 51130 - protein, 11 aa, Dengue virus
NDTGKHGMEIK

SEQ ID NO: 51131 - protein, 11 aa, Dengue virus
DTGKHGKEVKI

SEQ ID NO: 51132 - protein, 11 aa, Dengue virus
TGKHGKEVKIT

SEQ ID NO: 51133 - protein, 11 aa, Dengue virus
GKHGKEVKITP

SEQ ID NO: 51134 - protein, 11 aa, Dengue virus
KHGKEVKITPQ

SEQ ID NO: 51135 - protein, 11 aa, Dengue virus
HGKEVKITPQS

SEQ ID NO: 51136 - protein, 11 aa, Dengue virus
MESKAWLVHRQ

SEQ ID NO: 51137 - protein, 11 aa, Dengue virus
ESKAWLVHRQW

SEQ ID NO: 51138 - protein, 11 aa, Dengue virus
SKAWLVHRQWF

SEQ ID NO: 51139 - protein, 11 aa, Dengue virus
LPWLPGADTQE

SEQ ID NO: 51140 - protein, 11 aa, Dengue virus
PWLPGADTQES

SEQ ID NO: 51141 - protein, 11 aa, Dengue virus
WLPGADTQESN

SEQ ID NO: 51142 - protein, 11 aa, Dengue virus
LPGADTQESNW

SEQ ID NO: 51143 - protein, 11 aa, Dengue virus
PGADTQESNWI

SEQ ID NO: 51144 - protein, 11 aa, Dengue virus
GADTQESNWIQ

SEQ ID NO: 51145 - protein, 11 aa, Dengue virus
ADTQESNWIQK

SEQ ID NO: 51146 - protein, 11 aa, Dengue virus
DTQESNWIQKE

SEQ ID NO: 51147 - protein, 11 aa, Dengue virus
QGLNWIQKETL

SEQ ID NO: 51148 - protein, 11 aa, Dengue virus
ESNWIQKEMLV

SEQ ID NO: 51149 - protein, 11 aa, Dengue virus
TIVIRVQYEGE

SEQ ID NO: 51150 - protein, 11 aa, Dengue virus
VVRVQYEGDGS

SEQ ID NO: 51151 - protein, 11 aa, Dengue virus
VRVQYEGDGSP

SEQ ID NO: 51152 - protein, 11 aa, Dengue virus
RLQYEGDGSPC

SEQ ID NO: 51153 - protein, 11 aa, Dengue virus
IQYEGDGSPCK

SEQ ID NO: 51154 - protein, 11 aa, Dengue virus
QYEGDGSPCKV

SEQ ID NO: 51155 - protein, 11 aa, Dengue virus
YEGDGSPCKVP

SEQ ID NO: 51156 - protein, 11 aa, Dengue virus
EGDGSPCKVPF

SEQ ID NO: 51157 - protein, 11 aa, Dengue virus
GDGSPCKVPFE

SEQ ID NO: 51158 - protein, 11 aa, Dengue virus
DGSPCKVPFEI

SEQ ID NO: 51159 - protein, 11 aa, Dengue virus
SPCKVPFEIMD

SEQ ID NO: 51160 - protein, 11 aa, Dengue virus
PCKVPFEIMDL

SEQ ID NO: 51161 - protein, 11 aa, Dengue virus
CKVPFEIMDLE

SEQ ID NO: 51162 - protein, 11 aa, Dengue virus
KVPFEIMDLEK

SEQ ID NO: 51163 - protein, 11 aa, Dengue virus
VPFEIMDLEKR

SEQ ID NO: 51164 - protein, 11 aa, Dengue virus
PFEIMDLEKKH

SEQ ID NO: 51165 - protein, 11 aa, Dengue virus
DLERRYVLGRL

SEQ ID NO: 51166 - protein, 11 aa, Dengue virus
LERRYVLGRLI

SEQ ID NO: 51167 - protein, 11 aa, Dengue virus
ERRYVLGRLIT

SEQ ID NO: 51168 - protein, 11 aa, Dengue virus
RRYVLGRLITV

SEQ ID NO: 51169 - protein, 11 aa, Dengue virus
RYILGRLITVN

SEQ ID NO: 51170 - protein, 11 aa, Dengue virus
GRLITVNPIIT

SEQ ID NO: 51171 - protein, 11 aa, Dengue virus
EKDNPINIEAE

SEQ ID NO: 51172 - protein, 11 aa, Dengue virus
FGDSYIIIGAE

SEQ ID NO: 51173 - protein, 11 aa, Dengue virus
IGVEPGQLKLD

SEQ ID NO: 51174 - protein, 11 aa, Dengue virus
EPGQLKLDWFR

SEQ ID NO: 51175 - protein, 11 aa, Dengue virus
FGSLGGAFTSI

SEQ ID NO: 51176 - protein, 11 aa, Dengue virus
GSLGGAFTSIG

SEQ ID NO: 51177 - protein, 11 aa, Dengue virus
SLGGAFTSIGK

SEQ ID NO: 51178 - protein, 11 aa, Dengue virus
LGGAFTSIGKA

SEQ ID NO: 51179 - protein, 11 aa, Dengue virus
GAAFNGVSWTM

SEQ ID NO: 51180 - protein, 11 aa, Dengue virus
AAFNGVSWTMK

SEQ ID NO: 51181 - protein, 11 aa, Dengue virus
VSWTMKIFIGV

SEQ ID NO: 51182 - protein, 11 aa, Dengue virus
SWIMKILIGVI

SEQ ID NO: 51183 - protein, 11 aa, Dengue virus
WIMKILIGVII

SEQ ID NO: 51184 - protein, 11 aa, Dengue virus
IMKILIGVIIT

SEQ ID NO: 51185 - protein, 11 aa, Dengue virus
MKIFIGVIITW

SEQ ID NO: 51186 - protein, 11 aa, Dengue virus
SLSVSLILVGI

SEQ ID NO: 51187 - protein, 11 aa, Dengue virus
LSVTLVLVGIV

SEQ ID NO: 51188 - protein, 11 aa, Dengue virus
LVLVGVVILYL

SEQ ID NO: 51189 - protein, 11 aa, Dengue virus
VLVGVVILYLG

SEQ ID NO: 51190 - protein, 11 aa, Dengue virus
LVGVITLYLGA

SEQ ID NO: 51191 - protein, 11 aa, Dengue virus
ITLYLGAMVQA

SEQ ID NO: 51192 - protein, 11 aa, Dengue virus
LYLGVMVQADT

SEQ ID NO: 51193 - protein, 11 aa, Dengue virus
YLGVMVQADTG

SEQ ID NO: 51194 - protein, 11 aa, Dengue virus
LGVMVQADTGC

SEQ ID NO: 51195 - protein, 11 aa, Dengue virus
GVMVQADTGCV

SEQ ID NO: 51196 - protein, 11 aa, Dengue virus
VMVQADTGCVV

SEQ ID NO: 51197 - protein, 11 aa, Dengue virus
MVQADSGCIVS

SEQ ID NO: 51198 - protein, 11 aa, Dengue virus
ADSGCIVSWKN

SEQ ID NO: 51199 - protein, 11 aa, Dengue virus
DSGCIVSWKNK

SEQ ID NO: 51200 - protein, 11 aa, Dengue virus
SGCIVSWKNKE

SEQ ID NO: 51201 - protein, 11 aa, Dengue virus
ASAIQKAYEEG

SEQ ID NO: 51202 - protein, 11 aa, Dengue virus
SAIQKAYEEGI

SEQ ID NO: 51203 - protein, 11 aa, Dengue virus
AIQKAYEEGIC

SEQ ID NO: 51204 - protein, 11 aa, Dengue virus
IQKAHEDGICG

SEQ ID NO: 51205 - protein, 11 aa, Dengue virus
QKAYEEGICGI

SEQ ID NO: 51206 - protein, 11 aa, Dengue virus
KAYEEGICGIR

SEQ ID NO: 51207 - protein, 11 aa, Dengue virus
AHEDGICGIRS

SEQ ID NO: 51208 - protein, 11 aa, Dengue virus
HEDGICGIRSV

SEQ ID NO: 51209 - protein, 11 aa, Dengue virus
QITPELNHILT

SEQ ID NO: 51210 - protein, 11 aa, Dengue virus
ITPELNHILTE

SEQ ID NO: 51211 - protein, 11 aa, Dengue virus
NHILSENEVKM

SEQ ID NO: 51212 - protein, 11 aa, Dengue virus
HILSENEVKMT

SEQ ID NO: 51213 - protein, 11 aa, Dengue virus
ILSENEVKMTI

SEQ ID NO: 51214 - protein, 11 aa, Dengue virus
SENEVKMTIMT

SEQ ID NO: 51215 - protein, 11 aa, Dengue virus
NEVKMTIMTGD

SEQ ID NO: 51216 - protein, 11 aa, Dengue virus
EAKLTIMTGDI

SEQ ID NO: 51217 - protein, 11 aa, Dengue virus
KLTIMTGEIKG

SEQ ID NO: 51218 - protein, 11 aa, Dengue virus
TIMTGEIKGIM

SEQ ID NO: 51219 - protein, 11 aa, Dengue virus
IMTGEIKGIMQ

SEQ ID NO: 51220 - protein, 11 aa, Dengue virus
LQPQPTELKYS

SEQ ID NO: 51221 - protein, 11 aa, Dengue virus
QPQPTELKYSW

SEQ ID NO: 51222 - protein, 11 aa, Dengue virus
QPTQLKYSWKT

SEQ ID NO: 51223 - protein, 11 aa, Dengue virus
PTQLKYSWKTW

SEQ ID NO: 51224 - protein, 11 aa, Dengue virus
TQLKYSWKTWG

SEQ ID NO: 51225 - protein, 11 aa, Dengue virus
SWKTWGKAKIL

SEQ ID NO: 51226 - protein, 11 aa, Dengue virus
QNQTFLIDGPE

SEQ ID NO: 51227 - protein, 11 aa, Dengue virus
QTFLIDGPETV

SEQ ID NO: 51228 - protein, 11 aa, Dengue virus
TVECPNTNRAW

SEQ ID NO: 51229 - protein, 11 aa, Dengue virus
VECPNTNRAWN

SEQ ID NO: 51230 - protein, 11 aa, Dengue virus
FGIFTTNIWLK

SEQ ID NO: 51231 - protein, 11 aa, Dengue virus
GIFTTNIWLKL

SEQ ID NO: 51232 - protein, 11 aa, Dengue virus
FTTNIWLRLRE

SEQ ID NO: 51233 - protein, 11 aa, Dengue virus
TNIWLRLREKQ

SEQ ID NO: 51234 - protein, 11 aa, Dengue virus
NIWLRLREKQD

SEQ ID NO: 51235 - protein, 11 aa, Dengue virus
SKLMSAAIKNN

SEQ ID NO: 51236 - protein, 11 aa, Dengue virus
KLMSAAIKNNR

SEQ ID NO: 51237 - protein, 11 aa, Dengue virus
LMSAAIKNNRA

SEQ ID NO: 51238 - protein, 11 aa, Dengue virus
MSAAIKNNRAV

SEQ ID NO: 51239 - protein, 11 aa, Dengue virus
SAAIKNNRAVH

SEQ ID NO: 51240 - protein, 11 aa, Dengue virus
AAIKNNRAVHA

SEQ ID NO: 51241 - protein, 11 aa, Dengue virus
AIKNNRAVHAD

SEQ ID NO: 51242 - protein, 11 aa, Dengue virus
IKNNRAVHADM

SEQ ID NO: 51243 - protein, 11 aa, Dengue virus
MESALNDTWKI

SEQ ID NO: 51244 - protein, 11 aa, Dengue virus
SALNDTWKIER

SEQ ID NO: 51245 - protein, 11 aa, Dengue virus
ALNDTWKMERA

SEQ ID NO: 51246 - protein, 11 aa, Dengue virus
MEKASFIEIKS

SEQ ID NO: 51247 - protein, 11 aa, Dengue virus
KASFIEVKSCY

SEQ ID NO: 51248 - protein, 11 aa, Dengue virus
ASFIEVKSCYW

SEQ ID NO: 51249 - protein, 11 aa, Dengue virus
SFIEVKSCYWP

SEQ ID NO: 51250 - protein, 11 aa, Dengue virus
FIEVKSCYWPR

SEQ ID NO: 51251 - protein, 11 aa, Dengue virus
IEVKSCYWPRS

SEQ ID NO: 51252 - protein, 11 aa, Dengue virus
EVKSCYWPRSH

SEQ ID NO: 51253 - protein, 11 aa, Dengue virus
VKSCYWPRSHT

SEQ ID NO: 51254 - protein, 11 aa, Dengue virus
KSCHWPRSHTL

SEQ ID NO: 51255 - protein, 11 aa, Dengue virus
SCHWPRSHTLW

SEQ ID NO: 51256 - protein, 11 aa, Dengue virus
IPKNIAGPVSQ

SEQ ID NO: 51257 - protein, 11 aa, Dengue virus
PKGFAGPVSQH

SEQ ID NO: 51258 - protein, 11 aa, Dengue virus
KNIAGPVSQHN

SEQ ID NO: 51259 - protein, 11 aa, Dengue virus
FAGPVSQHNHR

SEQ ID NO: 51260 - protein, 11 aa, Dengue virus
VSQHNNRPGYY

SEQ ID NO: 51261 - protein, 11 aa, Dengue virus
SQHNNRPGYYT

SEQ ID NO: 51262 - protein, 11 aa, Dengue virus
QHNNRPGYYTQ

SEQ ID NO: 51263 - protein, 11 aa, Dengue virus
RPGYHTQITGP

SEQ ID NO: 51264 - protein, 11 aa, Dengue virus
PGYHTQITGPW

SEQ ID NO: 51265 - protein, 11 aa, Dengue virus
GYHTQITGPWH

SEQ ID NO: 51266 - protein, 11 aa, Dengue virus
YHTQITGPWHL

SEQ ID NO: 51267 - protein, 11 aa, Dengue virus
HTQITGPWHLG

SEQ ID NO: 51268 - protein, 11 aa, Dengue virus
TQITGPWHLGK

SEQ ID NO: 51269 - protein, 11 aa, Dengue virus
QITGPWHLGKL

SEQ ID NO: 51270 - protein, 11 aa, Dengue virus
ITGPWHLGKLE

SEQ ID NO: 51271 - protein, 11 aa, Dengue virus
WHLGKLEMDFN

SEQ ID NO: 51272 - protein, 11 aa, Dengue virus
HLGKLEMDFEF

SEQ ID NO: 51273 - protein, 11 aa, Dengue virus
LGKLEMDFEFC

SEQ ID NO: 51274 - protein, 11 aa, Dengue virus
LEMDFEFCEGT

SEQ ID NO: 51275 - protein, 11 aa, Dengue virus
EMDFEFCEGTT

SEQ ID NO: 51276 - protein, 11 aa, Dengue virus
MDFEFCEGTTV

SEQ ID NO: 51277 - protein, 11 aa, Dengue virus
FCDGTTVVVTE

SEQ ID NO: 51278 - protein, 11 aa, Dengue virus
CEGTTVVVTEE

SEQ ID NO: 51279 - protein, 11 aa, Dengue virus
EGTTVVVTEEC

SEQ ID NO: 51280 - protein, 11 aa, Dengue virus
GTTVVVTENCG

SEQ ID NO: 51281 - protein, 11 aa, Dengue virus
TTVVVTENCGN

SEQ ID NO: 51282 - protein, 11 aa, Dengue virus
TVVVTENCGNR

SEQ ID NO: 51283 - protein, 11 aa, Dengue virus
VVVTENCGNRG

SEQ ID NO: 51284 - protein, 11 aa, Dengue virus
VVTENCGNRGP

SEQ ID NO: 51285 - protein, 11 aa, Dengue virus
VNSLVTAGYGQ

SEQ ID NO: 51286 - protein, 11 aa, Dengue virus
NSLVTAGQGQV

SEQ ID NO: 51287 - protein, 11 aa, Dengue virus
QGQVDNFSLGV

SEQ ID NO: 51288 - protein, 11 aa, Dengue virus
FSLGVLGMALL

SEQ ID NO: 51289 - protein, 11 aa, Dengue virus
SLGVLGMALLL

SEQ ID NO: 51290 - protein, 11 aa, Dengue virus
LGVLGMALLLE

SEQ ID NO: 51291 - protein, 11 aa, Dengue virus
GVLGMALLLEE

SEQ ID NO: 51292 - protein, 11 aa, Dengue virus
VLGMALLLEEM

SEQ ID NO: 51293 - protein, 11 aa, Dengue virus
LFLEEMLKTRV

SEQ ID NO: 51294 - protein, 11 aa, Dengue virus
FLEEMLKTRVG

SEQ ID NO: 51295 - protein, 11 aa, Dengue virus
MLRTRMGTKHA

SEQ ID NO: 51296 - protein, 11 aa, Dengue virus
SFLTLITGNMS

SEQ ID NO: 51297 - protein, 11 aa, Dengue virus
FLTLITGNMSF

SEQ ID NO: 51298 - protein, 11 aa, Dengue virus
RDLGRVVVMVG

SEQ ID NO: 51299 - protein, 11 aa, Dengue virus
DLGRVVVMVGT

SEQ ID NO: 51300 - protein, 11 aa, Dengue virus
TDDIGMGITYL

SEQ ID NO: 51301 - protein, 11 aa, Dengue virus
DDIGIGVTYLA

SEQ ID NO: 51302 - protein, 11 aa, Dengue virus
DIGIGVTYLAL

SEQ ID NO: 51303 - protein, 11 aa, Dengue virus
IGIGVTYLALL

SEQ ID NO: 51304 - protein, 11 aa, Dengue virus
LAAYKVRPTFA

SEQ ID NO: 51305 - protein, 11 aa, Dengue virus
AAFKVRPTFVA

SEQ ID NO: 51306 - protein, 11 aa, Dengue virus
AFKVRPTFVAG

SEQ ID NO: 51307 - protein, 11 aa, Dengue virus
YKVRPTFAAGL

SEQ ID NO: 51308 - protein, 11 aa, Dengue virus
RVRPTFAAGLL

SEQ ID NO: 51309 - protein, 11 aa, Dengue virus
VRPTFVAGLLL

SEQ ID NO: 51310 - protein, 11 aa, Dengue virus
RPTFAAGLLLK

SEQ ID NO: 51311 - protein, 11 aa, Dengue virus
PTFAAGLLLKK

SEQ ID NO: 51312 - protein, 11 aa, Dengue virus
TFAAGLLLKKL

SEQ ID NO: 51313 - protein, 11 aa, Dengue virus
FAAGLLLKKLT

SEQ ID NO: 51314 - protein, 11 aa, Dengue virus
AAGLLLKKLTS

SEQ ID NO: 51315 - protein, 11 aa, Dengue virus
LLKKLTSKELM

SEQ ID NO: 51316 - protein, 11 aa, Dengue virus
KKLTSKELMMT

SEQ ID NO: 51317 - protein, 11 aa, Dengue virus
SKELMMATIGV

SEQ ID NO: 51318 - protein, 11 aa, Dengue virus
SILELTDALAL

SEQ ID NO: 51319 - protein, 11 aa, Dengue virus
LTDALALGMMI

SEQ ID NO: 51320 - protein, 11 aa, Dengue virus
TDALALGMMIL

SEQ ID NO: 51321 - protein, 11 aa, Dengue virus
DALALGMMILK

SEQ ID NO: 51322 - protein, 11 aa, Dengue virus
EKYQLAVTIMV

SEQ ID NO: 51323 - protein, 11 aa, Dengue virus
CVPNAVILLNA

SEQ ID NO: 51324 - protein, 11 aa, Dengue virus
VPNAVILLNAW

SEQ ID NO: 51325 - protein, 11 aa, Dengue virus
VSVFPLLLTSS

SEQ ID NO: 51326 - protein, 11 aa, Dengue virus
SVSPLLLTSSR

SEQ ID NO: 51327 - protein, 11 aa, Dengue virus
VSPLLLTSSRQ

SEQ ID NO: 51328 - protein, 11 aa, Dengue virus
SPLLLTSSRQK

SEQ ID NO: 51329 - protein, 11 aa, Dengue virus
LTSSRQKADWI

SEQ ID NO: 51330 - protein, 11 aa, Dengue virus
SQQKTDWIPLV

SEQ ID NO: 51331 - protein, 11 aa, Dengue virus
QQKTDWIPLVL

SEQ ID NO: 51332 - protein, 11 aa, Dengue virus
TDWIPLVLIIK

SEQ ID NO: 51333 - protein, 11 aa, Dengue virus
AIFLTTLTRTS

SEQ ID NO: 51334 - protein, 11 aa, Dengue virus
IFLTTLTRTSK

SEQ ID NO: 51335 - protein, 11 aa, Dengue virus
LTTLSRPNKIR

SEQ ID NO: 51336 - protein, 11 aa, Dengue virus
TTLSRPNKIRS

SEQ ID NO: 51337 - protein, 11 aa, Dengue virus
TLSRPNKIRSW

SEQ ID NO: 51338 - protein, 11 aa, Dengue virus
LSRPNKIRSWP

SEQ ID NO: 51339 - protein, 11 aa, Dengue virus
RPNKIRSWPLN

SEQ ID NO: 51340 - protein, 11 aa, Dengue virus
PNKIRSWPLNE

SEQ ID NO: 51341 - protein, 11 aa, Dengue virus
SADLELEKAAD

SEQ ID NO: 51342 - protein, 11 aa, Dengue virus
ADLELEKAADV

SEQ ID NO: 51343 - protein, 11 aa, Dengue virus
VRWEDQAEISG

SEQ ID NO: 51344 - protein, 11 aa, Dengue virus
RWEDQAEISGS

SEQ ID NO: 51345 - protein, 11 aa, Dengue virus
EDHAEISGSSP

SEQ ID NO: 51346 - protein, 11 aa, Dengue virus
GSSPILSIIIS

SEQ ID NO: 51347 - protein, 11 aa, Dengue virus
LVISGLFPVSM

SEQ ID NO: 51348 - protein, 11 aa, Dengue virus
VISGLFPVSMP

SEQ ID NO: 51349 - protein, 11 aa, Dengue virus
SGLFPVSMPIT

SEQ ID NO: 51350 - protein, 11 aa, Dengue virus
GLFPVSMPITA

SEQ ID NO: 51351 - protein, 11 aa, Dengue virus
LFPVSMPITAA

SEQ ID NO: 51352 - protein, 11 aa, Dengue virus
VSIPVTAAAWY

SEQ ID NO: 51353 - protein, 11 aa, Dengue virus
LWDVPSPPPIG

SEQ ID NO: 51354 - protein, 11 aa, Dengue virus
GAYRIKQKGIF

SEQ ID NO: 51355 - protein, 11 aa, Dengue virus
AYRIKQKGIFG

SEQ ID NO: 51356 - protein, 11 aa, Dengue virus
YRIKQKGIFGY

SEQ ID NO: 51357 - protein, 11 aa, Dengue virus
RIKQKGIFGYS

SEQ ID NO: 51358 - protein, 11 aa, Dengue virus
IKQKGIFGYSQ

SEQ ID NO: 51359 - protein, 11 aa, Dengue virus
KQKGIFGYSQI

SEQ ID NO: 51360 - protein, 11 aa, Dengue virus
QKGIFGYSQIG

SEQ ID NO: 51361 - protein, 11 aa, Dengue virus
KGIFGYSQIGA

SEQ ID NO: 51362 - protein, 11 aa, Dengue virus
HVTRGAVLTHK

SEQ ID NO: 51363 - protein, 11 aa, Dengue virus
VTRGAVLTHKG

SEQ ID NO: 51364 - protein, 11 aa, Dengue virus
TRGAVLTHKGK

SEQ ID NO: 51365 - protein, 11 aa, Dengue virus
RGAVLTHKGKR

SEQ ID NO: 51366 - protein, 11 aa, Dengue virus
GAVLTHKGKRI

SEQ ID NO: 51367 - protein, 11 aa, Dengue virus
AVLTHKGKRIE

SEQ ID NO: 51368 - protein, 11 aa, Dengue virus
VLTHKGKRIEP

SEQ ID NO: 51369 - protein, 11 aa, Dengue virus
LTHKGKRIEPS

SEQ ID NO: 51370 - protein, 11 aa, Dengue virus
THKGKRIEPSW

SEQ ID NO: 51371 - protein, 11 aa, Dengue virus
RAVQTKPGFFK

SEQ ID NO: 51372 - protein, 11 aa, Dengue virus
AVQTKPGFFKT

SEQ ID NO: 51373 - protein, 11 aa, Dengue virus
VQTKPGLFKTS

SEQ ID NO: 51374 - protein, 11 aa, Dengue virus
FKTSTGTIGAV

SEQ ID NO: 51375 - protein, 11 aa, Dengue virus
KTSTGTIGAVS

SEQ ID NO: 51376 - protein, 11 aa, Dengue virus
GGAYVSAIAQT

SEQ ID NO: 51377 - protein, 11 aa, Dengue virus
YVSAIAQTEKG

SEQ ID NO: 51378 - protein, 11 aa, Dengue virus
VSAIAQTEKGI

SEQ ID NO: 51379 - protein, 11 aa, Dengue virus
SAIAQTEKGIE

SEQ ID NO: 51380 - protein, 11 aa, Dengue virus
ENNPEIEDDIF

SEQ ID NO: 51381 - protein, 11 aa, Dengue virus
NNPEIEDDIFR

SEQ ID NO: 51382 - protein, 11 aa, Dengue virus
PEIEDHIFRKR

SEQ ID NO: 51383 - protein, 11 aa, Dengue virus
EIEDDIFRKRK

SEQ ID NO: 51384 - protein, 11 aa, Dengue virus
IEDHIFRKRRL

SEQ ID NO: 51385 - protein, 11 aa, Dengue virus
EDHIFRKRRLT

SEQ ID NO: 51386 - protein, 11 aa, Dengue virus
DHIFRKRRLTI

SEQ ID NO: 51387 - protein, 11 aa, Dengue virus
PIRYQTTAIKT

SEQ ID NO: 51388 - protein, 11 aa, Dengue virus
IRYQTTAIKTE

SEQ ID NO: 51389 - protein, 11 aa, Dengue virus
RYQTTAIKTEH

SEQ ID NO: 51390 - protein, 11 aa, Dengue virus
YQTTAIKTEHT

SEQ ID NO: 51391 - protein, 11 aa, Dengue virus
QTTAIKTEHTG

SEQ ID NO: 51392 - protein, 11 aa, Dengue virus
TTAIKTEHTGR

SEQ ID NO: 51393 - protein, 11 aa, Dengue virus
TAIKTEHTGRE

SEQ ID NO: 51394 - protein, 11 aa, Dengue virus
ERSWNTGHEWV

SEQ ID NO: 51395 - protein, 11 aa, Dengue virus
RSWNTGHEWVT

SEQ ID NO: 51396 - protein, 11 aa, Dengue virus
SWNTGHEWVTD

SEQ ID NO: 51397 - protein, 11 aa, Dengue virus
WNTGHEWVTDF

SEQ ID NO: 51398 - protein, 11 aa, Dengue virus
GHEWITDFKGK

SEQ ID NO: 51399 - protein, 11 aa, Dengue virus
HEWITDFKGKT

SEQ ID NO: 51400 - protein, 11 aa, Dengue virus
EWITDFKGKTV

SEQ ID NO: 51401 - protein, 11 aa, Dengue virus
WITNFEGKTVW

SEQ ID NO: 51402 - protein, 11 aa, Dengue virus
ITDFKGKTVWF

SEQ ID NO: 51403 - protein, 11 aa, Dengue virus
LSRKTFDSEYA

SEQ ID NO: 51404 - protein, 11 aa, Dengue virus
SRKTFDTEYTK

SEQ ID NO: 51405 - protein, 11 aa, Dengue virus
RKTFDSEYAKT

SEQ ID NO: 51406 - protein, 11 aa, Dengue virus
KTFDSEYAKTR

SEQ ID NO: 51407 - protein, 11 aa, Dengue virus
LPVWLAFKVAA

SEQ ID NO: 51408 - protein, 11 aa, Dengue virus
PVWLAFKVAAE

SEQ ID NO: 51409 - protein, 11 aa, Dengue virus
VWLAFKVAAEG

SEQ ID NO: 51410 - protein, 11 aa, Dengue virus
WLAFKVAAEGI

SEQ ID NO: 51411 - protein, 11 aa, Dengue virus
LAFKVAAEGIN

SEQ ID NO: 51412 - protein, 11 aa, Dengue virus
AFKVAAEGINY

SEQ ID NO: 51413 - protein, 11 aa, Dengue virus
KVAAEGINYTD

SEQ ID NO: 51414 - protein, 11 aa, Dengue virus
VASEGISYADR

SEQ ID NO: 51415 - protein, 11 aa, Dengue virus
EGISYADRKWC

SEQ ID NO: 51416 - protein, 11 aa, Dengue virus
GISYADRKWCF

SEQ ID NO: 51417 - protein, 11 aa, Dengue virus
ISYADRKWCFD

SEQ ID NO: 51418 - protein, 11 aa, Dengue virus
SYADRKWCFDG

SEQ ID NO: 51419 - protein, 11 aa, Dengue virus
YADRRWCFDGT

SEQ ID NO: 51420 - protein, 11 aa, Dengue virus
DRRWCFDGTRN

SEQ ID NO: 51421 - protein, 11 aa, Dengue virus
RRWCFDGTRNN

SEQ ID NO: 51422 - protein, 11 aa, Dengue virus
RWCFDGTRNNQ

SEQ ID NO: 51423 - protein, 11 aa, Dengue virus
WCFDGTRNNQI

SEQ ID NO: 51424 - protein, 11 aa, Dengue virus
CFDGTRNNQIL

SEQ ID NO: 51425 - protein, 11 aa, Dengue virus
FDGTRNNQILE

SEQ ID NO: 51426 - protein, 11 aa, Dengue virus
DGTRNNQILEE

SEQ ID NO: 51427 - protein, 11 aa, Dengue virus
GTRNNQILEEN

SEQ ID NO: 51428 - protein, 11 aa, Dengue virus
RNNQILEENME

SEQ ID NO: 51429 - protein, 11 aa, Dengue virus
LEENIEVEIWT

SEQ ID NO: 51430 - protein, 11 aa, Dengue virus
EENIEVEIWTK

SEQ ID NO: 51431 - protein, 11 aa, Dengue virus
ENIEVEIWTKE

SEQ ID NO: 51432 - protein, 11 aa, Dengue virus
NIEVEIWTKEG

SEQ ID NO: 51433 - protein, 11 aa, Dengue virus
IEVEIWTKEGE

SEQ ID NO: 51434 - protein, 11 aa, Dengue virus
AVLHTAEVGGK

SEQ ID NO: 51435 - protein, 11 aa, Dengue virus
VLHTAEVGGKA

SEQ ID NO: 51436 - protein, 11 aa, Dengue virus
GGRAHNHALSE

SEQ ID NO: 51437 - protein, 11 aa, Dengue virus
GRAHNHALSEL

SEQ ID NO: 51438 - protein, 11 aa, Dengue virus
RAHNHALSELP

SEQ ID NO: 51439 - protein, 11 aa, Dengue virus
FLFLMSGRGVG

SEQ ID NO: 51440 - protein, 11 aa, Dengue virus
LFLMSGRGVGK

SEQ ID NO: 51441 - protein, 11 aa, Dengue virus
FLMSGRGVGKM

SEQ ID NO: 51442 - protein, 11 aa, Dengue virus
LMSGRGVGKMT

SEQ ID NO: 51443 - protein, 11 aa, Dengue virus
MSGRGVGKMTL

SEQ ID NO: 51444 - protein, 11 aa, Dengue virus
SGRGVGKMTLG

SEQ ID NO: 51445 - protein, 11 aa, Dengue virus
GRGVGKMTLGM

SEQ ID NO: 51446 - protein, 11 aa, Dengue virus
RGVGKMTLGMC

SEQ ID NO: 51447 - protein, 11 aa, Dengue virus
QPEINILDIDL

SEQ ID NO: 51448 - protein, 11 aa, Dengue virus
HESNILDIDLR

SEQ ID NO: 51449 - protein, 11 aa, Dengue virus
NPVTLTAALLL

SEQ ID NO: 51450 - protein, 11 aa, Dengue virus
PVTLTAALLLL

SEQ ID NO: 51451 - protein, 11 aa, Dengue virus
LMAHYAIIGPG

SEQ ID NO: 51452 - protein, 11 aa, Dengue virus
VAHYAIIGPAL

SEQ ID NO: 51453 - protein, 11 aa, Dengue virus
LLFSIMRNTTS

SEQ ID NO: 51454 - protein, 11 aa, Dengue virus
RRGTGNVGETL

SEQ ID NO: 51455 - protein, 11 aa, Dengue virus
RGTGNVGETLG

SEQ ID NO: 51456 - protein, 11 aa, Dengue virus
GTGNVGETLGE

SEQ ID NO: 51457 - protein, 11 aa, Dengue virus
TGNVGETLGEK

SEQ ID NO: 51458 - protein, 11 aa, Dengue virus
GNVGETLGEKW

SEQ ID NO: 51459 - protein, 11 aa, Dengue virus
NVGETLGEKWK

SEQ ID NO: 51460 - protein, 11 aa, Dengue virus
LGEKWKNRLNS

SEQ ID NO: 51461 - protein, 11 aa, Dengue virus
GEKWKNRLNSL

SEQ ID NO: 51462 - protein, 11 aa, Dengue virus
EKWKNRLNSLG

SEQ ID NO: 51463 - protein, 11 aa, Dengue virus
LGKSEFQTYKK

SEQ ID NO: 51464 - protein, 11 aa, Dengue virus
GRSEFQIYKKS

SEQ ID NO: 51465 - protein, 11 aa, Dengue virus
KSEFQTYKKSG

SEQ ID NO: 51466 - protein, 11 aa, Dengue virus
NEFQIYKKSGI

SEQ ID NO: 51467 - protein, 11 aa, Dengue virus
RNMVAPEGKVV

SEQ ID NO: 51468 - protein, 11 aa, Dengue virus
NMVAPEGKVVD

SEQ ID NO: 51469 - protein, 11 aa, Dengue virus
MVAPEGKVVDL

SEQ ID NO: 51470 - protein, 11 aa, Dengue virus
SYYCGGLKSVR

SEQ ID NO: 51471 - protein, 11 aa, Dengue virus
YYCGGLKSVRE

SEQ ID NO: 51472 - protein, 11 aa, Dengue virus
YCGGLKSVREV

SEQ ID NO: 51473 - protein, 11 aa, Dengue virus
CGGLKSVREVK

SEQ ID NO: 51474 - protein, 11 aa, Dengue virus
GGLKSVREVKG

SEQ ID NO: 51475 - protein, 11 aa, Dengue virus
GLKSVREVKGL

SEQ ID NO: 51476 - protein, 11 aa, Dengue virus
LKSVREVKGLT

SEQ ID NO: 51477 - protein, 11 aa, Dengue virus
KSVREVKGLTK

SEQ ID NO: 51478 - protein, 11 aa, Dengue virus
SVREVKGLTKG

SEQ ID NO: 51479 - protein, 11 aa, Dengue virus
RLQSGIDVFFT

SEQ ID NO: 51480 - protein, 11 aa, Dengue virus
LQSGIDVFFTP

SEQ ID NO: 51481 - protein, 11 aa, Dengue virus
QSGIDVFFTPP

SEQ ID NO: 51482 - protein, 11 aa, Dengue virus
SGIDVFFTPPE

SEQ ID NO: 51483 - protein, 11 aa, Dengue virus
GVDVFFTPPER

SEQ ID NO: 51484 - protein, 11 aa, Dengue virus
VDVFFTPPERC

SEQ ID NO: 51485 - protein, 11 aa, Dengue virus
DVFFTPPERCD

SEQ ID NO: 51486 - protein, 11 aa, Dengue virus
VFFTPPERCDT

SEQ ID NO: 51487 - protein, 11 aa, Dengue virus
FFTPPERCDTL

SEQ ID NO: 51488 - protein, 11 aa, Dengue virus
FTPPERCDTLL

SEQ ID NO: 51489 - protein, 11 aa, Dengue virus
TPPERCDTLLC

SEQ ID NO: 51490 - protein, 11 aa, Dengue virus
VLNLVESWLNN

SEQ ID NO: 51491 - protein, 11 aa, Dengue virus
LNLVESWLNNN

SEQ ID NO: 51492 - protein, 11 aa, Dengue virus
ESWLNNNTQFC

SEQ ID NO: 51493 - protein, 11 aa, Dengue virus
WLGSNTQFCVK

SEQ ID NO: 51494 - protein, 11 aa, Dengue virus
LGSNTQFCVKV

SEQ ID NO: 51495 - protein, 11 aa, Dengue virus
GSNTQFCVKVL

SEQ ID NO: 51496 - protein, 11 aa, Dengue virus
SNTQFCVKVLN

SEQ ID NO: 51497 - protein, 11 aa, Dengue virus
YMPSVIERMEA

SEQ ID NO: 51498 - protein, 11 aa, Dengue virus
MPSVIERMEAL

SEQ ID NO: 51499 - protein, 11 aa, Dengue virus
PSVIERMEALQ

SEQ ID NO: 51500 - protein, 11 aa, Dengue virus
SVIERMEALQR

SEQ ID NO: 51501 - protein, 11 aa, Dengue virus
MQRKYGGALVR

SEQ ID NO: 51502 - protein, 11 aa, Dengue virus
QRRYGGALVRN

SEQ ID NO: 51503 - protein, 11 aa, Dengue virus
INRFTMRHKRA

SEQ ID NO: 51504 - protein, 11 aa, Dengue virus
TMRHKRATYEP

SEQ ID NO: 51505 - protein, 11 aa, Dengue virus
MRHKRATYEPD

SEQ ID NO: 51506 - protein, 11 aa, Dengue virus
RHKRATYEPDV

SEQ ID NO: 51507 - protein, 11 aa, Dengue virus
GSGTRNIGTES

SEQ ID NO: 51508 - protein, 11 aa, Dengue virus
SGTRNIGTESE

SEQ ID NO: 51509 - protein, 11 aa, Dengue virus
ETPNMDIIGKR

SEQ ID NO: 51510 - protein, 11 aa, Dengue virus
TPNMDIIGKRI

SEQ ID NO: 51511 - protein, 11 aa, Dengue virus
RIEKIKQEHEA

SEQ ID NO: 51512 - protein, 11 aa, Dengue virus
IEKIKQEHEAS

SEQ ID NO: 51513 - protein, 11 aa, Dengue virus
EKIKQEHEASW

SEQ ID NO: 51514 - protein, 11 aa, Dengue virus
KIKQEHEASWH

SEQ ID NO: 51515 - protein, 11 aa, Dengue virus
IKQEHEASWHY

SEQ ID NO: 51516 - protein, 11 aa, Dengue virus
KQEHEASWHYD

SEQ ID NO: 51517 - protein, 11 aa, Dengue virus
QEHEASWHYDQ

SEQ ID NO: 51518 - protein, 11 aa, Dengue virus
VKLLTKPWDVV

SEQ ID NO: 51519 - protein, 11 aa, Dengue virus
KLLTKPWDVVP

SEQ ID NO: 51520 - protein, 11 aa, Dengue virus
LLTKPWDVLPM

SEQ ID NO: 51521 - protein, 11 aa, Dengue virus
LTKPWDVLPMV

SEQ ID NO: 51522 - protein, 11 aa, Dengue virus
TKPWDVLPMVT

SEQ ID NO: 51523 - protein, 11 aa, Dengue virus
KPWDVLPMVTQ

SEQ ID NO: 51524 - protein, 11 aa, Dengue virus
PWDVLPMVTQM

SEQ ID NO: 51525 - protein, 11 aa, Dengue virus
WDVLPMVTQMA

SEQ ID NO: 51526 - protein, 11 aa, Dengue virus
DVLPMVTQMAM

SEQ ID NO: 51527 - protein, 11 aa, Dengue virus
VLPMVTQMAMT

SEQ ID NO: 51528 - protein, 11 aa, Dengue virus
LPMVTQMAMTD

SEQ ID NO: 51529 - protein, 11 aa, Dengue virus
GTKKLMRITAK

SEQ ID NO: 51530 - protein, 11 aa, Dengue virus
TKKLMRITAKW

SEQ ID NO: 51531 - protein, 11 aa, Dengue virus
KKLMRITAKWL

SEQ ID NO: 51532 - protein, 11 aa, Dengue virus
KLMRITAKWLW

SEQ ID NO: 51533 - protein, 11 aa, Dengue virus
LMRITAEWLWG

SEQ ID NO: 51534 - protein, 11 aa, Dengue virus
MKITAKWLWKE

SEQ ID NO: 51535 - protein, 11 aa, Dengue virus
KITAKWLWKEL

SEQ ID NO: 51536 - protein, 11 aa, Dengue virus
ITAKWLWGELG

SEQ ID NO: 51537 - protein, 11 aa, Dengue virus
TAKWLWGELGR

SEQ ID NO: 51538 - protein, 11 aa, Dengue virus
WLWKELGKKKI

SEQ ID NO: 51539 - protein, 11 aa, Dengue virus
LWKELGKKKIP

SEQ ID NO: 51540 - protein, 11 aa, Dengue virus
WKELGKKKIPR

SEQ ID NO: 51541 - protein, 11 aa, Dengue virus
KIPRMCTREEF

SEQ ID NO: 51542 - protein, 11 aa, Dengue virus
CTREEFARKVR

SEQ ID NO: 51543 - protein, 11 aa, Dengue virus
TREEFARKVRS

SEQ ID NO: 51544 - protein, 11 aa, Dengue virus
REEFARKVRSN

SEQ ID NO: 51545 - protein, 11 aa, Dengue virus
EEFARKVRSNA

SEQ ID NO: 51546 - protein, 11 aa, Dengue virus
WKSAREAVEDE

SEQ ID NO: 51547 - protein, 11 aa, Dengue virus
KSAREAVEDNR

SEQ ID NO: 51548 - protein, 11 aa, Dengue virus
SAREAVEDERF

SEQ ID NO: 51549 - protein, 11 aa, Dengue virus
AREAVEDERFW

SEQ ID NO: 51550 - protein, 11 aa, Dengue virus
REAVEDNRFWE

SEQ ID NO: 51551 - protein, 11 aa, Dengue virus
EAVEDNRFWEL

SEQ ID NO: 51552 - protein, 11 aa, Dengue virus
FWELVEKERNL

SEQ ID NO: 51553 - protein, 11 aa, Dengue virus
WELVEKERNLH

SEQ ID NO: 51554 - protein, 11 aa, Dengue virus
ELVEKERNLHL

SEQ ID NO: 51555 - protein, 11 aa, Dengue virus
ERERNLHLDGK

SEQ ID NO: 51556 - protein, 11 aa, Dengue virus
RERNLHLDGKC

SEQ ID NO: 51557 - protein, 11 aa, Dengue virus
GLHKLGYILRE

SEQ ID NO: 51558 - protein, 11 aa, Dengue virus
LHKLGYILREV

SEQ ID NO: 51559 - protein, 11 aa, Dengue virus
LGYILREVSKK

SEQ ID NO: 51560 - protein, 11 aa, Dengue virus
ISKKAGGAMYA

SEQ ID NO: 51561 - protein, 11 aa, Dengue virus
SKKAGGAMYAD

SEQ ID NO: 51562 - protein, 11 aa, Dengue virus
EDLKNEEMITG

SEQ ID NO: 51563 - protein, 11 aa, Dengue virus
DLKNEEMITGQ

SEQ ID NO: 51564 - protein, 11 aa, Dengue virus
LKNEEMITGQM

SEQ ID NO: 51565 - protein, 11 aa, Dengue virus
EHKKLAEAIFR

SEQ ID NO: 51566 - protein, 11 aa, Dengue virus
DDRFAKALTAL

SEQ ID NO: 51567 - protein, 11 aa, Dengue virus
DRFAKALTALN

SEQ ID NO: 51568 - protein, 11 aa, Dengue virus
RFAKALTALND

SEQ ID NO: 51569 - protein, 11 aa, Dengue virus
FAKALTALNDM

SEQ ID NO: 51570 - protein, 11 aa, Dengue virus
AKALTALNDMG

SEQ ID NO: 51571 - protein, 11 aa, Dengue virus
KALTALNDMGK

SEQ ID NO: 51572 - protein, 11 aa, Dengue virus
MKDGRKLVVPC

SEQ ID NO: 51573 - protein, 11 aa, Dengue virus
KDGRKLVVPCR

SEQ ID NO: 51574 - protein, 11 aa, Dengue virus
TSRTTWSIHAR

SEQ ID NO: 51575 - protein, 11 aa, Dengue virus
SRTTWSIHARH

SEQ ID NO: 51576 - protein, 11 aa, Dengue virus
RTTWSIHARHE

SEQ ID NO: 51577 - protein, 11 aa, Dengue virus
TTWSIHARHEW

SEQ ID NO: 51578 - protein, 11 aa, Dengue virus
TWSIHARHEWM

SEQ ID NO: 51579 - protein, 11 aa, Dengue virus
WSIHARHEWMT

SEQ ID NO: 51580 - protein, 11 aa, Dengue virus
SIHARHEWMTT

SEQ ID NO: 51581 - protein, 11 aa, Dengue virus
IHARHEWMTTE

SEQ ID NO: 51582 - protein, 11 aa, Dengue virus
HARHEWMTTED

SEQ ID NO: 51583 - protein, 11 aa, Dengue virus
ARHEWMTTEDM

SEQ ID NO: 51584 - protein, 11 aa, Dengue virus
RHEWMTTEDML

SEQ ID NO: 51585 - protein, 11 aa, Dengue virus
MLTVWNRVWIL

SEQ ID NO: 51586 - protein, 11 aa, Dengue virus
VWNRVWIQDNP

SEQ ID NO: 51587 - protein, 11 aa, Dengue virus
WNRVWIQDNPW

SEQ ID NO: 51588 - protein, 11 aa, Dengue virus
VWIQENPWIED

SEQ ID NO: 51589 - protein, 11 aa, Dengue virus
WIQENPWIEDK

SEQ ID NO: 51590 - protein, 11 aa, Dengue virus
IQENPWIEDKT

SEQ ID NO: 51591 - protein, 11 aa, Dengue virus
DNPWMEDKTFV

SEQ ID NO: 51592 - protein, 11 aa, Dengue virus
MEEKTPVESWE

SEQ ID NO: 51593 - protein, 11 aa, Dengue virus
EDKTLVESWEE

SEQ ID NO: 51594 - protein, 11 aa, Dengue virus
DKTPVETWEEI

SEQ ID NO: 51595 - protein, 11 aa, Dengue virus
KTPVETWEEIP

SEQ ID NO: 51596 - protein, 11 aa, Dengue virus
TPVETWEEIPY

SEQ ID NO: 51597 - protein, 11 aa, Dengue virus
PVETWEEIPYL

SEQ ID NO: 51598 - protein, 11 aa, Dengue virus
TWARNIQTAIN

SEQ ID NO: 51599 - protein, 11 aa, Dengue virus
WARNIQTAINQ

SEQ ID NO: 51600 - protein, 11 aa, Dengue virus
ARNIQTAINQV

SEQ ID NO: 51601 - protein, 11 aa, Dengue virus
RNIQTAINQVR

SEQ ID NO: 51602 - protein, 11 aa, Dengue virus
NIQTAINQVRA

SEQ ID NO: 51603 - protein, 11 aa, Dengue virus
IQTAINQVRAL

SEQ ID NO: 51604 - protein, 11 aa, Dengue virus
QTAINQVRALI

SEQ ID NO: 51605 - protein, 11 aa, Dengue virus
TAINQVRALIG

SEQ ID NO: 51606 - protein, 11 aa, Dengue virus
AINQVRSLIGS

SEQ ID NO: 51607 - protein, 11 aa, Dengue virus
INQVRSLIGSE

SEQ ID NO: 51608 - protein, 11 aa, Dengue virus
NQVRSLIGSEE

SEQ ID NO: 51609 - protein, 11 aa, Dengue virus
QVRSLIGSEEY

SEQ ID NO: 51610 - protein, 11 aa, Dengue virus
GTIKKSRAINV

SEQ ID NO: 51611 - protein, 11 aa, Dengue virus
AIKKSKAINVL

SEQ ID NO: 51612 - protein, 11 aa, Dengue virus
IKKSRAINVLR

SEQ ID NO: 51613 - protein, 11 aa, Dengue virus
LNILNRRRRTV

SEQ ID NO: 51614 - protein, 11 aa, Dengue virus
NILNRRRRTVG

SEQ ID NO: 51615 - protein, 11 aa, Dengue virus
RNGEPHMIVSK

SEQ ID NO: 51616 - protein, 11 aa, Dengue virus
GEPHMIVSKNE

SEQ ID NO: 51617 - protein, 11 aa, Dengue virus
EPHMIVSKNEK

SEQ ID NO: 51618 - protein, 11 aa, Dengue virus
PHMIVSKNEKG

SEQ ID NO: 51619 - protein, 11 aa, Dengue virus
HMIVSKNEKGK

SEQ ID NO: 51620 - protein, 11 aa, Dengue virus
MIVSKNEKGKS

SEQ ID NO: 51621 - protein, 11 aa, Dengue virus
IVSKNEKGKSL

SEQ ID NO: 51622 - protein, 11 aa, Dengue virus
VSKNEKGKSLL

SEQ ID NO: 51623 - protein, 11 aa, Dengue virus
SKNEKGKSLLF

SEQ ID NO: 51624 - protein, 11 aa, Dengue virus
GINMCTLMAID

SEQ ID NO: 51625 - protein, 11 aa, Dengue virus
INMCTLMAIDL

SEQ ID NO: 51626 - protein, 11 aa, Dengue virus
TYNCPLLKQNE

SEQ ID NO: 51627 - protein, 11 aa, Dengue virus
YNCPLLKQNEP

SEQ ID NO: 51628 - protein, 11 aa, Dengue virus
NCPLLKQNEPE

SEQ ID NO: 51629 - protein, 11 aa, Dengue virus
LRHPGFTTMAA

SEQ ID NO: 51630 - protein, 11 aa, Dengue virus
GTTHFQKALIF

SEQ ID NO: 51631 - protein, 11 aa, Dengue virus
TTHFQKALIFI

SEQ ID NO: 51632 - protein, 11 aa, Dengue virus
THFQKALIFIL

SEQ ID NO: 51633 - protein, 11 aa, Dengue virus
HFQKALIFILL

SEQ ID NO: 51634 - protein, 11 aa, Dengue virus
FQKALIFILLT

SEQ ID NO: 51635 - protein, 11 aa, Dengue virus
LIFILLTTVAP

SEQ ID NO: 51636 - protein, 11 aa, Dengue virus
IFILLTTVAPS

SEQ ID NO: 51637 - protein, 11 aa, Dengue virus
LLTAIAPSMAM

SEQ ID NO: 51638 - protein, 11 aa, Dengue virus
LTTVAPSMTMR

SEQ ID NO: 51639 - protein, 11 aa, Dengue virus
TTVAPSMTMRC

SEQ ID NO: 51640 - protein, 11 aa, Dengue virus
EAKQSATLRKY

SEQ ID NO: 51641 - protein, 11 aa, Dengue virus
AKQSATLRKYC

SEQ ID NO: 51642 - protein, 11 aa, Dengue virus
IEARLTNTTTE

SEQ ID NO: 51643 - protein, 11 aa, Dengue virus
RCPTQGEPSLV

SEQ ID NO: 51644 - protein, 11 aa, Dengue virus
CPTQGEPSLSE

SEQ ID NO: 51645 - protein, 11 aa, Dengue virus
PTQGEPSLSEE

SEQ ID NO: 51646 - protein, 11 aa, Dengue virus
TQGEPSLSEEQ

SEQ ID NO: 51647 - protein, 11 aa, Dengue virus
QGEPSLSEEQD

SEQ ID NO: 51648 - protein, 11 aa, Dengue virus
GEPSLVEEQDK

SEQ ID NO: 51649 - protein, 11 aa, Dengue virus
EPSLVEEQDKR

SEQ ID NO: 51650 - protein, 11 aa, Dengue virus
PSLSEEQDKRF

SEQ ID NO: 51651 - protein, 11 aa, Dengue virus
GIVTCAKFTCK

SEQ ID NO: 51652 - protein, 11 aa, Dengue virus
IVTCAMFSCKK

SEQ ID NO: 51653 - protein, 11 aa, Dengue virus
VTCAKFTCKKN

SEQ ID NO: 51654 - protein, 11 aa, Dengue virus
TCAMFSCKKNM

SEQ ID NO: 51655 - protein, 11 aa, Dengue virus
AMFSCKKNMEG

SEQ ID NO: 51656 - protein, 11 aa, Dengue virus
CLKKMEGKVVQ

SEQ ID NO: 51657 - protein, 11 aa, Dengue virus
LKKMEGKVVQP

SEQ ID NO: 51658 - protein, 11 aa, Dengue virus
KKMEGKVVQPE

SEQ ID NO: 51659 - protein, 11 aa, Dengue virus
KMEGKVVQPEN

SEQ ID NO: 51660 - protein, 11 aa, Dengue virus
IVVTPHSGEEN

SEQ ID NO: 51661 - protein, 11 aa, Dengue virus
MITPHSGEEHA

SEQ ID NO: 51662 - protein, 11 aa, Dengue virus
AVGNDTGKHGE

SEQ ID NO: 51663 - protein, 11 aa, Dengue virus
GDDTGKHGKEI

SEQ ID NO: 51664 - protein, 11 aa, Dengue virus
NDTGKHGEEIK

SEQ ID NO: 51665 - protein, 11 aa, Dengue virus
DTGKHGMEIKV

SEQ ID NO: 51666 - protein, 11 aa, Dengue virus
TGKHGMEIKVT

SEQ ID NO: 51667 - protein, 11 aa, Dengue virus
GKHGMEIKVTP

SEQ ID NO: 51668 - protein, 11 aa, Dengue virus
KHGMEIKVTPQ

SEQ ID NO: 51669 - protein, 11 aa, Dengue virus
HGMEIKVTPQS

SEQ ID NO: 51670 - protein, 11 aa, Dengue virus
MGNKAWLVHRQ

SEQ ID NO: 51671 - protein, 11 aa, Dengue virus
GNKAWLVHRQW

SEQ ID NO: 51672 - protein, 11 aa, Dengue virus
LPWLPGADIQG

SEQ ID NO: 51673 - protein, 11 aa, Dengue virus
PWLPGADIQGS

SEQ ID NO: 51674 - protein, 11 aa, Dengue virus
WLPGADIQGSN

SEQ ID NO: 51675 - protein, 11 aa, Dengue virus
LPGADIQGSNW

SEQ ID NO: 51676 - protein, 11 aa, Dengue virus
PGADIQGSNWI

SEQ ID NO: 51677 - protein, 11 aa, Dengue virus
GADIQGSNWIQ

SEQ ID NO: 51678 - protein, 11 aa, Dengue virus
ADIQGSNWIQK

SEQ ID NO: 51679 - protein, 11 aa, Dengue virus
DIQGSNWIQKE

SEQ ID NO: 51680 - protein, 11 aa, Dengue virus
VIRLQYEGDGS

SEQ ID NO: 51681 - protein, 11 aa, Dengue virus
IRLQYEGDGSP

SEQ ID NO: 51682 - protein, 11 aa, Dengue virus
LQYEGDGSPCK

SEQ ID NO: 51683 - protein, 11 aa, Dengue virus
QYEGEDSPCKI

SEQ ID NO: 51684 - protein, 11 aa, Dengue virus
YEGEDSPCKIP

SEQ ID NO: 51685 - protein, 11 aa, Dengue virus
EGDGSPCKTPF

SEQ ID NO: 51686 - protein, 11 aa, Dengue virus
GEDSPCKIPFE

SEQ ID NO: 51687 - protein, 11 aa, Dengue virus
EGAPCKIPFEI

SEQ ID NO: 51688 - protein, 11 aa, Dengue virus
KIPFEIMDLER

SEQ ID NO: 51689 - protein, 11 aa, Dengue virus
IPFEIMDLERR

SEQ ID NO: 51690 - protein, 11 aa, Dengue virus
PFEIMDLERRY

SEQ ID NO: 51691 - protein, 11 aa, Dengue virus
DLEKRYILGRL

SEQ ID NO: 51692 - protein, 11 aa, Dengue virus
LEKRYILGRLI

SEQ ID NO: 51693 - protein, 11 aa, Dengue virus
EKRYILGRLIT

SEQ ID NO: 51694 - protein, 11 aa, Dengue virus
KRYILGRLITV

SEQ ID NO: 51695 - protein, 11 aa, Dengue virus
GRLITVNPIAT

SEQ ID NO: 51696 - protein, 11 aa, Dengue virus
FGSLGGMFTSI

SEQ ID NO: 51697 - protein, 11 aa, Dengue virus
GSLGGVFTSMG

SEQ ID NO: 51698 - protein, 11 aa, Dengue virus
SLGGVFTSMGK

SEQ ID NO: 51699 - protein, 11 aa, Dengue virus
LGGVFTSMGKA

SEQ ID NO: 51700 - protein, 11 aa, Dengue virus
SWTMKIFIGVI

SEQ ID NO: 51701 - protein, 11 aa, Dengue virus
WTMKIFIGVII

SEQ ID NO: 51702 - protein, 11 aa, Dengue virus
TMKIFIGVIIT

SEQ ID NO: 51703 - protein, 11 aa, Dengue virus
LSVTLVIVGIV

SEQ ID NO: 51704 - protein, 11 aa, Dengue virus
LVGVVILYLGA

SEQ ID NO: 51705 - protein, 11 aa, Dengue virus
GAMVQADSGCI

SEQ ID NO: 51706 - protein, 11 aa, Dengue virus
AMVQADSGCIV

SEQ ID NO: 51707 - protein, 11 aa, Dengue virus
SAIQKAHEDGI

SEQ ID NO: 51708 - protein, 11 aa, Dengue virus
AIQKAHEDGIC

SEQ ID NO: 51709 - protein, 11 aa, Dengue virus
IQKAYEEGICG

SEQ ID NO: 51710 - protein, 11 aa, Dengue virus
QKAHEDGICGI

SEQ ID NO: 51711 - protein, 11 aa, Dengue virus
YEEGICGIRSV

SEQ ID NO: 51712 - protein, 11 aa, Dengue virus
NHILTENEVKL

SEQ ID NO: 51713 - protein, 11 aa, Dengue virus
HILTENEVKLT

SEQ ID NO: 51714 - protein, 11 aa, Dengue virus
ILTENEVKLTI

SEQ ID NO: 51715 - protein, 11 aa, Dengue virus
TENEVKLTIMT

SEQ ID NO: 51716 - protein, 11 aa, Dengue virus
EVKMTIMTGDI

SEQ ID NO: 51717 - protein, 11 aa, Dengue virus
KMTIMTGDIKG

SEQ ID NO: 51718 - protein, 11 aa, Dengue virus
TIMTGDIKGTM

SEQ ID NO: 51719 - protein, 11 aa, Dengue virus
IMTGDIKGIMH

SEQ ID NO: 51720 - protein, 11 aa, Dengue virus
HNRTFLIDGPE

SEQ ID NO: 51721 - protein, 11 aa, Dengue virus
RTFLIDGPETA

SEQ ID NO: 51722 - protein, 11 aa, Dengue virus
TTECPSSNRAW

SEQ ID NO: 51723 - protein, 11 aa, Dengue virus
AECPNANRAWN

SEQ ID NO: 51724 - protein, 11 aa, Dengue virus
FTTNIWLRLKE

SEQ ID NO: 51725 - protein, 11 aa, Dengue virus
TNIWLRLKEKQ

SEQ ID NO: 51726 - protein, 11 aa, Dengue virus
NIWLRLKEKQD

SEQ ID NO: 51727 - protein, 11 aa, Dengue virus
SKLMSAAIKDS

SEQ ID NO: 51728 - protein, 11 aa, Dengue virus
FIEVKSCHWPR

SEQ ID NO: 51729 - protein, 11 aa, Dengue virus
IEVKSCHWPRS

SEQ ID NO: 51730 - protein, 11 aa, Dengue virus
EVKSCHWPRSH

SEQ ID NO: 51731 - protein, 11 aa, Dengue virus
VKSCHWPRSHT

SEQ ID NO: 51732 - protein, 11 aa, Dengue virus
IPKGFAGPVSQ

SEQ ID NO: 51733 - protein, 11 aa, Dengue virus
PKNIAGPVSQH

SEQ ID NO: 51734 - protein, 11 aa, Dengue virus
KGFAGPVSQHN

SEQ ID NO: 51735 - protein, 11 aa, Dengue virus
IAGPVSQHNNR

SEQ ID NO: 51736 - protein, 11 aa, Dengue virus
VSQHNYRLGYH

SEQ ID NO: 51737 - protein, 11 aa, Dengue virus
SQHNYRLGYHT

SEQ ID NO: 51738 - protein, 11 aa, Dengue virus
QHNYRLGYHTQ

SEQ ID NO: 51739 - protein, 11 aa, Dengue virus
HLGKLEMDFNF

SEQ ID NO: 51740 - protein, 11 aa, Dengue virus
LGKLEMDFNFC

SEQ ID NO: 51741 - protein, 11 aa, Dengue virus
LEMDFNFCDGT

SEQ ID NO: 51742 - protein, 11 aa, Dengue virus
EMDFNFCDGTT

SEQ ID NO: 51743 - protein, 11 aa, Dengue virus
MDFNFCDGTTV

SEQ ID NO: 51744 - protein, 11 aa, Dengue virus
CEGTTVVVTEN

SEQ ID NO: 51745 - protein, 11 aa, Dengue virus
EGTTVVVTENC

SEQ ID NO: 51746 - protein, 11 aa, Dengue virus
NSLVTAGYGQI

SEQ ID NO: 51747 - protein, 11 aa, Dengue virus
YGQIDNFSLGV

SEQ ID NO: 51748 - protein, 11 aa, Dengue virus
FVTLITGNLSF

SEQ ID NO: 51749 - protein, 11 aa, Dengue virus
KDLGRVIVMVG

SEQ ID NO: 51750 - protein, 11 aa, Dengue virus
TDDIGIGVTYL

SEQ ID NO: 51751 - protein, 11 aa, Dengue virus
AAYKVRPTFAA

SEQ ID NO: 51752 - protein, 11 aa, Dengue virus
AYKVRPTFAAG

SEQ ID NO: 51753 - protein, 11 aa, Dengue virus
FKVRPTFVAGL

SEQ ID NO: 51754 - protein, 11 aa, Dengue virus
KVRPTFVAGLL

SEQ ID NO: 51755 - protein, 11 aa, Dengue virus
PTFVAGLLLRK

SEQ ID NO: 51756 - protein, 11 aa, Dengue virus
TFAAGLLLRRL

SEQ ID NO: 51757 - protein, 11 aa, Dengue virus
FAAGLLLRRLT

SEQ ID NO: 51758 - protein, 11 aa, Dengue virus
NILELTDALAL

SEQ ID NO: 51759 - protein, 11 aa, Dengue virus
CVPNAVVLQNA

SEQ ID NO: 51760 - protein, 11 aa, Dengue virus
VPNAVVLQNAW

SEQ ID NO: 51761 - protein, 11 aa, Dengue virus
SVFPLLLTSSQ

SEQ ID NO: 51762 - protein, 11 aa, Dengue virus
VFPLLLTSSQQ

SEQ ID NO: 51763 - protein, 11 aa, Dengue virus
FPLLLTSSQQK

SEQ ID NO: 51764 - protein, 11 aa, Dengue virus
SRQKADWIPLA

SEQ ID NO: 51765 - protein, 11 aa, Dengue virus
RQKADWIPLAL

SEQ ID NO: 51766 - protein, 11 aa, Dengue virus
AIFLTTLSRSN

SEQ ID NO: 51767 - protein, 11 aa, Dengue virus
IFLTTLSRSNK

SEQ ID NO: 51768 - protein, 11 aa, Dengue virus
LTTLTRTSKKR

SEQ ID NO: 51769 - protein, 11 aa, Dengue virus
TTLTRTSKKRS

SEQ ID NO: 51770 - protein, 11 aa, Dengue virus
TLTRTSKKRSW

SEQ ID NO: 51771 - protein, 11 aa, Dengue virus
LTRTSKKRSWP

SEQ ID NO: 51772 - protein, 11 aa, Dengue virus
SADLELERAAE

SEQ ID NO: 51773 - protein, 11 aa, Dengue virus
ADLELERAAEV

SEQ ID NO: 51774 - protein, 11 aa, Dengue virus
VKWEEQAEISG

SEQ ID NO: 51775 - protein, 11 aa, Dengue virus
KWEEQAEISGS

SEQ ID NO: 51776 - protein, 11 aa, Dengue virus
SGVFPVSIPVT

SEQ ID NO: 51777 - protein, 11 aa, Dengue virus
GVFPVSIPVTA

SEQ ID NO: 51778 - protein, 11 aa, Dengue virus
VFPVSIPVTAA

SEQ ID NO: 51779 - protein, 11 aa, Dengue virus
LWDVPSPPPME

SEQ ID NO: 51780 - protein, 11 aa, Dengue virus
YRIKQKRILGY

SEQ ID NO: 51781 - protein, 11 aa, Dengue virus
RIKQRGFLGYS

SEQ ID NO: 51782 - protein, 11 aa, Dengue virus
IKQKRILGYSQ

SEQ ID NO: 51783 - protein, 11 aa, Dengue virus
KQKRILGYSQI

SEQ ID NO: 51784 - protein, 11 aa, Dengue virus
QRGFLGYSQIG

SEQ ID NO: 51785 - protein, 11 aa, Dengue virus
RGFLGYSQIGA

SEQ ID NO: 51786 - protein, 11 aa, Dengue virus
VQTKPGIFRTN

SEQ ID NO: 51787 - protein, 11 aa, Dengue virus
FRTNAGTIGAV

SEQ ID NO: 51788 - protein, 11 aa, Dengue virus
KTNTGIIGAVS

SEQ ID NO: 51789 - protein, 11 aa, Dengue virus
VSSIAQTETSV

SEQ ID NO: 51790 - protein, 11 aa, Dengue virus
SSIAQTETSVE

SEQ ID NO: 51791 - protein, 11 aa, Dengue virus
EIEDHIFRKRR

SEQ ID NO: 51792 - protein, 11 aa, Dengue virus
WNSGHEWITDF

SEQ ID NO: 51793 - protein, 11 aa, Dengue virus
GHEWITNFEGK

SEQ ID NO: 51794 - protein, 11 aa, Dengue virus
HEWITNFEGKT

SEQ ID NO: 51795 - protein, 11 aa, Dengue virus
LSRKTFDTEYI

SEQ ID NO: 51796 - protein, 11 aa, Dengue virus
SRKTFDTEYIK

SEQ ID NO: 51797 - protein, 11 aa, Dengue virus
RKTFDTEYIKT

SEQ ID NO: 51798 - protein, 11 aa, Dengue virus
KTFDTEYIKTR

SEQ ID NO: 51799 - protein, 11 aa, Dengue virus
LAYKVASEGIS

SEQ ID NO: 51800 - protein, 11 aa, Dengue virus
AYKVASEGISY

SEQ ID NO: 51801 - protein, 11 aa, Dengue virus
KVASEGISYAD

SEQ ID NO: 51802 - protein, 11 aa, Dengue virus
YTDRKWCFDGI

SEQ ID NO: 51803 - protein, 11 aa, Dengue virus
DRKWCFDGIRN

SEQ ID NO: 51804 - protein, 11 aa, Dengue virus
RKWCFDGIRNN

SEQ ID NO: 51805 - protein, 11 aa, Dengue virus
KWCFDGIRNNQ

SEQ ID NO: 51806 - protein, 11 aa, Dengue virus
AVLHSAEMGGR

SEQ ID NO: 51807 - protein, 11 aa, Dengue virus
VLHSAEMGGRA

SEQ ID NO: 51808 - protein, 11 aa, Dengue virus
FLFLMSARGIG

SEQ ID NO: 51809 - protein, 11 aa, Dengue virus
LFLMSARGIGK

SEQ ID NO: 51810 - protein, 11 aa, Dengue virus
FLMSARGIGKM

SEQ ID NO: 51811 - protein, 11 aa, Dengue virus
LMSARGIGKMT

SEQ ID NO: 51812 - protein, 11 aa, Dengue virus
MSARGIGKMTL

SEQ ID NO: 51813 - protein, 11 aa, Dengue virus
SARGIGKMTLG

SEQ ID NO: 51814 - protein, 11 aa, Dengue virus
ARGIGKMTLGM

SEQ ID NO: 51815 - protein, 11 aa, Dengue virus
RGMGKMTLGMC

SEQ ID NO: 51816 - protein, 11 aa, Dengue virus
QHESNILDIDL

SEQ ID NO: 51817 - protein, 11 aa, Dengue virus
NPITLTAALLM

SEQ ID NO: 51818 - protein, 11 aa, Dengue virus
PITLTAALLML

SEQ ID NO: 51819 - protein, 11 aa, Dengue virus
LLFSIMKNTIN

SEQ ID NO: 51820 - protein, 11 aa, Dengue virus
RRGTGTIGETL

SEQ ID NO: 51821 - protein, 11 aa, Dengue virus
RGTGTIGETLG

SEQ ID NO: 51822 - protein, 11 aa, Dengue virus
GTGTIGETLGE

SEQ ID NO: 51823 - protein, 11 aa, Dengue virus
TGTIGETLGEK

SEQ ID NO: 51824 - protein, 11 aa, Dengue virus
GTIGETLGEKW

SEQ ID NO: 51825 - protein, 11 aa, Dengue virus
TIGETLGEKWK

SEQ ID NO: 51826 - protein, 11 aa, Dengue virus
GEKWKSQLNAL

SEQ ID NO: 51827 - protein, 11 aa, Dengue virus
EKWKSQLNALG

SEQ ID NO: 51828 - protein, 11 aa, Dengue virus
LGKNEFQIYKK

SEQ ID NO: 51829 - protein, 11 aa, Dengue virus
GKNEFQIYKKS

SEQ ID NO: 51830 - protein, 11 aa, Dengue virus
KNEFQIYKKSG

SEQ ID NO: 51831 - protein, 11 aa, Dengue virus
GIDVFFTPPEK

SEQ ID NO: 51832 - protein, 11 aa, Dengue virus
IDVFFTPPEKC

SEQ ID NO: 51833 - protein, 11 aa, Dengue virus
DVFFIPPERCD

SEQ ID NO: 51834 - protein, 11 aa, Dengue virus
VFFIPPERCDT

SEQ ID NO: 51835 - protein, 11 aa, Dengue virus
FFIPPERCDTL

SEQ ID NO: 51836 - protein, 11 aa, Dengue virus
FIPPERCDTLL

SEQ ID NO: 51837 - protein, 11 aa, Dengue virus
LNLVENWLKNN

SEQ ID NO: 51838 - protein, 11 aa, Dengue virus
ENWLNNNTKFC

SEQ ID NO: 51839 - protein, 11 aa, Dengue virus
WLNNNTKFCIK

SEQ ID NO: 51840 - protein, 11 aa, Dengue virus
LNNNTKFCIKV

SEQ ID NO: 51841 - protein, 11 aa, Dengue virus
NNNIQFCIKVL

SEQ ID NO: 51842 - protein, 11 aa, Dengue virus
LQRKHGGALVR

SEQ ID NO: 51843 - protein, 11 aa, Dengue virus
EKPNLDIIGKR

SEQ ID NO: 51844 - protein, 11 aa, Dengue virus
KPNLDIIGKRI

SEQ ID NO: 51845 - protein, 11 aa, Dengue virus
KIKQEHETSWY

SEQ ID NO: 51846 - protein, 11 aa, Dengue virus
IKQEHETSWHH

SEQ ID NO: 51847 - protein, 11 aa, Dengue virus
LMRITAKWLWG

SEQ ID NO: 51848 - protein, 11 aa, Dengue virus
MRITAKWLWGE

SEQ ID NO: 51849 - protein, 11 aa, Dengue virus
RITAKWLWGEL

SEQ ID NO: 51850 - protein, 11 aa, Dengue virus
WLWKELGRKKT

SEQ ID NO: 51851 - protein, 11 aa, Dengue virus
LWKELGRKKTP

SEQ ID NO: 51852 - protein, 11 aa, Dengue virus
WKELGRKKTPR

SEQ ID NO: 51853 - protein, 11 aa, Dengue virus
KTPRVCTREEF

SEQ ID NO: 51854 - protein, 11 aa, Dengue virus
KSAREAVEDER

SEQ ID NO: 51855 - protein, 11 aa, Dengue virus
SAREAVEDNRF

SEQ ID NO: 51856 - protein, 11 aa, Dengue virus
AREAVEDNRFW

SEQ ID NO: 51857 - protein, 11 aa, Dengue virus
REAVEDERFWE

SEQ ID NO: 51858 - protein, 11 aa, Dengue virus
EAVEDERFWEL

SEQ ID NO: 51859 - protein, 11 aa, Dengue virus
FWELVERERNL

SEQ ID NO: 51860 - protein, 11 aa, Dengue virus
WELVERERNLH

SEQ ID NO: 51861 - protein, 11 aa, Dengue virus
ELVERERNLHL

SEQ ID NO: 51862 - protein, 11 aa, Dengue virus
LHKLGYILRDI

SEQ ID NO: 51863 - protein, 11 aa, Dengue virus
LGYILRDISRK

SEQ ID NO: 51864 - protein, 11 aa, Dengue virus
ISRKAGGAIYA

SEQ ID NO: 51865 - protein, 11 aa, Dengue virus
SKKEGGTMYAD

SEQ ID NO: 51866 - protein, 11 aa, Dengue virus
MKDGRMLVVPC

SEQ ID NO: 51867 - protein, 11 aa, Dengue virus
KDGRMLVVPCR

SEQ ID NO: 51868 - protein, 11 aa, Dengue virus
MLTVWNKVWIR

SEQ ID NO: 51869 - protein, 11 aa, Dengue virus
VWNKVWIRENP

SEQ ID NO: 51870 - protein, 11 aa, Dengue virus
WNKVWIRENPW

SEQ ID NO: 51871 - protein, 11 aa, Dengue virus
VWIQDNPWMED

SEQ ID NO: 51872 - protein, 11 aa, Dengue virus
WIQDNPWMEDK

SEQ ID NO: 51873 - protein, 11 aa, Dengue virus
IQDNPWMEDKT

SEQ ID NO: 51874 - protein, 11 aa, Dengue virus
DKTLVESWEEV

SEQ ID NO: 51875 - protein, 11 aa, Dengue virus
QTAINQVRSLM

SEQ ID NO: 51876 - protein, 11 aa, Dengue virus
TAINQVRSLMG

SEQ ID NO: 51877 - protein, 11 aa, Dengue virus
NQVRSLIGNEG

SEQ ID NO: 51878 - protein, 11 aa, Dengue virus
QVRSLIGNEGY

SEQ ID NO: 51879 - protein, 8 aa, Dengue virus
MNNQRKKT

SEQ ID NO: 51880 - protein, 8 aa, Dengue virus
NNQRKKTG

SEQ ID NO: 51881 - protein, 8 aa, Dengue virus
NQRKKTGK

SEQ ID NO: 51882 - protein, 8 aa, Dengue virus
QRKKTGKP

SEQ ID NO: 51883 - protein, 8 aa, Dengue virus
RKKTGKPS

SEQ ID NO: 51884 - protein, 8 aa, Dengue virus
KKTGKPSI

SEQ ID NO: 51885 - protein, 8 aa, Dengue virus
KTGKPSIN

SEQ ID NO: 51886 - protein, 8 aa, Dengue virus
TGKPSINM

SEQ ID NO: 51887 - protein, 8 aa, Dengue virus
GKPSINML

SEQ ID NO: 51888 - protein, 8 aa, Dengue virus
KPSINMLK

SEQ ID NO: 51889 - protein, 8 aa, Dengue virus
PSINMLKR

SEQ ID NO: 51890 - protein, 8 aa, Dengue virus
SINMLKRV

SEQ ID NO: 51891 - protein, 8 aa, Dengue virus
INMLKRVR

SEQ ID NO: 51892 - protein, 8 aa, Dengue virus
NMLKRVRN

SEQ ID NO: 51893 - protein, 8 aa, Dengue virus
MLKRVRNR

SEQ ID NO: 51894 - protein, 8 aa, Dengue virus
LKRVRNRV

SEQ ID NO: 51895 - protein, 8 aa, Dengue virus
KRVRNRVS

SEQ ID NO: 51896 - protein, 8 aa, Dengue virus
RVRNRVST

SEQ ID NO: 51897 - protein, 8 aa, Dengue virus
VRNRVSTG

SEQ ID NO: 51898 - protein, 8 aa, Dengue virus
RNRVSTGS

SEQ ID NO: 51899 - protein, 8 aa, Dengue virus
NRVSTGSQ

SEQ ID NO: 51900 - protein, 8 aa, Dengue virus
RVSTGSQL

SEQ ID NO: 51901 - protein, 8 aa, Dengue virus
VSTGSQLA

SEQ ID NO: 51902 - protein, 8 aa, Dengue virus
STGSQLAK

SEQ ID NO: 51903 - protein, 8 aa, Dengue virus
TGSQLAKR

SEQ ID NO: 51904 - protein, 8 aa, Dengue virus
GSQLAKRF

SEQ ID NO: 51905 - protein, 8 aa, Dengue virus
SQLAKRFS

SEQ ID NO: 51906 - protein, 8 aa, Dengue virus
QLAKRFSK

SEQ ID NO: 51907 - protein, 8 aa, Dengue virus
LAKRFSKG

SEQ ID NO: 51908 - protein, 8 aa, Dengue virus
AKRFSKGL

SEQ ID NO: 51909 - protein, 8 aa, Dengue virus
KRFSKGLL

SEQ ID NO: 51910 - protein, 8 aa, Dengue virus
RFSKGLLN

SEQ ID NO: 51911 - protein, 8 aa, Dengue virus
FSKGLLNG

SEQ ID NO: 51912 - protein, 8 aa, Dengue virus
SKGLLNGQ

SEQ ID NO: 51913 - protein, 8 aa, Dengue virus
KGLLNGQG

SEQ ID NO: 51914 - protein, 8 aa, Dengue virus
GLLNGQGP

SEQ ID NO: 51915 - protein, 8 aa, Dengue virus
LLNGQGPM

SEQ ID NO: 51916 - protein, 8 aa, Dengue virus
LNGQGPMK

SEQ ID NO: 51917 - protein, 8 aa, Dengue virus
NGQGPMKL

SEQ ID NO: 51918 - protein, 8 aa, Dengue virus
GQGPMKLV

SEQ ID NO: 51919 - protein, 8 aa, Dengue virus
QGPMKLVM

SEQ ID NO: 51920 - protein, 8 aa, Dengue virus
GPMKLVMA

SEQ ID NO: 51921 - protein, 8 aa, Dengue virus
PMKLVMAF

SEQ ID NO: 51922 - protein, 8 aa, Dengue virus
MKLVMAFI

SEQ ID NO: 51923 - protein, 8 aa, Dengue virus
KLVMAFIA

SEQ ID NO: 51924 - protein, 8 aa, Dengue virus
LVMAFIAF

SEQ ID NO: 51925 - protein, 8 aa, Dengue virus
VMAFIAFL

SEQ ID NO: 51926 - protein, 8 aa, Dengue virus
MAFIAFLR

SEQ ID NO: 51927 - protein, 8 aa, Dengue virus
AFIAFLRF

SEQ ID NO: 51928 - protein, 8 aa, Dengue virus
FIAFLRFL

SEQ ID NO: 51929 - protein, 8 aa, Dengue virus
IAFLRFLA

SEQ ID NO: 51930 - protein, 8 aa, Dengue virus
AFLRFLAI

SEQ ID NO: 51931 - protein, 8 aa, Dengue virus
FLRFLAIP

SEQ ID NO: 51932 - protein, 8 aa, Dengue virus
LRFLAIPP

SEQ ID NO: 51933 - protein, 8 aa, Dengue virus
RFLAIPPT

SEQ ID NO: 51934 - protein, 8 aa, Dengue virus
FLAIPPTA

SEQ ID NO: 51935 - protein, 8 aa, Dengue virus
LAIPPTAG

SEQ ID NO: 51936 - protein, 8 aa, Dengue virus
AIPPTAGV

SEQ ID NO: 51937 - protein, 8 aa, Dengue virus
IPPTAGVL

SEQ ID NO: 51938 - protein, 8 aa, Dengue virus
PPTAGVLA

SEQ ID NO: 51939 - protein, 8 aa, Dengue virus
PTAGVLAR

SEQ ID NO: 51940 - protein, 8 aa, Dengue virus
TAGVLARW

SEQ ID NO: 51941 - protein, 8 aa, Dengue virus
AGVLARWG

SEQ ID NO: 51942 - protein, 8 aa, Dengue virus
GVLARWGT

SEQ ID NO: 51943 - protein, 8 aa, Dengue virus
VLARWGTF

SEQ ID NO: 51944 - protein, 8 aa, Dengue virus
LARWGTFK

SEQ ID NO: 51945 - protein, 8 aa, Dengue virus
ARWGTFKK

SEQ ID NO: 51946 - protein, 8 aa, Dengue virus
RWGTFKKS

SEQ ID NO: 51947 - protein, 8 aa, Dengue virus
WGTFKKSG

SEQ ID NO: 51948 - protein, 8 aa, Dengue virus
GTFKKSGA

SEQ ID NO: 51949 - protein, 8 aa, Dengue virus
TFKKSGAI

SEQ ID NO: 51950 - protein, 8 aa, Dengue virus
FKKSGAIK

SEQ ID NO: 51951 - protein, 8 aa, Dengue virus
KKSGAIKV

SEQ ID NO: 51952 - protein, 8 aa, Dengue virus
KSGAIKVL

SEQ ID NO: 51953 - protein, 8 aa, Dengue virus
SGAIKVLK

SEQ ID NO: 51954 - protein, 8 aa, Dengue virus
GAIKVLKG

SEQ ID NO: 51955 - protein, 8 aa, Dengue virus
AIKVLKGF

SEQ ID NO: 51956 - protein, 8 aa, Dengue virus
IKVLKGFK

SEQ ID NO: 51957 - protein, 8 aa, Dengue virus
KVLKGFKK

SEQ ID NO: 51958 - protein, 8 aa, Dengue virus
VLKGFKKE

SEQ ID NO: 51959 - protein, 8 aa, Dengue virus
LKGFKKEI

SEQ ID NO: 51960 - protein, 8 aa, Dengue virus
KGFKKEIS

SEQ ID NO: 51961 - protein, 8 aa, Dengue virus
GFKKEISN

SEQ ID NO: 51962 - protein, 8 aa, Dengue virus
FKKEISNM

SEQ ID NO: 51963 - protein, 8 aa, Dengue virus
KKEISNML

SEQ ID NO: 51964 - protein, 8 aa, Dengue virus
KEISNMLS

SEQ ID NO: 51965 - protein, 8 aa, Dengue virus
EISNMLSI

SEQ ID NO: 51966 - protein, 8 aa, Dengue virus
ISNMLSII

SEQ ID NO: 51967 - protein, 8 aa, Dengue virus
SNMLSIIN

SEQ ID NO: 51968 - protein, 8 aa, Dengue virus
NMLSIINK

SEQ ID NO: 51969 - protein, 8 aa, Dengue virus
MLSIINKR

SEQ ID NO: 51970 - protein, 8 aa, Dengue virus
LSIINKRK

SEQ ID NO: 51971 - protein, 8 aa, Dengue virus
SIINKRKK

SEQ ID NO: 51972 - protein, 8 aa, Dengue virus
IINKRKKT

SEQ ID NO: 51973 - protein, 8 aa, Dengue virus
INKRKKTS

SEQ ID NO: 51974 - protein, 8 aa, Dengue virus
NKRKKTSL

SEQ ID NO: 51975 - protein, 8 aa, Dengue virus
KRKKTSLC

SEQ ID NO: 51976 - protein, 8 aa, Dengue virus
RKKTSLCL

SEQ ID NO: 51977 - protein, 8 aa, Dengue virus
KKTSLCLM

SEQ ID NO: 51978 - protein, 8 aa, Dengue virus
KTSLCLMM

SEQ ID NO: 51979 - protein, 8 aa, Dengue virus
CLMMILPA

SEQ ID NO: 51980 - protein, 8 aa, Dengue virus
MILPAALA

SEQ ID NO: 51981 - protein, 8 aa, Dengue virus
ILPAALAF

SEQ ID NO: 51982 - protein, 8 aa, Dengue virus
LPAALAFH

SEQ ID NO: 51983 - protein, 8 aa, Dengue virus
PAALAFHL

SEQ ID NO: 51984 - protein, 8 aa, Dengue virus
AALAFHLT

SEQ ID NO: 51985 - protein, 8 aa, Dengue virus
ALAFHLTS

SEQ ID NO: 51986 - protein, 8 aa, Dengue virus
LAFHLTSR

SEQ ID NO: 51987 - protein, 8 aa, Dengue virus
AFHLTSRD

SEQ ID NO: 51988 - protein, 8 aa, Dengue virus
FHLTSRDG

SEQ ID NO: 51989 - protein, 8 aa, Dengue virus
HLTSRDGE

SEQ ID NO: 51990 - protein, 8 aa, Dengue virus
LTSRDGEP

SEQ ID NO: 51991 - protein, 8 aa, Dengue virus
TSRDGEPR

SEQ ID NO: 51992 - protein, 8 aa, Dengue virus
SRDGEPRM

SEQ ID NO: 51993 - protein, 8 aa, Dengue virus
RDGEPRMI

SEQ ID NO: 51994 - protein, 8 aa, Dengue virus
DGEPRMIV

SEQ ID NO: 51995 - protein, 8 aa, Dengue virus
GEPRMIVG

SEQ ID NO: 51996 - protein, 8 aa, Dengue virus
EPRMIVGK

SEQ ID NO: 51997 - protein, 8 aa, Dengue virus
PRMIVGKN

SEQ ID NO: 51998 - protein, 8 aa, Dengue virus
RMIVGKNE

SEQ ID NO: 51999 - protein, 8 aa, Dengue virus
MIVGKNER

SEQ ID NO: 52000 - protein, 8 aa, Dengue virus
IVGKNERG

SEQ ID NO: 52001 - protein, 8 aa, Dengue virus
VGKNERGK

SEQ ID NO: 52002 - protein, 8 aa, Dengue virus
GKNERGKS

SEQ ID NO: 52003 - protein, 8 aa, Dengue virus
KNERGKSL

SEQ ID NO: 52004 - protein, 8 aa, Dengue virus
NERGKSLL

SEQ ID NO: 52005 - protein, 8 aa, Dengue virus
ERGKSLLF

SEQ ID NO: 52006 - protein, 8 aa, Dengue virus
RGKSLLFK

SEQ ID NO: 52007 - protein, 8 aa, Dengue virus
GKSLLFKT

SEQ ID NO: 52008 - protein, 8 aa, Dengue virus
KSLLFKTA

SEQ ID NO: 52009 - protein, 8 aa, Dengue virus
SLLFKTAS

SEQ ID NO: 52010 - protein, 8 aa, Dengue virus
LLFKTASG

SEQ ID NO: 52011 - protein, 8 aa, Dengue virus
LFKTASGI

SEQ ID NO: 52012 - protein, 8 aa, Dengue virus
FKTASGIN

SEQ ID NO: 52013 - protein, 8 aa, Dengue virus
KTASGINM

SEQ ID NO: 52014 - protein, 8 aa, Dengue virus
TASGINMC

SEQ ID NO: 52015 - protein, 8 aa, Dengue virus
ASGINMCT

SEQ ID NO: 52016 - protein, 8 aa, Dengue virus
SGINMCTL

SEQ ID NO: 52017 - protein, 8 aa, Dengue virus
GINMCTLI

SEQ ID NO: 52018 - protein, 8 aa, Dengue virus
INMCTLIA

SEQ ID NO: 52019 - protein, 8 aa, Dengue virus
NMCTLIAM

SEQ ID NO: 52020 - protein, 8 aa, Dengue virus
MCTLIAMD

SEQ ID NO: 52021 - protein, 8 aa, Dengue virus
CTLIAMDL

SEQ ID NO: 52022 - protein, 8 aa, Dengue virus
TLIAMDLG

SEQ ID NO: 52023 - protein, 8 aa, Dengue virus
LIAMDLGE

SEQ ID NO: 52024 - protein, 8 aa, Dengue virus
IAMDLGEM

SEQ ID NO: 52025 - protein, 8 aa, Dengue virus
AMDLGEMC

SEQ ID NO: 52026 - protein, 8 aa, Dengue virus
MDLGEMCD

SEQ ID NO: 52027 - protein, 8 aa, Dengue virus
DLGEMCDD

SEQ ID NO: 52028 - protein, 8 aa, Dengue virus
LGEMCDDT

SEQ ID NO: 52029 - protein, 8 aa, Dengue virus
GEMCDDTV

SEQ ID NO: 52030 - protein, 8 aa, Dengue virus
EMCDDTVT

SEQ ID NO: 52031 - protein, 8 aa, Dengue virus
MCDDTVTY

SEQ ID NO: 52032 - protein, 8 aa, Dengue virus
CDDTVTYK

SEQ ID NO: 52033 - protein, 8 aa, Dengue virus
DDTVTYKC

SEQ ID NO: 52034 - protein, 8 aa, Dengue virus
DTVTYKCP

SEQ ID NO: 52035 - protein, 8 aa, Dengue virus
TVTYKCPH

SEQ ID NO: 52036 - protein, 8 aa, Dengue virus
VTYKCPHI

SEQ ID NO: 52037 - protein, 8 aa, Dengue virus
TYKCPHIT

SEQ ID NO: 52038 - protein, 8 aa, Dengue virus
YKCPHITE

SEQ ID NO: 52039 - protein, 8 aa, Dengue virus
ITEVEPED

SEQ ID NO: 52040 - protein, 8 aa, Dengue virus
TEVEPEDI

SEQ ID NO: 52041 - protein, 8 aa, Dengue virus
EVEPEDID

SEQ ID NO: 52042 - protein, 8 aa, Dengue virus
VEPEDIDC

SEQ ID NO: 52043 - protein, 8 aa, Dengue virus
EPEDIDCW

SEQ ID NO: 52044 - protein, 8 aa, Dengue virus
PEDIDCWC

SEQ ID NO: 52045 - protein, 8 aa, Dengue virus
EDIDCWCN

SEQ ID NO: 52046 - protein, 8 aa, Dengue virus
DIDCWCNL

SEQ ID NO: 52047 - protein, 8 aa, Dengue virus
IDCWCNLT

SEQ ID NO: 52048 - protein, 8 aa, Dengue virus
DCWCNLTS

SEQ ID NO: 52049 - protein, 8 aa, Dengue virus
CWCNLTST

SEQ ID NO: 52050 - protein, 8 aa, Dengue virus
WCNLTSTW

SEQ ID NO: 52051 - protein, 8 aa, Dengue virus
CNLTSTWV

SEQ ID NO: 52052 - protein, 8 aa, Dengue virus
NLTSTWVT

SEQ ID NO: 52053 - protein, 8 aa, Dengue virus
LTSTWVTY

SEQ ID NO: 52054 - protein, 8 aa, Dengue virus
TSTWVTYG

SEQ ID NO: 52055 - protein, 8 aa, Dengue virus
STWVTYGT

SEQ ID NO: 52056 - protein, 8 aa, Dengue virus
TWVTYGTC

SEQ ID NO: 52057 - protein, 8 aa, Dengue virus
WVTYGTCN

SEQ ID NO: 52058 - protein, 8 aa, Dengue virus
VTYGTCNQ

SEQ ID NO: 52059 - protein, 8 aa, Dengue virus
TYGTCNQA

SEQ ID NO: 52060 - protein, 8 aa, Dengue virus
YGTCNQAG

SEQ ID NO: 52061 - protein, 8 aa, Dengue virus
GTCNQAGE

SEQ ID NO: 52062 - protein, 8 aa, Dengue virus
TCNQAGEH

SEQ ID NO: 52063 - protein, 8 aa, Dengue virus
CNQAGEHR

SEQ ID NO: 52064 - protein, 8 aa, Dengue virus
NQAGEHRR

SEQ ID NO: 52065 - protein, 8 aa, Dengue virus
QAGEHRRD

SEQ ID NO: 52066 - protein, 8 aa, Dengue virus
AGEHRRDK

SEQ ID NO: 52067 - protein, 8 aa, Dengue virus
GEHRRDKR

SEQ ID NO: 52068 - protein, 8 aa, Dengue virus
EHRRDKRS

SEQ ID NO: 52069 - protein, 8 aa, Dengue virus
HRRDKRSV

SEQ ID NO: 52070 - protein, 8 aa, Dengue virus
RRDKRSVA

SEQ ID NO: 52071 - protein, 8 aa, Dengue virus
RDKRSVAL

SEQ ID NO: 52072 - protein, 8 aa, Dengue virus
DKRSVALA

SEQ ID NO: 52073 - protein, 8 aa, Dengue virus
KRSVALAP

SEQ ID NO: 52074 - protein, 8 aa, Dengue virus
RSVALAPH

SEQ ID NO: 52075 - protein, 8 aa, Dengue virus
SVALAPHV

SEQ ID NO: 52076 - protein, 8 aa, Dengue virus
VALAPHVG

SEQ ID NO: 52077 - protein, 8 aa, Dengue virus
ALAPHVGM

SEQ ID NO: 52078 - protein, 8 aa, Dengue virus
LAPHVGMG

SEQ ID NO: 52079 - protein, 8 aa, Dengue virus
APHVGMGL

SEQ ID NO: 52080 - protein, 8 aa, Dengue virus
PHVGMGLD

SEQ ID NO: 52081 - protein, 8 aa, Dengue virus
HVGMGLDT

SEQ ID NO: 52082 - protein, 8 aa, Dengue virus
VGMGLDTR

SEQ ID NO: 52083 - protein, 8 aa, Dengue virus
GMGLDTRT

SEQ ID NO: 52084 - protein, 8 aa, Dengue virus
MGLDTRTQ

SEQ ID NO: 52085 - protein, 8 aa, Dengue virus
GLDTRTQT

SEQ ID NO: 52086 - protein, 8 aa, Dengue virus
LDTRTQTW

SEQ ID NO: 52087 - protein, 8 aa, Dengue virus
DTRTQTWM

SEQ ID NO: 52088 - protein, 8 aa, Dengue virus
TRTQTWMS

SEQ ID NO: 52089 - protein, 8 aa, Dengue virus
RTQTWMSA

SEQ ID NO: 52090 - protein, 8 aa, Dengue virus
TQTWMSAE

SEQ ID NO: 52091 - protein, 8 aa, Dengue virus
QTWMSAEG

SEQ ID NO: 52092 - protein, 8 aa, Dengue virus
TWMSAEGA

SEQ ID NO: 52093 - protein, 8 aa, Dengue virus
WMSAEGAW

SEQ ID NO: 52094 - protein, 8 aa, Dengue virus
MSAEGAWR

SEQ ID NO: 52095 - protein, 8 aa, Dengue virus
SAEGAWRQ

SEQ ID NO: 52096 - protein, 8 aa, Dengue virus
AEGAWRQV

SEQ ID NO: 52097 - protein, 8 aa, Dengue virus
EGAWRQVE

SEQ ID NO: 52098 - protein, 8 aa, Dengue virus
GAWRQVEK

SEQ ID NO: 52099 - protein, 8 aa, Dengue virus
AWRQVEKV

SEQ ID NO: 52100 - protein, 8 aa, Dengue virus
WRQVEKVE

SEQ ID NO: 52101 - protein, 8 aa, Dengue virus
RQVEKVET

SEQ ID NO: 52102 - protein, 8 aa, Dengue virus
QVEKVETW

SEQ ID NO: 52103 - protein, 8 aa, Dengue virus
VEKVETWA

SEQ ID NO: 52104 - protein, 8 aa, Dengue virus
EKVETWAL

SEQ ID NO: 52105 - protein, 8 aa, Dengue virus
KVETWALR

SEQ ID NO: 52106 - protein, 8 aa, Dengue virus
VETWALRH

SEQ ID NO: 52107 - protein, 8 aa, Dengue virus
ETWALRHP

SEQ ID NO: 52108 - protein, 8 aa, Dengue virus
TWALRHPG

SEQ ID NO: 52109 - protein, 8 aa, Dengue virus
WALRHPGF

SEQ ID NO: 52110 - protein, 8 aa, Dengue virus
ALRHPGFT

SEQ ID NO: 52111 - protein, 8 aa, Dengue virus
LRHPGFTI

SEQ ID NO: 52112 - protein, 8 aa, Dengue virus
RHPGFTIL

SEQ ID NO: 52113 - protein, 8 aa, Dengue virus
HPGFTILA

SEQ ID NO: 52114 - protein, 8 aa, Dengue virus
PGFTILAL

SEQ ID NO: 52115 - protein, 8 aa, Dengue virus
GFTILALF

SEQ ID NO: 52116 - protein, 8 aa, Dengue virus
FTILALFL

SEQ ID NO: 52117 - protein, 8 aa, Dengue virus
TILALFLA

SEQ ID NO: 52118 - protein, 8 aa, Dengue virus
ILALFLAH

SEQ ID NO: 52119 - protein, 8 aa, Dengue virus
LALFLAHY

SEQ ID NO: 52120 - protein, 8 aa, Dengue virus
ALFLAHYI

SEQ ID NO: 52121 - protein, 8 aa, Dengue virus
LFLAHYIG

SEQ ID NO: 52122 - protein, 8 aa, Dengue virus
FLAHYIGT

SEQ ID NO: 52123 - protein, 8 aa, Dengue virus
LAHYIGTS

SEQ ID NO: 52124 - protein, 8 aa, Dengue virus
AHYIGTSL

SEQ ID NO: 52125 - protein, 8 aa, Dengue virus
HYIGTSLT

SEQ ID NO: 52126 - protein, 8 aa, Dengue virus
YIGTSLTQ

SEQ ID NO: 52127 - protein, 8 aa, Dengue virus
IGTSLTQK

SEQ ID NO: 52128 - protein, 8 aa, Dengue virus
GTSLTQKV

SEQ ID NO: 52129 - protein, 8 aa, Dengue virus
TSLTQKVV

SEQ ID NO: 52130 - protein, 8 aa, Dengue virus
SLTQKVVI

SEQ ID NO: 52131 - protein, 8 aa, Dengue virus
LTQKVVIF

SEQ ID NO: 52132 - protein, 8 aa, Dengue virus
TQKVVIFI

SEQ ID NO: 52133 - protein, 8 aa, Dengue virus
QKVVIFIL

SEQ ID NO: 52134 - protein, 8 aa, Dengue virus
KVVIFILL

SEQ ID NO: 52135 - protein, 8 aa, Dengue virus
VVIFILLM

SEQ ID NO: 52136 - protein, 8 aa, Dengue virus
VIFILLML

SEQ ID NO: 52137 - protein, 8 aa, Dengue virus
IFILLMLV

SEQ ID NO: 52138 - protein, 8 aa, Dengue virus
FILLMLVT

SEQ ID NO: 52139 - protein, 8 aa, Dengue virus
ILLMLVTP

SEQ ID NO: 52140 - protein, 8 aa, Dengue virus
LLMLVTPS

SEQ ID NO: 52141 - protein, 8 aa, Dengue virus
LMLVTPSM

SEQ ID NO: 52142 - protein, 8 aa, Dengue virus
MLVTPSMT

SEQ ID NO: 52143 - protein, 8 aa, Dengue virus
LVTPSMTM

SEQ ID NO: 52144 - protein, 8 aa, Dengue virus
VTPSMTMR

SEQ ID NO: 52145 - protein, 8 aa, Dengue virus
TPSMTMRC

SEQ ID NO: 52146 - protein, 8 aa, Dengue virus
PSMTMRCV

SEQ ID NO: 52147 - protein, 8 aa, Dengue virus
SMTMRCVG

SEQ ID NO: 52148 - protein, 8 aa, Dengue virus
MTMRCVGV

SEQ ID NO: 52149 - protein, 8 aa, Dengue virus
TMRCVGVG

SEQ ID NO: 52150 - protein, 8 aa, Dengue virus
MRCVGVGN

SEQ ID NO: 52151 - protein, 8 aa, Dengue virus
RCVGVGNR

SEQ ID NO: 52152 - protein, 8 aa, Dengue virus
CVGVGNRD

SEQ ID NO: 52153 - protein, 8 aa, Dengue virus
VGVGNRDF

SEQ ID NO: 52154 - protein, 8 aa, Dengue virus
GVGNRDFV

SEQ ID NO: 52155 - protein, 8 aa, Dengue virus
VGNRDFVE

SEQ ID NO: 52156 - protein, 8 aa, Dengue virus
GNRDFVEG

SEQ ID NO: 52157 - protein, 8 aa, Dengue virus
NRDFVEGL

SEQ ID NO: 52158 - protein, 8 aa, Dengue virus
RDFVEGLS

SEQ ID NO: 52159 - protein, 8 aa, Dengue virus
DFVEGLSG

SEQ ID NO: 52160 - protein, 8 aa, Dengue virus
FVEGLSGA

SEQ ID NO: 52161 - protein, 8 aa, Dengue virus
VEGLSGAT

SEQ ID NO: 52162 - protein, 8 aa, Dengue virus
EGLSGATW

SEQ ID NO: 52163 - protein, 8 aa, Dengue virus
GLSGATWV

SEQ ID NO: 52164 - protein, 8 aa, Dengue virus
LSGATWVD

SEQ ID NO: 52165 - protein, 8 aa, Dengue virus
SGATWVDV

SEQ ID NO: 52166 - protein, 8 aa, Dengue virus
GATWVDVV

SEQ ID NO: 52167 - protein, 8 aa, Dengue virus
ATWVDVVL

SEQ ID NO: 52168 - protein, 8 aa, Dengue virus
TWVDVVLE

SEQ ID NO: 52169 - protein, 8 aa, Dengue virus
WVDVVLEH

SEQ ID NO: 52170 - protein, 8 aa, Dengue virus
VDVVLEHG

SEQ ID NO: 52171 - protein, 8 aa, Dengue virus
DVVLEHGG

SEQ ID NO: 52172 - protein, 8 aa, Dengue virus
VVLEHGGC

SEQ ID NO: 52173 - protein, 8 aa, Dengue virus
VLEHGGCV

SEQ ID NO: 52174 - protein, 8 aa, Dengue virus
LEHGGCVT

SEQ ID NO: 52175 - protein, 8 aa, Dengue virus
EHGGCVTT

SEQ ID NO: 52176 - protein, 8 aa, Dengue virus
HGGCVTTM

SEQ ID NO: 52177 - protein, 8 aa, Dengue virus
GGCVTTMA

SEQ ID NO: 52178 - protein, 8 aa, Dengue virus
GCVTTMAK

SEQ ID NO: 52179 - protein, 8 aa, Dengue virus
CVTTMAKN

SEQ ID NO: 52180 - protein, 8 aa, Dengue virus
VTTMAKNK

SEQ ID NO: 52181 - protein, 8 aa, Dengue virus
TTMAKNKP

SEQ ID NO: 52182 - protein, 8 aa, Dengue virus
TMAKNKPT

SEQ ID NO: 52183 - protein, 8 aa, Dengue virus
MAKNKPTL

SEQ ID NO: 52184 - protein, 8 aa, Dengue virus
AKNKPTLD

SEQ ID NO: 52185 - protein, 8 aa, Dengue virus
KNKPTLDI

SEQ ID NO: 52186 - protein, 8 aa, Dengue virus
NKPTLDIE

SEQ ID NO: 52187 - protein, 8 aa, Dengue virus
KPTLDIEL

SEQ ID NO: 52188 - protein, 8 aa, Dengue virus
PTLDIELQ

SEQ ID NO: 52189 - protein, 8 aa, Dengue virus
TLDIELQK

SEQ ID NO: 52190 - protein, 8 aa, Dengue virus
LDIELQKT

SEQ ID NO: 52191 - protein, 8 aa, Dengue virus
DIELQKTE

SEQ ID NO: 52192 - protein, 8 aa, Dengue virus
IELQKTEA

SEQ ID NO: 52193 - protein, 8 aa, Dengue virus
ELQKTEAT

SEQ ID NO: 52194 - protein, 8 aa, Dengue virus
LQKTEATQ

SEQ ID NO: 52195 - protein, 8 aa, Dengue virus
QKTEATQL

SEQ ID NO: 52196 - protein, 8 aa, Dengue virus
KTEATQLA

SEQ ID NO: 52197 - protein, 8 aa, Dengue virus
TEATQLAT

SEQ ID NO: 52198 - protein, 8 aa, Dengue virus
EATQLATL

SEQ ID NO: 52199 - protein, 8 aa, Dengue virus
ATQLATLR

SEQ ID NO: 52200 - protein, 8 aa, Dengue virus
TQLATLRK

SEQ ID NO: 52201 - protein, 8 aa, Dengue virus
QLATLRKL

SEQ ID NO: 52202 - protein, 8 aa, Dengue virus
LATLRKLC

SEQ ID NO: 52203 - protein, 8 aa, Dengue virus
ATLRKLCI

SEQ ID NO: 52204 - protein, 8 aa, Dengue virus
TLRKLCIE

SEQ ID NO: 52205 - protein, 8 aa, Dengue virus
LRKLCIEG

SEQ ID NO: 52206 - protein, 8 aa, Dengue virus
RKLCIEGK

SEQ ID NO: 52207 - protein, 8 aa, Dengue virus
KLCIEGKI

SEQ ID NO: 52208 - protein, 8 aa, Dengue virus
LCIEGKIT

SEQ ID NO: 52209 - protein, 8 aa, Dengue virus
CIEGKITN

SEQ ID NO: 52210 - protein, 8 aa, Dengue virus
IEGKITNI

SEQ ID NO: 52211 - protein, 8 aa, Dengue virus
EGKITNIT

SEQ ID NO: 52212 - protein, 8 aa, Dengue virus
GKITNITT

SEQ ID NO: 52213 - protein, 8 aa, Dengue virus
KITNITTD

SEQ ID NO: 52214 - protein, 8 aa, Dengue virus
ITNITTDS

SEQ ID NO: 52215 - protein, 8 aa, Dengue virus
TNITTDSR

SEQ ID NO: 52216 - protein, 8 aa, Dengue virus
NITTDSRC

SEQ ID NO: 52217 - protein, 8 aa, Dengue virus
ITTDSRCP

SEQ ID NO: 52218 - protein, 8 aa, Dengue virus
TTDSRCPT

SEQ ID NO: 52219 - protein, 8 aa, Dengue virus
TDSRCPTQ

SEQ ID NO: 52220 - protein, 8 aa, Dengue virus
DSRCPTQG

SEQ ID NO: 52221 - protein, 8 aa, Dengue virus
SRCPTQGE

SEQ ID NO: 52222 - protein, 8 aa, Dengue virus
RCPTQGEA

SEQ ID NO: 52223 - protein, 8 aa, Dengue virus
CPTQGEAV

SEQ ID NO: 52224 - protein, 8 aa, Dengue virus
PTQGEAVL

SEQ ID NO: 52225 - protein, 8 aa, Dengue virus
TQGEAVLP

SEQ ID NO: 52226 - protein, 8 aa, Dengue virus
QGEAVLPE

SEQ ID NO: 52227 - protein, 8 aa, Dengue virus
GEAVLPEE

SEQ ID NO: 52228 - protein, 8 aa, Dengue virus
EAVLPEEQ

SEQ ID NO: 52229 - protein, 8 aa, Dengue virus
AVLPEEQD

SEQ ID NO: 52230 - protein, 8 aa, Dengue virus
VLPEEQDQ

SEQ ID NO: 52231 - protein, 8 aa, Dengue virus
LPEEQDQN

SEQ ID NO: 52232 - protein, 8 aa, Dengue virus
PEEQDQNY

SEQ ID NO: 52233 - protein, 8 aa, Dengue virus
EEQDQNYV

SEQ ID NO: 52234 - protein, 8 aa, Dengue virus
EQDQNYVC

SEQ ID NO: 52235 - protein, 8 aa, Dengue virus
QDQNYVCK

SEQ ID NO: 52236 - protein, 8 aa, Dengue virus
DQNYVCKH

SEQ ID NO: 52237 - protein, 8 aa, Dengue virus
QNYVCKHT

SEQ ID NO: 52238 - protein, 8 aa, Dengue virus
NYVCKHTY

SEQ ID NO: 52239 - protein, 8 aa, Dengue virus
YVCKHTYV

SEQ ID NO: 52240 - protein, 8 aa, Dengue virus
VCKHTYVD

SEQ ID NO: 52241 - protein, 8 aa, Dengue virus
CKHTYVDR

SEQ ID NO: 52242 - protein, 8 aa, Dengue virus
KHTYVDRG

SEQ ID NO: 52243 - protein, 8 aa, Dengue virus
HTYVDRGW

SEQ ID NO: 52244 - protein, 8 aa, Dengue virus
TYVDRGWG

SEQ ID NO: 52245 - protein, 8 aa, Dengue virus
YVDRGWGN

SEQ ID NO: 52246 - protein, 8 aa, Dengue virus
VDRGWGNG

SEQ ID NO: 52247 - protein, 8 aa, Dengue virus
DRGWGNGC

SEQ ID NO: 52248 - protein, 8 aa, Dengue virus
RGWGNGCG

SEQ ID NO: 52249 - protein, 8 aa, Dengue virus
GWGNGCGL

SEQ ID NO: 52250 - protein, 8 aa, Dengue virus
WGNGCGLF

SEQ ID NO: 52251 - protein, 8 aa, Dengue virus
GNGCGLFG

SEQ ID NO: 52252 - protein, 8 aa, Dengue virus
NGCGLFGK

SEQ ID NO: 52253 - protein, 8 aa, Dengue virus
GCGLFGKG

SEQ ID NO: 52254 - protein, 8 aa, Dengue virus
CGLFGKGS

SEQ ID NO: 52255 - protein, 8 aa, Dengue virus
GLFGKGSL

SEQ ID NO: 52256 - protein, 8 aa, Dengue virus
LFGKGSLV

SEQ ID NO: 52257 - protein, 8 aa, Dengue virus
FGKGSLVT

SEQ ID NO: 52258 - protein, 8 aa, Dengue virus
GKGSLVTC

SEQ ID NO: 52259 - protein, 8 aa, Dengue virus
KGSLVTCA

SEQ ID NO: 52260 - protein, 8 aa, Dengue virus
GSLVTCAK

SEQ ID NO: 52261 - protein, 8 aa, Dengue virus
SLVTCAKF

SEQ ID NO: 52262 - protein, 8 aa, Dengue virus
LVTCAKFQ

SEQ ID NO: 52263 - protein, 8 aa, Dengue virus
VTCAKFQC

SEQ ID NO: 52264 - protein, 8 aa, Dengue virus
TCAKFQCL

SEQ ID NO: 52265 - protein, 8 aa, Dengue virus
CAKFQCLE

SEQ ID NO: 52266 - protein, 8 aa, Dengue virus
AKFQCLEP

SEQ ID NO: 52267 - protein, 8 aa, Dengue virus
KFQCLEPI

SEQ ID NO: 52268 - protein, 8 aa, Dengue virus
FQCLEPIE

SEQ ID NO: 52269 - protein, 8 aa, Dengue virus
QCLEPIEG

SEQ ID NO: 52270 - protein, 8 aa, Dengue virus
CLEPIEGK

SEQ ID NO: 52271 - protein, 8 aa, Dengue virus
PIEGKVVQ

SEQ ID NO: 52272 - protein, 8 aa, Dengue virus
IEGKVVQY

SEQ ID NO: 52273 - protein, 8 aa, Dengue virus
EGKVVQYE

SEQ ID NO: 52274 - protein, 8 aa, Dengue virus
GKVVQYEN

SEQ ID NO: 52275 - protein, 8 aa, Dengue virus
KVVQYENL

SEQ ID NO: 52276 - protein, 8 aa, Dengue virus
VVQYENLK

SEQ ID NO: 52277 - protein, 8 aa, Dengue virus
VQYENLKY

SEQ ID NO: 52278 - protein, 8 aa, Dengue virus
QYENLKYT

SEQ ID NO: 52279 - protein, 8 aa, Dengue virus
YENLKYTV

SEQ ID NO: 52280 - protein, 8 aa, Dengue virus
ENLKYTVI

SEQ ID NO: 52281 - protein, 8 aa, Dengue virus
NLKYTVII

SEQ ID NO: 52282 - protein, 8 aa, Dengue virus
LKYTVIIT

SEQ ID NO: 52283 - protein, 8 aa, Dengue virus
KYTVIITV

SEQ ID NO: 52284 - protein, 8 aa, Dengue virus
YTVIITVH

SEQ ID NO: 52285 - protein, 8 aa, Dengue virus
TVIITVHT

SEQ ID NO: 52286 - protein, 8 aa, Dengue virus
VIITVHTG

SEQ ID NO: 52287 - protein, 8 aa, Dengue virus
IITVHTGD

SEQ ID NO: 52288 - protein, 8 aa, Dengue virus
ITVHTGDQ

SEQ ID NO: 52289 - protein, 8 aa, Dengue virus
TVHTGDQH

SEQ ID NO: 52290 - protein, 8 aa, Dengue virus
VHTGDQHQ

SEQ ID NO: 52291 - protein, 8 aa, Dengue virus
HTGDQHQV

SEQ ID NO: 52292 - protein, 8 aa, Dengue virus
TGDQHQVG

SEQ ID NO: 52293 - protein, 8 aa, Dengue virus
GDQHQVGN

SEQ ID NO: 52294 - protein, 8 aa, Dengue virus
DQHQVGNE

SEQ ID NO: 52295 - protein, 8 aa, Dengue virus
QHQVGNET

SEQ ID NO: 52296 - protein, 8 aa, Dengue virus
HQVGNETQ

SEQ ID NO: 52297 - protein, 8 aa, Dengue virus
QVGNETQG

SEQ ID NO: 52298 - protein, 8 aa, Dengue virus
VGNETQGV

SEQ ID NO: 52299 - protein, 8 aa, Dengue virus
GNETQGVT

SEQ ID NO: 52300 - protein, 8 aa, Dengue virus
NETQGVTA

SEQ ID NO: 52301 - protein, 8 aa, Dengue virus
ETQGVTAE

SEQ ID NO: 52302 - protein, 8 aa, Dengue virus
TQGVTAEI

SEQ ID NO: 52303 - protein, 8 aa, Dengue virus
QGVTAEIT

SEQ ID NO: 52304 - protein, 8 aa, Dengue virus
GVTAEITP

SEQ ID NO: 52305 - protein, 8 aa, Dengue virus
VTAEITPQ

SEQ ID NO: 52306 - protein, 8 aa, Dengue virus
TAEITPQA

SEQ ID NO: 52307 - protein, 8 aa, Dengue virus
AEITPQAS

SEQ ID NO: 52308 - protein, 8 aa, Dengue virus
EITPQAST

SEQ ID NO: 52309 - protein, 8 aa, Dengue virus
ITPQASTT

SEQ ID NO: 52310 - protein, 8 aa, Dengue virus
TPQASTTE

SEQ ID NO: 52311 - protein, 8 aa, Dengue virus
PQASTTEA

SEQ ID NO: 52312 - protein, 8 aa, Dengue virus
QASTTEAI

SEQ ID NO: 52313 - protein, 8 aa, Dengue virus
ASTTEAIL

SEQ ID NO: 52314 - protein, 8 aa, Dengue virus
TEAILPEY

SEQ ID NO: 52315 - protein, 8 aa, Dengue virus
EAILPEYG

SEQ ID NO: 52316 - protein, 8 aa, Dengue virus
AILPEYGT

SEQ ID NO: 52317 - protein, 8 aa, Dengue virus
ILPEYGTL

SEQ ID NO: 52318 - protein, 8 aa, Dengue virus
LPEYGTLG

SEQ ID NO: 52319 - protein, 8 aa, Dengue virus
PEYGTLGL

SEQ ID NO: 52320 - protein, 8 aa, Dengue virus
EYGTLGLE

SEQ ID NO: 52321 - protein, 8 aa, Dengue virus
YGTLGLEC

SEQ ID NO: 52322 - protein, 8 aa, Dengue virus
GTLGLECS

SEQ ID NO: 52323 - protein, 8 aa, Dengue virus
TLGLECSP

SEQ ID NO: 52324 - protein, 8 aa, Dengue virus
LGLECSPR

SEQ ID NO: 52325 - protein, 8 aa, Dengue virus
GLECSPRT

SEQ ID NO: 52326 - protein, 8 aa, Dengue virus
LECSPRTG

SEQ ID NO: 52327 - protein, 8 aa, Dengue virus
ECSPRTGL

SEQ ID NO: 52328 - protein, 8 aa, Dengue virus
CSPRTGLD

SEQ ID NO: 52329 - protein, 8 aa, Dengue virus
SPRTGLDF

SEQ ID NO: 52330 - protein, 8 aa, Dengue virus
PRTGLDFN

SEQ ID NO: 52331 - protein, 8 aa, Dengue virus
RTGLDFNE

SEQ ID NO: 52332 - protein, 8 aa, Dengue virus
TGLDFNEM

SEQ ID NO: 52333 - protein, 8 aa, Dengue virus
GLDFNEMI

SEQ ID NO: 52334 - protein, 8 aa, Dengue virus
LDFNEMIL

SEQ ID NO: 52335 - protein, 8 aa, Dengue virus
DFNEMILL

SEQ ID NO: 52336 - protein, 8 aa, Dengue virus
FNEMILLT

SEQ ID NO: 52337 - protein, 8 aa, Dengue virus
NEMILLTM

SEQ ID NO: 52338 - protein, 8 aa, Dengue virus
EMILLTMK

SEQ ID NO: 52339 - protein, 8 aa, Dengue virus
MILLTMKN

SEQ ID NO: 52340 - protein, 8 aa, Dengue virus
ILLTMKNK

SEQ ID NO: 52341 - protein, 8 aa, Dengue virus
LLTMKNKA

SEQ ID NO: 52342 - protein, 8 aa, Dengue virus
LTMKNKAW

SEQ ID NO: 52343 - protein, 8 aa, Dengue virus
TMKNKAWM

SEQ ID NO: 52344 - protein, 8 aa, Dengue virus
MKNKAWMV

SEQ ID NO: 52345 - protein, 8 aa, Dengue virus
KNKAWMVH

SEQ ID NO: 52346 - protein, 8 aa, Dengue virus
NKAWMVHR

SEQ ID NO: 52347 - protein, 8 aa, Dengue virus
KAWMVHRQ

SEQ ID NO: 52348 - protein, 8 aa, Dengue virus
AWMVHRQW

SEQ ID NO: 52349 - protein, 8 aa, Dengue virus
WMVHRQWF

SEQ ID NO: 52350 - protein, 8 aa, Dengue virus
MVHRQWFF

SEQ ID NO: 52351 - protein, 8 aa, Dengue virus
VHRQWFFD

SEQ ID NO: 52352 - protein, 8 aa, Dengue virus
HRQWFFDL

SEQ ID NO: 52353 - protein, 8 aa, Dengue virus
RQWFFDLP

SEQ ID NO: 52354 - protein, 8 aa, Dengue virus
QWFFDLPL

SEQ ID NO: 52355 - protein, 8 aa, Dengue virus
WFFDLPLP

SEQ ID NO: 52356 - protein, 8 aa, Dengue virus
FFDLPLPW

SEQ ID NO: 52357 - protein, 8 aa, Dengue virus
FDLPLPWT

SEQ ID NO: 52358 - protein, 8 aa, Dengue virus
DLPLPWTS

SEQ ID NO: 52359 - protein, 8 aa, Dengue virus
LPLPWTSG

SEQ ID NO: 52360 - protein, 8 aa, Dengue virus
PLPWTSGA

SEQ ID NO: 52361 - protein, 8 aa, Dengue virus
LPWTSGAT

SEQ ID NO: 52362 - protein, 8 aa, Dengue virus
PWTSGATT

SEQ ID NO: 52363 - protein, 8 aa, Dengue virus
TTETPTWN

SEQ ID NO: 52364 - protein, 8 aa, Dengue virus
TETPTWNR

SEQ ID NO: 52365 - protein, 8 aa, Dengue virus
ETPTWNRK

SEQ ID NO: 52366 - protein, 8 aa, Dengue virus
TPTWNRKE

SEQ ID NO: 52367 - protein, 8 aa, Dengue virus
PTWNRKEL

SEQ ID NO: 52368 - protein, 8 aa, Dengue virus
TWNRKELL

SEQ ID NO: 52369 - protein, 8 aa, Dengue virus
WNRKELLV

SEQ ID NO: 52370 - protein, 8 aa, Dengue virus
NRKELLVT

SEQ ID NO: 52371 - protein, 8 aa, Dengue virus
RKELLVTF

SEQ ID NO: 52372 - protein, 8 aa, Dengue virus
KELLVTFK

SEQ ID NO: 52373 - protein, 8 aa, Dengue virus
ELLVTFKN

SEQ ID NO: 52374 - protein, 8 aa, Dengue virus
LLVTFKNA

SEQ ID NO: 52375 - protein, 8 aa, Dengue virus
LVTFKNAH

SEQ ID NO: 52376 - protein, 8 aa, Dengue virus
VTFKNAHA

SEQ ID NO: 52377 - protein, 8 aa, Dengue virus
TFKNAHAK

SEQ ID NO: 52378 - protein, 8 aa, Dengue virus
FKNAHAKK

SEQ ID NO: 52379 - protein, 8 aa, Dengue virus
KNAHAKKQ

SEQ ID NO: 52380 - protein, 8 aa, Dengue virus
NAHAKKQE

SEQ ID NO: 52381 - protein, 8 aa, Dengue virus
AHAKKQEV

SEQ ID NO: 52382 - protein, 8 aa, Dengue virus
HAKKQEVV

SEQ ID NO: 52383 - protein, 8 aa, Dengue virus
AKKQEVVV

SEQ ID NO: 52384 - protein, 8 aa, Dengue virus
KKQEVVVL

SEQ ID NO: 52385 - protein, 8 aa, Dengue virus
KQEVVVLG

SEQ ID NO: 52386 - protein, 8 aa, Dengue virus
QEVVVLGS

SEQ ID NO: 52387 - protein, 8 aa, Dengue virus
EVVVLGSQ

SEQ ID NO: 52388 - protein, 8 aa, Dengue virus
VVVLGSQE

SEQ ID NO: 52389 - protein, 8 aa, Dengue virus
VVLGSQEG

SEQ ID NO: 52390 - protein, 8 aa, Dengue virus
VLGSQEGA

SEQ ID NO: 52391 - protein, 8 aa, Dengue virus
LGSQEGAM

SEQ ID NO: 52392 - protein, 8 aa, Dengue virus
GSQEGAMH

SEQ ID NO: 52393 - protein, 8 aa, Dengue virus
SQEGAMHT

SEQ ID NO: 52394 - protein, 8 aa, Dengue virus
QEGAMHTA

SEQ ID NO: 52395 - protein, 8 aa, Dengue virus
EGAMHTAL

SEQ ID NO: 52396 - protein, 8 aa, Dengue virus
GAMHTALT

SEQ ID NO: 52397 - protein, 8 aa, Dengue virus
AMHTALTG

SEQ ID NO: 52398 - protein, 8 aa, Dengue virus
MHTALTGA

SEQ ID NO: 52399 - protein, 8 aa, Dengue virus
HTALTGAT

SEQ ID NO: 52400 - protein, 8 aa, Dengue virus
TALTGATE

SEQ ID NO: 52401 - protein, 8 aa, Dengue virus
ALTGATEI

SEQ ID NO: 52402 - protein, 8 aa, Dengue virus
LTGATEIQ

SEQ ID NO: 52403 - protein, 8 aa, Dengue virus
TGATEIQN

SEQ ID NO: 52404 - protein, 8 aa, Dengue virus
GATEIQNS

SEQ ID NO: 52405 - protein, 8 aa, Dengue virus
ATEIQNSG

SEQ ID NO: 52406 - protein, 8 aa, Dengue virus
TEIQNSGG

SEQ ID NO: 52407 - protein, 8 aa, Dengue virus
EIQNSGGT

SEQ ID NO: 52408 - protein, 8 aa, Dengue virus
IQNSGGTS

SEQ ID NO: 52409 - protein, 8 aa, Dengue virus
QNSGGTSI

SEQ ID NO: 52410 - protein, 8 aa, Dengue virus
NSGGTSIF

SEQ ID NO: 52411 - protein, 8 aa, Dengue virus
SGGTSIFA

SEQ ID NO: 52412 - protein, 8 aa, Dengue virus
GGTSIFAG

SEQ ID NO: 52413 - protein, 8 aa, Dengue virus
GTSIFAGH

SEQ ID NO: 52414 - protein, 8 aa, Dengue virus
TSIFAGHL

SEQ ID NO: 52415 - protein, 8 aa, Dengue virus
SIFAGHLK

SEQ ID NO: 52416 - protein, 8 aa, Dengue virus
IFAGHLKC

SEQ ID NO: 52417 - protein, 8 aa, Dengue virus
FAGHLKCR

SEQ ID NO: 52418 - protein, 8 aa, Dengue virus
AGHLKCRL

SEQ ID NO: 52419 - protein, 8 aa, Dengue virus
GHLKCRLK

SEQ ID NO: 52420 - protein, 8 aa, Dengue virus
HLKCRLKM

SEQ ID NO: 52421 - protein, 8 aa, Dengue virus
LKCRLKMD

SEQ ID NO: 52422 - protein, 8 aa, Dengue virus
KCRLKMDK

SEQ ID NO: 52423 - protein, 8 aa, Dengue virus
CRLKMDKL

SEQ ID NO: 52424 - protein, 8 aa, Dengue virus
RLKMDKLE

SEQ ID NO: 52425 - protein, 8 aa, Dengue virus
LKMDKLEL

SEQ ID NO: 52426 - protein, 8 aa, Dengue virus
KMDKLELK

SEQ ID NO: 52427 - protein, 8 aa, Dengue virus
MDKLELKG

SEQ ID NO: 52428 - protein, 8 aa, Dengue virus
DKLELKGM

SEQ ID NO: 52429 - protein, 8 aa, Dengue virus
KLELKGMS

SEQ ID NO: 52430 - protein, 8 aa, Dengue virus
LELKGMSY

SEQ ID NO: 52431 - protein, 8 aa, Dengue virus
ELKGMSYA

SEQ ID NO: 52432 - protein, 8 aa, Dengue virus
LKGMSYAM

SEQ ID NO: 52433 - protein, 8 aa, Dengue virus
KGMSYAMC

SEQ ID NO: 52434 - protein, 8 aa, Dengue virus
GMSYAMCT

SEQ ID NO: 52435 - protein, 8 aa, Dengue virus
MSYAMCTN

SEQ ID NO: 52436 - protein, 8 aa, Dengue virus
SYAMCTNT

SEQ ID NO: 52437 - protein, 8 aa, Dengue virus
YAMCTNTF

SEQ ID NO: 52438 - protein, 8 aa, Dengue virus
AMCTNTFV

SEQ ID NO: 52439 - protein, 8 aa, Dengue virus
MCTNTFVL

SEQ ID NO: 52440 - protein, 8 aa, Dengue virus
NTFVLKKE

SEQ ID NO: 52441 - protein, 8 aa, Dengue virus
TFVLKKEV

SEQ ID NO: 52442 - protein, 8 aa, Dengue virus
FVLKKEVS

SEQ ID NO: 52443 - protein, 8 aa, Dengue virus
VLKKEVSE

SEQ ID NO: 52444 - protein, 8 aa, Dengue virus
LKKEVSET

SEQ ID NO: 52445 - protein, 8 aa, Dengue virus
KKEVSETQ

SEQ ID NO: 52446 - protein, 8 aa, Dengue virus
KEVSETQH

SEQ ID NO: 52447 - protein, 8 aa, Dengue virus
EVSETQHG

SEQ ID NO: 52448 - protein, 8 aa, Dengue virus
VSETQHGT

SEQ ID NO: 52449 - protein, 8 aa, Dengue virus
SETQHGTI

SEQ ID NO: 52450 - protein, 8 aa, Dengue virus
ETQHGTIL

SEQ ID NO: 52451 - protein, 8 aa, Dengue virus
TQHGTILI

SEQ ID NO: 52452 - protein, 8 aa, Dengue virus
QHGTILIK

SEQ ID NO: 52453 - protein, 8 aa, Dengue virus
HGTILIKV

SEQ ID NO: 52454 - protein, 8 aa, Dengue virus
GTILIKVE

SEQ ID NO: 52455 - protein, 8 aa, Dengue virus
TILIKVEY

SEQ ID NO: 52456 - protein, 8 aa, Dengue virus
ILIKVEYK

SEQ ID NO: 52457 - protein, 8 aa, Dengue virus
LIKVEYKG

SEQ ID NO: 52458 - protein, 8 aa, Dengue virus
IKVEYKGE

SEQ ID NO: 52459 - protein, 8 aa, Dengue virus
KVEYKGED

SEQ ID NO: 52460 - protein, 8 aa, Dengue virus
VEYKGEDA

SEQ ID NO: 52461 - protein, 8 aa, Dengue virus
EYKGEDAP

SEQ ID NO: 52462 - protein, 8 aa, Dengue virus
YKGEDAPC

SEQ ID NO: 52463 - protein, 8 aa, Dengue virus
KGEDAPCK

SEQ ID NO: 52464 - protein, 8 aa, Dengue virus
GEDAPCKI

SEQ ID NO: 52465 - protein, 8 aa, Dengue virus
EDAPCKIP

SEQ ID NO: 52466 - protein, 8 aa, Dengue virus
DAPCKIPF

SEQ ID NO: 52467 - protein, 8 aa, Dengue virus
APCKIPFS

SEQ ID NO: 52468 - protein, 8 aa, Dengue virus
PCKIPFST

SEQ ID NO: 52469 - protein, 8 aa, Dengue virus
CKIPFSTE

SEQ ID NO: 52470 - protein, 8 aa, Dengue virus
KIPFSTED

SEQ ID NO: 52471 - protein, 8 aa, Dengue virus
IPFSTEDG

SEQ ID NO: 52472 - protein, 8 aa, Dengue virus
PFSTEDGQ

SEQ ID NO: 52473 - protein, 8 aa, Dengue virus
FSTEDGQG

SEQ ID NO: 52474 - protein, 8 aa, Dengue virus
STEDGQGK

SEQ ID NO: 52475 - protein, 8 aa, Dengue virus
TEDGQGKA

SEQ ID NO: 52476 - protein, 8 aa, Dengue virus
EDGQGKAH

SEQ ID NO: 52477 - protein, 8 aa, Dengue virus
DGQGKAHN

SEQ ID NO: 52478 - protein, 8 aa, Dengue virus
GQGKAHNG

SEQ ID NO: 52479 - protein, 8 aa, Dengue virus
QGKAHNGR

SEQ ID NO: 52480 - protein, 8 aa, Dengue virus
GKAHNGRL

SEQ ID NO: 52481 - protein, 8 aa, Dengue virus
KAHNGRLI

SEQ ID NO: 52482 - protein, 8 aa, Dengue virus
AHNGRLIT

SEQ ID NO: 52483 - protein, 8 aa, Dengue virus
HNGRLITA

SEQ ID NO: 52484 - protein, 8 aa, Dengue virus
NGRLITAN

SEQ ID NO: 52485 - protein, 8 aa, Dengue virus
GRLITANP

SEQ ID NO: 52486 - protein, 8 aa, Dengue virus
RLITANPV

SEQ ID NO: 52487 - protein, 8 aa, Dengue virus
LITANPVV

SEQ ID NO: 52488 - protein, 8 aa, Dengue virus
ITANPVVT

SEQ ID NO: 52489 - protein, 8 aa, Dengue virus
TANPVVTK

SEQ ID NO: 52490 - protein, 8 aa, Dengue virus
ANPVVTKK

SEQ ID NO: 52491 - protein, 8 aa, Dengue virus
NPVVTKKE

SEQ ID NO: 52492 - protein, 8 aa, Dengue virus
PVVTKKEE

SEQ ID NO: 52493 - protein, 8 aa, Dengue virus
VVTKKEEP

SEQ ID NO: 52494 - protein, 8 aa, Dengue virus
VTKKEEPV

SEQ ID NO: 52495 - protein, 8 aa, Dengue virus
TKKEEPVN

SEQ ID NO: 52496 - protein, 8 aa, Dengue virus
KKEEPVNI

SEQ ID NO: 52497 - protein, 8 aa, Dengue virus
KEEPVNIE

SEQ ID NO: 52498 - protein, 8 aa, Dengue virus
EEPVNIEA

SEQ ID NO: 52499 - protein, 8 aa, Dengue virus
EPVNIEAE

SEQ ID NO: 52500 - protein, 8 aa, Dengue virus
PVNIEAEP

SEQ ID NO: 52501 - protein, 8 aa, Dengue virus
VNIEAEPP

SEQ ID NO: 52502 - protein, 8 aa, Dengue virus
NIEAEPPF

SEQ ID NO: 52503 - protein, 8 aa, Dengue virus
IEAEPPFG

SEQ ID NO: 52504 - protein, 8 aa, Dengue virus
EAEPPFGE

SEQ ID NO: 52505 - protein, 8 aa, Dengue virus
AEPPFGES

SEQ ID NO: 52506 - protein, 8 aa, Dengue virus
EPPFGESN

SEQ ID NO: 52507 - protein, 8 aa, Dengue virus
PPFGESNI

SEQ ID NO: 52508 - protein, 8 aa, Dengue virus
PFGESNIV

SEQ ID NO: 52509 - protein, 8 aa, Dengue virus
FGESNIVI

SEQ ID NO: 52510 - protein, 8 aa, Dengue virus
GESNIVIG

SEQ ID NO: 52511 - protein, 8 aa, Dengue virus
ESNIVIGI

SEQ ID NO: 52512 - protein, 8 aa, Dengue virus
SNIVIGIG

SEQ ID NO: 52513 - protein, 8 aa, Dengue virus
NIVIGIGD

SEQ ID NO: 52514 - protein, 8 aa, Dengue virus
GDNALKIN

SEQ ID NO: 52515 - protein, 8 aa, Dengue virus
DNALKINW

SEQ ID NO: 52516 - protein, 8 aa, Dengue virus
NALKINWY

SEQ ID NO: 52517 - protein, 8 aa, Dengue virus
ALKINWYK

SEQ ID NO: 52518 - protein, 8 aa, Dengue virus
LKINWYKK

SEQ ID NO: 52519 - protein, 8 aa, Dengue virus
KINWYKKG

SEQ ID NO: 52520 - protein, 8 aa, Dengue virus
INWYKKGS

SEQ ID NO: 52521 - protein, 8 aa, Dengue virus
NWYKKGSS

SEQ ID NO: 52522 - protein, 8 aa, Dengue virus
WYKKGSSI

SEQ ID NO: 52523 - protein, 8 aa, Dengue virus
YKKGSSIG

SEQ ID NO: 52524 - protein, 8 aa, Dengue virus
KKGSSIGK

SEQ ID NO: 52525 - protein, 8 aa, Dengue virus
KGSSIGKM

SEQ ID NO: 52526 - protein, 8 aa, Dengue virus
GSSIGKMF

SEQ ID NO: 52527 - protein, 8 aa, Dengue virus
SSIGKMFE

SEQ ID NO: 52528 - protein, 8 aa, Dengue virus
SIGKMFEA

SEQ ID NO: 52529 - protein, 8 aa, Dengue virus
IGKMFEAT

SEQ ID NO: 52530 - protein, 8 aa, Dengue virus
GKMFEATA

SEQ ID NO: 52531 - protein, 8 aa, Dengue virus
KMFEATAR

SEQ ID NO: 52532 - protein, 8 aa, Dengue virus
MFEATARG

SEQ ID NO: 52533 - protein, 8 aa, Dengue virus
FEATARGA

SEQ ID NO: 52534 - protein, 8 aa, Dengue virus
EATARGAR

SEQ ID NO: 52535 - protein, 8 aa, Dengue virus
ATARGARR

SEQ ID NO: 52536 - protein, 8 aa, Dengue virus
TARGARRM

SEQ ID NO: 52537 - protein, 8 aa, Dengue virus
ARGARRMA

SEQ ID NO: 52538 - protein, 8 aa, Dengue virus
RGARRMAI

SEQ ID NO: 52539 - protein, 8 aa, Dengue virus
GARRMAIL

SEQ ID NO: 52540 - protein, 8 aa, Dengue virus
ARRMAILG

SEQ ID NO: 52541 - protein, 8 aa, Dengue virus
RRMAILGD

SEQ ID NO: 52542 - protein, 8 aa, Dengue virus
RMAILGDT

SEQ ID NO: 52543 - protein, 8 aa, Dengue virus
MAILGDTA

SEQ ID NO: 52544 - protein, 8 aa, Dengue virus
AILGDTAW

SEQ ID NO: 52545 - protein, 8 aa, Dengue virus
ILGDTAWD

SEQ ID NO: 52546 - protein, 8 aa, Dengue virus
LGDTAWDF

SEQ ID NO: 52547 - protein, 8 aa, Dengue virus
GDTAWDFG

SEQ ID NO: 52548 - protein, 8 aa, Dengue virus
DTAWDFGS

SEQ ID NO: 52549 - protein, 8 aa, Dengue virus
TAWDFGSV

SEQ ID NO: 52550 - protein, 8 aa, Dengue virus
AWDFGSVG

SEQ ID NO: 52551 - protein, 8 aa, Dengue virus
WDFGSVGG

SEQ ID NO: 52552 - protein, 8 aa, Dengue virus
DFGSVGGV

SEQ ID NO: 52553 - protein, 8 aa, Dengue virus
FGSVGGVL

SEQ ID NO: 52554 - protein, 8 aa, Dengue virus
GSVGGVLN

SEQ ID NO: 52555 - protein, 8 aa, Dengue virus
SVGGVLNS

SEQ ID NO: 52556 - protein, 8 aa, Dengue virus
VGGVLNSL

SEQ ID NO: 52557 - protein, 8 aa, Dengue virus
GGVLNSLG

SEQ ID NO: 52558 - protein, 8 aa, Dengue virus
GVLNSLGK

SEQ ID NO: 52559 - protein, 8 aa, Dengue virus
VLNSLGKM

SEQ ID NO: 52560 - protein, 8 aa, Dengue virus
LNSLGKMV

SEQ ID NO: 52561 - protein, 8 aa, Dengue virus
NSLGKMVH

SEQ ID NO: 52562 - protein, 8 aa, Dengue virus
SLGKMVHQ

SEQ ID NO: 52563 - protein, 8 aa, Dengue virus
LGKMVHQI

SEQ ID NO: 52564 - protein, 8 aa, Dengue virus
GKMVHQIF

SEQ ID NO: 52565 - protein, 8 aa, Dengue virus
KMVHQIFG

SEQ ID NO: 52566 - protein, 8 aa, Dengue virus
MVHQIFGS

SEQ ID NO: 52567 - protein, 8 aa, Dengue virus
VHQIFGSA

SEQ ID NO: 52568 - protein, 8 aa, Dengue virus
HQIFGSAY

SEQ ID NO: 52569 - protein, 8 aa, Dengue virus
QIFGSAYT

SEQ ID NO: 52570 - protein, 8 aa, Dengue virus
IFGSAYTA

SEQ ID NO: 52571 - protein, 8 aa, Dengue virus
FGSAYTAL

SEQ ID NO: 52572 - protein, 8 aa, Dengue virus
GSAYTALF

SEQ ID NO: 52573 - protein, 8 aa, Dengue virus
SAYTALFS

SEQ ID NO: 52574 - protein, 8 aa, Dengue virus
AYTALFSG

SEQ ID NO: 52575 - protein, 8 aa, Dengue virus
YTALFSGV

SEQ ID NO: 52576 - protein, 8 aa, Dengue virus
TALFSGVS

SEQ ID NO: 52577 - protein, 8 aa, Dengue virus
ALFSGVSW

SEQ ID NO: 52578 - protein, 8 aa, Dengue virus
LFSGVSWV

SEQ ID NO: 52579 - protein, 8 aa, Dengue virus
FSGVSWVM

SEQ ID NO: 52580 - protein, 8 aa, Dengue virus
SGVSWVMK

SEQ ID NO: 52581 - protein, 8 aa, Dengue virus
GVSWVMKI

SEQ ID NO: 52582 - protein, 8 aa, Dengue virus
VSWVMKIG

SEQ ID NO: 52583 - protein, 8 aa, Dengue virus
SWVMKIGI

SEQ ID NO: 52584 - protein, 8 aa, Dengue virus
WVMKIGIG

SEQ ID NO: 52585 - protein, 8 aa, Dengue virus
VMKIGIGV

SEQ ID NO: 52586 - protein, 8 aa, Dengue virus
MKIGIGVL

SEQ ID NO: 52587 - protein, 8 aa, Dengue virus
KIGIGVLL

SEQ ID NO: 52588 - protein, 8 aa, Dengue virus
IGIGVLLT

SEQ ID NO: 52589 - protein, 8 aa, Dengue virus
GIGVLLTW

SEQ ID NO: 52590 - protein, 8 aa, Dengue virus
IGVLLTWI

SEQ ID NO: 52591 - protein, 8 aa, Dengue virus
GVLLTWIG

SEQ ID NO: 52592 - protein, 8 aa, Dengue virus
VLLTWIGL

SEQ ID NO: 52593 - protein, 8 aa, Dengue virus
LLTWIGLN

SEQ ID NO: 52594 - protein, 8 aa, Dengue virus
LTWIGLNS

SEQ ID NO: 52595 - protein, 8 aa, Dengue virus
TWIGLNSK

SEQ ID NO: 52596 - protein, 8 aa, Dengue virus
WIGLNSKN

SEQ ID NO: 52597 - protein, 8 aa, Dengue virus
IGLNSKNT

SEQ ID NO: 52598 - protein, 8 aa, Dengue virus
GLNSKNTS

SEQ ID NO: 52599 - protein, 8 aa, Dengue virus
LNSKNTSM

SEQ ID NO: 52600 - protein, 8 aa, Dengue virus
NSKNTSMS

SEQ ID NO: 52601 - protein, 8 aa, Dengue virus
SKNTSMSF

SEQ ID NO: 52602 - protein, 8 aa, Dengue virus
KNTSMSFS

SEQ ID NO: 52603 - protein, 8 aa, Dengue virus
NTSMSFSC

SEQ ID NO: 52604 - protein, 8 aa, Dengue virus
TSMSFSCI

SEQ ID NO: 52605 - protein, 8 aa, Dengue virus
SMSFSCIA

SEQ ID NO: 52606 - protein, 8 aa, Dengue virus
MSFSCIAI

SEQ ID NO: 52607 - protein, 8 aa, Dengue virus
SFSCIAIG

SEQ ID NO: 52608 - protein, 8 aa, Dengue virus
FSCIAIGI

SEQ ID NO: 52609 - protein, 8 aa, Dengue virus
SCIAIGII

SEQ ID NO: 52610 - protein, 8 aa, Dengue virus
CIAIGIIT

SEQ ID NO: 52611 - protein, 8 aa, Dengue virus
IAIGIITL

SEQ ID NO: 52612 - protein, 8 aa, Dengue virus
AIGIITLY

SEQ ID NO: 52613 - protein, 8 aa, Dengue virus
IGIITLYL

SEQ ID NO: 52614 - protein, 8 aa, Dengue virus
GIITLYLG

SEQ ID NO: 52615 - protein, 8 aa, Dengue virus
IITLYLGA

SEQ ID NO: 52616 - protein, 8 aa, Dengue virus
ITLYLGAV

SEQ ID NO: 52617 - protein, 8 aa, Dengue virus
TLYLGAVV

SEQ ID NO: 52618 - protein, 8 aa, Dengue virus
LYLGAVVQ

SEQ ID NO: 52619 - protein, 8 aa, Dengue virus
YLGAVVQA

SEQ ID NO: 52620 - protein, 8 aa, Dengue virus
LGAVVQAD

SEQ ID NO: 52621 - protein, 8 aa, Dengue virus
GAVVQADM

SEQ ID NO: 52622 - protein, 8 aa, Dengue virus
AVVQADMG

SEQ ID NO: 52623 - protein, 8 aa, Dengue virus
VVQADMGC

SEQ ID NO: 52624 - protein, 8 aa, Dengue virus
VQADMGCV

SEQ ID NO: 52625 - protein, 8 aa, Dengue virus
QADMGCVI

SEQ ID NO: 52626 - protein, 8 aa, Dengue virus
ADMGCVIN

SEQ ID NO: 52627 - protein, 8 aa, Dengue virus
DMGCVINW

SEQ ID NO: 52628 - protein, 8 aa, Dengue virus
MGCVINWK

SEQ ID NO: 52629 - protein, 8 aa, Dengue virus
GCVINWKG

SEQ ID NO: 52630 - protein, 8 aa, Dengue virus
CVINWKGK

SEQ ID NO: 52631 - protein, 8 aa, Dengue virus
VINWKGKE

SEQ ID NO: 52632 - protein, 8 aa, Dengue virus
INWKGKEL

SEQ ID NO: 52633 - protein, 8 aa, Dengue virus
NWKGKELK

SEQ ID NO: 52634 - protein, 8 aa, Dengue virus
WKGKELKC

SEQ ID NO: 52635 - protein, 8 aa, Dengue virus
KGKELKCG

SEQ ID NO: 52636 - protein, 8 aa, Dengue virus
GKELKCGS

SEQ ID NO: 52637 - protein, 8 aa, Dengue virus
KELKCGSG

SEQ ID NO: 52638 - protein, 8 aa, Dengue virus
ELKCGSGI

SEQ ID NO: 52639 - protein, 8 aa, Dengue virus
LKCGSGIF

SEQ ID NO: 52640 - protein, 8 aa, Dengue virus
KCGSGIFV

SEQ ID NO: 52641 - protein, 8 aa, Dengue virus
CGSGIFVT

SEQ ID NO: 52642 - protein, 8 aa, Dengue virus
GSGIFVTN

SEQ ID NO: 52643 - protein, 8 aa, Dengue virus
SGIFVTNE

SEQ ID NO: 52644 - protein, 8 aa, Dengue virus
GIFVTNEV

SEQ ID NO: 52645 - protein, 8 aa, Dengue virus
IFVTNEVH

SEQ ID NO: 52646 - protein, 8 aa, Dengue virus
FVTNEVHT

SEQ ID NO: 52647 - protein, 8 aa, Dengue virus
VTNEVHTW

SEQ ID NO: 52648 - protein, 8 aa, Dengue virus
TNEVHTWT

SEQ ID NO: 52649 - protein, 8 aa, Dengue virus
NEVHTWTE

SEQ ID NO: 52650 - protein, 8 aa, Dengue virus
EVHTWTEQ

SEQ ID NO: 52651 - protein, 8 aa, Dengue virus
VHTWTEQY

SEQ ID NO: 52652 - protein, 8 aa, Dengue virus
HTWTEQYK

SEQ ID NO: 52653 - protein, 8 aa, Dengue virus
TWTEQYKF

SEQ ID NO: 52654 - protein, 8 aa, Dengue virus
WTEQYKFQ

SEQ ID NO: 52655 - protein, 8 aa, Dengue virus
TEQYKFQA

SEQ ID NO: 52656 - protein, 8 aa, Dengue virus
EQYKFQAD

SEQ ID NO: 52657 - protein, 8 aa, Dengue virus
QYKFQADS

SEQ ID NO: 52658 - protein, 8 aa, Dengue virus
YKFQADSP

SEQ ID NO: 52659 - protein, 8 aa, Dengue virus
KFQADSPK

SEQ ID NO: 52660 - protein, 8 aa, Dengue virus
FQADSPKR

SEQ ID NO: 52661 - protein, 8 aa, Dengue virus
QADSPKRL

SEQ ID NO: 52662 - protein, 8 aa, Dengue virus
ADSPKRLA

SEQ ID NO: 52663 - protein, 8 aa, Dengue virus
DSPKRLAT

SEQ ID NO: 52664 - protein, 8 aa, Dengue virus
SPKRLATA

SEQ ID NO: 52665 - protein, 8 aa, Dengue virus
PKRLATAI

SEQ ID NO: 52666 - protein, 8 aa, Dengue virus
KRLATAIA

SEQ ID NO: 52667 - protein, 8 aa, Dengue virus
RLATAIAG

SEQ ID NO: 52668 - protein, 8 aa, Dengue virus
LATAIAGA

SEQ ID NO: 52669 - protein, 8 aa, Dengue virus
ATAIAGAW

SEQ ID NO: 52670 - protein, 8 aa, Dengue virus
TAIAGAWE

SEQ ID NO: 52671 - protein, 8 aa, Dengue virus
AIAGAWEN

SEQ ID NO: 52672 - protein, 8 aa, Dengue virus
IAGAWENG

SEQ ID NO: 52673 - protein, 8 aa, Dengue virus
AGAWENGV

SEQ ID NO: 52674 - protein, 8 aa, Dengue virus
GAWENGVC

SEQ ID NO: 52675 - protein, 8 aa, Dengue virus
AWENGVCG

SEQ ID NO: 52676 - protein, 8 aa, Dengue virus
WENGVCGI

SEQ ID NO: 52677 - protein, 8 aa, Dengue virus
ENGVCGIR

SEQ ID NO: 52678 - protein, 8 aa, Dengue virus
NGVCGIRS

SEQ ID NO: 52679 - protein, 8 aa, Dengue virus
GVCGIRST

SEQ ID NO: 52680 - protein, 8 aa, Dengue virus
VCGIRSTT

SEQ ID NO: 52681 - protein, 8 aa, Dengue virus
CGIRSTTR

SEQ ID NO: 52682 - protein, 8 aa, Dengue virus
GIRSTTRM

SEQ ID NO: 52683 - protein, 8 aa, Dengue virus
IRSTTRME

SEQ ID NO: 52684 - protein, 8 aa, Dengue virus
RSTTRMEN

SEQ ID NO: 52685 - protein, 8 aa, Dengue virus
STTRMENL

SEQ ID NO: 52686 - protein, 8 aa, Dengue virus
TTRMENLL

SEQ ID NO: 52687 - protein, 8 aa, Dengue virus
TRMENLLW

SEQ ID NO: 52688 - protein, 8 aa, Dengue virus
RMENLLWK

SEQ ID NO: 52689 - protein, 8 aa, Dengue virus
MENLLWKQ

SEQ ID NO: 52690 - protein, 8 aa, Dengue virus
ENLLWKQI

SEQ ID NO: 52691 - protein, 8 aa, Dengue virus
NLLWKQIA

SEQ ID NO: 52692 - protein, 8 aa, Dengue virus
LLWKQIAN

SEQ ID NO: 52693 - protein, 8 aa, Dengue virus
LWKQIANE

SEQ ID NO: 52694 - protein, 8 aa, Dengue virus
WKQIANEL

SEQ ID NO: 52695 - protein, 8 aa, Dengue virus
KQIANELN

SEQ ID NO: 52696 - protein, 8 aa, Dengue virus
QIANELNY

SEQ ID NO: 52697 - protein, 8 aa, Dengue virus
IANELNYI

SEQ ID NO: 52698 - protein, 8 aa, Dengue virus
ANELNYIL

SEQ ID NO: 52699 - protein, 8 aa, Dengue virus
NELNYILW

SEQ ID NO: 52700 - protein, 8 aa, Dengue virus
ELNYILWE

SEQ ID NO: 52701 - protein, 8 aa, Dengue virus
LNYILWEN

SEQ ID NO: 52702 - protein, 8 aa, Dengue virus
NYILWENN

SEQ ID NO: 52703 - protein, 8 aa, Dengue virus
YILWENNI

SEQ ID NO: 52704 - protein, 8 aa, Dengue virus
ILWENNIK

SEQ ID NO: 52705 - protein, 8 aa, Dengue virus
LWENNIKL

SEQ ID NO: 52706 - protein, 8 aa, Dengue virus
WENNIKLT

SEQ ID NO: 52707 - protein, 8 aa, Dengue virus
ENNIKLTV

SEQ ID NO: 52708 - protein, 8 aa, Dengue virus
NNIKLTVV

SEQ ID NO: 52709 - protein, 8 aa, Dengue virus
NIKLTVVV

SEQ ID NO: 52710 - protein, 8 aa, Dengue virus
IKLTVVVG

SEQ ID NO: 52711 - protein, 8 aa, Dengue virus
KLTVVVGD

SEQ ID NO: 52712 - protein, 8 aa, Dengue virus
LTVVVGDI

SEQ ID NO: 52713 - protein, 8 aa, Dengue virus
TVVVGDII

SEQ ID NO: 52714 - protein, 8 aa, Dengue virus
VVVGDIIG

SEQ ID NO: 52715 - protein, 8 aa, Dengue virus
IGVLEQGK

SEQ ID NO: 52716 - protein, 8 aa, Dengue virus
GVLEQGKR

SEQ ID NO: 52717 - protein, 8 aa, Dengue virus
VLEQGKRT

SEQ ID NO: 52718 - protein, 8 aa, Dengue virus
LEQGKRTL

SEQ ID NO: 52719 - protein, 8 aa, Dengue virus
EQGKRTLT

SEQ ID NO: 52720 - protein, 8 aa, Dengue virus
QGKRTLTP

SEQ ID NO: 52721 - protein, 8 aa, Dengue virus
GKRTLTPQ

SEQ ID NO: 52722 - protein, 8 aa, Dengue virus
KRTLTPQP

SEQ ID NO: 52723 - protein, 8 aa, Dengue virus
RTLTPQPM

SEQ ID NO: 52724 - protein, 8 aa, Dengue virus
TLTPQPME

SEQ ID NO: 52725 - protein, 8 aa, Dengue virus
LTPQPMEL

SEQ ID NO: 52726 - protein, 8 aa, Dengue virus
TPQPMELK

SEQ ID NO: 52727 - protein, 8 aa, Dengue virus
PQPMELKY

SEQ ID NO: 52728 - protein, 8 aa, Dengue virus
QPMELKYS

SEQ ID NO: 52729 - protein, 8 aa, Dengue virus
PMELKYSW

SEQ ID NO: 52730 - protein, 8 aa, Dengue virus
MELKYSWK

SEQ ID NO: 52731 - protein, 8 aa, Dengue virus
ELKYSWKT

SEQ ID NO: 52732 - protein, 8 aa, Dengue virus
LKYSWKTW

SEQ ID NO: 52733 - protein, 8 aa, Dengue virus
KYSWKTWG

SEQ ID NO: 52734 - protein, 8 aa, Dengue virus
YSWKTWGK

SEQ ID NO: 52735 - protein, 8 aa, Dengue virus
SWKTWGKA

SEQ ID NO: 52736 - protein, 8 aa, Dengue virus
WKTWGKAK

SEQ ID NO: 52737 - protein, 8 aa, Dengue virus
KTWGKAKI

SEQ ID NO: 52738 - protein, 8 aa, Dengue virus
TWGKAKIV

SEQ ID NO: 52739 - protein, 8 aa, Dengue virus
WGKAKIVT

SEQ ID NO: 52740 - protein, 8 aa, Dengue virus
GKAKIVTA

SEQ ID NO: 52741 - protein, 8 aa, Dengue virus
KAKIVTAE

SEQ ID NO: 52742 - protein, 8 aa, Dengue virus
AETQNSSF

SEQ ID NO: 52743 - protein, 8 aa, Dengue virus
ETQNSSFI

SEQ ID NO: 52744 - protein, 8 aa, Dengue virus
TQNSSFII

SEQ ID NO: 52745 - protein, 8 aa, Dengue virus
QNSSFIID

SEQ ID NO: 52746 - protein, 8 aa, Dengue virus
NSSFIIDG

SEQ ID NO: 52747 - protein, 8 aa, Dengue virus
SSFIIDGP

SEQ ID NO: 52748 - protein, 8 aa, Dengue virus
SFIIDGPN

SEQ ID NO: 52749 - protein, 8 aa, Dengue virus
FIIDGPNT

SEQ ID NO: 52750 - protein, 8 aa, Dengue virus
IIDGPNTP

SEQ ID NO: 52751 - protein, 8 aa, Dengue virus
IDGPNTPE

SEQ ID NO: 52752 - protein, 8 aa, Dengue virus
DGPNTPEC

SEQ ID NO: 52753 - protein, 8 aa, Dengue virus
GPNTPECP

SEQ ID NO: 52754 - protein, 8 aa, Dengue virus
PNTPECPS

SEQ ID NO: 52755 - protein, 8 aa, Dengue virus
NTPECPSA

SEQ ID NO: 52756 - protein, 8 aa, Dengue virus
PSASRAWN

SEQ ID NO: 52757 - protein, 8 aa, Dengue virus
SASRAWNV

SEQ ID NO: 52758 - protein, 8 aa, Dengue virus
ASRAWNVW

SEQ ID NO: 52759 - protein, 8 aa, Dengue virus
SRAWNVWE

SEQ ID NO: 52760 - protein, 8 aa, Dengue virus
RAWNVWEV

SEQ ID NO: 52761 - protein, 8 aa, Dengue virus
AWNVWEVE

SEQ ID NO: 52762 - protein, 8 aa, Dengue virus
WNVWEVED

SEQ ID NO: 52763 - protein, 8 aa, Dengue virus
NVWEVEDY

SEQ ID NO: 52764 - protein, 8 aa, Dengue virus
VWEVEDYG

SEQ ID NO: 52765 - protein, 8 aa, Dengue virus
WEVEDYGF

SEQ ID NO: 52766 - protein, 8 aa, Dengue virus
EVEDYGFG

SEQ ID NO: 52767 - protein, 8 aa, Dengue virus
VEDYGFGV

SEQ ID NO: 52768 - protein, 8 aa, Dengue virus
EDYGFGVF

SEQ ID NO: 52769 - protein, 8 aa, Dengue virus
DYGFGVFT

SEQ ID NO: 52770 - protein, 8 aa, Dengue virus
YGFGVFTT

SEQ ID NO: 52771 - protein, 8 aa, Dengue virus
GFGVFTTN

SEQ ID NO: 52772 - protein, 8 aa, Dengue virus
FGVFTTNI

SEQ ID NO: 52773 - protein, 8 aa, Dengue virus
GVFTTNIW

SEQ ID NO: 52774 - protein, 8 aa, Dengue virus
VFTTNIWL

SEQ ID NO: 52775 - protein, 8 aa, Dengue virus
FTTNIWLK

SEQ ID NO: 52776 - protein, 8 aa, Dengue virus
TTNIWLKL

SEQ ID NO: 52777 - protein, 8 aa, Dengue virus
TNIWLKLR

SEQ ID NO: 52778 - protein, 8 aa, Dengue virus
NIWLKLRE

SEQ ID NO: 52779 - protein, 8 aa, Dengue virus
IWLKLREV

SEQ ID NO: 52780 - protein, 8 aa, Dengue virus
WLKLREVY

SEQ ID NO: 52781 - protein, 8 aa, Dengue virus
LKLREVYT

SEQ ID NO: 52782 - protein, 8 aa, Dengue virus
KLREVYTQ

SEQ ID NO: 52783 - protein, 8 aa, Dengue virus
TQLCDHRL

SEQ ID NO: 52784 - protein, 8 aa, Dengue virus
QLCDHRLM

SEQ ID NO: 52785 - protein, 8 aa, Dengue virus
LCDHRLMS

SEQ ID NO: 52786 - protein, 8 aa, Dengue virus
CDHRLMSA

SEQ ID NO: 52787 - protein, 8 aa, Dengue virus
DHRLMSAA

SEQ ID NO: 52788 - protein, 8 aa, Dengue virus
HRLMSAAV

SEQ ID NO: 52789 - protein, 8 aa, Dengue virus
RLMSAAVK

SEQ ID NO: 52790 - protein, 8 aa, Dengue virus
LMSAAVKD

SEQ ID NO: 52791 - protein, 8 aa, Dengue virus
MSAAVKDE

SEQ ID NO: 52792 - protein, 8 aa, Dengue virus
SAAVKDER

SEQ ID NO: 52793 - protein, 8 aa, Dengue virus
AAVKDERA

SEQ ID NO: 52794 - protein, 8 aa, Dengue virus
AVKDERAV

SEQ ID NO: 52795 - protein, 8 aa, Dengue virus
VKDERAVH

SEQ ID NO: 52796 - protein, 8 aa, Dengue virus
KDERAVHA

SEQ ID NO: 52797 - protein, 8 aa, Dengue virus
DERAVHAD

SEQ ID NO: 52798 - protein, 8 aa, Dengue virus
ERAVHADM

SEQ ID NO: 52799 - protein, 8 aa, Dengue virus
RAVHADMG

SEQ ID NO: 52800 - protein, 8 aa, Dengue virus
AVHADMGY

SEQ ID NO: 52801 - protein, 8 aa, Dengue virus
VHADMGYW

SEQ ID NO: 52802 - protein, 8 aa, Dengue virus
HADMGYWI

SEQ ID NO: 52803 - protein, 8 aa, Dengue virus
ADMGYWIE

SEQ ID NO: 52804 - protein, 8 aa, Dengue virus
DMGYWIES

SEQ ID NO: 52805 - protein, 8 aa, Dengue virus
MGYWIESQ

SEQ ID NO: 52806 - protein, 8 aa, Dengue virus
GYWIESQK

SEQ ID NO: 52807 - protein, 8 aa, Dengue virus
YWIESQKN

SEQ ID NO: 52808 - protein, 8 aa, Dengue virus
WIESQKNG

SEQ ID NO: 52809 - protein, 8 aa, Dengue virus
IESQKNGS

SEQ ID NO: 52810 - protein, 8 aa, Dengue virus
ESQKNGSW

SEQ ID NO: 52811 - protein, 8 aa, Dengue virus
SQKNGSWK

SEQ ID NO: 52812 - protein, 8 aa, Dengue virus
QKNGSWKL

SEQ ID NO: 52813 - protein, 8 aa, Dengue virus
KNGSWKLE

SEQ ID NO: 52814 - protein, 8 aa, Dengue virus
NGSWKLEK

SEQ ID NO: 52815 - protein, 8 aa, Dengue virus
GSWKLEKA

SEQ ID NO: 52816 - protein, 8 aa, Dengue virus
SWKLEKAS

SEQ ID NO: 52817 - protein, 8 aa, Dengue virus
WKLEKASL

SEQ ID NO: 52818 - protein, 8 aa, Dengue virus
KLEKASLI

SEQ ID NO: 52819 - protein, 8 aa, Dengue virus
LEKASLIE

SEQ ID NO: 52820 - protein, 8 aa, Dengue virus
EKASLIEV

SEQ ID NO: 52821 - protein, 8 aa, Dengue virus
KASLIEVK

SEQ ID NO: 52822 - protein, 8 aa, Dengue virus
ASLIEVKT

SEQ ID NO: 52823 - protein, 8 aa, Dengue virus
SLIEVKTC

SEQ ID NO: 52824 - protein, 8 aa, Dengue virus
LIEVKTCT

SEQ ID NO: 52825 - protein, 8 aa, Dengue virus
IEVKTCTW

SEQ ID NO: 52826 - protein, 8 aa, Dengue virus
EVKTCTWP

SEQ ID NO: 52827 - protein, 8 aa, Dengue virus
VKTCTWPK

SEQ ID NO: 52828 - protein, 8 aa, Dengue virus
KTCTWPKS

SEQ ID NO: 52829 - protein, 8 aa, Dengue virus
TCTWPKSH

SEQ ID NO: 52830 - protein, 8 aa, Dengue virus
CTWPKSHT

SEQ ID NO: 52831 - protein, 8 aa, Dengue virus
TWPKSHTL

SEQ ID NO: 52832 - protein, 8 aa, Dengue virus
WPKSHTLW

SEQ ID NO: 52833 - protein, 8 aa, Dengue virus
PKSHTLWS

SEQ ID NO: 52834 - protein, 8 aa, Dengue virus
KSHTLWSN

SEQ ID NO: 52835 - protein, 8 aa, Dengue virus
SHTLWSNG

SEQ ID NO: 52836 - protein, 8 aa, Dengue virus
HTLWSNGV

SEQ ID NO: 52837 - protein, 8 aa, Dengue virus
TLWSNGVL

SEQ ID NO: 52838 - protein, 8 aa, Dengue virus
LWSNGVLE

SEQ ID NO: 52839 - protein, 8 aa, Dengue virus
WSNGVLES

SEQ ID NO: 52840 - protein, 8 aa, Dengue virus
SNGVLESD

SEQ ID NO: 52841 - protein, 8 aa, Dengue virus
NGVLESDM

SEQ ID NO: 52842 - protein, 8 aa, Dengue virus
GVLESDMI

SEQ ID NO: 52843 - protein, 8 aa, Dengue virus
VLESDMII

SEQ ID NO: 52844 - protein, 8 aa, Dengue virus
LESDMIIP

SEQ ID NO: 52845 - protein, 8 aa, Dengue virus
ESDMIIPK

SEQ ID NO: 52846 - protein, 8 aa, Dengue virus
SDMIIPKS

SEQ ID NO: 52847 - protein, 8 aa, Dengue virus
DMIIPKSL

SEQ ID NO: 52848 - protein, 8 aa, Dengue virus
MIIPKSLA

SEQ ID NO: 52849 - protein, 8 aa, Dengue virus
IIPKSLAG

SEQ ID NO: 52850 - protein, 8 aa, Dengue virus
IPKSLAGP

SEQ ID NO: 52851 - protein, 8 aa, Dengue virus
PKSLAGPI

SEQ ID NO: 52852 - protein, 8 aa, Dengue virus
KSLAGPIS

SEQ ID NO: 52853 - protein, 8 aa, Dengue virus
SLAGPISQ

SEQ ID NO: 52854 - protein, 8 aa, Dengue virus
LAGPISQH

SEQ ID NO: 52855 - protein, 8 aa, Dengue virus
AGPISQHN

SEQ ID NO: 52856 - protein, 8 aa, Dengue virus
GPISQHNY

SEQ ID NO: 52857 - protein, 8 aa, Dengue virus
PISQHNYR

SEQ ID NO: 52858 - protein, 8 aa, Dengue virus
ISQHNYRP

SEQ ID NO: 52859 - protein, 8 aa, Dengue virus
SQHNYRPG

SEQ ID NO: 52860 - protein, 8 aa, Dengue virus
QHNYRPGY

SEQ ID NO: 52861 - protein, 8 aa, Dengue virus
HNYRPGYH

SEQ ID NO: 52862 - protein, 8 aa, Dengue virus
NYRPGYHT

SEQ ID NO: 52863 - protein, 8 aa, Dengue virus
YRPGYHTQ

SEQ ID NO: 52864 - protein, 8 aa, Dengue virus
RPGYHTQT

SEQ ID NO: 52865 - protein, 8 aa, Dengue virus
PGYHTQTA

SEQ ID NO: 52866 - protein, 8 aa, Dengue virus
GYHTQTAG

SEQ ID NO: 52867 - protein, 8 aa, Dengue virus
YHTQTAGP

SEQ ID NO: 52868 - protein, 8 aa, Dengue virus
HTQTAGPW

SEQ ID NO: 52869 - protein, 8 aa, Dengue virus
TQTAGPWH

SEQ ID NO: 52870 - protein, 8 aa, Dengue virus
QTAGPWHL

SEQ ID NO: 52871 - protein, 8 aa, Dengue virus
TAGPWHLG

SEQ ID NO: 52872 - protein, 8 aa, Dengue virus
AGPWHLGK

SEQ ID NO: 52873 - protein, 8 aa, Dengue virus
GPWHLGKL

SEQ ID NO: 52874 - protein, 8 aa, Dengue virus
PWHLGKLE

SEQ ID NO: 52875 - protein, 8 aa, Dengue virus
WHLGKLEL

SEQ ID NO: 52876 - protein, 8 aa, Dengue virus
HLGKLELD

SEQ ID NO: 52877 - protein, 8 aa, Dengue virus
LGKLELDF

SEQ ID NO: 52878 - protein, 8 aa, Dengue virus
GKLELDFN

SEQ ID NO: 52879 - protein, 8 aa, Dengue virus
KLELDFNY

SEQ ID NO: 52880 - protein, 8 aa, Dengue virus
LELDFNYC

SEQ ID NO: 52881 - protein, 8 aa, Dengue virus
ELDFNYCE

SEQ ID NO: 52882 - protein, 8 aa, Dengue virus
LDFNYCEG

SEQ ID NO: 52883 - protein, 8 aa, Dengue virus
DFNYCEGT

SEQ ID NO: 52884 - protein, 8 aa, Dengue virus
FNYCEGTT

SEQ ID NO: 52885 - protein, 8 aa, Dengue virus
NYCEGTTV

SEQ ID NO: 52886 - protein, 8 aa, Dengue virus
YCEGTTVV

SEQ ID NO: 52887 - protein, 8 aa, Dengue virus
CEGTTVVI

SEQ ID NO: 52888 - protein, 8 aa, Dengue virus
EGTTVVIT

SEQ ID NO: 52889 - protein, 8 aa, Dengue virus
GTTVVITE

SEQ ID NO: 52890 - protein, 8 aa, Dengue virus
TTVVITEN

SEQ ID NO: 52891 - protein, 8 aa, Dengue virus
TVVITENC

SEQ ID NO: 52892 - protein, 8 aa, Dengue virus
VVITENCG

SEQ ID NO: 52893 - protein, 8 aa, Dengue virus
VITENCGT

SEQ ID NO: 52894 - protein, 8 aa, Dengue virus
CGTRGPSL

SEQ ID NO: 52895 - protein, 8 aa, Dengue virus
GTRGPSLR

SEQ ID NO: 52896 - protein, 8 aa, Dengue virus
TRGPSLRT

SEQ ID NO: 52897 - protein, 8 aa, Dengue virus
RGPSLRTT

SEQ ID NO: 52898 - protein, 8 aa, Dengue virus
GPSLRTTT

SEQ ID NO: 52899 - protein, 8 aa, Dengue virus
PSLRTTTV

SEQ ID NO: 52900 - protein, 8 aa, Dengue virus
SLRTTTVS

SEQ ID NO: 52901 - protein, 8 aa, Dengue virus
LRTTTVSG

SEQ ID NO: 52902 - protein, 8 aa, Dengue virus
RTTTVSGK

SEQ ID NO: 52903 - protein, 8 aa, Dengue virus
TTTVSGKL

SEQ ID NO: 52904 - protein, 8 aa, Dengue virus
TTVSGKLI

SEQ ID NO: 52905 - protein, 8 aa, Dengue virus
TVSGKLIH

SEQ ID NO: 52906 - protein, 8 aa, Dengue virus
VSGKLIHE

SEQ ID NO: 52907 - protein, 8 aa, Dengue virus
SGKLIHEW

SEQ ID NO: 52908 - protein, 8 aa, Dengue virus
GKLIHEWC

SEQ ID NO: 52909 - protein, 8 aa, Dengue virus
KLIHEWCC

SEQ ID NO: 52910 - protein, 8 aa, Dengue virus
LIHEWCCR

SEQ ID NO: 52911 - protein, 8 aa, Dengue virus
IHEWCCRS

SEQ ID NO: 52912 - protein, 8 aa, Dengue virus
HEWCCRSC

SEQ ID NO: 52913 - protein, 8 aa, Dengue virus
EWCCRSCT

SEQ ID NO: 52914 - protein, 8 aa, Dengue virus
WCCRSCTL

SEQ ID NO: 52915 - protein, 8 aa, Dengue virus
CCRSCTLP

SEQ ID NO: 52916 - protein, 8 aa, Dengue virus
CRSCTLPP

SEQ ID NO: 52917 - protein, 8 aa, Dengue virus
RSCTLPPL

SEQ ID NO: 52918 - protein, 8 aa, Dengue virus
SCTLPPLR

SEQ ID NO: 52919 - protein, 8 aa, Dengue virus
CTLPPLRY

SEQ ID NO: 52920 - protein, 8 aa, Dengue virus
TLPPLRYM

SEQ ID NO: 52921 - protein, 8 aa, Dengue virus
LPPLRYMG

SEQ ID NO: 52922 - protein, 8 aa, Dengue virus
PPLRYMGE

SEQ ID NO: 52923 - protein, 8 aa, Dengue virus
PLRYMGED

SEQ ID NO: 52924 - protein, 8 aa, Dengue virus
LRYMGEDG

SEQ ID NO: 52925 - protein, 8 aa, Dengue virus
RYMGEDGC

SEQ ID NO: 52926 - protein, 8 aa, Dengue virus
YMGEDGCW

SEQ ID NO: 52927 - protein, 8 aa, Dengue virus
MGEDGCWY

SEQ ID NO: 52928 - protein, 8 aa, Dengue virus
GEDGCWYG

SEQ ID NO: 52929 - protein, 8 aa, Dengue virus
EDGCWYGM

SEQ ID NO: 52930 - protein, 8 aa, Dengue virus
DGCWYGME

SEQ ID NO: 52931 - protein, 8 aa, Dengue virus
GCWYGMEI

SEQ ID NO: 52932 - protein, 8 aa, Dengue virus
CWYGMEIR

SEQ ID NO: 52933 - protein, 8 aa, Dengue virus
WYGMEIRP

SEQ ID NO: 52934 - protein, 8 aa, Dengue virus
YGMEIRPI

SEQ ID NO: 52935 - protein, 8 aa, Dengue virus
GMEIRPIS

SEQ ID NO: 52936 - protein, 8 aa, Dengue virus
MEIRPISE

SEQ ID NO: 52937 - protein, 8 aa, Dengue virus
EIRPISEK

SEQ ID NO: 52938 - protein, 8 aa, Dengue virus
IRPISEKE

SEQ ID NO: 52939 - protein, 8 aa, Dengue virus
RPISEKEE

SEQ ID NO: 52940 - protein, 8 aa, Dengue virus
PISEKEEN

SEQ ID NO: 52941 - protein, 8 aa, Dengue virus
ISEKEENM

SEQ ID NO: 52942 - protein, 8 aa, Dengue virus
SEKEENMV

SEQ ID NO: 52943 - protein, 8 aa, Dengue virus
EKEENMVK

SEQ ID NO: 52944 - protein, 8 aa, Dengue virus
KEENMVKS

SEQ ID NO: 52945 - protein, 8 aa, Dengue virus
EENMVKSL

SEQ ID NO: 52946 - protein, 8 aa, Dengue virus
ENMVKSLV

SEQ ID NO: 52947 - protein, 8 aa, Dengue virus
NMVKSLVS

SEQ ID NO: 52948 - protein, 8 aa, Dengue virus
MVKSLVSA

SEQ ID NO: 52949 - protein, 8 aa, Dengue virus
VKSLVSAG

SEQ ID NO: 52950 - protein, 8 aa, Dengue virus
KSLVSAGS

SEQ ID NO: 52951 - protein, 8 aa, Dengue virus
SLVSAGSG

SEQ ID NO: 52952 - protein, 8 aa, Dengue virus
LVSAGSGK

SEQ ID NO: 52953 - protein, 8 aa, Dengue virus
VSAGSGKV

SEQ ID NO: 52954 - protein, 8 aa, Dengue virus
SAGSGKVD

SEQ ID NO: 52955 - protein, 8 aa, Dengue virus
AGSGKVDN

SEQ ID NO: 52956 - protein, 8 aa, Dengue virus
GSGKVDNF

SEQ ID NO: 52957 - protein, 8 aa, Dengue virus
SGKVDNFT

SEQ ID NO: 52958 - protein, 8 aa, Dengue virus
GKVDNFTM

SEQ ID NO: 52959 - protein, 8 aa, Dengue virus
KVDNFTMG

SEQ ID NO: 52960 - protein, 8 aa, Dengue virus
VDNFTMGV

SEQ ID NO: 52961 - protein, 8 aa, Dengue virus
DNFTMGVL

SEQ ID NO: 52962 - protein, 8 aa, Dengue virus
NFTMGVLC

SEQ ID NO: 52963 - protein, 8 aa, Dengue virus
FTMGVLCL

SEQ ID NO: 52964 - protein, 8 aa, Dengue virus
TMGVLCLA

SEQ ID NO: 52965 - protein, 8 aa, Dengue virus
MGVLCLAI

SEQ ID NO: 52966 - protein, 8 aa, Dengue virus
GVLCLAIL

SEQ ID NO: 52967 - protein, 8 aa, Dengue virus
VLCLAILF

SEQ ID NO: 52968 - protein, 8 aa, Dengue virus
LCLAILFE

SEQ ID NO: 52969 - protein, 8 aa, Dengue virus
CLAILFEE

SEQ ID NO: 52970 - protein, 8 aa, Dengue virus
LAILFEEV

SEQ ID NO: 52971 - protein, 8 aa, Dengue virus
AILFEEVM

SEQ ID NO: 52972 - protein, 8 aa, Dengue virus
ILFEEVMR

SEQ ID NO: 52973 - protein, 8 aa, Dengue virus
LFEEVMRG

SEQ ID NO: 52974 - protein, 8 aa, Dengue virus
FEEVMRGK

SEQ ID NO: 52975 - protein, 8 aa, Dengue virus
EEVMRGKF

SEQ ID NO: 52976 - protein, 8 aa, Dengue virus
EVMRGKFG

SEQ ID NO: 52977 - protein, 8 aa, Dengue virus
VMRGKFGK

SEQ ID NO: 52978 - protein, 8 aa, Dengue virus
MRGKFGKK

SEQ ID NO: 52979 - protein, 8 aa, Dengue virus
RGKFGKKH

SEQ ID NO: 52980 - protein, 8 aa, Dengue virus
GKFGKKHM

SEQ ID NO: 52981 - protein, 8 aa, Dengue virus
KFGKKHMI

SEQ ID NO: 52982 - protein, 8 aa, Dengue virus
FGKKHMIA

SEQ ID NO: 52983 - protein, 8 aa, Dengue virus
GKKHMIAG

SEQ ID NO: 52984 - protein, 8 aa, Dengue virus
KKHMIAGV

SEQ ID NO: 52985 - protein, 8 aa, Dengue virus
FTFVLLLS

SEQ ID NO: 52986 - protein, 8 aa, Dengue virus
TFVLLLSG

SEQ ID NO: 52987 - protein, 8 aa, Dengue virus
FVLLLSGQ

SEQ ID NO: 52988 - protein, 8 aa, Dengue virus
VLLLSGQI

SEQ ID NO: 52989 - protein, 8 aa, Dengue virus
LLLSGQIT

SEQ ID NO: 52990 - protein, 8 aa, Dengue virus
LLSGQITW

SEQ ID NO: 52991 - protein, 8 aa, Dengue virus
LSGQITWR

SEQ ID NO: 52992 - protein, 8 aa, Dengue virus
SGQITWRD

SEQ ID NO: 52993 - protein, 8 aa, Dengue virus
GQITWRDM

SEQ ID NO: 52994 - protein, 8 aa, Dengue virus
QITWRDMA

SEQ ID NO: 52995 - protein, 8 aa, Dengue virus
DMAHTLIM

SEQ ID NO: 52996 - protein, 8 aa, Dengue virus
AHTLIMIG

SEQ ID NO: 52997 - protein, 8 aa, Dengue virus
HTLIMIGS

SEQ ID NO: 52998 - protein, 8 aa, Dengue virus
TLIMIGSN

SEQ ID NO: 52999 - protein, 8 aa, Dengue virus
LIMIGSNA

SEQ ID NO: 53000 - protein, 8 aa, Dengue virus
IMIGSNAS

SEQ ID NO: 53001 - protein, 8 aa, Dengue virus
MIGSNASD

SEQ ID NO: 53002 - protein, 8 aa, Dengue virus
IGSNASDR

SEQ ID NO: 53003 - protein, 8 aa, Dengue virus
GSNASDRM

SEQ ID NO: 53004 - protein, 8 aa, Dengue virus
SNASDRMG

SEQ ID NO: 53005 - protein, 8 aa, Dengue virus
NASDRMGM

SEQ ID NO: 53006 - protein, 8 aa, Dengue virus
ASDRMGMG

SEQ ID NO: 53007 - protein, 8 aa, Dengue virus
SDRMGMGV

SEQ ID NO: 53008 - protein, 8 aa, Dengue virus
DRMGMGVT

SEQ ID NO: 53009 - protein, 8 aa, Dengue virus
RMGMGVTY

SEQ ID NO: 53010 - protein, 8 aa, Dengue virus
MGMGVTYL

SEQ ID NO: 53011 - protein, 8 aa, Dengue virus
GMGVTYLA

SEQ ID NO: 53012 - protein, 8 aa, Dengue virus
MGVTYLAL

SEQ ID NO: 53013 - protein, 8 aa, Dengue virus
GVTYLALI

SEQ ID NO: 53014 - protein, 8 aa, Dengue virus
VTYLALIA

SEQ ID NO: 53015 - protein, 8 aa, Dengue virus
TYLALIAT

SEQ ID NO: 53016 - protein, 8 aa, Dengue virus
YLALIATF

SEQ ID NO: 53017 - protein, 8 aa, Dengue virus
LALIATFK

SEQ ID NO: 53018 - protein, 8 aa, Dengue virus
ALIATFKI

SEQ ID NO: 53019 - protein, 8 aa, Dengue virus
LIATFKIQ

SEQ ID NO: 53020 - protein, 8 aa, Dengue virus
IATFKIQP

SEQ ID NO: 53021 - protein, 8 aa, Dengue virus
ATFKIQPF

SEQ ID NO: 53022 - protein, 8 aa, Dengue virus
TFKIQPFL

SEQ ID NO: 53023 - protein, 8 aa, Dengue virus
FKIQPFLA

SEQ ID NO: 53024 - protein, 8 aa, Dengue virus
KIQPFLAL

SEQ ID NO: 53025 - protein, 8 aa, Dengue virus
IQPFLALG

SEQ ID NO: 53026 - protein, 8 aa, Dengue virus
QPFLALGF

SEQ ID NO: 53027 - protein, 8 aa, Dengue virus
PFLALGFF

SEQ ID NO: 53028 - protein, 8 aa, Dengue virus
FLALGFFL

SEQ ID NO: 53029 - protein, 8 aa, Dengue virus
LALGFFLR

SEQ ID NO: 53030 - protein, 8 aa, Dengue virus
ALGFFLRK

SEQ ID NO: 53031 - protein, 8 aa, Dengue virus
LGFFLRKL

SEQ ID NO: 53032 - protein, 8 aa, Dengue virus
GFFLRKLT

SEQ ID NO: 53033 - protein, 8 aa, Dengue virus
FFLRKLTS

SEQ ID NO: 53034 - protein, 8 aa, Dengue virus
FLRKLTSR

SEQ ID NO: 53035 - protein, 8 aa, Dengue virus
LRKLTSRE

SEQ ID NO: 53036 - protein, 8 aa, Dengue virus
RKLTSREN

SEQ ID NO: 53037 - protein, 8 aa, Dengue virus
KLTSRENL

SEQ ID NO: 53038 - protein, 8 aa, Dengue virus
LTSRENLL

SEQ ID NO: 53039 - protein, 8 aa, Dengue virus
TSRENLLL

SEQ ID NO: 53040 - protein, 8 aa, Dengue virus
SRENLLLG

SEQ ID NO: 53041 - protein, 8 aa, Dengue virus
RENLLLGV

SEQ ID NO: 53042 - protein, 8 aa, Dengue virus
ENLLLGVG

SEQ ID NO: 53043 - protein, 8 aa, Dengue virus
NLLLGVGL

SEQ ID NO: 53044 - protein, 8 aa, Dengue virus
LLLGVGLA

SEQ ID NO: 53045 - protein, 8 aa, Dengue virus
LLGVGLAM

SEQ ID NO: 53046 - protein, 8 aa, Dengue virus
LGVGLAMA

SEQ ID NO: 53047 - protein, 8 aa, Dengue virus
GVGLAMAT

SEQ ID NO: 53048 - protein, 8 aa, Dengue virus
VGLAMATT

SEQ ID NO: 53049 - protein, 8 aa, Dengue virus
GLAMATTL

SEQ ID NO: 53050 - protein, 8 aa, Dengue virus
LAMATTLQ

SEQ ID NO: 53051 - protein, 8 aa, Dengue virus
AMATTLQL

SEQ ID NO: 53052 - protein, 8 aa, Dengue virus
MATTLQLP

SEQ ID NO: 53053 - protein, 8 aa, Dengue virus
ATTLQLPE

SEQ ID NO: 53054 - protein, 8 aa, Dengue virus
TTLQLPED

SEQ ID NO: 53055 - protein, 8 aa, Dengue virus
TLQLPEDI

SEQ ID NO: 53056 - protein, 8 aa, Dengue virus
LQLPEDIE

SEQ ID NO: 53057 - protein, 8 aa, Dengue virus
QLPEDIEQ

SEQ ID NO: 53058 - protein, 8 aa, Dengue virus
LPEDIEQM

SEQ ID NO: 53059 - protein, 8 aa, Dengue virus
PEDIEQMA

SEQ ID NO: 53060 - protein, 8 aa, Dengue virus
EDIEQMAN

SEQ ID NO: 53061 - protein, 8 aa, Dengue virus
DIEQMANG

SEQ ID NO: 53062 - protein, 8 aa, Dengue virus
IEQMANGI

SEQ ID NO: 53063 - protein, 8 aa, Dengue virus
EQMANGIA

SEQ ID NO: 53064 - protein, 8 aa, Dengue virus
QMANGIAL

SEQ ID NO: 53065 - protein, 8 aa, Dengue virus
MANGIALG

SEQ ID NO: 53066 - protein, 8 aa, Dengue virus
ANGIALGL

SEQ ID NO: 53067 - protein, 8 aa, Dengue virus
NGIALGLM

SEQ ID NO: 53068 - protein, 8 aa, Dengue virus
GIALGLMA

SEQ ID NO: 53069 - protein, 8 aa, Dengue virus
IALGLMAL

SEQ ID NO: 53070 - protein, 8 aa, Dengue virus
ALGLMALK

SEQ ID NO: 53071 - protein, 8 aa, Dengue virus
LGLMALKL

SEQ ID NO: 53072 - protein, 8 aa, Dengue virus
GLMALKLI

SEQ ID NO: 53073 - protein, 8 aa, Dengue virus
LMALKLIT

SEQ ID NO: 53074 - protein, 8 aa, Dengue virus
MALKLITQ

SEQ ID NO: 53075 - protein, 8 aa, Dengue virus
ALKLITQF

SEQ ID NO: 53076 - protein, 8 aa, Dengue virus
LKLITQFE

SEQ ID NO: 53077 - protein, 8 aa, Dengue virus
KLITQFET

SEQ ID NO: 53078 - protein, 8 aa, Dengue virus
LITQFETY

SEQ ID NO: 53079 - protein, 8 aa, Dengue virus
ITQFETYQ

SEQ ID NO: 53080 - protein, 8 aa, Dengue virus
TQFETYQL

SEQ ID NO: 53081 - protein, 8 aa, Dengue virus
QFETYQLW

SEQ ID NO: 53082 - protein, 8 aa, Dengue virus
FETYQLWT

SEQ ID NO: 53083 - protein, 8 aa, Dengue virus
ETYQLWTA

SEQ ID NO: 53084 - protein, 8 aa, Dengue virus
TYQLWTAL

SEQ ID NO: 53085 - protein, 8 aa, Dengue virus
YQLWTALI

SEQ ID NO: 53086 - protein, 8 aa, Dengue virus
QLWTALIS

SEQ ID NO: 53087 - protein, 8 aa, Dengue virus
LWTALISL

SEQ ID NO: 53088 - protein, 8 aa, Dengue virus
WTALISLT

SEQ ID NO: 53089 - protein, 8 aa, Dengue virus
TALISLTC

SEQ ID NO: 53090 - protein, 8 aa, Dengue virus
ALISLTCS

SEQ ID NO: 53091 - protein, 8 aa, Dengue virus
LISLTCSN

SEQ ID NO: 53092 - protein, 8 aa, Dengue virus
ISLTCSNT

SEQ ID NO: 53093 - protein, 8 aa, Dengue virus
SLTCSNTI

SEQ ID NO: 53094 - protein, 8 aa, Dengue virus
LTCSNTIF

SEQ ID NO: 53095 - protein, 8 aa, Dengue virus
TCSNTIFT

SEQ ID NO: 53096 - protein, 8 aa, Dengue virus
CSNTIFTL

SEQ ID NO: 53097 - protein, 8 aa, Dengue virus
SNTIFTLT

SEQ ID NO: 53098 - protein, 8 aa, Dengue virus
NTIFTLTV

SEQ ID NO: 53099 - protein, 8 aa, Dengue virus
TIFTLTVA

SEQ ID NO: 53100 - protein, 8 aa, Dengue virus
IFTLTVAW

SEQ ID NO: 53101 - protein, 8 aa, Dengue virus
FTLTVAWR

SEQ ID NO: 53102 - protein, 8 aa, Dengue virus
TLTVAWRT

SEQ ID NO: 53103 - protein, 8 aa, Dengue virus
LTVAWRTA

SEQ ID NO: 53104 - protein, 8 aa, Dengue virus
TVAWRTAT

SEQ ID NO: 53105 - protein, 8 aa, Dengue virus
VAWRTATL

SEQ ID NO: 53106 - protein, 8 aa, Dengue virus
AWRTATLI

SEQ ID NO: 53107 - protein, 8 aa, Dengue virus
WRTATLIL

SEQ ID NO: 53108 - protein, 8 aa, Dengue virus
RTATLILA

SEQ ID NO: 53109 - protein, 8 aa, Dengue virus
TATLILAG

SEQ ID NO: 53110 - protein, 8 aa, Dengue virus
ATLILAGV

SEQ ID NO: 53111 - protein, 8 aa, Dengue virus
TLILAGVS

SEQ ID NO: 53112 - protein, 8 aa, Dengue virus
LILAGVSL

SEQ ID NO: 53113 - protein, 8 aa, Dengue virus
ILAGVSLL

SEQ ID NO: 53114 - protein, 8 aa, Dengue virus
LAGVSLLP

SEQ ID NO: 53115 - protein, 8 aa, Dengue virus
VSLLPVCQ

SEQ ID NO: 53116 - protein, 8 aa, Dengue virus
SLLPVCQS

SEQ ID NO: 53117 - protein, 8 aa, Dengue virus
LLPVCQSS

SEQ ID NO: 53118 - protein, 8 aa, Dengue virus
LPVCQSSS

SEQ ID NO: 53119 - protein, 8 aa, Dengue virus
PVCQSSSM

SEQ ID NO: 53120 - protein, 8 aa, Dengue virus
VCQSSSMR

SEQ ID NO: 53121 - protein, 8 aa, Dengue virus
CQSSSMRK

SEQ ID NO: 53122 - protein, 8 aa, Dengue virus
QSSSMRKT

SEQ ID NO: 53123 - protein, 8 aa, Dengue virus
SSSMRKTD

SEQ ID NO: 53124 - protein, 8 aa, Dengue virus
SSMRKTDW

SEQ ID NO: 53125 - protein, 8 aa, Dengue virus
SMRKTDWL

SEQ ID NO: 53126 - protein, 8 aa, Dengue virus
MRKTDWLP

SEQ ID NO: 53127 - protein, 8 aa, Dengue virus
RKTDWLPM

SEQ ID NO: 53128 - protein, 8 aa, Dengue virus
KTDWLPMT

SEQ ID NO: 53129 - protein, 8 aa, Dengue virus
TDWLPMTV

SEQ ID NO: 53130 - protein, 8 aa, Dengue virus
DWLPMTVA

SEQ ID NO: 53131 - protein, 8 aa, Dengue virus
WLPMTVAA

SEQ ID NO: 53132 - protein, 8 aa, Dengue virus
LPMTVAAM

SEQ ID NO: 53133 - protein, 8 aa, Dengue virus
PMTVAAMG

SEQ ID NO: 53134 - protein, 8 aa, Dengue virus
MTVAAMGV

SEQ ID NO: 53135 - protein, 8 aa, Dengue virus
TVAAMGVP

SEQ ID NO: 53136 - protein, 8 aa, Dengue virus
VAAMGVPP

SEQ ID NO: 53137 - protein, 8 aa, Dengue virus
AAMGVPPL

SEQ ID NO: 53138 - protein, 8 aa, Dengue virus
AMGVPPLP

SEQ ID NO: 53139 - protein, 8 aa, Dengue virus
MGVPPLPL

SEQ ID NO: 53140 - protein, 8 aa, Dengue virus
GVPPLPLF

SEQ ID NO: 53141 - protein, 8 aa, Dengue virus
VPPLPLFI

SEQ ID NO: 53142 - protein, 8 aa, Dengue virus
PPLPLFIF

SEQ ID NO: 53143 - protein, 8 aa, Dengue virus
PLPLFIFS

SEQ ID NO: 53144 - protein, 8 aa, Dengue virus
LPLFIFSL

SEQ ID NO: 53145 - protein, 8 aa, Dengue virus
PLFIFSLK

SEQ ID NO: 53146 - protein, 8 aa, Dengue virus
LFIFSLKD

SEQ ID NO: 53147 - protein, 8 aa, Dengue virus
FIFSLKDT

SEQ ID NO: 53148 - protein, 8 aa, Dengue virus
LKDTLKRR

SEQ ID NO: 53149 - protein, 8 aa, Dengue virus
KDTLKRRS

SEQ ID NO: 53150 - protein, 8 aa, Dengue virus
DTLKRRSW

SEQ ID NO: 53151 - protein, 8 aa, Dengue virus
TLKRRSWP

SEQ ID NO: 53152 - protein, 8 aa, Dengue virus
LKRRSWPL

SEQ ID NO: 53153 - protein, 8 aa, Dengue virus
KRRSWPLN

SEQ ID NO: 53154 - protein, 8 aa, Dengue virus
RRSWPLNE

SEQ ID NO: 53155 - protein, 8 aa, Dengue virus
RSWPLNEG

SEQ ID NO: 53156 - protein, 8 aa, Dengue virus
SWPLNEGV

SEQ ID NO: 53157 - protein, 8 aa, Dengue virus
WPLNEGVM

SEQ ID NO: 53158 - protein, 8 aa, Dengue virus
PLNEGVMA

SEQ ID NO: 53159 - protein, 8 aa, Dengue virus
LNEGVMAV

SEQ ID NO: 53160 - protein, 8 aa, Dengue virus
NEGVMAVG

SEQ ID NO: 53161 - protein, 8 aa, Dengue virus
EGVMAVGL

SEQ ID NO: 53162 - protein, 8 aa, Dengue virus
GVMAVGLV

SEQ ID NO: 53163 - protein, 8 aa, Dengue virus
VMAVGLVS

SEQ ID NO: 53164 - protein, 8 aa, Dengue virus
MAVGLVSI

SEQ ID NO: 53165 - protein, 8 aa, Dengue virus
AVGLVSIL

SEQ ID NO: 53166 - protein, 8 aa, Dengue virus
VGLVSILA

SEQ ID NO: 53167 - protein, 8 aa, Dengue virus
GLVSILAS

SEQ ID NO: 53168 - protein, 8 aa, Dengue virus
LVSILASS

SEQ ID NO: 53169 - protein, 8 aa, Dengue virus
VSILASSL

SEQ ID NO: 53170 - protein, 8 aa, Dengue virus
SILASSLL

SEQ ID NO: 53171 - protein, 8 aa, Dengue virus
ILASSLLR

SEQ ID NO: 53172 - protein, 8 aa, Dengue virus
LASSLLRN

SEQ ID NO: 53173 - protein, 8 aa, Dengue virus
ASSLLRND

SEQ ID NO: 53174 - protein, 8 aa, Dengue virus
SSLLRNDV

SEQ ID NO: 53175 - protein, 8 aa, Dengue virus
SLLRNDVP

SEQ ID NO: 53176 - protein, 8 aa, Dengue virus
LLRNDVPM

SEQ ID NO: 53177 - protein, 8 aa, Dengue virus
LRNDVPMA

SEQ ID NO: 53178 - protein, 8 aa, Dengue virus
RNDVPMAG

SEQ ID NO: 53179 - protein, 8 aa, Dengue virus
NDVPMAGP

SEQ ID NO: 53180 - protein, 8 aa, Dengue virus
DVPMAGPL

SEQ ID NO: 53181 - protein, 8 aa, Dengue virus
VPMAGPLV

SEQ ID NO: 53182 - protein, 8 aa, Dengue virus
PMAGPLVA

SEQ ID NO: 53183 - protein, 8 aa, Dengue virus
MAGPLVAG

SEQ ID NO: 53184 - protein, 8 aa, Dengue virus
AGPLVAGG

SEQ ID NO: 53185 - protein, 8 aa, Dengue virus
GPLVAGGL

SEQ ID NO: 53186 - protein, 8 aa, Dengue virus
PLVAGGLL

SEQ ID NO: 53187 - protein, 8 aa, Dengue virus
LVAGGLLI

SEQ ID NO: 53188 - protein, 8 aa, Dengue virus
VAGGLLIA

SEQ ID NO: 53189 - protein, 8 aa, Dengue virus
AGGLLIAC

SEQ ID NO: 53190 - protein, 8 aa, Dengue virus
GGLLIACY

SEQ ID NO: 53191 - protein, 8 aa, Dengue virus
GLLIACYV

SEQ ID NO: 53192 - protein, 8 aa, Dengue virus
LLIACYVI

SEQ ID NO: 53193 - protein, 8 aa, Dengue virus
LIACYVIT

SEQ ID NO: 53194 - protein, 8 aa, Dengue virus
IACYVITG

SEQ ID NO: 53195 - protein, 8 aa, Dengue virus
ACYVITGT

SEQ ID NO: 53196 - protein, 8 aa, Dengue virus
CYVITGTS

SEQ ID NO: 53197 - protein, 8 aa, Dengue virus
YVITGTSA

SEQ ID NO: 53198 - protein, 8 aa, Dengue virus
VITGTSAD

SEQ ID NO: 53199 - protein, 8 aa, Dengue virus
ITGTSADL

SEQ ID NO: 53200 - protein, 8 aa, Dengue virus
TGTSADLT

SEQ ID NO: 53201 - protein, 8 aa, Dengue virus
GTSADLTV

SEQ ID NO: 53202 - protein, 8 aa, Dengue virus
TSADLTVE

SEQ ID NO: 53203 - protein, 8 aa, Dengue virus
SADLTVEK

SEQ ID NO: 53204 - protein, 8 aa, Dengue virus
ADLTVEKA

SEQ ID NO: 53205 - protein, 8 aa, Dengue virus
DLTVEKAA

SEQ ID NO: 53206 - protein, 8 aa, Dengue virus
LTVEKAAD

SEQ ID NO: 53207 - protein, 8 aa, Dengue virus
ADVTWEEE

SEQ ID NO: 53208 - protein, 8 aa, Dengue virus
DVTWEEEA

SEQ ID NO: 53209 - protein, 8 aa, Dengue virus
VTWEEEAE

SEQ ID NO: 53210 - protein, 8 aa, Dengue virus
TWEEEAEQ

SEQ ID NO: 53211 - protein, 8 aa, Dengue virus
WEEEAEQT

SEQ ID NO: 53212 - protein, 8 aa, Dengue virus
EEEAEQTG

SEQ ID NO: 53213 - protein, 8 aa, Dengue virus
EEAEQTGV

SEQ ID NO: 53214 - protein, 8 aa, Dengue virus
EAEQTGVS

SEQ ID NO: 53215 - protein, 8 aa, Dengue virus
AEQTGVSH

SEQ ID NO: 53216 - protein, 8 aa, Dengue virus
EQTGVSHN

SEQ ID NO: 53217 - protein, 8 aa, Dengue virus
QTGVSHNL

SEQ ID NO: 53218 - protein, 8 aa, Dengue virus
TGVSHNLM

SEQ ID NO: 53219 - protein, 8 aa, Dengue virus
GVSHNLMI

SEQ ID NO: 53220 - protein, 8 aa, Dengue virus
VSHNLMIT

SEQ ID NO: 53221 - protein, 8 aa, Dengue virus
SHNLMITV

SEQ ID NO: 53222 - protein, 8 aa, Dengue virus
HNLMITVD

SEQ ID NO: 53223 - protein, 8 aa, Dengue virus
NLMITVDD

SEQ ID NO: 53224 - protein, 8 aa, Dengue virus
LMITVDDD

SEQ ID NO: 53225 - protein, 8 aa, Dengue virus
MITVDDDG

SEQ ID NO: 53226 - protein, 8 aa, Dengue virus
ITVDDDGT

SEQ ID NO: 53227 - protein, 8 aa, Dengue virus
TVDDDGTM

SEQ ID NO: 53228 - protein, 8 aa, Dengue virus
VDDDGTMR

SEQ ID NO: 53229 - protein, 8 aa, Dengue virus
DDDGTMRI

SEQ ID NO: 53230 - protein, 8 aa, Dengue virus
DDGTMRIK

SEQ ID NO: 53231 - protein, 8 aa, Dengue virus
DGTMRIKD

SEQ ID NO: 53232 - protein, 8 aa, Dengue virus
GTMRIKDD

SEQ ID NO: 53233 - protein, 8 aa, Dengue virus
TMRIKDDE

SEQ ID NO: 53234 - protein, 8 aa, Dengue virus
MRIKDDET

SEQ ID NO: 53235 - protein, 8 aa, Dengue virus
RIKDDETE

SEQ ID NO: 53236 - protein, 8 aa, Dengue virus
IKDDETEN

SEQ ID NO: 53237 - protein, 8 aa, Dengue virus
KDDETENI

SEQ ID NO: 53238 - protein, 8 aa, Dengue virus
DDETENIL

SEQ ID NO: 53239 - protein, 8 aa, Dengue virus
DETENILT

SEQ ID NO: 53240 - protein, 8 aa, Dengue virus
ETENILTV

SEQ ID NO: 53241 - protein, 8 aa, Dengue virus
TENILTVL

SEQ ID NO: 53242 - protein, 8 aa, Dengue virus
ENILTVLL

SEQ ID NO: 53243 - protein, 8 aa, Dengue virus
NILTVLLK

SEQ ID NO: 53244 - protein, 8 aa, Dengue virus
ILTVLLKT

SEQ ID NO: 53245 - protein, 8 aa, Dengue virus
LTVLLKTA

SEQ ID NO: 53246 - protein, 8 aa, Dengue virus
TVLLKTAL

SEQ ID NO: 53247 - protein, 8 aa, Dengue virus
VLLKTALL

SEQ ID NO: 53248 - protein, 8 aa, Dengue virus
LLKTALLI

SEQ ID NO: 53249 - protein, 8 aa, Dengue virus
LKTALLIV

SEQ ID NO: 53250 - protein, 8 aa, Dengue virus
KTALLIVS

SEQ ID NO: 53251 - protein, 8 aa, Dengue virus
TALLIVSG

SEQ ID NO: 53252 - protein, 8 aa, Dengue virus
ALLIVSGI

SEQ ID NO: 53253 - protein, 8 aa, Dengue virus
LLIVSGIF

SEQ ID NO: 53254 - protein, 8 aa, Dengue virus
LIVSGIFP

SEQ ID NO: 53255 - protein, 8 aa, Dengue virus
IVSGIFPY

SEQ ID NO: 53256 - protein, 8 aa, Dengue virus
VSGIFPYS

SEQ ID NO: 53257 - protein, 8 aa, Dengue virus
SGIFPYSI

SEQ ID NO: 53258 - protein, 8 aa, Dengue virus
GIFPYSIP

SEQ ID NO: 53259 - protein, 8 aa, Dengue virus
IFPYSIPA

SEQ ID NO: 53260 - protein, 8 aa, Dengue virus
FPYSIPAT

SEQ ID NO: 53261 - protein, 8 aa, Dengue virus
PYSIPATL

SEQ ID NO: 53262 - protein, 8 aa, Dengue virus
YSIPATLL

SEQ ID NO: 53263 - protein, 8 aa, Dengue virus
SIPATLLV

SEQ ID NO: 53264 - protein, 8 aa, Dengue virus
IPATLLVW

SEQ ID NO: 53265 - protein, 8 aa, Dengue virus
PATLLVWH

SEQ ID NO: 53266 - protein, 8 aa, Dengue virus
ATLLVWHT

SEQ ID NO: 53267 - protein, 8 aa, Dengue virus
TLLVWHTW

SEQ ID NO: 53268 - protein, 8 aa, Dengue virus
LLVWHTWQ

SEQ ID NO: 53269 - protein, 8 aa, Dengue virus
LVWHTWQK

SEQ ID NO: 53270 - protein, 8 aa, Dengue virus
VWHTWQKQ

SEQ ID NO: 53271 - protein, 8 aa, Dengue virus
WHTWQKQT

SEQ ID NO: 53272 - protein, 8 aa, Dengue virus
HTWQKQTQ

SEQ ID NO: 53273 - protein, 8 aa, Dengue virus
TWQKQTQR

SEQ ID NO: 53274 - protein, 8 aa, Dengue virus
WQKQTQRS

SEQ ID NO: 53275 - protein, 8 aa, Dengue virus
QKQTQRSG

SEQ ID NO: 53276 - protein, 8 aa, Dengue virus
KQTQRSGV

SEQ ID NO: 53277 - protein, 8 aa, Dengue virus
QTQRSGVL

SEQ ID NO: 53278 - protein, 8 aa, Dengue virus
TQRSGVLW

SEQ ID NO: 53279 - protein, 8 aa, Dengue virus
QRSGVLWD

SEQ ID NO: 53280 - protein, 8 aa, Dengue virus
RSGVLWDV

SEQ ID NO: 53281 - protein, 8 aa, Dengue virus
SGVLWDVP

SEQ ID NO: 53282 - protein, 8 aa, Dengue virus
GVLWDVPS

SEQ ID NO: 53283 - protein, 8 aa, Dengue virus
VLWDVPSP

SEQ ID NO: 53284 - protein, 8 aa, Dengue virus
LWDVPSPP

SEQ ID NO: 53285 - protein, 8 aa, Dengue virus
WDVPSPPE

SEQ ID NO: 53286 - protein, 8 aa, Dengue virus
DVPSPPET

SEQ ID NO: 53287 - protein, 8 aa, Dengue virus
VPSPPETQ

SEQ ID NO: 53288 - protein, 8 aa, Dengue virus
PSPPETQK

SEQ ID NO: 53289 - protein, 8 aa, Dengue virus
SPPETQKA

SEQ ID NO: 53290 - protein, 8 aa, Dengue virus
PPETQKAE

SEQ ID NO: 53291 - protein, 8 aa, Dengue virus
PETQKAEL

SEQ ID NO: 53292 - protein, 8 aa, Dengue virus
ETQKAELE

SEQ ID NO: 53293 - protein, 8 aa, Dengue virus
TQKAELEE

SEQ ID NO: 53294 - protein, 8 aa, Dengue virus
QKAELEEG

SEQ ID NO: 53295 - protein, 8 aa, Dengue virus
KAELEEGV

SEQ ID NO: 53296 - protein, 8 aa, Dengue virus
AELEEGVY

SEQ ID NO: 53297 - protein, 8 aa, Dengue virus
ELEEGVYR

SEQ ID NO: 53298 - protein, 8 aa, Dengue virus
LEEGVYRI

SEQ ID NO: 53299 - protein, 8 aa, Dengue virus
EEGVYRIK

SEQ ID NO: 53300 - protein, 8 aa, Dengue virus
EGVYRIKQ

SEQ ID NO: 53301 - protein, 8 aa, Dengue virus
GVYRIKQQ

SEQ ID NO: 53302 - protein, 8 aa, Dengue virus
VYRIKQQG

SEQ ID NO: 53303 - protein, 8 aa, Dengue virus
YRIKQQGI

SEQ ID NO: 53304 - protein, 8 aa, Dengue virus
RIKQQGIF

SEQ ID NO: 53305 - protein, 8 aa, Dengue virus
IKQQGIFG

SEQ ID NO: 53306 - protein, 8 aa, Dengue virus
KQQGIFGK

SEQ ID NO: 53307 - protein, 8 aa, Dengue virus
QQGIFGKT

SEQ ID NO: 53308 - protein, 8 aa, Dengue virus
QGIFGKTQ

SEQ ID NO: 53309 - protein, 8 aa, Dengue virus
GIFGKTQV

SEQ ID NO: 53310 - protein, 8 aa, Dengue virus
IFGKTQVG

SEQ ID NO: 53311 - protein, 8 aa, Dengue virus
FGKTQVGV

SEQ ID NO: 53312 - protein, 8 aa, Dengue virus
GKTQVGVG

SEQ ID NO: 53313 - protein, 8 aa, Dengue virus
KTQVGVGV

SEQ ID NO: 53314 - protein, 8 aa, Dengue virus
TQVGVGVQ

SEQ ID NO: 53315 - protein, 8 aa, Dengue virus
QVGVGVQK

SEQ ID NO: 53316 - protein, 8 aa, Dengue virus
VGVGVQKE

SEQ ID NO: 53317 - protein, 8 aa, Dengue virus
GVGVQKEG

SEQ ID NO: 53318 - protein, 8 aa, Dengue virus
VGVQKEGV

SEQ ID NO: 53319 - protein, 8 aa, Dengue virus
GVQKEGVF

SEQ ID NO: 53320 - protein, 8 aa, Dengue virus
VQKEGVFH

SEQ ID NO: 53321 - protein, 8 aa, Dengue virus
QKEGVFHT

SEQ ID NO: 53322 - protein, 8 aa, Dengue virus
KEGVFHTM

SEQ ID NO: 53323 - protein, 8 aa, Dengue virus
EGVFHTMW

SEQ ID NO: 53324 - protein, 8 aa, Dengue virus
GVFHTMWH

SEQ ID NO: 53325 - protein, 8 aa, Dengue virus
VFHTMWHV

SEQ ID NO: 53326 - protein, 8 aa, Dengue virus
FHTMWHVT

SEQ ID NO: 53327 - protein, 8 aa, Dengue virus
HTMWHVTR

SEQ ID NO: 53328 - protein, 8 aa, Dengue virus
TMWHVTRG

SEQ ID NO: 53329 - protein, 8 aa, Dengue virus
MWHVTRGA

SEQ ID NO: 53330 - protein, 8 aa, Dengue virus
WHVTRGAV

SEQ ID NO: 53331 - protein, 8 aa, Dengue virus
HVTRGAVL

SEQ ID NO: 53332 - protein, 8 aa, Dengue virus
VTRGAVLT

SEQ ID NO: 53333 - protein, 8 aa, Dengue virus
TRGAVLTY

SEQ ID NO: 53334 - protein, 8 aa, Dengue virus
RGAVLTYN

SEQ ID NO: 53335 - protein, 8 aa, Dengue virus
GAVLTYNG

SEQ ID NO: 53336 - protein, 8 aa, Dengue virus
AVLTYNGK

SEQ ID NO: 53337 - protein, 8 aa, Dengue virus
VLTYNGKR

SEQ ID NO: 53338 - protein, 8 aa, Dengue virus
LTYNGKRL

SEQ ID NO: 53339 - protein, 8 aa, Dengue virus
TYNGKRLE

SEQ ID NO: 53340 - protein, 8 aa, Dengue virus
YNGKRLEP

SEQ ID NO: 53341 - protein, 8 aa, Dengue virus
NGKRLEPN

SEQ ID NO: 53342 - protein, 8 aa, Dengue virus
GKRLEPNW

SEQ ID NO: 53343 - protein, 8 aa, Dengue virus
KRLEPNWA

SEQ ID NO: 53344 - protein, 8 aa, Dengue virus
RLEPNWAS

SEQ ID NO: 53345 - protein, 8 aa, Dengue virus
LEPNWASV

SEQ ID NO: 53346 - protein, 8 aa, Dengue virus
EPNWASVK

SEQ ID NO: 53347 - protein, 8 aa, Dengue virus
PNWASVKK

SEQ ID NO: 53348 - protein, 8 aa, Dengue virus
NWASVKKD

SEQ ID NO: 53349 - protein, 8 aa, Dengue virus
WASVKKDL

SEQ ID NO: 53350 - protein, 8 aa, Dengue virus
ASVKKDLI

SEQ ID NO: 53351 - protein, 8 aa, Dengue virus
SVKKDLIS

SEQ ID NO: 53352 - protein, 8 aa, Dengue virus
VKKDLISY

SEQ ID NO: 53353 - protein, 8 aa, Dengue virus
KKDLISYG

SEQ ID NO: 53354 - protein, 8 aa, Dengue virus
KDLISYGG

SEQ ID NO: 53355 - protein, 8 aa, Dengue virus
DLISYGGG

SEQ ID NO: 53356 - protein, 8 aa, Dengue virus
LISYGGGW

SEQ ID NO: 53357 - protein, 8 aa, Dengue virus
ISYGGGWR

SEQ ID NO: 53358 - protein, 8 aa, Dengue virus
SYGGGWRL

SEQ ID NO: 53359 - protein, 8 aa, Dengue virus
YGGGWRLS

SEQ ID NO: 53360 - protein, 8 aa, Dengue virus
GGGWRLSA

SEQ ID NO: 53361 - protein, 8 aa, Dengue virus
GGWRLSAQ

SEQ ID NO: 53362 - protein, 8 aa, Dengue virus
GWRLSAQW

SEQ ID NO: 53363 - protein, 8 aa, Dengue virus
WRLSAQWQ

SEQ ID NO: 53364 - protein, 8 aa, Dengue virus
RLSAQWQK

SEQ ID NO: 53365 - protein, 8 aa, Dengue virus
LSAQWQKG

SEQ ID NO: 53366 - protein, 8 aa, Dengue virus
SAQWQKGE

SEQ ID NO: 53367 - protein, 8 aa, Dengue virus
AQWQKGEE

SEQ ID NO: 53368 - protein, 8 aa, Dengue virus
QWQKGEEV

SEQ ID NO: 53369 - protein, 8 aa, Dengue virus
WQKGEEVQ

SEQ ID NO: 53370 - protein, 8 aa, Dengue virus
QKGEEVQV

SEQ ID NO: 53371 - protein, 8 aa, Dengue virus
KGEEVQVI

SEQ ID NO: 53372 - protein, 8 aa, Dengue virus
GEEVQVIA

SEQ ID NO: 53373 - protein, 8 aa, Dengue virus
EEVQVIAV

SEQ ID NO: 53374 - protein, 8 aa, Dengue virus
EVQVIAVE

SEQ ID NO: 53375 - protein, 8 aa, Dengue virus
VQVIAVEP

SEQ ID NO: 53376 - protein, 8 aa, Dengue virus
QVIAVEPG

SEQ ID NO: 53377 - protein, 8 aa, Dengue virus
VIAVEPGK

SEQ ID NO: 53378 - protein, 8 aa, Dengue virus
IAVEPGKN

SEQ ID NO: 53379 - protein, 8 aa, Dengue virus
AVEPGKNP

SEQ ID NO: 53380 - protein, 8 aa, Dengue virus
VEPGKNPK

SEQ ID NO: 53381 - protein, 8 aa, Dengue virus
EPGKNPKN

SEQ ID NO: 53382 - protein, 8 aa, Dengue virus
PGKNPKNF

SEQ ID NO: 53383 - protein, 8 aa, Dengue virus
GKNPKNFQ

SEQ ID NO: 53384 - protein, 8 aa, Dengue virus
KNPKNFQT

SEQ ID NO: 53385 - protein, 8 aa, Dengue virus
NPKNFQTM

SEQ ID NO: 53386 - protein, 8 aa, Dengue virus
PKNFQTMP

SEQ ID NO: 53387 - protein, 8 aa, Dengue virus
KNFQTMPG

SEQ ID NO: 53388 - protein, 8 aa, Dengue virus
NFQTMPGT

SEQ ID NO: 53389 - protein, 8 aa, Dengue virus
FQTMPGTF

SEQ ID NO: 53390 - protein, 8 aa, Dengue virus
QTMPGTFQ

SEQ ID NO: 53391 - protein, 8 aa, Dengue virus
TMPGTFQT

SEQ ID NO: 53392 - protein, 8 aa, Dengue virus
MPGTFQTT

SEQ ID NO: 53393 - protein, 8 aa, Dengue virus
PGTFQTTT

SEQ ID NO: 53394 - protein, 8 aa, Dengue virus
GTFQTTTG

SEQ ID NO: 53395 - protein, 8 aa, Dengue virus
TFQTTTGE

SEQ ID NO: 53396 - protein, 8 aa, Dengue virus
FQTTTGEI

SEQ ID NO: 53397 - protein, 8 aa, Dengue virus
QTTTGEIG

SEQ ID NO: 53398 - protein, 8 aa, Dengue virus
TTTGEIGA

SEQ ID NO: 53399 - protein, 8 aa, Dengue virus
TTGEIGAI

SEQ ID NO: 53400 - protein, 8 aa, Dengue virus
TGEIGAIA

SEQ ID NO: 53401 - protein, 8 aa, Dengue virus
GEIGAIAL

SEQ ID NO: 53402 - protein, 8 aa, Dengue virus
EIGAIALD

SEQ ID NO: 53403 - protein, 8 aa, Dengue virus
IGAIALDF

SEQ ID NO: 53404 - protein, 8 aa, Dengue virus
GAIALDFK

SEQ ID NO: 53405 - protein, 8 aa, Dengue virus
AIALDFKP

SEQ ID NO: 53406 - protein, 8 aa, Dengue virus
IALDFKPG

SEQ ID NO: 53407 - protein, 8 aa, Dengue virus
ALDFKPGT

SEQ ID NO: 53408 - protein, 8 aa, Dengue virus
LDFKPGTS

SEQ ID NO: 53409 - protein, 8 aa, Dengue virus
DFKPGTSG

SEQ ID NO: 53410 - protein, 8 aa, Dengue virus
FKPGTSGS

SEQ ID NO: 53411 - protein, 8 aa, Dengue virus
KPGTSGSP

SEQ ID NO: 53412 - protein, 8 aa, Dengue virus
PGTSGSPI

SEQ ID NO: 53413 - protein, 8 aa, Dengue virus
GTSGSPII

SEQ ID NO: 53414 - protein, 8 aa, Dengue virus
TSGSPIIN

SEQ ID NO: 53415 - protein, 8 aa, Dengue virus
SGSPIINR

SEQ ID NO: 53416 - protein, 8 aa, Dengue virus
GSPIINRE

SEQ ID NO: 53417 - protein, 8 aa, Dengue virus
SPIINREG

SEQ ID NO: 53418 - protein, 8 aa, Dengue virus
PIINREGK

SEQ ID NO: 53419 - protein, 8 aa, Dengue virus
IINREGKV

SEQ ID NO: 53420 - protein, 8 aa, Dengue virus
INREGKVV

SEQ ID NO: 53421 - protein, 8 aa, Dengue virus
NREGKVVG

SEQ ID NO: 53422 - protein, 8 aa, Dengue virus
REGKVVGL

SEQ ID NO: 53423 - protein, 8 aa, Dengue virus
EGKVVGLY

SEQ ID NO: 53424 - protein, 8 aa, Dengue virus
GKVVGLYG

SEQ ID NO: 53425 - protein, 8 aa, Dengue virus
KVVGLYGN

SEQ ID NO: 53426 - protein, 8 aa, Dengue virus
VVGLYGNG

SEQ ID NO: 53427 - protein, 8 aa, Dengue virus
VGLYGNGV

SEQ ID NO: 53428 - protein, 8 aa, Dengue virus
GLYGNGVV

SEQ ID NO: 53429 - protein, 8 aa, Dengue virus
LYGNGVVT

SEQ ID NO: 53430 - protein, 8 aa, Dengue virus
YGNGVVTK

SEQ ID NO: 53431 - protein, 8 aa, Dengue virus
GNGVVTKN

SEQ ID NO: 53432 - protein, 8 aa, Dengue virus
NGVVTKNG

SEQ ID NO: 53433 - protein, 8 aa, Dengue virus
GVVTKNGG

SEQ ID NO: 53434 - protein, 8 aa, Dengue virus
VVTKNGGY

SEQ ID NO: 53435 - protein, 8 aa, Dengue virus
VTKNGGYV

SEQ ID NO: 53436 - protein, 8 aa, Dengue virus
TKNGGYVS

SEQ ID NO: 53437 - protein, 8 aa, Dengue virus
KNGGYVSG

SEQ ID NO: 53438 - protein, 8 aa, Dengue virus
NGGYVSGI

SEQ ID NO: 53439 - protein, 8 aa, Dengue virus
GGYVSGIA

SEQ ID NO: 53440 - protein, 8 aa, Dengue virus
GYVSGIAQ

SEQ ID NO: 53441 - protein, 8 aa, Dengue virus
YVSGIAQT

SEQ ID NO: 53442 - protein, 8 aa, Dengue virus
VSGIAQTN

SEQ ID NO: 53443 - protein, 8 aa, Dengue virus
SGIAQTNA

SEQ ID NO: 53444 - protein, 8 aa, Dengue virus
GIAQTNAE

SEQ ID NO: 53445 - protein, 8 aa, Dengue virus
IAQTNAEP

SEQ ID NO: 53446 - protein, 8 aa, Dengue virus
AQTNAEPD

SEQ ID NO: 53447 - protein, 8 aa, Dengue virus
QTNAEPDG

SEQ ID NO: 53448 - protein, 8 aa, Dengue virus
TNAEPDGP

SEQ ID NO: 53449 - protein, 8 aa, Dengue virus
NAEPDGPT

SEQ ID NO: 53450 - protein, 8 aa, Dengue virus
AEPDGPTP

SEQ ID NO: 53451 - protein, 8 aa, Dengue virus
EPDGPTPE

SEQ ID NO: 53452 - protein, 8 aa, Dengue virus
PDGPTPEL

SEQ ID NO: 53453 - protein, 8 aa, Dengue virus
DGPTPELE

SEQ ID NO: 53454 - protein, 8 aa, Dengue virus
GPTPELEE

SEQ ID NO: 53455 - protein, 8 aa, Dengue virus
PTPELEEE

SEQ ID NO: 53456 - protein, 8 aa, Dengue virus
TPELEEEM

SEQ ID NO: 53457 - protein, 8 aa, Dengue virus
PELEEEMF

SEQ ID NO: 53458 - protein, 8 aa, Dengue virus
ELEEEMFK

SEQ ID NO: 53459 - protein, 8 aa, Dengue virus
LEEEMFKK

SEQ ID NO: 53460 - protein, 8 aa, Dengue virus
EEEMFKKR

SEQ ID NO: 53461 - protein, 8 aa, Dengue virus
EEMFKKRN

SEQ ID NO: 53462 - protein, 8 aa, Dengue virus
EMFKKRNL

SEQ ID NO: 53463 - protein, 8 aa, Dengue virus
MFKKRNLT

SEQ ID NO: 53464 - protein, 8 aa, Dengue virus
FKKRNLTI

SEQ ID NO: 53465 - protein, 8 aa, Dengue virus
KKRNLTIM

SEQ ID NO: 53466 - protein, 8 aa, Dengue virus
KRNLTIMD

SEQ ID NO: 53467 - protein, 8 aa, Dengue virus
RNLTIMDL

SEQ ID NO: 53468 - protein, 8 aa, Dengue virus
NLTIMDLH

SEQ ID NO: 53469 - protein, 8 aa, Dengue virus
LTIMDLHP

SEQ ID NO: 53470 - protein, 8 aa, Dengue virus
TIMDLHPG

SEQ ID NO: 53471 - protein, 8 aa, Dengue virus
IMDLHPGS

SEQ ID NO: 53472 - protein, 8 aa, Dengue virus
MDLHPGSG

SEQ ID NO: 53473 - protein, 8 aa, Dengue virus
DLHPGSGK

SEQ ID NO: 53474 - protein, 8 aa, Dengue virus
LHPGSGKT

SEQ ID NO: 53475 - protein, 8 aa, Dengue virus
HPGSGKTR

SEQ ID NO: 53476 - protein, 8 aa, Dengue virus
PGSGKTRK

SEQ ID NO: 53477 - protein, 8 aa, Dengue virus
GSGKTRKY

SEQ ID NO: 53478 - protein, 8 aa, Dengue virus
SGKTRKYL

SEQ ID NO: 53479 - protein, 8 aa, Dengue virus
GKTRKYLP

SEQ ID NO: 53480 - protein, 8 aa, Dengue virus
KTRKYLPA

SEQ ID NO: 53481 - protein, 8 aa, Dengue virus
TRKYLPAI

SEQ ID NO: 53482 - protein, 8 aa, Dengue virus
RKYLPAIV

SEQ ID NO: 53483 - protein, 8 aa, Dengue virus
KYLPAIVR

SEQ ID NO: 53484 - protein, 8 aa, Dengue virus
YLPAIVRE

SEQ ID NO: 53485 - protein, 8 aa, Dengue virus
LPAIVREA

SEQ ID NO: 53486 - protein, 8 aa, Dengue virus
PAIVREAI

SEQ ID NO: 53487 - protein, 8 aa, Dengue virus
AIVREAIK

SEQ ID NO: 53488 - protein, 8 aa, Dengue virus
IVREAIKR

SEQ ID NO: 53489 - protein, 8 aa, Dengue virus
VREAIKRR

SEQ ID NO: 53490 - protein, 8 aa, Dengue virus
REAIKRRL

SEQ ID NO: 53491 - protein, 8 aa, Dengue virus
EAIKRRLR

SEQ ID NO: 53492 - protein, 8 aa, Dengue virus
AIKRRLRT

SEQ ID NO: 53493 - protein, 8 aa, Dengue virus
IKRRLRTL

SEQ ID NO: 53494 - protein, 8 aa, Dengue virus
KRRLRTLI

SEQ ID NO: 53495 - protein, 8 aa, Dengue virus
RRLRTLIL

SEQ ID NO: 53496 - protein, 8 aa, Dengue virus
RLRTLILA

SEQ ID NO: 53497 - protein, 8 aa, Dengue virus
LRTLILAP

SEQ ID NO: 53498 - protein, 8 aa, Dengue virus
RTLILAPT

SEQ ID NO: 53499 - protein, 8 aa, Dengue virus
TLILAPTR

SEQ ID NO: 53500 - protein, 8 aa, Dengue virus
LILAPTRV

SEQ ID NO: 53501 - protein, 8 aa, Dengue virus
ILAPTRVV

SEQ ID NO: 53502 - protein, 8 aa, Dengue virus
LAPTRVVA

SEQ ID NO: 53503 - protein, 8 aa, Dengue virus
APTRVVAA

SEQ ID NO: 53504 - protein, 8 aa, Dengue virus
PTRVVAAE

SEQ ID NO: 53505 - protein, 8 aa, Dengue virus
TRVVAAEM

SEQ ID NO: 53506 - protein, 8 aa, Dengue virus
RVVAAEME

SEQ ID NO: 53507 - protein, 8 aa, Dengue virus
VVAAEMEE

SEQ ID NO: 53508 - protein, 8 aa, Dengue virus
VAAEMEEA

SEQ ID NO: 53509 - protein, 8 aa, Dengue virus
AAEMEEAL

SEQ ID NO: 53510 - protein, 8 aa, Dengue virus
AEMEEALK

SEQ ID NO: 53511 - protein, 8 aa, Dengue virus
EMEEALKG

SEQ ID NO: 53512 - protein, 8 aa, Dengue virus
MEEALKGL

SEQ ID NO: 53513 - protein, 8 aa, Dengue virus
EEALKGLP

SEQ ID NO: 53514 - protein, 8 aa, Dengue virus
EALKGLPI

SEQ ID NO: 53515 - protein, 8 aa, Dengue virus
ALKGLPIR

SEQ ID NO: 53516 - protein, 8 aa, Dengue virus
LKGLPIRY

SEQ ID NO: 53517 - protein, 8 aa, Dengue virus
KGLPIRYQ

SEQ ID NO: 53518 - protein, 8 aa, Dengue virus
GLPIRYQT

SEQ ID NO: 53519 - protein, 8 aa, Dengue virus
LPIRYQTT

SEQ ID NO: 53520 - protein, 8 aa, Dengue virus
PIRYQTTA

SEQ ID NO: 53521 - protein, 8 aa, Dengue virus
IRYQTTAT

SEQ ID NO: 53522 - protein, 8 aa, Dengue virus
RYQTTATK

SEQ ID NO: 53523 - protein, 8 aa, Dengue virus
YQTTATKS

SEQ ID NO: 53524 - protein, 8 aa, Dengue virus
QTTATKSE

SEQ ID NO: 53525 - protein, 8 aa, Dengue virus
TTATKSEH

SEQ ID NO: 53526 - protein, 8 aa, Dengue virus
TATKSEHT

SEQ ID NO: 53527 - protein, 8 aa, Dengue virus
ATKSEHTG

SEQ ID NO: 53528 - protein, 8 aa, Dengue virus
TKSEHTGR

SEQ ID NO: 53529 - protein, 8 aa, Dengue virus
KSEHTGRE

SEQ ID NO: 53530 - protein, 8 aa, Dengue virus
SEHTGREI

SEQ ID NO: 53531 - protein, 8 aa, Dengue virus
EHTGREIV

SEQ ID NO: 53532 - protein, 8 aa, Dengue virus
HTGREIVD

SEQ ID NO: 53533 - protein, 8 aa, Dengue virus
TGREIVDL

SEQ ID NO: 53534 - protein, 8 aa, Dengue virus
GREIVDLM

SEQ ID NO: 53535 - protein, 8 aa, Dengue virus
REIVDLMC

SEQ ID NO: 53536 - protein, 8 aa, Dengue virus
EIVDLMCH

SEQ ID NO: 53537 - protein, 8 aa, Dengue virus
IVDLMCHA

SEQ ID NO: 53538 - protein, 8 aa, Dengue virus
VDLMCHAT

SEQ ID NO: 53539 - protein, 8 aa, Dengue virus
DLMCHATF

SEQ ID NO: 53540 - protein, 8 aa, Dengue virus
LMCHATFT

SEQ ID NO: 53541 - protein, 8 aa, Dengue virus
MCHATFTM

SEQ ID NO: 53542 - protein, 8 aa, Dengue virus
CHATFTMR

SEQ ID NO: 53543 - protein, 8 aa, Dengue virus
HATFTMRL

SEQ ID NO: 53544 - protein, 8 aa, Dengue virus
ATFTMRLL

SEQ ID NO: 53545 - protein, 8 aa, Dengue virus
TFTMRLLS

SEQ ID NO: 53546 - protein, 8 aa, Dengue virus
FTMRLLSP

SEQ ID NO: 53547 - protein, 8 aa, Dengue virus
TMRLLSPV

SEQ ID NO: 53548 - protein, 8 aa, Dengue virus
MRLLSPVR

SEQ ID NO: 53549 - protein, 8 aa, Dengue virus
RLLSPVRV

SEQ ID NO: 53550 - protein, 8 aa, Dengue virus
LLSPVRVP

SEQ ID NO: 53551 - protein, 8 aa, Dengue virus
LSPVRVPN

SEQ ID NO: 53552 - protein, 8 aa, Dengue virus
SPVRVPNY

SEQ ID NO: 53553 - protein, 8 aa, Dengue virus
PVRVPNYN

SEQ ID NO: 53554 - protein, 8 aa, Dengue virus
VRVPNYNL

SEQ ID NO: 53555 - protein, 8 aa, Dengue virus
RVPNYNLI

SEQ ID NO: 53556 - protein, 8 aa, Dengue virus
VPNYNLII

SEQ ID NO: 53557 - protein, 8 aa, Dengue virus
PNYNLIIM

SEQ ID NO: 53558 - protein, 8 aa, Dengue virus
NYNLIIMD

SEQ ID NO: 53559 - protein, 8 aa, Dengue virus
YNLIIMDE

SEQ ID NO: 53560 - protein, 8 aa, Dengue virus
NLIIMDEA

SEQ ID NO: 53561 - protein, 8 aa, Dengue virus
LIIMDEAH

SEQ ID NO: 53562 - protein, 8 aa, Dengue virus
IIMDEAHF

SEQ ID NO: 53563 - protein, 8 aa, Dengue virus
IMDEAHFT

SEQ ID NO: 53564 - protein, 8 aa, Dengue virus
MDEAHFTD

SEQ ID NO: 53565 - protein, 8 aa, Dengue virus
DEAHFTDP

SEQ ID NO: 53566 - protein, 8 aa, Dengue virus
EAHFTDPA

SEQ ID NO: 53567 - protein, 8 aa, Dengue virus
AHFTDPAS

SEQ ID NO: 53568 - protein, 8 aa, Dengue virus
HFTDPASI

SEQ ID NO: 53569 - protein, 8 aa, Dengue virus
FTDPASIA

SEQ ID NO: 53570 - protein, 8 aa, Dengue virus
TDPASIAA

SEQ ID NO: 53571 - protein, 8 aa, Dengue virus
DPASIAAR

SEQ ID NO: 53572 - protein, 8 aa, Dengue virus
PASIAARG

SEQ ID NO: 53573 - protein, 8 aa, Dengue virus
ASIAARGY

SEQ ID NO: 53574 - protein, 8 aa, Dengue virus
SIAARGYI

SEQ ID NO: 53575 - protein, 8 aa, Dengue virus
IAARGYIS

SEQ ID NO: 53576 - protein, 8 aa, Dengue virus
AARGYIST

SEQ ID NO: 53577 - protein, 8 aa, Dengue virus
ARGYISTR

SEQ ID NO: 53578 - protein, 8 aa, Dengue virus
RGYISTRV

SEQ ID NO: 53579 - protein, 8 aa, Dengue virus
GYISTRVG

SEQ ID NO: 53580 - protein, 8 aa, Dengue virus
YISTRVGM

SEQ ID NO: 53581 - protein, 8 aa, Dengue virus
ISTRVGMG

SEQ ID NO: 53582 - protein, 8 aa, Dengue virus
STRVGMGE

SEQ ID NO: 53583 - protein, 8 aa, Dengue virus
TRVGMGEA

SEQ ID NO: 53584 - protein, 8 aa, Dengue virus
RVGMGEAA

SEQ ID NO: 53585 - protein, 8 aa, Dengue virus
VGMGEAAA

SEQ ID NO: 53586 - protein, 8 aa, Dengue virus
GMGEAAAI

SEQ ID NO: 53587 - protein, 8 aa, Dengue virus
MGEAAAIF

SEQ ID NO: 53588 - protein, 8 aa, Dengue virus
GEAAAIFM

SEQ ID NO: 53589 - protein, 8 aa, Dengue virus
EAAAIFMT

SEQ ID NO: 53590 - protein, 8 aa, Dengue virus
AAAIFMTA

SEQ ID NO: 53591 - protein, 8 aa, Dengue virus
AAIFMTAT

SEQ ID NO: 53592 - protein, 8 aa, Dengue virus
AIFMTATP

SEQ ID NO: 53593 - protein, 8 aa, Dengue virus
IFMTATPP

SEQ ID NO: 53594 - protein, 8 aa, Dengue virus
FMTATPPG

SEQ ID NO: 53595 - protein, 8 aa, Dengue virus
MTATPPGT

SEQ ID NO: 53596 - protein, 8 aa, Dengue virus
TATPPGTA

SEQ ID NO: 53597 - protein, 8 aa, Dengue virus
ATPPGTAD

SEQ ID NO: 53598 - protein, 8 aa, Dengue virus
TPPGTADA

SEQ ID NO: 53599 - protein, 8 aa, Dengue virus
PPGTADAF

SEQ ID NO: 53600 - protein, 8 aa, Dengue virus
PGTADAFP

SEQ ID NO: 53601 - protein, 8 aa, Dengue virus
GTADAFPQ

SEQ ID NO: 53602 - protein, 8 aa, Dengue virus
TADAFPQS

SEQ ID NO: 53603 - protein, 8 aa, Dengue virus
ADAFPQSN

SEQ ID NO: 53604 - protein, 8 aa, Dengue virus
DAFPQSNA

SEQ ID NO: 53605 - protein, 8 aa, Dengue virus
AFPQSNAP

SEQ ID NO: 53606 - protein, 8 aa, Dengue virus
FPQSNAPI

SEQ ID NO: 53607 - protein, 8 aa, Dengue virus
PQSNAPIQ

SEQ ID NO: 53608 - protein, 8 aa, Dengue virus
QSNAPIQD

SEQ ID NO: 53609 - protein, 8 aa, Dengue virus
SNAPIQDE

SEQ ID NO: 53610 - protein, 8 aa, Dengue virus
NAPIQDEE

SEQ ID NO: 53611 - protein, 8 aa, Dengue virus
APIQDEER

SEQ ID NO: 53612 - protein, 8 aa, Dengue virus
PIQDEERD

SEQ ID NO: 53613 - protein, 8 aa, Dengue virus
IQDEERDI

SEQ ID NO: 53614 - protein, 8 aa, Dengue virus
QDEERDIP

SEQ ID NO: 53615 - protein, 8 aa, Dengue virus
DEERDIPE

SEQ ID NO: 53616 - protein, 8 aa, Dengue virus
EERDIPER

SEQ ID NO: 53617 - protein, 8 aa, Dengue virus
ERDIPERS

SEQ ID NO: 53618 - protein, 8 aa, Dengue virus
RDIPERSW

SEQ ID NO: 53619 - protein, 8 aa, Dengue virus
DIPERSWN

SEQ ID NO: 53620 - protein, 8 aa, Dengue virus
IPERSWNS

SEQ ID NO: 53621 - protein, 8 aa, Dengue virus
PERSWNSG

SEQ ID NO: 53622 - protein, 8 aa, Dengue virus
ERSWNSGN

SEQ ID NO: 53623 - protein, 8 aa, Dengue virus
RSWNSGNE

SEQ ID NO: 53624 - protein, 8 aa, Dengue virus
SWNSGNEW

SEQ ID NO: 53625 - protein, 8 aa, Dengue virus
WNSGNEWI

SEQ ID NO: 53626 - protein, 8 aa, Dengue virus
NSGNEWIT

SEQ ID NO: 53627 - protein, 8 aa, Dengue virus
SGNEWITD

SEQ ID NO: 53628 - protein, 8 aa, Dengue virus
GNEWITDF

SEQ ID NO: 53629 - protein, 8 aa, Dengue virus
NEWITDFA

SEQ ID NO: 53630 - protein, 8 aa, Dengue virus
EWITDFAG

SEQ ID NO: 53631 - protein, 8 aa, Dengue virus
WITDFAGK

SEQ ID NO: 53632 - protein, 8 aa, Dengue virus
ITDFAGKT

SEQ ID NO: 53633 - protein, 8 aa, Dengue virus
TDFAGKTV

SEQ ID NO: 53634 - protein, 8 aa, Dengue virus
DFAGKTVW

SEQ ID NO: 53635 - protein, 8 aa, Dengue virus
FAGKTVWF

SEQ ID NO: 53636 - protein, 8 aa, Dengue virus
AGKTVWFV

SEQ ID NO: 53637 - protein, 8 aa, Dengue virus
GKTVWFVP

SEQ ID NO: 53638 - protein, 8 aa, Dengue virus
KTVWFVPS

SEQ ID NO: 53639 - protein, 8 aa, Dengue virus
TVWFVPSI

SEQ ID NO: 53640 - protein, 8 aa, Dengue virus
VWFVPSIK

SEQ ID NO: 53641 - protein, 8 aa, Dengue virus
WFVPSIKA

SEQ ID NO: 53642 - protein, 8 aa, Dengue virus
FVPSIKAG

SEQ ID NO: 53643 - protein, 8 aa, Dengue virus
VPSIKAGN

SEQ ID NO: 53644 - protein, 8 aa, Dengue virus
PSIKAGND

SEQ ID NO: 53645 - protein, 8 aa, Dengue virus
SIKAGNDI

SEQ ID NO: 53646 - protein, 8 aa, Dengue virus
IKAGNDIA

SEQ ID NO: 53647 - protein, 8 aa, Dengue virus
KAGNDIAN

SEQ ID NO: 53648 - protein, 8 aa, Dengue virus
AGNDIANC

SEQ ID NO: 53649 - protein, 8 aa, Dengue virus
GNDIANCL

SEQ ID NO: 53650 - protein, 8 aa, Dengue virus
NDIANCLR

SEQ ID NO: 53651 - protein, 8 aa, Dengue virus
DIANCLRK

SEQ ID NO: 53652 - protein, 8 aa, Dengue virus
IANCLRKN

SEQ ID NO: 53653 - protein, 8 aa, Dengue virus
ANCLRKNG

SEQ ID NO: 53654 - protein, 8 aa, Dengue virus
NCLRKNGK

SEQ ID NO: 53655 - protein, 8 aa, Dengue virus
CLRKNGKK

SEQ ID NO: 53656 - protein, 8 aa, Dengue virus
LRKNGKKV

SEQ ID NO: 53657 - protein, 8 aa, Dengue virus
RKNGKKVI

SEQ ID NO: 53658 - protein, 8 aa, Dengue virus
KNGKKVIQ

SEQ ID NO: 53659 - protein, 8 aa, Dengue virus
NGKKVIQL

SEQ ID NO: 53660 - protein, 8 aa, Dengue virus
GKKVIQLS

SEQ ID NO: 53661 - protein, 8 aa, Dengue virus
KKVIQLSR

SEQ ID NO: 53662 - protein, 8 aa, Dengue virus
KVIQLSRK

SEQ ID NO: 53663 - protein, 8 aa, Dengue virus
VIQLSRKT

SEQ ID NO: 53664 - protein, 8 aa, Dengue virus
IQLSRKTF

SEQ ID NO: 53665 - protein, 8 aa, Dengue virus
QLSRKTFD

SEQ ID NO: 53666 - protein, 8 aa, Dengue virus
LSRKTFDT

SEQ ID NO: 53667 - protein, 8 aa, Dengue virus
SRKTFDTE

SEQ ID NO: 53668 - protein, 8 aa, Dengue virus
RKTFDTEY

SEQ ID NO: 53669 - protein, 8 aa, Dengue virus
KTFDTEYQ

SEQ ID NO: 53670 - protein, 8 aa, Dengue virus
TFDTEYQK

SEQ ID NO: 53671 - protein, 8 aa, Dengue virus
FDTEYQKT

SEQ ID NO: 53672 - protein, 8 aa, Dengue virus
DTEYQKTK

SEQ ID NO: 53673 - protein, 8 aa, Dengue virus
TEYQKTKL

SEQ ID NO: 53674 - protein, 8 aa, Dengue virus
EYQKTKLN

SEQ ID NO: 53675 - protein, 8 aa, Dengue virus
YQKTKLND

SEQ ID NO: 53676 - protein, 8 aa, Dengue virus
QKTKLNDW

SEQ ID NO: 53677 - protein, 8 aa, Dengue virus
KTKLNDWD

SEQ ID NO: 53678 - protein, 8 aa, Dengue virus
TKLNDWDF

SEQ ID NO: 53679 - protein, 8 aa, Dengue virus
KLNDWDFV

SEQ ID NO: 53680 - protein, 8 aa, Dengue virus
LNDWDFVV

SEQ ID NO: 53681 - protein, 8 aa, Dengue virus
NDWDFVVT

SEQ ID NO: 53682 - protein, 8 aa, Dengue virus
DWDFVVTT

SEQ ID NO: 53683 - protein, 8 aa, Dengue virus
WDFVVTTD

SEQ ID NO: 53684 - protein, 8 aa, Dengue virus
DFVVTTDI

SEQ ID NO: 53685 - protein, 8 aa, Dengue virus
FVVTTDIS

SEQ ID NO: 53686 - protein, 8 aa, Dengue virus
VVTTDISE

SEQ ID NO: 53687 - protein, 8 aa, Dengue virus
VTTDISEM

SEQ ID NO: 53688 - protein, 8 aa, Dengue virus
TTDISEMG

SEQ ID NO: 53689 - protein, 8 aa, Dengue virus
TDISEMGA

SEQ ID NO: 53690 - protein, 8 aa, Dengue virus
DISEMGAN

SEQ ID NO: 53691 - protein, 8 aa, Dengue virus
ISEMGANF

SEQ ID NO: 53692 - protein, 8 aa, Dengue virus
SEMGANFK

SEQ ID NO: 53693 - protein, 8 aa, Dengue virus
EMGANFKA

SEQ ID NO: 53694 - protein, 8 aa, Dengue virus
MGANFKAD

SEQ ID NO: 53695 - protein, 8 aa, Dengue virus
GANFKADR

SEQ ID NO: 53696 - protein, 8 aa, Dengue virus
ANFKADRV

SEQ ID NO: 53697 - protein, 8 aa, Dengue virus
NFKADRVI

SEQ ID NO: 53698 - protein, 8 aa, Dengue virus
FKADRVID

SEQ ID NO: 53699 - protein, 8 aa, Dengue virus
KADRVIDP

SEQ ID NO: 53700 - protein, 8 aa, Dengue virus
ADRVIDPR

SEQ ID NO: 53701 - protein, 8 aa, Dengue virus
DRVIDPRR

SEQ ID NO: 53702 - protein, 8 aa, Dengue virus
RVIDPRRC

SEQ ID NO: 53703 - protein, 8 aa, Dengue virus
VIDPRRCL

SEQ ID NO: 53704 - protein, 8 aa, Dengue virus
IDPRRCLK

SEQ ID NO: 53705 - protein, 8 aa, Dengue virus
DPRRCLKP

SEQ ID NO: 53706 - protein, 8 aa, Dengue virus
PRRCLKPV

SEQ ID NO: 53707 - protein, 8 aa, Dengue virus
RRCLKPVI

SEQ ID NO: 53708 - protein, 8 aa, Dengue virus
RCLKPVIL

SEQ ID NO: 53709 - protein, 8 aa, Dengue virus
CLKPVILT

SEQ ID NO: 53710 - protein, 8 aa, Dengue virus
LKPVILTD

SEQ ID NO: 53711 - protein, 8 aa, Dengue virus
KPVILTDG

SEQ ID NO: 53712 - protein, 8 aa, Dengue virus
PVILTDGP

SEQ ID NO: 53713 - protein, 8 aa, Dengue virus
VILTDGPE

SEQ ID NO: 53714 - protein, 8 aa, Dengue virus
ILTDGPER

SEQ ID NO: 53715 - protein, 8 aa, Dengue virus
LTDGPERV

SEQ ID NO: 53716 - protein, 8 aa, Dengue virus
TDGPERVI

SEQ ID NO: 53717 - protein, 8 aa, Dengue virus
DGPERVIL

SEQ ID NO: 53718 - protein, 8 aa, Dengue virus
GPERVILA

SEQ ID NO: 53719 - protein, 8 aa, Dengue virus
PERVILAG

SEQ ID NO: 53720 - protein, 8 aa, Dengue virus
ERVILAGP

SEQ ID NO: 53721 - protein, 8 aa, Dengue virus
RVILAGPM

SEQ ID NO: 53722 - protein, 8 aa, Dengue virus
VILAGPMP

SEQ ID NO: 53723 - protein, 8 aa, Dengue virus
ILAGPMPV

SEQ ID NO: 53724 - protein, 8 aa, Dengue virus
LAGPMPVT

SEQ ID NO: 53725 - protein, 8 aa, Dengue virus
AGPMPVTA

SEQ ID NO: 53726 - protein, 8 aa, Dengue virus
GPMPVTAA

SEQ ID NO: 53727 - protein, 8 aa, Dengue virus
PMPVTAAS

SEQ ID NO: 53728 - protein, 8 aa, Dengue virus
MPVTAASA

SEQ ID NO: 53729 - protein, 8 aa, Dengue virus
PVTAASAA

SEQ ID NO: 53730 - protein, 8 aa, Dengue virus
VTAASAAQ

SEQ ID NO: 53731 - protein, 8 aa, Dengue virus
TAASAAQR

SEQ ID NO: 53732 - protein, 8 aa, Dengue virus
AASAAQRR

SEQ ID NO: 53733 - protein, 8 aa, Dengue virus
ASAAQRRG

SEQ ID NO: 53734 - protein, 8 aa, Dengue virus
SAAQRRGR

SEQ ID NO: 53735 - protein, 8 aa, Dengue virus
AAQRRGRV

SEQ ID NO: 53736 - protein, 8 aa, Dengue virus
AQRRGRVG

SEQ ID NO: 53737 - protein, 8 aa, Dengue virus
QRRGRVGR

SEQ ID NO: 53738 - protein, 8 aa, Dengue virus
RRGRVGRN

SEQ ID NO: 53739 - protein, 8 aa, Dengue virus
RGRVGRNP

SEQ ID NO: 53740 - protein, 8 aa, Dengue virus
GRVGRNPQ

SEQ ID NO: 53741 - protein, 8 aa, Dengue virus
RVGRNPQK

SEQ ID NO: 53742 - protein, 8 aa, Dengue virus
VGRNPQKE

SEQ ID NO: 53743 - protein, 8 aa, Dengue virus
GRNPQKEN

SEQ ID NO: 53744 - protein, 8 aa, Dengue virus
RNPQKEND

SEQ ID NO: 53745 - protein, 8 aa, Dengue virus
NPQKENDQ

SEQ ID NO: 53746 - protein, 8 aa, Dengue virus
PQKENDQY

SEQ ID NO: 53747 - protein, 8 aa, Dengue virus
QKENDQYI

SEQ ID NO: 53748 - protein, 8 aa, Dengue virus
KENDQYIF

SEQ ID NO: 53749 - protein, 8 aa, Dengue virus
ENDQYIFT

SEQ ID NO: 53750 - protein, 8 aa, Dengue virus
NDQYIFTG

SEQ ID NO: 53751 - protein, 8 aa, Dengue virus
DQYIFTGQ

SEQ ID NO: 53752 - protein, 8 aa, Dengue virus
QYIFTGQP

SEQ ID NO: 53753 - protein, 8 aa, Dengue virus
YIFTGQPL

SEQ ID NO: 53754 - protein, 8 aa, Dengue virus
IFTGQPLN

SEQ ID NO: 53755 - protein, 8 aa, Dengue virus
FTGQPLNN

SEQ ID NO: 53756 - protein, 8 aa, Dengue virus
TGQPLNND

SEQ ID NO: 53757 - protein, 8 aa, Dengue virus
GQPLNNDE

SEQ ID NO: 53758 - protein, 8 aa, Dengue virus
QPLNNDED

SEQ ID NO: 53759 - protein, 8 aa, Dengue virus
PLNNDEDH

SEQ ID NO: 53760 - protein, 8 aa, Dengue virus
LNNDEDHA

SEQ ID NO: 53761 - protein, 8 aa, Dengue virus
NNDEDHAH

SEQ ID NO: 53762 - protein, 8 aa, Dengue virus
NDEDHAHW

SEQ ID NO: 53763 - protein, 8 aa, Dengue virus
DEDHAHWT

SEQ ID NO: 53764 - protein, 8 aa, Dengue virus
EDHAHWTE

SEQ ID NO: 53765 - protein, 8 aa, Dengue virus
DHAHWTEA

SEQ ID NO: 53766 - protein, 8 aa, Dengue virus
HAHWTEAK

SEQ ID NO: 53767 - protein, 8 aa, Dengue virus
AHWTEAKM

SEQ ID NO: 53768 - protein, 8 aa, Dengue virus
HWTEAKML

SEQ ID NO: 53769 - protein, 8 aa, Dengue virus
WTEAKMLL

SEQ ID NO: 53770 - protein, 8 aa, Dengue virus
TEAKMLLD

SEQ ID NO: 53771 - protein, 8 aa, Dengue virus
EAKMLLDN

SEQ ID NO: 53772 - protein, 8 aa, Dengue virus
AKMLLDNI

SEQ ID NO: 53773 - protein, 8 aa, Dengue virus
KMLLDNIN

SEQ ID NO: 53774 - protein, 8 aa, Dengue virus
MLLDNINT

SEQ ID NO: 53775 - protein, 8 aa, Dengue virus
LLDNINTP

SEQ ID NO: 53776 - protein, 8 aa, Dengue virus
LDNINTPE

SEQ ID NO: 53777 - protein, 8 aa, Dengue virus
DNINTPEG

SEQ ID NO: 53778 - protein, 8 aa, Dengue virus
NINTPEGI

SEQ ID NO: 53779 - protein, 8 aa, Dengue virus
INTPEGII

SEQ ID NO: 53780 - protein, 8 aa, Dengue virus
NTPEGIIP

SEQ ID NO: 53781 - protein, 8 aa, Dengue virus
TPEGIIPA

SEQ ID NO: 53782 - protein, 8 aa, Dengue virus
PEGIIPAL

SEQ ID NO: 53783 - protein, 8 aa, Dengue virus
EGIIPALF

SEQ ID NO: 53784 - protein, 8 aa, Dengue virus
GIIPALFE

SEQ ID NO: 53785 - protein, 8 aa, Dengue virus
IIPALFEP

SEQ ID NO: 53786 - protein, 8 aa, Dengue virus
IPALFEPE

SEQ ID NO: 53787 - protein, 8 aa, Dengue virus
PALFEPER

SEQ ID NO: 53788 - protein, 8 aa, Dengue virus
ALFEPERE

SEQ ID NO: 53789 - protein, 8 aa, Dengue virus
LFEPEREK

SEQ ID NO: 53790 - protein, 8 aa, Dengue virus
FEPEREKS

SEQ ID NO: 53791 - protein, 8 aa, Dengue virus
EPEREKSA

SEQ ID NO: 53792 - protein, 8 aa, Dengue virus
PEREKSAA

SEQ ID NO: 53793 - protein, 8 aa, Dengue virus
EREKSAAI

SEQ ID NO: 53794 - protein, 8 aa, Dengue virus
REKSAAID

SEQ ID NO: 53795 - protein, 8 aa, Dengue virus
EKSAAIDG

SEQ ID NO: 53796 - protein, 8 aa, Dengue virus
KSAAIDGE

SEQ ID NO: 53797 - protein, 8 aa, Dengue virus
SAAIDGEY

SEQ ID NO: 53798 - protein, 8 aa, Dengue virus
AAIDGEYR

SEQ ID NO: 53799 - protein, 8 aa, Dengue virus
AIDGEYRL

SEQ ID NO: 53800 - protein, 8 aa, Dengue virus
IDGEYRLK

SEQ ID NO: 53801 - protein, 8 aa, Dengue virus
DGEYRLKG

SEQ ID NO: 53802 - protein, 8 aa, Dengue virus
GEYRLKGE

SEQ ID NO: 53803 - protein, 8 aa, Dengue virus
EYRLKGES

SEQ ID NO: 53804 - protein, 8 aa, Dengue virus
YRLKGESR

SEQ ID NO: 53805 - protein, 8 aa, Dengue virus
RLKGESRK

SEQ ID NO: 53806 - protein, 8 aa, Dengue virus
LKGESRKT

SEQ ID NO: 53807 - protein, 8 aa, Dengue virus
KGESRKTF

SEQ ID NO: 53808 - protein, 8 aa, Dengue virus
GESRKTFV

SEQ ID NO: 53809 - protein, 8 aa, Dengue virus
ESRKTFVE

SEQ ID NO: 53810 - protein, 8 aa, Dengue virus
SRKTFVEL

SEQ ID NO: 53811 - protein, 8 aa, Dengue virus
RKTFVELM

SEQ ID NO: 53812 - protein, 8 aa, Dengue virus
KTFVELMR

SEQ ID NO: 53813 - protein, 8 aa, Dengue virus
TFVELMRR

SEQ ID NO: 53814 - protein, 8 aa, Dengue virus
FVELMRRG

SEQ ID NO: 53815 - protein, 8 aa, Dengue virus
VELMRRGD

SEQ ID NO: 53816 - protein, 8 aa, Dengue virus
ELMRRGDL

SEQ ID NO: 53817 - protein, 8 aa, Dengue virus
LMRRGDLP

SEQ ID NO: 53818 - protein, 8 aa, Dengue virus
MRRGDLPV

SEQ ID NO: 53819 - protein, 8 aa, Dengue virus
RRGDLPVW

SEQ ID NO: 53820 - protein, 8 aa, Dengue virus
RGDLPVWL

SEQ ID NO: 53821 - protein, 8 aa, Dengue virus
GDLPVWLA

SEQ ID NO: 53822 - protein, 8 aa, Dengue virus
DLPVWLAH

SEQ ID NO: 53823 - protein, 8 aa, Dengue virus
LPVWLAHK

SEQ ID NO: 53824 - protein, 8 aa, Dengue virus
PVWLAHKV

SEQ ID NO: 53825 - protein, 8 aa, Dengue virus
VWLAHKVA

SEQ ID NO: 53826 - protein, 8 aa, Dengue virus
WLAHKVAS

SEQ ID NO: 53827 - protein, 8 aa, Dengue virus
LAHKVASE

SEQ ID NO: 53828 - protein, 8 aa, Dengue virus
AHKVASEG

SEQ ID NO: 53829 - protein, 8 aa, Dengue virus
HKVASEGI

SEQ ID NO: 53830 - protein, 8 aa, Dengue virus
KVASEGIK

SEQ ID NO: 53831 - protein, 8 aa, Dengue virus
VASEGIKY

SEQ ID NO: 53832 - protein, 8 aa, Dengue virus
ASEGIKYT

SEQ ID NO: 53833 - protein, 8 aa, Dengue virus
SEGIKYTD

SEQ ID NO: 53834 - protein, 8 aa, Dengue virus
EGIKYTDR

SEQ ID NO: 53835 - protein, 8 aa, Dengue virus
GIKYTDRK

SEQ ID NO: 53836 - protein, 8 aa, Dengue virus
IKYTDRKW

SEQ ID NO: 53837 - protein, 8 aa, Dengue virus
KYTDRKWC

SEQ ID NO: 53838 - protein, 8 aa, Dengue virus
YTDRKWCF

SEQ ID NO: 53839 - protein, 8 aa, Dengue virus
TDRKWCFD

SEQ ID NO: 53840 - protein, 8 aa, Dengue virus
DRKWCFDG

SEQ ID NO: 53841 - protein, 8 aa, Dengue virus
RKWCFDGQ

SEQ ID NO: 53842 - protein, 8 aa, Dengue virus
KWCFDGQR

SEQ ID NO: 53843 - protein, 8 aa, Dengue virus
WCFDGQRN

SEQ ID NO: 53844 - protein, 8 aa, Dengue virus
CFDGQRNN

SEQ ID NO: 53845 - protein, 8 aa, Dengue virus
FDGQRNNQ

SEQ ID NO: 53846 - protein, 8 aa, Dengue virus
DGQRNNQI

SEQ ID NO: 53847 - protein, 8 aa, Dengue virus
GQRNNQIL

SEQ ID NO: 53848 - protein, 8 aa, Dengue virus
QRNNQILE

SEQ ID NO: 53849 - protein, 8 aa, Dengue virus
RNNQILEE

SEQ ID NO: 53850 - protein, 8 aa, Dengue virus
NNQILEEN

SEQ ID NO: 53851 - protein, 8 aa, Dengue virus
NQILEENM

SEQ ID NO: 53852 - protein, 8 aa, Dengue virus
QILEENMD

SEQ ID NO: 53853 - protein, 8 aa, Dengue virus
ILEENMDV

SEQ ID NO: 53854 - protein, 8 aa, Dengue virus
LEENMDVE

SEQ ID NO: 53855 - protein, 8 aa, Dengue virus
EENMDVEI

SEQ ID NO: 53856 - protein, 8 aa, Dengue virus
ENMDVEIW

SEQ ID NO: 53857 - protein, 8 aa, Dengue virus
NMDVEIWT

SEQ ID NO: 53858 - protein, 8 aa, Dengue virus
MDVEIWTK

SEQ ID NO: 53859 - protein, 8 aa, Dengue virus
DVEIWTKE

SEQ ID NO: 53860 - protein, 8 aa, Dengue virus
VEIWTKEG

SEQ ID NO: 53861 - protein, 8 aa, Dengue virus
EIWTKEGE

SEQ ID NO: 53862 - protein, 8 aa, Dengue virus
IWTKEGEK

SEQ ID NO: 53863 - protein, 8 aa, Dengue virus
WTKEGEKK

SEQ ID NO: 53864 - protein, 8 aa, Dengue virus
TKEGEKKK

SEQ ID NO: 53865 - protein, 8 aa, Dengue virus
KEGEKKKL

SEQ ID NO: 53866 - protein, 8 aa, Dengue virus
EGEKKKLR

SEQ ID NO: 53867 - protein, 8 aa, Dengue virus
GEKKKLRP

SEQ ID NO: 53868 - protein, 8 aa, Dengue virus
EKKKLRPR

SEQ ID NO: 53869 - protein, 8 aa, Dengue virus
KKKLRPRW

SEQ ID NO: 53870 - protein, 8 aa, Dengue virus
KKLRPRWL

SEQ ID NO: 53871 - protein, 8 aa, Dengue virus
KLRPRWLD

SEQ ID NO: 53872 - protein, 8 aa, Dengue virus
LRPRWLDA

SEQ ID NO: 53873 - protein, 8 aa, Dengue virus
RPRWLDAR

SEQ ID NO: 53874 - protein, 8 aa, Dengue virus
PRWLDART

SEQ ID NO: 53875 - protein, 8 aa, Dengue virus
RWLDARTY

SEQ ID NO: 53876 - protein, 8 aa, Dengue virus
WLDARTYS

SEQ ID NO: 53877 - protein, 8 aa, Dengue virus
LDARTYSD

SEQ ID NO: 53878 - protein, 8 aa, Dengue virus
DARTYSDP

SEQ ID NO: 53879 - protein, 8 aa, Dengue virus
ARTYSDPL

SEQ ID NO: 53880 - protein, 8 aa, Dengue virus
RTYSDPLA

SEQ ID NO: 53881 - protein, 8 aa, Dengue virus
TYSDPLAL

SEQ ID NO: 53882 - protein, 8 aa, Dengue virus
YSDPLALK

SEQ ID NO: 53883 - protein, 8 aa, Dengue virus
SDPLALKE

SEQ ID NO: 53884 - protein, 8 aa, Dengue virus
DPLALKEF

SEQ ID NO: 53885 - protein, 8 aa, Dengue virus
PLALKEFK

SEQ ID NO: 53886 - protein, 8 aa, Dengue virus
LALKEFKD

SEQ ID NO: 53887 - protein, 8 aa, Dengue virus
ALKEFKDF

SEQ ID NO: 53888 - protein, 8 aa, Dengue virus
LKEFKDFA

SEQ ID NO: 53889 - protein, 8 aa, Dengue virus
KEFKDFAA

SEQ ID NO: 53890 - protein, 8 aa, Dengue virus
EFKDFAAG

SEQ ID NO: 53891 - protein, 8 aa, Dengue virus
FKDFAAGR

SEQ ID NO: 53892 - protein, 8 aa, Dengue virus
KDFAAGRK

SEQ ID NO: 53893 - protein, 8 aa, Dengue virus
DFAAGRKS

SEQ ID NO: 53894 - protein, 8 aa, Dengue virus
FAAGRKSI

SEQ ID NO: 53895 - protein, 8 aa, Dengue virus
AAGRKSIA

SEQ ID NO: 53896 - protein, 8 aa, Dengue virus
AGRKSIAL

SEQ ID NO: 53897 - protein, 8 aa, Dengue virus
GRKSIALD

SEQ ID NO: 53898 - protein, 8 aa, Dengue virus
RKSIALDL

SEQ ID NO: 53899 - protein, 8 aa, Dengue virus
KSIALDLV

SEQ ID NO: 53900 - protein, 8 aa, Dengue virus
SIALDLVT

SEQ ID NO: 53901 - protein, 8 aa, Dengue virus
IALDLVTE

SEQ ID NO: 53902 - protein, 8 aa, Dengue virus
ALDLVTEI

SEQ ID NO: 53903 - protein, 8 aa, Dengue virus
LDLVTEIG

SEQ ID NO: 53904 - protein, 8 aa, Dengue virus
DLVTEIGR

SEQ ID NO: 53905 - protein, 8 aa, Dengue virus
LVTEIGRV

SEQ ID NO: 53906 - protein, 8 aa, Dengue virus
VTEIGRVP

SEQ ID NO: 53907 - protein, 8 aa, Dengue virus
TEIGRVPS

SEQ ID NO: 53908 - protein, 8 aa, Dengue virus
EIGRVPSH

SEQ ID NO: 53909 - protein, 8 aa, Dengue virus
IGRVPSHL

SEQ ID NO: 53910 - protein, 8 aa, Dengue virus
GRVPSHLA

SEQ ID NO: 53911 - protein, 8 aa, Dengue virus
RVPSHLAH

SEQ ID NO: 53912 - protein, 8 aa, Dengue virus
VPSHLAHR

SEQ ID NO: 53913 - protein, 8 aa, Dengue virus
PSHLAHRT

SEQ ID NO: 53914 - protein, 8 aa, Dengue virus
SHLAHRTR

SEQ ID NO: 53915 - protein, 8 aa, Dengue virus
HLAHRTRN

SEQ ID NO: 53916 - protein, 8 aa, Dengue virus
LAHRTRNA

SEQ ID NO: 53917 - protein, 8 aa, Dengue virus
AHRTRNAL

SEQ ID NO: 53918 - protein, 8 aa, Dengue virus
HRTRNALD

SEQ ID NO: 53919 - protein, 8 aa, Dengue virus
RTRNALDN

SEQ ID NO: 53920 - protein, 8 aa, Dengue virus
TRNALDNL

SEQ ID NO: 53921 - protein, 8 aa, Dengue virus
RNALDNLV

SEQ ID NO: 53922 - protein, 8 aa, Dengue virus
NALDNLVM

SEQ ID NO: 53923 - protein, 8 aa, Dengue virus
ALDNLVML

SEQ ID NO: 53924 - protein, 8 aa, Dengue virus
LDNLVMLH

SEQ ID NO: 53925 - protein, 8 aa, Dengue virus
DNLVMLHT

SEQ ID NO: 53926 - protein, 8 aa, Dengue virus
NLVMLHTS

SEQ ID NO: 53927 - protein, 8 aa, Dengue virus
LVMLHTSE

SEQ ID NO: 53928 - protein, 8 aa, Dengue virus
VMLHTSEH

SEQ ID NO: 53929 - protein, 8 aa, Dengue virus
MLHTSEHG

SEQ ID NO: 53930 - protein, 8 aa, Dengue virus
LHTSEHGG

SEQ ID NO: 53931 - protein, 8 aa, Dengue virus
HTSEHGGR

SEQ ID NO: 53932 - protein, 8 aa, Dengue virus
TSEHGGRA

SEQ ID NO: 53933 - protein, 8 aa, Dengue virus
SEHGGRAY

SEQ ID NO: 53934 - protein, 8 aa, Dengue virus
EHGGRAYR

SEQ ID NO: 53935 - protein, 8 aa, Dengue virus
HGGRAYRH

SEQ ID NO: 53936 - protein, 8 aa, Dengue virus
GGRAYRHA

SEQ ID NO: 53937 - protein, 8 aa, Dengue virus
GRAYRHAV

SEQ ID NO: 53938 - protein, 8 aa, Dengue virus
RAYRHAVE

SEQ ID NO: 53939 - protein, 8 aa, Dengue virus
AYRHAVEE

SEQ ID NO: 53940 - protein, 8 aa, Dengue virus
YRHAVEEL

SEQ ID NO: 53941 - protein, 8 aa, Dengue virus
RHAVEELP

SEQ ID NO: 53942 - protein, 8 aa, Dengue virus
HAVEELPE

SEQ ID NO: 53943 - protein, 8 aa, Dengue virus
AVEELPET

SEQ ID NO: 53944 - protein, 8 aa, Dengue virus
VEELPETM

SEQ ID NO: 53945 - protein, 8 aa, Dengue virus
EELPETME

SEQ ID NO: 53946 - protein, 8 aa, Dengue virus
ELPETMET

SEQ ID NO: 53947 - protein, 8 aa, Dengue virus
LPETMETL

SEQ ID NO: 53948 - protein, 8 aa, Dengue virus
PETMETLL

SEQ ID NO: 53949 - protein, 8 aa, Dengue virus
ETMETLLL

SEQ ID NO: 53950 - protein, 8 aa, Dengue virus
TMETLLLL

SEQ ID NO: 53951 - protein, 8 aa, Dengue virus
METLLLLG

SEQ ID NO: 53952 - protein, 8 aa, Dengue virus
ETLLLLGL

SEQ ID NO: 53953 - protein, 8 aa, Dengue virus
TLLLLGLM

SEQ ID NO: 53954 - protein, 8 aa, Dengue virus
LLLLGLMI

SEQ ID NO: 53955 - protein, 8 aa, Dengue virus
LLLGLMIL

SEQ ID NO: 53956 - protein, 8 aa, Dengue virus
LLGLMILL

SEQ ID NO: 53957 - protein, 8 aa, Dengue virus
LGLMILLT

SEQ ID NO: 53958 - protein, 8 aa, Dengue virus
GLMILLTG

SEQ ID NO: 53959 - protein, 8 aa, Dengue virus
LMILLTGG

SEQ ID NO: 53960 - protein, 8 aa, Dengue virus
MILLTGGA

SEQ ID NO: 53961 - protein, 8 aa, Dengue virus
ILLTGGAM

SEQ ID NO: 53962 - protein, 8 aa, Dengue virus
LLTGGAML

SEQ ID NO: 53963 - protein, 8 aa, Dengue virus
LTGGAMLF

SEQ ID NO: 53964 - protein, 8 aa, Dengue virus
TGGAMLFL

SEQ ID NO: 53965 - protein, 8 aa, Dengue virus
GGAMLFLI

SEQ ID NO: 53966 - protein, 8 aa, Dengue virus
GAMLFLIS

SEQ ID NO: 53967 - protein, 8 aa, Dengue virus
AMLFLISG

SEQ ID NO: 53968 - protein, 8 aa, Dengue virus
MLFLISGK

SEQ ID NO: 53969 - protein, 8 aa, Dengue virus
LFLISGKG

SEQ ID NO: 53970 - protein, 8 aa, Dengue virus
FLISGKGI

SEQ ID NO: 53971 - protein, 8 aa, Dengue virus
LISGKGIG

SEQ ID NO: 53972 - protein, 8 aa, Dengue virus
ISGKGIGK

SEQ ID NO: 53973 - protein, 8 aa, Dengue virus
SGKGIGKT

SEQ ID NO: 53974 - protein, 8 aa, Dengue virus
GKGIGKTS

SEQ ID NO: 53975 - protein, 8 aa, Dengue virus
KGIGKTSI

SEQ ID NO: 53976 - protein, 8 aa, Dengue virus
GIGKTSIG

SEQ ID NO: 53977 - protein, 8 aa, Dengue virus
IGKTSIGL

SEQ ID NO: 53978 - protein, 8 aa, Dengue virus
GKTSIGLI

SEQ ID NO: 53979 - protein, 8 aa, Dengue virus
KTSIGLIC

SEQ ID NO: 53980 - protein, 8 aa, Dengue virus
TSIGLICV

SEQ ID NO: 53981 - protein, 8 aa, Dengue virus
SIGLICVI

SEQ ID NO: 53982 - protein, 8 aa, Dengue virus
IGLICVIA

SEQ ID NO: 53983 - protein, 8 aa, Dengue virus
GLICVIAS

SEQ ID NO: 53984 - protein, 8 aa, Dengue virus
LICVIASS

SEQ ID NO: 53985 - protein, 8 aa, Dengue virus
ICVIASSG

SEQ ID NO: 53986 - protein, 8 aa, Dengue virus
CVIASSGM

SEQ ID NO: 53987 - protein, 8 aa, Dengue virus
VIASSGML

SEQ ID NO: 53988 - protein, 8 aa, Dengue virus
IASSGMLW

SEQ ID NO: 53989 - protein, 8 aa, Dengue virus
ASSGMLWM

SEQ ID NO: 53990 - protein, 8 aa, Dengue virus
SSGMLWMA

SEQ ID NO: 53991 - protein, 8 aa, Dengue virus
SGMLWMAE

SEQ ID NO: 53992 - protein, 8 aa, Dengue virus
GMLWMAEI

SEQ ID NO: 53993 - protein, 8 aa, Dengue virus
MLWMAEIP

SEQ ID NO: 53994 - protein, 8 aa, Dengue virus
LWMAEIPL

SEQ ID NO: 53995 - protein, 8 aa, Dengue virus
WMAEIPLQ

SEQ ID NO: 53996 - protein, 8 aa, Dengue virus
MAEIPLQW

SEQ ID NO: 53997 - protein, 8 aa, Dengue virus
AEIPLQWI

SEQ ID NO: 53998 - protein, 8 aa, Dengue virus
EIPLQWIA

SEQ ID NO: 53999 - protein, 8 aa, Dengue virus
IPLQWIAS

SEQ ID NO: 54000 - protein, 8 aa, Dengue virus
PLQWIASA

SEQ ID NO: 54001 - protein, 8 aa, Dengue virus
LQWIASAI

SEQ ID NO: 54002 - protein, 8 aa, Dengue virus
QWIASAIV

SEQ ID NO: 54003 - protein, 8 aa, Dengue virus
WIASAIVL

SEQ ID NO: 54004 - protein, 8 aa, Dengue virus
IASAIVLE

SEQ ID NO: 54005 - protein, 8 aa, Dengue virus
ASAIVLEF

SEQ ID NO: 54006 - protein, 8 aa, Dengue virus
SAIVLEFF

SEQ ID NO: 54007 - protein, 8 aa, Dengue virus
AIVLEFFM

SEQ ID NO: 54008 - protein, 8 aa, Dengue virus
IVLEFFMM

SEQ ID NO: 54009 - protein, 8 aa, Dengue virus
VLEFFMMV

SEQ ID NO: 54010 - protein, 8 aa, Dengue virus
LEFFMMVL

SEQ ID NO: 54011 - protein, 8 aa, Dengue virus
EFFMMVLL

SEQ ID NO: 54012 - protein, 8 aa, Dengue virus
FFMMVLLI

SEQ ID NO: 54013 - protein, 8 aa, Dengue virus
FMMVLLIP

SEQ ID NO: 54014 - protein, 8 aa, Dengue virus
MMVLLIPE

SEQ ID NO: 54015 - protein, 8 aa, Dengue virus
MVLLIPEP

SEQ ID NO: 54016 - protein, 8 aa, Dengue virus
VLLIPEPE

SEQ ID NO: 54017 - protein, 8 aa, Dengue virus
LLIPEPEK

SEQ ID NO: 54018 - protein, 8 aa, Dengue virus
LIPEPEKQ

SEQ ID NO: 54019 - protein, 8 aa, Dengue virus
IPEPEKQR

SEQ ID NO: 54020 - protein, 8 aa, Dengue virus
PEPEKQRT

SEQ ID NO: 54021 - protein, 8 aa, Dengue virus
EPEKQRTP

SEQ ID NO: 54022 - protein, 8 aa, Dengue virus
PEKQRTPQ

SEQ ID NO: 54023 - protein, 8 aa, Dengue virus
EKQRTPQD

SEQ ID NO: 54024 - protein, 8 aa, Dengue virus
KQRTPQDN

SEQ ID NO: 54025 - protein, 8 aa, Dengue virus
QRTPQDNQ

SEQ ID NO: 54026 - protein, 8 aa, Dengue virus
RTPQDNQL

SEQ ID NO: 54027 - protein, 8 aa, Dengue virus
TPQDNQLA

SEQ ID NO: 54028 - protein, 8 aa, Dengue virus
PQDNQLAY

SEQ ID NO: 54029 - protein, 8 aa, Dengue virus
QDNQLAYV

SEQ ID NO: 54030 - protein, 8 aa, Dengue virus
DNQLAYVV

SEQ ID NO: 54031 - protein, 8 aa, Dengue virus
NQLAYVVI

SEQ ID NO: 54032 - protein, 8 aa, Dengue virus
QLAYVVIG

SEQ ID NO: 54033 - protein, 8 aa, Dengue virus
LAYVVIGI

SEQ ID NO: 54034 - protein, 8 aa, Dengue virus
AYVVIGIL

SEQ ID NO: 54035 - protein, 8 aa, Dengue virus
YVVIGILT

SEQ ID NO: 54036 - protein, 8 aa, Dengue virus
VVIGILTL

SEQ ID NO: 54037 - protein, 8 aa, Dengue virus
VIGILTLA

SEQ ID NO: 54038 - protein, 8 aa, Dengue virus
IGILTLAA

SEQ ID NO: 54039 - protein, 8 aa, Dengue virus
GILTLAAI

SEQ ID NO: 54040 - protein, 8 aa, Dengue virus
ILTLAAII

SEQ ID NO: 54041 - protein, 8 aa, Dengue virus
LTLAAIIA

SEQ ID NO: 54042 - protein, 8 aa, Dengue virus
TLAAIIAA

SEQ ID NO: 54043 - protein, 8 aa, Dengue virus
LAAIIAAN

SEQ ID NO: 54044 - protein, 8 aa, Dengue virus
AAIIAANE

SEQ ID NO: 54045 - protein, 8 aa, Dengue virus
AIIAANEM

SEQ ID NO: 54046 - protein, 8 aa, Dengue virus
IIAANEMG

SEQ ID NO: 54047 - protein, 8 aa, Dengue virus
IAANEMGL

SEQ ID NO: 54048 - protein, 8 aa, Dengue virus
AANEMGLL

SEQ ID NO: 54049 - protein, 8 aa, Dengue virus
ANEMGLLE

SEQ ID NO: 54050 - protein, 8 aa, Dengue virus
NEMGLLET

SEQ ID NO: 54051 - protein, 8 aa, Dengue virus
EMGLLETT

SEQ ID NO: 54052 - protein, 8 aa, Dengue virus
MGLLETTK

SEQ ID NO: 54053 - protein, 8 aa, Dengue virus
GLLETTKR

SEQ ID NO: 54054 - protein, 8 aa, Dengue virus
LLETTKRD

SEQ ID NO: 54055 - protein, 8 aa, Dengue virus
LETTKRDL

SEQ ID NO: 54056 - protein, 8 aa, Dengue virus
ETTKRDLG

SEQ ID NO: 54057 - protein, 8 aa, Dengue virus
TTKRDLGM

SEQ ID NO: 54058 - protein, 8 aa, Dengue virus
TKRDLGMS

SEQ ID NO: 54059 - protein, 8 aa, Dengue virus
KRDLGMSK

SEQ ID NO: 54060 - protein, 8 aa, Dengue virus
RDLGMSKE

SEQ ID NO: 54061 - protein, 8 aa, Dengue virus
DLGMSKEP

SEQ ID NO: 54062 - protein, 8 aa, Dengue virus
LGMSKEPG

SEQ ID NO: 54063 - protein, 8 aa, Dengue virus
GMSKEPGV

SEQ ID NO: 54064 - protein, 8 aa, Dengue virus
MSKEPGVV

SEQ ID NO: 54065 - protein, 8 aa, Dengue virus
SKEPGVVS

SEQ ID NO: 54066 - protein, 8 aa, Dengue virus
KEPGVVSP

SEQ ID NO: 54067 - protein, 8 aa, Dengue virus
EPGVVSPT

SEQ ID NO: 54068 - protein, 8 aa, Dengue virus
PGVVSPTS

SEQ ID NO: 54069 - protein, 8 aa, Dengue virus
GVVSPTSY

SEQ ID NO: 54070 - protein, 8 aa, Dengue virus
VVSPTSYL

SEQ ID NO: 54071 - protein, 8 aa, Dengue virus
VSPTSYLD

SEQ ID NO: 54072 - protein, 8 aa, Dengue virus
SPTSYLDV

SEQ ID NO: 54073 - protein, 8 aa, Dengue virus
PTSYLDVD

SEQ ID NO: 54074 - protein, 8 aa, Dengue virus
TSYLDVDL

SEQ ID NO: 54075 - protein, 8 aa, Dengue virus
SYLDVDLH

SEQ ID NO: 54076 - protein, 8 aa, Dengue virus
YLDVDLHP

SEQ ID NO: 54077 - protein, 8 aa, Dengue virus
LDVDLHPA

SEQ ID NO: 54078 - protein, 8 aa, Dengue virus
DVDLHPAS

SEQ ID NO: 54079 - protein, 8 aa, Dengue virus
VDLHPASA

SEQ ID NO: 54080 - protein, 8 aa, Dengue virus
DLHPASAW

SEQ ID NO: 54081 - protein, 8 aa, Dengue virus
LHPASAWT

SEQ ID NO: 54082 - protein, 8 aa, Dengue virus
HPASAWTL

SEQ ID NO: 54083 - protein, 8 aa, Dengue virus
PASAWTLY

SEQ ID NO: 54084 - protein, 8 aa, Dengue virus
ASAWTLYA

SEQ ID NO: 54085 - protein, 8 aa, Dengue virus
SAWTLYAV

SEQ ID NO: 54086 - protein, 8 aa, Dengue virus
AWTLYAVA

SEQ ID NO: 54087 - protein, 8 aa, Dengue virus
WTLYAVAT

SEQ ID NO: 54088 - protein, 8 aa, Dengue virus
TLYAVATT

SEQ ID NO: 54089 - protein, 8 aa, Dengue virus
LYAVATTV

SEQ ID NO: 54090 - protein, 8 aa, Dengue virus
YAVATTVI

SEQ ID NO: 54091 - protein, 8 aa, Dengue virus
AVATTVIT

SEQ ID NO: 54092 - protein, 8 aa, Dengue virus
VATTVITP

SEQ ID NO: 54093 - protein, 8 aa, Dengue virus
ATTVITPM

SEQ ID NO: 54094 - protein, 8 aa, Dengue virus
TTVITPML

SEQ ID NO: 54095 - protein, 8 aa, Dengue virus
TVITPMLR

SEQ ID NO: 54096 - protein, 8 aa, Dengue virus
VITPMLRH

SEQ ID NO: 54097 - protein, 8 aa, Dengue virus
ITPMLRHT

SEQ ID NO: 54098 - protein, 8 aa, Dengue virus
TPMLRHTI

SEQ ID NO: 54099 - protein, 8 aa, Dengue virus
PMLRHTIE

SEQ ID NO: 54100 - protein, 8 aa, Dengue virus
MLRHTIEN

SEQ ID NO: 54101 - protein, 8 aa, Dengue virus
LRHTIENS

SEQ ID NO: 54102 - protein, 8 aa, Dengue virus
RHTIENST

SEQ ID NO: 54103 - protein, 8 aa, Dengue virus
HTIENSTA

SEQ ID NO: 54104 - protein, 8 aa, Dengue virus
TIENSTAN

SEQ ID NO: 54105 - protein, 8 aa, Dengue virus
IENSTANV

SEQ ID NO: 54106 - protein, 8 aa, Dengue virus
ENSTANVS

SEQ ID NO: 54107 - protein, 8 aa, Dengue virus
NSTANVSL

SEQ ID NO: 54108 - protein, 8 aa, Dengue virus
STANVSLA

SEQ ID NO: 54109 - protein, 8 aa, Dengue virus
TANVSLAA

SEQ ID NO: 54110 - protein, 8 aa, Dengue virus
ANVSLAAI

SEQ ID NO: 54111 - protein, 8 aa, Dengue virus
NVSLAAIA

SEQ ID NO: 54112 - protein, 8 aa, Dengue virus
VSLAAIAN

SEQ ID NO: 54113 - protein, 8 aa, Dengue virus
SLAAIANQ

SEQ ID NO: 54114 - protein, 8 aa, Dengue virus
LAAIANQA

SEQ ID NO: 54115 - protein, 8 aa, Dengue virus
AAIANQAV

SEQ ID NO: 54116 - protein, 8 aa, Dengue virus
AIANQAVV

SEQ ID NO: 54117 - protein, 8 aa, Dengue virus
IANQAVVL

SEQ ID NO: 54118 - protein, 8 aa, Dengue virus
ANQAVVLM

SEQ ID NO: 54119 - protein, 8 aa, Dengue virus
NQAVVLMG

SEQ ID NO: 54120 - protein, 8 aa, Dengue virus
QAVVLMGL

SEQ ID NO: 54121 - protein, 8 aa, Dengue virus
AVVLMGLD

SEQ ID NO: 54122 - protein, 8 aa, Dengue virus
VVLMGLDK

SEQ ID NO: 54123 - protein, 8 aa, Dengue virus
VLMGLDKG

SEQ ID NO: 54124 - protein, 8 aa, Dengue virus
LMGLDKGW

SEQ ID NO: 54125 - protein, 8 aa, Dengue virus
MGLDKGWP

SEQ ID NO: 54126 - protein, 8 aa, Dengue virus
GLDKGWPI

SEQ ID NO: 54127 - protein, 8 aa, Dengue virus
LDKGWPIS

SEQ ID NO: 54128 - protein, 8 aa, Dengue virus
DKGWPISK

SEQ ID NO: 54129 - protein, 8 aa, Dengue virus
KGWPISKM

SEQ ID NO: 54130 - protein, 8 aa, Dengue virus
GWPISKMD

SEQ ID NO: 54131 - protein, 8 aa, Dengue virus
WPISKMDL

SEQ ID NO: 54132 - protein, 8 aa, Dengue virus
PISKMDLG

SEQ ID NO: 54133 - protein, 8 aa, Dengue virus
ISKMDLGV

SEQ ID NO: 54134 - protein, 8 aa, Dengue virus
SKMDLGVP

SEQ ID NO: 54135 - protein, 8 aa, Dengue virus
KMDLGVPL

SEQ ID NO: 54136 - protein, 8 aa, Dengue virus
MDLGVPLL

SEQ ID NO: 54137 - protein, 8 aa, Dengue virus
DLGVPLLA

SEQ ID NO: 54138 - protein, 8 aa, Dengue virus
LGVPLLAL

SEQ ID NO: 54139 - protein, 8 aa, Dengue virus
GVPLLALG

SEQ ID NO: 54140 - protein, 8 aa, Dengue virus
VPLLALGC

SEQ ID NO: 54141 - protein, 8 aa, Dengue virus
PLLALGCY

SEQ ID NO: 54142 - protein, 8 aa, Dengue virus
LLALGCYS

SEQ ID NO: 54143 - protein, 8 aa, Dengue virus
LALGCYSQ

SEQ ID NO: 54144 - protein, 8 aa, Dengue virus
ALGCYSQV

SEQ ID NO: 54145 - protein, 8 aa, Dengue virus
LGCYSQVN

SEQ ID NO: 54146 - protein, 8 aa, Dengue virus
GCYSQVNP

SEQ ID NO: 54147 - protein, 8 aa, Dengue virus
CYSQVNPL

SEQ ID NO: 54148 - protein, 8 aa, Dengue virus
YSQVNPLT

SEQ ID NO: 54149 - protein, 8 aa, Dengue virus
SQVNPLTL

SEQ ID NO: 54150 - protein, 8 aa, Dengue virus
QVNPLTLT

SEQ ID NO: 54151 - protein, 8 aa, Dengue virus
VNPLTLTA

SEQ ID NO: 54152 - protein, 8 aa, Dengue virus
NPLTLTAA

SEQ ID NO: 54153 - protein, 8 aa, Dengue virus
PLTLTAAV

SEQ ID NO: 54154 - protein, 8 aa, Dengue virus
LTLTAAVL

SEQ ID NO: 54155 - protein, 8 aa, Dengue virus
TLTAAVLL

SEQ ID NO: 54156 - protein, 8 aa, Dengue virus
LTAAVLLL

SEQ ID NO: 54157 - protein, 8 aa, Dengue virus
TAAVLLLI

SEQ ID NO: 54158 - protein, 8 aa, Dengue virus
AAVLLLIT

SEQ ID NO: 54159 - protein, 8 aa, Dengue virus
AVLLLITH

SEQ ID NO: 54160 - protein, 8 aa, Dengue virus
VLLLITHY

SEQ ID NO: 54161 - protein, 8 aa, Dengue virus
LLLITHYA

SEQ ID NO: 54162 - protein, 8 aa, Dengue virus
LLITHYAI

SEQ ID NO: 54163 - protein, 8 aa, Dengue virus
LITHYAII

SEQ ID NO: 54164 - protein, 8 aa, Dengue virus
ITHYAIIG

SEQ ID NO: 54165 - protein, 8 aa, Dengue virus
THYAIIGP

SEQ ID NO: 54166 - protein, 8 aa, Dengue virus
HYAIIGPG

SEQ ID NO: 54167 - protein, 8 aa, Dengue virus
YAIIGPGL

SEQ ID NO: 54168 - protein, 8 aa, Dengue virus
AIIGPGLQ

SEQ ID NO: 54169 - protein, 8 aa, Dengue virus
IIGPGLQA

SEQ ID NO: 54170 - protein, 8 aa, Dengue virus
IGPGLQAK

SEQ ID NO: 54171 - protein, 8 aa, Dengue virus
GPGLQAKA

SEQ ID NO: 54172 - protein, 8 aa, Dengue virus
PGLQAKAT

SEQ ID NO: 54173 - protein, 8 aa, Dengue virus
GLQAKATR

SEQ ID NO: 54174 - protein, 8 aa, Dengue virus
LQAKATRE

SEQ ID NO: 54175 - protein, 8 aa, Dengue virus
QAKATREA

SEQ ID NO: 54176 - protein, 8 aa, Dengue virus
AKATREAQ

SEQ ID NO: 54177 - protein, 8 aa, Dengue virus
KATREAQK

SEQ ID NO: 54178 - protein, 8 aa, Dengue virus
ATREAQKR

SEQ ID NO: 54179 - protein, 8 aa, Dengue virus
TREAQKRT

SEQ ID NO: 54180 - protein, 8 aa, Dengue virus
REAQKRTA

SEQ ID NO: 54181 - protein, 8 aa, Dengue virus
EAQKRTAA

SEQ ID NO: 54182 - protein, 8 aa, Dengue virus
AQKRTAAG

SEQ ID NO: 54183 - protein, 8 aa, Dengue virus
QKRTAAGI

SEQ ID NO: 54184 - protein, 8 aa, Dengue virus
KRTAAGIM

SEQ ID NO: 54185 - protein, 8 aa, Dengue virus
RTAAGIMK

SEQ ID NO: 54186 - protein, 8 aa, Dengue virus
TAAGIMKN

SEQ ID NO: 54187 - protein, 8 aa, Dengue virus
AAGIMKNP

SEQ ID NO: 54188 - protein, 8 aa, Dengue virus
AGIMKNPT

SEQ ID NO: 54189 - protein, 8 aa, Dengue virus
GIMKNPTV

SEQ ID NO: 54190 - protein, 8 aa, Dengue virus
IMKNPTVD

SEQ ID NO: 54191 - protein, 8 aa, Dengue virus
MKNPTVDG

SEQ ID NO: 54192 - protein, 8 aa, Dengue virus
KNPTVDGI

SEQ ID NO: 54193 - protein, 8 aa, Dengue virus
NPTVDGIM

SEQ ID NO: 54194 - protein, 8 aa, Dengue virus
PTVDGIMT

SEQ ID NO: 54195 - protein, 8 aa, Dengue virus
TVDGIMTI

SEQ ID NO: 54196 - protein, 8 aa, Dengue virus
VDGIMTID

SEQ ID NO: 54197 - protein, 8 aa, Dengue virus
DGIMTIDL

SEQ ID NO: 54198 - protein, 8 aa, Dengue virus
GIMTIDLD

SEQ ID NO: 54199 - protein, 8 aa, Dengue virus
IMTIDLDP

SEQ ID NO: 54200 - protein, 8 aa, Dengue virus
MTIDLDPV

SEQ ID NO: 54201 - protein, 8 aa, Dengue virus
TIDLDPVI

SEQ ID NO: 54202 - protein, 8 aa, Dengue virus
IDLDPVIY

SEQ ID NO: 54203 - protein, 8 aa, Dengue virus
DLDPVIYD

SEQ ID NO: 54204 - protein, 8 aa, Dengue virus
LDPVIYDS

SEQ ID NO: 54205 - protein, 8 aa, Dengue virus
DPVIYDSK

SEQ ID NO: 54206 - protein, 8 aa, Dengue virus
PVIYDSKF

SEQ ID NO: 54207 - protein, 8 aa, Dengue virus
VIYDSKFE

SEQ ID NO: 54208 - protein, 8 aa, Dengue virus
IYDSKFEK

SEQ ID NO: 54209 - protein, 8 aa, Dengue virus
YDSKFEKQ

SEQ ID NO: 54210 - protein, 8 aa, Dengue virus
DSKFEKQL

SEQ ID NO: 54211 - protein, 8 aa, Dengue virus
SKFEKQLG

SEQ ID NO: 54212 - protein, 8 aa, Dengue virus
KFEKQLGQ

SEQ ID NO: 54213 - protein, 8 aa, Dengue virus
FEKQLGQV

SEQ ID NO: 54214 - protein, 8 aa, Dengue virus
EKQLGQVM

SEQ ID NO: 54215 - protein, 8 aa, Dengue virus
KQLGQVML

SEQ ID NO: 54216 - protein, 8 aa, Dengue virus
QLGQVMLL

SEQ ID NO: 54217 - protein, 8 aa, Dengue virus
LGQVMLLV

SEQ ID NO: 54218 - protein, 8 aa, Dengue virus
GQVMLLVL

SEQ ID NO: 54219 - protein, 8 aa, Dengue virus
QVMLLVLC

SEQ ID NO: 54220 - protein, 8 aa, Dengue virus
VMLLVLCA

SEQ ID NO: 54221 - protein, 8 aa, Dengue virus
MLLVLCAV

SEQ ID NO: 54222 - protein, 8 aa, Dengue virus
LLVLCAVQ

SEQ ID NO: 54223 - protein, 8 aa, Dengue virus
LVLCAVQL

SEQ ID NO: 54224 - protein, 8 aa, Dengue virus
VLCAVQLL

SEQ ID NO: 54225 - protein, 8 aa, Dengue virus
LCAVQLLL

SEQ ID NO: 54226 - protein, 8 aa, Dengue virus
CAVQLLLM

SEQ ID NO: 54227 - protein, 8 aa, Dengue virus
AVQLLLMR

SEQ ID NO: 54228 - protein, 8 aa, Dengue virus
VQLLLMRT

SEQ ID NO: 54229 - protein, 8 aa, Dengue virus
QLLLMRTS

SEQ ID NO: 54230 - protein, 8 aa, Dengue virus
LLLMRTSW

SEQ ID NO: 54231 - protein, 8 aa, Dengue virus
LLMRTSWA

SEQ ID NO: 54232 - protein, 8 aa, Dengue virus
LMRTSWAL

SEQ ID NO: 54233 - protein, 8 aa, Dengue virus
MRTSWALC

SEQ ID NO: 54234 - protein, 8 aa, Dengue virus
RTSWALCE

SEQ ID NO: 54235 - protein, 8 aa, Dengue virus
TSWALCEA

SEQ ID NO: 54236 - protein, 8 aa, Dengue virus
SWALCEAL

SEQ ID NO: 54237 - protein, 8 aa, Dengue virus
WALCEALT

SEQ ID NO: 54238 - protein, 8 aa, Dengue virus
ALCEALTL

SEQ ID NO: 54239 - protein, 8 aa, Dengue virus
LCEALTLA

SEQ ID NO: 54240 - protein, 8 aa, Dengue virus
CEALTLAT

SEQ ID NO: 54241 - protein, 8 aa, Dengue virus
EALTLATG

SEQ ID NO: 54242 - protein, 8 aa, Dengue virus
ALTLATGP

SEQ ID NO: 54243 - protein, 8 aa, Dengue virus
LTLATGPI

SEQ ID NO: 54244 - protein, 8 aa, Dengue virus
TLATGPIT

SEQ ID NO: 54245 - protein, 8 aa, Dengue virus
LATGPITT

SEQ ID NO: 54246 - protein, 8 aa, Dengue virus
ATGPITTL

SEQ ID NO: 54247 - protein, 8 aa, Dengue virus
TGPITTLW

SEQ ID NO: 54248 - protein, 8 aa, Dengue virus
GPITTLWE

SEQ ID NO: 54249 - protein, 8 aa, Dengue virus
PITTLWEG

SEQ ID NO: 54250 - protein, 8 aa, Dengue virus
ITTLWEGS

SEQ ID NO: 54251 - protein, 8 aa, Dengue virus
TTLWEGSP

SEQ ID NO: 54252 - protein, 8 aa, Dengue virus
TLWEGSPG

SEQ ID NO: 54253 - protein, 8 aa, Dengue virus
LWEGSPGK

SEQ ID NO: 54254 - protein, 8 aa, Dengue virus
WEGSPGKF

SEQ ID NO: 54255 - protein, 8 aa, Dengue virus
EGSPGKFW

SEQ ID NO: 54256 - protein, 8 aa, Dengue virus
GSPGKFWN

SEQ ID NO: 54257 - protein, 8 aa, Dengue virus
SPGKFWNT

SEQ ID NO: 54258 - protein, 8 aa, Dengue virus
PGKFWNTT

SEQ ID NO: 54259 - protein, 8 aa, Dengue virus
GKFWNTTI

SEQ ID NO: 54260 - protein, 8 aa, Dengue virus
KFWNTTIA

SEQ ID NO: 54261 - protein, 8 aa, Dengue virus
FWNTTIAV

SEQ ID NO: 54262 - protein, 8 aa, Dengue virus
WNTTIAVS

SEQ ID NO: 54263 - protein, 8 aa, Dengue virus
NTTIAVSM

SEQ ID NO: 54264 - protein, 8 aa, Dengue virus
TTIAVSMA

SEQ ID NO: 54265 - protein, 8 aa, Dengue virus
TIAVSMAN

SEQ ID NO: 54266 - protein, 8 aa, Dengue virus
IAVSMANI

SEQ ID NO: 54267 - protein, 8 aa, Dengue virus
AVSMANIF

SEQ ID NO: 54268 - protein, 8 aa, Dengue virus
VSMANIFR

SEQ ID NO: 54269 - protein, 8 aa, Dengue virus
SMANIFRG

SEQ ID NO: 54270 - protein, 8 aa, Dengue virus
MANIFRGS

SEQ ID NO: 54271 - protein, 8 aa, Dengue virus
ANIFRGSY

SEQ ID NO: 54272 - protein, 8 aa, Dengue virus
NIFRGSYL

SEQ ID NO: 54273 - protein, 8 aa, Dengue virus
IFRGSYLA

SEQ ID NO: 54274 - protein, 8 aa, Dengue virus
FRGSYLAG

SEQ ID NO: 54275 - protein, 8 aa, Dengue virus
RGSYLAGA

SEQ ID NO: 54276 - protein, 8 aa, Dengue virus
GSYLAGAG

SEQ ID NO: 54277 - protein, 8 aa, Dengue virus
SYLAGAGL

SEQ ID NO: 54278 - protein, 8 aa, Dengue virus
YLAGAGLA

SEQ ID NO: 54279 - protein, 8 aa, Dengue virus
LAGAGLAF

SEQ ID NO: 54280 - protein, 8 aa, Dengue virus
AGAGLAFS

SEQ ID NO: 54281 - protein, 8 aa, Dengue virus
GAGLAFSI

SEQ ID NO: 54282 - protein, 8 aa, Dengue virus
AGLAFSIM

SEQ ID NO: 54283 - protein, 8 aa, Dengue virus
GLAFSIMK

SEQ ID NO: 54284 - protein, 8 aa, Dengue virus
LAFSIMKS

SEQ ID NO: 54285 - protein, 8 aa, Dengue virus
AFSIMKSV

SEQ ID NO: 54286 - protein, 8 aa, Dengue virus
FSIMKSVG

SEQ ID NO: 54287 - protein, 8 aa, Dengue virus
SIMKSVGT

SEQ ID NO: 54288 - protein, 8 aa, Dengue virus
IMKSVGTG

SEQ ID NO: 54289 - protein, 8 aa, Dengue virus
MKSVGTGK

SEQ ID NO: 54290 - protein, 8 aa, Dengue virus
KSVGTGKR

SEQ ID NO: 54291 - protein, 8 aa, Dengue virus
SVGTGKRG

SEQ ID NO: 54292 - protein, 8 aa, Dengue virus
VGTGKRGT

SEQ ID NO: 54293 - protein, 8 aa, Dengue virus
GTGKRGTG

SEQ ID NO: 54294 - protein, 8 aa, Dengue virus
TGKRGTGS

SEQ ID NO: 54295 - protein, 8 aa, Dengue virus
GKRGTGSQ

SEQ ID NO: 54296 - protein, 8 aa, Dengue virus
KRGTGSQG

SEQ ID NO: 54297 - protein, 8 aa, Dengue virus
RGTGSQGE

SEQ ID NO: 54298 - protein, 8 aa, Dengue virus
GTGSQGET

SEQ ID NO: 54299 - protein, 8 aa, Dengue virus
TGSQGETL

SEQ ID NO: 54300 - protein, 8 aa, Dengue virus
GSQGETLG

SEQ ID NO: 54301 - protein, 8 aa, Dengue virus
SQGETLGE

SEQ ID NO: 54302 - protein, 8 aa, Dengue virus
QGETLGEK

SEQ ID NO: 54303 - protein, 8 aa, Dengue virus
GETLGEKW

SEQ ID NO: 54304 - protein, 8 aa, Dengue virus
ETLGEKWK

SEQ ID NO: 54305 - protein, 8 aa, Dengue virus
TLGEKWKK

SEQ ID NO: 54306 - protein, 8 aa, Dengue virus
LGEKWKKK

SEQ ID NO: 54307 - protein, 8 aa, Dengue virus
GEKWKKKL

SEQ ID NO: 54308 - protein, 8 aa, Dengue virus
EKWKKKLN

SEQ ID NO: 54309 - protein, 8 aa, Dengue virus
KWKKKLNQ

SEQ ID NO: 54310 - protein, 8 aa, Dengue virus
WKKKLNQL

SEQ ID NO: 54311 - protein, 8 aa, Dengue virus
KKKLNQLS

SEQ ID NO: 54312 - protein, 8 aa, Dengue virus
KKLNQLSR

SEQ ID NO: 54313 - protein, 8 aa, Dengue virus
KLNQLSRK

SEQ ID NO: 54314 - protein, 8 aa, Dengue virus
LNQLSRKE

SEQ ID NO: 54315 - protein, 8 aa, Dengue virus
NQLSRKEF

SEQ ID NO: 54316 - protein, 8 aa, Dengue virus
QLSRKEFD

SEQ ID NO: 54317 - protein, 8 aa, Dengue virus
LSRKEFDL

SEQ ID NO: 54318 - protein, 8 aa, Dengue virus
SRKEFDLY

SEQ ID NO: 54319 - protein, 8 aa, Dengue virus
RKEFDLYK

SEQ ID NO: 54320 - protein, 8 aa, Dengue virus
KEFDLYKK

SEQ ID NO: 54321 - protein, 8 aa, Dengue virus
EFDLYKKS

SEQ ID NO: 54322 - protein, 8 aa, Dengue virus
FDLYKKSG

SEQ ID NO: 54323 - protein, 8 aa, Dengue virus
DLYKKSGI

SEQ ID NO: 54324 - protein, 8 aa, Dengue virus
LYKKSGIT

SEQ ID NO: 54325 - protein, 8 aa, Dengue virus
YKKSGITE

SEQ ID NO: 54326 - protein, 8 aa, Dengue virus
KKSGITEV

SEQ ID NO: 54327 - protein, 8 aa, Dengue virus
KSGITEVD

SEQ ID NO: 54328 - protein, 8 aa, Dengue virus
SGITEVDR

SEQ ID NO: 54329 - protein, 8 aa, Dengue virus
GITEVDRT

SEQ ID NO: 54330 - protein, 8 aa, Dengue virus
ITEVDRTE

SEQ ID NO: 54331 - protein, 8 aa, Dengue virus
TEVDRTEA

SEQ ID NO: 54332 - protein, 8 aa, Dengue virus
EVDRTEAK

SEQ ID NO: 54333 - protein, 8 aa, Dengue virus
VDRTEAKE

SEQ ID NO: 54334 - protein, 8 aa, Dengue virus
DRTEAKEG

SEQ ID NO: 54335 - protein, 8 aa, Dengue virus
RTEAKEGL

SEQ ID NO: 54336 - protein, 8 aa, Dengue virus
TEAKEGLK

SEQ ID NO: 54337 - protein, 8 aa, Dengue virus
EAKEGLKR

SEQ ID NO: 54338 - protein, 8 aa, Dengue virus
AKEGLKRG

SEQ ID NO: 54339 - protein, 8 aa, Dengue virus
KEGLKRGE

SEQ ID NO: 54340 - protein, 8 aa, Dengue virus
EGLKRGEI

SEQ ID NO: 54341 - protein, 8 aa, Dengue virus
GLKRGEIT

SEQ ID NO: 54342 - protein, 8 aa, Dengue virus
RGEITHHA

SEQ ID NO: 54343 - protein, 8 aa, Dengue virus
GEITHHAV

SEQ ID NO: 54344 - protein, 8 aa, Dengue virus
EITHHAVS

SEQ ID NO: 54345 - protein, 8 aa, Dengue virus
ITHHAVSR

SEQ ID NO: 54346 - protein, 8 aa, Dengue virus
THHAVSRG

SEQ ID NO: 54347 - protein, 8 aa, Dengue virus
HHAVSRGS

SEQ ID NO: 54348 - protein, 8 aa, Dengue virus
HAVSRGSA

SEQ ID NO: 54349 - protein, 8 aa, Dengue virus
AVSRGSAK

SEQ ID NO: 54350 - protein, 8 aa, Dengue virus
VSRGSAKL

SEQ ID NO: 54351 - protein, 8 aa, Dengue virus
SRGSAKLQ

SEQ ID NO: 54352 - protein, 8 aa, Dengue virus
RGSAKLQW

SEQ ID NO: 54353 - protein, 8 aa, Dengue virus
GSAKLQWF

SEQ ID NO: 54354 - protein, 8 aa, Dengue virus
SAKLQWFV

SEQ ID NO: 54355 - protein, 8 aa, Dengue virus
AKLQWFVE

SEQ ID NO: 54356 - protein, 8 aa, Dengue virus
KLQWFVER

SEQ ID NO: 54357 - protein, 8 aa, Dengue virus
LQWFVERN

SEQ ID NO: 54358 - protein, 8 aa, Dengue virus
QWFVERNM

SEQ ID NO: 54359 - protein, 8 aa, Dengue virus
WFVERNMV

SEQ ID NO: 54360 - protein, 8 aa, Dengue virus
FVERNMVI

SEQ ID NO: 54361 - protein, 8 aa, Dengue virus
VERNMVIP

SEQ ID NO: 54362 - protein, 8 aa, Dengue virus
ERNMVIPE

SEQ ID NO: 54363 - protein, 8 aa, Dengue virus
RNMVIPEG

SEQ ID NO: 54364 - protein, 8 aa, Dengue virus
NMVIPEGR

SEQ ID NO: 54365 - protein, 8 aa, Dengue virus
MVIPEGRV

SEQ ID NO: 54366 - protein, 8 aa, Dengue virus
VIPEGRVI

SEQ ID NO: 54367 - protein, 8 aa, Dengue virus
IPEGRVID

SEQ ID NO: 54368 - protein, 8 aa, Dengue virus
PEGRVIDL

SEQ ID NO: 54369 - protein, 8 aa, Dengue virus
EGRVIDLG

SEQ ID NO: 54370 - protein, 8 aa, Dengue virus
GRVIDLGC

SEQ ID NO: 54371 - protein, 8 aa, Dengue virus
RVIDLGCG

SEQ ID NO: 54372 - protein, 8 aa, Dengue virus
VIDLGCGR

SEQ ID NO: 54373 - protein, 8 aa, Dengue virus
IDLGCGRG

SEQ ID NO: 54374 - protein, 8 aa, Dengue virus
DLGCGRGG

SEQ ID NO: 54375 - protein, 8 aa, Dengue virus
LGCGRGGW

SEQ ID NO: 54376 - protein, 8 aa, Dengue virus
GCGRGGWS

SEQ ID NO: 54377 - protein, 8 aa, Dengue virus
CGRGGWSY

SEQ ID NO: 54378 - protein, 8 aa, Dengue virus
GRGGWSYY

SEQ ID NO: 54379 - protein, 8 aa, Dengue virus
RGGWSYYC

SEQ ID NO: 54380 - protein, 8 aa, Dengue virus
GGWSYYCA

SEQ ID NO: 54381 - protein, 8 aa, Dengue virus
GWSYYCAG

SEQ ID NO: 54382 - protein, 8 aa, Dengue virus
WSYYCAGL

SEQ ID NO: 54383 - protein, 8 aa, Dengue virus
SYYCAGLK

SEQ ID NO: 54384 - protein, 8 aa, Dengue virus
YYCAGLKK

SEQ ID NO: 54385 - protein, 8 aa, Dengue virus
YCAGLKKV

SEQ ID NO: 54386 - protein, 8 aa, Dengue virus
CAGLKKVT

SEQ ID NO: 54387 - protein, 8 aa, Dengue virus
AGLKKVTE

SEQ ID NO: 54388 - protein, 8 aa, Dengue virus
GLKKVTEV

SEQ ID NO: 54389 - protein, 8 aa, Dengue virus
LKKVTEVR

SEQ ID NO: 54390 - protein, 8 aa, Dengue virus
KKVTEVRG

SEQ ID NO: 54391 - protein, 8 aa, Dengue virus
KVTEVRGY

SEQ ID NO: 54392 - protein, 8 aa, Dengue virus
VTEVRGYT

SEQ ID NO: 54393 - protein, 8 aa, Dengue virus
TEVRGYTK

SEQ ID NO: 54394 - protein, 8 aa, Dengue virus
EVRGYTKG

SEQ ID NO: 54395 - protein, 8 aa, Dengue virus
VRGYTKGG

SEQ ID NO: 54396 - protein, 8 aa, Dengue virus
RGYTKGGP

SEQ ID NO: 54397 - protein, 8 aa, Dengue virus
GYTKGGPG

SEQ ID NO: 54398 - protein, 8 aa, Dengue virus
YTKGGPGH

SEQ ID NO: 54399 - protein, 8 aa, Dengue virus
TKGGPGHE

SEQ ID NO: 54400 - protein, 8 aa, Dengue virus
KGGPGHEE

SEQ ID NO: 54401 - protein, 8 aa, Dengue virus
GGPGHEEP

SEQ ID NO: 54402 - protein, 8 aa, Dengue virus
GPGHEEPV

SEQ ID NO: 54403 - protein, 8 aa, Dengue virus
PGHEEPVP

SEQ ID NO: 54404 - protein, 8 aa, Dengue virus
GHEEPVPM

SEQ ID NO: 54405 - protein, 8 aa, Dengue virus
HEEPVPMS

SEQ ID NO: 54406 - protein, 8 aa, Dengue virus
EEPVPMST

SEQ ID NO: 54407 - protein, 8 aa, Dengue virus
EPVPMSTY

SEQ ID NO: 54408 - protein, 8 aa, Dengue virus
PVPMSTYG

SEQ ID NO: 54409 - protein, 8 aa, Dengue virus
VPMSTYGW

SEQ ID NO: 54410 - protein, 8 aa, Dengue virus
PMSTYGWN

SEQ ID NO: 54411 - protein, 8 aa, Dengue virus
MSTYGWNI

SEQ ID NO: 54412 - protein, 8 aa, Dengue virus
STYGWNIV

SEQ ID NO: 54413 - protein, 8 aa, Dengue virus
TYGWNIVK

SEQ ID NO: 54414 - protein, 8 aa, Dengue virus
YGWNIVKL

SEQ ID NO: 54415 - protein, 8 aa, Dengue virus
GWNIVKLM

SEQ ID NO: 54416 - protein, 8 aa, Dengue virus
WNIVKLMS

SEQ ID NO: 54417 - protein, 8 aa, Dengue virus
NIVKLMSG

SEQ ID NO: 54418 - protein, 8 aa, Dengue virus
IVKLMSGK

SEQ ID NO: 54419 - protein, 8 aa, Dengue virus
VKLMSGKD

SEQ ID NO: 54420 - protein, 8 aa, Dengue virus
KLMSGKDV

SEQ ID NO: 54421 - protein, 8 aa, Dengue virus
LMSGKDVF

SEQ ID NO: 54422 - protein, 8 aa, Dengue virus
MSGKDVFY

SEQ ID NO: 54423 - protein, 8 aa, Dengue virus
SGKDVFYL

SEQ ID NO: 54424 - protein, 8 aa, Dengue virus
GKDVFYLP

SEQ ID NO: 54425 - protein, 8 aa, Dengue virus
KDVFYLPP

SEQ ID NO: 54426 - protein, 8 aa, Dengue virus
DVFYLPPE

SEQ ID NO: 54427 - protein, 8 aa, Dengue virus
VFYLPPEK

SEQ ID NO: 54428 - protein, 8 aa, Dengue virus
FYLPPEKC

SEQ ID NO: 54429 - protein, 8 aa, Dengue virus
YLPPEKCD

SEQ ID NO: 54430 - protein, 8 aa, Dengue virus
LPPEKCDT

SEQ ID NO: 54431 - protein, 8 aa, Dengue virus
PPEKCDTL

SEQ ID NO: 54432 - protein, 8 aa, Dengue virus
PEKCDTLL

SEQ ID NO: 54433 - protein, 8 aa, Dengue virus
EKCDTLLC

SEQ ID NO: 54434 - protein, 8 aa, Dengue virus
KCDTLLCD

SEQ ID NO: 54435 - protein, 8 aa, Dengue virus
CDTLLCDI

SEQ ID NO: 54436 - protein, 8 aa, Dengue virus
DTLLCDIG

SEQ ID NO: 54437 - protein, 8 aa, Dengue virus
TLLCDIGE

SEQ ID NO: 54438 - protein, 8 aa, Dengue virus
LLCDIGES

SEQ ID NO: 54439 - protein, 8 aa, Dengue virus
LCDIGESS

SEQ ID NO: 54440 - protein, 8 aa, Dengue virus
CDIGESSP

SEQ ID NO: 54441 - protein, 8 aa, Dengue virus
DIGESSPS

SEQ ID NO: 54442 - protein, 8 aa, Dengue virus
IGESSPSP

SEQ ID NO: 54443 - protein, 8 aa, Dengue virus
GESSPSPT

SEQ ID NO: 54444 - protein, 8 aa, Dengue virus
ESSPSPTV

SEQ ID NO: 54445 - protein, 8 aa, Dengue virus
SSPSPTVE

SEQ ID NO: 54446 - protein, 8 aa, Dengue virus
SPSPTVEE

SEQ ID NO: 54447 - protein, 8 aa, Dengue virus
PSPTVEES

SEQ ID NO: 54448 - protein, 8 aa, Dengue virus
SPTVEESR

SEQ ID NO: 54449 - protein, 8 aa, Dengue virus
PTVEESRT

SEQ ID NO: 54450 - protein, 8 aa, Dengue virus
TVEESRTI

SEQ ID NO: 54451 - protein, 8 aa, Dengue virus
VEESRTIR

SEQ ID NO: 54452 - protein, 8 aa, Dengue virus
EESRTIRV

SEQ ID NO: 54453 - protein, 8 aa, Dengue virus
ESRTIRVL

SEQ ID NO: 54454 - protein, 8 aa, Dengue virus
SRTIRVLK

SEQ ID NO: 54455 - protein, 8 aa, Dengue virus
RTIRVLKM

SEQ ID NO: 54456 - protein, 8 aa, Dengue virus
TIRVLKMV

SEQ ID NO: 54457 - protein, 8 aa, Dengue virus
IRVLKMVE

SEQ ID NO: 54458 - protein, 8 aa, Dengue virus
RVLKMVEP

SEQ ID NO: 54459 - protein, 8 aa, Dengue virus
VLKMVEPW

SEQ ID NO: 54460 - protein, 8 aa, Dengue virus
LKMVEPWL

SEQ ID NO: 54461 - protein, 8 aa, Dengue virus
KMVEPWLK

SEQ ID NO: 54462 - protein, 8 aa, Dengue virus
MVEPWLKN

SEQ ID NO: 54463 - protein, 8 aa, Dengue virus
VEPWLKNN

SEQ ID NO: 54464 - protein, 8 aa, Dengue virus
EPWLKNNQ

SEQ ID NO: 54465 - protein, 8 aa, Dengue virus
PWLKNNQF

SEQ ID NO: 54466 - protein, 8 aa, Dengue virus
WLKNNQFC

SEQ ID NO: 54467 - protein, 8 aa, Dengue virus
LKNNQFCI

SEQ ID NO: 54468 - protein, 8 aa, Dengue virus
KNNQFCIK

SEQ ID NO: 54469 - protein, 8 aa, Dengue virus
NNQFCIKV

SEQ ID NO: 54470 - protein, 8 aa, Dengue virus
NQFCIKVL

SEQ ID NO: 54471 - protein, 8 aa, Dengue virus
QFCIKVLN

SEQ ID NO: 54472 - protein, 8 aa, Dengue virus
FCIKVLNP

SEQ ID NO: 54473 - protein, 8 aa, Dengue virus
CIKVLNPY

SEQ ID NO: 54474 - protein, 8 aa, Dengue virus
IKVLNPYM

SEQ ID NO: 54475 - protein, 8 aa, Dengue virus
KVLNPYMP

SEQ ID NO: 54476 - protein, 8 aa, Dengue virus
VLNPYMPT

SEQ ID NO: 54477 - protein, 8 aa, Dengue virus
LNPYMPTV

SEQ ID NO: 54478 - protein, 8 aa, Dengue virus
NPYMPTVI

SEQ ID NO: 54479 - protein, 8 aa, Dengue virus
PYMPTVIE

SEQ ID NO: 54480 - protein, 8 aa, Dengue virus
YMPTVIEH

SEQ ID NO: 54481 - protein, 8 aa, Dengue virus
MPTVIEHL

SEQ ID NO: 54482 - protein, 8 aa, Dengue virus
PTVIEHLE

SEQ ID NO: 54483 - protein, 8 aa, Dengue virus
TVIEHLER

SEQ ID NO: 54484 - protein, 8 aa, Dengue virus
VIEHLERL

SEQ ID NO: 54485 - protein, 8 aa, Dengue virus
IEHLERLQ

SEQ ID NO: 54486 - protein, 8 aa, Dengue virus
EHLERLQR

SEQ ID NO: 54487 - protein, 8 aa, Dengue virus
HLERLQRK

SEQ ID NO: 54488 - protein, 8 aa, Dengue virus
LERLQRKH

SEQ ID NO: 54489 - protein, 8 aa, Dengue virus
ERLQRKHG

SEQ ID NO: 54490 - protein, 8 aa, Dengue virus
RLQRKHGG

SEQ ID NO: 54491 - protein, 8 aa, Dengue virus
LQRKHGGM

SEQ ID NO: 54492 - protein, 8 aa, Dengue virus
QRKHGGML

SEQ ID NO: 54493 - protein, 8 aa, Dengue virus
RKHGGMLV

SEQ ID NO: 54494 - protein, 8 aa, Dengue virus
KHGGMLVR

SEQ ID NO: 54495 - protein, 8 aa, Dengue virus
HGGMLVRN

SEQ ID NO: 54496 - protein, 8 aa, Dengue virus
GGMLVRNP

SEQ ID NO: 54497 - protein, 8 aa, Dengue virus
GMLVRNPL

SEQ ID NO: 54498 - protein, 8 aa, Dengue virus
MLVRNPLS

SEQ ID NO: 54499 - protein, 8 aa, Dengue virus
LVRNPLSR

SEQ ID NO: 54500 - protein, 8 aa, Dengue virus
VRNPLSRN

SEQ ID NO: 54501 - protein, 8 aa, Dengue virus
RNPLSRNS

SEQ ID NO: 54502 - protein, 8 aa, Dengue virus
NPLSRNST

SEQ ID NO: 54503 - protein, 8 aa, Dengue virus
PLSRNSTH

SEQ ID NO: 54504 - protein, 8 aa, Dengue virus
LSRNSTHE

SEQ ID NO: 54505 - protein, 8 aa, Dengue virus
SRNSTHEM

SEQ ID NO: 54506 - protein, 8 aa, Dengue virus
RNSTHEMY

SEQ ID NO: 54507 - protein, 8 aa, Dengue virus
NSTHEMYW

SEQ ID NO: 54508 - protein, 8 aa, Dengue virus
STHEMYWI

SEQ ID NO: 54509 - protein, 8 aa, Dengue virus
THEMYWIS

SEQ ID NO: 54510 - protein, 8 aa, Dengue virus
HEMYWISN

SEQ ID NO: 54511 - protein, 8 aa, Dengue virus
EMYWISNG

SEQ ID NO: 54512 - protein, 8 aa, Dengue virus
MYWISNGT

SEQ ID NO: 54513 - protein, 8 aa, Dengue virus
YWISNGTG

SEQ ID NO: 54514 - protein, 8 aa, Dengue virus
WISNGTGN

SEQ ID NO: 54515 - protein, 8 aa, Dengue virus
ISNGTGNI

SEQ ID NO: 54516 - protein, 8 aa, Dengue virus
SNGTGNIV

SEQ ID NO: 54517 - protein, 8 aa, Dengue virus
NGTGNIVA

SEQ ID NO: 54518 - protein, 8 aa, Dengue virus
GTGNIVAS

SEQ ID NO: 54519 - protein, 8 aa, Dengue virus
TGNIVASV

SEQ ID NO: 54520 - protein, 8 aa, Dengue virus
GNIVASVN

SEQ ID NO: 54521 - protein, 8 aa, Dengue virus
NIVASVNM

SEQ ID NO: 54522 - protein, 8 aa, Dengue virus
IVASVNMV

SEQ ID NO: 54523 - protein, 8 aa, Dengue virus
VASVNMVS

SEQ ID NO: 54524 - protein, 8 aa, Dengue virus
ASVNMVSR

SEQ ID NO: 54525 - protein, 8 aa, Dengue virus
SVNMVSRL

SEQ ID NO: 54526 - protein, 8 aa, Dengue virus
VNMVSRLL

SEQ ID NO: 54527 - protein, 8 aa, Dengue virus
NMVSRLLL

SEQ ID NO: 54528 - protein, 8 aa, Dengue virus
MVSRLLLN

SEQ ID NO: 54529 - protein, 8 aa, Dengue virus
VSRLLLNR

SEQ ID NO: 54530 - protein, 8 aa, Dengue virus
SRLLLNRF

SEQ ID NO: 54531 - protein, 8 aa, Dengue virus
RLLLNRFT

SEQ ID NO: 54532 - protein, 8 aa, Dengue virus
LLLNRFTM

SEQ ID NO: 54533 - protein, 8 aa, Dengue virus
LLNRFTMT

SEQ ID NO: 54534 - protein, 8 aa, Dengue virus
LNRFTMTH

SEQ ID NO: 54535 - protein, 8 aa, Dengue virus
NRFTMTHR

SEQ ID NO: 54536 - protein, 8 aa, Dengue virus
RFTMTHRR

SEQ ID NO: 54537 - protein, 8 aa, Dengue virus
FTMTHRRP

SEQ ID NO: 54538 - protein, 8 aa, Dengue virus
TMTHRRPT

SEQ ID NO: 54539 - protein, 8 aa, Dengue virus
MTHRRPTI

SEQ ID NO: 54540 - protein, 8 aa, Dengue virus
THRRPTIE

SEQ ID NO: 54541 - protein, 8 aa, Dengue virus
HRRPTIEK

SEQ ID NO: 54542 - protein, 8 aa, Dengue virus
RRPTIEKD

SEQ ID NO: 54543 - protein, 8 aa, Dengue virus
RPTIEKDV

SEQ ID NO: 54544 - protein, 8 aa, Dengue virus
PTIEKDVD

SEQ ID NO: 54545 - protein, 8 aa, Dengue virus
TIEKDVDL

SEQ ID NO: 54546 - protein, 8 aa, Dengue virus
IEKDVDLG

SEQ ID NO: 54547 - protein, 8 aa, Dengue virus
EKDVDLGA

SEQ ID NO: 54548 - protein, 8 aa, Dengue virus
KDVDLGAG

SEQ ID NO: 54549 - protein, 8 aa, Dengue virus
DVDLGAGT

SEQ ID NO: 54550 - protein, 8 aa, Dengue virus
VDLGAGTR

SEQ ID NO: 54551 - protein, 8 aa, Dengue virus
DLGAGTRH

SEQ ID NO: 54552 - protein, 8 aa, Dengue virus
LGAGTRHV

SEQ ID NO: 54553 - protein, 8 aa, Dengue virus
GAGTRHVN

SEQ ID NO: 54554 - protein, 8 aa, Dengue virus
AGTRHVNA

SEQ ID NO: 54555 - protein, 8 aa, Dengue virus
GTRHVNAE

SEQ ID NO: 54556 - protein, 8 aa, Dengue virus
TRHVNAEP

SEQ ID NO: 54557 - protein, 8 aa, Dengue virus
RHVNAEPE

SEQ ID NO: 54558 - protein, 8 aa, Dengue virus
HVNAEPET

SEQ ID NO: 54559 - protein, 8 aa, Dengue virus
VNAEPETP

SEQ ID NO: 54560 - protein, 8 aa, Dengue virus
NAEPETPN

SEQ ID NO: 54561 - protein, 8 aa, Dengue virus
AEPETPNM

SEQ ID NO: 54562 - protein, 8 aa, Dengue virus
EPETPNMD

SEQ ID NO: 54563 - protein, 8 aa, Dengue virus
PETPNMDV

SEQ ID NO: 54564 - protein, 8 aa, Dengue virus
ETPNMDVI

SEQ ID NO: 54565 - protein, 8 aa, Dengue virus
TPNMDVIG

SEQ ID NO: 54566 - protein, 8 aa, Dengue virus
PNMDVIGE

SEQ ID NO: 54567 - protein, 8 aa, Dengue virus
NMDVIGER

SEQ ID NO: 54568 - protein, 8 aa, Dengue virus
MDVIGERI

SEQ ID NO: 54569 - protein, 8 aa, Dengue virus
DVIGERIK

SEQ ID NO: 54570 - protein, 8 aa, Dengue virus
VIGERIKR

SEQ ID NO: 54571 - protein, 8 aa, Dengue virus
IGERIKRI

SEQ ID NO: 54572 - protein, 8 aa, Dengue virus
GERIKRIK

SEQ ID NO: 54573 - protein, 8 aa, Dengue virus
ERIKRIKE

SEQ ID NO: 54574 - protein, 8 aa, Dengue virus
RIKRIKEE

SEQ ID NO: 54575 - protein, 8 aa, Dengue virus
IKRIKEEH

SEQ ID NO: 54576 - protein, 8 aa, Dengue virus
RIKEEHNS

SEQ ID NO: 54577 - protein, 8 aa, Dengue virus
IKEEHNST

SEQ ID NO: 54578 - protein, 8 aa, Dengue virus
KEEHNSTW

SEQ ID NO: 54579 - protein, 8 aa, Dengue virus
EEHNSTWH

SEQ ID NO: 54580 - protein, 8 aa, Dengue virus
EHNSTWHY

SEQ ID NO: 54581 - protein, 8 aa, Dengue virus
HNSTWHYD

SEQ ID NO: 54582 - protein, 8 aa, Dengue virus
NSTWHYDD

SEQ ID NO: 54583 - protein, 8 aa, Dengue virus
STWHYDDE

SEQ ID NO: 54584 - protein, 8 aa, Dengue virus
TWHYDDEN

SEQ ID NO: 54585 - protein, 8 aa, Dengue virus
WHYDDENP

SEQ ID NO: 54586 - protein, 8 aa, Dengue virus
HYDDENPY

SEQ ID NO: 54587 - protein, 8 aa, Dengue virus
YDDENPYK

SEQ ID NO: 54588 - protein, 8 aa, Dengue virus
DDENPYKT

SEQ ID NO: 54589 - protein, 8 aa, Dengue virus
DENPYKTW

SEQ ID NO: 54590 - protein, 8 aa, Dengue virus
ENPYKTWA

SEQ ID NO: 54591 - protein, 8 aa, Dengue virus
NPYKTWAY

SEQ ID NO: 54592 - protein, 8 aa, Dengue virus
PYKTWAYH

SEQ ID NO: 54593 - protein, 8 aa, Dengue virus
YKTWAYHG

SEQ ID NO: 54594 - protein, 8 aa, Dengue virus
KTWAYHGS

SEQ ID NO: 54595 - protein, 8 aa, Dengue virus
TWAYHGSY

SEQ ID NO: 54596 - protein, 8 aa, Dengue virus
WAYHGSYE

SEQ ID NO: 54597 - protein, 8 aa, Dengue virus
AYHGSYEV

SEQ ID NO: 54598 - protein, 8 aa, Dengue virus
YHGSYEVK

SEQ ID NO: 54599 - protein, 8 aa, Dengue virus
HGSYEVKA

SEQ ID NO: 54600 - protein, 8 aa, Dengue virus
GSYEVKAT

SEQ ID NO: 54601 - protein, 8 aa, Dengue virus
SYEVKATG

SEQ ID NO: 54602 - protein, 8 aa, Dengue virus
YEVKATGS

SEQ ID NO: 54603 - protein, 8 aa, Dengue virus
EVKATGSA

SEQ ID NO: 54604 - protein, 8 aa, Dengue virus
VKATGSAS

SEQ ID NO: 54605 - protein, 8 aa, Dengue virus
KATGSASS

SEQ ID NO: 54606 - protein, 8 aa, Dengue virus
ATGSASSM

SEQ ID NO: 54607 - protein, 8 aa, Dengue virus
TGSASSMI

SEQ ID NO: 54608 - protein, 8 aa, Dengue virus
GSASSMIN

SEQ ID NO: 54609 - protein, 8 aa, Dengue virus
SASSMING

SEQ ID NO: 54610 - protein, 8 aa, Dengue virus
ASSMINGV

SEQ ID NO: 54611 - protein, 8 aa, Dengue virus
SSMINGVV

SEQ ID NO: 54612 - protein, 8 aa, Dengue virus
SMINGVVK

SEQ ID NO: 54613 - protein, 8 aa, Dengue virus
MINGVVKL

SEQ ID NO: 54614 - protein, 8 aa, Dengue virus
INGVVKLL

SEQ ID NO: 54615 - protein, 8 aa, Dengue virus
NGVVKLLT

SEQ ID NO: 54616 - protein, 8 aa, Dengue virus
GVVKLLTK

SEQ ID NO: 54617 - protein, 8 aa, Dengue virus
VVKLLTKP

SEQ ID NO: 54618 - protein, 8 aa, Dengue virus
VKLLTKPW

SEQ ID NO: 54619 - protein, 8 aa, Dengue virus
KLLTKPWD

SEQ ID NO: 54620 - protein, 8 aa, Dengue virus
LLTKPWDV

SEQ ID NO: 54621 - protein, 8 aa, Dengue virus
LTKPWDVV

SEQ ID NO: 54622 - protein, 8 aa, Dengue virus
TKPWDVVP

SEQ ID NO: 54623 - protein, 8 aa, Dengue virus
KPWDVVPM

SEQ ID NO: 54624 - protein, 8 aa, Dengue virus
PWDVVPMV

SEQ ID NO: 54625 - protein, 8 aa, Dengue virus
WDVVPMVT

SEQ ID NO: 54626 - protein, 8 aa, Dengue virus
DVVPMVTQ

SEQ ID NO: 54627 - protein, 8 aa, Dengue virus
VVPMVTQM

SEQ ID NO: 54628 - protein, 8 aa, Dengue virus
VPMVTQMA

SEQ ID NO: 54629 - protein, 8 aa, Dengue virus
PMVTQMAM

SEQ ID NO: 54630 - protein, 8 aa, Dengue virus
MVTQMAMT

SEQ ID NO: 54631 - protein, 8 aa, Dengue virus
VTQMAMTD

SEQ ID NO: 54632 - protein, 8 aa, Dengue virus
TQMAMTDT

SEQ ID NO: 54633 - protein, 8 aa, Dengue virus
QMAMTDTT

SEQ ID NO: 54634 - protein, 8 aa, Dengue virus
MAMTDTTP

SEQ ID NO: 54635 - protein, 8 aa, Dengue virus
AMTDTTPF

SEQ ID NO: 54636 - protein, 8 aa, Dengue virus
MTDTTPFG

SEQ ID NO: 54637 - protein, 8 aa, Dengue virus
TDTTPFGQ

SEQ ID NO: 54638 - protein, 8 aa, Dengue virus
DTTPFGQQ

SEQ ID NO: 54639 - protein, 8 aa, Dengue virus
TTPFGQQR

SEQ ID NO: 54640 - protein, 8 aa, Dengue virus
TPFGQQRV

SEQ ID NO: 54641 - protein, 8 aa, Dengue virus
PFGQQRVF

SEQ ID NO: 54642 - protein, 8 aa, Dengue virus
FGQQRVFK

SEQ ID NO: 54643 - protein, 8 aa, Dengue virus
GQQRVFKE

SEQ ID NO: 54644 - protein, 8 aa, Dengue virus
QQRVFKEK

SEQ ID NO: 54645 - protein, 8 aa, Dengue virus
QRVFKEKV

SEQ ID NO: 54646 - protein, 8 aa, Dengue virus
RVFKEKVD

SEQ ID NO: 54647 - protein, 8 aa, Dengue virus
VFKEKVDT

SEQ ID NO: 54648 - protein, 8 aa, Dengue virus
FKEKVDTR

SEQ ID NO: 54649 - protein, 8 aa, Dengue virus
KEKVDTRT

SEQ ID NO: 54650 - protein, 8 aa, Dengue virus
EKVDTRTP

SEQ ID NO: 54651 - protein, 8 aa, Dengue virus
KVDTRTPR

SEQ ID NO: 54652 - protein, 8 aa, Dengue virus
VDTRTPRS

SEQ ID NO: 54653 - protein, 8 aa, Dengue virus
DTRTPRSM

SEQ ID NO: 54654 - protein, 8 aa, Dengue virus
TRTPRSMP

SEQ ID NO: 54655 - protein, 8 aa, Dengue virus
RTPRSMPG

SEQ ID NO: 54656 - protein, 8 aa, Dengue virus
TPRSMPGT

SEQ ID NO: 54657 - protein, 8 aa, Dengue virus
PRSMPGTR

SEQ ID NO: 54658 - protein, 8 aa, Dengue virus
MPGTRRVM

SEQ ID NO: 54659 - protein, 8 aa, Dengue virus
GTRKVMEI

SEQ ID NO: 54660 - protein, 8 aa, Dengue virus
TRKVMEIT

SEQ ID NO: 54661 - protein, 8 aa, Dengue virus
VMEITAEW

SEQ ID NO: 54662 - protein, 8 aa, Dengue virus
MEITAEWL

SEQ ID NO: 54663 - protein, 8 aa, Dengue virus
EITAEWLW

SEQ ID NO: 54664 - protein, 8 aa, Dengue virus
ITAEWLWR

SEQ ID NO: 54665 - protein, 8 aa, Dengue virus
TAEWLWRT

SEQ ID NO: 54666 - protein, 8 aa, Dengue virus
AEWLWRTL

SEQ ID NO: 54667 - protein, 8 aa, Dengue virus
EWLWRTLG

SEQ ID NO: 54668 - protein, 8 aa, Dengue virus
WLWRTLGR

SEQ ID NO: 54669 - protein, 8 aa, Dengue virus
LWRTLGRN

SEQ ID NO: 54670 - protein, 8 aa, Dengue virus
WRTLGRNK

SEQ ID NO: 54671 - protein, 8 aa, Dengue virus
RTLGRNKK

SEQ ID NO: 54672 - protein, 8 aa, Dengue virus
TLGRNKKP

SEQ ID NO: 54673 - protein, 8 aa, Dengue virus
LGRNKKPR

SEQ ID NO: 54674 - protein, 8 aa, Dengue virus
GRNKKPRL

SEQ ID NO: 54675 - protein, 8 aa, Dengue virus
RNKKPRLC

SEQ ID NO: 54676 - protein, 8 aa, Dengue virus
NKKPRLCT

SEQ ID NO: 54677 - protein, 8 aa, Dengue virus
KKPRLCTR

SEQ ID NO: 54678 - protein, 8 aa, Dengue virus
KPRLCTRE

SEQ ID NO: 54679 - protein, 8 aa, Dengue virus
PRLCTREE

SEQ ID NO: 54680 - protein, 8 aa, Dengue virus
RLCTREEF

SEQ ID NO: 54681 - protein, 8 aa, Dengue virus
LCTREEFT

SEQ ID NO: 54682 - protein, 8 aa, Dengue virus
CTREEFTK

SEQ ID NO: 54683 - protein, 8 aa, Dengue virus
TREEFTKK

SEQ ID NO: 54684 - protein, 8 aa, Dengue virus
REEFTKKV

SEQ ID NO: 54685 - protein, 8 aa, Dengue virus
EEFTKKVR

SEQ ID NO: 54686 - protein, 8 aa, Dengue virus
EFTKKVRT

SEQ ID NO: 54687 - protein, 8 aa, Dengue virus
FTKKVRTN

SEQ ID NO: 54688 - protein, 8 aa, Dengue virus
TKKVRTNA

SEQ ID NO: 54689 - protein, 8 aa, Dengue virus
KKVRTNAA

SEQ ID NO: 54690 - protein, 8 aa, Dengue virus
KVRTNAAM

SEQ ID NO: 54691 - protein, 8 aa, Dengue virus
VRTNAAMG

SEQ ID NO: 54692 - protein, 8 aa, Dengue virus
RTNAAMGA

SEQ ID NO: 54693 - protein, 8 aa, Dengue virus
TNAAMGAV

SEQ ID NO: 54694 - protein, 8 aa, Dengue virus
NAAMGAVF

SEQ ID NO: 54695 - protein, 8 aa, Dengue virus
AAMGAVFT

SEQ ID NO: 54696 - protein, 8 aa, Dengue virus
AMGAVFTE

SEQ ID NO: 54697 - protein, 8 aa, Dengue virus
MGAVFTEE

SEQ ID NO: 54698 - protein, 8 aa, Dengue virus
GAVFTEEN

SEQ ID NO: 54699 - protein, 8 aa, Dengue virus
AVFTEENQ

SEQ ID NO: 54700 - protein, 8 aa, Dengue virus
VFTEENQW

SEQ ID NO: 54701 - protein, 8 aa, Dengue virus
FTEENQWD

SEQ ID NO: 54702 - protein, 8 aa, Dengue virus
TEENQWDS

SEQ ID NO: 54703 - protein, 8 aa, Dengue virus
EENQWDSA

SEQ ID NO: 54704 - protein, 8 aa, Dengue virus
ENQWDSAK

SEQ ID NO: 54705 - protein, 8 aa, Dengue virus
NQWDSAKA

SEQ ID NO: 54706 - protein, 8 aa, Dengue virus
QWDSAKAA

SEQ ID NO: 54707 - protein, 8 aa, Dengue virus
WDSAKAAV

SEQ ID NO: 54708 - protein, 8 aa, Dengue virus
DSAKAAVE

SEQ ID NO: 54709 - protein, 8 aa, Dengue virus
SAKAAVED

SEQ ID NO: 54710 - protein, 8 aa, Dengue virus
AKAAVEDE

SEQ ID NO: 54711 - protein, 8 aa, Dengue virus
KAAVEDED

SEQ ID NO: 54712 - protein, 8 aa, Dengue virus
AAVEDEDF

SEQ ID NO: 54713 - protein, 8 aa, Dengue virus
AVEDEDFW

SEQ ID NO: 54714 - protein, 8 aa, Dengue virus
VEDEDFWK

SEQ ID NO: 54715 - protein, 8 aa, Dengue virus
EDEDFWKL

SEQ ID NO: 54716 - protein, 8 aa, Dengue virus
DEDFWKLV

SEQ ID NO: 54717 - protein, 8 aa, Dengue virus
EDFWKLVD

SEQ ID NO: 54718 - protein, 8 aa, Dengue virus
DFWKLVDR

SEQ ID NO: 54719 - protein, 8 aa, Dengue virus
FWKLVDRE

SEQ ID NO: 54720 - protein, 8 aa, Dengue virus
WKLVDRER

SEQ ID NO: 54721 - protein, 8 aa, Dengue virus
KLVDRERE

SEQ ID NO: 54722 - protein, 8 aa, Dengue virus
LVDREREL

SEQ ID NO: 54723 - protein, 8 aa, Dengue virus
VDRERELH

SEQ ID NO: 54724 - protein, 8 aa, Dengue virus
DRERELHK

SEQ ID NO: 54725 - protein, 8 aa, Dengue virus
RERELHKL

SEQ ID NO: 54726 - protein, 8 aa, Dengue virus
ERELHKLG

SEQ ID NO: 54727 - protein, 8 aa, Dengue virus
RELHKLGK

SEQ ID NO: 54728 - protein, 8 aa, Dengue virus
ELHKLGKC

SEQ ID NO: 54729 - protein, 8 aa, Dengue virus
LHKLGKCG

SEQ ID NO: 54730 - protein, 8 aa, Dengue virus
HKLGKCGS

SEQ ID NO: 54731 - protein, 8 aa, Dengue virus
KLGKCGSC

SEQ ID NO: 54732 - protein, 8 aa, Dengue virus
LGKCGSCV

SEQ ID NO: 54733 - protein, 8 aa, Dengue virus
GKCGSCVY

SEQ ID NO: 54734 - protein, 8 aa, Dengue virus
KCGSCVYN

SEQ ID NO: 54735 - protein, 8 aa, Dengue virus
CGSCVYNM

SEQ ID NO: 54736 - protein, 8 aa, Dengue virus
GSCVYNMM

SEQ ID NO: 54737 - protein, 8 aa, Dengue virus
SCVYNMMG

SEQ ID NO: 54738 - protein, 8 aa, Dengue virus
CVYNMMGK

SEQ ID NO: 54739 - protein, 8 aa, Dengue virus
VYNMMGKR

SEQ ID NO: 54740 - protein, 8 aa, Dengue virus
YNMMGKRE

SEQ ID NO: 54741 - protein, 8 aa, Dengue virus
NMMGKREK

SEQ ID NO: 54742 - protein, 8 aa, Dengue virus
MMGKREKK

SEQ ID NO: 54743 - protein, 8 aa, Dengue virus
MGKREKKL

SEQ ID NO: 54744 - protein, 8 aa, Dengue virus
GKREKKLG

SEQ ID NO: 54745 - protein, 8 aa, Dengue virus
KREKKLGE

SEQ ID NO: 54746 - protein, 8 aa, Dengue virus
REKKLGEF

SEQ ID NO: 54747 - protein, 8 aa, Dengue virus
EKKLGEFG

SEQ ID NO: 54748 - protein, 8 aa, Dengue virus
KKLGEFGK

SEQ ID NO: 54749 - protein, 8 aa, Dengue virus
KLGEFGKA

SEQ ID NO: 54750 - protein, 8 aa, Dengue virus
LGEFGKAK

SEQ ID NO: 54751 - protein, 8 aa, Dengue virus
GEFGKAKG

SEQ ID NO: 54752 - protein, 8 aa, Dengue virus
EFGKAKGS

SEQ ID NO: 54753 - protein, 8 aa, Dengue virus
FGKAKGSR

SEQ ID NO: 54754 - protein, 8 aa, Dengue virus
GKAKGSRA

SEQ ID NO: 54755 - protein, 8 aa, Dengue virus
KAKGSRAI

SEQ ID NO: 54756 - protein, 8 aa, Dengue virus
AKGSRAIW

SEQ ID NO: 54757 - protein, 8 aa, Dengue virus
KGSRAIWY

SEQ ID NO: 54758 - protein, 8 aa, Dengue virus
GSRAIWYM

SEQ ID NO: 54759 - protein, 8 aa, Dengue virus
SRAIWYMW

SEQ ID NO: 54760 - protein, 8 aa, Dengue virus
RAIWYMWL

SEQ ID NO: 54761 - protein, 8 aa, Dengue virus
AIWYMWLG

SEQ ID NO: 54762 - protein, 8 aa, Dengue virus
IWYMWLGA

SEQ ID NO: 54763 - protein, 8 aa, Dengue virus
WYMWLGAR

SEQ ID NO: 54764 - protein, 8 aa, Dengue virus
YMWLGARY

SEQ ID NO: 54765 - protein, 8 aa, Dengue virus
MWLGARYL

SEQ ID NO: 54766 - protein, 8 aa, Dengue virus
WLGARYLE

SEQ ID NO: 54767 - protein, 8 aa, Dengue virus
LGARYLEF

SEQ ID NO: 54768 - protein, 8 aa, Dengue virus
GARYLEFE
